United States Patent 7,691,997 (FUNCTIONAL AND HYPERFUNCTIONAL SIRNA) - sequence listing, part 32

SEQ ID NO: 1295952 - RNA, 19 nt, Homo sapiens
gaauaugcacagucugaau

SEQ ID NO: 1295953 - RNA, 19 nt, Homo sapiens
caacagcuacaguguguca

SEQ ID NO: 1295954 - RNA, 19 nt, Homo sapiens
guccagagcauguaugaau

SEQ ID NO: 1295955 - RNA, 19 nt, Homo sapiens
cuccuaaacucaaagucua

SEQ ID NO: 1295956 - RNA, 19 nt, Homo sapiens
ccaguauggcuaacuauau

SEQ ID NO: 1295957 - RNA, 19 nt, Homo sapiens
uuaggguucucucaagauu

SEQ ID NO: 1295958 - RNA, 19 nt, Homo sapiens
uaucacagacauuaagcua

SEQ ID NO: 1295959 - RNA, 19 nt, Homo sapiens
agagacacaugcccacuuc

SEQ ID NO: 1295960 - RNA, 19 nt, Homo sapiens
gaaaaugggauugaguuaa

SEQ ID NO: 1295961 - RNA, 19 nt, Homo sapiens
gcugugagaauuugucuuc

SEQ ID NO: 1295962 - RNA, 19 nt, Homo sapiens
ucacugacgucuuuucuug

SEQ ID NO: 1295963 - RNA, 19 nt, Homo sapiens
uuggaacaguugucaauau

SEQ ID NO: 1295964 - RNA, 19 nt, Homo sapiens
caaaucagaaacucacugu

SEQ ID NO: 1295965 - RNA, 19 nt, Homo sapiens
gaauguauaccaggagugu

SEQ ID NO: 1295966 - RNA, 19 nt, Homo sapiens
ugcacagucugaauguaua

SEQ ID NO: 1295967 - RNA, 19 nt, Homo sapiens
aaccuacgaucuggugaua

SEQ ID NO: 1295968 - RNA, 19 nt, Homo sapiens
caagcccucuccacuguag

SEQ ID NO: 1295969 - RNA, 19 nt, Homo sapiens
cuaagauguccuauuguaa

SEQ ID NO: 1295970 - RNA, 19 nt, Homo sapiens
guccucagccagugcuuua

SEQ ID NO: 1295971 - RNA, 19 nt, Homo sapiens
gugaaaccuugucucuaug

SEQ ID NO: 1295972 - RNA, 19 nt, Homo sapiens
aagagaauaugcacagucu

SEQ ID NO: 1295973 - RNA, 19 nt, Homo sapiens
uacacacacuucaagagaa

SEQ ID NO: 1295974 - RNA, 19 nt, Homo sapiens
cuuccaaagugaccacaaa

SEQ ID NO: 1295975 - RNA, 19 nt, Homo sapiens
uagccaucaucgaaacuaa

SEQ ID NO: 1295976 - RNA, 19 nt, Homo sapiens
ugaauucgaccaguauuug

SEQ ID NO: 1295977 - RNA, 19 nt, Homo sapiens
caaugaauucgaccaguau

SEQ ID NO: 1295978 - RNA, 19 nt, Homo sapiens
aaagacaguuguugguuuu

SEQ ID NO: 1295979 - RNA, 19 nt, Homo sapiens
aagaauaugcacagucuga

SEQ ID NO: 1295980 - RNA, 19 nt, Homo sapiens
agaacgcccugccggagaa

SEQ ID NO: 1295981 - RNA, 19 nt, Homo sapiens
aaaggaagauggggaaauu

SEQ ID NO: 1295982 - RNA, 19 nt, Homo sapiens
aagcuggacucuccuuauc

SEQ ID NO: 1295983 - RNA, 19 nt, Homo sapiens
aacaguaucacagacauua

SEQ ID NO: 1295984 - RNA, 19 nt, Homo sapiens
auaacagugugcugaaaga

SEQ ID NO: 1295985 - RNA, 19 nt, Homo sapiens
gccaacucccuguuucuaa

SEQ ID NO: 1295986 - RNA, 19 nt, Homo sapiens
cccaagcccucuccacugu

SEQ ID NO: 1295987 - RNA, 19 nt, Homo sapiens
gguaugauuacucuuuaug

SEQ ID NO: 1295988 - RNA, 19 nt, Homo sapiens
uagcugcugugagaauuug

SEQ ID NO: 1295989 - RNA, 19 nt, Homo sapiens
uccuuuagcugcugugaga

SEQ ID NO: 1295990 - RNA, 19 nt, Homo sapiens
acucaaagucuaaaucaga

SEQ ID NO: 1295991 - RNA, 19 nt, Homo sapiens
gagagacacaugcccacuu

SEQ ID NO: 1295992 - RNA, 19 nt, Homo sapiens
ggcaggagaaugucuugaa

SEQ ID NO: 1295993 - RNA, 19 nt, Homo sapiens
gcauguaugaauaaucuca

SEQ ID NO: 1295994 - RNA, 19 nt, Homo sapiens
uuuaaaggagcaugcauaa

SEQ ID NO: 1295995 - RNA, 19 nt, Homo sapiens
ggagaaugucuugaaccua

SEQ ID NO: 1295996 - RNA, 19 nt, Homo sapiens
gguccaguuuucugauuua

SEQ ID NO: 1295997 - RNA, 19 nt, Homo sapiens
gcuacagugugucauagag

SEQ ID NO: 1295998 - RNA, 19 nt, Homo sapiens
acacagaacuuccauucaa

SEQ ID NO: 1295999 - RNA, 19 nt, Homo sapiens
gguccuagcugccuuccuu

SEQ ID NO: 1296000 - RNA, 19 nt, Homo sapiens
ggaggaggcagaagucauu

SEQ ID NO: 1296001 - RNA, 19 nt, Homo sapiens
gagcgucacaugcaaauug

SEQ ID NO: 1296002 - RNA, 19 nt, Homo sapiens
gaacuugccauuggacuga

SEQ ID NO: 1296003 - RNA, 19 nt, Homo sapiens
caacacagaacuuccauuc

SEQ ID NO: 1296004 - RNA, 19 nt, Homo sapiens
ugaucgacuucuugaaaua

SEQ ID NO: 1296005 - RNA, 19 nt, Homo sapiens
cauccucuuucccuaguua

SEQ ID NO: 1296006 - RNA, 19 nt, Homo sapiens
gaagaucucccaaaacauu

SEQ ID NO: 1296007 - RNA, 19 nt, Homo sapiens
gugcagacccauccucuuu

SEQ ID NO: 1296008 - RNA, 19 nt, Homo sapiens
ggaggagaccgcaaguuga

SEQ ID NO: 1296009 - RNA, 19 nt, Homo sapiens
ccucuuuccucccuacuuu

SEQ ID NO: 1296010 - RNA, 19 nt, Homo sapiens
cagaagucauuaaccagaa

SEQ ID NO: 1296011 - RNA, 19 nt, Homo sapiens
cucagaagcugcuacaaga

SEQ ID NO: 1296012 - RNA, 19 nt, Homo sapiens
ccauuggacugagcucuuu

SEQ ID NO: 1296013 - RNA, 19 nt, Homo sapiens
gaucgacuucuugaaauaa

SEQ ID NO: 1296014 - RNA, 19 nt, Homo sapiens
cagaagaucucccaaaaca

SEQ ID NO: 1296015 - RNA, 19 nt, Homo sapiens
ggacuugaacuugccauug

SEQ ID NO: 1296016 - RNA, 19 nt, Homo sapiens
gacuugaacuugccauugg

SEQ ID NO: 1296017 - RNA, 19 nt, Homo sapiens
ccaacuuuaucauucuuug

SEQ ID NO: 1296018 - RNA, 19 nt, Homo sapiens
agaagcugcuacaagauga

SEQ ID NO: 1296019 - RNA, 19 nt, Homo sapiens
ccggguagcucucaaacuc

SEQ ID NO: 1296020 - RNA, 19 nt, Homo sapiens
cacagaacuuccauucaau

SEQ ID NO: 1296021 - RNA, 19 nt, Homo sapiens
aaacauuuccaacacagaa

SEQ ID NO: 1296022 - RNA, 19 nt, Homo sapiens
cuacagaagaucucccaaa

SEQ ID NO: 1296023 - RNA, 19 nt, Homo sapiens
gagggcauccuggcuguuu

SEQ ID NO: 1296024 - RNA, 19 nt, Homo sapiens
ugguggagcuguucuguag

SEQ ID NO: 1296025 - RNA, 19 nt, Homo sapiens
guacacagccugccuuucc

SEQ ID NO: 1296026 - RNA, 19 nt, Homo sapiens
gcacuuaccccaauguaga

SEQ ID NO: 1296027 - RNA, 19 nt, Homo sapiens
gugguugcccuaccuguuu

SEQ ID NO: 1296028 - RNA, 19 nt, Homo sapiens
ucaugucccugcccucuuc

SEQ ID NO: 1296029 - RNA, 19 nt, Homo sapiens
cuccagacuucuaugcuuu

SEQ ID NO: 1296030 - RNA, 19 nt, Homo sapiens
cagaagcugcuacaagaug

SEQ ID NO: 1296031 - RNA, 19 nt, Homo sapiens
gacagagaaggaagccaua

SEQ ID NO: 1296032 - RNA, 19 nt, Homo sapiens
gaggaggcagaagucauua

SEQ ID NO: 1296033 - RNA, 19 nt, Homo sapiens
guguagacgccuccucuuu

SEQ ID NO: 1296034 - RNA, 19 nt, Homo sapiens
gaggagaccgcaaguugag

SEQ ID NO: 1296035 - RNA, 19 nt, Homo sapiens
uggaggagaccgcaaguug

SEQ ID NO: 1296036 - RNA, 19 nt, Homo sapiens
aggcagaagucauuaacca

SEQ ID NO: 1296037 - RNA, 19 nt, Homo sapiens
cagcuacuccagacuucua

SEQ ID NO: 1296038 - RNA, 19 nt, Homo sapiens
uacagaagaucucccaaaa

SEQ ID NO: 1296039 - RNA, 19 nt, Homo sapiens
uccaagagcagcugaaauc

SEQ ID NO: 1296040 - RNA, 19 nt, Homo sapiens
acagaacuuccauucaauu

SEQ ID NO: 1296041 - RNA, 19 nt, Homo sapiens
caggguagcauccucuuuc

SEQ ID NO: 1296042 - RNA, 19 nt, Homo sapiens
ccucuuucccuaguuauuu

SEQ ID NO: 1296043 - RNA, 19 nt, Homo sapiens
ggaggaggaggcagaaguc

SEQ ID NO: 1296044 - RNA, 19 nt, Homo sapiens
gcagacccauccucuuucc

SEQ ID NO: 1296045 - RNA, 19 nt, Homo sapiens
cagccugccuuuccacucu

SEQ ID NO: 1296046 - RNA, 19 nt, Homo sapiens
gaguacacagccugccuuu

SEQ ID NO: 1296047 - RNA, 19 nt, Homo sapiens
guagacgccuccucuuuuc

SEQ ID NO: 1296048 - RNA, 19 nt, Homo sapiens
ggaggcagaagucauuaac

SEQ ID NO: 1296049 - RNA, 19 nt, Homo sapiens
uugaucgacuucuugaaau

SEQ ID NO: 1296050 - RNA, 19 nt, Homo sapiens
uuugaucgacuucuugaaa

SEQ ID NO: 1296051 - RNA, 19 nt, Homo sapiens
cagaacuuccauucaauuc

SEQ ID NO: 1296052 - RNA, 19 nt, Homo sapiens
gguccaagagcagcugaaa

SEQ ID NO: 1296053 - RNA, 19 nt, Homo sapiens
caagagcagcugaaaucuc

SEQ ID NO: 1296054 - RNA, 19 nt, Homo sapiens
gcugggagcgucacaugca

SEQ ID NO: 1296055 - RNA, 19 nt, Homo sapiens
gccucuaccuccugcacuu

SEQ ID NO: 1296056 - RNA, 19 nt, Homo sapiens
ccaaaacauuuccaacaca

SEQ ID NO: 1296057 - RNA, 19 nt, Homo sapiens
acuccagacuucuaugcuu

SEQ ID NO: 1296058 - RNA, 19 nt, Homo sapiens
uaaaguuuguacgaguuca

SEQ ID NO: 1296059 - RNA, 19 nt, Homo sapiens
ggugguugcccuaccuguu

SEQ ID NO: 1296060 - RNA, 19 nt, Homo sapiens
ucucagaagcugcuacaag

SEQ ID NO: 1296061 - RNA, 19 nt, Homo sapiens
agaagucauuaaccagaag

SEQ ID NO: 1296062 - RNA, 19 nt, Homo sapiens
acacagaacuuccauucaa

SEQ ID NO: 1296063 - RNA, 19 nt, Homo sapiens
uagaagcccugcccaagaa

SEQ ID NO: 1296064 - RNA, 19 nt, Homo sapiens
gguccuagcugccuuccuu

SEQ ID NO: 1296065 - RNA, 19 nt, Homo sapiens
ggaggaggcagaagucauu

SEQ ID NO: 1296066 - RNA, 19 nt, Homo sapiens
gagcgucacaugcaaauug

SEQ ID NO: 1296067 - RNA, 19 nt, Homo sapiens
gaacuugccauuggacuga

SEQ ID NO: 1296068 - RNA, 19 nt, Homo sapiens
caacacagaacuuccauuc

SEQ ID NO: 1296069 - RNA, 19 nt, Homo sapiens
ugaucgacuucuugaaaua

SEQ ID NO: 1296070 - RNA, 19 nt, Homo sapiens
cauccucuuucccuaguua

SEQ ID NO: 1296071 - RNA, 19 nt, Homo sapiens
gaagaucucccaaaacauu

SEQ ID NO: 1296072 - RNA, 19 nt, Homo sapiens
gugcagacccauccucuuu

SEQ ID NO: 1296073 - RNA, 19 nt, Homo sapiens
ggaggagaccgcaaguuga

SEQ ID NO: 1296074 - RNA, 19 nt, Homo sapiens
ccucuuuccucccuacuuu

SEQ ID NO: 1296075 - RNA, 19 nt, Homo sapiens
cagaagucauuaaccagaa

SEQ ID NO: 1296076 - RNA, 19 nt, Homo sapiens
cucagaagcugcuacaaga

SEQ ID NO: 1296077 - RNA, 19 nt, Homo sapiens
ccauuggacugagcucuuu

SEQ ID NO: 1296078 - RNA, 19 nt, Homo sapiens
gaucgacuucuugaaauaa

SEQ ID NO: 1296079 - RNA, 19 nt, Homo sapiens
cagaagaucucccaaaaca

SEQ ID NO: 1296080 - RNA, 19 nt, Homo sapiens
ggacuugaacuugccauug

SEQ ID NO: 1296081 - RNA, 19 nt, Homo sapiens
gacuugaacuugccauugg

SEQ ID NO: 1296082 - RNA, 19 nt, Homo sapiens
ccaacuuuaucauucuuug

SEQ ID NO: 1296083 - RNA, 19 nt, Homo sapiens
agaagcugcuacaagauga

SEQ ID NO: 1296084 - RNA, 19 nt, Homo sapiens
ccggguagcucucaaacuc

SEQ ID NO: 1296085 - RNA, 19 nt, Homo sapiens
cacagaacuuccauucaau

SEQ ID NO: 1296086 - RNA, 19 nt, Homo sapiens
aaacauuuccaacacagaa

SEQ ID NO: 1296087 - RNA, 19 nt, Homo sapiens
cuacagaagaucucccaaa

SEQ ID NO: 1296088 - RNA, 19 nt, Homo sapiens
gagggcauccuggcuguuu

SEQ ID NO: 1296089 - RNA, 19 nt, Homo sapiens
aagaagagccaacagacuu

SEQ ID NO: 1296090 - RNA, 19 nt, Homo sapiens
ugguggagcuguucuguag

SEQ ID NO: 1296091 - RNA, 19 nt, Homo sapiens
guacacagccugccuuucc

SEQ ID NO: 1296092 - RNA, 19 nt, Homo sapiens
gcacuuaccccaauguaga

SEQ ID NO: 1296093 - RNA, 19 nt, Homo sapiens
gugguugcccuaccuguuu

SEQ ID NO: 1296094 - RNA, 19 nt, Homo sapiens
ucaugucccugcccucuuc

SEQ ID NO: 1296095 - RNA, 19 nt, Homo sapiens
cuccagacuucuaugcuuu

SEQ ID NO: 1296096 - RNA, 19 nt, Homo sapiens
cagaagcugcuacaagaug

SEQ ID NO: 1296097 - RNA, 19 nt, Homo sapiens
gacagagaaggaagccaua

SEQ ID NO: 1296098 - RNA, 19 nt, Homo sapiens
gaggaggcagaagucauua

SEQ ID NO: 1296099 - RNA, 19 nt, Homo sapiens
gagccgccuucgaagaugu

SEQ ID NO: 1296100 - RNA, 19 nt, Homo sapiens
guguagacgccuccucuuu

SEQ ID NO: 1296101 - RNA, 19 nt, Homo sapiens
cuagaagcccugcccaaga

SEQ ID NO: 1296102 - RNA, 19 nt, Homo sapiens
gaggagaccgcaaguugag

SEQ ID NO: 1296103 - RNA, 19 nt, Homo sapiens
uggaggagaccgcaaguug

SEQ ID NO: 1296104 - RNA, 19 nt, Homo sapiens
aggcagaagucauuaacca

SEQ ID NO: 1296105 - RNA, 19 nt, Homo sapiens
cagcuacuccagacuucua

SEQ ID NO: 1296106 - RNA, 19 nt, Homo sapiens
uacagaagaucucccaaaa

SEQ ID NO: 1296107 - RNA, 19 nt, Homo sapiens
caggguagcauccucuuuc

SEQ ID NO: 1296108 - RNA, 19 nt, Homo sapiens
uccaagagcagcugaaauc

SEQ ID NO: 1296109 - RNA, 19 nt, Homo sapiens
acagaacuuccauucaauu

SEQ ID NO: 1296110 - RNA, 19 nt, Homo sapiens
ggaggaggaggcagaaguc

SEQ ID NO: 1296111 - RNA, 19 nt, Homo sapiens
gcagacccauccucuuucc

SEQ ID NO: 1296112 - RNA, 19 nt, Homo sapiens
cagccugccuuuccacucu

SEQ ID NO: 1296113 - RNA, 19 nt, Homo sapiens
ccucuuucccuaguuauuu

SEQ ID NO: 1296114 - RNA, 19 nt, Homo sapiens
gaguacacagccugccuuu

SEQ ID NO: 1296115 - RNA, 19 nt, Homo sapiens
gaagcccugcccaagaaga

SEQ ID NO: 1296116 - RNA, 19 nt, Homo sapiens
guagacgccuccucuuuuc

SEQ ID NO: 1296117 - RNA, 19 nt, Homo sapiens
ggaggcagaagucauuaac

SEQ ID NO: 1296118 - RNA, 19 nt, Homo sapiens
caagaagagccaacagacu

SEQ ID NO: 1296119 - RNA, 19 nt, Homo sapiens
uugaucgacuucuugaaau

SEQ ID NO: 1296120 - RNA, 19 nt, Homo sapiens
uuugaucgacuucuugaaa

SEQ ID NO: 1296121 - RNA, 19 nt, Homo sapiens
cagaacuuccauucaauuc

SEQ ID NO: 1296122 - RNA, 19 nt, Homo sapiens
gguccaagagcagcugaaa

SEQ ID NO: 1296123 - RNA, 19 nt, Homo sapiens
caagagcagcugaaaucuc

SEQ ID NO: 1296124 - RNA, 19 nt, Homo sapiens
gcugggagcgucacaugca

SEQ ID NO: 1296125 - RNA, 19 nt, Homo sapiens
gccucuaccuccugcacuu

SEQ ID NO: 1296126 - RNA, 19 nt, Homo sapiens
ccaaaacauuuccaacaca

SEQ ID NO: 1296127 - RNA, 19 nt, Homo sapiens
acuccagacuucuaugcuu

SEQ ID NO: 1296128 - RNA, 19 nt, Homo sapiens
uaaaguuuguacgaguuca

SEQ ID NO: 1296129 - RNA, 19 nt, Homo sapiens
ggugguugcccuaccuguu

SEQ ID NO: 1296130 - RNA, 19 nt, Homo sapiens
guuccaacuccaccuagaa

SEQ ID NO: 1296131 - RNA, 19 nt, Homo sapiens
ucucagaagcugcuacaag

SEQ ID NO: 1296132 - RNA, 19 nt, Homo sapiens
agaagucauuaaccagaag

SEQ ID NO: 1296133 - RNA, 19 nt, Homo sapiens
gcaaauguuucaggaguua

SEQ ID NO: 1296134 - RNA, 19 nt, Homo sapiens
gaaaugcuauagaggaaga

SEQ ID NO: 1296135 - RNA, 19 nt, Homo sapiens
uguaggaacuuaagcauuu

SEQ ID NO: 1296136 - RNA, 19 nt, Homo sapiens
ccacaucuguaggaacuua

SEQ ID NO: 1296137 - RNA, 19 nt, Homo sapiens
agaggaagauuucaguuga

SEQ ID NO: 1296138 - RNA, 19 nt, Homo sapiens
gaagauuucaguugauaga

SEQ ID NO: 1296139 - RNA, 19 nt, Homo sapiens
gaacuggagugaggagaag

SEQ ID NO: 1296140 - RNA, 19 nt, Homo sapiens
aagaaaugcuauagaggaa

SEQ ID NO: 1296141 - RNA, 19 nt, Homo sapiens
gaggaagauuucaguugau

SEQ ID NO: 1296142 - RNA, 19 nt, Homo sapiens
acagaaguguggaagcaaa

SEQ ID NO: 1296143 - RNA, 19 nt, Homo sapiens
aggaagauuucaguugaua

SEQ ID NO: 1296144 - RNA, 19 nt, Homo sapiens
gaaacaugaagcuaaguca

SEQ ID NO: 1296145 - RNA, 19 nt, Homo sapiens
acacaauagugacaacugu

SEQ ID NO: 1296146 - RNA, 19 nt, Homo sapiens
cugaagaaaugcuauagag

SEQ ID NO: 1296147 - RNA, 19 nt, Homo sapiens
uauaugagccuuggaaaca

SEQ ID NO: 1296148 - RNA, 19 nt, Homo sapiens
gcugggcccauacagguua

SEQ ID NO: 1296149 - RNA, 19 nt, Homo sapiens
ugacaacugugaggcaugu

SEQ ID NO: 1296150 - RNA, 19 nt, Homo sapiens
gaagggccacacaauagug

SEQ ID NO: 1296151 - RNA, 19 nt, Homo sapiens
acaugaagcuaagucagaa

SEQ ID NO: 1296152 - RNA, 19 nt, Homo sapiens
gaucaaggacaucucucuu

SEQ ID NO: 1296153 - RNA, 19 nt, Homo sapiens
gugaagaugaggguguuua

SEQ ID NO: 1296154 - RNA, 19 nt, Homo sapiens
ggaaacaugaagcuaaguc

SEQ ID NO: 1296155 - RNA, 19 nt, Homo sapiens
aaggacaucucucuugaag

SEQ ID NO: 1296156 - RNA, 19 nt, Homo sapiens
gaaguguggaagcaaaugu

SEQ ID NO: 1296157 - RNA, 19 nt, Homo sapiens
acccagagauguaagaagu

SEQ ID NO: 1296158 - RNA, 19 nt, Homo sapiens
cuugaagggccacacaaua

SEQ ID NO: 1296159 - RNA, 19 nt, Homo sapiens
uagaggaagauuucaguug

SEQ ID NO: 1296160 - RNA, 19 nt, Homo sapiens
uaugagccuuggaaacaug

SEQ ID NO: 1296161 - RNA, 19 nt, Homo sapiens
uuucugcuguugugucauu

SEQ ID NO: 1296162 - RNA, 19 nt, Homo sapiens
acaauagugacaacuguga

SEQ ID NO: 1296163 - RNA, 19 nt, Homo sapiens
aaccugguguuccgaauuc

SEQ ID NO: 1296164 - RNA, 19 nt, Homo sapiens
guguuuacccagagaugua

SEQ ID NO: 1296165 - RNA, 19 nt, Homo sapiens
ugugucauucucauuguua

SEQ ID NO: 1296166 - RNA, 19 nt, Homo sapiens
ggagguuccuaugaucaag

SEQ ID NO: 1296167 - RNA, 19 nt, Homo sapiens
gacccugaguucacacaag

SEQ ID NO: 1296168 - RNA, 19 nt, Homo sapiens
gcuauaugagccuuggaaa

SEQ ID NO: 1296169 - RNA, 19 nt, Homo sapiens
caagguggaggagguaguu

SEQ ID NO: 1296170 - RNA, 19 nt, Homo sapiens
ugaggacccugaguucaca

SEQ ID NO: 1296171 - RNA, 19 nt, Homo sapiens
cuuggaaacaugaagcuaa

SEQ ID NO: 1296172 - RNA, 19 nt, Homo sapiens
aaccacaucuguaggaacu

SEQ ID NO: 1296173 - RNA, 19 nt, Homo sapiens
cuucugugcugggcccaua

SEQ ID NO: 1296174 - RNA, 19 nt, Homo sapiens
acccugaguucacacaaga

SEQ ID NO: 1296175 - RNA, 19 nt, Homo sapiens
guugugucauucucauugu

SEQ ID NO: 1296176 - RNA, 19 nt, Homo sapiens
gcuguugugucauucucau

SEQ ID NO: 1296177 - RNA, 19 nt, Homo sapiens
ggaagauuucaguugauag

SEQ ID NO: 1296178 - RNA, 19 nt, Homo sapiens
aaaccugguguuccgaauu

SEQ ID NO: 1296179 - RNA, 19 nt, Homo sapiens
uugaagggccacacaauag

SEQ ID NO: 1296180 - RNA, 19 nt, Homo sapiens
ugaacuggagugaggagaa

SEQ ID NO: 1296181 - RNA, 19 nt, Homo sapiens
aacaugaagcuaagucaga

SEQ ID NO: 1296182 - RNA, 19 nt, Homo sapiens
ugaagggccacacaauagu

SEQ ID NO: 1296183 - RNA, 19 nt, Homo sapiens
guaggaacuuaagcauuuu

SEQ ID NO: 1296184 - RNA, 19 nt, Homo sapiens
gcaaugaacugacugguaa

SEQ ID NO: 1296185 - RNA, 19 nt, Homo sapiens
caucacaucucgagucuua

SEQ ID NO: 1296186 - RNA, 19 nt, Homo sapiens
uauagaaggugaaccauua

SEQ ID NO: 1296187 - RNA, 19 nt, Homo sapiens
guaauaaguuguucccuaa

SEQ ID NO: 1296188 - RNA, 19 nt, Homo sapiens
gaaacuaguuggaaugaga

SEQ ID NO: 1296189 - RNA, 19 nt, Homo sapiens
gcauguaccuguauauuau

SEQ ID NO: 1296190 - RNA, 19 nt, Homo sapiens
ccacaucgauaguauuuaa

SEQ ID NO: 1296191 - RNA, 19 nt, Homo sapiens
uaagagagcugauuagaca

SEQ ID NO: 1296192 - RNA, 19 nt, Homo sapiens
gcaaagagcccuacacuag

SEQ ID NO: 1296193 - RNA, 19 nt, Homo sapiens
gcacacauauuugcaguuu

SEQ ID NO: 1296194 - RNA, 19 nt, Homo sapiens
gcaauuaggaugaucauuu

SEQ ID NO: 1296195 - RNA, 19 nt, Homo sapiens
gaaaugguguuaaucugaa

SEQ ID NO: 1296196 - RNA, 19 nt, Homo sapiens
aaagaaaucugcaugaguu

SEQ ID NO: 1296197 - RNA, 19 nt, Homo sapiens
uaagugacgucuaauugua

SEQ ID NO: 1296198 - RNA, 19 nt, Homo sapiens
gcacuaaccuuguacacau

SEQ ID NO: 1296199 - RNA, 19 nt, Homo sapiens
caauagaguugccuaagaa

SEQ ID NO: 1296200 - RNA, 19 nt, Homo sapiens
gacaaggauuccacuguua

SEQ ID NO: 1296201 - RNA, 19 nt, Homo sapiens
ccaauagucucaaaguaaa

SEQ ID NO: 1296202 - RNA, 19 nt, Homo sapiens
gauguguucuuaagcauaa

SEQ ID NO: 1296203 - RNA, 19 nt, Homo sapiens
guucugagaucucuuuauu

SEQ ID NO: 1296204 - RNA, 19 nt, Homo sapiens
gcagaaagaagcauuagaa

SEQ ID NO: 1296205 - RNA, 19 nt, Homo sapiens
gaacugcccuucagcaucu

SEQ ID NO: 1296206 - RNA, 19 nt, Homo sapiens
gaaaagagaguagcaauua

SEQ ID NO: 1296207 - RNA, 19 nt, Homo sapiens
uagagagacuuauguguuu

SEQ ID NO: 1296208 - RNA, 19 nt, Homo sapiens
gcagugcacucuaaccuau

SEQ ID NO: 1296209 - RNA, 19 nt, Homo sapiens
ucacacacauauagcauaa

SEQ ID NO: 1296210 - RNA, 19 nt, Homo sapiens
ucacggaugugguuugaaa

SEQ ID NO: 1296211 - RNA, 19 nt, Homo sapiens
gcaguuaauugcauauugu

SEQ ID NO: 1296212 - RNA, 19 nt, Homo sapiens
uaugguaccuuaaagcuuu

SEQ ID NO: 1296213 - RNA, 19 nt, Homo sapiens
cagagugucuugcaguuaa

SEQ ID NO: 1296214 - RNA, 19 nt, Homo sapiens
gacaugugcuucucauuau

SEQ ID NO: 1296215 - RNA, 19 nt, Homo sapiens
cacaaucaguucuucauuu

SEQ ID NO: 1296216 - RNA, 19 nt, Homo sapiens
aaacacaguucuucuuuca

SEQ ID NO: 1296217 - RNA, 19 nt, Homo sapiens
gcaguuugcucaguugauu

SEQ ID NO: 1296218 - RNA, 19 nt, Homo sapiens
gaagucaucuauguggaaa

SEQ ID NO: 1296219 - RNA, 19 nt, Homo sapiens
guagcuauauguuacugua

SEQ ID NO: 1296220 - RNA, 19 nt, Homo sapiens
ggaauuacuuacugacugu

SEQ ID NO: 1296221 - RNA, 19 nt, Homo sapiens
gaaagugucaauagaguug

SEQ ID NO: 1296222 - RNA, 19 nt, Homo sapiens
cagagcagcaugagaaaua

SEQ ID NO: 1296223 - RNA, 19 nt, Homo sapiens
cagcaaccauugugagaaa

SEQ ID NO: 1296224 - RNA, 19 nt, Homo sapiens
cuaaagcugugccuagaaa

SEQ ID NO: 1296225 - RNA, 19 nt, Homo sapiens
gcuauuaguuucuguacug

SEQ ID NO: 1296226 - RNA, 19 nt, Homo sapiens
gguugaagcacacauauuu

SEQ ID NO: 1296227 - RNA, 19 nt, Homo sapiens
ggauuuauguuaagggaau

SEQ ID NO: 1296228 - RNA, 19 nt, Homo sapiens
ucaauagaguugccuaaga

SEQ ID NO: 1296229 - RNA, 19 nt, Homo sapiens
agacaugugcuucucauua

SEQ ID NO: 1296230 - RNA, 19 nt, Homo sapiens
ugacaaggauuccacuguu

SEQ ID NO: 1296231 - RNA, 19 nt, Homo sapiens
ugaacugacugguaaguga

SEQ ID NO: 1296232 - RNA, 19 nt, Homo sapiens
ucaauggaaggaaguauua

SEQ ID NO: 1296233 - RNA, 19 nt, Homo sapiens
gaaggugaaccauuaguau

SEQ ID NO: 1296234 - RNA, 19 nt, Homo sapiens
aaacaagugugcguaugua

SEQ ID NO: 1296235 - RNA, 19 nt, Homo sapiens
ggauuagcauguaccugua

SEQ ID NO: 1296236 - RNA, 19 nt, Homo sapiens
gacagaauauguuauaggu

SEQ ID NO: 1296237 - RNA, 19 nt, Homo sapiens
gagcaggaccacaucgaua

SEQ ID NO: 1296238 - RNA, 19 nt, Homo sapiens
ggcaaaugcugcaaacuuc

SEQ ID NO: 1296239 - RNA, 19 nt, Homo sapiens
gaccacaucgauaguauuu

SEQ ID NO: 1296240 - RNA, 19 nt, Homo sapiens
gaguagaauucaucugguu

SEQ ID NO: 1296241 - RNA, 19 nt, Homo sapiens
aggaauagcgauagauuua

SEQ ID NO: 1296242 - RNA, 19 nt, Homo sapiens
uaagaaaggaauagcgaua

SEQ ID NO: 1296243 - RNA, 19 nt, Homo sapiens
gcaaacaagugugcguaug

SEQ ID NO: 1296244 - RNA, 19 nt, Homo sapiens
gcugcaaacuuccaauaug

SEQ ID NO: 1296245 - RNA, 19 nt, Homo sapiens
cagcuugucuuaagaaugg

SEQ ID NO: 1296246 - RNA, 19 nt, Homo sapiens
gcugcaaacuuguguuaau

SEQ ID NO: 1296247 - RNA, 19 nt, Homo sapiens
uagaguugccuaagaauaa

SEQ ID NO: 1296248 - RNA, 19 nt, Homo sapiens
gaaagaaaucugcaugagu

SEQ ID NO: 1296249 - RNA, 19 nt, Homo sapiens
uguaagcacuguaguugaa

SEQ ID NO: 1296250 - RNA, 19 nt, Homo sapiens
uaagaacuaugaagacuac

SEQ ID NO: 1296251 - RNA, 19 nt, Homo sapiens
gguaagugacgucuaauug

SEQ ID NO: 1296252 - RNA, 19 nt, Homo sapiens
caaagugacagaauauguu

SEQ ID NO: 1296253 - RNA, 19 nt, Homo sapiens
caaagacacuaaaacagua

SEQ ID NO: 1296254 - RNA, 19 nt, Homo sapiens
ucucgagucuuaucaaguu

SEQ ID NO: 1296255 - RNA, 19 nt, Homo sapiens
aguaccagguuuagucuua

SEQ ID NO: 1296256 - RNA, 19 nt, Homo sapiens
ggugaaccauuaguauaaa

SEQ ID NO: 1296257 - RNA, 19 nt, Homo sapiens
gaaccaauagucucaaagu

SEQ ID NO: 1296258 - RNA, 19 nt, Homo sapiens
ccgauuucuugcacaauua

SEQ ID NO: 1296259 - RNA, 19 nt, Homo sapiens
aaaccaauaucaucacauc

SEQ ID NO: 1296260 - RNA, 19 nt, Homo sapiens
ucacagacagaaaccuuua

SEQ ID NO: 1296261 - RNA, 19 nt, Homo sapiens
gcuauauguuacuguauug

SEQ ID NO: 1296262 - RNA, 19 nt, Homo sapiens
gcaaacuuguguuaauucu

SEQ ID NO: 1296263 - RNA, 19 nt, Homo sapiens
cagguuuagucuuacuuua

SEQ ID NO: 1296264 - RNA, 19 nt, Homo sapiens
cagcagcgauuggcagauu

SEQ ID NO: 1296265 - RNA, 19 nt, Homo sapiens
cuacauuggcuguugguua

SEQ ID NO: 1296266 - RNA, 19 nt, Homo sapiens
caaaugaagggucuauaug

SEQ ID NO: 1296267 - RNA, 19 nt, Homo sapiens
acaaucaguucuucauuuc

SEQ ID NO: 1296268 - RNA, 19 nt, Homo sapiens
caugguauccugguuauuu

SEQ ID NO: 1296269 - RNA, 19 nt, Homo sapiens
aaagagcccuacacuagau

SEQ ID NO: 1296270 - RNA, 19 nt, Homo sapiens
ccucugaaguuaacugaug

SEQ ID NO: 1296271 - RNA, 19 nt, Homo sapiens
uacauuggcuguugguuau

SEQ ID NO: 1296272 - RNA, 19 nt, Homo sapiens
caaagagcccuacacuaga

SEQ ID NO: 1296273 - RNA, 19 nt, Homo sapiens
acacauauuugcaguuuac

SEQ ID NO: 1296274 - RNA, 19 nt, Homo sapiens
gcagagugucuugcaguua

SEQ ID NO: 1296275 - RNA, 19 nt, Homo sapiens
ucacgaauaugaaguacca

SEQ ID NO: 1296276 - RNA, 19 nt, Homo sapiens
cugaugggcuaaccgauuu

SEQ ID NO: 1296277 - RNA, 19 nt, Homo sapiens
ggauuacgucugcaucuuu

SEQ ID NO: 1296278 - RNA, 19 nt, Homo sapiens
gcaacuauauuuucguuug

SEQ ID NO: 1296279 - RNA, 19 nt, Homo sapiens
guagauuucuuaugugacu

SEQ ID NO: 1296280 - RNA, 19 nt, Homo sapiens
gcucaaagugacagaauau

SEQ ID NO: 1296281 - RNA, 19 nt, Homo sapiens
aauaugaaguaccagguuu

SEQ ID NO: 1296282 - RNA, 19 nt, Homo sapiens
ccacauacauuugccuauc

SEQ ID NO: 1296283 - RNA, 19 nt, Homo sapiens
gcauaagcaacauuuagaa

SEQ ID NO: 1296284 - RNA, 19 nt, Homo sapiens
ggaauugucucgccauuua

SEQ ID NO: 1296285 - RNA, 19 nt, Homo sapiens
gaaguuuacugcaauguga

SEQ ID NO: 1296286 - RNA, 19 nt, Homo sapiens
gcaccaagcugucaucaca

SEQ ID NO: 1296287 - RNA, 19 nt, Homo sapiens
agaaggagguaaaguauuu

SEQ ID NO: 1296288 - RNA, 19 nt, Homo sapiens
caucaucacugacagcuuu

SEQ ID NO: 1296289 - RNA, 19 nt, Homo sapiens
gcacagcgaugacucuucu

SEQ ID NO: 1296290 - RNA, 19 nt, Homo sapiens
ggacagagcgauauuugau

SEQ ID NO: 1296291 - RNA, 19 nt, Homo sapiens
gcaagaagccuggaauugu

SEQ ID NO: 1296292 - RNA, 19 nt, Homo sapiens
uaacguccauaccaggaua

SEQ ID NO: 1296293 - RNA, 19 nt, Homo sapiens
uaagaaagcccaugagaag

SEQ ID NO: 1296294 - RNA, 19 nt, Homo sapiens
caagaagccuggaauuguc

SEQ ID NO: 1296295 - RNA, 19 nt, Homo sapiens
gcgacuauauugagaagga

SEQ ID NO: 1296296 - RNA, 19 nt, Homo sapiens
gauaagaaagcccaugaga

SEQ ID NO: 1296297 - RNA, 19 nt, Homo sapiens
cuacaaaaguggacauuaa

SEQ ID NO: 1296298 - RNA, 19 nt, Homo sapiens
ggaccaggacucagcauga

SEQ ID NO: 1296299 - RNA, 19 nt, Homo sapiens
ggacaucagcagcgacauu

SEQ ID NO: 1296300 - RNA, 19 nt, Homo sapiens
cauagacaaugcaaagaga

SEQ ID NO: 1296301 - RNA, 19 nt, Homo sapiens
gagauaagaaagcccauga

SEQ ID NO: 1296302 - RNA, 19 nt, Homo sapiens
cacaggagauccagcaguu

SEQ ID NO: 1296303 - RNA, 19 nt, Homo sapiens
aaagagagcccaccagcuu

SEQ ID NO: 1296304 - RNA, 19 nt, Homo sapiens
gccaagcccugcagugugu

SEQ ID NO: 1296305 - RNA, 19 nt, Homo sapiens
gagaaggagguaaaguauu

SEQ ID NO: 1296306 - RNA, 19 nt, Homo sapiens
gcgaugacucuucuacaaa

SEQ ID NO: 1296307 - RNA, 19 nt, Homo sapiens
cugaaucccuccaguagga

SEQ ID NO: 1296308 - RNA, 19 nt, Homo sapiens
gagcgacuauauugagaag

SEQ ID NO: 1296309 - RNA, 19 nt, Homo sapiens
gaccaggacucagcaugau

SEQ ID NO: 1296310 - RNA, 19 nt, Homo sapiens
aaagaaguuuacugcaaug

SEQ ID NO: 1296311 - RNA, 19 nt, Homo sapiens
caugauguuccuauuguaa

SEQ ID NO: 1296312 - RNA, 19 nt, Homo sapiens
gaaaagaguagagauaaga

SEQ ID NO: 1296313 - RNA, 19 nt, Homo sapiens
gaauugucucgccauuuaa

SEQ ID NO: 1296314 - RNA, 19 nt, Homo sapiens
ugagaaggagguaaaguau

SEQ ID NO: 1296315 - RNA, 19 nt, Homo sapiens
ggcaagaagccuggaauug

SEQ ID NO: 1296316 - RNA, 19 nt, Homo sapiens
gggccucuauccacgaguu

SEQ ID NO: 1296317 - RNA, 19 nt, Homo sapiens
ggaagaggagggcaagaag

SEQ ID NO: 1296318 - RNA, 19 nt, Homo sapiens
gggcaagaagccuggaauu

SEQ ID NO: 1296319 - RNA, 19 nt, Homo sapiens
ggagaccauuggcgugaag

SEQ ID NO: 1296320 - RNA, 19 nt, Homo sapiens
cggaggagcuuugcugucu

SEQ ID NO: 1296321 - RNA, 19 nt, Homo sapiens
caggagauccagcaguuug

SEQ ID NO: 1296322 - RNA, 19 nt, Homo sapiens
guauuuaggucaguuaacg

SEQ ID NO: 1296323 - RNA, 19 nt, Homo sapiens
uugagaaggagguaaagua

SEQ ID NO: 1296324 - RNA, 19 nt, Homo sapiens
gacaucagcagcgacauug

SEQ ID NO: 1296325 - RNA, 19 nt, Homo sapiens
acagcaagaccaucaguga

SEQ ID NO: 1296326 - RNA, 19 nt, Homo sapiens
gguggaagccagcacuuuc

SEQ ID NO: 1296327 - RNA, 19 nt, Homo sapiens
cugcugagcgacuauauug

SEQ ID NO: 1296328 - RNA, 19 nt, Homo sapiens
cgaugacucuucuacaaaa

SEQ ID NO: 1296329 - RNA, 19 nt, Homo sapiens
ucagggugcccauccauga

SEQ ID NO: 1296330 - RNA, 19 nt, Homo sapiens
gucauaggccuucccagaa

SEQ ID NO: 1296331 - RNA, 19 nt, Homo sapiens
ccuaaaaggugaaaagagu

SEQ ID NO: 1296332 - RNA, 19 nt, Homo sapiens
gccagcacuucgagaacuu

SEQ ID NO: 1296333 - RNA, 19 nt, Homo sapiens
caugagaaggugacagaga

SEQ ID NO: 1296334 - RNA, 19 nt, Homo sapiens
auaagaaagcccaugagaa

SEQ ID NO: 1296335 - RNA, 19 nt, Homo sapiens
cccagguccucuacuguga

SEQ ID NO: 1296336 - RNA, 19 nt, Homo sapiens
gaacuuccuggagaccauu

SEQ ID NO: 1296337 - RNA, 19 nt, Homo sapiens
agcgaugacucuucuacaa

SEQ ID NO: 1296338 - RNA, 19 nt, Homo sapiens
ccacgggcagcucugauga

SEQ ID NO: 1296339 - RNA, 19 nt, Homo sapiens
ggugaaaagaguagagaua

SEQ ID NO: 1296340 - RNA, 19 nt, Homo sapiens
acagacugcugagcgacua

SEQ ID NO: 1296341 - RNA, 19 nt, Homo sapiens
aaacgaguauuccuaaaag

SEQ ID NO: 1296342 - RNA, 19 nt, Homo sapiens
gacagagcgauauuugaug

SEQ ID NO: 1296343 - RNA, 19 nt, Homo sapiens
gcugagcgacuauauugag

SEQ ID NO: 1296344 - RNA, 19 nt, Homo sapiens
ucuccuauguucgggauga

SEQ ID NO: 1296345 - RNA, 19 nt, Homo sapiens
agaaagcccaugagaaggu

SEQ ID NO: 1296346 - RNA, 19 nt, Homo sapiens
cagcauggaccaggacuca

SEQ ID NO: 1296347 - RNA, 19 nt, Homo sapiens
ggagcuuugcugucugcua

SEQ ID NO: 1296348 - RNA, 19 nt, Homo sapiens
ucaguuaacguccauacca

SEQ ID NO: 1296349 - RNA, 19 nt, Homo sapiens
uaccugaaucccuccagua

SEQ ID NO: 1296350 - RNA, 19 nt, Homo sapiens
cugagcgacuauauugaga

SEQ ID NO: 1296351 - RNA, 19 nt, Homo sapiens
cagccaagcccugcagugu

SEQ ID NO: 1296352 - RNA, 19 nt, Homo sapiens
gugaaaagaguagagauaa

SEQ ID NO: 1296353 - RNA, 19 nt, Homo sapiens
uggaagaggagggcaagaa

SEQ ID NO: 1296354 - RNA, 19 nt, Homo sapiens
cuuccgcgcagucgucaua

SEQ ID NO: 1296355 - RNA, 19 nt, Homo sapiens
ccaguuccaccaccaaugg

SEQ ID NO: 1296356 - RNA, 19 nt, Homo sapiens
gcaaaucauugaacacuuu

SEQ ID NO: 1296357 - RNA, 19 nt, Homo sapiens
gaacugaacugccuucucu

SEQ ID NO: 1296358 - RNA, 19 nt, Homo sapiens
gacauucucucuguaauua

SEQ ID NO: 1296359 - RNA, 19 nt, Homo sapiens
aaaguuggcuugucucaua

SEQ ID NO: 1296360 - RNA, 19 nt, Homo sapiens
gaagugggcucagugguuu

SEQ ID NO: 1296361 - RNA, 19 nt, Homo sapiens
gcagguggcucucaggaaa

SEQ ID NO: 1296362 - RNA, 19 nt, Homo sapiens
guagaaauguugcccuauu

SEQ ID NO: 1296363 - RNA, 19 nt, Homo sapiens
uacgauaccugccauuuaa

SEQ ID NO: 1296364 - RNA, 19 nt, Homo sapiens
gaagcggucuagaagugua

SEQ ID NO: 1296365 - RNA, 19 nt, Homo sapiens
guacgauaccugccauuua

SEQ ID NO: 1296366 - RNA, 19 nt, Homo sapiens
caugaaagguuuguaguug

SEQ ID NO: 1296367 - RNA, 19 nt, Homo sapiens
guguugacaucuacaauuu

SEQ ID NO: 1296368 - RNA, 19 nt, Homo sapiens
cgugguagguuuaaagaaa

SEQ ID NO: 1296369 - RNA, 19 nt, Homo sapiens
uccaauguaugguauguua

SEQ ID NO: 1296370 - RNA, 19 nt, Homo sapiens
ucaaggaccagcccaauuu

SEQ ID NO: 1296371 - RNA, 19 nt, Homo sapiens
ccacacaaguccagcaaug

SEQ ID NO: 1296372 - RNA, 19 nt, Homo sapiens
gcuaggacauucucucugu

SEQ ID NO: 1296373 - RNA, 19 nt, Homo sapiens
caauuucucuggcuugguu

SEQ ID NO: 1296374 - RNA, 19 nt, Homo sapiens
gcaaagacuucagaccaau

SEQ ID NO: 1296375 - RNA, 19 nt, Homo sapiens
caauuucacuaacuguuga

SEQ ID NO: 1296376 - RNA, 19 nt, Homo sapiens
ggacauucucucuguaauu

SEQ ID NO: 1296377 - RNA, 19 nt, Homo sapiens
aaagaaguccuggguguua

SEQ ID NO: 1296378 - RNA, 19 nt, Homo sapiens
gaaugucuuugaucacuag

SEQ ID NO: 1296379 - RNA, 19 nt, Homo sapiens
gcuccgaacuggaacugaa

SEQ ID NO: 1296380 - RNA, 19 nt, Homo sapiens
ccucuuggcuauauaacuu

SEQ ID NO: 1296381 - RNA, 19 nt, Homo sapiens
guuuguaguugagacauua

SEQ ID NO: 1296382 - RNA, 19 nt, Homo sapiens
uagagacccuuucaacaug

SEQ ID NO: 1296383 - RNA, 19 nt, Homo sapiens
gagaaugucuuugaucacu

SEQ ID NO: 1296384 - RNA, 19 nt, Homo sapiens
ucagaccaauucuuuguau

SEQ ID NO: 1296385 - RNA, 19 nt, Homo sapiens
ggauagcuccgaacuggaa

SEQ ID NO: 1296386 - RNA, 19 nt, Homo sapiens
guugacaucuacaauuuca

SEQ ID NO: 1296387 - RNA, 19 nt, Homo sapiens
guaguugagacauuacaua

SEQ ID NO: 1296388 - RNA, 19 nt, Homo sapiens
caagaucuguuuuccauga

SEQ ID NO: 1296389 - RNA, 19 nt, Homo sapiens
uauauggccuucagugcaa

SEQ ID NO: 1296390 - RNA, 19 nt, Homo sapiens
caacaugaaagguuuguag

SEQ ID NO: 1296391 - RNA, 19 nt, Homo sapiens
gucugucgguguuggauua

SEQ ID NO: 1296392 - RNA, 19 nt, Homo sapiens
gaaguccuggguguuaaua

SEQ ID NO: 1296393 - RNA, 19 nt, Homo sapiens
guucggaguucguuucauc

SEQ ID NO: 1296394 - RNA, 19 nt, Homo sapiens
ugucgguguuggauuauuu

SEQ ID NO: 1296395 - RNA, 19 nt, Homo sapiens
cuauuugucuucuccaaug

SEQ ID NO: 1296396 - RNA, 19 nt, Homo sapiens
gaagcaagagacuauaugg

SEQ ID NO: 1296397 - RNA, 19 nt, Homo sapiens
gaccaauucuuuguauuac

SEQ ID NO: 1296398 - RNA, 19 nt, Homo sapiens
gacuucagaccaauucuuu

SEQ ID NO: 1296399 - RNA, 19 nt, Homo sapiens
gagugcaaaucauugaaca

SEQ ID NO: 1296400 - RNA, 19 nt, Homo sapiens
guuggcuugucucauaaua

SEQ ID NO: 1296401 - RNA, 19 nt, Homo sapiens
cgaccaagggaaaccauuu

SEQ ID NO: 1296402 - RNA, 19 nt, Homo sapiens
ggaaaguuggcuugucuca

SEQ ID NO: 1296403 - RNA, 19 nt, Homo sapiens
aggaagcggucuagaagug

SEQ ID NO: 1296404 - RNA, 19 nt, Homo sapiens
acaagaauugggcugguua

SEQ ID NO: 1296405 - RNA, 19 nt, Homo sapiens
caaagacuucagaccaauu

SEQ ID NO: 1296406 - RNA, 19 nt, Homo sapiens
ugcaaagacuucagaccaa

SEQ ID NO: 1296407 - RNA, 19 nt, Homo sapiens
gagacuauauggccuucag

SEQ ID NO: 1296408 - RNA, 19 nt, Homo sapiens
ugaaagguuuguaguugag

SEQ ID NO: 1296409 - RNA, 19 nt, Homo sapiens
cauucucucuguaauuaug

SEQ ID NO: 1296410 - RNA, 19 nt, Homo sapiens
ugaagugggcucagugguu

SEQ ID NO: 1296411 - RNA, 19 nt, Homo sapiens
aagaaguccuggguguuaa

SEQ ID NO: 1296412 - RNA, 19 nt, Homo sapiens
gaccaagggaaaccauuug

SEQ ID NO: 1296413 - RNA, 19 nt, Homo sapiens
uaacgaaguauuguagaga

SEQ ID NO: 1296414 - RNA, 19 nt, Homo sapiens
cagaccaauucuuuguauu

SEQ ID NO: 1296415 - RNA, 19 nt, Homo sapiens
aguccuggguguuaauauu

SEQ ID NO: 1296416 - RNA, 19 nt, Homo sapiens
gguuuguaguugagacauu

SEQ ID NO: 1296417 - RNA, 19 nt, Homo sapiens
agagacccuuucaacauga

SEQ ID NO: 1296418 - RNA, 19 nt, Homo sapiens
uuagagacccuuucaacau

SEQ ID NO: 1296419 - RNA, 19 nt, Homo sapiens
agaaugucuuugaucacua

SEQ ID NO: 1296420 - RNA, 19 nt, Homo sapiens
cuaggacauucucucugua

SEQ ID NO: 1296421 - RNA, 19 nt, Homo sapiens
aacgaaguauuguagagaa

SEQ ID NO: 1296422 - RNA, 19 nt, Homo sapiens
gauaccugccauuuaagaa

SEQ ID NO: 1296423 - RNA, 19 nt, Homo sapiens
uauaacuucugagugcaaa

SEQ ID NO: 1296424 - RNA, 19 nt, Homo sapiens
augaaagguuuguaguuga

SEQ ID NO: 1296425 - RNA, 19 nt, Homo sapiens
ggugugcgugguagguuua

SEQ ID NO: 1296426 - RNA, 19 nt, Homo sapiens
gguugccucuuggcuauau

SEQ ID NO: 1296427 - RNA, 19 nt, Homo sapiens
cacaagaauugggcugguu

SEQ ID NO: 1296428 - RNA, 19 nt, Homo sapiens
caucuacaauuucacuaac

SEQ ID NO: 1296429 - RNA, 19 nt, Homo sapiens
uaggacauucucucuguaa

SEQ ID NO: 1296430 - RNA, 19 nt, Homo sapiens
ggucacggucgccucauga

SEQ ID NO: 1296431 - RNA, 19 nt, Homo sapiens
ucaggaagcggucuagaag

SEQ ID NO: 1296432 - RNA, 19 nt, Homo sapiens
guucauuucguucuuacuu

SEQ ID NO: 1296433 - RNA, 19 nt, Homo sapiens
guccuggguguuaauauuu

SEQ ID NO: 1296434 - RNA, 19 nt, Homo sapiens
gaauuguccuuguuuuaca

SEQ ID NO: 1296435 - RNA, 19 nt, Homo sapiens
cauugaacacuuuaacgaa

SEQ ID NO: 1296436 - RNA, 19 nt, Homo sapiens
guuagagacccuuucaaca

SEQ ID NO: 1296437 - RNA, 19 nt, Homo sapiens
acuagagucugucgguguu

SEQ ID NO: 1296438 - RNA, 19 nt, Homo sapiens
acaauuucacuaacuguug

SEQ ID NO: 1296439 - RNA, 19 nt, Homo sapiens
ccacugugagauucuuaaa

SEQ ID NO: 1296440 - RNA, 19 nt, Homo sapiens
gauuauuuccacugugaga

SEQ ID NO: 1296441 - RNA, 19 nt, Homo sapiens
ggaccagcccaauuucucu

SEQ ID NO: 1296442 - RNA, 19 nt, Homo sapiens
ucauccauguggcagcuuu

SEQ ID NO: 1296443 - RNA, 19 nt, Homo sapiens
uuaacgaaguauuguagag

SEQ ID NO: 1296444 - RNA, 19 nt, Homo sapiens
ucauugaacacuuuaacga

SEQ ID NO: 1296445 - RNA, 19 nt, Homo sapiens
agggagcuauguguucuuu

SEQ ID NO: 1296446 - RNA, 19 nt, Homo sapiens
uucacuaacuguugacguu

SEQ ID NO: 1296447 - RNA, 19 nt, Homo sapiens
cgauaccugccauuuaaga

SEQ ID NO: 1296448 - RNA, 19 nt, Homo sapiens
gcugaguguuuccuuuguc

SEQ ID NO: 1296449 - RNA, 19 nt, Homo sapiens
gucaggaagcggucuagaa

SEQ ID NO: 1296450 - RNA, 19 nt, Homo sapiens
ugaagcaagagacuauaug

SEQ ID NO: 1296451 - RNA, 19 nt, Homo sapiens
aaguuggcuugucucauaa

SEQ ID NO: 1296452 - RNA, 19 nt, Homo sapiens
cuggaaaguuggcuugucu

SEQ ID NO: 1296453 - RNA, 19 nt, Homo sapiens
caaggaccagcccaauuuc

SEQ ID NO: 1296454 - RNA, 19 nt, Homo sapiens
gguaaccacuguuuucaag

SEQ ID NO: 1296455 - RNA, 19 nt, Homo sapiens
aaagacuucagaccaauuc

SEQ ID NO: 1296456 - RNA, 19 nt, Homo sapiens
gaaaauaccucauuagugu

SEQ ID NO: 1296457 - RNA, 19 nt, Homo sapiens
gaaaguuccuuguagauac

SEQ ID NO: 1296458 - RNA, 19 nt, Homo sapiens
gaagaaacguguccauacu

SEQ ID NO: 1296459 - RNA, 19 nt, Homo sapiens
aaacacuucucucaacuaa

SEQ ID NO: 1296460 - RNA, 19 nt, Homo sapiens
ugacaugucuggcucgaaa

SEQ ID NO: 1296461 - RNA, 19 nt, Homo sapiens
gcgagaaacuauacacuca

SEQ ID NO: 1296462 - RNA, 19 nt, Homo sapiens
gaaaccugccuaccucaua

SEQ ID NO: 1296463 - RNA, 19 nt, Homo sapiens
gaaacuagaucugaaugca

SEQ ID NO: 1296464 - RNA, 19 nt, Homo sapiens
agaaaugccugaugucaau

SEQ ID NO: 1296465 - RNA, 19 nt, Homo sapiens
gaagcuuugugucaacauu

SEQ ID NO: 1296466 - RNA, 19 nt, Homo sapiens
ucacaagucucuuucucuu

SEQ ID NO: 1296467 - RNA, 19 nt, Homo sapiens
gcggguagguguuccuuug

SEQ ID NO: 1296468 - RNA, 19 nt, Homo sapiens
aauaagaaaugccugaugu

SEQ ID NO: 1296469 - RNA, 19 nt, Homo sapiens
gaaacacuucucucaacua

SEQ ID NO: 1296470 - RNA, 19 nt, Homo sapiens
ggacagcugugaggaucaa

SEQ ID NO: 1296471 - RNA, 19 nt, Homo sapiens
gagaaacuauacacucagu

SEQ ID NO: 1296472 - RNA, 19 nt, Homo sapiens
aagguggacuucagaaauu

SEQ ID NO: 1296473 - RNA, 19 nt, Homo sapiens
uaagagcacuuuugaagaa

SEQ ID NO: 1296474 - RNA, 19 nt, Homo sapiens
uaugaaaguuccuuguaga

SEQ ID NO: 1296475 - RNA, 19 nt, Homo sapiens
ugaaaguuccuuguagaua

SEQ ID NO: 1296476 - RNA, 19 nt, Homo sapiens
cauggaaacuagaucugaa

SEQ ID NO: 1296477 - RNA, 19 nt, Homo sapiens
gaugucaauucugaaacua

SEQ ID NO: 1296478 - RNA, 19 nt, Homo sapiens
ggacugcaaacccaaauca

SEQ ID NO: 1296479 - RNA, 19 nt, Homo sapiens
acagaacagugaaacauca

SEQ ID NO: 1296480 - RNA, 19 nt, Homo sapiens
acacuucucucaacuaaaa

SEQ ID NO: 1296481 - RNA, 19 nt, Homo sapiens
caacagaacagugaaacau

SEQ ID NO: 1296482 - RNA, 19 nt, Homo sapiens
aacuagaucugaaugcaaa

SEQ ID NO: 1296483 - RNA, 19 nt, Homo sapiens
uugaauacauggaaacuag

SEQ ID NO: 1296484 - RNA, 19 nt, Homo sapiens
agugaaacaucaugguaaa

SEQ ID NO: 1296485 - RNA, 19 nt, Homo sapiens
caaagguggacuucagaaa

SEQ ID NO: 1296486 - RNA, 19 nt, Homo sapiens
gaaggacugcaaacccaaa

SEQ ID NO: 1296487 - RNA, 19 nt, Homo sapiens
ugccugaugucaauucuga

SEQ ID NO: 1296488 - RNA, 19 nt, Homo sapiens
cgagaagcgagaaacuaua

SEQ ID NO: 1296489 - RNA, 19 nt, Homo sapiens
agaaacguguccauacugu

SEQ ID NO: 1296490 - RNA, 19 nt, Homo sapiens
gagaagcgagaaacuauac

SEQ ID NO: 1296491 - RNA, 19 nt, Homo sapiens
aaaccugccuaccucauag

SEQ ID NO: 1296492 - RNA, 19 nt, Homo sapiens
acaagucucuuucucuuuu

SEQ ID NO: 1296493 - RNA, 19 nt, Homo sapiens
uaagaaaugccugauguca

SEQ ID NO: 1296494 - RNA, 19 nt, Homo sapiens
ucuacuugcuccucaaaga

SEQ ID NO: 1296495 - RNA, 19 nt, Homo sapiens
cugcaaacccaaaucauga

SEQ ID NO: 1296496 - RNA, 19 nt, Homo sapiens
ccagagagaaggacugcaa

SEQ ID NO: 1296497 - RNA, 19 nt, Homo sapiens
agaucugaaugcaaacuuu

SEQ ID NO: 1296498 - RNA, 19 nt, Homo sapiens
gaauacauggaaacuagau

SEQ ID NO: 1296499 - RNA, 19 nt, Homo sapiens
cagaaugaaucccaaaaga

SEQ ID NO: 1296500 - RNA, 19 nt, Homo sapiens
guagaagcuuugugucaac

SEQ ID NO: 1296501 - RNA, 19 nt, Homo sapiens
gauaagagcacuuuugaag

SEQ ID NO: 1296502 - RNA, 19 nt, Homo sapiens
uggcauccuucaguguuua

SEQ ID NO: 1296503 - RNA, 19 nt, Homo sapiens
ucugaaggguggacuuuua

SEQ ID NO: 1296504 - RNA, 19 nt, Homo sapiens
ugaagaaacguguccauac

SEQ ID NO: 1296505 - RNA, 19 nt, Homo sapiens
ggaaaauaccucauuagug

SEQ ID NO: 1296506 - RNA, 19 nt, Homo sapiens
ggguggacuuuuaaaauaa

SEQ ID NO: 1296507 - RNA, 19 nt, Homo sapiens
aaagguggacuucagaaau

SEQ ID NO: 1296508 - RNA, 19 nt, Homo sapiens
cagugaaacaucaugguaa

SEQ ID NO: 1296509 - RNA, 19 nt, Homo sapiens
aguagaagcuuugugucaa

SEQ ID NO: 1296510 - RNA, 19 nt, Homo sapiens
gaaacguguccauacuguu

SEQ ID NO: 1296511 - RNA, 19 nt, Homo sapiens
ucaaagaacaccagcaaaa

SEQ ID NO: 1296512 - RNA, 19 nt, Homo sapiens
acagugaaacaucauggua

SEQ ID NO: 1296513 - RNA, 19 nt, Homo sapiens
gcaacagaacagugaaaca

SEQ ID NO: 1296514 - RNA, 19 nt, Homo sapiens
guguauuguugaucacuug

SEQ ID NO: 1296515 - RNA, 19 nt, Homo sapiens
cccgcuaccuccuguaaga

SEQ ID NO: 1296516 - RNA, 19 nt, Homo sapiens
gaaacaucaugguaaaagu

SEQ ID NO: 1296517 - RNA, 19 nt, Homo sapiens
aaauaccucauuaguguga

SEQ ID NO: 1296518 - RNA, 19 nt, Homo sapiens
gaaaugccugaugucaauu

SEQ ID NO: 1296519 - RNA, 19 nt, Homo sapiens
ccucaaagaacaccagcaa

SEQ ID NO: 1296520 - RNA, 19 nt, Homo sapiens
auaugaaaguuccuuguag

SEQ ID NO: 1296521 - RNA, 19 nt, Homo sapiens
aggguggacuuuuaaaaua

SEQ ID NO: 1296522 - RNA, 19 nt, Homo sapiens
guugaucacuuguaaaaca

SEQ ID NO: 1296523 - RNA, 19 nt, Homo sapiens
ucgagaagcgagaaacuau

SEQ ID NO: 1296524 - RNA, 19 nt, Homo sapiens
gcuccucacaagucucuuu

SEQ ID NO: 1296525 - RNA, 19 nt, Homo sapiens
gaaggguggacuuuuaaaa

SEQ ID NO: 1296526 - RNA, 19 nt, Homo sapiens
uguaaaacaugcaacagaa

SEQ ID NO: 1296527 - RNA, 19 nt, Homo sapiens
ccucauaggacagcuguga

SEQ ID NO: 1296528 - RNA, 19 nt, Homo sapiens
ccaaagguggacuucagaa

SEQ ID NO: 1296529 - RNA, 19 nt, Homo sapiens
ugaugucaauucugaaacu

SEQ ID NO: 1296530 - RNA, 19 nt, Homo sapiens
cuacuugcuccucaaagaa

SEQ ID NO: 1296531 - RNA, 19 nt, Homo sapiens
caagucucuuucucuuuua

SEQ ID NO: 1296532 - RNA, 19 nt, Homo sapiens
aaacuagaucugaaugcaa

SEQ ID NO: 1296533 - RNA, 19 nt, Homo sapiens
gcaaacccaaaucaugaca

SEQ ID NO: 1296534 - RNA, 19 nt, Homo sapiens
caaagacuccaaaagugua

SEQ ID NO: 1296535 - RNA, 19 nt, Homo sapiens
gaugauaagagcacuuuug

SEQ ID NO: 1296536 - RNA, 19 nt, Homo sapiens
ccucacaagucucuuucuc

SEQ ID NO: 1296537 - RNA, 19 nt, Homo sapiens
aaaguucaaagacuccaaa

SEQ ID NO: 1296538 - RNA, 19 nt, Homo sapiens
ccugaugucaauucugaaa

SEQ ID NO: 1296539 - RNA, 19 nt, Homo sapiens
uggggaaaauaccucauua

SEQ ID NO: 1296540 - RNA, 19 nt, Homo sapiens
cacaagucucuuucucuuu

SEQ ID NO: 1296541 - RNA, 19 nt, Homo sapiens
cauacuguuuccagcuguu

SEQ ID NO: 1296542 - RNA, 19 nt, Homo sapiens
aagaaaugccugaugucaa

SEQ ID NO: 1296543 - RNA, 19 nt, Homo sapiens
gcaaaacaaagaaacacuu

SEQ ID NO: 1296544 - RNA, 19 nt, Homo sapiens
guaucuacuugcuccucaa

SEQ ID NO: 1296545 - RNA, 19 nt, Homo sapiens
ggaaacuagaucugaaugc

SEQ ID NO: 1296546 - RNA, 19 nt, Homo sapiens
aaauaagaaaugccugaug

SEQ ID NO: 1296547 - RNA, 19 nt, Homo sapiens
uagaagcuuugugucaaca

SEQ ID NO: 1296548 - RNA, 19 nt, Homo sapiens
uugaagaaacguguccaua

SEQ ID NO: 1296549 - RNA, 19 nt, Homo sapiens
ccaaaaguguauuguugau

SEQ ID NO: 1296550 - RNA, 19 nt, Homo sapiens
guucaaagacuccaaaagu

SEQ ID NO: 1296551 - RNA, 19 nt, Homo sapiens
ugaagacaccagagagaag

SEQ ID NO: 1296552 - RNA, 19 nt, Homo sapiens
guauuguugaucacuugua

SEQ ID NO: 1296553 - RNA, 19 nt, Homo sapiens
gaagcgagaaacuauacac

SEQ ID NO: 1296554 - RNA, 19 nt, Homo sapiens
gaucugaaugcaaacuuuu

SEQ ID NO: 1296555 - RNA, 19 nt, Homo sapiens
cagagagaaggacugcaaa

SEQ ID NO: 1296556 - RNA, 19 nt, Homo sapiens
gagaaaguguguagaugua

SEQ ID NO: 1296557 - RNA, 19 nt, Homo sapiens
caacuuugcaucucuauua

SEQ ID NO: 1296558 - RNA, 19 nt, Homo sapiens
gggaagaacuacacuaaug

SEQ ID NO: 1296559 - RNA, 19 nt, Homo sapiens
gcaaaugcguaagcucuuu

SEQ ID NO: 1296560 - RNA, 19 nt, Homo sapiens
caagaugcaugauuaagug

SEQ ID NO: 1296561 - RNA, 19 nt, Homo sapiens
gaaaguguguagauguaug

SEQ ID NO: 1296562 - RNA, 19 nt, Homo sapiens
gagcauuccuucuauuaca

SEQ ID NO: 1296563 - RNA, 19 nt, Homo sapiens
gcaaugcuacuccuaagaa

SEQ ID NO: 1296564 - RNA, 19 nt, Homo sapiens
ggaaugacuuuucaaugua

SEQ ID NO: 1296565 - RNA, 19 nt, Homo sapiens
gagggaagaacuacacuaa

SEQ ID NO: 1296566 - RNA, 19 nt, Homo sapiens
ggcugaagaugcauuguaa

SEQ ID NO: 1296567 - RNA, 19 nt, Homo sapiens
ggaugucucugggaggaua

SEQ ID NO: 1296568 - RNA, 19 nt, Homo sapiens
gaagaacuacacuaauguu

SEQ ID NO: 1296569 - RNA, 19 nt, Homo sapiens
gcaggagugugacauguag

SEQ ID NO: 1296570 - RNA, 19 nt, Homo sapiens
gauugaaccuuuccucuac

SEQ ID NO: 1296571 - RNA, 19 nt, Homo sapiens
ggagaaaguguguagaugu

SEQ ID NO: 1296572 - RNA, 19 nt, Homo sapiens
cagagcauuccuucuauua

SEQ ID NO: 1296573 - RNA, 19 nt, Homo sapiens
cagcuuaaacaauggaaua

SEQ ID NO: 1296574 - RNA, 19 nt, Homo sapiens
ggaagaacuacacuaaugu

SEQ ID NO: 1296575 - RNA, 19 nt, Homo sapiens
gaaccuuuccucuacuuga

SEQ ID NO: 1296576 - RNA, 19 nt, Homo sapiens
gggaaugacuuuucaaugu

SEQ ID NO: 1296577 - RNA, 19 nt, Homo sapiens
gaaauuccgguuggauaaa

SEQ ID NO: 1296578 - RNA, 19 nt, Homo sapiens
cagcauacuugacaacaca

SEQ ID NO: 1296579 - RNA, 19 nt, Homo sapiens
ccagagcauuccuucuauu

SEQ ID NO: 1296580 - RNA, 19 nt, Homo sapiens
ggcccucucuugauccuuu

SEQ ID NO: 1296581 - RNA, 19 nt, Homo sapiens
uaagaauuguaccugugua

SEQ ID NO: 1296582 - RNA, 19 nt, Homo sapiens
agaaaugucucagccaugu

SEQ ID NO: 1296583 - RNA, 19 nt, Homo sapiens
ggaauugccuuuuacagau

SEQ ID NO: 1296584 - RNA, 19 nt, Homo sapiens
ugaauugccucugggaaga

SEQ ID NO: 1296585 - RNA, 19 nt, Homo sapiens
gaugaaacaaggugucaga

SEQ ID NO: 1296586 - RNA, 19 nt, Homo sapiens
caugguauccuaauguuug

SEQ ID NO: 1296587 - RNA, 19 nt, Homo sapiens
gccccaagaugcaugauua

SEQ ID NO: 1296588 - RNA, 19 nt, Homo sapiens
caauggauccugugugugu

SEQ ID NO: 1296589 - RNA, 19 nt, Homo sapiens
guccagagcauuccuucua

SEQ ID NO: 1296590 - RNA, 19 nt, Homo sapiens
gaagaugcauuguaaaagg

SEQ ID NO: 1296591 - RNA, 19 nt, Homo sapiens
gcuggacggugucuaucaa

SEQ ID NO: 1296592 - RNA, 19 nt, Homo sapiens
acuguaaccuugaaguuug

SEQ ID NO: 1296593 - RNA, 19 nt, Homo sapiens
cguaagcucuuugaacuag

SEQ ID NO: 1296594 - RNA, 19 nt, Homo sapiens
guaacuugaugggcagaaa

SEQ ID NO: 1296595 - RNA, 19 nt, Homo sapiens
gaauggagaaaguguguag

SEQ ID NO: 1296596 - RNA, 19 nt, Homo sapiens
gggcuugucuuaccacacu

SEQ ID NO: 1296597 - RNA, 19 nt, Homo sapiens
gcucaagguagaugacuga

SEQ ID NO: 1296598 - RNA, 19 nt, Homo sapiens
aacaauggauccugugugu

SEQ ID NO: 1296599 - RNA, 19 nt, Homo sapiens
ucuacuugaugcuuaguuu

SEQ ID NO: 1296600 - RNA, 19 nt, Homo sapiens
uugcaucucuauuaggaaa

SEQ ID NO: 1296601 - RNA, 19 nt, Homo sapiens
ccaagaugcaugauuaagu

SEQ ID NO: 1296602 - RNA, 19 nt, Homo sapiens
ggagagugccaccaauaca

SEQ ID NO: 1296603 - RNA, 19 nt, Homo sapiens
cagcaucuagcucaaggua

SEQ ID NO: 1296604 - RNA, 19 nt, Homo sapiens
gggaauaccguggauguuc

SEQ ID NO: 1296605 - RNA, 19 nt, Homo sapiens
gugcaaaacuggagaaucu

SEQ ID NO: 1296606 - RNA, 19 nt, Homo sapiens
aguauucccucuucucaau

SEQ ID NO: 1296607 - RNA, 19 nt, Homo sapiens
guugaaacauuguaauagc

SEQ ID NO: 1296608 - RNA, 19 nt, Homo sapiens
caaugcuacuccuaagaau

SEQ ID NO: 1296609 - RNA, 19 nt, Homo sapiens
gaauugccuuuuacagauu

SEQ ID NO: 1296610 - RNA, 19 nt, Homo sapiens
gcauaugccuaggaugucu

SEQ ID NO: 1296611 - RNA, 19 nt, Homo sapiens
ggugguggcaggaguguga

SEQ ID NO: 1296612 - RNA, 19 nt, Homo sapiens
ccuugaaguuugagaugaa

SEQ ID NO: 1296613 - RNA, 19 nt, Homo sapiens
caauaaaugugcaaaacug

SEQ ID NO: 1296614 - RNA, 19 nt, Homo sapiens
aaacaaggugucagagguu

SEQ ID NO: 1296615 - RNA, 19 nt, Homo sapiens
uggagaaucuggugcugau

SEQ ID NO: 1296616 - RNA, 19 nt, Homo sapiens
acaggggaaugguuaaaua

SEQ ID NO: 1296617 - RNA, 19 nt, Homo sapiens
ggcaggagugugacaugua

SEQ ID NO: 1296618 - RNA, 19 nt, Homo sapiens
aaaugugucaugaaccuaa

SEQ ID NO: 1296619 - RNA, 19 nt, Homo sapiens
ucagccaugugaaccaaga

SEQ ID NO: 1296620 - RNA, 19 nt, Homo sapiens
ucagagguuuugaaucuuu

SEQ ID NO: 1296621 - RNA, 19 nt, Homo sapiens
uggagaaaguguguagaug

SEQ ID NO: 1296622 - RNA, 19 nt, Homo sapiens
cccaugguauccuaauguu

SEQ ID NO: 1296623 - RNA, 19 nt, Homo sapiens
gagaaucuggugcugaucu

SEQ ID NO: 1296624 - RNA, 19 nt, Homo sapiens
gagaugaaacaagguguca

SEQ ID NO: 1296625 - RNA, 19 nt, Homo sapiens
agauugaaccuuuccucua

SEQ ID NO: 1296626 - RNA, 19 nt, Homo sapiens
gaugacugacugggaaauu

SEQ ID NO: 1296627 - RNA, 19 nt, Homo sapiens
gcauauguuuucacacaga

SEQ ID NO: 1296628 - RNA, 19 nt, Homo sapiens
gugcauauguuuucacaca

SEQ ID NO: 1296629 - RNA, 19 nt, Homo sapiens
guguguguguacuaccaua

SEQ ID NO: 1296630 - RNA, 19 nt, Homo sapiens
uaagcucuuugaacuagca

SEQ ID NO: 1296631 - RNA, 19 nt, Homo sapiens
gcguaagcucuuugaacua

SEQ ID NO: 1296632 - RNA, 19 nt, Homo sapiens
gcagcauacuugacaacac

SEQ ID NO: 1296633 - RNA, 19 nt, Homo sapiens
uguuagagauaagguaugu

SEQ ID NO: 1296634 - RNA, 19 nt, Homo sapiens
caugaaguccagagcauuc

SEQ ID NO: 1296635 - RNA, 19 nt, Homo sapiens
ugucagagguuuugaaucu

SEQ ID NO: 1296636 - RNA, 19 nt, Homo sapiens
uccagagcauuccuucuau

SEQ ID NO: 1296637 - RNA, 19 nt, Homo sapiens
caauacaggggaaugguua

SEQ ID NO: 1296638 - RNA, 19 nt, Homo sapiens
ugcguaagcucuuugaacu

SEQ ID NO: 1296639 - RNA, 19 nt, Homo sapiens
aaaugucucagccauguga

SEQ ID NO: 1296640 - RNA, 19 nt, Homo sapiens
aacaaggugucagagguuu

SEQ ID NO: 1296641 - RNA, 19 nt, Homo sapiens
cuuugcaucucuauuagga

SEQ ID NO: 1296642 - RNA, 19 nt, Homo sapiens
ggaauggagaaagugugua

SEQ ID NO: 1296643 - RNA, 19 nt, Homo sapiens
gcccaugguauccuaaugu

SEQ ID NO: 1296644 - RNA, 19 nt, Homo sapiens
caaaagugcaaaugcguaa

SEQ ID NO: 1296645 - RNA, 19 nt, Homo sapiens
gaaguccagagcauuccuu

SEQ ID NO: 1296646 - RNA, 19 nt, Homo sapiens
uguguguacuaccauagaa

SEQ ID NO: 1296647 - RNA, 19 nt, Homo sapiens
uacauuauggccagcuuaa

SEQ ID NO: 1296648 - RNA, 19 nt, Homo sapiens
augcuacuccuaagaauug

SEQ ID NO: 1296649 - RNA, 19 nt, Homo sapiens
gcucuuugaacuagcaaug

SEQ ID NO: 1296650 - RNA, 19 nt, Homo sapiens
gagagugccaccaauacag

SEQ ID NO: 1296651 - RNA, 19 nt, Homo sapiens
cugcauaugccuaggaugu

SEQ ID NO: 1296652 - RNA, 19 nt, Homo sapiens
cagggaauaccguggaugu

SEQ ID NO: 1296653 - RNA, 19 nt, Homo sapiens
uaacuugaugggcagaaau

SEQ ID NO: 1296654 - RNA, 19 nt, Homo sapiens
cccaggcccucucuugauc

SEQ ID NO: 1296655 - RNA, 19 nt, Homo sapiens
uuccucuacuugaugcuua

SEQ ID NO: 1296656 - RNA, 19 nt, Homo sapiens
gcaauagcauuaugucuaa

SEQ ID NO: 1296657 - RNA, 19 nt, Homo sapiens
gaaauugcauugguacuga

SEQ ID NO: 1296658 - RNA, 19 nt, Homo sapiens
caaauagacuugccugaug

SEQ ID NO: 1296659 - RNA, 19 nt, Homo sapiens
gcuacaaaccuucaauuua

SEQ ID NO: 1296660 - RNA, 19 nt, Homo sapiens
gaugacaaguggacaguuu

SEQ ID NO: 1296661 - RNA, 19 nt, Homo sapiens
gcaaggaagcgcauuguuu

SEQ ID NO: 1296662 - RNA, 19 nt, Homo sapiens
caucaucaguguauuacua

SEQ ID NO: 1296663 - RNA, 19 nt, Homo sapiens
gggccgagauccaguauga

SEQ ID NO: 1296664 - RNA, 19 nt, Homo sapiens
gaaguggugugauauaaac

SEQ ID NO: 1296665 - RNA, 19 nt, Homo sapiens
gagguuuacuucucaaaug

SEQ ID NO: 1296666 - RNA, 19 nt, Homo sapiens
ccacaucaucaguguauua

SEQ ID NO: 1296667 - RNA, 19 nt, Homo sapiens
aggcauagcuguacugugu

SEQ ID NO: 1296668 - RNA, 19 nt, Homo sapiens
uaaacaauaugguguagca

SEQ ID NO: 1296669 - RNA, 19 nt, Homo sapiens
gcauauugcaguccacuaa

SEQ ID NO: 1296670 - RNA, 19 nt, Homo sapiens
ugaaugugaucgauuacaa

SEQ ID NO: 1296671 - RNA, 19 nt, Homo sapiens
uuucugaaguggugugaua

SEQ ID NO: 1296672 - RNA, 19 nt, Homo sapiens
acacagaaacgcaaaguga

SEQ ID NO: 1296673 - RNA, 19 nt, Homo sapiens
ggaaaauggugccaaauag

SEQ ID NO: 1296674 - RNA, 19 nt, Homo sapiens
gcagugucauguuccagaa

SEQ ID NO: 1296675 - RNA, 19 nt, Homo sapiens
uuaaaugacucugugauuc

SEQ ID NO: 1296676 - RNA, 19 nt, Homo sapiens
gaacuacgacuugaaugug

SEQ ID NO: 1296677 - RNA, 19 nt, Homo sapiens
agaaauuacugaugaagca

SEQ ID NO: 1296678 - RNA, 19 nt, Homo sapiens
gauccaguaugaugacuag

SEQ ID NO: 1296679 - RNA, 19 nt, Homo sapiens
acuugaaugugaucgauua

SEQ ID NO: 1296680 - RNA, 19 nt, Homo sapiens
ucacaaagcauaguagaau

SEQ ID NO: 1296681 - RNA, 19 nt, Homo sapiens
ugaacuacgucaccaagga

SEQ ID NO: 1296682 - RNA, 19 nt, Homo sapiens
gcuaugccauugcccauca

SEQ ID NO: 1296683 - RNA, 19 nt, Homo sapiens
caaccagccuuggauagga

SEQ ID NO: 1296684 - RNA, 19 nt, Homo sapiens
guauugcucuuucugaagu

SEQ ID NO: 1296685 - RNA, 19 nt, Homo sapiens
gaaucauguuuaccuccua

SEQ ID NO: 1296686 - RNA, 19 nt, Homo sapiens
gcauagcuguacugugugu

SEQ ID NO: 1296687 - RNA, 19 nt, Homo sapiens
gcaucuaagucauguuuac

SEQ ID NO: 1296688 - RNA, 19 nt, Homo sapiens
caacaucacaauaaagcaa

SEQ ID NO: 1296689 - RNA, 19 nt, Homo sapiens
aagccaacaucacaauaaa

SEQ ID NO: 1296690 - RNA, 19 nt, Homo sapiens
ggaaggugugcguagguua

SEQ ID NO: 1296691 - RNA, 19 nt, Homo sapiens
gauauaaaccaucucuaag

SEQ ID NO: 1296692 - RNA, 19 nt, Homo sapiens
agaaugagguaugccugua

SEQ ID NO: 1296693 - RNA, 19 nt, Homo sapiens
aaagccaacaucacaauaa

SEQ ID NO: 1296694 - RNA, 19 nt, Homo sapiens
uuccagaaauuacugauga

SEQ ID NO: 1296695 - RNA, 19 nt, Homo sapiens
ucacuuugcuuucagaacu

SEQ ID NO: 1296696 - RNA, 19 nt, Homo sapiens
cugaaguggugugauauaa

SEQ ID NO: 1296697 - RNA, 19 nt, Homo sapiens
uaaagccaacaucacaaua

SEQ ID NO: 1296698 - RNA, 19 nt, Homo sapiens
gagaugacuccucuucaga

SEQ ID NO: 1296699 - RNA, 19 nt, Homo sapiens
ugguaguucuugagguuua

SEQ ID NO: 1296700 - RNA, 19 nt, Homo sapiens
ucaaaaugcugacacagaa

SEQ ID NO: 1296701 - RNA, 19 nt, Homo sapiens
guaaagccaacaucacaau

SEQ ID NO: 1296702 - RNA, 19 nt, Homo sapiens
gcugugcagugucauguuc

SEQ ID NO: 1296703 - RNA, 19 nt, Homo sapiens
gggaaucuccacaucauca

SEQ ID NO: 1296704 - RNA, 19 nt, Homo sapiens
agagguggcuugggaguug

SEQ ID NO: 1296705 - RNA, 19 nt, Homo sapiens
gugcaaacgcuaugccauu

SEQ ID NO: 1296706 - RNA, 19 nt, Homo sapiens
cauugguacugaacacgua

SEQ ID NO: 1296707 - RNA, 19 nt, Homo sapiens
uaagucauguuuacugcau

SEQ ID NO: 1296708 - RNA, 19 nt, Homo sapiens
gugcaucuaagucauguuu

SEQ ID NO: 1296709 - RNA, 19 nt, Homo sapiens
gaugaagcagcauguguug

SEQ ID NO: 1296710 - RNA, 19 nt, Homo sapiens
ccauggauacugaggcaua

SEQ ID NO: 1296711 - RNA, 19 nt, Homo sapiens
cacaaagcauaguagaaug

SEQ ID NO: 1296712 - RNA, 19 nt, Homo sapiens
ccugguaguucuugagguu

SEQ ID NO: 1296713 - RNA, 19 nt, Homo sapiens
gaaaaguccugguaguucu

SEQ ID NO: 1296714 - RNA, 19 nt, Homo sapiens
caucaguguauuacuagua

SEQ ID NO: 1296715 - RNA, 19 nt, Homo sapiens
ugacaaguggacaguuuaa

SEQ ID NO: 1296716 - RNA, 19 nt, Homo sapiens
ggugugauauaaaccaucu

SEQ ID NO: 1296717 - RNA, 19 nt, Homo sapiens
gaaugagguaugccuguau

SEQ ID NO: 1296718 - RNA, 19 nt, Homo sapiens
gaaugugaucgauuacaau

SEQ ID NO: 1296719 - RNA, 19 nt, Homo sapiens
aaugagguaugccuguauu

SEQ ID NO: 1296720 - RNA, 19 nt, Homo sapiens
caaggaagcgcauuguuuu

SEQ ID NO: 1296721 - RNA, 19 nt, Homo sapiens
ugaaguggugugauauaaa

SEQ ID NO: 1296722 - RNA, 19 nt, Homo sapiens
acaaagcauaguagaauga

SEQ ID NO: 1296723 - RNA, 19 nt, Homo sapiens
gaugccaggcugcuacaaa

SEQ ID NO: 1296724 - RNA, 19 nt, Homo sapiens
ugcaauagcauuaugucua

SEQ ID NO: 1296725 - RNA, 19 nt, Homo sapiens
gauauuguggguucaguuc

SEQ ID NO: 1296726 - RNA, 19 nt, Homo sapiens
uggccaugcuggugaacua

SEQ ID NO: 1296727 - RNA, 19 nt, Homo sapiens
ccaaauagacuugccugau

SEQ ID NO: 1296728 - RNA, 19 nt, Homo sapiens
gaaaauggugccaaauaga

SEQ ID NO: 1296729 - RNA, 19 nt, Homo sapiens
ugucauguuccagaaauua

SEQ ID NO: 1296730 - RNA, 19 nt, Homo sapiens
ccaccgcugugcaguguca

SEQ ID NO: 1296731 - RNA, 19 nt, Homo sapiens
cgacuugaaugugaucgau

SEQ ID NO: 1296732 - RNA, 19 nt, Homo sapiens
uaaaugacucugugauucu

SEQ ID NO: 1296733 - RNA, 19 nt, Homo sapiens
uuaggugccuggaugacaa

SEQ ID NO: 1296734 - RNA, 19 nt, Homo sapiens
cacuaaaugugcaauagca

SEQ ID NO: 1296735 - RNA, 19 nt, Homo sapiens
gaagcgcauuguuuuaguu

SEQ ID NO: 1296736 - RNA, 19 nt, Homo sapiens
ucagaacuacgacuugaau

SEQ ID NO: 1296737 - RNA, 19 nt, Homo sapiens
uuucagaacuacgacuuga

SEQ ID NO: 1296738 - RNA, 19 nt, Homo sapiens
ugcaaacgcuaugccauug

SEQ ID NO: 1296739 - RNA, 19 nt, Homo sapiens
gaaggugugcguagguuac

SEQ ID NO: 1296740 - RNA, 19 nt, Homo sapiens
gccgagauccaguaugaug

SEQ ID NO: 1296741 - RNA, 19 nt, Homo sapiens
gccauuauucccuaaacaa

SEQ ID NO: 1296742 - RNA, 19 nt, Homo sapiens
ccuuggauaggaaauauuu

SEQ ID NO: 1296743 - RNA, 19 nt, Homo sapiens
gguaaagccaacaucacaa

SEQ ID NO: 1296744 - RNA, 19 nt, Homo sapiens
agguuuacuucucaaauga

SEQ ID NO: 1296745 - RNA, 19 nt, Homo sapiens
acaaauaccgaguggacuu

SEQ ID NO: 1296746 - RNA, 19 nt, Homo sapiens
ugagugaagccacaaauac

SEQ ID NO: 1296747 - RNA, 19 nt, Homo sapiens
aaccaucucuaagaaaugu

SEQ ID NO: 1296748 - RNA, 19 nt, Homo sapiens
guauucacaaagcauagua

SEQ ID NO: 1296749 - RNA, 19 nt, Homo sapiens
aaacacaguauucacaaag

SEQ ID NO: 1296750 - RNA, 19 nt, Homo sapiens
auacugaggcauagcugua

SEQ ID NO: 1296751 - RNA, 19 nt, Homo sapiens
caaauaccgaguggacuug

SEQ ID NO: 1296752 - RNA, 19 nt, Homo sapiens
ugaugaagcagcauguguu

SEQ ID NO: 1296753 - RNA, 19 nt, Homo sapiens
aacuacgacuugaauguga

SEQ ID NO: 1296754 - RNA, 19 nt, Homo sapiens
acacaguauucacaaagca

SEQ ID NO: 1296755 - RNA, 19 nt, Homo sapiens
gagauauuguggguucagu

SEQ ID NO: 1296756 - RNA, 19 nt, Homo sapiens
gcccaucccugccaacuua

SEQ ID NO: 1296757 - RNA, 19 nt, Homo sapiens
gcaaguggcuuaugcaucu

SEQ ID NO: 1296758 - RNA, 19 nt, Homo sapiens
gcacaacgccugccacuga

SEQ ID NO: 1296759 - RNA, 19 nt, Homo sapiens
ggaacuaccugcaucuuca

SEQ ID NO: 1296760 - RNA, 19 nt, Homo sapiens
gcuccuggcauuucaauaa

SEQ ID NO: 1296761 - RNA, 19 nt, Homo sapiens
cuacaagccugaugucuac

SEQ ID NO: 1296762 - RNA, 19 nt, Homo sapiens
uuaagugccugcucaccua

SEQ ID NO: 1296763 - RNA, 19 nt, Homo sapiens
cuaggucacuugggaacua

SEQ ID NO: 1296764 - RNA, 19 nt, Homo sapiens
gggcuggauugcaguguau

SEQ ID NO: 1296765 - RNA, 19 nt, Homo sapiens
uacccaccaucccaaguua

SEQ ID NO: 1296766 - RNA, 19 nt, Homo sapiens
gucugugucuugaguguuu

SEQ ID NO: 1296767 - RNA, 19 nt, Homo sapiens
acaccuaccugggcaucua

SEQ ID NO: 1296768 - RNA, 19 nt, Homo sapiens
gugcagacaccuagaagga

SEQ ID NO: 1296769 - RNA, 19 nt, Homo sapiens
ugagagccguuuccagcuu

SEQ ID NO: 1296770 - RNA, 19 nt, Homo sapiens
ccacugcccagcaccauga

SEQ ID NO: 1296771 - RNA, 19 nt, Homo sapiens
aaggagagacuucuuggaa

SEQ ID NO: 1296772 - RNA, 19 nt, Homo sapiens
ccuacaagccugaugucua

SEQ ID NO: 1296773 - RNA, 19 nt, Homo sapiens
guacccaccaucccaaguu

SEQ ID NO: 1296774 - RNA, 19 nt, Homo sapiens
gccaggucaucuguguuua

SEQ ID NO: 1296775 - RNA, 19 nt, Homo sapiens
gcuugggucugugucuuga

SEQ ID NO: 1296776 - RNA, 19 nt, Homo sapiens
guuggauccuccugucuuc

SEQ ID NO: 1296777 - RNA, 19 nt, Homo sapiens
cuccuggcauuucaauaaa

SEQ ID NO: 1296778 - RNA, 19 nt, Homo sapiens
agccugaugucuacaccua

SEQ ID NO: 1296779 - RNA, 19 nt, Homo sapiens
caggucaucuguguuuaca

SEQ ID NO: 1296780 - RNA, 19 nt, Homo sapiens
cgccaggucaucuguguuu

SEQ ID NO: 1296781 - RNA, 19 nt, Homo sapiens
ccuucagccucccuuugua

SEQ ID NO: 1296782 - RNA, 19 nt, Homo sapiens
gggaacuaccugcaucuuc

SEQ ID NO: 1296783 - RNA, 19 nt, Homo sapiens
gccaacaacguggaacuga

SEQ ID NO: 1296784 - RNA, 19 nt, Homo sapiens
gugcagcgggcauuaagug

SEQ ID NO: 1296785 - RNA, 19 nt, Homo sapiens
ggagagagaaaacuuagug

SEQ ID NO: 1296786 - RNA, 19 nt, Homo sapiens
caggugaggagcuggaaga

SEQ ID NO: 1296787 - RNA, 19 nt, Homo sapiens
ggccugagcaugccauuuu

SEQ ID NO: 1296788 - RNA, 19 nt, Homo sapiens
ugggcuggauugcagugua

SEQ ID NO: 1296789 - RNA, 19 nt, Homo sapiens
ggcgccaggucaucugugu

SEQ ID NO: 1296790 - RNA, 19 nt, Homo sapiens
gagagaaaacuuagugcuu

SEQ ID NO: 1296791 - RNA, 19 nt, Homo sapiens
cuucagccucccuuuguaa

SEQ ID NO: 1296792 - RNA, 19 nt, Homo sapiens
cagccucccuuuguaaugc

SEQ ID NO: 1296793 - RNA, 19 nt, Homo sapiens
gguuggauccuccugucuu

SEQ ID NO: 1296794 - RNA, 19 nt, Homo sapiens
gcugaugucuggaaucuua

SEQ ID NO: 1296795 - RNA, 19 nt, Homo sapiens
caacaugcuucaaagaaua

SEQ ID NO: 1296796 - RNA, 19 nt, Homo sapiens
gaaaggcggugaagagaca

SEQ ID NO: 1296797 - RNA, 19 nt, Homo sapiens
gcaacaugcuucaaagaau

SEQ ID NO: 1296798 - RNA, 19 nt, Homo sapiens
ccaggaaaccauacuaaua

SEQ ID NO: 1296799 - RNA, 19 nt, Homo sapiens
caggaaaccauacuaauaa

SEQ ID NO: 1296800 - RNA, 19 nt, Homo sapiens
ggaagcagauccagccaau

SEQ ID NO: 1296801 - RNA, 19 nt, Homo sapiens
gaauacagagauacuauga

SEQ ID NO: 1296802 - RNA, 19 nt, Homo sapiens
gagggagaauacagagaua

SEQ ID NO: 1296803 - RNA, 19 nt, Homo sapiens
gccuagagcuguauuguca

SEQ ID NO: 1296804 - RNA, 19 nt, Homo sapiens
ccagaccucuccagaagaa

SEQ ID NO: 1296805 - RNA, 19 nt, Homo sapiens
ggaggaggccauaacaauu

SEQ ID NO: 1296806 - RNA, 19 nt, Homo sapiens
ggaaauaugcaacaugcuu

SEQ ID NO: 1296807 - RNA, 19 nt, Homo sapiens
gaggaggccauaacaauug

SEQ ID NO: 1296808 - RNA, 19 nt, Homo sapiens
gcaccugcuuggcuggaua

SEQ ID NO: 1296809 - RNA, 19 nt, Homo sapiens
ccucugagccugauugaaa

SEQ ID NO: 1296810 - RNA, 19 nt, Homo sapiens
gaacugcgggagagaagaa

SEQ ID NO: 1296811 - RNA, 19 nt, Homo sapiens
gagaauacagagauacuau

SEQ ID NO: 1296812 - RNA, 19 nt, Homo sapiens
cugcuuggcuggauacaaa

SEQ ID NO: 1296813 - RNA, 19 nt, Homo sapiens
ucaacaagcugaggaguag

SEQ ID NO: 1296814 - RNA, 19 nt, Homo sapiens
cacaucagcugcucacuca

SEQ ID NO: 1296815 - RNA, 19 nt, Homo sapiens
gaacuaugugugacaaaug

SEQ ID NO: 1296816 - RNA, 19 nt, Homo sapiens
gcaguaggacccauguuug

SEQ ID NO: 1296817 - RNA, 19 nt, Homo sapiens
gggaacgagucaccgugua

SEQ ID NO: 1296818 - RNA, 19 nt, Homo sapiens
gagcaaccgugacccucuu

SEQ ID NO: 1296819 - RNA, 19 nt, Homo sapiens
ccaaagugcugggauuaca

SEQ ID NO: 1296820 - RNA, 19 nt, Homo sapiens
cuagagcuguauugucaaa

SEQ ID NO: 1296821 - RNA, 19 nt, Homo sapiens
gauccagccaauauguuua

SEQ ID NO: 1296822 - RNA, 19 nt, Homo sapiens
gcagauccagccaauaugu

SEQ ID NO: 1296823 - RNA, 19 nt, Homo sapiens
gaugaacuaugugugacaa

SEQ ID NO: 1296824 - RNA, 19 nt, Homo sapiens
gccaucauuuauucacuuu

SEQ ID NO: 1296825 - RNA, 19 nt, Homo sapiens
gggaggaggccauaacaau

SEQ ID NO: 1296826 - RNA, 19 nt, Homo sapiens
cagccaauauguuuaacug

SEQ ID NO: 1296827 - RNA, 19 nt, Homo sapiens
aagcagauccagccaauau

SEQ ID NO: 1296828 - RNA, 19 nt, Homo sapiens
ggagaauacagagauacua

SEQ ID NO: 1296829 - RNA, 19 nt, Homo sapiens
ggagccuucuuacuguuga

SEQ ID NO: 1296830 - RNA, 19 nt, Homo sapiens
guaggacccauguuuguga

SEQ ID NO: 1296831 - RNA, 19 nt, Homo sapiens
ggacugagacagccauuuu

SEQ ID NO: 1296832 - RNA, 19 nt, Homo sapiens
ggaacgagucaccguguau

SEQ ID NO: 1296833 - RNA, 19 nt, Homo sapiens
ggacaggcuuggcggaacu

SEQ ID NO: 1296834 - RNA, 19 nt, Homo sapiens
auacagagauacuaugaac

SEQ ID NO: 1296835 - RNA, 19 nt, Homo sapiens
ugacaaauggugccguuga

SEQ ID NO: 1296836 - RNA, 19 nt, Homo sapiens
gaauaagaagagaacuuug

SEQ ID NO: 1296837 - RNA, 19 nt, Homo sapiens
ggaauuugagggagaauac

SEQ ID NO: 1296838 - RNA, 19 nt, Homo sapiens
gaucgugaccuccuacagu

SEQ ID NO: 1296839 - RNA, 19 nt, Homo sapiens
ugaacuaugugugacaaau

SEQ ID NO: 1296840 - RNA, 19 nt, Homo sapiens
uaacuggaccacagaggaa

SEQ ID NO: 1296841 - RNA, 19 nt, Homo sapiens
aggaguagaugggaauuug

SEQ ID NO: 1296842 - RNA, 19 nt, Homo sapiens
cagagauacuaugaacgua

SEQ ID NO: 1296843 - RNA, 19 nt, Homo sapiens
caaccgugacccucuuaaa

SEQ ID NO: 1296844 - RNA, 19 nt, Homo sapiens
caaagaauaagaagagaac

SEQ ID NO: 1296845 - RNA, 19 nt, Homo sapiens
ggaguagaugggaauuuga

SEQ ID NO: 1296846 - RNA, 19 nt, Homo sapiens
gcaggcugaugucuggaau

SEQ ID NO: 1296847 - RNA, 19 nt, Homo sapiens
cugcugccaucauuuauuc

SEQ ID NO: 1296848 - RNA, 19 nt, Homo sapiens
guacaacucgaugcuauca

SEQ ID NO: 1296849 - RNA, 19 nt, Homo sapiens
gaagcagauccagccaaua

SEQ ID NO: 1296850 - RNA, 19 nt, Homo sapiens
gacaaauggugccguugag

SEQ ID NO: 1296851 - RNA, 19 nt, Homo sapiens
gaacuuugggccaguagag

SEQ ID NO: 1296852 - RNA, 19 nt, Homo sapiens
ggccaccugucuucccauu

SEQ ID NO: 1296853 - RNA, 19 nt, Homo sapiens
caaccucgaaagacugaaa

SEQ ID NO: 1296854 - RNA, 19 nt, Homo sapiens
acaacucgaugcuaucaag

SEQ ID NO: 1296855 - RNA, 19 nt, Homo sapiens
auaaacauuucugcuguga

SEQ ID NO: 1296856 - RNA, 19 nt, Homo sapiens
uaggaugaacuauguguga

SEQ ID NO: 1296857 - RNA, 19 nt, Homo sapiens
ccucgggccuagagcugua

SEQ ID NO: 1296858 - RNA, 19 nt, Homo sapiens
ucccagaccucuccagaag

SEQ ID NO: 1296859 - RNA, 19 nt, Homo sapiens
cuggagaccauguguguaa

SEQ ID NO: 1296860 - RNA, 19 nt, Homo sapiens
acagggcacugaaugucaa

SEQ ID NO: 1296861 - RNA, 19 nt, Homo sapiens
gauuacagggcacugaaug

SEQ ID NO: 1296862 - RNA, 19 nt, Homo sapiens
cauugcugcugccaucauu

SEQ ID NO: 1296863 - RNA, 19 nt, Homo sapiens
ugguacaacucgaugcuau

SEQ ID NO: 1296864 - RNA, 19 nt, Homo sapiens
ucucuucccuaucccaaug

SEQ ID NO: 1296865 - RNA, 19 nt, Homo sapiens
caaaagggucuguccauga

SEQ ID NO: 1296866 - RNA, 19 nt, Homo sapiens
agagaacuuugggccagua

SEQ ID NO: 1296867 - RNA, 19 nt, Homo sapiens
gaacgagucaccguguauc

SEQ ID NO: 1296868 - RNA, 19 nt, Homo sapiens
ugucuucccauuccuguuu

SEQ ID NO: 1296869 - RNA, 19 nt, Homo sapiens
gagggaagcgugcccacau

SEQ ID NO: 1296870 - RNA, 19 nt, Homo sapiens
ucuggaaucuuagcaguag

SEQ ID NO: 1296871 - RNA, 19 nt, Homo sapiens
caaugaagcccggaucaag

SEQ ID NO: 1296872 - RNA, 19 nt, Homo sapiens
gaggaguagaugggaauuu

SEQ ID NO: 1296873 - RNA, 19 nt, Homo sapiens
aucgugaccuccuacagua

SEQ ID NO: 1296874 - RNA, 19 nt, Homo sapiens
gggaauuugagggagaaua

SEQ ID NO: 1296875 - RNA, 19 nt, Homo sapiens
uugcugcugccaucauuua

SEQ ID NO: 1296876 - RNA, 19 nt, Homo sapiens
acucgaugcuaucaaggaa

SEQ ID NO: 1296877 - RNA, 19 nt, Homo sapiens
uaugcaacaugcuucaaag

SEQ ID NO: 1296878 - RNA, 19 nt, Homo sapiens
ugucaacaacccuccauug

SEQ ID NO: 1296879 - RNA, 19 nt, Homo sapiens
guaacuacugugaggauuc

SEQ ID NO: 1296880 - RNA, 19 nt, Homo sapiens
gggauuacagggcacugaa

SEQ ID NO: 1296881 - RNA, 19 nt, Homo sapiens
ggucccgccuccaucuuca

SEQ ID NO: 1296882 - RNA, 19 nt, Homo sapiens
ccaaugccccauguaauua

SEQ ID NO: 1296883 - RNA, 19 nt, Homo sapiens
gcaaccgugacccucuuaa

SEQ ID NO: 1296884 - RNA, 19 nt, Homo sapiens
gcugcugccaucauuuauu

SEQ ID NO: 1296885 - RNA, 19 nt, Homo sapiens
gccaggaaaccauacuaau

SEQ ID NO: 1296886 - RNA, 19 nt, Homo sapiens
gaaugucaaagugaaggaa

SEQ ID NO: 1296887 - RNA, 19 nt, Homo sapiens
ugagggagaauacagagau

SEQ ID NO: 1296888 - RNA, 19 nt, Homo sapiens
ccaccugucuucccauucc

SEQ ID NO: 1296889 - RNA, 19 nt, Homo sapiens
gaucacuggagguggcauu

SEQ ID NO: 1296890 - RNA, 19 nt, Homo sapiens
uuucagugcuccuucucuu

SEQ ID NO: 1296891 - RNA, 19 nt, Homo sapiens
agauccagccaauauguuu

SEQ ID NO: 1296892 - RNA, 19 nt, Homo sapiens
gccaaugccccauguaauu

SEQ ID NO: 1296893 - RNA, 19 nt, Homo sapiens
uagccaggauggucucgau

SEQ ID NO: 1296894 - RNA, 19 nt, Homo sapiens
gaagagauguuugcuagua

SEQ ID NO: 1296895 - RNA, 19 nt, Homo sapiens
gcuaguagauucacagaaa

SEQ ID NO: 1296896 - RNA, 19 nt, Homo sapiens
gagaguauccauaugcuua

SEQ ID NO: 1296897 - RNA, 19 nt, Homo sapiens
caucagcaguugaaaggua

SEQ ID NO: 1296898 - RNA, 19 nt, Homo sapiens
guacauaacaucagcaguu

SEQ ID NO: 1296899 - RNA, 19 nt, Homo sapiens
ugagucagcuccacacuug

SEQ ID NO: 1296900 - RNA, 19 nt, Homo sapiens
gcucaugaaugcacagcua

SEQ ID NO: 1296901 - RNA, 19 nt, Homo sapiens
gauauaaucagcucaugaa

SEQ ID NO: 1296902 - RNA, 19 nt, Homo sapiens
gguaagagaguauccauau

SEQ ID NO: 1296903 - RNA, 19 nt, Homo sapiens
gacaaucgauccaaucagu

SEQ ID NO: 1296904 - RNA, 19 nt, Homo sapiens
agagggaaaucaguaauaa

SEQ ID NO: 1296905 - RNA, 19 nt, Homo sapiens
ggaaaucaguaauaaagcu

SEQ ID NO: 1296906 - RNA, 19 nt, Homo sapiens
ggccugagcuggauugaca

SEQ ID NO: 1296907 - RNA, 19 nt, Homo sapiens
uauuugaccucuaggaauu

SEQ ID NO: 1296908 - RNA, 19 nt, Homo sapiens
gauguuugcuaguagauuc

SEQ ID NO: 1296909 - RNA, 19 nt, Homo sapiens
ccagcaauauggacauuau

SEQ ID NO: 1296910 - RNA, 19 nt, Homo sapiens
gguacuuugugauuccuua

SEQ ID NO: 1296911 - RNA, 19 nt, Homo sapiens
guaagagaguauccauaug

SEQ ID NO: 1296912 - RNA, 19 nt, Homo sapiens
gaaacuguggauuauauug

SEQ ID NO: 1296913 - RNA, 19 nt, Homo sapiens
cugaaacuguggauuauau

SEQ ID NO: 1296914 - RNA, 19 nt, Homo sapiens
ccgaagcuguuccaaaguu

SEQ ID NO: 1296915 - RNA, 19 nt, Homo sapiens
ugacuaugguacuuuguga

SEQ ID NO: 1296916 - RNA, 19 nt, Homo sapiens
uaccugaaacuguggauua

SEQ ID NO: 1296917 - RNA, 19 nt, Homo sapiens
cgaagcuguuccaaaguuu

SEQ ID NO: 1296918 - RNA, 19 nt, Homo sapiens
auaaucagcucaugaaugc

SEQ ID NO: 1296919 - RNA, 19 nt, Homo sapiens
uagaaauguuggcagcuuu

SEQ ID NO: 1296920 - RNA, 19 nt, Homo sapiens
acaaggaguaucaggaaua

SEQ ID NO: 1296921 - RNA, 19 nt, Homo sapiens
gcuuagaugugcucguuuc

SEQ ID NO: 1296922 - RNA, 19 nt, Homo sapiens
caacuacccgcaacacaga

SEQ ID NO: 1296923 - RNA, 19 nt, Homo sapiens
gacaagaaccuuacuaucc

SEQ ID NO: 1296924 - RNA, 19 nt, Homo sapiens
gaaugcacagcuaugcuuu

SEQ ID NO: 1296925 - RNA, 19 nt, Homo sapiens
uagagggaaaucaguaaua

SEQ ID NO: 1296926 - RNA, 19 nt, Homo sapiens
cauaacaucagcaguugaa

SEQ ID NO: 1296927 - RNA, 19 nt, Homo sapiens
caauauggacauuaugguu

SEQ ID NO: 1296928 - RNA, 19 nt, Homo sapiens
ugacaaggaguaucaggaa

SEQ ID NO: 1296929 - RNA, 19 nt, Homo sapiens
acagcugccucaaaccuuu

SEQ ID NO: 1296930 - RNA, 19 nt, Homo sapiens
caagacaacagacaguuca

SEQ ID NO: 1296931 - RNA, 19 nt, Homo sapiens
gcaagacaacagacaguuc

SEQ ID NO: 1296932 - RNA, 19 nt, Homo sapiens
gacaaggaguaucaggaau

SEQ ID NO: 1296933 - RNA, 19 nt, Homo sapiens
gaucuuacuugcgaaaugc

SEQ ID NO: 1296934 - RNA, 19 nt, Homo sapiens
gagggaaaucaguaauaaa

SEQ ID NO: 1296935 - RNA, 19 nt, Homo sapiens
gcuccacacuugagucucu

SEQ ID NO: 1296936 - RNA, 19 nt, Homo sapiens
ucuagagguugauauaauc

SEQ ID NO: 1296937 - RNA, 19 nt, Homo sapiens
gaaucuucuuuguuucaug

SEQ ID NO: 1296938 - RNA, 19 nt, Homo sapiens
caaagaaacagaggcaauc

SEQ ID NO: 1296939 - RNA, 19 nt, Homo sapiens
uacauaacaucagcaguug

SEQ ID NO: 1296940 - RNA, 19 nt, Homo sapiens
ggaguuccacgguguagug

SEQ ID NO: 1296941 - RNA, 19 nt, Homo sapiens
guauccauaugcuuagaug

SEQ ID NO: 1296942 - RNA, 19 nt, Homo sapiens
acaaccagcggccuccuua

SEQ ID NO: 1296943 - RNA, 19 nt, Homo sapiens
ccaaagaaacagaggcaau

SEQ ID NO: 1296944 - RNA, 19 nt, Homo sapiens
ugccgaagcuguuccaaag

SEQ ID NO: 1296945 - RNA, 19 nt, Homo sapiens
cauagcccuuggcggauuu

SEQ ID NO: 1296946 - RNA, 19 nt, Homo sapiens
uauaaucagcucaugaaug

SEQ ID NO: 1296947 - RNA, 19 nt, Homo sapiens
gguuacuacugauagaaau

SEQ ID NO: 1296948 - RNA, 19 nt, Homo sapiens
guugaggaauggaauagca

SEQ ID NO: 1296949 - RNA, 19 nt, Homo sapiens
caguacagcugccucaaac

SEQ ID NO: 1296950 - RNA, 19 nt, Homo sapiens
cagacaagaaccuuacuau

SEQ ID NO: 1296951 - RNA, 19 nt, Homo sapiens
uaagagaguauccauaugc

SEQ ID NO: 1296952 - RNA, 19 nt, Homo sapiens
accuaaacauuaagcagua

SEQ ID NO: 1296953 - RNA, 19 nt, Homo sapiens
ggugggaaccaaagaaaca

SEQ ID NO: 1296954 - RNA, 19 nt, Homo sapiens
gauuauauugcuugacuuc

SEQ ID NO: 1296955 - RNA, 19 nt, Homo sapiens
ggauuauauugcuugacuu

SEQ ID NO: 1296956 - RNA, 19 nt, Homo sapiens
caacacagacaagaaccuu

SEQ ID NO: 1296957 - RNA, 19 nt, Homo sapiens
agagauguuugcuaguaga

SEQ ID NO: 1296958 - RNA, 19 nt, Homo sapiens
gaguauccauaugcuuaga

SEQ ID NO: 1296959 - RNA, 19 nt, Homo sapiens
ggucauaguuuuacaucug

SEQ ID NO: 1296960 - RNA, 19 nt, Homo sapiens
uaacaucagcaguugaaag

SEQ ID NO: 1296961 - RNA, 19 nt, Homo sapiens
ugagucuccuccaauuguu

SEQ ID NO: 1296962 - RNA, 19 nt, Homo sapiens
ugaccucuaggaauucuuu

SEQ ID NO: 1296963 - RNA, 19 nt, Homo sapiens
uggauuauauugcuugacu

SEQ ID NO: 1296964 - RNA, 19 nt, Homo sapiens
guuugggugucuucuguug

SEQ ID NO: 1296965 - RNA, 19 nt, Homo sapiens
cucuaggaauucuuuguuu

SEQ ID NO: 1296966 - RNA, 19 nt, Homo sapiens
uauauugcuugacuucuac

SEQ ID NO: 1296967 - RNA, 19 nt, Homo sapiens
gcaauauggacauuauggu

SEQ ID NO: 1296968 - RNA, 19 nt, Homo sapiens
cuccugggcuucucagugu

SEQ ID NO: 1296969 - RNA, 19 nt, Homo sapiens
ugaaugcacagcuaugcuu

SEQ ID NO: 1296970 - RNA, 19 nt, Homo sapiens
guacuuugugauuccuuaa

SEQ ID NO: 1296971 - RNA, 19 nt, Homo sapiens
uuuguaagguaagagagua

SEQ ID NO: 1296972 - RNA, 19 nt, Homo sapiens
acauagcccuuggcggauu

SEQ ID NO: 1296973 - RNA, 19 nt, Homo sapiens
auagaaauguuggcagcuu

SEQ ID NO: 1296974 - RNA, 19 nt, Homo sapiens
ugacacugccgaagcuguu

SEQ ID NO: 1296975 - RNA, 19 nt, Homo sapiens
gaugugcucguuucuaaaa

SEQ ID NO: 1296976 - RNA, 19 nt, Homo sapiens
agaucuuacuugcgaaaug

SEQ ID NO: 1296977 - RNA, 19 nt, Homo sapiens
gagaaaaguuugggugucu

SEQ ID NO: 1296978 - RNA, 19 nt, Homo sapiens
gaaauguuggcagcuuuua

SEQ ID NO: 1296979 - RNA, 19 nt, Homo sapiens
gugauagauuguacauaac

SEQ ID NO: 1296980 - RNA, 19 nt, Homo sapiens
gcucguuucuaaaauucua

SEQ ID NO: 1296981 - RNA, 19 nt, Homo sapiens
ccucuaggaauucuuuguu

SEQ ID NO: 1296982 - RNA, 19 nt, Homo sapiens
aagagauguuugcuaguag

SEQ ID NO: 1296983 - RNA, 19 nt, Homo sapiens
aaguuugggugucuucugu

SEQ ID NO: 1296984 - RNA, 19 nt, Homo sapiens
gcauuuacucuguuaccau

SEQ ID NO: 1296985 - RNA, 19 nt, Homo sapiens
agacaagaaccuuacuauc

SEQ ID NO: 1296986 - RNA, 19 nt, Homo sapiens
gugacaaucgauccaauca

SEQ ID NO: 1296987 - RNA, 19 nt, Homo sapiens
agggaaaucaguaauaaag

SEQ ID NO: 1296988 - RNA, 19 nt, Homo sapiens
aauagugcuuuaaguuugg

SEQ ID NO: 1296989 - RNA, 19 nt, Homo sapiens
cagaaaaugacaaggagua

SEQ ID NO: 1296990 - RNA, 19 nt, Homo sapiens
uccuuacgguuacuacuga

SEQ ID NO: 1296991 - RNA, 19 nt, Homo sapiens
cuaaaauucuagagguuga

SEQ ID NO: 1296992 - RNA, 19 nt, Homo sapiens
augcuuagaugugcucguu

SEQ ID NO: 1296993 - RNA, 19 nt, Homo sapiens
gugcuuuaaguuugguaua

SEQ ID NO: 1296994 - RNA, 19 nt, Homo sapiens
gaagaaaucugacuuggaa

SEQ ID NO: 1296995 - RNA, 19 nt, Homo sapiens
acucaaaucugcagaauua

SEQ ID NO: 1296996 - RNA, 19 nt, Homo sapiens
gaaauagggugagaaguuu

SEQ ID NO: 1296997 - RNA, 19 nt, Homo sapiens
gaagaauuguugaggauuu

SEQ ID NO: 1296998 - RNA, 19 nt, Homo sapiens
gaagauguauagcauuuga

SEQ ID NO: 1296999 - RNA, 19 nt, Homo sapiens
gaaaugcguuuaaucuguu

SEQ ID NO: 1297000 - RNA, 19 nt, Homo sapiens
gaagugugaugacugauga

SEQ ID NO: 1297001 - RNA, 19 nt, Homo sapiens
caaggaggcuucaucagaa

SEQ ID NO: 1297002 - RNA, 19 nt, Homo sapiens
gagaagcucuuugaaguug

SEQ ID NO: 1297003 - RNA, 19 nt, Homo sapiens
gcuaaacgguggaauguau

SEQ ID NO: 1297004 - RNA, 19 nt, Homo sapiens
gggacuggcucauaucuuu

SEQ ID NO: 1297005 - RNA, 19 nt, Homo sapiens
cagaagauguauagcauuu

SEQ ID NO: 1297006 - RNA, 19 nt, Homo sapiens
uaauugagaucaccuagaa

SEQ ID NO: 1297007 - RNA, 19 nt, Homo sapiens
guaauuugguuucgaagaa

SEQ ID NO: 1297008 - RNA, 19 nt, Homo sapiens
ugacuggaauucuuucuuu

SEQ ID NO: 1297009 - RNA, 19 nt, Homo sapiens
gauuauaccugaaauggau

SEQ ID NO: 1297010 - RNA, 19 nt, Homo sapiens
cauaaggacucauaucuca

SEQ ID NO: 1297011 - RNA, 19 nt, Homo sapiens
ugggaaugcuuuaguguua

SEQ ID NO: 1297012 - RNA, 19 nt, Homo sapiens
gaggguuucuguucaguuu

SEQ ID NO: 1297013 - RNA, 19 nt, Homo sapiens
gcaguaggauuugguuuga

SEQ ID NO: 1297014 - RNA, 19 nt, Homo sapiens
ugacaauccugaacucauu

SEQ ID NO: 1297015 - RNA, 19 nt, Homo sapiens
ggacucauaucucauuaca

SEQ ID NO: 1297016 - RNA, 19 nt, Homo sapiens
gaugucagaucuugaaauc

SEQ ID NO: 1297017 - RNA, 19 nt, Homo sapiens
aaaggagacuuguaaauag

SEQ ID NO: 1297018 - RNA, 19 nt, Homo sapiens
ccagaauugucuuguuuaa

SEQ ID NO: 1297019 - RNA, 19 nt, Homo sapiens
gcagcacgcuccucagaga

SEQ ID NO: 1297020 - RNA, 19 nt, Homo sapiens
gaaaucugacuuggaaaua

SEQ ID NO: 1297021 - RNA, 19 nt, Homo sapiens
gaagguacauccuguccau

SEQ ID NO: 1297022 - RNA, 19 nt, Homo sapiens
gaagaagaaaucugacuug

SEQ ID NO: 1297023 - RNA, 19 nt, Homo sapiens
gagcuuaacuagaauucau

SEQ ID NO: 1297024 - RNA, 19 nt, Homo sapiens
agagaaacauguuaguuga

SEQ ID NO: 1297025 - RNA, 19 nt, Homo sapiens
gcucauguauuucuuuauc

SEQ ID NO: 1297026 - RNA, 19 nt, Homo sapiens
guaguaguguugcuuucua

SEQ ID NO: 1297027 - RNA, 19 nt, Homo sapiens
uguuagcaguugacaauua

SEQ ID NO: 1297028 - RNA, 19 nt, Homo sapiens
uaacccagcuucaguagca

SEQ ID NO: 1297029 - RNA, 19 nt, Homo sapiens
gcacguaaguuggaaugau

SEQ ID NO: 1297030 - RNA, 19 nt, Homo sapiens
uaauaaagcagaaggaaga

SEQ ID NO: 1297031 - RNA, 19 nt, Homo sapiens
guaaaguggugucuuaugc

SEQ ID NO: 1297032 - RNA, 19 nt, Homo sapiens
ugaaaucuguauucucgaa

SEQ ID NO: 1297033 - RNA, 19 nt, Homo sapiens
gguucucuguguaauaaua

SEQ ID NO: 1297034 - RNA, 19 nt, Homo sapiens
agaaaugcguuuaaucugu

SEQ ID NO: 1297035 - RNA, 19 nt, Homo sapiens
uaacagaaccaacaagcaa

SEQ ID NO: 1297036 - RNA, 19 nt, Homo sapiens
guucagagacuuaacagaa

SEQ ID NO: 1297037 - RNA, 19 nt, Homo sapiens
aaacugaucaauccuguaa

SEQ ID NO: 1297038 - RNA, 19 nt, Homo sapiens
cugaggauauugaccauaa

SEQ ID NO: 1297039 - RNA, 19 nt, Homo sapiens
gaagaagaagcacagaaga

SEQ ID NO: 1297040 - RNA, 19 nt, Homo sapiens
gaccauuucuguuccuaga

SEQ ID NO: 1297041 - RNA, 19 nt, Homo sapiens
agaauggaaugguaacuau

SEQ ID NO: 1297042 - RNA, 19 nt, Homo sapiens
agaaauagggugagaaguu

SEQ ID NO: 1297043 - RNA, 19 nt, Homo sapiens
guggaugccuugccuguga

SEQ ID NO: 1297044 - RNA, 19 nt, Homo sapiens
ucacaagccugauucaaac

SEQ ID NO: 1297045 - RNA, 19 nt, Homo sapiens
gaugacugaugaucuugaa

SEQ ID NO: 1297046 - RNA, 19 nt, Homo sapiens
uuaaaugucuugcugaucu

SEQ ID NO: 1297047 - RNA, 19 nt, Homo sapiens
gaguugcacuacuugguuu

SEQ ID NO: 1297048 - RNA, 19 nt, Homo sapiens
gaagaagcacagaagaaga

SEQ ID NO: 1297049 - RNA, 19 nt, Homo sapiens
aaaguggugucuuaugcua

SEQ ID NO: 1297050 - RNA, 19 nt, Homo sapiens
uagcgaugcuguuuguaaa

SEQ ID NO: 1297051 - RNA, 19 nt, Homo sapiens
gugaugaugcuguugauaa

SEQ ID NO: 1297052 - RNA, 19 nt, Homo sapiens
gaagaggacacuggaauca

SEQ ID NO: 1297053 - RNA, 19 nt, Homo sapiens
acucauaucucauuacaag

SEQ ID NO: 1297054 - RNA, 19 nt, Homo sapiens
gucgaugacuacuauauug

SEQ ID NO: 1297055 - RNA, 19 nt, Homo sapiens
gcaccaagaccucgugugu

SEQ ID NO: 1297056 - RNA, 19 nt, Homo sapiens
uggagcagcuugaacuuga

SEQ ID NO: 1297057 - RNA, 19 nt, Homo sapiens
ggaagaagaagcacagaag

SEQ ID NO: 1297058 - RNA, 19 nt, Homo sapiens
ccaucaagaucuucacaga

SEQ ID NO: 1297059 - RNA, 19 nt, Homo sapiens
gaagcaauucugccacuug

SEQ ID NO: 1297060 - RNA, 19 nt, Homo sapiens
ucaaggaggcuucaucaga

SEQ ID NO: 1297061 - RNA, 19 nt, Homo sapiens
cagacuacauagaagauga

SEQ ID NO: 1297062 - RNA, 19 nt, Homo sapiens
ugaugucgaugacuacuau

SEQ ID NO: 1297063 - RNA, 19 nt, Homo sapiens
gagaacaggccaagaaguc

SEQ ID NO: 1297064 - RNA, 19 nt, Homo sapiens
cuacauagaagaugacaau

SEQ ID NO: 1297065 - RNA, 19 nt, Homo sapiens
aagcauuucuuuccuaauc

SEQ ID NO: 1297066 - RNA, 19 nt, Homo sapiens
gaucuugaaaucuguauuc

SEQ ID NO: 1297067 - RNA, 19 nt, Homo sapiens
uagagaaacauguuaguug

SEQ ID NO: 1297068 - RNA, 19 nt, Homo sapiens
caggauuucucuaggcauu

SEQ ID NO: 1297069 - RNA, 19 nt, Homo sapiens
uaaaugucuugcugaucua

SEQ ID NO: 1297070 - RNA, 19 nt, Homo sapiens
aaacgagaccaaguaauaa

SEQ ID NO: 1297071 - RNA, 19 nt, Homo sapiens
acaauuaggcccauauuca

SEQ ID NO: 1297072 - RNA, 19 nt, Homo sapiens
uaaggacucauaucucauu

SEQ ID NO: 1297073 - RNA, 19 nt, Homo sapiens
ucauuagaauccaagcuuu

SEQ ID NO: 1297074 - RNA, 19 nt, Homo sapiens
aagcagaaauugcaagaag

SEQ ID NO: 1297075 - RNA, 19 nt, Homo sapiens
cugguaggcuccuuuagaa

SEQ ID NO: 1297076 - RNA, 19 nt, Homo sapiens
gacuagcgaugcuguuugu

SEQ ID NO: 1297077 - RNA, 19 nt, Homo sapiens
caauuaggcccauauucaa

SEQ ID NO: 1297078 - RNA, 19 nt, Homo sapiens
gcaguuaacaccagagaag

SEQ ID NO: 1297079 - RNA, 19 nt, Homo sapiens
cguuuaaucuguucacuca

SEQ ID NO: 1297080 - RNA, 19 nt, Homo sapiens
ugacuuguuugaguguaua

SEQ ID NO: 1297081 - RNA, 19 nt, Homo sapiens
gcuauaacagucgacuuua

SEQ ID NO: 1297082 - RNA, 19 nt, Homo sapiens
gcaauucugccacuugauc

SEQ ID NO: 1297083 - RNA, 19 nt, Homo sapiens
gacagcagccgcauucuca

SEQ ID NO: 1297084 - RNA, 19 nt, Homo sapiens
gcauaucauuagaauccaa

SEQ ID NO: 1297085 - RNA, 19 nt, Homo sapiens
agaggacacuggaaucaau

SEQ ID NO: 1297086 - RNA, 19 nt, Homo sapiens
uaaagcagaaggaagaaga

SEQ ID NO: 1297087 - RNA, 19 nt, Homo sapiens
uugaacaucugagcaguuu

SEQ ID NO: 1297088 - RNA, 19 nt, Homo sapiens
agcguaaaguggugucuua

SEQ ID NO: 1297089 - RNA, 19 nt, Homo sapiens
aagcaauucugccacuuga

SEQ ID NO: 1297090 - RNA, 19 nt, Homo sapiens
gauugcacguugacuggaa

SEQ ID NO: 1297091 - RNA, 19 nt, Homo sapiens
aaggaagugugaugacuga

SEQ ID NO: 1297092 - RNA, 19 nt, Homo sapiens
guuagcaguugacaauuag

SEQ ID NO: 1297093 - RNA, 19 nt, Homo sapiens
ugauaaggaugaugucgau

SEQ ID NO: 1297094 - RNA, 19 nt, Homo sapiens
ggucccagcugugugauua

SEQ ID NO: 1297095 - RNA, 19 nt, Homo sapiens
aaagacaccuccuuaccua

SEQ ID NO: 1297096 - RNA, 19 nt, Homo sapiens
gcuauagucuaacuucuug

SEQ ID NO: 1297097 - RNA, 19 nt, Homo sapiens
gcaggugcgucuucuaguu

SEQ ID NO: 1297098 - RNA, 19 nt, Homo sapiens
uccaaucucuucuucuuua

SEQ ID NO: 1297099 - RNA, 19 nt, Homo sapiens
uaaugucucugaacucaaa

SEQ ID NO: 1297100 - RNA, 19 nt, Homo sapiens
ggacuacuccuauuucuuc

SEQ ID NO: 1297101 - RNA, 19 nt, Homo sapiens
gagagaaacugagcaaucu

SEQ ID NO: 1297102 - RNA, 19 nt, Homo sapiens
ucagacugcuuccuaaauu

SEQ ID NO: 1297103 - RNA, 19 nt, Homo sapiens
ggcaggcacugucagauuu

SEQ ID NO: 1297104 - RNA, 19 nt, Homo sapiens
gcacuucaccuuucuggaa

SEQ ID NO: 1297105 - RNA, 19 nt, Homo sapiens
gcugaguaauuguuucuaa

SEQ ID NO: 1297106 - RNA, 19 nt, Homo sapiens
aaagugaggugcuccaaga

SEQ ID NO: 1297107 - RNA, 19 nt, Homo sapiens
ccaagacgcugugaacuuc

SEQ ID NO: 1297108 - RNA, 19 nt, Homo sapiens
acaaagaguugaagaugau

SEQ ID NO: 1297109 - RNA, 19 nt, Homo sapiens
gcagguaauuaaacaagau

SEQ ID NO: 1297110 - RNA, 19 nt, Homo sapiens
gugcuuagccuuuauuuca

SEQ ID NO: 1297111 - RNA, 19 nt, Homo sapiens
caagagaacagaaggaugu

SEQ ID NO: 1297112 - RNA, 19 nt, Homo sapiens
ggagucaauuuccaagaug

SEQ ID NO: 1297113 - RNA, 19 nt, Homo sapiens
gcugugaacuucugcaaag

SEQ ID NO: 1297114 - RNA, 19 nt, Homo sapiens
gcaccucacuggccacauc

SEQ ID NO: 1297115 - RNA, 19 nt, Homo sapiens
uacaaagaguugaagauga

SEQ ID NO: 1297116 - RNA, 19 nt, Homo sapiens
gcuguauucuccauaguau

SEQ ID NO: 1297117 - RNA, 19 nt, Homo sapiens
ucaacgugcuuagccuuua

SEQ ID NO: 1297118 - RNA, 19 nt, Homo sapiens
gcagagcagcccagaaaga

SEQ ID NO: 1297119 - RNA, 19 nt, Homo sapiens
ggacuggacagaagagaga

SEQ ID NO: 1297120 - RNA, 19 nt, Homo sapiens
ugagugagguuucguacau

SEQ ID NO: 1297121 - RNA, 19 nt, Homo sapiens
caacgugcuuagccuuuau

SEQ ID NO: 1297122 - RNA, 19 nt, Homo sapiens
gaaauggcaggcacuguca

SEQ ID NO: 1297123 - RNA, 19 nt, Homo sapiens
ccagcugugugauuaagaa

SEQ ID NO: 1297124 - RNA, 19 nt, Homo sapiens
ggaggaccacgucaagaaa

SEQ ID NO: 1297125 - RNA, 19 nt, Homo sapiens
gaagacaguaggcucaugu

SEQ ID NO: 1297126 - RNA, 19 nt, Homo sapiens
gcagggcagcagguaauua

SEQ ID NO: 1297127 - RNA, 19 nt, Homo sapiens
gaaugagugagguuucgua

SEQ ID NO: 1297128 - RNA, 19 nt, Homo sapiens
cauuaguccugaugaguga

SEQ ID NO: 1297129 - RNA, 19 nt, Homo sapiens
gagcagggcagcagguaau

SEQ ID NO: 1297130 - RNA, 19 nt, Homo sapiens
ggaagacaguaggcucaug

SEQ ID NO: 1297131 - RNA, 19 nt, Homo sapiens
ugucagauuuccacucuuc

SEQ ID NO: 1297132 - RNA, 19 nt, Homo sapiens
guacgucagugcacuuguc

SEQ ID NO: 1297133 - RNA, 19 nt, Homo sapiens
cugcaaagacaccuccuua

SEQ ID NO: 1297134 - RNA, 19 nt, Homo sapiens
cuuccuaaauugagagaaa

SEQ ID NO: 1297135 - RNA, 19 nt, Homo sapiens
cagacugcuuccuaaauug

SEQ ID NO: 1297136 - RNA, 19 nt, Homo sapiens
ucaucagacugcuuccuaa

SEQ ID NO: 1297137 - RNA, 19 nt, Homo sapiens
ggcagcagguaauuaaaca

SEQ ID NO: 1297138 - RNA, 19 nt, Homo sapiens
cagggcagcagguaauuaa

SEQ ID NO: 1297139 - RNA, 19 nt, Homo sapiens
gagagaacauuuuagaauc

SEQ ID NO: 1297140 - RNA, 19 nt, Homo sapiens
ccacuucauuagcuguauu

SEQ ID NO: 1297141 - RNA, 19 nt, Homo sapiens
ggaaauccaggaagacagu

SEQ ID NO: 1297142 - RNA, 19 nt, Homo sapiens
ucuaaugucucugaacuca

SEQ ID NO: 1297143 - RNA, 19 nt, Homo sapiens
uagucuaacuucuuguuug

SEQ ID NO: 1297144 - RNA, 19 nt, Homo sapiens
cuacuccuauuucuucuuc

SEQ ID NO: 1297145 - RNA, 19 nt, Homo sapiens
gcuuagccuuuauuucaga

SEQ ID NO: 1297146 - RNA, 19 nt, Homo sapiens
guacaugcagcuauuucaa

SEQ ID NO: 1297147 - RNA, 19 nt, Homo sapiens
agaguauucacuagacuua

SEQ ID NO: 1297148 - RNA, 19 nt, Homo sapiens
caccaaagcacuucaccuu

SEQ ID NO: 1297149 - RNA, 19 nt, Homo sapiens
ggagagaacauuuuagaau

SEQ ID NO: 1297150 - RNA, 19 nt, Homo sapiens
gcugugugauuaagaaguc

SEQ ID NO: 1297151 - RNA, 19 nt, Homo sapiens
cuucuuguuugcugaguaa

SEQ ID NO: 1297152 - RNA, 19 nt, Homo sapiens
gcagaaggccuuguuugag

SEQ ID NO: 1297153 - RNA, 19 nt, Homo sapiens
cuacaaagaguugaagaug

SEQ ID NO: 1297154 - RNA, 19 nt, Homo sapiens
cggagucaauuuccaagau

SEQ ID NO: 1297155 - RNA, 19 nt, Homo sapiens
ccaaucucuucuucuuuau

SEQ ID NO: 1297156 - RNA, 19 nt, Homo sapiens
caggauggaugaaaauuau

SEQ ID NO: 1297157 - RNA, 19 nt, Homo sapiens
ccacugcuauagucuaacu

SEQ ID NO: 1297158 - RNA, 19 nt, Homo sapiens
ugagagaaacugagcaauc

SEQ ID NO: 1297159 - RNA, 19 nt, Homo sapiens
gagaaugagugagguuucg

SEQ ID NO: 1297160 - RNA, 19 nt, Homo sapiens
uggcgguaauugagaauga

SEQ ID NO: 1297161 - RNA, 19 nt, Homo sapiens
ucagugcacuuguccuuac

SEQ ID NO: 1297162 - RNA, 19 nt, Homo sapiens
gaguugaagaugauaccua

SEQ ID NO: 1297163 - RNA, 19 nt, Homo sapiens
uuucguacaugcagcuauu

SEQ ID NO: 1297164 - RNA, 19 nt, Homo sapiens
gguaauugagaaugaguga

SEQ ID NO: 1297165 - RNA, 19 nt, Homo sapiens
gugcauacuguucugcuuu

SEQ ID NO: 1297166 - RNA, 19 nt, Homo sapiens
gcaaagacaccuccuuacc

SEQ ID NO: 1297167 - RNA, 19 nt, Homo sapiens
gugaacuucugcaaagaca

SEQ ID NO: 1297168 - RNA, 19 nt, Homo sapiens
aaagacaucaacgugcuua

SEQ ID NO: 1297169 - RNA, 19 nt, Homo sapiens
ggaggaggaccacgucaag

SEQ ID NO: 1297170 - RNA, 19 nt, Homo sapiens
caacaccagcuacaaagag

SEQ ID NO: 1297171 - RNA, 19 nt, Homo sapiens
uuucaaggguuguaagagu

SEQ ID NO: 1297172 - RNA, 19 nt, Homo sapiens
caggugcgucuucuaguuu

SEQ ID NO: 1297173 - RNA, 19 nt, Homo sapiens
gacagaagagagacuuuua

SEQ ID NO: 1297174 - RNA, 19 nt, Homo sapiens
uggguuaucuucugaucau

SEQ ID NO: 1297175 - RNA, 19 nt, Homo sapiens
gagaguauucacuagacuu

SEQ ID NO: 1297176 - RNA, 19 nt, Homo sapiens
cuuguuugcugaguaauug

SEQ ID NO: 1297177 - RNA, 19 nt, Homo sapiens
ucucucagccacugcuaua

SEQ ID NO: 1297178 - RNA, 19 nt, Homo sapiens
aguugaagaugauaccuau

SEQ ID NO: 1297179 - RNA, 19 nt, Homo sapiens
gaaauccaggaagacagua

SEQ ID NO: 1297180 - RNA, 19 nt, Homo sapiens
ggagcagggcagcagguaa

SEQ ID NO: 1297181 - RNA, 19 nt, Homo sapiens
uuuaaucacgcauuuggua

SEQ ID NO: 1297182 - RNA, 19 nt, Homo sapiens
ucaaggguuguaagaguuu

SEQ ID NO: 1297183 - RNA, 19 nt, Homo sapiens
uuuccacucuucugccuuu

SEQ ID NO: 1297184 - RNA, 19 nt, Homo sapiens
ccauuccaaucucuucuuc

SEQ ID NO: 1297185 - RNA, 19 nt, Homo sapiens
caucagacugcuuccuaaa

SEQ ID NO: 1297186 - RNA, 19 nt, Homo sapiens
caaagacaccuccuuaccu

SEQ ID NO: 1297187 - RNA, 19 nt, Homo sapiens
cuaaauugagagaaacuga

SEQ ID NO: 1297188 - RNA, 19 nt, Homo sapiens
caaagaguugaagaugaua

SEQ ID NO: 1297189 - RNA, 19 nt, Homo sapiens
gugcagaaggccuuguuug

SEQ ID NO: 1297190 - RNA, 19 nt, Homo sapiens
gugaugcuguccucuguac

SEQ ID NO: 1297191 - RNA, 19 nt, Homo sapiens
aaaugagaguauucacuag

SEQ ID NO: 1297192 - RNA, 19 nt, Homo sapiens
ggugcuggccucaauguca

SEQ ID NO: 1297193 - RNA, 19 nt, Homo sapiens
gagugagguuucguacaug

SEQ ID NO: 1297194 - RNA, 19 nt, Homo sapiens
ggacagggauaaauaaaga

SEQ ID NO: 1297195 - RNA, 19 nt, Homo sapiens
ccagugaccuccugaguug

SEQ ID NO: 1297196 - RNA, 19 nt, Homo sapiens
ggagggacagggauaaaua

SEQ ID NO: 1297197 - RNA, 19 nt, Homo sapiens
ccuauugcccugcuacuua

SEQ ID NO: 1297198 - RNA, 19 nt, Homo sapiens
gaaaguccaaggaaagaug

SEQ ID NO: 1297199 - RNA, 19 nt, Homo sapiens
ggagaaaguccaaggaaag

SEQ ID NO: 1297200 - RNA, 19 nt, Homo sapiens
gagggacagggauaaauaa

SEQ ID NO: 1297201 - RNA, 19 nt, Homo sapiens
cgagugguguggacuguug

SEQ ID NO: 1297202 - RNA, 19 nt, Homo sapiens
cuauugcccugcuacuuaa

SEQ ID NO: 1297203 - RNA, 19 nt, Homo sapiens
gagaaaguccaaggaaaga

SEQ ID NO: 1297204 - RNA, 19 nt, Homo sapiens
gaggagaaaguccaaggaa

SEQ ID NO: 1297205 - RNA, 19 nt, Homo sapiens
uaaagacaaagacugaaga

SEQ ID NO: 1297206 - RNA, 19 nt, Homo sapiens
ggugugcgcuguccugcau

SEQ ID NO: 1297207 - RNA, 19 nt, Homo sapiens
gcucaacguccucagcauu

SEQ ID NO: 1297208 - RNA, 19 nt, Homo sapiens
gaaagauggcuggcaguca

SEQ ID NO: 1297209 - RNA, 19 nt, Homo sapiens
aggagaaaguccaaggaaa

SEQ ID NO: 1297210 - RNA, 19 nt, Homo sapiens
gcacuccaaugaggucaca

SEQ ID NO: 1297211 - RNA, 19 nt, Homo sapiens
guggaggagugagauagaa

SEQ ID NO: 1297212 - RNA, 19 nt, Homo sapiens
ggaagguggaggagugaga

SEQ ID NO: 1297213 - RNA, 19 nt, Homo sapiens
caacaguggccuuccuauc

SEQ ID NO: 1297214 - RNA, 19 nt, Homo sapiens
ggcacuuucugacaucaug

SEQ ID NO: 1297215 - RNA, 19 nt, Homo sapiens
ggcagcauccuaggacuaa

SEQ ID NO: 1297216 - RNA, 19 nt, Homo sapiens
gggcagcauccuaggacua

SEQ ID NO: 1297217 - RNA, 19 nt, Homo sapiens
ucugggaccuccugacauc

SEQ ID NO: 1297218 - RNA, 19 nt, Homo sapiens
acaguggccuuccuaucug

SEQ ID NO: 1297219 - RNA, 19 nt, Homo sapiens
cauuggaugugccuacagu

SEQ ID NO: 1297220 - RNA, 19 nt, Homo sapiens
cagcauugccaucauuaca

SEQ ID NO: 1297221 - RNA, 19 nt, Homo sapiens
ugggcuaugugcaggcuuu

SEQ ID NO: 1297222 - RNA, 19 nt, Homo sapiens
acaccacccugggcuaugu

SEQ ID NO: 1297223 - RNA, 19 nt, Homo sapiens
gaagguggaggagugagau

SEQ ID NO: 1297224 - RNA, 19 nt, Homo sapiens
cccggaaccucagcuguga

SEQ ID NO: 1297225 - RNA, 19 nt, Homo sapiens
gguuguggcccuuauacug

SEQ ID NO: 1297226 - RNA, 19 nt, Homo sapiens
ccaugagacuguggcacuu

SEQ ID NO: 1297227 - RNA, 19 nt, Homo sapiens
ccuggacucuggacacuac

SEQ ID NO: 1297228 - RNA, 19 nt, Homo sapiens
gguggaggagugagauaga

SEQ ID NO: 1297229 - RNA, 19 nt, Homo sapiens
gggacagggauaaauaaag

SEQ ID NO: 1297230 - RNA, 19 nt, Homo sapiens
gaggagugagauagaacuu

SEQ ID NO: 1297231 - RNA, 19 nt, Homo sapiens
gggcuucuggucuaucguu

SEQ ID NO: 1297232 - RNA, 19 nt, Homo sapiens
gaccuggacucuggacacu

SEQ ID NO: 1297233 - RNA, 19 nt, Homo sapiens
cauccuaggacuaaucauc

SEQ ID NO: 1297234 - RNA, 19 nt, Homo sapiens
aaagguucuuccaccguau

SEQ ID NO: 1297235 - RNA, 19 nt, Homo sapiens
gggagggacagggauaaau

SEQ ID NO: 1297236 - RNA, 19 nt, Homo sapiens
guugggagggacagggaua

SEQ ID NO: 1297237 - RNA, 19 nt, Homo sapiens
gccaggaggagaggagaaa

SEQ ID NO: 1297238 - RNA, 19 nt, Homo sapiens
ccuccugccucccaacagu

SEQ ID NO: 1297239 - RNA, 19 nt, Homo sapiens
gcacacacauucuagagua

SEQ ID NO: 1297240 - RNA, 19 nt, Homo sapiens
gaagcaaucuguauuaguc

SEQ ID NO: 1297241 - RNA, 19 nt, Homo sapiens
gcaagagucuagucuguga

SEQ ID NO: 1297242 - RNA, 19 nt, Homo sapiens
aaacagaggugaccagaga

SEQ ID NO: 1297243 - RNA, 19 nt, Homo sapiens
uggaugagcuuaccacuaa

SEQ ID NO: 1297244 - RNA, 19 nt, Homo sapiens
caaugcaaauggagaaaua

SEQ ID NO: 1297245 - RNA, 19 nt, Homo sapiens
ggaaauagaauucgccaaa

SEQ ID NO: 1297246 - RNA, 19 nt, Homo sapiens
ccacaaagcacuuauauag

SEQ ID NO: 1297247 - RNA, 19 nt, Homo sapiens
gagcugaacugcaauugug

SEQ ID NO: 1297248 - RNA, 19 nt, Homo sapiens
guagaagcaaucuguauua

SEQ ID NO: 1297249 - RNA, 19 nt, Homo sapiens
ggucagaacugcucauaag

SEQ ID NO: 1297250 - RNA, 19 nt, Homo sapiens
uuagaaagcucucauccaa

SEQ ID NO: 1297251 - RNA, 19 nt, Homo sapiens
ggacaagggugggaacuca

SEQ ID NO: 1297252 - RNA, 19 nt, Homo sapiens
agaaagcucucauccaaug

SEQ ID NO: 1297253 - RNA, 19 nt, Homo sapiens
gcaggaaucuccgaucugu

SEQ ID NO: 1297254 - RNA, 19 nt, Homo sapiens
agacaggccuucaucagaa

SEQ ID NO: 1297255 - RNA, 19 nt, Homo sapiens
gcaauucccugacaacacu

SEQ ID NO: 1297256 - RNA, 19 nt, Homo sapiens
gauauuugcugccauuucu

SEQ ID NO: 1297257 - RNA, 19 nt, Homo sapiens
gaacugcucauaagaaucu

SEQ ID NO: 1297258 - RNA, 19 nt, Homo sapiens
caaagcacuuauauaguug

SEQ ID NO: 1297259 - RNA, 19 nt, Homo sapiens
cgagaucgguucacuuugu

SEQ ID NO: 1297260 - RNA, 19 nt, Homo sapiens
gcucugaugccauuaauga

SEQ ID NO: 1297261 - RNA, 19 nt, Homo sapiens
gcagcuauuguaaauguua

SEQ ID NO: 1297262 - RNA, 19 nt, Homo sapiens
gaugagacccugagguuug

SEQ ID NO: 1297263 - RNA, 19 nt, Homo sapiens
gaagcuggguuucacauac

SEQ ID NO: 1297264 - RNA, 19 nt, Homo sapiens
cgucaacacuuucuugguu

SEQ ID NO: 1297265 - RNA, 19 nt, Homo sapiens
ugugauuucuggcaaguua

SEQ ID NO: 1297266 - RNA, 19 nt, Homo sapiens
gcaaguuacugaaauucuc

SEQ ID NO: 1297267 - RNA, 19 nt, Homo sapiens
gaaauagaauucgccaaac

SEQ ID NO: 1297268 - RNA, 19 nt, Homo sapiens
cagaacugcucauaagaau

SEQ ID NO: 1297269 - RNA, 19 nt, Homo sapiens
ggacagccuuacuuuccaa

SEQ ID NO: 1297270 - RNA, 19 nt, Homo sapiens
gcuuaccacuaaucucuuu

SEQ ID NO: 1297271 - RNA, 19 nt, Homo sapiens
gcuaugcuuuguuucuuga

SEQ ID NO: 1297272 - RNA, 19 nt, Homo sapiens
ggagaauucuggauaaaau

SEQ ID NO: 1297273 - RNA, 19 nt, Homo sapiens
ccaaaccaaugcaaaugga

SEQ ID NO: 1297274 - RNA, 19 nt, Homo sapiens
gagacaggccuucaucaga

SEQ ID NO: 1297275 - RNA, 19 nt, Homo sapiens
guucucaagcugcuaauaa

SEQ ID NO: 1297276 - RNA, 19 nt, Homo sapiens
gacaggccuucaucagaaa

SEQ ID NO: 1297277 - RNA, 19 nt, Homo sapiens
gggcucaaccucugugauu

SEQ ID NO: 1297278 - RNA, 19 nt, Homo sapiens
caccugaagucugagauuu

SEQ ID NO: 1297279 - RNA, 19 nt, Homo sapiens
uaaagcaauucccugacaa

SEQ ID NO: 1297280 - RNA, 19 nt, Homo sapiens
ccaagaaccuccagaaacc

SEQ ID NO: 1297281 - RNA, 19 nt, Homo sapiens
gggaugagacccugagguu

SEQ ID NO: 1297282 - RNA, 19 nt, Homo sapiens
gcacacucuuugaggaaau

SEQ ID NO: 1297283 - RNA, 19 nt, Homo sapiens
cuagcgaguuugcagaauu

SEQ ID NO: 1297284 - RNA, 19 nt, Homo sapiens
ggggaaacgucaacacuuu

SEQ ID NO: 1297285 - RNA, 19 nt, Homo sapiens
cacaauagccaaauguaga

SEQ ID NO: 1297286 - RNA, 19 nt, Homo sapiens
uguaaaggcuuccaagaac

SEQ ID NO: 1297287 - RNA, 19 nt, Homo sapiens
cauucugccuggaucauuu

SEQ ID NO: 1297288 - RNA, 19 nt, Homo sapiens
gagcuuaccacuaaucucu

SEQ ID NO: 1297289 - RNA, 19 nt, Homo sapiens
cugcagcuauuguaaaugu

SEQ ID NO: 1297290 - RNA, 19 nt, Homo sapiens
gaugagugccugcagcuau

SEQ ID NO: 1297291 - RNA, 19 nt, Homo sapiens
gcugacacgugacaugcaa

SEQ ID NO: 1297292 - RNA, 19 nt, Homo sapiens
gagaucgguucacuuugug

SEQ ID NO: 1297293 - RNA, 19 nt, Homo sapiens
gaucagaagcuggguuuca

SEQ ID NO: 1297294 - RNA, 19 nt, Homo sapiens
aggaugcuaugcuuuguuu

SEQ ID NO: 1297295 - RNA, 19 nt, Homo sapiens
uuaaagcaauucccugaca

SEQ ID NO: 1297296 - RNA, 19 nt, Homo sapiens
ucagaacugcucauaagaa

SEQ ID NO: 1297297 - RNA, 19 nt, Homo sapiens
cagcaugacucacaauagc

SEQ ID NO: 1297298 - RNA, 19 nt, Homo sapiens
gagguuugccuuucauuag

SEQ ID NO: 1297299 - RNA, 19 nt, Homo sapiens
agaguaagcagcaaacaga

SEQ ID NO: 1297300 - RNA, 19 nt, Homo sapiens
ugauggaaaugaccucugu

SEQ ID NO: 1297301 - RNA, 19 nt, Homo sapiens
aggcucaccugaagucuga

SEQ ID NO: 1297302 - RNA, 19 nt, Homo sapiens
gccugcagcuauuguaaau

SEQ ID NO: 1297303 - RNA, 19 nt, Homo sapiens
ugagguuugccuuucauua

SEQ ID NO: 1297304 - RNA, 19 nt, Homo sapiens
uagcgaguuugcagaauuc

SEQ ID NO: 1297305 - RNA, 19 nt, Homo sapiens
ggaggcaacccaucuggau

SEQ ID NO: 1297306 - RNA, 19 nt, Homo sapiens
cuaaggaugcuaugcuuug

SEQ ID NO: 1297307 - RNA, 19 nt, Homo sapiens
uaaucaagacuuagaggaa

SEQ ID NO: 1297308 - RNA, 19 nt, Homo sapiens
ggguuauggugaauaccua

SEQ ID NO: 1297309 - RNA, 19 nt, Homo sapiens
uuacuggacuuagcaggaa

SEQ ID NO: 1297310 - RNA, 19 nt, Homo sapiens
uagaagcaaucuguauuag

SEQ ID NO: 1297311 - RNA, 19 nt, Homo sapiens
ucaccugggucucucacuu

SEQ ID NO: 1297312 - RNA, 19 nt, Homo sapiens
caccuggccucaccaagug

SEQ ID NO: 1297313 - RNA, 19 nt, Homo sapiens
gcgaucagaagcuggguuu

SEQ ID NO: 1297314 - RNA, 19 nt, Homo sapiens
gaaggccauuuguggucuu

SEQ ID NO: 1297315 - RNA, 19 nt, Homo sapiens
agaauucgccaaaccaaug

SEQ ID NO: 1297316 - RNA, 19 nt, Homo sapiens
cacacacauucuagaguaa

SEQ ID NO: 1297317 - RNA, 19 nt, Homo sapiens
gacucacccuggacuaaug

SEQ ID NO: 1297318 - RNA, 19 nt, Homo sapiens
ggaccgggcacuuagaaag

SEQ ID NO: 1297319 - RNA, 19 nt, Homo sapiens
cagccuuacuuuccaaauc

SEQ ID NO: 1297320 - RNA, 19 nt, Homo sapiens
gccacaaagcacuuauaua

SEQ ID NO: 1297321 - RNA, 19 nt, Homo sapiens
ucucucagaucuacuagca

SEQ ID NO: 1297322 - RNA, 19 nt, Homo sapiens
gggacagucucugcaggaa

SEQ ID NO: 1297323 - RNA, 19 nt, Homo sapiens
ggaugagacccugagguuu

SEQ ID NO: 1297324 - RNA, 19 nt, Homo sapiens
uaaggaugcuaugcuuugu

SEQ ID NO: 1297325 - RNA, 19 nt, Homo sapiens
gcuaaggaugcuaugcuuu

SEQ ID NO: 1297326 - RNA, 19 nt, Homo sapiens
aaacgucaacacuuucuug

SEQ ID NO: 1297327 - RNA, 19 nt, Homo sapiens
gagacaauaaucaagacuu

SEQ ID NO: 1297328 - RNA, 19 nt, Homo sapiens
ggcucaaccucugugauuu

SEQ ID NO: 1297329 - RNA, 19 nt, Homo sapiens
gggcucugaugccauuaau

SEQ ID NO: 1297330 - RNA, 19 nt, Homo sapiens
uagcaggaaucuccgaucu

SEQ ID NO: 1297331 - RNA, 19 nt, Homo sapiens
uuuggagaauucuggauaa

SEQ ID NO: 1297332 - RNA, 19 nt, Homo sapiens
gcagcaugacucacaauag

SEQ ID NO: 1297333 - RNA, 19 nt, Homo sapiens
guacacccauguucauagc

SEQ ID NO: 1297334 - RNA, 19 nt, Homo sapiens
gcaggacagccuuacuuuc

SEQ ID NO: 1297335 - RNA, 19 nt, Homo sapiens
cuccugagcuccuuaguac

SEQ ID NO: 1297336 - RNA, 19 nt, Homo sapiens
gaggugaccagagaugcua

SEQ ID NO: 1297337 - RNA, 19 nt, Homo sapiens
cacacucuuugaggaaaua

SEQ ID NO: 1297338 - RNA, 19 nt, Homo sapiens
acaauagccaaauguagaa

SEQ ID NO: 1297339 - RNA, 19 nt, Homo sapiens
gaagaaugcauaccgauua

SEQ ID NO: 1297340 - RNA, 19 nt, Homo sapiens
cauuaggucugccuuauua

SEQ ID NO: 1297341 - RNA, 19 nt, Homo sapiens
agacagaacuucagguuga

SEQ ID NO: 1297342 - RNA, 19 nt, Homo sapiens
gaagagaaguuacgagacu

SEQ ID NO: 1297343 - RNA, 19 nt, Homo sapiens
gauuaacgcuggcaggaaa

SEQ ID NO: 1297344 - RNA, 19 nt, Homo sapiens
ggacacuuacuaugauuua

SEQ ID NO: 1297345 - RNA, 19 nt, Homo sapiens
gcaggagaauccacuuaga

SEQ ID NO: 1297346 - RNA, 19 nt, Homo sapiens
ugagaaagagccagauuaa

SEQ ID NO: 1297347 - RNA, 19 nt, Homo sapiens
aagggaaacuucacaaaga

SEQ ID NO: 1297348 - RNA, 19 nt, Homo sapiens
ggaaaugugaagaaagaaa

SEQ ID NO: 1297349 - RNA, 19 nt, Homo sapiens
caguagauauagaaccaua

SEQ ID NO: 1297350 - RNA, 19 nt, Homo sapiens
gauugcaucuuggaacuga

SEQ ID NO: 1297351 - RNA, 19 nt, Homo sapiens
gaagaaagaaacgcaaaca

SEQ ID NO: 1297352 - RNA, 19 nt, Homo sapiens
caaagggaaacuucacaaa

SEQ ID NO: 1297353 - RNA, 19 nt, Homo sapiens
gggcauccuugcuuuguuc

SEQ ID NO: 1297354 - RNA, 19 nt, Homo sapiens
gagcugcuauuccggagau

SEQ ID NO: 1297355 - RNA, 19 nt, Homo sapiens
gaauugaugugaguauggu

SEQ ID NO: 1297356 - RNA, 19 nt, Homo sapiens
ggagagagagugggagaga

SEQ ID NO: 1297357 - RNA, 19 nt, Homo sapiens
gccauuaggucugccuuau

SEQ ID NO: 1297358 - RNA, 19 nt, Homo sapiens
ggggaaaugugaagaaaga

SEQ ID NO: 1297359 - RNA, 19 nt, Homo sapiens
ucaaguggguugggauuuc

SEQ ID NO: 1297360 - RNA, 19 nt, Homo sapiens
ggguugggauuuccaguuc

SEQ ID NO: 1297361 - RNA, 19 nt, Homo sapiens
gaaaugugaagaaagaaac

SEQ ID NO: 1297362 - RNA, 19 nt, Homo sapiens
agaaguacaaggugaagaa

SEQ ID NO: 1297363 - RNA, 19 nt, Homo sapiens
gaaucgccaugagcugcua

SEQ ID NO: 1297364 - RNA, 19 nt, Homo sapiens
caggagaauccacuuagaa

SEQ ID NO: 1297365 - RNA, 19 nt, Homo sapiens
uaggucugccuuauuauuu

SEQ ID NO: 1297366 - RNA, 19 nt, Homo sapiens
gaaugcauaccgauuacau

SEQ ID NO: 1297367 - RNA, 19 nt, Homo sapiens
ggaggccgguagugcugaa

SEQ ID NO: 1297368 - RNA, 19 nt, Homo sapiens
caaucugucuccacucaag

SEQ ID NO: 1297369 - RNA, 19 nt, Homo sapiens
cauccuugcuuuguuccua

SEQ ID NO: 1297370 - RNA, 19 nt, Homo sapiens
gacugggcauccuugcuuu

SEQ ID NO: 1297371 - RNA, 19 nt, Homo sapiens
cauuagacccaguagauau

SEQ ID NO: 1297372 - RNA, 19 nt, Homo sapiens
ugaagaaugcauaccgauu

SEQ ID NO: 1297373 - RNA, 19 nt, Homo sapiens
uuccggagauucuaugcua

SEQ ID NO: 1297374 - RNA, 19 nt, Homo sapiens
agaaagagccagauuaacg

SEQ ID NO: 1297375 - RNA, 19 nt, Homo sapiens
cugagaaagagccagauua

SEQ ID NO: 1297376 - RNA, 19 nt, Homo sapiens
gugcaggagaauccacuua

SEQ ID NO: 1297377 - RNA, 19 nt, Homo sapiens
gauuuccaguuccuugaug

SEQ ID NO: 1297378 - RNA, 19 nt, Homo sapiens
ccauuagacccaguagaua

SEQ ID NO: 1297379 - RNA, 19 nt, Homo sapiens
gcuguacacccaaggaaga

SEQ ID NO: 1297380 - RNA, 19 nt, Homo sapiens
ggaauugaugugaguaugg

SEQ ID NO: 1297381 - RNA, 19 nt, Homo sapiens
gagagagagugggagagau

SEQ ID NO: 1297382 - RNA, 19 nt, Homo sapiens
gagagugggagagauguga

SEQ ID NO: 1297383 - RNA, 19 nt, Homo sapiens
ugagacagaacuucagguu

SEQ ID NO: 1297384 - RNA, 19 nt, Homo sapiens
gaaguacaaggugaagaau

SEQ ID NO: 1297385 - RNA, 19 nt, Homo sapiens
cauucagucuucugccauu

SEQ ID NO: 1297386 - RNA, 19 nt, Homo sapiens
aagcaggagugcccuucaa

SEQ ID NO: 1297387 - RNA, 19 nt, Homo sapiens
aaagggaaacuucacaaag

SEQ ID NO: 1297388 - RNA, 19 nt, Homo sapiens
gaagcuguacacccaagga

SEQ ID NO: 1297389 - RNA, 19 nt, Homo sapiens
gugaagaaagaaacgcaaa

SEQ ID NO: 1297390 - RNA, 19 nt, Homo sapiens
caggagugcccuucaaaca

SEQ ID NO: 1297391 - RNA, 19 nt, Homo sapiens
ucaguguugugcaggagaa

SEQ ID NO: 1297392 - RNA, 19 nt, Homo sapiens
acaaggugaagaaugcaua

SEQ ID NO: 1297393 - RNA, 19 nt, Homo sapiens
uacaugaucuuggguuugg

SEQ ID NO: 1297394 - RNA, 19 nt, Homo sapiens
ccaguuccuugaugaagag

SEQ ID NO: 1297395 - RNA, 19 nt, Homo sapiens
ucaaagggaaacuucacaa

SEQ ID NO: 1297396 - RNA, 19 nt, Homo sapiens
aguacaaggugaagaaugc

SEQ ID NO: 1297397 - RNA, 19 nt, Homo sapiens
ggugugagacagaacuuca

SEQ ID NO: 1297398 - RNA, 19 nt, Homo sapiens
ccauuaggucugccuuauu

SEQ ID NO: 1297399 - RNA, 19 nt, Homo sapiens
ccacucagaaauaaagauc

SEQ ID NO: 1297400 - RNA, 19 nt, Homo sapiens
aagaaugcauaccgauuac

SEQ ID NO: 1297401 - RNA, 19 nt, Homo sapiens
ggagauucuaugcuacaga

SEQ ID NO: 1297402 - RNA, 19 nt, Homo sapiens
gaguauggugugagacaga

SEQ ID NO: 1297403 - RNA, 19 nt, Homo sapiens
uuaggucugccuuauuauu

SEQ ID NO: 1297404 - RNA, 19 nt, Homo sapiens
agacugggcauccuugcuu

SEQ ID NO: 1297405 - RNA, 19 nt, Homo sapiens
gggauuuccaguuccuuga

SEQ ID NO: 1297406 - RNA, 19 nt, Homo sapiens
cccaguagauauagaacca

SEQ ID NO: 1297407 - RNA, 19 nt, Homo sapiens
cucaaucugucuccacuca

SEQ ID NO: 1297408 - RNA, 19 nt, Homo sapiens
gugcuuuggacacuuacua

SEQ ID NO: 1297409 - RNA, 19 nt, Homo sapiens
cagacuggauuagugaaag

SEQ ID NO: 1297410 - RNA, 19 nt, Homo sapiens
aacaggaggugaaaacauu

SEQ ID NO: 1297411 - RNA, 19 nt, Homo sapiens
cccauuagacccaguagau

SEQ ID NO: 1297412 - RNA, 19 nt, Homo sapiens
uccaguuccuugaugaaga

SEQ ID NO: 1297413 - RNA, 19 nt, Homo sapiens
agagagagugggagagaug

SEQ ID NO: 1297414 - RNA, 19 nt, Homo sapiens
gcuauuccggagauucuau

SEQ ID NO: 1297415 - RNA, 19 nt, Homo sapiens
acauggggcuggaugaaaa

SEQ ID NO: 1297416 - RNA, 19 nt, Homo sapiens
auuagacccaguagauaua

SEQ ID NO: 1297417 - RNA, 19 nt, Homo sapiens
guuccuugaugaagagaag

SEQ ID NO: 1297418 - RNA, 19 nt, Homo sapiens
uuuggacacuuacuaugau

SEQ ID NO: 1297419 - RNA, 19 nt, Homo sapiens
gacacuuacuaugauuuag

SEQ ID NO: 1297420 - RNA, 19 nt, Homo sapiens
gcaggagugcccuucaaac

SEQ ID NO: 1297421 - RNA, 19 nt, Homo sapiens
gagaaagagccagauuaac

SEQ ID NO: 1297422 - RNA, 19 nt, Homo sapiens
uggaauugaugugaguaug

SEQ ID NO: 1297423 - RNA, 19 nt, Homo sapiens
ggaaacuucgaaaacuaua

SEQ ID NO: 1297424 - RNA, 19 nt, Homo sapiens
ucuuggaacugaggagguu

SEQ ID NO: 1297425 - RNA, 19 nt, Homo sapiens
cuuuggacacuuacuauga

SEQ ID NO: 1297426 - RNA, 19 nt, Homo sapiens
gaacuucagguugacuuuu

SEQ ID NO: 1297427 - RNA, 19 nt, Homo sapiens
ggguuuggucccugagaaa

SEQ ID NO: 1297428 - RNA, 19 nt, Homo sapiens
gaacuaugguuguaaaugc

SEQ ID NO: 1297429 - RNA, 19 nt, Homo sapiens
acacuuggcucucucauga

SEQ ID NO: 1297430 - RNA, 19 nt, Homo sapiens
uaaagaggauccagaguca

SEQ ID NO: 1297431 - RNA, 19 nt, Homo sapiens
gaacaaccuuggacaacuc

SEQ ID NO: 1297432 - RNA, 19 nt, Homo sapiens
uaaggaauaucuucugauc

SEQ ID NO: 1297433 - RNA, 19 nt, Homo sapiens
gcacaguucgugauauuga

SEQ ID NO: 1297434 - RNA, 19 nt, Homo sapiens
caugguagcuccagauaag

SEQ ID NO: 1297435 - RNA, 19 nt, Homo sapiens
aagcacaguucgugauauu

SEQ ID NO: 1297436 - RNA, 19 nt, Homo sapiens
cagaauccaugugaauaga

SEQ ID NO: 1297437 - RNA, 19 nt, Homo sapiens
aagaggauccagagucaua

SEQ ID NO: 1297438 - RNA, 19 nt, Homo sapiens
ggaacuaugguuguaaaug

SEQ ID NO: 1297439 - RNA, 19 nt, Homo sapiens
ucagaucaaagaaacauga

SEQ ID NO: 1297440 - RNA, 19 nt, Homo sapiens
gguuguaaaugcagaaggu

SEQ ID NO: 1297441 - RNA, 19 nt, Homo sapiens
uauuggaacuaugguugua

SEQ ID NO: 1297442 - RNA, 19 nt, Homo sapiens
gcucucucaugaguauuaa

SEQ ID NO: 1297443 - RNA, 19 nt, Homo sapiens
aggaauaucuucugaucgu

SEQ ID NO: 1297444 - RNA, 19 nt, Homo sapiens
gguauucccauccgaacaa

SEQ ID NO: 1297445 - RNA, 19 nt, Homo sapiens
uggcagagguggaggaaac

SEQ ID NO: 1297446 - RNA, 19 nt, Homo sapiens
cgaacaaccuuggacaacu

SEQ ID NO: 1297447 - RNA, 19 nt, Homo sapiens
gaggauccagagucauaaa

SEQ ID NO: 1297448 - RNA, 19 nt, Homo sapiens
gaaacacuuggcucucuca

SEQ ID NO: 1297449 - RNA, 19 nt, Homo sapiens
augcaggccuucuucauca

SEQ ID NO: 1297450 - RNA, 19 nt, Homo sapiens
ggcucucucaugaguauua

SEQ ID NO: 1297451 - RNA, 19 nt, Homo sapiens
gauggccaaggcuguuuaa

SEQ ID NO: 1297452 - RNA, 19 nt, Homo sapiens
ucagaauccaugugaauag

SEQ ID NO: 1297453 - RNA, 19 nt, Homo sapiens
guaaaugcagaagguauuc

SEQ ID NO: 1297454 - RNA, 19 nt, Homo sapiens
uuggaacuaugguuguaaa

SEQ ID NO: 1297455 - RNA, 19 nt, Homo sapiens
aagcgacacuggguuggaa

SEQ ID NO: 1297456 - RNA, 19 nt, Homo sapiens
aaagcacaguucgugauau

SEQ ID NO: 1297457 - RNA, 19 nt, Homo sapiens
caauaugcaggccuucuuc

SEQ ID NO: 1297458 - RNA, 19 nt, Homo sapiens
uuggacaacucaacaacug

SEQ ID NO: 1297459 - RNA, 19 nt, Homo sapiens
uguaaaugcagaagguauu

SEQ ID NO: 1297460 - RNA, 19 nt, Homo sapiens
gaccugacuuuucuuagga

SEQ ID NO: 1297461 - RNA, 19 nt, Homo sapiens
ugauauugauccucagaac

SEQ ID NO: 1297462 - RNA, 19 nt, Homo sapiens
uggaaacacuuggcucucu

SEQ ID NO: 1297463 - RNA, 19 nt, Homo sapiens
acacuggguuggaaacacu

SEQ ID NO: 1297464 - RNA, 19 nt, Homo sapiens
ggccugagcccagaguuuc

SEQ ID NO: 1297465 - RNA, 19 nt, Homo sapiens
cgauggccaaggcuguuua

SEQ ID NO: 1297466 - RNA, 19 nt, Homo sapiens
uagcuccagauaaggaaua

SEQ ID NO: 1297467 - RNA, 19 nt, Homo sapiens
ucaauaugcaggccuucuu

SEQ ID NO: 1297468 - RNA, 19 nt, Homo sapiens
guggaggaaaccuuaaaga

SEQ ID NO: 1297469 - RNA, 19 nt, Homo sapiens
gcacaggacucgcuaagug

SEQ ID NO: 1297470 - RNA, 19 nt, Homo sapiens
gcacccagcuuccuucuga

SEQ ID NO: 1297471 - RNA, 19 nt, Homo sapiens
gaucucaccuuccuucgaa

SEQ ID NO: 1297472 - RNA, 19 nt, Homo sapiens
cgaauaagccacucucuug

SEQ ID NO: 1297473 - RNA, 19 nt, Homo sapiens
ccaagaauguuaaugucaa

SEQ ID NO: 1297474 - RNA, 19 nt, Homo sapiens
cgaauucgcuccaagaaaa

SEQ ID NO: 1297475 - RNA, 19 nt, Homo sapiens
gaccuucaguucacuuugu

SEQ ID NO: 1297476 - RNA, 19 nt, Homo sapiens
ggaacccacucacaccaau

SEQ ID NO: 1297477 - RNA, 19 nt, Homo sapiens
cagaaggcauucccaucaa

SEQ ID NO: 1297478 - RNA, 19 nt, Homo sapiens
caccagauaaagacuauuu

SEQ ID NO: 1297479 - RNA, 19 nt, Homo sapiens
gaaggcauucccaucaaga

SEQ ID NO: 1297480 - RNA, 19 nt, Homo sapiens
ucuccucacuuccagguuu

SEQ ID NO: 1297481 - RNA, 19 nt, Homo sapiens
uaaugucaaucaugucagu

SEQ ID NO: 1297482 - RNA, 19 nt, Homo sapiens
ccugugucauuccuuaauu

SEQ ID NO: 1297483 - RNA, 19 nt, Homo sapiens
ucagaauccaaccgaauaa

SEQ ID NO: 1297484 - RNA, 19 nt, Homo sapiens
aaagacuauuuccugauug

SEQ ID NO: 1297485 - RNA, 19 nt, Homo sapiens
gacuauuuccugauuguga

SEQ ID NO: 1297486 - RNA, 19 nt, Homo sapiens
acagaaggcauucccauca

SEQ ID NO: 1297487 - RNA, 19 nt, Homo sapiens
ggaaucaucgucgugaaca

SEQ ID NO: 1297488 - RNA, 19 nt, Homo sapiens
guuaaugucaaucauguca

SEQ ID NO: 1297489 - RNA, 19 nt, Homo sapiens
agaagggagugcagggaau

SEQ ID NO: 1297490 - RNA, 19 nt, Homo sapiens
aagacuauuuccugauugu

SEQ ID NO: 1297491 - RNA, 19 nt, Homo sapiens
cugugucauuccuuaauuu

SEQ ID NO: 1297492 - RNA, 19 nt, Homo sapiens
ccagcuuccuucugaccuu

SEQ ID NO: 1297493 - RNA, 19 nt, Homo sapiens
gaagggagugcagggaauc

SEQ ID NO: 1297494 - RNA, 19 nt, Homo sapiens
cucccugugucauuccuua

SEQ ID NO: 1297495 - RNA, 19 nt, Homo sapiens
uucagaauccaaccgaaua

SEQ ID NO: 1297496 - RNA, 19 nt, Homo sapiens
ucaagagcaccauggacaa

SEQ ID NO: 1297497 - RNA, 19 nt, Homo sapiens
agaaggcauucccaucaag

SEQ ID NO: 1297498 - RNA, 19 nt, Homo sapiens
acauggcagucgcuuggaa

SEQ ID NO: 1297499 - RNA, 19 nt, Homo sapiens
ucaugucaguggacuagca

SEQ ID NO: 1297500 - RNA, 19 nt, Homo sapiens
ccgaauaagccacucucuu

SEQ ID NO: 1297501 - RNA, 19 nt, Homo sapiens
gaacgaucucaccuuccuu

SEQ ID NO: 1297502 - RNA, 19 nt, Homo sapiens
gaacccacucacaccaauc

SEQ ID NO: 1297503 - RNA, 19 nt, Homo sapiens
ccggaucggucggaaaugg

SEQ ID NO: 1297504 - RNA, 19 nt, Homo sapiens
agaacgaucucaccuuccu

SEQ ID NO: 1297505 - RNA, 19 nt, Homo sapiens
ccaguaugccagccucaug

SEQ ID NO: 1297506 - RNA, 19 nt, Homo sapiens
cgugaacacagaaggcauu

SEQ ID NO: 1297507 - RNA, 19 nt, Homo sapiens
gaauguaacugaugaucua

SEQ ID NO: 1297508 - RNA, 19 nt, Homo sapiens
ucaaagagaacaccauuua

SEQ ID NO: 1297509 - RNA, 19 nt, Homo sapiens
ggaagaaggaguuagauga

SEQ ID NO: 1297510 - RNA, 19 nt, Homo sapiens
gggacaagcuggcugauca

SEQ ID NO: 1297511 - RNA, 19 nt, Homo sapiens
gccagaggcuuguggauga

SEQ ID NO: 1297512 - RNA, 19 nt, Homo sapiens
gaaggagguucaagagauc

SEQ ID NO: 1297513 - RNA, 19 nt, Homo sapiens
gaaccgcucugccaaguac

SEQ ID NO: 1297514 - RNA, 19 nt, Homo sapiens
gcacauugcuaacaagaac

SEQ ID NO: 1297515 - RNA, 19 nt, Homo sapiens
aaagagcccuugcacauca

SEQ ID NO: 1297516 - RNA, 19 nt, Homo sapiens
gaaaagaccacaagaaaau

SEQ ID NO: 1297517 - RNA, 19 nt, Homo sapiens
aaagcgaugugaacaagaa

SEQ ID NO: 1297518 - RNA, 19 nt, Homo sapiens
caagauugaaggaaacuuu

SEQ ID NO: 1297519 - RNA, 19 nt, Homo sapiens
aauauaggcuaaugaagga

SEQ ID NO: 1297520 - RNA, 19 nt, Homo sapiens
agaaugggcugaaggauac

SEQ ID NO: 1297521 - RNA, 19 nt, Homo sapiens
gagaucauccagggcauua

SEQ ID NO: 1297522 - RNA, 19 nt, Homo sapiens
ggaaaccucaaauggcuaa

SEQ ID NO: 1297523 - RNA, 19 nt, Homo sapiens
ccaaugaucugcgcaagca

SEQ ID NO: 1297524 - RNA, 19 nt, Homo sapiens
caccaaacaucagauauuc

SEQ ID NO: 1297525 - RNA, 19 nt, Homo sapiens
gucgugaugucgcacaaua

SEQ ID NO: 1297526 - RNA, 19 nt, Homo sapiens
caacaacucaccaaacauc

SEQ ID NO: 1297527 - RNA, 19 nt, Homo sapiens
gagaagcgcauuggcauug

SEQ ID NO: 1297528 - RNA, 19 nt, Homo sapiens
ugaaagagcccuugcacau

SEQ ID NO: 1297529 - RNA, 19 nt, Homo sapiens
gcacaauauaggcuaauga

SEQ ID NO: 1297530 - RNA, 19 nt, Homo sapiens
gagcagcuugugaauguaa

SEQ ID NO: 1297531 - RNA, 19 nt, Homo sapiens
gcuuguggaugaaauugaa

SEQ ID NO: 1297532 - RNA, 19 nt, Homo sapiens
ucaaaggucccgaucagaa

SEQ ID NO: 1297533 - RNA, 19 nt, Homo sapiens
gcucaaaggucccgaucag

SEQ ID NO: 1297534 - RNA, 19 nt, Homo sapiens
ccaaguuccugcccucaga

SEQ ID NO: 1297535 - RNA, 19 nt, Homo sapiens
caagcuggcugaucaucug

SEQ ID NO: 1297536 - RNA, 19 nt, Homo sapiens
agcaugagcugauaaagga

SEQ ID NO: 1297537 - RNA, 19 nt, Homo sapiens
gaacaagaaacuagaacag

SEQ ID NO: 1297538 - RNA, 19 nt, Homo sapiens
gaaagagcccuugcacauc

SEQ ID NO: 1297539 - RNA, 19 nt, Homo sapiens
gaaggaguuagaugacaaa

SEQ ID NO: 1297540 - RNA, 19 nt, Homo sapiens
gaugcugucugcuaauagu

SEQ ID NO: 1297541 - RNA, 19 nt, Homo sapiens
gaggaaauccaucccacuu

SEQ ID NO: 1297542 - RNA, 19 nt, Homo sapiens
gagaacaccauuuauaucg

SEQ ID NO: 1297543 - RNA, 19 nt, Homo sapiens
caaagagaacaccauuuau

SEQ ID NO: 1297544 - RNA, 19 nt, Homo sapiens
ggucaaagagaacaccauu

SEQ ID NO: 1297545 - RNA, 19 nt, Homo sapiens
guguggcgcugaggaauuu

SEQ ID NO: 1297546 - RNA, 19 nt, Homo sapiens
ucaccaaacaucagauauu

SEQ ID NO: 1297547 - RNA, 19 nt, Homo sapiens
aacaacaacucaccaaaca

SEQ ID NO: 1297548 - RNA, 19 nt, Homo sapiens
uugagcagcuugugaaugu

SEQ ID NO: 1297549 - RNA, 19 nt, Homo sapiens
cagaguggcacauugcuaa

SEQ ID NO: 1297550 - RNA, 19 nt, Homo sapiens
gcugaaggauacaaaggau

SEQ ID NO: 1297551 - RNA, 19 nt, Homo sapiens
aagaaugggcugaaggaua

SEQ ID NO: 1297552 - RNA, 19 nt, Homo sapiens
gcuucucgcucaacaacaa

SEQ ID NO: 1297553 - RNA, 19 nt, Homo sapiens
ggauuugaaggacaaguuu

SEQ ID NO: 1297554 - RNA, 19 nt, Homo sapiens
ucaaagcgaugugaacaag

SEQ ID NO: 1297555 - RNA, 19 nt, Homo sapiens
ccauuuauaucgacgaagu

SEQ ID NO: 1297556 - RNA, 19 nt, Homo sapiens
gagaacgccgugaggauug

SEQ ID NO: 1297557 - RNA, 19 nt, Homo sapiens
agaaggauuugaaggacaa

SEQ ID NO: 1297558 - RNA, 19 nt, Homo sapiens
gauaaaggaggcugagauc

SEQ ID NO: 1297559 - RNA, 19 nt, Homo sapiens
caagaaacuagaacagaga

SEQ ID NO: 1297560 - RNA, 19 nt, Homo sapiens
aguacaaucuugagaagga

SEQ ID NO: 1297561 - RNA, 19 nt, Homo sapiens
agaaggaguuagaugacaa

SEQ ID NO: 1297562 - RNA, 19 nt, Homo sapiens
cuaguuccaauucucauua

SEQ ID NO: 1297563 - RNA, 19 nt, Homo sapiens
aaaggaggcugagaucauc

SEQ ID NO: 1297564 - RNA, 19 nt, Homo sapiens
uaaaggaggcugagaucau

SEQ ID NO: 1297565 - RNA, 19 nt, Homo sapiens
cgugaugucgcacaauaua

SEQ ID NO: 1297566 - RNA, 19 nt, Homo sapiens
caacucaccaaacaucaga

SEQ ID NO: 1297567 - RNA, 19 nt, Homo sapiens
gaucauccagggcauuaug

SEQ ID NO: 1297568 - RNA, 19 nt, Homo sapiens
ggacuucuccagcaccaau

SEQ ID NO: 1297569 - RNA, 19 nt, Homo sapiens
gagcaugagcugauaaagg

SEQ ID NO: 1297570 - RNA, 19 nt, Homo sapiens
ugacaaacuugagcagcuu

SEQ ID NO: 1297571 - RNA, 19 nt, Homo sapiens
gaagaaggaguuagaugac

SEQ ID NO: 1297572 - RNA, 19 nt, Homo sapiens
uaaaccacauuguaaacag

SEQ ID NO: 1297573 - RNA, 19 nt, Homo sapiens
cugaugcugucugcuaaua

SEQ ID NO: 1297574 - RNA, 19 nt, Homo sapiens
guaugcagaugaggaaauc

SEQ ID NO: 1297575 - RNA, 19 nt, Homo sapiens
caacaacaacucaccaaac

SEQ ID NO: 1297576 - RNA, 19 nt, Homo sapiens
gcccugaccauagaugaua

SEQ ID NO: 1297577 - RNA, 19 nt, Homo sapiens
ggagaagcgcauuggcauu

SEQ ID NO: 1297578 - RNA, 19 nt, Homo sapiens
gaugugaacaagaaacuag

SEQ ID NO: 1297579 - RNA, 19 nt, Homo sapiens
gcuaauaguagggcuaguu

SEQ ID NO: 1297580 - RNA, 19 nt, Homo sapiens
uggccaaggucauggaaga

SEQ ID NO: 1297581 - RNA, 19 nt, Homo sapiens
acaacucccugaugcugaa

SEQ ID NO: 1297582 - RNA, 19 nt, Homo sapiens
caagaaccaguaccacaga

SEQ ID NO: 1297583 - RNA, 19 nt, Homo sapiens
ccucaaauggcuaaacuau

SEQ ID NO: 1297584 - RNA, 19 nt, Homo sapiens
cacaauauaggcuaaugaa

SEQ ID NO: 1297585 - RNA, 19 nt, Homo sapiens
guggagcugugucgugaug

SEQ ID NO: 1297586 - RNA, 19 nt, Homo sapiens
uuaccucucuguucugcaa

SEQ ID NO: 1297587 - RNA, 19 nt, Homo sapiens
gcgcugaggaauuuggaaa

SEQ ID NO: 1297588 - RNA, 19 nt, Homo sapiens
ucgacgaagugcuguguau

SEQ ID NO: 1297589 - RNA, 19 nt, Homo sapiens
ccaaggucauggaagagau

SEQ ID NO: 1297590 - RNA, 19 nt, Homo sapiens
gcugaaagcccugguggau

SEQ ID NO: 1297591 - RNA, 19 nt, Homo sapiens
ggagcugugucgugauguc

SEQ ID NO: 1297592 - RNA, 19 nt, Homo sapiens
ucaagaaugggcugaagga

SEQ ID NO: 1297593 - RNA, 19 nt, Homo sapiens
ugagaacgccgugaggauu

SEQ ID NO: 1297594 - RNA, 19 nt, Homo sapiens
aaacuugagcagcuuguga

SEQ ID NO: 1297595 - RNA, 19 nt, Homo sapiens
uaguagggcuaguuccaau

SEQ ID NO: 1297596 - RNA, 19 nt, Homo sapiens
gcccugaugcugucugcua

SEQ ID NO: 1297597 - RNA, 19 nt, Homo sapiens
caaaggaugccagggacaa

SEQ ID NO: 1297598 - RNA, 19 nt, Homo sapiens
aaaccacauuguaaacagu

SEQ ID NO: 1297599 - RNA, 19 nt, Homo sapiens
guagggcuaguuccaauuc

SEQ ID NO: 1297600 - RNA, 19 nt, Homo sapiens
ggagauccaggucaaagag

SEQ ID NO: 1297601 - RNA, 19 nt, Homo sapiens
ccagaggcuuguggaugaa

SEQ ID NO: 1297602 - RNA, 19 nt, Homo sapiens
gaacgccuggucgcagaaa

SEQ ID NO: 1297603 - RNA, 19 nt, Homo sapiens
caccauuuauaucgacgaa

SEQ ID NO: 1297604 - RNA, 19 nt, Homo sapiens
agaacaccauuuauaucga

SEQ ID NO: 1297605 - RNA, 19 nt, Homo sapiens
caaggucauggaagagauu

SEQ ID NO: 1297606 - RNA, 19 nt, Homo sapiens
guacaaucuugagaaggau

SEQ ID NO: 1297607 - RNA, 19 nt, Homo sapiens
cgagaaagcuugugaguuu

SEQ ID NO: 1297608 - RNA, 19 nt, Homo sapiens
gaacgaagcugccagugaa

SEQ ID NO: 1297609 - RNA, 19 nt, Homo sapiens
gcagaacacuggauuacua

SEQ ID NO: 1297610 - RNA, 19 nt, Homo sapiens
gcacacagaugaugaccua

SEQ ID NO: 1297611 - RNA, 19 nt, Homo sapiens
gaacauuugucgacuauca

SEQ ID NO: 1297612 - RNA, 19 nt, Homo sapiens
ccaagaaacuauugaagaa

SEQ ID NO: 1297613 - RNA, 19 nt, Homo sapiens
ggaaagccgugucagauau

SEQ ID NO: 1297614 - RNA, 19 nt, Homo sapiens
ccagaaaacugaacgauua

SEQ ID NO: 1297615 - RNA, 19 nt, Homo sapiens
ggacuggcuucacaaauga

SEQ ID NO: 1297616 - RNA, 19 nt, Homo sapiens
cgaaauccauucucaaguu

SEQ ID NO: 1297617 - RNA, 19 nt, Homo sapiens
caacgcagcugcccagaau

SEQ ID NO: 1297618 - RNA, 19 nt, Homo sapiens
gaaauccauucucaaguug

SEQ ID NO: 1297619 - RNA, 19 nt, Homo sapiens
agacgacugugguuaaaua

SEQ ID NO: 1297620 - RNA, 19 nt, Homo sapiens
ugacacaacuggcaagcua

SEQ ID NO: 1297621 - RNA, 19 nt, Homo sapiens
gaagacaaccgcaauaagu

SEQ ID NO: 1297622 - RNA, 19 nt, Homo sapiens
ccagaaugcuauuaagaaa

SEQ ID NO: 1297623 - RNA, 19 nt, Homo sapiens
caaugcagcugccauguug

SEQ ID NO: 1297624 - RNA, 19 nt, Homo sapiens
gaagaaaugcuaaagaaag

SEQ ID NO: 1297625 - RNA, 19 nt, Homo sapiens
cagcugaacuugcuuuaug

SEQ ID NO: 1297626 - RNA, 19 nt, Homo sapiens
ccagacccaucuuguauuu

SEQ ID NO: 1297627 - RNA, 19 nt, Homo sapiens
ggccaaagcuguugccaau

SEQ ID NO: 1297628 - RNA, 19 nt, Homo sapiens
gaacaaggaguagaugaaa

SEQ ID NO: 1297629 - RNA, 19 nt, Homo sapiens
gaucacagccgaacauuca

SEQ ID NO: 1297630 - RNA, 19 nt, Homo sapiens
ucauugacgucauagaaua

SEQ ID NO: 1297631 - RNA, 19 nt, Homo sapiens
gaaaagagccucagacaau

SEQ ID NO: 1297632 - RNA, 19 nt, Homo sapiens
ggacaccaccauuauguuu

SEQ ID NO: 1297633 - RNA, 19 nt, Homo sapiens
uagggaaccucaagaauau

SEQ ID NO: 1297634 - RNA, 19 nt, Homo sapiens
caaagaauguugcccaagu

SEQ ID NO: 1297635 - RNA, 19 nt, Homo sapiens
ggacgacccuuccauguac

SEQ ID NO: 1297636 - RNA, 19 nt, Homo sapiens
uaaaggcaguggaggauga

SEQ ID NO: 1297637 - RNA, 19 nt, Homo sapiens
gagcaucaaucaacucauc

SEQ ID NO: 1297638 - RNA, 19 nt, Homo sapiens
gaugugcgaucaccacuau

SEQ ID NO: 1297639 - RNA, 19 nt, Homo sapiens
gaaacaaaguaaagaucga

SEQ ID NO: 1297640 - RNA, 19 nt, Homo sapiens
gcagauaucccagcugauu

SEQ ID NO: 1297641 - RNA, 19 nt, Homo sapiens
gaagaauacuccuuaaucc

SEQ ID NO: 1297642 - RNA, 19 nt, Homo sapiens
ggacagagggagugugauu

SEQ ID NO: 1297643 - RNA, 19 nt, Homo sapiens
gcagggauuucacagaaug

SEQ ID NO: 1297644 - RNA, 19 nt, Homo sapiens
gcaaggcaguggcugauca

SEQ ID NO: 1297645 - RNA, 19 nt, Homo sapiens
gagggaagaugagggcuaa

SEQ ID NO: 1297646 - RNA, 19 nt, Homo sapiens
caaagaagguggcggaaac

SEQ ID NO: 1297647 - RNA, 19 nt, Homo sapiens
ucaagagucucaucacuuc

SEQ ID NO: 1297648 - RNA, 19 nt, Homo sapiens
ggaagcugcuaaauccauu

SEQ ID NO: 1297649 - RNA, 19 nt, Homo sapiens
agagggagcugaucgaaug

SEQ ID NO: 1297650 - RNA, 19 nt, Homo sapiens
ggugacagcucaggaaaug

SEQ ID NO: 1297651 - RNA, 19 nt, Homo sapiens
gaaaguucagugaugauuu

SEQ ID NO: 1297652 - RNA, 19 nt, Homo sapiens
caucagaccucgucaaugc

SEQ ID NO: 1297653 - RNA, 19 nt, Homo sapiens
ggaacggcuucaguuguua

SEQ ID NO: 1297654 - RNA, 19 nt, Homo sapiens
cauaagaacugcggagaga

SEQ ID NO: 1297655 - RNA, 19 nt, Homo sapiens
gacggaagcuggaguugga

SEQ ID NO: 1297656 - RNA, 19 nt, Homo sapiens
ggaagaaaugcuaaagaaa

SEQ ID NO: 1297657 - RNA, 19 nt, Homo sapiens
ugacagcguucgccucaaa

SEQ ID NO: 1297658 - RNA, 19 nt, Homo sapiens
ccaagucucucucuguaga

SEQ ID NO: 1297659 - RNA, 19 nt, Homo sapiens
gauauggcaucuaggguau

SEQ ID NO: 1297660 - RNA, 19 nt, Homo sapiens
ggcaggaaaugcugugaaa

SEQ ID NO: 1297661 - RNA, 19 nt, Homo sapiens
gagaucggauuccagauuc

SEQ ID NO: 1297662 - RNA, 19 nt, Homo sapiens
gcuguuagcugccaagucu

SEQ ID NO: 1297663 - RNA, 19 nt, Homo sapiens
aggaagaaaugcuaaagaa

SEQ ID NO: 1297664 - RNA, 19 nt, Homo sapiens
ugaagaccaugcaguuuga

SEQ ID NO: 1297665 - RNA, 19 nt, Homo sapiens
gaacaaagucgacgaaucc

SEQ ID NO: 1297666 - RNA, 19 nt, Homo sapiens
ugacgacgauguuguagug

SEQ ID NO: 1297667 - RNA, 19 nt, Homo sapiens
ggagaucggauuccagauu

SEQ ID NO: 1297668 - RNA, 19 nt, Homo sapiens
gcccuguccuuaaagauuu

SEQ ID NO: 1297669 - RNA, 19 nt, Homo sapiens
gggaacauuugucgacuau

SEQ ID NO: 1297670 - RNA, 19 nt, Homo sapiens
ugaaggcacuccuccagaa

SEQ ID NO: 1297671 - RNA, 19 nt, Homo sapiens
caggaaaucggacaccuua

SEQ ID NO: 1297672 - RNA, 19 nt, Homo sapiens
ugcagacgcuuaagaauga

SEQ ID NO: 1297673 - RNA, 19 nt, Homo sapiens
caaagucgacgaauccaaa

SEQ ID NO: 1297674 - RNA, 19 nt, Homo sapiens
gaugaggagucaaccaugu

SEQ ID NO: 1297675 - RNA, 19 nt, Homo sapiens
gaaagggauuuggcuggaa

SEQ ID NO: 1297676 - RNA, 19 nt, Homo sapiens
gauguuguaugcagccaaa

SEQ ID NO: 1297677 - RNA, 19 nt, Homo sapiens
ugacagagagcaucaauca

SEQ ID NO: 1297678 - RNA, 19 nt, Homo sapiens
caucgaagcugcugcuaag

SEQ ID NO: 1297679 - RNA, 19 nt, Homo sapiens
ggccacaauugaaugcaua

SEQ ID NO: 1297680 - RNA, 19 nt, Homo sapiens
uuagugaccucucuuacuu

SEQ ID NO: 1297681 - RNA, 19 nt, Homo sapiens
agacagugaugguggauga

SEQ ID NO: 1297682 - RNA, 19 nt, Homo sapiens
caaaagacguaccugaaaa

SEQ ID NO: 1297683 - RNA, 19 nt, Homo sapiens
gaccuggacaccaccauua

SEQ ID NO: 1297684 - RNA, 19 nt, Homo sapiens
gggugacgcuggugaaaug

SEQ ID NO: 1297685 - RNA, 19 nt, Homo sapiens
ccaagggugugaagcuauu

SEQ ID NO: 1297686 - RNA, 19 nt, Homo sapiens
ccaccgagcugagggaaga

SEQ ID NO: 1297687 - RNA, 19 nt, Homo sapiens
cgacgauguuguagugaaa

SEQ ID NO: 1297688 - RNA, 19 nt, Homo sapiens
gcaagcuucugacuaugga

SEQ ID NO: 1297689 - RNA, 19 nt, Homo sapiens
gaaccagagccuugcguuu

SEQ ID NO: 1297690 - RNA, 19 nt, Homo sapiens
acagacagcuacaccaaga

SEQ ID NO: 1297691 - RNA, 19 nt, Homo sapiens
gacauaaggugacacaacu

SEQ ID NO: 1297692 - RNA, 19 nt, Homo sapiens
caacucaucacucugugua

SEQ ID NO: 1297693 - RNA, 19 nt, Homo sapiens
ucaaucaacucaucacucu

SEQ ID NO: 1297694 - RNA, 19 nt, Homo sapiens
gagagaaugagacugauga

SEQ ID NO: 1297695 - RNA, 19 nt, Homo sapiens
gagcacgucuuggugauuc

SEQ ID NO: 1297696 - RNA, 19 nt, Homo sapiens
gaaagagcgagaacuggaa

SEQ ID NO: 1297697 - RNA, 19 nt, Homo sapiens
gaucuuagccgcaguuggu

SEQ ID NO: 1297698 - RNA, 19 nt, Homo sapiens
ggaaaucggacaccuuauc

SEQ ID NO: 1297699 - RNA, 19 nt, Homo sapiens
cggaacggcuucaguuguu

SEQ ID NO: 1297700 - RNA, 19 nt, Homo sapiens
gcacauauggcguguccuu

SEQ ID NO: 1297701 - RNA, 19 nt, Homo sapiens
ggauggaucugugaagaca

SEQ ID NO: 1297702 - RNA, 19 nt, Homo sapiens
cugagaggcugggcacuua

SEQ ID NO: 1297703 - RNA, 19 nt, Homo sapiens
gaaacagagaccucagaaa

SEQ ID NO: 1297704 - RNA, 19 nt, Homo sapiens
gaagacacgaaacuacuug

SEQ ID NO: 1297705 - RNA, 19 nt, Homo sapiens
ccaaagcuguugccaaugc

SEQ ID NO: 1297706 - RNA, 19 nt, Homo sapiens
gaacggcuucaguuguuaa

SEQ ID NO: 1297707 - RNA, 19 nt, Homo sapiens
ggaauaggaucaagagaua

SEQ ID NO: 1297708 - RNA, 19 nt, Homo sapiens
gaaugaaacugagcucuaa

SEQ ID NO: 1297709 - RNA, 19 nt, Homo sapiens
caugugagcuuguggguua

SEQ ID NO: 1297710 - RNA, 19 nt, Homo sapiens
gcacaugcaucagcacaua

SEQ ID NO: 1297711 - RNA, 19 nt, Homo sapiens
caucacagaucuaaguauu

SEQ ID NO: 1297712 - RNA, 19 nt, Homo sapiens
ccagugagauccaagcaaa

SEQ ID NO: 1297713 - RNA, 19 nt, Homo sapiens
gauccaagcaaauaaguaa

SEQ ID NO: 1297714 - RNA, 19 nt, Homo sapiens
ggacuucggauccuucuaa

SEQ ID NO: 1297715 - RNA, 19 nt, Homo sapiens
gagcaagcaugaauucgau

SEQ ID NO: 1297716 - RNA, 19 nt, Homo sapiens
cauucaaucuucacucuuu

SEQ ID NO: 1297717 - RNA, 19 nt, Homo sapiens
gcaaauaaguaaggcuaca

SEQ ID NO: 1297718 - RNA, 19 nt, Homo sapiens
aaacgucucucccacuguu

SEQ ID NO: 1297719 - RNA, 19 nt, Homo sapiens
uaaguaaggcuacagauuc

SEQ ID NO: 1297720 - RNA, 19 nt, Homo sapiens
caaugugagugucaucuau

SEQ ID NO: 1297721 - RNA, 19 nt, Homo sapiens
gaacaucgucagugcaauc

SEQ ID NO: 1297722 - RNA, 19 nt, Homo sapiens
gaagaagacagagauuuua

SEQ ID NO: 1297723 - RNA, 19 nt, Homo sapiens
gcagagcaagcaugaauuc

SEQ ID NO: 1297724 - RNA, 19 nt, Homo sapiens
aaacaucuaugcagcaaac

SEQ ID NO: 1297725 - RNA, 19 nt, Homo sapiens
ccaaacaucuaugcagcaa

SEQ ID NO: 1297726 - RNA, 19 nt, Homo sapiens
cgaaugaaacugagcucua

SEQ ID NO: 1297727 - RNA, 19 nt, Homo sapiens
aagaaguccuccucccuuu

SEQ ID NO: 1297728 - RNA, 19 nt, Homo sapiens
gcaaugugagugucaucua

SEQ ID NO: 1297729 - RNA, 19 nt, Homo sapiens
ggaggcuugugguuuauca

SEQ ID NO: 1297730 - RNA, 19 nt, Homo sapiens
gacauucaaucuucacucu

SEQ ID NO: 1297731 - RNA, 19 nt, Homo sapiens
ugaccucaccaccaaguua

SEQ ID NO: 1297732 - RNA, 19 nt, Homo sapiens
uggguuagaggaacaaaua

SEQ ID NO: 1297733 - RNA, 19 nt, Homo sapiens
gcaagcaugaauucgauga

SEQ ID NO: 1297734 - RNA, 19 nt, Homo sapiens
ucaccuucauucuucaauu

SEQ ID NO: 1297735 - RNA, 19 nt, Homo sapiens
aaauagauacugagcauuc

SEQ ID NO: 1297736 - RNA, 19 nt, Homo sapiens
ggucguuccuguucugaca

SEQ ID NO: 1297737 - RNA, 19 nt, Homo sapiens
ggcuugugguuuaucauuu

SEQ ID NO: 1297738 - RNA, 19 nt, Homo sapiens
gcuugugguuuaucauuuc

SEQ ID NO: 1297739 - RNA, 19 nt, Homo sapiens
cuaguuuggugucgaaugu

SEQ ID NO: 1297740 - RNA, 19 nt, Homo sapiens
caagaagaagacagagauu

SEQ ID NO: 1297741 - RNA, 19 nt, Homo sapiens
caccuucauucuucaauuc

SEQ ID NO: 1297742 - RNA, 19 nt, Homo sapiens
acucucaccuucauucuuc

SEQ ID NO: 1297743 - RNA, 19 nt, Homo sapiens
ccaaguuauuccagugaga

SEQ ID NO: 1297744 - RNA, 19 nt, Homo sapiens
cauguaaccuggccugcau

SEQ ID NO: 1297745 - RNA, 19 nt, Homo sapiens
gaaaaucagccauauucuu

SEQ ID NO: 1297746 - RNA, 19 nt, Homo sapiens
gguggccaauucuguguug

SEQ ID NO: 1297747 - RNA, 19 nt, Homo sapiens
ucaauucagucuaggaaac

SEQ ID NO: 1297748 - RNA, 19 nt, Homo sapiens
ugucaucuauccaaacauc

SEQ ID NO: 1297749 - RNA, 19 nt, Homo sapiens
augcgcaucuucccacuuu

SEQ ID NO: 1297750 - RNA, 19 nt, Homo sapiens
gcaugaauucgaugacuuc

SEQ ID NO: 1297751 - RNA, 19 nt, Homo sapiens
gcaaagaaaaggaauagga

SEQ ID NO: 1297752 - RNA, 19 nt, Homo sapiens
gaaguccuccucccuuucu

SEQ ID NO: 1297753 - RNA, 19 nt, Homo sapiens
gcagcaaacccagugauca

SEQ ID NO: 1297754 - RNA, 19 nt, Homo sapiens
ucaagaagaagacagagau

SEQ ID NO: 1297755 - RNA, 19 nt, Homo sapiens
ugagugucaucuauccaaa

SEQ ID NO: 1297756 - RNA, 19 nt, Homo sapiens
caguuggucugcugucaau

SEQ ID NO: 1297757 - RNA, 19 nt, Homo sapiens
ucacagaucuaaguauucc

SEQ ID NO: 1297758 - RNA, 19 nt, Homo sapiens
cgugugcucugcugcaugu

SEQ ID NO: 1297759 - RNA, 19 nt, Homo sapiens
agacagagauuuuaaacag

SEQ ID NO: 1297760 - RNA, 19 nt, Homo sapiens
agugagauccaagcaaaua

SEQ ID NO: 1297761 - RNA, 19 nt, Homo sapiens
auaccugucuauuucauuc

SEQ ID NO: 1297762 - RNA, 19 nt, Homo sapiens
aagaagaagacagagauuu

SEQ ID NO: 1297763 - RNA, 19 nt, Homo sapiens
gcucuaagcagcauguaac

SEQ ID NO: 1297764 - RNA, 19 nt, Homo sapiens
auaaguaaggcuacagauu

SEQ ID NO: 1297765 - RNA, 19 nt, Homo sapiens
gaccucaccaccaaguuau

SEQ ID NO: 1297766 - RNA, 19 nt, Homo sapiens
cccaguacauucauucucu

SEQ ID NO: 1297767 - RNA, 19 nt, Homo sapiens
gaaaaggaauaggaucaag

SEQ ID NO: 1297768 - RNA, 19 nt, Homo sapiens
gugagauccaagcaaauaa

SEQ ID NO: 1297769 - RNA, 19 nt, Homo sapiens
gcuggcagagcaagcauga

SEQ ID NO: 1297770 - RNA, 19 nt, Homo sapiens
cagaaaaucagccauauuc

SEQ ID NO: 1297771 - RNA, 19 nt, Homo sapiens
uagauacugagcauucaaa

SEQ ID NO: 1297772 - RNA, 19 nt, Homo sapiens
caggaaauaaauacgaaug

SEQ ID NO: 1297773 - RNA, 19 nt, Homo sapiens
uggcagagcaagcaugaau

SEQ ID NO: 1297774 - RNA, 19 nt, Homo sapiens
uggggaggcuugugguuua

SEQ ID NO: 1297775 - RNA, 19 nt, Homo sapiens
ccauccagaucaucauugg

SEQ ID NO: 1297776 - RNA, 19 nt, Homo sapiens
caguuccgguggccaauuc

SEQ ID NO: 1297777 - RNA, 19 nt, Homo sapiens
ggaacaaauaucuagacau

SEQ ID NO: 1297778 - RNA, 19 nt, Homo sapiens
guuagaggaacaaauaucu

SEQ ID NO: 1297779 - RNA, 19 nt, Homo sapiens
aaguaaggcuacagauucu

SEQ ID NO: 1297780 - RNA, 19 nt, Homo sapiens
gagauccaagcaaauaagu

SEQ ID NO: 1297781 - RNA, 19 nt, Homo sapiens
aauagauacugagcauuca

SEQ ID NO: 1297782 - RNA, 19 nt, Homo sapiens
ucaucuauccaaacaucua

SEQ ID NO: 1297783 - RNA, 19 nt, Homo sapiens
uucgaugacuucagcaguu

SEQ ID NO: 1297784 - RNA, 19 nt, Homo sapiens
aggaacaaauaucuagaca

SEQ ID NO: 1297785 - RNA, 19 nt, Homo sapiens
agaagaagacagagauuuu

SEQ ID NO: 1297786 - RNA, 19 nt, Homo sapiens
ccaugcuguuucucuauca

SEQ ID NO: 1297787 - RNA, 19 nt, Homo sapiens
ggugugaacccuggaaugg

SEQ ID NO: 1297788 - RNA, 19 nt, Homo sapiens
gcagaaaaucagccauauu

SEQ ID NO: 1297789 - RNA, 19 nt, Homo sapiens
cauucauucucucaggaaa

SEQ ID NO: 1297790 - RNA, 19 nt, Homo sapiens
ucuagacauucaaucuuca

SEQ ID NO: 1297791 - RNA, 19 nt, Homo sapiens
gaaacgucucucccacugu

SEQ ID NO: 1297792 - RNA, 19 nt, Homo sapiens
aaauaaguaaggcuacaga

SEQ ID NO: 1297793 - RNA, 19 nt, Homo sapiens
gcaguuccgguggccaauu

SEQ ID NO: 1297794 - RNA, 19 nt, Homo sapiens
gaggaacaaauaucuagac

SEQ ID NO: 1297795 - RNA, 19 nt, Homo sapiens
gguuagaggaacaaauauc

SEQ ID NO: 1297796 - RNA, 19 nt, Homo sapiens
gacagagauuuuaaacaga

SEQ ID NO: 1297797 - RNA, 19 nt, Homo sapiens
agugucaucuauccaaaca

SEQ ID NO: 1297798 - RNA, 19 nt, Homo sapiens
gugagugucaucuauccaa

SEQ ID NO: 1297799 - RNA, 19 nt, Homo sapiens
gcaguuugggcuugaacau

SEQ ID NO: 1297800 - RNA, 19 nt, Homo sapiens
aaaggaauaggaucaagag

SEQ ID NO: 1297801 - RNA, 19 nt, Homo sapiens
ucauuggccuggcucacau

SEQ ID NO: 1297802 - RNA, 19 nt, Homo sapiens
ccgcaaguccaccuaguuc

SEQ ID NO: 1297803 - RNA, 19 nt, Homo sapiens
ggcagagcaagcaugaauu

SEQ ID NO: 1297804 - RNA, 19 nt, Homo sapiens
caagcaaugugagugucau

SEQ ID NO: 1297805 - RNA, 19 nt, Homo sapiens
caaacagccagccgcaagu

SEQ ID NO: 1297806 - RNA, 19 nt, Homo sapiens
auucuucaauucagucuag

SEQ ID NO: 1297807 - RNA, 19 nt, Homo sapiens
ggacauccguuaaauauug

SEQ ID NO: 1297808 - RNA, 19 nt, Homo sapiens
caacagauuuggagauaua

SEQ ID NO: 1297809 - RNA, 19 nt, Homo sapiens
gaauauaucccauggguua

SEQ ID NO: 1297810 - RNA, 19 nt, Homo sapiens
ggacagaguuagagauuga

SEQ ID NO: 1297811 - RNA, 19 nt, Homo sapiens
ggauuuaacuuguucugua

SEQ ID NO: 1297812 - RNA, 19 nt, Homo sapiens
gcaaaucucugcaaguguu

SEQ ID NO: 1297813 - RNA, 19 nt, Homo sapiens
ugaaaggacuagccacaua

SEQ ID NO: 1297814 - RNA, 19 nt, Homo sapiens
ggaagccaaugaugaguaa

SEQ ID NO: 1297815 - RNA, 19 nt, Homo sapiens
ggaaacagcagcagagauu

SEQ ID NO: 1297816 - RNA, 19 nt, Homo sapiens
gguaaaagcugguggauuu

SEQ ID NO: 1297817 - RNA, 19 nt, Homo sapiens
gaaauuaucagcccaggaa

SEQ ID NO: 1297818 - RNA, 19 nt, Homo sapiens
gcauauacuucaccaagaa

SEQ ID NO: 1297819 - RNA, 19 nt, Homo sapiens
gguccaagaugcugaguuu

SEQ ID NO: 1297820 - RNA, 19 nt, Homo sapiens
ggacaugcacccaggaaua

SEQ ID NO: 1297821 - RNA, 19 nt, Homo sapiens
ccugaaaccuuuguuauuu

SEQ ID NO: 1297822 - RNA, 19 nt, Homo sapiens
aaacagggauguacuggaa

SEQ ID NO: 1297823 - RNA, 19 nt, Homo sapiens
gugaaguccuccagaauaa

SEQ ID NO: 1297824 - RNA, 19 nt, Homo sapiens
gcucagaucuuuccucagu

SEQ ID NO: 1297825 - RNA, 19 nt, Homo sapiens
aagaguggcuugaauauau

SEQ ID NO: 1297826 - RNA, 19 nt, Homo sapiens
ccacaaaggcuaaacaguu

SEQ ID NO: 1297827 - RNA, 19 nt, Homo sapiens
aaacuacagucuaugcuuu

SEQ ID NO: 1297828 - RNA, 19 nt, Homo sapiens
caaagucaauucuacaaca

SEQ ID NO: 1297829 - RNA, 19 nt, Homo sapiens
gcagacggcagauguaauu

SEQ ID NO: 1297830 - RNA, 19 nt, Homo sapiens
gagcagcagcuuacaauga

SEQ ID NO: 1297831 - RNA, 19 nt, Homo sapiens
ugggugaacuaaccaaaua

SEQ ID NO: 1297832 - RNA, 19 nt, Homo sapiens
uggcagcccuguugauuaa

SEQ ID NO: 1297833 - RNA, 19 nt, Homo sapiens
gaaaggaacaugacauuuu

SEQ ID NO: 1297834 - RNA, 19 nt, Homo sapiens
uaaccacaaugacuucaaa

SEQ ID NO: 1297835 - RNA, 19 nt, Homo sapiens
gagaaaggaacaugacauu

SEQ ID NO: 1297836 - RNA, 19 nt, Homo sapiens
gcaaguggcagcccuguug

SEQ ID NO: 1297837 - RNA, 19 nt, Homo sapiens
cagcaaaucucugcaagug

SEQ ID NO: 1297838 - RNA, 19 nt, Homo sapiens
ccaggaauauguacaguca

SEQ ID NO: 1297839 - RNA, 19 nt, Homo sapiens
uggagaagauagacaauga

SEQ ID NO: 1297840 - RNA, 19 nt, Homo sapiens
cagaauaaguuuggcugua

SEQ ID NO: 1297841 - RNA, 19 nt, Homo sapiens
cggcagauguaauuguuaa

SEQ ID NO: 1297842 - RNA, 19 nt, Homo sapiens
caccauaucuggaaacuac

SEQ ID NO: 1297843 - RNA, 19 nt, Homo sapiens
auacggagcuggcauauac

SEQ ID NO: 1297844 - RNA, 19 nt, Homo sapiens
gaacauugaagauaugcuu

SEQ ID NO: 1297845 - RNA, 19 nt, Homo sapiens
ggaaacauggaaauaaaga

SEQ ID NO: 1297846 - RNA, 19 nt, Homo sapiens
cucaagagcuucuagauca

SEQ ID NO: 1297847 - RNA, 19 nt, Homo sapiens
uccuaaaccucagauauua

SEQ ID NO: 1297848 - RNA, 19 nt, Homo sapiens
ggagauauauaaggcuuuc

SEQ ID NO: 1297849 - RNA, 19 nt, Homo sapiens
cagcagagauuuuguuuga

SEQ ID NO: 1297850 - RNA, 19 nt, Homo sapiens
gcaaugaggacccuacugu

SEQ ID NO: 1297851 - RNA, 19 nt, Homo sapiens
cggaauuucuugccacaaa

SEQ ID NO: 1297852 - RNA, 19 nt, Homo sapiens
caagggaagccaaugauga

SEQ ID NO: 1297853 - RNA, 19 nt, Homo sapiens
gcagagggccauuguaagu

SEQ ID NO: 1297854 - RNA, 19 nt, Homo sapiens
guaaacccacaugauauua

SEQ ID NO: 1297855 - RNA, 19 nt, Homo sapiens
gacggcagauguaauuguu

SEQ ID NO: 1297856 - RNA, 19 nt, Homo sapiens
ccaaugaugaguaauuuga

SEQ ID NO: 1297857 - RNA, 19 nt, Homo sapiens
agugucagcuggugagaua

SEQ ID NO: 1297858 - RNA, 19 nt, Homo sapiens
gauaccaaaugaaacacuu

SEQ ID NO: 1297859 - RNA, 19 nt, Homo sapiens
ccaagaugcugaguuugaa

SEQ ID NO: 1297860 - RNA, 19 nt, Homo sapiens
guuggcaaauucccauuaa

SEQ ID NO: 1297861 - RNA, 19 nt, Homo sapiens
ggacugacuggguuauuga

SEQ ID NO: 1297862 - RNA, 19 nt, Homo sapiens
caaagaguggcuugaauau

SEQ ID NO: 1297863 - RNA, 19 nt, Homo sapiens
cuggaaacauggaaauaaa

SEQ ID NO: 1297864 - RNA, 19 nt, Homo sapiens
gaauaaguuuggcuguauc

SEQ ID NO: 1297865 - RNA, 19 nt, Homo sapiens
gccuuuaucugucuuuaug

SEQ ID NO: 1297866 - RNA, 19 nt, Homo sapiens
gcaagucccauaccaguuc

SEQ ID NO: 1297867 - RNA, 19 nt, Homo sapiens
gaaacuacagucuaugcuu

SEQ ID NO: 1297868 - RNA, 19 nt, Homo sapiens
guagagacuauccggguua

SEQ ID NO: 1297869 - RNA, 19 nt, Homo sapiens
gccuugagcucugggauuu

SEQ ID NO: 1297870 - RNA, 19 nt, Homo sapiens
gaaugcagccaaugaagau

SEQ ID NO: 1297871 - RNA, 19 nt, Homo sapiens
agaauaaguuuggcuguau

SEQ ID NO: 1297872 - RNA, 19 nt, Homo sapiens
guagauaccaaaugaaaca

SEQ ID NO: 1297873 - RNA, 19 nt, Homo sapiens
gccacauacuagcaucuua

SEQ ID NO: 1297874 - RNA, 19 nt, Homo sapiens
caaccugacccuccagauu

SEQ ID NO: 1297875 - RNA, 19 nt, Homo sapiens
agagugagcugggacaaga

SEQ ID NO: 1297876 - RNA, 19 nt, Homo sapiens
uauauaaggcuuucaguuc

SEQ ID NO: 1297877 - RNA, 19 nt, Homo sapiens
gcagagauuuuguuugaug

SEQ ID NO: 1297878 - RNA, 19 nt, Homo sapiens
ucuguaaacccacaugaua

SEQ ID NO: 1297879 - RNA, 19 nt, Homo sapiens
gaacuaaccaaauaaugac

SEQ ID NO: 1297880 - RNA, 19 nt, Homo sapiens
aagcaggaguugaaaugaa

SEQ ID NO: 1297881 - RNA, 19 nt, Homo sapiens
gucacaagauuacucauca

SEQ ID NO: 1297882 - RNA, 19 nt, Homo sapiens
uauguacagucacaagauu

SEQ ID NO: 1297883 - RNA, 19 nt, Homo sapiens
ccagggacauccguuaaau

SEQ ID NO: 1297884 - RNA, 19 nt, Homo sapiens
ggcauauacuucaccaaga

SEQ ID NO: 1297885 - RNA, 19 nt, Homo sapiens
ucaaugcaauggucgugaa

SEQ ID NO: 1297886 - RNA, 19 nt, Homo sapiens
aagaugaccucaccacaca

SEQ ID NO: 1297887 - RNA, 19 nt, Homo sapiens
ggaaggacagaguuagaga

SEQ ID NO: 1297888 - RNA, 19 nt, Homo sapiens
ccacaucauugagaauaau

SEQ ID NO: 1297889 - RNA, 19 nt, Homo sapiens
guucugaaauggcaaagag

SEQ ID NO: 1297890 - RNA, 19 nt, Homo sapiens
ggaaauaaagaaggaaaca

SEQ ID NO: 1297891 - RNA, 19 nt, Homo sapiens
ucccauggguuaucuguau

SEQ ID NO: 1297892 - RNA, 19 nt, Homo sapiens
gauaagcugaucuaugugu

SEQ ID NO: 1297893 - RNA, 19 nt, Homo sapiens
gaaacagcagcagagauuu

SEQ ID NO: 1297894 - RNA, 19 nt, Homo sapiens
gcagcagcuuacaaugaaa

SEQ ID NO: 1297895 - RNA, 19 nt, Homo sapiens
gggaagccaaugaugagua

SEQ ID NO: 1297896 - RNA, 19 nt, Homo sapiens
gauagacaaugagguccuu

SEQ ID NO: 1297897 - RNA, 19 nt, Homo sapiens
ccagaaccaccacaucauu

SEQ ID NO: 1297898 - RNA, 19 nt, Homo sapiens
ggaauuucuugccacaaag

SEQ ID NO: 1297899 - RNA, 19 nt, Homo sapiens
ucuggaaacuacagucuau

SEQ ID NO: 1297900 - RNA, 19 nt, Homo sapiens
gaauucauccuagggaaga

SEQ ID NO: 1297901 - RNA, 19 nt, Homo sapiens
ugugaaguccuccagaaua

SEQ ID NO: 1297902 - RNA, 19 nt, Homo sapiens
uaacgcaggccuuuuauuu

SEQ ID NO: 1297903 - RNA, 19 nt, Homo sapiens
gaaaggacuagccacauac

SEQ ID NO: 1297904 - RNA, 19 nt, Homo sapiens
gcagcccuguugauuaauc

SEQ ID NO: 1297905 - RNA, 19 nt, Homo sapiens
caagacgaaaugaaagaaa

SEQ ID NO: 1297906 - RNA, 19 nt, Homo sapiens
ggacuggaaacauggaaau

SEQ ID NO: 1297907 - RNA, 19 nt, Homo sapiens
gcgcagagcucaaggacua

SEQ ID NO: 1297908 - RNA, 19 nt, Homo sapiens
gcagugggcuuguguguga

SEQ ID NO: 1297909 - RNA, 19 nt, Homo sapiens
gcagaaaucuuuggcuuug

SEQ ID NO: 1297910 - RNA, 19 nt, Homo sapiens
gcaaaugacugugaauuac

SEQ ID NO: 1297911 - RNA, 19 nt, Homo sapiens
gggccaagcucggaauuaa

SEQ ID NO: 1297912 - RNA, 19 nt, Homo sapiens
gcaccaggguucuuguuug

SEQ ID NO: 1297913 - RNA, 19 nt, Homo sapiens
gagaagaccacccgaagaa

SEQ ID NO: 1297914 - RNA, 19 nt, Homo sapiens
cuagagaguuugagccuuu

SEQ ID NO: 1297915 - RNA, 19 nt, Homo sapiens
gagggaguauuagauuaua

SEQ ID NO: 1297916 - RNA, 19 nt, Homo sapiens
ugaagaggagggaguauua

SEQ ID NO: 1297917 - RNA, 19 nt, Homo sapiens
ggagugguauccaguguuc

SEQ ID NO: 1297918 - RNA, 19 nt, Homo sapiens
gcagggacccguugaacaa

SEQ ID NO: 1297919 - RNA, 19 nt, Homo sapiens
ggccauggcucaucaccaa

SEQ ID NO: 1297920 - RNA, 19 nt, Homo sapiens
ucagcgagaucaacaaguu

SEQ ID NO: 1297921 - RNA, 19 nt, Homo sapiens
ggagggcacugaagaaagg

SEQ ID NO: 1297922 - RNA, 19 nt, Homo sapiens
gaagaccacccgaagaaug

SEQ ID NO: 1297923 - RNA, 19 nt, Homo sapiens
ggagagaggccaaguacau

SEQ ID NO: 1297924 - RNA, 19 nt, Homo sapiens
cagagaagguccacgugaa

SEQ ID NO: 1297925 - RNA, 19 nt, Homo sapiens
gagagaggccaaguacaua

SEQ ID NO: 1297926 - RNA, 19 nt, Homo sapiens
gcuuugagcuggagaaguc

SEQ ID NO: 1297927 - RNA, 19 nt, Homo sapiens
ucagauaugaugacuauga

SEQ ID NO: 1297928 - RNA, 19 nt, Homo sapiens
ggagggaguauuagauuau

SEQ ID NO: 1297929 - RNA, 19 nt, Homo sapiens
gcagggccaucuggaacua

SEQ ID NO: 1297930 - RNA, 19 nt, Homo sapiens
gaggagggaguauuagauu

SEQ ID NO: 1297931 - RNA, 19 nt, Homo sapiens
ugccacagcugcagacuga

SEQ ID NO: 1297932 - RNA, 19 nt, Homo sapiens
ugugaugacuguaaauguu

SEQ ID NO: 1297933 - RNA, 19 nt, Homo sapiens
gcagagggcacaggaaaga

SEQ ID NO: 1297934 - RNA, 19 nt, Homo sapiens
ucaagacaguggccugcua

SEQ ID NO: 1297935 - RNA, 19 nt, Homo sapiens
ccuccucucugaccaguuu

SEQ ID NO: 1297936 - RNA, 19 nt, Homo sapiens
ccuauagccucaccuacaa

SEQ ID NO: 1297937 - RNA, 19 nt, Homo sapiens
gcaagccgcucugcuguac

SEQ ID NO: 1297938 - RNA, 19 nt, Homo sapiens
gggcaugugaugacuguaa

SEQ ID NO: 1297939 - RNA, 19 nt, Homo sapiens
gagggcaugugaugacugu

SEQ ID NO: 1297940 - RNA, 19 nt, Homo sapiens
ccacuacauugccaucaug

SEQ ID NO: 1297941 - RNA, 19 nt, Homo sapiens
gagaagcugcgcaaacuca

SEQ ID NO: 1297942 - RNA, 19 nt, Homo sapiens
gauguccucugggcgagua

SEQ ID NO: 1297943 - RNA, 19 nt, Homo sapiens
cgacuucucuugcccuucu

SEQ ID NO: 1297944 - RNA, 19 nt, Homo sapiens
aggagggaguauuagauua

SEQ ID NO: 1297945 - RNA, 19 nt, Homo sapiens
gcucuccuccuucguguuu

SEQ ID NO: 1297946 - RNA, 19 nt, Homo sapiens
ugaauuacgacuucucuug

SEQ ID NO: 1297947 - RNA, 19 nt, Homo sapiens
cuaaaagccuguucuguug

SEQ ID NO: 1297948 - RNA, 19 nt, Homo sapiens
cagauuucauuaccuccua

SEQ ID NO: 1297949 - RNA, 19 nt, Homo sapiens
ggagauggagagccgcuuu

SEQ ID NO: 1297950 - RNA, 19 nt, Homo sapiens
gguauccaguguucaagug

SEQ ID NO: 1297951 - RNA, 19 nt, Homo sapiens
ggcaugugaugacuguaaa

SEQ ID NO: 1297952 - RNA, 19 nt, Homo sapiens
gccaacagcaagcggauuu

SEQ ID NO: 1297953 - RNA, 19 nt, Homo sapiens
gaagccacacccucccuuu

SEQ ID NO: 1297954 - RNA, 19 nt, Homo sapiens
cacaaggacuucucugucu

SEQ ID NO: 1297955 - RNA, 19 nt, Homo sapiens
gagaggccaaguacauaaa

SEQ ID NO: 1297956 - RNA, 19 nt, Homo sapiens
gaagguccacgugaacuug

SEQ ID NO: 1297957 - RNA, 19 nt, Homo sapiens
ccugcacccugacuacuuu

SEQ ID NO: 1297958 - RNA, 19 nt, Homo sapiens
gccaagcucggaauuaaug

SEQ ID NO: 1297959 - RNA, 19 nt, Homo sapiens
cagauaugaugacuaugau

SEQ ID NO: 1297960 - RNA, 19 nt, Homo sapiens
agcaaaugacugugaauua

SEQ ID NO: 1297961 - RNA, 19 nt, Homo sapiens
gggcuuaaguggguugcuu

SEQ ID NO: 1297962 - RNA, 19 nt, Homo sapiens
caucggccauggcucauca

SEQ ID NO: 1297963 - RNA, 19 nt, Homo sapiens
gaccacacccuuccuccuu

SEQ ID NO: 1297964 - RNA, 19 nt, Homo sapiens
gcugagguuuuguuucaua

SEQ ID NO: 1297965 - RNA, 19 nt, Homo sapiens
gccaucacccgcuacauga

SEQ ID NO: 1297966 - RNA, 19 nt, Homo sapiens
gccacucgcucuccuccuu

SEQ ID NO: 1297967 - RNA, 19 nt, Homo sapiens
gaaagcccucccugcaaga

SEQ ID NO: 1297968 - RNA, 19 nt, Homo sapiens
gacugugaauuacgacuuc

SEQ ID NO: 1297969 - RNA, 19 nt, Homo sapiens
aaaugacugugaauuacga

SEQ ID NO: 1297970 - RNA, 19 nt, Homo sapiens
ggagagggagaauucuguu

SEQ ID NO: 1297971 - RNA, 19 nt, Homo sapiens
gcuaccaguuccauaugau

SEQ ID NO: 1297972 - RNA, 19 nt, Homo sapiens
uauagccucaccuacaaua

SEQ ID NO: 1297973 - RNA, 19 nt, Homo sapiens
ggacgucccaggaggagau

SEQ ID NO: 1297974 - RNA, 19 nt, Homo sapiens
ccgagaagcugcgcaaacu

SEQ ID NO: 1297975 - RNA, 19 nt, Homo sapiens
agaggagccuggccagugu

SEQ ID NO: 1297976 - RNA, 19 nt, Homo sapiens
gcucccacauggccgaguu

SEQ ID NO: 1297977 - RNA, 19 nt, Homo sapiens
gaagaggagggaguauuag

SEQ ID NO: 1297978 - RNA, 19 nt, Homo sapiens
ccagacaugcugugcuuug

SEQ ID NO: 1297979 - RNA, 19 nt, Homo sapiens
agagaggccaaguacauaa

SEQ ID NO: 1297980 - RNA, 19 nt, Homo sapiens
cucaaggucuauaucaaga

SEQ ID NO: 1297981 - RNA, 19 nt, Homo sapiens
ucuccugggugccuucuga

SEQ ID NO: 1297982 - RNA, 19 nt, Homo sapiens
gaauguacaaccucuucug

SEQ ID NO: 1297983 - RNA, 19 nt, Homo sapiens
cuauauccacugcgucuuu

SEQ ID NO: 1297984 - RNA, 19 nt, Homo sapiens
gaaaucuuuggcuuugcua

SEQ ID NO: 1297985 - RNA, 19 nt, Homo sapiens
uguagcaaaugacugugaa

SEQ ID NO: 1297986 - RNA, 19 nt, Homo sapiens
ggcacuuucuguagcaaau

SEQ ID NO: 1297987 - RNA, 19 nt, Homo sapiens
ccacauggccgaguuucug

SEQ ID NO: 1297988 - RNA, 19 nt, Homo sapiens
caccaggguucuuguuugg

SEQ ID NO: 1297989 - RNA, 19 nt, Homo sapiens
uggaagagcacuuggagau

SEQ ID NO: 1297990 - RNA, 19 nt, Homo sapiens
uagcaaaugacugugaauu

SEQ ID NO: 1297991 - RNA, 19 nt, Homo sapiens
ccacagcugcagacugaga

SEQ ID NO: 1297992 - RNA, 19 nt, Homo sapiens
ggaggcaccaggguucuug

SEQ ID NO: 1297993 - RNA, 19 nt, Homo sapiens
ccgcagaugucucccaaaa

SEQ ID NO: 1297994 - RNA, 19 nt, Homo sapiens
gcacuuggagauccuaagg

SEQ ID NO: 1297995 - RNA, 19 nt, Homo sapiens
agccuuugcuggucacauu

SEQ ID NO: 1297996 - RNA, 19 nt, Homo sapiens
uauauccacugcgucuuug

SEQ ID NO: 1297997 - RNA, 19 nt, Homo sapiens
aaacucagcgagaucaaca

SEQ ID NO: 1297998 - RNA, 19 nt, Homo sapiens
ccaguuccauaugaugaga

SEQ ID NO: 1297999 - RNA, 19 nt, Homo sapiens
cacuuucuguagcaaauga

SEQ ID NO: 1298000 - RNA, 19 nt, Homo sapiens
ccaggcacuuucuguagca

SEQ ID NO: 1298001 - RNA, 19 nt, Homo sapiens
aaguugagccuuucuagau

SEQ ID NO: 1298002 - RNA, 19 nt, Homo sapiens
ggaagagcacuuggagauc

SEQ ID NO: 1298003 - RNA, 19 nt, Homo sapiens
gcccagucccggcuucauu

SEQ ID NO: 1298004 - RNA, 19 nt, Homo sapiens
agggccaucuggaacuaua

SEQ ID NO: 1298005 - RNA, 19 nt, Homo sapiens
acaauaccaucgccaugca

SEQ ID NO: 1298006 - RNA, 19 nt, Homo sapiens
agacccuacuuucggauau

SEQ ID NO: 1298007 - RNA, 19 nt, Homo sapiens
gaacaaagaugaacuaaug

SEQ ID NO: 1298008 - RNA, 19 nt, Homo sapiens
gcaguuauuucuacaguua

SEQ ID NO: 1298009 - RNA, 19 nt, Homo sapiens
gaaguaagauuaagagauc

SEQ ID NO: 1298010 - RNA, 19 nt, Homo sapiens
gcaaauaucagucugcuaa

SEQ ID NO: 1298011 - RNA, 19 nt, Homo sapiens
cagaguacaucaacuauuu

SEQ ID NO: 1298012 - RNA, 19 nt, Homo sapiens
ggaaagaucugcagaaucc

SEQ ID NO: 1298013 - RNA, 19 nt, Homo sapiens
cagcaaaugucccaaauug

SEQ ID NO: 1298014 - RNA, 19 nt, Homo sapiens
gcaagcaaauccacauuau

SEQ ID NO: 1298015 - RNA, 19 nt, Homo sapiens
ggaaaggcauucagagugu

SEQ ID NO: 1298016 - RNA, 19 nt, Homo sapiens
gcaaaugucccaaauuguu

SEQ ID NO: 1298017 - RNA, 19 nt, Homo sapiens
gaaagaaaccuuaucacau

SEQ ID NO: 1298018 - RNA, 19 nt, Homo sapiens
gaugguggcuggguagaua

SEQ ID NO: 1298019 - RNA, 19 nt, Homo sapiens
gagaagaggaaacaaauga

SEQ ID NO: 1298020 - RNA, 19 nt, Homo sapiens
gccauuaauuugugucaua

SEQ ID NO: 1298021 - RNA, 19 nt, Homo sapiens
guucauggcuagagcaauu

SEQ ID NO: 1298022 - RNA, 19 nt, Homo sapiens
uguaguaaauguaggguua

SEQ ID NO: 1298023 - RNA, 19 nt, Homo sapiens
gaagaggaaacaaaugaaa

SEQ ID NO: 1298024 - RNA, 19 nt, Homo sapiens
agccagagcuuucuaugua

SEQ ID NO: 1298025 - RNA, 19 nt, Homo sapiens
gcugguggauuuacauauu

SEQ ID NO: 1298026 - RNA, 19 nt, Homo sapiens
gcugguggauaaacauuaa

SEQ ID NO: 1298027 - RNA, 19 nt, Homo sapiens
uaacauuacuguacagagu

SEQ ID NO: 1298028 - RNA, 19 nt, Homo sapiens
cagaaucgguugugccauu

SEQ ID NO: 1298029 - RNA, 19 nt, Homo sapiens
agaccuacauugcuucuuu

SEQ ID NO: 1298030 - RNA, 19 nt, Homo sapiens
acaaugacaugcagaguau

SEQ ID NO: 1298031 - RNA, 19 nt, Homo sapiens
ucagaaaguuuacagaauc

SEQ ID NO: 1298032 - RNA, 19 nt, Homo sapiens
agaaagaccuacauugcuu

SEQ ID NO: 1298033 - RNA, 19 nt, Homo sapiens
gagcugcaauucauuaugg

SEQ ID NO: 1298034 - RNA, 19 nt, Homo sapiens
guagagcugcaauucauua

SEQ ID NO: 1298035 - RNA, 19 nt, Homo sapiens
gagccugucuuggagauuu

SEQ ID NO: 1298036 - RNA, 19 nt, Homo sapiens
gcagaauccugggcugaaa

SEQ ID NO: 1298037 - RNA, 19 nt, Homo sapiens
gauaguagcagaaaugaag

SEQ ID NO: 1298038 - RNA, 19 nt, Homo sapiens
guacaaucgugguaugaug

SEQ ID NO: 1298039 - RNA, 19 nt, Homo sapiens
gugugaaacugaauacuug

SEQ ID NO: 1298040 - RNA, 19 nt, Homo sapiens
gguaaaugaccuuguauau

SEQ ID NO: 1298041 - RNA, 19 nt, Homo sapiens
guaacuguaugcaagcaaa

SEQ ID NO: 1298042 - RNA, 19 nt, Homo sapiens
caacccauauuguccauuc

SEQ ID NO: 1298043 - RNA, 19 nt, Homo sapiens
gcucaccucucccaggaaa

SEQ ID NO: 1298044 - RNA, 19 nt, Homo sapiens
ucagaguggugguaugaaa

SEQ ID NO: 1298045 - RNA, 19 nt, Homo sapiens
uaaagacuauuccaaaugc

SEQ ID NO: 1298046 - RNA, 19 nt, Homo sapiens
ccauaaagacuauuccaaa

SEQ ID NO: 1298047 - RNA, 19 nt, Homo sapiens
caaaugucccaaauuguuu

SEQ ID NO: 1298048 - RNA, 19 nt, Homo sapiens
gacaaugacaugcagagua

SEQ ID NO: 1298049 - RNA, 19 nt, Homo sapiens
ccaaauuguuucuugugaa

SEQ ID NO: 1298050 - RNA, 19 nt, Homo sapiens
gaugauaguagcagaaaug

SEQ ID NO: 1298051 - RNA, 19 nt, Homo sapiens
gacuuuagcuacccauaug

SEQ ID NO: 1298052 - RNA, 19 nt, Homo sapiens
aaugguaaaugaccuugua

SEQ ID NO: 1298053 - RNA, 19 nt, Homo sapiens
caaauuguuucuugugaag

SEQ ID NO: 1298054 - RNA, 19 nt, Homo sapiens
ccaacagccucuaauaugg

SEQ ID NO: 1298055 - RNA, 19 nt, Homo sapiens
gaaaaucugugcuacaaag

SEQ ID NO: 1298056 - RNA, 19 nt, Homo sapiens
auccugaggucauucauua

SEQ ID NO: 1298057 - RNA, 19 nt, Homo sapiens
ggacauuagcuuugggaaa

SEQ ID NO: 1298058 - RNA, 19 nt, Homo sapiens
gaaaggcauucagaguguu

SEQ ID NO: 1298059 - RNA, 19 nt, Homo sapiens
ucacauugcccaagaguau

SEQ ID NO: 1298060 - RNA, 19 nt, Homo sapiens
gacaaggaagaaagcauua

SEQ ID NO: 1298061 - RNA, 19 nt, Homo sapiens
gagaaaaucugugcuacaa

SEQ ID NO: 1298062 - RNA, 19 nt, Homo sapiens
gggaaauccugaggucauu

SEQ ID NO: 1298063 - RNA, 19 nt, Homo sapiens
gcuaauuccuucacagucu

SEQ ID NO: 1298064 - RNA, 19 nt, Homo sapiens
caaggaagaaagcauuauu

SEQ ID NO: 1298065 - RNA, 19 nt, Homo sapiens
gacauuagcuuugggaaaa

SEQ ID NO: 1298066 - RNA, 19 nt, Homo sapiens
cugguggauuuacauauua

SEQ ID NO: 1298067 - RNA, 19 nt, Homo sapiens
ugaaagaaaccuuaucaca

SEQ ID NO: 1298068 - RNA, 19 nt, Homo sapiens
guagauaucacuagacaag

SEQ ID NO: 1298069 - RNA, 19 nt, Homo sapiens
uaaaguuauuggcagugua

SEQ ID NO: 1298070 - RNA, 19 nt, Homo sapiens
cauaucaugguaccuauaa

SEQ ID NO: 1298071 - RNA, 19 nt, Homo sapiens
gaucauguaguaaauguag

SEQ ID NO: 1298072 - RNA, 19 nt, Homo sapiens
agaguauacuguccucgua

SEQ ID NO: 1298073 - RNA, 19 nt, Homo sapiens
ggguagauaucacuagaca

SEQ ID NO: 1298074 - RNA, 19 nt, Homo sapiens
ccugcuggcuguuuggaua

SEQ ID NO: 1298075 - RNA, 19 nt, Homo sapiens
aaaggaacaaccugcaaua

SEQ ID NO: 1298076 - RNA, 19 nt, Homo sapiens
ggugccaaaugcauauaaa

SEQ ID NO: 1298077 - RNA, 19 nt, Homo sapiens
agagaucagugcaaaggaa

SEQ ID NO: 1298078 - RNA, 19 nt, Homo sapiens
gauggugagugguggauag

SEQ ID NO: 1298079 - RNA, 19 nt, Homo sapiens
caggaaguauaauagcaaa

SEQ ID NO: 1298080 - RNA, 19 nt, Homo sapiens
ggucacauauuuucuuuug

SEQ ID NO: 1298081 - RNA, 19 nt, Homo sapiens
uguaaugccuguggacaaa

SEQ ID NO: 1298082 - RNA, 19 nt, Homo sapiens
agaaucgguugugccauua

SEQ ID NO: 1298083 - RNA, 19 nt, Homo sapiens
cgucugcggucccuuguga

SEQ ID NO: 1298084 - RNA, 19 nt, Homo sapiens
gaagaggaccauaaagacu

SEQ ID NO: 1298085 - RNA, 19 nt, Homo sapiens
gugaucauguaguaaaugu

SEQ ID NO: 1298086 - RNA, 19 nt, Homo sapiens
ggaagaggaccauaaagac

SEQ ID NO: 1298087 - RNA, 19 nt, Homo sapiens
gaaaucacggugguuaugu

SEQ ID NO: 1298088 - RNA, 19 nt, Homo sapiens
auucugaucuguccaguau

SEQ ID NO: 1298089 - RNA, 19 nt, Homo sapiens
gcaaaggaacaaccugcaa

SEQ ID NO: 1298090 - RNA, 19 nt, Homo sapiens
gugguaugaugaagugaaa

SEQ ID NO: 1298091 - RNA, 19 nt, Homo sapiens
ggacagccagagcuuucua

SEQ ID NO: 1298092 - RNA, 19 nt, Homo sapiens
gcuguugugugaaacugaa

SEQ ID NO: 1298093 - RNA, 19 nt, Homo sapiens
gugguuauguugauguaau

SEQ ID NO: 1298094 - RNA, 19 nt, Homo sapiens
gaaauccugaggucauuca

SEQ ID NO: 1298095 - RNA, 19 nt, Homo sapiens
gaaugcaacccauauuguc

SEQ ID NO: 1298096 - RNA, 19 nt, Homo sapiens
cauaugaacaugaaugcaa

SEQ ID NO: 1298097 - RNA, 19 nt, Homo sapiens
gaggaaaggcauucagagu

SEQ ID NO: 1298098 - RNA, 19 nt, Homo sapiens
cacagucucuaaaguaaca

SEQ ID NO: 1298099 - RNA, 19 nt, Homo sapiens
caucaaguccaauagaaau

SEQ ID NO: 1298100 - RNA, 19 nt, Homo sapiens
agauaucacuagacaagga

SEQ ID NO: 1298101 - RNA, 19 nt, Homo sapiens
ccaacugcaggucuaauuu

SEQ ID NO: 1298102 - RNA, 19 nt, Homo sapiens
cuacccauaugaacaugaa

SEQ ID NO: 1298103 - RNA, 19 nt, Homo sapiens
gaacauggaccugcaagcu

SEQ ID NO: 1298104 - RNA, 19 nt, Homo sapiens
caacagccucuaauaugga

SEQ ID NO: 1298105 - RNA, 19 nt, Homo sapiens
uauccaacagccucuaaua

SEQ ID NO: 1298106 - RNA, 19 nt, Homo sapiens
uggaagaggaccauaaaga

SEQ ID NO: 1298107 - RNA, 19 nt, Homo sapiens
gaaagaaacuuccucagua

SEQ ID NO: 1298108 - RNA, 19 nt, Homo sapiens
ggacuuggcugaugcuuug

SEQ ID NO: 1298109 - RNA, 19 nt, Homo sapiens
aaacaugcaucucgugaua

SEQ ID NO: 1298110 - RNA, 19 nt, Homo sapiens
gcaaauacuuuaggaaaug

SEQ ID NO: 1298111 - RNA, 19 nt, Homo sapiens
ggauaaguaugaagcaauu

SEQ ID NO: 1298112 - RNA, 19 nt, Homo sapiens
aaagaaacuuccucaguaa

SEQ ID NO: 1298113 - RNA, 19 nt, Homo sapiens
aaacgcaggugacuuugua

SEQ ID NO: 1298114 - RNA, 19 nt, Homo sapiens
ccacagacaucuuacacuu

SEQ ID NO: 1298115 - RNA, 19 nt, Homo sapiens
gcugaggccugaugacauu

SEQ ID NO: 1298116 - RNA, 19 nt, Homo sapiens
caccagagcuccagcaaau

SEQ ID NO: 1298117 - RNA, 19 nt, Homo sapiens
uaacaacucugagcacaug

SEQ ID NO: 1298118 - RNA, 19 nt, Homo sapiens
cugaugacauuuaugcuua

SEQ ID NO: 1298119 - RNA, 19 nt, Homo sapiens
gcguggagcugccugguuu

SEQ ID NO: 1298120 - RNA, 19 nt, Homo sapiens
ugaaaggacugguugaaag

SEQ ID NO: 1298121 - RNA, 19 nt, Homo sapiens
gaauaugugcugucuguga

SEQ ID NO: 1298122 - RNA, 19 nt, Homo sapiens
uagaauaugugcugucugu

SEQ ID NO: 1298123 - RNA, 19 nt, Homo sapiens
gagacuuggugccgaaauu

SEQ ID NO: 1298124 - RNA, 19 nt, Homo sapiens
guuguccacuuuaccuuua

SEQ ID NO: 1298125 - RNA, 19 nt, Homo sapiens
gccagaauccugcuuguuu

SEQ ID NO: 1298126 - RNA, 19 nt, Homo sapiens
cagccugccuccagcuuua

SEQ ID NO: 1298127 - RNA, 19 nt, Homo sapiens
gcaauucguaggccuguuu

SEQ ID NO: 1298128 - RNA, 19 nt, Homo sapiens
gugaaacgcaggugacuuu

SEQ ID NO: 1298129 - RNA, 19 nt, Homo sapiens
ccagaauccugcuuguuug

SEQ ID NO: 1298130 - RNA, 19 nt, Homo sapiens
gaugagcucuggguguuug

SEQ ID NO: 1298131 - RNA, 19 nt, Homo sapiens
gaaccuggaagccguggua

SEQ ID NO: 1298132 - RNA, 19 nt, Homo sapiens
cagcaaauacuuuaggaaa

SEQ ID NO: 1298133 - RNA, 19 nt, Homo sapiens
guccaggugugacuuguaa

SEQ ID NO: 1298134 - RNA, 19 nt, Homo sapiens
gaaaggacugguugaaagu

SEQ ID NO: 1298135 - RNA, 19 nt, Homo sapiens
cuagagcugugacguagaa

SEQ ID NO: 1298136 - RNA, 19 nt, Homo sapiens
gcugugacguagaauaugu

SEQ ID NO: 1298137 - RNA, 19 nt, Homo sapiens
gagcugugacguagaauau

SEQ ID NO: 1298138 - RNA, 19 nt, Homo sapiens
gaaagcacuucugaaagca

SEQ ID NO: 1298139 - RNA, 19 nt, Homo sapiens
gaagggagagaaccuggaa

SEQ ID NO: 1298140 - RNA, 19 nt, Homo sapiens
ugacugcaguugagagaga

SEQ ID NO: 1298141 - RNA, 19 nt, Homo sapiens
gacauucgcuugguuuagu

SEQ ID NO: 1298142 - RNA, 19 nt, Homo sapiens
gauagucaguuugcugugu

SEQ ID NO: 1298143 - RNA, 19 nt, Homo sapiens
gcggaggcuuucagugauu

SEQ ID NO: 1298144 - RNA, 19 nt, Homo sapiens
ggauuggacuuggcugaug

SEQ ID NO: 1298145 - RNA, 19 nt, Homo sapiens
ggugugacuuguaaacugu

SEQ ID NO: 1298146 - RNA, 19 nt, Homo sapiens
gcacccaggaugaugguuu

SEQ ID NO: 1298147 - RNA, 19 nt, Homo sapiens
gaagucacagcucaaggaa

SEQ ID NO: 1298148 - RNA, 19 nt, Homo sapiens
gaauccugcuuguuugcuu

SEQ ID NO: 1298149 - RNA, 19 nt, Homo sapiens
ggaugaugguuucacuuca

SEQ ID NO: 1298150 - RNA, 19 nt, Homo sapiens
ggcagagccuggcaccauu

SEQ ID NO: 1298151 - RNA, 19 nt, Homo sapiens
gaggaugcagugaaagaaa

SEQ ID NO: 1298152 - RNA, 19 nt, Homo sapiens
ugaaagaaacuuccucagu

SEQ ID NO: 1298153 - RNA, 19 nt, Homo sapiens
uagcaagagugaccgaugu

SEQ ID NO: 1298154 - RNA, 19 nt, Homo sapiens
uggaagccgugguauguga

SEQ ID NO: 1298155 - RNA, 19 nt, Homo sapiens
cuuguaaacugucuagugu

SEQ ID NO: 1298156 - RNA, 19 nt, Homo sapiens
agaauucccuguacaucug

SEQ ID NO: 1298157 - RNA, 19 nt, Homo sapiens
agucacagcucaaggaaag

SEQ ID NO: 1298158 - RNA, 19 nt, Homo sapiens
ggagguggcuauggaggau

SEQ ID NO: 1298159 - RNA, 19 nt, Homo sapiens
ccagacaggcaggaucuua

SEQ ID NO: 1298160 - RNA, 19 nt, Homo sapiens
gagacauucgcuugguuua

SEQ ID NO: 1298161 - RNA, 19 nt, Homo sapiens
ccuggaggaugcagugaaa

SEQ ID NO: 1298162 - RNA, 19 nt, Homo sapiens
ugacaaggguaaaggugau

SEQ ID NO: 1298163 - RNA, 19 nt, Homo sapiens
caccaugugucuaucugaa

SEQ ID NO: 1298164 - RNA, 19 nt, Homo sapiens
ccacugagcgggauugucu

SEQ ID NO: 1298165 - RNA, 19 nt, Homo sapiens
ccaaguaacaccacacaca

SEQ ID NO: 1298166 - RNA, 19 nt, Homo sapiens
cggaugagcucuggguguu

SEQ ID NO: 1298167 - RNA, 19 nt, Homo sapiens
caacgcagacuacgugaag

SEQ ID NO: 1298168 - RNA, 19 nt, Homo sapiens
gagaauacaaaccugacaa

SEQ ID NO: 1298169 - RNA, 19 nt, Homo sapiens
gaaacuuccucaguaaagc

SEQ ID NO: 1298170 - RNA, 19 nt, Homo sapiens
cuugagagcuuaggaaucu

SEQ ID NO: 1298171 - RNA, 19 nt, Homo sapiens
gaugaugguuucacuucag

SEQ ID NO: 1298172 - RNA, 19 nt, Homo sapiens
ugucuaguguuugcauuaa

SEQ ID NO: 1298173 - RNA, 19 nt, Homo sapiens
ggacugaucucaaaauucc

SEQ ID NO: 1298174 - RNA, 19 nt, Homo sapiens
gguugaaaguggccaaucu

SEQ ID NO: 1298175 - RNA, 19 nt, Homo sapiens
ucaguuugcugugucagaa

SEQ ID NO: 1298176 - RNA, 19 nt, Homo sapiens
ccggugagcucuguuguca

SEQ ID NO: 1298177 - RNA, 19 nt, Homo sapiens
ugauaguccugccuugaga

SEQ ID NO: 1298178 - RNA, 19 nt, Homo sapiens
gaugauggccgcaggaaac

SEQ ID NO: 1298179 - RNA, 19 nt, Homo sapiens
gaugauggccgcaggaaac

SEQ ID NO: 1298180 - RNA, 19 nt, Homo sapiens
uucauaggcuguccacuga

SEQ ID NO: 1298181 - RNA, 19 nt, Homo sapiens
gaaacgcaggugacuuugu

SEQ ID NO: 1298182 - RNA, 19 nt, Homo sapiens
aauccugcuuguuugcuua

SEQ ID NO: 1298183 - RNA, 19 nt, Homo sapiens
uuucccaucugauuccaua

SEQ ID NO: 1298184 - RNA, 19 nt, Homo sapiens
gagcuccagcaaauacuuu

SEQ ID NO: 1298185 - RNA, 19 nt, Homo sapiens
caggaaaccggguauagga

SEQ ID NO: 1298186 - RNA, 19 nt, Homo sapiens
cagcuuaauuuggcagaga

SEQ ID NO: 1298187 - RNA, 19 nt, Homo sapiens
gcgaggaucuggggacuuu

SEQ ID NO: 1298188 - RNA, 19 nt, Homo sapiens
uaaggaaaccacuggaauc

SEQ ID NO: 1298189 - RNA, 19 nt, Homo sapiens
ggaggaugcagugaaagaa

SEQ ID NO: 1298190 - RNA, 19 nt, Homo sapiens
gaaccggucagcaccaagu

SEQ ID NO: 1298191 - RNA, 19 nt, Homo sapiens
ggaggaagagagagaugga

SEQ ID NO: 1298192 - RNA, 19 nt, Homo sapiens
gguauaggaggaagagaga

SEQ ID NO: 1298193 - RNA, 19 nt, Homo sapiens
uaacgcaugccucguguuc

SEQ ID NO: 1298194 - RNA, 19 nt, Homo sapiens
gaggccugaugacauuuau

SEQ ID NO: 1298195 - RNA, 19 nt, Homo sapiens
ugaaagcagauaugaguca

SEQ ID NO: 1298196 - RNA, 19 nt, Homo sapiens
gagcaucaaagccagaauc

SEQ ID NO: 1298197 - RNA, 19 nt, Homo sapiens
gucaagaacgagcaucaaa

SEQ ID NO: 1298198 - RNA, 19 nt, Homo sapiens
gguguggccuucggguuga

SEQ ID NO: 1298199 - RNA, 19 nt, Homo sapiens
ugaagucacagcucaagga

SEQ ID NO: 1298200 - RNA, 19 nt, Homo sapiens
aaagagacauucgcuuggu

SEQ ID NO: 1298201 - RNA, 19 nt, Homo sapiens
gcagagccuggcaccauug

SEQ ID NO: 1298202 - RNA, 19 nt, Homo sapiens
ucgagaagcuucccaugcu

SEQ ID NO: 1298203 - RNA, 19 nt, Homo sapiens
gaagagagagauggaacca

SEQ ID NO: 1298204 - RNA, 19 nt, Homo sapiens
gaaucuuccggauaaguau

SEQ ID NO: 1298205 - RNA, 19 nt, Homo sapiens
cgaaccagcccggaucuga

SEQ ID NO: 1298206 - RNA, 19 nt, Homo sapiens
gcaugccucguguucguuu

SEQ ID NO: 1298207 - RNA, 19 nt, Homo sapiens
gaacacaccuugucaguga

SEQ ID NO: 1298208 - RNA, 19 nt, Homo sapiens
gaauaugccucuaaaggaa

SEQ ID NO: 1298209 - RNA, 19 nt, Homo sapiens
gaucaugucuucagaacuu

SEQ ID NO: 1298210 - RNA, 19 nt, Homo sapiens
gaagaucaguggucaacuu

SEQ ID NO: 1298211 - RNA, 19 nt, Homo sapiens
ccacagcagucuaauauug

SEQ ID NO: 1298212 - RNA, 19 nt, Homo sapiens
guccauagcugcagugaaa

SEQ ID NO: 1298213 - RNA, 19 nt, Homo sapiens
gcacaaacccucacaauac

SEQ ID NO: 1298214 - RNA, 19 nt, Homo sapiens
gcagucaucuuuugauuua

SEQ ID NO: 1298215 - RNA, 19 nt, Homo sapiens
gaacuuauuccuagauuug

SEQ ID NO: 1298216 - RNA, 19 nt, Homo sapiens
gcagagccuugcaauauga

SEQ ID NO: 1298217 - RNA, 19 nt, Homo sapiens
gauguaaacuucucuccuu

SEQ ID NO: 1298218 - RNA, 19 nt, Homo sapiens
gacuuaacauggacucuua

SEQ ID NO: 1298219 - RNA, 19 nt, Homo sapiens
caacugguauuucauuaga

SEQ ID NO: 1298220 - RNA, 19 nt, Homo sapiens
uaagauugcugguacuauu

SEQ ID NO: 1298221 - RNA, 19 nt, Homo sapiens
gagcuaauuugaaaguuga

SEQ ID NO: 1298222 - RNA, 19 nt, Homo sapiens
ccaguaaugucuuagauug

SEQ ID NO: 1298223 - RNA, 19 nt, Homo sapiens
gagaagcccugaaggacaa

SEQ ID NO: 1298224 - RNA, 19 nt, Homo sapiens
gaacacauccugucucuac

SEQ ID NO: 1298225 - RNA, 19 nt, Homo sapiens
ucuaaucccuuucuaugua

SEQ ID NO: 1298226 - RNA, 19 nt, Homo sapiens
gacauugccuacaggauuu

SEQ ID NO: 1298227 - RNA, 19 nt, Homo sapiens
gaagcuaguagauugguua

SEQ ID NO: 1298228 - RNA, 19 nt, Homo sapiens
gcuauggaaugaacuuauu

SEQ ID NO: 1298229 - RNA, 19 nt, Homo sapiens
ggauauuggucccauucua

SEQ ID NO: 1298230 - RNA, 19 nt, Homo sapiens
ggacaaauuacguguguga

SEQ ID NO: 1298231 - RNA, 19 nt, Homo sapiens
gaaccucgauauucugaca

SEQ ID NO: 1298232 - RNA, 19 nt, Homo sapiens
gaacuuagaugugaaaauc

SEQ ID NO: 1298233 - RNA, 19 nt, Homo sapiens
ggacucuuauaggguauua

SEQ ID NO: 1298234 - RNA, 19 nt, Homo sapiens
aagccgaggucucaauaua

SEQ ID NO: 1298235 - RNA, 19 nt, Homo sapiens
gagcagagcagacuugauc

SEQ ID NO: 1298236 - RNA, 19 nt, Homo sapiens
ggaaauaugaaccuuugaa

SEQ ID NO: 1298237 - RNA, 19 nt, Homo sapiens
cagcagagccuugcaauau

SEQ ID NO: 1298238 - RNA, 19 nt, Homo sapiens
guuggcaucuugguaaaua

SEQ ID NO: 1298239 - RNA, 19 nt, Homo sapiens
guaguuguuuguuuccuuu

SEQ ID NO: 1298240 - RNA, 19 nt, Homo sapiens
gacgugaacuuugauguau

SEQ ID NO: 1298241 - RNA, 19 nt, Homo sapiens
cauauaaagccaaccauuu

SEQ ID NO: 1298242 - RNA, 19 nt, Homo sapiens
uuucaaaucugcuauggaa

SEQ ID NO: 1298243 - RNA, 19 nt, Homo sapiens
agccuacgcugaagaguua

SEQ ID NO: 1298244 - RNA, 19 nt, Homo sapiens
caacagaugggauuggaaa

SEQ ID NO: 1298245 - RNA, 19 nt, Homo sapiens
gggcaaacaugcugauugg

SEQ ID NO: 1298246 - RNA, 19 nt, Homo sapiens
cgugaacuuugauguauaa

SEQ ID NO: 1298247 - RNA, 19 nt, Homo sapiens
caaaucugcuauggaauga

SEQ ID NO: 1298248 - RNA, 19 nt, Homo sapiens
ugucaggucuuauaauuuc

SEQ ID NO: 1298249 - RNA, 19 nt, Homo sapiens
ggaauccucuugacuucau

SEQ ID NO: 1298250 - RNA, 19 nt, Homo sapiens
agagaaaccugcagucauc

SEQ ID NO: 1298251 - RNA, 19 nt, Homo sapiens
gcaagccgaggucucaaua

SEQ ID NO: 1298252 - RNA, 19 nt, Homo sapiens
cuucagaacuuagauguga

SEQ ID NO: 1298253 - RNA, 19 nt, Homo sapiens
cuaagcuguuugaaaguua

SEQ ID NO: 1298254 - RNA, 19 nt, Homo sapiens
gguuguugcuaaagacaua

SEQ ID NO: 1298255 - RNA, 19 nt, Homo sapiens
gaugugacuugcacucaga

SEQ ID NO: 1298256 - RNA, 19 nt, Homo sapiens
gaaaccugcagucaucuuu

SEQ ID NO: 1298257 - RNA, 19 nt, Homo sapiens
ggauggcacaggaucaaua

SEQ ID NO: 1298258 - RNA, 19 nt, Homo sapiens
aggcaauucuuguggauaa

SEQ ID NO: 1298259 - RNA, 19 nt, Homo sapiens
gacaagcucugggacauca

SEQ ID NO: 1298260 - RNA, 19 nt, Homo sapiens
uaaauaacguggguguguu

SEQ ID NO: 1298261 - RNA, 19 nt, Homo sapiens
gccgaggucucaauauaau

SEQ ID NO: 1298262 - RNA, 19 nt, Homo sapiens
aagcaucacugucaucugu

SEQ ID NO: 1298263 - RNA, 19 nt, Homo sapiens
ugcagaagcuaguagauug

SEQ ID NO: 1298264 - RNA, 19 nt, Homo sapiens
ccaguagcauuauugauag

SEQ ID NO: 1298265 - RNA, 19 nt, Homo sapiens
cagauuggccuuaagagaa

SEQ ID NO: 1298266 - RNA, 19 nt, Homo sapiens
gauauuggucccauucuau

SEQ ID NO: 1298267 - RNA, 19 nt, Homo sapiens
ggucagguaguuauaugua

SEQ ID NO: 1298268 - RNA, 19 nt, Homo sapiens
gcuaguagauugguuaaaa

SEQ ID NO: 1298269 - RNA, 19 nt, Homo sapiens
gcagauuggccuuaagaga

SEQ ID NO: 1298270 - RNA, 19 nt, Homo sapiens
caagaaagacuacugaaaa

SEQ ID NO: 1298271 - RNA, 19 nt, Homo sapiens
ugacauugccuacaggauu

SEQ ID NO: 1298272 - RNA, 19 nt, Homo sapiens
ccauguaccuagugcuuug

SEQ ID NO: 1298273 - RNA, 19 nt, Homo sapiens
caaauuacgugugugacau

SEQ ID NO: 1298274 - RNA, 19 nt, Homo sapiens
uccaguagcauuauugaua

SEQ ID NO: 1298275 - RNA, 19 nt, Homo sapiens
cuaaauaagccuaccaaau

SEQ ID NO: 1298276 - RNA, 19 nt, Homo sapiens
aaaugugcaucaagaaaga

SEQ ID NO: 1298277 - RNA, 19 nt, Homo sapiens
gauggcacaggaucaauaa

SEQ ID NO: 1298278 - RNA, 19 nt, Homo sapiens
cacaguauaugccugaaug

SEQ ID NO: 1298279 - RNA, 19 nt, Homo sapiens
caaaguggaaacugauauu

SEQ ID NO: 1298280 - RNA, 19 nt, Homo sapiens
cguacaaaguggaaacuga

SEQ ID NO: 1298281 - RNA, 19 nt, Homo sapiens
acauugacgugaacuuuga

SEQ ID NO: 1298282 - RNA, 19 nt, Homo sapiens
cuuuagagcuuguuauauc

SEQ ID NO: 1298283 - RNA, 19 nt, Homo sapiens
guaaauaacgugggugugu

SEQ ID NO: 1298284 - RNA, 19 nt, Homo sapiens
ugggaaauaugaaccuuug

SEQ ID NO: 1298285 - RNA, 19 nt, Homo sapiens
gugaaaauauggucaggua

SEQ ID NO: 1298286 - RNA, 19 nt, Homo sapiens
acgcuuagaucaugucuuc

SEQ ID NO: 1298287 - RNA, 19 nt, Homo sapiens
cacaauacgcguuaacauu

SEQ ID NO: 1298288 - RNA, 19 nt, Homo sapiens
ucaagaaagacuacugaaa

SEQ ID NO: 1298289 - RNA, 19 nt, Homo sapiens
cagcagcggucgugagauc

SEQ ID NO: 1298290 - RNA, 19 nt, Homo sapiens
gggaacacauccugucucu

SEQ ID NO: 1298291 - RNA, 19 nt, Homo sapiens
uuaagaaugugggaaauag

SEQ ID NO: 1298292 - RNA, 19 nt, Homo sapiens
aagguuacgugguccagua

SEQ ID NO: 1298293 - RNA, 19 nt, Homo sapiens
ugacgugaacuuugaugua

SEQ ID NO: 1298294 - RNA, 19 nt, Homo sapiens
gcagaccuaagcacaguuu

SEQ ID NO: 1298295 - RNA, 19 nt, Homo sapiens
gaagcuuauucuugguuug

SEQ ID NO: 1298296 - RNA, 19 nt, Homo sapiens
gaucaagcaguauggaaga

SEQ ID NO: 1298297 - RNA, 19 nt, Homo sapiens
uaugauuugucaggucuua

SEQ ID NO: 1298298 - RNA, 19 nt, Homo sapiens
ugauggaguuugcuuggaa

SEQ ID NO: 1298299 - RNA, 19 nt, Homo sapiens
gcuguugguuugccaugaa

SEQ ID NO: 1298300 - RNA, 19 nt, Homo sapiens
gagccacagcagucuaaua

SEQ ID NO: 1298301 - RNA, 19 nt, Homo sapiens
ugaauaugccucuaaagga

SEQ ID NO: 1298302 - RNA, 19 nt, Homo sapiens
ccacauugacgugaacuuu

SEQ ID NO: 1298303 - RNA, 19 nt, Homo sapiens
cuacaggauuuccagaugu

SEQ ID NO: 1298304 - RNA, 19 nt, Homo sapiens
gaaauuuagcccuuuagag

SEQ ID NO: 1298305 - RNA, 19 nt, Homo sapiens
ucaaaucugcuauggaaug

SEQ ID NO: 1298306 - RNA, 19 nt, Homo sapiens
gguuugccaugaaugauau

SEQ ID NO: 1298307 - RNA, 19 nt, Homo sapiens
gaacugaauuugauuggaa

SEQ ID NO: 1298308 - RNA, 19 nt, Homo sapiens
ugacgaagcugcucaggua

SEQ ID NO: 1298309 - RNA, 19 nt, Homo sapiens
ggaccgaccugggaaauuu

SEQ ID NO: 1298310 - RNA, 19 nt, Homo sapiens
gaaauuuccacuagaguuu

SEQ ID NO: 1298311 - RNA, 19 nt, Homo sapiens
gaauuugauuggaaaggaa

SEQ ID NO: 1298312 - RNA, 19 nt, Homo sapiens
gagggaggcugaaggugaa

SEQ ID NO: 1298313 - RNA, 19 nt, Homo sapiens
cagaggagaucuucaacug

SEQ ID NO: 1298314 - RNA, 19 nt, Homo sapiens
agacagagaagacaaguga

SEQ ID NO: 1298315 - RNA, 19 nt, Homo sapiens
ccacgugccuggcucugaa

SEQ ID NO: 1298316 - RNA, 19 nt, Homo sapiens
gugguuaccucaaagacaa

SEQ ID NO: 1298317 - RNA, 19 nt, Homo sapiens
gggagugccugacaugaca

SEQ ID NO: 1298318 - RNA, 19 nt, Homo sapiens
gagccacccuucaggaauc

SEQ ID NO: 1298319 - RNA, 19 nt, Homo sapiens
gagaggagcaggugaagca

SEQ ID NO: 1298320 - RNA, 19 nt, Homo sapiens
gacaauugccuccaguuug

SEQ ID NO: 1298321 - RNA, 19 nt, Homo sapiens
caacuauccauggcucuua

SEQ ID NO: 1298322 - RNA, 19 nt, Homo sapiens
acauccggcucacauauuu

SEQ ID NO: 1298323 - RNA, 19 nt, Homo sapiens
gaugaaggcucagcucaac

SEQ ID NO: 1298324 - RNA, 19 nt, Homo sapiens
gggcucagcucuggcucua

SEQ ID NO: 1298325 - RNA, 19 nt, Homo sapiens
gagcgaggacuccaucuuc

SEQ ID NO: 1298326 - RNA, 19 nt, Homo sapiens
acaauugccuccaguuugg

SEQ ID NO: 1298327 - RNA, 19 nt, Homo sapiens
ccaugucacugccuacugu

SEQ ID NO: 1298328 - RNA, 19 nt, Homo sapiens
cuccagagcucaacacagu

SEQ ID NO: 1298329 - RNA, 19 nt, Homo sapiens
gggcagaggagaucuucaa

SEQ ID NO: 1298330 - RNA, 19 nt, Homo sapiens
gcugugaagcugaaaauua

SEQ ID NO: 1298331 - RNA, 19 nt, Homo sapiens
ugaauuugauuggaaagga

SEQ ID NO: 1298332 - RNA, 19 nt, Homo sapiens
agaagguggugucagcaaa

SEQ ID NO: 1298333 - RNA, 19 nt, Homo sapiens
ggacuucuccgaaccuucu

SEQ ID NO: 1298334 - RNA, 19 nt, Homo sapiens
agaaauguuugcugaacug

SEQ ID NO: 1298335 - RNA, 19 nt, Homo sapiens
gcucuuagccagaaauguc

SEQ ID NO: 1298336 - RNA, 19 nt, Homo sapiens
aagcgcagccuguacauga

SEQ ID NO: 1298337 - RNA, 19 nt, Homo sapiens
uugcugaacugaauuugau

SEQ ID NO: 1298338 - RNA, 19 nt, Homo sapiens
acagagaagacaagugaaa

SEQ ID NO: 1298339 - RNA, 19 nt, Homo sapiens
ccagaaauguuugcugaac

SEQ ID NO: 1298340 - RNA, 19 nt, Homo sapiens
cggccucucugcugacuga

SEQ ID NO: 1298341 - RNA, 19 nt, Homo sapiens
gggaggccguggacaaucu

SEQ ID NO: 1298342 - RNA, 19 nt, Homo sapiens
aauguuugcugaacugaau

SEQ ID NO: 1298343 - RNA, 19 nt, Homo sapiens
ggaugaaggcucagcucaa

SEQ ID NO: 1298344 - RNA, 19 nt, Homo sapiens
agacaauugccuccaguuu

SEQ ID NO: 1298345 - RNA, 19 nt, Homo sapiens
caggcgcacucccgacauu

SEQ ID NO: 1298346 - RNA, 19 nt, Homo sapiens
cgaagcugcucagguacuu

SEQ ID NO: 1298347 - RNA, 19 nt, Homo sapiens
gggagcggcugaccaucau

SEQ ID NO: 1298348 - RNA, 19 nt, Homo sapiens
ggaccuuuguggugaagag

SEQ ID NO: 1298349 - RNA, 19 nt, Homo sapiens
gucccaagcucacguguac

SEQ ID NO: 1298350 - RNA, 19 nt, Homo sapiens
gagggaccuuuguggugaa

SEQ ID NO: 1298351 - RNA, 19 nt, Homo sapiens
gcucaacacaguaccagau

SEQ ID NO: 1298352 - RNA, 19 nt, Homo sapiens
cugcucagguacuuuguga

SEQ ID NO: 1298353 - RNA, 19 nt, Homo sapiens
cgcgguggcucacgucuau

SEQ ID NO: 1298354 - RNA, 19 nt, Homo sapiens
gagaagguggugucagcaa

SEQ ID NO: 1298355 - RNA, 19 nt, Homo sapiens
ucacauccggcucacauau

SEQ ID NO: 1298356 - RNA, 19 nt, Homo sapiens
uaggagggcuggccagaac

SEQ ID NO: 1298357 - RNA, 19 nt, Homo sapiens
gugaggcugugaagcugaa

SEQ ID NO: 1298358 - RNA, 19 nt, Homo sapiens
acucaagucccaucccuuu

SEQ ID NO: 1298359 - RNA, 19 nt, Homo sapiens
ugaaagcgcagccuguaca

SEQ ID NO: 1298360 - RNA, 19 nt, Homo sapiens
ugagagaggagcaggugaa

SEQ ID NO: 1298361 - RNA, 19 nt, Homo sapiens
gaaauguuugcugaacuga

SEQ ID NO: 1298362 - RNA, 19 nt, Homo sapiens
cagaugcuccagaaauguu

SEQ ID NO: 1298363 - RNA, 19 nt, Homo sapiens
ggcccuggcuguuuaccau

SEQ ID NO: 1298364 - RNA, 19 nt, Homo sapiens
uugggucucuacuguauga

SEQ ID NO: 1298365 - RNA, 19 nt, Homo sapiens
ggucacauccggcucacau

SEQ ID NO: 1298366 - RNA, 19 nt, Homo sapiens
cagaaauguuugcugaacu

SEQ ID NO: 1298367 - RNA, 19 nt, Homo sapiens
accagaugcuccagaaaug

SEQ ID NO: 1298368 - RNA, 19 nt, Homo sapiens
caccugcaccuucaagcua

SEQ ID NO: 1298369 - RNA, 19 nt, Homo sapiens
gaaagcgcagccuguacau

SEQ ID NO: 1298370 - RNA, 19 nt, Homo sapiens
gaggcagacggaucacuug

SEQ ID NO: 1298371 - RNA, 19 nt, Homo sapiens
gcugaacugaauuugauug

SEQ ID NO: 1298372 - RNA, 19 nt, Homo sapiens
ucugaaggcccaacuguca

SEQ ID NO: 1298373 - RNA, 19 nt, Homo sapiens
ugaacugaauuugauugga

SEQ ID NO: 1298374 - RNA, 19 nt, Homo sapiens
gaacugcugacgggaaugg

SEQ ID NO: 1298375 - RNA, 19 nt, Homo sapiens
gggcuggccagaacucaga

SEQ ID NO: 1298376 - RNA, 19 nt, Homo sapiens
gacaaaacgugacuaucug

SEQ ID NO: 1298377 - RNA, 19 nt, Homo sapiens
gcucugaaggcccaacugu

SEQ ID NO: 1298378 - RNA, 19 nt, Homo sapiens
uaccagaugcuccagaaau

SEQ ID NO: 1298379 - RNA, 19 nt, Homo sapiens
ggucucuacuguaugaacu

SEQ ID NO: 1298380 - RNA, 19 nt, Homo sapiens
cuuugggucucuacuguau

SEQ ID NO: 1298381 - RNA, 19 nt, Homo sapiens
aguaccagaugcuccagaa

SEQ ID NO: 1298382 - RNA, 19 nt, Homo sapiens
cgaggcagacggaucacuu

SEQ ID NO: 1298383 - RNA, 19 nt, Homo sapiens
gcccuggagcgcgauguua

SEQ ID NO: 1298384 - RNA, 19 nt, Homo sapiens
ccagguggcgcuucugaca

SEQ ID NO: 1298385 - RNA, 19 nt, Homo sapiens
gguggugucagcaaacuca

SEQ ID NO: 1298386 - RNA, 19 nt, Homo sapiens
gaagguggugucagcaaac

SEQ ID NO: 1298387 - RNA, 19 nt, Homo sapiens
gcaaccggagggaccuuug

SEQ ID NO: 1298388 - RNA, 19 nt, Homo sapiens
gcagaggagaucuucaacu

SEQ ID NO: 1298389 - RNA, 19 nt, Homo sapiens
gggcuccucucaggguuca

SEQ ID NO: 1298390 - RNA, 19 nt, Homo sapiens
aaacgcauggaacaacuau

SEQ ID NO: 1298391 - RNA, 19 nt, Homo sapiens
cagagccacccuucaggaa

SEQ ID NO: 1298392 - RNA, 19 nt, Homo sapiens
ccaccuggagugugagaga

SEQ ID NO: 1298393 - RNA, 19 nt, Homo sapiens
aaagccugcucuggccuaa

SEQ ID NO: 1298394 - RNA, 19 nt, Homo sapiens
ggucccaagcucacgugua

SEQ ID NO: 1298395 - RNA, 19 nt, Homo sapiens
ucacuugaggucaggaguu

SEQ ID NO: 1298396 - RNA, 19 nt, Homo sapiens
ccagaggugggugggauuu

SEQ ID NO: 1298397 - RNA, 19 nt, Homo sapiens
gaagcugcucagguacuuu

SEQ ID NO: 1298398 - RNA, 19 nt, Homo sapiens
guaccagaugcuccagaaa

SEQ ID NO: 1298399 - RNA, 19 nt, Homo sapiens
ugccuacugugacuucaug

SEQ ID NO: 1298400 - RNA, 19 nt, Homo sapiens
agacucaucucaggacacu

SEQ ID NO: 1298401 - RNA, 19 nt, Homo sapiens
gagcuuugggucucuacug

SEQ ID NO: 1298402 - RNA, 19 nt, Homo sapiens
ugacaaaacgugacuaucu

SEQ ID NO: 1298403 - RNA, 19 nt, Homo sapiens
cacauccggcucacauauu

SEQ ID NO: 1298404 - RNA, 19 nt, Homo sapiens
ugaaggcccaacugucaga

SEQ ID NO: 1298405 - RNA, 19 nt, Homo sapiens
ccacaaaacgcauggaaca

SEQ ID NO: 1298406 - RNA, 19 nt, Homo sapiens
cacuugaggucaggaguuc

SEQ ID NO: 1298407 - RNA, 19 nt, Homo sapiens
guaaauggcugcagaaagu

SEQ ID NO: 1298408 - RNA, 19 nt, Homo sapiens
gagcuuaccuuauguguuc

SEQ ID NO: 1298409 - RNA, 19 nt, Homo sapiens
ggacaaguauggaauaaag

SEQ ID NO: 1298410 - RNA, 19 nt, Homo sapiens
caccaugccuggcuaauuu

SEQ ID NO: 1298411 - RNA, 19 nt, Homo sapiens
uaagauacuuugugucaug

SEQ ID NO: 1298412 - RNA, 19 nt, Homo sapiens
cuucagagcuuaccuuaug

SEQ ID NO: 1298413 - RNA, 19 nt, Homo sapiens
gauguaauauugcucuguu

SEQ ID NO: 1298414 - RNA, 19 nt, Homo sapiens
gaggacaaguauggaauaa

SEQ ID NO: 1298415 - RNA, 19 nt, Homo sapiens
gcgagacacucaagucgaa

SEQ ID NO: 1298416 - RNA, 19 nt, Homo sapiens
gaccuguucugguuaaaga

SEQ ID NO: 1298417 - RNA, 19 nt, Homo sapiens
caucaguaauacagcaaua

SEQ ID NO: 1298418 - RNA, 19 nt, Homo sapiens
caucaucugugaaggaaga

SEQ ID NO: 1298419 - RNA, 19 nt, Homo sapiens
gguaugaucucaccuuacu

SEQ ID NO: 1298420 - RNA, 19 nt, Homo sapiens
cuucuaagcugcacucuuc

SEQ ID NO: 1298421 - RNA, 19 nt, Homo sapiens
gcaggcacuucagagcuua

SEQ ID NO: 1298422 - RNA, 19 nt, Homo sapiens
ggagugcagugguaugauc

SEQ ID NO: 1298423 - RNA, 19 nt, Homo sapiens
gagcagaagccaauuccuu

SEQ ID NO: 1298424 - RNA, 19 nt, Homo sapiens
gagggaagcugagcagaag

SEQ ID NO: 1298425 - RNA, 19 nt, Homo sapiens
gugguaugaucucaccuua

SEQ ID NO: 1298426 - RNA, 19 nt, Homo sapiens
caucaguaaucucaauaga

SEQ ID NO: 1298427 - RNA, 19 nt, Homo sapiens
ggaauaaaggucacaugga

SEQ ID NO: 1298428 - RNA, 19 nt, Homo sapiens
gaagccaauuccuugugaa

SEQ ID NO: 1298429 - RNA, 19 nt, Homo sapiens
ccaaagcugugggaacaug

SEQ ID NO: 1298430 - RNA, 19 nt, Homo sapiens
gaugugguuucuccauguu

SEQ ID NO: 1298431 - RNA, 19 nt, Homo sapiens
agaagccaauuccuuguga

SEQ ID NO: 1298432 - RNA, 19 nt, Homo sapiens
gccuugaccucacaaagug

SEQ ID NO: 1298433 - RNA, 19 nt, Homo sapiens
gaaaacagccuucuaagcu

SEQ ID NO: 1298434 - RNA, 19 nt, Homo sapiens
cgaggacaaguauggaaua

SEQ ID NO: 1298435 - RNA, 19 nt, Homo sapiens
cacacuggcacuccuaaua

SEQ ID NO: 1298436 - RNA, 19 nt, Homo sapiens
gaccacagcaccaucacuu

SEQ ID NO: 1298437 - RNA, 19 nt, Homo sapiens
acaguucaguuuaguguca

SEQ ID NO: 1298438 - RNA, 19 nt, Homo sapiens
gccuggaccuguucugguu

SEQ ID NO: 1298439 - RNA, 19 nt, Homo sapiens
gaauccugcuuccaucagu

SEQ ID NO: 1298440 - RNA, 19 nt, Homo sapiens
cuacacagcuucccaucac

SEQ ID NO: 1298441 - RNA, 19 nt, Homo sapiens
ucuaagauacuuuguguca

SEQ ID NO: 1298442 - RNA, 19 nt, Homo sapiens
cuaacagcaucaugugguu

SEQ ID NO: 1298443 - RNA, 19 nt, Homo sapiens
aaaggauguuuccagaaga

SEQ ID NO: 1298444 - RNA, 19 nt, Homo sapiens
guucccagccuaccagaaa

SEQ ID NO: 1298445 - RNA, 19 nt, Homo sapiens
ccgccagccuucccagaaa

SEQ ID NO: 1298446 - RNA, 19 nt, Homo sapiens
gcacuucagagcuuaccuu

SEQ ID NO: 1298447 - RNA, 19 nt, Homo sapiens
agcaucaugugguuacuaa

SEQ ID NO: 1298448 - RNA, 19 nt, Homo sapiens
gccgagauuuguuuucuaa

SEQ ID NO: 1298449 - RNA, 19 nt, Homo sapiens
gcagaagccaauuccuugu

SEQ ID NO: 1298450 - RNA, 19 nt, Homo sapiens
ggcauggguuggaauugga

SEQ ID NO: 1298451 - RNA, 19 nt, Homo sapiens
cagaagacccuuaguucca

SEQ ID NO: 1298452 - RNA, 19 nt, Homo sapiens
gcccagccgagauuuguuu

SEQ ID NO: 1298453 - RNA, 19 nt, Homo sapiens
gguuggaauuggagccuau

SEQ ID NO: 1298454 - RNA, 19 nt, Homo sapiens
gucaucaucugugaaggaa

SEQ ID NO: 1298455 - RNA, 19 nt, Homo sapiens
gagaauccugcuuccauca

SEQ ID NO: 1298456 - RNA, 19 nt, Homo sapiens
gggcuggcauggguuggaa

SEQ ID NO: 1298457 - RNA, 19 nt, Homo sapiens
guugaugccucccagaaaa

SEQ ID NO: 1298458 - RNA, 19 nt, Homo sapiens
uaaguaaauggcugcagaa

SEQ ID NO: 1298459 - RNA, 19 nt, Homo sapiens
cgagauuuguuuucuaaga

SEQ ID NO: 1298460 - RNA, 19 nt, Homo sapiens
ccaccaugccuggcuaauu

SEQ ID NO: 1298461 - RNA, 19 nt, Homo sapiens
aggcuggagugcaguggua

SEQ ID NO: 1298462 - RNA, 19 nt, Homo sapiens
ccuaccaccuccaaguuuc

SEQ ID NO: 1298463 - RNA, 19 nt, Homo sapiens
aauccugcuuccaucagua

SEQ ID NO: 1298464 - RNA, 19 nt, Homo sapiens
gauacuuugugucaugaac

SEQ ID NO: 1298465 - RNA, 19 nt, Homo sapiens
ggccuugaccucacaaagu

SEQ ID NO: 1298466 - RNA, 19 nt, Homo sapiens
gccaucaguaaucucaaua

SEQ ID NO: 1298467 - RNA, 19 nt, Homo sapiens
gguugaugccucccagaaa

SEQ ID NO: 1298468 - RNA, 19 nt, Homo sapiens
uagagaauccugcuuccau

SEQ ID NO: 1298469 - RNA, 19 nt, Homo sapiens
aagauacuuugugucauga

SEQ ID NO: 1298470 - RNA, 19 nt, Homo sapiens
uuacuaacuguuccucauu

SEQ ID NO: 1298471 - RNA, 19 nt, Homo sapiens
uaguagagaugugguuucu

SEQ ID NO: 1298472 - RNA, 19 nt, Homo sapiens
uuucuggagucauaaagga

SEQ ID NO: 1298473 - RNA, 19 nt, Homo sapiens
acacuggcacuccuaauag

SEQ ID NO: 1298474 - RNA, 19 nt, Homo sapiens
aaaaggauguuuccagaag

SEQ ID NO: 1298475 - RNA, 19 nt, Homo sapiens
ccuccaaguuuccacaucu

SEQ ID NO: 1298476 - RNA, 19 nt, Homo sapiens
agaugugguuucuccaugu

SEQ ID NO: 1298477 - RNA, 19 nt, Homo sapiens
uacuaacuguuccucauuc

SEQ ID NO: 1298478 - RNA, 19 nt, Homo sapiens
aagcugagcagaagccaau

SEQ ID NO: 1298479 - RNA, 19 nt, Homo sapiens
aagcugcacucuucacacu

SEQ ID NO: 1298480 - RNA, 19 nt, Homo sapiens
agagggaagcugagcagaa

SEQ ID NO: 1298481 - RNA, 19 nt, Homo sapiens
cuggaccuguucugguuaa

SEQ ID NO: 1298482 - RNA, 19 nt, Homo sapiens
ugugaaggaagaacucauu

SEQ ID NO: 1298483 - RNA, 19 nt, Homo sapiens
aaaccuaccaccuccaagu

SEQ ID NO: 1298484 - RNA, 19 nt, Homo sapiens
aaauggcugcagaaaguuu

SEQ ID NO: 1298485 - RNA, 19 nt, Homo sapiens
gugcagugguaugaucuca

SEQ ID NO: 1298486 - RNA, 19 nt, Homo sapiens
ugcaggcacuucagagcuu

SEQ ID NO: 1298487 - RNA, 19 nt, Homo sapiens
cuccaaguuuccacaucua

SEQ ID NO: 1298488 - RNA, 19 nt, Homo sapiens
gaaaaccuaccaccuccaa

SEQ ID NO: 1298489 - RNA, 19 nt, Homo sapiens
uggcauggguuggaauugg

SEQ ID NO: 1298490 - RNA, 19 nt, Homo sapiens
ugccaucaguaaucucaau

SEQ ID NO: 1298491 - RNA, 19 nt, Homo sapiens
gcuggcauggguuggaauu

SEQ ID NO: 1298492 - RNA, 19 nt, Homo sapiens
cacuucagagcuuaccuua

SEQ ID NO: 1298493 - RNA, 19 nt, Homo sapiens
uccagaagacccuuaguuc

SEQ ID NO: 1298494 - RNA, 19 nt, Homo sapiens
gaaggcuaacagcaucaug

SEQ ID NO: 1298495 - RNA, 19 nt, Homo sapiens
cgaaaguucucaccacuaa

SEQ ID NO: 1298496 - RNA, 19 nt, Homo sapiens
gagaagagcggaacaagaa

SEQ ID NO: 1298497 - RNA, 19 nt, Homo sapiens
aagaggcgauuuccuauua

SEQ ID NO: 1298498 - RNA, 19 nt, Homo sapiens
ccaagcagcuggaggaaga

SEQ ID NO: 1298499 - RNA, 19 nt, Homo sapiens
ggagaaagucagcaacuaa

SEQ ID NO: 1298500 - RNA, 19 nt, Homo sapiens
gcagacgacuggaacgauu

SEQ ID NO: 1298501 - RNA, 19 nt, Homo sapiens
gcccagaucugcacauuca

SEQ ID NO: 1298502 - RNA, 19 nt, Homo sapiens
gagcugcccuggaaggauu

SEQ ID NO: 1298503 - RNA, 19 nt, Homo sapiens
cauggaagcaucagaauuu

SEQ ID NO: 1298504 - RNA, 19 nt, Homo sapiens
ggacagagccacagacaag

SEQ ID NO: 1298505 - RNA, 19 nt, Homo sapiens
gcacauucauugcaaccuu

SEQ ID NO: 1298506 - RNA, 19 nt, Homo sapiens
cgacuucccuuuggccaua

SEQ ID NO: 1298507 - RNA, 19 nt, Homo sapiens
uggaagcuguccugaauuu

SEQ ID NO: 1298508 - RNA, 19 nt, Homo sapiens
caacaaagcaggcgacuac

SEQ ID NO: 1298509 - RNA, 19 nt, Homo sapiens
gaaagucagcaacuaauca

SEQ ID NO: 1298510 - RNA, 19 nt, Homo sapiens
uaauguaucuguccagcuu

SEQ ID NO: 1298511 - RNA, 19 nt, Homo sapiens
cgauuacugugaacgguua

SEQ ID NO: 1298512 - RNA, 19 nt, Homo sapiens
gaugguauauaacccaaug

SEQ ID NO: 1298513 - RNA, 19 nt, Homo sapiens
ugaaggauauuacaggaau

SEQ ID NO: 1298514 - RNA, 19 nt, Homo sapiens
ggagaugugugugaaguuc

SEQ ID NO: 1298515 - RNA, 19 nt, Homo sapiens
gcuuggagcugcccuggaa

SEQ ID NO: 1298516 - RNA, 19 nt, Homo sapiens
cagcagacauuacaagaag

SEQ ID NO: 1298517 - RNA, 19 nt, Homo sapiens
ccuuagcccugaagacaua

SEQ ID NO: 1298518 - RNA, 19 nt, Homo sapiens
gaaggauuguguucagcuu

SEQ ID NO: 1298519 - RNA, 19 nt, Homo sapiens
gggccacacugaaggauau

SEQ ID NO: 1298520 - RNA, 19 nt, Homo sapiens
ggaaacccuugcccaguuc

SEQ ID NO: 1298521 - RNA, 19 nt, Homo sapiens
cagcuucugucaucuauca

SEQ ID NO: 1298522 - RNA, 19 nt, Homo sapiens
gagagauggugccguagga

SEQ ID NO: 1298523 - RNA, 19 nt, Homo sapiens
caacuuggcaggagagaug

SEQ ID NO: 1298524 - RNA, 19 nt, Homo sapiens
ccuggaagcuguccugaau

SEQ ID NO: 1298525 - RNA, 19 nt, Homo sapiens
gaaguucagcugaugguau

SEQ ID NO: 1298526 - RNA, 19 nt, Homo sapiens
gaugguugaugccaagaga

SEQ ID NO: 1298527 - RNA, 19 nt, Homo sapiens
aaguucagcugaugguaua

SEQ ID NO: 1298528 - RNA, 19 nt, Homo sapiens
ucaaggagaugugugugaa

SEQ ID NO: 1298529 - RNA, 19 nt, Homo sapiens
gaacuauacguccaagugu

SEQ ID NO: 1298530 - RNA, 19 nt, Homo sapiens
agaaagauguggcccaaag

SEQ ID NO: 1298531 - RNA, 19 nt, Homo sapiens
gagcauggaagcaucagaa

SEQ ID NO: 1298532 - RNA, 19 nt, Homo sapiens
gaacugccuuagcccugaa

SEQ ID NO: 1298533 - RNA, 19 nt, Homo sapiens
gaucggacgugcuaagaac

SEQ ID NO: 1298534 - RNA, 19 nt, Homo sapiens
agaaagaaauggugagcau

SEQ ID NO: 1298535 - RNA, 19 nt, Homo sapiens
ggagaagagcggaacaaga

SEQ ID NO: 1298536 - RNA, 19 nt, Homo sapiens
ccuauuacagcaaguauaa

SEQ ID NO: 1298537 - RNA, 19 nt, Homo sapiens
auaaagaggcgauuuccua

SEQ ID NO: 1298538 - RNA, 19 nt, Homo sapiens
caaucaacaucaaagugaa

SEQ ID NO: 1298539 - RNA, 19 nt, Homo sapiens
aaagaaauggugagcauga

SEQ ID NO: 1298540 - RNA, 19 nt, Homo sapiens
acacagacagcagacauua

SEQ ID NO: 1298541 - RNA, 19 nt, Homo sapiens
aggacucccuggugcauua

SEQ ID NO: 1298542 - RNA, 19 nt, Homo sapiens
gagaaagucagcaacuaau

SEQ ID NO: 1298543 - RNA, 19 nt, Homo sapiens
cccaaagccuagagaacua

SEQ ID NO: 1298544 - RNA, 19 nt, Homo sapiens
uaagaaugcgggagugauu

SEQ ID NO: 1298545 - RNA, 19 nt, Homo sapiens
gauaaccugccgggaauaa

SEQ ID NO: 1298546 - RNA, 19 nt, Homo sapiens
ucaggcaugugaaacuauu

SEQ ID NO: 1298547 - RNA, 19 nt, Homo sapiens
ucaaagugaagcuggauuu

SEQ ID NO: 1298548 - RNA, 19 nt, Homo sapiens
gcuggaagcuagaggaaac

SEQ ID NO: 1298549 - RNA, 19 nt, Homo sapiens
gcaagucugcguucuucaa

SEQ ID NO: 1298550 - RNA, 19 nt, Homo sapiens
gagcugcugcguucuguga

SEQ ID NO: 1298551 - RNA, 19 nt, Homo sapiens
ggugaugaaauaucuacua

SEQ ID NO: 1298552 - RNA, 19 nt, Homo sapiens
guggagggccugcuacaaa

SEQ ID NO: 1298553 - RNA, 19 nt, Homo sapiens
guacguguccuugcaauuc

SEQ ID NO: 1298554 - RNA, 19 nt, Homo sapiens
acaaucaacaucaaaguga

SEQ ID NO: 1298555 - RNA, 19 nt, Homo sapiens
gcauggaagcaucagaauu

SEQ ID NO: 1298556 - RNA, 19 nt, Homo sapiens
uaaagaggcgauuuccuau

SEQ ID NO: 1298557 - RNA, 19 nt, Homo sapiens
gaagucgagccgucuguau

SEQ ID NO: 1298558 - RNA, 19 nt, Homo sapiens
ccaaugccguuugaacuuc

SEQ ID NO: 1298559 - RNA, 19 nt, Homo sapiens
cgucaggcaugugaaacua

SEQ ID NO: 1298560 - RNA, 19 nt, Homo sapiens
ucaccaagcuucccaucgu

SEQ ID NO: 1298561 - RNA, 19 nt, Homo sapiens
aggaaacccuugcccaguu

SEQ ID NO: 1298562 - RNA, 19 nt, Homo sapiens
gcacacaaccguggagaag

SEQ ID NO: 1298563 - RNA, 19 nt, Homo sapiens
agaacggcgugcacaacua

SEQ ID NO: 1298564 - RNA, 19 nt, Homo sapiens
uggagaaagucagcaacua

SEQ ID NO: 1298565 - RNA, 19 nt, Homo sapiens
gugacuguuugcuggauaa

SEQ ID NO: 1298566 - RNA, 19 nt, Homo sapiens
cuauucaaguggacaaguu

SEQ ID NO: 1298567 - RNA, 19 nt, Homo sapiens
gaaggauauuacaggaauc

SEQ ID NO: 1298568 - RNA, 19 nt, Homo sapiens
ggacacagacagcagacau

SEQ ID NO: 1298569 - RNA, 19 nt, Homo sapiens
uggauaaccugccgggaau

SEQ ID NO: 1298570 - RNA, 19 nt, Homo sapiens
gcaaugagcaaggccuuca

SEQ ID NO: 1298571 - RNA, 19 nt, Homo sapiens
ggaaaauauuggaauggaa

SEQ ID NO: 1298572 - RNA, 19 nt, Homo sapiens
gaguggaguucgagucucu

SEQ ID NO: 1298573 - RNA, 19 nt, Homo sapiens
acacaaccguggagaagag

SEQ ID NO: 1298574 - RNA, 19 nt, Homo sapiens
gaggcgauuuccuauuaca

SEQ ID NO: 1298575 - RNA, 19 nt, Homo sapiens
cugaagacauaauugacaa

SEQ ID NO: 1298576 - RNA, 19 nt, Homo sapiens
ggaucucagugaugaugga

SEQ ID NO: 1298577 - RNA, 19 nt, Homo sapiens
guguucagcuucugucauc

SEQ ID NO: 1298578 - RNA, 19 nt, Homo sapiens
ggucagaacgugucaacca

SEQ ID NO: 1298579 - RNA, 19 nt, Homo sapiens
gaacggcgugcacaacuac

SEQ ID NO: 1298580 - RNA, 19 nt, Homo sapiens
ugcaggaucucagugauga

SEQ ID NO: 1298581 - RNA, 19 nt, Homo sapiens
ccagaucugcacauucauu

SEQ ID NO: 1298582 - RNA, 19 nt, Homo sapiens
gucagaacgugucaaccaa

SEQ ID NO: 1298583 - RNA, 19 nt, Homo sapiens
cuauugaaccuuccugcua

SEQ ID NO: 1298584 - RNA, 19 nt, Homo sapiens
cuacaaacuccuccuggaa

SEQ ID NO: 1298585 - RNA, 19 nt, Homo sapiens
gaagacauaauugacaagu

SEQ ID NO: 1298586 - RNA, 19 nt, Homo sapiens
cuacuuccgucccucuuuc

SEQ ID NO: 1298587 - RNA, 19 nt, Homo sapiens
gagcagcgaggcacucauc

SEQ ID NO: 1298588 - RNA, 19 nt, Homo sapiens
gaaaguucucaccacuaaa

SEQ ID NO: 1298589 - RNA, 19 nt, Homo sapiens
ggucuucgguguguucagu

SEQ ID NO: 1298590 - RNA, 19 nt, Homo sapiens
ccaguggguucaaggagau

SEQ ID NO: 1298591 - RNA, 19 nt, Homo sapiens
gacagcagacauuacaaga

SEQ ID NO: 1298592 - RNA, 19 nt, Homo sapiens
gcccugaagacauaauuga

SEQ ID NO: 1298593 - RNA, 19 nt, Homo sapiens
gaagguggccacguucaca

SEQ ID NO: 1298594 - RNA, 19 nt, Homo sapiens
cgacuggaacgauuacugu

SEQ ID NO: 1298595 - RNA, 19 nt, Homo sapiens
ggaaagggcuaccaugaga

SEQ ID NO: 1298596 - RNA, 19 nt, Homo sapiens
gcaggaaggucccguggua

SEQ ID NO: 1298597 - RNA, 19 nt, Homo sapiens
ugaauuagcuggaguagga

SEQ ID NO: 1298598 - RNA, 19 nt, Homo sapiens
ccaaaugucugccaucuca

SEQ ID NO: 1298599 - RNA, 19 nt, Homo sapiens
gcaaagggcucagcgacuu

SEQ ID NO: 1298600 - RNA, 19 nt, Homo sapiens
gaacuugacccauaccuau

SEQ ID NO: 1298601 - RNA, 19 nt, Homo sapiens
gcaggaagcaagcauguuu

SEQ ID NO: 1298602 - RNA, 19 nt, Homo sapiens
gaaaggcuucugacaauga

SEQ ID NO: 1298603 - RNA, 19 nt, Homo sapiens
gccaaaggcuccagaaauc

SEQ ID NO: 1298604 - RNA, 19 nt, Homo sapiens
gcagguggguacuguuuga

SEQ ID NO: 1298605 - RNA, 19 nt, Homo sapiens
caacauuucugugaauuag

SEQ ID NO: 1298606 - RNA, 19 nt, Homo sapiens
gcauucaguucacuaauag

SEQ ID NO: 1298607 - RNA, 19 nt, Homo sapiens
gagagaagcaucccugaga

SEQ ID NO: 1298608 - RNA, 19 nt, Homo sapiens
gcuguggccuugaugcuuu

SEQ ID NO: 1298609 - RNA, 19 nt, Homo sapiens
cauguuugcugugcacuua

SEQ ID NO: 1298610 - RNA, 19 nt, Homo sapiens
ucacuaaugccaucacuuu

SEQ ID NO: 1298611 - RNA, 19 nt, Homo sapiens
uauggcaucuuccuguaua

SEQ ID NO: 1298612 - RNA, 19 nt, Homo sapiens
guucugagauucugugcaa

SEQ ID NO: 1298613 - RNA, 19 nt, Homo sapiens
gugcaagccucauggaaau

SEQ ID NO: 1298614 - RNA, 19 nt, Homo sapiens
gaagugacagugaagauuc

SEQ ID NO: 1298615 - RNA, 19 nt, Homo sapiens
ugacaggccuggugguguu

SEQ ID NO: 1298616 - RNA, 19 nt, Homo sapiens
gggugaagcuguuguugau

SEQ ID NO: 1298617 - RNA, 19 nt, Homo sapiens
cagagacgacauugacuua

SEQ ID NO: 1298618 - RNA, 19 nt, Homo sapiens
cuaauagggugaagcuguu

SEQ ID NO: 1298619 - RNA, 19 nt, Homo sapiens
caacagaucacagcaguca

SEQ ID NO: 1298620 - RNA, 19 nt, Homo sapiens
cggccguacucuacauuua

SEQ ID NO: 1298621 - RNA, 19 nt, Homo sapiens
ggaagugacagugaagauu

SEQ ID NO: 1298622 - RNA, 19 nt, Homo sapiens
gggcugcuuuggauaauca

SEQ ID NO: 1298623 - RNA, 19 nt, Homo sapiens
augcugaacuugacccaua

SEQ ID NO: 1298624 - RNA, 19 nt, Homo sapiens
gagauuacagccuggacua

SEQ ID NO: 1298625 - RNA, 19 nt, Homo sapiens
agcauucaguucacuaaua

SEQ ID NO: 1298626 - RNA, 19 nt, Homo sapiens
ggacugccuugguaugucu

SEQ ID NO: 1298627 - RNA, 19 nt, Homo sapiens
cagcuguccuccucaguga

SEQ ID NO: 1298628 - RNA, 19 nt, Homo sapiens
agggagugcuggaaaguuu

SEQ ID NO: 1298629 - RNA, 19 nt, Homo sapiens
gcucuacucauccaagaaa

SEQ ID NO: 1298630 - RNA, 19 nt, Homo sapiens
gcgcuggaguggagagaga

SEQ ID NO: 1298631 - RNA, 19 nt, Homo sapiens
agagaagcaucccugagaa

SEQ ID NO: 1298632 - RNA, 19 nt, Homo sapiens
gagcaaggaacugggagua

SEQ ID NO: 1298633 - RNA, 19 nt, Homo sapiens
ucacagcagucauccucaa

SEQ ID NO: 1298634 - RNA, 19 nt, Homo sapiens
gagacgacauugacuuagg

SEQ ID NO: 1298635 - RNA, 19 nt, Homo sapiens
uggcagcccuggaugcauu

SEQ ID NO: 1298636 - RNA, 19 nt, Homo sapiens
acauuuaccuggccacugu

SEQ ID NO: 1298637 - RNA, 19 nt, Homo sapiens
caaaggcuccagaaaucaa

SEQ ID NO: 1298638 - RNA, 19 nt, Homo sapiens
gcagcauucaguucacuaa

SEQ ID NO: 1298639 - RNA, 19 nt, Homo sapiens
gcugggagaugccacugau

SEQ ID NO: 1298640 - RNA, 19 nt, Homo sapiens
gggcucuacucauccaaga

SEQ ID NO: 1298641 - RNA, 19 nt, Homo sapiens
gugcucaaguucauuccaa

SEQ ID NO: 1298642 - RNA, 19 nt, Homo sapiens
guaaagaccagccgcuucu

SEQ ID NO: 1298643 - RNA, 19 nt, Homo sapiens
ccuuacuucuuucuucuuu

SEQ ID NO: 1298644 - RNA, 19 nt, Homo sapiens
gcaucuggguggcuaccuu

SEQ ID NO: 1298645 - RNA, 19 nt, Homo sapiens
cauucacccucuacucauu

SEQ ID NO: 1298646 - RNA, 19 nt, Homo sapiens
ucuauggcaucuuccugua

SEQ ID NO: 1298647 - RNA, 19 nt, Homo sapiens
ccagugcuccuagaaauau

SEQ ID NO: 1298648 - RNA, 19 nt, Homo sapiens
cagcaaccuucaugaccuu

SEQ ID NO: 1298649 - RNA, 19 nt, Homo sapiens
cuggugguguucauccuua

SEQ ID NO: 1298650 - RNA, 19 nt, Homo sapiens
gagucucaauggauaagga

SEQ ID NO: 1298651 - RNA, 19 nt, Homo sapiens
cuacgaugcugugggcaaa

SEQ ID NO: 1298652 - RNA, 19 nt, Homo sapiens
gaagcugccaggccaggaa

SEQ ID NO: 1298653 - RNA, 19 nt, Homo sapiens
gcccucaaguguguaaaga

SEQ ID NO: 1298654 - RNA, 19 nt, Homo sapiens
gcaaaaugcugaacuugac

SEQ ID NO: 1298655 - RNA, 19 nt, Homo sapiens
caauuccaguggucaguuc

SEQ ID NO: 1298656 - RNA, 19 nt, Homo sapiens
ggacccaacagcccggauu

SEQ ID NO: 1298657 - RNA, 19 nt, Homo sapiens
ggucuucucaccacaggaa

SEQ ID NO: 1298658 - RNA, 19 nt, Homo sapiens
gacuuaggccugaucaaug

SEQ ID NO: 1298659 - RNA, 19 nt, Homo sapiens
ugacuuaggccugaucaau

SEQ ID NO: 1298660 - RNA, 19 nt, Homo sapiens
cgccugcucuucucuuuca

SEQ ID NO: 1298661 - RNA, 19 nt, Homo sapiens
gcggaacccugugguacug

SEQ ID NO: 1298662 - RNA, 19 nt, Homo sapiens
gcucggcuguggccuugau

SEQ ID NO: 1298663 - RNA, 19 nt, Homo sapiens
caguggaagugacagugaa

SEQ ID NO: 1298664 - RNA, 19 nt, Homo sapiens
cuauggcccucaagugugu

SEQ ID NO: 1298665 - RNA, 19 nt, Homo sapiens
gcccaaaugucugccaucu

SEQ ID NO: 1298666 - RNA, 19 nt, Homo sapiens
gaaagggcuaccaugagau

SEQ ID NO: 1298667 - RNA, 19 nt, Homo sapiens
ccacugggagccuuuguuc

SEQ ID NO: 1298668 - RNA, 19 nt, Homo sapiens
ccaggaaacagcaugagau

SEQ ID NO: 1298669 - RNA, 19 nt, Homo sapiens
ggagccagaacacucauuc

SEQ ID NO: 1298670 - RNA, 19 nt, Homo sapiens
ucccuucuccucuuccuua

SEQ ID NO: 1298671 - RNA, 19 nt, Homo sapiens
ucccagacauugccuucuu

SEQ ID NO: 1298672 - RNA, 19 nt, Homo sapiens
auaccuauccuauccagaa

SEQ ID NO: 1298673 - RNA, 19 nt, Homo sapiens
uaccugcccuuccgccuau

SEQ ID NO: 1298674 - RNA, 19 nt, Homo sapiens
ccauccagcuugccugucu

SEQ ID NO: 1298675 - RNA, 19 nt, Homo sapiens
caaugccugugcucuaugg

SEQ ID NO: 1298676 - RNA, 19 nt, Homo sapiens
cuucuccucuuccuuacuu

SEQ ID NO: 1298677 - RNA, 19 nt, Homo sapiens
gcaauuccaguggucaguu

SEQ ID NO: 1298678 - RNA, 19 nt, Homo sapiens
gcugugcacuuaggaaagg

SEQ ID NO: 1298679 - RNA, 19 nt, Homo sapiens
cuccagugcuccuagaaau

SEQ ID NO: 1298680 - RNA, 19 nt, Homo sapiens
gccaagaccucaguuaccu

SEQ ID NO: 1298681 - RNA, 19 nt, Homo sapiens
caggaaacagcaugagaug

SEQ ID NO: 1298682 - RNA, 19 nt, Homo sapiens
gcucagcagcauucaguuc

SEQ ID NO: 1298683 - RNA, 19 nt, Homo sapiens
gcgcucagcagcauucagu

SEQ ID NO: 1298684 - RNA, 19 nt, Homo sapiens
uccaaugccugugcucuau

SEQ ID NO: 1298685 - RNA, 19 nt, Homo sapiens
ucauacagucccagacauu

SEQ ID NO: 1298686 - RNA, 19 nt, Homo sapiens
ggacugaucaggccccauu

SEQ ID NO: 1298687 - RNA, 19 nt, Homo sapiens
gcugccaagaccucaguua

SEQ ID NO: 1298688 - RNA, 19 nt, Homo sapiens
gagaagcaucccugagaag

SEQ ID NO: 1298689 - RNA, 19 nt, Homo sapiens
ggauaaggacaaggccaaa

SEQ ID NO: 1298690 - RNA, 19 nt, Homo sapiens
caaccuucaugaccuucug

SEQ ID NO: 1298691 - RNA, 19 nt, Homo sapiens
gggaaagggcuaccaugag

SEQ ID NO: 1298692 - RNA, 19 nt, Homo sapiens
ugggaaagggcuaccauga

SEQ ID NO: 1298693 - RNA, 19 nt, Homo sapiens
ccaaaggcuccagaaauca

SEQ ID NO: 1298694 - RNA, 19 nt, Homo sapiens
agccagaccugcuacucuu

SEQ ID NO: 1298695 - RNA, 19 nt, Homo sapiens
gaacuuguccuucuauuua

SEQ ID NO: 1298696 - RNA, 19 nt, Homo sapiens
caacagaacagguaauuua

SEQ ID NO: 1298697 - RNA, 19 nt, Homo sapiens
gaagagagccugaaugaga

SEQ ID NO: 1298698 - RNA, 19 nt, Homo sapiens
gcgaacagcuggcuaauau

SEQ ID NO: 1298699 - RNA, 19 nt, Homo sapiens
gaacagagacccuucaaga

SEQ ID NO: 1298700 - RNA, 19 nt, Homo sapiens
gaacugagaugaaacuuuu

SEQ ID NO: 1298701 - RNA, 19 nt, Homo sapiens
ggaguuaucuucccacugu

SEQ ID NO: 1298702 - RNA, 19 nt, Homo sapiens
gcacguugcucuucaccua

SEQ ID NO: 1298703 - RNA, 19 nt, Homo sapiens
gcagguggaucacuuaaga

SEQ ID NO: 1298704 - RNA, 19 nt, Homo sapiens
gcaauuacccuuaaagaau

SEQ ID NO: 1298705 - RNA, 19 nt, Homo sapiens
ccuaaucgcuuacaccuaa

SEQ ID NO: 1298706 - RNA, 19 nt, Homo sapiens
ucgaacaacuucauccuua

SEQ ID NO: 1298707 - RNA, 19 nt, Homo sapiens
ggaugaccuuuguaaguua

SEQ ID NO: 1298708 - RNA, 19 nt, Homo sapiens
ugacagaaauaucaucuug

SEQ ID NO: 1298709 - RNA, 19 nt, Homo sapiens
gagaggcaauuacccuuaa

SEQ ID NO: 1298710 - RNA, 19 nt, Homo sapiens
gggauauacuuuccuguuu

SEQ ID NO: 1298711 - RNA, 19 nt, Homo sapiens
gaaggaagacacagaauuc

SEQ ID NO: 1298712 - RNA, 19 nt, Homo sapiens
agucauaacucuagagaaa

SEQ ID NO: 1298713 - RNA, 19 nt, Homo sapiens
ggauuggaauucucaacua

SEQ ID NO: 1298714 - RNA, 19 nt, Homo sapiens
gaagcuuucuugucucuau

SEQ ID NO: 1298715 - RNA, 19 nt, Homo sapiens
uguaauaguucccuuugua

SEQ ID NO: 1298716 - RNA, 19 nt, Homo sapiens
gaaggcaaacaagauauua

SEQ ID NO: 1298717 - RNA, 19 nt, Homo sapiens
uaaagaaucugggugguau

SEQ ID NO: 1298718 - RNA, 19 nt, Homo sapiens
gggagaaucuaucugaaau

SEQ ID NO: 1298719 - RNA, 19 nt, Homo sapiens
uaaaagaccucaaaucaga

SEQ ID NO: 1298720 - RNA, 19 nt, Homo sapiens
cagaugaacugagaugaaa

SEQ ID NO: 1298721 - RNA, 19 nt, Homo sapiens
gcaauggcuuccagaaugu

SEQ ID NO: 1298722 - RNA, 19 nt, Homo sapiens
gggcagcuguagaaacuuu

SEQ ID NO: 1298723 - RNA, 19 nt, Homo sapiens
aaagagaaaugcaauccaa

SEQ ID NO: 1298724 - RNA, 19 nt, Homo sapiens
agacucaggucauaaauca

SEQ ID NO: 1298725 - RNA, 19 nt, Homo sapiens
cuagguaaauugacagaaa

SEQ ID NO: 1298726 - RNA, 19 nt, Homo sapiens
aaacacagguuggcucauu

SEQ ID NO: 1298727 - RNA, 19 nt, Homo sapiens
gggcauagcagaucuugaa

SEQ ID NO: 1298728 - RNA, 19 nt, Homo sapiens
cuaaagggcugucuucagu

SEQ ID NO: 1298729 - RNA, 19 nt, Homo sapiens
gcuauggccuucaucauca

SEQ ID NO: 1298730 - RNA, 19 nt, Homo sapiens
caacccagcagaaggaaua

SEQ ID NO: 1298731 - RNA, 19 nt, Homo sapiens
ggucuacgaucuugcaguu

SEQ ID NO: 1298732 - RNA, 19 nt, Homo sapiens
uauuaagccuccaaucuuu

SEQ ID NO: 1298733 - RNA, 19 nt, Homo sapiens
ggagauuacugcuuacucu

SEQ ID NO: 1298734 - RNA, 19 nt, Homo sapiens
caaauggucuacgaucuug

SEQ ID NO: 1298735 - RNA, 19 nt, Homo sapiens
ggagaggcaauuacccuua

SEQ ID NO: 1298736 - RNA, 19 nt, Homo sapiens
guagucagauuagccagua

SEQ ID NO: 1298737 - RNA, 19 nt, Homo sapiens
cagcagccauccagguaua

SEQ ID NO: 1298738 - RNA, 19 nt, Homo sapiens
caaaggcccauagucauua

SEQ ID NO: 1298739 - RNA, 19 nt, Homo sapiens
caacuucccauucauagaa

SEQ ID NO: 1298740 - RNA, 19 nt, Homo sapiens
cgaacaacuucauccuuaa

SEQ ID NO: 1298741 - RNA, 19 nt, Homo sapiens
guccaaaugcagaauauua

SEQ ID NO: 1298742 - RNA, 19 nt, Homo sapiens
ugaagcacauucucuauca

SEQ ID NO: 1298743 - RNA, 19 nt, Homo sapiens
caauuacccuuaaagaauc

SEQ ID NO: 1298744 - RNA, 19 nt, Homo sapiens
uaaguagacuggguagaaa

SEQ ID NO: 1298745 - RNA, 19 nt, Homo sapiens
gaugaccuuuguaaguuaa

SEQ ID NO: 1298746 - RNA, 19 nt, Homo sapiens
gagggcagcuguagaaacu

SEQ ID NO: 1298747 - RNA, 19 nt, Homo sapiens
uggaggagcucgaugaaau

SEQ ID NO: 1298748 - RNA, 19 nt, Homo sapiens
gaacagcuggcuaauaucu

SEQ ID NO: 1298749 - RNA, 19 nt, Homo sapiens
gcuaagaguccguaaccua

SEQ ID NO: 1298750 - RNA, 19 nt, Homo sapiens
acagaaauaucaucuugga

SEQ ID NO: 1298751 - RNA, 19 nt, Homo sapiens
ccacgugacugaucugaca

SEQ ID NO: 1298752 - RNA, 19 nt, Homo sapiens
gaaaaugaguacuucuuug

SEQ ID NO: 1298753 - RNA, 19 nt, Homo sapiens
cacccaaggucuccaauga

SEQ ID NO: 1298754 - RNA, 19 nt, Homo sapiens
caaggcagguggaucacuu

SEQ ID NO: 1298755 - RNA, 19 nt, Homo sapiens
ucaccuaaaucuagcaguu

SEQ ID NO: 1298756 - RNA, 19 nt, Homo sapiens
uaaagaacacuccaauuca

SEQ ID NO: 1298757 - RNA, 19 nt, Homo sapiens
ggagaaucuaucugaaaua

SEQ ID NO: 1298758 - RNA, 19 nt, Homo sapiens
ggaaggcaaacaagauauu

SEQ ID NO: 1298759 - RNA, 19 nt, Homo sapiens
uuaaagaacacuccaauuc

SEQ ID NO: 1298760 - RNA, 19 nt, Homo sapiens
gcccugagcuagcggcauu

SEQ ID NO: 1298761 - RNA, 19 nt, Homo sapiens
cuaugaauauuccugauga

SEQ ID NO: 1298762 - RNA, 19 nt, Homo sapiens
cccaaggucuccaaugaaa

SEQ ID NO: 1298763 - RNA, 19 nt, Homo sapiens
cggaugaccuuuguaaguu

SEQ ID NO: 1298764 - RNA, 19 nt, Homo sapiens
gagccuuucucccagcuuu

SEQ ID NO: 1298765 - RNA, 19 nt, Homo sapiens
ugaaggacauugagaacau

SEQ ID NO: 1298766 - RNA, 19 nt, Homo sapiens
gaacacgauagacagcaua

SEQ ID NO: 1298767 - RNA, 19 nt, Homo sapiens
aaagcgauauguuucagaa

SEQ ID NO: 1298768 - RNA, 19 nt, Homo sapiens
caacaacccagcagaagga

SEQ ID NO: 1298769 - RNA, 19 nt, Homo sapiens
gcaagaaggaagacacaga

SEQ ID NO: 1298770 - RNA, 19 nt, Homo sapiens
gaacaacuucauccuuaau

SEQ ID NO: 1298771 - RNA, 19 nt, Homo sapiens
ggaguuugcuuuguuaguc

SEQ ID NO: 1298772 - RNA, 19 nt, Homo sapiens
caucuuaccuuucccuuac

SEQ ID NO: 1298773 - RNA, 19 nt, Homo sapiens
ccaaaggcccauagucauu

SEQ ID NO: 1298774 - RNA, 19 nt, Homo sapiens
gauauuaagccuccaaucu

SEQ ID NO: 1298775 - RNA, 19 nt, Homo sapiens
gcacaagugaugagcaaga

SEQ ID NO: 1298776 - RNA, 19 nt, Homo sapiens
agagagagauggcaagaag

SEQ ID NO: 1298777 - RNA, 19 nt, Homo sapiens
ccacuacuaugaauucaag

SEQ ID NO: 1298778 - RNA, 19 nt, Homo sapiens
gaaaugcaauccaaaaugg

SEQ ID NO: 1298779 - RNA, 19 nt, Homo sapiens
gagaccaccuaacgaugaa

SEQ ID NO: 1298780 - RNA, 19 nt, Homo sapiens
ccaaacuggugucuucaga

SEQ ID NO: 1298781 - RNA, 19 nt, Homo sapiens
gcccauagucauuacauuu

SEQ ID NO: 1298782 - RNA, 19 nt, Homo sapiens
gcugagugauugacaaaca

SEQ ID NO: 1298783 - RNA, 19 nt, Homo sapiens
ggagagaucaaacgacugu

SEQ ID NO: 1298784 - RNA, 19 nt, Homo sapiens
ucgcuuacaccuaauauaa

SEQ ID NO: 1298785 - RNA, 19 nt, Homo sapiens
gauugcagccaaccagaua

SEQ ID NO: 1298786 - RNA, 19 nt, Homo sapiens
ggacauugagaacaucauu

SEQ ID NO: 1298787 - RNA, 19 nt, Homo sapiens
ucauuggccucuucaguga

SEQ ID NO: 1298788 - RNA, 19 nt, Homo sapiens
gaccucaaaucagaacauu

SEQ ID NO: 1298789 - RNA, 19 nt, Homo sapiens
aaaucucacuugacaaaug

SEQ ID NO: 1298790 - RNA, 19 nt, Homo sapiens
gagcuagcggcauuccuua

SEQ ID NO: 1298791 - RNA, 19 nt, Homo sapiens
caagaaggaagacacagaa

SEQ ID NO: 1298792 - RNA, 19 nt, Homo sapiens
ggaagagaacugaauccaa

SEQ ID NO: 1298793 - RNA, 19 nt, Homo sapiens
ggucaacccucaguuccaa

SEQ ID NO: 1298794 - RNA, 19 nt, Homo sapiens
cuucagugcuuuaaugguu

SEQ ID NO: 1298795 - RNA, 19 nt, Homo sapiens
gaaauaccgucaccuguua

SEQ ID NO: 1298796 - RNA, 19 nt, Homo sapiens
uaacagggaugcuuaauuu

SEQ ID NO: 1298797 - RNA, 19 nt, Homo sapiens
ugaaagagcagaagaauua

SEQ ID NO: 1298798 - RNA, 19 nt, Homo sapiens
gaaagcagcacauuaaauu

SEQ ID NO: 1298799 - RNA, 19 nt, Homo sapiens
gaagaagaguggaagauga

SEQ ID NO: 1298800 - RNA, 19 nt, Homo sapiens
ggaacgagcuguagguuug

SEQ ID NO: 1298801 - RNA, 19 nt, Homo sapiens
cuaaagaacuuguugaaug

SEQ ID NO: 1298802 - RNA, 19 nt, Homo sapiens
caaaggguguugaagauuu

SEQ ID NO: 1298803 - RNA, 19 nt, Homo sapiens
gcacacacaugcuuaccua

SEQ ID NO: 1298804 - RNA, 19 nt, Homo sapiens
acacuuagcucagagaaua

SEQ ID NO: 1298805 - RNA, 19 nt, Homo sapiens
gcacuuugcuccauauaau

SEQ ID NO: 1298806 - RNA, 19 nt, Homo sapiens
agacaaagcuacccagauu

SEQ ID NO: 1298807 - RNA, 19 nt, Homo sapiens
agaaauacaugucagguuu

SEQ ID NO: 1298808 - RNA, 19 nt, Homo sapiens
guacugaacuuuguguuga

SEQ ID NO: 1298809 - RNA, 19 nt, Homo sapiens
ggauugcaccuuugaaaua

SEQ ID NO: 1298810 - RNA, 19 nt, Homo sapiens
gaacagaggcaauggaugu

SEQ ID NO: 1298811 - RNA, 19 nt, Homo sapiens
ggauauuacugguuaguug

SEQ ID NO: 1298812 - RNA, 19 nt, Homo sapiens
ggaacagccuugaauagga

SEQ ID NO: 1298813 - RNA, 19 nt, Homo sapiens
gaacagccuugaauaggau

SEQ ID NO: 1298814 - RNA, 19 nt, Homo sapiens
ugaaagauguggcuauaau

SEQ ID NO: 1298815 - RNA, 19 nt, Homo sapiens
ccacacgcauuaucaguaa

SEQ ID NO: 1298816 - RNA, 19 nt, Homo sapiens
caccucagauucuaauaua

SEQ ID NO: 1298817 - RNA, 19 nt, Homo sapiens
ugagacugcuugaaagaua

SEQ ID NO: 1298818 - RNA, 19 nt, Homo sapiens
uauaguagaugccggaauu

SEQ ID NO: 1298819 - RNA, 19 nt, Homo sapiens
gaugggaauuguaggcaua

SEQ ID NO: 1298820 - RNA, 19 nt, Homo sapiens
ccaacaagauagaguuuga

SEQ ID NO: 1298821 - RNA, 19 nt, Homo sapiens
caugaaagcagcacauuaa

SEQ ID NO: 1298822 - RNA, 19 nt, Homo sapiens
caaaggaaaugugcugcua

SEQ ID NO: 1298823 - RNA, 19 nt, Homo sapiens
gacaaaggguguugaagau

SEQ ID NO: 1298824 - RNA, 19 nt, Homo sapiens
aggcauagauuucauauca

SEQ ID NO: 1298825 - RNA, 19 nt, Homo sapiens
ggaaauaccgucaccuguu

SEQ ID NO: 1298826 - RNA, 19 nt, Homo sapiens
gaguggagguaaauuaaga

SEQ ID NO: 1298827 - RNA, 19 nt, Homo sapiens
guaugugagucuucugaua

SEQ ID NO: 1298828 - RNA, 19 nt, Homo sapiens
aaauaugucugccaaguug

SEQ ID NO: 1298829 - RNA, 19 nt, Homo sapiens
gaaggaggguggaggaagu

SEQ ID NO: 1298830 - RNA, 19 nt, Homo sapiens
uuaacuagcugccuuuaga

SEQ ID NO: 1298831 - RNA, 19 nt, Homo sapiens
gaacaucgaacauaucuac

SEQ ID NO: 1298832 - RNA, 19 nt, Homo sapiens
gaaaggaaaaucucaguua

SEQ ID NO: 1298833 - RNA, 19 nt, Homo sapiens
gacacaugauccacaauuu

SEQ ID NO: 1298834 - RNA, 19 nt, Homo sapiens
uaacuagaauggacacaug

SEQ ID NO: 1298835 - RNA, 19 nt, Homo sapiens
gagcaacacacaugagaaa

SEQ ID NO: 1298836 - RNA, 19 nt, Homo sapiens
gcagaaccuuagagaagaa

SEQ ID NO: 1298837 - RNA, 19 nt, Homo sapiens
ggagguggauaucacaaug

SEQ ID NO: 1298838 - RNA, 19 nt, Homo sapiens
agaaaugugugaaaccaaa

SEQ ID NO: 1298839 - RNA, 19 nt, Homo sapiens
gcaugaaagcagcacauua

SEQ ID NO: 1298840 - RNA, 19 nt, Homo sapiens
gcauagauuucauaucaag

SEQ ID NO: 1298841 - RNA, 19 nt, Homo sapiens
uaaguaagauccaggucaa

SEQ ID NO: 1298842 - RNA, 19 nt, Homo sapiens
gauuuguaguccaggauua

SEQ ID NO: 1298843 - RNA, 19 nt, Homo sapiens
uuucagcucuagcaauuua

SEQ ID NO: 1298844 - RNA, 19 nt, Homo sapiens
ccagaaaucccuguuguaa

SEQ ID NO: 1298845 - RNA, 19 nt, Homo sapiens
ugacugaucuccugaguac

SEQ ID NO: 1298846 - RNA, 19 nt, Homo sapiens
ucaaauggaugacugaucu

SEQ ID NO: 1298847 - RNA, 19 nt, Homo sapiens
uuucacaccucucuuaauu

SEQ ID NO: 1298848 - RNA, 19 nt, Homo sapiens
gauuucaacuuguaugugu

SEQ ID NO: 1298849 - RNA, 19 nt, Homo sapiens
guugaggcuuugcaaguua

SEQ ID NO: 1298850 - RNA, 19 nt, Homo sapiens
ggacacaugauccacaauu

SEQ ID NO: 1298851 - RNA, 19 nt, Homo sapiens
gaaauaugucugccaaguu

SEQ ID NO: 1298852 - RNA, 19 nt, Homo sapiens
acagauacuuguucucauu

SEQ ID NO: 1298853 - RNA, 19 nt, Homo sapiens
agaauugcaugauugcuuu

SEQ ID NO: 1298854 - RNA, 19 nt, Homo sapiens
gaccauagccuucuugucu

SEQ ID NO: 1298855 - RNA, 19 nt, Homo sapiens
gcagcaagaugugguuaga

SEQ ID NO: 1298856 - RNA, 19 nt, Homo sapiens
uagccaggguucaaugaua

SEQ ID NO: 1298857 - RNA, 19 nt, Homo sapiens
gauugcaccuuugaaauau

SEQ ID NO: 1298858 - RNA, 19 nt, Homo sapiens
gcagcacauuaaauuguaa

SEQ ID NO: 1298859 - RNA, 19 nt, Homo sapiens
gguuaguugucauuaagua

SEQ ID NO: 1298860 - RNA, 19 nt, Homo sapiens
uaaagaacuuguugaaugc

SEQ ID NO: 1298861 - RNA, 19 nt, Homo sapiens
gagcaggaaauuuauaaga

SEQ ID NO: 1298862 - RNA, 19 nt, Homo sapiens
acucuuaccuccacauauu

SEQ ID NO: 1298863 - RNA, 19 nt, Homo sapiens
caugauugcuuuaaaccaa

SEQ ID NO: 1298864 - RNA, 19 nt, Homo sapiens
ggaauuguaggcauagauu

SEQ ID NO: 1298865 - RNA, 19 nt, Homo sapiens
ggaccacacuuagcucaga

SEQ ID NO: 1298866 - RNA, 19 nt, Homo sapiens
ccaaguuguuagaaucuuu

SEQ ID NO: 1298867 - RNA, 19 nt, Homo sapiens
gcagaaaugugugaaacca

SEQ ID NO: 1298868 - RNA, 19 nt, Homo sapiens
ggacugaggauggaguuaa

SEQ ID NO: 1298869 - RNA, 19 nt, Homo sapiens
gaaagaaguggaugggaau

SEQ ID NO: 1298870 - RNA, 19 nt, Homo sapiens
aggaaaguaugacagauuu

SEQ ID NO: 1298871 - RNA, 19 nt, Homo sapiens
gcacaaguaagguuucaga

SEQ ID NO: 1298872 - RNA, 19 nt, Homo sapiens
uaaagaagaagcagcaaga

SEQ ID NO: 1298873 - RNA, 19 nt, Homo sapiens
aaugaucacugccuacuug

SEQ ID NO: 1298874 - RNA, 19 nt, Homo sapiens
gcaacacacaugagaaaga

SEQ ID NO: 1298875 - RNA, 19 nt, Homo sapiens
ccauguauguauccuuaaa

SEQ ID NO: 1298876 - RNA, 19 nt, Homo sapiens
ccauagccuucuugucuuu

SEQ ID NO: 1298877 - RNA, 19 nt, Homo sapiens
gaaggaaaguaugacagau

SEQ ID NO: 1298878 - RNA, 19 nt, Homo sapiens
ugacaaaggguguugaaga

SEQ ID NO: 1298879 - RNA, 19 nt, Homo sapiens
uguauguguuugucucuua

SEQ ID NO: 1298880 - RNA, 19 nt, Homo sapiens
cguaguauaccuauuauga

SEQ ID NO: 1298881 - RNA, 19 nt, Homo sapiens
caucgaacauaucuacuuc

SEQ ID NO: 1298882 - RNA, 19 nt, Homo sapiens
cagaaucaguuacaaacau

SEQ ID NO: 1298883 - RNA, 19 nt, Homo sapiens
aagcagcgcugguugacaa

SEQ ID NO: 1298884 - RNA, 19 nt, Homo sapiens
gaaagauguggcuauaaug

SEQ ID NO: 1298885 - RNA, 19 nt, Homo sapiens
cuuauugccuuuccuuuga

SEQ ID NO: 1298886 - RNA, 19 nt, Homo sapiens
gcaagaugugguuagauuu

SEQ ID NO: 1298887 - RNA, 19 nt, Homo sapiens
gacugaggauggaguuaaa

SEQ ID NO: 1298888 - RNA, 19 nt, Homo sapiens
gaagaggaaagcaagguau

SEQ ID NO: 1298889 - RNA, 19 nt, Homo sapiens
caacacacaugagaaagag

SEQ ID NO: 1298890 - RNA, 19 nt, Homo sapiens
gagacugcuugaaagauau

SEQ ID NO: 1298891 - RNA, 19 nt, Homo sapiens
uuacugggaugacaauaau

SEQ ID NO: 1298892 - RNA, 19 nt, Homo sapiens
caagugaucagaacuaagu

SEQ ID NO: 1298893 - RNA, 19 nt, Homo sapiens
gaucugcccuagguuauag

SEQ ID NO: 1298894 - RNA, 19 nt, Homo sapiens
ggcagaaccuuagagaaga

SEQ ID NO: 1298895 - RNA, 19 nt, Homo sapiens
ggacagagcuagacacuca

SEQ ID NO: 1298896 - RNA, 19 nt, Homo sapiens
gcacauaccucugcuagaa

SEQ ID NO: 1298897 - RNA, 19 nt, Homo sapiens
gaacugucuugcaucauua

SEQ ID NO: 1298898 - RNA, 19 nt, Homo sapiens
gcaaggagcugcugagaag

SEQ ID NO: 1298899 - RNA, 19 nt, Homo sapiens
ggaaguagcugccuauaac

SEQ ID NO: 1298900 - RNA, 19 nt, Homo sapiens
ggaacugucuugcaucauu

SEQ ID NO: 1298901 - RNA, 19 nt, Homo sapiens
ggacugaagugcuguaaag

SEQ ID NO: 1298902 - RNA, 19 nt, Homo sapiens
gcaaggaaauugaugagau

SEQ ID NO: 1298903 - RNA, 19 nt, Homo sapiens
gaacauuggcggaauuauu

SEQ ID NO: 1298904 - RNA, 19 nt, Homo sapiens
caaguucccuccaucauug

SEQ ID NO: 1298905 - RNA, 19 nt, Homo sapiens
gaaaucaguuugcaucucu

SEQ ID NO: 1298906 - RNA, 19 nt, Homo sapiens
gaccauaguugcuuaggaa

SEQ ID NO: 1298907 - RNA, 19 nt, Homo sapiens
caaggaaauugaugagauu

SEQ ID NO: 1298908 - RNA, 19 nt, Homo sapiens
gaaaugaccgcaaggaaau

SEQ ID NO: 1298909 - RNA, 19 nt, Homo sapiens
gaauggcucucacuacuca

SEQ ID NO: 1298910 - RNA, 19 nt, Homo sapiens
ccaccgcaguuucuucuua

SEQ ID NO: 1298911 - RNA, 19 nt, Homo sapiens
ccacaugaauagaagaauu

SEQ ID NO: 1298912 - RNA, 19 nt, Homo sapiens
gaaaugguacugaaauaug

SEQ ID NO: 1298913 - RNA, 19 nt, Homo sapiens
gcuagacacucauucagaa

SEQ ID NO: 1298914 - RNA, 19 nt, Homo sapiens
caauucuucuuuccacuua

SEQ ID NO: 1298915 - RNA, 19 nt, Homo sapiens
gccgaaggcuguaccagua

SEQ ID NO: 1298916 - RNA, 19 nt, Homo sapiens
ggaagaaaauucaagauga

SEQ ID NO: 1298917 - RNA, 19 nt, Homo sapiens
cugaagaucuggaauguga

SEQ ID NO: 1298918 - RNA, 19 nt, Homo sapiens
caaaggcaauugcgaaauc

SEQ ID NO: 1298919 - RNA, 19 nt, Homo sapiens
cuaugggucuuguuuauuu

SEQ ID NO: 1298920 - RNA, 19 nt, Homo sapiens
uaaagaguuugcucacgua

SEQ ID NO: 1298921 - RNA, 19 nt, Homo sapiens
uaaauugguugcuggaaga

SEQ ID NO: 1298922 - RNA, 19 nt, Homo sapiens
gcuagaaacuccugucaag

SEQ ID NO: 1298923 - RNA, 19 nt, Homo sapiens
gaaaccagauggaguuaac

SEQ ID NO: 1298924 - RNA, 19 nt, Homo sapiens
gaaaauggaucccacuguu

SEQ ID NO: 1298925 - RNA, 19 nt, Homo sapiens
gaaguuuacugugauguuc

SEQ ID NO: 1298926 - RNA, 19 nt, Homo sapiens
ggaauccucucauggaagu

SEQ ID NO: 1298927 - RNA, 19 nt, Homo sapiens
gugaaacgccugaaucaaa

SEQ ID NO: 1298928 - RNA, 19 nt, Homo sapiens
gaaaucaagucugucaagu

SEQ ID NO: 1298929 - RNA, 19 nt, Homo sapiens
ggaaauugaugagauugug

SEQ ID NO: 1298930 - RNA, 19 nt, Homo sapiens
guagagagaagugaaagua

SEQ ID NO: 1298931 - RNA, 19 nt, Homo sapiens
guaaauauaaccacaagga

SEQ ID NO: 1298932 - RNA, 19 nt, Homo sapiens
gcuacuucaucaacaauaa

SEQ ID NO: 1298933 - RNA, 19 nt, Homo sapiens
guacaggaauuugaaagug

SEQ ID NO: 1298934 - RNA, 19 nt, Homo sapiens
guacuaacacaccguaauu

SEQ ID NO: 1298935 - RNA, 19 nt, Homo sapiens
cuaacaagccacaugaaua

SEQ ID NO: 1298936 - RNA, 19 nt, Homo sapiens
guuaagcaauguugaaauc

SEQ ID NO: 1298937 - RNA, 19 nt, Homo sapiens
ggcuaagucugaaauggua

SEQ ID NO: 1298938 - RNA, 19 nt, Homo sapiens
caacagggugucaggauuu

SEQ ID NO: 1298939 - RNA, 19 nt, Homo sapiens
ccacuacucuucuuacucu

SEQ ID NO: 1298940 - RNA, 19 nt, Homo sapiens
uaaacaggauggagaaagu

SEQ ID NO: 1298941 - RNA, 19 nt, Homo sapiens
gcaaguucccuccaucauu

SEQ ID NO: 1298942 - RNA, 19 nt, Homo sapiens
cuacucaccuugucuuuca

SEQ ID NO: 1298943 - RNA, 19 nt, Homo sapiens
uaacaagccacaugaauag

SEQ ID NO: 1298944 - RNA, 19 nt, Homo sapiens
cgaaaugaccgcaaggaaa

SEQ ID NO: 1298945 - RNA, 19 nt, Homo sapiens
ggagagacucagcccuuua

SEQ ID NO: 1298946 - RNA, 19 nt, Homo sapiens
gaacccugcuuguccaaca

SEQ ID NO: 1298947 - RNA, 19 nt, Homo sapiens
ucaggaagguaaauugguu

SEQ ID NO: 1298948 - RNA, 19 nt, Homo sapiens
gauggacccgguaaauaua

SEQ ID NO: 1298949 - RNA, 19 nt, Homo sapiens
ucaagucugucaaguacaa

SEQ ID NO: 1298950 - RNA, 19 nt, Homo sapiens
ccagaagcccucagaugua

SEQ ID NO: 1298951 - RNA, 19 nt, Homo sapiens
ucauggaaguuuacuguga

SEQ ID NO: 1298952 - RNA, 19 nt, Homo sapiens
cgaguuaacugugcaagug

SEQ ID NO: 1298953 - RNA, 19 nt, Homo sapiens
cugaaaugguacugaaaua

SEQ ID NO: 1298954 - RNA, 19 nt, Homo sapiens
agacacaagucaucguuug

SEQ ID NO: 1298955 - RNA, 19 nt, Homo sapiens
ggaagucuaugaccugaac

SEQ ID NO: 1298956 - RNA, 19 nt, Homo sapiens
agagagaagugaaaguaga

SEQ ID NO: 1298957 - RNA, 19 nt, Homo sapiens
ccaacagggugucaggauu

SEQ ID NO: 1298958 - RNA, 19 nt, Homo sapiens
agacguggcuacuucauca

SEQ ID NO: 1298959 - RNA, 19 nt, Homo sapiens
ccacuuaaacucugaaaca

SEQ ID NO: 1298960 - RNA, 19 nt, Homo sapiens
gggaaguagcugccuauaa

SEQ ID NO: 1298961 - RNA, 19 nt, Homo sapiens
gaaagugaaacgccugaau

SEQ ID NO: 1298962 - RNA, 19 nt, Homo sapiens
gcuuugggcuccuguaaca

SEQ ID NO: 1298963 - RNA, 19 nt, Homo sapiens
auacagacguggcuacuuc

SEQ ID NO: 1298964 - RNA, 19 nt, Homo sapiens
ucacugcuguucacaagga

SEQ ID NO: 1298965 - RNA, 19 nt, Homo sapiens
gaaauugaugagauuguga

SEQ ID NO: 1298966 - RNA, 19 nt, Homo sapiens
gaagacaucccugaagauc

SEQ ID NO: 1298967 - RNA, 19 nt, Homo sapiens
gcauuuguuuaaccucauu

SEQ ID NO: 1298968 - RNA, 19 nt, Homo sapiens
gugauaggguagccuuauu

SEQ ID NO: 1298969 - RNA, 19 nt, Homo sapiens
gaacugccucuuccugaga

SEQ ID NO: 1298970 - RNA, 19 nt, Homo sapiens
ucacugaguuggguuccua

SEQ ID NO: 1298971 - RNA, 19 nt, Homo sapiens
ggacgacucugggcaguac

SEQ ID NO: 1298972 - RNA, 19 nt, Homo sapiens
ggauggauguugcuguaca

SEQ ID NO: 1298973 - RNA, 19 nt, Homo sapiens
aaucaagucugucaaguac

SEQ ID NO: 1298974 - RNA, 19 nt, Homo sapiens
cuacuaguguuaaauugga

SEQ ID NO: 1298975 - RNA, 19 nt, Homo sapiens
guuccaagcuacuaguguu

SEQ ID NO: 1298976 - RNA, 19 nt, Homo sapiens
ggccaaaguugaccacuac

SEQ ID NO: 1298977 - RNA, 19 nt, Homo sapiens
agacaucccugaagaucug

SEQ ID NO: 1298978 - RNA, 19 nt, Homo sapiens
ccuaaaaccuucuacacua

SEQ ID NO: 1298979 - RNA, 19 nt, Homo sapiens
ccaagcuacuaguguuaaa

SEQ ID NO: 1298980 - RNA, 19 nt, Homo sapiens
ugaguuggguuccuaaucu

SEQ ID NO: 1298981 - RNA, 19 nt, Homo sapiens
gguuauggauggcucacaa

SEQ ID NO: 1298982 - RNA, 19 nt, Homo sapiens
caccgcaguuucuucuuaa

SEQ ID NO: 1298983 - RNA, 19 nt, Homo sapiens
gagagacucagcccuuuau

SEQ ID NO: 1298984 - RNA, 19 nt, Homo sapiens
agacacugcucccauuugu

SEQ ID NO: 1298985 - RNA, 19 nt, Homo sapiens
ggaaguuuacugugauguu

SEQ ID NO: 1298986 - RNA, 19 nt, Homo sapiens
ucuaugaccugaacauugg

SEQ ID NO: 1298987 - RNA, 19 nt, Homo sapiens
caucauugccaccuuggua

SEQ ID NO: 1298988 - RNA, 19 nt, Homo sapiens
caauaaacaggauggagaa

SEQ ID NO: 1298989 - RNA, 19 nt, Homo sapiens
gcaauguugaaaucaguuu

SEQ ID NO: 1298990 - RNA, 19 nt, Homo sapiens
caucaacaauaaacaggau

SEQ ID NO: 1298991 - RNA, 19 nt, Homo sapiens
cauguagcgucccagcuuu

SEQ ID NO: 1298992 - RNA, 19 nt, Homo sapiens
gaaacugggugcguucacu

SEQ ID NO: 1298993 - RNA, 19 nt, Homo sapiens
caagauggacccgguaaau

SEQ ID NO: 1298994 - RNA, 19 nt, Homo sapiens
aagaugaacaaaccacaua

SEQ ID NO: 1298995 - RNA, 19 nt, Homo sapiens
gggaggagcuggaugaaga

SEQ ID NO: 1298996 - RNA, 19 nt, Homo sapiens
gaagagcucuaugacuuga

SEQ ID NO: 1298997 - RNA, 19 nt, Homo sapiens
gcagguggccaucgaguuu

SEQ ID NO: 1298998 - RNA, 19 nt, Homo sapiens
caaacgaguucuuucuugu

SEQ ID NO: 1298999 - RNA, 19 nt, Homo sapiens
ucaaacgaguucuuucuug

SEQ ID NO: 1299000 - RNA, 19 nt, Homo sapiens
aggaagagcucuaugacuu

SEQ ID NO: 1299001 - RNA, 19 nt, Homo sapiens
gccagacgcuguaccauca

SEQ ID NO: 1299002 - RNA, 19 nt, Homo sapiens
gucaagaccuggcguuuca

SEQ ID NO: 1299003 - RNA, 19 nt, Homo sapiens
aacgaguucuuucuuguua

SEQ ID NO: 1299004 - RNA, 19 nt, Homo sapiens
ucugagggcugucugauug

SEQ ID NO: 1299005 - RNA, 19 nt, Homo sapiens
agaccacacuguccuacua

SEQ ID NO: 1299006 - RNA, 19 nt, Homo sapiens
gcuacaggaugaugaaaca

SEQ ID NO: 1299007 - RNA, 19 nt, Homo sapiens
gaauuguacacgaguauau

SEQ ID NO: 1299008 - RNA, 19 nt, Homo sapiens
ggaagagcucuaugacuug

SEQ ID NO: 1299009 - RNA, 19 nt, Homo sapiens
gagaagaagaagaaagaga

SEQ ID NO: 1299010 - RNA, 19 nt, Homo sapiens
agaaggagaagaagaagaa

SEQ ID NO: 1299011 - RNA, 19 nt, Homo sapiens
agaagaaggagaagaagaa

SEQ ID NO: 1299012 - RNA, 19 nt, Homo sapiens
caaggaccaucuccgaauc

SEQ ID NO: 1299013 - RNA, 19 nt, Homo sapiens
gagaagaaggagaagaaga

SEQ ID NO: 1299014 - RNA, 19 nt, Homo sapiens
uacuacagcuucuucgauu

SEQ ID NO: 1299015 - RNA, 19 nt, Homo sapiens
acuggacacuggacaagua

SEQ ID NO: 1299016 - RNA, 19 nt, Homo sapiens
gaccaucuccgaaucuuuc

SEQ ID NO: 1299017 - RNA, 19 nt, Homo sapiens
agaagaagaagaaagagaa

SEQ ID NO: 1299018 - RNA, 19 nt, Homo sapiens
cgacgcacgccucuucuuu

SEQ ID NO: 1299019 - RNA, 19 nt, Homo sapiens
agaaggagccagaggaaga

SEQ ID NO: 1299020 - RNA, 19 nt, Homo sapiens
ucugccagcugccgaauug

SEQ ID NO: 1299021 - RNA, 19 nt, Homo sapiens
caaggaagaccagauguag

SEQ ID NO: 1299022 - RNA, 19 nt, Homo sapiens
caugggagcugcggguguu

SEQ ID NO: 1299023 - RNA, 19 nt, Homo sapiens
acaaggaagaccagaugua

SEQ ID NO: 1299024 - RNA, 19 nt, Homo sapiens
gaagaagaagaaagagaag

SEQ ID NO: 1299025 - RNA, 19 nt, Homo sapiens
gcaacaugcgccaguggaa

SEQ ID NO: 1299026 - RNA, 19 nt, Homo sapiens
ugaggugguucccgauguu

SEQ ID NO: 1299027 - RNA, 19 nt, Homo sapiens
aggaggagaugaugguguu

SEQ ID NO: 1299028 - RNA, 19 nt, Homo sapiens
gcuauuuggugggaacaga

SEQ ID NO: 1299029 - RNA, 19 nt, Homo sapiens
caagggcugugaggugguu

SEQ ID NO: 1299030 - RNA, 19 nt, Homo sapiens
acacuguccuacuacaaga

SEQ ID NO: 1299031 - RNA, 19 nt, Homo sapiens
cggcaucuccuaugucaug

SEQ ID NO: 1299032 - RNA, 19 nt, Homo sapiens
cccggaagcugacccugaa

SEQ ID NO: 1299033 - RNA, 19 nt, Homo sapiens
gcaccgaggaggagaugau

SEQ ID NO: 1299034 - RNA, 19 nt, Homo sapiens
gggcaugagugagaucuac

SEQ ID NO: 1299035 - RNA, 19 nt, Homo sapiens
ggaccaucuccgaaucuuu

SEQ ID NO: 1299036 - RNA, 19 nt, Homo sapiens
cuacagcuucuucgauuug

SEQ ID NO: 1299037 - RNA, 19 nt, Homo sapiens
guacuacagcuucuucgau

SEQ ID NO: 1299038 - RNA, 19 nt, Homo sapiens
guucugcauuaaacuccua

SEQ ID NO: 1299039 - RNA, 19 nt, Homo sapiens
uaacgucuccggccagaag

SEQ ID NO: 1299040 - RNA, 19 nt, Homo sapiens
gcaagcaggacuggucaga

SEQ ID NO: 1299041 - RNA, 19 nt, Homo sapiens
gaaggagaagaagaagaaa

SEQ ID NO: 1299042 - RNA, 19 nt, Homo sapiens
acacaaggaagaccagaug

SEQ ID NO: 1299043 - RNA, 19 nt, Homo sapiens
gccgaauuguacacgagua

SEQ ID NO: 1299044 - RNA, 19 nt, Homo sapiens
gaggugguucccgauguua

SEQ ID NO: 1299045 - RNA, 19 nt, Homo sapiens
ucaaggaccaucuccgaau

SEQ ID NO: 1299046 - RNA, 19 nt, Homo sapiens
cguggcaccugcacuguuc

SEQ ID NO: 1299047 - RNA, 19 nt, Homo sapiens
aaacgaguucuuucuuguu

SEQ ID NO: 1299048 - RNA, 19 nt, Homo sapiens
gaaaguucaaggccaagca

SEQ ID NO: 1299049 - RNA, 19 nt, Homo sapiens
agaagaagaaagagaagga

SEQ ID NO: 1299050 - RNA, 19 nt, Homo sapiens
cgacuucggcaucuccuau

SEQ ID NO: 1299051 - RNA, 19 nt, Homo sapiens
gccaggaugagcagcagua

SEQ ID NO: 1299052 - RNA, 19 nt, Homo sapiens
gugaggugguucccgaugu

SEQ ID NO: 1299053 - RNA, 19 nt, Homo sapiens
caaguacuacagcuucuuc

SEQ ID NO: 1299054 - RNA, 19 nt, Homo sapiens
ugaagauuguggagcagau

SEQ ID NO: 1299055 - RNA, 19 nt, Homo sapiens
gaagaaggagaagaagaag

SEQ ID NO: 1299056 - RNA, 19 nt, Homo sapiens
cgaauuguacacgaguaua

SEQ ID NO: 1299057 - RNA, 19 nt, Homo sapiens
gaggagaugaugguguuug

SEQ ID NO: 1299058 - RNA, 19 nt, Homo sapiens
aggagaagaagaagaaaga

SEQ ID NO: 1299059 - RNA, 19 nt, Homo sapiens
guagcuacaggaugaugaa

SEQ ID NO: 1299060 - RNA, 19 nt, Homo sapiens
gacgcacgccucuucuuug

SEQ ID NO: 1299061 - RNA, 19 nt, Homo sapiens
guucaagggcagcaggaaa

SEQ ID NO: 1299062 - RNA, 19 nt, Homo sapiens
cugagaagaaggagaagaa

SEQ ID NO: 1299063 - RNA, 19 nt, Homo sapiens
caacaugcgccaguggaau

SEQ ID NO: 1299064 - RNA, 19 nt, Homo sapiens
ccuaugucauggucagguu

SEQ ID NO: 1299065 - RNA, 19 nt, Homo sapiens
gcccugcaguaccacauca

SEQ ID NO: 1299066 - RNA, 19 nt, Homo sapiens
cgaguucuuucuuguuacu

SEQ ID NO: 1299067 - RNA, 19 nt, Homo sapiens
ccugagggcaugagugaga

SEQ ID NO: 1299068 - RNA, 19 nt, Homo sapiens
acuacagcuucuucgauuu

SEQ ID NO: 1299069 - RNA, 19 nt, Homo sapiens
ggaagaccagauguagcua

SEQ ID NO: 1299070 - RNA, 19 nt, Homo sapiens
gcaguaccacaucaacaag

SEQ ID NO: 1299071 - RNA, 19 nt, Homo sapiens
gaaggagccagaggaagag

SEQ ID NO: 1299072 - RNA, 19 nt, Homo sapiens
ccacacuguccuacuacaa

SEQ ID NO: 1299073 - RNA, 19 nt, Homo sapiens
gaggaagagcucuaugacu

SEQ ID NO: 1299074 - RNA, 19 nt, Homo sapiens
agagaaggagccagaggaa

SEQ ID NO: 1299075 - RNA, 19 nt, Homo sapiens
gucagaccaugcuauuugg

SEQ ID NO: 1299076 - RNA, 19 nt, Homo sapiens
accagaauguggcccaguu

SEQ ID NO: 1299077 - RNA, 19 nt, Homo sapiens
uggaagcccaccagaaugu

SEQ ID NO: 1299078 - RNA, 19 nt, Homo sapiens
uggcugcgcuucaaguacu

SEQ ID NO: 1299079 - RNA, 19 nt, Homo sapiens
gcacucuggcugcgcuuca

SEQ ID NO: 1299080 - RNA, 19 nt, Homo sapiens
cauuucaccugcugucacu

SEQ ID NO: 1299081 - RNA, 19 nt, Homo sapiens
ggaggaggauccaacaaua

SEQ ID NO: 1299082 - RNA, 19 nt, Homo sapiens
aagcacagcuccagagaaa

SEQ ID NO: 1299083 - RNA, 19 nt, Homo sapiens
gcggucccauugugaaaua

SEQ ID NO: 1299084 - RNA, 19 nt, Homo sapiens
gaggaggauccaacaauaa

SEQ ID NO: 1299085 - RNA, 19 nt, Homo sapiens
gcuaguccaugguacauuc

SEQ ID NO: 1299086 - RNA, 19 nt, Homo sapiens
gcacuggccauccauccua

SEQ ID NO: 1299087 - RNA, 19 nt, Homo sapiens
ccaaggcucuguccuaugc

SEQ ID NO: 1299088 - RNA, 19 nt, Homo sapiens
gcacagcuccagagaaagg

SEQ ID NO: 1299089 - RNA, 19 nt, Homo sapiens
guccaaggcucuguccuau

SEQ ID NO: 1299090 - RNA, 19 nt, Homo sapiens
caaggaggcccugcagcua

SEQ ID NO: 1299091 - RNA, 19 nt, Homo sapiens
cauguuucaucauccugua

SEQ ID NO: 1299092 - RNA, 19 nt, Homo sapiens
ggcaugcggucccauugug

SEQ ID NO: 1299093 - RNA, 19 nt, Homo sapiens
ggccauccauccuacucaa

SEQ ID NO: 1299094 - RNA, 19 nt, Homo sapiens
aaauagcuguguucaucga

SEQ ID NO: 1299095 - RNA, 19 nt, Homo sapiens
gcagauggaauacccuucu

SEQ ID NO: 1299096 - RNA, 19 nt, Homo sapiens
cagauggaauacccuucuu

SEQ ID NO: 1299097 - RNA, 19 nt, Homo sapiens
uuccuuggcuggugaugaa

SEQ ID NO: 1299098 - RNA, 19 nt, Homo sapiens
aggaggauccaacaauaaa

SEQ ID NO: 1299099 - RNA, 19 nt, Homo sapiens
gcuuccuccuucccaagua

SEQ ID NO: 1299100 - RNA, 19 nt, Homo sapiens
gcaugcggucccauuguga

SEQ ID NO: 1299101 - RNA, 19 nt, Homo sapiens
caagcacagcuccagagaa

SEQ ID NO: 1299102 - RNA, 19 nt, Homo sapiens
gcuacgcccuacccgaaag

SEQ ID NO: 1299103 - RNA, 19 nt, Homo sapiens
uaccuaaguuggagcugau

SEQ ID NO: 1299104 - RNA, 19 nt, Homo sapiens
ccaagcacagcuccagaga

SEQ ID NO: 1299105 - RNA, 19 nt, Homo sapiens
cagggaaggacgcacauuc

SEQ ID NO: 1299106 - RNA, 19 nt, Homo sapiens
uguccaaggcucuguccua

SEQ ID NO: 1299107 - RNA, 19 nt, Homo sapiens
ugacuccagggaauacuga

SEQ ID NO: 1299108 - RNA, 19 nt, Homo sapiens
ggacauacuucugcuauua

SEQ ID NO: 1299109 - RNA, 19 nt, Homo sapiens
ggaaagaccuugccuuaga

SEQ ID NO: 1299110 - RNA, 19 nt, Homo sapiens
ggagagggcucacuuauca

SEQ ID NO: 1299111 - RNA, 19 nt, Homo sapiens
gagaagaacccgaaccuua

SEQ ID NO: 1299112 - RNA, 19 nt, Homo sapiens
ggaagagccuuguagagaa

SEQ ID NO: 1299113 - RNA, 19 nt, Homo sapiens
gaaagaccuugccuuagaa

SEQ ID NO: 1299114 - RNA, 19 nt, Homo sapiens
caacaaagagcgggaguua

SEQ ID NO: 1299115 - RNA, 19 nt, Homo sapiens
ggaagaaacagccagaauu

SEQ ID NO: 1299116 - RNA, 19 nt, Homo sapiens
gaagaaacagccagaauuc

SEQ ID NO: 1299117 - RNA, 19 nt, Homo sapiens
ccaagagccuggccaguga

SEQ ID NO: 1299118 - RNA, 19 nt, Homo sapiens
gaaagaggcaggcgcaaug

SEQ ID NO: 1299119 - RNA, 19 nt, Homo sapiens
cauagcaccuggucucaaa

SEQ ID NO: 1299120 - RNA, 19 nt, Homo sapiens
gcacaucugcucacaguug

SEQ ID NO: 1299121 - RNA, 19 nt, Homo sapiens
gaagccaguuaguuugauu

SEQ ID NO: 1299122 - RNA, 19 nt, Homo sapiens
gaaaggagagggcucacuu

SEQ ID NO: 1299123 - RNA, 19 nt, Homo sapiens
ggaaucaguggcuuucuaa

SEQ ID NO: 1299124 - RNA, 19 nt, Homo sapiens
caaaucaagaccacagaua

SEQ ID NO: 1299125 - RNA, 19 nt, Homo sapiens
gauuaggaguaaagaaaga

SEQ ID NO: 1299126 - RNA, 19 nt, Homo sapiens
caacccagguggagcaguu

SEQ ID NO: 1299127 - RNA, 19 nt, Homo sapiens
gcagagaaagacaguggua

SEQ ID NO: 1299128 - RNA, 19 nt, Homo sapiens
agaagaacccgaaccuuaa

SEQ ID NO: 1299129 - RNA, 19 nt, Homo sapiens
agaacuauccaccucauua

SEQ ID NO: 1299130 - RNA, 19 nt, Homo sapiens
gaauguccaucucauaagg

SEQ ID NO: 1299131 - RNA, 19 nt, Homo sapiens
gaaacagccagaauucaau

SEQ ID NO: 1299132 - RNA, 19 nt, Homo sapiens
gaagagccuuguagagaac

SEQ ID NO: 1299133 - RNA, 19 nt, Homo sapiens
gcuccugcauguuauuuau

SEQ ID NO: 1299134 - RNA, 19 nt, Homo sapiens
ggacagagacaggcaggaa

SEQ ID NO: 1299135 - RNA, 19 nt, Homo sapiens
ugacuggguuagagaagaa

SEQ ID NO: 1299136 - RNA, 19 nt, Homo sapiens
gaacuauccaccucauuag

SEQ ID NO: 1299137 - RNA, 19 nt, Homo sapiens
aagcaaagccaaaucaaga

SEQ ID NO: 1299138 - RNA, 19 nt, Homo sapiens
caggagagaugagggagaa

SEQ ID NO: 1299139 - RNA, 19 nt, Homo sapiens
cggcugcuccugcauguua

SEQ ID NO: 1299140 - RNA, 19 nt, Homo sapiens
gagaagaaccgggaugcaa

SEQ ID NO: 1299141 - RNA, 19 nt, Homo sapiens
aaacagccagaauucaaua

SEQ ID NO: 1299142 - RNA, 19 nt, Homo sapiens
gugcacaucugcucacagu

SEQ ID NO: 1299143 - RNA, 19 nt, Homo sapiens
uggaaucaguggcuuucua

SEQ ID NO: 1299144 - RNA, 19 nt, Homo sapiens
gacauacuucugcuauuaa

SEQ ID NO: 1299145 - RNA, 19 nt, Homo sapiens
ucauaaggcugagagcuau

SEQ ID NO: 1299146 - RNA, 19 nt, Homo sapiens
gcauaggaguugcuugaac

SEQ ID NO: 1299147 - RNA, 19 nt, Homo sapiens
ucaaacaggccacccaguu

SEQ ID NO: 1299148 - RNA, 19 nt, Homo sapiens
acuuaucacuugugccaua

SEQ ID NO: 1299149 - RNA, 19 nt, Homo sapiens
guacagcuaaccugaacaa

SEQ ID NO: 1299150 - RNA, 19 nt, Homo sapiens
caauggcucaugccuguaa

SEQ ID NO: 1299151 - RNA, 19 nt, Homo sapiens
acucagacuucaccuauuc

SEQ ID NO: 1299152 - RNA, 19 nt, Homo sapiens
ccacucagacuucaccuau

SEQ ID NO: 1299153 - RNA, 19 nt, Homo sapiens
acaaagagcgggaguuagu

SEQ ID NO: 1299154 - RNA, 19 nt, Homo sapiens
agggaaagaccuugccuua

SEQ ID NO: 1299155 - RNA, 19 nt, Homo sapiens
caggagagcaggaggaaga

SEQ ID NO: 1299156 - RNA, 19 nt, Homo sapiens
gaagaacccgaaccuuaag

SEQ ID NO: 1299157 - RNA, 19 nt, Homo sapiens
cagccagaauucaauacaa

SEQ ID NO: 1299158 - RNA, 19 nt, Homo sapiens
ccauuggaauaaacucuug

SEQ ID NO: 1299159 - RNA, 19 nt, Homo sapiens
agaaacagccagaauucaa

SEQ ID NO: 1299160 - RNA, 19 nt, Homo sapiens
aaaggagagggcucacuua

SEQ ID NO: 1299161 - RNA, 19 nt, Homo sapiens
ugagguggguggaucacuu

SEQ ID NO: 1299162 - RNA, 19 nt, Homo sapiens
ggaguuaguauaggaaugu

SEQ ID NO: 1299163 - RNA, 19 nt, Homo sapiens
caaagagcgggaguuagua

SEQ ID NO: 1299164 - RNA, 19 nt, Homo sapiens
gaaaagcaaagccaaauca

SEQ ID NO: 1299165 - RNA, 19 nt, Homo sapiens
gcucagcugcuucuccauu

SEQ ID NO: 1299166 - RNA, 19 nt, Homo sapiens
gagucuuucuggcugguuu

SEQ ID NO: 1299167 - RNA, 19 nt, Homo sapiens
caaacaggccacccaguuc

SEQ ID NO: 1299168 - RNA, 19 nt, Homo sapiens
ccaaacacaacucaacuuc

SEQ ID NO: 1299169 - RNA, 19 nt, Homo sapiens
ggucuugugcugugccuuu

SEQ ID NO: 1299170 - RNA, 19 nt, Homo sapiens
ggaaggcugaggcauagga

SEQ ID NO: 1299171 - RNA, 19 nt, Homo sapiens
uggauuaggaguaaagaaa

SEQ ID NO: 1299172 - RNA, 19 nt, Homo sapiens
cagcauucuuucugauuuc

SEQ ID NO: 1299173 - RNA, 19 nt, Homo sapiens
gggaagaaacagccagaau

SEQ ID NO: 1299174 - RNA, 19 nt, Homo sapiens
ccaggauucugauucaucu

SEQ ID NO: 1299175 - RNA, 19 nt, Homo sapiens
gaccuugccuuagaagaag

SEQ ID NO: 1299176 - RNA, 19 nt, Homo sapiens
ggugguggaugcugagagu

SEQ ID NO: 1299177 - RNA, 19 nt, Homo sapiens
uggaagagccuuguagaga

SEQ ID NO: 1299178 - RNA, 19 nt, Homo sapiens
ccuuguccaucacccaaua

SEQ ID NO: 1299179 - RNA, 19 nt, Homo sapiens
cacuugaggucaggaguuu

SEQ ID NO: 1299180 - RNA, 19 nt, Homo sapiens
ccagaucccugagagucuu

SEQ ID NO: 1299181 - RNA, 19 nt, Homo sapiens
ucggaucucugcuggaugu

SEQ ID NO: 1299182 - RNA, 19 nt, Homo sapiens
aggaauguccaucucauaa

SEQ ID NO: 1299183 - RNA, 19 nt, Homo sapiens
cacaucugcucacaguuga

SEQ ID NO: 1299184 - RNA, 19 nt, Homo sapiens
guauuguccuggaaucagu

SEQ ID NO: 1299185 - RNA, 19 nt, Homo sapiens
gagguugucaccacucaga

SEQ ID NO: 1299186 - RNA, 19 nt, Homo sapiens
ccacccaguuccugcacaa

SEQ ID NO: 1299187 - RNA, 19 nt, Homo sapiens
ggaauguccaucucauaag

SEQ ID NO: 1299188 - RNA, 19 nt, Homo sapiens
gggaguuaguauaggaaug

SEQ ID NO: 1299189 - RNA, 19 nt, Homo sapiens
ggcccacgaugccaggauu

SEQ ID NO: 1299190 - RNA, 19 nt, Homo sapiens
ccaauacaaucggaucucu

SEQ ID NO: 1299191 - RNA, 19 nt, Homo sapiens
ucucuggccucuugagcuu

SEQ ID NO: 1299192 - RNA, 19 nt, Homo sapiens
ucgggaaauuggagacuga

SEQ ID NO: 1299193 - RNA, 19 nt, Homo sapiens
acacaggcacccaauacaa

SEQ ID NO: 1299194 - RNA, 19 nt, Homo sapiens
guauaggaauguccaucuc

SEQ ID NO: 1299195 - RNA, 19 nt, Homo sapiens
agaccuugccuuagaagaa

SEQ ID NO: 1299196 - RNA, 19 nt, Homo sapiens
ucacugccuugcuccacaa

SEQ ID NO: 1299197 - RNA, 19 nt, Homo sapiens
aaagacagugguacagcua

SEQ ID NO: 1299198 - RNA, 19 nt, Homo sapiens
ccuguaaucccagcacuuu

SEQ ID NO: 1299199 - RNA, 19 nt, Homo sapiens
ggauuaggaguaaagaaag

SEQ ID NO: 1299200 - RNA, 19 nt, Homo sapiens
ucuggccucuugagcuuaa

SEQ ID NO: 1299201 - RNA, 19 nt, Homo sapiens
gucugaagccaguuaguuu

SEQ ID NO: 1299202 - RNA, 19 nt, Homo sapiens
uaggaauguccaucucaua

SEQ ID NO: 1299203 - RNA, 19 nt, Homo sapiens
gcugacugcuguccuuguc

SEQ ID NO: 1299204 - RNA, 19 nt, Homo sapiens
gagacccuccuguuggaaa

SEQ ID NO: 1299205 - RNA, 19 nt, Homo sapiens
agacucugcuuucucucaa

SEQ ID NO: 1299206 - RNA, 19 nt, Homo sapiens
ugacacaggcacccaauac

SEQ ID NO: 1299207 - RNA, 19 nt, Homo sapiens
cuucugcuauuaacgcuau

SEQ ID NO: 1299208 - RNA, 19 nt, Homo sapiens
ggaagaagcuggaagaaga

SEQ ID NO: 1299209 - RNA, 19 nt, Homo sapiens
ccgcagagcuggaggcuaa

SEQ ID NO: 1299210 - RNA, 19 nt, Homo sapiens
ggacaucgcuaaguacuag

SEQ ID NO: 1299211 - RNA, 19 nt, Homo sapiens
caacaacaaaugcugcuua

SEQ ID NO: 1299212 - RNA, 19 nt, Homo sapiens
ccacuacgcugccgccaaa

SEQ ID NO: 1299213 - RNA, 19 nt, Homo sapiens
cgcuagagcugcagacaua

SEQ ID NO: 1299214 - RNA, 19 nt, Homo sapiens
caccaagucuuucaacaug

SEQ ID NO: 1299215 - RNA, 19 nt, Homo sapiens
ugaacuggcucuugcauca

SEQ ID NO: 1299216 - RNA, 19 nt, Homo sapiens
ggcauguccucacccaaua

SEQ ID NO: 1299217 - RNA, 19 nt, Homo sapiens
gcagagugcaggacaaaga

SEQ ID NO: 1299218 - RNA, 19 nt, Homo sapiens
ccagcacccucuccaacua

SEQ ID NO: 1299219 - RNA, 19 nt, Homo sapiens
gcaugccgacuuacauaua

SEQ ID NO: 1299220 - RNA, 19 nt, Homo sapiens
cgacuuacauauauuugca

SEQ ID NO: 1299221 - RNA, 19 nt, Homo sapiens
uuauuugcaugccgacuua

SEQ ID NO: 1299222 - RNA, 19 nt, Homo sapiens
gcauguucguugacuauca

SEQ ID NO: 1299223 - RNA, 19 nt, Homo sapiens
gcaagaugcagcugaagau

SEQ ID NO: 1299224 - RNA, 19 nt, Homo sapiens
gaccucagcucgccuacca

SEQ ID NO: 1299225 - RNA, 19 nt, Homo sapiens
aaagcgcucucaucuggaa

SEQ ID NO: 1299226 - RNA, 19 nt, Homo sapiens
caugccgacuuacauauau

SEQ ID NO: 1299227 - RNA, 19 nt, Homo sapiens
gaaggaacagucagagaag

SEQ ID NO: 1299228 - RNA, 19 nt, Homo sapiens
gagcuacuggcugagauua

SEQ ID NO: 1299229 - RNA, 19 nt, Homo sapiens
gcaccaagucuuucaacau

SEQ ID NO: 1299230 - RNA, 19 nt, Homo sapiens
gcaaggggcugaccacagu

SEQ ID NO: 1299231 - RNA, 19 nt, Homo sapiens
ccaagucuuucaacaugau

SEQ ID NO: 1299232 - RNA, 19 nt, Homo sapiens
acaggcagcugacaucuac

SEQ ID NO: 1299233 - RNA, 19 nt, Homo sapiens
gagaaggaacagucagaga

SEQ ID NO: 1299234 - RNA, 19 nt, Homo sapiens
cagcugacaucuacaugca

SEQ ID NO: 1299235 - RNA, 19 nt, Homo sapiens
agaaggaacagucagagaa

SEQ ID NO: 1299236 - RNA, 19 nt, Homo sapiens
cugcagacauacagagcua

SEQ ID NO: 1299237 - RNA, 19 nt, Homo sapiens
gguuuccucucagucauuu

SEQ ID NO: 1299238 - RNA, 19 nt, Homo sapiens
cgccaaggguuuccucuca

SEQ ID NO: 1299239 - RNA, 19 nt, Homo sapiens
gcuacuggcugagauuaag

SEQ ID NO: 1299240 - RNA, 19 nt, Homo sapiens
ggacguggaggcucucauc

SEQ ID NO: 1299241 - RNA, 19 nt, Homo sapiens
gucauuuguuuaccagaaa

SEQ ID NO: 1299242 - RNA, 19 nt, Homo sapiens
aacaacaaaugcugcuuau

SEQ ID NO: 1299243 - RNA, 19 nt, Homo sapiens
ccaaggguuuccucucagu

SEQ ID NO: 1299244 - RNA, 19 nt, Homo sapiens
aagaagagagggagcagaa

SEQ ID NO: 1299245 - RNA, 19 nt, Homo sapiens
ugacgcaaacaacaacaaa

SEQ ID NO: 1299246 - RNA, 19 nt, Homo sapiens
gaagaagcuggaagaagag

SEQ ID NO: 1299247 - RNA, 19 nt, Homo sapiens
gcccagucaucgugugguu

SEQ ID NO: 1299248 - RNA, 19 nt, Homo sapiens
gugaaugcccaaaccaaga

SEQ ID NO: 1299249 - RNA, 19 nt, Homo sapiens
uggagugaauagaggauga

SEQ ID NO: 1299250 - RNA, 19 nt, Homo sapiens
ccucucagucauuuguuua

SEQ ID NO: 1299251 - RNA, 19 nt, Homo sapiens
gcaaacaacaacaaaugcu

SEQ ID NO: 1299252 - RNA, 19 nt, Homo sapiens
gggagaaggaacagucaga

SEQ ID NO: 1299253 - RNA, 19 nt, Homo sapiens
ugaaugcccaaaccaagaa

SEQ ID NO: 1299254 - RNA, 19 nt, Homo sapiens
agucauuuguuuaccagaa

SEQ ID NO: 1299255 - RNA, 19 nt, Homo sapiens
ccaagcugcugacgcaaac

SEQ ID NO: 1299256 - RNA, 19 nt, Homo sapiens
cugggaagcugcacugucu

SEQ ID NO: 1299257 - RNA, 19 nt, Homo sapiens
gagauuaaggcaggcaaga

SEQ ID NO: 1299258 - RNA, 19 nt, Homo sapiens
cauuaaagcgcucucaucu

SEQ ID NO: 1299259 - RNA, 19 nt, Homo sapiens
ggacgcugggcuacgauga

SEQ ID NO: 1299260 - RNA, 19 nt, Homo sapiens
ugugucaccugcacuguca

SEQ ID NO: 1299261 - RNA, 19 nt, Homo sapiens
ggagcuacuggcugagauu

SEQ ID NO: 1299262 - RNA, 19 nt, Homo sapiens
gacccugugucuccaacug

SEQ ID NO: 1299263 - RNA, 19 nt, Homo sapiens
gagugaaugcccaaaccaa

SEQ ID NO: 1299264 - RNA, 19 nt, Homo sapiens
acgcaaacaacaacaaaug

SEQ ID NO: 1299265 - RNA, 19 nt, Homo sapiens
agacauacagagcuacaug

SEQ ID NO: 1299266 - RNA, 19 nt, Homo sapiens
gcagacauacagagcuaca

SEQ ID NO: 1299267 - RNA, 19 nt, Homo sapiens
gccgcugccuucuguguca

SEQ ID NO: 1299268 - RNA, 19 nt, Homo sapiens
gcaggacaaagacaauucu

SEQ ID NO: 1299269 - RNA, 19 nt, Homo sapiens
auauuugcauguucguuga

SEQ ID NO: 1299270 - RNA, 19 nt, Homo sapiens
cgccacgguugcccagaaa

SEQ ID NO: 1299271 - RNA, 19 nt, Homo sapiens
ccaccucgcagccccauua

SEQ ID NO: 1299272 - RNA, 19 nt, Homo sapiens
cguggguggugacuuuguu

SEQ ID NO: 1299273 - RNA, 19 nt, Homo sapiens
caagaugcagcugaagaug

SEQ ID NO: 1299274 - RNA, 19 nt, Homo sapiens
ccauuaaagcgcucucauc

SEQ ID NO: 1299275 - RNA, 19 nt, Homo sapiens
uugcaugccgacuuacaua

SEQ ID NO: 1299276 - RNA, 19 nt, Homo sapiens
gggacaucgcuaaguacua

SEQ ID NO: 1299277 - RNA, 19 nt, Homo sapiens
acaucuacaugcagaccaa

SEQ ID NO: 1299278 - RNA, 19 nt, Homo sapiens
gggagugaaugcccaaacc

SEQ ID NO: 1299279 - RNA, 19 nt, Homo sapiens
gggagcagaagcggaaaga

SEQ ID NO: 1299280 - RNA, 19 nt, Homo sapiens
gcuagagugcugccagauc

SEQ ID NO: 1299281 - RNA, 19 nt, Homo sapiens
cgacaacucggagcuacug

SEQ ID NO: 1299282 - RNA, 19 nt, Homo sapiens
ggugauggugcgcaagaug

SEQ ID NO: 1299283 - RNA, 19 nt, Homo sapiens
gcucaauggaagcuugguu

SEQ ID NO: 1299284 - RNA, 19 nt, Homo sapiens
gaacugguuugauuucuaa

SEQ ID NO: 1299285 - RNA, 19 nt, Homo sapiens
gaagaaaccuacacuccaa

SEQ ID NO: 1299286 - RNA, 19 nt, Homo sapiens
caaaugggcuagaguaaga

SEQ ID NO: 1299287 - RNA, 19 nt, Homo sapiens
ggugaugccuucuuucuuu

SEQ ID NO: 1299288 - RNA, 19 nt, Homo sapiens
gcaacucacugcccaagaa

SEQ ID NO: 1299289 - RNA, 19 nt, Homo sapiens
ggagaacgcggucuacuuu

SEQ ID NO: 1299290 - RNA, 19 nt, Homo sapiens
gcaaaggguccacguguaa

SEQ ID NO: 1299291 - RNA, 19 nt, Homo sapiens
ggaccuggcugucuuuauc

SEQ ID NO: 1299292 - RNA, 19 nt, Homo sapiens
gaucgggacccuuucuuua

SEQ ID NO: 1299293 - RNA, 19 nt, Homo sapiens
ccaaugaguuucaggaaug

SEQ ID NO: 1299294 - RNA, 19 nt, Homo sapiens
gagguuagcagcucaguuu

SEQ ID NO: 1299295 - RNA, 19 nt, Homo sapiens
caacuuguguuaccgagaa

SEQ ID NO: 1299296 - RNA, 19 nt, Homo sapiens
ggaaacaagacuauaaaug

SEQ ID NO: 1299297 - RNA, 19 nt, Homo sapiens
ggaggcagcugcaggaaca

SEQ ID NO: 1299298 - RNA, 19 nt, Homo sapiens
gcaaauaccagcacaacga

SEQ ID NO: 1299299 - RNA, 19 nt, Homo sapiens
ucacucagcccgcaguuua

SEQ ID NO: 1299300 - RNA, 19 nt, Homo sapiens
ugaaagaacuagcagaaag

SEQ ID NO: 1299301 - RNA, 19 nt, Homo sapiens
uaugaaagcucgucuagca

SEQ ID NO: 1299302 - RNA, 19 nt, Homo sapiens
ccaaacaucugggaaacuu

SEQ ID NO: 1299303 - RNA, 19 nt, Homo sapiens
gaaguacccuuuuguaaau

SEQ ID NO: 1299304 - RNA, 19 nt, Homo sapiens
gaaagcucgucuagcauau

SEQ ID NO: 1299305 - RNA, 19 nt, Homo sapiens
ugaaacgacucuugccaaa

SEQ ID NO: 1299306 - RNA, 19 nt, Homo sapiens
guuugaagcccaagucuua

SEQ ID NO: 1299307 - RNA, 19 nt, Homo sapiens
gaaaugaaguacccuuuug

SEQ ID NO: 1299308 - RNA, 19 nt, Homo sapiens
gcucauucauggugucaaa

SEQ ID NO: 1299309 - RNA, 19 nt, Homo sapiens
caggauggcucuauacaca

SEQ ID NO: 1299310 - RNA, 19 nt, Homo sapiens
gaaguagaagguaguuauu

SEQ ID NO: 1299311 - RNA, 19 nt, Homo sapiens
cuacugggcuccgguguuu

SEQ ID NO: 1299312 - RNA, 19 nt, Homo sapiens
gcagcucaguuugugguua

SEQ ID NO: 1299313 - RNA, 19 nt, Homo sapiens
ggacguccucucuccuuua

SEQ ID NO: 1299314 - RNA, 19 nt, Homo sapiens
gugaacaccugccggaaga

SEQ ID NO: 1299315 - RNA, 19 nt, Homo sapiens
gcauuguagucuagucgua

SEQ ID NO: 1299316 - RNA, 19 nt, Homo sapiens
gaacuagcagaaagucaaa

SEQ ID NO: 1299317 - RNA, 19 nt, Homo sapiens
gcaaagacgaaccuuccua

SEQ ID NO: 1299318 - RNA, 19 nt, Homo sapiens
ugaaagcucgucuagcaua

SEQ ID NO: 1299319 - RNA, 19 nt, Homo sapiens
gaaagaacuagcagaaagu

SEQ ID NO: 1299320 - RNA, 19 nt, Homo sapiens
gaagaggccuuuugagcaa

SEQ ID NO: 1299321 - RNA, 19 nt, Homo sapiens
gcgaagaucuuuggaacuc

SEQ ID NO: 1299322 - RNA, 19 nt, Homo sapiens
ccagugggcucgcuuccaa

SEQ ID NO: 1299323 - RNA, 19 nt, Homo sapiens
aaacuaagauacuguagac

SEQ ID NO: 1299324 - RNA, 19 nt, Homo sapiens
gcucagcugugcccguuug

SEQ ID NO: 1299325 - RNA, 19 nt, Homo sapiens
ucacaggacuacgugcuuu

SEQ ID NO: 1299326 - RNA, 19 nt, Homo sapiens
guucagcagucacuucaga

SEQ ID NO: 1299327 - RNA, 19 nt, Homo sapiens
gcuauguguucuucuguug

SEQ ID NO: 1299328 - RNA, 19 nt, Homo sapiens
uggaauauuugucuucaga

SEQ ID NO: 1299329 - RNA, 19 nt, Homo sapiens
uaagagggcugcggguaug

SEQ ID NO: 1299330 - RNA, 19 nt, Homo sapiens
aaacggacgagaugaauga

SEQ ID NO: 1299331 - RNA, 19 nt, Homo sapiens
gugcugguuucucauauug

SEQ ID NO: 1299332 - RNA, 19 nt, Homo sapiens
ccuaggugaugccuucuuu

SEQ ID NO: 1299333 - RNA, 19 nt, Homo sapiens
ggugaaagaacuagcagaa

SEQ ID NO: 1299334 - RNA, 19 nt, Homo sapiens
agacaaaugggcuagagua

SEQ ID NO: 1299335 - RNA, 19 nt, Homo sapiens
aaacuuccuuugacugaug

SEQ ID NO: 1299336 - RNA, 19 nt, Homo sapiens
gaaacuggaauauuugucu

SEQ ID NO: 1299337 - RNA, 19 nt, Homo sapiens
gaccugggaugacgaacug

SEQ ID NO: 1299338 - RNA, 19 nt, Homo sapiens
gagcaagcgccaaugaguu

SEQ ID NO: 1299339 - RNA, 19 nt, Homo sapiens
gaugugacaccaagaugaa

SEQ ID NO: 1299340 - RNA, 19 nt, Homo sapiens
ccacguuguugcaauuguu

SEQ ID NO: 1299341 - RNA, 19 nt, Homo sapiens
gggccacguuguugcaauu

SEQ ID NO: 1299342 - RNA, 19 nt, Homo sapiens
gaccaaguuucacucuguu

SEQ ID NO: 1299343 - RNA, 19 nt, Homo sapiens
cuucauggcccaccuguuu

SEQ ID NO: 1299344 - RNA, 19 nt, Homo sapiens
gacaaaugggcuagaguaa

SEQ ID NO: 1299345 - RNA, 19 nt, Homo sapiens
ccacaaggcgaagaucuuu

SEQ ID NO: 1299346 - RNA, 19 nt, Homo sapiens
gcccacaggaugaacauuu

SEQ ID NO: 1299347 - RNA, 19 nt, Homo sapiens
ccaaguaccugggacuaca

SEQ ID NO: 1299348 - RNA, 19 nt, Homo sapiens
aagcaauucucaugcauca

SEQ ID NO: 1299349 - RNA, 19 nt, Homo sapiens
ggcgugaucucugcucauu

SEQ ID NO: 1299350 - RNA, 19 nt, Homo sapiens
cagcucaguuugugguuau

SEQ ID NO: 1299351 - RNA, 19 nt, Homo sapiens
ugaaguagaagguaguuau

SEQ ID NO: 1299352 - RNA, 19 nt, Homo sapiens
gaaaggccuuccggaucuu

SEQ ID NO: 1299353 - RNA, 19 nt, Homo sapiens
caaagcgugugcugguuuc

SEQ ID NO: 1299354 - RNA, 19 nt, Homo sapiens
ugggaggaauggagucuuu

SEQ ID NO: 1299355 - RNA, 19 nt, Homo sapiens
gccaaugaguuucaggaau

SEQ ID NO: 1299356 - RNA, 19 nt, Homo sapiens
gcugucaggcagugaauuu

SEQ ID NO: 1299357 - RNA, 19 nt, Homo sapiens
aagugaaagugcaggauuu

SEQ ID NO: 1299358 - RNA, 19 nt, Homo sapiens
agaccaaguuucacucugu

SEQ ID NO: 1299359 - RNA, 19 nt, Homo sapiens
cuacgugcuuugugcauug

SEQ ID NO: 1299360 - RNA, 19 nt, Homo sapiens
gcccaacgucacucucuua

SEQ ID NO: 1299361 - RNA, 19 nt, Homo sapiens
aaacgacucuugccaaacg

SEQ ID NO: 1299362 - RNA, 19 nt, Homo sapiens
ccacgcacccgaugaccua

SEQ ID NO: 1299363 - RNA, 19 nt, Homo sapiens
gcucuuugcugcuuuuaaa

SEQ ID NO: 1299364 - RNA, 19 nt, Homo sapiens
ggaucgggacccuuucuuu

SEQ ID NO: 1299365 - RNA, 19 nt, Homo sapiens
caaugaguuucaggaauga

SEQ ID NO: 1299366 - RNA, 19 nt, Homo sapiens
gaaacuuccuuugacugau

SEQ ID NO: 1299367 - RNA, 19 nt, Homo sapiens
cgagaugaaugagguggaa

SEQ ID NO: 1299368 - RNA, 19 nt, Homo sapiens
gaaacggacgagaugaaug

SEQ ID NO: 1299369 - RNA, 19 nt, Homo sapiens
gagaugggguuucauuaug

SEQ ID NO: 1299370 - RNA, 19 nt, Homo sapiens
ggacuacaggcgugagcua

SEQ ID NO: 1299371 - RNA, 19 nt, Homo sapiens
gucugugucugcaagauaa

SEQ ID NO: 1299372 - RNA, 19 nt, Homo sapiens
ucaacuacaugacccaagu

SEQ ID NO: 1299373 - RNA, 19 nt, Homo sapiens
ccaaagcgugugcugguuu

SEQ ID NO: 1299374 - RNA, 19 nt, Homo sapiens
gaaaauggaaacaagacua

SEQ ID NO: 1299375 - RNA, 19 nt, Homo sapiens
gaguugaccccaucauuua

SEQ ID NO: 1299376 - RNA, 19 nt, Homo sapiens
guuagcagcucaguuugug

SEQ ID NO: 1299377 - RNA, 19 nt, Homo sapiens
guaagagggcugcggguau

SEQ ID NO: 1299378 - RNA, 19 nt, Homo sapiens
ugcagucccucagcaaaua

SEQ ID NO: 1299379 - RNA, 19 nt, Homo sapiens
ccaccaaacaucugggaaa

SEQ ID NO: 1299380 - RNA, 19 nt, Homo sapiens
gaauggagucuuugguaca

SEQ ID NO: 1299381 - RNA, 19 nt, Homo sapiens
cauucaggauggcucuaua

SEQ ID NO: 1299382 - RNA, 19 nt, Homo sapiens
ggacuccucgggauggaaa

SEQ ID NO: 1299383 - RNA, 19 nt, Homo sapiens
ccauggaccuggcugucuu

SEQ ID NO: 1299384 - RNA, 19 nt, Homo sapiens
ggaucuagcuccuguauau

SEQ ID NO: 1299385 - RNA, 19 nt, Homo sapiens
ggaaguacaucauugaacu

SEQ ID NO: 1299386 - RNA, 19 nt, Homo sapiens
gaacucaaccacaugauca

SEQ ID NO: 1299387 - RNA, 19 nt, Homo sapiens
ucaaccacaugaucaaaga

SEQ ID NO: 1299388 - RNA, 19 nt, Homo sapiens
gaaauaugaacaggccuuu

SEQ ID NO: 1299389 - RNA, 19 nt, Homo sapiens
ucuagcuccuguauauaua

SEQ ID NO: 1299390 - RNA, 19 nt, Homo sapiens
gauugucaccggagguaua

SEQ ID NO: 1299391 - RNA, 19 nt, Homo sapiens
ccagugcaccguuugcuuu

SEQ ID NO: 1299392 - RNA, 19 nt, Homo sapiens
uuucaaagcccaagacguu

SEQ ID NO: 1299393 - RNA, 19 nt, Homo sapiens
gaacugcaagaccacuuug

SEQ ID NO: 1299394 - RNA, 19 nt, Homo sapiens
gaucuagcuccuguauaua

SEQ ID NO: 1299395 - RNA, 19 nt, Homo sapiens
gcagccagaaguacaaaga

SEQ ID NO: 1299396 - RNA, 19 nt, Homo sapiens
aauaugaacaggccuuuga

SEQ ID NO: 1299397 - RNA, 19 nt, Homo sapiens
gggcgugccuaccucuuca

SEQ ID NO: 1299398 - RNA, 19 nt, Homo sapiens
caccugcccuauaguuaug

SEQ ID NO: 1299399 - RNA, 19 nt, Homo sapiens
gugccuaccucuucaacuc

SEQ ID NO: 1299400 - RNA, 19 nt, Homo sapiens
ccacuuugggcuggaaaua

SEQ ID NO: 1299401 - RNA, 19 nt, Homo sapiens
ccaccugcccuauaguuau

SEQ ID NO: 1299402 - RNA, 19 nt, Homo sapiens
uuuauugcaugcacuguga

SEQ ID NO: 1299403 - RNA, 19 nt, Homo sapiens
gagagcagccagaaguaca

SEQ ID NO: 1299404 - RNA, 19 nt, Homo sapiens
cgaucuggcuggcuuggau

SEQ ID NO: 1299405 - RNA, 19 nt, Homo sapiens
caaccacgacgaccucauc

SEQ ID NO: 1299406 - RNA, 19 nt, Homo sapiens
gugcaccguuugcuuugug

SEQ ID NO: 1299407 - RNA, 19 nt, Homo sapiens
gcagaggacggaucuagcu

SEQ ID NO: 1299408 - RNA, 19 nt, Homo sapiens
gaggggaaguacaucauug

SEQ ID NO: 1299409 - RNA, 19 nt, Homo sapiens
agacaacggcugggacuga

SEQ ID NO: 1299410 - RNA, 19 nt, Homo sapiens
acuuugggcuggaaauaug

SEQ ID NO: 1299411 - RNA, 19 nt, Homo sapiens
acgacgaccucaucuccaa

SEQ ID NO: 1299412 - RNA, 19 nt, Homo sapiens
guagcguuuguacauaaua

SEQ ID NO: 1299413 - RNA, 19 nt, Homo sapiens
ccauggugcggauuucaaa

SEQ ID NO: 1299414 - RNA, 19 nt, Homo sapiens
gaaguacaucauugaacuc

SEQ ID NO: 1299415 - RNA, 19 nt, Homo sapiens
gagcagccagaaguacaaa

SEQ ID NO: 1299416 - RNA, 19 nt, Homo sapiens
caaagcccaagacguuuca

SEQ ID NO: 1299417 - RNA, 19 nt, Homo sapiens
cuauaguuauggccugugu

SEQ ID NO: 1299418 - RNA, 19 nt, Homo sapiens
aggccuacuuggaugauug

SEQ ID NO: 1299419 - RNA, 19 nt, Homo sapiens
ucaaagcccaagacguuuc

SEQ ID NO: 1299420 - RNA, 19 nt, Homo sapiens
gaucuggcuggcuuggauu

SEQ ID NO: 1299421 - RNA, 19 nt, Homo sapiens
gagaacugcaagaccacuu

SEQ ID NO: 1299422 - RNA, 19 nt, Homo sapiens
cgacauccacugcgagaac

SEQ ID NO: 1299423 - RNA, 19 nt, Homo sapiens
ucaacucaguggugaacgu

SEQ ID NO: 1299424 - RNA, 19 nt, Homo sapiens
agaacugcaagaccacuuu

SEQ ID NO: 1299425 - RNA, 19 nt, Homo sapiens
gcaagauccucauccagua

SEQ ID NO: 1299426 - RNA, 19 nt, Homo sapiens
gcacaagcaccaggucaaa

SEQ ID NO: 1299427 - RNA, 19 nt, Homo sapiens
ucucaaggcuuccuccaau

SEQ ID NO: 1299428 - RNA, 19 nt, Homo sapiens
gcuugaggaaucuuauuua

SEQ ID NO: 1299429 - RNA, 19 nt, Homo sapiens
ggaccaggagucagaaugu

SEQ ID NO: 1299430 - RNA, 19 nt, Homo sapiens
aauuugaacuagucuguug

SEQ ID NO: 1299431 - RNA, 19 nt, Homo sapiens
guggcuaccugcacaagga

SEQ ID NO: 1299432 - RNA, 19 nt, Homo sapiens
ggaggccgacgcagucauu

SEQ ID NO: 1299433 - RNA, 19 nt, Homo sapiens
caaauuugaacuagucugu

SEQ ID NO: 1299434 - RNA, 19 nt, Homo sapiens
uaagggagacuucuuucug

SEQ ID NO: 1299435 - RNA, 19 nt, Homo sapiens
ggguaagggagacuucuuu

SEQ ID NO: 1299436 - RNA, 19 nt, Homo sapiens
acacacugcugcacaaggu

SEQ ID NO: 1299437 - RNA, 19 nt, Homo sapiens
gaccaggagucagaaugug

SEQ ID NO: 1299438 - RNA, 19 nt, Homo sapiens
cuuuacagaccgcuaauaa

SEQ ID NO: 1299439 - RNA, 19 nt, Homo sapiens
gacccugggaggugcuuua

SEQ ID NO: 1299440 - RNA, 19 nt, Homo sapiens
ccauggugcuggugugcuu

SEQ ID NO: 1299441 - RNA, 19 nt, Homo sapiens
uuacagaccgcuaauaaaa

SEQ ID NO: 1299442 - RNA, 19 nt, Homo sapiens
uaggccagcuugaggaauc

SEQ ID NO: 1299443 - RNA, 19 nt, Homo sapiens
gcugugcccuacuucaucu

SEQ ID NO: 1299444 - RNA, 19 nt, Homo sapiens
gagaggacgccccaacuaa

SEQ ID NO: 1299445 - RNA, 19 nt, Homo sapiens
ccugcaagcacaucauuga

SEQ ID NO: 1299446 - RNA, 19 nt, Homo sapiens
acagaccgcuaauaaaaga

SEQ ID NO: 1299447 - RNA, 19 nt, Homo sapiens
ccugggaggugcuuuacag

SEQ ID NO: 1299448 - RNA, 19 nt, Homo sapiens
ggagaggacgccccaacua

SEQ ID NO: 1299449 - RNA, 19 nt, Homo sapiens
gguaagggagacuucuuuc

SEQ ID NO: 1299450 - RNA, 19 nt, Homo sapiens
ccucagcucuacugguucu

SEQ ID NO: 1299451 - RNA, 19 nt, Homo sapiens
uuucuggguugcauguuga

SEQ ID NO: 1299452 - RNA, 19 nt, Homo sapiens
cgacgcagucauugucuca

SEQ ID NO: 1299453 - RNA, 19 nt, Homo sapiens
acccaaauuugaacuaguc

SEQ ID NO: 1299454 - RNA, 19 nt, Homo sapiens
guaagggagacuucuuucu

SEQ ID NO: 1299455 - RNA, 19 nt, Homo sapiens
gugcuuuacagaccgcuaa

SEQ ID NO: 1299456 - RNA, 19 nt, Homo sapiens
gguaggccagcuugaggaa

SEQ ID NO: 1299457 - RNA, 19 nt, Homo sapiens
ggacaccaacaggguuuca

SEQ ID NO: 1299458 - RNA, 19 nt, Homo sapiens
cagcuugaggaaucuuauu

SEQ ID NO: 1299459 - RNA, 19 nt, Homo sapiens
gcucuuucccuaccuguac

SEQ ID NO: 1299460 - RNA, 19 nt, Homo sapiens
caacaaaugugagucauaa

SEQ ID NO: 1299461 - RNA, 19 nt, Homo sapiens
gcacuaagccuaagaaguu

SEQ ID NO: 1299462 - RNA, 19 nt, Homo sapiens
gguaagggcuguugaggua

SEQ ID NO: 1299463 - RNA, 19 nt, Homo sapiens
caacaguucuucaagugua

SEQ ID NO: 1299464 - RNA, 19 nt, Homo sapiens
gguaaagcguuucuucuaa

SEQ ID NO: 1299465 - RNA, 19 nt, Homo sapiens
gaaggcaacagcacaguua

SEQ ID NO: 1299466 - RNA, 19 nt, Homo sapiens
guaaagcguuucuucuaaa

SEQ ID NO: 1299467 - RNA, 19 nt, Homo sapiens
ggagauggguaaagcguuu

SEQ ID NO: 1299468 - RNA, 19 nt, Homo sapiens
gagaagaugucagggacua

SEQ ID NO: 1299469 - RNA, 19 nt, Homo sapiens
gcacagcuauccaucagau

SEQ ID NO: 1299470 - RNA, 19 nt, Homo sapiens
cuaagaaguucccugguuu

SEQ ID NO: 1299471 - RNA, 19 nt, Homo sapiens
gaagucugguguccugaaa

SEQ ID NO: 1299472 - RNA, 19 nt, Homo sapiens
gagcaacaguucuucaagu

SEQ ID NO: 1299473 - RNA, 19 nt, Homo sapiens
cagguuggcugauguguug

SEQ ID NO: 1299474 - RNA, 19 nt, Homo sapiens
gagacaagcauuuauacuu

SEQ ID NO: 1299475 - RNA, 19 nt, Homo sapiens
gaccagucgucccagaaua

SEQ ID NO: 1299476 - RNA, 19 nt, Homo sapiens
gggaggaggucaucagcuu

SEQ ID NO: 1299477 - RNA, 19 nt, Homo sapiens
ccuaagaaguucccugguu

SEQ ID NO: 1299478 - RNA, 19 nt, Homo sapiens
caacaaccaccuggcaaua

SEQ ID NO: 1299479 - RNA, 19 nt, Homo sapiens
agacggaugugccagauau

SEQ ID NO: 1299480 - RNA, 19 nt, Homo sapiens
gguaccagcugaauuacug

SEQ ID NO: 1299481 - RNA, 19 nt, Homo sapiens
gaagagaccaagaugaagu

SEQ ID NO: 1299482 - RNA, 19 nt, Homo sapiens
gcgccuggcuuauacuuuc

SEQ ID NO: 1299483 - RNA, 19 nt, Homo sapiens
gugaagagaccaagaugaa

SEQ ID NO: 1299484 - RNA, 19 nt, Homo sapiens
gacaagcauuuauacuuuc

SEQ ID NO: 1299485 - RNA, 19 nt, Homo sapiens
ggguaaagcguuucuucua

SEQ ID NO: 1299486 - RNA, 19 nt, Homo sapiens
gauuacaucaucuuucuga

SEQ ID NO: 1299487 - RNA, 19 nt, Homo sapiens
ccgaagugaugagauuaua

SEQ ID NO: 1299488 - RNA, 19 nt, Homo sapiens
ccaaaugggcacuuucuug

SEQ ID NO: 1299489 - RNA, 19 nt, Homo sapiens
gccaguaccuccuguugug

SEQ ID NO: 1299490 - RNA, 19 nt, Homo sapiens
gcaugcggcucccugaugu

SEQ ID NO: 1299491 - RNA, 19 nt, Homo sapiens
ccacaaagucaaagcuauu

SEQ ID NO: 1299492 - RNA, 19 nt, Homo sapiens
caaaugugagucauaaaga

SEQ ID NO: 1299493 - RNA, 19 nt, Homo sapiens
caaaugggcacuuucuugu

SEQ ID NO: 1299494 - RNA, 19 nt, Homo sapiens
gaguguggcuccagggaau

SEQ ID NO: 1299495 - RNA, 19 nt, Homo sapiens
acagcucccugcucacuuu

SEQ ID NO: 1299496 - RNA, 19 nt, Homo sapiens
cugagacucuggcuuauuc

SEQ ID NO: 1299497 - RNA, 19 nt, Homo sapiens
uaaagcguuucuucuaaag

SEQ ID NO: 1299498 - RNA, 19 nt, Homo sapiens
acaaccaccuggcaauaug

SEQ ID NO: 1299499 - RNA, 19 nt, Homo sapiens
gaagugaugagauuauagg

SEQ ID NO: 1299500 - RNA, 19 nt, Homo sapiens
ggaggaggaagcagauaga

SEQ ID NO: 1299501 - RNA, 19 nt, Homo sapiens
ggagugaagagaccaagau

SEQ ID NO: 1299502 - RNA, 19 nt, Homo sapiens
gaggaggucaucagcuuug

SEQ ID NO: 1299503 - RNA, 19 nt, Homo sapiens
gaggucaucagcuuugcua

SEQ ID NO: 1299504 - RNA, 19 nt, Homo sapiens
ucaacaaaugugagucaua

SEQ ID NO: 1299505 - RNA, 19 nt, Homo sapiens
ggaggaggucaucagcuuu

SEQ ID NO: 1299506 - RNA, 19 nt, Homo sapiens
ggcaauaugacucacuuga

SEQ ID NO: 1299507 - RNA, 19 nt, Homo sapiens
caucaucuuucugacauca

SEQ ID NO: 1299508 - RNA, 19 nt, Homo sapiens
agaaacaggagucaggaaa

SEQ ID NO: 1299509 - RNA, 19 nt, Homo sapiens
gcugauguguugggagaug

SEQ ID NO: 1299510 - RNA, 19 nt, Homo sapiens
caagacggaugugccagau

SEQ ID NO: 1299511 - RNA, 19 nt, Homo sapiens
caggcgagaccauuacgua

SEQ ID NO: 1299512 - RNA, 19 nt, Homo sapiens
cagcuuugcuacugucaca

SEQ ID NO: 1299513 - RNA, 19 nt, Homo sapiens
ucaucuuucugacaucauu

SEQ ID NO: 1299514 - RNA, 19 nt, Homo sapiens
gaggccgugugacauguga

SEQ ID NO: 1299515 - RNA, 19 nt, Homo sapiens
ugggagacaagcauuuaua

SEQ ID NO: 1299516 - RNA, 19 nt, Homo sapiens
gcaacaguucuucaagugu

SEQ ID NO: 1299517 - RNA, 19 nt, Homo sapiens
ggcacuuucuugucugaga

SEQ ID NO: 1299518 - RNA, 19 nt, Homo sapiens
gcgagaccauuacguagac

SEQ ID NO: 1299519 - RNA, 19 nt, Homo sapiens
ccuuaacucugcccucuag

SEQ ID NO: 1299520 - RNA, 19 nt, Homo sapiens
uacaucaucuuucugacau

SEQ ID NO: 1299521 - RNA, 19 nt, Homo sapiens
aaagaaggguuagggugau

SEQ ID NO: 1299522 - RNA, 19 nt, Homo sapiens
ccuaaguccugugagaaga

SEQ ID NO: 1299523 - RNA, 19 nt, Homo sapiens
caaccaccuggcaauauga

SEQ ID NO: 1299524 - RNA, 19 nt, Homo sapiens
gagcuagccaagcagcaaa

SEQ ID NO: 1299525 - RNA, 19 nt, Homo sapiens
ccagaggccgugugacaug

SEQ ID NO: 1299526 - RNA, 19 nt, Homo sapiens
cacaaagucaaagcuauuu

SEQ ID NO: 1299527 - RNA, 19 nt, Homo sapiens
ggagaaagaaaaucaacaa

SEQ ID NO: 1299528 - RNA, 19 nt, Homo sapiens
gaaacaggagucaggaaaa

SEQ ID NO: 1299529 - RNA, 19 nt, Homo sapiens
uccucuaccuggaucauaa

SEQ ID NO: 1299530 - RNA, 19 nt, Homo sapiens
gucaucagcuuugcuacug

SEQ ID NO: 1299531 - RNA, 19 nt, Homo sapiens
ccgagcagcugggauuaca

SEQ ID NO: 1299532 - RNA, 19 nt, Homo sapiens
agaccaagaugaaguuucc

SEQ ID NO: 1299533 - RNA, 19 nt, Homo sapiens
acaaaugugagucauaaag

SEQ ID NO: 1299534 - RNA, 19 nt, Homo sapiens
gaggagcugugagggucaa

SEQ ID NO: 1299535 - RNA, 19 nt, Homo sapiens
ccuggcuuauacuuucuua

SEQ ID NO: 1299536 - RNA, 19 nt, Homo sapiens
ggagacaagcauuuauacu

SEQ ID NO: 1299537 - RNA, 19 nt, Homo sapiens
gggcuguugagguaccuua

SEQ ID NO: 1299538 - RNA, 19 nt, Homo sapiens
uaaguccugugagaagaug

SEQ ID NO: 1299539 - RNA, 19 nt, Homo sapiens
gcaauaugacucacuugac

SEQ ID NO: 1299540 - RNA, 19 nt, Homo sapiens
ugacuggaggcaucagauu

SEQ ID NO: 1299541 - RNA, 19 nt, Homo sapiens
ggagcuagccaagcagcaa

SEQ ID NO: 1299542 - RNA, 19 nt, Homo sapiens
gggauggcgggacuggaua

SEQ ID NO: 1299543 - RNA, 19 nt, Homo sapiens
guugcaggcgagaccauua

SEQ ID NO: 1299544 - RNA, 19 nt, Homo sapiens
aagcacagcuauccaucag

SEQ ID NO: 1299545 - RNA, 19 nt, Homo sapiens
gggagggaaggcagagaaa

SEQ ID NO: 1299546 - RNA, 19 nt, Homo sapiens
aaugggcacuuucuugucu

SEQ ID NO: 1299547 - RNA, 19 nt, Homo sapiens
ggaucauaauggcaaugug

SEQ ID NO: 1299548 - RNA, 19 nt, Homo sapiens
ggcgagaccauuacguaga

SEQ ID NO: 1299549 - RNA, 19 nt, Homo sapiens
gggcuggcauaccuuaacu

SEQ ID NO: 1299550 - RNA, 19 nt, Homo sapiens
agcaacaguucuucaagug

SEQ ID NO: 1299551 - RNA, 19 nt, Homo sapiens
caagcacagcuauccauca

SEQ ID NO: 1299552 - RNA, 19 nt, Homo sapiens
gacacgaucuuggcucacu

SEQ ID NO: 1299553 - RNA, 19 nt, Homo sapiens
ccaacaaccaccuggcaau

SEQ ID NO: 1299554 - RNA, 19 nt, Homo sapiens
cauguuauuugccuuuuga

SEQ ID NO: 1299555 - RNA, 19 nt, Homo sapiens
cuucaaguguacucuguag

SEQ ID NO: 1299556 - RNA, 19 nt, Homo sapiens
cagagcaacaguucuucaa

SEQ ID NO: 1299557 - RNA, 19 nt, Homo sapiens
aggauggucucaaucucuu

SEQ ID NO: 1299558 - RNA, 19 nt, Homo sapiens
gggagacaagcauuuauac

SEQ ID NO: 1299559 - RNA, 19 nt, Homo sapiens
ccacugggagacaagcauu

SEQ ID NO: 1299560 - RNA, 19 nt, Homo sapiens
gaagauggcuuauugguuu

SEQ ID NO: 1299561 - RNA, 19 nt, Homo sapiens
gaaaggacuuguucugauu

SEQ ID NO: 1299562 - RNA, 19 nt, Homo sapiens
gaaauagcaucucaaagga

SEQ ID NO: 1299563 - RNA, 19 nt, Homo sapiens
caacgucaaugauuucuuu

SEQ ID NO: 1299564 - RNA, 19 nt, Homo sapiens
gaagacggauucaaauguu

SEQ ID NO: 1299565 - RNA, 19 nt, Homo sapiens
ucaaagaucgggauaaaua

SEQ ID NO: 1299566 - RNA, 19 nt, Homo sapiens
gaaggucccugcacuccua

SEQ ID NO: 1299567 - RNA, 19 nt, Homo sapiens
gaacauggaugcuuaucuc

SEQ ID NO: 1299568 - RNA, 19 nt, Homo sapiens
ggacugggaugaaggaguu

SEQ ID NO: 1299569 - RNA, 19 nt, Homo sapiens
ggaaaggacuuguucugau

SEQ ID NO: 1299570 - RNA, 19 nt, Homo sapiens
gaauucagauuucgucaug

SEQ ID NO: 1299571 - RNA, 19 nt, Homo sapiens
caucugaggucaucugauu

SEQ ID NO: 1299572 - RNA, 19 nt, Homo sapiens
ggaaauagcaucucaaagg

SEQ ID NO: 1299573 - RNA, 19 nt, Homo sapiens
gaaaugaggaacuuaauca

SEQ ID NO: 1299574 - RNA, 19 nt, Homo sapiens
gcagagcaaucaaaauuua

SEQ ID NO: 1299575 - RNA, 19 nt, Homo sapiens
gcagaucucagugaauuua

SEQ ID NO: 1299576 - RNA, 19 nt, Homo sapiens
gacaaggucuuacggaaau

SEQ ID NO: 1299577 - RNA, 19 nt, Homo sapiens
gagcauauauuccuagaac

SEQ ID NO: 1299578 - RNA, 19 nt, Homo sapiens
gaaccaauaaugcuaagaa

SEQ ID NO: 1299579 - RNA, 19 nt, Homo sapiens
guucaaagaucgggauaaa

SEQ ID NO: 1299580 - RNA, 19 nt, Homo sapiens
gcgccaacgucaaugauuu

SEQ ID NO: 1299581 - RNA, 19 nt, Homo sapiens
ggaagcaugauaaauguuu

SEQ ID NO: 1299582 - RNA, 19 nt, Homo sapiens
gcuaaacacagcagagaua

SEQ ID NO: 1299583 - RNA, 19 nt, Homo sapiens
ggacuccucugacagugaa

SEQ ID NO: 1299584 - RNA, 19 nt, Homo sapiens
cgacagcaguucagccaaa

SEQ ID NO: 1299585 - RNA, 19 nt, Homo sapiens
gcaaauagaaugagaacca

SEQ ID NO: 1299586 - RNA, 19 nt, Homo sapiens
ggagagagcagagcaauca

SEQ ID NO: 1299587 - RNA, 19 nt, Homo sapiens
gcuaauguauaccaugcua

SEQ ID NO: 1299588 - RNA, 19 nt, Homo sapiens
gcucuuacacuucgucuuu

SEQ ID NO: 1299589 - RNA, 19 nt, Homo sapiens
gauuauaaggccauguuua

SEQ ID NO: 1299590 - RNA, 19 nt, Homo sapiens
gaggucaucugauuauaag

SEQ ID NO: 1299591 - RNA, 19 nt, Homo sapiens
ccacggacccugacauuga

SEQ ID NO: 1299592 - RNA, 19 nt, Homo sapiens
ggaaaauggugaaaacuug

SEQ ID NO: 1299593 - RNA, 19 nt, Homo sapiens
gaauggugaaggugaaaua

SEQ ID NO: 1299594 - RNA, 19 nt, Homo sapiens
gacagaggauuuauuuaag

SEQ ID NO: 1299595 - RNA, 19 nt, Homo sapiens
ucuggaagauggcuuauug

SEQ ID NO: 1299596 - RNA, 19 nt, Homo sapiens
gaaggaugacauucuguuu

SEQ ID NO: 1299597 - RNA, 19 nt, Homo sapiens
gaagacagccaagacgaaa

SEQ ID NO: 1299598 - RNA, 19 nt, Homo sapiens
aaaggaagcagauauguau

SEQ ID NO: 1299599 - RNA, 19 nt, Homo sapiens
cugauuccgucauaaauaa

SEQ ID NO: 1299600 - RNA, 19 nt, Homo sapiens
ugaagacagucaaagagaa

SEQ ID NO: 1299601 - RNA, 19 nt, Homo sapiens
guuaggaccucucaguuca

SEQ ID NO: 1299602 - RNA, 19 nt, Homo sapiens
cagaggcacucaugggaaa

SEQ ID NO: 1299603 - RNA, 19 nt, Homo sapiens
uaaaggaaacccuaggaaa

SEQ ID NO: 1299604 - RNA, 19 nt, Homo sapiens
cgucauggcuauuguaaag

SEQ ID NO: 1299605 - RNA, 19 nt, Homo sapiens
gaaugagaauggugaaggu

SEQ ID NO: 1299606 - RNA, 19 nt, Homo sapiens
ggaccucucaguucauaaa

SEQ ID NO: 1299607 - RNA, 19 nt, Homo sapiens
uauuggcgaucauuuguaa

SEQ ID NO: 1299608 - RNA, 19 nt, Homo sapiens
uuacaggauugaagaaaga

SEQ ID NO: 1299609 - RNA, 19 nt, Homo sapiens
gaagucauguucuugucau

SEQ ID NO: 1299610 - RNA, 19 nt, Homo sapiens
guugacagaggauuuauuu

SEQ ID NO: 1299611 - RNA, 19 nt, Homo sapiens
ggaagauggcuuauugguu

SEQ ID NO: 1299612 - RNA, 19 nt, Homo sapiens
ccuagaaccuugaaugaag

SEQ ID NO: 1299613 - RNA, 19 nt, Homo sapiens
ggaaucauaacagagauaa

SEQ ID NO: 1299614 - RNA, 19 nt, Homo sapiens
cuagaggaaucauaacaga

SEQ ID NO: 1299615 - RNA, 19 nt, Homo sapiens
ugucacagauccauccauu

SEQ ID NO: 1299616 - RNA, 19 nt, Homo sapiens
cgucaaugauuucuuuaug

SEQ ID NO: 1299617 - RNA, 19 nt, Homo sapiens
gaagcaacccacaggcaaa

SEQ ID NO: 1299618 - RNA, 19 nt, Homo sapiens
ccucucaguucauaaaguu

SEQ ID NO: 1299619 - RNA, 19 nt, Homo sapiens
ggaggcguguauaucauug

SEQ ID NO: 1299620 - RNA, 19 nt, Homo sapiens
gauguugacuagaggaauc

SEQ ID NO: 1299621 - RNA, 19 nt, Homo sapiens
ugcgggagcucuuugaauu

SEQ ID NO: 1299622 - RNA, 19 nt, Homo sapiens
caaagagaaggaugacauu

SEQ ID NO: 1299623 - RNA, 19 nt, Homo sapiens
gagcagagcaaucaaaauu

SEQ ID NO: 1299624 - RNA, 19 nt, Homo sapiens
gaucccagaacaagaauga

SEQ ID NO: 1299625 - RNA, 19 nt, Homo sapiens
gaauuucacccacaguuca

SEQ ID NO: 1299626 - RNA, 19 nt, Homo sapiens
uuucucgccugaacucuua

SEQ ID NO: 1299627 - RNA, 19 nt, Homo sapiens
ggccaugaaugcccaacaa

SEQ ID NO: 1299628 - RNA, 19 nt, Homo sapiens
cauggaugcuuaucucuca

SEQ ID NO: 1299629 - RNA, 19 nt, Homo sapiens
augagaacauggaugcuua

SEQ ID NO: 1299630 - RNA, 19 nt, Homo sapiens
aggaugacauucuguuuga

SEQ ID NO: 1299631 - RNA, 19 nt, Homo sapiens
uaggaccucucaguucaua

SEQ ID NO: 1299632 - RNA, 19 nt, Homo sapiens
caauaaugcuaagaaguca

SEQ ID NO: 1299633 - RNA, 19 nt, Homo sapiens
ccaauaaugcuaagaaguc

SEQ ID NO: 1299634 - RNA, 19 nt, Homo sapiens
uggugaaggugaaauagaa

SEQ ID NO: 1299635 - RNA, 19 nt, Homo sapiens
ccaaggcucgggaguugua

SEQ ID NO: 1299636 - RNA, 19 nt, Homo sapiens
gagauaccauguccagaac

SEQ ID NO: 1299637 - RNA, 19 nt, Homo sapiens
guaaaggaaacccuaggaa

SEQ ID NO: 1299638 - RNA, 19 nt, Homo sapiens
gucaacaucuguaacucuu

SEQ ID NO: 1299639 - RNA, 19 nt, Homo sapiens
aaacagagacuugaagaca

SEQ ID NO: 1299640 - RNA, 19 nt, Homo sapiens
aaaggcaaauagaaugaga

SEQ ID NO: 1299641 - RNA, 19 nt, Homo sapiens
caaagaucgggauaaauau

SEQ ID NO: 1299642 - RNA, 19 nt, Homo sapiens
gaagacagucaaagagaag

SEQ ID NO: 1299643 - RNA, 19 nt, Homo sapiens
ugagaauggugaaggugaa

SEQ ID NO: 1299644 - RNA, 19 nt, Homo sapiens
aagacaaugugaaugagaa

SEQ ID NO: 1299645 - RNA, 19 nt, Homo sapiens
ugaggucaucugauuauaa

SEQ ID NO: 1299646 - RNA, 19 nt, Homo sapiens
caaauagaaugagaaccau

SEQ ID NO: 1299647 - RNA, 19 nt, Homo sapiens
ugaaugcccaacaagauaa

SEQ ID NO: 1299648 - RNA, 19 nt, Homo sapiens
ccagaaccaauaaugcuaa

SEQ ID NO: 1299649 - RNA, 19 nt, Homo sapiens
aaggugaaauagaagauga

SEQ ID NO: 1299650 - RNA, 19 nt, Homo sapiens
ggaguuaggaccucucagu

SEQ ID NO: 1299651 - RNA, 19 nt, Homo sapiens
uagccaagaucauguggau

SEQ ID NO: 1299652 - RNA, 19 nt, Homo sapiens
ucacagauccauccauuac

SEQ ID NO: 1299653 - RNA, 19 nt, Homo sapiens
cgggagcucuuugaauuug

SEQ ID NO: 1299654 - RNA, 19 nt, Homo sapiens
augcagaucucagugaauu

SEQ ID NO: 1299655 - RNA, 19 nt, Homo sapiens
ccaugcagaucucagugaa

SEQ ID NO: 1299656 - RNA, 19 nt, Homo sapiens
ggaacuuaaucaggcuaaa

SEQ ID NO: 1299657 - RNA, 19 nt, Homo sapiens
caacucugccuuugugugu

SEQ ID NO: 1299658 - RNA, 19 nt, Homo sapiens
ggaauuucacccacaguuc

SEQ ID NO: 1299659 - RNA, 19 nt, Homo sapiens
gguguugacagaggauuua

SEQ ID NO: 1299660 - RNA, 19 nt, Homo sapiens
gaagauggcuuauugguuu

SEQ ID NO: 1299661 - RNA, 19 nt, Homo sapiens
gaaaggacuuguucugauu

SEQ ID NO: 1299662 - RNA, 19 nt, Homo sapiens
gaaauagcaucucaaagga

SEQ ID NO: 1299663 - RNA, 19 nt, Homo sapiens
caacgucaaugauuucuuu

SEQ ID NO: 1299664 - RNA, 19 nt, Homo sapiens
gaagacggauucaaauguu

SEQ ID NO: 1299665 - RNA, 19 nt, Homo sapiens
ucaaagaucgggauaaaua

SEQ ID NO: 1299666 - RNA, 19 nt, Homo sapiens
gaaggucccugcacuccua

SEQ ID NO: 1299667 - RNA, 19 nt, Homo sapiens
gaacauggaugcuuaucuc

SEQ ID NO: 1299668 - RNA, 19 nt, Homo sapiens
ggaaaggacuuguucugau

SEQ ID NO: 1299669 - RNA, 19 nt, Homo sapiens
caucugaggucaucugauu

SEQ ID NO: 1299670 - RNA, 19 nt, Homo sapiens
ggaaauagcaucucaaagg

SEQ ID NO: 1299671 - RNA, 19 nt, Homo sapiens
gaaaugaggaacuuaauca

SEQ ID NO: 1299672 - RNA, 19 nt, Homo sapiens
gcagaucucagugaauuua

SEQ ID NO: 1299673 - RNA, 19 nt, Homo sapiens
gagcauauauuccuagaac

SEQ ID NO: 1299674 - RNA, 19 nt, Homo sapiens
guucaaagaucgggauaaa

SEQ ID NO: 1299675 - RNA, 19 nt, Homo sapiens
gaaccaauaaugcuaagaa

SEQ ID NO: 1299676 - RNA, 19 nt, Homo sapiens
gcgccaacgucaaugauuu

SEQ ID NO: 1299677 - RNA, 19 nt, Homo sapiens
ggaagcaugauaaauguuu

SEQ ID NO: 1299678 - RNA, 19 nt, Homo sapiens
gcuaaacacagcagagaua

SEQ ID NO: 1299679 - RNA, 19 nt, Homo sapiens
gcaaauagaaugagaacca

SEQ ID NO: 1299680 - RNA, 19 nt, Homo sapiens
gcucuuacacuucgucuuu

SEQ ID NO: 1299681 - RNA, 19 nt, Homo sapiens
gauuauaaggccauguuua

SEQ ID NO: 1299682 - RNA, 19 nt, Homo sapiens
ccaguugguuuaauuucua

SEQ ID NO: 1299683 - RNA, 19 nt, Homo sapiens
gaggucaucugauuauaag

SEQ ID NO: 1299684 - RNA, 19 nt, Homo sapiens
ccacggacccugacauuga

SEQ ID NO: 1299685 - RNA, 19 nt, Homo sapiens
ggaaaauggugaaaacuug

SEQ ID NO: 1299686 - RNA, 19 nt, Homo sapiens
gacagaggauuuauuuaag

SEQ ID NO: 1299687 - RNA, 19 nt, Homo sapiens
ucuggaagauggcuuauug

SEQ ID NO: 1299688 - RNA, 19 nt, Homo sapiens
gaagacagccaagacgaaa

SEQ ID NO: 1299689 - RNA, 19 nt, Homo sapiens
guuaggaccucucaguuca

SEQ ID NO: 1299690 - RNA, 19 nt, Homo sapiens
cagaggcacucaugggaaa

SEQ ID NO: 1299691 - RNA, 19 nt, Homo sapiens
uaaaggaaacccuaggaaa

SEQ ID NO: 1299692 - RNA, 19 nt, Homo sapiens
cgucauggcuauuguaaag

SEQ ID NO: 1299693 - RNA, 19 nt, Homo sapiens
ggaccucucaguucauaaa

SEQ ID NO: 1299694 - RNA, 19 nt, Homo sapiens
uauuggcgaucauuuguaa

SEQ ID NO: 1299695 - RNA, 19 nt, Homo sapiens
gaauucagguaaguucaga

SEQ ID NO: 1299696 - RNA, 19 nt, Homo sapiens
uuacaggauugaagaaaga

SEQ ID NO: 1299697 - RNA, 19 nt, Homo sapiens
gaagucauguucuugucau

SEQ ID NO: 1299698 - RNA, 19 nt, Homo sapiens
guugacagaggauuuauuu

SEQ ID NO: 1299699 - RNA, 19 nt, Homo sapiens
ggaagauggcuuauugguu

SEQ ID NO: 1299700 - RNA, 19 nt, Homo sapiens
ccuagaaccuugaaugaag

SEQ ID NO: 1299701 - RNA, 19 nt, Homo sapiens
ugucacagauccauccauu

SEQ ID NO: 1299702 - RNA, 19 nt, Homo sapiens
cgucaaugauuucuuuaug

SEQ ID NO: 1299703 - RNA, 19 nt, Homo sapiens
ccucucaguucauaaaguu

SEQ ID NO: 1299704 - RNA, 19 nt, Homo sapiens
ggaggcguguauaucauug

SEQ ID NO: 1299705 - RNA, 19 nt, Homo sapiens
ugcgggagcucuuugaauu

SEQ ID NO: 1299706 - RNA, 19 nt, Homo sapiens
gaauuucacccacaguuca

SEQ ID NO: 1299707 - RNA, 19 nt, Homo sapiens
uuucucgccugaacucuua

SEQ ID NO: 1299708 - RNA, 19 nt, Homo sapiens
ggccaugaaugcccaacaa

SEQ ID NO: 1299709 - RNA, 19 nt, Homo sapiens
cauggaugcuuaucucuca

SEQ ID NO: 1299710 - RNA, 19 nt, Homo sapiens
augagaacauggaugcuua

SEQ ID NO: 1299711 - RNA, 19 nt, Homo sapiens
uaggaccucucaguucaua

SEQ ID NO: 1299712 - RNA, 19 nt, Homo sapiens
caauaaugcuaagaaguca

SEQ ID NO: 1299713 - RNA, 19 nt, Homo sapiens
ccaauaaugcuaagaaguc

SEQ ID NO: 1299714 - RNA, 19 nt, Homo sapiens
ggagaauucagguaaguuc

SEQ ID NO: 1299715 - RNA, 19 nt, Homo sapiens
ccaaggcucgggaguugua

SEQ ID NO: 1299716 - RNA, 19 nt, Homo sapiens
gagauaccauguccagaac

SEQ ID NO: 1299717 - RNA, 19 nt, Homo sapiens
guaaaggaaacccuaggaa

SEQ ID NO: 1299718 - RNA, 19 nt, Homo sapiens
gucaacaucuguaacucuu

SEQ ID NO: 1299719 - RNA, 19 nt, Homo sapiens
aaaggcaaauagaaugaga

SEQ ID NO: 1299720 - RNA, 19 nt, Homo sapiens
caaagaucgggauaaauau

SEQ ID NO: 1299721 - RNA, 19 nt, Homo sapiens
ugaggucaucugauuauaa

SEQ ID NO: 1299722 - RNA, 19 nt, Homo sapiens
ucagguaaguucagauuuu

SEQ ID NO: 1299723 - RNA, 19 nt, Homo sapiens
caaauagaaugagaaccau

SEQ ID NO: 1299724 - RNA, 19 nt, Homo sapiens
ugaaugcccaacaagauaa

SEQ ID NO: 1299725 - RNA, 19 nt, Homo sapiens
ccagaaccaauaaugcuaa

SEQ ID NO: 1299726 - RNA, 19 nt, Homo sapiens
ggaguuaggaccucucagu

SEQ ID NO: 1299727 - RNA, 19 nt, Homo sapiens
uagccaagaucauguggau

SEQ ID NO: 1299728 - RNA, 19 nt, Homo sapiens
ucacagauccauccauuac

SEQ ID NO: 1299729 - RNA, 19 nt, Homo sapiens
cgggagcucuuugaauuug

SEQ ID NO: 1299730 - RNA, 19 nt, Homo sapiens
augcagaucucagugaauu

SEQ ID NO: 1299731 - RNA, 19 nt, Homo sapiens
ccaugcagaucucagugaa

SEQ ID NO: 1299732 - RNA, 19 nt, Homo sapiens
ggaacuuaaucaggcuaaa

SEQ ID NO: 1299733 - RNA, 19 nt, Homo sapiens
caacucugccuuugugugu

SEQ ID NO: 1299734 - RNA, 19 nt, Homo sapiens
ggaauuucacccacaguuc

SEQ ID NO: 1299735 - RNA, 19 nt, Homo sapiens
gguguugacagaggauuua

SEQ ID NO: 1299736 - RNA, 19 nt, Homo sapiens
gcgagcauauauuccuaga

SEQ ID NO: 1299737 - RNA, 19 nt, Homo sapiens
ccauggaaauagcaucuca

SEQ ID NO: 1299738 - RNA, 19 nt, Homo sapiens
caaaggccauggaaauagc

SEQ ID NO: 1299739 - RNA, 19 nt, Homo sapiens
gguggaggcguguauauca

SEQ ID NO: 1299740 - RNA, 19 nt, Homo sapiens
gcaggucauucaguacaug

SEQ ID NO: 1299741 - RNA, 19 nt, Homo sapiens
agagauaccauguccagaa

SEQ ID NO: 1299742 - RNA, 19 nt, Homo sapiens
aaccuugaaugaagugaaa

SEQ ID NO: 1299743 - RNA, 19 nt, Homo sapiens
uauucaagauuucgucaug

SEQ ID NO: 1299744 - RNA, 19 nt, Homo sapiens
auauguaaguggagaauuc

SEQ ID NO: 1299745 - RNA, 19 nt, Homo sapiens
ccacaugccuuggaguucu

SEQ ID NO: 1299746 - RNA, 19 nt, Homo sapiens
gagaagaauguaucaggau

SEQ ID NO: 1299747 - RNA, 19 nt, Homo sapiens
ucauggcuauuguaaagga

SEQ ID NO: 1299748 - RNA, 19 nt, Homo sapiens
ucaaggaagcccagagaga

SEQ ID NO: 1299749 - RNA, 19 nt, Homo sapiens
gaggaaaggacuuguucug

SEQ ID NO: 1299750 - RNA, 19 nt, Homo sapiens
gaaccuugaaugaagugaa

SEQ ID NO: 1299751 - RNA, 19 nt, Homo sapiens
ucucaaaggccauggaaau

SEQ ID NO: 1299752 - RNA, 19 nt, Homo sapiens
ucacugcaacucugccuuu

SEQ ID NO: 1299753 - RNA, 19 nt, Homo sapiens
ggucaaggaagcccagaga

SEQ ID NO: 1299754 - RNA, 19 nt, Homo sapiens
gaaagauuugucaggaguu

SEQ ID NO: 1299755 - RNA, 19 nt, Homo sapiens
caggauugaagaaagauuu

SEQ ID NO: 1299756 - RNA, 19 nt, Homo sapiens
guuacaggauugaagaaag

SEQ ID NO: 1299757 - RNA, 19 nt, Homo sapiens
gaucgggauaaauauguaa

SEQ ID NO: 1299758 - RNA, 19 nt, Homo sapiens
cugcaacucugccuuugug

SEQ ID NO: 1299759 - RNA, 19 nt, Homo sapiens
aagacggauucaaauguuu

SEQ ID NO: 1299760 - RNA, 19 nt, Homo sapiens
gcagcgaucugaacuauau

SEQ ID NO: 1299761 - RNA, 19 nt, Homo sapiens
aaacagcccuauauucuaa

SEQ ID NO: 1299762 - RNA, 19 nt, Homo sapiens
ucagucagcuugaggauuu

SEQ ID NO: 1299763 - RNA, 19 nt, Homo sapiens
caaggaacacucugaaaua

SEQ ID NO: 1299764 - RNA, 19 nt, Homo sapiens
ggucauagcaccucucuuu

SEQ ID NO: 1299765 - RNA, 19 nt, Homo sapiens
ggaacacucugaaauaaag

SEQ ID NO: 1299766 - RNA, 19 nt, Homo sapiens
gaagccaguuccuuggaua

SEQ ID NO: 1299767 - RNA, 19 nt, Homo sapiens
ucaacgagcucgccgguaa

SEQ ID NO: 1299768 - RNA, 19 nt, Homo sapiens
gaaacagcccuauauucua

SEQ ID NO: 1299769 - RNA, 19 nt, Homo sapiens
ggaaagccauguacaaagg

SEQ ID NO: 1299770 - RNA, 19 nt, Homo sapiens
gagcgcaucuuaaaguguu

SEQ ID NO: 1299771 - RNA, 19 nt, Homo sapiens
gcaccuaguuugagaccaa

SEQ ID NO: 1299772 - RNA, 19 nt, Homo sapiens
agacagagcuggaggucaa

SEQ ID NO: 1299773 - RNA, 19 nt, Homo sapiens
gaaggguuguuucuguauu

SEQ ID NO: 1299774 - RNA, 19 nt, Homo sapiens
ggagaaacagcccuauauu

SEQ ID NO: 1299775 - RNA, 19 nt, Homo sapiens
gcaccucucuuugggauug

SEQ ID NO: 1299776 - RNA, 19 nt, Homo sapiens
gggccaggcugcacucaaa

SEQ ID NO: 1299777 - RNA, 19 nt, Homo sapiens
aaggaacacucugaaauaa

SEQ ID NO: 1299778 - RNA, 19 nt, Homo sapiens
gagaaacagcccuauauuc

SEQ ID NO: 1299779 - RNA, 19 nt, Homo sapiens
ggagagcgcaucuuaaagu

SEQ ID NO: 1299780 - RNA, 19 nt, Homo sapiens
gauuggagagcgcaucuua

SEQ ID NO: 1299781 - RNA, 19 nt, Homo sapiens
gcaggcaaguugucacuca

SEQ ID NO: 1299782 - RNA, 19 nt, Homo sapiens
gggagaaacagcccuauau

SEQ ID NO: 1299783 - RNA, 19 nt, Homo sapiens
gcuugaggauuuagcauug

SEQ ID NO: 1299784 - RNA, 19 nt, Homo sapiens
cagccaaacucaucaaugg

SEQ ID NO: 1299785 - RNA, 19 nt, Homo sapiens
cagcagcgaucugaacuau

SEQ ID NO: 1299786 - RNA, 19 nt, Homo sapiens
aaaugguacuuucguugua

SEQ ID NO: 1299787 - RNA, 19 nt, Homo sapiens
gagagcgcaucuuaaagug

SEQ ID NO: 1299788 - RNA, 19 nt, Homo sapiens
uggaaaugcucaagauuca

SEQ ID NO: 1299789 - RNA, 19 nt, Homo sapiens
ccaaggaacacucugaaau

SEQ ID NO: 1299790 - RNA, 19 nt, Homo sapiens
gggaccaucugccuucaug

SEQ ID NO: 1299791 - RNA, 19 nt, Homo sapiens
gcagugacgccucuagaug

SEQ ID NO: 1299792 - RNA, 19 nt, Homo sapiens
uaacagguagucacaauag

SEQ ID NO: 1299793 - RNA, 19 nt, Homo sapiens
ccauggaaaugcucaagau

SEQ ID NO: 1299794 - RNA, 19 nt, Homo sapiens
aguuaaagcuggacagaau

SEQ ID NO: 1299795 - RNA, 19 nt, Homo sapiens
caaggggucuauuuuauug

SEQ ID NO: 1299796 - RNA, 19 nt, Homo sapiens
gccucuagauguucugaaa

SEQ ID NO: 1299797 - RNA, 19 nt, Homo sapiens
gacauuccuuucuccauca

SEQ ID NO: 1299798 - RNA, 19 nt, Homo sapiens
gaaccucacucuggucacu

SEQ ID NO: 1299799 - RNA, 19 nt, Homo sapiens
gcagagguucuuaccgaaa

SEQ ID NO: 1299800 - RNA, 19 nt, Homo sapiens
ccuauauucuaacaaguug

SEQ ID NO: 1299801 - RNA, 19 nt, Homo sapiens
ggacagcauaugacaagga

SEQ ID NO: 1299802 - RNA, 19 nt, Homo sapiens
gaauccaaacccucaagaa

SEQ ID NO: 1299803 - RNA, 19 nt, Homo sapiens
gcagaaccagcaugggaaa

SEQ ID NO: 1299804 - RNA, 19 nt, Homo sapiens
aaaggaggaucagaaguuc

SEQ ID NO: 1299805 - RNA, 19 nt, Homo sapiens
aaggguuguuucuguauuu

SEQ ID NO: 1299806 - RNA, 19 nt, Homo sapiens
gcaaugaagccaguuccuu

SEQ ID NO: 1299807 - RNA, 19 nt, Homo sapiens
gaccaucugccuucaugaa

SEQ ID NO: 1299808 - RNA, 19 nt, Homo sapiens
gccaguuccuuggauauau

SEQ ID NO: 1299809 - RNA, 19 nt, Homo sapiens
acucaucaauggaggugua

SEQ ID NO: 1299810 - RNA, 19 nt, Homo sapiens
uaaccaaggaacacucuga

SEQ ID NO: 1299811 - RNA, 19 nt, Homo sapiens
ccucugcguuguagugcua

SEQ ID NO: 1299812 - RNA, 19 nt, Homo sapiens
gcucaaggggucuauuuua

SEQ ID NO: 1299813 - RNA, 19 nt, Homo sapiens
ugagaagagucgagugaag

SEQ ID NO: 1299814 - RNA, 19 nt, Homo sapiens
ccaagcacccuuucgaauc

SEQ ID NO: 1299815 - RNA, 19 nt, Homo sapiens
gaccaagcacccuuucgaa

SEQ ID NO: 1299816 - RNA, 19 nt, Homo sapiens
gugaaagcccucagaguca

SEQ ID NO: 1299817 - RNA, 19 nt, Homo sapiens
gaggauuuagcauuguuaa

SEQ ID NO: 1299818 - RNA, 19 nt, Homo sapiens
aauccaaacccucaagaaa

SEQ ID NO: 1299819 - RNA, 19 nt, Homo sapiens
ggugaccugucccauggaa

SEQ ID NO: 1299820 - RNA, 19 nt, Homo sapiens
caucacagccaaacucauc

SEQ ID NO: 1299821 - RNA, 19 nt, Homo sapiens
uaacuuaugaguccuagca

SEQ ID NO: 1299822 - RNA, 19 nt, Homo sapiens
uuaaagcuggacagaauuu

SEQ ID NO: 1299823 - RNA, 19 nt, Homo sapiens
gaaagccauguacaaagga

SEQ ID NO: 1299824 - RNA, 19 nt, Homo sapiens
cuuaacagguagucacaau

SEQ ID NO: 1299825 - RNA, 19 nt, Homo sapiens
caagcacccuuucgaaucc

SEQ ID NO: 1299826 - RNA, 19 nt, Homo sapiens
ccaagacucgccugcagaa

SEQ ID NO: 1299827 - RNA, 19 nt, Homo sapiens
gagcaucacagccaaacuc

SEQ ID NO: 1299828 - RNA, 19 nt, Homo sapiens
cagagguucuuaccgaaag

SEQ ID NO: 1299829 - RNA, 19 nt, Homo sapiens
gucagcaccuaguuugaga

SEQ ID NO: 1299830 - RNA, 19 nt, Homo sapiens
caucuacuucccacuguuu

SEQ ID NO: 1299831 - RNA, 19 nt, Homo sapiens
ggaugcagcggaaccugaa

SEQ ID NO: 1299832 - RNA, 19 nt, Homo sapiens
gggaaagccauguacaaag

SEQ ID NO: 1299833 - RNA, 19 nt, Homo sapiens
gaacgucgacucgcuugca

SEQ ID NO: 1299834 - RNA, 19 nt, Homo sapiens
ccaguuccuuggauauauc

SEQ ID NO: 1299835 - RNA, 19 nt, Homo sapiens
cagaaugacccaccaggau

SEQ ID NO: 1299836 - RNA, 19 nt, Homo sapiens
ggagccagcagccuugugu

SEQ ID NO: 1299837 - RNA, 19 nt, Homo sapiens
gaaaaggcagagguucuua

SEQ ID NO: 1299838 - RNA, 19 nt, Homo sapiens
uuggagagcgcaucuuaaa

SEQ ID NO: 1299839 - RNA, 19 nt, Homo sapiens
ggauuuggacuucauucug

SEQ ID NO: 1299840 - RNA, 19 nt, Homo sapiens
caccgacugugccaggaaa

SEQ ID NO: 1299841 - RNA, 19 nt, Homo sapiens
cagagucagcaccuaguuu

SEQ ID NO: 1299842 - RNA, 19 nt, Homo sapiens
ccaccuacuuuucaacaaa

SEQ ID NO: 1299843 - RNA, 19 nt, Homo sapiens
ggaagccccuaaccaccua

SEQ ID NO: 1299844 - RNA, 19 nt, Homo sapiens
uccaaacccucaagaaagg

SEQ ID NO: 1299845 - RNA, 19 nt, Homo sapiens
aaagccauguacaaaggaa

SEQ ID NO: 1299846 - RNA, 19 nt, Homo sapiens
caacaacugagaugaacgu

SEQ ID NO: 1299847 - RNA, 19 nt, Homo sapiens
acagguagucacaauagaa

SEQ ID NO: 1299848 - RNA, 19 nt, Homo sapiens
ccaucugccuucaugaaag

SEQ ID NO: 1299849 - RNA, 19 nt, Homo sapiens
ccucagagacauuccuuuc

SEQ ID NO: 1299850 - RNA, 19 nt, Homo sapiens
ugaagccaguuccuuggau

SEQ ID NO: 1299851 - RNA, 19 nt, Homo sapiens
gaaugacccaccaggaucu

SEQ ID NO: 1299852 - RNA, 19 nt, Homo sapiens
acucugaaauaaaggugaa

SEQ ID NO: 1299853 - RNA, 19 nt, Homo sapiens
uagcauuguuaaucuugga

SEQ ID NO: 1299854 - RNA, 19 nt, Homo sapiens
gggugccacucuccucaga

SEQ ID NO: 1299855 - RNA, 19 nt, Homo sapiens
ugggaaagccauguacaaa

SEQ ID NO: 1299856 - RNA, 19 nt, Homo sapiens
agagucagcaccuaguuug

SEQ ID NO: 1299857 - RNA, 19 nt, Homo sapiens
ugaccugucccauggaaau

SEQ ID NO: 1299858 - RNA, 19 nt, Homo sapiens
aaacucggcauucuucagu

SEQ ID NO: 1299859 - RNA, 19 nt, Homo sapiens
uuaacagguagucacaaua

SEQ ID NO: 1299860 - RNA, 19 nt, Homo sapiens
ggacugauaccauggaaua

SEQ ID NO: 1299861 - RNA, 19 nt, Homo sapiens
ggaggaggcuuucgagcua

SEQ ID NO: 1299862 - RNA, 19 nt, Homo sapiens
guacuucacuuccauuugu

SEQ ID NO: 1299863 - RNA, 19 nt, Homo sapiens
auucaugacuccuguauua

SEQ ID NO: 1299864 - RNA, 19 nt, Homo sapiens
ucaaaggacuguucugaug

SEQ ID NO: 1299865 - RNA, 19 nt, Homo sapiens
ggauuuaccugucccugaa

SEQ ID NO: 1299866 - RNA, 19 nt, Homo sapiens
gaagaaugccaagaguuua

SEQ ID NO: 1299867 - RNA, 19 nt, Homo sapiens
cguccgaagugauuaaaua

SEQ ID NO: 1299868 - RNA, 19 nt, Homo sapiens
gcucacaccuguaauccaa

SEQ ID NO: 1299869 - RNA, 19 nt, Homo sapiens
uugauaggcugaauguuua

SEQ ID NO: 1299870 - RNA, 19 nt, Homo sapiens
gaaaugucccuuaacaaga

SEQ ID NO: 1299871 - RNA, 19 nt, Homo sapiens
ccgaagugauuaaauauga

SEQ ID NO: 1299872 - RNA, 19 nt, Homo sapiens
gagcuacccuuggaugauu

SEQ ID NO: 1299873 - RNA, 19 nt, Homo sapiens
cgaagaaugccaagaguuu

SEQ ID NO: 1299874 - RNA, 19 nt, Homo sapiens
guucaugagugcuauaaga

SEQ ID NO: 1299875 - RNA, 19 nt, Homo sapiens
ugaacgaaaugucccuuaa

SEQ ID NO: 1299876 - RNA, 19 nt, Homo sapiens
gcaacaggaacauccaaua

SEQ ID NO: 1299877 - RNA, 19 nt, Homo sapiens
ggacauaugggaaggaguu

SEQ ID NO: 1299878 - RNA, 19 nt, Homo sapiens
acacaaaugucuacagcaa

SEQ ID NO: 1299879 - RNA, 19 nt, Homo sapiens
ggugggagguuggcuuuaa

SEQ ID NO: 1299880 - RNA, 19 nt, Homo sapiens
gaaucuaccucugaguuau

SEQ ID NO: 1299881 - RNA, 19 nt, Homo sapiens
uuagggcacuugcagguua

SEQ ID NO: 1299882 - RNA, 19 nt, Homo sapiens
ucaacuauaucacaucaug

SEQ ID NO: 1299883 - RNA, 19 nt, Homo sapiens
gugcagaauucauuaaaca

SEQ ID NO: 1299884 - RNA, 19 nt, Homo sapiens
gaaugggucugugauguca

SEQ ID NO: 1299885 - RNA, 19 nt, Homo sapiens
cauggaauauuucaucuca

SEQ ID NO: 1299886 - RNA, 19 nt, Homo sapiens
caucauggcugagcauugu

SEQ ID NO: 1299887 - RNA, 19 nt, Homo sapiens
cugauaccauggaauauuu

SEQ ID NO: 1299888 - RNA, 19 nt, Homo sapiens
uacagcaacugauguuuga

SEQ ID NO: 1299889 - RNA, 19 nt, Homo sapiens
ggaugauugugaagugauu

SEQ ID NO: 1299890 - RNA, 19 nt, Homo sapiens
caacagauaggugauaguu

SEQ ID NO: 1299891 - RNA, 19 nt, Homo sapiens
gaaacccugucgguacaaa

SEQ ID NO: 1299892 - RNA, 19 nt, Homo sapiens
gggagaccuuuaacucuga

SEQ ID NO: 1299893 - RNA, 19 nt, Homo sapiens
ggaccaugggacacuauua

SEQ ID NO: 1299894 - RNA, 19 nt, Homo sapiens
acaggaacauccaauacuu

SEQ ID NO: 1299895 - RNA, 19 nt, Homo sapiens
cagcaacugauguuugaua

SEQ ID NO: 1299896 - RNA, 19 nt, Homo sapiens
gcacgaagaaugccaagag

SEQ ID NO: 1299897 - RNA, 19 nt, Homo sapiens
aaaugucccuuaacaagau

SEQ ID NO: 1299898 - RNA, 19 nt, Homo sapiens
cgaaaugucccuuaacaag

SEQ ID NO: 1299899 - RNA, 19 nt, Homo sapiens
ugaaucuaccucugaguua

SEQ ID NO: 1299900 - RNA, 19 nt, Homo sapiens
ccaaagugcugggauuaca

SEQ ID NO: 1299901 - RNA, 19 nt, Homo sapiens
gaaacacuucaaagggaua

SEQ ID NO: 1299902 - RNA, 19 nt, Homo sapiens
ggcugaauguuuagaagaa

SEQ ID NO: 1299903 - RNA, 19 nt, Homo sapiens
ggaauugcggcacgaagaa

SEQ ID NO: 1299904 - RNA, 19 nt, Homo sapiens
cauuuaacauggaagaaga

SEQ ID NO: 1299905 - RNA, 19 nt, Homo sapiens
ggagauugagggagaaaug

SEQ ID NO: 1299906 - RNA, 19 nt, Homo sapiens
cuauugaguuuaggaauug

SEQ ID NO: 1299907 - RNA, 19 nt, Homo sapiens
ugacuccuguauuaaagaa

SEQ ID NO: 1299908 - RNA, 19 nt, Homo sapiens
gugaaacccugucgguaca

SEQ ID NO: 1299909 - RNA, 19 nt, Homo sapiens
gcugaauguuuagaagaaa

SEQ ID NO: 1299910 - RNA, 19 nt, Homo sapiens
gaauauuucaucucaccaa

SEQ ID NO: 1299911 - RNA, 19 nt, Homo sapiens
gaaugucaacuauaucaca

SEQ ID NO: 1299912 - RNA, 19 nt, Homo sapiens
ggugauaguugggaaugga

SEQ ID NO: 1299913 - RNA, 19 nt, Homo sapiens
uuugauaggcugaauguuu

SEQ ID NO: 1299914 - RNA, 19 nt, Homo sapiens
caucaaaggacuguucuga

SEQ ID NO: 1299915 - RNA, 19 nt, Homo sapiens
gaauucaugacuccuguau

SEQ ID NO: 1299916 - RNA, 19 nt, Homo sapiens
caacaggaacauccaauac

SEQ ID NO: 1299917 - RNA, 19 nt, Homo sapiens
gggcugaaucuaccucuga

SEQ ID NO: 1299918 - RNA, 19 nt, Homo sapiens
gcacuugcagguuauucuu

SEQ ID NO: 1299919 - RNA, 19 nt, Homo sapiens
cuaggaauaccaacauuau

SEQ ID NO: 1299920 - RNA, 19 nt, Homo sapiens
acaaaugucuacagcaacu

SEQ ID NO: 1299921 - RNA, 19 nt, Homo sapiens
ggagaccuuuaacucugaa

SEQ ID NO: 1299922 - RNA, 19 nt, Homo sapiens
gaugggagaccuuuaacuc

SEQ ID NO: 1299923 - RNA, 19 nt, Homo sapiens
ccaacguuauugugcagaa

SEQ ID NO: 1299924 - RNA, 19 nt, Homo sapiens
cauuaaacauucacaacag

SEQ ID NO: 1299925 - RNA, 19 nt, Homo sapiens
gaacgaaaugucccuuaac

SEQ ID NO: 1299926 - RNA, 19 nt, Homo sapiens
caaagcaacgucucaggau

SEQ ID NO: 1299927 - RNA, 19 nt, Homo sapiens
ucaugacuccuguauuaaa

SEQ ID NO: 1299928 - RNA, 19 nt, Homo sapiens
uuagaugggagaccuuuaa

SEQ ID NO: 1299929 - RNA, 19 nt, Homo sapiens
uagccaagauggucucgau

SEQ ID NO: 1299930 - RNA, 19 nt, Homo sapiens
gcagcagcguccgaaguga

SEQ ID NO: 1299931 - RNA, 19 nt, Homo sapiens
cuacagcaacugauguuug

SEQ ID NO: 1299932 - RNA, 19 nt, Homo sapiens
aacgaaaugucccuuaaca

SEQ ID NO: 1299933 - RNA, 19 nt, Homo sapiens
ugucaacuauaucacauca

SEQ ID NO: 1299934 - RNA, 19 nt, Homo sapiens
caugacuccuguauuaaag

SEQ ID NO: 1299935 - RNA, 19 nt, Homo sapiens
gaggugggagguuggcuuu

SEQ ID NO: 1299936 - RNA, 19 nt, Homo sapiens
aaauuugccuguuuauggu

SEQ ID NO: 1299937 - RNA, 19 nt, Homo sapiens
gugccuguacuuuacuuua

SEQ ID NO: 1299938 - RNA, 19 nt, Homo sapiens
aagaaugggucugugaugu

SEQ ID NO: 1299939 - RNA, 19 nt, Homo sapiens
uaacauggaagaagaugag

SEQ ID NO: 1299940 - RNA, 19 nt, Homo sapiens
gggacacuauuacgcaaca

SEQ ID NO: 1299941 - RNA, 19 nt, Homo sapiens
gauugagggagaaauguau

SEQ ID NO: 1299942 - RNA, 19 nt, Homo sapiens
guacuucaucccugcaaga

SEQ ID NO: 1299943 - RNA, 19 nt, Homo sapiens
cauggaagaagaugaguuc

SEQ ID NO: 1299944 - RNA, 19 nt, Homo sapiens
gauugugaagugauugaaa

SEQ ID NO: 1299945 - RNA, 19 nt, Homo sapiens
acuaggaauaccaacauua

SEQ ID NO: 1299946 - RNA, 19 nt, Homo sapiens
gaccaucaaaggacuguuc

SEQ ID NO: 1299947 - RNA, 19 nt, Homo sapiens
caacguuauugugcagaau

SEQ ID NO: 1299948 - RNA, 19 nt, Homo sapiens
aagcaacgucucaggauga

SEQ ID NO: 1299949 - RNA, 19 nt, Homo sapiens
ggaguucaugagugcuaua

SEQ ID NO: 1299950 - RNA, 19 nt, Homo sapiens
uaagaaugggucugugaug

SEQ ID NO: 1299951 - RNA, 19 nt, Homo sapiens
ccugcaagacgaaugaauu

SEQ ID NO: 1299952 - RNA, 19 nt, Homo sapiens
gaccaugggacacuauuac

SEQ ID NO: 1299953 - RNA, 19 nt, Homo sapiens
cacaacagauaggugauag

SEQ ID NO: 1299954 - RNA, 19 nt, Homo sapiens
cgaagugauuaaauaugag

SEQ ID NO: 1299955 - RNA, 19 nt, Homo sapiens
gauguuugauaggcugaau

SEQ ID NO: 1299956 - RNA, 19 nt, Homo sapiens
aaacauuccaacguuauug

SEQ ID NO: 1299957 - RNA, 19 nt, Homo sapiens
caggaacauccaauacuug

SEQ ID NO: 1299958 - RNA, 19 nt, Homo sapiens
caaggugggagcaucacuu

SEQ ID NO: 1299959 - RNA, 19 nt, Homo sapiens
gaguucaugagugcuauaa

SEQ ID NO: 1299960 - RNA, 19 nt, Homo sapiens
ggaaggaccucacuuguuu

SEQ ID NO: 1299961 - RNA, 19 nt, Homo sapiens
gaaacuacauguucagaaa

SEQ ID NO: 1299962 - RNA, 19 nt, Homo sapiens
gguaauauauggcuaauga

SEQ ID NO: 1299963 - RNA, 19 nt, Homo sapiens
gcucauaccuguaauccua

SEQ ID NO: 1299964 - RNA, 19 nt, Homo sapiens
aagcaaagguucaguauuu

SEQ ID NO: 1299965 - RNA, 19 nt, Homo sapiens
gaaguucucuggaauuaau

SEQ ID NO: 1299966 - RNA, 19 nt, Homo sapiens
gcaaacaaaucaugugguu

SEQ ID NO: 1299967 - RNA, 19 nt, Homo sapiens
cagaucaccugaaauauuu

SEQ ID NO: 1299968 - RNA, 19 nt, Homo sapiens
gagaagaagguuuagauua

SEQ ID NO: 1299969 - RNA, 19 nt, Homo sapiens
ccucauagcucauguauca

SEQ ID NO: 1299970 - RNA, 19 nt, Homo sapiens
caagguggcuguuauaaau

SEQ ID NO: 1299971 - RNA, 19 nt, Homo sapiens
gaaaucaggucugcaaaug

SEQ ID NO: 1299972 - RNA, 19 nt, Homo sapiens
guaagauacugccaucaua

SEQ ID NO: 1299973 - RNA, 19 nt, Homo sapiens
gcagggaaguccuuuggua

SEQ ID NO: 1299974 - RNA, 19 nt, Homo sapiens
ggacaagaguaacuucuga

SEQ ID NO: 1299975 - RNA, 19 nt, Homo sapiens
gcaauauucuuguaacaga

SEQ ID NO: 1299976 - RNA, 19 nt, Homo sapiens
gcaaagacaugccaucuac

SEQ ID NO: 1299977 - RNA, 19 nt, Homo sapiens
guugggaacugcugcauua

SEQ ID NO: 1299978 - RNA, 19 nt, Homo sapiens
cgacuucuauuuaguauug

SEQ ID NO: 1299979 - RNA, 19 nt, Homo sapiens
ggacguauuuauuauguug

SEQ ID NO: 1299980 - RNA, 19 nt, Homo sapiens
gacacaagcuuucuuugaa

SEQ ID NO: 1299981 - RNA, 19 nt, Homo sapiens
ccacagcacauaaagauua

SEQ ID NO: 1299982 - RNA, 19 nt, Homo sapiens
caaauagaccgcagacaua

SEQ ID NO: 1299983 - RNA, 19 nt, Homo sapiens
gucaugaacuggauugaua

SEQ ID NO: 1299984 - RNA, 19 nt, Homo sapiens
gaaugagacuucugcaguu

SEQ ID NO: 1299985 - RNA, 19 nt, Homo sapiens
gaagaacuaccaccuauau

SEQ ID NO: 1299986 - RNA, 19 nt, Homo sapiens
ucaagcagcucauaauaau

SEQ ID NO: 1299987 - RNA, 19 nt, Homo sapiens
ggucacagccugcaaauga

SEQ ID NO: 1299988 - RNA, 19 nt, Homo sapiens
gaagaagguuuagauuaug

SEQ ID NO: 1299989 - RNA, 19 nt, Homo sapiens
acacaaaguucucauccua

SEQ ID NO: 1299990 - RNA, 19 nt, Homo sapiens
gaucaagcagcucauaaua

SEQ ID NO: 1299991 - RNA, 19 nt, Homo sapiens
gcaaggaccagcaaacaaa

SEQ ID NO: 1299992 - RNA, 19 nt, Homo sapiens
caacuacccguucauuaua

SEQ ID NO: 1299993 - RNA, 19 nt, Homo sapiens
gggaccggcugccaucuua

SEQ ID NO: 1299994 - RNA, 19 nt, Homo sapiens
uauaaagacuuccuguuga

SEQ ID NO: 1299995 - RNA, 19 nt, Homo sapiens
aaacuugucuacuguaaga

SEQ ID NO: 1299996 - RNA, 19 nt, Homo sapiens
gcaauggaccacagaaauu

SEQ ID NO: 1299997 - RNA, 19 nt, Homo sapiens
gaucacaacuugguucaau

SEQ ID NO: 1299998 - RNA, 19 nt, Homo sapiens
guaagaggcauuuguuaaa

SEQ ID NO: 1299999 - RNA, 19 nt, Homo sapiens
gcaagagauugauuugaau

SEQ ID NO: 1300000 - RNA, 19 nt, Homo sapiens
gucaugaucugaaaccuaa

SEQ ID NO: 1300001 - RNA, 19 nt, Homo sapiens
gacaguggaucacaacuug

SEQ ID NO: 1300002 - RNA, 19 nt, Homo sapiens
ugacucaacuauacacaaa

SEQ ID NO: 1300003 - RNA, 19 nt, Homo sapiens
gguccaaacugaacauaug

SEQ ID NO: 1300004 - RNA, 19 nt, Homo sapiens
ugucuucccugcuguguua

SEQ ID NO: 1300005 - RNA, 19 nt, Homo sapiens
gaacuaccaccuauauaga

SEQ ID NO: 1300006 - RNA, 19 nt, Homo sapiens
agcaacaucuggauuaaua

SEQ ID NO: 1300007 - RNA, 19 nt, Homo sapiens
ggaccucacuuguuucauc

SEQ ID NO: 1300008 - RNA, 19 nt, Homo sapiens
guagucauuuccauucuuu

SEQ ID NO: 1300009 - RNA, 19 nt, Homo sapiens
gaagagaacagacagcaau

SEQ ID NO: 1300010 - RNA, 19 nt, Homo sapiens
gagcaaugcagcaguuuaa

SEQ ID NO: 1300011 - RNA, 19 nt, Homo sapiens
ggagcaacaucuggauuaa

SEQ ID NO: 1300012 - RNA, 19 nt, Homo sapiens
gguaagaggcauuuguuaa

SEQ ID NO: 1300013 - RNA, 19 nt, Homo sapiens
ggcauagcaugaacaagua

SEQ ID NO: 1300014 - RNA, 19 nt, Homo sapiens
ccacuaguuuauuccuuua

SEQ ID NO: 1300015 - RNA, 19 nt, Homo sapiens
gaaccuugcuuaacaugag

SEQ ID NO: 1300016 - RNA, 19 nt, Homo sapiens
gaaauuaagagucaugauc

SEQ ID NO: 1300017 - RNA, 19 nt, Homo sapiens
gaaagugaugggucuagua

SEQ ID NO: 1300018 - RNA, 19 nt, Homo sapiens
gcacaaauggaucagauga

SEQ ID NO: 1300019 - RNA, 19 nt, Homo sapiens
auaggagacuugucaauuu

SEQ ID NO: 1300020 - RNA, 19 nt, Homo sapiens
caagauguaagacuguuua

SEQ ID NO: 1300021 - RNA, 19 nt, Homo sapiens
uaaaguuccuucagugguu

SEQ ID NO: 1300022 - RNA, 19 nt, Homo sapiens
gcaaauagaccgcagacau

SEQ ID NO: 1300023 - RNA, 19 nt, Homo sapiens
ggaauuagagguccuuuua

SEQ ID NO: 1300024 - RNA, 19 nt, Homo sapiens
guacuucuccguugacaaa

SEQ ID NO: 1300025 - RNA, 19 nt, Homo sapiens
agacagcaauggcagagua

SEQ ID NO: 1300026 - RNA, 19 nt, Homo sapiens
gagcacaaauggaucagau

SEQ ID NO: 1300027 - RNA, 19 nt, Homo sapiens
uaagagucaugaucugaaa

SEQ ID NO: 1300028 - RNA, 19 nt, Homo sapiens
uagaagaacuaccaccuau

SEQ ID NO: 1300029 - RNA, 19 nt, Homo sapiens
caacaugggacguauuuau

SEQ ID NO: 1300030 - RNA, 19 nt, Homo sapiens
acacugaaaucugauguuu

SEQ ID NO: 1300031 - RNA, 19 nt, Homo sapiens
cagcaaaacuuaaggaaaa

SEQ ID NO: 1300032 - RNA, 19 nt, Homo sapiens
aaagaugucucuggugauu

SEQ ID NO: 1300033 - RNA, 19 nt, Homo sapiens
acaaaguucucauccuaaa

SEQ ID NO: 1300034 - RNA, 19 nt, Homo sapiens
gcgaaugucugccaacuac

SEQ ID NO: 1300035 - RNA, 19 nt, Homo sapiens
uaaaagcccugguuguuaa

SEQ ID NO: 1300036 - RNA, 19 nt, Homo sapiens
gaaauuugccuugucuuau

SEQ ID NO: 1300037 - RNA, 19 nt, Homo sapiens
ugaaauuugccuugucuua

SEQ ID NO: 1300038 - RNA, 19 nt, Homo sapiens
ccagaucaccugaaauauu

SEQ ID NO: 1300039 - RNA, 19 nt, Homo sapiens
gaagucaaggucaauuaaa

SEQ ID NO: 1300040 - RNA, 19 nt, Homo sapiens
gcaauggcagaguauauuu

SEQ ID NO: 1300041 - RNA, 19 nt, Homo sapiens
gaacugcugcauuagauau

SEQ ID NO: 1300042 - RNA, 19 nt, Homo sapiens
ggagucaaaugcuuuuaua

SEQ ID NO: 1300043 - RNA, 19 nt, Homo sapiens
ucaagcagcucaguguaaa

SEQ ID NO: 1300044 - RNA, 19 nt, Homo sapiens
agaagaaacagaaggauuu

SEQ ID NO: 1300045 - RNA, 19 nt, Homo sapiens
ugaggaaugugauuuggaa

SEQ ID NO: 1300046 - RNA, 19 nt, Homo sapiens
gaaaagcccuuaccugaag

SEQ ID NO: 1300047 - RNA, 19 nt, Homo sapiens
aaccagagauucauuuaug

SEQ ID NO: 1300048 - RNA, 19 nt, Homo sapiens
aaacaagagugagcacaaa

SEQ ID NO: 1300049 - RNA, 19 nt, Homo sapiens
gaaacaagagugagcacaa

SEQ ID NO: 1300050 - RNA, 19 nt, Homo sapiens
guuagagucugaaguuguu

SEQ ID NO: 1300051 - RNA, 19 nt, Homo sapiens
gcacuggauuguauauuac

SEQ ID NO: 1300052 - RNA, 19 nt, Homo sapiens
ccaagaaucagagguuaua

SEQ ID NO: 1300053 - RNA, 19 nt, Homo sapiens
ggaucucccuacuccauuu

SEQ ID NO: 1300054 - RNA, 19 nt, Homo sapiens
cagcugagucucuaucaua

SEQ ID NO: 1300055 - RNA, 19 nt, Homo sapiens
ggcaguggaugaagccuaa

SEQ ID NO: 1300056 - RNA, 19 nt, Homo sapiens
ugcaagagauugauuugaa

SEQ ID NO: 1300057 - RNA, 19 nt, Homo sapiens
ggauuccuuucaacagaua

SEQ ID NO: 1300058 - RNA, 19 nt, Homo sapiens
gauggacagucaaagaaga

SEQ ID NO: 1300059 - RNA, 19 nt, Homo sapiens
guuaacgacuucuauuuag

SEQ ID NO: 1300060 - RNA, 19 nt, Homo sapiens
gaaauugcaucguaagcuu

SEQ ID NO: 1300061 - RNA, 19 nt, Homo sapiens
gagaacaucuugccagaca

SEQ ID NO: 1300062 - RNA, 19 nt, Homo sapiens
gacaucagccaaagaaaua

SEQ ID NO: 1300063 - RNA, 19 nt, Homo sapiens
ccaaacaaaucuguaaaga

SEQ ID NO: 1300064 - RNA, 19 nt, Homo sapiens
gacaacauauggaacagaa

SEQ ID NO: 1300065 - RNA, 19 nt, Homo sapiens
ccaaagaaauacucagcaa

SEQ ID NO: 1300066 - RNA, 19 nt, Homo sapiens
gugaaaugcugaacuacuu

SEQ ID NO: 1300067 - RNA, 19 nt, Homo sapiens
gcuaaugucacccuccuua

SEQ ID NO: 1300068 - RNA, 19 nt, Homo sapiens
ggagaaacccaacauguca

SEQ ID NO: 1300069 - RNA, 19 nt, Homo sapiens
aggcgaagauacaauauuu

SEQ ID NO: 1300070 - RNA, 19 nt, Homo sapiens
cagaaucuauuuccagaga

SEQ ID NO: 1300071 - RNA, 19 nt, Homo sapiens
ccaaacaguucucagugaa

SEQ ID NO: 1300072 - RNA, 19 nt, Homo sapiens
ccucaaugcuucacucuug

SEQ ID NO: 1300073 - RNA, 19 nt, Homo sapiens
gcucuaagcacuuuccaaa

SEQ ID NO: 1300074 - RNA, 19 nt, Homo sapiens
ggcaauaugugcagcucua

SEQ ID NO: 1300075 - RNA, 19 nt, Homo sapiens
caacaugucaacuaccuuu

SEQ ID NO: 1300076 - RNA, 19 nt, Homo sapiens
auaaaucucuucugccuau

SEQ ID NO: 1300077 - RNA, 19 nt, Homo sapiens
gaaagaacagacagcaaga

SEQ ID NO: 1300078 - RNA, 19 nt, Homo sapiens
gcacuuggcucgggauuuu

SEQ ID NO: 1300079 - RNA, 19 nt, Homo sapiens
ggaaugcacccagaucaaa

SEQ ID NO: 1300080 - RNA, 19 nt, Homo sapiens
ccagagacauuuaacacau

SEQ ID NO: 1300081 - RNA, 19 nt, Homo sapiens
gagcccaccgacuuuauua

SEQ ID NO: 1300082 - RNA, 19 nt, Homo sapiens
ucuaagcacuuuccaaaca

SEQ ID NO: 1300083 - RNA, 19 nt, Homo sapiens
uggccaagguggagugaua

SEQ ID NO: 1300084 - RNA, 19 nt, Homo sapiens
cagagacauuuaacacauu

SEQ ID NO: 1300085 - RNA, 19 nt, Homo sapiens
ggccguuugucccuucuua

SEQ ID NO: 1300086 - RNA, 19 nt, Homo sapiens
gagucuugcugcugauauu

SEQ ID NO: 1300087 - RNA, 19 nt, Homo sapiens
aaccuccaguuccuuauua

SEQ ID NO: 1300088 - RNA, 19 nt, Homo sapiens
aaacaguucucagugaaau

SEQ ID NO: 1300089 - RNA, 19 nt, Homo sapiens
ugacauccagagacauuua

SEQ ID NO: 1300090 - RNA, 19 nt, Homo sapiens
cgaccaaacaaaucuguaa

SEQ ID NO: 1300091 - RNA, 19 nt, Homo sapiens
caucuugccagacaacaua

SEQ ID NO: 1300092 - RNA, 19 nt, Homo sapiens
gaccauugcugagguaaag

SEQ ID NO: 1300093 - RNA, 19 nt, Homo sapiens
caagggaccuacgacauca

SEQ ID NO: 1300094 - RNA, 19 nt, Homo sapiens
gaaucuauuuccagagagu

SEQ ID NO: 1300095 - RNA, 19 nt, Homo sapiens
gaagacggaaagcagcuaa

SEQ ID NO: 1300096 - RNA, 19 nt, Homo sapiens
aaacuuaccagcaggaaga

SEQ ID NO: 1300097 - RNA, 19 nt, Homo sapiens
caagguggagugauaagaa

SEQ ID NO: 1300098 - RNA, 19 nt, Homo sapiens
guccuuccauuacgaguuu

SEQ ID NO: 1300099 - RNA, 19 nt, Homo sapiens
ccuccucuccuuuaacuua

SEQ ID NO: 1300100 - RNA, 19 nt, Homo sapiens
uggauaggcuuggcuuaaa

SEQ ID NO: 1300101 - RNA, 19 nt, Homo sapiens
cuagcuacaucaaacagaa

SEQ ID NO: 1300102 - RNA, 19 nt, Homo sapiens
uuugaucacucauggcuuu

SEQ ID NO: 1300103 - RNA, 19 nt, Homo sapiens
caauuccacugucgccuau

SEQ ID NO: 1300104 - RNA, 19 nt, Homo sapiens
cgacaucagccaaagaaau

SEQ ID NO: 1300105 - RNA, 19 nt, Homo sapiens
uggcuacacuugugaaaca

SEQ ID NO: 1300106 - RNA, 19 nt, Homo sapiens
cagacuagcuacaucaaac

SEQ ID NO: 1300107 - RNA, 19 nt, Homo sapiens
gcaguaggagaacaucuug

SEQ ID NO: 1300108 - RNA, 19 nt, Homo sapiens
ggugaccauugcugaggua

SEQ ID NO: 1300109 - RNA, 19 nt, Homo sapiens
ggcaaaaccauuacaauuu

SEQ ID NO: 1300110 - RNA, 19 nt, Homo sapiens
caaacagaaucuauuucca

SEQ ID NO: 1300111 - RNA, 19 nt, Homo sapiens
caacauauggaacagaaag

SEQ ID NO: 1300112 - RNA, 19 nt, Homo sapiens
ggauaggcuuggcuuaaac

SEQ ID NO: 1300113 - RNA, 19 nt, Homo sapiens
aaagaaauacucagcaagu

SEQ ID NO: 1300114 - RNA, 19 nt, Homo sapiens
uccaaacaguucucaguga

SEQ ID NO: 1300115 - RNA, 19 nt, Homo sapiens
cagacccacuccaauucua

SEQ ID NO: 1300116 - RNA, 19 nt, Homo sapiens
gaccaaacaaaucuguaaa

SEQ ID NO: 1300117 - RNA, 19 nt, Homo sapiens
aaacccaacaugucaacua

SEQ ID NO: 1300118 - RNA, 19 nt, Homo sapiens
cagugcugaugcuuaauuu

SEQ ID NO: 1300119 - RNA, 19 nt, Homo sapiens
caaacaguucucagugaaa

SEQ ID NO: 1300120 - RNA, 19 nt, Homo sapiens
gaggcaaggagcuaucuga

SEQ ID NO: 1300121 - RNA, 19 nt, Homo sapiens
ggcgaagauacaauauuua

SEQ ID NO: 1300122 - RNA, 19 nt, Homo sapiens
guuugucccuucuuaguuc

SEQ ID NO: 1300123 - RNA, 19 nt, Homo sapiens
aguccacgaugccgagaua

SEQ ID NO: 1300124 - RNA, 19 nt, Homo sapiens
gaaaauacaagaaguuugg

SEQ ID NO: 1300125 - RNA, 19 nt, Homo sapiens
uaucauugagggugacuaa

SEQ ID NO: 1300126 - RNA, 19 nt, Homo sapiens
uuauuaaccugcacaaugc

SEQ ID NO: 1300127 - RNA, 19 nt, Homo sapiens
ggagcccaccgacuuuauu

SEQ ID NO: 1300128 - RNA, 19 nt, Homo sapiens
guugaaagaaccuccaguu

SEQ ID NO: 1300129 - RNA, 19 nt, Homo sapiens
aaucuucaguggaccaaau

SEQ ID NO: 1300130 - RNA, 19 nt, Homo sapiens
gcaauaugugcagcucuaa

SEQ ID NO: 1300131 - RNA, 19 nt, Homo sapiens
gggcaaaaccauuacaauu

SEQ ID NO: 1300132 - RNA, 19 nt, Homo sapiens
ccagggagcugcuuuugug

SEQ ID NO: 1300133 - RNA, 19 nt, Homo sapiens
ccaagggaccuacgacauc

SEQ ID NO: 1300134 - RNA, 19 nt, Homo sapiens
cauugagggugacuaaucu

SEQ ID NO: 1300135 - RNA, 19 nt, Homo sapiens
aagaacagacagcaagaaa

SEQ ID NO: 1300136 - RNA, 19 nt, Homo sapiens
ccagacaacauauggaaca

SEQ ID NO: 1300137 - RNA, 19 nt, Homo sapiens
gaacaucuugccagacaac

SEQ ID NO: 1300138 - RNA, 19 nt, Homo sapiens
ggucaaccccacagacuua

SEQ ID NO: 1300139 - RNA, 19 nt, Homo sapiens
gaaagagggcaaaacagaa

SEQ ID NO: 1300140 - RNA, 19 nt, Homo sapiens
ugagagagaaauuggauag

SEQ ID NO: 1300141 - RNA, 19 nt, Homo sapiens
gaaugcacccagaucaaag

SEQ ID NO: 1300142 - RNA, 19 nt, Homo sapiens
uuccuugucuccugggaua

SEQ ID NO: 1300143 - RNA, 19 nt, Homo sapiens
augcugaacuacuuggaaa

SEQ ID NO: 1300144 - RNA, 19 nt, Homo sapiens
gacauccagagacauuuaa

SEQ ID NO: 1300145 - RNA, 19 nt, Homo sapiens
ccaaagcaguaggagaaca

SEQ ID NO: 1300146 - RNA, 19 nt, Homo sapiens
ccaaauacaaggugaccau

SEQ ID NO: 1300147 - RNA, 19 nt, Homo sapiens
ugcaaauacucuccacaga

SEQ ID NO: 1300148 - RNA, 19 nt, Homo sapiens
gagaaacccaacaugucaa

SEQ ID NO: 1300149 - RNA, 19 nt, Homo sapiens
gauccuggcgaccaaacaa

SEQ ID NO: 1300150 - RNA, 19 nt, Homo sapiens
aggcuuggcuuaaacuuac

SEQ ID NO: 1300151 - RNA, 19 nt, Homo sapiens
uuuauuaaccugcacaaug

SEQ ID NO: 1300152 - RNA, 19 nt, Homo sapiens
caccaccaguccuuccauu

SEQ ID NO: 1300153 - RNA, 19 nt, Homo sapiens
gagggugacuaaucuucag

SEQ ID NO: 1300154 - RNA, 19 nt, Homo sapiens
acacauuucaguuugauca

SEQ ID NO: 1300155 - RNA, 19 nt, Homo sapiens
aucguaagcuuucggagaa

SEQ ID NO: 1300156 - RNA, 19 nt, Homo sapiens
aaacacacuacucacaaga

SEQ ID NO: 1300157 - RNA, 19 nt, Homo sapiens
ccaccucagucgguauaga

SEQ ID NO: 1300158 - RNA, 19 nt, Homo sapiens
ggaagacggaaagcagcua

SEQ ID NO: 1300159 - RNA, 19 nt, Homo sapiens
uaggcuuggcuuaaacuua

SEQ ID NO: 1300160 - RNA, 19 nt, Homo sapiens
gaacauuccuuuacauugu

SEQ ID NO: 1300161 - RNA, 19 nt, Homo sapiens
ggauaaaguuugguuguuu

SEQ ID NO: 1300162 - RNA, 19 nt, Homo sapiens
gaaaugaagccaaaguuau

SEQ ID NO: 1300163 - RNA, 19 nt, Homo sapiens
gaagauugauuuugccuua

SEQ ID NO: 1300164 - RNA, 19 nt, Homo sapiens
ggaccgaugugccucauug

SEQ ID NO: 1300165 - RNA, 19 nt, Homo sapiens
ccagaugggugaagauuga

SEQ ID NO: 1300166 - RNA, 19 nt, Homo sapiens
gaaagucaccugcaagaga

SEQ ID NO: 1300167 - RNA, 19 nt, Homo sapiens
gauaaaguuugguuguuug

SEQ ID NO: 1300168 - RNA, 19 nt, Homo sapiens
cgaugugccucauuguuua

SEQ ID NO: 1300169 - RNA, 19 nt, Homo sapiens
cgaccaugguggaauguua

SEQ ID NO: 1300170 - RNA, 19 nt, Homo sapiens
gagcaguauucccaccuua

SEQ ID NO: 1300171 - RNA, 19 nt, Homo sapiens
ggacacaagauucuggaua

SEQ ID NO: 1300172 - RNA, 19 nt, Homo sapiens
gauuugaguuccagcguuu

SEQ ID NO: 1300173 - RNA, 19 nt, Homo sapiens
cucauuagcuuaucaaaga

SEQ ID NO: 1300174 - RNA, 19 nt, Homo sapiens
ccaucuaaguuacaucuuu

SEQ ID NO: 1300175 - RNA, 19 nt, Homo sapiens
gaacagccagaguaagauu

SEQ ID NO: 1300176 - RNA, 19 nt, Homo sapiens
gguaugagaagaacacgua

SEQ ID NO: 1300177 - RNA, 19 nt, Homo sapiens
ucacugcccuucuagaugu

SEQ ID NO: 1300178 - RNA, 19 nt, Homo sapiens
agaaaugaagccaaaguua

SEQ ID NO: 1300179 - RNA, 19 nt, Homo sapiens
guccagcgcuguuugcauu

SEQ ID NO: 1300180 - RNA, 19 nt, Homo sapiens
gggaacagccagaguaaga

SEQ ID NO: 1300181 - RNA, 19 nt, Homo sapiens
acugcaaccucaaggauua

SEQ ID NO: 1300182 - RNA, 19 nt, Homo sapiens
gagaguggguuugggaaga

SEQ ID NO: 1300183 - RNA, 19 nt, Homo sapiens
caagagaucccggcacuga

SEQ ID NO: 1300184 - RNA, 19 nt, Homo sapiens
ggagaugcucauuagcuua

SEQ ID NO: 1300185 - RNA, 19 nt, Homo sapiens
gacacaagauucuggauac

SEQ ID NO: 1300186 - RNA, 19 nt, Homo sapiens
gguggaauguuaaggugaa

SEQ ID NO: 1300187 - RNA, 19 nt, Homo sapiens
acacgugccuguagcauuc

SEQ ID NO: 1300188 - RNA, 19 nt, Homo sapiens
guuccagcguuuauucuuu

SEQ ID NO: 1300189 - RNA, 19 nt, Homo sapiens
ccuguaagguuuccauguu

SEQ ID NO: 1300190 - RNA, 19 nt, Homo sapiens
gcagaagcuuucagagucu

SEQ ID NO: 1300191 - RNA, 19 nt, Homo sapiens
aaaggaaagucaccugcaa

SEQ ID NO: 1300192 - RNA, 19 nt, Homo sapiens
gagaaaugaagccaaaguu

SEQ ID NO: 1300193 - RNA, 19 nt, Homo sapiens
gcuguguucuguuugaaga

SEQ ID NO: 1300194 - RNA, 19 nt, Homo sapiens
gagaccagccuccuuaauc

SEQ ID NO: 1300195 - RNA, 19 nt, Homo sapiens
gcuaugauuuggacacaag

SEQ ID NO: 1300196 - RNA, 19 nt, Homo sapiens
aaagucaccugcaagagau

SEQ ID NO: 1300197 - RNA, 19 nt, Homo sapiens
gaccugaacuggggaauuu

SEQ ID NO: 1300198 - RNA, 19 nt, Homo sapiens
gagaugcucauuagcuuau

SEQ ID NO: 1300199 - RNA, 19 nt, Homo sapiens
guuuaguggugauuacaaa

SEQ ID NO: 1300200 - RNA, 19 nt, Homo sapiens
gaauuccuguucuccuugu

SEQ ID NO: 1300201 - RNA, 19 nt, Homo sapiens
ugccuuaacucaagagaau

SEQ ID NO: 1300202 - RNA, 19 nt, Homo sapiens
cauuggcuguguucuguuu

SEQ ID NO: 1300203 - RNA, 19 nt, Homo sapiens
gagaggaagagaggacuaa

SEQ ID NO: 1300204 - RNA, 19 nt, Homo sapiens
ggagcaguauucccaccuu

SEQ ID NO: 1300205 - RNA, 19 nt, Homo sapiens
ggagaaaugaagccaaagu

SEQ ID NO: 1300206 - RNA, 19 nt, Homo sapiens
gaccaugguggaauguuaa

SEQ ID NO: 1300207 - RNA, 19 nt, Homo sapiens
caaauaugcuuuucuggau

SEQ ID NO: 1300208 - RNA, 19 nt, Homo sapiens
gaugggugaagauugauuu

SEQ ID NO: 1300209 - RNA, 19 nt, Homo sapiens
ccaaaguuauucagauggu

SEQ ID NO: 1300210 - RNA, 19 nt, Homo sapiens
gaagccaaaguuauucaga

SEQ ID NO: 1300211 - RNA, 19 nt, Homo sapiens
ccgaugugccucauuguuu

SEQ ID NO: 1300212 - RNA, 19 nt, Homo sapiens
gaggaagagaggacuaaga

SEQ ID NO: 1300213 - RNA, 19 nt, Homo sapiens
gggucucccuuaccaaaga

SEQ ID NO: 1300214 - RNA, 19 nt, Homo sapiens
gguccauccuucucaagau

SEQ ID NO: 1300215 - RNA, 19 nt, Homo sapiens
cuggauaccuggaacuuag

SEQ ID NO: 1300216 - RNA, 19 nt, Homo sapiens
caaaguuauucagaugguu

SEQ ID NO: 1300217 - RNA, 19 nt, Homo sapiens
ccgaagggcccaacccauu

SEQ ID NO: 1300218 - RNA, 19 nt, Homo sapiens
ucaaggcccugugccauag

SEQ ID NO: 1300219 - RNA, 19 nt, Homo sapiens
ggcugggccuguaagguuu

SEQ ID NO: 1300220 - RNA, 19 nt, Homo sapiens
gagaagucccgcuguuaca

SEQ ID NO: 1300221 - RNA, 19 nt, Homo sapiens
ccagcgcuguuugcauuaa

SEQ ID NO: 1300222 - RNA, 19 nt, Homo sapiens
caggaugagcgacgaguuu

SEQ ID NO: 1300223 - RNA, 19 nt, Homo sapiens
agagcucacugcccuucua

SEQ ID NO: 1300224 - RNA, 19 nt, Homo sapiens
ccagugaggaaguagauug

SEQ ID NO: 1300225 - RNA, 19 nt, Homo sapiens
cgaagggcccaacccauug

SEQ ID NO: 1300226 - RNA, 19 nt, Homo sapiens
uggauaaaguuugguuguu

SEQ ID NO: 1300227 - RNA, 19 nt, Homo sapiens
ggagaggaagagaggacua

SEQ ID NO: 1300228 - RNA, 19 nt, Homo sapiens
ugaacauuccuuuacauug

SEQ ID NO: 1300229 - RNA, 19 nt, Homo sapiens
gaugcucauuagcuuauca

SEQ ID NO: 1300230 - RNA, 19 nt, Homo sapiens
uggagaugcucauuagcuu

SEQ ID NO: 1300231 - RNA, 19 nt, Homo sapiens
ggugcugucucccuuucuu

SEQ ID NO: 1300232 - RNA, 19 nt, Homo sapiens
ccaaacacacacuaacugu

SEQ ID NO: 1300233 - RNA, 19 nt, Homo sapiens
caaaagagagaguggguuu

SEQ ID NO: 1300234 - RNA, 19 nt, Homo sapiens
aaacaguggauuugaguuc

SEQ ID NO: 1300235 - RNA, 19 nt, Homo sapiens
ccauaucuguuugcauuag

SEQ ID NO: 1300236 - RNA, 19 nt, Homo sapiens
gcucacugcccuucuagau

SEQ ID NO: 1300237 - RNA, 19 nt, Homo sapiens
cagcgcuguuugcauuaaa

SEQ ID NO: 1300238 - RNA, 19 nt, Homo sapiens
ccuaaacaguggauuugag

SEQ ID NO: 1300239 - RNA, 19 nt, Homo sapiens
aagccaaaguuauucagau

SEQ ID NO: 1300240 - RNA, 19 nt, Homo sapiens
gcaguauucccaccuuaag

SEQ ID NO: 1300241 - RNA, 19 nt, Homo sapiens
gagaagccgguggguugua

SEQ ID NO: 1300242 - RNA, 19 nt, Homo sapiens
ucuuggagaugcucauuag

SEQ ID NO: 1300243 - RNA, 19 nt, Homo sapiens
cagaaucccagcccagaau

SEQ ID NO: 1300244 - RNA, 19 nt, Homo sapiens
ucccugcccuccagcguuu

SEQ ID NO: 1300245 - RNA, 19 nt, Homo sapiens
ccccauaucuguuugcauu

SEQ ID NO: 1300246 - RNA, 19 nt, Homo sapiens
agccaaaguuauucagaug

SEQ ID NO: 1300247 - RNA, 19 nt, Homo sapiens
guuugguuguuugcucuua

SEQ ID NO: 1300248 - RNA, 19 nt, Homo sapiens
ucagguccauccuucucaa

SEQ ID NO: 1300249 - RNA, 19 nt, Homo sapiens
gaucaccaucuaaguuaca

SEQ ID NO: 1300250 - RNA, 19 nt, Homo sapiens
cccauuggcuguguucugu

SEQ ID NO: 1300251 - RNA, 19 nt, Homo sapiens
cuguaagguuuccauguug

SEQ ID NO: 1300252 - RNA, 19 nt, Homo sapiens
gccaaacacacacuaacug

SEQ ID NO: 1300253 - RNA, 19 nt, Homo sapiens
uggcugggccuguaagguu

SEQ ID NO: 1300254 - RNA, 19 nt, Homo sapiens
ggcgcugccuucuggauca

SEQ ID NO: 1300255 - RNA, 19 nt, Homo sapiens
gcucauuagcuuaucaaag

SEQ ID NO: 1300256 - RNA, 19 nt, Homo sapiens
ggaacagccagaguaagau

SEQ ID NO: 1300257 - RNA, 19 nt, Homo sapiens
cuacuccgccuuuguccuu

SEQ ID NO: 1300258 - RNA, 19 nt, Homo sapiens
ccuggaacuuagcugugua

SEQ ID NO: 1300259 - RNA, 19 nt, Homo sapiens
caauggaagagcccagaug

SEQ ID NO: 1300260 - RNA, 19 nt, Homo sapiens
ggaggaagaugaagaggau

SEQ ID NO: 1300261 - RNA, 19 nt, Homo sapiens
gggaggagcuggucaugga

SEQ ID NO: 1300262 - RNA, 19 nt, Homo sapiens
gggcagugaugaagaagaa

SEQ ID NO: 1300263 - RNA, 19 nt, Homo sapiens
cgugauggauucuguuuga

SEQ ID NO: 1300264 - RNA, 19 nt, Homo sapiens
ccaaagaacucgguuuaac

SEQ ID NO: 1300265 - RNA, 19 nt, Homo sapiens
caccaaagaacucgguuua

SEQ ID NO: 1300266 - RNA, 19 nt, Homo sapiens
ggaaacugaagucgaauug

SEQ ID NO: 1300267 - RNA, 19 nt, Homo sapiens
caauaaaggaccaagaaga

SEQ ID NO: 1300268 - RNA, 19 nt, Homo sapiens
ugaagaggaugaagaagag

SEQ ID NO: 1300269 - RNA, 19 nt, Homo sapiens
gagcuuccucuuacacuuu

SEQ ID NO: 1300270 - RNA, 19 nt, Homo sapiens
gaauugggcuccccuggaa

SEQ ID NO: 1300271 - RNA, 19 nt, Homo sapiens
gcaacagacugaugaugcu

SEQ ID NO: 1300272 - RNA, 19 nt, Homo sapiens
uacaguggcugcaccaaau

SEQ ID NO: 1300273 - RNA, 19 nt, Homo sapiens
gaugagcaggcccaaauga

SEQ ID NO: 1300274 - RNA, 19 nt, Homo sapiens
gggaugagcaggcccaaau

SEQ ID NO: 1300275 - RNA, 19 nt, Homo sapiens
gcccagagcaacagacuga

SEQ ID NO: 1300276 - RNA, 19 nt, Homo sapiens
uaaccagggcucuguaaga

SEQ ID NO: 1300277 - RNA, 19 nt, Homo sapiens
gggcugccgugauggauuc

SEQ ID NO: 1300278 - RNA, 19 nt, Homo sapiens
cuuggaaacugaagucgaa

SEQ ID NO: 1300279 - RNA, 19 nt, Homo sapiens
ccaggaguuuccaggguaa

SEQ ID NO: 1300280 - RNA, 19 nt, Homo sapiens
gauucuguuugacguauug

SEQ ID NO: 1300281 - RNA, 19 nt, Homo sapiens
ugucauggcugggugaaga

SEQ ID NO: 1300282 - RNA, 19 nt, Homo sapiens
aagaagaggaggaagauga

SEQ ID NO: 1300283 - RNA, 19 nt, Homo sapiens
agagggcagugaugaagaa

SEQ ID NO: 1300284 - RNA, 19 nt, Homo sapiens
gcgagaggguucgaagaug

SEQ ID NO: 1300285 - RNA, 19 nt, Homo sapiens
gcagugaugaagaagaaga

SEQ ID NO: 1300286 - RNA, 19 nt, Homo sapiens
uagaaggccuggcucugau

SEQ ID NO: 1300287 - RNA, 19 nt, Homo sapiens
gggaucaccugggagacaa

SEQ ID NO: 1300288 - RNA, 19 nt, Homo sapiens
gcaauaaaggaccaagaag

SEQ ID NO: 1300289 - RNA, 19 nt, Homo sapiens
cagagcaacagacugauga

SEQ ID NO: 1300290 - RNA, 19 nt, Homo sapiens
ggacgaggaggccuaugug

SEQ ID NO: 1300291 - RNA, 19 nt, Homo sapiens
ccuccucccugacuuuaga

SEQ ID NO: 1300292 - RNA, 19 nt, Homo sapiens
ggauucuguuugacguauu

SEQ ID NO: 1300293 - RNA, 19 nt, Homo sapiens
gaguucuccuccagcguuu

SEQ ID NO: 1300294 - RNA, 19 nt, Homo sapiens
agacugaugaugcuucuga

SEQ ID NO: 1300295 - RNA, 19 nt, Homo sapiens
cuagaaggccuggcucuga

SEQ ID NO: 1300296 - RNA, 19 nt, Homo sapiens
cagcucagucucccaggua

SEQ ID NO: 1300297 - RNA, 19 nt, Homo sapiens
uccgcacccucuccgauua

SEQ ID NO: 1300298 - RNA, 19 nt, Homo sapiens
caguagggcggaucucauu

SEQ ID NO: 1300299 - RNA, 19 nt, Homo sapiens
gguguggguuccuccaaca

SEQ ID NO: 1300300 - RNA, 19 nt, Homo sapiens
aggcuggucucaaauucuu

SEQ ID NO: 1300301 - RNA, 19 nt, Homo sapiens
cuccuucgcuggacacaug

SEQ ID NO: 1300302 - RNA, 19 nt, Homo sapiens
ggaugaagaagagcggaaa

SEQ ID NO: 1300303 - RNA, 19 nt, Homo sapiens
cguauccgcaggcuucuuu

SEQ ID NO: 1300304 - RNA, 19 nt, Homo sapiens
agaugaagaggaugaagaa

SEQ ID NO: 1300305 - RNA, 19 nt, Homo sapiens
ugaagaagaagaggaggaa

SEQ ID NO: 1300306 - RNA, 19 nt, Homo sapiens
gugauucucucagcucagu

SEQ ID NO: 1300307 - RNA, 19 nt, Homo sapiens
ggaagaugaagaggaugaa

SEQ ID NO: 1300308 - RNA, 19 nt, Homo sapiens
acacaugggcgagggcuuu

SEQ ID NO: 1300309 - RNA, 19 nt, Homo sapiens
gaaagcgaaacccggaagu

SEQ ID NO: 1300310 - RNA, 19 nt, Homo sapiens
agaagaggaggaagaugaa

SEQ ID NO: 1300311 - RNA, 19 nt, Homo sapiens
gaagaagaggaggaagaug

SEQ ID NO: 1300312 - RNA, 19 nt, Homo sapiens
cggcgucgcacgugugaaa

SEQ ID NO: 1300313 - RNA, 19 nt, Homo sapiens
aauaaaggaccaagaagag

SEQ ID NO: 1300314 - RNA, 19 nt, Homo sapiens
ugacccauuugaccugugu

SEQ ID NO: 1300315 - RNA, 19 nt, Homo sapiens
aagaagaagaggaggaaga

SEQ ID NO: 1300316 - RNA, 19 nt, Homo sapiens
ugaugaugcuucugaugca

SEQ ID NO: 1300317 - RNA, 19 nt, Homo sapiens
gagcaacagacugaugaug

SEQ ID NO: 1300318 - RNA, 19 nt, Homo sapiens
guagggcggaucucauuag

SEQ ID NO: 1300319 - RNA, 19 nt, Homo sapiens
ggaugagcaggcccaaaug

SEQ ID NO: 1300320 - RNA, 19 nt, Homo sapiens
aagcgaaacccggaaguga

SEQ ID NO: 1300321 - RNA, 19 nt, Homo sapiens
ucucagcuuugacauaguc

SEQ ID NO: 1300322 - RNA, 19 nt, Homo sapiens
caccacaccccguuaauuu

SEQ ID NO: 1300323 - RNA, 19 nt, Homo sapiens
cccacuggcucugaucuug

SEQ ID NO: 1300324 - RNA, 19 nt, Homo sapiens
agaugcaguuucuccguau

SEQ ID NO: 1300325 - RNA, 19 nt, Homo sapiens
ccucuuacacuuuacuugu

SEQ ID NO: 1300326 - RNA, 19 nt, Homo sapiens
guggguuccuccaacacaa

SEQ ID NO: 1300327 - RNA, 19 nt, Homo sapiens
ucugggaccuucggcaguu

SEQ ID NO: 1300328 - RNA, 19 nt, Homo sapiens
ccagagcaacagacugaug

SEQ ID NO: 1300329 - RNA, 19 nt, Homo sapiens
gcaguagggcggaucucau

SEQ ID NO: 1300330 - RNA, 19 nt, Homo sapiens
ugacguauuguucucuaga

SEQ ID NO: 1300331 - RNA, 19 nt, Homo sapiens
ggaggccuaugugcucuac

SEQ ID NO: 1300332 - RNA, 19 nt, Homo sapiens
ugucaggcuucaccaucuu

SEQ ID NO: 1300333 - RNA, 19 nt, Homo sapiens
aagaugaagaggaugaaga

SEQ ID NO: 1300334 - RNA, 19 nt, Homo sapiens
ccaacacaauuugcuucug

SEQ ID NO: 1300335 - RNA, 19 nt, Homo sapiens
gguuaaagugauucucuca

SEQ ID NO: 1300336 - RNA, 19 nt, Homo sapiens
ucaccaaagaacucgguuu

SEQ ID NO: 1300337 - RNA, 19 nt, Homo sapiens
gccgugauggauucuguuu

SEQ ID NO: 1300338 - RNA, 19 nt, Homo sapiens
gaaacugaagucgaauugg

SEQ ID NO: 1300339 - RNA, 19 nt, Homo sapiens
gaagaugaagaggaugaag

SEQ ID NO: 1300340 - RNA, 19 nt, Homo sapiens
agcuuccucuuacacuuua

SEQ ID NO: 1300341 - RNA, 19 nt, Homo sapiens
ccuccuggguuaaagugau

SEQ ID NO: 1300342 - RNA, 19 nt, Homo sapiens
uggauucuguuugacguau

SEQ ID NO: 1300343 - RNA, 19 nt, Homo sapiens
gaugcaguuucuccguauc

SEQ ID NO: 1300344 - RNA, 19 nt, Homo sapiens
cagccuuccuccgggauga

SEQ ID NO: 1300345 - RNA, 19 nt, Homo sapiens
augaagaggaugaagaaga

SEQ ID NO: 1300346 - RNA, 19 nt, Homo sapiens
agaagaagaggaggaagau

SEQ ID NO: 1300347 - RNA, 19 nt, Homo sapiens
caagauuccuuuguaguua

SEQ ID NO: 1300348 - RNA, 19 nt, Homo sapiens
gagcugggcuuguauguuc

SEQ ID NO: 1300349 - RNA, 19 nt, Homo sapiens
cauccaagauuccuuugua

SEQ ID NO: 1300350 - RNA, 19 nt, Homo sapiens
ccaaagaggccacaaagaa

SEQ ID NO: 1300351 - RNA, 19 nt, Homo sapiens
gaacacagaacccucaaga

SEQ ID NO: 1300352 - RNA, 19 nt, Homo sapiens
cuagagagcugggcuugua

SEQ ID NO: 1300353 - RNA, 19 nt, Homo sapiens
ggaggaagauggccugagu

SEQ ID NO: 1300354 - RNA, 19 nt, Homo sapiens
gauccucucuguguaaauu

SEQ ID NO: 1300355 - RNA, 19 nt, Homo sapiens
ggagucaagugaagcagaa

SEQ ID NO: 1300356 - RNA, 19 nt, Homo sapiens
gauaguuuccggaguuaua

SEQ ID NO: 1300357 - RNA, 19 nt, Homo sapiens
gcaggaaacagacgacuga

SEQ ID NO: 1300358 - RNA, 19 nt, Homo sapiens
agaggaagaugacgacuug

SEQ ID NO: 1300359 - RNA, 19 nt, Homo sapiens
uaacauggauugcccaaac

SEQ ID NO: 1300360 - RNA, 19 nt, Homo sapiens
gaagggcuaccucaugaaa

SEQ ID NO: 1300361 - RNA, 19 nt, Homo sapiens
cggaagaucuacugugaug

SEQ ID NO: 1300362 - RNA, 19 nt, Homo sapiens
gaccauccaugccaaguuc

SEQ ID NO: 1300363 - RNA, 19 nt, Homo sapiens
uaugauaguuuccggaguu

SEQ ID NO: 1300364 - RNA, 19 nt, Homo sapiens
uggaagggcuaccucauga

SEQ ID NO: 1300365 - RNA, 19 nt, Homo sapiens
caucgagacucuuuaacau

SEQ ID NO: 1300366 - RNA, 19 nt, Homo sapiens
guuccuaccuaaaugaaga

SEQ ID NO: 1300367 - RNA, 19 nt, Homo sapiens
gggaggaugugaugaaagg

SEQ ID NO: 1300368 - RNA, 19 nt, Homo sapiens
gccuugagcugcuuucugu

SEQ ID NO: 1300369 - RNA, 19 nt, Homo sapiens
ccaagauuccuuuguaguu

SEQ ID NO: 1300370 - RNA, 19 nt, Homo sapiens
gagaacuacuuggagaaga

SEQ ID NO: 1300371 - RNA, 19 nt, Homo sapiens
guuaugaggcacagacuuu

SEQ ID NO: 1300372 - RNA, 19 nt, Homo sapiens
ggacgcuucccguggauuu

SEQ ID NO: 1300373 - RNA, 19 nt, Homo sapiens
gaacaucaagcaggaaaca

SEQ ID NO: 1300374 - RNA, 19 nt, Homo sapiens
gagaacaucaagcaggaaa

SEQ ID NO: 1300375 - RNA, 19 nt, Homo sapiens
gaaggaagagcaucuagac

SEQ ID NO: 1300376 - RNA, 19 nt, Homo sapiens
acacagaacccucaagaca

SEQ ID NO: 1300377 - RNA, 19 nt, Homo sapiens
cagaaccaauggaggaaga

SEQ ID NO: 1300378 - RNA, 19 nt, Homo sapiens
guuaaaggguccaguucug

SEQ ID NO: 1300379 - RNA, 19 nt, Homo sapiens
caaagaggccacaaagaag

SEQ ID NO: 1300380 - RNA, 19 nt, Homo sapiens
acagaacccucaagacaag

SEQ ID NO: 1300381 - RNA, 19 nt, Homo sapiens
gggaggacauugggaggaa

SEQ ID NO: 1300382 - RNA, 19 nt, Homo sapiens
uggaggugcucaacaguga

SEQ ID NO: 1300383 - RNA, 19 nt, Homo sapiens
caacugggagaacuacuug

SEQ ID NO: 1300384 - RNA, 19 nt, Homo sapiens
ucaagcacgucccacucua

SEQ ID NO: 1300385 - RNA, 19 nt, Homo sapiens
gagccuuccuccacucuca

SEQ ID NO: 1300386 - RNA, 19 nt, Homo sapiens
agacugauccucucugugu

SEQ ID NO: 1300387 - RNA, 19 nt, Homo sapiens
gagaagaccaagucgaaag

SEQ ID NO: 1300388 - RNA, 19 nt, Homo sapiens
cuacgaggauggugacagu

SEQ ID NO: 1300389 - RNA, 19 nt, Homo sapiens
guggaaaggucuauaugac

SEQ ID NO: 1300390 - RNA, 19 nt, Homo sapiens
ggaagccagcccagcguuu

SEQ ID NO: 1300391 - RNA, 19 nt, Homo sapiens
ggagaagaccaagucgaaa

SEQ ID NO: 1300392 - RNA, 19 nt, Homo sapiens
cacagaaggcgguugguuu

SEQ ID NO: 1300393 - RNA, 19 nt, Homo sapiens
gaagguacgagcagucuac

SEQ ID NO: 1300394 - RNA, 19 nt, Homo sapiens
uccggaagaucuacuguga

SEQ ID NO: 1300395 - RNA, 19 nt, Homo sapiens
guaguuaaaggguccaguu

SEQ ID NO: 1300396 - RNA, 19 nt, Homo sapiens
ugacucccauuuccuaaag

SEQ ID NO: 1300397 - RNA, 19 nt, Homo sapiens
gagcugcuuucuguguuug

SEQ ID NO: 1300398 - RNA, 19 nt, Homo sapiens
ugagcugcuuucuguguuu

SEQ ID NO: 1300399 - RNA, 19 nt, Homo sapiens
aaagaggccacaaagaaga

SEQ ID NO: 1300400 - RNA, 19 nt, Homo sapiens
gauaccugaugaucugugu

SEQ ID NO: 1300401 - RNA, 19 nt, Homo sapiens
ucagagaggcgaagugaca

SEQ ID NO: 1300402 - RNA, 19 nt, Homo sapiens
ggagcuguuugguggcuau

SEQ ID NO: 1300403 - RNA, 19 nt, Homo sapiens
gcugccugcucuuccuuaa

SEQ ID NO: 1300404 - RNA, 19 nt, Homo sapiens
ggaaaaccaccgaccaaaa

SEQ ID NO: 1300405 - RNA, 19 nt, Homo sapiens
gacugauccucucugugua

SEQ ID NO: 1300406 - RNA, 19 nt, Homo sapiens
ggugugccaucaacagcaa

SEQ ID NO: 1300407 - RNA, 19 nt, Homo sapiens
gugggaggaugugaugaaa

SEQ ID NO: 1300408 - RNA, 19 nt, Homo sapiens
ggaccauccaugccaaguu

SEQ ID NO: 1300409 - RNA, 19 nt, Homo sapiens
caacagcaagauccuagug

SEQ ID NO: 1300410 - RNA, 19 nt, Homo sapiens
ggacccgccuguugcuucu

SEQ ID NO: 1300411 - RNA, 19 nt, Homo sapiens
cagauggcuuggacugguu

SEQ ID NO: 1300412 - RNA, 19 nt, Homo sapiens
cuggauggauaccugauga

SEQ ID NO: 1300413 - RNA, 19 nt, Homo sapiens
gguacgagcagucuacaca

SEQ ID NO: 1300414 - RNA, 19 nt, Homo sapiens
ugaaggaucacaguuacaa

SEQ ID NO: 1300415 - RNA, 19 nt, Homo sapiens
ccaagcagaaugccucuca

SEQ ID NO: 1300416 - RNA, 19 nt, Homo sapiens
acagaaggcgguugguuug

SEQ ID NO: 1300417 - RNA, 19 nt, Homo sapiens
cacagaacccucaagacaa

SEQ ID NO: 1300418 - RNA, 19 nt, Homo sapiens
gggcuuguauguucuuuug

SEQ ID NO: 1300419 - RNA, 19 nt, Homo sapiens
gaagccagcccagcguuuc

SEQ ID NO: 1300420 - RNA, 19 nt, Homo sapiens
uggagaagaccaagucgaa

SEQ ID NO: 1300421 - RNA, 19 nt, Homo sapiens
ugacagugacgacgacuuc

SEQ ID NO: 1300422 - RNA, 19 nt, Homo sapiens
ggaguuauaacagcagugu

SEQ ID NO: 1300423 - RNA, 19 nt, Homo sapiens
aagaagcagugaccaggau

SEQ ID NO: 1300424 - RNA, 19 nt, Homo sapiens
ggaagggcuaccucaugaa

SEQ ID NO: 1300425 - RNA, 19 nt, Homo sapiens
gcuguuugguggcuaugau

SEQ ID NO: 1300426 - RNA, 19 nt, Homo sapiens
acaucuagcugccauugca

SEQ ID NO: 1300427 - RNA, 19 nt, Homo sapiens
gcccagcguuucucuacca

SEQ ID NO: 1300428 - RNA, 19 nt, Homo sapiens
uacgagcagucuacacaga

SEQ ID NO: 1300429 - RNA, 19 nt, Homo sapiens
ggacuccucgcuccuugga

SEQ ID NO: 1300430 - RNA, 19 nt, Homo sapiens
uaugaaggcuuugaaaaug

SEQ ID NO: 1300431 - RNA, 19 nt, Homo sapiens
ccugaaggaucacaguuac

SEQ ID NO: 1300432 - RNA, 19 nt, Homo sapiens
gacugacucccauuuccua

SEQ ID NO: 1300433 - RNA, 19 nt, Homo sapiens
ccucucagccucauguguu

SEQ ID NO: 1300434 - RNA, 19 nt, Homo sapiens
ccagcugucugugagaugu

SEQ ID NO: 1300435 - RNA, 19 nt, Homo sapiens
ggaagaaaaggaaaagaau

SEQ ID NO: 1300436 - RNA, 19 nt, Homo sapiens
ccaucgagacucuuuaaca

SEQ ID NO: 1300437 - RNA, 19 nt, Homo sapiens
ucaagaugguggagagcau

SEQ ID NO: 1300438 - RNA, 19 nt, Homo sapiens
gcagaugggacaccaacag

SEQ ID NO: 1300439 - RNA, 19 nt, Homo sapiens
caauggaggaagaggaaga

SEQ ID NO: 1300440 - RNA, 19 nt, Homo sapiens
ggaggaagaggaagaugac

SEQ ID NO: 1300441 - RNA, 19 nt, Homo sapiens
ugaaggaagagcaucuaga

SEQ ID NO: 1300442 - RNA, 19 nt, Homo sapiens
gccaaagaggccacaaaga

SEQ ID NO: 1300443 - RNA, 19 nt, Homo sapiens
gagacucuuuaacauggau

SEQ ID NO: 1300444 - RNA, 19 nt, Homo sapiens
ggagaacuacuuggagaag

SEQ ID NO: 1300445 - RNA, 19 nt, Homo sapiens
gccuacggcuccucuacga

SEQ ID NO: 1300446 - RNA, 19 nt, Homo sapiens
ucugugagaugugugguau

SEQ ID NO: 1300447 - RNA, 19 nt, Homo sapiens
ggauuuaccuguagaguuu

SEQ ID NO: 1300448 - RNA, 19 nt, Homo sapiens
ggaaagauauagcauagug

SEQ ID NO: 1300449 - RNA, 19 nt, Homo sapiens
gaaacucugucucuacaaa

SEQ ID NO: 1300450 - RNA, 19 nt, Homo sapiens
gagagaagguugcagagaa

SEQ ID NO: 1300451 - RNA, 19 nt, Homo sapiens
uaauaaaccucaaguagug

SEQ ID NO: 1300452 - RNA, 19 nt, Homo sapiens
gaggagcgguucaagauga

SEQ ID NO: 1300453 - RNA, 19 nt, Homo sapiens
caacaccacugcuaccauu

SEQ ID NO: 1300454 - RNA, 19 nt, Homo sapiens
uaagaggguuauagcaaua

SEQ ID NO: 1300455 - RNA, 19 nt, Homo sapiens
gaugguggcuuuacuguca

SEQ ID NO: 1300456 - RNA, 19 nt, Homo sapiens
guaauggacuucagaaucu

SEQ ID NO: 1300457 - RNA, 19 nt, Homo sapiens
aggcaaagaugaaaguaua

SEQ ID NO: 1300458 - RNA, 19 nt, Homo sapiens
caacuauucuuggcuauau

SEQ ID NO: 1300459 - RNA, 19 nt, Homo sapiens
ggagguaucucagcguuug

SEQ ID NO: 1300460 - RNA, 19 nt, Homo sapiens
gcagagaacacaucuuaga

SEQ ID NO: 1300461 - RNA, 19 nt, Homo sapiens
gaacaagcaacaaagagaa

SEQ ID NO: 1300462 - RNA, 19 nt, Homo sapiens
caaauaugcaguacaauug

SEQ ID NO: 1300463 - RNA, 19 nt, Homo sapiens
gagaagccauaucccauug

SEQ ID NO: 1300464 - RNA, 19 nt, Homo sapiens
gagauuaaguucaaaugca

SEQ ID NO: 1300465 - RNA, 19 nt, Homo sapiens
gcugguacguucagaugua

SEQ ID NO: 1300466 - RNA, 19 nt, Homo sapiens
ccaagcagcuggaacaaca

SEQ ID NO: 1300467 - RNA, 19 nt, Homo sapiens
aaagagaaacuccagauuu

SEQ ID NO: 1300468 - RNA, 19 nt, Homo sapiens
acacauaucucagguacuu

SEQ ID NO: 1300469 - RNA, 19 nt, Homo sapiens
caaguggacccuacaauga

SEQ ID NO: 1300470 - RNA, 19 nt, Homo sapiens
gcacaagaauugccugaac

SEQ ID NO: 1300471 - RNA, 19 nt, Homo sapiens
gcucaaagguacugacaca

SEQ ID NO: 1300472 - RNA, 19 nt, Homo sapiens
ggauucuucuggauaauga

SEQ ID NO: 1300473 - RNA, 19 nt, Homo sapiens
gcaguacaauugguugaaa

SEQ ID NO: 1300474 - RNA, 19 nt, Homo sapiens
ccacuacacucuguugauu

SEQ ID NO: 1300475 - RNA, 19 nt, Homo sapiens
gagcugggaucgcgccauu

SEQ ID NO: 1300476 - RNA, 19 nt, Homo sapiens
ucauucagguuccagguua

SEQ ID NO: 1300477 - RNA, 19 nt, Homo sapiens
gaacuaggcaaagaugaaa

SEQ ID NO: 1300478 - RNA, 19 nt, Homo sapiens
ccaccgguauagaccauua

SEQ ID NO: 1300479 - RNA, 19 nt, Homo sapiens
caacccaguguuccuauua

SEQ ID NO: 1300480 - RNA, 19 nt, Homo sapiens
aauaugcucugacuagaaa

SEQ ID NO: 1300481 - RNA, 19 nt, Homo sapiens
caagcaagaugaugauaag

SEQ ID NO: 1300482 - RNA, 19 nt, Homo sapiens
gaagaucaguggccaagac

SEQ ID NO: 1300483 - RNA, 19 nt, Homo sapiens
acaauugguugaaauguug

SEQ ID NO: 1300484 - RNA, 19 nt, Homo sapiens
ggaagcagcccucagaaca

SEQ ID NO: 1300485 - RNA, 19 nt, Homo sapiens
caacguacgacaggauuua

SEQ ID NO: 1300486 - RNA, 19 nt, Homo sapiens
ggaccgacuugaggaguuu

SEQ ID NO: 1300487 - RNA, 19 nt, Homo sapiens
gcgaaacucugucucuaca

SEQ ID NO: 1300488 - RNA, 19 nt, Homo sapiens
caauucaggcuauguauga

SEQ ID NO: 1300489 - RNA, 19 nt, Homo sapiens
gagcgggacugaagcaagu

SEQ ID NO: 1300490 - RNA, 19 nt, Homo sapiens
ccaauccuaugcuuuguug

SEQ ID NO: 1300491 - RNA, 19 nt, Homo sapiens
ucaaagagauaaagagacu

SEQ ID NO: 1300492 - RNA, 19 nt, Homo sapiens
guaauaaaccucaaguagu

SEQ ID NO: 1300493 - RNA, 19 nt, Homo sapiens
gaacuuaugguagaacuuc

SEQ ID NO: 1300494 - RNA, 19 nt, Homo sapiens
gaauaugcucugacuagaa

SEQ ID NO: 1300495 - RNA, 19 nt, Homo sapiens
gaagaugaagaugaagaua

SEQ ID NO: 1300496 - RNA, 19 nt, Homo sapiens
uaucucagguacuuuagaa

SEQ ID NO: 1300497 - RNA, 19 nt, Homo sapiens
ggacacaggcgcaccuaug

SEQ ID NO: 1300498 - RNA, 19 nt, Homo sapiens
uaaagucugugucaaagag

SEQ ID NO: 1300499 - RNA, 19 nt, Homo sapiens
agaugaagaugaagaugaa

SEQ ID NO: 1300500 - RNA, 19 nt, Homo sapiens
ccaugaaauccaaguaaua

SEQ ID NO: 1300501 - RNA, 19 nt, Homo sapiens
agauagagauugcccauag

SEQ ID NO: 1300502 - RNA, 19 nt, Homo sapiens
gcagcaacgcaaagaagua

SEQ ID NO: 1300503 - RNA, 19 nt, Homo sapiens
gcaauagguuuggcuugga

SEQ ID NO: 1300504 - RNA, 19 nt, Homo sapiens
aaccauaacuucacagauc

SEQ ID NO: 1300505 - RNA, 19 nt, Homo sapiens
uagaugagguugacaaacu

SEQ ID NO: 1300506 - RNA, 19 nt, Homo sapiens
gaagaugaagauaaugaug

SEQ ID NO: 1300507 - RNA, 19 nt, Homo sapiens
gcucacaccuguaauucca

SEQ ID NO: 1300508 - RNA, 19 nt, Homo sapiens
gcuaguguuuaguauagaa

SEQ ID NO: 1300509 - RNA, 19 nt, Homo sapiens
gaacaaaaccauaacuuca

SEQ ID NO: 1300510 - RNA, 19 nt, Homo sapiens
ccauaaagucugugucaaa

SEQ ID NO: 1300511 - RNA, 19 nt, Homo sapiens
guugaaauguuggauaugu

SEQ ID NO: 1300512 - RNA, 19 nt, Homo sapiens
cugauuccgucuccuauuu

SEQ ID NO: 1300513 - RNA, 19 nt, Homo sapiens
agccaugacuggagaaauu

SEQ ID NO: 1300514 - RNA, 19 nt, Homo sapiens
uugcagagaacacaucuua

SEQ ID NO: 1300515 - RNA, 19 nt, Homo sapiens
gcauaaggaagccaaguug

SEQ ID NO: 1300516 - RNA, 19 nt, Homo sapiens
ucaauuauccgaacaagca

SEQ ID NO: 1300517 - RNA, 19 nt, Homo sapiens
ggagcuaggagaacuauca

SEQ ID NO: 1300518 - RNA, 19 nt, Homo sapiens
gccagcaugucaucaguga

SEQ ID NO: 1300519 - RNA, 19 nt, Homo sapiens
gagggccaguuaacucuga

SEQ ID NO: 1300520 - RNA, 19 nt, Homo sapiens
ccaagcaagaugaugauaa

SEQ ID NO: 1300521 - RNA, 19 nt, Homo sapiens
caaagagaaacuccagauu

SEQ ID NO: 1300522 - RNA, 19 nt, Homo sapiens
cagagcaguuuuacaaaua

SEQ ID NO: 1300523 - RNA, 19 nt, Homo sapiens
gacaucaucaccagguaua

SEQ ID NO: 1300524 - RNA, 19 nt, Homo sapiens
cauaaagucugugucaaag

SEQ ID NO: 1300525 - RNA, 19 nt, Homo sapiens
cuuaguggauuuaccugua

SEQ ID NO: 1300526 - RNA, 19 nt, Homo sapiens
caacaguaauaaaccucaa

SEQ ID NO: 1300527 - RNA, 19 nt, Homo sapiens
gcacacagagcgggacuga

SEQ ID NO: 1300528 - RNA, 19 nt, Homo sapiens
ccacaggauugcacuugga

SEQ ID NO: 1300529 - RNA, 19 nt, Homo sapiens
cccaagaguucaagacaau

SEQ ID NO: 1300530 - RNA, 19 nt, Homo sapiens
gcccaagaguucaagacaa

SEQ ID NO: 1300531 - RNA, 19 nt, Homo sapiens
caaguaguggcuaguguuu

SEQ ID NO: 1300532 - RNA, 19 nt, Homo sapiens
guuaugaagugcucaaagg

SEQ ID NO: 1300533 - RNA, 19 nt, Homo sapiens
gauugcacuuggaggagua

SEQ ID NO: 1300534 - RNA, 19 nt, Homo sapiens
aagagaaacuccagauuuu

SEQ ID NO: 1300535 - RNA, 19 nt, Homo sapiens
ucaccgagcccaagaguuc

SEQ ID NO: 1300536 - RNA, 19 nt, Homo sapiens
ccuaugccguuuccagauu

SEQ ID NO: 1300537 - RNA, 19 nt, Homo sapiens
ucacuuaagcucaggaguu

SEQ ID NO: 1300538 - RNA, 19 nt, Homo sapiens
guucaaaugcaauguauag

SEQ ID NO: 1300539 - RNA, 19 nt, Homo sapiens
uggaugagguucuuaaugc

SEQ ID NO: 1300540 - RNA, 19 nt, Homo sapiens
uaccagacaucuugacauc

SEQ ID NO: 1300541 - RNA, 19 nt, Homo sapiens
uacugucccuggaaagaua

SEQ ID NO: 1300542 - RNA, 19 nt, Homo sapiens
cauuccagcugccuuguug

SEQ ID NO: 1300543 - RNA, 19 nt, Homo sapiens
acauaucucagguacuuua

SEQ ID NO: 1300544 - RNA, 19 nt, Homo sapiens
cgaacaagcaacaaagaga

SEQ ID NO: 1300545 - RNA, 19 nt, Homo sapiens
ggacucaauucaggcuaug

SEQ ID NO: 1300546 - RNA, 19 nt, Homo sapiens
ggaugagguucuuaaugca

SEQ ID NO: 1300547 - RNA, 19 nt, Homo sapiens
acacaccacuuccuuauua

SEQ ID NO: 1300548 - RNA, 19 nt, Homo sapiens
gaagauugccuccaucauu

SEQ ID NO: 1300549 - RNA, 19 nt, Homo sapiens
gaacacaccacuuccuuau

SEQ ID NO: 1300550 - RNA, 19 nt, Homo sapiens
caaaggaauucauugacaa

SEQ ID NO: 1300551 - RNA, 19 nt, Homo sapiens
caucaugccuaaggaauuu

SEQ ID NO: 1300552 - RNA, 19 nt, Homo sapiens
ugaaggcucucauugcaaa

SEQ ID NO: 1300553 - RNA, 19 nt, Homo sapiens
aagauugccuccaucauuu

SEQ ID NO: 1300554 - RNA, 19 nt, Homo sapiens
ugaagucucucucuuaaag

SEQ ID NO: 1300555 - RNA, 19 nt, Homo sapiens
cuaaggaauuugaagauug

SEQ ID NO: 1300556 - RNA, 19 nt, Homo sapiens
ccaaaggaauucauugaca

SEQ ID NO: 1300557 - RNA, 19 nt, Homo sapiens
gcaaaccucauccuuagaa

SEQ ID NO: 1300558 - RNA, 19 nt, Homo sapiens
caaacucccuuccuuccaa

SEQ ID NO: 1300559 - RNA, 19 nt, Homo sapiens
guauuugcauucuaccuuu

SEQ ID NO: 1300560 - RNA, 19 nt, Homo sapiens
aagcaaaccucauccuuag

SEQ ID NO: 1300561 - RNA, 19 nt, Homo sapiens
caaauuguccuccaacauc

SEQ ID NO: 1300562 - RNA, 19 nt, Homo sapiens
cuaaaucucugcugugaac

SEQ ID NO: 1300563 - RNA, 19 nt, Homo sapiens
agugaagucucucucuuaa

SEQ ID NO: 1300564 - RNA, 19 nt, Homo sapiens
gaaguccagugaagucucu

SEQ ID NO: 1300565 - RNA, 19 nt, Homo sapiens
ggacuguucaagagaauug

SEQ ID NO: 1300566 - RNA, 19 nt, Homo sapiens
ccuaaggaauuugaagauu

SEQ ID NO: 1300567 - RNA, 19 nt, Homo sapiens
cuuauuacguccuuuccua

SEQ ID NO: 1300568 - RNA, 19 nt, Homo sapiens
cagugaagucucucucuua

SEQ ID NO: 1300569 - RNA, 19 nt, Homo sapiens
caaaccucauccuuagaaa

SEQ ID NO: 1300570 - RNA, 19 nt, Homo sapiens
ccagugaagucucucucuu

SEQ ID NO: 1300571 - RNA, 19 nt, Homo sapiens
gagaaccuccacccucuga

SEQ ID NO: 1300572 - RNA, 19 nt, Homo sapiens
uaaggaauuugaagauugc

SEQ ID NO: 1300573 - RNA, 19 nt, Homo sapiens
cagaccaccugcuguagga

SEQ ID NO: 1300574 - RNA, 19 nt, Homo sapiens
ugaacacaccacuuccuua

SEQ ID NO: 1300575 - RNA, 19 nt, Homo sapiens
ucaggacauuuauucauca

SEQ ID NO: 1300576 - RNA, 19 nt, Homo sapiens
gcuguggccuggagaacug

SEQ ID NO: 1300577 - RNA, 19 nt, Homo sapiens
gaaccuccacccucugaca

SEQ ID NO: 1300578 - RNA, 19 nt, Homo sapiens
aaacucccuuccuuccaaa

SEQ ID NO: 1300579 - RNA, 19 nt, Homo sapiens
aaccucauccuuagaaauu

SEQ ID NO: 1300580 - RNA, 19 nt, Homo sapiens
uguccaaacucccuuccuu

SEQ ID NO: 1300581 - RNA, 19 nt, Homo sapiens
ugucagaccaccugcugua

SEQ ID NO: 1300582 - RNA, 19 nt, Homo sapiens
uuacguccuuuccuacaga

SEQ ID NO: 1300583 - RNA, 19 nt, Homo sapiens
uaaagccuccaaccuugaa

SEQ ID NO: 1300584 - RNA, 19 nt, Homo sapiens
ucuauucuauuggcacuga

SEQ ID NO: 1300585 - RNA, 19 nt, Homo sapiens
caaccuugaaguccaguga

SEQ ID NO: 1300586 - RNA, 19 nt, Homo sapiens
guagggccacagaucuuaa

SEQ ID NO: 1300587 - RNA, 19 nt, Homo sapiens
ccucccaccucuuugacuu

SEQ ID NO: 1300588 - RNA, 19 nt, Homo sapiens
ugcuaaaucucugcuguga

SEQ ID NO: 1300589 - RNA, 19 nt, Homo sapiens
ucuuaaagccuccaaccuu

SEQ ID NO: 1300590 - RNA, 19 nt, Homo sapiens
caacauccucccaccucuu

SEQ ID NO: 1300591 - RNA, 19 nt, Homo sapiens
gcggacuguucaagagaau

SEQ ID NO: 1300592 - RNA, 19 nt, Homo sapiens
ccuggaaacccaccgagaa

SEQ ID NO: 1300593 - RNA, 19 nt, Homo sapiens
ugccuccucuugcugcuaa

SEQ ID NO: 1300594 - RNA, 19 nt, Homo sapiens
guaccaaaauaaaccucua

SEQ ID NO: 1300595 - RNA, 19 nt, Homo sapiens
gacuucaggacauuuauuc

SEQ ID NO: 1300596 - RNA, 19 nt, Homo sapiens
ugacuucaggacauuuauu

SEQ ID NO: 1300597 - RNA, 19 nt, Homo sapiens
caugcggacuguucaagag

SEQ ID NO: 1300598 - RNA, 19 nt, Homo sapiens
uguagggccacagaucuua

SEQ ID NO: 1300599 - RNA, 19 nt, Homo sapiens
guccuuuccuacagaugaa

SEQ ID NO: 1300600 - RNA, 19 nt, Homo sapiens
gugaacacaccacuuccuu

SEQ ID NO: 1300601 - RNA, 19 nt, Homo sapiens
guuauuuccauguaccaaa

SEQ ID NO: 1300602 - RNA, 19 nt, Homo sapiens
gaagucucucucuuaaagu

SEQ ID NO: 1300603 - RNA, 19 nt, Homo sapiens
cauccucccaccucuuuga

SEQ ID NO: 1300604 - RNA, 19 nt, Homo sapiens
gugaagucucucucuuaaa

SEQ ID NO: 1300605 - RNA, 19 nt, Homo sapiens
uuaaagccuccaaccuuga

SEQ ID NO: 1300606 - RNA, 19 nt, Homo sapiens
ucaucaugccuaaggaauu

SEQ ID NO: 1300607 - RNA, 19 nt, Homo sapiens
uucaggacauuuauucauc

SEQ ID NO: 1300608 - RNA, 19 nt, Homo sapiens
uugcaaacaugcggacugu

SEQ ID NO: 1300609 - RNA, 19 nt, Homo sapiens
gaacuaagcuuugggcauu

SEQ ID NO: 1300610 - RNA, 19 nt, Homo sapiens
ggucuggcgucccaaauga

SEQ ID NO: 1300611 - RNA, 19 nt, Homo sapiens
gcgagcaggucuucaggaa

SEQ ID NO: 1300612 - RNA, 19 nt, Homo sapiens
ggagcuggcuggaaucucu

SEQ ID NO: 1300613 - RNA, 19 nt, Homo sapiens
caaccucacuggcuacuac

SEQ ID NO: 1300614 - RNA, 19 nt, Homo sapiens
gcucacagacgcucuuguu

SEQ ID NO: 1300615 - RNA, 19 nt, Homo sapiens
caaccaaucuccgcucucu

SEQ ID NO: 1300616 - RNA, 19 nt, Homo sapiens
gcucucuccuguccauuug

SEQ ID NO: 1300617 - RNA, 19 nt, Homo sapiens
acacuccacugcccaauag

SEQ ID NO: 1300618 - RNA, 19 nt, Homo sapiens
gccaagaucccuccagaca

SEQ ID NO: 1300619 - RNA, 19 nt, Homo sapiens
ucacagacgcucuuguugu

SEQ ID NO: 1300620 - RNA, 19 nt, Homo sapiens
gcauuuggcgauuagugaa

SEQ ID NO: 1300621 - RNA, 19 nt, Homo sapiens
gaaaaugccagaccauagu

SEQ ID NO: 1300622 - RNA, 19 nt, Homo sapiens
aaugaaagaagcaggcaaa

SEQ ID NO: 1300623 - RNA, 19 nt, Homo sapiens
ggagggagagaugcuguau

SEQ ID NO: 1300624 - RNA, 19 nt, Homo sapiens
cacccugucuccugcauuc

SEQ ID NO: 1300625 - RNA, 19 nt, Homo sapiens
aaaccuucauccacacaau

SEQ ID NO: 1300626 - RNA, 19 nt, Homo sapiens
gcucagcaccuuccgaaac

SEQ ID NO: 1300627 - RNA, 19 nt, Homo sapiens
ccugauggacuucuggaaa

SEQ ID NO: 1300628 - RNA, 19 nt, Homo sapiens
ggcauuuggcgauuaguga

SEQ ID NO: 1300629 - RNA, 19 nt, Homo sapiens
gacagcaccagcucacaga

SEQ ID NO: 1300630 - RNA, 19 nt, Homo sapiens
ugacugggguucaagaguu

SEQ ID NO: 1300631 - RNA, 19 nt, Homo sapiens
caccagggcaaccacauga

SEQ ID NO: 1300632 - RNA, 19 nt, Homo sapiens
gaaaccuucauccacacaa

SEQ ID NO: 1300633 - RNA, 19 nt, Homo sapiens
ggaaggagccccugagaac

SEQ ID NO: 1300634 - RNA, 19 nt, Homo sapiens
cugcaagcccuaaacauca

SEQ ID NO: 1300635 - RNA, 19 nt, Homo sapiens
ugaaaauucuauccugaug

SEQ ID NO: 1300636 - RNA, 19 nt, Homo sapiens
aaaauucuauccugaugga

SEQ ID NO: 1300637 - RNA, 19 nt, Homo sapiens
cauuugaccucuucuuuuc

SEQ ID NO: 1300638 - RNA, 19 nt, Homo sapiens
caaggucuggcgucccaaa

SEQ ID NO: 1300639 - RNA, 19 nt, Homo sapiens
ggacaaggagaucgaacac

SEQ ID NO: 1300640 - RNA, 19 nt, Homo sapiens
agaucgcgcugcugcugaa

SEQ ID NO: 1300641 - RNA, 19 nt, Homo sapiens
gaugcuguaucuggaacug

SEQ ID NO: 1300642 - RNA, 19 nt, Homo sapiens
gagcguggacggacgaaaa

SEQ ID NO: 1300643 - RNA, 19 nt, Homo sapiens
cacacuccacugcccaaua

SEQ ID NO: 1300644 - RNA, 19 nt, Homo sapiens
ccugcaagcccuaaacauc

SEQ ID NO: 1300645 - RNA, 19 nt, Homo sapiens
ccuggugugugugcagaaa

SEQ ID NO: 1300646 - RNA, 19 nt, Homo sapiens
gaaagauuaugccuucgua

SEQ ID NO: 1300647 - RNA, 19 nt, Homo sapiens
ggaaggugcuggaauguga

SEQ ID NO: 1300648 - RNA, 19 nt, Homo sapiens
gagccaaguuugaggagua

SEQ ID NO: 1300649 - RNA, 19 nt, Homo sapiens
ggaauucucuguaugacau

SEQ ID NO: 1300650 - RNA, 19 nt, Homo sapiens
gaagggcacugguccaaag

SEQ ID NO: 1300651 - RNA, 19 nt, Homo sapiens
ucuggacucuuaacacuua

SEQ ID NO: 1300652 - RNA, 19 nt, Homo sapiens
ggagagggcuacgguuaug

SEQ ID NO: 1300653 - RNA, 19 nt, Homo sapiens
uguuagcucuggacucuua

SEQ ID NO: 1300654 - RNA, 19 nt, Homo sapiens
uacgcaaccugcaccauua

SEQ ID NO: 1300655 - RNA, 19 nt, Homo sapiens
gguaugaacgggagcagua

SEQ ID NO: 1300656 - RNA, 19 nt, Homo sapiens
uuacaacgaugcauaugga

SEQ ID NO: 1300657 - RNA, 19 nt, Homo sapiens
ugaacaauauggagcaguu

SEQ ID NO: 1300658 - RNA, 19 nt, Homo sapiens
gauaccggguccgcucuua

SEQ ID NO: 1300659 - RNA, 19 nt, Homo sapiens
cagcaucuccuuucccuuu

SEQ ID NO: 1300660 - RNA, 19 nt, Homo sapiens
gaagccagcaagaauaaga

SEQ ID NO: 1300661 - RNA, 19 nt, Homo sapiens
gaaauugcuaggaccauug

SEQ ID NO: 1300662 - RNA, 19 nt, Homo sapiens
cauuaagaauuacggcuuu

SEQ ID NO: 1300663 - RNA, 19 nt, Homo sapiens
gagcagcccuagguaagga

SEQ ID NO: 1300664 - RNA, 19 nt, Homo sapiens
gaccaacuauguuuucuuu

SEQ ID NO: 1300665 - RNA, 19 nt, Homo sapiens
gcaucuccuuucccuuuaa

SEQ ID NO: 1300666 - RNA, 19 nt, Homo sapiens
gugacaucgugaaagauua

SEQ ID NO: 1300667 - RNA, 19 nt, Homo sapiens
gcaaagcuucaaccaaguu

SEQ ID NO: 1300668 - RNA, 19 nt, Homo sapiens
gcugaaauuuacccuuguu

SEQ ID NO: 1300669 - RNA, 19 nt, Homo sapiens
gagcaguucgaacaccuua

SEQ ID NO: 1300670 - RNA, 19 nt, Homo sapiens
acagacaccuauugccaaa

SEQ ID NO: 1300671 - RNA, 19 nt, Homo sapiens
ugaaauugcuaggaccauu

SEQ ID NO: 1300672 - RNA, 19 nt, Homo sapiens
uuacuccacuccucccuuu

SEQ ID NO: 1300673 - RNA, 19 nt, Homo sapiens
acuagucucuguagccuuu

SEQ ID NO: 1300674 - RNA, 19 nt, Homo sapiens
gcucuggacucuuaacacu

SEQ ID NO: 1300675 - RNA, 19 nt, Homo sapiens
gcacucgacuacuauaagc

SEQ ID NO: 1300676 - RNA, 19 nt, Homo sapiens
caaagcuucaaccaaguua

SEQ ID NO: 1300677 - RNA, 19 nt, Homo sapiens
agcauuagcugaaauuuac

SEQ ID NO: 1300678 - RNA, 19 nt, Homo sapiens
acacuuaaguuacucuucu

SEQ ID NO: 1300679 - RNA, 19 nt, Homo sapiens
ccucaacucuacuucuguu

SEQ ID NO: 1300680 - RNA, 19 nt, Homo sapiens
gauuaugccuucguacaca

SEQ ID NO: 1300681 - RNA, 19 nt, Homo sapiens
gagcacucgacuacuauaa

SEQ ID NO: 1300682 - RNA, 19 nt, Homo sapiens
guggaagccagcaagaaua

SEQ ID NO: 1300683 - RNA, 19 nt, Homo sapiens
ucacucuguuccuuauauu

SEQ ID NO: 1300684 - RNA, 19 nt, Homo sapiens
caaagagugcccaguagau

SEQ ID NO: 1300685 - RNA, 19 nt, Homo sapiens
acacggaauucucuguaug

SEQ ID NO: 1300686 - RNA, 19 nt, Homo sapiens
gccagagagugaauuaucu

SEQ ID NO: 1300687 - RNA, 19 nt, Homo sapiens
guccaaagagugcccagua

SEQ ID NO: 1300688 - RNA, 19 nt, Homo sapiens
gagcuucgagccaaguuug

SEQ ID NO: 1300689 - RNA, 19 nt, Homo sapiens
caucuccuuucccuuuaaa

SEQ ID NO: 1300690 - RNA, 19 nt, Homo sapiens
guuaugggccagagaguga

SEQ ID NO: 1300691 - RNA, 19 nt, Homo sapiens
ccaaagagugcccaguaga

SEQ ID NO: 1300692 - RNA, 19 nt, Homo sapiens
gaauaagagcaaagcuuca

SEQ ID NO: 1300693 - RNA, 19 nt, Homo sapiens
ggagauucgcucacucuuc

SEQ ID NO: 1300694 - RNA, 19 nt, Homo sapiens
uaggauaauugcggacuga

SEQ ID NO: 1300695 - RNA, 19 nt, Homo sapiens
ggagcacucgacuacuaua

SEQ ID NO: 1300696 - RNA, 19 nt, Homo sapiens
cagcaagaauaagagcaaa

SEQ ID NO: 1300697 - RNA, 19 nt, Homo sapiens
ugaucgugguacagcauua

SEQ ID NO: 1300698 - RNA, 19 nt, Homo sapiens
ggccagagagugaauuauc

SEQ ID NO: 1300699 - RNA, 19 nt, Homo sapiens
auggagcacucgacuacua

SEQ ID NO: 1300700 - RNA, 19 nt, Homo sapiens
guauuacaacgaugcauau

SEQ ID NO: 1300701 - RNA, 19 nt, Homo sapiens
gcaguucgaacaccuuaca

SEQ ID NO: 1300702 - RNA, 19 nt, Homo sapiens
uuacggcuuugugcacaua

SEQ ID NO: 1300703 - RNA, 19 nt, Homo sapiens
uggaagccagcaagaauaa

SEQ ID NO: 1300704 - RNA, 19 nt, Homo sapiens
uaucuugcuuucccuagga

SEQ ID NO: 1300705 - RNA, 19 nt, Homo sapiens
cuacagagcaggagauucg

SEQ ID NO: 1300706 - RNA, 19 nt, Homo sapiens
caccucaacucuacuucug

SEQ ID NO: 1300707 - RNA, 19 nt, Homo sapiens
ccagccaccucaacucuac

SEQ ID NO: 1300708 - RNA, 19 nt, Homo sapiens
ggaguaugguccggucauc

SEQ ID NO: 1300709 - RNA, 19 nt, Homo sapiens
cggaggcucuugucaggau

SEQ ID NO: 1300710 - RNA, 19 nt, Homo sapiens
gggcacugguccaaagagu

SEQ ID NO: 1300711 - RNA, 19 nt, Homo sapiens
gcaaccugcaccauuacaa

SEQ ID NO: 1300712 - RNA, 19 nt, Homo sapiens
aaaaggaguuugugaccaa

SEQ ID NO: 1300713 - RNA, 19 nt, Homo sapiens
ucaggauggugaagcuguu

SEQ ID NO: 1300714 - RNA, 19 nt, Homo sapiens
agacaccuauugccaaacu

SEQ ID NO: 1300715 - RNA, 19 nt, Homo sapiens
cacagaguuucaaggcaaa

SEQ ID NO: 1300716 - RNA, 19 nt, Homo sapiens
ugacaucgugaaagauuau

SEQ ID NO: 1300717 - RNA, 19 nt, Homo sapiens
gaccugugaucgugguaca

SEQ ID NO: 1300718 - RNA, 19 nt, Homo sapiens
gcaagcagccuuuuacucu

SEQ ID NO: 1300719 - RNA, 19 nt, Homo sapiens
ccaucugccucaaguccaa

SEQ ID NO: 1300720 - RNA, 19 nt, Homo sapiens
caagacggcagcugaggau

SEQ ID NO: 1300721 - RNA, 19 nt, Homo sapiens
ugagcaguauaaugaacaa

SEQ ID NO: 1300722 - RNA, 19 nt, Homo sapiens
guaguggcaagcagccuuu

SEQ ID NO: 1300723 - RNA, 19 nt, Homo sapiens
ucuguuagcucuggacucu

SEQ ID NO: 1300724 - RNA, 19 nt, Homo sapiens
cacggaauucucuguauga

SEQ ID NO: 1300725 - RNA, 19 nt, Homo sapiens
uuggagagggcuacgguua

SEQ ID NO: 1300726 - RNA, 19 nt, Homo sapiens
agaccagaguggcugcuau

SEQ ID NO: 1300727 - RNA, 19 nt, Homo sapiens
ugugacaucgugaaagauu

SEQ ID NO: 1300728 - RNA, 19 nt, Homo sapiens
ccagcaagaauaagagcaa

SEQ ID NO: 1300729 - RNA, 19 nt, Homo sapiens
caauauggagcaguucgaa

SEQ ID NO: 1300730 - RNA, 19 nt, Homo sapiens
ggucguguggcagacuuua

SEQ ID NO: 1300731 - RNA, 19 nt, Homo sapiens
caaccugcaccauuacaag

SEQ ID NO: 1300732 - RNA, 19 nt, Homo sapiens
aagaauaagagcaaagcuu

SEQ ID NO: 1300733 - RNA, 19 nt, Homo sapiens
uaagaauuacggcuuugug

SEQ ID NO: 1300734 - RNA, 19 nt, Homo sapiens
uuccauugcuucauguuuc

SEQ ID NO: 1300735 - RNA, 19 nt, Homo sapiens
ccaccacuuccuccuacua

SEQ ID NO: 1300736 - RNA, 19 nt, Homo sapiens
cgacuacuauaagcgauac

SEQ ID NO: 1300737 - RNA, 19 nt, Homo sapiens
gcaagaauaagagcaaagc

SEQ ID NO: 1300738 - RNA, 19 nt, Homo sapiens
ugacaacacagaguuucaa

SEQ ID NO: 1300739 - RNA, 19 nt, Homo sapiens
guccggucaucgaauguga

SEQ ID NO: 1300740 - RNA, 19 nt, Homo sapiens
cguggaagccagcaagaau

SEQ ID NO: 1300741 - RNA, 19 nt, Homo sapiens
gccuuuuacucuucuguua

SEQ ID NO: 1300742 - RNA, 19 nt, Homo sapiens
agcaucuccuuucccuuua

SEQ ID NO: 1300743 - RNA, 19 nt, Homo sapiens
auacgcaaccugcaccauu

SEQ ID NO: 1300744 - RNA, 19 nt, Homo sapiens
uccaaagagugcccaguag

SEQ ID NO: 1300745 - RNA, 19 nt, Homo sapiens
augggaaggugcuggaaug

SEQ ID NO: 1300746 - RNA, 19 nt, Homo sapiens
ggacuugggugaaccaguu

SEQ ID NO: 1300747 - RNA, 19 nt, Homo sapiens
ggaccacgcuugagguuug

SEQ ID NO: 1300748 - RNA, 19 nt, Homo sapiens
ucaacaagcuccucaagau

SEQ ID NO: 1300749 - RNA, 19 nt, Homo sapiens
gcaggagccuugccucuca

SEQ ID NO: 1300750 - RNA, 19 nt, Homo sapiens
gaaccaguuuccaacauuc

SEQ ID NO: 1300751 - RNA, 19 nt, Homo sapiens
gcgccuaucuccucaagug

SEQ ID NO: 1300752 - RNA, 19 nt, Homo sapiens
gggcacaccugucaacaag

SEQ ID NO: 1300753 - RNA, 19 nt, Homo sapiens
cggcugacgugcugguaua

SEQ ID NO: 1300754 - RNA, 19 nt, Homo sapiens
ugaaccaguuuccaacauu

SEQ ID NO: 1300755 - RNA, 19 nt, Homo sapiens
cuagaaacaugccuuugug

SEQ ID NO: 1300756 - RNA, 19 nt, Homo sapiens
gccacgagcugccguuuua

SEQ ID NO: 1300757 - RNA, 19 nt, Homo sapiens
gcacaccugucaacaagcu

SEQ ID NO: 1300758 - RNA, 19 nt, Homo sapiens
gcuccaguguggugccuuu

SEQ ID NO: 1300759 - RNA, 19 nt, Homo sapiens
ggaggaggagcccaucuug

SEQ ID NO: 1300760 - RNA, 19 nt, Homo sapiens
aguggcagcuccaguggua

SEQ ID NO: 1300761 - RNA, 19 nt, Homo sapiens
caagcaggccgaacugaug

SEQ ID NO: 1300762 - RNA, 19 nt, Homo sapiens
uccggauggugcucaauua

SEQ ID NO: 1300763 - RNA, 19 nt, Homo sapiens
ugguauaccuagcggauga

SEQ ID NO: 1300764 - RNA, 19 nt, Homo sapiens
gaugggcagugucccuguu

SEQ ID NO: 1300765 - RNA, 19 nt, Homo sapiens
gguagaggaccacgcuuga

SEQ ID NO: 1300766 - RNA, 19 nt, Homo sapiens
acaagcuccucaagaucua

SEQ ID NO: 1300767 - RNA, 19 nt, Homo sapiens
caacauuccuccggauggu

SEQ ID NO: 1300768 - RNA, 19 nt, Homo sapiens
caacaagcuccucaagauc

SEQ ID NO: 1300769 - RNA, 19 nt, Homo sapiens
gcagugucccuguucugaa

SEQ ID NO: 1300770 - RNA, 19 nt, Homo sapiens
ggccauggaugagccuuuc

SEQ ID NO: 1300771 - RNA, 19 nt, Homo sapiens
ccaagcaccagcccuacaa

SEQ ID NO: 1300772 - RNA, 19 nt, Homo sapiens
gugaaccaguuuccaacau

SEQ ID NO: 1300773 - RNA, 19 nt, Homo sapiens
ggugggcgcaagccaguuu

SEQ ID NO: 1300774 - RNA, 19 nt, Homo sapiens
ccuagaaacaugccuuugu

SEQ ID NO: 1300775 - RNA, 19 nt, Homo sapiens
gguugaccgucucgucuuc

SEQ ID NO: 1300776 - RNA, 19 nt, Homo sapiens
gaggaccacgcuugagguu

SEQ ID NO: 1300777 - RNA, 19 nt, Homo sapiens
gagauggacgggacagaag

SEQ ID NO: 1300778 - RNA, 19 nt, Homo sapiens
gaaccugcccucgcucagu

SEQ ID NO: 1300779 - RNA, 19 nt, Homo sapiens
gcgcaccacauccuucuuc

SEQ ID NO: 1300780 - RNA, 19 nt, Homo sapiens
ggaaggcgugcacgucauc

SEQ ID NO: 1300781 - RNA, 19 nt, Homo sapiens
cgagauggacgggacagaa

SEQ ID NO: 1300782 - RNA, 19 nt, Homo sapiens
cagugucccuguucugaag

SEQ ID NO: 1300783 - RNA, 19 nt, Homo sapiens
gaggaggagcccaucuugu

SEQ ID NO: 1300784 - RNA, 19 nt, Homo sapiens
gcgugcacgucaucgauag

SEQ ID NO: 1300785 - RNA, 19 nt, Homo sapiens
ggaccugaagcuccagugu

SEQ ID NO: 1300786 - RNA, 19 nt, Homo sapiens
gagcugcugcugcgcuuca

SEQ ID NO: 1300787 - RNA, 19 nt, Homo sapiens
ggcgugcacgucaucgaua

SEQ ID NO: 1300788 - RNA, 19 nt, Homo sapiens
ggcagugucccuguucuga

SEQ ID NO: 1300789 - RNA, 19 nt, Homo sapiens
ccaagcaggccgaacugau

SEQ ID NO: 1300790 - RNA, 19 nt, Homo sapiens
aggaggagcccaucuugug

SEQ ID NO: 1300791 - RNA, 19 nt, Homo sapiens
gucaacaagcuccucaaga

SEQ ID NO: 1300792 - RNA, 19 nt, Homo sapiens
uccugcggcugcucuauga

SEQ ID NO: 1300793 - RNA, 19 nt, Homo sapiens
aagcaggccgaacugauga

SEQ ID NO: 1300794 - RNA, 19 nt, Homo sapiens
uuaugggugugccuucuuc

SEQ ID NO: 1300795 - RNA, 19 nt, Homo sapiens
gaacacuucuagaaugaua

SEQ ID NO: 1300796 - RNA, 19 nt, Homo sapiens
gaccaagccugaccaauau

SEQ ID NO: 1300797 - RNA, 19 nt, Homo sapiens
gaaacccugucucuacuaa

SEQ ID NO: 1300798 - RNA, 19 nt, Homo sapiens
gcaaaugcuuguuaucuuc

SEQ ID NO: 1300799 - RNA, 19 nt, Homo sapiens
caucauuccuuucccuuua

SEQ ID NO: 1300800 - RNA, 19 nt, Homo sapiens
gugcuuaaguggaaagaua

SEQ ID NO: 1300801 - RNA, 19 nt, Homo sapiens
gagagaauguuuccuagga

SEQ ID NO: 1300802 - RNA, 19 nt, Homo sapiens
gcaaaacucugucucaaaa

SEQ ID NO: 1300803 - RNA, 19 nt, Homo sapiens
ggaggauccuguaauuauu

SEQ ID NO: 1300804 - RNA, 19 nt, Homo sapiens
cuaaauaaccugaguguga

SEQ ID NO: 1300805 - RNA, 19 nt, Homo sapiens
cgaaugugcuuaaguggaa

SEQ ID NO: 1300806 - RNA, 19 nt, Homo sapiens
guaaugcagucuggauaua

SEQ ID NO: 1300807 - RNA, 19 nt, Homo sapiens
ccaaguggauucaucauuc

SEQ ID NO: 1300808 - RNA, 19 nt, Homo sapiens
uaaauaaccugagugugaa

SEQ ID NO: 1300809 - RNA, 19 nt, Homo sapiens
agagaaagcuuuaaaugca

SEQ ID NO: 1300810 - RNA, 19 nt, Homo sapiens
ugagacagcaucaguauuu

SEQ ID NO: 1300811 - RNA, 19 nt, Homo sapiens
ggagauucuucuucgagua

SEQ ID NO: 1300812 - RNA, 19 nt, Homo sapiens
aauaugagcccaaauugua

SEQ ID NO: 1300813 - RNA, 19 nt, Homo sapiens
ucucccagcugcuaaauuu

SEQ ID NO: 1300814 - RNA, 19 nt, Homo sapiens
agaagaaugugcccagaaa

SEQ ID NO: 1300815 - RNA, 19 nt, Homo sapiens
uaacugaugguucauauga

SEQ ID NO: 1300816 - RNA, 19 nt, Homo sapiens
agacuuaacugaugguuca

SEQ ID NO: 1300817 - RNA, 19 nt, Homo sapiens
agaccaagccugaccaaua

SEQ ID NO: 1300818 - RNA, 19 nt, Homo sapiens
guggaaagauaucuaugaa

SEQ ID NO: 1300819 - RNA, 19 nt, Homo sapiens
gggauacgcucuucgaagu

SEQ ID NO: 1300820 - RNA, 19 nt, Homo sapiens
gaggugagauagcgccauu

SEQ ID NO: 1300821 - RNA, 19 nt, Homo sapiens
gaagugauuugcaguuacu

SEQ ID NO: 1300822 - RNA, 19 nt, Homo sapiens
guacuuacgcuauuucaga

SEQ ID NO: 1300823 - RNA, 19 nt, Homo sapiens
ucaguuaaccaagcuauua

SEQ ID NO: 1300824 - RNA, 19 nt, Homo sapiens
ggucacuucuagucaauga

SEQ ID NO: 1300825 - RNA, 19 nt, Homo sapiens
cauuuaagcuacccuucua

SEQ ID NO: 1300826 - RNA, 19 nt, Homo sapiens
gagcccaaauuguauaauc

SEQ ID NO: 1300827 - RNA, 19 nt, Homo sapiens
ccaagugaauauaagaguu

SEQ ID NO: 1300828 - RNA, 19 nt, Homo sapiens
ucuaaaugcugaacaacuu

SEQ ID NO: 1300829 - RNA, 19 nt, Homo sapiens
cagcaucaguauuugacua

SEQ ID NO: 1300830 - RNA, 19 nt, Homo sapiens
aagcuacccuucuaccuuu

SEQ ID NO: 1300831 - RNA, 19 nt, Homo sapiens
gcuauaacuugccgugguu

SEQ ID NO: 1300832 - RNA, 19 nt, Homo sapiens
gcaaaggagauucuucuuc

SEQ ID NO: 1300833 - RNA, 19 nt, Homo sapiens
gcacaugcuucacaguuac

SEQ ID NO: 1300834 - RNA, 19 nt, Homo sapiens
uaaccaagcuauuauucgu

SEQ ID NO: 1300835 - RNA, 19 nt, Homo sapiens
ccugaagacuuaacugaug

SEQ ID NO: 1300836 - RNA, 19 nt, Homo sapiens
caccugagaucgggaguuu

SEQ ID NO: 1300837 - RNA, 19 nt, Homo sapiens
ugaccauacugcuuucaaa

SEQ ID NO: 1300838 - RNA, 19 nt, Homo sapiens
ugaaguggcaguaaccuuu

SEQ ID NO: 1300839 - RNA, 19 nt, Homo sapiens
ccuguuacauggagaagaa

SEQ ID NO: 1300840 - RNA, 19 nt, Homo sapiens
gguuauaggcuuugagcua

SEQ ID NO: 1300841 - RNA, 19 nt, Homo sapiens
ggguaacaaugcagccuuu

SEQ ID NO: 1300842 - RNA, 19 nt, Homo sapiens
gauauacaucagucaagua

SEQ ID NO: 1300843 - RNA, 19 nt, Homo sapiens
acacacuguucuacuguuu

SEQ ID NO: 1300844 - RNA, 19 nt, Homo sapiens
ggaaugccuucuacguaca

SEQ ID NO: 1300845 - RNA, 19 nt, Homo sapiens
ggacucacccacuccauuc

SEQ ID NO: 1300846 - RNA, 19 nt, Homo sapiens
auaaagaacugccucaaaa

SEQ ID NO: 1300847 - RNA, 19 nt, Homo sapiens
gcaggagaauugcuugaac

SEQ ID NO: 1300848 - RNA, 19 nt, Homo sapiens
gcgggcagaucaccugaga

SEQ ID NO: 1300849 - RNA, 19 nt, Homo sapiens
gagacagcaucaguauuug

SEQ ID NO: 1300850 - RNA, 19 nt, Homo sapiens
uaagagcuuuaguugauca

SEQ ID NO: 1300851 - RNA, 19 nt, Homo sapiens
acacuguucuacuguuuga

SEQ ID NO: 1300852 - RNA, 19 nt, Homo sapiens
gcuuugagcuaggccguuu

SEQ ID NO: 1300853 - RNA, 19 nt, Homo sapiens
gugguucucagauuuauuu

SEQ ID NO: 1300854 - RNA, 19 nt, Homo sapiens
gaguaaugcagucuggaua

SEQ ID NO: 1300855 - RNA, 19 nt, Homo sapiens
acaugacuguuaccaauga

SEQ ID NO: 1300856 - RNA, 19 nt, Homo sapiens
cggaggauccuguaauuau

SEQ ID NO: 1300857 - RNA, 19 nt, Homo sapiens
uugaagugauuugcaguua

SEQ ID NO: 1300858 - RNA, 19 nt, Homo sapiens
gcugcuaaauuuaaacagu

SEQ ID NO: 1300859 - RNA, 19 nt, Homo sapiens
gagaagaaugugcccagaa

SEQ ID NO: 1300860 - RNA, 19 nt, Homo sapiens
uauaaagaacugccucaaa

SEQ ID NO: 1300861 - RNA, 19 nt, Homo sapiens
gaaauggaaacacgaaggu

SEQ ID NO: 1300862 - RNA, 19 nt, Homo sapiens
gaggauccuguaauuauug

SEQ ID NO: 1300863 - RNA, 19 nt, Homo sapiens
caacggaggauccuguaau

SEQ ID NO: 1300864 - RNA, 19 nt, Homo sapiens
caacugaauagucuuguuc

SEQ ID NO: 1300865 - RNA, 19 nt, Homo sapiens
guggauucaucauuccuuu

SEQ ID NO: 1300866 - RNA, 19 nt, Homo sapiens
caaacaaaaucaaccauuc

SEQ ID NO: 1300867 - RNA, 19 nt, Homo sapiens
uaguagcaaugaaauccua

SEQ ID NO: 1300868 - RNA, 19 nt, Homo sapiens
guauuccaauuguugcaaa

SEQ ID NO: 1300869 - RNA, 19 nt, Homo sapiens
aaugcagucuggauauaaa

SEQ ID NO: 1300870 - RNA, 19 nt, Homo sapiens
acacgaaggugcaaguuuu

SEQ ID NO: 1300871 - RNA, 19 nt, Homo sapiens
uggcuggacugacauuguu

SEQ ID NO: 1300872 - RNA, 19 nt, Homo sapiens
ccagaguauuaaagagaaa

SEQ ID NO: 1300873 - RNA, 19 nt, Homo sapiens
ccaaccagaguauuaaaga

SEQ ID NO: 1300874 - RNA, 19 nt, Homo sapiens
gucauuaacacagcuauaa

SEQ ID NO: 1300875 - RNA, 19 nt, Homo sapiens
ccacguagcaaaggagauu

SEQ ID NO: 1300876 - RNA, 19 nt, Homo sapiens
gaaacacgaaggugcaagu

SEQ ID NO: 1300877 - RNA, 19 nt, Homo sapiens
caaccagaguauuaaagag

SEQ ID NO: 1300878 - RNA, 19 nt, Homo sapiens
aauaugggaucccgugugu

SEQ ID NO: 1300879 - RNA, 19 nt, Homo sapiens
gagcuccgaaugugcuuaa

SEQ ID NO: 1300880 - RNA, 19 nt, Homo sapiens
ggccgaggcaggagaauug

SEQ ID NO: 1300881 - RNA, 19 nt, Homo sapiens
cgguggcucuugccuguaa

SEQ ID NO: 1300882 - RNA, 19 nt, Homo sapiens
gaaugugcccagaaaauaa

SEQ ID NO: 1300883 - RNA, 19 nt, Homo sapiens
aacggaggauccuguaauu

SEQ ID NO: 1300884 - RNA, 19 nt, Homo sapiens
caacuucagaaacuccuuu

SEQ ID NO: 1300885 - RNA, 19 nt, Homo sapiens
ucacuucuagucaaugaaa

SEQ ID NO: 1300886 - RNA, 19 nt, Homo sapiens
gcaucaguauuugacuaaa

SEQ ID NO: 1300887 - RNA, 19 nt, Homo sapiens
ugcaaaugcuuguuaucuu

SEQ ID NO: 1300888 - RNA, 19 nt, Homo sapiens
gaugccaagugaauauaag

SEQ ID NO: 1300889 - RNA, 19 nt, Homo sapiens
gguguuacuuacuggaaau

SEQ ID NO: 1300890 - RNA, 19 nt, Homo sapiens
uaaccugagugugaauguu

SEQ ID NO: 1300891 - RNA, 19 nt, Homo sapiens
ugauggagcuccgaaugug

SEQ ID NO: 1300892 - RNA, 19 nt, Homo sapiens
gauuugcaguuacucaucu

SEQ ID NO: 1300893 - RNA, 19 nt, Homo sapiens
uaagcuacccuucuaccuu

SEQ ID NO: 1300894 - RNA, 19 nt, Homo sapiens
ggugguauuccaauuguug

SEQ ID NO: 1300895 - RNA, 19 nt, Homo sapiens
caauaaaguuggucucuac

SEQ ID NO: 1300896 - RNA, 19 nt, Homo sapiens
cagcaagcauuauaucuca

SEQ ID NO: 1300897 - RNA, 19 nt, Homo sapiens
ggucuucugugucuucuau

SEQ ID NO: 1300898 - RNA, 19 nt, Homo sapiens
ggucaggucuucugugucu

SEQ ID NO: 1300899 - RNA, 19 nt, Homo sapiens
uggcagcaguuucuucuuu

SEQ ID NO: 1300900 - RNA, 19 nt, Homo sapiens
gcacaguugucacuaccau

SEQ ID NO: 1300901 - RNA, 19 nt, Homo sapiens
gcaagaggaguccaaguca

SEQ ID NO: 1300902 - RNA, 19 nt, Homo sapiens
aagguggucuugagauuga

SEQ ID NO: 1300903 - RNA, 19 nt, Homo sapiens
cagcgagggcuucuacuuu

SEQ ID NO: 1300904 - RNA, 19 nt, Homo sapiens
acaauaaaguuggucucua

SEQ ID NO: 1300905 - RNA, 19 nt, Homo sapiens
guggagggcuggagcuuca

SEQ ID NO: 1300906 - RNA, 19 nt, Homo sapiens
ggcagcaguuucuucuuug

SEQ ID NO: 1300907 - RNA, 19 nt, Homo sapiens
caggucaggucuucugugu

SEQ ID NO: 1300908 - RNA, 19 nt, Homo sapiens
cuacuuugcuuucaucacu

SEQ ID NO: 1300909 - RNA, 19 nt, Homo sapiens
guacaaaggaaaggacaga

SEQ ID NO: 1300910 - RNA, 19 nt, Homo sapiens
cauggaagccugggugaaa

SEQ ID NO: 1300911 - RNA, 19 nt, Homo sapiens
cauuauaucucaguguauc

SEQ ID NO: 1300912 - RNA, 19 nt, Homo sapiens
agcauuauaucucagugua

SEQ ID NO: 1300913 - RNA, 19 nt, Homo sapiens
ccagggaccaguuucaguu

SEQ ID NO: 1300914 - RNA, 19 nt, Homo sapiens
ugucuucuaugcccuguug

SEQ ID NO: 1300915 - RNA, 19 nt, Homo sapiens
gcuggucauucucaucuuc

SEQ ID NO: 1300916 - RNA, 19 nt, Homo sapiens
gggaccaguuucaguugga

SEQ ID NO: 1300917 - RNA, 19 nt, Homo sapiens
ugacagacagcaaguccuu

SEQ ID NO: 1300918 - RNA, 19 nt, Homo sapiens
gcaucccgcuuaacgugau

SEQ ID NO: 1300919 - RNA, 19 nt, Homo sapiens
agcgagggcuucuacuuug

SEQ ID NO: 1300920 - RNA, 19 nt, Homo sapiens
ccaagcucauggacaagug

SEQ ID NO: 1300921 - RNA, 19 nt, Homo sapiens
ggacgcuggucauucucau

SEQ ID NO: 1300922 - RNA, 19 nt, Homo sapiens
gcaagcauuauaucucagu

SEQ ID NO: 1300923 - RNA, 19 nt, Homo sapiens
ccaaaggcaacucuaccaa

SEQ ID NO: 1300924 - RNA, 19 nt, Homo sapiens
ggacuuuggcagcaguuuc

SEQ ID NO: 1300925 - RNA, 19 nt, Homo sapiens
cucccaagcucauggacaa

SEQ ID NO: 1300926 - RNA, 19 nt, Homo sapiens
ucucagcaccauuggcuuu

SEQ ID NO: 1300927 - RNA, 19 nt, Homo sapiens
gggcuucuacuuugcuuuc

SEQ ID NO: 1300928 - RNA, 19 nt, Homo sapiens
gcagcaguuucuucuuugc

SEQ ID NO: 1300929 - RNA, 19 nt, Homo sapiens
gcucggugccacuaucuuc

SEQ ID NO: 1300930 - RNA, 19 nt, Homo sapiens
gcucccagguacugcaagu

SEQ ID NO: 1300931 - RNA, 19 nt, Homo sapiens
cagcuggggucccucuuuu

SEQ ID NO: 1300932 - RNA, 19 nt, Homo sapiens
gaagcaaggaguggacaag

SEQ ID NO: 1300933 - RNA, 19 nt, Homo sapiens
gcauuauaucucaguguau

SEQ ID NO: 1300934 - RNA, 19 nt, Homo sapiens
gagggcuucuacuuugcuu

SEQ ID NO: 1300935 - RNA, 19 nt, Homo sapiens
agaggcaggucaggucuuc

SEQ ID NO: 1300936 - RNA, 19 nt, Homo sapiens
gaggacccacggacucuuc

SEQ ID NO: 1300937 - RNA, 19 nt, Homo sapiens
gcaggcacaguugucacua

SEQ ID NO: 1300938 - RNA, 19 nt, Homo sapiens
gacaauaaaguuggucucu

SEQ ID NO: 1300939 - RNA, 19 nt, Homo sapiens
ccagcaagcauuauaucuc

SEQ ID NO: 1300940 - RNA, 19 nt, Homo sapiens
gcugcucggugccacuauc

SEQ ID NO: 1300941 - RNA, 19 nt, Homo sapiens
gcgagggcuucuacuuugc

SEQ ID NO: 1300942 - RNA, 19 nt, Homo sapiens
gcacagaccccagcaagca

SEQ ID NO: 1300943 - RNA, 19 nt, Homo sapiens
cagaagagcuugaguauaa

SEQ ID NO: 1300944 - RNA, 19 nt, Homo sapiens
gaacgaugcucaugaguuu

SEQ ID NO: 1300945 - RNA, 19 nt, Homo sapiens
ccacaaagcuggagguaaa

SEQ ID NO: 1300946 - RNA, 19 nt, Homo sapiens
gaagauaccucacuuuguc

SEQ ID NO: 1300947 - RNA, 19 nt, Homo sapiens
caaaugagcuagaaucugu

SEQ ID NO: 1300948 - RNA, 19 nt, Homo sapiens
ccacaaaguugaugagaaa

SEQ ID NO: 1300949 - RNA, 19 nt, Homo sapiens
aaacauggcugcccuauuc

SEQ ID NO: 1300950 - RNA, 19 nt, Homo sapiens
gcacaagacuuccguugga

SEQ ID NO: 1300951 - RNA, 19 nt, Homo sapiens
aaacagaucugguucacuu

SEQ ID NO: 1300952 - RNA, 19 nt, Homo sapiens
gcuagaaucuguauacuca

SEQ ID NO: 1300953 - RNA, 19 nt, Homo sapiens
gcacauccuucaucuauuc

SEQ ID NO: 1300954 - RNA, 19 nt, Homo sapiens
gcacuggguuccaauaaga

SEQ ID NO: 1300955 - RNA, 19 nt, Homo sapiens
gagaaugcccagcuuaaua

SEQ ID NO: 1300956 - RNA, 19 nt, Homo sapiens
acaaaggaauccaaagaua

SEQ ID NO: 1300957 - RNA, 19 nt, Homo sapiens
gaaaucaaguagcaaaucu

SEQ ID NO: 1300958 - RNA, 19 nt, Homo sapiens
gaagagaaugcccagcuua

SEQ ID NO: 1300959 - RNA, 19 nt, Homo sapiens
ccaguaaguuuguagcuuu

SEQ ID NO: 1300960 - RNA, 19 nt, Homo sapiens
uaacaggaauucccuacuu

SEQ ID NO: 1300961 - RNA, 19 nt, Homo sapiens
gaugagaaaucaaguagca

SEQ ID NO: 1300962 - RNA, 19 nt, Homo sapiens
gauaaggagucugaacaaa

SEQ ID NO: 1300963 - RNA, 19 nt, Homo sapiens
gagugaggauggagaaauu

SEQ ID NO: 1300964 - RNA, 19 nt, Homo sapiens
ccuaagaccuacaaaauua

SEQ ID NO: 1300965 - RNA, 19 nt, Homo sapiens
caacaaaggaauccaaaga

SEQ ID NO: 1300966 - RNA, 19 nt, Homo sapiens
gcugaacaauugaagauau

SEQ ID NO: 1300967 - RNA, 19 nt, Homo sapiens
ucaccugcauuuaacuuua

SEQ ID NO: 1300968 - RNA, 19 nt, Homo sapiens
uaucagaauuccagaaaga

SEQ ID NO: 1300969 - RNA, 19 nt, Homo sapiens
gaaagaugacuucuggaaa

SEQ ID NO: 1300970 - RNA, 19 nt, Homo sapiens
ccacagaugcugaacaauu

SEQ ID NO: 1300971 - RNA, 19 nt, Homo sapiens
ccaauaagaauccaagaaa

SEQ ID NO: 1300972 - RNA, 19 nt, Homo sapiens
ggaaauccuuaccuagaug

SEQ ID NO: 1300973 - RNA, 19 nt, Homo sapiens
gaaauuggaaugugaaucu

SEQ ID NO: 1300974 - RNA, 19 nt, Homo sapiens
gagcagaagagcuugagua

SEQ ID NO: 1300975 - RNA, 19 nt, Homo sapiens
aaagaaugcucucaucuag

SEQ ID NO: 1300976 - RNA, 19 nt, Homo sapiens
gaagacagcagcaaaagua

SEQ ID NO: 1300977 - RNA, 19 nt, Homo sapiens
uuaaaggugucuucucauu

SEQ ID NO: 1300978 - RNA, 19 nt, Homo sapiens
gcaagacugggauaucuaa

SEQ ID NO: 1300979 - RNA, 19 nt, Homo sapiens
ggagaucgagcauucauug

SEQ ID NO: 1300980 - RNA, 19 nt, Homo sapiens
ucaaggagauguuacucuu

SEQ ID NO: 1300981 - RNA, 19 nt, Homo sapiens
cacagaugcugaacaauug

SEQ ID NO: 1300982 - RNA, 19 nt, Homo sapiens
gagagaaacaauugaaguu

SEQ ID NO: 1300983 - RNA, 19 nt, Homo sapiens
caaaggaauccaaagauau

SEQ ID NO: 1300984 - RNA, 19 nt, Homo sapiens
uaucauggccugcaacaaa

SEQ ID NO: 1300985 - RNA, 19 nt, Homo sapiens
aaagaagaaugaccaggaa

SEQ ID NO: 1300986 - RNA, 19 nt, Homo sapiens
cacaaagugggauaaauua

SEQ ID NO: 1300987 - RNA, 19 nt, Homo sapiens
gaagagauguugaaaagag

SEQ ID NO: 1300988 - RNA, 19 nt, Homo sapiens
uauccuggcuccacacauu

SEQ ID NO: 1300989 - RNA, 19 nt, Homo sapiens
auaauuaccucuccaucaa

SEQ ID NO: 1300990 - RNA, 19 nt, Homo sapiens
gcacuccauugcuuguaaa

SEQ ID NO: 1300991 - RNA, 19 nt, Homo sapiens
acacaaagugggauaaauu

SEQ ID NO: 1300992 - RNA, 19 nt, Homo sapiens
cagaggaugccuuugcuua

SEQ ID NO: 1300993 - RNA, 19 nt, Homo sapiens
gauaugcggguguuaggua

SEQ ID NO: 1300994 - RNA, 19 nt, Homo sapiens
gaacugcaagacugggaua

SEQ ID NO: 1300995 - RNA, 19 nt, Homo sapiens
aaagaugacuucuggaaac

SEQ ID NO: 1300996 - RNA, 19 nt, Homo sapiens
gcagaagagcuugaguaua

SEQ ID NO: 1300997 - RNA, 19 nt, Homo sapiens
ggacagaguucaucaaaac

SEQ ID NO: 1300998 - RNA, 19 nt, Homo sapiens
aagauagacuggugcugua

SEQ ID NO: 1300999 - RNA, 19 nt, Homo sapiens
ggaagauaccucacuuugu

SEQ ID NO: 1301000 - RNA, 19 nt, Homo sapiens
cgaaagaugacuucuggaa

SEQ ID NO: 1301001 - RNA, 19 nt, Homo sapiens
gcuauagcuugaaugaguu

SEQ ID NO: 1301002 - RNA, 19 nt, Homo sapiens
gagcuugaguauaaaugug

SEQ ID NO: 1301003 - RNA, 19 nt, Homo sapiens
aaggagauguuacucuuga

SEQ ID NO: 1301004 - RNA, 19 nt, Homo sapiens
gaaagaagaaagauagacu

SEQ ID NO: 1301005 - RNA, 19 nt, Homo sapiens
uaaaccaaaugagcuagaa

SEQ ID NO: 1301006 - RNA, 19 nt, Homo sapiens
gauauuccauggcaaugca

SEQ ID NO: 1301007 - RNA, 19 nt, Homo sapiens
gaggaugccuuugcuuaca

SEQ ID NO: 1301008 - RNA, 19 nt, Homo sapiens
uaaagucaggccauuauau

SEQ ID NO: 1301009 - RNA, 19 nt, Homo sapiens
ccacacauuggaucagaua

SEQ ID NO: 1301010 - RNA, 19 nt, Homo sapiens
gaccaggaagucaucauuu

SEQ ID NO: 1301011 - RNA, 19 nt, Homo sapiens
uuaaugcucuuaccaugug

SEQ ID NO: 1301012 - RNA, 19 nt, Homo sapiens
ccaagaaacaaagacauuu

SEQ ID NO: 1301013 - RNA, 19 nt, Homo sapiens
guuacagucucuacuuuca

SEQ ID NO: 1301014 - RNA, 19 nt, Homo sapiens
cgagguguguaagcuauaa

SEQ ID NO: 1301015 - RNA, 19 nt, Homo sapiens
caauaagaauccaagaaac

SEQ ID NO: 1301016 - RNA, 19 nt, Homo sapiens
gcacacaaagaaccuccua

SEQ ID NO: 1301017 - RNA, 19 nt, Homo sapiens
gcacaccucucucaaaagu

SEQ ID NO: 1301018 - RNA, 19 nt, Homo sapiens
accguuagcucacuuaaug

SEQ ID NO: 1301019 - RNA, 19 nt, Homo sapiens
caaacgcuauagcuugaau

SEQ ID NO: 1301020 - RNA, 19 nt, Homo sapiens
ccuagaauccuuauuguuc

SEQ ID NO: 1301021 - RNA, 19 nt, Homo sapiens
gcacagaacgaugcucaug

SEQ ID NO: 1301022 - RNA, 19 nt, Homo sapiens
gaaauccuuaccuagauga

SEQ ID NO: 1301023 - RNA, 19 nt, Homo sapiens
cuagaauccuuauuguuca

SEQ ID NO: 1301024 - RNA, 19 nt, Homo sapiens
cuaccuagaauccuuauug

SEQ ID NO: 1301025 - RNA, 19 nt, Homo sapiens
ggaaaagaaugcucucauc

SEQ ID NO: 1301026 - RNA, 19 nt, Homo sapiens
gaagagcuugaguauaaau

SEQ ID NO: 1301027 - RNA, 19 nt, Homo sapiens
acugaaagauaacauggaa

SEQ ID NO: 1301028 - RNA, 19 nt, Homo sapiens
cuguuuagaucaacugaaa

SEQ ID NO: 1301029 - RNA, 19 nt, Homo sapiens
auagacuggugcuguauuu

SEQ ID NO: 1301030 - RNA, 19 nt, Homo sapiens
gaacgccacuggaaauccu

SEQ ID NO: 1301031 - RNA, 19 nt, Homo sapiens
ccuaugacuuugagaaaca

SEQ ID NO: 1301032 - RNA, 19 nt, Homo sapiens
gcaaaaguaccuuggaaaa

SEQ ID NO: 1301033 - RNA, 19 nt, Homo sapiens
agaaaucaaggagauguua

SEQ ID NO: 1301034 - RNA, 19 nt, Homo sapiens
guguuacagucucuacuuu

SEQ ID NO: 1301035 - RNA, 19 nt, Homo sapiens
ggaaagaaagaagaaagau

SEQ ID NO: 1301036 - RNA, 19 nt, Homo sapiens
aaucggagauacguauauu

SEQ ID NO: 1301037 - RNA, 19 nt, Homo sapiens
aagcacauccuucaucuau

SEQ ID NO: 1301038 - RNA, 19 nt, Homo sapiens
ugagaaaucaaguagcaaa

SEQ ID NO: 1301039 - RNA, 19 nt, Homo sapiens
cgcuauagcuugaaugagu

SEQ ID NO: 1301040 - RNA, 19 nt, Homo sapiens
gaagagaauaagaaauugg

SEQ ID NO: 1301041 - RNA, 19 nt, Homo sapiens
gcuauaaucgagagaaaca

SEQ ID NO: 1301042 - RNA, 19 nt, Homo sapiens
uugaagcaguggaaagaaa

SEQ ID NO: 1301043 - RNA, 19 nt, Homo sapiens
guagaaagcucccacaguu

SEQ ID NO: 1301044 - RNA, 19 nt, Homo sapiens
gaaauggacagcaguauaa

SEQ ID NO: 1301045 - RNA, 19 nt, Homo sapiens
gaaauucucucucuugaag

SEQ ID NO: 1301046 - RNA, 19 nt, Homo sapiens
aagcagaacuugaagguua

SEQ ID NO: 1301047 - RNA, 19 nt, Homo sapiens
ccaccaaaguucaguaaua

SEQ ID NO: 1301048 - RNA, 19 nt, Homo sapiens
ggacauuuguuugcauuua

SEQ ID NO: 1301049 - RNA, 19 nt, Homo sapiens
gaaguugcauguucagauu

SEQ ID NO: 1301050 - RNA, 19 nt, Homo sapiens
ggauggagcuagaagauga

SEQ ID NO: 1301051 - RNA, 19 nt, Homo sapiens
ccaaggagcuuacuaugga

SEQ ID NO: 1301052 - RNA, 19 nt, Homo sapiens
gaaauuagaaguugcaugu

SEQ ID NO: 1301053 - RNA, 19 nt, Homo sapiens
guaaugaaauugacaguag

SEQ ID NO: 1301054 - RNA, 19 nt, Homo sapiens
gaaauaccacuguacaauu

SEQ ID NO: 1301055 - RNA, 19 nt, Homo sapiens
caaauguaaucgacaauug

SEQ ID NO: 1301056 - RNA, 19 nt, Homo sapiens
gaaauuaaagccaugcaaa

SEQ ID NO: 1301057 - RNA, 19 nt, Homo sapiens
agacucaucuucgaauuua

SEQ ID NO: 1301058 - RNA, 19 nt, Homo sapiens
ggaaauggacagcaguaua

SEQ ID NO: 1301059 - RNA, 19 nt, Homo sapiens
ucacugcugugcuacuuua

SEQ ID NO: 1301060 - RNA, 19 nt, Homo sapiens
caccaaaguucaguaauaa

SEQ ID NO: 1301061 - RNA, 19 nt, Homo sapiens
ccagaagacuguacauuuc

SEQ ID NO: 1301062 - RNA, 19 nt, Homo sapiens
gacaaacucucauucuuca

SEQ ID NO: 1301063 - RNA, 19 nt, Homo sapiens
aaugagaggugauuccuaa

SEQ ID NO: 1301064 - RNA, 19 nt, Homo sapiens
gaucugauaccacuacaaa

SEQ ID NO: 1301065 - RNA, 19 nt, Homo sapiens
gaaaucuucugccaaugug

SEQ ID NO: 1301066 - RNA, 19 nt, Homo sapiens
gaugaagaguugcuaagug

SEQ ID NO: 1301067 - RNA, 19 nt, Homo sapiens
ggaaacacauccuagaacu

SEQ ID NO: 1301068 - RNA, 19 nt, Homo sapiens
agaaagcucccacaguuua

SEQ ID NO: 1301069 - RNA, 19 nt, Homo sapiens
gcaaagacaaacucucauu

SEQ ID NO: 1301070 - RNA, 19 nt, Homo sapiens
gaagaaacuccaccaagga

SEQ ID NO: 1301071 - RNA, 19 nt, Homo sapiens
ggagagaugagaauacuau

SEQ ID NO: 1301072 - RNA, 19 nt, Homo sapiens
gguguacgcugucuagaug

SEQ ID NO: 1301073 - RNA, 19 nt, Homo sapiens
ggaacacaauuaggauauu

SEQ ID NO: 1301074 - RNA, 19 nt, Homo sapiens
ccaagaauacuucaucuga

SEQ ID NO: 1301075 - RNA, 19 nt, Homo sapiens
gaagaguugcuaagugaaa

SEQ ID NO: 1301076 - RNA, 19 nt, Homo sapiens
gagaugagaauacuaugaa

SEQ ID NO: 1301077 - RNA, 19 nt, Homo sapiens
caacaugguccucaaguga

SEQ ID NO: 1301078 - RNA, 19 nt, Homo sapiens
gcaauggaguggaaucagu

SEQ ID NO: 1301079 - RNA, 19 nt, Homo sapiens
guuguagacuuuagagaaa

SEQ ID NO: 1301080 - RNA, 19 nt, Homo sapiens
caaaccauguugaugaguu

SEQ ID NO: 1301081 - RNA, 19 nt, Homo sapiens
gauaccagguuuagaaugg

SEQ ID NO: 1301082 - RNA, 19 nt, Homo sapiens
gagcuaacaugggauuaug

SEQ ID NO: 1301083 - RNA, 19 nt, Homo sapiens
caauaaagggaauguguuu

SEQ ID NO: 1301084 - RNA, 19 nt, Homo sapiens
aagcagagcuaacacugaa

SEQ ID NO: 1301085 - RNA, 19 nt, Homo sapiens
ucaggaagauuacuaagca

SEQ ID NO: 1301086 - RNA, 19 nt, Homo sapiens
ugaguaggauggaagugua

SEQ ID NO: 1301087 - RNA, 19 nt, Homo sapiens
ggaaaucuucugccaaugu

SEQ ID NO: 1301088 - RNA, 19 nt, Homo sapiens
ggacucaaguucaaaccau

SEQ ID NO: 1301089 - RNA, 19 nt, Homo sapiens
caauaccuauguucaguug

SEQ ID NO: 1301090 - RNA, 19 nt, Homo sapiens
ccaaagcagugauccuaug

SEQ ID NO: 1301091 - RNA, 19 nt, Homo sapiens
gaauacauccaagcaauga

SEQ ID NO: 1301092 - RNA, 19 nt, Homo sapiens
gaaguucucccauuaggau

SEQ ID NO: 1301093 - RNA, 19 nt, Homo sapiens
gaagauucauggacuuguc

SEQ ID NO: 1301094 - RNA, 19 nt, Homo sapiens
ucugauaccacuacaaaua

SEQ ID NO: 1301095 - RNA, 19 nt, Homo sapiens
uuaaaccacuagcccauuu

SEQ ID NO: 1301096 - RNA, 19 nt, Homo sapiens
ggacugugccugagaagga

SEQ ID NO: 1301097 - RNA, 19 nt, Homo sapiens
caagaauacuucaucugau

SEQ ID NO: 1301098 - RNA, 19 nt, Homo sapiens
gaaagcucccacaguuuaa

SEQ ID NO: 1301099 - RNA, 19 nt, Homo sapiens
aaagggagcaucacagaaa

SEQ ID NO: 1301100 - RNA, 19 nt, Homo sapiens
gcuagaagaugauggaaaa

SEQ ID NO: 1301101 - RNA, 19 nt, Homo sapiens
gacugucacucauuucuga

SEQ ID NO: 1301102 - RNA, 19 nt, Homo sapiens
ggauggaaguguauauuuu

SEQ ID NO: 1301103 - RNA, 19 nt, Homo sapiens
gaaacacacaacaggaauu

SEQ ID NO: 1301104 - RNA, 19 nt, Homo sapiens
guugaugaguuugaagaua

SEQ ID NO: 1301105 - RNA, 19 nt, Homo sapiens
gagcauauaaucuaaccaa

SEQ ID NO: 1301106 - RNA, 19 nt, Homo sapiens
aaucaaaugucacuuccaa

SEQ ID NO: 1301107 - RNA, 19 nt, Homo sapiens
ccagugauauucugcaauc

SEQ ID NO: 1301108 - RNA, 19 nt, Homo sapiens
caacagguaugugaaagca

SEQ ID NO: 1301109 - RNA, 19 nt, Homo sapiens
gaaauguccaccaaaguuc

SEQ ID NO: 1301110 - RNA, 19 nt, Homo sapiens
caaaaggacucaaguucaa

SEQ ID NO: 1301111 - RNA, 19 nt, Homo sapiens
ugagaaauguccaccaaag

SEQ ID NO: 1301112 - RNA, 19 nt, Homo sapiens
gcaaauguaaucgacaauu

SEQ ID NO: 1301113 - RNA, 19 nt, Homo sapiens
gacuguacauuucuaacaa

SEQ ID NO: 1301114 - RNA, 19 nt, Homo sapiens
gaagacuguacauuucuaa

SEQ ID NO: 1301115 - RNA, 19 nt, Homo sapiens
gugaaugaagcaacuauaa

SEQ ID NO: 1301116 - RNA, 19 nt, Homo sapiens
ucaaagacagcagguauuu

SEQ ID NO: 1301117 - RNA, 19 nt, Homo sapiens
gaaauugacaguagaaagc

SEQ ID NO: 1301118 - RNA, 19 nt, Homo sapiens
aaggaaaucuucugccaau

SEQ ID NO: 1301119 - RNA, 19 nt, Homo sapiens
gugcaaauguaaucgacaa

SEQ ID NO: 1301120 - RNA, 19 nt, Homo sapiens
cuacagagacagauuccua

SEQ ID NO: 1301121 - RNA, 19 nt, Homo sapiens
ugagacagaguguaacuuu

SEQ ID NO: 1301122 - RNA, 19 nt, Homo sapiens
aagaauacauccaagcaau

SEQ ID NO: 1301123 - RNA, 19 nt, Homo sapiens
gguuuagaaugguauaaug

SEQ ID NO: 1301124 - RNA, 19 nt, Homo sapiens
guuggacugucacucauuu

SEQ ID NO: 1301125 - RNA, 19 nt, Homo sapiens
aaucagugcccauuucuuu

SEQ ID NO: 1301126 - RNA, 19 nt, Homo sapiens
ggaaauaaggaaauucucu

SEQ ID NO: 1301127 - RNA, 19 nt, Homo sapiens
caacaggaaauaaggaaau

SEQ ID NO: 1301128 - RNA, 19 nt, Homo sapiens
gcauuucccucuacaucau

SEQ ID NO: 1301129 - RNA, 19 nt, Homo sapiens
gaaaacaaauccaaugcau

SEQ ID NO: 1301130 - RNA, 19 nt, Homo sapiens
acacauaggguaucuuguu

SEQ ID NO: 1301131 - RNA, 19 nt, Homo sapiens
gaaagcaagaacagagcua

SEQ ID NO: 1301132 - RNA, 19 nt, Homo sapiens
gggacgaucuacagcaugu

SEQ ID NO: 1301133 - RNA, 19 nt, Homo sapiens
gacagagggacauuuguuu

SEQ ID NO: 1301134 - RNA, 19 nt, Homo sapiens
ccucgagcauauaaucuaa

SEQ ID NO: 1301135 - RNA, 19 nt, Homo sapiens
cagccacaauuucuauuug

SEQ ID NO: 1301136 - RNA, 19 nt, Homo sapiens
aguugaaguucucccauua

SEQ ID NO: 1301137 - RNA, 19 nt, Homo sapiens
caacugacagcaaggaaug

SEQ ID NO: 1301138 - RNA, 19 nt, Homo sapiens
ugacugcucuggugcuugu

SEQ ID NO: 1301139 - RNA, 19 nt, Homo sapiens
augaagaguugcuaaguga

SEQ ID NO: 1301140 - RNA, 19 nt, Homo sapiens
caaaauaaccacuggauau

SEQ ID NO: 1301141 - RNA, 19 nt, Homo sapiens
gcauagacauaacaaaaug

SEQ ID NO: 1301142 - RNA, 19 nt, Homo sapiens
ggaauuacccaaagcaaaa

SEQ ID NO: 1301143 - RNA, 19 nt, Homo sapiens
uaacagaucuugagcagaa

SEQ ID NO: 1301144 - RNA, 19 nt, Homo sapiens
ugauaggucuuucagauuu

SEQ ID NO: 1301145 - RNA, 19 nt, Homo sapiens
ggagauccacuuccuguaa

SEQ ID NO: 1301146 - RNA, 19 nt, Homo sapiens
caagcgguauguggaauua

SEQ ID NO: 1301147 - RNA, 19 nt, Homo sapiens
gagauccacuuccuguaaa

SEQ ID NO: 1301148 - RNA, 19 nt, Homo sapiens
caacuuacccugaaucaca

SEQ ID NO: 1301149 - RNA, 19 nt, Homo sapiens
caugauaggucuuucagau

SEQ ID NO: 1301150 - RNA, 19 nt, Homo sapiens
ucaaagcgcucuuacaacu

SEQ ID NO: 1301151 - RNA, 19 nt, Homo sapiens
gagcagaaguggaagaacu

SEQ ID NO: 1301152 - RNA, 19 nt, Homo sapiens
guaaaggacagaauggaaa

SEQ ID NO: 1301153 - RNA, 19 nt, Homo sapiens
ugaaaacucugaagaugua

SEQ ID NO: 1301154 - RNA, 19 nt, Homo sapiens
aaauacaacuuacccugaa

SEQ ID NO: 1301155 - RNA, 19 nt, Homo sapiens
gaagauguaggccauuaau

SEQ ID NO: 1301156 - RNA, 19 nt, Homo sapiens
ggucuaggguguuguugga

SEQ ID NO: 1301157 - RNA, 19 nt, Homo sapiens
ggaauuaacagaucuugag

SEQ ID NO: 1301158 - RNA, 19 nt, Homo sapiens
ucagauuucuucuuuccaa

SEQ ID NO: 1301159 - RNA, 19 nt, Homo sapiens
cugaagauguaggccauua

SEQ ID NO: 1301160 - RNA, 19 nt, Homo sapiens
caacuggauccuugugaaa

SEQ ID NO: 1301161 - RNA, 19 nt, Homo sapiens
gauaggucuuucagauuuc

SEQ ID NO: 1301162 - RNA, 19 nt, Homo sapiens
caggaagaacggcaugaua

SEQ ID NO: 1301163 - RNA, 19 nt, Homo sapiens
cagauuagacucagaugug

SEQ ID NO: 1301164 - RNA, 19 nt, Homo sapiens
ccauuaauacagagaagaa

SEQ ID NO: 1301165 - RNA, 19 nt, Homo sapiens
cagauuucuucuuuccaaa

SEQ ID NO: 1301166 - RNA, 19 nt, Homo sapiens
gaagaacggcaugauaggu

SEQ ID NO: 1301167 - RNA, 19 nt, Homo sapiens
uaaaggacagaauggaaau

SEQ ID NO: 1301168 - RNA, 19 nt, Homo sapiens
ggaagaacggcaugauagg

SEQ ID NO: 1301169 - RNA, 19 nt, Homo sapiens
uauguggaauuaacagauc

SEQ ID NO: 1301170 - RNA, 19 nt, Homo sapiens
caagcagugucaccacaag

SEQ ID NO: 1301171 - RNA, 19 nt, Homo sapiens
cggacauccugaagcaauu

SEQ ID NO: 1301172 - RNA, 19 nt, Homo sapiens
aauccuaccuugccucucu

SEQ ID NO: 1301173 - RNA, 19 nt, Homo sapiens
ggagacggaauccuaccuu

SEQ ID NO: 1301174 - RNA, 19 nt, Homo sapiens
uggcaccaaauacaacuua

SEQ ID NO: 1301175 - RNA, 19 nt, Homo sapiens
gcaguugguccgaauuucu

SEQ ID NO: 1301176 - RNA, 19 nt, Homo sapiens
auucaaagcgcucuuacaa

SEQ ID NO: 1301177 - RNA, 19 nt, Homo sapiens
gcucagcagauccacauuc

SEQ ID NO: 1301178 - RNA, 19 nt, Homo sapiens
ugaagauguaggccauuaa

SEQ ID NO: 1301179 - RNA, 19 nt, Homo sapiens
agauguaggccauuaauac

SEQ ID NO: 1301180 - RNA, 19 nt, Homo sapiens
aaaauucuggcaccaaaua

SEQ ID NO: 1301181 - RNA, 19 nt, Homo sapiens
aagauguaggccauuaaua

SEQ ID NO: 1301182 - RNA, 19 nt, Homo sapiens
gacacaggccugacucaag

SEQ ID NO: 1301183 - RNA, 19 nt, Homo sapiens
uguaaaggacagaauggaa

SEQ ID NO: 1301184 - RNA, 19 nt, Homo sapiens
uuaaaauucuggcaccaaa

SEQ ID NO: 1301185 - RNA, 19 nt, Homo sapiens
agauuagacucagaugugu

SEQ ID NO: 1301186 - RNA, 19 nt, Homo sapiens
ggacauccugaagcaauuc

SEQ ID NO: 1301187 - RNA, 19 nt, Homo sapiens
aggaagaacggcaugauag

SEQ ID NO: 1301188 - RNA, 19 nt, Homo sapiens
ccgcuacuuggccagauua

SEQ ID NO: 1301189 - RNA, 19 nt, Homo sapiens
ggccauuaauacagagaag

SEQ ID NO: 1301190 - RNA, 19 nt, Homo sapiens
gcgcucagcagauccacau

SEQ ID NO: 1301191 - RNA, 19 nt, Homo sapiens
ggcaguugguccgaauuuc

SEQ ID NO: 1301192 - RNA, 19 nt, Homo sapiens
guauguggaauuaacagau

SEQ ID NO: 1301193 - RNA, 19 nt, Homo sapiens
gcccacggcaacccagaaa

SEQ ID NO: 1301194 - RNA, 19 nt, Homo sapiens
aauauagacgccaggaaga

SEQ ID NO: 1301195 - RNA, 19 nt, Homo sapiens
ccuuggagacggaauccua

SEQ ID NO: 1301196 - RNA, 19 nt, Homo sapiens
cuacguuuaccgcuacuug

SEQ ID NO: 1301197 - RNA, 19 nt, Homo sapiens
cuaccuugccucucuaaag

SEQ ID NO: 1301198 - RNA, 19 nt, Homo sapiens
gguuugagcucauaucuua

SEQ ID NO: 1301199 - RNA, 19 nt, Homo sapiens
gguggaggcuggacuguga

SEQ ID NO: 1301200 - RNA, 19 nt, Homo sapiens
ucagucaacuucuucacua

SEQ ID NO: 1301201 - RNA, 19 nt, Homo sapiens
gcaagaugguucagucaac

SEQ ID NO: 1301202 - RNA, 19 nt, Homo sapiens
gaacagaguggaguguaug

SEQ ID NO: 1301203 - RNA, 19 nt, Homo sapiens
gagcacgugcccacuauga

SEQ ID NO: 1301204 - RNA, 19 nt, Homo sapiens
gcacgugcccacuaugaug

SEQ ID NO: 1301205 - RNA, 19 nt, Homo sapiens
cuaccuggcagcacuauaa

SEQ ID NO: 1301206 - RNA, 19 nt, Homo sapiens
cgagacuccuauucuggua

SEQ ID NO: 1301207 - RNA, 19 nt, Homo sapiens
gaccgagacuccuauucug

SEQ ID NO: 1301208 - RNA, 19 nt, Homo sapiens
ggaccgagacuccuauucu

SEQ ID NO: 1301209 - RNA, 19 nt, Homo sapiens
ugaacagaguggaguguau

SEQ ID NO: 1301210 - RNA, 19 nt, Homo sapiens
gggcauauucucucaggaa

SEQ ID NO: 1301211 - RNA, 19 nt, Homo sapiens
cuucuuguguguucuguga

SEQ ID NO: 1301212 - RNA, 19 nt, Homo sapiens
ucauucauaucucgguuug

SEQ ID NO: 1301213 - RNA, 19 nt, Homo sapiens
gcucuuccuuggacuucuu

SEQ ID NO: 1301214 - RNA, 19 nt, Homo sapiens
caagaugguucagucaacu

SEQ ID NO: 1301215 - RNA, 19 nt, Homo sapiens
ucaauaucuuggccucaga

SEQ ID NO: 1301216 - RNA, 19 nt, Homo sapiens
ucucuuuccuggcacaaug

SEQ ID NO: 1301217 - RNA, 19 nt, Homo sapiens
gccuugaacccguguauca

SEQ ID NO: 1301218 - RNA, 19 nt, Homo sapiens
ucacguagugucaguaugg

SEQ ID NO: 1301219 - RNA, 19 nt, Homo sapiens
uggagcacgugcccacuau

SEQ ID NO: 1301220 - RNA, 19 nt, Homo sapiens
aauacuggcugggccuuga

SEQ ID NO: 1301221 - RNA, 19 nt, Homo sapiens
ggcaggccaugaacagagu

SEQ ID NO: 1301222 - RNA, 19 nt, Homo sapiens
gagaccagacccagagaca

SEQ ID NO: 1301223 - RNA, 19 nt, Homo sapiens
ccaaggucauucauaucuc

SEQ ID NO: 1301224 - RNA, 19 nt, Homo sapiens
gaagcugugacucuguguu

SEQ ID NO: 1301225 - RNA, 19 nt, Homo sapiens
ucugugagcuucgcuggau

SEQ ID NO: 1301226 - RNA, 19 nt, Homo sapiens
gcaggagcccaaguuguuc

SEQ ID NO: 1301227 - RNA, 19 nt, Homo sapiens
gagacuccuauucugguaa

SEQ ID NO: 1301228 - RNA, 19 nt, Homo sapiens
ccaagccuccucucuccuu

SEQ ID NO: 1301229 - RNA, 19 nt, Homo sapiens
cuacugggcugaguuucgu

SEQ ID NO: 1301230 - RNA, 19 nt, Homo sapiens
gcaccagugacaccaguag

SEQ ID NO: 1301231 - RNA, 19 nt, Homo sapiens
ucagauggcuccccaaggu

SEQ ID NO: 1301232 - RNA, 19 nt, Homo sapiens
agcaggagcccaaguuguu

SEQ ID NO: 1301233 - RNA, 19 nt, Homo sapiens
guggguagcaccagugaca

SEQ ID NO: 1301234 - RNA, 19 nt, Homo sapiens
ccagcuggacgucaaguuc

SEQ ID NO: 1301235 - RNA, 19 nt, Homo sapiens
ggacuucuuguguguucug

SEQ ID NO: 1301236 - RNA, 19 nt, Homo sapiens
ggcaagaugguucagucaa

SEQ ID NO: 1301237 - RNA, 19 nt, Homo sapiens
ggccucauccuuguauuua

SEQ ID NO: 1301238 - RNA, 19 nt, Homo sapiens
uacaaguccucgcaccuaa

SEQ ID NO: 1301239 - RNA, 19 nt, Homo sapiens
gccaaagccuacuacaagu

SEQ ID NO: 1301240 - RNA, 19 nt, Homo sapiens
ccucauccuuguauuuaau

SEQ ID NO: 1301241 - RNA, 19 nt, Homo sapiens
cgccaaagccuacuacaag

SEQ ID NO: 1301242 - RNA, 19 nt, Homo sapiens
gccucauccuuguauuuaa

SEQ ID NO: 1301243 - RNA, 19 nt, Homo sapiens
cuacaaguccucgcaccua

SEQ ID NO: 1301244 - RNA, 19 nt, Homo sapiens
gcgccaaagccuacuacaa

SEQ ID NO: 1301245 - RNA, 19 nt, Homo sapiens
ggaacgcccuuuugcuugu

SEQ ID NO: 1301246 - RNA, 19 nt, Homo sapiens
uggcgugcguggauuacuu

SEQ ID NO: 1301247 - RNA, 19 nt, Homo sapiens
gugaccaccuggccaagca

SEQ ID NO: 1301248 - RNA, 19 nt, Homo sapiens
caaguccucgcaccuaaag

SEQ ID NO: 1301249 - RNA, 19 nt, Homo sapiens
ucccaggagucgcugauca

SEQ ID NO: 1301250 - RNA, 19 nt, Homo sapiens
ccaaagccuacuacaaguc

SEQ ID NO: 1301251 - RNA, 19 nt, Homo sapiens
gcaacaaggucauuagaua

SEQ ID NO: 1301252 - RNA, 19 nt, Homo sapiens
ggagaacucugaagaacua

SEQ ID NO: 1301253 - RNA, 19 nt, Homo sapiens
aaaggaaccugaagaauuu

SEQ ID NO: 1301254 - RNA, 19 nt, Homo sapiens
gaacucugaagaacuauua

SEQ ID NO: 1301255 - RNA, 19 nt, Homo sapiens
uaaaggaaccugaagaauu

SEQ ID NO: 1301256 - RNA, 19 nt, Homo sapiens
ggaacaagcucguaaaucc

SEQ ID NO: 1301257 - RNA, 19 nt, Homo sapiens
uuucaacucuggcaaauaa

SEQ ID NO: 1301258 - RNA, 19 nt, Homo sapiens
caacaaggucauuagauau

SEQ ID NO: 1301259 - RNA, 19 nt, Homo sapiens
guaauaaugcccuggagaa

SEQ ID NO: 1301260 - RNA, 19 nt, Homo sapiens
ucguaaaucccaagaguua

SEQ ID NO: 1301261 - RNA, 19 nt, Homo sapiens
gcucguaaaucccaagagu

SEQ ID NO: 1301262 - RNA, 19 nt, Homo sapiens
uaaaaggaguucaggaaaa

SEQ ID NO: 1301263 - RNA, 19 nt, Homo sapiens
ucucagaguuagaugaaga

SEQ ID NO: 1301264 - RNA, 19 nt, Homo sapiens
gaguuacagagucagauua

SEQ ID NO: 1301265 - RNA, 19 nt, Homo sapiens
gcaggaacaagcucguaaa

SEQ ID NO: 1301266 - RNA, 19 nt, Homo sapiens
uauaaaggaaccugaagaa

SEQ ID NO: 1301267 - RNA, 19 nt, Homo sapiens
ggaaaauucguccaacaua

SEQ ID NO: 1301268 - RNA, 19 nt, Homo sapiens
cuacagaggaucauuucaa

SEQ ID NO: 1301269 - RNA, 19 nt, Homo sapiens
ggauuucuuuacugauuuc

SEQ ID NO: 1301270 - RNA, 19 nt, Homo sapiens
uacacuacaucauacacua

SEQ ID NO: 1301271 - RNA, 19 nt, Homo sapiens
gaaaauucguccaacauac

SEQ ID NO: 1301272 - RNA, 19 nt, Homo sapiens
gccauggacucccagaaag

SEQ ID NO: 1301273 - RNA, 19 nt, Homo sapiens
agagucagauuagucaaug

SEQ ID NO: 1301274 - RNA, 19 nt, Homo sapiens
cccaagaguuacagaguca

SEQ ID NO: 1301275 - RNA, 19 nt, Homo sapiens
ggucauuagauauaaagga

SEQ ID NO: 1301276 - RNA, 19 nt, Homo sapiens
cagaaagaagcucuacaga

SEQ ID NO: 1301277 - RNA, 19 nt, Homo sapiens
gauauaaaggaaccugaag

SEQ ID NO: 1301278 - RNA, 19 nt, Homo sapiens
ccagaaagaagcucuacag

SEQ ID NO: 1301279 - RNA, 19 nt, Homo sapiens
auaaugcccuggagaacuc

SEQ ID NO: 1301280 - RNA, 19 nt, Homo sapiens
cguccaacauacucucaga

SEQ ID NO: 1301281 - RNA, 19 nt, Homo sapiens
cagaggaucauuucaacuc

SEQ ID NO: 1301282 - RNA, 19 nt, Homo sapiens
acacuacaucauacacuaa

SEQ ID NO: 1301283 - RNA, 19 nt, Homo sapiens
aaaaggaguucaggaaaau

SEQ ID NO: 1301284 - RNA, 19 nt, Homo sapiens
uaauaaagccuugggguuu

SEQ ID NO: 1301285 - RNA, 19 nt, Homo sapiens
cgccauggacucccagaaa

SEQ ID NO: 1301286 - RNA, 19 nt, Homo sapiens
caagaguuacagagucaga

SEQ ID NO: 1301287 - RNA, 19 nt, Homo sapiens
uacagaggaucauuucaac

SEQ ID NO: 1301288 - RNA, 19 nt, Homo sapiens
uuacagagucagauuaguc

SEQ ID NO: 1301289 - RNA, 19 nt, Homo sapiens
agucagauuagucaaugua

SEQ ID NO: 1301290 - RNA, 19 nt, Homo sapiens
ccauggacucccagaaaga

SEQ ID NO: 1301291 - RNA, 19 nt, Homo sapiens
caggaacaagcucguaaau

SEQ ID NO: 1301292 - RNA, 19 nt, Homo sapiens
gagucagauuagucaaugu

SEQ ID NO: 1301293 - RNA, 19 nt, Homo sapiens
cauggacucccagaaagaa

SEQ ID NO: 1301294 - RNA, 19 nt, Homo sapiens
gccuugggguuucuugaua

SEQ ID NO: 1301295 - RNA, 19 nt, Homo sapiens
cagaguuagaugaagaauu

SEQ ID NO: 1301296 - RNA, 19 nt, Homo sapiens
cagagucagauuagucaau

SEQ ID NO: 1301297 - RNA, 19 nt, Homo sapiens
agaguuacagagucagauu

SEQ ID NO: 1301298 - RNA, 19 nt, Homo sapiens
acucuauacuggaugaagu

SEQ ID NO: 1301299 - RNA, 19 nt, Homo sapiens
ggaagaagcuaucaccuua

SEQ ID NO: 1301300 - RNA, 19 nt, Homo sapiens
gaacagcucucaaguugua

SEQ ID NO: 1301301 - RNA, 19 nt, Homo sapiens
gaacuuagccaccaucuuu

SEQ ID NO: 1301302 - RNA, 19 nt, Homo sapiens
gaacauggguggcauccaa

SEQ ID NO: 1301303 - RNA, 19 nt, Homo sapiens
gaagaggcuuugcagauuu

SEQ ID NO: 1301304 - RNA, 19 nt, Homo sapiens
acacaaagcugagauauug

SEQ ID NO: 1301305 - RNA, 19 nt, Homo sapiens
gcaaagauguacuaucaga

SEQ ID NO: 1301306 - RNA, 19 nt, Homo sapiens
caaauuggaucgccuagaa

SEQ ID NO: 1301307 - RNA, 19 nt, Homo sapiens
gaagaaauauaccaaacug

SEQ ID NO: 1301308 - RNA, 19 nt, Homo sapiens
cagaacagcucucaaguug

SEQ ID NO: 1301309 - RNA, 19 nt, Homo sapiens
ccagauuucucuugauaua

SEQ ID NO: 1301310 - RNA, 19 nt, Homo sapiens
caaauaugguccagaguuu

SEQ ID NO: 1301311 - RNA, 19 nt, Homo sapiens
gcacaggccuggaugaaca

SEQ ID NO: 1301312 - RNA, 19 nt, Homo sapiens
uguagaaccuuccagaaua

SEQ ID NO: 1301313 - RNA, 19 nt, Homo sapiens
gacccaaccucauaggaua

SEQ ID NO: 1301314 - RNA, 19 nt, Homo sapiens
gcaagcagcaauagaaauu

SEQ ID NO: 1301315 - RNA, 19 nt, Homo sapiens
gggcacaacuaaugagauu

SEQ ID NO: 1301316 - RNA, 19 nt, Homo sapiens
ggaagcuccuggaauugua

SEQ ID NO: 1301317 - RNA, 19 nt, Homo sapiens
ggagaucuaauucuguuua

SEQ ID NO: 1301318 - RNA, 19 nt, Homo sapiens
gauaaauccucugugguaa

SEQ ID NO: 1301319 - RNA, 19 nt, Homo sapiens
cgaagaggcuuugcagauu

SEQ ID NO: 1301320 - RNA, 19 nt, Homo sapiens
gaaacagaaugaaauuugg

SEQ ID NO: 1301321 - RNA, 19 nt, Homo sapiens
gaaauuuccugcuuaccau

SEQ ID NO: 1301322 - RNA, 19 nt, Homo sapiens
guagaaccuuccagaauau

SEQ ID NO: 1301323 - RNA, 19 nt, Homo sapiens
gcagagcuucuauucuuua

SEQ ID NO: 1301324 - RNA, 19 nt, Homo sapiens
caauagaaauuuccugcuu

SEQ ID NO: 1301325 - RNA, 19 nt, Homo sapiens
ccaggaagcugcagcacuu

SEQ ID NO: 1301326 - RNA, 19 nt, Homo sapiens
gaagcuaucaccuuacuga

SEQ ID NO: 1301327 - RNA, 19 nt, Homo sapiens
gagcuucuauucuuuaugg

SEQ ID NO: 1301328 - RNA, 19 nt, Homo sapiens
ugaaggauuccaucaaaua

SEQ ID NO: 1301329 - RNA, 19 nt, Homo sapiens
aggcaaagauguacuauca

SEQ ID NO: 1301330 - RNA, 19 nt, Homo sapiens
ugauauaucucugugcuuu

SEQ ID NO: 1301331 - RNA, 19 nt, Homo sapiens
ggagagaguccuuuacaug

SEQ ID NO: 1301332 - RNA, 19 nt, Homo sapiens
cagcaggccaucaaacuua

SEQ ID NO: 1301333 - RNA, 19 nt, Homo sapiens
cgagauuccucaccuauuc

SEQ ID NO: 1301334 - RNA, 19 nt, Homo sapiens
aaaagaagcugaaaagaug

SEQ ID NO: 1301335 - RNA, 19 nt, Homo sapiens
aaauuuggcugucaagaga

SEQ ID NO: 1301336 - RNA, 19 nt, Homo sapiens
gcaagagcuuauuaugaga

SEQ ID NO: 1301337 - RNA, 19 nt, Homo sapiens
gcugagauauugucaccuu

SEQ ID NO: 1301338 - RNA, 19 nt, Homo sapiens
gaaauauaccaaacuggaa

SEQ ID NO: 1301339 - RNA, 19 nt, Homo sapiens
gaaggauuccaucaaauau

SEQ ID NO: 1301340 - RNA, 19 nt, Homo sapiens
aggcagagcuucuauucuu

SEQ ID NO: 1301341 - RNA, 19 nt, Homo sapiens
gaaggaaaaucuugccaaa

SEQ ID NO: 1301342 - RNA, 19 nt, Homo sapiens
gcucagauuuacacaacaa

SEQ ID NO: 1301343 - RNA, 19 nt, Homo sapiens
cuacaacuaugccaauuuc

SEQ ID NO: 1301344 - RNA, 19 nt, Homo sapiens
gaaauacagaagcuugaaa

SEQ ID NO: 1301345 - RNA, 19 nt, Homo sapiens
gcaaacugcugaaggaaaa

SEQ ID NO: 1301346 - RNA, 19 nt, Homo sapiens
gaagcgaucuaccacuaca

SEQ ID NO: 1301347 - RNA, 19 nt, Homo sapiens
guacuuccgucuguggaua

SEQ ID NO: 1301348 - RNA, 19 nt, Homo sapiens
gagaaaaggaucaaacaua

SEQ ID NO: 1301349 - RNA, 19 nt, Homo sapiens
ugaaugcuaucgccucuug

SEQ ID NO: 1301350 - RNA, 19 nt, Homo sapiens
uagaguggcugugcaacua

SEQ ID NO: 1301351 - RNA, 19 nt, Homo sapiens
cagcagaggcaaagaugua

SEQ ID NO: 1301352 - RNA, 19 nt, Homo sapiens
aagaggcuuugcagauuua

SEQ ID NO: 1301353 - RNA, 19 nt, Homo sapiens
gaaugaaauuuggcuguca

SEQ ID NO: 1301354 - RNA, 19 nt, Homo sapiens
agaugcauauucaagcuua

SEQ ID NO: 1301355 - RNA, 19 nt, Homo sapiens
gagcaagcagcaauagaaa

SEQ ID NO: 1301356 - RNA, 19 nt, Homo sapiens
cagcauaaccgggcucuuu

SEQ ID NO: 1301357 - RNA, 19 nt, Homo sapiens
gaaugaguaucuaauagcu

SEQ ID NO: 1301358 - RNA, 19 nt, Homo sapiens
ccagacagcucagauuuac

SEQ ID NO: 1301359 - RNA, 19 nt, Homo sapiens
ggcagagcuucuauucuuu

SEQ ID NO: 1301360 - RNA, 19 nt, Homo sapiens
gauaauguggugccucuga

SEQ ID NO: 1301361 - RNA, 19 nt, Homo sapiens
ccggaugccuugaaugcua

SEQ ID NO: 1301362 - RNA, 19 nt, Homo sapiens
gcacuucagccuucucaga

SEQ ID NO: 1301363 - RNA, 19 nt, Homo sapiens
ucaagagagucccuauuca

SEQ ID NO: 1301364 - RNA, 19 nt, Homo sapiens
gaaauuuggcugucaagag

SEQ ID NO: 1301365 - RNA, 19 nt, Homo sapiens
guucccgccugcaaauaua

SEQ ID NO: 1301366 - RNA, 19 nt, Homo sapiens
cuaagugagcuuuaucuaa

SEQ ID NO: 1301367 - RNA, 19 nt, Homo sapiens
cuccagauuucucuugaua

SEQ ID NO: 1301368 - RNA, 19 nt, Homo sapiens
gguccuaaguuaugugcuu

SEQ ID NO: 1301369 - RNA, 19 nt, Homo sapiens
gccugcaaauauauuguua

SEQ ID NO: 1301370 - RNA, 19 nt, Homo sapiens
caggaaugaguaucuaaua

SEQ ID NO: 1301371 - RNA, 19 nt, Homo sapiens
ugcaagagcuuauuaugag

SEQ ID NO: 1301372 - RNA, 19 nt, Homo sapiens
aaagaugaccaaucacauu

SEQ ID NO: 1301373 - RNA, 19 nt, Homo sapiens
auaccaaacuggaauaaag

SEQ ID NO: 1301374 - RNA, 19 nt, Homo sapiens
gaaccaggaaugaguaucu

SEQ ID NO: 1301375 - RNA, 19 nt, Homo sapiens
uuugagaccuggagaucua

SEQ ID NO: 1301376 - RNA, 19 nt, Homo sapiens
ggaaaaucuugccaaauug

SEQ ID NO: 1301377 - RNA, 19 nt, Homo sapiens
uuacaacacuggccgauac

SEQ ID NO: 1301378 - RNA, 19 nt, Homo sapiens
acugaaggauuccaucaaa

SEQ ID NO: 1301379 - RNA, 19 nt, Homo sapiens
caagugcgcucaacaaccu

SEQ ID NO: 1301380 - RNA, 19 nt, Homo sapiens
gauaaugggaggaucuaug

SEQ ID NO: 1301381 - RNA, 19 nt, Homo sapiens
aaagggcuauugcuaagug

SEQ ID NO: 1301382 - RNA, 19 nt, Homo sapiens
gcccagugcugaaggacuu

SEQ ID NO: 1301383 - RNA, 19 nt, Homo sapiens
gcaacuaaacccagaccaa

SEQ ID NO: 1301384 - RNA, 19 nt, Homo sapiens
ucaaauaugguccagaguu

SEQ ID NO: 1301385 - RNA, 19 nt, Homo sapiens
aggaagcgaucuaccacua

SEQ ID NO: 1301386 - RNA, 19 nt, Homo sapiens
uuaagagacuggagcacaa

SEQ ID NO: 1301387 - RNA, 19 nt, Homo sapiens
aggaaaaucuugccaaauu

SEQ ID NO: 1301388 - RNA, 19 nt, Homo sapiens
acaaggcucuccagcugaa

SEQ ID NO: 1301389 - RNA, 19 nt, Homo sapiens
aaaaggcaguggcccauua

SEQ ID NO: 1301390 - RNA, 19 nt, Homo sapiens
caggagcgguuuaaagaag

SEQ ID NO: 1301391 - RNA, 19 nt, Homo sapiens
gcagaugcauauucaagcu

SEQ ID NO: 1301392 - RNA, 19 nt, Homo sapiens
ggaacaaggaagcgaucua

SEQ ID NO: 1301393 - RNA, 19 nt, Homo sapiens
acagaagcuugaaaugcua

SEQ ID NO: 1301394 - RNA, 19 nt, Homo sapiens
ugagagggaaggagaauga

SEQ ID NO: 1301395 - RNA, 19 nt, Homo sapiens
cgucugacccaaccucaua

SEQ ID NO: 1301396 - RNA, 19 nt, Homo sapiens
gcacacaaagcugagauau

SEQ ID NO: 1301397 - RNA, 19 nt, Homo sapiens
gaacaaggaagcgaucuac

SEQ ID NO: 1301398 - RNA, 19 nt, Homo sapiens
uaaguuaugugcuugucau

SEQ ID NO: 1301399 - RNA, 19 nt, Homo sapiens
ggaagaagcuaucaccuua

SEQ ID NO: 1301400 - RNA, 19 nt, Homo sapiens
gaacagcucucaaguugua

SEQ ID NO: 1301401 - RNA, 19 nt, Homo sapiens
gaacuuagccaccaucuuu

SEQ ID NO: 1301402 - RNA, 19 nt, Homo sapiens
gaaaggggcuguaaaguua

SEQ ID NO: 1301403 - RNA, 19 nt, Homo sapiens
gaacauggguggcauccaa

SEQ ID NO: 1301404 - RNA, 19 nt, Homo sapiens
gaagaggcuuugcagauuu

SEQ ID NO: 1301405 - RNA, 19 nt, Homo sapiens
acacaaagcugagauauug

SEQ ID NO: 1301406 - RNA, 19 nt, Homo sapiens
gcaaagauguacuaucaga

SEQ ID NO: 1301407 - RNA, 19 nt, Homo sapiens
caaauuggaucgccuagaa

SEQ ID NO: 1301408 - RNA, 19 nt, Homo sapiens
gaagaaauauaccaaacug

SEQ ID NO: 1301409 - RNA, 19 nt, Homo sapiens
cagaacagcucucaaguug

SEQ ID NO: 1301410 - RNA, 19 nt, Homo sapiens
ccagauuucucuugauaua

SEQ ID NO: 1301411 - RNA, 19 nt, Homo sapiens
caaauaugguccagaguuu

SEQ ID NO: 1301412 - RNA, 19 nt, Homo sapiens
caaauuaucuugagcaaac

SEQ ID NO: 1301413 - RNA, 19 nt, Homo sapiens
gcacaggccuggaugaaca

SEQ ID NO: 1301414 - RNA, 19 nt, Homo sapiens
uguagaaccuuccagaaua

SEQ ID NO: 1301415 - RNA, 19 nt, Homo sapiens
gacccaaccucauaggaua

SEQ ID NO: 1301416 - RNA, 19 nt, Homo sapiens
gggcacaacuaaugagauu

SEQ ID NO: 1301417 - RNA, 19 nt, Homo sapiens
ggaagcuccuggaauugua

SEQ ID NO: 1301418 - RNA, 19 nt, Homo sapiens
ggagaucuaauucuguuua

SEQ ID NO: 1301419 - RNA, 19 nt, Homo sapiens
gauaaauccucugugguaa

SEQ ID NO: 1301420 - RNA, 19 nt, Homo sapiens
cgaagaggcuuugcagauu

SEQ ID NO: 1301421 - RNA, 19 nt, Homo sapiens
gaaacagaaugaaauuugg

SEQ ID NO: 1301422 - RNA, 19 nt, Homo sapiens
guagaaccuuccagaauau

SEQ ID NO: 1301423 - RNA, 19 nt, Homo sapiens
gcagagcuucuauucuuua

SEQ ID NO: 1301424 - RNA, 19 nt, Homo sapiens
ccaggaagcugcagcacuu

SEQ ID NO: 1301425 - RNA, 19 nt, Homo sapiens
gaagcuaucaccuuacuga

SEQ ID NO: 1301426 - RNA, 19 nt, Homo sapiens
gagcuucuauucuuuaugg

SEQ ID NO: 1301427 - RNA, 19 nt, Homo sapiens
caagacaagucgagcaaug

SEQ ID NO: 1301428 - RNA, 19 nt, Homo sapiens
ugaaggauuccaucaaaua

SEQ ID NO: 1301429 - RNA, 19 nt, Homo sapiens
aggcaaagauguacuauca

SEQ ID NO: 1301430 - RNA, 19 nt, Homo sapiens
ugauauaucucugugcuuu

SEQ ID NO: 1301431 - RNA, 19 nt, Homo sapiens
ggagagaguccuuuacaug

SEQ ID NO: 1301432 - RNA, 19 nt, Homo sapiens
cagcaggccaucaaacuua

SEQ ID NO: 1301433 - RNA, 19 nt, Homo sapiens
aaaagaagcugaaaagaug

SEQ ID NO: 1301434 - RNA, 19 nt, Homo sapiens
aaauuuggcugucaagaga

SEQ ID NO: 1301435 - RNA, 19 nt, Homo sapiens
uggcagagcggacguguua

SEQ ID NO: 1301436 - RNA, 19 nt, Homo sapiens
gcaagagcuuauuaugaga

SEQ ID NO: 1301437 - RNA, 19 nt, Homo sapiens
gcugagauauugucaccuu

SEQ ID NO: 1301438 - RNA, 19 nt, Homo sapiens
gaaauauaccaaacuggaa

SEQ ID NO: 1301439 - RNA, 19 nt, Homo sapiens
gaaggauuccaucaaauau

SEQ ID NO: 1301440 - RNA, 19 nt, Homo sapiens
aggcagagcuucuauucuu

SEQ ID NO: 1301441 - RNA, 19 nt, Homo sapiens
gaaggaaaaucuugccaaa

SEQ ID NO: 1301442 - RNA, 19 nt, Homo sapiens
uagauuggcugugcaacua

SEQ ID NO: 1301443 - RNA, 19 nt, Homo sapiens
gcucagauuuacacaacaa

SEQ ID NO: 1301444 - RNA, 19 nt, Homo sapiens
cuacaacuaugccaauuuc

SEQ ID NO: 1301445 - RNA, 19 nt, Homo sapiens
gaaauacagaagcuugaaa

SEQ ID NO: 1301446 - RNA, 19 nt, Homo sapiens
gcaaacugcugaaggaaaa

SEQ ID NO: 1301447 - RNA, 19 nt, Homo sapiens
gaagcgaucuaccacuaca

SEQ ID NO: 1301448 - RNA, 19 nt, Homo sapiens
gauguacaccugugauaaa

SEQ ID NO: 1301449 - RNA, 19 nt, Homo sapiens
gagaaaaggaucaaacaua

SEQ ID NO: 1301450 - RNA, 19 nt, Homo sapiens
ugaaugcuaucgccucuug

SEQ ID NO: 1301451 - RNA, 19 nt, Homo sapiens
ggagugugcuugguuuaug

SEQ ID NO: 1301452 - RNA, 19 nt, Homo sapiens
ugaggaaggugcucccuau

SEQ ID NO: 1301453 - RNA, 19 nt, Homo sapiens
cagcagaggcaaagaugua

SEQ ID NO: 1301454 - RNA, 19 nt, Homo sapiens
gugcgaugcuggugaaaga

SEQ ID NO: 1301455 - RNA, 19 nt, Homo sapiens
aagaggcuuugcagauuua

SEQ ID NO: 1301456 - RNA, 19 nt, Homo sapiens
gaaugaaauuuggcuguca

SEQ ID NO: 1301457 - RNA, 19 nt, Homo sapiens
agaugcauauucaagcuua

SEQ ID NO: 1301458 - RNA, 19 nt, Homo sapiens
cagcauaaccgggcucuuu

SEQ ID NO: 1301459 - RNA, 19 nt, Homo sapiens
ugacugguaugaacccauu

SEQ ID NO: 1301460 - RNA, 19 nt, Homo sapiens
gaaugaguaucuaauagcu

SEQ ID NO: 1301461 - RNA, 19 nt, Homo sapiens
ccagacagcucagauuuac

SEQ ID NO: 1301462 - RNA, 19 nt, Homo sapiens
gcgguucccucacaaagga

SEQ ID NO: 1301463 - RNA, 19 nt, Homo sapiens
gagugugcuugguuuauga

SEQ ID NO: 1301464 - RNA, 19 nt, Homo sapiens
ggcagagcuucuauucuuu

SEQ ID NO: 1301465 - RNA, 19 nt, Homo sapiens
gauaauguggugccucuga

SEQ ID NO: 1301466 - RNA, 19 nt, Homo sapiens
ccggaugccuugaaugcua

SEQ ID NO: 1301467 - RNA, 19 nt, Homo sapiens
gcacuucagccuucucaga

SEQ ID NO: 1301468 - RNA, 19 nt, Homo sapiens
ucaagagagucccuauuca

SEQ ID NO: 1301469 - RNA, 19 nt, Homo sapiens
gaaauuuggcugucaagag

SEQ ID NO: 1301470 - RNA, 19 nt, Homo sapiens
guucccgccugcaaauaua

SEQ ID NO: 1301471 - RNA, 19 nt, Homo sapiens
cuaagugagcuuuaucuaa

SEQ ID NO: 1301472 - RNA, 19 nt, Homo sapiens
cuccagauuucucuugaua

SEQ ID NO: 1301473 - RNA, 19 nt, Homo sapiens
gccugcaaauauauuguua

SEQ ID NO: 1301474 - RNA, 19 nt, Homo sapiens
caggaaugaguaucuaaua

SEQ ID NO: 1301475 - RNA, 19 nt, Homo sapiens
ugcaagagcuuauuaugag

SEQ ID NO: 1301476 - RNA, 19 nt, Homo sapiens
aaagaugaccaaucacauu

SEQ ID NO: 1301477 - RNA, 19 nt, Homo sapiens
cuggaaggcuaaacauauu

SEQ ID NO: 1301478 - RNA, 19 nt, Homo sapiens
auaccaaacuggaauaaag

SEQ ID NO: 1301479 - RNA, 19 nt, Homo sapiens
gaaccaggaaugaguaucu

SEQ ID NO: 1301480 - RNA, 19 nt, Homo sapiens
uuugagaccuggagaucua

SEQ ID NO: 1301481 - RNA, 19 nt, Homo sapiens
ggaaaaucuugccaaauug

SEQ ID NO: 1301482 - RNA, 19 nt, Homo sapiens
uuacaacacuggccgauac

SEQ ID NO: 1301483 - RNA, 19 nt, Homo sapiens
acugaaggauuccaucaaa

SEQ ID NO: 1301484 - RNA, 19 nt, Homo sapiens
caagugcgcucaacaaccu

SEQ ID NO: 1301485 - RNA, 19 nt, Homo sapiens
gcugugugguccaugauga

SEQ ID NO: 1301486 - RNA, 19 nt, Homo sapiens
aaagggcuauugcuaagug

SEQ ID NO: 1301487 - RNA, 19 nt, Homo sapiens
gcccagugcugaaggacuu

SEQ ID NO: 1301488 - RNA, 19 nt, Homo sapiens
gcaacuaaacccagaccaa

SEQ ID NO: 1301489 - RNA, 19 nt, Homo sapiens
gauuggcugugcaacuaaa

SEQ ID NO: 1301490 - RNA, 19 nt, Homo sapiens
ucaaauaugguccagaguu

SEQ ID NO: 1301491 - RNA, 19 nt, Homo sapiens
aggaagcgaucuaccacua

SEQ ID NO: 1301492 - RNA, 19 nt, Homo sapiens
uuaagagacuggagcacaa

SEQ ID NO: 1301493 - RNA, 19 nt, Homo sapiens
cagcagcgguucccucaca

SEQ ID NO: 1301494 - RNA, 19 nt, Homo sapiens
aggaaaaucuugccaaauu

SEQ ID NO: 1301495 - RNA, 19 nt, Homo sapiens
acaaggcucuccagcugaa

SEQ ID NO: 1301496 - RNA, 19 nt, Homo sapiens
aaaaggcaguggcccauua

SEQ ID NO: 1301497 - RNA, 19 nt, Homo sapiens
caggagcgguuuaaagaag

SEQ ID NO: 1301498 - RNA, 19 nt, Homo sapiens
gcagaugcauauucaagcu

SEQ ID NO: 1301499 - RNA, 19 nt, Homo sapiens
aguccaagcucaaagagua

SEQ ID NO: 1301500 - RNA, 19 nt, Homo sapiens
caacacagcaacaaauuca

SEQ ID NO: 1301501 - RNA, 19 nt, Homo sapiens
ggauggagcugcggcacaa

SEQ ID NO: 1301502 - RNA, 19 nt, Homo sapiens
ugacaacuguguucuuaag

SEQ ID NO: 1301503 - RNA, 19 nt, Homo sapiens
ggacaaauggagcaacuuc

SEQ ID NO: 1301504 - RNA, 19 nt, Homo sapiens
gcgagccacugaggagaua

SEQ ID NO: 1301505 - RNA, 19 nt, Homo sapiens
ggacuacgccaucaugaca

SEQ ID NO: 1301506 - RNA, 19 nt, Homo sapiens
uuugacaacuguguucuua

SEQ ID NO: 1301507 - RNA, 19 nt, Homo sapiens
gaaagcagcgccugaagcu

SEQ ID NO: 1301508 - RNA, 19 nt, Homo sapiens
caacuuugaacaccaagaa

SEQ ID NO: 1301509 - RNA, 19 nt, Homo sapiens
ggagaaugcagacaucauc

SEQ ID NO: 1301510 - RNA, 19 nt, Homo sapiens
gauaagcaaggaccucaga

SEQ ID NO: 1301511 - RNA, 19 nt, Homo sapiens
agcagcaacuucucaauga

SEQ ID NO: 1301512 - RNA, 19 nt, Homo sapiens
gauggacgccugcuugcaa

SEQ ID NO: 1301513 - RNA, 19 nt, Homo sapiens
ccacugaggagauaagcaa

SEQ ID NO: 1301514 - RNA, 19 nt, Homo sapiens
gccaacacagcaacaaauu

SEQ ID NO: 1301515 - RNA, 19 nt, Homo sapiens
cagcagcaccagcagauga

SEQ ID NO: 1301516 - RNA, 19 nt, Homo sapiens
uagcaacuuugaacaccaa

SEQ ID NO: 1301517 - RNA, 19 nt, Homo sapiens
gcaacaguccaagcucaaa

SEQ ID NO: 1301518 - RNA, 19 nt, Homo sapiens
ccaaggacgcccugaaucu

SEQ ID NO: 1301519 - RNA, 19 nt, Homo sapiens
gagcugcggcacaagaaug

SEQ ID NO: 1301520 - RNA, 19 nt, Homo sapiens
cagcagcaacuucucaaug

SEQ ID NO: 1301521 - RNA, 19 nt, Homo sapiens
ggacggcuggcaccuuguu

SEQ ID NO: 1301522 - RNA, 19 nt, Homo sapiens
gaagaugugcuggcugaag

SEQ ID NO: 1301523 - RNA, 19 nt, Homo sapiens
cgacaucgccauagcaacu

SEQ ID NO: 1301524 - RNA, 19 nt, Homo sapiens
gcgagcagauccgccugaa

SEQ ID NO: 1301525 - RNA, 19 nt, Homo sapiens
ggucuacucagccaagaau

SEQ ID NO: 1301526 - RNA, 19 nt, Homo sapiens
gcgggagaaugcagacauc

SEQ ID NO: 1301527 - RNA, 19 nt, Homo sapiens
cagcagcaccagcagaaga

SEQ ID NO: 1301528 - RNA, 19 nt, Homo sapiens
cuggagcacucgcguuaug

SEQ ID NO: 1301529 - RNA, 19 nt, Homo sapiens
gacgcuguuugccaagaaa

SEQ ID NO: 1301530 - RNA, 19 nt, Homo sapiens
gauggacacccgcgugcaa

SEQ ID NO: 1301531 - RNA, 19 nt, Homo sapiens
ggccaacacagcaacaaau

SEQ ID NO: 1301532 - RNA, 19 nt, Homo sapiens
acacagcaacaaauucaug

SEQ ID NO: 1301533 - RNA, 19 nt, Homo sapiens
gggccaacacagcaacaaa

SEQ ID NO: 1301534 - RNA, 19 nt, Homo sapiens
agacgcuguuugccaagaa

SEQ ID NO: 1301535 - RNA, 19 nt, Homo sapiens
cagccggucucgucucagu

SEQ ID NO: 1301536 - RNA, 19 nt, Homo sapiens
gccaucaacagccgcauug

SEQ ID NO: 1301537 - RNA, 19 nt, Homo sapiens
ccaacacagcaacaaauuc

SEQ ID NO: 1301538 - RNA, 19 nt, Homo sapiens
ccagggcccaguaucaaga

SEQ ID NO: 1301539 - RNA, 19 nt, Homo sapiens
gcuacgaggaccaacugaa

SEQ ID NO: 1301540 - RNA, 19 nt, Homo sapiens
ggacacccgcgugcaagau

SEQ ID NO: 1301541 - RNA, 19 nt, Homo sapiens
acaaauggagcaacuucga

SEQ ID NO: 1301542 - RNA, 19 nt, Homo sapiens
gggugagacugcauuuuga

SEQ ID NO: 1301543 - RNA, 19 nt, Homo sapiens
cugaggagauaagcaagga

SEQ ID NO: 1301544 - RNA, 19 nt, Homo sapiens
caacaguccaagcucaaag

SEQ ID NO: 1301545 - RNA, 19 nt, Homo sapiens
caaggacgcccugaaucug

SEQ ID NO: 1301546 - RNA, 19 nt, Homo sapiens
guucgacugugccaucaac

SEQ ID NO: 1301547 - RNA, 19 nt, Homo sapiens
cuacgaggaccaacugaag

SEQ ID NO: 1301548 - RNA, 19 nt, Homo sapiens
ggaggaguccgugcagaag

SEQ ID NO: 1301549 - RNA, 19 nt, Homo sapiens
cagccgcauugacgugaug

SEQ ID NO: 1301550 - RNA, 19 nt, Homo sapiens
gcacucaggcauggacuac

SEQ ID NO: 1301551 - RNA, 19 nt, Homo sapiens
acaucgccauagcaacuuu

SEQ ID NO: 1301552 - RNA, 19 nt, Homo sapiens
gcagcagcaacuucucaau

SEQ ID NO: 1301553 - RNA, 19 nt, Homo sapiens
ggaggguguugugcucagu

SEQ ID NO: 1301554 - RNA, 19 nt, Homo sapiens
gucagccggucucgucuca

SEQ ID NO: 1301555 - RNA, 19 nt, Homo sapiens
ggauuccgugccuuuguga

SEQ ID NO: 1301556 - RNA, 19 nt, Homo sapiens
gcugaggagaggaggaaga

SEQ ID NO: 1301557 - RNA, 19 nt, Homo sapiens
ggcccaguaucaagacaag

SEQ ID NO: 1301558 - RNA, 19 nt, Homo sapiens
ucaaugaggagaauuuacg

SEQ ID NO: 1301559 - RNA, 19 nt, Homo sapiens
gagggaagcuucaaaguca

SEQ ID NO: 1301560 - RNA, 19 nt, Homo sapiens
agaaauugcugaucgcaua

SEQ ID NO: 1301561 - RNA, 19 nt, Homo sapiens
aaacagcagugggaaauaa

SEQ ID NO: 1301562 - RNA, 19 nt, Homo sapiens
gauggaggcuaccuacaaa

SEQ ID NO: 1301563 - RNA, 19 nt, Homo sapiens
gcuaaugaaugaaguugaa

SEQ ID NO: 1301564 - RNA, 19 nt, Homo sapiens
gcagaaagcaugucgaugu

SEQ ID NO: 1301565 - RNA, 19 nt, Homo sapiens
gagcagagcaugucacaga

SEQ ID NO: 1301566 - RNA, 19 nt, Homo sapiens
ggagagcucuuugacuuug

SEQ ID NO: 1301567 - RNA, 19 nt, Homo sapiens
ggacugggccaaucaaaug

SEQ ID NO: 1301568 - RNA, 19 nt, Homo sapiens
gaagaacagugcuugacau

SEQ ID NO: 1301569 - RNA, 19 nt, Homo sapiens
aaaggaaguuuauggaaga

SEQ ID NO: 1301570 - RNA, 19 nt, Homo sapiens
gaaaagaggcuguguaugu

SEQ ID NO: 1301571 - RNA, 19 nt, Homo sapiens
gcaaacagaauuauaccuu

SEQ ID NO: 1301572 - RNA, 19 nt, Homo sapiens
ggaaaggaaguuuauggaa

SEQ ID NO: 1301573 - RNA, 19 nt, Homo sapiens
gagauaggauuucuuccau

SEQ ID NO: 1301574 - RNA, 19 nt, Homo sapiens
aaggagagcucuuugacuu

SEQ ID NO: 1301575 - RNA, 19 nt, Homo sapiens
ggaaguaauggaagaagaa

SEQ ID NO: 1301576 - RNA, 19 nt, Homo sapiens
gaaccuaugcauuauggaa

SEQ ID NO: 1301577 - RNA, 19 nt, Homo sapiens
ugaagaaccuaugcauuau

SEQ ID NO: 1301578 - RNA, 19 nt, Homo sapiens
augaagaaccuaugcauua

SEQ ID NO: 1301579 - RNA, 19 nt, Homo sapiens
gaaggguaauucgagguaa

SEQ ID NO: 1301580 - RNA, 19 nt, Homo sapiens
ccgcaggccucaaggauga

SEQ ID NO: 1301581 - RNA, 19 nt, Homo sapiens
gaaacagcagugggaaaua

SEQ ID NO: 1301582 - RNA, 19 nt, Homo sapiens
ccaccaacaccacucuuua

SEQ ID NO: 1301583 - RNA, 19 nt, Homo sapiens
aaagagauauugagauagg

SEQ ID NO: 1301584 - RNA, 19 nt, Homo sapiens
gaccuucucccgucuguuu

SEQ ID NO: 1301585 - RNA, 19 nt, Homo sapiens
gaaauugcugaucgcauaa

SEQ ID NO: 1301586 - RNA, 19 nt, Homo sapiens
cuacaaagaacaacauaug

SEQ ID NO: 1301587 - RNA, 19 nt, Homo sapiens
ccagucagcgugaguauga

SEQ ID NO: 1301588 - RNA, 19 nt, Homo sapiens
aagccaagcuccaccgaaa

SEQ ID NO: 1301589 - RNA, 19 nt, Homo sapiens
caacaccacucuuuauucc

SEQ ID NO: 1301590 - RNA, 19 nt, Homo sapiens
uuccauggcuaaugaauga

SEQ ID NO: 1301591 - RNA, 19 nt, Homo sapiens
gcgugaguaugaagaacua

SEQ ID NO: 1301592 - RNA, 19 nt, Homo sapiens
gaugaagaaccuaugcauu

SEQ ID NO: 1301593 - RNA, 19 nt, Homo sapiens
guaauggacugggccaauc

SEQ ID NO: 1301594 - RNA, 19 nt, Homo sapiens
gaggaagaauugucauagg

SEQ ID NO: 1301595 - RNA, 19 nt, Homo sapiens
caaagaacaacauaugaca

SEQ ID NO: 1301596 - RNA, 19 nt, Homo sapiens
gauauggaaugccaaacag

SEQ ID NO: 1301597 - RNA, 19 nt, Homo sapiens
cagaaagcaugucgaugug

SEQ ID NO: 1301598 - RNA, 19 nt, Homo sapiens
gaagaaccuaugcauuaug

SEQ ID NO: 1301599 - RNA, 19 nt, Homo sapiens
gaacaacauaugacagaag

SEQ ID NO: 1301600 - RNA, 19 nt, Homo sapiens
ggaagaacagugcuugaca

SEQ ID NO: 1301601 - RNA, 19 nt, Homo sapiens
gauaguggcuacuuuuaug

SEQ ID NO: 1301602 - RNA, 19 nt, Homo sapiens
gagcauuugcacagcguua

SEQ ID NO: 1301603 - RNA, 19 nt, Homo sapiens
uaugaagaacuacggaaua

SEQ ID NO: 1301604 - RNA, 19 nt, Homo sapiens
gcaugucgaugugcaaaca

SEQ ID NO: 1301605 - RNA, 19 nt, Homo sapiens
gggaggaagaauugucaua

SEQ ID NO: 1301606 - RNA, 19 nt, Homo sapiens
gcacaacgagacaucacaa

SEQ ID NO: 1301607 - RNA, 19 nt, Homo sapiens
aagaagagcuggcuaaccu

SEQ ID NO: 1301608 - RNA, 19 nt, Homo sapiens
ucaaagucaugaaaccaau

SEQ ID NO: 1301609 - RNA, 19 nt, Homo sapiens
ggagggaagcuucaaaguc

SEQ ID NO: 1301610 - RNA, 19 nt, Homo sapiens
gggaaauaaugcacaagca

SEQ ID NO: 1301611 - RNA, 19 nt, Homo sapiens
gaaguuaaaccaguguuag

SEQ ID NO: 1301612 - RNA, 19 nt, Homo sapiens
aaaagaggcuguguaugua

SEQ ID NO: 1301613 - RNA, 19 nt, Homo sapiens
ugagcagucucuucuggaa

SEQ ID NO: 1301614 - RNA, 19 nt, Homo sapiens
ggucaucccaggaaaggaa

SEQ ID NO: 1301615 - RNA, 19 nt, Homo sapiens
ugaaguuaaaccaguguua

SEQ ID NO: 1301616 - RNA, 19 nt, Homo sapiens
aggaagaauugucauagga

SEQ ID NO: 1301617 - RNA, 19 nt, Homo sapiens
aaacagcaaugaggaaguc

SEQ ID NO: 1301618 - RNA, 19 nt, Homo sapiens
guaauucgagguaacacuu

SEQ ID NO: 1301619 - RNA, 19 nt, Homo sapiens
ggaggaagaauugucauag

SEQ ID NO: 1301620 - RNA, 19 nt, Homo sapiens
ggaggcuaccuacaaagaa

SEQ ID NO: 1301621 - RNA, 19 nt, Homo sapiens
uuucuuccauggcuaauga

SEQ ID NO: 1301622 - RNA, 19 nt, Homo sapiens
uagugaacgugcugaaguu

SEQ ID NO: 1301623 - RNA, 19 nt, Homo sapiens
gagagcucuuugacuuuga

SEQ ID NO: 1301624 - RNA, 19 nt, Homo sapiens
gcaaagccacauuccaaag

SEQ ID NO: 1301625 - RNA, 19 nt, Homo sapiens
cauuauauguaaccagcaa

SEQ ID NO: 1301626 - RNA, 19 nt, Homo sapiens
gaugaagaaacagcaauga

SEQ ID NO: 1301627 - RNA, 19 nt, Homo sapiens
cagggauaguggcuacuuu

SEQ ID NO: 1301628 - RNA, 19 nt, Homo sapiens
gcacaagcacaacgagaca

SEQ ID NO: 1301629 - RNA, 19 nt, Homo sapiens
agauguggccacccaaaua

SEQ ID NO: 1301630 - RNA, 19 nt, Homo sapiens
ccaaucaacagccaaguca

SEQ ID NO: 1301631 - RNA, 19 nt, Homo sapiens
gcugaucgcauaauagaag

SEQ ID NO: 1301632 - RNA, 19 nt, Homo sapiens
ugacgcagccagaugaaga

SEQ ID NO: 1301633 - RNA, 19 nt, Homo sapiens
gaggcuaccuacaaagaac

SEQ ID NO: 1301634 - RNA, 19 nt, Homo sapiens
gcaagcaaucagguaauga

SEQ ID NO: 1301635 - RNA, 19 nt, Homo sapiens
ggauuucuuccauggcuaa

SEQ ID NO: 1301636 - RNA, 19 nt, Homo sapiens
ccaacaccacucuuuauuc

SEQ ID NO: 1301637 - RNA, 19 nt, Homo sapiens
cgaugugcaaacagaauua

SEQ ID NO: 1301638 - RNA, 19 nt, Homo sapiens
gcgcccaccugcuucaaag

SEQ ID NO: 1301639 - RNA, 19 nt, Homo sapiens
cagaaggucaucccaggaa

SEQ ID NO: 1301640 - RNA, 19 nt, Homo sapiens
gaggcgacaccgagaagaa

SEQ ID NO: 1301641 - RNA, 19 nt, Homo sapiens
gaauagugaacgugcugaa

SEQ ID NO: 1301642 - RNA, 19 nt, Homo sapiens
uaaaccaguguuagaaguu

SEQ ID NO: 1301643 - RNA, 19 nt, Homo sapiens
uuaaaccaguguuagaagu

SEQ ID NO: 1301644 - RNA, 19 nt, Homo sapiens
uaauucgagguaacacuua

SEQ ID NO: 1301645 - RNA, 19 nt, Homo sapiens
ccucagguuauagaaauua

SEQ ID NO: 1301646 - RNA, 19 nt, Homo sapiens
ucagcaagcaaucagguaa

SEQ ID NO: 1301647 - RNA, 19 nt, Homo sapiens
aagaaccuaugcauuaugg

SEQ ID NO: 1301648 - RNA, 19 nt, Homo sapiens
gaaacagcaaugaggaagu

SEQ ID NO: 1301649 - RNA, 19 nt, Homo sapiens
aagaacaacauaugacaga

SEQ ID NO: 1301650 - RNA, 19 nt, Homo sapiens
acacaucagucuccagaac

SEQ ID NO: 1301651 - RNA, 19 nt, Homo sapiens
gaaagagauauugagauag

SEQ ID NO: 1301652 - RNA, 19 nt, Homo sapiens
aagaagaagagcuggcuaa

SEQ ID NO: 1301653 - RNA, 19 nt, Homo sapiens
uggaaguaauggaagaaga

SEQ ID NO: 1301654 - RNA, 19 nt, Homo sapiens
aauugcugaucgcauaaua

SEQ ID NO: 1301655 - RNA, 19 nt, Homo sapiens
gcagccagaugaagaaccu

SEQ ID NO: 1301656 - RNA, 19 nt, Homo sapiens
gaaggagagcucuuugacu

SEQ ID NO: 1301657 - RNA, 19 nt, Homo sapiens
agaaggucaucccaggaaa

SEQ ID NO: 1301658 - RNA, 19 nt, Homo sapiens
caauugagcagucucuucu

SEQ ID NO: 1301659 - RNA, 19 nt, Homo sapiens
ggacacuucuggcagcuuu

SEQ ID NO: 1301660 - RNA, 19 nt, Homo sapiens
ccagugcccucaauaaaga

SEQ ID NO: 1301661 - RNA, 19 nt, Homo sapiens
gccaaggccucuucuuuga

SEQ ID NO: 1301662 - RNA, 19 nt, Homo sapiens
ugaccaaacuucagaacaa

SEQ ID NO: 1301663 - RNA, 19 nt, Homo sapiens
gaaccaauuccucuccuuu

SEQ ID NO: 1301664 - RNA, 19 nt, Homo sapiens
ggacgaguaugagaaguuc

SEQ ID NO: 1301665 - RNA, 19 nt, Homo sapiens
uaagaagaauggauuguac

SEQ ID NO: 1301666 - RNA, 19 nt, Homo sapiens
gagcaagcaggcuaaguuu

SEQ ID NO: 1301667 - RNA, 19 nt, Homo sapiens
cagcaggacuuccagaaca

SEQ ID NO: 1301668 - RNA, 19 nt, Homo sapiens
gcgccaaggccucuucuuu

SEQ ID NO: 1301669 - RNA, 19 nt, Homo sapiens
caaggccucuucuuugaca

SEQ ID NO: 1301670 - RNA, 19 nt, Homo sapiens
gaccaaacuucagaacaau

SEQ ID NO: 1301671 - RNA, 19 nt, Homo sapiens
gcugguggguguuccauca

SEQ ID NO: 1301672 - RNA, 19 nt, Homo sapiens
gagagcauccucaucaaca

SEQ ID NO: 1301673 - RNA, 19 nt, Homo sapiens
ugacauggaggccuauuug

SEQ ID NO: 1301674 - RNA, 19 nt, Homo sapiens
cacaggagcuggagaacca

SEQ ID NO: 1301675 - RNA, 19 nt, Homo sapiens
uggaggagcugaccaaacu

SEQ ID NO: 1301676 - RNA, 19 nt, Homo sapiens
gggcuucuguccugugugu

SEQ ID NO: 1301677 - RNA, 19 nt, Homo sapiens
ccaaacuucagaacaauug

SEQ ID NO: 1301678 - RNA, 19 nt, Homo sapiens
gcccagugcccucaauaaa

SEQ ID NO: 1301679 - RNA, 19 nt, Homo sapiens
caacggcucccggaucaaa

SEQ ID NO: 1301680 - RNA, 19 nt, Homo sapiens
gggagagcauccucaucaa

SEQ ID NO: 1301681 - RNA, 19 nt, Homo sapiens
auaaagagaggcccagaaa

SEQ ID NO: 1301682 - RNA, 19 nt, Homo sapiens
ucaccuuccugcugccuuu

SEQ ID NO: 1301683 - RNA, 19 nt, Homo sapiens
ggucucauguaccagaaau

SEQ ID NO: 1301684 - RNA, 19 nt, Homo sapiens
ugacagaugcugccuucaa

SEQ ID NO: 1301685 - RNA, 19 nt, Homo sapiens
cuaagaagaauggauugua

SEQ ID NO: 1301686 - RNA, 19 nt, Homo sapiens
ccuauuugccuaagaagaa

SEQ ID NO: 1301687 - RNA, 19 nt, Homo sapiens
gacagaugcugccuucaac

SEQ ID NO: 1301688 - RNA, 19 nt, Homo sapiens
ugagcaagcaggcuaaguu

SEQ ID NO: 1301689 - RNA, 19 nt, Homo sapiens
gguggguguuccaucacua

SEQ ID NO: 1301690 - RNA, 19 nt, Homo sapiens
aacaacggcucccggauca

SEQ ID NO: 1301691 - RNA, 19 nt, Homo sapiens
uggagaaccagaugaaaga

SEQ ID NO: 1301692 - RNA, 19 nt, Homo sapiens
ucuauucucccuuggguuu

SEQ ID NO: 1301693 - RNA, 19 nt, Homo sapiens
ugcaguuucuccaguacua

SEQ ID NO: 1301694 - RNA, 19 nt, Homo sapiens
gcccgacggucucauguac

SEQ ID NO: 1301695 - RNA, 19 nt, Homo sapiens
cgggagagcauccucauca

SEQ ID NO: 1301696 - RNA, 19 nt, Homo sapiens
ccuacaaggacgaguauga

SEQ ID NO: 1301697 - RNA, 19 nt, Homo sapiens
cgccaaggccucuucuuug

SEQ ID NO: 1301698 - RNA, 19 nt, Homo sapiens
ggacugggaggaucuacag

SEQ ID NO: 1301699 - RNA, 19 nt, Homo sapiens
gaggagcugaccaaacuuc

SEQ ID NO: 1301700 - RNA, 19 nt, Homo sapiens
ugugggcccugaaggaaga

SEQ ID NO: 1301701 - RNA, 19 nt, Homo sapiens
acaaggacgaguaugagaa

SEQ ID NO: 1301702 - RNA, 19 nt, Homo sapiens
ggcccagugcccucaauaa

SEQ ID NO: 1301703 - RNA, 19 nt, Homo sapiens
gugcuuaugugcggcuuuc

SEQ ID NO: 1301704 - RNA, 19 nt, Homo sapiens
ggagacccaucggcucuac

SEQ ID NO: 1301705 - RNA, 19 nt, Homo sapiens
caaggacgaguaugagaag

SEQ ID NO: 1301706 - RNA, 19 nt, Homo sapiens
cagaaauuccggaaccaau

SEQ ID NO: 1301707 - RNA, 19 nt, Homo sapiens
agagcauccucaucaacaa

SEQ ID NO: 1301708 - RNA, 19 nt, Homo sapiens
augagaaguucaagcucua

SEQ ID NO: 1301709 - RNA, 19 nt, Homo sapiens
cagaugcugccuucaacuu

SEQ ID NO: 1301710 - RNA, 19 nt, Homo sapiens
gcugugggcccugaaggaa

SEQ ID NO: 1301711 - RNA, 19 nt, Homo sapiens
gcaccacaaguuucacagu

SEQ ID NO: 1301712 - RNA, 19 nt, Homo sapiens
ucgugcaguuucuccagua

SEQ ID NO: 1301713 - RNA, 19 nt, Homo sapiens
ccagagcuucgugcaguuu

SEQ ID NO: 1301714 - RNA, 19 nt, Homo sapiens
ggagagcauccucaucaac

SEQ ID NO: 1301715 - RNA, 19 nt, Homo sapiens
ccaucacgcggcagaagaa

SEQ ID NO: 1301716 - RNA, 19 nt, Homo sapiens
gcuucuguccuguguguug

SEQ ID NO: 1301717 - RNA, 19 nt, Homo sapiens
ugaaauaacucucaagcaa

SEQ ID NO: 1301718 - RNA, 19 nt, Homo sapiens
ugucauagcuccaaacauu

SEQ ID NO: 1301719 - RNA, 19 nt, Homo sapiens
cgagagcuguaaauaaaua

SEQ ID NO: 1301720 - RNA, 19 nt, Homo sapiens
gaaacgagagcuguaaaua

SEQ ID NO: 1301721 - RNA, 19 nt, Homo sapiens
caaaguauguugcauucuu

SEQ ID NO: 1301722 - RNA, 19 nt, Homo sapiens
gaaauaacucucaagcaaa

SEQ ID NO: 1301723 - RNA, 19 nt, Homo sapiens
caauggccaugccuaauaa

SEQ ID NO: 1301724 - RNA, 19 nt, Homo sapiens
aacgagagcuguaaauaaa

SEQ ID NO: 1301725 - RNA, 19 nt, Homo sapiens
acagguagcuacuagguuu

SEQ ID NO: 1301726 - RNA, 19 nt, Homo sapiens
gggugucacuggccuguua

SEQ ID NO: 1301727 - RNA, 19 nt, Homo sapiens
uaaggagugugucagcaua

SEQ ID NO: 1301728 - RNA, 19 nt, Homo sapiens
aaacgagagcuguaaauaa

SEQ ID NO: 1301729 - RNA, 19 nt, Homo sapiens
cuacguggcuuagugguaa

SEQ ID NO: 1301730 - RNA, 19 nt, Homo sapiens
auaaagaggucagccuuaa

SEQ ID NO: 1301731 - RNA, 19 nt, Homo sapiens
auacucagaugaaccuuaa

SEQ ID NO: 1301732 - RNA, 19 nt, Homo sapiens
gaaguuggauugucaaacc

SEQ ID NO: 1301733 - RNA, 19 nt, Homo sapiens
aauagcagauacagacuuu

SEQ ID NO: 1301734 - RNA, 19 nt, Homo sapiens
gaagguccccugccauuua

SEQ ID NO: 1301735 - RNA, 19 nt, Homo sapiens
gcucuucuauuucuaugga

SEQ ID NO: 1301736 - RNA, 19 nt, Homo sapiens
gaacacacaggaagacaca

SEQ ID NO: 1301737 - RNA, 19 nt, Homo sapiens
acaauggccaugccuaaua

SEQ ID NO: 1301738 - RNA, 19 nt, Homo sapiens
caugacaucuccuuuaggu

SEQ ID NO: 1301739 - RNA, 19 nt, Homo sapiens
ccaaagcccugcagguucu

SEQ ID NO: 1301740 - RNA, 19 nt, Homo sapiens
ggaagaaaugcuuauaaag

SEQ ID NO: 1301741 - RNA, 19 nt, Homo sapiens
guccaucucugcaccuuga

SEQ ID NO: 1301742 - RNA, 19 nt, Homo sapiens
ugacugagaccacuacaau

SEQ ID NO: 1301743 - RNA, 19 nt, Homo sapiens
agacacagguagcuacuag

SEQ ID NO: 1301744 - RNA, 19 nt, Homo sapiens
gcuccuacguggcuuagug

SEQ ID NO: 1301745 - RNA, 19 nt, Homo sapiens
ggucuaaugugccgcucuu

SEQ ID NO: 1301746 - RNA, 19 nt, Homo sapiens
ccauuuaauugaucgucua

SEQ ID NO: 1301747 - RNA, 19 nt, Homo sapiens
caacauaauagcagauaca

SEQ ID NO: 1301748 - RNA, 19 nt, Homo sapiens
uaaaugucauagcuccaaa

SEQ ID NO: 1301749 - RNA, 19 nt, Homo sapiens
uauaaagaggucagccuua

SEQ ID NO: 1301750 - RNA, 19 nt, Homo sapiens
guccaugacaucuccuuua

SEQ ID NO: 1301751 - RNA, 19 nt, Homo sapiens
gcccagguguggugaagug

SEQ ID NO: 1301752 - RNA, 19 nt, Homo sapiens
aaaccuaaaugucauagcu

SEQ ID NO: 1301753 - RNA, 19 nt, Homo sapiens
uaaagaggucagccuuaaa

SEQ ID NO: 1301754 - RNA, 19 nt, Homo sapiens
gcacacgcucacauuggua

SEQ ID NO: 1301755 - RNA, 19 nt, Homo sapiens
ccucugccauucaugagaa

SEQ ID NO: 1301756 - RNA, 19 nt, Homo sapiens
aaugugaccugaagaagag

SEQ ID NO: 1301757 - RNA, 19 nt, Homo sapiens
cauaaugugaccugaagaa

SEQ ID NO: 1301758 - RNA, 19 nt, Homo sapiens
cuacaauggccaugccuaa

SEQ ID NO: 1301759 - RNA, 19 nt, Homo sapiens
cagguucuguugcuucuuc

SEQ ID NO: 1301760 - RNA, 19 nt, Homo sapiens
uaaugugaccugaagaaga

SEQ ID NO: 1301761 - RNA, 19 nt, Homo sapiens
cuaaugugccgcucuucua

SEQ ID NO: 1301762 - RNA, 19 nt, Homo sapiens
cuacaccaauacucagaug

SEQ ID NO: 1301763 - RNA, 19 nt, Homo sapiens
gguuguauguugaaauaac

SEQ ID NO: 1301764 - RNA, 19 nt, Homo sapiens
ugauauaaguaaggaggaa

SEQ ID NO: 1301765 - RNA, 19 nt, Homo sapiens
gauacagacuuuuaagcuu

SEQ ID NO: 1301766 - RNA, 19 nt, Homo sapiens
gaucgucuacagugggauu

SEQ ID NO: 1301767 - RNA, 19 nt, Homo sapiens
cacaugcugucgucucuca

SEQ ID NO: 1301768 - RNA, 19 nt, Homo sapiens
gagugugucagcauaaugu

SEQ ID NO: 1301769 - RNA, 19 nt, Homo sapiens
acagacccgugcccucuug

SEQ ID NO: 1301770 - RNA, 19 nt, Homo sapiens
cagguguggugaagugaau

SEQ ID NO: 1301771 - RNA, 19 nt, Homo sapiens
guaaggaggaaaagcauuu

SEQ ID NO: 1301772 - RNA, 19 nt, Homo sapiens
acaccaauacucagaugaa

SEQ ID NO: 1301773 - RNA, 19 nt, Homo sapiens
ccaaacaaagguacacaag

SEQ ID NO: 1301774 - RNA, 19 nt, Homo sapiens
uccaugacaucuccuuuag

SEQ ID NO: 1301775 - RNA, 19 nt, Homo sapiens
gaccgaacacacaggaaga

SEQ ID NO: 1301776 - RNA, 19 nt, Homo sapiens
gugccgcucuucuauuucu

SEQ ID NO: 1301777 - RNA, 19 nt, Homo sapiens
uagcagauacagacuuuua

SEQ ID NO: 1301778 - RNA, 19 nt, Homo sapiens
gauauaaguaaggaggaaa

SEQ ID NO: 1301779 - RNA, 19 nt, Homo sapiens
accaaaguauguugcauuc

SEQ ID NO: 1301780 - RNA, 19 nt, Homo sapiens
cgucuacagugggauuuau

SEQ ID NO: 1301781 - RNA, 19 nt, Homo sapiens
ccuccuaccucugccauuc

SEQ ID NO: 1301782 - RNA, 19 nt, Homo sapiens
uaaugugccgcucuucuau

SEQ ID NO: 1301783 - RNA, 19 nt, Homo sapiens
uaucuggaagaaaugcuua

SEQ ID NO: 1301784 - RNA, 19 nt, Homo sapiens
uaccaaaguauguugcauu

SEQ ID NO: 1301785 - RNA, 19 nt, Homo sapiens
ggagugugucagcauaaug

SEQ ID NO: 1301786 - RNA, 19 nt, Homo sapiens
aguaaugcuuccagccaaa

SEQ ID NO: 1301787 - RNA, 19 nt, Homo sapiens
gcuagggcaccaggaguaa

SEQ ID NO: 1301788 - RNA, 19 nt, Homo sapiens
augugccgcucuucuauuu

SEQ ID NO: 1301789 - RNA, 19 nt, Homo sapiens
cuggaagaaaugcuuauaa

SEQ ID NO: 1301790 - RNA, 19 nt, Homo sapiens
ugaaacgagagcuguaaau

SEQ ID NO: 1301791 - RNA, 19 nt, Homo sapiens
ggcuagggcaccaggagua

SEQ ID NO: 1301792 - RNA, 19 nt, Homo sapiens
gacaucuccuuuagguagu

SEQ ID NO: 1301793 - RNA, 19 nt, Homo sapiens
gaagacacagguagcuacu

SEQ ID NO: 1301794 - RNA, 19 nt, Homo sapiens
acacaggaagacacaggua

SEQ ID NO: 1301795 - RNA, 19 nt, Homo sapiens
caaggucuccggcacacau

SEQ ID NO: 1301796 - RNA, 19 nt, Homo sapiens
cagcauaaugugaccugaa

SEQ ID NO: 1301797 - RNA, 19 nt, Homo sapiens
cuaccucugccauucauga

SEQ ID NO: 1301798 - RNA, 19 nt, Homo sapiens
gaccucuccugagcuccua

SEQ ID NO: 1301799 - RNA, 19 nt, Homo sapiens
ggucuccggcacacauuga

SEQ ID NO: 1301800 - RNA, 19 nt, Homo sapiens
ccaccucuggccaaacaaa

SEQ ID NO: 1301801 - RNA, 19 nt, Homo sapiens
ugagaacugugaggacucu

SEQ ID NO: 1301802 - RNA, 19 nt, Homo sapiens
cauuucagguccaugacau

SEQ ID NO: 1301803 - RNA, 19 nt, Homo sapiens
aaagaggucagccuuaaaa

SEQ ID NO: 1301804 - RNA, 19 nt, Homo sapiens
gcuuaaaaccuaaauguca

SEQ ID NO: 1301805 - RNA, 19 nt, Homo sapiens
gucauagcuccaaacauuu

SEQ ID NO: 1301806 - RNA, 19 nt, Homo sapiens
ucuacagugggauuuauuu

SEQ ID NO: 1301807 - RNA, 19 nt, Homo sapiens
aauacucagaugaaccuua

SEQ ID NO: 1301808 - RNA, 19 nt, Homo sapiens
cuaaaugucauagcuccaa

SEQ ID NO: 1301809 - RNA, 19 nt, Homo sapiens
gugggugucugggugucua

SEQ ID NO: 1301810 - RNA, 19 nt, Homo sapiens
gaaacaggugcaggugugu

SEQ ID NO: 1301811 - RNA, 19 nt, Homo sapiens
ggacaggacaaggacucaa

SEQ ID NO: 1301812 - RNA, 19 nt, Homo sapiens
ccauucaugagaacuguga

SEQ ID NO: 1301813 - RNA, 19 nt, Homo sapiens
uaauagcagauacagacuu

SEQ ID NO: 1301814 - RNA, 19 nt, Homo sapiens
aaacaggugcaggugugua

SEQ ID NO: 1301815 - RNA, 19 nt, Homo sapiens
gccaaacaaagguacacaa

SEQ ID NO: 1301816 - RNA, 19 nt, Homo sapiens
ucccaaagcccugcagguu

SEQ ID NO: 1301817 - RNA, 19 nt, Homo sapiens
aaacagggcuccuccuuua

SEQ ID NO: 1301818 - RNA, 19 nt, Homo sapiens
gcaauuagagaccuuauaa

SEQ ID NO: 1301819 - RNA, 19 nt, Homo sapiens
auacugagauggcauauuu

SEQ ID NO: 1301820 - RNA, 19 nt, Homo sapiens
gaaugggcuucaaguauuu

SEQ ID NO: 1301821 - RNA, 19 nt, Homo sapiens
gaucucaucuguguauuau

SEQ ID NO: 1301822 - RNA, 19 nt, Homo sapiens
aaucuaggcuuacauuuga

SEQ ID NO: 1301823 - RNA, 19 nt, Homo sapiens
cggacaagcuaacuucuaa

SEQ ID NO: 1301824 - RNA, 19 nt, Homo sapiens
ugagauggcauauuuauug

SEQ ID NO: 1301825 - RNA, 19 nt, Homo sapiens
gcugugaucuuuacaacga

SEQ ID NO: 1301826 - RNA, 19 nt, Homo sapiens
caagcuaacuucuaaggau

SEQ ID NO: 1301827 - RNA, 19 nt, Homo sapiens
gaguugggcugugaucuuu

SEQ ID NO: 1301828 - RNA, 19 nt, Homo sapiens
gugaaagaguggagauaaa

SEQ ID NO: 1301829 - RNA, 19 nt, Homo sapiens
acacaagacuaaagaugaa

SEQ ID NO: 1301830 - RNA, 19 nt, Homo sapiens
gcagaaucacuauggauaa

SEQ ID NO: 1301831 - RNA, 19 nt, Homo sapiens
gagguuaagagugcaauua

SEQ ID NO: 1301832 - RNA, 19 nt, Homo sapiens
gagauggcauauuuauugu

SEQ ID NO: 1301833 - RNA, 19 nt, Homo sapiens
gacuaaagaugaagaagag

SEQ ID NO: 1301834 - RNA, 19 nt, Homo sapiens
ccagacauuggaccuauua

SEQ ID NO: 1301835 - RNA, 19 nt, Homo sapiens
aguccaagguacuguguua

SEQ ID NO: 1301836 - RNA, 19 nt, Homo sapiens
gcuccagaauuuauauguu

SEQ ID NO: 1301837 - RNA, 19 nt, Homo sapiens
ccuaauguauuugguacua

SEQ ID NO: 1301838 - RNA, 19 nt, Homo sapiens
ggcagaaucacuauggaua

SEQ ID NO: 1301839 - RNA, 19 nt, Homo sapiens
gguuaagagugcaauuaga

SEQ ID NO: 1301840 - RNA, 19 nt, Homo sapiens
aauauugccuguggucuuu

SEQ ID NO: 1301841 - RNA, 19 nt, Homo sapiens
gaguggagauaaaagaaua

SEQ ID NO: 1301842 - RNA, 19 nt, Homo sapiens
ccaagguacuguguuauag

SEQ ID NO: 1301843 - RNA, 19 nt, Homo sapiens
ccuguggucuuuccauuug

SEQ ID NO: 1301844 - RNA, 19 nt, Homo sapiens
cgaauccacacaagacuaa

SEQ ID NO: 1301845 - RNA, 19 nt, Homo sapiens
aauagaaaccgguggguaa

SEQ ID NO: 1301846 - RNA, 19 nt, Homo sapiens
ugaaauggaugaguucucu

SEQ ID NO: 1301847 - RNA, 19 nt, Homo sapiens
cagaaucacuauggauaau

SEQ ID NO: 1301848 - RNA, 19 nt, Homo sapiens
ucaaaucuaggcuuacauu

SEQ ID NO: 1301849 - RNA, 19 nt, Homo sapiens
ugucucauguguacgcaua

SEQ ID NO: 1301850 - RNA, 19 nt, Homo sapiens
gcuccuccuuuacaauuga

SEQ ID NO: 1301851 - RNA, 19 nt, Homo sapiens
gacauuggaccuauuagug

SEQ ID NO: 1301852 - RNA, 19 nt, Homo sapiens
ccgaagaguugggcuguga

SEQ ID NO: 1301853 - RNA, 19 nt, Homo sapiens
uguaaagguuucucuguca

SEQ ID NO: 1301854 - RNA, 19 nt, Homo sapiens
cauaacauuuacuccuuug

SEQ ID NO: 1301855 - RNA, 19 nt, Homo sapiens
acaacaagcccagcucuaa

SEQ ID NO: 1301856 - RNA, 19 nt, Homo sapiens
guacuguguuauagcauca

SEQ ID NO: 1301857 - RNA, 19 nt, Homo sapiens
ggaagaagagacccaccuu

SEQ ID NO: 1301858 - RNA, 19 nt, Homo sapiens
ccuacuauauuccucaaau

SEQ ID NO: 1301859 - RNA, 19 nt, Homo sapiens
gaauaaucgagucaaguga

SEQ ID NO: 1301860 - RNA, 19 nt, Homo sapiens
caacaagcccagcucuaau

SEQ ID NO: 1301861 - RNA, 19 nt, Homo sapiens
ccagaugacucuugguaac

SEQ ID NO: 1301862 - RNA, 19 nt, Homo sapiens
aagcuaacuucuaaggauu

SEQ ID NO: 1301863 - RNA, 19 nt, Homo sapiens
cuccagaauuuauauguug

SEQ ID NO: 1301864 - RNA, 19 nt, Homo sapiens
gugcccaucucauaucaau

SEQ ID NO: 1301865 - RNA, 19 nt, Homo sapiens
uaaucacacuccagaagau

SEQ ID NO: 1301866 - RNA, 19 nt, Homo sapiens
gggcuccuccuuuacaauu

SEQ ID NO: 1301867 - RNA, 19 nt, Homo sapiens
guaaagguuucucugucau

SEQ ID NO: 1301868 - RNA, 19 nt, Homo sapiens
cuugugaucucaucugugu

SEQ ID NO: 1301869 - RNA, 19 nt, Homo sapiens
uggcauauuuauuguggaa

SEQ ID NO: 1301870 - RNA, 19 nt, Homo sapiens
ggacuucccagugucuaaa

SEQ ID NO: 1301871 - RNA, 19 nt, Homo sapiens
cacacaagacuaaagauga

SEQ ID NO: 1301872 - RNA, 19 nt, Homo sapiens
cuauauuccucaaaucuag

SEQ ID NO: 1301873 - RNA, 19 nt, Homo sapiens
agauaugucucauguguac

SEQ ID NO: 1301874 - RNA, 19 nt, Homo sapiens
ggcuucaaguauuucguua

SEQ ID NO: 1301875 - RNA, 19 nt, Homo sapiens
ccacacaagacuaaagaug

SEQ ID NO: 1301876 - RNA, 19 nt, Homo sapiens
uaaaugccccugugugaua

SEQ ID NO: 1301877 - RNA, 19 nt, Homo sapiens
guguaugaaccgagaauaa

SEQ ID NO: 1301878 - RNA, 19 nt, Homo sapiens
augugucgcuccagaauuu

SEQ ID NO: 1301879 - RNA, 19 nt, Homo sapiens
auaaucgagucaagugaaa

SEQ ID NO: 1301880 - RNA, 19 nt, Homo sapiens
cuucuaaggauuaugagua

SEQ ID NO: 1301881 - RNA, 19 nt, Homo sapiens
caccagacauuggaccuau

SEQ ID NO: 1301882 - RNA, 19 nt, Homo sapiens
ccucaaaucuaggcuuaca

SEQ ID NO: 1301883 - RNA, 19 nt, Homo sapiens
cgagaauaaucgagucaag

SEQ ID NO: 1301884 - RNA, 19 nt, Homo sapiens
agacaaaacucugaauaga

SEQ ID NO: 1301885 - RNA, 19 nt, Homo sapiens
gcuaacuucuaaggauuau

SEQ ID NO: 1301886 - RNA, 19 nt, Homo sapiens
gcggacaagcuaacuucua

SEQ ID NO: 1301887 - RNA, 19 nt, Homo sapiens
aaagaacucaauggaagua

SEQ ID NO: 1301888 - RNA, 19 nt, Homo sapiens
aagcccagcucuaaucaca

SEQ ID NO: 1301889 - RNA, 19 nt, Homo sapiens
agacuaaagaugaagaaga

SEQ ID NO: 1301890 - RNA, 19 nt, Homo sapiens
ucacuuuguagucacuuua

SEQ ID NO: 1301891 - RNA, 19 nt, Homo sapiens
guaauucgacucaucuuuu

SEQ ID NO: 1301892 - RNA, 19 nt, Homo sapiens
ugacaccuguggcuggaau

SEQ ID NO: 1301893 - RNA, 19 nt, Homo sapiens
ugaagaagaggacaacaag

SEQ ID NO: 1301894 - RNA, 19 nt, Homo sapiens
uuccucaaaucuaggcuua

SEQ ID NO: 1301895 - RNA, 19 nt, Homo sapiens
gacaacaagcccagcucua

SEQ ID NO: 1301896 - RNA, 19 nt, Homo sapiens
caucagucuuucccagaga

SEQ ID NO: 1301897 - RNA, 19 nt, Homo sapiens
cuucaaguauuucguuagu

SEQ ID NO: 1301898 - RNA, 19 nt, Homo sapiens
ggcauuagaaauaguacaa

SEQ ID NO: 1301899 - RNA, 19 nt, Homo sapiens
gggcugugaucuuuacaac

SEQ ID NO: 1301900 - RNA, 19 nt, Homo sapiens
agaauaaucgagucaagug

SEQ ID NO: 1301901 - RNA, 19 nt, Homo sapiens
gagaauaaucgagucaagu

SEQ ID NO: 1301902 - RNA, 19 nt, Homo sapiens
aaagguuucucugucauca

SEQ ID NO: 1301903 - RNA, 19 nt, Homo sapiens
gcccaucucauaucaauac

SEQ ID NO: 1301904 - RNA, 19 nt, Homo sapiens
ugaucucaucuguguauua

SEQ ID NO: 1301905 - RNA, 19 nt, Homo sapiens
uccaagguacuguguuaua

SEQ ID NO: 1301906 - RNA, 19 nt, Homo sapiens
gagaacacagcaacaaggu

SEQ ID NO: 1301907 - RNA, 19 nt, Homo sapiens
uagaggacacuguauuugu

SEQ ID NO: 1301908 - RNA, 19 nt, Homo sapiens
cauuagaggacacuguauu

SEQ ID NO: 1301909 - RNA, 19 nt, Homo sapiens
cagaagauaacuagucuac

SEQ ID NO: 1301910 - RNA, 19 nt, Homo sapiens
ggacuuugggaggagguua

SEQ ID NO: 1301911 - RNA, 19 nt, Homo sapiens
ccugugugauagaauuaaa

SEQ ID NO: 1301912 - RNA, 19 nt, Homo sapiens
caauauugccuguggucuu

SEQ ID NO: 1301913 - RNA, 19 nt, Homo sapiens
cuacuauauuccucaaauc

SEQ ID NO: 1301914 - RNA, 19 nt, Homo sapiens
ccgggcaucuugaaaugga

SEQ ID NO: 1301915 - RNA, 19 nt, Homo sapiens
ccagagacagauugaacuu

SEQ ID NO: 1301916 - RNA, 19 nt, Homo sapiens
agaaggguaagcuguguuu

SEQ ID NO: 1301917 - RNA, 19 nt, Homo sapiens
ggaagcagcugccaugauu

SEQ ID NO: 1301918 - RNA, 19 nt, Homo sapiens
caaaguggauccaguguca

SEQ ID NO: 1301919 - RNA, 19 nt, Homo sapiens
ccagagaggugcuguuuca

SEQ ID NO: 1301920 - RNA, 19 nt, Homo sapiens
gcuccagccuauucaauuu

SEQ ID NO: 1301921 - RNA, 19 nt, Homo sapiens
gcaauuuagugguuaagga

SEQ ID NO: 1301922 - RNA, 19 nt, Homo sapiens
gcacucugcuccucuugaa

SEQ ID NO: 1301923 - RNA, 19 nt, Homo sapiens
ggaggcaauuuagugguua

SEQ ID NO: 1301924 - RNA, 19 nt, Homo sapiens
gcagaagucaggaaaguug

SEQ ID NO: 1301925 - RNA, 19 nt, Homo sapiens
caaguuaugugccaucuac

SEQ ID NO: 1301926 - RNA, 19 nt, Homo sapiens
gcagcugccaugauuauaa

SEQ ID NO: 1301927 - RNA, 19 nt, Homo sapiens
caggaaaguugcucaagga

SEQ ID NO: 1301928 - RNA, 19 nt, Homo sapiens
ccaaugcugugacaaagug

SEQ ID NO: 1301929 - RNA, 19 nt, Homo sapiens
caacaucauucugcaacaa

SEQ ID NO: 1301930 - RNA, 19 nt, Homo sapiens
gaaacuaggcaacaacauc

SEQ ID NO: 1301931 - RNA, 19 nt, Homo sapiens
ucaaggagcuauggcgauu

SEQ ID NO: 1301932 - RNA, 19 nt, Homo sapiens
ccaaaucccauccugguuu

SEQ ID NO: 1301933 - RNA, 19 nt, Homo sapiens
gaggugcuguuucagagaa

SEQ ID NO: 1301934 - RNA, 19 nt, Homo sapiens
cauaugguaguucaaguua

SEQ ID NO: 1301935 - RNA, 19 nt, Homo sapiens
uaugguaguucaaguuaug

SEQ ID NO: 1301936 - RNA, 19 nt, Homo sapiens
gaagcagcugccaugauua

SEQ ID NO: 1301937 - RNA, 19 nt, Homo sapiens
ugagauagauacggcagaa

SEQ ID NO: 1301938 - RNA, 19 nt, Homo sapiens
gaggcaauuuagugguuaa

SEQ ID NO: 1301939 - RNA, 19 nt, Homo sapiens
aguggcagcuuggugauua

SEQ ID NO: 1301940 - RNA, 19 nt, Homo sapiens
cagagaaacuaggcaacaa

SEQ ID NO: 1301941 - RNA, 19 nt, Homo sapiens
ggccuuggaugucuuaugg

SEQ ID NO: 1301942 - RNA, 19 nt, Homo sapiens
gguuaaggaugaaguuucu

SEQ ID NO: 1301943 - RNA, 19 nt, Homo sapiens
gcauaugguaguucaaguu

SEQ ID NO: 1301944 - RNA, 19 nt, Homo sapiens
ucaaaucauuggccaacug

SEQ ID NO: 1301945 - RNA, 19 nt, Homo sapiens
uaacaggaauagucagcau

SEQ ID NO: 1301946 - RNA, 19 nt, Homo sapiens
cugccaggcucaaaucauu

SEQ ID NO: 1301947 - RNA, 19 nt, Homo sapiens
auagucagcauuucacaua

SEQ ID NO: 1301948 - RNA, 19 nt, Homo sapiens
ggacccagcagaaucaaag

SEQ ID NO: 1301949 - RNA, 19 nt, Homo sapiens
agagagaaaugcaaaagaa

SEQ ID NO: 1301950 - RNA, 19 nt, Homo sapiens
agucagcauuucacauaaa

SEQ ID NO: 1301951 - RNA, 19 nt, Homo sapiens
gagcgagggccuuggaugu

SEQ ID NO: 1301952 - RNA, 19 nt, Homo sapiens
cggaggcaauuuagugguu

SEQ ID NO: 1301953 - RNA, 19 nt, Homo sapiens
aaacuaggcaacaacauca

SEQ ID NO: 1301954 - RNA, 19 nt, Homo sapiens
gagaaacuaggcaacaaca

SEQ ID NO: 1301955 - RNA, 19 nt, Homo sapiens
acaggaauagucagcauuu

SEQ ID NO: 1301956 - RNA, 19 nt, Homo sapiens
cggcagaagucaggaaagu

SEQ ID NO: 1301957 - RNA, 19 nt, Homo sapiens
caacaacaucauucugcaa

SEQ ID NO: 1301958 - RNA, 19 nt, Homo sapiens
uagucagcauuucacauaa

SEQ ID NO: 1301959 - RNA, 19 nt, Homo sapiens
caaaucccauccugguuuu

SEQ ID NO: 1301960 - RNA, 19 nt, Homo sapiens
agugucagcuccagccuau

SEQ ID NO: 1301961 - RNA, 19 nt, Homo sapiens
cagcugccaugauuauaac

SEQ ID NO: 1301962 - RNA, 19 nt, Homo sapiens
caugagaacauuggcagaa

SEQ ID NO: 1301963 - RNA, 19 nt, Homo sapiens
gcgagggccuuggaugucu

SEQ ID NO: 1301964 - RNA, 19 nt, Homo sapiens
caauuuagugguuaaggau

SEQ ID NO: 1301965 - RNA, 19 nt, Homo sapiens
gcagcuuggugauuaucca

SEQ ID NO: 1301966 - RNA, 19 nt, Homo sapiens
gaauagucagcauuucaca

SEQ ID NO: 1301967 - RNA, 19 nt, Homo sapiens
gagggccuuggaugucuua

SEQ ID NO: 1301968 - RNA, 19 nt, Homo sapiens
gcagaaaagaccaaaggaa

SEQ ID NO: 1301969 - RNA, 19 nt, Homo sapiens
aagcagcugccaugauuau

SEQ ID NO: 1301970 - RNA, 19 nt, Homo sapiens
aaucggaggcaauuuagug

SEQ ID NO: 1301971 - RNA, 19 nt, Homo sapiens
ggaauagucagcauuucac

SEQ ID NO: 1301972 - RNA, 19 nt, Homo sapiens
ggugcacucugcuccucuu

SEQ ID NO: 1301973 - RNA, 19 nt, Homo sapiens
gauagauacggcagaaguc

SEQ ID NO: 1301974 - RNA, 19 nt, Homo sapiens
agagaggugcuguuucaga

SEQ ID NO: 1301975 - RNA, 19 nt, Homo sapiens
gagaaaugcaaaagaagaa

SEQ ID NO: 1301976 - RNA, 19 nt, Homo sapiens
ccucuugaagcauauggua

SEQ ID NO: 1301977 - RNA, 19 nt, Homo sapiens
caauacaugagauagauac

SEQ ID NO: 1301978 - RNA, 19 nt, Homo sapiens
ugucagcuccagccuauuc

SEQ ID NO: 1301979 - RNA, 19 nt, Homo sapiens
aauuaaccuugaagagaga

SEQ ID NO: 1301980 - RNA, 19 nt, Homo sapiens
ugagaacauuggcagaaaa

SEQ ID NO: 1301981 - RNA, 19 nt, Homo sapiens
augagaacauuggcagaaa

SEQ ID NO: 1301982 - RNA, 19 nt, Homo sapiens
aaccagagaggugcuguuu

SEQ ID NO: 1301983 - RNA, 19 nt, Homo sapiens
caggaauagucagcauuuc

SEQ ID NO: 1301984 - RNA, 19 nt, Homo sapiens
ucagagaaacuaggcaaca

SEQ ID NO: 1301985 - RNA, 19 nt, Homo sapiens
gccaugauuauaacaauac

SEQ ID NO: 1301986 - RNA, 19 nt, Homo sapiens
uugaagagagaaaugcaaa

SEQ ID NO: 1301987 - RNA, 19 nt, Homo sapiens
cagaaaagaccaaaggaau

SEQ ID NO: 1301988 - RNA, 19 nt, Homo sapiens
cagaauaugucacaaugua

SEQ ID NO: 1301989 - RNA, 19 nt, Homo sapiens
ucacaaagccuuccugaaa

SEQ ID NO: 1301990 - RNA, 19 nt, Homo sapiens
ggaagaauguaucaucuca

SEQ ID NO: 1301991 - RNA, 19 nt, Homo sapiens
guacaggacuaagaagaaa

SEQ ID NO: 1301992 - RNA, 19 nt, Homo sapiens
gaagaagagacucauauca

SEQ ID NO: 1301993 - RNA, 19 nt, Homo sapiens
gaaagucacaucaccuaga

SEQ ID NO: 1301994 - RNA, 19 nt, Homo sapiens
gcauggcccuggaagaaug

SEQ ID NO: 1301995 - RNA, 19 nt, Homo sapiens
gaaaacaacucaggcaaga

SEQ ID NO: 1301996 - RNA, 19 nt, Homo sapiens
ugacaaacccagaauaugu

SEQ ID NO: 1301997 - RNA, 19 nt, Homo sapiens
agaguuaugucuucuucua

SEQ ID NO: 1301998 - RNA, 19 nt, Homo sapiens
uaccacacaucucuuguuu

SEQ ID NO: 1301999 - RNA, 19 nt, Homo sapiens
gcauggcccuggcaaaaua

SEQ ID NO: 1302000 - RNA, 19 nt, Homo sapiens
agacucauaucaccuaaau

SEQ ID NO: 1302001 - RNA, 19 nt, Homo sapiens
gaugauagacccagagaca

SEQ ID NO: 1302002 - RNA, 19 nt, Homo sapiens
ggagcccguuccacccuua

SEQ ID NO: 1302003 - RNA, 19 nt, Homo sapiens
cagaaacgaggaugaauug

SEQ ID NO: 1302004 - RNA, 19 nt, Homo sapiens
gcuaaccacuauuaugaca

SEQ ID NO: 1302005 - RNA, 19 nt, Homo sapiens
cacaauguauccuguugaa

SEQ ID NO: 1302006 - RNA, 19 nt, Homo sapiens
cauaucaccuaaaugacaa

SEQ ID NO: 1302007 - RNA, 19 nt, Homo sapiens
uaggagaguugccugcauu

SEQ ID NO: 1302008 - RNA, 19 nt, Homo sapiens
gcagagcccagucagaaga

SEQ ID NO: 1302009 - RNA, 19 nt, Homo sapiens
agaguuacaucaccuagga

SEQ ID NO: 1302010 - RNA, 19 nt, Homo sapiens
gagauuagaguuaugucuu

SEQ ID NO: 1302011 - RNA, 19 nt, Homo sapiens
gaggagccauacuaccuau

SEQ ID NO: 1302012 - RNA, 19 nt, Homo sapiens
acaggaauauggcacaaug

SEQ ID NO: 1302013 - RNA, 19 nt, Homo sapiens
ccacacaucucuuguuuuc

SEQ ID NO: 1302014 - RNA, 19 nt, Homo sapiens
gcaggaauguaaugucacu

SEQ ID NO: 1302015 - RNA, 19 nt, Homo sapiens
guucugagauauucacaag

SEQ ID NO: 1302016 - RNA, 19 nt, Homo sapiens
guucugaguucugagauau

SEQ ID NO: 1302017 - RNA, 19 nt, Homo sapiens
ccagaaacgaggaugaauu

SEQ ID NO: 1302018 - RNA, 19 nt, Homo sapiens
gaauaugucacaauguauc

SEQ ID NO: 1302019 - RNA, 19 nt, Homo sapiens
aaacaacucaggcaagaga

SEQ ID NO: 1302020 - RNA, 19 nt, Homo sapiens
ucacuauccugccaugugu

SEQ ID NO: 1302021 - RNA, 19 nt, Homo sapiens
cuaggaagaugucacuauc

SEQ ID NO: 1302022 - RNA, 19 nt, Homo sapiens
cacaaagccuuccugaaag

SEQ ID NO: 1302023 - RNA, 19 nt, Homo sapiens
aaagucacaucaccuagau

SEQ ID NO: 1302024 - RNA, 19 nt, Homo sapiens
cagaagaagagacucauau

SEQ ID NO: 1302025 - RNA, 19 nt, Homo sapiens
gguucugaguucugagaua

SEQ ID NO: 1302026 - RNA, 19 nt, Homo sapiens
ugaugaaaguccuuacugu

SEQ ID NO: 1302027 - RNA, 19 nt, Homo sapiens
caauguauccuguugaaag

SEQ ID NO: 1302028 - RNA, 19 nt, Homo sapiens
uaugaugucugugagaaug

SEQ ID NO: 1302029 - RNA, 19 nt, Homo sapiens
ucauggacccagugauaua

SEQ ID NO: 1302030 - RNA, 19 nt, Homo sapiens
aagaauguaucaucucaca

SEQ ID NO: 1302031 - RNA, 19 nt, Homo sapiens
cagcauggcccuggaagaa

SEQ ID NO: 1302032 - RNA, 19 nt, Homo sapiens
uauaugcccugugcuaugu

SEQ ID NO: 1302033 - RNA, 19 nt, Homo sapiens
cccagaauaugucacaaug

SEQ ID NO: 1302034 - RNA, 19 nt, Homo sapiens
cauucuagauccagugaug

SEQ ID NO: 1302035 - RNA, 19 nt, Homo sapiens
agucauggacccagugaua

SEQ ID NO: 1302036 - RNA, 19 nt, Homo sapiens
ucugagauauucacaaguc

SEQ ID NO: 1302037 - RNA, 19 nt, Homo sapiens
agaguugccugcauucauc

SEQ ID NO: 1302038 - RNA, 19 nt, Homo sapiens
uuaugacacucucuauuca

SEQ ID NO: 1302039 - RNA, 19 nt, Homo sapiens
ggaccagaaacgaggauga

SEQ ID NO: 1302040 - RNA, 19 nt, Homo sapiens
uaaccacuauuaugacacu

SEQ ID NO: 1302041 - RNA, 19 nt, Homo sapiens
caauaccacacaucucuug

SEQ ID NO: 1302042 - RNA, 19 nt, Homo sapiens
ggucuagcaauaugucauu

SEQ ID NO: 1302043 - RNA, 19 nt, Homo sapiens
uaagaagaaagucacauca

SEQ ID NO: 1302044 - RNA, 19 nt, Homo sapiens
uugcuaaccacuauuauga

SEQ ID NO: 1302045 - RNA, 19 nt, Homo sapiens
guuaaagacaggaauaugg

SEQ ID NO: 1302046 - RNA, 19 nt, Homo sapiens
gaccagaaacgaggaugaa

SEQ ID NO: 1302047 - RNA, 19 nt, Homo sapiens
aggcaggaauguaauguca

SEQ ID NO: 1302048 - RNA, 19 nt, Homo sapiens
gaguuaugucuucuucuaa

SEQ ID NO: 1302049 - RNA, 19 nt, Homo sapiens
uuagaguuaugucuucuuc

SEQ ID NO: 1302050 - RNA, 19 nt, Homo sapiens
guuccacccuuaugucaca

SEQ ID NO: 1302051 - RNA, 19 nt, Homo sapiens
agauuagaguuaugucuuc

SEQ ID NO: 1302052 - RNA, 19 nt, Homo sapiens
acaugugacuggccuagga

SEQ ID NO: 1302053 - RNA, 19 nt, Homo sapiens
aaggagaggagccauacua

SEQ ID NO: 1302054 - RNA, 19 nt, Homo sapiens
uaaaugacaaacccagaau

SEQ ID NO: 1302055 - RNA, 19 nt, Homo sapiens
ccagagacacgucacaaag

SEQ ID NO: 1302056 - RNA, 19 nt, Homo sapiens
aagaaagucacaucaccua

SEQ ID NO: 1302057 - RNA, 19 nt, Homo sapiens
aauuuccucuguuugcuaa

SEQ ID NO: 1302058 - RNA, 19 nt, Homo sapiens
cagccaagugugcauauga

SEQ ID NO: 1302059 - RNA, 19 nt, Homo sapiens
cuaaaugacaaacccagaa

SEQ ID NO: 1302060 - RNA, 19 nt, Homo sapiens
ugacuggccuaggaagaug

SEQ ID NO: 1302061 - RNA, 19 nt, Homo sapiens
gagaggagccauacuaccu

SEQ ID NO: 1302062 - RNA, 19 nt, Homo sapiens
gucacaauguauccuguug

SEQ ID NO: 1302063 - RNA, 19 nt, Homo sapiens
gagaguugccugcauucau

SEQ ID NO: 1302064 - RNA, 19 nt, Homo sapiens
guaggagaguugccugcau

SEQ ID NO: 1302065 - RNA, 19 nt, Homo sapiens
uaccuggucuagcaauaug

SEQ ID NO: 1302066 - RNA, 19 nt, Homo sapiens
cuucauguguacaggacua

SEQ ID NO: 1302067 - RNA, 19 nt, Homo sapiens
aaugacaaacccagaauau

SEQ ID NO: 1302068 - RNA, 19 nt, Homo sapiens
gucuagcaauaugucauua

SEQ ID NO: 1302069 - RNA, 19 nt, Homo sapiens
aaaugacaaacccagaaua

SEQ ID NO: 1302070 - RNA, 19 nt, Homo sapiens
ucuguuugcuaaccacuau

SEQ ID NO: 1302071 - RNA, 19 nt, Homo sapiens
caucaucugguucugaguu

SEQ ID NO: 1302072 - RNA, 19 nt, Homo sapiens
gagaaugggcaggcaggaa

SEQ ID NO: 1302073 - RNA, 19 nt, Homo sapiens
ccacaucaucugguucuga

SEQ ID NO: 1302074 - RNA, 19 nt, Homo sapiens
acagaagaagagacucaua

SEQ ID NO: 1302075 - RNA, 19 nt, Homo sapiens
guaccuggucuagcaauau

SEQ ID NO: 1302076 - RNA, 19 nt, Homo sapiens
ucacaaguccccuuagaaa

SEQ ID NO: 1302077 - RNA, 19 nt, Homo sapiens
caauuuccucuguuugcua

SEQ ID NO: 1302078 - RNA, 19 nt, Homo sapiens
gaaugggcaggcaggaaug

SEQ ID NO: 1302079 - RNA, 19 nt, Homo sapiens
acuaugaugucugugagaa

SEQ ID NO: 1302080 - RNA, 19 nt, Homo sapiens
uaugucuucuucuaaguca

SEQ ID NO: 1302081 - RNA, 19 nt, Homo sapiens
ucugaguucugagauauuc

SEQ ID NO: 1302082 - RNA, 19 nt, Homo sapiens
uguaccuggucuagcaaua

SEQ ID NO: 1302083 - RNA, 19 nt, Homo sapiens
cucacaauuuccucuguuu

SEQ ID NO: 1302084 - RNA, 19 nt, Homo sapiens
aauguaaugucacuugcau

SEQ ID NO: 1302085 - RNA, 19 nt, Homo sapiens
gauuagaguuaugucuucu

SEQ ID NO: 1302086 - RNA, 19 nt, Homo sapiens
aagagacucauaucaccua

SEQ ID NO: 1302087 - RNA, 19 nt, Homo sapiens
gaauguaaugucacuugca

SEQ ID NO: 1302088 - RNA, 19 nt, Homo sapiens
ccaagacgauggaguauug

SEQ ID NO: 1302089 - RNA, 19 nt, Homo sapiens
ccaagaagauggagaagug

SEQ ID NO: 1302090 - RNA, 19 nt, Homo sapiens
gcucacaguuugaauagaa

SEQ ID NO: 1302091 - RNA, 19 nt, Homo sapiens
ggaccugaauuugaguuua

SEQ ID NO: 1302092 - RNA, 19 nt, Homo sapiens
caucguagcuaccauuaga

SEQ ID NO: 1302093 - RNA, 19 nt, Homo sapiens
gaccugaauuugaguuuau

SEQ ID NO: 1302094 - RNA, 19 nt, Homo sapiens
gaagacaggugaaguugcu

SEQ ID NO: 1302095 - RNA, 19 nt, Homo sapiens
agaagugcaucccucauga

SEQ ID NO: 1302096 - RNA, 19 nt, Homo sapiens
aaacagacaagcaaccaaa

SEQ ID NO: 1302097 - RNA, 19 nt, Homo sapiens
gacucuauguuccaggaua

SEQ ID NO: 1302098 - RNA, 19 nt, Homo sapiens
gagaagugcaucccucaug

SEQ ID NO: 1302099 - RNA, 19 nt, Homo sapiens
gauaaaaucccaagaagau

SEQ ID NO: 1302100 - RNA, 19 nt, Homo sapiens
gcugggaccugaauuugag

SEQ ID NO: 1302101 - RNA, 19 nt, Homo sapiens
auagaagaauccaaagcua

SEQ ID NO: 1302102 - RNA, 19 nt, Homo sapiens
gagaagacaggugaaguug

SEQ ID NO: 1302103 - RNA, 19 nt, Homo sapiens
cuagggcucuguuugaugu

SEQ ID NO: 1302104 - RNA, 19 nt, Homo sapiens
gcuaugaggcccgugauga

SEQ ID NO: 1302105 - RNA, 19 nt, Homo sapiens
gagcucacaguuugaauag

SEQ ID NO: 1302106 - RNA, 19 nt, Homo sapiens
uucgagagcucacaguuug

SEQ ID NO: 1302107 - RNA, 19 nt, Homo sapiens
ggaacccauucuccauuca

SEQ ID NO: 1302108 - RNA, 19 nt, Homo sapiens
gagccaaacagacaagcaa

SEQ ID NO: 1302109 - RNA, 19 nt, Homo sapiens
caacagcagcagcagcuau

SEQ ID NO: 1302110 - RNA, 19 nt, Homo sapiens
gaaguugugggaucucauc

SEQ ID NO: 1302111 - RNA, 19 nt, Homo sapiens
ccaagcagagccaaacaga

SEQ ID NO: 1302112 - RNA, 19 nt, Homo sapiens
gaaguugcuggaacccauu

SEQ ID NO: 1302113 - RNA, 19 nt, Homo sapiens
agagaagacaggugaaguu

SEQ ID NO: 1302114 - RNA, 19 nt, Homo sapiens
aagcagagccaaacagaca

SEQ ID NO: 1302115 - RNA, 19 nt, Homo sapiens
gugcgcagcugggaaccaa

SEQ ID NO: 1302116 - RNA, 19 nt, Homo sapiens
acucuauguuccaggauaa

SEQ ID NO: 1302117 - RNA, 19 nt, Homo sapiens
gaagaauccaaagcuacaa

SEQ ID NO: 1302118 - RNA, 19 nt, Homo sapiens
gaagugcaucccucaugau

SEQ ID NO: 1302119 - RNA, 19 nt, Homo sapiens
uauuguugcucacacucua

SEQ ID NO: 1302120 - RNA, 19 nt, Homo sapiens
agagcucacaguuugaaua

SEQ ID NO: 1302121 - RNA, 19 nt, Homo sapiens
ccauggauccaacagagaa

SEQ ID NO: 1302122 - RNA, 19 nt, Homo sapiens
guagcuaccauuagauuac

SEQ ID NO: 1302123 - RNA, 19 nt, Homo sapiens
gaauagaagaauccaaagc

SEQ ID NO: 1302124 - RNA, 19 nt, Homo sapiens
cguagcuaccauuagauua

SEQ ID NO: 1302125 - RNA, 19 nt, Homo sapiens
aagggagacucaccaccaa

SEQ ID NO: 1302126 - RNA, 19 nt, Homo sapiens
gcagcugggaaccaaauuc

SEQ ID NO: 1302127 - RNA, 19 nt, Homo sapiens
cagacaagcaaccaaaaua

SEQ ID NO: 1302128 - RNA, 19 nt, Homo sapiens
agaagaauccaaagcuaca

SEQ ID NO: 1302129 - RNA, 19 nt, Homo sapiens
aacagcagcagcagcuaua

SEQ ID NO: 1302130 - RNA, 19 nt, Homo sapiens
gacaagcaaccaaaauaaa

SEQ ID NO: 1302131 - RNA, 19 nt, Homo sapiens
cgagagcucacaguuugaa

SEQ ID NO: 1302132 - RNA, 19 nt, Homo sapiens
gcgcagcugggaaccaaau

SEQ ID NO: 1302133 - RNA, 19 nt, Homo sapiens
caaacagacaagcaaccaa

SEQ ID NO: 1302134 - RNA, 19 nt, Homo sapiens
cuuaugaugugaaccaacu

SEQ ID NO: 1302135 - RNA, 19 nt, Homo sapiens
aacccaagacgauggagua

SEQ ID NO: 1302136 - RNA, 19 nt, Homo sapiens
agacaagcaaccaaaauaa

SEQ ID NO: 1302137 - RNA, 19 nt, Homo sapiens
ggcccgugaugacagcuau

SEQ ID NO: 1302138 - RNA, 19 nt, Homo sapiens
gcucagacucuauguucca

SEQ ID NO: 1302139 - RNA, 19 nt, Homo sapiens
ggcugggaccugaauuuga

SEQ ID NO: 1302140 - RNA, 19 nt, Homo sapiens
caguuugaauagaagaauc

SEQ ID NO: 1302141 - RNA, 19 nt, Homo sapiens
gcagagccaaacagacaag

SEQ ID NO: 1302142 - RNA, 19 nt, Homo sapiens
agggcucuguuugauguua

SEQ ID NO: 1302143 - RNA, 19 nt, Homo sapiens
ggaccgagaucuucaguug

SEQ ID NO: 1302144 - RNA, 19 nt, Homo sapiens
ggccagagcuucucaugca

SEQ ID NO: 1302145 - RNA, 19 nt, Homo sapiens
caauggcugugacggauaa

SEQ ID NO: 1302146 - RNA, 19 nt, Homo sapiens
ggcugaggcugaaggaaua

SEQ ID NO: 1302147 - RNA, 19 nt, Homo sapiens
gcccaggaauucaagacua

SEQ ID NO: 1302148 - RNA, 19 nt, Homo sapiens
gacccugacuuuaaaauaa

SEQ ID NO: 1302149 - RNA, 19 nt, Homo sapiens
auacugagacccugacuuu

SEQ ID NO: 1302150 - RNA, 19 nt, Homo sapiens
cugagacccugacuuuaaa

SEQ ID NO: 1302151 - RNA, 19 nt, Homo sapiens
acugagacccugacuuuaa

SEQ ID NO: 1302152 - RNA, 19 nt, Homo sapiens
agacuagccugcacaacau

SEQ ID NO: 1302153 - RNA, 19 nt, Homo sapiens
ggacaaugggccagagcuu

SEQ ID NO: 1302154 - RNA, 19 nt, Homo sapiens
uugguggcaugcauguuua

SEQ ID NO: 1302155 - RNA, 19 nt, Homo sapiens
cagggaggcugaggcugaa

SEQ ID NO: 1302156 - RNA, 19 nt, Homo sapiens
ccaauggcugugacggaua

SEQ ID NO: 1302157 - RNA, 19 nt, Homo sapiens
aagacuagccugcacaaca

SEQ ID NO: 1302158 - RNA, 19 nt, Homo sapiens
cccaggaauucaagacuag

SEQ ID NO: 1302159 - RNA, 19 nt, Homo sapiens
cuugguggcaugcauguuu

SEQ ID NO: 1302160 - RNA, 19 nt, Homo sapiens
gaggcugaaggaauacuug

SEQ ID NO: 1302161 - RNA, 19 nt, Homo sapiens
gacuagccugcacaacaua

SEQ ID NO: 1302162 - RNA, 19 nt, Homo sapiens
auacuugagcccaggaauu

SEQ ID NO: 1302163 - RNA, 19 nt, Homo sapiens
ucaguaguccuccgcaaca

SEQ ID NO: 1302164 - RNA, 19 nt, Homo sapiens
gaggccacccugagaugga

SEQ ID NO: 1302165 - RNA, 19 nt, Homo sapiens
gaauacuugagcccaggaa

SEQ ID NO: 1302166 - RNA, 19 nt, Homo sapiens
gggaagacuugccucauua

SEQ ID NO: 1302167 - RNA, 19 nt, Homo sapiens
agacuugccucauuaauag

SEQ ID NO: 1302168 - RNA, 19 nt, Homo sapiens
agaagaagcccacauguug

SEQ ID NO: 1302169 - RNA, 19 nt, Homo sapiens
gcaagaagaagcccacaug

SEQ ID NO: 1302170 - RNA, 19 nt, Homo sapiens
uggcugagcuggagaaauc

SEQ ID NO: 1302171 - RNA, 19 nt, Homo sapiens
cacugugccuuaugcauua

SEQ ID NO: 1302172 - RNA, 19 nt, Homo sapiens
ugaggaugcuuaaugauuc

SEQ ID NO: 1302173 - RNA, 19 nt, Homo sapiens
ggacauuugcacugacuuu

SEQ ID NO: 1302174 - RNA, 19 nt, Homo sapiens
uggcagcacugaccuuuga

SEQ ID NO: 1302175 - RNA, 19 nt, Homo sapiens
guuugaggaugcuuaauga

SEQ ID NO: 1302176 - RNA, 19 nt, Homo sapiens
ugaggagacuguucagaga

SEQ ID NO: 1302177 - RNA, 19 nt, Homo sapiens
gacagcaaccucuaccuaa

SEQ ID NO: 1302178 - RNA, 19 nt, Homo sapiens
gcucaagccaucaucauug

SEQ ID NO: 1302179 - RNA, 19 nt, Homo sapiens
ggaagacuugccucauuaa

SEQ ID NO: 1302180 - RNA, 19 nt, Homo sapiens
ggacaggcaccgugggauu

SEQ ID NO: 1302181 - RNA, 19 nt, Homo sapiens
gugcuucucuuccuuguag

SEQ ID NO: 1302182 - RNA, 19 nt, Homo sapiens
caggagagguucaaaugca

SEQ ID NO: 1302183 - RNA, 19 nt, Homo sapiens
gugagaauguccgagaauu

SEQ ID NO: 1302184 - RNA, 19 nt, Homo sapiens
gcaucaaccuacuauagag

SEQ ID NO: 1302185 - RNA, 19 nt, Homo sapiens
ggaaggaggccgcuuugca

SEQ ID NO: 1302186 - RNA, 19 nt, Homo sapiens
aguaugcgcugauggagaa

SEQ ID NO: 1302187 - RNA, 19 nt, Homo sapiens
ccgaugcccugaaggagaa

SEQ ID NO: 1302188 - RNA, 19 nt, Homo sapiens
aagacuugccucauuaaua

SEQ ID NO: 1302189 - RNA, 19 nt, Homo sapiens
ugacagcaaccucuaccua

SEQ ID NO: 1302190 - RNA, 19 nt, Homo sapiens
agaaugacccuuccagugu

SEQ ID NO: 1302191 - RNA, 19 nt, Homo sapiens
ggauuuaagaucuccaaga

SEQ ID NO: 1302192 - RNA, 19 nt, Homo sapiens
ucacugugccuuaugcauu

SEQ ID NO: 1302193 - RNA, 19 nt, Homo sapiens
ggaucaugcuagucacuuc

SEQ ID NO: 1302194 - RNA, 19 nt, Homo sapiens
gcaggcaggaugaacauuc

SEQ ID NO: 1302195 - RNA, 19 nt, Homo sapiens
gacauuugcacugacuuua

SEQ ID NO: 1302196 - RNA, 19 nt, Homo sapiens
uaacugccagcaagaagaa

SEQ ID NO: 1302197 - RNA, 19 nt, Homo sapiens
uggcaucucuggaacauac

SEQ ID NO: 1302198 - RNA, 19 nt, Homo sapiens
uuaauagguucugcaaaga

SEQ ID NO: 1302199 - RNA, 19 nt, Homo sapiens
auuaauagguucugcaaag

SEQ ID NO: 1302200 - RNA, 19 nt, Homo sapiens
gaagacuugccucauuaau

SEQ ID NO: 1302201 - RNA, 19 nt, Homo sapiens
ggcaggagagguucaaaug

SEQ ID NO: 1302202 - RNA, 19 nt, Homo sapiens
gggcauucccuucaguuug

SEQ ID NO: 1302203 - RNA, 19 nt, Homo sapiens
cauuugcacugacuuuauc

SEQ ID NO: 1302204 - RNA, 19 nt, Homo sapiens
ccaagaaggaucugaguac

SEQ ID NO: 1302205 - RNA, 19 nt, Homo sapiens
gaauuacaaggccaccauu

SEQ ID NO: 1302206 - RNA, 19 nt, Homo sapiens
agacaccuuugauaagaau

SEQ ID NO: 1302207 - RNA, 19 nt, Homo sapiens
ggggaagacuugccucauu

SEQ ID NO: 1302208 - RNA, 19 nt, Homo sapiens
gcugggcccuuuguguuug

SEQ ID NO: 1302209 - RNA, 19 nt, Homo sapiens
gacaggcaccgugggauuu

SEQ ID NO: 1302210 - RNA, 19 nt, Homo sapiens
ggagagguucaaaugcauu

SEQ ID NO: 1302211 - RNA, 19 nt, Homo sapiens
gcacgggcacaaagacuuc

SEQ ID NO: 1302212 - RNA, 19 nt, Homo sapiens
ccucauuccuccagagcuu

SEQ ID NO: 1302213 - RNA, 19 nt, Homo sapiens
gaguggacuucgagaugga

SEQ ID NO: 1302214 - RNA, 19 nt, Homo sapiens
gcugggaucaugcuaguca

SEQ ID NO: 1302215 - RNA, 19 nt, Homo sapiens
aagaagaagcccacauguu

SEQ ID NO: 1302216 - RNA, 19 nt, Homo sapiens
caagaagaagcccacaugu

SEQ ID NO: 1302217 - RNA, 19 nt, Homo sapiens
caucaucauugucuucaac

SEQ ID NO: 1302218 - RNA, 19 nt, Homo sapiens
ggcauucccuucaguuugc

SEQ ID NO: 1302219 - RNA, 19 nt, Homo sapiens
gaggaaggaggccgcuuug

SEQ ID NO: 1302220 - RNA, 19 nt, Homo sapiens
gagugucucuguucuuuug

SEQ ID NO: 1302221 - RNA, 19 nt, Homo sapiens
ugaggaaggaggccgcuuu

SEQ ID NO: 1302222 - RNA, 19 nt, Homo sapiens
gagagguucaaaugcauug

SEQ ID NO: 1302223 - RNA, 19 nt, Homo sapiens
ggagaugaaggcugaguac

SEQ ID NO: 1302224 - RNA, 19 nt, Homo sapiens
uuacaaggccaccauugga

SEQ ID NO: 1302225 - RNA, 19 nt, Homo sapiens
gggcugaggagacuguuca

SEQ ID NO: 1302226 - RNA, 19 nt, Homo sapiens
aagacaccuuugauaagaa

SEQ ID NO: 1302227 - RNA, 19 nt, Homo sapiens
aauagguucugcaaagaca

SEQ ID NO: 1302228 - RNA, 19 nt, Homo sapiens
gauuccagccucucacugu

SEQ ID NO: 1302229 - RNA, 19 nt, Homo sapiens
gcauugcaucaaccuacua

SEQ ID NO: 1302230 - RNA, 19 nt, Homo sapiens
caugagggcugaggagacu

SEQ ID NO: 1302231 - RNA, 19 nt, Homo sapiens
uugaggaugcuuaaugauu

SEQ ID NO: 1302232 - RNA, 19 nt, Homo sapiens
gggcaggagagguucaaau

SEQ ID NO: 1302233 - RNA, 19 nt, Homo sapiens
acaggcaccgugggauuua

SEQ ID NO: 1302234 - RNA, 19 nt, Homo sapiens
caggcaggaugaacauucu

SEQ ID NO: 1302235 - RNA, 19 nt, Homo sapiens
cucaagccaucaucauugu

SEQ ID NO: 1302236 - RNA, 19 nt, Homo sapiens
gagcucaagccaucaucau

SEQ ID NO: 1302237 - RNA, 19 nt, Homo sapiens
caggcaccgugggauuuaa

SEQ ID NO: 1302238 - RNA, 19 nt, Homo sapiens
ggugagaauguccgagaau

SEQ ID NO: 1302239 - RNA, 19 nt, Homo sapiens
gcaggagagguucaaaugc

SEQ ID NO: 1302240 - RNA, 19 nt, Homo sapiens
acagcaaccucuaccuaac

SEQ ID NO: 1302241 - RNA, 19 nt, Homo sapiens
gugaugacagcaaccucua

SEQ ID NO: 1302242 - RNA, 19 nt, Homo sapiens
gaguaccccugcucaguau

SEQ ID NO: 1302243 - RNA, 19 nt, Homo sapiens
ggagcucaagccaucauca

SEQ ID NO: 1302244 - RNA, 19 nt, Homo sapiens
ccauuggaguggacuucga

SEQ ID NO: 1302245 - RNA, 19 nt, Homo sapiens
ugggcagucucaucucuca

SEQ ID NO: 1302246 - RNA, 19 nt, Homo sapiens
ccagugugcuucucuuccu

SEQ ID NO: 1302247 - RNA, 19 nt, Homo sapiens
caagccaucaucauugucu

SEQ ID NO: 1302248 - RNA, 19 nt, Homo sapiens
guuugcagcuuugggauac

SEQ ID NO: 1302249 - RNA, 19 nt, Homo sapiens
gcugggcauucccuucagu

SEQ ID NO: 1302250 - RNA, 19 nt, Homo sapiens
gugcugggcauucccuuca

SEQ ID NO: 1302251 - RNA, 19 nt, Homo sapiens
cgagauggaacgauuugag

SEQ ID NO: 1302252 - RNA, 19 nt, Homo sapiens
ggacuucgagauggaacga

SEQ ID NO: 1302253 - RNA, 19 nt, Homo sapiens
ggacuuggcugugaucuuu

SEQ ID NO: 1302254 - RNA, 19 nt, Homo sapiens
gaacugggacuacaaacua

SEQ ID NO: 1302255 - RNA, 19 nt, Homo sapiens
ggucuuggcuguucauuga

SEQ ID NO: 1302256 - RNA, 19 nt, Homo sapiens
cagcaaagauggauuuaug

SEQ ID NO: 1302257 - RNA, 19 nt, Homo sapiens
gacaagaaaucaggaaauu

SEQ ID NO: 1302258 - RNA, 19 nt, Homo sapiens
gaacuguguugguugguau

SEQ ID NO: 1302259 - RNA, 19 nt, Homo sapiens
gacaaagacuuaaaucucu

SEQ ID NO: 1302260 - RNA, 19 nt, Homo sapiens
ggguuuccaugauccauua

SEQ ID NO: 1302261 - RNA, 19 nt, Homo sapiens
ggacuggccucccugaucu

SEQ ID NO: 1302262 - RNA, 19 nt, Homo sapiens
uuaaaucucucuccuaucu

SEQ ID NO: 1302263 - RNA, 19 nt, Homo sapiens
gguguggucucuauuugaa

SEQ ID NO: 1302264 - RNA, 19 nt, Homo sapiens
gcacacagcuuuugcuuag

SEQ ID NO: 1302265 - RNA, 19 nt, Homo sapiens
cuacuucccucaauugaau

SEQ ID NO: 1302266 - RNA, 19 nt, Homo sapiens
cagaagauucacagaguua

SEQ ID NO: 1302267 - RNA, 19 nt, Homo sapiens
ggagaagcaucagcugaga

SEQ ID NO: 1302268 - RNA, 19 nt, Homo sapiens
gaaccuggguauggugaga

SEQ ID NO: 1302269 - RNA, 19 nt, Homo sapiens
ggucuuugcuguccuuuac

SEQ ID NO: 1302270 - RNA, 19 nt, Homo sapiens
cagggucgcuggacuagga

SEQ ID NO: 1302271 - RNA, 19 nt, Homo sapiens
gcucagcaaagauggauuu

SEQ ID NO: 1302272 - RNA, 19 nt, Homo sapiens
ggauuuaugaggaaacuga

SEQ ID NO: 1302273 - RNA, 19 nt, Homo sapiens
cagcagcucuugccauucu

SEQ ID NO: 1302274 - RNA, 19 nt, Homo sapiens
ccauuuaagcagcuaauaa

SEQ ID NO: 1302275 - RNA, 19 nt, Homo sapiens
caggaaauuuacauaagga

SEQ ID NO: 1302276 - RNA, 19 nt, Homo sapiens
cauccuacuucccucaauu

SEQ ID NO: 1302277 - RNA, 19 nt, Homo sapiens
ccugaucucucuccucaug

SEQ ID NO: 1302278 - RNA, 19 nt, Homo sapiens
ucagaagauucacagaguu

SEQ ID NO: 1302279 - RNA, 19 nt, Homo sapiens
gugagacggugacgagaga

SEQ ID NO: 1302280 - RNA, 19 nt, Homo sapiens
ugacaaagacuuaaaucuc

SEQ ID NO: 1302281 - RNA, 19 nt, Homo sapiens
ggagcgcuacuauuacgua

SEQ ID NO: 1302282 - RNA, 19 nt, Homo sapiens
cuccagcucugcccucuuu

SEQ ID NO: 1302283 - RNA, 19 nt, Homo sapiens
gggacuacaaacuaaauuu

SEQ ID NO: 1302284 - RNA, 19 nt, Homo sapiens
gaaauucagaagauucaca

SEQ ID NO: 1302285 - RNA, 19 nt, Homo sapiens
ucaauugaaucagguaaca

SEQ ID NO: 1302286 - RNA, 19 nt, Homo sapiens
acuuaaaucucucuccuau

SEQ ID NO: 1302287 - RNA, 19 nt, Homo sapiens
cccagcagcucuugccauu

SEQ ID NO: 1302288 - RNA, 19 nt, Homo sapiens
gcaaagauggauuuaugag

SEQ ID NO: 1302289 - RNA, 19 nt, Homo sapiens
ggauguugcuucggaaucu

SEQ ID NO: 1302290 - RNA, 19 nt, Homo sapiens
ucaggaaauuuacauaagg

SEQ ID NO: 1302291 - RNA, 19 nt, Homo sapiens
ccgaaucccaggccagaua

SEQ ID NO: 1302292 - RNA, 19 nt, Homo sapiens
gagcucagcaagcaguuug

SEQ ID NO: 1302293 - RNA, 19 nt, Homo sapiens
caccuggauuggcuacuuu

SEQ ID NO: 1302294 - RNA, 19 nt, Homo sapiens
gaaaauuugucuucgucuu

SEQ ID NO: 1302295 - RNA, 19 nt, Homo sapiens
gauagucucccauuuaagc

SEQ ID NO: 1302296 - RNA, 19 nt, Homo sapiens
ggagggaaccuggguaugg

SEQ ID NO: 1302297 - RNA, 19 nt, Homo sapiens
gagacaagaaaucaggaaa

SEQ ID NO: 1302298 - RNA, 19 nt, Homo sapiens
uuccaacccuuucuucuau

SEQ ID NO: 1302299 - RNA, 19 nt, Homo sapiens
gugguguggucucuauuug

SEQ ID NO: 1302300 - RNA, 19 nt, Homo sapiens
ggugguguggucucuauuu

SEQ ID NO: 1302301 - RNA, 19 nt, Homo sapiens
gaguuggucuuggcuguuc

SEQ ID NO: 1302302 - RNA, 19 nt, Homo sapiens
gagggaaccuggguauggu

SEQ ID NO: 1302303 - RNA, 19 nt, Homo sapiens
ggagacaagaaaucaggaa

SEQ ID NO: 1302304 - RNA, 19 nt, Homo sapiens
caaauuccuggcucacuga

SEQ ID NO: 1302305 - RNA, 19 nt, Homo sapiens
caacacacagggaauaacu

SEQ ID NO: 1302306 - RNA, 19 nt, Homo sapiens
ggaaagcagcggugguucu

SEQ ID NO: 1302307 - RNA, 19 nt, Homo sapiens
uaaggaacccuaaaacuga

SEQ ID NO: 1302308 - RNA, 19 nt, Homo sapiens
gguauugguggugguauuu

SEQ ID NO: 1302309 - RNA, 19 nt, Homo sapiens
aagauggauuuaugaggaa

SEQ ID NO: 1302310 - RNA, 19 nt, Homo sapiens
agaaaagggucacaaagga

SEQ ID NO: 1302311 - RNA, 19 nt, Homo sapiens
gcuguugacuuccgaaucc

SEQ ID NO: 1302312 - RNA, 19 nt, Homo sapiens
caguuugucugcuucuuca

SEQ ID NO: 1302313 - RNA, 19 nt, Homo sapiens
gcucagcccauuucaacug

SEQ ID NO: 1302314 - RNA, 19 nt, Homo sapiens
gaagauucacagaguuagu

SEQ ID NO: 1302315 - RNA, 19 nt, Homo sapiens
cuucagugacaaagacuua

SEQ ID NO: 1302316 - RNA, 19 nt, Homo sapiens
ucaccuggauuggcuacuu

SEQ ID NO: 1302317 - RNA, 19 nt, Homo sapiens
gcugagaggagcuaucaca

SEQ ID NO: 1302318 - RNA, 19 nt, Homo sapiens
auguggagcgcuacuauua

SEQ ID NO: 1302319 - RNA, 19 nt, Homo sapiens
ggagccaccugcuguugac

SEQ ID NO: 1302320 - RNA, 19 nt, Homo sapiens
gaaagcagcggugguucuc

SEQ ID NO: 1302321 - RNA, 19 nt, Homo sapiens
caauguggagcgcuacuau

SEQ ID NO: 1302322 - RNA, 19 nt, Homo sapiens
ugaaucagguaacacuaac

SEQ ID NO: 1302323 - RNA, 19 nt, Homo sapiens
ucacagaguuaguaauacc

SEQ ID NO: 1302324 - RNA, 19 nt, Homo sapiens
cacagggaauaacugcaaa

SEQ ID NO: 1302325 - RNA, 19 nt, Homo sapiens
ugagaggagcuaucacaug

SEQ ID NO: 1302326 - RNA, 19 nt, Homo sapiens
gcaacucaccagcgacauc

SEQ ID NO: 1302327 - RNA, 19 nt, Homo sapiens
gaggcacuaucccagagau

SEQ ID NO: 1302328 - RNA, 19 nt, Homo sapiens
acacagggaauaacugcaa

SEQ ID NO: 1302329 - RNA, 19 nt, Homo sapiens
ggaacagagccaacaggau

SEQ ID NO: 1302330 - RNA, 19 nt, Homo sapiens
caacucaccagcgacauca

SEQ ID NO: 1302331 - RNA, 19 nt, Homo sapiens
uuacauaaggaacccuaaa

SEQ ID NO: 1302332 - RNA, 19 nt, Homo sapiens
ucagugacaaagacuuaaa

SEQ ID NO: 1302333 - RNA, 19 nt, Homo sapiens
agacaagaaaucaggaaau

SEQ ID NO: 1302334 - RNA, 19 nt, Homo sapiens
aagauucacagaguuagua

SEQ ID NO: 1302335 - RNA, 19 nt, Homo sapiens
gagacggugacgagagaaa

SEQ ID NO: 1302336 - RNA, 19 nt, Homo sapiens
ggucucugcacacagcuuu

SEQ ID NO: 1302337 - RNA, 19 nt, Homo sapiens
aacugggacuacaaacuaa

SEQ ID NO: 1302338 - RNA, 19 nt, Homo sapiens
gguggucuuugcuguccuu

SEQ ID NO: 1302339 - RNA, 19 nt, Homo sapiens
ggugucagccaucaaugug

SEQ ID NO: 1302340 - RNA, 19 nt, Homo sapiens
cggaaucuguggcccucuu

SEQ ID NO: 1302341 - RNA, 19 nt, Homo sapiens
uucagaagauucacagagu

SEQ ID NO: 1302342 - RNA, 19 nt, Homo sapiens
gacuuaaaucucucuccua

SEQ ID NO: 1302343 - RNA, 19 nt, Homo sapiens
uagcuucagugacaaagac

SEQ ID NO: 1302344 - RNA, 19 nt, Homo sapiens
gccaccugcuguugacuuc

SEQ ID NO: 1302345 - RNA, 19 nt, Homo sapiens
cuuccaacccuuucuucua

SEQ ID NO: 1302346 - RNA, 19 nt, Homo sapiens
cgccucuacuuguuucuga

SEQ ID NO: 1302347 - RNA, 19 nt, Homo sapiens
uugaaucagguaacacuaa

SEQ ID NO: 1302348 - RNA, 19 nt, Homo sapiens
ccaccuguccauccuacuu

SEQ ID NO: 1302349 - RNA, 19 nt, Homo sapiens
gagagaaaagggucacaaa

SEQ ID NO: 1302350 - RNA, 19 nt, Homo sapiens
gccuuggacuuggcuguga

SEQ ID NO: 1302351 - RNA, 19 nt, Homo sapiens
ccaacccuuucuucuaugg

SEQ ID NO: 1302352 - RNA, 19 nt, Homo sapiens
gugcucagcccauuucaac

SEQ ID NO: 1302353 - RNA, 19 nt, Homo sapiens
gcagaacccuggaaaguuu

SEQ ID NO: 1302354 - RNA, 19 nt, Homo sapiens
gaaauaaacagccuuguau

SEQ ID NO: 1302355 - RNA, 19 nt, Homo sapiens
acaaauggauggccaagaa

SEQ ID NO: 1302356 - RNA, 19 nt, Homo sapiens
ugacagagcgccagauuga

SEQ ID NO: 1302357 - RNA, 19 nt, Homo sapiens
gccugagccuccuuauuua

SEQ ID NO: 1302358 - RNA, 19 nt, Homo sapiens
aaacagccuuguauagaga

SEQ ID NO: 1302359 - RNA, 19 nt, Homo sapiens
gaagagcaacggagagaau

SEQ ID NO: 1302360 - RNA, 19 nt, Homo sapiens
ggagagggcagcuggagaa

SEQ ID NO: 1302361 - RNA, 19 nt, Homo sapiens
uaaacagccuuguauagag

SEQ ID NO: 1302362 - RNA, 19 nt, Homo sapiens
ccaaguggcuggacgugau

SEQ ID NO: 1302363 - RNA, 19 nt, Homo sapiens
gaggcaaggugaaguuaca

SEQ ID NO: 1302364 - RNA, 19 nt, Homo sapiens
agaaauaaacagccuugua

SEQ ID NO: 1302365 - RNA, 19 nt, Homo sapiens
ugccugagccuccuuauuu

SEQ ID NO: 1302366 - RNA, 19 nt, Homo sapiens
ugaggacaccuacuuguaa

SEQ ID NO: 1302367 - RNA, 19 nt, Homo sapiens
ugagccuccuuauuuauuu

SEQ ID NO: 1302368 - RNA, 19 nt, Homo sapiens
ggacauguucuucugugaa

SEQ ID NO: 1302369 - RNA, 19 nt, Homo sapiens
uaacuacacgguucaugaa

SEQ ID NO: 1302370 - RNA, 19 nt, Homo sapiens
gagcagcggaaacagauga

SEQ ID NO: 1302371 - RNA, 19 nt, Homo sapiens
gacccgcuccucuauauga

SEQ ID NO: 1302372 - RNA, 19 nt, Homo sapiens
ccaaguggcuggacaugcu

SEQ ID NO: 1302373 - RNA, 19 nt, Homo sapiens
gugaggacaccuacuugua

SEQ ID NO: 1302374 - RNA, 19 nt, Homo sapiens
gaucgacccgcuccucuau

SEQ ID NO: 1302375 - RNA, 19 nt, Homo sapiens
caacaacugggacaaaugg

SEQ ID NO: 1302376 - RNA, 19 nt, Homo sapiens
gagucuggcugguccaaca

SEQ ID NO: 1302377 - RNA, 19 nt, Homo sapiens
gggacauguucuucuguga

SEQ ID NO: 1302378 - RNA, 19 nt, Homo sapiens
gaggacaccuacuuguaac

SEQ ID NO: 1302379 - RNA, 19 nt, Homo sapiens
ccaagcaggcccagaagga

SEQ ID NO: 1302380 - RNA, 19 nt, Homo sapiens
gcccauugccgcugucuug

SEQ ID NO: 1302381 - RNA, 19 nt, Homo sapiens
ucgacccgcuccucuauau

SEQ ID NO: 1302382 - RNA, 19 nt, Homo sapiens
auaaacagccuuguauaga

SEQ ID NO: 1302383 - RNA, 19 nt, Homo sapiens
gcucaacaacugggacaaa

SEQ ID NO: 1302384 - RNA, 19 nt, Homo sapiens
cagcagaacccuggaaagu

SEQ ID NO: 1302385 - RNA, 19 nt, Homo sapiens
aauaaacagccuuguauag

SEQ ID NO: 1302386 - RNA, 19 nt, Homo sapiens
gcgaagagcaacggagaga

SEQ ID NO: 1302387 - RNA, 19 nt, Homo sapiens
gauucugccugguccaaca

SEQ ID NO: 1302388 - RNA, 19 nt, Homo sapiens
gaucaugcaggaggccuuu

SEQ ID NO: 1302389 - RNA, 19 nt, Homo sapiens
ggcuggacaugcucaacaa

SEQ ID NO: 1302390 - RNA, 19 nt, Homo sapiens
caccucagccgucagaaga

SEQ ID NO: 1302391 - RNA, 19 nt, Homo sapiens
cccauuccaugagauguuu

SEQ ID NO: 1302392 - RNA, 19 nt, Homo sapiens
uuguaacccuggcagcuaa

SEQ ID NO: 1302393 - RNA, 19 nt, Homo sapiens
cggcuaggauggcgaagag

SEQ ID NO: 1302394 - RNA, 19 nt, Homo sapiens
auaacuacacgguucauga

SEQ ID NO: 1302395 - RNA, 19 nt, Homo sapiens
gagugaggacaccuacuug

SEQ ID NO: 1302396 - RNA, 19 nt, Homo sapiens
ugacgucccaagagaguga

SEQ ID NO: 1302397 - RNA, 19 nt, Homo sapiens
ugacagaaugguucaugug

SEQ ID NO: 1302398 - RNA, 19 nt, Homo sapiens
agaaggagcagcggaaaca

SEQ ID NO: 1302399 - RNA, 19 nt, Homo sapiens
cgacaaguucggcuucauc

SEQ ID NO: 1302400 - RNA, 19 nt, Homo sapiens
gcaguucccauuccaugag

SEQ ID NO: 1302401 - RNA, 19 nt, Homo sapiens
agagugaggacaccuacuu

SEQ ID NO: 1302402 - RNA, 19 nt, Homo sapiens
uaucuuggaugcagaaccu

SEQ ID NO: 1302403 - RNA, 19 nt, Homo sapiens
gcaccggcaguucccauuc

SEQ ID NO: 1302404 - RNA, 19 nt, Homo sapiens
gagccuccuuauuuauuuu

SEQ ID NO: 1302405 - RNA, 19 nt, Homo sapiens
ggacucagccccucaggau

SEQ ID NO: 1302406 - RNA, 19 nt, Homo sapiens
gcuccucuauaugacagaa

SEQ ID NO: 1302407 - RNA, 19 nt, Homo sapiens
gcaccucagccgucagaag

SEQ ID NO: 1302408 - RNA, 19 nt, Homo sapiens
caaguggcuggacgugauu

SEQ ID NO: 1302409 - RNA, 19 nt, Homo sapiens
uugacgagcuggacauguc

SEQ ID NO: 1302410 - RNA, 19 nt, Homo sapiens
cuacaaccuucaccaucca

SEQ ID NO: 1302411 - RNA, 19 nt, Homo sapiens
uggacaugcucaacaacug

SEQ ID NO: 1302412 - RNA, 19 nt, Homo sapiens
ucaacaacugggacaaaug

SEQ ID NO: 1302413 - RNA, 19 nt, Homo sapiens
cucaacaacugggacaaau

SEQ ID NO: 1302414 - RNA, 19 nt, Homo sapiens
caggaggcaaggugaaguu

SEQ ID NO: 1302415 - RNA, 19 nt, Homo sapiens
cugagccuccuuauuuauu

SEQ ID NO: 1302416 - RNA, 19 nt, Homo sapiens
cacccaagcaggcccagaa

SEQ ID NO: 1302417 - RNA, 19 nt, Homo sapiens
cgugacagagcgccagauu

SEQ ID NO: 1302418 - RNA, 19 nt, Homo sapiens
gaagaacccuagaaguuua

SEQ ID NO: 1302419 - RNA, 19 nt, Homo sapiens
cauaaagacuggagaaaua

SEQ ID NO: 1302420 - RNA, 19 nt, Homo sapiens
uaacaagccugcacaugua

SEQ ID NO: 1302421 - RNA, 19 nt, Homo sapiens
gagaccaacuuuaugaaua

SEQ ID NO: 1302422 - RNA, 19 nt, Homo sapiens
gaccagggcuguguuauaa

SEQ ID NO: 1302423 - RNA, 19 nt, Homo sapiens
ggaaggaggcauugaauuu

SEQ ID NO: 1302424 - RNA, 19 nt, Homo sapiens
ccuagaaguuuaccaguua

SEQ ID NO: 1302425 - RNA, 19 nt, Homo sapiens
ggaagaacccuagaaguuu

SEQ ID NO: 1302426 - RNA, 19 nt, Homo sapiens
ugaauaaaguggacauuga

SEQ ID NO: 1302427 - RNA, 19 nt, Homo sapiens
gauuugugcugucaagaua

SEQ ID NO: 1302428 - RNA, 19 nt, Homo sapiens
caacugcacauccucauua

SEQ ID NO: 1302429 - RNA, 19 nt, Homo sapiens
gaacaaccucuaaagauga

SEQ ID NO: 1302430 - RNA, 19 nt, Homo sapiens
uaccauagcuuuggaauga

SEQ ID NO: 1302431 - RNA, 19 nt, Homo sapiens
gcaaguuucuacagaguga

SEQ ID NO: 1302432 - RNA, 19 nt, Homo sapiens
guacaagggugauuacuac

SEQ ID NO: 1302433 - RNA, 19 nt, Homo sapiens
gguuugagcugccugguaa

SEQ ID NO: 1302434 - RNA, 19 nt, Homo sapiens
gggaaauacuccucagaaa

SEQ ID NO: 1302435 - RNA, 19 nt, Homo sapiens
ggaaugacaaggaacuaua

SEQ ID NO: 1302436 - RNA, 19 nt, Homo sapiens
caggugauauguucuauug

SEQ ID NO: 1302437 - RNA, 19 nt, Homo sapiens
ugaacaaccucuaaagaug

SEQ ID NO: 1302438 - RNA, 19 nt, Homo sapiens
cauaugguuucuccuauaa

SEQ ID NO: 1302439 - RNA, 19 nt, Homo sapiens
ggaccagggcuguguuaua

SEQ ID NO: 1302440 - RNA, 19 nt, Homo sapiens
ggaaggauaaguacaauca

SEQ ID NO: 1302441 - RNA, 19 nt, Homo sapiens
ccagggcuguguuauaauu

SEQ ID NO: 1302442 - RNA, 19 nt, Homo sapiens
gcaccgagaccaacuuuau

SEQ ID NO: 1302443 - RNA, 19 nt, Homo sapiens
ccauaugguuucuccuaua

SEQ ID NO: 1302444 - RNA, 19 nt, Homo sapiens
guagauuggagcaaauuua

SEQ ID NO: 1302445 - RNA, 19 nt, Homo sapiens
gaauaaaguggacauugaa

SEQ ID NO: 1302446 - RNA, 19 nt, Homo sapiens
gauggaacagcauacaaua

SEQ ID NO: 1302447 - RNA, 19 nt, Homo sapiens
guaacaagccugcacaugu

SEQ ID NO: 1302448 - RNA, 19 nt, Homo sapiens
gagagaagauggcuuuuau

SEQ ID NO: 1302449 - RNA, 19 nt, Homo sapiens
gagacaaccugaguccauu

SEQ ID NO: 1302450 - RNA, 19 nt, Homo sapiens
gauuggagcaaauuuauug

SEQ ID NO: 1302451 - RNA, 19 nt, Homo sapiens
ggacauaaagacuggagaa

SEQ ID NO: 1302452 - RNA, 19 nt, Homo sapiens
ggugauggguucguuagaa

SEQ ID NO: 1302453 - RNA, 19 nt, Homo sapiens
ugaauacuauguucccuau

SEQ ID NO: 1302454 - RNA, 19 nt, Homo sapiens
gcaauuuucuccuaguuuu

SEQ ID NO: 1302455 - RNA, 19 nt, Homo sapiens
aaagguagauuggagcaaa

SEQ ID NO: 1302456 - RNA, 19 nt, Homo sapiens
gggauucucugaucaaggu

SEQ ID NO: 1302457 - RNA, 19 nt, Homo sapiens
guaauacgcgguuucaugu

SEQ ID NO: 1302458 - RNA, 19 nt, Homo sapiens
gagcaaguuucuacagagu

SEQ ID NO: 1302459 - RNA, 19 nt, Homo sapiens
cacaaggucuggaaacuag

SEQ ID NO: 1302460 - RNA, 19 nt, Homo sapiens
gaaugacaaggaacuauau

SEQ ID NO: 1302461 - RNA, 19 nt, Homo sapiens
caaagggcacagugacaua

SEQ ID NO: 1302462 - RNA, 19 nt, Homo sapiens
gaaggaggcauugaauuuc

SEQ ID NO: 1302463 - RNA, 19 nt, Homo sapiens
cuacagagugauacauaua

SEQ ID NO: 1302464 - RNA, 19 nt, Homo sapiens
caaccagaaugaaagcaau

SEQ ID NO: 1302465 - RNA, 19 nt, Homo sapiens
gcauugaauuuccucagau

SEQ ID NO: 1302466 - RNA, 19 nt, Homo sapiens
uggaagaacccuagaaguu

SEQ ID NO: 1302467 - RNA, 19 nt, Homo sapiens
auaagacacugaagguuug

SEQ ID NO: 1302468 - RNA, 19 nt, Homo sapiens
gaacuccuuugggccauau

SEQ ID NO: 1302469 - RNA, 19 nt, Homo sapiens
aauaagacacugaagguuu

SEQ ID NO: 1302470 - RNA, 19 nt, Homo sapiens
gaaguuuaccaguuacaga

SEQ ID NO: 1302471 - RNA, 19 nt, Homo sapiens
gguacaagggugauuacua

SEQ ID NO: 1302472 - RNA, 19 nt, Homo sapiens
ggcauugaauuuccucaga

SEQ ID NO: 1302473 - RNA, 19 nt, Homo sapiens
gauacuacagcaaaccuuu

SEQ ID NO: 1302474 - RNA, 19 nt, Homo sapiens
gaaaccuucuuacuaccau

SEQ ID NO: 1302475 - RNA, 19 nt, Homo sapiens
ggaacuccuuugggccaua

SEQ ID NO: 1302476 - RNA, 19 nt, Homo sapiens
cacacaauauacucaugua

SEQ ID NO: 1302477 - RNA, 19 nt, Homo sapiens
gcacacaauauacucaugu

SEQ ID NO: 1302478 - RNA, 19 nt, Homo sapiens
gaaaauugccacuucuaaa

SEQ ID NO: 1302479 - RNA, 19 nt, Homo sapiens
ggauggaacagcauacaau

SEQ ID NO: 1302480 - RNA, 19 nt, Homo sapiens
cucaauggcucucuacuuc

SEQ ID NO: 1302481 - RNA, 19 nt, Homo sapiens
ggaaauacuccucagaaaa

SEQ ID NO: 1302482 - RNA, 19 nt, Homo sapiens
gaauaagacacugaagguu

SEQ ID NO: 1302483 - RNA, 19 nt, Homo sapiens
caauggcucucuacuucga

SEQ ID NO: 1302484 - RNA, 19 nt, Homo sapiens
ggauuuccuuccugugaug

SEQ ID NO: 1302485 - RNA, 19 nt, Homo sapiens
agguugauguggugaauaa

SEQ ID NO: 1302486 - RNA, 19 nt, Homo sapiens
ggagacaaccugaguccau

SEQ ID NO: 1302487 - RNA, 19 nt, Homo sapiens
ggugauauguucuauugcu

SEQ ID NO: 1302488 - RNA, 19 nt, Homo sapiens
gaucugcugcucucaugaa

SEQ ID NO: 1302489 - RNA, 19 nt, Homo sapiens
gaggaccagggcuguguua

SEQ ID NO: 1302490 - RNA, 19 nt, Homo sapiens
gaguccaggugauauguuc

SEQ ID NO: 1302491 - RNA, 19 nt, Homo sapiens
ggacauugaaacucuggaa

SEQ ID NO: 1302492 - RNA, 19 nt, Homo sapiens
cuggagaaauaaacacuga

SEQ ID NO: 1302493 - RNA, 19 nt, Homo sapiens
ccacaaggucuggaaacua

SEQ ID NO: 1302494 - RNA, 19 nt, Homo sapiens
gccuuuaaaugucaguuug

SEQ ID NO: 1302495 - RNA, 19 nt, Homo sapiens
uugaucagguccauaauuc

SEQ ID NO: 1302496 - RNA, 19 nt, Homo sapiens
aaagguacaugggaaauac

SEQ ID NO: 1302497 - RNA, 19 nt, Homo sapiens
cugaguccauuguccuaua

SEQ ID NO: 1302498 - RNA, 19 nt, Homo sapiens
gauauguucuauugcuucu

SEQ ID NO: 1302499 - RNA, 19 nt, Homo sapiens
gccauaugguuucuccuau

SEQ ID NO: 1302500 - RNA, 19 nt, Homo sapiens
ugacugacgauacuaaugu

SEQ ID NO: 1302501 - RNA, 19 nt, Homo sapiens
gauccaugcaagaauguuu

SEQ ID NO: 1302502 - RNA, 19 nt, Homo sapiens
guuccaugguaccuucaua

SEQ ID NO: 1302503 - RNA, 19 nt, Homo sapiens
agagguaccugugcagaug

SEQ ID NO: 1302504 - RNA, 19 nt, Homo sapiens
ggcuguggcuuucggcauu

SEQ ID NO: 1302505 - RNA, 19 nt, Homo sapiens
uuccucagaucuacuauga

SEQ ID NO: 1302506 - RNA, 19 nt, Homo sapiens
gcuuuggaaugacaaggaa

SEQ ID NO: 1302507 - RNA, 19 nt, Homo sapiens
agggaaaccuucuuacuac

SEQ ID NO: 1302508 - RNA, 19 nt, Homo sapiens
caagguugauguggugaau

SEQ ID NO: 1302509 - RNA, 19 nt, Homo sapiens
cuacuaugaucgauucagu

SEQ ID NO: 1302510 - RNA, 19 nt, Homo sapiens
gcucaauggcucucuacuu

SEQ ID NO: 1302511 - RNA, 19 nt, Homo sapiens
ggaaaauugccacuucuaa

SEQ ID NO: 1302512 - RNA, 19 nt, Homo sapiens
gguuucuccuauaagguua

SEQ ID NO: 1302513 - RNA, 19 nt, Homo sapiens
ggccauaugguuucuccua

SEQ ID NO: 1302514 - RNA, 19 nt, Homo sapiens
gcaacugcacauccucauu

SEQ ID NO: 1302515 - RNA, 19 nt, Homo sapiens
ucaacuaugugcgguacaa

SEQ ID NO: 1302516 - RNA, 19 nt, Homo sapiens
aaaggaaggaggcauugaa

SEQ ID NO: 1302517 - RNA, 19 nt, Homo sapiens
gcaaagggcacagugacau

SEQ ID NO: 1302518 - RNA, 19 nt, Homo sapiens
gagaauacuuguuaccuua

SEQ ID NO: 1302519 - RNA, 19 nt, Homo sapiens
caugauaacuuacgggaua

SEQ ID NO: 1302520 - RNA, 19 nt, Homo sapiens
cgacaacccugagauagua

SEQ ID NO: 1302521 - RNA, 19 nt, Homo sapiens
gcagggaaaugguucugua

SEQ ID NO: 1302522 - RNA, 19 nt, Homo sapiens
gggaaaugguucuguauga

SEQ ID NO: 1302523 - RNA, 19 nt, Homo sapiens
ugagaaagcuaacacauag

SEQ ID NO: 1302524 - RNA, 19 nt, Homo sapiens
gaccaggacuuuauuagau

SEQ ID NO: 1302525 - RNA, 19 nt, Homo sapiens
guauauagauucagugcuu

SEQ ID NO: 1302526 - RNA, 19 nt, Homo sapiens
ggagaauacuuguuaccuu

SEQ ID NO: 1302527 - RNA, 19 nt, Homo sapiens
gguacacacuuucuuuaaa

SEQ ID NO: 1302528 - RNA, 19 nt, Homo sapiens
ggauaacaauaguagguaa

SEQ ID NO: 1302529 - RNA, 19 nt, Homo sapiens
gagcuggaauucaaacaug

SEQ ID NO: 1302530 - RNA, 19 nt, Homo sapiens
caaauuugaugagcaggua

SEQ ID NO: 1302531 - RNA, 19 nt, Homo sapiens
caaagcaaaugcaaacauc

SEQ ID NO: 1302532 - RNA, 19 nt, Homo sapiens
gcaaacaucucugcuucug

SEQ ID NO: 1302533 - RNA, 19 nt, Homo sapiens
agacugcuuucacuuauuu

SEQ ID NO: 1302534 - RNA, 19 nt, Homo sapiens
gaagaucaaaggaacacua

SEQ ID NO: 1302535 - RNA, 19 nt, Homo sapiens
ccugagauaguaaguauua

SEQ ID NO: 1302536 - RNA, 19 nt, Homo sapiens
gcagguacacacuuucuuu

SEQ ID NO: 1302537 - RNA, 19 nt, Homo sapiens
uguaugacccugugaauuu

SEQ ID NO: 1302538 - RNA, 19 nt, Homo sapiens
ggacuuuauuagaugauga

SEQ ID NO: 1302539 - RNA, 19 nt, Homo sapiens
ccagguaacucaguaaaca

SEQ ID NO: 1302540 - RNA, 19 nt, Homo sapiens
gugcuuauuucucagcuuu

SEQ ID NO: 1302541 - RNA, 19 nt, Homo sapiens
gaaaucacagcaaggagaa

SEQ ID NO: 1302542 - RNA, 19 nt, Homo sapiens
ggacagaaauccccagguu

SEQ ID NO: 1302543 - RNA, 19 nt, Homo sapiens
ggugaucaauccuaguuau

SEQ ID NO: 1302544 - RNA, 19 nt, Homo sapiens
gcuaacacauagggaaauu

SEQ ID NO: 1302545 - RNA, 19 nt, Homo sapiens
gcgcagagcagcagggaaa

SEQ ID NO: 1302546 - RNA, 19 nt, Homo sapiens
cuccauaucugaaacuaaa

SEQ ID NO: 1302547 - RNA, 19 nt, Homo sapiens
gaacgacagucugagauac

SEQ ID NO: 1302548 - RNA, 19 nt, Homo sapiens
gggagccucugaagaaugu

SEQ ID NO: 1302549 - RNA, 19 nt, Homo sapiens
cuuguuaccuuaagcguuu

SEQ ID NO: 1302550 - RNA, 19 nt, Homo sapiens
ccaaguguauauagauuca

SEQ ID NO: 1302551 - RNA, 19 nt, Homo sapiens
gaugagaacgacagucuga

SEQ ID NO: 1302552 - RNA, 19 nt, Homo sapiens
ggugagaaaguauaagaaa

SEQ ID NO: 1302553 - RNA, 19 nt, Homo sapiens
caguggagcuggaauucaa

SEQ ID NO: 1302554 - RNA, 19 nt, Homo sapiens
cuuaggagaauacuuguua

SEQ ID NO: 1302555 - RNA, 19 nt, Homo sapiens
ggaaaugguucuguaugag

SEQ ID NO: 1302556 - RNA, 19 nt, Homo sapiens
gaccaaagacagaggagaa

SEQ ID NO: 1302557 - RNA, 19 nt, Homo sapiens
gcaguuccauggaccaaag

SEQ ID NO: 1302558 - RNA, 19 nt, Homo sapiens
ucaggcucaugauaacuua

SEQ ID NO: 1302559 - RNA, 19 nt, Homo sapiens
aaacagucauugcuuucaa

SEQ ID NO: 1302560 - RNA, 19 nt, Homo sapiens
gggcaucuuuggcuucuca

SEQ ID NO: 1302561 - RNA, 19 nt, Homo sapiens
guaugacccugugaauuug

SEQ ID NO: 1302562 - RNA, 19 nt, Homo sapiens
gcugguguauggacuguau

SEQ ID NO: 1302563 - RNA, 19 nt, Homo sapiens
acugauggaugguuagaaa

SEQ ID NO: 1302564 - RNA, 19 nt, Homo sapiens
uagauucagugcuuauuuc

SEQ ID NO: 1302565 - RNA, 19 nt, Homo sapiens
gaaaugguucuguaugagu

SEQ ID NO: 1302566 - RNA, 19 nt, Homo sapiens
gagauucccuccugaucca

SEQ ID NO: 1302567 - RNA, 19 nt, Homo sapiens
gacaaggugagaaaguaua

SEQ ID NO: 1302568 - RNA, 19 nt, Homo sapiens
cuauaaagcauguguugaa

SEQ ID NO: 1302569 - RNA, 19 nt, Homo sapiens
gauggaugguuagaaaugu

SEQ ID NO: 1302570 - RNA, 19 nt, Homo sapiens
uaacuuacgggauaacaau

SEQ ID NO: 1302571 - RNA, 19 nt, Homo sapiens
gaauacuuguuaccuuaag

SEQ ID NO: 1302572 - RNA, 19 nt, Homo sapiens
cuagacugcuuucacuuau

SEQ ID NO: 1302573 - RNA, 19 nt, Homo sapiens
ucaagccuguucuccauau

SEQ ID NO: 1302574 - RNA, 19 nt, Homo sapiens
ucaaacauguacggucuga

SEQ ID NO: 1302575 - RNA, 19 nt, Homo sapiens
caucuuuggcuucucauaa

SEQ ID NO: 1302576 - RNA, 19 nt, Homo sapiens
cagguacacacuuucuuua

SEQ ID NO: 1302577 - RNA, 19 nt, Homo sapiens
gagauacucggccuuuguu

SEQ ID NO: 1302578 - RNA, 19 nt, Homo sapiens
ucauagauaucgcccuuca

SEQ ID NO: 1302579 - RNA, 19 nt, Homo sapiens
aaacaaagcaaaugcaaac

SEQ ID NO: 1302580 - RNA, 19 nt, Homo sapiens
uaacacauagggaaauuag

SEQ ID NO: 1302581 - RNA, 19 nt, Homo sapiens
ccaggacuuuauuagauga

SEQ ID NO: 1302582 - RNA, 19 nt, Homo sapiens
gaucaauccuaguuaucca

SEQ ID NO: 1302583 - RNA, 19 nt, Homo sapiens
aagcagcccucccgaguca

SEQ ID NO: 1302584 - RNA, 19 nt, Homo sapiens
ucuagacugcuuucacuua

SEQ ID NO: 1302585 - RNA, 19 nt, Homo sapiens
cugacaaggugagaaagua

SEQ ID NO: 1302586 - RNA, 19 nt, Homo sapiens
ugggaaccauggccuauga

SEQ ID NO: 1302587 - RNA, 19 nt, Homo sapiens
ggaauucagggcugggaaa

SEQ ID NO: 1302588 - RNA, 19 nt, Homo sapiens
ucucacugcuugccucuug

SEQ ID NO: 1302589 - RNA, 19 nt, Homo sapiens
uaacaccgagugcuuacaa

SEQ ID NO: 1302590 - RNA, 19 nt, Homo sapiens
agucauugcuuucaagauc

SEQ ID NO: 1302591 - RNA, 19 nt, Homo sapiens
gugcauugcugagccauca

SEQ ID NO: 1302592 - RNA, 19 nt, Homo sapiens
gaaacuaaaggaggaauac

SEQ ID NO: 1302593 - RNA, 19 nt, Homo sapiens
uguacggucugacuucuug

SEQ ID NO: 1302594 - RNA, 19 nt, Homo sapiens
gagcagcagggaaaugguu

SEQ ID NO: 1302595 - RNA, 19 nt, Homo sapiens
gaagaagaucaaaggaaca

SEQ ID NO: 1302596 - RNA, 19 nt, Homo sapiens
gugaagaagaucaaaggaa

SEQ ID NO: 1302597 - RNA, 19 nt, Homo sapiens
caucacauuuggcuacuac

SEQ ID NO: 1302598 - RNA, 19 nt, Homo sapiens
cauccugccuuuccaugga

SEQ ID NO: 1302599 - RNA, 19 nt, Homo sapiens
gggauaacaauaguaggua

SEQ ID NO: 1302600 - RNA, 19 nt, Homo sapiens
auucagugcuuauuucuca

SEQ ID NO: 1302601 - RNA, 19 nt, Homo sapiens
guucuucuacgcaaauaaa

SEQ ID NO: 1302602 - RNA, 19 nt, Homo sapiens
ucagaccaggacuuuauua

SEQ ID NO: 1302603 - RNA, 19 nt, Homo sapiens
aaacaguggagcuggaauu

SEQ ID NO: 1302604 - RNA, 19 nt, Homo sapiens
cagagauccugcaguucuu

SEQ ID NO: 1302605 - RNA, 19 nt, Homo sapiens
ccacuaucauccagagauc

SEQ ID NO: 1302606 - RNA, 19 nt, Homo sapiens
cagcugagccacuaucauc

SEQ ID NO: 1302607 - RNA, 19 nt, Homo sapiens
aaaggaacacuaagcucua

SEQ ID NO: 1302608 - RNA, 19 nt, Homo sapiens
uaaaggaggaauacagcuu

SEQ ID NO: 1302609 - RNA, 19 nt, Homo sapiens
gguuccuucuucauagaua

SEQ ID NO: 1302610 - RNA, 19 nt, Homo sapiens
ccagagauccugcaguucu

SEQ ID NO: 1302611 - RNA, 19 nt, Homo sapiens
gaucaaaggaacacuaagc

SEQ ID NO: 1302612 - RNA, 19 nt, Homo sapiens
agaacgacagucugagaua

SEQ ID NO: 1302613 - RNA, 19 nt, Homo sapiens
acuaagcccaguuaacuuu

SEQ ID NO: 1302614 - RNA, 19 nt, Homo sapiens
aaauuuagccgagucauca

SEQ ID NO: 1302615 - RNA, 19 nt, Homo sapiens
cugcuugccucuugggauu

SEQ ID NO: 1302616 - RNA, 19 nt, Homo sapiens
cagaaaaggacaucaauga

SEQ ID NO: 1302617 - RNA, 19 nt, Homo sapiens
uaauuuaugugagcugagu

SEQ ID NO: 1302618 - RNA, 19 nt, Homo sapiens
uuacagaccugaugaauuu

SEQ ID NO: 1302619 - RNA, 19 nt, Homo sapiens
gaaguagaauccuuauaga

SEQ ID NO: 1302620 - RNA, 19 nt, Homo sapiens
gcaaagaggacugagaaua

SEQ ID NO: 1302621 - RNA, 19 nt, Homo sapiens
acacugaaauucugacuuu

SEQ ID NO: 1302622 - RNA, 19 nt, Homo sapiens
gagaauacuuuggcuuaaa

SEQ ID NO: 1302623 - RNA, 19 nt, Homo sapiens
guacauugcuauaucuuca

SEQ ID NO: 1302624 - RNA, 19 nt, Homo sapiens
aaacagcgauuugcaaaga

SEQ ID NO: 1302625 - RNA, 19 nt, Homo sapiens
gagggcauuuguuugguua

SEQ ID NO: 1302626 - RNA, 19 nt, Homo sapiens
gcaaagaccguaugaugau

SEQ ID NO: 1302627 - RNA, 19 nt, Homo sapiens
gcacaaaacauaaaggaua

SEQ ID NO: 1302628 - RNA, 19 nt, Homo sapiens
gcauuuguuugguuaagaa

SEQ ID NO: 1302629 - RNA, 19 nt, Homo sapiens
gaaauggccguggauugua

SEQ ID NO: 1302630 - RNA, 19 nt, Homo sapiens
ugaucuuacuggugaauua

SEQ ID NO: 1302631 - RNA, 19 nt, Homo sapiens
caaguggaccuaacaaguu

SEQ ID NO: 1302632 - RNA, 19 nt, Homo sapiens
ugaaagcuccgucuucuga

SEQ ID NO: 1302633 - RNA, 19 nt, Homo sapiens
gggauuuggugguuuguug

SEQ ID NO: 1302634 - RNA, 19 nt, Homo sapiens
ggacacuacuucauaacca

SEQ ID NO: 1302635 - RNA, 19 nt, Homo sapiens
gaucugaagcugaacaaug

SEQ ID NO: 1302636 - RNA, 19 nt, Homo sapiens
ggagggcauuuguuugguu

SEQ ID NO: 1302637 - RNA, 19 nt, Homo sapiens
ccagaaaacuugaugaaga

SEQ ID NO: 1302638 - RNA, 19 nt, Homo sapiens
caaagaggacugagaauac

SEQ ID NO: 1302639 - RNA, 19 nt, Homo sapiens
aaacuccucuuugauauca

SEQ ID NO: 1302640 - RNA, 19 nt, Homo sapiens
cccagaaucuuguuguuug

SEQ ID NO: 1302641 - RNA, 19 nt, Homo sapiens
aaggagaucugaagcugaa

SEQ ID NO: 1302642 - RNA, 19 nt, Homo sapiens
gcaaguggaccuaacaagu

SEQ ID NO: 1302643 - RNA, 19 nt, Homo sapiens
gcaacuggugcacuguuua

SEQ ID NO: 1302644 - RNA, 19 nt, Homo sapiens
ccacuuuacucuacuccuu

SEQ ID NO: 1302645 - RNA, 19 nt, Homo sapiens
cauaaccacuuuacucuac

SEQ ID NO: 1302646 - RNA, 19 nt, Homo sapiens
ggaacuugguuaugguugu

SEQ ID NO: 1302647 - RNA, 19 nt, Homo sapiens
cugcugugcuucaguuuaa

SEQ ID NO: 1302648 - RNA, 19 nt, Homo sapiens
guagaauccuuauagaaac

SEQ ID NO: 1302649 - RNA, 19 nt, Homo sapiens
aaauggccguggauuguaa

SEQ ID NO: 1302650 - RNA, 19 nt, Homo sapiens
ggaauuucaacccagauuu

SEQ ID NO: 1302651 - RNA, 19 nt, Homo sapiens
ugagaauacuuuggcuuaa

SEQ ID NO: 1302652 - RNA, 19 nt, Homo sapiens
cuaggugguugcccgguua

SEQ ID NO: 1302653 - RNA, 19 nt, Homo sapiens
cagaccugaugaauuuaua

SEQ ID NO: 1302654 - RNA, 19 nt, Homo sapiens
gaccugcugugcuucaguu

SEQ ID NO: 1302655 - RNA, 19 nt, Homo sapiens
gaaaugcaaagaggacuga

SEQ ID NO: 1302656 - RNA, 19 nt, Homo sapiens
ccucugcucuuaccuaauc

SEQ ID NO: 1302657 - RNA, 19 nt, Homo sapiens
guuaguuacuuacuucugu

SEQ ID NO: 1302658 - RNA, 19 nt, Homo sapiens
gauaguggcgaguuuacaa

SEQ ID NO: 1302659 - RNA, 19 nt, Homo sapiens
aaaggauaguggcgaguuu

SEQ ID NO: 1302660 - RNA, 19 nt, Homo sapiens
ggugaaagcuccgucuucu

SEQ ID NO: 1302661 - RNA, 19 nt, Homo sapiens
cuggugcacuguuuacuaa

SEQ ID NO: 1302662 - RNA, 19 nt, Homo sapiens
gugguugcccgguuaguua

SEQ ID NO: 1302663 - RNA, 19 nt, Homo sapiens
agaaguagaauccuuauag

SEQ ID NO: 1302664 - RNA, 19 nt, Homo sapiens
ggcagaaguagaauccuua

SEQ ID NO: 1302665 - RNA, 19 nt, Homo sapiens
guaauacacacugaaauuc

SEQ ID NO: 1302666 - RNA, 19 nt, Homo sapiens
uaaaguauaccggacacua

SEQ ID NO: 1302667 - RNA, 19 nt, Homo sapiens
gaacuugguuaugguuguc

SEQ ID NO: 1302668 - RNA, 19 nt, Homo sapiens
gcugcgagcugggaauaug

SEQ ID NO: 1302669 - RNA, 19 nt, Homo sapiens
caaagaccguaugaugaug

SEQ ID NO: 1302670 - RNA, 19 nt, Homo sapiens
gagggcugaugccaaguga

SEQ ID NO: 1302671 - RNA, 19 nt, Homo sapiens
cugagaauacuuuggcuua

SEQ ID NO: 1302672 - RNA, 19 nt, Homo sapiens
guggaucgauucuguuugg

SEQ ID NO: 1302673 - RNA, 19 nt, Homo sapiens
ccagugccaugccuuagau

SEQ ID NO: 1302674 - RNA, 19 nt, Homo sapiens
cagaaaacuugaugaagaa

SEQ ID NO: 1302675 - RNA, 19 nt, Homo sapiens
uaccggacacuacuucaua

SEQ ID NO: 1302676 - RNA, 19 nt, Homo sapiens
gaauuacagaccugaugaa

SEQ ID NO: 1302677 - RNA, 19 nt, Homo sapiens
uauagaaacaggaccagaa

SEQ ID NO: 1302678 - RNA, 19 nt, Homo sapiens
ucuuuggacuuuggaauuu

SEQ ID NO: 1302679 - RNA, 19 nt, Homo sapiens
gggcugaugccaagugaug

SEQ ID NO: 1302680 - RNA, 19 nt, Homo sapiens
gugaagacccaguggauca

SEQ ID NO: 1302681 - RNA, 19 nt, Homo sapiens
gaauuuacuucugcugcau

SEQ ID NO: 1302682 - RNA, 19 nt, Homo sapiens
uugauuacgugcaugcaaa

SEQ ID NO: 1302683 - RNA, 19 nt, Homo sapiens
aucugaagcugaacaauga

SEQ ID NO: 1302684 - RNA, 19 nt, Homo sapiens
aaguggaccuaacaaguug

SEQ ID NO: 1302685 - RNA, 19 nt, Homo sapiens
gguuaugguugucucaagu

SEQ ID NO: 1302686 - RNA, 19 nt, Homo sapiens
ugaauuacagaccugauga

SEQ ID NO: 1302687 - RNA, 19 nt, Homo sapiens
caguuuaauuggcuuggaa

SEQ ID NO: 1302688 - RNA, 19 nt, Homo sapiens
gcagaaguagaauccuuau

SEQ ID NO: 1302689 - RNA, 19 nt, Homo sapiens
gaaagcuccgucuucugaa

SEQ ID NO: 1302690 - RNA, 19 nt, Homo sapiens
aaacaccucccuucuccaa

SEQ ID NO: 1302691 - RNA, 19 nt, Homo sapiens
uggcagaaguagaauccuu

SEQ ID NO: 1302692 - RNA, 19 nt, Homo sapiens
agaaauggccguggauugu

SEQ ID NO: 1302693 - RNA, 19 nt, Homo sapiens
aaagaggacugagaauacu

SEQ ID NO: 1302694 - RNA, 19 nt, Homo sapiens
ggauccauguuccucuugu

SEQ ID NO: 1302695 - RNA, 19 nt, Homo sapiens
gaauuucaacccagauuuu

SEQ ID NO: 1302696 - RNA, 19 nt, Homo sapiens
ccgguuaguuacuuacuuc

SEQ ID NO: 1302697 - RNA, 19 nt, Homo sapiens
gugguuuguugaccuuauu

SEQ ID NO: 1302698 - RNA, 19 nt, Homo sapiens
gaucauguuggaaaugcaa

SEQ ID NO: 1302699 - RNA, 19 nt, Homo sapiens
acaccucccuucuccaaca

SEQ ID NO: 1302700 - RNA, 19 nt, Homo sapiens
agaaacaggaccagaaaca

SEQ ID NO: 1302701 - RNA, 19 nt, Homo sapiens
aaccauggcagaaguagaa

SEQ ID NO: 1302702 - RNA, 19 nt, Homo sapiens
uagaaauggccguggauug

SEQ ID NO: 1302703 - RNA, 19 nt, Homo sapiens
gauccauguuccucuugug

SEQ ID NO: 1302704 - RNA, 19 nt, Homo sapiens
gagcaaguggaccuaacaa

SEQ ID NO: 1302705 - RNA, 19 nt, Homo sapiens
aaagcuccgucuucugaau

SEQ ID NO: 1302706 - RNA, 19 nt, Homo sapiens
ggugguuuguugaccuuau

SEQ ID NO: 1302707 - RNA, 19 nt, Homo sapiens
gcaguagggaagcuguuga

SEQ ID NO: 1302708 - RNA, 19 nt, Homo sapiens
ccaggaacuugguuauggu

SEQ ID NO: 1302709 - RNA, 19 nt, Homo sapiens
gaccugaugaauuuauaga

SEQ ID NO: 1302710 - RNA, 19 nt, Homo sapiens
ugcaaagaccguaugauga

SEQ ID NO: 1302711 - RNA, 19 nt, Homo sapiens
ggagcaaguggaccuaaca

SEQ ID NO: 1302712 - RNA, 19 nt, Homo sapiens
gcuauaucuucaguccuuu

SEQ ID NO: 1302713 - RNA, 19 nt, Homo sapiens
ugcuauaucuucaguccuu

SEQ ID NO: 1302714 - RNA, 19 nt, Homo sapiens
gcagacggaaugacaagca

SEQ ID NO: 1302715 - RNA, 19 nt, Homo sapiens
uugcaaagaccguaugaug

SEQ ID NO: 1302716 - RNA, 19 nt, Homo sapiens
cguuugaccugcugugcuu

SEQ ID NO: 1302717 - RNA, 19 nt, Homo sapiens
ugaaaccauggcagaagua

SEQ ID NO: 1302718 - RNA, 19 nt, Homo sapiens
uuaccuaccugaugaauuu

SEQ ID NO: 1302719 - RNA, 19 nt, Homo sapiens
acacugaaauucugacuuu

SEQ ID NO: 1302720 - RNA, 19 nt, Homo sapiens
gcucuuaccuaccugauga

SEQ ID NO: 1302721 - RNA, 19 nt, Homo sapiens
guacauugcuauaucuuca

SEQ ID NO: 1302722 - RNA, 19 nt, Homo sapiens
gagggcauuuguuugguua

SEQ ID NO: 1302723 - RNA, 19 nt, Homo sapiens
gcacaaaacauaaaggaua

SEQ ID NO: 1302724 - RNA, 19 nt, Homo sapiens
gcauuuguuugguuaagaa

SEQ ID NO: 1302725 - RNA, 19 nt, Homo sapiens
gaaauggccguggauugua

SEQ ID NO: 1302726 - RNA, 19 nt, Homo sapiens
caaguggaccuaacaaguu

SEQ ID NO: 1302727 - RNA, 19 nt, Homo sapiens
ugaaagcuccgucuucuga

SEQ ID NO: 1302728 - RNA, 19 nt, Homo sapiens
gggauuuggugguuuguug

SEQ ID NO: 1302729 - RNA, 19 nt, Homo sapiens
ggacacuacuucauaacca

SEQ ID NO: 1302730 - RNA, 19 nt, Homo sapiens
gaucugaagcugaacaaug

SEQ ID NO: 1302731 - RNA, 19 nt, Homo sapiens
ggagggcauuuguuugguu

SEQ ID NO: 1302732 - RNA, 19 nt, Homo sapiens
aaacuccucuuugauauca

SEQ ID NO: 1302733 - RNA, 19 nt, Homo sapiens
aaggagaucugaagcugaa

SEQ ID NO: 1302734 - RNA, 19 nt, Homo sapiens
gcaaguggaccuaacaagu

SEQ ID NO: 1302735 - RNA, 19 nt, Homo sapiens
gcaacuggugcacuguuua

SEQ ID NO: 1302736 - RNA, 19 nt, Homo sapiens
ccacuuuacucuacuccuu

SEQ ID NO: 1302737 - RNA, 19 nt, Homo sapiens
cauaaccacuuuacucuac

SEQ ID NO: 1302738 - RNA, 19 nt, Homo sapiens
ggaacuugguuaugguugu

SEQ ID NO: 1302739 - RNA, 19 nt, Homo sapiens
aaauggccguggauuguaa

SEQ ID NO: 1302740 - RNA, 19 nt, Homo sapiens
ggaauuucaacccagauuu

SEQ ID NO: 1302741 - RNA, 19 nt, Homo sapiens
cuaggugguugcccgguua

SEQ ID NO: 1302742 - RNA, 19 nt, Homo sapiens
gauaguggcgaguuuacaa

SEQ ID NO: 1302743 - RNA, 19 nt, Homo sapiens
aaaggauaguggcgaguuu

SEQ ID NO: 1302744 - RNA, 19 nt, Homo sapiens
gugguugcccgguuaguua

SEQ ID NO: 1302745 - RNA, 19 nt, Homo sapiens
ggugaaagcuccgucuucu

SEQ ID NO: 1302746 - RNA, 19 nt, Homo sapiens
cuggugcacuguuuacuaa

SEQ ID NO: 1302747 - RNA, 19 nt, Homo sapiens
guuaguuacuuacuucugu

SEQ ID NO: 1302748 - RNA, 19 nt, Homo sapiens
guaauacacacugaaauuc

SEQ ID NO: 1302749 - RNA, 19 nt, Homo sapiens
uaaaguauaccggacacua

SEQ ID NO: 1302750 - RNA, 19 nt, Homo sapiens
gaacuugguuaugguuguc

SEQ ID NO: 1302751 - RNA, 19 nt, Homo sapiens
gcugcgagcugggaauaug

SEQ ID NO: 1302752 - RNA, 19 nt, Homo sapiens
gagggcugaugccaaguga

SEQ ID NO: 1302753 - RNA, 19 nt, Homo sapiens
guggaucgauucuguuugg

SEQ ID NO: 1302754 - RNA, 19 nt, Homo sapiens
ccagugccaugccuuagau

SEQ ID NO: 1302755 - RNA, 19 nt, Homo sapiens
uaccggacacuacuucaua

SEQ ID NO: 1302756 - RNA, 19 nt, Homo sapiens
ccuaccugaugaauuuaua

SEQ ID NO: 1302757 - RNA, 19 nt, Homo sapiens
ucuuuggacuuuggaauuu

SEQ ID NO: 1302758 - RNA, 19 nt, Homo sapiens
gggcugaugccaagugaug

SEQ ID NO: 1302759 - RNA, 19 nt, Homo sapiens
gugaagacccaguggauca

SEQ ID NO: 1302760 - RNA, 19 nt, Homo sapiens
gaauuuacuucugcugcau

SEQ ID NO: 1302761 - RNA, 19 nt, Homo sapiens
aucugaagcugaacaauga

SEQ ID NO: 1302762 - RNA, 19 nt, Homo sapiens
aaguggaccuaacaaguug

SEQ ID NO: 1302763 - RNA, 19 nt, Homo sapiens
gguuaugguugucucaagu

SEQ ID NO: 1302764 - RNA, 19 nt, Homo sapiens
gaaagcuccgucuucugaa

SEQ ID NO: 1302765 - RNA, 19 nt, Homo sapiens
agaaauggccguggauugu

SEQ ID NO: 1302766 - RNA, 19 nt, Homo sapiens
ggauccauguuccucuugu

SEQ ID NO: 1302767 - RNA, 19 nt, Homo sapiens
gaauuucaacccagauuuu

SEQ ID NO: 1302768 - RNA, 19 nt, Homo sapiens
ccgguuaguuacuuacuuc

SEQ ID NO: 1302769 - RNA, 19 nt, Homo sapiens
gugguuuguugaccuuauu

SEQ ID NO: 1302770 - RNA, 19 nt, Homo sapiens
gaucauguuggaaaugcaa

SEQ ID NO: 1302771 - RNA, 19 nt, Homo sapiens
uagaaauggccguggauug

SEQ ID NO: 1302772 - RNA, 19 nt, Homo sapiens
gauccauguuccucuugug

SEQ ID NO: 1302773 - RNA, 19 nt, Homo sapiens
gagcaaguggaccuaacaa

SEQ ID NO: 1302774 - RNA, 19 nt, Homo sapiens
aaagcuccgucuucugaau

SEQ ID NO: 1302775 - RNA, 19 nt, Homo sapiens
ggugguuuguugaccuuau

SEQ ID NO: 1302776 - RNA, 19 nt, Homo sapiens
gcaguagggaagcuguuga

SEQ ID NO: 1302777 - RNA, 19 nt, Homo sapiens
ccaggaacuugguuauggu

SEQ ID NO: 1302778 - RNA, 19 nt, Homo sapiens
ggagcaaguggaccuaaca

SEQ ID NO: 1302779 - RNA, 19 nt, Homo sapiens
gcuauaucuucaguccuuu

SEQ ID NO: 1302780 - RNA, 19 nt, Homo sapiens
ugcuauaucuucaguccuu

SEQ ID NO: 1302781 - RNA, 19 nt, Homo sapiens
gcagacggaaugacaagca

SEQ ID NO: 1302782 - RNA, 19 nt, Homo sapiens
gaccuaacaaguugagcaa

SEQ ID NO: 1302783 - RNA, 19 nt, Homo sapiens
cagacggaaugacaagcaa

SEQ ID NO: 1302784 - RNA, 19 nt, Homo sapiens
ggcauuuguuugguuaaga

SEQ ID NO: 1302785 - RNA, 19 nt, Homo sapiens
ggauuuggugguuuguuga

SEQ ID NO: 1302786 - RNA, 19 nt, Homo sapiens
aauacacacugaaauucug

SEQ ID NO: 1302787 - RNA, 19 nt, Homo sapiens
ccuaacaaguugagcaaaa

SEQ ID NO: 1302788 - RNA, 19 nt, Homo sapiens
uaaaggauaguggcgaguu

SEQ ID NO: 1302789 - RNA, 19 nt, Homo sapiens
cccaggaacuugguuaugg

SEQ ID NO: 1302790 - RNA, 19 nt, Homo sapiens
gaauauuuggauccauguu

SEQ ID NO: 1302791 - RNA, 19 nt, Homo sapiens
cauagucuuccuuucugua

SEQ ID NO: 1302792 - RNA, 19 nt, Homo sapiens
gacuugggauuuggugguu

SEQ ID NO: 1302793 - RNA, 19 nt, Homo sapiens
cccaguggaucauguugga

SEQ ID NO: 1302794 - RNA, 19 nt, Homo sapiens
ucucggagccacucgcaaa

SEQ ID NO: 1302795 - RNA, 19 nt, Homo sapiens
gggcauuuguuugguuaag

SEQ ID NO: 1302796 - RNA, 19 nt, Homo sapiens
ggagggcugaugccaagug

SEQ ID NO: 1302797 - RNA, 19 nt, Homo sapiens
ucauaaccacuuuacucua

SEQ ID NO: 1302798 - RNA, 19 nt, Homo sapiens
ugccuuagauggaauugag

SEQ ID NO: 1302799 - RNA, 19 nt, Homo sapiens
cgacguggaacacacuuca

SEQ ID NO: 1302800 - RNA, 19 nt, Homo sapiens
ggagaucugaagcugaaca

SEQ ID NO: 1302801 - RNA, 19 nt, Homo sapiens
ccauagucuuccuuucugu

SEQ ID NO: 1302802 - RNA, 19 nt, Homo sapiens
caguggaucauguuggaaa

SEQ ID NO: 1302803 - RNA, 19 nt, Homo sapiens
accggacacuacuucauaa

SEQ ID NO: 1302804 - RNA, 19 nt, Homo sapiens
gaagacccaguggaucaug

SEQ ID NO: 1302805 - RNA, 19 nt, Homo sapiens
caucccaggaacuugguua

SEQ ID NO: 1302806 - RNA, 19 nt, Homo sapiens
gaaaaucuucagcagaaau

SEQ ID NO: 1302807 - RNA, 19 nt, Homo sapiens
gcugaacaaugaaaaucuu

SEQ ID NO: 1302808 - RNA, 19 nt, Homo sapiens
cuucugaauucaucucuac

SEQ ID NO: 1302809 - RNA, 19 nt, Homo sapiens
caacuggugcacuguuuac

SEQ ID NO: 1302810 - RNA, 19 nt, Homo sapiens
guguggaucgauucuguuu

SEQ ID NO: 1302811 - RNA, 19 nt, Homo sapiens
cuacuucauaaccacuuua

SEQ ID NO: 1302812 - RNA, 19 nt, Homo sapiens
gagaucugaagcugaacaa

SEQ ID NO: 1302813 - RNA, 19 nt, Homo sapiens
gacccugagucuucaugca

SEQ ID NO: 1302814 - RNA, 19 nt, Homo sapiens
agcaacuggugcacuguuu

SEQ ID NO: 1302815 - RNA, 19 nt, Homo sapiens
uuggaggacuugggauuug

SEQ ID NO: 1302816 - RNA, 19 nt, Homo sapiens
gcuuggaggacuugggauu

SEQ ID NO: 1302817 - RNA, 19 nt, Homo sapiens
aaggauaguggcgaguuua

SEQ ID NO: 1302818 - RNA, 19 nt, Homo sapiens
gaacagggauuuaugcaaa

SEQ ID NO: 1302819 - RNA, 19 nt, Homo sapiens
uaaugaagauucucucaga

SEQ ID NO: 1302820 - RNA, 19 nt, Homo sapiens
gagcgccguucucuaauga

SEQ ID NO: 1302821 - RNA, 19 nt, Homo sapiens
gcaagcagcugaaaaggaa

SEQ ID NO: 1302822 - RNA, 19 nt, Homo sapiens
aaagaaagacucagguaaa

SEQ ID NO: 1302823 - RNA, 19 nt, Homo sapiens
gagggaagcuggugcacau

SEQ ID NO: 1302824 - RNA, 19 nt, Homo sapiens
gaagcaggacugacaagaa

SEQ ID NO: 1302825 - RNA, 19 nt, Homo sapiens
gaaggcagcaguguggaua

SEQ ID NO: 1302826 - RNA, 19 nt, Homo sapiens
uaaagaaagacucagguaa

SEQ ID NO: 1302827 - RNA, 19 nt, Homo sapiens
caggagcgccguucucuaa

SEQ ID NO: 1302828 - RNA, 19 nt, Homo sapiens
ccagacagcuguggcaugu

SEQ ID NO: 1302829 - RNA, 19 nt, Homo sapiens
ggagcgccguucucuaaug

SEQ ID NO: 1302830 - RNA, 19 nt, Homo sapiens
ggaggcugcuggcacaaga

SEQ ID NO: 1302831 - RNA, 19 nt, Homo sapiens
gcccacaucuuucccacaa

SEQ ID NO: 1302832 - RNA, 19 nt, Homo sapiens
gcagaaagagguucaagag

SEQ ID NO: 1302833 - RNA, 19 nt, Homo sapiens
aggagacgcugcagaaaga

SEQ ID NO: 1302834 - RNA, 19 nt, Homo sapiens
uucaagagcugcaggauuc

SEQ ID NO: 1302835 - RNA, 19 nt, Homo sapiens
cgaaggagaagcauucaga

SEQ ID NO: 1302836 - RNA, 19 nt, Homo sapiens
ggacugacaagaagaugga

SEQ ID NO: 1302837 - RNA, 19 nt, Homo sapiens
uggaacagguggcucagaa

SEQ ID NO: 1302838 - RNA, 19 nt, Homo sapiens
gagcugaacagggauuuau

SEQ ID NO: 1302839 - RNA, 19 nt, Homo sapiens
gcugcaggauucccucuug

SEQ ID NO: 1302840 - RNA, 19 nt, Homo sapiens
gaaggagacgcugcagaaa

SEQ ID NO: 1302841 - RNA, 19 nt, Homo sapiens
gaagagcaacgccggaagu

SEQ ID NO: 1302842 - RNA, 19 nt, Homo sapiens
gccaggcaauaaagaaaga

SEQ ID NO: 1302843 - RNA, 19 nt, Homo sapiens
cagaagcagcccuacagua

SEQ ID NO: 1302844 - RNA, 19 nt, Homo sapiens
aagcagcccuacaguacaa

SEQ ID NO: 1302845 - RNA, 19 nt, Homo sapiens
aagcaggacugacaagaag

SEQ ID NO: 1302846 - RNA, 19 nt, Homo sapiens
gggcguggccaggcaauaa

SEQ ID NO: 1302847 - RNA, 19 nt, Homo sapiens
agaaggagacgcugcagaa

SEQ ID NO: 1302848 - RNA, 19 nt, Homo sapiens
ugacgaaggagaagcauuc

SEQ ID NO: 1302849 - RNA, 19 nt, Homo sapiens
aaacagcaguggcggacau

SEQ ID NO: 1302850 - RNA, 19 nt, Homo sapiens
agaggaggcugccauggau

SEQ ID NO: 1302851 - RNA, 19 nt, Homo sapiens
caucuggccuugcaguaca

SEQ ID NO: 1302852 - RNA, 19 nt, Homo sapiens
gagcccugcccacaucuuu

SEQ ID NO: 1302853 - RNA, 19 nt, Homo sapiens
gaaguuggagcagcagaug

SEQ ID NO: 1302854 - RNA, 19 nt, Homo sapiens
ggaagcaggacugacaaga

SEQ ID NO: 1302855 - RNA, 19 nt, Homo sapiens
gccguucucuaaugaagau

SEQ ID NO: 1302856 - RNA, 19 nt, Homo sapiens
gaagcagcccuacaguaca

SEQ ID NO: 1302857 - RNA, 19 nt, Homo sapiens
gcuguggcaugucauaaac

SEQ ID NO: 1302858 - RNA, 19 nt, Homo sapiens
gcucaaaugcuuuaaucgu

SEQ ID NO: 1302859 - RNA, 19 nt, Homo sapiens
auaaagaaagacucaggua

SEQ ID NO: 1302860 - RNA, 19 nt, Homo sapiens
ggagaagacacaaauucag

SEQ ID NO: 1302861 - RNA, 19 nt, Homo sapiens
ggacgaggaagagugguau

SEQ ID NO: 1302862 - RNA, 19 nt, Homo sapiens
guucaagagcugcaggauu

SEQ ID NO: 1302863 - RNA, 19 nt, Homo sapiens
gcaggacugacaagaagau

SEQ ID NO: 1302864 - RNA, 19 nt, Homo sapiens
agaagcagcccuacaguac

SEQ ID NO: 1302865 - RNA, 19 nt, Homo sapiens
aagaaagacucagguaaaa

SEQ ID NO: 1302866 - RNA, 19 nt, Homo sapiens
ggcaauaaagaaagacuca

SEQ ID NO: 1302867 - RNA, 19 nt, Homo sapiens
guccuggagugacaucaug

SEQ ID NO: 1302868 - RNA, 19 nt, Homo sapiens
gggacgaggaagaguggua

SEQ ID NO: 1302869 - RNA, 19 nt, Homo sapiens
gcgccguucucuaaugaag

SEQ ID NO: 1302870 - RNA, 19 nt, Homo sapiens
cuaggaagcaggacugaca

SEQ ID NO: 1302871 - RNA, 19 nt, Homo sapiens
ggaaguuggagcagcagau

SEQ ID NO: 1302872 - RNA, 19 nt, Homo sapiens
aggagcagcugcagucucu

SEQ ID NO: 1302873 - RNA, 19 nt, Homo sapiens
gagagggguugacgaagga

SEQ ID NO: 1302874 - RNA, 19 nt, Homo sapiens
gugaaggccucagcaugca

SEQ ID NO: 1302875 - RNA, 19 nt, Homo sapiens
uggagaagacacaaauuca

SEQ ID NO: 1302876 - RNA, 19 nt, Homo sapiens
cgacuggagaagacacaaa

SEQ ID NO: 1302877 - RNA, 19 nt, Homo sapiens
cugcaggauucccucuuga

SEQ ID NO: 1302878 - RNA, 19 nt, Homo sapiens
gacuggagaagacacaaau

SEQ ID NO: 1302879 - RNA, 19 nt, Homo sapiens
gcaggagcacagcagaauc

SEQ ID NO: 1302880 - RNA, 19 nt, Homo sapiens
aagaggaggcugccaugga

SEQ ID NO: 1302881 - RNA, 19 nt, Homo sapiens
gagcagcagauggcacuca

SEQ ID NO: 1302882 - RNA, 19 nt, Homo sapiens
ugaacagggauuuaugcaa

SEQ ID NO: 1302883 - RNA, 19 nt, Homo sapiens
ugaguagccgagaggauga

SEQ ID NO: 1302884 - RNA, 19 nt, Homo sapiens
gaagguauauugcuaguua

SEQ ID NO: 1302885 - RNA, 19 nt, Homo sapiens
gcagaaagaucucagagua

SEQ ID NO: 1302886 - RNA, 19 nt, Homo sapiens
gaagauauauaaccguuca

SEQ ID NO: 1302887 - RNA, 19 nt, Homo sapiens
gcacaagguucaaguuuag

SEQ ID NO: 1302888 - RNA, 19 nt, Homo sapiens
ugaguaagcugauuugaau

SEQ ID NO: 1302889 - RNA, 19 nt, Homo sapiens
gagaacgucugcagcaauu

SEQ ID NO: 1302890 - RNA, 19 nt, Homo sapiens
gcgcuuauguuacaaguug

SEQ ID NO: 1302891 - RNA, 19 nt, Homo sapiens
ccgcuuaguuucugaauuu

SEQ ID NO: 1302892 - RNA, 19 nt, Homo sapiens
ggcacaagguucaaguuua

SEQ ID NO: 1302893 - RNA, 19 nt, Homo sapiens
gaagaugaccugcccagaa

SEQ ID NO: 1302894 - RNA, 19 nt, Homo sapiens
gcacuuggaaacacaauaa

SEQ ID NO: 1302895 - RNA, 19 nt, Homo sapiens
gaaugugcaugccuacuug

SEQ ID NO: 1302896 - RNA, 19 nt, Homo sapiens
gaaugaggcugcagucagu

SEQ ID NO: 1302897 - RNA, 19 nt, Homo sapiens
gaagaacuggcaaguguuu

SEQ ID NO: 1302898 - RNA, 19 nt, Homo sapiens
gugaagaacuggcaagugu

SEQ ID NO: 1302899 - RNA, 19 nt, Homo sapiens
ccaauuuacuugcauaugu

SEQ ID NO: 1302900 - RNA, 19 nt, Homo sapiens
agaaagaucucagaguaaa

SEQ ID NO: 1302901 - RNA, 19 nt, Homo sapiens
ugacaucucugccagucua

SEQ ID NO: 1302902 - RNA, 19 nt, Homo sapiens
gagcaucacagaagguaua

SEQ ID NO: 1302903 - RNA, 19 nt, Homo sapiens
gaaucuaaguguuuguaug

SEQ ID NO: 1302904 - RNA, 19 nt, Homo sapiens
caacuccgauucagaagau

SEQ ID NO: 1302905 - RNA, 19 nt, Homo sapiens
aaagugaggugcaagaugu

SEQ ID NO: 1302906 - RNA, 19 nt, Homo sapiens
ggucagauaucagugaaga

SEQ ID NO: 1302907 - RNA, 19 nt, Homo sapiens
ugaaauagcccucauaaaa

SEQ ID NO: 1302908 - RNA, 19 nt, Homo sapiens
acucaugucugaauuagaa

SEQ ID NO: 1302909 - RNA, 19 nt, Homo sapiens
guauugcgcuuauguuaca

SEQ ID NO: 1302910 - RNA, 19 nt, Homo sapiens
ggaagaggauaaguacaug

SEQ ID NO: 1302911 - RNA, 19 nt, Homo sapiens
gaugaaaguggaaugaauu

SEQ ID NO: 1302912 - RNA, 19 nt, Homo sapiens
caagauguauuagaccauu

SEQ ID NO: 1302913 - RNA, 19 nt, Homo sapiens
gaagacuauugauaccaaa

SEQ ID NO: 1302914 - RNA, 19 nt, Homo sapiens
ugaggacucugauaaugaa

SEQ ID NO: 1302915 - RNA, 19 nt, Homo sapiens
gaagaugaaaguggaauga

SEQ ID NO: 1302916 - RNA, 19 nt, Homo sapiens
ucagauaugugaaguugau

SEQ ID NO: 1302917 - RNA, 19 nt, Homo sapiens
guucuaacuugucugcuuu

SEQ ID NO: 1302918 - RNA, 19 nt, Homo sapiens
gguaauuauugcagauuga

SEQ ID NO: 1302919 - RNA, 19 nt, Homo sapiens
uaucauggcuuugggaaug

SEQ ID NO: 1302920 - RNA, 19 nt, Homo sapiens
cacagaagguauauugcua

SEQ ID NO: 1302921 - RNA, 19 nt, Homo sapiens
ccaaucaaguuaaucuuag

SEQ ID NO: 1302922 - RNA, 19 nt, Homo sapiens
ugacaguugugacagcuuu

SEQ ID NO: 1302923 - RNA, 19 nt, Homo sapiens
cagcuuugcuucugauaau

SEQ ID NO: 1302924 - RNA, 19 nt, Homo sapiens
gaccuugaaucgauaagug

SEQ ID NO: 1302925 - RNA, 19 nt, Homo sapiens
caucacagaagguauauug

SEQ ID NO: 1302926 - RNA, 19 nt, Homo sapiens
gaccguggauggcuacaug

SEQ ID NO: 1302927 - RNA, 19 nt, Homo sapiens
guguuuguauguccaauuu

SEQ ID NO: 1302928 - RNA, 19 nt, Homo sapiens
cauguaagguauugcaaau

SEQ ID NO: 1302929 - RNA, 19 nt, Homo sapiens
aaacgaguaugauuuagca

SEQ ID NO: 1302930 - RNA, 19 nt, Homo sapiens
auaagaaacuccaaucaag

SEQ ID NO: 1302931 - RNA, 19 nt, Homo sapiens
ugaucagccuguuucauaa

SEQ ID NO: 1302932 - RNA, 19 nt, Homo sapiens
ucacugggcucuacuuguc

SEQ ID NO: 1302933 - RNA, 19 nt, Homo sapiens
guggauggcuacaugaaug

SEQ ID NO: 1302934 - RNA, 19 nt, Homo sapiens
ggccagaugucacuaacga

SEQ ID NO: 1302935 - RNA, 19 nt, Homo sapiens
gaaagugaggugcaagaug

SEQ ID NO: 1302936 - RNA, 19 nt, Homo sapiens
cgaguaugauuuagcauuc

SEQ ID NO: 1302937 - RNA, 19 nt, Homo sapiens
cgucagaagacuauugaua

SEQ ID NO: 1302938 - RNA, 19 nt, Homo sapiens
gcaagcauaauaucuggaa

SEQ ID NO: 1302939 - RNA, 19 nt, Homo sapiens
ggaaugugcaugccuacuu

SEQ ID NO: 1302940 - RNA, 19 nt, Homo sapiens
cuaacgaacuggccgguau

SEQ ID NO: 1302941 - RNA, 19 nt, Homo sapiens
gaucucagaguaaagaaga

SEQ ID NO: 1302942 - RNA, 19 nt, Homo sapiens
gagguggaaucuaaguguu

SEQ ID NO: 1302943 - RNA, 19 nt, Homo sapiens
gauuuagcauucauacuag

SEQ ID NO: 1302944 - RNA, 19 nt, Homo sapiens
ugaggugcaagauguauua

SEQ ID NO: 1302945 - RNA, 19 nt, Homo sapiens
gcaaacacgaaaccuaaau

SEQ ID NO: 1302946 - RNA, 19 nt, Homo sapiens
ggacucugauaaugaaucu

SEQ ID NO: 1302947 - RNA, 19 nt, Homo sapiens
uaugaggacucugauaaug

SEQ ID NO: 1302948 - RNA, 19 nt, Homo sapiens
ggugggcaauguaauacuu

SEQ ID NO: 1302949 - RNA, 19 nt, Homo sapiens
cauaagaaacuccaaucaa

SEQ ID NO: 1302950 - RNA, 19 nt, Homo sapiens
cagaaagaucucagaguaa

SEQ ID NO: 1302951 - RNA, 19 nt, Homo sapiens
aaacuagucugugguucuu

SEQ ID NO: 1302952 - RNA, 19 nt, Homo sapiens
agaagacuauugauaccaa

SEQ ID NO: 1302953 - RNA, 19 nt, Homo sapiens
ugaaguugauuuccaugga

SEQ ID NO: 1302954 - RNA, 19 nt, Homo sapiens
caaacacgaaaccuaaauu

SEQ ID NO: 1302955 - RNA, 19 nt, Homo sapiens
gguggaaucuaaguguuug

SEQ ID NO: 1302956 - RNA, 19 nt, Homo sapiens
guucacauguaagguauug

SEQ ID NO: 1302957 - RNA, 19 nt, Homo sapiens
guugaaauagcccucauaa

SEQ ID NO: 1302958 - RNA, 19 nt, Homo sapiens
ggaggaagaggauaaguac

SEQ ID NO: 1302959 - RNA, 19 nt, Homo sapiens
uugcauauguaaaccauug

SEQ ID NO: 1302960 - RNA, 19 nt, Homo sapiens
caucaaugccgucagaaga

SEQ ID NO: 1302961 - RNA, 19 nt, Homo sapiens
gauuaugaguaagcugauu

SEQ ID NO: 1302962 - RNA, 19 nt, Homo sapiens
aaauucaggucagauauca

SEQ ID NO: 1302963 - RNA, 19 nt, Homo sapiens
aaacucaugucugaauuag

SEQ ID NO: 1302964 - RNA, 19 nt, Homo sapiens
ucaguucacauguaaggua

SEQ ID NO: 1302965 - RNA, 19 nt, Homo sapiens
aagaugaccugcccagaag

SEQ ID NO: 1302966 - RNA, 19 nt, Homo sapiens
ccuaaauucaggucagaua

SEQ ID NO: 1302967 - RNA, 19 nt, Homo sapiens
guuggugggcaauguaaua

SEQ ID NO: 1302968 - RNA, 19 nt, Homo sapiens
ugucaucaaugccgucaga

SEQ ID NO: 1302969 - RNA, 19 nt, Homo sapiens
agaugaaaguggaaugaau

SEQ ID NO: 1302970 - RNA, 19 nt, Homo sapiens
ggugcaagauguauuagac

SEQ ID NO: 1302971 - RNA, 19 nt, Homo sapiens
gcaaaguuuauuucaguuc

SEQ ID NO: 1302972 - RNA, 19 nt, Homo sapiens
gcacaaaagucuuaaaacc

SEQ ID NO: 1302973 - RNA, 19 nt, Homo sapiens
ucacugaaaccugaguuaa

SEQ ID NO: 1302974 - RNA, 19 nt, Homo sapiens
ggagaacgucugcagcaau

SEQ ID NO: 1302975 - RNA, 19 nt, Homo sapiens
gauaugugaaguugauuuc

SEQ ID NO: 1302976 - RNA, 19 nt, Homo sapiens
cagaguaaagaagaacuua

SEQ ID NO: 1302977 - RNA, 19 nt, Homo sapiens
ucacaguugagacuuaauu

SEQ ID NO: 1302978 - RNA, 19 nt, Homo sapiens
ugucacaguugagacuuaa

SEQ ID NO: 1302979 - RNA, 19 nt, Homo sapiens
guauauugcuaguuacacu

SEQ ID NO: 1302980 - RNA, 19 nt, Homo sapiens
aaucuuagcagacaugugu

SEQ ID NO: 1302981 - RNA, 19 nt, Homo sapiens
uaagaaacuccaaucaagu

SEQ ID NO: 1302982 - RNA, 19 nt, Homo sapiens
gcauuaaucaagguauuug

SEQ ID NO: 1302983 - RNA, 19 nt, Homo sapiens
gcuccucuccaaccgcuua

SEQ ID NO: 1302984 - RNA, 19 nt, Homo sapiens
gaagguauauugcuaguua

SEQ ID NO: 1302985 - RNA, 19 nt, Homo sapiens
gcagaaagaucucagagua

SEQ ID NO: 1302986 - RNA, 19 nt, Homo sapiens
gaagauauauaaccguuca

SEQ ID NO: 1302987 - RNA, 19 nt, Homo sapiens
gcacaagguucaaguuuag

SEQ ID NO: 1302988 - RNA, 19 nt, Homo sapiens
ugaguaagcugauuugaau

SEQ ID NO: 1302989 - RNA, 19 nt, Homo sapiens
gagaacgucugcagcaauu

SEQ ID NO: 1302990 - RNA, 19 nt, Homo sapiens
gcgcuuauguuacaaguug

SEQ ID NO: 1302991 - RNA, 19 nt, Homo sapiens
ccgcuuaguuucugaauuu

SEQ ID NO: 1302992 - RNA, 19 nt, Homo sapiens
ggcacaagguucaaguuua

SEQ ID NO: 1302993 - RNA, 19 nt, Homo sapiens
gaagaugaccugcccagaa

SEQ ID NO: 1302994 - RNA, 19 nt, Homo sapiens
gcacuuggaaacacaauaa

SEQ ID NO: 1302995 - RNA, 19 nt, Homo sapiens
gaaugugcaugccuacuug

SEQ ID NO: 1302996 - RNA, 19 nt, Homo sapiens
ccaauuuacuugcauaugu

SEQ ID NO: 1302997 - RNA, 19 nt, Homo sapiens
agaaagaucucagaguaaa

SEQ ID NO: 1302998 - RNA, 19 nt, Homo sapiens
ugacaucucugccagucua

SEQ ID NO: 1302999 - RNA, 19 nt, Homo sapiens
gagcaucacagaagguaua

SEQ ID NO: 1303000 - RNA, 19 nt, Homo sapiens
gaaucuaaguguuuguaug

SEQ ID NO: 1303001 - RNA, 19 nt, Homo sapiens
caacuccgauucagaagau

SEQ ID NO: 1303002 - RNA, 19 nt, Homo sapiens
ugaaauagcccucauaaaa

SEQ ID NO: 1303003 - RNA, 19 nt, Homo sapiens
acucaugucugaauuagaa

SEQ ID NO: 1303004 - RNA, 19 nt, Homo sapiens
guauugcgcuuauguuaca

SEQ ID NO: 1303005 - RNA, 19 nt, Homo sapiens
ggaagaggauaaguacaug

SEQ ID NO: 1303006 - RNA, 19 nt, Homo sapiens
gaugaaaguggaaugaauu

SEQ ID NO: 1303007 - RNA, 19 nt, Homo sapiens
gaagacuauugauaccaaa

SEQ ID NO: 1303008 - RNA, 19 nt, Homo sapiens
ucagauaugugaaguugau

SEQ ID NO: 1303009 - RNA, 19 nt, Homo sapiens
gaagaugaaaguggaauga

SEQ ID NO: 1303010 - RNA, 19 nt, Homo sapiens
guucuaacuugucugcuuu

SEQ ID NO: 1303011 - RNA, 19 nt, Homo sapiens
gguaauuauugcagauuga

SEQ ID NO: 1303012 - RNA, 19 nt, Homo sapiens
uaucauggcuuugggaaug

SEQ ID NO: 1303013 - RNA, 19 nt, Homo sapiens
cacagaagguauauugcua

SEQ ID NO: 1303014 - RNA, 19 nt, Homo sapiens
ccaaucaaguuaaucuuag

SEQ ID NO: 1303015 - RNA, 19 nt, Homo sapiens
cagcuuugcuucugauaau

SEQ ID NO: 1303016 - RNA, 19 nt, Homo sapiens
ugacaguugugacagcuuu

SEQ ID NO: 1303017 - RNA, 19 nt, Homo sapiens
gaccuugaaucgauaagug

SEQ ID NO: 1303018 - RNA, 19 nt, Homo sapiens
caucacagaagguauauug

SEQ ID NO: 1303019 - RNA, 19 nt, Homo sapiens
gaccguggauggcuacaug

SEQ ID NO: 1303020 - RNA, 19 nt, Homo sapiens
guguuuguauguccaauuu

SEQ ID NO: 1303021 - RNA, 19 nt, Homo sapiens
cauguaagguauugcaaau

SEQ ID NO: 1303022 - RNA, 19 nt, Homo sapiens
aaacgaguaugauuuagca

SEQ ID NO: 1303023 - RNA, 19 nt, Homo sapiens
auaagaaacuccaaucaag

SEQ ID NO: 1303024 - RNA, 19 nt, Homo sapiens
ugaucagccuguuucauaa

SEQ ID NO: 1303025 - RNA, 19 nt, Homo sapiens
ucacugggcucuacuuguc

SEQ ID NO: 1303026 - RNA, 19 nt, Homo sapiens
guggauggcuacaugaaug

SEQ ID NO: 1303027 - RNA, 19 nt, Homo sapiens
cgaguaugauuuagcauuc

SEQ ID NO: 1303028 - RNA, 19 nt, Homo sapiens
cgucagaagacuauugaua

SEQ ID NO: 1303029 - RNA, 19 nt, Homo sapiens
gaucucagaguaaagaaga

SEQ ID NO: 1303030 - RNA, 19 nt, Homo sapiens
gcaagcauaauaucuggaa

SEQ ID NO: 1303031 - RNA, 19 nt, Homo sapiens
ggaaugugcaugccuacuu

SEQ ID NO: 1303032 - RNA, 19 nt, Homo sapiens
gagguggaaucuaaguguu

SEQ ID NO: 1303033 - RNA, 19 nt, Homo sapiens
gauuuagcauucauacuag

SEQ ID NO: 1303034 - RNA, 19 nt, Homo sapiens
ggugggcaauguaauacuu

SEQ ID NO: 1303035 - RNA, 19 nt, Homo sapiens
cauaagaaacuccaaucaa

SEQ ID NO: 1303036 - RNA, 19 nt, Homo sapiens
acacgaggcugcagucagu

SEQ ID NO: 1303037 - RNA, 19 nt, Homo sapiens
ugaaguugauuuccaugga

SEQ ID NO: 1303038 - RNA, 19 nt, Homo sapiens
cagaaagaucucagaguaa

SEQ ID NO: 1303039 - RNA, 19 nt, Homo sapiens
aaacuagucugugguucuu

SEQ ID NO: 1303040 - RNA, 19 nt, Homo sapiens
agaagacuauugauaccaa

SEQ ID NO: 1303041 - RNA, 19 nt, Homo sapiens
gguggaaucuaaguguuug

SEQ ID NO: 1303042 - RNA, 19 nt, Homo sapiens
guucacauguaagguauug

SEQ ID NO: 1303043 - RNA, 19 nt, Homo sapiens
guugaaauagcccucauaa

SEQ ID NO: 1303044 - RNA, 19 nt, Homo sapiens
ggaggaagaggauaaguac

SEQ ID NO: 1303045 - RNA, 19 nt, Homo sapiens
uugcauauguaaaccauug

SEQ ID NO: 1303046 - RNA, 19 nt, Homo sapiens
caucaaugccgucagaaga

SEQ ID NO: 1303047 - RNA, 19 nt, Homo sapiens
gauuaugaguaagcugauu

SEQ ID NO: 1303048 - RNA, 19 nt, Homo sapiens
aaacucaugucugaauuag

SEQ ID NO: 1303049 - RNA, 19 nt, Homo sapiens
ucaguucacauguaaggua

SEQ ID NO: 1303050 - RNA, 19 nt, Homo sapiens
aagaugaccugcccagaag

SEQ ID NO: 1303051 - RNA, 19 nt, Homo sapiens
guuggugggcaauguaaua

SEQ ID NO: 1303052 - RNA, 19 nt, Homo sapiens
ugucaucaaugccgucaga

SEQ ID NO: 1303053 - RNA, 19 nt, Homo sapiens
agaugaaaguggaaugaau

SEQ ID NO: 1303054 - RNA, 19 nt, Homo sapiens
gcaaaguuuauuucaguuc

SEQ ID NO: 1303055 - RNA, 19 nt, Homo sapiens
gcacaaaagucuuaaaacc

SEQ ID NO: 1303056 - RNA, 19 nt, Homo sapiens
ucacugaaaccugaguuaa

SEQ ID NO: 1303057 - RNA, 19 nt, Homo sapiens
ggagaacgucugcagcaau

SEQ ID NO: 1303058 - RNA, 19 nt, Homo sapiens
ucacaguugagacuuaauu

SEQ ID NO: 1303059 - RNA, 19 nt, Homo sapiens
ugucacaguugagacuuaa

SEQ ID NO: 1303060 - RNA, 19 nt, Homo sapiens
guauauugcuaguuacacu

SEQ ID NO: 1303061 - RNA, 19 nt, Homo sapiens
aaucuuagcagacaugugu

SEQ ID NO: 1303062 - RNA, 19 nt, Homo sapiens
uaagaaacuccaaucaagu

SEQ ID NO: 1303063 - RNA, 19 nt, Homo sapiens
cagaguaaagaagaacuua

SEQ ID NO: 1303064 - RNA, 19 nt, Homo sapiens
gauaugugaaguugauuuc

SEQ ID NO: 1303065 - RNA, 19 nt, Homo sapiens
gcauuaaucaagguauuug

SEQ ID NO: 1303066 - RNA, 19 nt, Homo sapiens
gcuccucuccaaccgcuua

SEQ ID NO: 1303067 - RNA, 19 nt, Homo sapiens
cucgagagaagauauauaa

SEQ ID NO: 1303068 - RNA, 19 nt, Homo sapiens
gaacgucugcagcaauucu

SEQ ID NO: 1303069 - RNA, 19 nt, Homo sapiens
gcaguuuguuaaccugaca

SEQ ID NO: 1303070 - RNA, 19 nt, Homo sapiens
ucuuugcaguuucuuguaa

SEQ ID NO: 1303071 - RNA, 19 nt, Homo sapiens
gaaauagcccucauaaaac

SEQ ID NO: 1303072 - RNA, 19 nt, Homo sapiens
aaagaucucagaguaaaga

SEQ ID NO: 1303073 - RNA, 19 nt, Homo sapiens
ucgaaaccguuauggugaa

SEQ ID NO: 1303074 - RNA, 19 nt, Homo sapiens
gcuuugcuucugauaauuu

SEQ ID NO: 1303075 - RNA, 19 nt, Homo sapiens
uagcauucauacuaguuga

SEQ ID NO: 1303076 - RNA, 19 nt, Homo sapiens
gaguaugauuuagcauuca

SEQ ID NO: 1303077 - RNA, 19 nt, Homo sapiens
gggcucuacuugucaucaa

SEQ ID NO: 1303078 - RNA, 19 nt, Homo sapiens
cagaggaggaguuggagaa

SEQ ID NO: 1303079 - RNA, 19 nt, Homo sapiens
cuacaugaaugaagaugac

SEQ ID NO: 1303080 - RNA, 19 nt, Homo sapiens
gaagaggauaaguacaugu

SEQ ID NO: 1303081 - RNA, 19 nt, Homo sapiens
caaaacucaugucugaauu

SEQ ID NO: 1303082 - RNA, 19 nt, Homo sapiens
ggaaucuaaguguuuguau

SEQ ID NO: 1303083 - RNA, 19 nt, Homo sapiens
ugacagcuuugcuucugau

SEQ ID NO: 1303084 - RNA, 19 nt, Homo sapiens
gaacauguaugaacugcau

SEQ ID NO: 1303085 - RNA, 19 nt, Homo sapiens
gaguugaccugaucaugaa

SEQ ID NO: 1303086 - RNA, 19 nt, Homo sapiens
caagugaccugcagcaagu

SEQ ID NO: 1303087 - RNA, 19 nt, Homo sapiens
ggaauuugcuaagaacaug

SEQ ID NO: 1303088 - RNA, 19 nt, Homo sapiens
cagaugaagugguuguuga

SEQ ID NO: 1303089 - RNA, 19 nt, Homo sapiens
ggacacaagucuccagaac

SEQ ID NO: 1303090 - RNA, 19 nt, Homo sapiens
caagggugcugcccgaguu

SEQ ID NO: 1303091 - RNA, 19 nt, Homo sapiens
gagcauaguguugcaauau

SEQ ID NO: 1303092 - RNA, 19 nt, Homo sapiens
ugagucagaugaagugguu

SEQ ID NO: 1303093 - RNA, 19 nt, Homo sapiens
ugaagugguuguugacaug

SEQ ID NO: 1303094 - RNA, 19 nt, Homo sapiens
ggaggucaccaauugcuuu

SEQ ID NO: 1303095 - RNA, 19 nt, Homo sapiens
gacauggaauuugcuaaga

SEQ ID NO: 1303096 - RNA, 19 nt, Homo sapiens
cuaagaacauguaugaacu

SEQ ID NO: 1303097 - RNA, 19 nt, Homo sapiens
gcuaagaacauguaugaac

SEQ ID NO: 1303098 - RNA, 19 nt, Homo sapiens
caacugugugugacucuaa

SEQ ID NO: 1303099 - RNA, 19 nt, Homo sapiens
ugagcauaguguugcaaua

SEQ ID NO: 1303100 - RNA, 19 nt, Homo sapiens
gaucaugaagaccugcuuu

SEQ ID NO: 1303101 - RNA, 19 nt, Homo sapiens
acauggaauuugcuaagaa

SEQ ID NO: 1303102 - RNA, 19 nt, Homo sapiens
acucugugcugauccauga

SEQ ID NO: 1303103 - RNA, 19 nt, Homo sapiens
ggacucagaagugaaggaa

SEQ ID NO: 1303104 - RNA, 19 nt, Homo sapiens
agaguugaccugaucauga

SEQ ID NO: 1303105 - RNA, 19 nt, Homo sapiens
cuguggaggucaccaauug

SEQ ID NO: 1303106 - RNA, 19 nt, Homo sapiens
ugacagugaaauaugcaua

SEQ ID NO: 1303107 - RNA, 19 nt, Homo sapiens
uauucacacucuucucuga

SEQ ID NO: 1303108 - RNA, 19 nt, Homo sapiens
aagccuaugucagcacuuu

SEQ ID NO: 1303109 - RNA, 19 nt, Homo sapiens
uugcuaagaacauguauga

SEQ ID NO: 1303110 - RNA, 19 nt, Homo sapiens
caccuuugacagugaaaua

SEQ ID NO: 1303111 - RNA, 19 nt, Homo sapiens
ggaggaccgugggaguguu

SEQ ID NO: 1303112 - RNA, 19 nt, Homo sapiens
ugguuggacucucaaguga

SEQ ID NO: 1303113 - RNA, 19 nt, Homo sapiens
gccuaugucagcacuuuaa

SEQ ID NO: 1303114 - RNA, 19 nt, Homo sapiens
caaugagucagaugaagug

SEQ ID NO: 1303115 - RNA, 19 nt, Homo sapiens
cauacaaugagucagauga

SEQ ID NO: 1303116 - RNA, 19 nt, Homo sapiens
ugggaacugucaacaaaca

SEQ ID NO: 1303117 - RNA, 19 nt, Homo sapiens
uagccuaccuuuuguaaau

SEQ ID NO: 1303118 - RNA, 19 nt, Homo sapiens
gugugugacucuaauaaac

SEQ ID NO: 1303119 - RNA, 19 nt, Homo sapiens
cuccagaacggccauauga

SEQ ID NO: 1303120 - RNA, 19 nt, Homo sapiens
agucacagauugcccucaa

SEQ ID NO: 1303121 - RNA, 19 nt, Homo sapiens
gcugauccaugaguacuac

SEQ ID NO: 1303122 - RNA, 19 nt, Homo sapiens
gaagccaccccaagcagua

SEQ ID NO: 1303123 - RNA, 19 nt, Homo sapiens
cauggaauuugcuaagaac

SEQ ID NO: 1303124 - RNA, 19 nt, Homo sapiens
gacccuggccucagcacaa

SEQ ID NO: 1303125 - RNA, 19 nt, Homo sapiens
gagcaucaaagccuauguc

SEQ ID NO: 1303126 - RNA, 19 nt, Homo sapiens
ugacauggaauuugcuaag

SEQ ID NO: 1303127 - RNA, 19 nt, Homo sapiens
acucagaagugaaggaaaa

SEQ ID NO: 1303128 - RNA, 19 nt, Homo sapiens
uaugucagcacuuuaaugg

SEQ ID NO: 1303129 - RNA, 19 nt, Homo sapiens
ucaacugugugugacucua

SEQ ID NO: 1303130 - RNA, 19 nt, Homo sapiens
ccucacacagucacagauu

SEQ ID NO: 1303131 - RNA, 19 nt, Homo sapiens
acaauacaaucaggaaggu

SEQ ID NO: 1303132 - RNA, 19 nt, Homo sapiens
gccuaccuuuuguaaauua

SEQ ID NO: 1303133 - RNA, 19 nt, Homo sapiens
ggccauaugagcaucaaag

SEQ ID NO: 1303134 - RNA, 19 nt, Homo sapiens
uaagaacauguaugaacug

SEQ ID NO: 1303135 - RNA, 19 nt, Homo sapiens
ccgaugacuuugagaccau

SEQ ID NO: 1303136 - RNA, 19 nt, Homo sapiens
ggucaccaauugcuuuuca

SEQ ID NO: 1303137 - RNA, 19 nt, Homo sapiens
gugguuggacucucaagug

SEQ ID NO: 1303138 - RNA, 19 nt, Homo sapiens
gcuaugagagacgcaacaa

SEQ ID NO: 1303139 - RNA, 19 nt, Homo sapiens
cagugaaauaugcauacua

SEQ ID NO: 1303140 - RNA, 19 nt, Homo sapiens
gaauuugcuaagaacaugu

SEQ ID NO: 1303141 - RNA, 19 nt, Homo sapiens
acaaugagucagaugaagu

SEQ ID NO: 1303142 - RNA, 19 nt, Homo sapiens
guucaaagcuggacucaug

SEQ ID NO: 1303143 - RNA, 19 nt, Homo sapiens
gaacaggcgugccaagucu

SEQ ID NO: 1303144 - RNA, 19 nt, Homo sapiens
gaacugaaacgaaaugucu

SEQ ID NO: 1303145 - RNA, 19 nt, Homo sapiens
ggccggagauuauccucaa

SEQ ID NO: 1303146 - RNA, 19 nt, Homo sapiens
gaaauccuuccaaccuuug

SEQ ID NO: 1303147 - RNA, 19 nt, Homo sapiens
ccacugugcuccuggaacu

SEQ ID NO: 1303148 - RNA, 19 nt, Homo sapiens
gcucccaaggucagaauuu

SEQ ID NO: 1303149 - RNA, 19 nt, Homo sapiens
gccgcaagcgcacgucuuu

SEQ ID NO: 1303150 - RNA, 19 nt, Homo sapiens
uggcuaggccggagauuau

SEQ ID NO: 1303151 - RNA, 19 nt, Homo sapiens
gaagacauugguucaaagc

SEQ ID NO: 1303152 - RNA, 19 nt, Homo sapiens
uccuggaacugaaacgaaa

SEQ ID NO: 1303153 - RNA, 19 nt, Homo sapiens
acacaucuuuucugccuuu

SEQ ID NO: 1303154 - RNA, 19 nt, Homo sapiens
ggaacugaaacgaaauguc

SEQ ID NO: 1303155 - RNA, 19 nt, Homo sapiens
cgcaagcgcacgucuuuca

SEQ ID NO: 1303156 - RNA, 19 nt, Homo sapiens
cagcagaaccuguacuuua

SEQ ID NO: 1303157 - RNA, 19 nt, Homo sapiens
gaagauggagccucuguca

SEQ ID NO: 1303158 - RNA, 19 nt, Homo sapiens
agcagaaccuguacuuuaa

SEQ ID NO: 1303159 - RNA, 19 nt, Homo sapiens
gagcagcugcgucaaguau

SEQ ID NO: 1303160 - RNA, 19 nt, Homo sapiens
gcagcugcgucaaguaucu

SEQ ID NO: 1303161 - RNA, 19 nt, Homo sapiens
ucaaguaucugaucuuccu

SEQ ID NO: 1303162 - RNA, 19 nt, Homo sapiens
cuacccagcucgcucacuu

SEQ ID NO: 1303163 - RNA, 19 nt, Homo sapiens
gggagcagcugcgucaagu

SEQ ID NO: 1303164 - RNA, 19 nt, Homo sapiens
cgucaaguaucugaucuuc

SEQ ID NO: 1303165 - RNA, 19 nt, Homo sapiens
gcagcagaaccuguacuuu

SEQ ID NO: 1303166 - RNA, 19 nt, Homo sapiens
gaucuuccucuccaacuuc

SEQ ID NO: 1303167 - RNA, 19 nt, Homo sapiens
gagaggagccccuuacugu

SEQ ID NO: 1303168 - RNA, 19 nt, Homo sapiens
ggaaacugcaggccagaag

SEQ ID NO: 1303169 - RNA, 19 nt, Homo sapiens
ggagcagcugcgucaagua

SEQ ID NO: 1303170 - RNA, 19 nt, Homo sapiens
cagaaccuguacuuuaacu

SEQ ID NO: 1303171 - RNA, 19 nt, Homo sapiens
uuauucggguguaucauuc

SEQ ID NO: 1303172 - RNA, 19 nt, Homo sapiens
ggggagauaguaaauguuu

SEQ ID NO: 1303173 - RNA, 19 nt, Homo sapiens
gcgaagauggagccucugu

SEQ ID NO: 1303174 - RNA, 19 nt, Homo sapiens
cuucugggcucgugauggu

SEQ ID NO: 1303175 - RNA, 19 nt, Homo sapiens
ugaucuuccucuccaacuu

SEQ ID NO: 1303176 - RNA, 19 nt, Homo sapiens
gcagaaccuguacuuuaac

SEQ ID NO: 1303177 - RNA, 19 nt, Homo sapiens
ggcagcagaaccuguacuu

SEQ ID NO: 1303178 - RNA, 19 nt, Homo sapiens
gcaggaagaugaugaugaa

SEQ ID NO: 1303179 - RNA, 19 nt, Homo sapiens
ugaaacaguuggaagcaua

SEQ ID NO: 1303180 - RNA, 19 nt, Homo sapiens
gaaaguugcugcucuugca

SEQ ID NO: 1303181 - RNA, 19 nt, Homo sapiens
ggaagaugaugaugaaaca

SEQ ID NO: 1303182 - RNA, 19 nt, Homo sapiens
gaauacagcaggaagauga

SEQ ID NO: 1303183 - RNA, 19 nt, Homo sapiens
gaaacaggcaggauuuauu

SEQ ID NO: 1303184 - RNA, 19 nt, Homo sapiens
ggacugaaagcuacuauga

SEQ ID NO: 1303185 - RNA, 19 nt, Homo sapiens
gcccauaauuguauugaaa

SEQ ID NO: 1303186 - RNA, 19 nt, Homo sapiens
ugugagaaaugaaggaaua

SEQ ID NO: 1303187 - RNA, 19 nt, Homo sapiens
gauguuaagugguggaguu

SEQ ID NO: 1303188 - RNA, 19 nt, Homo sapiens
gaacugagccgaucguuuu

SEQ ID NO: 1303189 - RNA, 19 nt, Homo sapiens
gagaaaugaaggaauagua

SEQ ID NO: 1303190 - RNA, 19 nt, Homo sapiens
gaacuaggcccuguccauu

SEQ ID NO: 1303191 - RNA, 19 nt, Homo sapiens
acugaaagcuacuaugauu

SEQ ID NO: 1303192 - RNA, 19 nt, Homo sapiens
ggagaugucagggaagaua

SEQ ID NO: 1303193 - RNA, 19 nt, Homo sapiens
gaagacauacgcccaagug

SEQ ID NO: 1303194 - RNA, 19 nt, Homo sapiens
gauccgaguccaugaguuu

SEQ ID NO: 1303195 - RNA, 19 nt, Homo sapiens
ugucagggccuuugcauaa

SEQ ID NO: 1303196 - RNA, 19 nt, Homo sapiens
cuauguaccuaaucugaaa

SEQ ID NO: 1303197 - RNA, 19 nt, Homo sapiens
cauauaauuucugcccaua

SEQ ID NO: 1303198 - RNA, 19 nt, Homo sapiens
gaauucaaguucuuuccau

SEQ ID NO: 1303199 - RNA, 19 nt, Homo sapiens
gaagcauacugaagugucu

SEQ ID NO: 1303200 - RNA, 19 nt, Homo sapiens
caggcaggauuuauuggua

SEQ ID NO: 1303201 - RNA, 19 nt, Homo sapiens
aaacaggcaggauuuauug

SEQ ID NO: 1303202 - RNA, 19 nt, Homo sapiens
ggaaacaggcaggauuuau

SEQ ID NO: 1303203 - RNA, 19 nt, Homo sapiens
ccaguggauuguauuaaau

SEQ ID NO: 1303204 - RNA, 19 nt, Homo sapiens
cccaguggauuguauuaaa

SEQ ID NO: 1303205 - RNA, 19 nt, Homo sapiens
uaaguguugugagaaauga

SEQ ID NO: 1303206 - RNA, 19 nt, Homo sapiens
caaguucuuuccauguaug

SEQ ID NO: 1303207 - RNA, 19 nt, Homo sapiens
uauggaagggccucuauuu

SEQ ID NO: 1303208 - RNA, 19 nt, Homo sapiens
cuucuacccuaaaucuuaa

SEQ ID NO: 1303209 - RNA, 19 nt, Homo sapiens
gaauggacaagcaggcaaa

SEQ ID NO: 1303210 - RNA, 19 nt, Homo sapiens
gggaaacaggcaggauuua

SEQ ID NO: 1303211 - RNA, 19 nt, Homo sapiens
guccuucgccucugcauuu

SEQ ID NO: 1303212 - RNA, 19 nt, Homo sapiens
cuuauauucuggacugaaa

SEQ ID NO: 1303213 - RNA, 19 nt, Homo sapiens
ggaagggccucuauuuuac

SEQ ID NO: 1303214 - RNA, 19 nt, Homo sapiens
ucaggaaaguggcuggaau

SEQ ID NO: 1303215 - RNA, 19 nt, Homo sapiens
gccagcaguuugucaggaa

SEQ ID NO: 1303216 - RNA, 19 nt, Homo sapiens
cauaaagccauuugugugu

SEQ ID NO: 1303217 - RNA, 19 nt, Homo sapiens
gagcaaucccugccaaugg

SEQ ID NO: 1303218 - RNA, 19 nt, Homo sapiens
ucaaguucuuuccauguau

SEQ ID NO: 1303219 - RNA, 19 nt, Homo sapiens
auaaagccauuugugugua

SEQ ID NO: 1303220 - RNA, 19 nt, Homo sapiens
acuaggcccuguccauuug

SEQ ID NO: 1303221 - RNA, 19 nt, Homo sapiens
uaggaaaguugcugcucuu

SEQ ID NO: 1303222 - RNA, 19 nt, Homo sapiens
ucuucuacccuaaaucuua

SEQ ID NO: 1303223 - RNA, 19 nt, Homo sapiens
uccaugaguuugaggacua

SEQ ID NO: 1303224 - RNA, 19 nt, Homo sapiens
gacguucccugaccuguac

SEQ ID NO: 1303225 - RNA, 19 nt, Homo sapiens
aagugaagaugcagacguu

SEQ ID NO: 1303226 - RNA, 19 nt, Homo sapiens
gaaagcuacuaugauucga

SEQ ID NO: 1303227 - RNA, 19 nt, Homo sapiens
aggcaaagcugagugaucu

SEQ ID NO: 1303228 - RNA, 19 nt, Homo sapiens
uggaagggccucuauuuua

SEQ ID NO: 1303229 - RNA, 19 nt, Homo sapiens
uucaaguucuuuccaugua

SEQ ID NO: 1303230 - RNA, 19 nt, Homo sapiens
gucagggccuuugcauaaa

SEQ ID NO: 1303231 - RNA, 19 nt, Homo sapiens
ggucugucgugaaggguau

SEQ ID NO: 1303232 - RNA, 19 nt, Homo sapiens
uaaagccauuuguguguac

SEQ ID NO: 1303233 - RNA, 19 nt, Homo sapiens
gugaagugccggcuacaga

SEQ ID NO: 1303234 - RNA, 19 nt, Homo sapiens
ggaaaguggcuggaaugga

SEQ ID NO: 1303235 - RNA, 19 nt, Homo sapiens
aggaauaguagccuuauau

SEQ ID NO: 1303236 - RNA, 19 nt, Homo sapiens
ucagggagaucaaaagaug

SEQ ID NO: 1303237 - RNA, 19 nt, Homo sapiens
uguaugaaauggagauguc

SEQ ID NO: 1303238 - RNA, 19 nt, Homo sapiens
agaugaugaugaaacaguu

SEQ ID NO: 1303239 - RNA, 19 nt, Homo sapiens
gggacagcguguguacuga

SEQ ID NO: 1303240 - RNA, 19 nt, Homo sapiens
ucacaggguucagcagagu

SEQ ID NO: 1303241 - RNA, 19 nt, Homo sapiens
ggauccgaguccaugaguu

SEQ ID NO: 1303242 - RNA, 19 nt, Homo sapiens
ccagcaguuugucaggaaa

SEQ ID NO: 1303243 - RNA, 19 nt, Homo sapiens
auaguagccuuauauucug

SEQ ID NO: 1303244 - RNA, 19 nt, Homo sapiens
agaaaugaaggaauaguag

SEQ ID NO: 1303245 - RNA, 19 nt, Homo sapiens
guuggaagcauacugaagu

SEQ ID NO: 1303246 - RNA, 19 nt, Homo sapiens
gcagcccuucgacacaaua

SEQ ID NO: 1303247 - RNA, 19 nt, Homo sapiens
ugguggaguugcuggaauu

SEQ ID NO: 1303248 - RNA, 19 nt, Homo sapiens
gaugaugaugaaacaguug

SEQ ID NO: 1303249 - RNA, 19 nt, Homo sapiens
gcugagugaucuccagacu

SEQ ID NO: 1303250 - RNA, 19 nt, Homo sapiens
caauaaaagugaagaugca

SEQ ID NO: 1303251 - RNA, 19 nt, Homo sapiens
ggcccuauguaccuaaucu

SEQ ID NO: 1303252 - RNA, 19 nt, Homo sapiens
caugggaauuuugguuuua

SEQ ID NO: 1303253 - RNA, 19 nt, Homo sapiens
ugggaaacaggcaggauuu

SEQ ID NO: 1303254 - RNA, 19 nt, Homo sapiens
ugaacugagccgaucguuu

SEQ ID NO: 1303255 - RNA, 19 nt, Homo sapiens
ccauuuguguguacaugca

SEQ ID NO: 1303256 - RNA, 19 nt, Homo sapiens
caggaaaguggcuggaaug

SEQ ID NO: 1303257 - RNA, 19 nt, Homo sapiens
gaaacaguuggaagcauac

SEQ ID NO: 1303258 - RNA, 19 nt, Homo sapiens
gaugaugaaacaguuggaa

SEQ ID NO: 1303259 - RNA, 19 nt, Homo sapiens
cagaguacaagaccacugu

SEQ ID NO: 1303260 - RNA, 19 nt, Homo sapiens
gaugaaacaguuggaagca

SEQ ID NO: 1303261 - RNA, 19 nt, Homo sapiens
ugaaagcuacuaugauucg

SEQ ID NO: 1303262 - RNA, 19 nt, Homo sapiens
gguuuuaucuucccuucuu

SEQ ID NO: 1303263 - RNA, 19 nt, Homo sapiens
gaagugucuuggugaaccu

SEQ ID NO: 1303264 - RNA, 19 nt, Homo sapiens
cuacuaugauucgagcaau

SEQ ID NO: 1303265 - RNA, 19 nt, Homo sapiens
agacguucccugaccugua

SEQ ID NO: 1303266 - RNA, 19 nt, Homo sapiens
ccuguccauuugauguuaa

SEQ ID NO: 1303267 - RNA, 19 nt, Homo sapiens
caauuuggucugucgugaa

SEQ ID NO: 1303268 - RNA, 19 nt, Homo sapiens
ugucagggaagauagcaaa

SEQ ID NO: 1303269 - RNA, 19 nt, Homo sapiens
gguuggcccuauguaccua

SEQ ID NO: 1303270 - RNA, 19 nt, Homo sapiens
cccuguccauuugauguua

SEQ ID NO: 1303271 - RNA, 19 nt, Homo sapiens
uuucuuugguggcuaugaa

SEQ ID NO: 1303272 - RNA, 19 nt, Homo sapiens
aaacucgguccucuucaug

SEQ ID NO: 1303273 - RNA, 19 nt, Homo sapiens
acugaagugucuuggugaa

SEQ ID NO: 1303274 - RNA, 19 nt, Homo sapiens
gcuacuaugauucgagcaa

SEQ ID NO: 1303275 - RNA, 19 nt, Homo sapiens
uggaguugcuggaauuugc

SEQ ID NO: 1303276 - RNA, 19 nt, Homo sapiens
gagaucaaaagaugaacua

SEQ ID NO: 1303277 - RNA, 19 nt, Homo sapiens
guuuguggccuacgaauac

SEQ ID NO: 1303278 - RNA, 19 nt, Homo sapiens
ccaccagacucauuuguaa

SEQ ID NO: 1303279 - RNA, 19 nt, Homo sapiens
ccagugcccuucaccaauu

SEQ ID NO: 1303280 - RNA, 19 nt, Homo sapiens
cagcaaagacaccgaguuu

SEQ ID NO: 1303281 - RNA, 19 nt, Homo sapiens
ccaaaaccaucaagaauga

SEQ ID NO: 1303282 - RNA, 19 nt, Homo sapiens
gcaagaaggaugccugcaa

SEQ ID NO: 1303283 - RNA, 19 nt, Homo sapiens
gaguggcccuggcaaguca

SEQ ID NO: 1303284 - RNA, 19 nt, Homo sapiens
ccaggaugcugaaccgaau

SEQ ID NO: 1303285 - RNA, 19 nt, Homo sapiens
gcgcacugcuuccgcaaca

SEQ ID NO: 1303286 - RNA, 19 nt, Homo sapiens
cagugcccuucaccaauua

SEQ ID NO: 1303287 - RNA, 19 nt, Homo sapiens
guaaauagcgcuccuuccu

SEQ ID NO: 1303288 - RNA, 19 nt, Homo sapiens
ugaggcagguggagagcaa

SEQ ID NO: 1303289 - RNA, 19 nt, Homo sapiens
ccucugagacgucccugua

SEQ ID NO: 1303290 - RNA, 19 nt, Homo sapiens
ggaccacacgcuauguaug

SEQ ID NO: 1303291 - RNA, 19 nt, Homo sapiens
gaaccgcccaggugucuac

SEQ ID NO: 1303292 - RNA, 19 nt, Homo sapiens
gaccacacgcuauguaugc

SEQ ID NO: 1303293 - RNA, 19 nt, Homo sapiens
gggaccacacgcuauguau

SEQ ID NO: 1303294 - RNA, 19 nt, Homo sapiens
caccagacucauuuguaaa

SEQ ID NO: 1303295 - RNA, 19 nt, Homo sapiens
ccaagugcaaccugcucua

SEQ ID NO: 1303296 - RNA, 19 nt, Homo sapiens
ccgcccaggugucuacauc

SEQ ID NO: 1303297 - RNA, 19 nt, Homo sapiens
caccagugcccuucaccaa

SEQ ID NO: 1303298 - RNA, 19 nt, Homo sapiens
aagcauagcuauuggauuu

SEQ ID NO: 1303299 - RNA, 19 nt, Homo sapiens
ggaauaaguuugauaagca

SEQ ID NO: 1303300 - RNA, 19 nt, Homo sapiens
gcacuucccuguaccaguu

SEQ ID NO: 1303301 - RNA, 19 nt, Homo sapiens
guucguggcugaauacuuu

SEQ ID NO: 1303302 - RNA, 19 nt, Homo sapiens
ccaccaagcuuaccaggaa

SEQ ID NO: 1303303 - RNA, 19 nt, Homo sapiens
uaacagcucugacaaagca

SEQ ID NO: 1303304 - RNA, 19 nt, Homo sapiens
gcagaaauauaucuccaau

SEQ ID NO: 1303305 - RNA, 19 nt, Homo sapiens
ugacaaagcacaauauguu

SEQ ID NO: 1303306 - RNA, 19 nt, Homo sapiens
gcaggcaacuuuguucuug

SEQ ID NO: 1303307 - RNA, 19 nt, Homo sapiens
gcacacgccucacaagaca

SEQ ID NO: 1303308 - RNA, 19 nt, Homo sapiens
gaagauguggccauaugua

SEQ ID NO: 1303309 - RNA, 19 nt, Homo sapiens
caagagcuccagaaacuaa

SEQ ID NO: 1303310 - RNA, 19 nt, Homo sapiens
uugcaagccugcugaguua

SEQ ID NO: 1303311 - RNA, 19 nt, Homo sapiens
gauguggccauauguauaa

SEQ ID NO: 1303312 - RNA, 19 nt, Homo sapiens
caagggagaugccacaaag

SEQ ID NO: 1303313 - RNA, 19 nt, Homo sapiens
aaacaauuaugcccauuug

SEQ ID NO: 1303314 - RNA, 19 nt, Homo sapiens
gcaccaagcauagcuauug

SEQ ID NO: 1303315 - RNA, 19 nt, Homo sapiens
caccaacacuggagaagaa

SEQ ID NO: 1303316 - RNA, 19 nt, Homo sapiens
caacauuccuaagugguaa

SEQ ID NO: 1303317 - RNA, 19 nt, Homo sapiens
caacaucgaugcugcaaaa

SEQ ID NO: 1303318 - RNA, 19 nt, Homo sapiens
gaugacaacuugaaaccau

SEQ ID NO: 1303319 - RNA, 19 nt, Homo sapiens
ccaaguucguggcugaaua

SEQ ID NO: 1303320 - RNA, 19 nt, Homo sapiens
gcgcugggaucuuugagaa

SEQ ID NO: 1303321 - RNA, 19 nt, Homo sapiens
gaucuccgcaucuauguuu

SEQ ID NO: 1303322 - RNA, 19 nt, Homo sapiens
ggucaugguuguaaaugga

SEQ ID NO: 1303323 - RNA, 19 nt, Homo sapiens
ccaaacaccugaagcacau

SEQ ID NO: 1303324 - RNA, 19 nt, Homo sapiens
guggccauauguauaaaua

SEQ ID NO: 1303325 - RNA, 19 nt, Homo sapiens
gcaacauuccuaaguggua

SEQ ID NO: 1303326 - RNA, 19 nt, Homo sapiens
uaagcaacauuccuaagug

SEQ ID NO: 1303327 - RNA, 19 nt, Homo sapiens
caacagcagcaucaauaaa

SEQ ID NO: 1303328 - RNA, 19 nt, Homo sapiens
guacauagugcagaaauau

SEQ ID NO: 1303329 - RNA, 19 nt, Homo sapiens
gaauguacaacgaggauga

SEQ ID NO: 1303330 - RNA, 19 nt, Homo sapiens
ccaccagcauguuaacuau

SEQ ID NO: 1303331 - RNA, 19 nt, Homo sapiens
gagaagaucaaagaaguga

SEQ ID NO: 1303332 - RNA, 19 nt, Homo sapiens
gacauccucuuuccgaaug

SEQ ID NO: 1303333 - RNA, 19 nt, Homo sapiens
acaaagcaagcccaaguua

SEQ ID NO: 1303334 - RNA, 19 nt, Homo sapiens
uuaagccuuugaccauuua

SEQ ID NO: 1303335 - RNA, 19 nt, Homo sapiens
agaaauauaucuccaaucc

SEQ ID NO: 1303336 - RNA, 19 nt, Homo sapiens
aggaauggauuaaauguca

SEQ ID NO: 1303337 - RNA, 19 nt, Homo sapiens
gguggaauaaguuugauaa

SEQ ID NO: 1303338 - RNA, 19 nt, Homo sapiens
uauaacagcucugacaaag

SEQ ID NO: 1303339 - RNA, 19 nt, Homo sapiens
gacugaagauguggccaua

SEQ ID NO: 1303340 - RNA, 19 nt, Homo sapiens
ggaauggauuaaaugucaa

SEQ ID NO: 1303341 - RNA, 19 nt, Homo sapiens
ugacagaggugggcuugau

SEQ ID NO: 1303342 - RNA, 19 nt, Homo sapiens
agagaaaacuuguccauga

SEQ ID NO: 1303343 - RNA, 19 nt, Homo sapiens
gaagugauuggucaugguu

SEQ ID NO: 1303344 - RNA, 19 nt, Homo sapiens
gaaaacuuguccaugauau

SEQ ID NO: 1303345 - RNA, 19 nt, Homo sapiens
uccaagagcuccagaaacu

SEQ ID NO: 1303346 - RNA, 19 nt, Homo sapiens
gcucugacaaagcacaaua

SEQ ID NO: 1303347 - RNA, 19 nt, Homo sapiens
gaaccagcgcccaaugaga

SEQ ID NO: 1303348 - RNA, 19 nt, Homo sapiens
cugacugucuuccuuauga

SEQ ID NO: 1303349 - RNA, 19 nt, Homo sapiens
cugaagauguggccauaug

SEQ ID NO: 1303350 - RNA, 19 nt, Homo sapiens
gcuccugacugucuuccuu

SEQ ID NO: 1303351 - RNA, 19 nt, Homo sapiens
ucagugacuuuaaagacuu

SEQ ID NO: 1303352 - RNA, 19 nt, Homo sapiens
ccacaaagcaagcccaagu

SEQ ID NO: 1303353 - RNA, 19 nt, Homo sapiens
caagcagaauguacaacga

SEQ ID NO: 1303354 - RNA, 19 nt, Homo sapiens
cuccagaaacuaaugaaua

SEQ ID NO: 1303355 - RNA, 19 nt, Homo sapiens
caauugcuuugagcucuuu

SEQ ID NO: 1303356 - RNA, 19 nt, Homo sapiens
ccaacagcagcaucaauaa

SEQ ID NO: 1303357 - RNA, 19 nt, Homo sapiens
aguuugaccucaguaauuu

SEQ ID NO: 1303358 - RNA, 19 nt, Homo sapiens
ccgcaucuauguuuguguu

SEQ ID NO: 1303359 - RNA, 19 nt, Homo sapiens
caaugacuauaccaaguuc

SEQ ID NO: 1303360 - RNA, 19 nt, Homo sapiens
gaaagcaauaguucaaguc

SEQ ID NO: 1303361 - RNA, 19 nt, Homo sapiens
gagaugagugggcaggauu

SEQ ID NO: 1303362 - RNA, 19 nt, Homo sapiens
caacacuggagaagaagaa

SEQ ID NO: 1303363 - RNA, 19 nt, Homo sapiens
uuuaagccuuugaccauuu

SEQ ID NO: 1303364 - RNA, 19 nt, Homo sapiens
uguacauagugcagaaaua

SEQ ID NO: 1303365 - RNA, 19 nt, Homo sapiens
ccaaugacuauaccaaguu

SEQ ID NO: 1303366 - RNA, 19 nt, Homo sapiens
ggacauccucuuuccgaau

SEQ ID NO: 1303367 - RNA, 19 nt, Homo sapiens
agaaagcaauaguucaagu

SEQ ID NO: 1303368 - RNA, 19 nt, Homo sapiens
guauggcacuucccuguac

SEQ ID NO: 1303369 - RNA, 19 nt, Homo sapiens
ggaaggguugguucgguuu

SEQ ID NO: 1303370 - RNA, 19 nt, Homo sapiens
caaagcacaauauguucaa

SEQ ID NO: 1303371 - RNA, 19 nt, Homo sapiens
guacaacgaggaugacucu

SEQ ID NO: 1303372 - RNA, 19 nt, Homo sapiens
gaaaauccaccgcaugguu

SEQ ID NO: 1303373 - RNA, 19 nt, Homo sapiens
aaugugaucuccgcaucua

SEQ ID NO: 1303374 - RNA, 19 nt, Homo sapiens
cuccaauccuuuacuuauu

SEQ ID NO: 1303375 - RNA, 19 nt, Homo sapiens
ccuggaaccaccaagcuua

SEQ ID NO: 1303376 - RNA, 19 nt, Homo sapiens
agagaaagcaauaguucaa

SEQ ID NO: 1303377 - RNA, 19 nt, Homo sapiens
gcuugaugcuccugacugu

SEQ ID NO: 1303378 - RNA, 19 nt, Homo sapiens
gcugggauguggacgaucu

SEQ ID NO: 1303379 - RNA, 19 nt, Homo sapiens
aauggacgcucagcagauu

SEQ ID NO: 1303380 - RNA, 19 nt, Homo sapiens
gauuggucaugguuguaaa

SEQ ID NO: 1303381 - RNA, 19 nt, Homo sapiens
uaucuccaauccuuuacuu

SEQ ID NO: 1303382 - RNA, 19 nt, Homo sapiens
gacaaagcacaauauguuc

SEQ ID NO: 1303383 - RNA, 19 nt, Homo sapiens
ccaauugcuuugagcucuu

SEQ ID NO: 1303384 - RNA, 19 nt, Homo sapiens
aaauauaacagcucugaca

SEQ ID NO: 1303385 - RNA, 19 nt, Homo sapiens
accagcauguuaacuauga

SEQ ID NO: 1303386 - RNA, 19 nt, Homo sapiens
gccaccagcauguuaacua

SEQ ID NO: 1303387 - RNA, 19 nt, Homo sapiens
ccaagcaggcaacuuuguu

SEQ ID NO: 1303388 - RNA, 19 nt, Homo sapiens
guaaugccacacauggaaa

SEQ ID NO: 1303389 - RNA, 19 nt, Homo sapiens
gagaaaacuuguccaugau

SEQ ID NO: 1303390 - RNA, 19 nt, Homo sapiens
accaacagcagcaucaaua

SEQ ID NO: 1303391 - RNA, 19 nt, Homo sapiens
ccuuugaccauuuauguuu

SEQ ID NO: 1303392 - RNA, 19 nt, Homo sapiens
cuagagaaagcaauaguuc

SEQ ID NO: 1303393 - RNA, 19 nt, Homo sapiens
caacaccaacacuggagaa

SEQ ID NO: 1303394 - RNA, 19 nt, Homo sapiens
gcaacuuuguucuuguuuu

SEQ ID NO: 1303395 - RNA, 19 nt, Homo sapiens
gcucuuuggguuugauauu

SEQ ID NO: 1303396 - RNA, 19 nt, Homo sapiens
gauguggacgaucugcuuu

SEQ ID NO: 1303397 - RNA, 19 nt, Homo sapiens
cuuaugagaagaucaaaga

SEQ ID NO: 1303398 - RNA, 19 nt, Homo sapiens
caacacagcugggaaagga

SEQ ID NO: 1303399 - RNA, 19 nt, Homo sapiens
gaucugagccuucuaugaa

SEQ ID NO: 1303400 - RNA, 19 nt, Homo sapiens
gaagagaguuucuaaucag

SEQ ID NO: 1303401 - RNA, 19 nt, Homo sapiens
gcaaggugcuggagaaguc

SEQ ID NO: 1303402 - RNA, 19 nt, Homo sapiens
ugacaagcauacacaacua

SEQ ID NO: 1303403 - RNA, 19 nt, Homo sapiens
ggaaugaggaagcaaagaa

SEQ ID NO: 1303404 - RNA, 19 nt, Homo sapiens
gaaaggacucgauggaaga

SEQ ID NO: 1303405 - RNA, 19 nt, Homo sapiens
gcagaguucagcaauauga

SEQ ID NO: 1303406 - RNA, 19 nt, Homo sapiens
gagaguuucuaaucagaug

SEQ ID NO: 1303407 - RNA, 19 nt, Homo sapiens
aagcauacacaacuacuua

SEQ ID NO: 1303408 - RNA, 19 nt, Homo sapiens
gaagaaggccugggaacau

SEQ ID NO: 1303409 - RNA, 19 nt, Homo sapiens
gaauuuccaguguucagua

SEQ ID NO: 1303410 - RNA, 19 nt, Homo sapiens
gcagcuaugugugugcaaa

SEQ ID NO: 1303411 - RNA, 19 nt, Homo sapiens
gacagacaaccaucucuuu

SEQ ID NO: 1303412 - RNA, 19 nt, Homo sapiens
gcauacacaacuacuuauu

SEQ ID NO: 1303413 - RNA, 19 nt, Homo sapiens
gcaacggcccaaauucuug

SEQ ID NO: 1303414 - RNA, 19 nt, Homo sapiens
gaaacucacagaagcaaca

SEQ ID NO: 1303415 - RNA, 19 nt, Homo sapiens
gggagagauuccugcacua

SEQ ID NO: 1303416 - RNA, 19 nt, Homo sapiens
aagaaggccugggaacauu

SEQ ID NO: 1303417 - RNA, 19 nt, Homo sapiens
gcccaaggccacagugaaa

SEQ ID NO: 1303418 - RNA, 19 nt, Homo sapiens
ggagagauuccugcacuau

SEQ ID NO: 1303419 - RNA, 19 nt, Homo sapiens
agccuucuaugaaaguuua

SEQ ID NO: 1303420 - RNA, 19 nt, Homo sapiens
gagggugacaggugaaaga

SEQ ID NO: 1303421 - RNA, 19 nt, Homo sapiens
aagcaaguuuaucggagua

SEQ ID NO: 1303422 - RNA, 19 nt, Homo sapiens
ucaugaauuuccaguguuc

SEQ ID NO: 1303423 - RNA, 19 nt, Homo sapiens
caacggcccaaauucuuga

SEQ ID NO: 1303424 - RNA, 19 nt, Homo sapiens
ggaguaucgccaugaaguu

SEQ ID NO: 1303425 - RNA, 19 nt, Homo sapiens
gaucugcagcuucucugaa

SEQ ID NO: 1303426 - RNA, 19 nt, Homo sapiens
gagggaaugaggaagcaaa

SEQ ID NO: 1303427 - RNA, 19 nt, Homo sapiens
aaaccuuacuggaaucaag

SEQ ID NO: 1303428 - RNA, 19 nt, Homo sapiens
gaaugaggaagcaaagaag

SEQ ID NO: 1303429 - RNA, 19 nt, Homo sapiens
gggaaaggacucgauggaa

SEQ ID NO: 1303430 - RNA, 19 nt, Homo sapiens
gcugggacgccaucucuga

SEQ ID NO: 1303431 - RNA, 19 nt, Homo sapiens
aagagaguuucuaaucaga

SEQ ID NO: 1303432 - RNA, 19 nt, Homo sapiens
gcaaguuuaucggaguauc

SEQ ID NO: 1303433 - RNA, 19 nt, Homo sapiens
acacagaccagaccuacug

SEQ ID NO: 1303434 - RNA, 19 nt, Homo sapiens
gcaacacagaccagaccua

SEQ ID NO: 1303435 - RNA, 19 nt, Homo sapiens
gagagauuccugcacuaug

SEQ ID NO: 1303436 - RNA, 19 nt, Homo sapiens
agaguucagcaauaugaua

SEQ ID NO: 1303437 - RNA, 19 nt, Homo sapiens
uauauuaugccgcuuucaa

SEQ ID NO: 1303438 - RNA, 19 nt, Homo sapiens
gcgccuuucucaucagcuu

SEQ ID NO: 1303439 - RNA, 19 nt, Homo sapiens
agagauuccugcacuaugc

SEQ ID NO: 1303440 - RNA, 19 nt, Homo sapiens
gcccaagagugacaagcau

SEQ ID NO: 1303441 - RNA, 19 nt, Homo sapiens
cugaugggcccaagaguga

SEQ ID NO: 1303442 - RNA, 19 nt, Homo sapiens
gcaauaugauagggaacag

SEQ ID NO: 1303443 - RNA, 19 nt, Homo sapiens
guagaaguuuugcuuuguu

SEQ ID NO: 1303444 - RNA, 19 nt, Homo sapiens
gaugcaacggcccaaauuc

SEQ ID NO: 1303445 - RNA, 19 nt, Homo sapiens
gaaagaccccuacagaucu

SEQ ID NO: 1303446 - RNA, 19 nt, Homo sapiens
aauuuccaguguucaguaa

SEQ ID NO: 1303447 - RNA, 19 nt, Homo sapiens
cacaacuacuuauuaucug

SEQ ID NO: 1303448 - RNA, 19 nt, Homo sapiens
gaguaucgccaugaaguuc

SEQ ID NO: 1303449 - RNA, 19 nt, Homo sapiens
gaguucagcaauaugauag

SEQ ID NO: 1303450 - RNA, 19 nt, Homo sapiens
ugacagacaaccaucucuu

SEQ ID NO: 1303451 - RNA, 19 nt, Homo sapiens
gaaggccugggaacauugu

SEQ ID NO: 1303452 - RNA, 19 nt, Homo sapiens
cuaugugugugcaaaauaa

SEQ ID NO: 1303453 - RNA, 19 nt, Homo sapiens
auauguaacgcauucauga

SEQ ID NO: 1303454 - RNA, 19 nt, Homo sapiens
ugacucgucccacuugugu

SEQ ID NO: 1303455 - RNA, 19 nt, Homo sapiens
aagcaacacagcugggaaa

SEQ ID NO: 1303456 - RNA, 19 nt, Homo sapiens
uuccaguguucaguaaaua

SEQ ID NO: 1303457 - RNA, 19 nt, Homo sapiens
caagcauacacaacuacuu

SEQ ID NO: 1303458 - RNA, 19 nt, Homo sapiens
ugaaagaccccuacagauc

SEQ ID NO: 1303459 - RNA, 19 nt, Homo sapiens
uuuccaguguucaguaaau

SEQ ID NO: 1303460 - RNA, 19 nt, Homo sapiens
uauguaacgcauucaugaa

SEQ ID NO: 1303461 - RNA, 19 nt, Homo sapiens
gagccuucuaugaaaguuu

SEQ ID NO: 1303462 - RNA, 19 nt, Homo sapiens
agaugcaacggcccaaauu

SEQ ID NO: 1303463 - RNA, 19 nt, Homo sapiens
cagacuggagggagagauu

SEQ ID NO: 1303464 - RNA, 19 nt, Homo sapiens
ggugaaagaccccuacaga

SEQ ID NO: 1303465 - RNA, 19 nt, Homo sapiens
guugaucugagccuucuau

SEQ ID NO: 1303466 - RNA, 19 nt, Homo sapiens
cccaagagugacaagcaua

SEQ ID NO: 1303467 - RNA, 19 nt, Homo sapiens
ggcccaaauucuugaucug

SEQ ID NO: 1303468 - RNA, 19 nt, Homo sapiens
cagaugcaacggcccaaau

SEQ ID NO: 1303469 - RNA, 19 nt, Homo sapiens
gagcagagauugaaugaaa

SEQ ID NO: 1303470 - RNA, 19 nt, Homo sapiens
ccaaagaacugccugauug

SEQ ID NO: 1303471 - RNA, 19 nt, Homo sapiens
gaagaaagaugagugaaau

SEQ ID NO: 1303472 - RNA, 19 nt, Homo sapiens
gaugaacacuuccuagaaa

SEQ ID NO: 1303473 - RNA, 19 nt, Homo sapiens
gagcauaucagaugaagua

SEQ ID NO: 1303474 - RNA, 19 nt, Homo sapiens
ccagguagcuucuuaguug

SEQ ID NO: 1303475 - RNA, 19 nt, Homo sapiens
gaaguuggcugggaagaaa

SEQ ID NO: 1303476 - RNA, 19 nt, Homo sapiens
gaucagggcuuucucuaug

SEQ ID NO: 1303477 - RNA, 19 nt, Homo sapiens
gagacaaugcucaauauua

SEQ ID NO: 1303478 - RNA, 19 nt, Homo sapiens
gaaacucucugcucuguuc

SEQ ID NO: 1303479 - RNA, 19 nt, Homo sapiens
gguaagagcuauaaguaau

SEQ ID NO: 1303480 - RNA, 19 nt, Homo sapiens
uaacacaucugauacucuu

SEQ ID NO: 1303481 - RNA, 19 nt, Homo sapiens
ggaagggagcccaguguua

SEQ ID NO: 1303482 - RNA, 19 nt, Homo sapiens
ggaggaggaugaacacuuc

SEQ ID NO: 1303483 - RNA, 19 nt, Homo sapiens
gagcaaacguuaccaaugc

SEQ ID NO: 1303484 - RNA, 19 nt, Homo sapiens
agaaagauaucucgaagga

SEQ ID NO: 1303485 - RNA, 19 nt, Homo sapiens
ggaagaaagaugagugaaa

SEQ ID NO: 1303486 - RNA, 19 nt, Homo sapiens
ggaggaagcauccgucuau

SEQ ID NO: 1303487 - RNA, 19 nt, Homo sapiens
caauauaccuacagugcaa

SEQ ID NO: 1303488 - RNA, 19 nt, Homo sapiens
caugcaggcuccuuucaua

SEQ ID NO: 1303489 - RNA, 19 nt, Homo sapiens
gaacacuuccuagaaauga

SEQ ID NO: 1303490 - RNA, 19 nt, Homo sapiens
ggacugaggccgcaccauu

SEQ ID NO: 1303491 - RNA, 19 nt, Homo sapiens
gagcuggaauggaacaguu

SEQ ID NO: 1303492 - RNA, 19 nt, Homo sapiens
cagcugugcucgauuagaa

SEQ ID NO: 1303493 - RNA, 19 nt, Homo sapiens
caaaagauguugauucuca

SEQ ID NO: 1303494 - RNA, 19 nt, Homo sapiens
ccugaaaccuccuacaguu

SEQ ID NO: 1303495 - RNA, 19 nt, Homo sapiens
gauagaagaagaugaggaa

SEQ ID NO: 1303496 - RNA, 19 nt, Homo sapiens
gaacauucuccaugacuga

SEQ ID NO: 1303497 - RNA, 19 nt, Homo sapiens
uaaccagagucuuuaccua

SEQ ID NO: 1303498 - RNA, 19 nt, Homo sapiens
ucaaugccuucugaacuua

SEQ ID NO: 1303499 - RNA, 19 nt, Homo sapiens
ggccacagaucuccaaauc

SEQ ID NO: 1303500 - RNA, 19 nt, Homo sapiens
gccucuggcucaaggauua

SEQ ID NO: 1303501 - RNA, 19 nt, Homo sapiens
gacaagcgcaacagaaauu

SEQ ID NO: 1303502 - RNA, 19 nt, Homo sapiens
uuaggcaccucaccaaauu

SEQ ID NO: 1303503 - RNA, 19 nt, Homo sapiens
gaaagagugaggaucaaga

SEQ ID NO: 1303504 - RNA, 19 nt, Homo sapiens
gaugaaagagugaggauca

SEQ ID NO: 1303505 - RNA, 19 nt, Homo sapiens
gauauugcgauacuacuuu

SEQ ID NO: 1303506 - RNA, 19 nt, Homo sapiens
ugacucgccuuuccuuuau

SEQ ID NO: 1303507 - RNA, 19 nt, Homo sapiens
ucaccuaacacaucugaua

SEQ ID NO: 1303508 - RNA, 19 nt, Homo sapiens
gcuaugacccggaaaugaa

SEQ ID NO: 1303509 - RNA, 19 nt, Homo sapiens
ggaugaacacuuccuagaa

SEQ ID NO: 1303510 - RNA, 19 nt, Homo sapiens
cauaucagaugaaguacug

SEQ ID NO: 1303511 - RNA, 19 nt, Homo sapiens
gccauccacuccacaguuu

SEQ ID NO: 1303512 - RNA, 19 nt, Homo sapiens
ggacucaucacugcacuuu

SEQ ID NO: 1303513 - RNA, 19 nt, Homo sapiens
uagcauggaugaagagcaa

SEQ ID NO: 1303514 - RNA, 19 nt, Homo sapiens
cgaaggaucacauugcauu

SEQ ID NO: 1303515 - RNA, 19 nt, Homo sapiens
cuaaacagaugagcacaga

SEQ ID NO: 1303516 - RNA, 19 nt, Homo sapiens
ccacagaucuccaaauccu

SEQ ID NO: 1303517 - RNA, 19 nt, Homo sapiens
ccuccuaaaugacaccaua

SEQ ID NO: 1303518 - RNA, 19 nt, Homo sapiens
gaggagcucuuuguagcaa

SEQ ID NO: 1303519 - RNA, 19 nt, Homo sapiens
ggaguccucucgcaacauc

SEQ ID NO: 1303520 - RNA, 19 nt, Homo sapiens
aaaugagacuuuccaagga

SEQ ID NO: 1303521 - RNA, 19 nt, Homo sapiens
gcugaagcgucuaggaaug

SEQ ID NO: 1303522 - RNA, 19 nt, Homo sapiens
ucucuugggugacaucaaa

SEQ ID NO: 1303523 - RNA, 19 nt, Homo sapiens
gagucucgcuauccucaaa

SEQ ID NO: 1303524 - RNA, 19 nt, Homo sapiens
gcacgggccuccaaauagc

SEQ ID NO: 1303525 - RNA, 19 nt, Homo sapiens
ggaagucccuaagccuuuc

SEQ ID NO: 1303526 - RNA, 19 nt, Homo sapiens
uaccuaguguccuguuuaa

SEQ ID NO: 1303527 - RNA, 19 nt, Homo sapiens
ggaccaggcuguggauugg

SEQ ID NO: 1303528 - RNA, 19 nt, Homo sapiens
uaaaacuccuccuaaauga

SEQ ID NO: 1303529 - RNA, 19 nt, Homo sapiens
gaggaagcauccgucuauu

SEQ ID NO: 1303530 - RNA, 19 nt, Homo sapiens
ggacaagcgcaacagaaau

SEQ ID NO: 1303531 - RNA, 19 nt, Homo sapiens
ccagaguggugugauaaga

SEQ ID NO: 1303532 - RNA, 19 nt, Homo sapiens
aaacugaggacaugguuga

SEQ ID NO: 1303533 - RNA, 19 nt, Homo sapiens
gagcaaaacugaggacaug

SEQ ID NO: 1303534 - RNA, 19 nt, Homo sapiens
gcuguagcauggaugaaga

SEQ ID NO: 1303535 - RNA, 19 nt, Homo sapiens
ccaaauccuuuccacucaa

SEQ ID NO: 1303536 - RNA, 19 nt, Homo sapiens
agaauaaggaggaggauga

SEQ ID NO: 1303537 - RNA, 19 nt, Homo sapiens
gaagggagcccaguguuac

SEQ ID NO: 1303538 - RNA, 19 nt, Homo sapiens
ccuauggaauggaugacua

SEQ ID NO: 1303539 - RNA, 19 nt, Homo sapiens
uacaaugccuggcuuaugg

SEQ ID NO: 1303540 - RNA, 19 nt, Homo sapiens
ggacaugguugagaaaaga

SEQ ID NO: 1303541 - RNA, 19 nt, Homo sapiens
ucaagcaccaguguaauaa

SEQ ID NO: 1303542 - RNA, 19 nt, Homo sapiens
ggguaagagcuauaaguaa

SEQ ID NO: 1303543 - RNA, 19 nt, Homo sapiens
uggaauggaugacuaugug

SEQ ID NO: 1303544 - RNA, 19 nt, Homo sapiens
ugacagcauuacuuucuuc

SEQ ID NO: 1303545 - RNA, 19 nt, Homo sapiens
uauaccggcuccaguuuau

SEQ ID NO: 1303546 - RNA, 19 nt, Homo sapiens
guacaucuacccuggacaa

SEQ ID NO: 1303547 - RNA, 19 nt, Homo sapiens
ccauguuugugcccaagua

SEQ ID NO: 1303548 - RNA, 19 nt, Homo sapiens
gugaccugcuugugacuuu

SEQ ID NO: 1303549 - RNA, 19 nt, Homo sapiens
cccaggcacuguucaaaga

SEQ ID NO: 1303550 - RNA, 19 nt, Homo sapiens
cuccaugacugaacgauug

SEQ ID NO: 1303551 - RNA, 19 nt, Homo sapiens
caagaagacgaaagagaga

SEQ ID NO: 1303552 - RNA, 19 nt, Homo sapiens
guucaaagagucucgcuau

SEQ ID NO: 1303553 - RNA, 19 nt, Homo sapiens
caaagagucucgcuauccu

SEQ ID NO: 1303554 - RNA, 19 nt, Homo sapiens
caaaauaugccguguguau

SEQ ID NO: 1303555 - RNA, 19 nt, Homo sapiens
guacaaugccuggcuuaug

SEQ ID NO: 1303556 - RNA, 19 nt, Homo sapiens
gcaccucaccaaauucuca

SEQ ID NO: 1303557 - RNA, 19 nt, Homo sapiens
gcccaucaaucaggaguga

SEQ ID NO: 1303558 - RNA, 19 nt, Homo sapiens
guuccuccaugcauuauuc

SEQ ID NO: 1303559 - RNA, 19 nt, Homo sapiens
cgucgggucugcuguggaa

SEQ ID NO: 1303560 - RNA, 19 nt, Homo sapiens
gguagugacagccuaauca

SEQ ID NO: 1303561 - RNA, 19 nt, Homo sapiens
gaaggaucacauugcauug

SEQ ID NO: 1303562 - RNA, 19 nt, Homo sapiens
gaaagaugagugaaauaac

SEQ ID NO: 1303563 - RNA, 19 nt, Homo sapiens
gaauaaggaggaggaugaa

SEQ ID NO: 1303564 - RNA, 19 nt, Homo sapiens
gccauugccuuugaccauu

SEQ ID NO: 1303565 - RNA, 19 nt, Homo sapiens
gcacuuuggcccagucugu

SEQ ID NO: 1303566 - RNA, 19 nt, Homo sapiens
ugggagagguaaagagguu

SEQ ID NO: 1303567 - RNA, 19 nt, Homo sapiens
aaagugcccugccgcuuca

SEQ ID NO: 1303568 - RNA, 19 nt, Homo sapiens
aaucugaaguggccaucaa

SEQ ID NO: 1303569 - RNA, 19 nt, Homo sapiens
gaagagaauuccauacuga

SEQ ID NO: 1303570 - RNA, 19 nt, Homo sapiens
cuaagaagcucccauguga

SEQ ID NO: 1303571 - RNA, 19 nt, Homo sapiens
ggaagagaauaacucauuu

SEQ ID NO: 1303572 - RNA, 19 nt, Homo sapiens
gaaagaagagcaaauacaa

SEQ ID NO: 1303573 - RNA, 19 nt, Homo sapiens
ccaaucagcugaaaugaau

SEQ ID NO: 1303574 - RNA, 19 nt, Homo sapiens
caggauggcuauugcuuua

SEQ ID NO: 1303575 - RNA, 19 nt, Homo sapiens
gcuaauaagcagaguaaua

SEQ ID NO: 1303576 - RNA, 19 nt, Homo sapiens
cagcuuacaugcagacuuu

SEQ ID NO: 1303577 - RNA, 19 nt, Homo sapiens
caaaguugcuggucuaugg

SEQ ID NO: 1303578 - RNA, 19 nt, Homo sapiens
guagaugaguuuaaagaug

SEQ ID NO: 1303579 - RNA, 19 nt, Homo sapiens
gaaagccccugaagaagua

SEQ ID NO: 1303580 - RNA, 19 nt, Homo sapiens
gaacucaccaugccaauca

SEQ ID NO: 1303581 - RNA, 19 nt, Homo sapiens
aacauuggcucacugaaua

SEQ ID NO: 1303582 - RNA, 19 nt, Homo sapiens
gggaagagaauaacucauu

SEQ ID NO: 1303583 - RNA, 19 nt, Homo sapiens
gaacauuggcucacugaau

SEQ ID NO: 1303584 - RNA, 19 nt, Homo sapiens
gcagugcuguguauggauu

SEQ ID NO: 1303585 - RNA, 19 nt, Homo sapiens
agccagacauuucagauua

SEQ ID NO: 1303586 - RNA, 19 nt, Homo sapiens
uaucagcucacacauauaa

SEQ ID NO: 1303587 - RNA, 19 nt, Homo sapiens
gaagaauccauaaggcaaa

SEQ ID NO: 1303588 - RNA, 19 nt, Homo sapiens
ugaagaagguaaagaacau

SEQ ID NO: 1303589 - RNA, 19 nt, Homo sapiens
gcaagcuuguuaaggacua

SEQ ID NO: 1303590 - RNA, 19 nt, Homo sapiens
ggaagaagaauccauaagg

SEQ ID NO: 1303591 - RNA, 19 nt, Homo sapiens
caacauuaauucguggauu

SEQ ID NO: 1303592 - RNA, 19 nt, Homo sapiens
gaauuucccaccauccuaa

SEQ ID NO: 1303593 - RNA, 19 nt, Homo sapiens
gugaauguguuccagaaga

SEQ ID NO: 1303594 - RNA, 19 nt, Homo sapiens
gaaggcuacccucaucuuu

SEQ ID NO: 1303595 - RNA, 19 nt, Homo sapiens
aaagagaaccugcgcagaa

SEQ ID NO: 1303596 - RNA, 19 nt, Homo sapiens
cagacuaggacaagcauua

SEQ ID NO: 1303597 - RNA, 19 nt, Homo sapiens
ggucuucaagcucucauua

SEQ ID NO: 1303598 - RNA, 19 nt, Homo sapiens
caaauguucuugauagacu

SEQ ID NO: 1303599 - RNA, 19 nt, Homo sapiens
ccaggaagaagaauccaua

SEQ ID NO: 1303600 - RNA, 19 nt, Homo sapiens
ggagaagccagacauuuca

SEQ ID NO: 1303601 - RNA, 19 nt, Homo sapiens
gaacuauuaucagcucaca

SEQ ID NO: 1303602 - RNA, 19 nt, Homo sapiens
gugacaagauucugcaugu

SEQ ID NO: 1303603 - RNA, 19 nt, Homo sapiens
ugaaaugaaugagcaaauc

SEQ ID NO: 1303604 - RNA, 19 nt, Homo sapiens
uuaaugcugugcugaagaa

SEQ ID NO: 1303605 - RNA, 19 nt, Homo sapiens
ccugcaagcuuguuaagga

SEQ ID NO: 1303606 - RNA, 19 nt, Homo sapiens
ccaaaucaguggccaaacu

SEQ ID NO: 1303607 - RNA, 19 nt, Homo sapiens
ggagcaaggucuucaagcu

SEQ ID NO: 1303608 - RNA, 19 nt, Homo sapiens
agaauuccauacugaaaga

SEQ ID NO: 1303609 - RNA, 19 nt, Homo sapiens
gaaugagcaaaucugaaua

SEQ ID NO: 1303610 - RNA, 19 nt, Homo sapiens
gcagaguaauaacauccaa

SEQ ID NO: 1303611 - RNA, 19 nt, Homo sapiens
cauaugcagcacuaauuua

SEQ ID NO: 1303612 - RNA, 19 nt, Homo sapiens
cagaaaacauccaaaauca

SEQ ID NO: 1303613 - RNA, 19 nt, Homo sapiens
aagagaaccugcgcagaaa

SEQ ID NO: 1303614 - RNA, 19 nt, Homo sapiens
gugggcagguguugaagaa

SEQ ID NO: 1303615 - RNA, 19 nt, Homo sapiens
gaagacuggaacauaauau

SEQ ID NO: 1303616 - RNA, 19 nt, Homo sapiens
gagcugaaaugcccaaaau

SEQ ID NO: 1303617 - RNA, 19 nt, Homo sapiens
auuaucagcucacacauau

SEQ ID NO: 1303618 - RNA, 19 nt, Homo sapiens
ucacagaucacuuaacagu

SEQ ID NO: 1303619 - RNA, 19 nt, Homo sapiens
ugaaugagcaaaucugaau

SEQ ID NO: 1303620 - RNA, 19 nt, Homo sapiens
gaaaugaaugagcaaaucu

SEQ ID NO: 1303621 - RNA, 19 nt, Homo sapiens
uaagauuaaucgagcaaca

SEQ ID NO: 1303622 - RNA, 19 nt, Homo sapiens
gaaaagucuuggugaaugu

SEQ ID NO: 1303623 - RNA, 19 nt, Homo sapiens
gaacuagacaugccaacag

SEQ ID NO: 1303624 - RNA, 19 nt, Homo sapiens
acaagauucugcaugucua

SEQ ID NO: 1303625 - RNA, 19 nt, Homo sapiens
aaggugaaaucaaagcaaa

SEQ ID NO: 1303626 - RNA, 19 nt, Homo sapiens
caaagaacauuggcucacu

SEQ ID NO: 1303627 - RNA, 19 nt, Homo sapiens
ggacuaggaacccaagcaa

SEQ ID NO: 1303628 - RNA, 19 nt, Homo sapiens
gaaggugaaaucaaagcaa

SEQ ID NO: 1303629 - RNA, 19 nt, Homo sapiens
ggaaggcuacccucaucuu

SEQ ID NO: 1303630 - RNA, 19 nt, Homo sapiens
gcucccaugugacaccaaa

SEQ ID NO: 1303631 - RNA, 19 nt, Homo sapiens
ucacugaauaggagacuuu

SEQ ID NO: 1303632 - RNA, 19 nt, Homo sapiens
ugaccaaucagcugaaaug

SEQ ID NO: 1303633 - RNA, 19 nt, Homo sapiens
gaauaggagacuuuacauc

SEQ ID NO: 1303634 - RNA, 19 nt, Homo sapiens
ucauaugcagcacuaauuu

SEQ ID NO: 1303635 - RNA, 19 nt, Homo sapiens
ccuuguagaugaguuuaaa

SEQ ID NO: 1303636 - RNA, 19 nt, Homo sapiens
ugaaagaagagcaaauaca

SEQ ID NO: 1303637 - RNA, 19 nt, Homo sapiens
guggaaggcuacccucauc

SEQ ID NO: 1303638 - RNA, 19 nt, Homo sapiens
uauguuugcugaaggugaa

SEQ ID NO: 1303639 - RNA, 19 nt, Homo sapiens
gagaggagagugaaaauug

SEQ ID NO: 1303640 - RNA, 19 nt, Homo sapiens
caaaucaguggccaaacuu

SEQ ID NO: 1303641 - RNA, 19 nt, Homo sapiens
gcagaaaacauccaaaauc

SEQ ID NO: 1303642 - RNA, 19 nt, Homo sapiens
cuaagauuaucacagucua

SEQ ID NO: 1303643 - RNA, 19 nt, Homo sapiens
gggcagguguugaagaacu

SEQ ID NO: 1303644 - RNA, 19 nt, Homo sapiens
agaagacuggaacauaaua

SEQ ID NO: 1303645 - RNA, 19 nt, Homo sapiens
ucuucaagcucucauuaug

SEQ ID NO: 1303646 - RNA, 19 nt, Homo sapiens
ggucuauggacaacaguuu

SEQ ID NO: 1303647 - RNA, 19 nt, Homo sapiens
uaucacagucuaaucagaa

SEQ ID NO: 1303648 - RNA, 19 nt, Homo sapiens
guugugcagugcuguguau

SEQ ID NO: 1303649 - RNA, 19 nt, Homo sapiens
ccucaucuuucacuaaugg

SEQ ID NO: 1303650 - RNA, 19 nt, Homo sapiens
uauacacggucguccauca

SEQ ID NO: 1303651 - RNA, 19 nt, Homo sapiens
gagccuauguuugcugaag

SEQ ID NO: 1303652 - RNA, 19 nt, Homo sapiens
uuaaacagcauauccagau

SEQ ID NO: 1303653 - RNA, 19 nt, Homo sapiens
ggaccuuguagaugaguuu

SEQ ID NO: 1303654 - RNA, 19 nt, Homo sapiens
gagaauuccauacugaaag

SEQ ID NO: 1303655 - RNA, 19 nt, Homo sapiens
uauuaucagcucacacaua

SEQ ID NO: 1303656 - RNA, 19 nt, Homo sapiens
caagauucugcaugucuaa

SEQ ID NO: 1303657 - RNA, 19 nt, Homo sapiens
uaaacagcauauccagauc

SEQ ID NO: 1303658 - RNA, 19 nt, Homo sapiens
gugcagugcuguguaugga

SEQ ID NO: 1303659 - RNA, 19 nt, Homo sapiens
cggagaagccagacauuuc

SEQ ID NO: 1303660 - RNA, 19 nt, Homo sapiens
ugcugaaggugaaaucaaa

SEQ ID NO: 1303661 - RNA, 19 nt, Homo sapiens
acugaaagaagagcaaaua

SEQ ID NO: 1303662 - RNA, 19 nt, Homo sapiens
aggcuacccucaucuuuca

SEQ ID NO: 1303663 - RNA, 19 nt, Homo sapiens
gaagccagacauuucagau

SEQ ID NO: 1303664 - RNA, 19 nt, Homo sapiens
aaacagagaggagagugaa

SEQ ID NO: 1303665 - RNA, 19 nt, Homo sapiens
uaugcaagauugguaaaca

SEQ ID NO: 1303666 - RNA, 19 nt, Homo sapiens
gugucuggcuuccuuacuu

SEQ ID NO: 1303667 - RNA, 19 nt, Homo sapiens
aaucauggaccuuguagau

SEQ ID NO: 1303668 - RNA, 19 nt, Homo sapiens
gacugaaacuggagaaaau

SEQ ID NO: 1303669 - RNA, 19 nt, Homo sapiens
caacauaccgauugaaaua

SEQ ID NO: 1303670 - RNA, 19 nt, Homo sapiens
gaacuucgaggaauguuua

SEQ ID NO: 1303671 - RNA, 19 nt, Homo sapiens
aaagagcucugauuaguuu

SEQ ID NO: 1303672 - RNA, 19 nt, Homo sapiens
gaagaaccaucaacaaaca

SEQ ID NO: 1303673 - RNA, 19 nt, Homo sapiens
aaacaugccucacagauga

SEQ ID NO: 1303674 - RNA, 19 nt, Homo sapiens
gaagauuguuuccaaguug

SEQ ID NO: 1303675 - RNA, 19 nt, Homo sapiens
ccaaagauuucccauaguu

SEQ ID NO: 1303676 - RNA, 19 nt, Homo sapiens
gggaaucuguggaacauuu

SEQ ID NO: 1303677 - RNA, 19 nt, Homo sapiens
gcaauugccauguuacuuu

SEQ ID NO: 1303678 - RNA, 19 nt, Homo sapiens
gaauguacauggaaaggau

SEQ ID NO: 1303679 - RNA, 19 nt, Homo sapiens
ucagcgaguuucagaauuu

SEQ ID NO: 1303680 - RNA, 19 nt, Homo sapiens
ucagugaccuguaugagaa

SEQ ID NO: 1303681 - RNA, 19 nt, Homo sapiens
gcugagaguucauuuagau

SEQ ID NO: 1303682 - RNA, 19 nt, Homo sapiens
gugagcaaauguugguuua

SEQ ID NO: 1303683 - RNA, 19 nt, Homo sapiens
gaugaaagacugugucaga

SEQ ID NO: 1303684 - RNA, 19 nt, Homo sapiens
acagagggcuuaacugaga

SEQ ID NO: 1303685 - RNA, 19 nt, Homo sapiens
ccaaucagaucaaugaaca

SEQ ID NO: 1303686 - RNA, 19 nt, Homo sapiens
guaccaaucagaucaauga

SEQ ID NO: 1303687 - RNA, 19 nt, Homo sapiens
guggagagguuacagaaga

SEQ ID NO: 1303688 - RNA, 19 nt, Homo sapiens
ccacagagggcuuaacuga

SEQ ID NO: 1303689 - RNA, 19 nt, Homo sapiens
caaguugaaggaugaaaua

SEQ ID NO: 1303690 - RNA, 19 nt, Homo sapiens
ggcaagcucuaaauucuau

SEQ ID NO: 1303691 - RNA, 19 nt, Homo sapiens
gugagcaauugccauguua

SEQ ID NO: 1303692 - RNA, 19 nt, Homo sapiens
gaaauucagcagugucuug

SEQ ID NO: 1303693 - RNA, 19 nt, Homo sapiens
uaccaaagauuucccauag

SEQ ID NO: 1303694 - RNA, 19 nt, Homo sapiens
guuaauaugugagaaccua

SEQ ID NO: 1303695 - RNA, 19 nt, Homo sapiens
guugaaggaugaaauaauc

SEQ ID NO: 1303696 - RNA, 19 nt, Homo sapiens
gaacuaaaugagaaacuug

SEQ ID NO: 1303697 - RNA, 19 nt, Homo sapiens
acaaauaaaccaccagaaa

SEQ ID NO: 1303698 - RNA, 19 nt, Homo sapiens
uaugagacccuaaaggaua

SEQ ID NO: 1303699 - RNA, 19 nt, Homo sapiens
gagaaccuaggaaguauuu

SEQ ID NO: 1303700 - RNA, 19 nt, Homo sapiens
gaaagacgccuuggcugaa

SEQ ID NO: 1303701 - RNA, 19 nt, Homo sapiens
ccagaaggcucagcgaguu

SEQ ID NO: 1303702 - RNA, 19 nt, Homo sapiens
acaagaaguuggaggaguu

SEQ ID NO: 1303703 - RNA, 19 nt, Homo sapiens
cgagagcacuuuggaaugu

SEQ ID NO: 1303704 - RNA, 19 nt, Homo sapiens
gagaugggcccaagagaug

SEQ ID NO: 1303705 - RNA, 19 nt, Homo sapiens
aaacagagagcacagcaaa

SEQ ID NO: 1303706 - RNA, 19 nt, Homo sapiens
gugagaagaacauuaauug

SEQ ID NO: 1303707 - RNA, 19 nt, Homo sapiens
caagcugccuuucaaaucu

SEQ ID NO: 1303708 - RNA, 19 nt, Homo sapiens
caaagaaauucagcagugu

SEQ ID NO: 1303709 - RNA, 19 nt, Homo sapiens
gaaagaacgcacagaccuu

SEQ ID NO: 1303710 - RNA, 19 nt, Homo sapiens
ccaggaagauguuuaugag

SEQ ID NO: 1303711 - RNA, 19 nt, Homo sapiens
caaaagagcucugauuagu

SEQ ID NO: 1303712 - RNA, 19 nt, Homo sapiens
gaaccuaggaaguauuuua

SEQ ID NO: 1303713 - RNA, 19 nt, Homo sapiens
gagcugagaguucauuuag

SEQ ID NO: 1303714 - RNA, 19 nt, Homo sapiens
gugagugcgucccuucuuu

SEQ ID NO: 1303715 - RNA, 19 nt, Homo sapiens
cagcgaguuucagaauuua

SEQ ID NO: 1303716 - RNA, 19 nt, Homo sapiens
caauugccauguuacuuug

SEQ ID NO: 1303717 - RNA, 19 nt, Homo sapiens
ggugagcaauugccauguu

SEQ ID NO: 1303718 - RNA, 19 nt, Homo sapiens
ccucacagaugauuuccaa

SEQ ID NO: 1303719 - RNA, 19 nt, Homo sapiens
gacaaaagagcucugauua

SEQ ID NO: 1303720 - RNA, 19 nt, Homo sapiens
gagaguucauuuagaucaa

SEQ ID NO: 1303721 - RNA, 19 nt, Homo sapiens
gagcaaauguugguuuacu

SEQ ID NO: 1303722 - RNA, 19 nt, Homo sapiens
gagagcacuuuggaaugua

SEQ ID NO: 1303723 - RNA, 19 nt, Homo sapiens
ggaaucuguggaacauuua

SEQ ID NO: 1303724 - RNA, 19 nt, Homo sapiens
ucaaugaacaagccaguuu

SEQ ID NO: 1303725 - RNA, 19 nt, Homo sapiens
ggaagaaccaucaacaaac

SEQ ID NO: 1303726 - RNA, 19 nt, Homo sapiens
gcaagcugccuuucaaauc

SEQ ID NO: 1303727 - RNA, 19 nt, Homo sapiens
gaaguuggaggaguugaaa

SEQ ID NO: 1303728 - RNA, 19 nt, Homo sapiens
aaacaaacugcgagaacua

SEQ ID NO: 1303729 - RNA, 19 nt, Homo sapiens
uaacugagaaccguauuga

SEQ ID NO: 1303730 - RNA, 19 nt, Homo sapiens
uggaacugcugcuaauuga

SEQ ID NO: 1303731 - RNA, 19 nt, Homo sapiens
ggacacagucagcuggauu

SEQ ID NO: 1303732 - RNA, 19 nt, Homo sapiens
agacagaggaggacaguga

SEQ ID NO: 1303733 - RNA, 19 nt, Homo sapiens
ccucaaagccagaagauuc

SEQ ID NO: 1303734 - RNA, 19 nt, Homo sapiens
caaagaaauaucuguggaa

SEQ ID NO: 1303735 - RNA, 19 nt, Homo sapiens
caaagauuucccauaguuu

SEQ ID NO: 1303736 - RNA, 19 nt, Homo sapiens
gaacugcugcuaauugaac

SEQ ID NO: 1303737 - RNA, 19 nt, Homo sapiens
ggugagaagaacauuaauu

SEQ ID NO: 1303738 - RNA, 19 nt, Homo sapiens
uuagcaagcugccuuucaa

SEQ ID NO: 1303739 - RNA, 19 nt, Homo sapiens
agaagauuguuuccaaguu

SEQ ID NO: 1303740 - RNA, 19 nt, Homo sapiens
guuaugcaaugcuuugugu

SEQ ID NO: 1303741 - RNA, 19 nt, Homo sapiens
gugagaaccuaggaaguau

SEQ ID NO: 1303742 - RNA, 19 nt, Homo sapiens
gaagcaaagagcaaaguca

SEQ ID NO: 1303743 - RNA, 19 nt, Homo sapiens
ugauggaacugcugcuaau

SEQ ID NO: 1303744 - RNA, 19 nt, Homo sapiens
uggaagaaccaucaacaaa

SEQ ID NO: 1303745 - RNA, 19 nt, Homo sapiens
gaacggauuggugguguga

SEQ ID NO: 1303746 - RNA, 19 nt, Homo sapiens
ugaccuguaugagaaauug

SEQ ID NO: 1303747 - RNA, 19 nt, Homo sapiens
ggagagcaaagaaauaucu

SEQ ID NO: 1303748 - RNA, 19 nt, Homo sapiens
uauaugcgcugauggaacu

SEQ ID NO: 1303749 - RNA, 19 nt, Homo sapiens
agaugaggcuggugaggaa

SEQ ID NO: 1303750 - RNA, 19 nt, Homo sapiens
ucccauaguuugagcauuc

SEQ ID NO: 1303751 - RNA, 19 nt, Homo sapiens
ggacugugaacauucuuau

SEQ ID NO: 1303752 - RNA, 19 nt, Homo sapiens
caaauaaaccaccagaaaa

SEQ ID NO: 1303753 - RNA, 19 nt, Homo sapiens
agagaauggugagcaauug

SEQ ID NO: 1303754 - RNA, 19 nt, Homo sapiens
caucaccaguggagagguu

SEQ ID NO: 1303755 - RNA, 19 nt, Homo sapiens
gcagugucuuguaggaaau

SEQ ID NO: 1303756 - RNA, 19 nt, Homo sapiens
uaaacaaacugcgagaacu

SEQ ID NO: 1303757 - RNA, 19 nt, Homo sapiens
aaagauuucccauaguuug

SEQ ID NO: 1303758 - RNA, 19 nt, Homo sapiens
cugagaaccguauugauuu

SEQ ID NO: 1303759 - RNA, 19 nt, Homo sapiens
ggacaaaagagcucugauu

SEQ ID NO: 1303760 - RNA, 19 nt, Homo sapiens
agaagagaauggugagcaa

SEQ ID NO: 1303761 - RNA, 19 nt, Homo sapiens
cuucauuuauugucaguga

SEQ ID NO: 1303762 - RNA, 19 nt, Homo sapiens
ugugagaaccuaggaagua

SEQ ID NO: 1303763 - RNA, 19 nt, Homo sapiens
acugagaaccguauugauu

SEQ ID NO: 1303764 - RNA, 19 nt, Homo sapiens
gagcaaagucaggaaacaa

SEQ ID NO: 1303765 - RNA, 19 nt, Homo sapiens
gcaaauguugguuuacuac

SEQ ID NO: 1303766 - RNA, 19 nt, Homo sapiens
cgccuuggcugaaccaugu

SEQ ID NO: 1303767 - RNA, 19 nt, Homo sapiens
gugcgucccuucuuuaaaa

SEQ ID NO: 1303768 - RNA, 19 nt, Homo sapiens
ugagugcgucccuucuuua

SEQ ID NO: 1303769 - RNA, 19 nt, Homo sapiens
caacagaaguaacaacaaa

SEQ ID NO: 1303770 - RNA, 19 nt, Homo sapiens
gaagauugcugaagucugu

SEQ ID NO: 1303771 - RNA, 19 nt, Homo sapiens
gaagagaugucaggagaaa

SEQ ID NO: 1303772 - RNA, 19 nt, Homo sapiens
guaaagagauuucauugca

SEQ ID NO: 1303773 - RNA, 19 nt, Homo sapiens
guaacaagccagaugauua

SEQ ID NO: 1303774 - RNA, 19 nt, Homo sapiens
gccuagagcuuguugauaa

SEQ ID NO: 1303775 - RNA, 19 nt, Homo sapiens
aggcauagcucauaaacua

SEQ ID NO: 1303776 - RNA, 19 nt, Homo sapiens
gaaggguccuguucauaaa

SEQ ID NO: 1303777 - RNA, 19 nt, Homo sapiens
caaauaagccaucugauug

SEQ ID NO: 1303778 - RNA, 19 nt, Homo sapiens
ggaaggguccuguucauaa

SEQ ID NO: 1303779 - RNA, 19 nt, Homo sapiens
gaggagacccugaacauuu

SEQ ID NO: 1303780 - RNA, 19 nt, Homo sapiens
ggacggguguucucaguga

SEQ ID NO: 1303781 - RNA, 19 nt, Homo sapiens
gguccaagcucuguuauug

SEQ ID NO: 1303782 - RNA, 19 nt, Homo sapiens
ugucuaagaucucuacuuu

SEQ ID NO: 1303783 - RNA, 19 nt, Homo sapiens
ccaaauacgugaagcugaa

SEQ ID NO: 1303784 - RNA, 19 nt, Homo sapiens
gaaugagugugaaguguau

SEQ ID NO: 1303785 - RNA, 19 nt, Homo sapiens
caagacaauuccuggcaua

SEQ ID NO: 1303786 - RNA, 19 nt, Homo sapiens
gacaauuccuggcauauuc

SEQ ID NO: 1303787 - RNA, 19 nt, Homo sapiens
gaagcacuuugguacgaua

SEQ ID NO: 1303788 - RNA, 19 nt, Homo sapiens
acaguuaagugugucauua

SEQ ID NO: 1303789 - RNA, 19 nt, Homo sapiens
acagcaaagucuacaauaa

SEQ ID NO: 1303790 - RNA, 19 nt, Homo sapiens
ugacaggcauagcucauaa

SEQ ID NO: 1303791 - RNA, 19 nt, Homo sapiens
ucaaauaagccaucugauu

SEQ ID NO: 1303792 - RNA, 19 nt, Homo sapiens
caagcucuguuauugagua

SEQ ID NO: 1303793 - RNA, 19 nt, Homo sapiens
gagcuucccugcuauaaac

SEQ ID NO: 1303794 - RNA, 19 nt, Homo sapiens
gaacaagcugugucuaaga

SEQ ID NO: 1303795 - RNA, 19 nt, Homo sapiens
gcucaaaguuuuagaugua

SEQ ID NO: 1303796 - RNA, 19 nt, Homo sapiens
guuaaagugugucucugua

SEQ ID NO: 1303797 - RNA, 19 nt, Homo sapiens
caccacaccuggcugcaua

SEQ ID NO: 1303798 - RNA, 19 nt, Homo sapiens
cagcaaagucuacaauaaa

SEQ ID NO: 1303799 - RNA, 19 nt, Homo sapiens
uaacaagccagaugauuau

SEQ ID NO: 1303800 - RNA, 19 nt, Homo sapiens
caaauaagccagccgugaa

SEQ ID NO: 1303801 - RNA, 19 nt, Homo sapiens
cuaaugagcuaguguuucu

SEQ ID NO: 1303802 - RNA, 19 nt, Homo sapiens
gcaaauugauugucuugac

SEQ ID NO: 1303803 - RNA, 19 nt, Homo sapiens
gcaauucugacgacaauau

SEQ ID NO: 1303804 - RNA, 19 nt, Homo sapiens
gaagaaugaguuuguggaa

SEQ ID NO: 1303805 - RNA, 19 nt, Homo sapiens
aaacaaucaugacugaaug

SEQ ID NO: 1303806 - RNA, 19 nt, Homo sapiens
gcggguagauagauaacuu

SEQ ID NO: 1303807 - RNA, 19 nt, Homo sapiens
gugaacagguugaggaugu

SEQ ID NO: 1303808 - RNA, 19 nt, Homo sapiens
guggaaauauggcugaaug

SEQ ID NO: 1303809 - RNA, 19 nt, Homo sapiens
uguaagcacuauccaggua

SEQ ID NO: 1303810 - RNA, 19 nt, Homo sapiens
aaagagggcuuacaaaaug

SEQ ID NO: 1303811 - RNA, 19 nt, Homo sapiens
gaacuuuccauggcaguaa

SEQ ID NO: 1303812 - RNA, 19 nt, Homo sapiens
gaaauauggcugaaugagu

SEQ ID NO: 1303813 - RNA, 19 nt, Homo sapiens
uaaccuuucugucucuuug

SEQ ID NO: 1303814 - RNA, 19 nt, Homo sapiens
uaacaugggcagccuuuga

SEQ ID NO: 1303815 - RNA, 19 nt, Homo sapiens
ugacaaggcaaauugauug

SEQ ID NO: 1303816 - RNA, 19 nt, Homo sapiens
cagcaauucugacgacaau

SEQ ID NO: 1303817 - RNA, 19 nt, Homo sapiens
agaaugaguuuguggaaca

SEQ ID NO: 1303818 - RNA, 19 nt, Homo sapiens
gaaagucgaagugaauguu

SEQ ID NO: 1303819 - RNA, 19 nt, Homo sapiens
ggaaagagggcuuacaaaa

SEQ ID NO: 1303820 - RNA, 19 nt, Homo sapiens
cagcuuagacuuuguacuu

SEQ ID NO: 1303821 - RNA, 19 nt, Homo sapiens
guuuagggaucaagccuuu

SEQ ID NO: 1303822 - RNA, 19 nt, Homo sapiens
uagcagaagccaaguacua

SEQ ID NO: 1303823 - RNA, 19 nt, Homo sapiens
guaaaacacuggcccaaga

SEQ ID NO: 1303824 - RNA, 19 nt, Homo sapiens
caaggcaaauugauugucu

SEQ ID NO: 1303825 - RNA, 19 nt, Homo sapiens
ccaaagugcugggauuaca

SEQ ID NO: 1303826 - RNA, 19 nt, Homo sapiens
gcccaugcccagcuaauuu

SEQ ID NO: 1303827 - RNA, 19 nt, Homo sapiens
aagcugggcuaacuuucua

SEQ ID NO: 1303828 - RNA, 19 nt, Homo sapiens
gggaagcacuuugguacga

SEQ ID NO: 1303829 - RNA, 19 nt, Homo sapiens
guucauaaaggaugucauu

SEQ ID NO: 1303830 - RNA, 19 nt, Homo sapiens
guacaaacguuggcgacau

SEQ ID NO: 1303831 - RNA, 19 nt, Homo sapiens
caccaacccugucuuucuu

SEQ ID NO: 1303832 - RNA, 19 nt, Homo sapiens
gaaagagggcuuacaaaau

SEQ ID NO: 1303833 - RNA, 19 nt, Homo sapiens
acaguuguaugccuucauu

SEQ ID NO: 1303834 - RNA, 19 nt, Homo sapiens
gggaaucguuaccguuuua

SEQ ID NO: 1303835 - RNA, 19 nt, Homo sapiens
caaaggaacaggagugagu

SEQ ID NO: 1303836 - RNA, 19 nt, Homo sapiens
ccuuaaggguucaguuuga

SEQ ID NO: 1303837 - RNA, 19 nt, Homo sapiens
aaacguuggcgacauguaa

SEQ ID NO: 1303838 - RNA, 19 nt, Homo sapiens
gauuugcuguggccucuau

SEQ ID NO: 1303839 - RNA, 19 nt, Homo sapiens
aaacaccaacccugucuuu

SEQ ID NO: 1303840 - RNA, 19 nt, Homo sapiens
caacagcaaagucuacaau

SEQ ID NO: 1303841 - RNA, 19 nt, Homo sapiens
gggcagccuuugacacaug

SEQ ID NO: 1303842 - RNA, 19 nt, Homo sapiens
guggagcccucuacuauac

SEQ ID NO: 1303843 - RNA, 19 nt, Homo sapiens
caagccagaugauuauuuu

SEQ ID NO: 1303844 - RNA, 19 nt, Homo sapiens
uaagcacuauccagguaaa

SEQ ID NO: 1303845 - RNA, 19 nt, Homo sapiens
ggccagcagugaacagguu

SEQ ID NO: 1303846 - RNA, 19 nt, Homo sapiens
ccagugagcaggcaagaga

SEQ ID NO: 1303847 - RNA, 19 nt, Homo sapiens
uaaacugucgugugagaaa

SEQ ID NO: 1303848 - RNA, 19 nt, Homo sapiens
gguggagcccucuacuaua

SEQ ID NO: 1303849 - RNA, 19 nt, Homo sapiens
gaaugugcgucaggugaug

SEQ ID NO: 1303850 - RNA, 19 nt, Homo sapiens
ggguucaguuugacaauuc

SEQ ID NO: 1303851 - RNA, 19 nt, Homo sapiens
gagaaucugagacucuuug

SEQ ID NO: 1303852 - RNA, 19 nt, Homo sapiens
ggguggagcccucuacuau

SEQ ID NO: 1303853 - RNA, 19 nt, Homo sapiens
aaacacuggcccaagauuu

SEQ ID NO: 1303854 - RNA, 19 nt, Homo sapiens
gcucuguuauugaguauac

SEQ ID NO: 1303855 - RNA, 19 nt, Homo sapiens
gaaugagugucuaaaucgu

SEQ ID NO: 1303856 - RNA, 19 nt, Homo sapiens
gaucaccucauccaaggaa

SEQ ID NO: 1303857 - RNA, 19 nt, Homo sapiens
uggaacagcuuuggugugu

SEQ ID NO: 1303858 - RNA, 19 nt, Homo sapiens
guuauugaguauacaagga

SEQ ID NO: 1303859 - RNA, 19 nt, Homo sapiens
gcggagucuugcucuauug

SEQ ID NO: 1303860 - RNA, 19 nt, Homo sapiens
ggcggagucuugcucuauu

SEQ ID NO: 1303861 - RNA, 19 nt, Homo sapiens
gaggaugugcggguagaua

SEQ ID NO: 1303862 - RNA, 19 nt, Homo sapiens
ugaaugagugugaagugua

SEQ ID NO: 1303863 - RNA, 19 nt, Homo sapiens
ugaacaagcugugucuaag

SEQ ID NO: 1303864 - RNA, 19 nt, Homo sapiens
ccgaagcccggauuuauga

SEQ ID NO: 1303865 - RNA, 19 nt, Homo sapiens
gccggaagauugcugaagu

SEQ ID NO: 1303866 - RNA, 19 nt, Homo sapiens
ugacgacaauauguugaaa

SEQ ID NO: 1303867 - RNA, 19 nt, Homo sapiens
uuauagccaugagugaaua

SEQ ID NO: 1303868 - RNA, 19 nt, Homo sapiens
cugaaugagugucuaaauc

SEQ ID NO: 1303869 - RNA, 19 nt, Homo sapiens
uaacagaacuugacaauca

SEQ ID NO: 1303870 - RNA, 19 nt, Homo sapiens
gaacagcacuugagcuuug

SEQ ID NO: 1303871 - RNA, 19 nt, Homo sapiens
gaacguguguggaauauga

SEQ ID NO: 1303872 - RNA, 19 nt, Homo sapiens
gaaggaagaagaaacaaua

SEQ ID NO: 1303873 - RNA, 19 nt, Homo sapiens
caauaucucuugacucuug

SEQ ID NO: 1303874 - RNA, 19 nt, Homo sapiens
gacacucuauguuucauua

SEQ ID NO: 1303875 - RNA, 19 nt, Homo sapiens
caaagacacucuauguuuc

SEQ ID NO: 1303876 - RNA, 19 nt, Homo sapiens
ccaaagacacucuauguuu

SEQ ID NO: 1303877 - RNA, 19 nt, Homo sapiens
ccaagcugcugaaauagua

SEQ ID NO: 1303878 - RNA, 19 nt, Homo sapiens
gaaagaaacaggcaaagau

SEQ ID NO: 1303879 - RNA, 19 nt, Homo sapiens
ggaaaugucacaagagauu

SEQ ID NO: 1303880 - RNA, 19 nt, Homo sapiens
gcacacaggagcauuguuu

SEQ ID NO: 1303881 - RNA, 19 nt, Homo sapiens
gaugccagcucuugcuaua

SEQ ID NO: 1303882 - RNA, 19 nt, Homo sapiens
guacacagaucuucaagca

SEQ ID NO: 1303883 - RNA, 19 nt, Homo sapiens
caaagcuuguuaccuguua

SEQ ID NO: 1303884 - RNA, 19 nt, Homo sapiens
guacauaauuucagcuuuc

SEQ ID NO: 1303885 - RNA, 19 nt, Homo sapiens
ccacuaagauaucccagaa

SEQ ID NO: 1303886 - RNA, 19 nt, Homo sapiens
aagcgaaucuugccaauau

SEQ ID NO: 1303887 - RNA, 19 nt, Homo sapiens
guagaaaucacacuugaaa

SEQ ID NO: 1303888 - RNA, 19 nt, Homo sapiens
ggaagaagaaacaauaaug

SEQ ID NO: 1303889 - RNA, 19 nt, Homo sapiens
caccagagcugaaucuuuc

SEQ ID NO: 1303890 - RNA, 19 nt, Homo sapiens
caacuggcagcaauaaaua

SEQ ID NO: 1303891 - RNA, 19 nt, Homo sapiens
gaagauacagugaggcaaa

SEQ ID NO: 1303892 - RNA, 19 nt, Homo sapiens
gaaaugaaguuggucuaca

SEQ ID NO: 1303893 - RNA, 19 nt, Homo sapiens
cagaguauauguacacaga

SEQ ID NO: 1303894 - RNA, 19 nt, Homo sapiens
uuagaugucuggagaggua

SEQ ID NO: 1303895 - RNA, 19 nt, Homo sapiens
uagcaaguguggcaaguuu

SEQ ID NO: 1303896 - RNA, 19 nt, Homo sapiens
gcaggaagcaguaggaguu

SEQ ID NO: 1303897 - RNA, 19 nt, Homo sapiens
cagcaaagguagucauuag

SEQ ID NO: 1303898 - RNA, 19 nt, Homo sapiens
uaagcaagcucaucaaacu

SEQ ID NO: 1303899 - RNA, 19 nt, Homo sapiens
gaaaucacacuugaaagaa

SEQ ID NO: 1303900 - RNA, 19 nt, Homo sapiens
gagcaggcacuaccacuaa

SEQ ID NO: 1303901 - RNA, 19 nt, Homo sapiens
cauaauggauguggaaaug

SEQ ID NO: 1303902 - RNA, 19 nt, Homo sapiens
caaguuucauugagacaaa

SEQ ID NO: 1303903 - RNA, 19 nt, Homo sapiens
augccaagcugcugaaaua

SEQ ID NO: 1303904 - RNA, 19 nt, Homo sapiens
gcaaagauaacagaacuug

SEQ ID NO: 1303905 - RNA, 19 nt, Homo sapiens
aaagaaacaggcaaagaua

SEQ ID NO: 1303906 - RNA, 19 nt, Homo sapiens
gcaagggcauccacuccaa

SEQ ID NO: 1303907 - RNA, 19 nt, Homo sapiens
ugaaguuggucuacauuga

SEQ ID NO: 1303908 - RNA, 19 nt, Homo sapiens
gaaggcagaaggugaagaa

SEQ ID NO: 1303909 - RNA, 19 nt, Homo sapiens
ugacaaagggcaucaaaga

SEQ ID NO: 1303910 - RNA, 19 nt, Homo sapiens
uaauggauguggaaaugaa

SEQ ID NO: 1303911 - RNA, 19 nt, Homo sapiens
gauaaacacaagcaagaaa

SEQ ID NO: 1303912 - RNA, 19 nt, Homo sapiens
gaaaugucacaagagauua

SEQ ID NO: 1303913 - RNA, 19 nt, Homo sapiens
gcaagcucaucaaacugua

SEQ ID NO: 1303914 - RNA, 19 nt, Homo sapiens
acaaagggcaucaaagaaa

SEQ ID NO: 1303915 - RNA, 19 nt, Homo sapiens
gaaauaguagacccuuuga

SEQ ID NO: 1303916 - RNA, 19 nt, Homo sapiens
gauaacagaacuugacaau

SEQ ID NO: 1303917 - RNA, 19 nt, Homo sapiens
ugacaaauggcuucaggua

SEQ ID NO: 1303918 - RNA, 19 nt, Homo sapiens
gcugaaucuuucucgguua

SEQ ID NO: 1303919 - RNA, 19 nt, Homo sapiens
gaucuugcccugaaucaug

SEQ ID NO: 1303920 - RNA, 19 nt, Homo sapiens
gaagaaaagccaacuagaa

SEQ ID NO: 1303921 - RNA, 19 nt, Homo sapiens
ggaagcgaaucuugccaau

SEQ ID NO: 1303922 - RNA, 19 nt, Homo sapiens
acuaagauaucccagaaga

SEQ ID NO: 1303923 - RNA, 19 nt, Homo sapiens
gaguauauguacacagauc

SEQ ID NO: 1303924 - RNA, 19 nt, Homo sapiens
aaagccaacuagaaagaaa

SEQ ID NO: 1303925 - RNA, 19 nt, Homo sapiens
agaaaucacacuugaaaga

SEQ ID NO: 1303926 - RNA, 19 nt, Homo sapiens
gaauugcugcagucacuaa

SEQ ID NO: 1303927 - RNA, 19 nt, Homo sapiens
gaagcgaaucuugccaaua

SEQ ID NO: 1303928 - RNA, 19 nt, Homo sapiens
aacaauaucucuugacucu

SEQ ID NO: 1303929 - RNA, 19 nt, Homo sapiens
gacaaagggcaucaaagaa

SEQ ID NO: 1303930 - RNA, 19 nt, Homo sapiens
ggaagggaagagagcauaa

SEQ ID NO: 1303931 - RNA, 19 nt, Homo sapiens
gagguaaacagguagaaau

SEQ ID NO: 1303932 - RNA, 19 nt, Homo sapiens
gcacuaccacuaagauauc

SEQ ID NO: 1303933 - RNA, 19 nt, Homo sapiens
gggaagagagcauaagcaa

SEQ ID NO: 1303934 - RNA, 19 nt, Homo sapiens
gcaagaaaauguccaccuu

SEQ ID NO: 1303935 - RNA, 19 nt, Homo sapiens
gaaguuggucuacauugau

SEQ ID NO: 1303936 - RNA, 19 nt, Homo sapiens
caaagggcaucaaagaaaa

SEQ ID NO: 1303937 - RNA, 19 nt, Homo sapiens
guacugugaagcuggauaa

SEQ ID NO: 1303938 - RNA, 19 nt, Homo sapiens
gagaaugcagugaauagga

SEQ ID NO: 1303939 - RNA, 19 nt, Homo sapiens
gagcagucccaggugauua

SEQ ID NO: 1303940 - RNA, 19 nt, Homo sapiens
cgugauugcugacuacaug

SEQ ID NO: 1303941 - RNA, 19 nt, Homo sapiens
aaccagaucuugcccugaa

SEQ ID NO: 1303942 - RNA, 19 nt, Homo sapiens
gcaguaggaguuuggagaa

SEQ ID NO: 1303943 - RNA, 19 nt, Homo sapiens
ugauggagaaguugcaaua

SEQ ID NO: 1303944 - RNA, 19 nt, Homo sapiens
caccuaacauccuggaaau

SEQ ID NO: 1303945 - RNA, 19 nt, Homo sapiens
gauauucacagagcauaaa

SEQ ID NO: 1303946 - RNA, 19 nt, Homo sapiens
gaaucuuucucgguuaugu

SEQ ID NO: 1303947 - RNA, 19 nt, Homo sapiens
ugaaauaguagacccuuug

SEQ ID NO: 1303948 - RNA, 19 nt, Homo sapiens
ccacuccaaugcccaccua

SEQ ID NO: 1303949 - RNA, 19 nt, Homo sapiens
ccaauuagaggacaguuuc

SEQ ID NO: 1303950 - RNA, 19 nt, Homo sapiens
ccucaggugugauggagaa

SEQ ID NO: 1303951 - RNA, 19 nt, Homo sapiens
ggagcaggcacuaccacua

SEQ ID NO: 1303952 - RNA, 19 nt, Homo sapiens
cagaauugcugcagucacu

SEQ ID NO: 1303953 - RNA, 19 nt, Homo sapiens
ccaacaauaucucuugacu

SEQ ID NO: 1303954 - RNA, 19 nt, Homo sapiens
gaucagcuuguuccaaaga

SEQ ID NO: 1303955 - RNA, 19 nt, Homo sapiens
ucagcaaguuggacucgaa

SEQ ID NO: 1303956 - RNA, 19 nt, Homo sapiens
cugugaagcuggauaacaa

SEQ ID NO: 1303957 - RNA, 19 nt, Homo sapiens
ucagcuuguuccaaagaua

SEQ ID NO: 1303958 - RNA, 19 nt, Homo sapiens
gcaaguguggcaaguuuca

SEQ ID NO: 1303959 - RNA, 19 nt, Homo sapiens
gaaaagccaacuagaaaga

SEQ ID NO: 1303960 - RNA, 19 nt, Homo sapiens
guaaacagguagaaaucac

SEQ ID NO: 1303961 - RNA, 19 nt, Homo sapiens
aaagaaagaggugguauuc

SEQ ID NO: 1303962 - RNA, 19 nt, Homo sapiens
uaagauaucccagaagaag

SEQ ID NO: 1303963 - RNA, 19 nt, Homo sapiens
cuggaaaugucacaagaga

SEQ ID NO: 1303964 - RNA, 19 nt, Homo sapiens
gcagagcuagcaaccauuc

SEQ ID NO: 1303965 - RNA, 19 nt, Homo sapiens
caggugugauggagaaguu

SEQ ID NO: 1303966 - RNA, 19 nt, Homo sapiens
uagaagcacccaauugaau

SEQ ID NO: 1303967 - RNA, 19 nt, Homo sapiens
gcgaaucuugccaauauug

SEQ ID NO: 1303968 - RNA, 19 nt, Homo sapiens
uaaaggaugccagcucuug

SEQ ID NO: 1303969 - RNA, 19 nt, Homo sapiens
caacaaagcuucugaaugc

SEQ ID NO: 1303970 - RNA, 19 nt, Homo sapiens
uaacaguccuugacacuua

SEQ ID NO: 1303971 - RNA, 19 nt, Homo sapiens
ccacagaccuggaugauga

SEQ ID NO: 1303972 - RNA, 19 nt, Homo sapiens
ggaaaccucuuacuacuug

SEQ ID NO: 1303973 - RNA, 19 nt, Homo sapiens
gaaagaauccuucgaagau

SEQ ID NO: 1303974 - RNA, 19 nt, Homo sapiens
uggauuaccuguaccauua

SEQ ID NO: 1303975 - RNA, 19 nt, Homo sapiens
gagcagagguaacauugaa

SEQ ID NO: 1303976 - RNA, 19 nt, Homo sapiens
gaagaaauccaucauguca

SEQ ID NO: 1303977 - RNA, 19 nt, Homo sapiens
ccugaggacuuacagauua

SEQ ID NO: 1303978 - RNA, 19 nt, Homo sapiens
gaacaacuauauagagucu

SEQ ID NO: 1303979 - RNA, 19 nt, Homo sapiens
acacuuagcugcugaggaa

SEQ ID NO: 1303980 - RNA, 19 nt, Homo sapiens
ggagagaccaucagcagua

SEQ ID NO: 1303981 - RNA, 19 nt, Homo sapiens
gaagacaaguggguaagga

SEQ ID NO: 1303982 - RNA, 19 nt, Homo sapiens
uguaugcucuggccuguua

SEQ ID NO: 1303983 - RNA, 19 nt, Homo sapiens
ugaaauagccaaagaagga

SEQ ID NO: 1303984 - RNA, 19 nt, Homo sapiens
ggaaagaauccuucgaaga

SEQ ID NO: 1303985 - RNA, 19 nt, Homo sapiens
aagaggaaguugcugcuua

SEQ ID NO: 1303986 - RNA, 19 nt, Homo sapiens
ggaauaugaaacagcauua

SEQ ID NO: 1303987 - RNA, 19 nt, Homo sapiens
uaaggaaccacuucuauga

SEQ ID NO: 1303988 - RNA, 19 nt, Homo sapiens
ggaaguugcugcuuauagg

SEQ ID NO: 1303989 - RNA, 19 nt, Homo sapiens
gaacucaguagguagguuu

SEQ ID NO: 1303990 - RNA, 19 nt, Homo sapiens
gagagaccaucagcaguaa

SEQ ID NO: 1303991 - RNA, 19 nt, Homo sapiens
uggaagaacucaguaggua

SEQ ID NO: 1303992 - RNA, 19 nt, Homo sapiens
ucaacuaccugcugucaug

SEQ ID NO: 1303993 - RNA, 19 nt, Homo sapiens
gcauaugggucuucucuac

SEQ ID NO: 1303994 - RNA, 19 nt, Homo sapiens
gcaugccucugauggauga

SEQ ID NO: 1303995 - RNA, 19 nt, Homo sapiens
caaagaaggaagugacaaa

SEQ ID NO: 1303996 - RNA, 19 nt, Homo sapiens
gaauaucuguguggacaug

SEQ ID NO: 1303997 - RNA, 19 nt, Homo sapiens
aagaagaaauccaucaugu

SEQ ID NO: 1303998 - RNA, 19 nt, Homo sapiens
gaugacagaagcaauuaaa

SEQ ID NO: 1303999 - RNA, 19 nt, Homo sapiens
cgaggaagauggucagcuu

SEQ ID NO: 1304000 - RNA, 19 nt, Homo sapiens
ggucucaauugaucaaaga

SEQ ID NO: 1304001 - RNA, 19 nt, Homo sapiens
gagaugacagaagcaauua

SEQ ID NO: 1304002 - RNA, 19 nt, Homo sapiens
ccacuucuaugaacgaugu

SEQ ID NO: 1304003 - RNA, 19 nt, Homo sapiens
caccgaggcugaagucuau

SEQ ID NO: 1304004 - RNA, 19 nt, Homo sapiens
cuaaugagcaugccucuga

SEQ ID NO: 1304005 - RNA, 19 nt, Homo sapiens
agagguaaauuucaaagga

SEQ ID NO: 1304006 - RNA, 19 nt, Homo sapiens
ggaaggagagcagagguaa

SEQ ID NO: 1304007 - RNA, 19 nt, Homo sapiens
ggagcagccugauaaacug

SEQ ID NO: 1304008 - RNA, 19 nt, Homo sapiens
gagcaugccucugauggau

SEQ ID NO: 1304009 - RNA, 19 nt, Homo sapiens
gaacgauguuuuaagauug

SEQ ID NO: 1304010 - RNA, 19 nt, Homo sapiens
gcucuggccuguuacuuca

SEQ ID NO: 1304011 - RNA, 19 nt, Homo sapiens
gagguaaauuucaaaggau

SEQ ID NO: 1304012 - RNA, 19 nt, Homo sapiens
cauugaaccugauccaguu

SEQ ID NO: 1304013 - RNA, 19 nt, Homo sapiens
gcaccgaggcugaagucua

SEQ ID NO: 1304014 - RNA, 19 nt, Homo sapiens
caauaauucugaagacaag

SEQ ID NO: 1304015 - RNA, 19 nt, Homo sapiens
uaaacuggauuaccuguac

SEQ ID NO: 1304016 - RNA, 19 nt, Homo sapiens
caucaaagcaagaagaaau

SEQ ID NO: 1304017 - RNA, 19 nt, Homo sapiens
gagcauguuacagauaaua

SEQ ID NO: 1304018 - RNA, 19 nt, Homo sapiens
gagagcagagguaacauug

SEQ ID NO: 1304019 - RNA, 19 nt, Homo sapiens
gugaacaacuauauagagu

SEQ ID NO: 1304020 - RNA, 19 nt, Homo sapiens
ggagagcagagguaacauu

SEQ ID NO: 1304021 - RNA, 19 nt, Homo sapiens
cagaugaugcuuacaguga

SEQ ID NO: 1304022 - RNA, 19 nt, Homo sapiens
gacagaagcaauuaaauac

SEQ ID NO: 1304023 - RNA, 19 nt, Homo sapiens
gcggaaaccucuuacuacu

SEQ ID NO: 1304024 - RNA, 19 nt, Homo sapiens
guaaggaaccacuucuaug

SEQ ID NO: 1304025 - RNA, 19 nt, Homo sapiens
gguaaggaaccacuucuau

SEQ ID NO: 1304026 - RNA, 19 nt, Homo sapiens
uaacaucaaagcaagaaga

SEQ ID NO: 1304027 - RNA, 19 nt, Homo sapiens
ugacacaacaguagagcua

SEQ ID NO: 1304028 - RNA, 19 nt, Homo sapiens
uaagauugcucagcugauc

SEQ ID NO: 1304029 - RNA, 19 nt, Homo sapiens
ccuguuacuucaauaauuc

SEQ ID NO: 1304030 - RNA, 19 nt, Homo sapiens
aggagcauguuacagauaa

SEQ ID NO: 1304031 - RNA, 19 nt, Homo sapiens
ucacuuaacaucaaagcaa

SEQ ID NO: 1304032 - RNA, 19 nt, Homo sapiens
ggugagagcaaguacaaug

SEQ ID NO: 1304033 - RNA, 19 nt, Homo sapiens
gaaauagccaaagaaggaa

SEQ ID NO: 1304034 - RNA, 19 nt, Homo sapiens
gccuguuacuucaauaauu

SEQ ID NO: 1304035 - RNA, 19 nt, Homo sapiens
ugaggacgcugagaggaaa

SEQ ID NO: 1304036 - RNA, 19 nt, Homo sapiens
gaagcauuccaucaauuga

SEQ ID NO: 1304037 - RNA, 19 nt, Homo sapiens
uaugaagcauuccaucaau

SEQ ID NO: 1304038 - RNA, 19 nt, Homo sapiens
uggaggagcagccugauaa

SEQ ID NO: 1304039 - RNA, 19 nt, Homo sapiens
agaggaaguugcugcuuau

SEQ ID NO: 1304040 - RNA, 19 nt, Homo sapiens
aaacggacuaugacucuuu

SEQ ID NO: 1304041 - RNA, 19 nt, Homo sapiens
aauaggagcauguuacaga

SEQ ID NO: 1304042 - RNA, 19 nt, Homo sapiens
ccuuagacuucaauacuug

SEQ ID NO: 1304043 - RNA, 19 nt, Homo sapiens
caagaagaaauccaucaug

SEQ ID NO: 1304044 - RNA, 19 nt, Homo sapiens
caguagagcuaaugagcau

SEQ ID NO: 1304045 - RNA, 19 nt, Homo sapiens
acagauuacucucagacaa

SEQ ID NO: 1304046 - RNA, 19 nt, Homo sapiens
aaagaauccuucgaagaug

SEQ ID NO: 1304047 - RNA, 19 nt, Homo sapiens
cagauuacucucagacaaa

SEQ ID NO: 1304048 - RNA, 19 nt, Homo sapiens
gcaagaagaaauccaucau

SEQ ID NO: 1304049 - RNA, 19 nt, Homo sapiens
cuucugaaauagccaaaga

SEQ ID NO: 1304050 - RNA, 19 nt, Homo sapiens
ugaagcauuccaucaauug

SEQ ID NO: 1304051 - RNA, 19 nt, Homo sapiens
acaagaagaauaucugugu

SEQ ID NO: 1304052 - RNA, 19 nt, Homo sapiens
gaaguugcugcuuauagga

SEQ ID NO: 1304053 - RNA, 19 nt, Homo sapiens
gacaaaaguucacuaugga

SEQ ID NO: 1304054 - RNA, 19 nt, Homo sapiens
ggaggagcagccugauaaa

SEQ ID NO: 1304055 - RNA, 19 nt, Homo sapiens
gacuaugacucuuuucaaa

SEQ ID NO: 1304056 - RNA, 19 nt, Homo sapiens
agagaugacagaagcaauu

SEQ ID NO: 1304057 - RNA, 19 nt, Homo sapiens
gaaccacuucuaugaacga

SEQ ID NO: 1304058 - RNA, 19 nt, Homo sapiens
aguggaagcuguaucucaa

SEQ ID NO: 1304059 - RNA, 19 nt, Homo sapiens
gcagagccaaggagagaug

SEQ ID NO: 1304060 - RNA, 19 nt, Homo sapiens
aagcggaaaccucuuacua

SEQ ID NO: 1304061 - RNA, 19 nt, Homo sapiens
acacaacaguagagcuaau

SEQ ID NO: 1304062 - RNA, 19 nt, Homo sapiens
auuccaaggucucaauuga

SEQ ID NO: 1304063 - RNA, 19 nt, Homo sapiens
auacaaacaggccaucaaa

SEQ ID NO: 1304064 - RNA, 19 nt, Homo sapiens
uccaaggucucaauugauc

SEQ ID NO: 1304065 - RNA, 19 nt, Homo sapiens
gcugcgagaugguuaucau

SEQ ID NO: 1304066 - RNA, 19 nt, Homo sapiens
aauccaucaugucaccuua

SEQ ID NO: 1304067 - RNA, 19 nt, Homo sapiens
aagaauccuucgaagaugu

SEQ ID NO: 1304068 - RNA, 19 nt, Homo sapiens
ggaacuccuacaagaagaa

SEQ ID NO: 1304069 - RNA, 19 nt, Homo sapiens
caucaaagacaccaaauua

SEQ ID NO: 1304070 - RNA, 19 nt, Homo sapiens
gaucuugccugcuggauau

SEQ ID NO: 1304071 - RNA, 19 nt, Homo sapiens
ccaagcaaccuaacucuua

SEQ ID NO: 1304072 - RNA, 19 nt, Homo sapiens
ugauauuucugcaggauua

SEQ ID NO: 1304073 - RNA, 19 nt, Homo sapiens
ccacgcagcugccagacua

SEQ ID NO: 1304074 - RNA, 19 nt, Homo sapiens
gaacuauccacaagucuaa

SEQ ID NO: 1304075 - RNA, 19 nt, Homo sapiens
caagcaaccuaacucuuaa

SEQ ID NO: 1304076 - RNA, 19 nt, Homo sapiens
ucaauuugcuugggauaua

SEQ ID NO: 1304077 - RNA, 19 nt, Homo sapiens
ggaacuggcuguggcauug

SEQ ID NO: 1304078 - RNA, 19 nt, Homo sapiens
gauacaaugucuucuguca

SEQ ID NO: 1304079 - RNA, 19 nt, Homo sapiens
uauaugagcucacaauucu

SEQ ID NO: 1304080 - RNA, 19 nt, Homo sapiens
ugucuucugucauuucuua

SEQ ID NO: 1304081 - RNA, 19 nt, Homo sapiens
caagugacauuccucaagu

SEQ ID NO: 1304082 - RNA, 19 nt, Homo sapiens
caaagacaccaaauuauag

SEQ ID NO: 1304083 - RNA, 19 nt, Homo sapiens
gaccaccucuggaccacua

SEQ ID NO: 1304084 - RNA, 19 nt, Homo sapiens
acacagaaaugcuacaaag

SEQ ID NO: 1304085 - RNA, 19 nt, Homo sapiens
uuacugacauguuguggaa

SEQ ID NO: 1304086 - RNA, 19 nt, Homo sapiens
ucacaauucuaucugauuc

SEQ ID NO: 1304087 - RNA, 19 nt, Homo sapiens
gcucaucacccaacauuca

SEQ ID NO: 1304088 - RNA, 19 nt, Homo sapiens
caacaucaaagacaccaaa

SEQ ID NO: 1304089 - RNA, 19 nt, Homo sapiens
caugagaacuauccacaag

SEQ ID NO: 1304090 - RNA, 19 nt, Homo sapiens
gacauguuguggaauuuau

SEQ ID NO: 1304091 - RNA, 19 nt, Homo sapiens
gcuggauauuucaguuaua

SEQ ID NO: 1304092 - RNA, 19 nt, Homo sapiens
uaucccagcuucuccauca

SEQ ID NO: 1304093 - RNA, 19 nt, Homo sapiens
ccaagcugcugccagauca

SEQ ID NO: 1304094 - RNA, 19 nt, Homo sapiens
caacauucagcuucuaaga

SEQ ID NO: 1304095 - RNA, 19 nt, Homo sapiens
ucuaauguuuccaugcuuu

SEQ ID NO: 1304096 - RNA, 19 nt, Homo sapiens
gcugugagcacccguauca

SEQ ID NO: 1304097 - RNA, 19 nt, Homo sapiens
gugauacaaugucuucugu

SEQ ID NO: 1304098 - RNA, 19 nt, Homo sapiens
ugagaacuauccacaaguc

SEQ ID NO: 1304099 - RNA, 19 nt, Homo sapiens
gacuuugcauugcuuguga

SEQ ID NO: 1304100 - RNA, 19 nt, Homo sapiens
guauaugagcucacaauuc

SEQ ID NO: 1304101 - RNA, 19 nt, Homo sapiens
ccacaagucuaauguuucc

SEQ ID NO: 1304102 - RNA, 19 nt, Homo sapiens
caaagccaccugcugauca

SEQ ID NO: 1304103 - RNA, 19 nt, Homo sapiens
guucucagacuuugcauug

SEQ ID NO: 1304104 - RNA, 19 nt, Homo sapiens
ccacuaacaaguucucaga

SEQ ID NO: 1304105 - RNA, 19 nt, Homo sapiens
gcucacaauucuaucugau

SEQ ID NO: 1304106 - RNA, 19 nt, Homo sapiens
ugacauguuguggaauuua

SEQ ID NO: 1304107 - RNA, 19 nt, Homo sapiens
ugggauauacuauuucuga

SEQ ID NO: 1304108 - RNA, 19 nt, Homo sapiens
ggacacagaaaugcuacaa

SEQ ID NO: 1304109 - RNA, 19 nt, Homo sapiens
cuaaguauaugagcucaca

SEQ ID NO: 1304110 - RNA, 19 nt, Homo sapiens
ggaagcucaucacccaaca

SEQ ID NO: 1304111 - RNA, 19 nt, Homo sapiens
acugacauguuguggaauu

SEQ ID NO: 1304112 - RNA, 19 nt, Homo sapiens
gaucagcuccugcggaacu

SEQ ID NO: 1304113 - RNA, 19 nt, Homo sapiens
auccacaagucuaauguuu

SEQ ID NO: 1304114 - RNA, 19 nt, Homo sapiens
gggauauacuauuucugau

SEQ ID NO: 1304115 - RNA, 19 nt, Homo sapiens
uaugagcucacaauucuau

SEQ ID NO: 1304116 - RNA, 19 nt, Homo sapiens
gaccagcuucuguggauau

SEQ ID NO: 1304117 - RNA, 19 nt, Homo sapiens
uugcauugcuugugaugga

SEQ ID NO: 1304118 - RNA, 19 nt, Homo sapiens
ggaccugcagcuccaguug

SEQ ID NO: 1304119 - RNA, 19 nt, Homo sapiens
ucugauccaucccuugguu

SEQ ID NO: 1304120 - RNA, 19 nt, Homo sapiens
cuaauguuuccaugcuuua

SEQ ID NO: 1304121 - RNA, 19 nt, Homo sapiens
ucaagucaccagagagaau

SEQ ID NO: 1304122 - RNA, 19 nt, Homo sapiens
ugcuugggauauacuauuu

SEQ ID NO: 1304123 - RNA, 19 nt, Homo sapiens
ucuaucugauuccauucua

SEQ ID NO: 1304124 - RNA, 19 nt, Homo sapiens
ccaagugacauuccucaag

SEQ ID NO: 1304125 - RNA, 19 nt, Homo sapiens
ccaaauuauagccaaguga

SEQ ID NO: 1304126 - RNA, 19 nt, Homo sapiens
gaauuuauccaugagaacu

SEQ ID NO: 1304127 - RNA, 19 nt, Homo sapiens
agaacuauccacaagucua

SEQ ID NO: 1304128 - RNA, 19 nt, Homo sapiens
ccaguuugcuuauuuucaa

SEQ ID NO: 1304129 - RNA, 19 nt, Homo sapiens
ccucaagucaccagagaga

SEQ ID NO: 1304130 - RNA, 19 nt, Homo sapiens
aaagccaccugcugaucau

SEQ ID NO: 1304131 - RNA, 19 nt, Homo sapiens
gacacagaaaugcuacaaa

SEQ ID NO: 1304132 - RNA, 19 nt, Homo sapiens
gacuagcuucugcggauuu

SEQ ID NO: 1304133 - RNA, 19 nt, Homo sapiens
aagcucaucacccaacauu

SEQ ID NO: 1304134 - RNA, 19 nt, Homo sapiens
caagucaccagagagaaug

SEQ ID NO: 1304135 - RNA, 19 nt, Homo sapiens
caauuugcuugggauauac

SEQ ID NO: 1304136 - RNA, 19 nt, Homo sapiens
ggugguggcaucagcuaug

SEQ ID NO: 1304137 - RNA, 19 nt, Homo sapiens
ggauuucccagcuucucaa

SEQ ID NO: 1304138 - RNA, 19 nt, Homo sapiens
caucaauuugcuugggaua

SEQ ID NO: 1304139 - RNA, 19 nt, Homo sapiens
ccugcuggauauuucaguu

SEQ ID NO: 1304140 - RNA, 19 nt, Homo sapiens
gagcugugagcacccguau

SEQ ID NO: 1304141 - RNA, 19 nt, Homo sapiens
gagcucacaauucuaucug

SEQ ID NO: 1304142 - RNA, 19 nt, Homo sapiens
agaccagcuucuguggaua

SEQ ID NO: 1304143 - RNA, 19 nt, Homo sapiens
ugaucuugccugcuggaua

SEQ ID NO: 1304144 - RNA, 19 nt, Homo sapiens
gauauuucugcaggauuaa

SEQ ID NO: 1304145 - RNA, 19 nt, Homo sapiens
cugcuggauauuucaguua

SEQ ID NO: 1304146 - RNA, 19 nt, Homo sapiens
ggaauuuauccaugagaac

SEQ ID NO: 1304147 - RNA, 19 nt, Homo sapiens
acuaacaaguucucagacu

SEQ ID NO: 1304148 - RNA, 19 nt, Homo sapiens
agacuagcuucugcggauu

SEQ ID NO: 1304149 - RNA, 19 nt, Homo sapiens
ggaucaaccugaccaccua

SEQ ID NO: 1304150 - RNA, 19 nt, Homo sapiens
ugagguggcugcccaaugu

SEQ ID NO: 1304151 - RNA, 19 nt, Homo sapiens
caucacucuuugagaaaua

SEQ ID NO: 1304152 - RNA, 19 nt, Homo sapiens
uuucaucacucuuugagaa

SEQ ID NO: 1304153 - RNA, 19 nt, Homo sapiens
gcuauuucaucacucuuug

SEQ ID NO: 1304154 - RNA, 19 nt, Homo sapiens
gcacauuuggguaccauug

SEQ ID NO: 1304155 - RNA, 19 nt, Homo sapiens
gcugcaagccugauaccua

SEQ ID NO: 1304156 - RNA, 19 nt, Homo sapiens
cugcaagccugauaccuau

SEQ ID NO: 1304157 - RNA, 19 nt, Homo sapiens
auaccuaugugccaacuug

SEQ ID NO: 1304158 - RNA, 19 nt, Homo sapiens
gcugugagagucccuguga

SEQ ID NO: 1304159 - RNA, 19 nt, Homo sapiens
gcaagccugauaccuaugu

SEQ ID NO: 1304160 - RNA, 19 nt, Homo sapiens
caaccugaccaccuauguu

SEQ ID NO: 1304161 - RNA, 19 nt, Homo sapiens
caccucccauugccaugua

SEQ ID NO: 1304162 - RNA, 19 nt, Homo sapiens
gcuggcugcucaacaacug

SEQ ID NO: 1304163 - RNA, 19 nt, Homo sapiens
gcaccugcccacaugagau

SEQ ID NO: 1304164 - RNA, 19 nt, Homo sapiens
ccaccaccuucugcucauu

SEQ ID NO: 1304165 - RNA, 19 nt, Homo sapiens
ucacuacugccuacaucaa

SEQ ID NO: 1304166 - RNA, 19 nt, Homo sapiens
cuugcuggcugcucaacaa

SEQ ID NO: 1304167 - RNA, 19 nt, Homo sapiens
cuucugcucauuugauaaa

SEQ ID NO: 1304168 - RNA, 19 nt, Homo sapiens
ucaucacucuuugagaaau

SEQ ID NO: 1304169 - RNA, 19 nt, Homo sapiens
ggcuauuucaucacucuuu

SEQ ID NO: 1304170 - RNA, 19 nt, Homo sapiens
acauuuggguaccauugga

SEQ ID NO: 1304171 - RNA, 19 nt, Homo sapiens
ccaauguccucugcaccau

SEQ ID NO: 1304172 - RNA, 19 nt, Homo sapiens
agccgagucugcacagguu

SEQ ID NO: 1304173 - RNA, 19 nt, Homo sapiens
gaucaaccugaccaccuau

SEQ ID NO: 1304174 - RNA, 19 nt, Homo sapiens
gaacuuaccuuugguuuua

SEQ ID NO: 1304175 - RNA, 19 nt, Homo sapiens
gcugauggauggcuacuuu

SEQ ID NO: 1304176 - RNA, 19 nt, Homo sapiens
ccaagaggcugcugaugga

SEQ ID NO: 1304177 - RNA, 19 nt, Homo sapiens
gaccucagauuacauguuc

SEQ ID NO: 1304178 - RNA, 19 nt, Homo sapiens
ucacuugccucaguaguuu

SEQ ID NO: 1304179 - RNA, 19 nt, Homo sapiens
gauuacauguucuugauca

SEQ ID NO: 1304180 - RNA, 19 nt, Homo sapiens
cagauuacauguucuugau

SEQ ID NO: 1304181 - RNA, 19 nt, Homo sapiens
gcaaaauacuguuucaauc

SEQ ID NO: 1304182 - RNA, 19 nt, Homo sapiens
gaagaacuuaccuuugguu

SEQ ID NO: 1304183 - RNA, 19 nt, Homo sapiens
ccagaugacccagauauga

SEQ ID NO: 1304184 - RNA, 19 nt, Homo sapiens
gagcccaucugcugugaca

SEQ ID NO: 1304185 - RNA, 19 nt, Homo sapiens
guauucacuugccucagua

SEQ ID NO: 1304186 - RNA, 19 nt, Homo sapiens
gaccagaugacccagauau

SEQ ID NO: 1304187 - RNA, 19 nt, Homo sapiens
guaguuugccagauguuaa

SEQ ID NO: 1304188 - RNA, 19 nt, Homo sapiens
caucugcugugacaacugu

SEQ ID NO: 1304189 - RNA, 19 nt, Homo sapiens
caucugcuccuccgacaaa

SEQ ID NO: 1304190 - RNA, 19 nt, Homo sapiens
cagaugacccagauaugaa

SEQ ID NO: 1304191 - RNA, 19 nt, Homo sapiens
gcucuuguuucuuguacug

SEQ ID NO: 1304192 - RNA, 19 nt, Homo sapiens
gugggcaggugaaugaguu

SEQ ID NO: 1304193 - RNA, 19 nt, Homo sapiens
augaagaacuuaccuuugg

SEQ ID NO: 1304194 - RNA, 19 nt, Homo sapiens
acccagauaugaagaacuu

SEQ ID NO: 1304195 - RNA, 19 nt, Homo sapiens
uaagaccucagauuacaug

SEQ ID NO: 1304196 - RNA, 19 nt, Homo sapiens
ugccagauguuaagguaga

SEQ ID NO: 1304197 - RNA, 19 nt, Homo sapiens
uuuaagaccucagauuaca

SEQ ID NO: 1304198 - RNA, 19 nt, Homo sapiens
gauaugaagaacuuaccuu

SEQ ID NO: 1304199 - RNA, 19 nt, Homo sapiens
gcucagugcccgacaacga

SEQ ID NO: 1304200 - RNA, 19 nt, Homo sapiens
ucaguaguuugccagaugu

SEQ ID NO: 1304201 - RNA, 19 nt, Homo sapiens
ucagauuacauguucuuga

SEQ ID NO: 1304202 - RNA, 19 nt, Homo sapiens
ugaagaacuuaccuuuggu

SEQ ID NO: 1304203 - RNA, 19 nt, Homo sapiens
uaugaagaacuuaccuuug

SEQ ID NO: 1304204 - RNA, 19 nt, Homo sapiens
aguauucacuugccucagu

SEQ ID NO: 1304205 - RNA, 19 nt, Homo sapiens
uagaccagaugacccagau

SEQ ID NO: 1304206 - RNA, 19 nt, Homo sapiens
uuugccagauguuaaggua

SEQ ID NO: 1304207 - RNA, 19 nt, Homo sapiens
gcaggugaaugaguuuuau

SEQ ID NO: 1304208 - RNA, 19 nt, Homo sapiens
cucaguaguuugccagaug

SEQ ID NO: 1304209 - RNA, 19 nt, Homo sapiens
cuuccuggcucuuguuucu

SEQ ID NO: 1304210 - RNA, 19 nt, Homo sapiens
gcaccugcccacacacagu

SEQ ID NO: 1304211 - RNA, 19 nt, Homo sapiens
guuaagguagaccagauga

SEQ ID NO: 1304212 - RNA, 19 nt, Homo sapiens
gcuaaccagacgcccauug

SEQ ID NO: 1304213 - RNA, 19 nt, Homo sapiens
uccuggcucuuguuucuug

SEQ ID NO: 1304214 - RNA, 19 nt, Homo sapiens
ucccuucaguauucacuug

SEQ ID NO: 1304215 - RNA, 19 nt, Homo sapiens
ccacacacaguuugguuac

SEQ ID NO: 1304216 - RNA, 19 nt, Homo sapiens
gcagaaauccuuaccuaua

SEQ ID NO: 1304217 - RNA, 19 nt, Homo sapiens
gaaccauccucaucucaaa

SEQ ID NO: 1304218 - RNA, 19 nt, Homo sapiens
gaugaucuuugcaaucuuu

SEQ ID NO: 1304219 - RNA, 19 nt, Homo sapiens
cagaaauccuuaccuauau

SEQ ID NO: 1304220 - RNA, 19 nt, Homo sapiens
uagcagaaauccuuaccua

SEQ ID NO: 1304221 - RNA, 19 nt, Homo sapiens
gaaccaccauccucacaca

SEQ ID NO: 1304222 - RNA, 19 nt, Homo sapiens
ggucucagcuuugacucua

SEQ ID NO: 1304223 - RNA, 19 nt, Homo sapiens
caaaacaccugcuguagga

SEQ ID NO: 1304224 - RNA, 19 nt, Homo sapiens
gcucaacugacucaucuuu

SEQ ID NO: 1304225 - RNA, 19 nt, Homo sapiens
acaaauuucugcucaacug

SEQ ID NO: 1304226 - RNA, 19 nt, Homo sapiens
gcaccuguguacugcagaa

SEQ ID NO: 1304227 - RNA, 19 nt, Homo sapiens
caacaaauuucugcucaac

SEQ ID NO: 1304228 - RNA, 19 nt, Homo sapiens
cuucaucuguucucaaguu

SEQ ID NO: 1304229 - RNA, 19 nt, Homo sapiens
cagaagaaccugcuacuac

SEQ ID NO: 1304230 - RNA, 19 nt, Homo sapiens
gaaauccuuaccuauaugu

SEQ ID NO: 1304231 - RNA, 19 nt, Homo sapiens
gcuggaagcccaccacugu

SEQ ID NO: 1304232 - RNA, 19 nt, Homo sapiens
cagaauacuucauccugau

SEQ ID NO: 1304233 - RNA, 19 nt, Homo sapiens
guauccuucuuucuucuuu

SEQ ID NO: 1304234 - RNA, 19 nt, Homo sapiens
guucuuguauccuucuuuc

SEQ ID NO: 1304235 - RNA, 19 nt, Homo sapiens
agaaauccuuaccuauaug

SEQ ID NO: 1304236 - RNA, 19 nt, Homo sapiens
ucgaugaucuuugcaaucu

SEQ ID NO: 1304237 - RNA, 19 nt, Homo sapiens
ccuuacaccuuguggauca

SEQ ID NO: 1304238 - RNA, 19 nt, Homo sapiens
gagucauggucucagcuuu

SEQ ID NO: 1304239 - RNA, 19 nt, Homo sapiens
cauccucacacaacaaauu

SEQ ID NO: 1304240 - RNA, 19 nt, Homo sapiens
ucucagcuuugacucuaaa

SEQ ID NO: 1304241 - RNA, 19 nt, Homo sapiens
gucauggucucagcuuuga

SEQ ID NO: 1304242 - RNA, 19 nt, Homo sapiens
ccuguguacugcagaagaa

SEQ ID NO: 1304243 - RNA, 19 nt, Homo sapiens
uaaagucaagagcuucauu

SEQ ID NO: 1304244 - RNA, 19 nt, Homo sapiens
ccaccauccucacacaaca

SEQ ID NO: 1304245 - RNA, 19 nt, Homo sapiens
caugcucucacccaaauuu

SEQ ID NO: 1304246 - RNA, 19 nt, Homo sapiens
ggaauuuagguuucugcaa

SEQ ID NO: 1304247 - RNA, 19 nt, Homo sapiens
cuucauucccugcuucuaa

SEQ ID NO: 1304248 - RNA, 19 nt, Homo sapiens
ucaacugacucaucuuuug

SEQ ID NO: 1304249 - RNA, 19 nt, Homo sapiens
caaauuucugcucaacuga

SEQ ID NO: 1304250 - RNA, 19 nt, Homo sapiens
acaacaaauuucugcucaa

SEQ ID NO: 1304251 - RNA, 19 nt, Homo sapiens
gagaaccaccauccucaca

SEQ ID NO: 1304252 - RNA, 19 nt, Homo sapiens
caauauccuccucaucguu

SEQ ID NO: 1304253 - RNA, 19 nt, Homo sapiens
gagggagggcagaauacuu

SEQ ID NO: 1304254 - RNA, 19 nt, Homo sapiens
cugaucacguuccaagaga

SEQ ID NO: 1304255 - RNA, 19 nt, Homo sapiens
ccucaucguucuuguaucc

SEQ ID NO: 1304256 - RNA, 19 nt, Homo sapiens
ucaauauccuccucaucgu

SEQ ID NO: 1304257 - RNA, 19 nt, Homo sapiens
gagggcagaauacuucauc

SEQ ID NO: 1304258 - RNA, 19 nt, Homo sapiens
ugugccagcuucaucuguu

SEQ ID NO: 1304259 - RNA, 19 nt, Homo sapiens
cugcucaacugacucaucu

SEQ ID NO: 1304260 - RNA, 19 nt, Homo sapiens
ccugguagcagaaauccuu

SEQ ID NO: 1304261 - RNA, 19 nt, Homo sapiens
ccaacuugcugucaaaaca

SEQ ID NO: 1304262 - RNA, 19 nt, Homo sapiens
ugaucacguuccaagagaa

SEQ ID NO: 1304263 - RNA, 19 nt, Homo sapiens
cuuguauccuucuuucuuc

SEQ ID NO: 1304264 - RNA, 19 nt, Homo sapiens
gcugaucacguuccaagag

SEQ ID NO: 1304265 - RNA, 19 nt, Homo sapiens
uggaagcccaccacuguga

SEQ ID NO: 1304266 - RNA, 19 nt, Homo sapiens
cgcccaacuugcugucaaa

SEQ ID NO: 1304267 - RNA, 19 nt, Homo sapiens
cuugagggagggcagaaua

SEQ ID NO: 1304268 - RNA, 19 nt, Homo sapiens
accaugcucucacccaaau

SEQ ID NO: 1304269 - RNA, 19 nt, Homo sapiens
ugaaccauccucaucucaa

SEQ ID NO: 1304270 - RNA, 19 nt, Homo sapiens
uaaggaauuuagguuucug

SEQ ID NO: 1304271 - RNA, 19 nt, Homo sapiens
aaagucaagagcuucauuc

SEQ ID NO: 1304272 - RNA, 19 nt, Homo sapiens
ccgcccaacuugcugucaa

SEQ ID NO: 1304273 - RNA, 19 nt, Homo sapiens
gugccagcuucaucuguuc

SEQ ID NO: 1304274 - RNA, 19 nt, Homo sapiens
agaauacuucauccugauu

SEQ ID NO: 1304275 - RNA, 19 nt, Homo sapiens
uagcagagauucuuaccua

SEQ ID NO: 1304276 - RNA, 19 nt, Homo sapiens
gaacuaccauccucacaca

SEQ ID NO: 1304277 - RNA, 19 nt, Homo sapiens
gcagagauucuuaccuaua

SEQ ID NO: 1304278 - RNA, 19 nt, Homo sapiens
cagagauucuuaccuauau

SEQ ID NO: 1304279 - RNA, 19 nt, Homo sapiens
gaaccaucuucaucucaaa

SEQ ID NO: 1304280 - RNA, 19 nt, Homo sapiens
cuaaucaacucccaagaga

SEQ ID NO: 1304281 - RNA, 19 nt, Homo sapiens
gaucucagcuuugucucaa

SEQ ID NO: 1304282 - RNA, 19 nt, Homo sapiens
gaucaaucaucuuugcaau

SEQ ID NO: 1304283 - RNA, 19 nt, Homo sapiens
cuucgucuguucuuaauuu

SEQ ID NO: 1304284 - RNA, 19 nt, Homo sapiens
caaaacaccugcuguagga

SEQ ID NO: 1304285 - RNA, 19 nt, Homo sapiens
aauaaacucugaaccaucu

SEQ ID NO: 1304286 - RNA, 19 nt, Homo sapiens
cucauucccucuuuccuua

SEQ ID NO: 1304287 - RNA, 19 nt, Homo sapiens
gcucaacugacuugucuuu

SEQ ID NO: 1304288 - RNA, 19 nt, Homo sapiens
gcaccuguguacugcagaa

SEQ ID NO: 1304289 - RNA, 19 nt, Homo sapiens
ugaauaaacucugaaccau

SEQ ID NO: 1304290 - RNA, 19 nt, Homo sapiens
uaaauauccuucucauggu

SEQ ID NO: 1304291 - RNA, 19 nt, Homo sapiens
caacugacuugucuuuuga

SEQ ID NO: 1304292 - RNA, 19 nt, Homo sapiens
cagcucaacugacuugucu

SEQ ID NO: 1304293 - RNA, 19 nt, Homo sapiens
acaacaaccuucagcucaa

SEQ ID NO: 1304294 - RNA, 19 nt, Homo sapiens
guauccuucuuucuucuuu

SEQ ID NO: 1304295 - RNA, 19 nt, Homo sapiens
guucuuguauccuucuuuc

SEQ ID NO: 1304296 - RNA, 19 nt, Homo sapiens
ccacccaacuugcugucaa

SEQ ID NO: 1304297 - RNA, 19 nt, Homo sapiens
aaauauccuucucaugguu

SEQ ID NO: 1304298 - RNA, 19 nt, Homo sapiens
gagucaugaucucagcuuu

SEQ ID NO: 1304299 - RNA, 19 nt, Homo sapiens
gucaugaucucagcuuugu

SEQ ID NO: 1304300 - RNA, 19 nt, Homo sapiens
ccuuacaccuuguggauca

SEQ ID NO: 1304301 - RNA, 19 nt, Homo sapiens
cuucauucuuugcuucuaa

SEQ ID NO: 1304302 - RNA, 19 nt, Homo sapiens
cgucuguucuuaauuugga

SEQ ID NO: 1304303 - RNA, 19 nt, Homo sapiens
cagcuucgucuguucuuaa

SEQ ID NO: 1304304 - RNA, 19 nt, Homo sapiens
cagaauacuucauccucau

SEQ ID NO: 1304305 - RNA, 19 nt, Homo sapiens
gagauucuuaccuauaugu

SEQ ID NO: 1304306 - RNA, 19 nt, Homo sapiens
ccagcuucgucuguucuua

SEQ ID NO: 1304307 - RNA, 19 nt, Homo sapiens
ccuguguacugcagaagaa

SEQ ID NO: 1304308 - RNA, 19 nt, Homo sapiens
gcugcaggaccacuuguuu

SEQ ID NO: 1304309 - RNA, 19 nt, Homo sapiens
cacccaacuugcugucaaa

SEQ ID NO: 1304310 - RNA, 19 nt, Homo sapiens
caugcucucacccaaauuu

SEQ ID NO: 1304311 - RNA, 19 nt, Homo sapiens
gguuaugucucugguagca

SEQ ID NO: 1304312 - RNA, 19 nt, Homo sapiens
ggaauuuagguuucugcaa

SEQ ID NO: 1304313 - RNA, 19 nt, Homo sapiens
auucuuugcuucuaaggaa

SEQ ID NO: 1304314 - RNA, 19 nt, Homo sapiens
ucaacugacuugucuuuug

SEQ ID NO: 1304315 - RNA, 19 nt, Homo sapiens
caacaaccuucagcucaac

SEQ ID NO: 1304316 - RNA, 19 nt, Homo sapiens
gcuaaucaacucccaagag

SEQ ID NO: 1304317 - RNA, 19 nt, Homo sapiens
gagggacuaauuuacuuug

SEQ ID NO: 1304318 - RNA, 19 nt, Homo sapiens
ucaugguucuuguauccuu

SEQ ID NO: 1304319 - RNA, 19 nt, Homo sapiens
gagggagggcagaauacuu

SEQ ID NO: 1304320 - RNA, 19 nt, Homo sapiens
uugagggacuaauuuacuu

SEQ ID NO: 1304321 - RNA, 19 nt, Homo sapiens
ggagucaugaucucagcuu

SEQ ID NO: 1304322 - RNA, 19 nt, Homo sapiens
gagggcagaauacuucauc

SEQ ID NO: 1304323 - RNA, 19 nt, Homo sapiens
ugagggacuaauuuacuuu

SEQ ID NO: 1304324 - RNA, 19 nt, Homo sapiens
cuaccauccucacacaaca

SEQ ID NO: 1304325 - RNA, 19 nt, Homo sapiens
ccaacuugcugucaaaaca

SEQ ID NO: 1304326 - RNA, 19 nt, Homo sapiens
ucaacucccaagagaacua

SEQ ID NO: 1304327 - RNA, 19 nt, Homo sapiens
cuuguauccuucuuucuuc

SEQ ID NO: 1304328 - RNA, 19 nt, Homo sapiens
gggacuaauuuacuuugcu

SEQ ID NO: 1304329 - RNA, 19 nt, Homo sapiens
ggguccagcuguggucaga

SEQ ID NO: 1304330 - RNA, 19 nt, Homo sapiens
ucucaugguucuuguaucc

SEQ ID NO: 1304331 - RNA, 19 nt, Homo sapiens
cuugagggagggcagaaua

SEQ ID NO: 1304332 - RNA, 19 nt, Homo sapiens
accaugcucucacccaaau

SEQ ID NO: 1304333 - RNA, 19 nt, Homo sapiens
uaaggaauuuagguuucug

SEQ ID NO: 1304334 - RNA, 19 nt, Homo sapiens
uggcagcccaccacuguga

SEQ ID NO: 1304335 - RNA, 19 nt, Homo sapiens
gagaacuaccauccucaca

SEQ ID NO: 1304336 - RNA, 19 nt, Homo sapiens
agagauucuuaccuauaug

SEQ ID NO: 1304337 - RNA, 19 nt, Homo sapiens
caugaucucagcuuugucu

SEQ ID NO: 1304338 - RNA, 19 nt, Homo sapiens
cauccucauucccucuuuc

SEQ ID NO: 1304339 - RNA, 19 nt, Homo sapiens
agaauacuucauccucauu

SEQ ID NO: 1304340 - RNA, 19 nt, Homo sapiens
uaacagagauucuuaccua

SEQ ID NO: 1304341 - RNA, 19 nt, Homo sapiens
ugaauucucugcauguuua

SEQ ID NO: 1304342 - RNA, 19 nt, Homo sapiens
gcagaauacuucaucuuga

SEQ ID NO: 1304343 - RNA, 19 nt, Homo sapiens
gaaucaugaucucaacuuu

SEQ ID NO: 1304344 - RNA, 19 nt, Homo sapiens
ugaguuauguccuugguaa

SEQ ID NO: 1304345 - RNA, 19 nt, Homo sapiens
cagagauucuuaccuauau

SEQ ID NO: 1304346 - RNA, 19 nt, Homo sapiens
uaaccauccucaucucaaa

SEQ ID NO: 1304347 - RNA, 19 nt, Homo sapiens
ccucaugguucuuguauuc

SEQ ID NO: 1304348 - RNA, 19 nt, Homo sapiens
cagaauacuucaucuugau

SEQ ID NO: 1304349 - RNA, 19 nt, Homo sapiens
cuucgucuguucucaauuu

SEQ ID NO: 1304350 - RNA, 19 nt, Homo sapiens
gaaccaccauacucacaca

SEQ ID NO: 1304351 - RNA, 19 nt, Homo sapiens
gcucaacugacucaucuuu

SEQ ID NO: 1304352 - RNA, 19 nt, Homo sapiens
acaaauuucugcucaacug

SEQ ID NO: 1304353 - RNA, 19 nt, Homo sapiens
gcaccuguguacugcagaa

SEQ ID NO: 1304354 - RNA, 19 nt, Homo sapiens
ggaaucaugaucucaacuu

SEQ ID NO: 1304355 - RNA, 19 nt, Homo sapiens
caacaaauuucugcucaac

SEQ ID NO: 1304356 - RNA, 19 nt, Homo sapiens
acagagauucuuaccuaua

SEQ ID NO: 1304357 - RNA, 19 nt, Homo sapiens
gcuggaagcccaccacugu

SEQ ID NO: 1304358 - RNA, 19 nt, Homo sapiens
ggcagaauacuucaucuug

SEQ ID NO: 1304359 - RNA, 19 nt, Homo sapiens
gaucaagucccaagagaac

SEQ ID NO: 1304360 - RNA, 19 nt, Homo sapiens
caagagaaccaccauacuc

SEQ ID NO: 1304361 - RNA, 19 nt, Homo sapiens
cauacucacacaacaaauu

SEQ ID NO: 1304362 - RNA, 19 nt, Homo sapiens
ccuuacaccuuguggauca

SEQ ID NO: 1304363 - RNA, 19 nt, Homo sapiens
ccaccauacucacacaaca

SEQ ID NO: 1304364 - RNA, 19 nt, Homo sapiens
caccaugcuuucacccaaa

SEQ ID NO: 1304365 - RNA, 19 nt, Homo sapiens
ccuguguacugcagaagaa

SEQ ID NO: 1304366 - RNA, 19 nt, Homo sapiens
ucaauauccuccucauggu

SEQ ID NO: 1304367 - RNA, 19 nt, Homo sapiens
ugcaaccgaccaauaauuu

SEQ ID NO: 1304368 - RNA, 19 nt, Homo sapiens
cgucuguucucaauuugga

SEQ ID NO: 1304369 - RNA, 19 nt, Homo sapiens
gagaaccaccauacucaca

SEQ ID NO: 1304370 - RNA, 19 nt, Homo sapiens
ggaauauagguuucugcaa

SEQ ID NO: 1304371 - RNA, 19 nt, Homo sapiens
uaugaauucucugcauguu

SEQ ID NO: 1304372 - RNA, 19 nt, Homo sapiens
ucaacugacucaucuuuug

SEQ ID NO: 1304373 - RNA, 19 nt, Homo sapiens
ucaugguucuuguauucuu

SEQ ID NO: 1304374 - RNA, 19 nt, Homo sapiens
ucuaaggaauauagguuuc

SEQ ID NO: 1304375 - RNA, 19 nt, Homo sapiens
ccugagggagggcagaaua

SEQ ID NO: 1304376 - RNA, 19 nt, Homo sapiens
uaaggaauauagguuucug

SEQ ID NO: 1304377 - RNA, 19 nt, Homo sapiens
guucauucucugcuucuaa

SEQ ID NO: 1304378 - RNA, 19 nt, Homo sapiens
caaauuucugcucaacuga

SEQ ID NO: 1304379 - RNA, 19 nt, Homo sapiens
acaacaaauuucugcucaa

SEQ ID NO: 1304380 - RNA, 19 nt, Homo sapiens
caauauccuccucaugguu

SEQ ID NO: 1304381 - RNA, 19 nt, Homo sapiens
gggcagaauacuucaucuu

SEQ ID NO: 1304382 - RNA, 19 nt, Homo sapiens
gagggagggcagaauacuu

SEQ ID NO: 1304383 - RNA, 19 nt, Homo sapiens
ugacagccaccaugcuuuc

SEQ ID NO: 1304384 - RNA, 19 nt, Homo sapiens
aagagaaccaccauacuca

SEQ ID NO: 1304385 - RNA, 19 nt, Homo sapiens
cugaucaagucccaagaga

SEQ ID NO: 1304386 - RNA, 19 nt, Homo sapiens
gagggcagaauacuucauc

SEQ ID NO: 1304387 - RNA, 19 nt, Homo sapiens
ucucugcuucuaaggaaua

SEQ ID NO: 1304388 - RNA, 19 nt, Homo sapiens
cugcucaacugacucaucu

SEQ ID NO: 1304389 - RNA, 19 nt, Homo sapiens
gaauucucugcauguuuaa

SEQ ID NO: 1304390 - RNA, 19 nt, Homo sapiens
ccaacuugcugucaaaaca

SEQ ID NO: 1304391 - RNA, 19 nt, Homo sapiens
caauuuggaaucaugaucu

SEQ ID NO: 1304392 - RNA, 19 nt, Homo sapiens
caugcuuucacccaaauuu

SEQ ID NO: 1304393 - RNA, 19 nt, Homo sapiens
uggaagcccaccacuguga

SEQ ID NO: 1304394 - RNA, 19 nt, Homo sapiens
caugguucuuguauucuuc

SEQ ID NO: 1304395 - RNA, 19 nt, Homo sapiens
ggguccagcuguggucaga

SEQ ID NO: 1304396 - RNA, 19 nt, Homo sapiens
cgcccaacuugcugucaaa

SEQ ID NO: 1304397 - RNA, 19 nt, Homo sapiens
caccaugacccacuguugu

SEQ ID NO: 1304398 - RNA, 19 nt, Homo sapiens
cugcaaccgaccaauaauu

SEQ ID NO: 1304399 - RNA, 19 nt, Homo sapiens
aaucaugaucucaacuuug

SEQ ID NO: 1304400 - RNA, 19 nt, Homo sapiens
gcaaccgaccaauaauuuu

SEQ ID NO: 1304401 - RNA, 19 nt, Homo sapiens
uuucugcaaccgaccaaua

SEQ ID NO: 1304402 - RNA, 19 nt, Homo sapiens
aaagucaagagguucauuc

SEQ ID NO: 1304403 - RNA, 19 nt, Homo sapiens
cugaauaaacucuuaacca

SEQ ID NO: 1304404 - RNA, 19 nt, Homo sapiens
ccgcccaacuugcugucaa

SEQ ID NO: 1304405 - RNA, 19 nt, Homo sapiens
aacagagauucuuaccuau

SEQ ID NO: 1304406 - RNA, 19 nt, Homo sapiens
gaaguucaaugucuuguac

SEQ ID NO: 1304407 - RNA, 19 nt, Homo sapiens
gugagccucuuaauaaauu

SEQ ID NO: 1304408 - RNA, 19 nt, Homo sapiens
gccauacucugaugaaaca

SEQ ID NO: 1304409 - RNA, 19 nt, Homo sapiens
uuugugagccucuuaauaa

SEQ ID NO: 1304410 - RNA, 19 nt, Homo sapiens
uccaacaccuucucuggua

SEQ ID NO: 1304411 - RNA, 19 nt, Homo sapiens
caccuucucugguauuuca

SEQ ID NO: 1304412 - RNA, 19 nt, Homo sapiens
gagccauacucugaugaaa

SEQ ID NO: 1304413 - RNA, 19 nt, Homo sapiens
uaagugaucccaagcucaa

SEQ ID NO: 1304414 - RNA, 19 nt, Homo sapiens
aaaacucggucacaacuaa

SEQ ID NO: 1304415 - RNA, 19 nt, Homo sapiens
caacaccuucucugguauu

SEQ ID NO: 1304416 - RNA, 19 nt, Homo sapiens
ccaacaccuucucugguau

SEQ ID NO: 1304417 - RNA, 19 nt, Homo sapiens
ugucuugucuuucugugau

SEQ ID NO: 1304418 - RNA, 19 nt, Homo sapiens
gauccuccgcccuggcuuu

SEQ ID NO: 1304419 - RNA, 19 nt, Homo sapiens
uugugagccucuuaauaaa

SEQ ID NO: 1304420 - RNA, 19 nt, Homo sapiens
caaggcaccgagaacaaga

SEQ ID NO: 1304421 - RNA, 19 nt, Homo sapiens
gagaacaagagccauacuc

SEQ ID NO: 1304422 - RNA, 19 nt, Homo sapiens
aguucaaugucuuguacua

SEQ ID NO: 1304423 - RNA, 19 nt, Homo sapiens
acaccuauaugcgacacaa

SEQ ID NO: 1304424 - RNA, 19 nt, Homo sapiens
gugaauccccaauacuuua

SEQ ID NO: 1304425 - RNA, 19 nt, Homo sapiens
cauacucugaugaaacauu

SEQ ID NO: 1304426 - RNA, 19 nt, Homo sapiens
gcaaaacugcugugaagag

SEQ ID NO: 1304427 - RNA, 19 nt, Homo sapiens
gacacaaaaugaagaccuu

SEQ ID NO: 1304428 - RNA, 19 nt, Homo sapiens
caaaugaccuucaagacua

SEQ ID NO: 1304429 - RNA, 19 nt, Homo sapiens
gaauaucacccuuauagua

SEQ ID NO: 1304430 - RNA, 19 nt, Homo sapiens
gaaccaaguugucuuccuu

SEQ ID NO: 1304431 - RNA, 19 nt, Homo sapiens
gcaaaugaccggccugauu

SEQ ID NO: 1304432 - RNA, 19 nt, Homo sapiens
ccaaauggaaacugaaaua

SEQ ID NO: 1304433 - RNA, 19 nt, Homo sapiens
ggaaacugguggugggaaa

SEQ ID NO: 1304434 - RNA, 19 nt, Homo sapiens
gacaagaugcugaaacaaa

SEQ ID NO: 1304435 - RNA, 19 nt, Homo sapiens
ggaaaccucucuccuccau

SEQ ID NO: 1304436 - RNA, 19 nt, Homo sapiens
gcagaugggaagaauauga

SEQ ID NO: 1304437 - RNA, 19 nt, Homo sapiens
ucaguucucuuuggccuua

SEQ ID NO: 1304438 - RNA, 19 nt, Homo sapiens
gcccaagaguucauaucua

SEQ ID NO: 1304439 - RNA, 19 nt, Homo sapiens
ucacacacccguagccaua

SEQ ID NO: 1304440 - RNA, 19 nt, Homo sapiens
acaagaugcugaaacaaau

SEQ ID NO: 1304441 - RNA, 19 nt, Homo sapiens
cagacaagaugcugaaaca

SEQ ID NO: 1304442 - RNA, 19 nt, Homo sapiens
gcacuccuccucuauguau

SEQ ID NO: 1304443 - RNA, 19 nt, Homo sapiens
gggauugacuuagagcaaa

SEQ ID NO: 1304444 - RNA, 19 nt, Homo sapiens
gcaacgcugugagaagauu

SEQ ID NO: 1304445 - RNA, 19 nt, Homo sapiens
gagagaguccugcuguaaa

SEQ ID NO: 1304446 - RNA, 19 nt, Homo sapiens
gggcagaugggaagaauau

SEQ ID NO: 1304447 - RNA, 19 nt, Homo sapiens
ucauugugcuggaauuuga

SEQ ID NO: 1304448 - RNA, 19 nt, Homo sapiens
ggaccugacuccuuuacag

SEQ ID NO: 1304449 - RNA, 19 nt, Homo sapiens
aaaccucucuccuccauuc

SEQ ID NO: 1304450 - RNA, 19 nt, Homo sapiens
aaacaaaugaccuucaaga

SEQ ID NO: 1304451 - RNA, 19 nt, Homo sapiens
ucaugaagaaggagaauaa

SEQ ID NO: 1304452 - RNA, 19 nt, Homo sapiens
ucuacaggcucaugaagaa

SEQ ID NO: 1304453 - RNA, 19 nt, Homo sapiens
caaaggcucugcaaaugac

SEQ ID NO: 1304454 - RNA, 19 nt, Homo sapiens
uacauuaccugacagacaa

SEQ ID NO: 1304455 - RNA, 19 nt, Homo sapiens
gagcaaaugcgaaccaagu

SEQ ID NO: 1304456 - RNA, 19 nt, Homo sapiens
ccaaaggcucugcaaauga

SEQ ID NO: 1304457 - RNA, 19 nt, Homo sapiens
gaccagauuuagucaaugg

SEQ ID NO: 1304458 - RNA, 19 nt, Homo sapiens
ugaagaaggagaauaacaa

SEQ ID NO: 1304459 - RNA, 19 nt, Homo sapiens
aaucauugcuauugaagga

SEQ ID NO: 1304460 - RNA, 19 nt, Homo sapiens
gccauugccuucccacaga

SEQ ID NO: 1304461 - RNA, 19 nt, Homo sapiens
gcaaaugcgaaccaaguug

SEQ ID NO: 1304462 - RNA, 19 nt, Homo sapiens
ucucacagguuuccaguca

SEQ ID NO: 1304463 - RNA, 19 nt, Homo sapiens
aaaugaccuucaagacuaa

SEQ ID NO: 1304464 - RNA, 19 nt, Homo sapiens
cccaagaguucauaucuag

SEQ ID NO: 1304465 - RNA, 19 nt, Homo sapiens
ggauugacuuagagcaaau

SEQ ID NO: 1304466 - RNA, 19 nt, Homo sapiens
caucaucuccaaagaguug

SEQ ID NO: 1304467 - RNA, 19 nt, Homo sapiens
ccacaggccaggacucuug

SEQ ID NO: 1304468 - RNA, 19 nt, Homo sapiens
uaacacuccugccaugaag

SEQ ID NO: 1304469 - RNA, 19 nt, Homo sapiens
uauugaaggaccagauuua

SEQ ID NO: 1304470 - RNA, 19 nt, Homo sapiens
gccaaaagcugggaaaaga

SEQ ID NO: 1304471 - RNA, 19 nt, Homo sapiens
gaucaagccggaagagcaa

SEQ ID NO: 1304472 - RNA, 19 nt, Homo sapiens
ggaacgggaugggauugug

SEQ ID NO: 1304473 - RNA, 19 nt, Homo sapiens
caagagagagggcuucaag

SEQ ID NO: 1304474 - RNA, 19 nt, Homo sapiens
uaucuagccuggucaacau

SEQ ID NO: 1304475 - RNA, 19 nt, Homo sapiens
guaacacuccugccaugaa

SEQ ID NO: 1304476 - RNA, 19 nt, Homo sapiens
caagugagcaucauugacu

SEQ ID NO: 1304477 - RNA, 19 nt, Homo sapiens
caaaccggccugucaugaa

SEQ ID NO: 1304478 - RNA, 19 nt, Homo sapiens
ccucaggucaguucucuuu

SEQ ID NO: 1304479 - RNA, 19 nt, Homo sapiens
gacggugacuaccaguuug

SEQ ID NO: 1304480 - RNA, 19 nt, Homo sapiens
caaccgcacagaaggcuuu

SEQ ID NO: 1304481 - RNA, 19 nt, Homo sapiens
ggaccagauuuagucaaug

SEQ ID NO: 1304482 - RNA, 19 nt, Homo sapiens
ugaagccucuggugcuguu

SEQ ID NO: 1304483 - RNA, 19 nt, Homo sapiens
auaguaaugugcucugguu

SEQ ID NO: 1304484 - RNA, 19 nt, Homo sapiens
gaagaaggagaauaacaac

SEQ ID NO: 1304485 - RNA, 19 nt, Homo sapiens
ugacggugacuaccaguuu

SEQ ID NO: 1304486 - RNA, 19 nt, Homo sapiens
agaagaaaauugugacuga

SEQ ID NO: 1304487 - RNA, 19 nt, Homo sapiens
ugagagaguccugcuguaa

SEQ ID NO: 1304488 - RNA, 19 nt, Homo sapiens
ccagucagcuuuucaaaca

SEQ ID NO: 1304489 - RNA, 19 nt, Homo sapiens
cugcaacgcugugagaaga

SEQ ID NO: 1304490 - RNA, 19 nt, Homo sapiens
cgagcucgcccaagccuaa

SEQ ID NO: 1304491 - RNA, 19 nt, Homo sapiens
gggaugggauugugguuuu

SEQ ID NO: 1304492 - RNA, 19 nt, Homo sapiens
gggaagagcagcacuaucc

SEQ ID NO: 1304493 - RNA, 19 nt, Homo sapiens
caaaugcgaaccaaguugu

SEQ ID NO: 1304494 - RNA, 19 nt, Homo sapiens
caaccaaaggcucugcaaa

SEQ ID NO: 1304495 - RNA, 19 nt, Homo sapiens
cagaaaaccuuugaggaaa

SEQ ID NO: 1304496 - RNA, 19 nt, Homo sapiens
ugaaggaccagauuuaguc

SEQ ID NO: 1304497 - RNA, 19 nt, Homo sapiens
aaccagggcuuccuucagu

SEQ ID NO: 1304498 - RNA, 19 nt, Homo sapiens
gaccggaggcguuucuuca

SEQ ID NO: 1304499 - RNA, 19 nt, Homo sapiens
acaggacaaugcugaacuu

SEQ ID NO: 1304500 - RNA, 19 nt, Homo sapiens
gccaugaagcaaauuaaga

SEQ ID NO: 1304501 - RNA, 19 nt, Homo sapiens
caucagugccucccuguuc

SEQ ID NO: 1304502 - RNA, 19 nt, Homo sapiens
ccucuuauccggugaagug

SEQ ID NO: 1304503 - RNA, 19 nt, Homo sapiens
acacacccguagccauaaa

SEQ ID NO: 1304504 - RNA, 19 nt, Homo sapiens
aacaauugcugaucacaca

SEQ ID NO: 1304505 - RNA, 19 nt, Homo sapiens
ugacagacaagaugcugaa

SEQ ID NO: 1304506 - RNA, 19 nt, Homo sapiens
gaaggaccagauuuaguca

SEQ ID NO: 1304507 - RNA, 19 nt, Homo sapiens
gguguuuggcgaaguguuu

SEQ ID NO: 1304508 - RNA, 19 nt, Homo sapiens
cuggaucccuccuaucaga

SEQ ID NO: 1304509 - RNA, 19 nt, Homo sapiens
accaaaggcucugcaaaug

SEQ ID NO: 1304510 - RNA, 19 nt, Homo sapiens
gaaauccugccagagauca

SEQ ID NO: 1304511 - RNA, 19 nt, Homo sapiens
gcuauugaaggaccagauu

SEQ ID NO: 1304512 - RNA, 19 nt, Homo sapiens
aggcaucacugcgcuuuga

SEQ ID NO: 1304513 - RNA, 19 nt, Homo sapiens
ugggaucacuauaauucaa

SEQ ID NO: 1304514 - RNA, 19 nt, Homo sapiens
gaucuuacccucccuugcu

SEQ ID NO: 1304515 - RNA, 19 nt, Homo sapiens
gaucaucaucuccaaagag

SEQ ID NO: 1304516 - RNA, 19 nt, Homo sapiens
gaccugacuccuuuacaga

SEQ ID NO: 1304517 - RNA, 19 nt, Homo sapiens
ccuucaagacuaaauguaa

SEQ ID NO: 1304518 - RNA, 19 nt, Homo sapiens
uaucacccuuauaguaaug

SEQ ID NO: 1304519 - RNA, 19 nt, Homo sapiens
guuuggagggauugacuua

SEQ ID NO: 1304520 - RNA, 19 nt, Homo sapiens
ggaaauccugccagagauc

SEQ ID NO: 1304521 - RNA, 19 nt, Homo sapiens
aaacugcaacgcugugaga

SEQ ID NO: 1304522 - RNA, 19 nt, Homo sapiens
gaggucugcagcaucuaua

SEQ ID NO: 1304523 - RNA, 19 nt, Homo sapiens
cagacaggcuggagagaac

SEQ ID NO: 1304524 - RNA, 19 nt, Homo sapiens
cccugaggauucugaguuu

SEQ ID NO: 1304525 - RNA, 19 nt, Homo sapiens
uuggagggauugacuuaga

SEQ ID NO: 1304526 - RNA, 19 nt, Homo sapiens
ccugggaucacuauaauuc

SEQ ID NO: 1304527 - RNA, 19 nt, Homo sapiens
aaaccggccugucaugaac

SEQ ID NO: 1304528 - RNA, 19 nt, Homo sapiens
ucacagacguuguaccaua

SEQ ID NO: 1304529 - RNA, 19 nt, Homo sapiens
acaaauaggugaagaaagu

SEQ ID NO: 1304530 - RNA, 19 nt, Homo sapiens
ccauauccaugcacauuua

SEQ ID NO: 1304531 - RNA, 19 nt, Homo sapiens
agaaggaggugaugcagua

SEQ ID NO: 1304532 - RNA, 19 nt, Homo sapiens
ccugauguguuaacaaaua

SEQ ID NO: 1304533 - RNA, 19 nt, Homo sapiens
guuaaggugucuucucuuu

SEQ ID NO: 1304534 - RNA, 19 nt, Homo sapiens
gacugagccugauguguua

SEQ ID NO: 1304535 - RNA, 19 nt, Homo sapiens
gaauugcgaauacauguaa

SEQ ID NO: 1304536 - RNA, 19 nt, Homo sapiens
ucaagaagcagaagaagaa

SEQ ID NO: 1304537 - RNA, 19 nt, Homo sapiens
gaaaggaauugcgaauaca

SEQ ID NO: 1304538 - RNA, 19 nt, Homo sapiens
guaagguaaugucaugauu

SEQ ID NO: 1304539 - RNA, 19 nt, Homo sapiens
uaaggugucuucucuuuag

SEQ ID NO: 1304540 - RNA, 19 nt, Homo sapiens
ucaccagacauuuguauua

SEQ ID NO: 1304541 - RNA, 19 nt, Homo sapiens
caggaggacuuucuguuug

SEQ ID NO: 1304542 - RNA, 19 nt, Homo sapiens
gaagaaaggaauugcgaau

SEQ ID NO: 1304543 - RNA, 19 nt, Homo sapiens
agacgugguuccuggauuu

SEQ ID NO: 1304544 - RNA, 19 nt, Homo sapiens
agaaaggaauugcgaauac

SEQ ID NO: 1304545 - RNA, 19 nt, Homo sapiens
ccucuuauucguaacauua

SEQ ID NO: 1304546 - RNA, 19 nt, Homo sapiens
caccagacauuuguauuau

SEQ ID NO: 1304547 - RNA, 19 nt, Homo sapiens
agagagggcagcacuuaua

SEQ ID NO: 1304548 - RNA, 19 nt, Homo sapiens
gccuguggcugguaaggua

SEQ ID NO: 1304549 - RNA, 19 nt, Homo sapiens
gcauugagaacacauuaga

SEQ ID NO: 1304550 - RNA, 19 nt, Homo sapiens
ggaauugcgaauacaugua

SEQ ID NO: 1304551 - RNA, 19 nt, Homo sapiens
uguauggccugaaguguug

SEQ ID NO: 1304552 - RNA, 19 nt, Homo sapiens
gaaaccacuuuuagaacua

SEQ ID NO: 1304553 - RNA, 19 nt, Homo sapiens
gaaagucuugugcuguauu

SEQ ID NO: 1304554 - RNA, 19 nt, Homo sapiens
ucagagagggcagcacuua

SEQ ID NO: 1304555 - RNA, 19 nt, Homo sapiens
ugaaccaccugccagaaga

SEQ ID NO: 1304556 - RNA, 19 nt, Homo sapiens
agacugagccugauguguu

SEQ ID NO: 1304557 - RNA, 19 nt, Homo sapiens
gaaaacagacuccugauag

SEQ ID NO: 1304558 - RNA, 19 nt, Homo sapiens
ucaggaggacuuucuguuu

SEQ ID NO: 1304559 - RNA, 19 nt, Homo sapiens
gaagcaggaucugaagaag

SEQ ID NO: 1304560 - RNA, 19 nt, Homo sapiens
gacguccacugcuggcuuu

SEQ ID NO: 1304561 - RNA, 19 nt, Homo sapiens
gagacgugguuccuggauu

SEQ ID NO: 1304562 - RNA, 19 nt, Homo sapiens
cgaagcaggaucugaagaa

SEQ ID NO: 1304563 - RNA, 19 nt, Homo sapiens
guuccuggauuucaaagug

SEQ ID NO: 1304564 - RNA, 19 nt, Homo sapiens
agaaaggcauaucugaugu

SEQ ID NO: 1304565 - RNA, 19 nt, Homo sapiens
guccacugcuggcuuuauu

SEQ ID NO: 1304566 - RNA, 19 nt, Homo sapiens
agaaagucaucgaggcaaa

SEQ ID NO: 1304567 - RNA, 19 nt, Homo sapiens
caauauccauuccaucaac

SEQ ID NO: 1304568 - RNA, 19 nt, Homo sapiens
aagguaaugucaugauuca

SEQ ID NO: 1304569 - RNA, 19 nt, Homo sapiens
cacagacguuguaccauau

SEQ ID NO: 1304570 - RNA, 19 nt, Homo sapiens
ucaaaguguuaccucaaga

SEQ ID NO: 1304571 - RNA, 19 nt, Homo sapiens
ggaggacuuucuguuuguu

SEQ ID NO: 1304572 - RNA, 19 nt, Homo sapiens
ggccaggaaccacccguua

SEQ ID NO: 1304573 - RNA, 19 nt, Homo sapiens
caacucauggccaggauug

SEQ ID NO: 1304574 - RNA, 19 nt, Homo sapiens
gcaauauccauuccaucaa

SEQ ID NO: 1304575 - RNA, 19 nt, Homo sapiens
caauguggcuaguuuuauu

SEQ ID NO: 1304576 - RNA, 19 nt, Homo sapiens
agccagagcucccaugcuu

SEQ ID NO: 1304577 - RNA, 19 nt, Homo sapiens
caaaguguuaccucaagaa

SEQ ID NO: 1304578 - RNA, 19 nt, Homo sapiens
gcuaugugcugcccaucau

SEQ ID NO: 1304579 - RNA, 19 nt, Homo sapiens
ugauuguucugaaauguuc

SEQ ID NO: 1304580 - RNA, 19 nt, Homo sapiens
aaacagacuccugauaguu

SEQ ID NO: 1304581 - RNA, 19 nt, Homo sapiens
aagaaaggcauaucugaug

SEQ ID NO: 1304582 - RNA, 19 nt, Homo sapiens
agccugauguguuaacaaa

SEQ ID NO: 1304583 - RNA, 19 nt, Homo sapiens
gcccaucauuucauucauc

SEQ ID NO: 1304584 - RNA, 19 nt, Homo sapiens
uuugaccucuuauucguaa

SEQ ID NO: 1304585 - RNA, 19 nt, Homo sapiens
acaguaaaguugaaauggu

SEQ ID NO: 1304586 - RNA, 19 nt, Homo sapiens
gaucugaagaagcugaaga

SEQ ID NO: 1304587 - RNA, 19 nt, Homo sapiens
gccaggaaccacccguuaa

SEQ ID NO: 1304588 - RNA, 19 nt, Homo sapiens
guuaacaaauaggugaaga

SEQ ID NO: 1304589 - RNA, 19 nt, Homo sapiens
ccacugcuggcuuuauuga

SEQ ID NO: 1304590 - RNA, 19 nt, Homo sapiens
cgacaguaaaguugaaaug

SEQ ID NO: 1304591 - RNA, 19 nt, Homo sapiens
ucaaggggcuuuuggcuau

SEQ ID NO: 1304592 - RNA, 19 nt, Homo sapiens
aggaggugaugcaguauga

SEQ ID NO: 1304593 - RNA, 19 nt, Homo sapiens
cauaucauguuuccuuugc

SEQ ID NO: 1304594 - RNA, 19 nt, Homo sapiens
uguuucaugucucagauuu

SEQ ID NO: 1304595 - RNA, 19 nt, Homo sapiens
aagaaaggaauugcgaaua

SEQ ID NO: 1304596 - RNA, 19 nt, Homo sapiens
guuaauacuugcauaugcu

SEQ ID NO: 1304597 - RNA, 19 nt, Homo sapiens
agaguuaaaugugaaugga

SEQ ID NO: 1304598 - RNA, 19 nt, Homo sapiens
aaaggcauaucugauguca

SEQ ID NO: 1304599 - RNA, 19 nt, Homo sapiens
aaagucuugugcuguauuc

SEQ ID NO: 1304600 - RNA, 19 nt, Homo sapiens
uuaaggugucuucucuuua

SEQ ID NO: 1304601 - RNA, 19 nt, Homo sapiens
aaagaaaggcauaucugau

SEQ ID NO: 1304602 - RNA, 19 nt, Homo sapiens
aguguuaccucaagaagca

SEQ ID NO: 1304603 - RNA, 19 nt, Homo sapiens
gugauccuuucgaagcuuu

SEQ ID NO: 1304604 - RNA, 19 nt, Homo sapiens
cacaugugcucuuuguaca

SEQ ID NO: 1304605 - RNA, 19 nt, Homo sapiens
gaaaagaaaggcauaucug

SEQ ID NO: 1304606 - RNA, 19 nt, Homo sapiens
uaagguaaugucaugauuc

SEQ ID NO: 1304607 - RNA, 19 nt, Homo sapiens
cugguaagguaaugucaug

SEQ ID NO: 1304608 - RNA, 19 nt, Homo sapiens
gaaaggcauaucugauguc

SEQ ID NO: 1304609 - RNA, 19 nt, Homo sapiens
cgcaauauccauuccauca

SEQ ID NO: 1304610 - RNA, 19 nt, Homo sapiens
gaggacuuucuguuuguuu

SEQ ID NO: 1304611 - RNA, 19 nt, Homo sapiens
gucuugugcuguauuccua

SEQ ID NO: 1304612 - RNA, 19 nt, Homo sapiens
caugugcucuuuguacagu

SEQ ID NO: 1304613 - RNA, 19 nt, Homo sapiens
gguaagguaaugucaugau

SEQ ID NO: 1304614 - RNA, 19 nt, Homo sapiens
ugagaaaccacuuuuagaa

SEQ ID NO: 1304615 - RNA, 19 nt, Homo sapiens
uaugugcugcccaucauuu

SEQ ID NO: 1304616 - RNA, 19 nt, Homo sapiens
ugagaacacauuagagaag

SEQ ID NO: 1304617 - RNA, 19 nt, Homo sapiens
ccguuaaggugucuucucu

SEQ ID NO: 1304618 - RNA, 19 nt, Homo sapiens
uaccauauccaugcacauu

SEQ ID NO: 1304619 - RNA, 19 nt, Homo sapiens
ugucgacaguaaaguugaa

SEQ ID NO: 1304620 - RNA, 19 nt, Homo sapiens
gagagggcagcacuuauac

SEQ ID NO: 1304621 - RNA, 19 nt, Homo sapiens
acagacuccugauaguuca

SEQ ID NO: 1304622 - RNA, 19 nt, Homo sapiens
caucauuucauucauccuu

SEQ ID NO: 1304623 - RNA, 19 nt, Homo sapiens
gacuuaaaccauucauauc

SEQ ID NO: 1304624 - RNA, 19 nt, Homo sapiens
gaaugcacaaaaugacuua

SEQ ID NO: 1304625 - RNA, 19 nt, Homo sapiens
cuuuagggauggugagguu

SEQ ID NO: 1304626 - RNA, 19 nt, Homo sapiens
guguauggccugaaguguu

SEQ ID NO: 1304627 - RNA, 19 nt, Homo sapiens
gaugaaccaccugccagaa

SEQ ID NO: 1304628 - RNA, 19 nt, Homo sapiens
gaagauacauucccaaaua

SEQ ID NO: 1304629 - RNA, 19 nt, Homo sapiens
gaaaggauauguucuagga

SEQ ID NO: 1304630 - RNA, 19 nt, Homo sapiens
uaacaaaguugccuaguug

SEQ ID NO: 1304631 - RNA, 19 nt, Homo sapiens
ggaaaguuaucuggaaaua

SEQ ID NO: 1304632 - RNA, 19 nt, Homo sapiens
gaacugauguaaaucuuca

SEQ ID NO: 1304633 - RNA, 19 nt, Homo sapiens
ucaaguaccaccuguauua

SEQ ID NO: 1304634 - RNA, 19 nt, Homo sapiens
ucaaggaaccagagaauua

SEQ ID NO: 1304635 - RNA, 19 nt, Homo sapiens
ucuaagauaucccuaagaa

SEQ ID NO: 1304636 - RNA, 19 nt, Homo sapiens
uacauucacucuugccuua

SEQ ID NO: 1304637 - RNA, 19 nt, Homo sapiens
ucacuaaugugcuauguca

SEQ ID NO: 1304638 - RNA, 19 nt, Homo sapiens
guaaugauccaaaguauag

SEQ ID NO: 1304639 - RNA, 19 nt, Homo sapiens
gaaguucugguuaauacua

SEQ ID NO: 1304640 - RNA, 19 nt, Homo sapiens
gaaacaagcaauuuaccuu

SEQ ID NO: 1304641 - RNA, 19 nt, Homo sapiens
caaucuagacuacaaagua

SEQ ID NO: 1304642 - RNA, 19 nt, Homo sapiens
gcucagaauuccagcaguu

SEQ ID NO: 1304643 - RNA, 19 nt, Homo sapiens
ggaaacugaucacuucaca

SEQ ID NO: 1304644 - RNA, 19 nt, Homo sapiens
gauccaaaguauaguacaa

SEQ ID NO: 1304645 - RNA, 19 nt, Homo sapiens
ggugaaauuugaacagaau

SEQ ID NO: 1304646 - RNA, 19 nt, Homo sapiens
ccgcagagaauaaagauaa

SEQ ID NO: 1304647 - RNA, 19 nt, Homo sapiens
cuaagcaacuacuuuccua

SEQ ID NO: 1304648 - RNA, 19 nt, Homo sapiens
uggcaacgauggaugauga

SEQ ID NO: 1304649 - RNA, 19 nt, Homo sapiens
gcaacuacuuuccuagagu

SEQ ID NO: 1304650 - RNA, 19 nt, Homo sapiens
acgaugagguggaugagua

SEQ ID NO: 1304651 - RNA, 19 nt, Homo sapiens
uagagacccuccugcauga

SEQ ID NO: 1304652 - RNA, 19 nt, Homo sapiens
gugagugggucugaagaua

SEQ ID NO: 1304653 - RNA, 19 nt, Homo sapiens
gaaaugauacaugccuauu

SEQ ID NO: 1304654 - RNA, 19 nt, Homo sapiens
ggacuugcaggcacuguuu

SEQ ID NO: 1304655 - RNA, 19 nt, Homo sapiens
gauggaugaugacuugaug

SEQ ID NO: 1304656 - RNA, 19 nt, Homo sapiens
ggcagcagauuuuaaguua

SEQ ID NO: 1304657 - RNA, 19 nt, Homo sapiens
ggugcuacauucacucuug

SEQ ID NO: 1304658 - RNA, 19 nt, Homo sapiens
gucaggaaguucugguuaa

SEQ ID NO: 1304659 - RNA, 19 nt, Homo sapiens
gguaaugauccaaaguaua

SEQ ID NO: 1304660 - RNA, 19 nt, Homo sapiens
aaggauaaguguaacaguu

SEQ ID NO: 1304661 - RNA, 19 nt, Homo sapiens
ucacuucacaugccauuaa

SEQ ID NO: 1304662 - RNA, 19 nt, Homo sapiens
ucccugaacugauguaaau

SEQ ID NO: 1304663 - RNA, 19 nt, Homo sapiens
ugccuuagguauacuguaa

SEQ ID NO: 1304664 - RNA, 19 nt, Homo sapiens
aaacugaucacuucacaug

SEQ ID NO: 1304665 - RNA, 19 nt, Homo sapiens
guggaaaguuaucuggaaa

SEQ ID NO: 1304666 - RNA, 19 nt, Homo sapiens
gcugauaaguaacugauac

SEQ ID NO: 1304667 - RNA, 19 nt, Homo sapiens
acagaaugguucaaguaaa

SEQ ID NO: 1304668 - RNA, 19 nt, Homo sapiens
aaauuuagcagagugguua

SEQ ID NO: 1304669 - RNA, 19 nt, Homo sapiens
gaguuuagcuguuuucuca

SEQ ID NO: 1304670 - RNA, 19 nt, Homo sapiens
ucacauaaccaauagaaag

SEQ ID NO: 1304671 - RNA, 19 nt, Homo sapiens
gaaugaaguucuggagucu

SEQ ID NO: 1304672 - RNA, 19 nt, Homo sapiens
ggagaaacaagcaauuuac

SEQ ID NO: 1304673 - RNA, 19 nt, Homo sapiens
ccuccugcaugaaaugaua

SEQ ID NO: 1304674 - RNA, 19 nt, Homo sapiens
aaaguugccuaguugaugu

SEQ ID NO: 1304675 - RNA, 19 nt, Homo sapiens
auaacaaaguugccuaguu

SEQ ID NO: 1304676 - RNA, 19 nt, Homo sapiens
ugucagguguuugguuaua

SEQ ID NO: 1304677 - RNA, 19 nt, Homo sapiens
gcuagaagauaagacuguu

SEQ ID NO: 1304678 - RNA, 19 nt, Homo sapiens
ucacuaauaacgacaaaga

SEQ ID NO: 1304679 - RNA, 19 nt, Homo sapiens
ucagguguuugguuauauu

SEQ ID NO: 1304680 - RNA, 19 nt, Homo sapiens
cuaguucacauaaccaaua

SEQ ID NO: 1304681 - RNA, 19 nt, Homo sapiens
cagaaugguucaaguaaaa

SEQ ID NO: 1304682 - RNA, 19 nt, Homo sapiens
gggaaaggauauguucuag

SEQ ID NO: 1304683 - RNA, 19 nt, Homo sapiens
gacccugugugcugggaua

SEQ ID NO: 1304684 - RNA, 19 nt, Homo sapiens
auucugugcugauaaguaa

SEQ ID NO: 1304685 - RNA, 19 nt, Homo sapiens
gagugggucugaagauaca

SEQ ID NO: 1304686 - RNA, 19 nt, Homo sapiens
cuucacaugccauuaauaa

SEQ ID NO: 1304687 - RNA, 19 nt, Homo sapiens
guauuacggcuaugucaaa

SEQ ID NO: 1304688 - RNA, 19 nt, Homo sapiens
gauguaaaucuucauagug

SEQ ID NO: 1304689 - RNA, 19 nt, Homo sapiens
gaacucauucccugaacug

SEQ ID NO: 1304690 - RNA, 19 nt, Homo sapiens
gaaggugacagcaucaaag

SEQ ID NO: 1304691 - RNA, 19 nt, Homo sapiens
aaacaguggcagcagauuu

SEQ ID NO: 1304692 - RNA, 19 nt, Homo sapiens
ggugaggcccagcuaguaa

SEQ ID NO: 1304693 - RNA, 19 nt, Homo sapiens
caaaguugccuaguugaug

SEQ ID NO: 1304694 - RNA, 19 nt, Homo sapiens
aacgauggaugaugacuug

SEQ ID NO: 1304695 - RNA, 19 nt, Homo sapiens
caaccacagcucagaauuc

SEQ ID NO: 1304696 - RNA, 19 nt, Homo sapiens
cccaagaucuuuuaaauca

SEQ ID NO: 1304697 - RNA, 19 nt, Homo sapiens
agaagggcaugguccagaa

SEQ ID NO: 1304698 - RNA, 19 nt, Homo sapiens
cauaaccaauagaaagugu

SEQ ID NO: 1304699 - RNA, 19 nt, Homo sapiens
guacaaccacagcucagaa

SEQ ID NO: 1304700 - RNA, 19 nt, Homo sapiens
cugggaaacugaucacuuc

SEQ ID NO: 1304701 - RNA, 19 nt, Homo sapiens
aggagaaacaagcaauuua

SEQ ID NO: 1304702 - RNA, 19 nt, Homo sapiens
gaagggaaggguggaaugu

SEQ ID NO: 1304703 - RNA, 19 nt, Homo sapiens
gugguaaugauccaaagua

SEQ ID NO: 1304704 - RNA, 19 nt, Homo sapiens
gcagugguaaugauccaaa

SEQ ID NO: 1304705 - RNA, 19 nt, Homo sapiens
guaaaucuucauaguguca

SEQ ID NO: 1304706 - RNA, 19 nt, Homo sapiens
guucacauaaccaauagaa

SEQ ID NO: 1304707 - RNA, 19 nt, Homo sapiens
ucaggaaguucugguuaau

SEQ ID NO: 1304708 - RNA, 19 nt, Homo sapiens
aaccagagaauuacucaaa

SEQ ID NO: 1304709 - RNA, 19 nt, Homo sapiens
gcgaaccccuuuugaaguu

SEQ ID NO: 1304710 - RNA, 19 nt, Homo sapiens
gaaaguuaucuggaaauag

SEQ ID NO: 1304711 - RNA, 19 nt, Homo sapiens
aaaccacaaucuagacuac

SEQ ID NO: 1304712 - RNA, 19 nt, Homo sapiens
cagcacaggccaccguauu

SEQ ID NO: 1304713 - RNA, 19 nt, Homo sapiens
gagacccuccugcaugaaa

SEQ ID NO: 1304714 - RNA, 19 nt, Homo sapiens
gguucugccugucguguau

SEQ ID NO: 1304715 - RNA, 19 nt, Homo sapiens
ucagauuaaugagcacuug

SEQ ID NO: 1304716 - RNA, 19 nt, Homo sapiens
ggaaaggaaccaguauugg

SEQ ID NO: 1304717 - RNA, 19 nt, Homo sapiens
agauaucccuaagaaauuc

SEQ ID NO: 1304718 - RNA, 19 nt, Homo sapiens
ggaaccagagaauuacuca

SEQ ID NO: 1304719 - RNA, 19 nt, Homo sapiens
uuacggcuaugucaaacga

SEQ ID NO: 1304720 - RNA, 19 nt, Homo sapiens
aguggaaaguuaucuggaa

SEQ ID NO: 1304721 - RNA, 19 nt, Homo sapiens
gauguaacaguggaaaguu

SEQ ID NO: 1304722 - RNA, 19 nt, Homo sapiens
aggaaguucugguuaauac

SEQ ID NO: 1304723 - RNA, 19 nt, Homo sapiens
uggagucucagauuaauga

SEQ ID NO: 1304724 - RNA, 19 nt, Homo sapiens
gaaguugaggccaagaaag

SEQ ID NO: 1304725 - RNA, 19 nt, Homo sapiens
uaggagaaacaagcaauuu

SEQ ID NO: 1304726 - RNA, 19 nt, Homo sapiens
ccucugcucaugacuauug

SEQ ID NO: 1304727 - RNA, 19 nt, Homo sapiens
caggaaguucugguuaaua

SEQ ID NO: 1304728 - RNA, 19 nt, Homo sapiens
ggaccgcgcuuguguacca

SEQ ID NO: 1304729 - RNA, 19 nt, Homo sapiens
gcacagcccagaguaugua

SEQ ID NO: 1304730 - RNA, 19 nt, Homo sapiens
ccacuggccuuugaguuug

SEQ ID NO: 1304731 - RNA, 19 nt, Homo sapiens
gaagcuccuguaccucuua

SEQ ID NO: 1304732 - RNA, 19 nt, Homo sapiens
ggaggagucuguggcugaa

SEQ ID NO: 1304733 - RNA, 19 nt, Homo sapiens
gagccucaguggaagaugu

SEQ ID NO: 1304734 - RNA, 19 nt, Homo sapiens
cuccagaccucgcccauga

SEQ ID NO: 1304735 - RNA, 19 nt, Homo sapiens
ggugaacagugguauagca

SEQ ID NO: 1304736 - RNA, 19 nt, Homo sapiens
gcaggugaacagugguaua

SEQ ID NO: 1304737 - RNA, 19 nt, Homo sapiens
ggaagcuccuguaccucuu

SEQ ID NO: 1304738 - RNA, 19 nt, Homo sapiens
ggccucggcuucacuguca

SEQ ID NO: 1304739 - RNA, 19 nt, Homo sapiens
ggacugggaugugcaccau

SEQ ID NO: 1304740 - RNA, 19 nt, Homo sapiens
caacgccggauaucacauu

SEQ ID NO: 1304741 - RNA, 19 nt, Homo sapiens
gccaacggguucugugugu

SEQ ID NO: 1304742 - RNA, 19 nt, Homo sapiens
gauccaguaucucuuugag

SEQ ID NO: 1304743 - RNA, 19 nt, Homo sapiens
gcuggucucggcaggauuu

SEQ ID NO: 1304744 - RNA, 19 nt, Homo sapiens
caacaacguggccauagca

SEQ ID NO: 1304745 - RNA, 19 nt, Homo sapiens
gggauccaguaucucuuug

SEQ ID NO: 1304746 - RNA, 19 nt, Homo sapiens
caacggguucuguguguuc

SEQ ID NO: 1304747 - RNA, 19 nt, Homo sapiens
cggcugcccuauccauguu

SEQ ID NO: 1304748 - RNA, 19 nt, Homo sapiens
gcacaugccaagcagaaac

SEQ ID NO: 1304749 - RNA, 19 nt, Homo sapiens
ggccaaggugggagcauuu

SEQ ID NO: 1304750 - RNA, 19 nt, Homo sapiens
gaugggaaacgcugacuac

SEQ ID NO: 1304751 - RNA, 19 nt, Homo sapiens
gccaaggugggagcauuua

SEQ ID NO: 1304752 - RNA, 19 nt, Homo sapiens
ggccauagcagcugcacau

SEQ ID NO: 1304753 - RNA, 19 nt, Homo sapiens
guucgacgccaucuacuuc

SEQ ID NO: 1304754 - RNA, 19 nt, Homo sapiens
gagcauuuacaccgcagaa

SEQ ID NO: 1304755 - RNA, 19 nt, Homo sapiens
gcuaccaccuggagucacu

SEQ ID NO: 1304756 - RNA, 19 nt, Homo sapiens
gagccugccuagguucugu

SEQ ID NO: 1304757 - RNA, 19 nt, Homo sapiens
cccacuggccuuugaguuu

SEQ ID NO: 1304758 - RNA, 19 nt, Homo sapiens
caaggugggagcauuuaca

SEQ ID NO: 1304759 - RNA, 19 nt, Homo sapiens
gggcaggugaacaguggua

SEQ ID NO: 1304760 - RNA, 19 nt, Homo sapiens
guucaacaacguggccaua

SEQ ID NO: 1304761 - RNA, 19 nt, Homo sapiens
gcccugacaacgccggaua

SEQ ID NO: 1304762 - RNA, 19 nt, Homo sapiens
cagaaacacgggcuacaca

SEQ ID NO: 1304763 - RNA, 19 nt, Homo sapiens
gugcuucgcccaccucaca

SEQ ID NO: 1304764 - RNA, 19 nt, Homo sapiens
ggaugggaaacgcugacua

SEQ ID NO: 1304765 - RNA, 19 nt, Homo sapiens
acuccuggcugcaaugcuu

SEQ ID NO: 1304766 - RNA, 19 nt, Homo sapiens
gaagagccuccagcagcaa

SEQ ID NO: 1304767 - RNA, 19 nt, Homo sapiens
ggauccaguaucucuuuga

SEQ ID NO: 1304768 - RNA, 19 nt, Homo sapiens
cggccaaggugggagcauu

SEQ ID NO: 1304769 - RNA, 19 nt, Homo sapiens
ucacugcacuugggaagcu

SEQ ID NO: 1304770 - RNA, 19 nt, Homo sapiens
ugacaacgccggauaucac

SEQ ID NO: 1304771 - RNA, 19 nt, Homo sapiens
gugcacagcccagaguaug

SEQ ID NO: 1304772 - RNA, 19 nt, Homo sapiens
uuacaccgcagaaaugaca

SEQ ID NO: 1304773 - RNA, 19 nt, Homo sapiens
cagcagccacccuggaugu

SEQ ID NO: 1304774 - RNA, 19 nt, Homo sapiens
gguggacgcugugcucacu

SEQ ID NO: 1304775 - RNA, 19 nt, Homo sapiens
ugacgucauccaacaggaa

SEQ ID NO: 1304776 - RNA, 19 nt, Homo sapiens
gacaacgccggauaucaca

SEQ ID NO: 1304777 - RNA, 19 nt, Homo sapiens
ccaacggguucuguguguu

SEQ ID NO: 1304778 - RNA, 19 nt, Homo sapiens
ucaacaacguggccauagc

SEQ ID NO: 1304779 - RNA, 19 nt, Homo sapiens
gaacuccacaccccagcua

SEQ ID NO: 1304780 - RNA, 19 nt, Homo sapiens
caggugaacagugguauag

SEQ ID NO: 1304781 - RNA, 19 nt, Homo sapiens
gcuccuguaccucuuagau

SEQ ID NO: 1304782 - RNA, 19 nt, Homo sapiens
gugcuggucucggcaggau

SEQ ID NO: 1304783 - RNA, 19 nt, Homo sapiens
uaaagucucuucacauuga

SEQ ID NO: 1304784 - RNA, 19 nt, Homo sapiens
gcacaguagucaccaauga

SEQ ID NO: 1304785 - RNA, 19 nt, Homo sapiens
gaacuggaaugccauagau

SEQ ID NO: 1304786 - RNA, 19 nt, Homo sapiens
cgaaguauguggaauuuau

SEQ ID NO: 1304787 - RNA, 19 nt, Homo sapiens
ccacuuaacuggauuucuu

SEQ ID NO: 1304788 - RNA, 19 nt, Homo sapiens
gaacagcacaggcuucuug

SEQ ID NO: 1304789 - RNA, 19 nt, Homo sapiens
ggacuguacuauucccuuu

SEQ ID NO: 1304790 - RNA, 19 nt, Homo sapiens
ccagugcacuuugccauua

SEQ ID NO: 1304791 - RNA, 19 nt, Homo sapiens
uaucaggugucuauaauug

SEQ ID NO: 1304792 - RNA, 19 nt, Homo sapiens
caacagaggugaaacuacu

SEQ ID NO: 1304793 - RNA, 19 nt, Homo sapiens
gagggaagcuggaaucucu

SEQ ID NO: 1304794 - RNA, 19 nt, Homo sapiens
gaggagcaccggaucaaua

SEQ ID NO: 1304795 - RNA, 19 nt, Homo sapiens
gaacuugagguagccauua

SEQ ID NO: 1304796 - RNA, 19 nt, Homo sapiens
ccaaauacauugucuuaac

SEQ ID NO: 1304797 - RNA, 19 nt, Homo sapiens
ucaggugucuauaauugua

SEQ ID NO: 1304798 - RNA, 19 nt, Homo sapiens
gagaagcuauuuaugaaac

SEQ ID NO: 1304799 - RNA, 19 nt, Homo sapiens
gaggaaaucuuuugaugaa

SEQ ID NO: 1304800 - RNA, 19 nt, Homo sapiens
gauaauuacccuccuaguu

SEQ ID NO: 1304801 - RNA, 19 nt, Homo sapiens
ggaacuaucaggugucuau

SEQ ID NO: 1304802 - RNA, 19 nt, Homo sapiens
uggagaagcuauuuaugaa

SEQ ID NO: 1304803 - RNA, 19 nt, Homo sapiens
ggacaucuuuugccacaua

SEQ ID NO: 1304804 - RNA, 19 nt, Homo sapiens
ugccagagcucuaugaguu

SEQ ID NO: 1304805 - RNA, 19 nt, Homo sapiens
ggaccacuauuuacagcaa

SEQ ID NO: 1304806 - RNA, 19 nt, Homo sapiens
gaagcaacuuguagagaca

SEQ ID NO: 1304807 - RNA, 19 nt, Homo sapiens
auaauuacccuccuaguuu

SEQ ID NO: 1304808 - RNA, 19 nt, Homo sapiens
ggagaaagcaaauguaaaa

SEQ ID NO: 1304809 - RNA, 19 nt, Homo sapiens
caaacaucaugaaggcuuu

SEQ ID NO: 1304810 - RNA, 19 nt, Homo sapiens
aaagauaauuacccuccua

SEQ ID NO: 1304811 - RNA, 19 nt, Homo sapiens
cugacuaucuuacaauuga

SEQ ID NO: 1304812 - RNA, 19 nt, Homo sapiens
gaaagcaaauguaaaacug

SEQ ID NO: 1304813 - RNA, 19 nt, Homo sapiens
gcucuagcccuaacuaaug

SEQ ID NO: 1304814 - RNA, 19 nt, Homo sapiens
gcacauggagaaagcaaau

SEQ ID NO: 1304815 - RNA, 19 nt, Homo sapiens
ggagaagcuauuuaugaaa

SEQ ID NO: 1304816 - RNA, 19 nt, Homo sapiens
ugucuuaacuuccaaacau

SEQ ID NO: 1304817 - RNA, 19 nt, Homo sapiens
guagaacugccacagcuaa

SEQ ID NO: 1304818 - RNA, 19 nt, Homo sapiens
ggccauggacagccacuua

SEQ ID NO: 1304819 - RNA, 19 nt, Homo sapiens
aagcggcaauuuccaguuu

SEQ ID NO: 1304820 - RNA, 19 nt, Homo sapiens
uaauuacccuccuaguuuc

SEQ ID NO: 1304821 - RNA, 19 nt, Homo sapiens
caauggagaagcuauuuau

SEQ ID NO: 1304822 - RNA, 19 nt, Homo sapiens
uggaaucucugacuaucuu

SEQ ID NO: 1304823 - RNA, 19 nt, Homo sapiens
gagcugguagcaucuguaa

SEQ ID NO: 1304824 - RNA, 19 nt, Homo sapiens
ccauuaaagucucuucaca

SEQ ID NO: 1304825 - RNA, 19 nt, Homo sapiens
uggcugaugcugcaaguua

SEQ ID NO: 1304826 - RNA, 19 nt, Homo sapiens
gcgagugguucugguggua

SEQ ID NO: 1304827 - RNA, 19 nt, Homo sapiens
cagcuaaccauucaucaga

SEQ ID NO: 1304828 - RNA, 19 nt, Homo sapiens
ucaauggagaagcuauuua

SEQ ID NO: 1304829 - RNA, 19 nt, Homo sapiens
gaauauugggcccacacua

SEQ ID NO: 1304830 - RNA, 19 nt, Homo sapiens
gaacugaccugcguuuugg

SEQ ID NO: 1304831 - RNA, 19 nt, Homo sapiens
ugccaaauacauugucuua

SEQ ID NO: 1304832 - RNA, 19 nt, Homo sapiens
ccuccuaguuucaaauaug

SEQ ID NO: 1304833 - RNA, 19 nt, Homo sapiens
gaacuaucaggugucuaua

SEQ ID NO: 1304834 - RNA, 19 nt, Homo sapiens
gacagccacuuaacuggau

SEQ ID NO: 1304835 - RNA, 19 nt, Homo sapiens
ggaacuggaaugccauaga

SEQ ID NO: 1304836 - RNA, 19 nt, Homo sapiens
gagugguucuggugguauu

SEQ ID NO: 1304837 - RNA, 19 nt, Homo sapiens
ggcaauuuccaguuucuaa

SEQ ID NO: 1304838 - RNA, 19 nt, Homo sapiens
gaaguauguggaauuuaug

SEQ ID NO: 1304839 - RNA, 19 nt, Homo sapiens
uuaacuggauuucuuugga

SEQ ID NO: 1304840 - RNA, 19 nt, Homo sapiens
aagcuggaaucucugacua

SEQ ID NO: 1304841 - RNA, 19 nt, Homo sapiens
ucuaugaguuagugaacaa

SEQ ID NO: 1304842 - RNA, 19 nt, Homo sapiens
guacacauccaagccuaaa

SEQ ID NO: 1304843 - RNA, 19 nt, Homo sapiens
guagagacaguuucaugug

SEQ ID NO: 1304844 - RNA, 19 nt, Homo sapiens
gccagagcucuaugaguua

SEQ ID NO: 1304845 - RNA, 19 nt, Homo sapiens
acuaucaggugucuauaau

SEQ ID NO: 1304846 - RNA, 19 nt, Homo sapiens
gcuggaaucucugacuauc

SEQ ID NO: 1304847 - RNA, 19 nt, Homo sapiens
ggucagaauauucguggaa

SEQ ID NO: 1304848 - RNA, 19 nt, Homo sapiens
gccaaccagugggcagaua

SEQ ID NO: 1304849 - RNA, 19 nt, Homo sapiens
guucagcccuuucccuuuu

SEQ ID NO: 1304850 - RNA, 19 nt, Homo sapiens
ugccacagcuaaccauuca

SEQ ID NO: 1304851 - RNA, 19 nt, Homo sapiens
caagugggguccuggcuaa

SEQ ID NO: 1304852 - RNA, 19 nt, Homo sapiens
ucaggccucuggugccaaa

SEQ ID NO: 1304853 - RNA, 19 nt, Homo sapiens
gcaugacaauagacaaacu

SEQ ID NO: 1304854 - RNA, 19 nt, Homo sapiens
gaaaacugcaugacaauag

SEQ ID NO: 1304855 - RNA, 19 nt, Homo sapiens
uaacuuccaaacaucauga

SEQ ID NO: 1304856 - RNA, 19 nt, Homo sapiens
cagugcacuuugccauuaa

SEQ ID NO: 1304857 - RNA, 19 nt, Homo sapiens
gauuuuggaccacuauuua

SEQ ID NO: 1304858 - RNA, 19 nt, Homo sapiens
gaccacuauuuacagcaaa

SEQ ID NO: 1304859 - RNA, 19 nt, Homo sapiens
aggaaaagauaccgaagua

SEQ ID NO: 1304860 - RNA, 19 nt, Homo sapiens
caauuuccaguuucuaaga

SEQ ID NO: 1304861 - RNA, 19 nt, Homo sapiens
gaaacuacugggccaugga

SEQ ID NO: 1304862 - RNA, 19 nt, Homo sapiens
ccuaacuaaugugaucuaa

SEQ ID NO: 1304863 - RNA, 19 nt, Homo sapiens
acacauccaagccuaaaga

SEQ ID NO: 1304864 - RNA, 19 nt, Homo sapiens
gaauuggugaagcaacuug

SEQ ID NO: 1304865 - RNA, 19 nt, Homo sapiens
ggaaucucugacuaucuua

SEQ ID NO: 1304866 - RNA, 19 nt, Homo sapiens
ccagagcucuaugaguuag

SEQ ID NO: 1304867 - RNA, 19 nt, Homo sapiens
gaacugccacagcuaacca

SEQ ID NO: 1304868 - RNA, 19 nt, Homo sapiens
ucauguggaggaaaucuuu

SEQ ID NO: 1304869 - RNA, 19 nt, Homo sapiens
caaccagugggcagauauu

SEQ ID NO: 1304870 - RNA, 19 nt, Homo sapiens
caugguggcuucuauaccu

SEQ ID NO: 1304871 - RNA, 19 nt, Homo sapiens
gcaaauguaaaacuggaua

SEQ ID NO: 1304872 - RNA, 19 nt, Homo sapiens
cuccuaguuucaaauauga

SEQ ID NO: 1304873 - RNA, 19 nt, Homo sapiens
uggccugguuauauaauga

SEQ ID NO: 1304874 - RNA, 19 nt, Homo sapiens
gcaauuuccaguuucuaag

SEQ ID NO: 1304875 - RNA, 19 nt, Homo sapiens
gguuugaccaggccaaguu

SEQ ID NO: 1304876 - RNA, 19 nt, Homo sapiens
ggaacuugagguagccauu

SEQ ID NO: 1304877 - RNA, 19 nt, Homo sapiens
cacauugauuuguuuccaa

SEQ ID NO: 1304878 - RNA, 19 nt, Homo sapiens
ugucuaaggcuaggaacua

SEQ ID NO: 1304879 - RNA, 19 nt, Homo sapiens
ucagaugccguguaaaugg

SEQ ID NO: 1304880 - RNA, 19 nt, Homo sapiens
gccauggacagccacuuaa

SEQ ID NO: 1304881 - RNA, 19 nt, Homo sapiens
cauccaagccuaaagaaaa

SEQ ID NO: 1304882 - RNA, 19 nt, Homo sapiens
gagcaccggaucaauacug

SEQ ID NO: 1304883 - RNA, 19 nt, Homo sapiens
gcugaaaccuuaacaaaua

SEQ ID NO: 1304884 - RNA, 19 nt, Homo sapiens
caacuagacuuauacuuug

SEQ ID NO: 1304885 - RNA, 19 nt, Homo sapiens
gcacaugauugaugcuuaa

SEQ ID NO: 1304886 - RNA, 19 nt, Homo sapiens
ggguacacauugcuauuua

SEQ ID NO: 1304887 - RNA, 19 nt, Homo sapiens
guauuuaucugcacuuugu

SEQ ID NO: 1304888 - RNA, 19 nt, Homo sapiens
aaagucggauguuaagaua

SEQ ID NO: 1304889 - RNA, 19 nt, Homo sapiens
ccaacuagacuuauacuuu

SEQ ID NO: 1304890 - RNA, 19 nt, Homo sapiens
ucagaguccuucuugauuu

SEQ ID NO: 1304891 - RNA, 19 nt, Homo sapiens
gagcugaaaccuuaacaaa

SEQ ID NO: 1304892 - RNA, 19 nt, Homo sapiens
uaaauauucuccaccauuc

SEQ ID NO: 1304893 - RNA, 19 nt, Homo sapiens
gaacacaggcuugacuauu

SEQ ID NO: 1304894 - RNA, 19 nt, Homo sapiens
cacaggaacuggucuaaga

SEQ ID NO: 1304895 - RNA, 19 nt, Homo sapiens
ucaauuuccugaacacauu

SEQ ID NO: 1304896 - RNA, 19 nt, Homo sapiens
gagcuucuuugcagucauu

SEQ ID NO: 1304897 - RNA, 19 nt, Homo sapiens
gagguacuguaguuuauau

SEQ ID NO: 1304898 - RNA, 19 nt, Homo sapiens
ugaaugauguggacuuuua

SEQ ID NO: 1304899 - RNA, 19 nt, Homo sapiens
gcagauguaauaucgagua

SEQ ID NO: 1304900 - RNA, 19 nt, Homo sapiens
gcacaccuuuaaucucuau

SEQ ID NO: 1304901 - RNA, 19 nt, Homo sapiens
caucugccaucuuucauga

SEQ ID NO: 1304902 - RNA, 19 nt, Homo sapiens
gguacacauugcuauuuaa

SEQ ID NO: 1304903 - RNA, 19 nt, Homo sapiens
uaucugcacuuuguguaua

SEQ ID NO: 1304904 - RNA, 19 nt, Homo sapiens
gaacacugucugcacauga

SEQ ID NO: 1304905 - RNA, 19 nt, Homo sapiens
gcagguuuaugaaugaugu

SEQ ID NO: 1304906 - RNA, 19 nt, Homo sapiens
guaguguucuguauuuauc

SEQ ID NO: 1304907 - RNA, 19 nt, Homo sapiens
gcagcugcccucacuguuu

SEQ ID NO: 1304908 - RNA, 19 nt, Homo sapiens
caucaacuggucucaauuu

SEQ ID NO: 1304909 - RNA, 19 nt, Homo sapiens
uguccuagaccaaugauua

SEQ ID NO: 1304910 - RNA, 19 nt, Homo sapiens
aaaugcagguuuaugaaug

SEQ ID NO: 1304911 - RNA, 19 nt, Homo sapiens
gaacuggucuaagaacacu

SEQ ID NO: 1304912 - RNA, 19 nt, Homo sapiens
caauuuagggaacagauuu

SEQ ID NO: 1304913 - RNA, 19 nt, Homo sapiens
gaagagucccucagagcuu

SEQ ID NO: 1304914 - RNA, 19 nt, Homo sapiens
agucggauguuaagauauu

SEQ ID NO: 1304915 - RNA, 19 nt, Homo sapiens
caaggugucugugguuuag

SEQ ID NO: 1304916 - RNA, 19 nt, Homo sapiens
ggaaaaugcagguuuauga

SEQ ID NO: 1304917 - RNA, 19 nt, Homo sapiens
ugacuauuguccagaaguu

SEQ ID NO: 1304918 - RNA, 19 nt, Homo sapiens
aacacaggcuugacuauug

SEQ ID NO: 1304919 - RNA, 19 nt, Homo sapiens
caggaugccuucuuuagca

SEQ ID NO: 1304920 - RNA, 19 nt, Homo sapiens
cagagaccauuuucauuua

SEQ ID NO: 1304921 - RNA, 19 nt, Homo sapiens
uugggaaacuuaaguguug

SEQ ID NO: 1304922 - RNA, 19 nt, Homo sapiens
ccucagagcuuugccucaa

SEQ ID NO: 1304923 - RNA, 19 nt, Homo sapiens
cuuuauaucugcccgugua

SEQ ID NO: 1304924 - RNA, 19 nt, Homo sapiens
uggaccaucugccaucuuu

SEQ ID NO: 1304925 - RNA, 19 nt, Homo sapiens
caacuggucucaauuuccu

SEQ ID NO: 1304926 - RNA, 19 nt, Homo sapiens
cauucaagaugccugugua

SEQ ID NO: 1304927 - RNA, 19 nt, Homo sapiens
uaugaaugauguggacuuu

SEQ ID NO: 1304928 - RNA, 19 nt, Homo sapiens
uugauucgcagauguaaua

SEQ ID NO: 1304929 - RNA, 19 nt, Homo sapiens
uaucaaagguugggauuuu

SEQ ID NO: 1304930 - RNA, 19 nt, Homo sapiens
uccaauauaccaccacaua

SEQ ID NO: 1304931 - RNA, 19 nt, Homo sapiens
aauggagucugugugcuua

SEQ ID NO: 1304932 - RNA, 19 nt, Homo sapiens
uugacaacauucacaguaa

SEQ ID NO: 1304933 - RNA, 19 nt, Homo sapiens
gucagaggcagaccaauuu

SEQ ID NO: 1304934 - RNA, 19 nt, Homo sapiens
gagucugugugcuuacuga

SEQ ID NO: 1304935 - RNA, 19 nt, Homo sapiens
ggagaaauggagucugugu

SEQ ID NO: 1304936 - RNA, 19 nt, Homo sapiens
ggugcucuauggagaaaug

SEQ ID NO: 1304937 - RNA, 19 nt, Homo sapiens
caguuccacuugguaauaa

SEQ ID NO: 1304938 - RNA, 19 nt, Homo sapiens
ccaguuccacuugguaaua

SEQ ID NO: 1304939 - RNA, 19 nt, Homo sapiens
acacaggcuugacuauugu

SEQ ID NO: 1304940 - RNA, 19 nt, Homo sapiens
gaacccuauuuauauacug

SEQ ID NO: 1304941 - RNA, 19 nt, Homo sapiens
aauuugagguacuguaguu

SEQ ID NO: 1304942 - RNA, 19 nt, Homo sapiens
cagaguccuucuugauuuc

SEQ ID NO: 1304943 - RNA, 19 nt, Homo sapiens
gaaaaugcagguuuaugaa

SEQ ID NO: 1304944 - RNA, 19 nt, Homo sapiens
ggucucaauuuccugaaca

SEQ ID NO: 1304945 - RNA, 19 nt, Homo sapiens
uauucaggaugccuucuuu

SEQ ID NO: 1304946 - RNA, 19 nt, Homo sapiens
gcuugacuauuguccagaa

SEQ ID NO: 1304947 - RNA, 19 nt, Homo sapiens
caaauuguagugauaccuu

SEQ ID NO: 1304948 - RNA, 19 nt, Homo sapiens
gaccaucugccaucuuuca

SEQ ID NO: 1304949 - RNA, 19 nt, Homo sapiens
aaugcagguuuaugaauga

SEQ ID NO: 1304950 - RNA, 19 nt, Homo sapiens
ucagaggcagaccaauuua

SEQ ID NO: 1304951 - RNA, 19 nt, Homo sapiens
aagagucccucagagcuuu

SEQ ID NO: 1304952 - RNA, 19 nt, Homo sapiens
ugacaacauucacaguaag

SEQ ID NO: 1304953 - RNA, 19 nt, Homo sapiens
guaauaacguugggaaaau

SEQ ID NO: 1304954 - RNA, 19 nt, Homo sapiens
ggguaucauucaugugguu

SEQ ID NO: 1304955 - RNA, 19 nt, Homo sapiens
aaccucauguuuauuccua

SEQ ID NO: 1304956 - RNA, 19 nt, Homo sapiens
cagauguaauaucgaguau

SEQ ID NO: 1304957 - RNA, 19 nt, Homo sapiens
gaaaaggguaucauucaug

SEQ ID NO: 1304958 - RNA, 19 nt, Homo sapiens
uucauuuacugccaucaua

SEQ ID NO: 1304959 - RNA, 19 nt, Homo sapiens
ucugugugcuuacugaaga

SEQ ID NO: 1304960 - RNA, 19 nt, Homo sapiens
uauuuaacuuugccuccua

SEQ ID NO: 1304961 - RNA, 19 nt, Homo sapiens
uucaugugguuucaguuua

SEQ ID NO: 1304962 - RNA, 19 nt, Homo sapiens
ccaaguucaguguggauuu

SEQ ID NO: 1304963 - RNA, 19 nt, Homo sapiens
uacaaggugucugugguuu

SEQ ID NO: 1304964 - RNA, 19 nt, Homo sapiens
gaacacauucacuguaucc

SEQ ID NO: 1304965 - RNA, 19 nt, Homo sapiens
ucaugugguuucaguuuag

SEQ ID NO: 1304966 - RNA, 19 nt, Homo sapiens
ugcacaugauugaugcuua

SEQ ID NO: 1304967 - RNA, 19 nt, Homo sapiens
caccuuuaaucucuauaug

SEQ ID NO: 1304968 - RNA, 19 nt, Homo sapiens
acaaggugucugugguuua

SEQ ID NO: 1304969 - RNA, 19 nt, Homo sapiens
gaaaauugaucugcauguc

SEQ ID NO: 1304970 - RNA, 19 nt, Homo sapiens
gaauuuggcagggaagaca

SEQ ID NO: 1304971 - RNA, 19 nt, Homo sapiens
cuagaccaaugauuacaag

SEQ ID NO: 1304972 - RNA, 19 nt, Homo sapiens
uugagguacuguaguuuau

SEQ ID NO: 1304973 - RNA, 19 nt, Homo sapiens
acccucaacugccuccuuu

SEQ ID NO: 1304974 - RNA, 19 nt, Homo sapiens
caaguucaguguggauuuu

SEQ ID NO: 1304975 - RNA, 19 nt, Homo sapiens
gcauguccuagaccaauga

SEQ ID NO: 1304976 - RNA, 19 nt, Homo sapiens
cagcugcccucacuguuuu

SEQ ID NO: 1304977 - RNA, 19 nt, Homo sapiens
cauaugccaacauguaaau

SEQ ID NO: 1304978 - RNA, 19 nt, Homo sapiens
gacaacaacucaauuuugc

SEQ ID NO: 1304979 - RNA, 19 nt, Homo sapiens
ccuuggcacucaugagaga

SEQ ID NO: 1304980 - RNA, 19 nt, Homo sapiens
ccaauuuagggaacagauu

SEQ ID NO: 1304981 - RNA, 19 nt, Homo sapiens
agucagaggcagaccaauu

SEQ ID NO: 1304982 - RNA, 19 nt, Homo sapiens
uaucgaguauucaucaacu

SEQ ID NO: 1304983 - RNA, 19 nt, Homo sapiens
cauaagaccuccguguuua

SEQ ID NO: 1304984 - RNA, 19 nt, Homo sapiens
ggaauaaggccacaaguau

SEQ ID NO: 1304985 - RNA, 19 nt, Homo sapiens
gaaacacggucauucaauc

SEQ ID NO: 1304986 - RNA, 19 nt, Homo sapiens
cugcagaaaucaaucuuua

SEQ ID NO: 1304987 - RNA, 19 nt, Homo sapiens
gaacaaauuuaggguggaa

SEQ ID NO: 1304988 - RNA, 19 nt, Homo sapiens
caacccagcuccaucauca

SEQ ID NO: 1304989 - RNA, 19 nt, Homo sapiens
guauugaacugaagaagug

SEQ ID NO: 1304990 - RNA, 19 nt, Homo sapiens
ucagucaugugaaguauuu

SEQ ID NO: 1304991 - RNA, 19 nt, Homo sapiens
gaaggaagaaugauaagga

SEQ ID NO: 1304992 - RNA, 19 nt, Homo sapiens
caauaaaggugugcuguau

SEQ ID NO: 1304993 - RNA, 19 nt, Homo sapiens
gaagaaugauaaggagaaa

SEQ ID NO: 1304994 - RNA, 19 nt, Homo sapiens
acaaaggcuugcaaagaua

SEQ ID NO: 1304995 - RNA, 19 nt, Homo sapiens
cgacaccgguucucuauca

SEQ ID NO: 1304996 - RNA, 19 nt, Homo sapiens
gaacugaagaagugagaaa

SEQ ID NO: 1304997 - RNA, 19 nt, Homo sapiens
ugaagucgcucaguacauu

SEQ ID NO: 1304998 - RNA, 19 nt, Homo sapiens
gcaaguccauucagaaguc

SEQ ID NO: 1304999 - RNA, 19 nt, Homo sapiens
cacaaaggcuugcaaagau

SEQ ID NO: 1305000 - RNA, 19 nt, Homo sapiens
cggccuagcugcccucuaa

SEQ ID NO: 1305001 - RNA, 19 nt, Homo sapiens
ggaagaaagagaaauaauc

SEQ ID NO: 1305002 - RNA, 19 nt, Homo sapiens
ggaagaaugauaaggagaa

SEQ ID NO: 1305003 - RNA, 19 nt, Homo sapiens
auaaaggugugcuguauug

SEQ ID NO: 1305004 - RNA, 19 nt, Homo sapiens
gaggugagaccaggaauaa

SEQ ID NO: 1305005 - RNA, 19 nt, Homo sapiens
uaaucaaacugaccaugaa

SEQ ID NO: 1305006 - RNA, 19 nt, Homo sapiens
gaagaagggacucugauca

SEQ ID NO: 1305007 - RNA, 19 nt, Homo sapiens
aagagaagaugaaggaaga

SEQ ID NO: 1305008 - RNA, 19 nt, Homo sapiens
aaacagagcaaacugaaga

SEQ ID NO: 1305009 - RNA, 19 nt, Homo sapiens
cuaaagcgauucuuacaag

SEQ ID NO: 1305010 - RNA, 19 nt, Homo sapiens
ccacaaaggcuugcaaaga

SEQ ID NO: 1305011 - RNA, 19 nt, Homo sapiens
agagagaccuaaagcgauu

SEQ ID NO: 1305012 - RNA, 19 nt, Homo sapiens
caaauuauucuccuguuga

SEQ ID NO: 1305013 - RNA, 19 nt, Homo sapiens
ccaaauuauucuccuguug

SEQ ID NO: 1305014 - RNA, 19 nt, Homo sapiens
caaacugaagaccaaauua

SEQ ID NO: 1305015 - RNA, 19 nt, Homo sapiens
gcaaacugaagaccaaauu

SEQ ID NO: 1305016 - RNA, 19 nt, Homo sapiens
caagaaacacggucauuca

SEQ ID NO: 1305017 - RNA, 19 nt, Homo sapiens
gaagaggaagaaagagaaa

SEQ ID NO: 1305018 - RNA, 19 nt, Homo sapiens
gaagaugaaggaagacugu

SEQ ID NO: 1305019 - RNA, 19 nt, Homo sapiens
cccagauacugaacaauuu

SEQ ID NO: 1305020 - RNA, 19 nt, Homo sapiens
caggaaugcugcugggaaa

SEQ ID NO: 1305021 - RNA, 19 nt, Homo sapiens
gcugagaguuccacagaca

SEQ ID NO: 1305022 - RNA, 19 nt, Homo sapiens
gacagcaaguccauucaga

SEQ ID NO: 1305023 - RNA, 19 nt, Homo sapiens
guccguggauggcagauuu

SEQ ID NO: 1305024 - RNA, 19 nt, Homo sapiens
ggagaaaugucuguuuuga

SEQ ID NO: 1305025 - RNA, 19 nt, Homo sapiens
gcaagaaacacggucauuc

SEQ ID NO: 1305026 - RNA, 19 nt, Homo sapiens
ccaaguaacuggccaacac

SEQ ID NO: 1305027 - RNA, 19 nt, Homo sapiens
gaagucgcucaguacauua

SEQ ID NO: 1305028 - RNA, 19 nt, Homo sapiens
ggccacuucuacaaucaua

SEQ ID NO: 1305029 - RNA, 19 nt, Homo sapiens
auccuuaggugcucaauaa

SEQ ID NO: 1305030 - RNA, 19 nt, Homo sapiens
gauggagaauuucaggaau

SEQ ID NO: 1305031 - RNA, 19 nt, Homo sapiens
gaauaaggccacaaguauc

SEQ ID NO: 1305032 - RNA, 19 nt, Homo sapiens
ccuguccucuuccuucaua

SEQ ID NO: 1305033 - RNA, 19 nt, Homo sapiens
gaggaagaaagagaaauaa

SEQ ID NO: 1305034 - RNA, 19 nt, Homo sapiens
agaggaagaaagagaaaua

SEQ ID NO: 1305035 - RNA, 19 nt, Homo sapiens
gugagaagaucgccaggau

SEQ ID NO: 1305036 - RNA, 19 nt, Homo sapiens
gcgaguacccgcugauuuc

SEQ ID NO: 1305037 - RNA, 19 nt, Homo sapiens
ucauaagaccuccguguuu

SEQ ID NO: 1305038 - RNA, 19 nt, Homo sapiens
gcccuccucuggcagcaua

SEQ ID NO: 1305039 - RNA, 19 nt, Homo sapiens
caaugacuuucaauacuuc

SEQ ID NO: 1305040 - RNA, 19 nt, Homo sapiens
agaccuaaagcgauucuua

SEQ ID NO: 1305041 - RNA, 19 nt, Homo sapiens
uaugagaucuagccugcuu

SEQ ID NO: 1305042 - RNA, 19 nt, Homo sapiens
cccaugaagucgcucagua

SEQ ID NO: 1305043 - RNA, 19 nt, Homo sapiens
auucuugucugcccucaua

SEQ ID NO: 1305044 - RNA, 19 nt, Homo sapiens
caugugaaguauuugucua

SEQ ID NO: 1305045 - RNA, 19 nt, Homo sapiens
gcagacaagaggaagagaa

SEQ ID NO: 1305046 - RNA, 19 nt, Homo sapiens
gcucuuaggccugcugaaa

SEQ ID NO: 1305047 - RNA, 19 nt, Homo sapiens
agagcaaacugaagaccaa

SEQ ID NO: 1305048 - RNA, 19 nt, Homo sapiens
ugugacugauggagaauuu

SEQ ID NO: 1305049 - RNA, 19 nt, Homo sapiens
uaaggagaaaugucuguuu

SEQ ID NO: 1305050 - RNA, 19 nt, Homo sapiens
ggaugacuuucaaugacuu

SEQ ID NO: 1305051 - RNA, 19 nt, Homo sapiens
gcguuucucuccucuagug

SEQ ID NO: 1305052 - RNA, 19 nt, Homo sapiens
gcagaaaucaaucuuuacu

SEQ ID NO: 1305053 - RNA, 19 nt, Homo sapiens
ucagaagucggagcucuua

SEQ ID NO: 1305054 - RNA, 19 nt, Homo sapiens
cucaguacauuaaguuuga

SEQ ID NO: 1305055 - RNA, 19 nt, Homo sapiens
ggaagaagggacucugauc

SEQ ID NO: 1305056 - RNA, 19 nt, Homo sapiens
ucaauaaaggugugcugua

SEQ ID NO: 1305057 - RNA, 19 nt, Homo sapiens
ggaacugcgucagggcaaa

SEQ ID NO: 1305058 - RNA, 19 nt, Homo sapiens
ggaacuugcugggucagau

SEQ ID NO: 1305059 - RNA, 19 nt, Homo sapiens
caacggccacuucuacaau

SEQ ID NO: 1305060 - RNA, 19 nt, Homo sapiens
gagacaccgugaggaagaa

SEQ ID NO: 1305061 - RNA, 19 nt, Homo sapiens
agaaugauaaggagaaaug

SEQ ID NO: 1305062 - RNA, 19 nt, Homo sapiens
gacaagaggaagagaagau

SEQ ID NO: 1305063 - RNA, 19 nt, Homo sapiens
gaggaagaagggacucuga

SEQ ID NO: 1305064 - RNA, 19 nt, Homo sapiens
gcugagacaccgugaggaa

SEQ ID NO: 1305065 - RNA, 19 nt, Homo sapiens
guuugugacugauggagaa

SEQ ID NO: 1305066 - RNA, 19 nt, Homo sapiens
ccugaaggaagaaugauaa

SEQ ID NO: 1305067 - RNA, 19 nt, Homo sapiens
ggaggccugcccacuguuu

SEQ ID NO: 1305068 - RNA, 19 nt, Homo sapiens
gcaaaugucacagcaggau

SEQ ID NO: 1305069 - RNA, 19 nt, Homo sapiens
uggagaauuucaggaauga

SEQ ID NO: 1305070 - RNA, 19 nt, Homo sapiens
gggaugacuuucaaugacu

SEQ ID NO: 1305071 - RNA, 19 nt, Homo sapiens
gccaucaccuugccacagu

SEQ ID NO: 1305072 - RNA, 19 nt, Homo sapiens
caagaggaagagaagauga

SEQ ID NO: 1305073 - RNA, 19 nt, Homo sapiens
gcucaguacauuaaguuug

SEQ ID NO: 1305074 - RNA, 19 nt, Homo sapiens
caucagucaugugaaguau

SEQ ID NO: 1305075 - RNA, 19 nt, Homo sapiens
cuguguaccucuugccuuu

SEQ ID NO: 1305076 - RNA, 19 nt, Homo sapiens
cagcagguaugagaucuag

SEQ ID NO: 1305077 - RNA, 19 nt, Homo sapiens
ccagcuccaucaucacaga

SEQ ID NO: 1305078 - RNA, 19 nt, Homo sapiens
aggaauaaggccacaagua

SEQ ID NO: 1305079 - RNA, 19 nt, Homo sapiens
ugccggugcuggacaguuu

SEQ ID NO: 1305080 - RNA, 19 nt, Homo sapiens
gaaccacaaaggcuugcaa

SEQ ID NO: 1305081 - RNA, 19 nt, Homo sapiens
gacuuucaaugacuuucaa

SEQ ID NO: 1305082 - RNA, 19 nt, Homo sapiens
gcugguggaggccaaguaa

SEQ ID NO: 1305083 - RNA, 19 nt, Homo sapiens
gaaaguaaccagacaagaa

SEQ ID NO: 1305084 - RNA, 19 nt, Homo sapiens
ggcaaucauucuucaaaua

SEQ ID NO: 1305085 - RNA, 19 nt, Homo sapiens
ggaagugucgcuacguuua

SEQ ID NO: 1305086 - RNA, 19 nt, Homo sapiens
gaacucaucuuggacaaca

SEQ ID NO: 1305087 - RNA, 19 nt, Homo sapiens
gaaagaggaucuggcugaa

SEQ ID NO: 1305088 - RNA, 19 nt, Homo sapiens
ccagggaacucaccaguca

SEQ ID NO: 1305089 - RNA, 19 nt, Homo sapiens
caauaucuuugccuugaaa

SEQ ID NO: 1305090 - RNA, 19 nt, Homo sapiens
caagagauacagaugcuuu

SEQ ID NO: 1305091 - RNA, 19 nt, Homo sapiens
guguagccaucaagaauuu

SEQ ID NO: 1305092 - RNA, 19 nt, Homo sapiens
gaggaagacuacaagagau

SEQ ID NO: 1305093 - RNA, 19 nt, Homo sapiens
caacuucuguauaccuuca

SEQ ID NO: 1305094 - RNA, 19 nt, Homo sapiens
ucagaggagucuucaugaa

SEQ ID NO: 1305095 - RNA, 19 nt, Homo sapiens
uguacaagcugcccaacuu

SEQ ID NO: 1305096 - RNA, 19 nt, Homo sapiens
ggucagaggagucuucaug

SEQ ID NO: 1305097 - RNA, 19 nt, Homo sapiens
ccuuaacccucaacaagaa

SEQ ID NO: 1305098 - RNA, 19 nt, Homo sapiens
ucagagggcaacagguuua

SEQ ID NO: 1305099 - RNA, 19 nt, Homo sapiens
agauacagaugcuuuguuc

SEQ ID NO: 1305100 - RNA, 19 nt, Homo sapiens
uggagaaccugcuggauca

SEQ ID NO: 1305101 - RNA, 19 nt, Homo sapiens
ucacucagcggcaaucauu

SEQ ID NO: 1305102 - RNA, 19 nt, Homo sapiens
caacagguuuauccgagau

SEQ ID NO: 1305103 - RNA, 19 nt, Homo sapiens
uggaggaacucaucuugga

SEQ ID NO: 1305104 - RNA, 19 nt, Homo sapiens
ugaggaagacuacaagaga

SEQ ID NO: 1305105 - RNA, 19 nt, Homo sapiens
aagaggaucuggcugaaag

SEQ ID NO: 1305106 - RNA, 19 nt, Homo sapiens
gaaaaguauuugucacuca

SEQ ID NO: 1305107 - RNA, 19 nt, Homo sapiens
gccuugaaaugaauggaaa

SEQ ID NO: 1305108 - RNA, 19 nt, Homo sapiens
uguauaccuucacccauuu

SEQ ID NO: 1305109 - RNA, 19 nt, Homo sapiens
cuguauaccuucacccauu

SEQ ID NO: 1305110 - RNA, 19 nt, Homo sapiens
gagaugaccagcucugaag

SEQ ID NO: 1305111 - RNA, 19 nt, Homo sapiens
gagauacagaugcuuuguu

SEQ ID NO: 1305112 - RNA, 19 nt, Homo sapiens
acaagaaccgaaucacuga

SEQ ID NO: 1305113 - RNA, 19 nt, Homo sapiens
gcggcaaucauucuucaaa

SEQ ID NO: 1305114 - RNA, 19 nt, Homo sapiens
cagcggcaaucauucuuca

SEQ ID NO: 1305115 - RNA, 19 nt, Homo sapiens
gaaccugcuggaucacuug

SEQ ID NO: 1305116 - RNA, 19 nt, Homo sapiens
caacaagaaccgaaucacu

SEQ ID NO: 1305117 - RNA, 19 nt, Homo sapiens
uaucuuugccuugaaauga

SEQ ID NO: 1305118 - RNA, 19 nt, Homo sapiens
gccaacuucuguauaccuu

SEQ ID NO: 1305119 - RNA, 19 nt, Homo sapiens
cggcaaucauucuucaaau

SEQ ID NO: 1305120 - RNA, 19 nt, Homo sapiens
gugcauguguuuuaguuuu

SEQ ID NO: 1305121 - RNA, 19 nt, Homo sapiens
caacuugaaauuucuggau

SEQ ID NO: 1305122 - RNA, 19 nt, Homo sapiens
gcugaaagacccgcaacuu

SEQ ID NO: 1305123 - RNA, 19 nt, Homo sapiens
gggaagugucgcuacguuu

SEQ ID NO: 1305124 - RNA, 19 nt, Homo sapiens
ggaacucaccagucaccaa

SEQ ID NO: 1305125 - RNA, 19 nt, Homo sapiens
uggaaggacugagcgcauu

SEQ ID NO: 1305126 - RNA, 19 nt, Homo sapiens
ccaaagccguggaguaccu

SEQ ID NO: 1305127 - RNA, 19 nt, Homo sapiens
cugcccaacuugaaauuuc

SEQ ID NO: 1305128 - RNA, 19 nt, Homo sapiens
cgagaugaccagcucugaa

SEQ ID NO: 1305129 - RNA, 19 nt, Homo sapiens
gaagugucgcuacguuuac

SEQ ID NO: 1305130 - RNA, 19 nt, Homo sapiens
aggaagacuacaagagaua

SEQ ID NO: 1305131 - RNA, 19 nt, Homo sapiens
ggaaggacugagcgcauuc

SEQ ID NO: 1305132 - RNA, 19 nt, Homo sapiens
gaugaggaagacuacaaga

SEQ ID NO: 1305133 - RNA, 19 nt, Homo sapiens
caguguagccaucaagaau

SEQ ID NO: 1305134 - RNA, 19 nt, Homo sapiens
gaagacuacaagagauaca

SEQ ID NO: 1305135 - RNA, 19 nt, Homo sapiens
ggaaaaggaugaggaagac

SEQ ID NO: 1305136 - RNA, 19 nt, Homo sapiens
ucacugauuuggagaaccu

SEQ ID NO: 1305137 - RNA, 19 nt, Homo sapiens
aacuuucacuuguugagaa

SEQ ID NO: 1305138 - RNA, 19 nt, Homo sapiens
uacaagagauacagaugcu

SEQ ID NO: 1305139 - RNA, 19 nt, Homo sapiens
gacccgcaacuuucacuug

SEQ ID NO: 1305140 - RNA, 19 nt, Homo sapiens
aaaguaaccagacaagaac

SEQ ID NO: 1305141 - RNA, 19 nt, Homo sapiens
ccagaaaguaaccagacaa

SEQ ID NO: 1305142 - RNA, 19 nt, Homo sapiens
uaccuucacccauuucaug

SEQ ID NO: 1305143 - RNA, 19 nt, Homo sapiens
ggaugaggaagacuacaag

SEQ ID NO: 1305144 - RNA, 19 nt, Homo sapiens
agaaccugcuggaucacuu

SEQ ID NO: 1305145 - RNA, 19 nt, Homo sapiens
uaccuuaacccucaacaag

SEQ ID NO: 1305146 - RNA, 19 nt, Homo sapiens
gaaggacugagcgcauuca

SEQ ID NO: 1305147 - RNA, 19 nt, Homo sapiens
uacccagacugcauaccuu

SEQ ID NO: 1305148 - RNA, 19 nt, Homo sapiens
uggaguaccugcuguugcu

SEQ ID NO: 1305149 - RNA, 19 nt, Homo sapiens
acucagagggcaacagguu

SEQ ID NO: 1305150 - RNA, 19 nt, Homo sapiens
aguggcaucugcucagugu

SEQ ID NO: 1305151 - RNA, 19 nt, Homo sapiens
gucagaggagucuucauga

SEQ ID NO: 1305152 - RNA, 19 nt, Homo sapiens
cuacguuuacuaugggaaa

SEQ ID NO: 1305153 - RNA, 19 nt, Homo sapiens
gucgcuacguuuacuaugg

SEQ ID NO: 1305154 - RNA, 19 nt, Homo sapiens
ggaagacuacaagagauac

SEQ ID NO: 1305155 - RNA, 19 nt, Homo sapiens
acagguuuauccgagauga

SEQ ID NO: 1305156 - RNA, 19 nt, Homo sapiens
cccagaaaguaaccagaca

SEQ ID NO: 1305157 - RNA, 19 nt, Homo sapiens
ucaguguagccaucaagaa

SEQ ID NO: 1305158 - RNA, 19 nt, Homo sapiens
gagccuggaggaacucauc

SEQ ID NO: 1305159 - RNA, 19 nt, Homo sapiens
ggacauguuugaaaucuuu

SEQ ID NO: 1305160 - RNA, 19 nt, Homo sapiens
ggaauuggguauuuaaaga

SEQ ID NO: 1305161 - RNA, 19 nt, Homo sapiens
gccaucaaaugcagaauua

SEQ ID NO: 1305162 - RNA, 19 nt, Homo sapiens
gcaaguugaugaccagaaa

SEQ ID NO: 1305163 - RNA, 19 nt, Homo sapiens
ggugauauauaccauguaa

SEQ ID NO: 1305164 - RNA, 19 nt, Homo sapiens
ucaagaaccuaaagaagaa

SEQ ID NO: 1305165 - RNA, 19 nt, Homo sapiens
caagguggcugucuauguu

SEQ ID NO: 1305166 - RNA, 19 nt, Homo sapiens
gaaauaaaccaaucaccaa

SEQ ID NO: 1305167 - RNA, 19 nt, Homo sapiens
gguaauagcuagcacagau

SEQ ID NO: 1305168 - RNA, 19 nt, Homo sapiens
caagugaaguacccaauga

SEQ ID NO: 1305169 - RNA, 19 nt, Homo sapiens
gcacagauguugacaagac

SEQ ID NO: 1305170 - RNA, 19 nt, Homo sapiens
caaauugcaugaagaggaa

SEQ ID NO: 1305171 - RNA, 19 nt, Homo sapiens
gcagaauuauggcagguuu

SEQ ID NO: 1305172 - RNA, 19 nt, Homo sapiens
uuacaaugcuguggaauaa

SEQ ID NO: 1305173 - RNA, 19 nt, Homo sapiens
gaaaagagauacgugaauu

SEQ ID NO: 1305174 - RNA, 19 nt, Homo sapiens
gcuggaagauuuggaauug

SEQ ID NO: 1305175 - RNA, 19 nt, Homo sapiens
ugacaagaguccagauuug

SEQ ID NO: 1305176 - RNA, 19 nt, Homo sapiens
gcucccagguuacggguua

SEQ ID NO: 1305177 - RNA, 19 nt, Homo sapiens
agaagaaacugaaagcaau

SEQ ID NO: 1305178 - RNA, 19 nt, Homo sapiens
gaacaagcagcaacuggaa

SEQ ID NO: 1305179 - RNA, 19 nt, Homo sapiens
ccacagagcacaccacgaa

SEQ ID NO: 1305180 - RNA, 19 nt, Homo sapiens
gaacaaacucuacacuaca

SEQ ID NO: 1305181 - RNA, 19 nt, Homo sapiens
gagaacaaacucuacacua

SEQ ID NO: 1305182 - RNA, 19 nt, Homo sapiens
gaccagaaaucagugcaaa

SEQ ID NO: 1305183 - RNA, 19 nt, Homo sapiens
aaaggaagcaugaagcuaa

SEQ ID NO: 1305184 - RNA, 19 nt, Homo sapiens
ggaauucuaguucuacuga

SEQ ID NO: 1305185 - RNA, 19 nt, Homo sapiens
gauuuggaauuggguauuu

SEQ ID NO: 1305186 - RNA, 19 nt, Homo sapiens
ggaaccaccucagaauaug

SEQ ID NO: 1305187 - RNA, 19 nt, Homo sapiens
cuaaaccgguggcuucuga

SEQ ID NO: 1305188 - RNA, 19 nt, Homo sapiens
gauguaguuuggaauucua

SEQ ID NO: 1305189 - RNA, 19 nt, Homo sapiens
agaaagugcuguagugcaa

SEQ ID NO: 1305190 - RNA, 19 nt, Homo sapiens
gaauaugaaaccacaauca

SEQ ID NO: 1305191 - RNA, 19 nt, Homo sapiens
uacaugugcucccagguua

SEQ ID NO: 1305192 - RNA, 19 nt, Homo sapiens
aguauuagcuggauuugga

SEQ ID NO: 1305193 - RNA, 19 nt, Homo sapiens
uaucuugcauccuauauca

SEQ ID NO: 1305194 - RNA, 19 nt, Homo sapiens
aacaauaacuuaccaagca

SEQ ID NO: 1305195 - RNA, 19 nt, Homo sapiens
gagcauauuuuaacagcua

SEQ ID NO: 1305196 - RNA, 19 nt, Homo sapiens
ggugcaccuucauuuguua

SEQ ID NO: 1305197 - RNA, 19 nt, Homo sapiens
uacccaaccuacaacuuua

SEQ ID NO: 1305198 - RNA, 19 nt, Homo sapiens
gggaagaauugcaaagucu

SEQ ID NO: 1305199 - RNA, 19 nt, Homo sapiens
cauacaagguggcugucua

SEQ ID NO: 1305200 - RNA, 19 nt, Homo sapiens
cauccuauaucaugucaau

SEQ ID NO: 1305201 - RNA, 19 nt, Homo sapiens
ggaagugugggaugugaaa

SEQ ID NO: 1305202 - RNA, 19 nt, Homo sapiens
ccaagcaguuccaagugaa

SEQ ID NO: 1305203 - RNA, 19 nt, Homo sapiens
agaacaaacucuacacuac

SEQ ID NO: 1305204 - RNA, 19 nt, Homo sapiens
gcagauaaaguuacaaugc

SEQ ID NO: 1305205 - RNA, 19 nt, Homo sapiens
agaaaucagugcaaacaca

SEQ ID NO: 1305206 - RNA, 19 nt, Homo sapiens
uagcacagauguugacaag

SEQ ID NO: 1305207 - RNA, 19 nt, Homo sapiens
ccaagauucuacuaagugu

SEQ ID NO: 1305208 - RNA, 19 nt, Homo sapiens
ucgaacaacugaaagaaca

SEQ ID NO: 1305209 - RNA, 19 nt, Homo sapiens
gaaacugaaagcaaucgaa

SEQ ID NO: 1305210 - RNA, 19 nt, Homo sapiens
aggaaacgauaagccauua

SEQ ID NO: 1305211 - RNA, 19 nt, Homo sapiens
cagaaggacuguacauggu

SEQ ID NO: 1305212 - RNA, 19 nt, Homo sapiens
gaaccaccucagaauauga

SEQ ID NO: 1305213 - RNA, 19 nt, Homo sapiens
uaaggcagauaaaguuaca

SEQ ID NO: 1305214 - RNA, 19 nt, Homo sapiens
caacuuugcuggaccucau

SEQ ID NO: 1305215 - RNA, 19 nt, Homo sapiens
gaaagcaaucgaacaacug

SEQ ID NO: 1305216 - RNA, 19 nt, Homo sapiens
ccacgccgcucuugacagu

SEQ ID NO: 1305217 - RNA, 19 nt, Homo sapiens
guaaugcagccuacuauag

SEQ ID NO: 1305218 - RNA, 19 nt, Homo sapiens
cuugaaaugugauccugua

SEQ ID NO: 1305219 - RNA, 19 nt, Homo sapiens
gggaaucugggaagaauug

SEQ ID NO: 1305220 - RNA, 19 nt, Homo sapiens
guuacaaugcuguggaaua

SEQ ID NO: 1305221 - RNA, 19 nt, Homo sapiens
gaaagaacaagcagcaacu

SEQ ID NO: 1305222 - RNA, 19 nt, Homo sapiens
auaaaccaaucaccaauuc

SEQ ID NO: 1305223 - RNA, 19 nt, Homo sapiens
ugaaguacccaaugaggaa

SEQ ID NO: 1305224 - RNA, 19 nt, Homo sapiens
ggaacugguccucguaaug

SEQ ID NO: 1305225 - RNA, 19 nt, Homo sapiens
aaagugcuguagugcaauu

SEQ ID NO: 1305226 - RNA, 19 nt, Homo sapiens
uacacuacauugcaacaaa

SEQ ID NO: 1305227 - RNA, 19 nt, Homo sapiens
ggagaaaauucagaaagaa

SEQ ID NO: 1305228 - RNA, 19 nt, Homo sapiens
ugaaagcaaucgaacaacu

SEQ ID NO: 1305229 - RNA, 19 nt, Homo sapiens
gaacugguccucguaaugc

SEQ ID NO: 1305230 - RNA, 19 nt, Homo sapiens
gaagcaugaagcuaagaaa

SEQ ID NO: 1305231 - RNA, 19 nt, Homo sapiens
ggaagcaugaagcuaagaa

SEQ ID NO: 1305232 - RNA, 19 nt, Homo sapiens
caucaaaugcagaauuaug

SEQ ID NO: 1305233 - RNA, 19 nt, Homo sapiens
ccagguuacggguuaauaa

SEQ ID NO: 1305234 - RNA, 19 nt, Homo sapiens
gauccuguauuugacuuug

SEQ ID NO: 1305235 - RNA, 19 nt, Homo sapiens
aaugugauccuguauuuga

SEQ ID NO: 1305236 - RNA, 19 nt, Homo sapiens
uguagagggugauauauac

SEQ ID NO: 1305237 - RNA, 19 nt, Homo sapiens
gaagaaacugaaagcaauc

SEQ ID NO: 1305238 - RNA, 19 nt, Homo sapiens
gaagcaagaagugacaaga

SEQ ID NO: 1305239 - RNA, 19 nt, Homo sapiens
gguuacggguuaauaaugg

SEQ ID NO: 1305240 - RNA, 19 nt, Homo sapiens
caccuucauuuguuagauu

SEQ ID NO: 1305241 - RNA, 19 nt, Homo sapiens
gaaaucagugcaaacacau

SEQ ID NO: 1305242 - RNA, 19 nt, Homo sapiens
gaagaauugcaaagucugu

SEQ ID NO: 1305243 - RNA, 19 nt, Homo sapiens
gcauuauacuggcucuauc

SEQ ID NO: 1305244 - RNA, 19 nt, Homo sapiens
uggagaaagugcuguagug

SEQ ID NO: 1305245 - RNA, 19 nt, Homo sapiens
uauccaagauucuacuaag

SEQ ID NO: 1305246 - RNA, 19 nt, Homo sapiens
ccaagggaaucugggaaga

SEQ ID NO: 1305247 - RNA, 19 nt, Homo sapiens
gugacaagaguccagauuu

SEQ ID NO: 1305248 - RNA, 19 nt, Homo sapiens
ugaggaaccuaaaguugca

SEQ ID NO: 1305249 - RNA, 19 nt, Homo sapiens
gacuguacauggugaaugg

SEQ ID NO: 1305250 - RNA, 19 nt, Homo sapiens
ccacaaucaggaaacgaua

SEQ ID NO: 1305251 - RNA, 19 nt, Homo sapiens
caaugaggaaccuaaaguu

SEQ ID NO: 1305252 - RNA, 19 nt, Homo sapiens
acacuacauugcaacaaau

SEQ ID NO: 1305253 - RNA, 19 nt, Homo sapiens
cagauaaaguuacaaugcu

SEQ ID NO: 1305254 - RNA, 19 nt, Homo sapiens
uacaguacuucuaaagaug

SEQ ID NO: 1305255 - RNA, 19 nt, Homo sapiens
caaaggaagcaugaagcua

SEQ ID NO: 1305256 - RNA, 19 nt, Homo sapiens
guauuugacuuuggaacug

SEQ ID NO: 1305257 - RNA, 19 nt, Homo sapiens
caaacucuacacuacauug

SEQ ID NO: 1305258 - RNA, 19 nt, Homo sapiens
gcacaccacgaaacacugu

SEQ ID NO: 1305259 - RNA, 19 nt, Homo sapiens
ggaauuagccaauacacua

SEQ ID NO: 1305260 - RNA, 19 nt, Homo sapiens
aaacucacaugcugaauuu

SEQ ID NO: 1305261 - RNA, 19 nt, Homo sapiens
caaagauacucaacucaaa

SEQ ID NO: 1305262 - RNA, 19 nt, Homo sapiens
gaauaacccugaucuuuac

SEQ ID NO: 1305263 - RNA, 19 nt, Homo sapiens
uacaagauguggugaauuu

SEQ ID NO: 1305264 - RNA, 19 nt, Homo sapiens
gaaaugaacccugccauau

SEQ ID NO: 1305265 - RNA, 19 nt, Homo sapiens
agaauaacccugaucuuua

SEQ ID NO: 1305266 - RNA, 19 nt, Homo sapiens
aaugaacccugccauauaa

SEQ ID NO: 1305267 - RNA, 19 nt, Homo sapiens
gaagcuaauuuggaaguuu

SEQ ID NO: 1305268 - RNA, 19 nt, Homo sapiens
uaaaggaguugcuaaaucu

SEQ ID NO: 1305269 - RNA, 19 nt, Homo sapiens
gagauaaugucagcaguga

SEQ ID NO: 1305270 - RNA, 19 nt, Homo sapiens
caacuugacugacccuaug

SEQ ID NO: 1305271 - RNA, 19 nt, Homo sapiens
gaacugcauuuccuaccaa

SEQ ID NO: 1305272 - RNA, 19 nt, Homo sapiens
uaacccugaucuuuacuua

SEQ ID NO: 1305273 - RNA, 19 nt, Homo sapiens
gaaacucacaugcugaauu

SEQ ID NO: 1305274 - RNA, 19 nt, Homo sapiens
ugaagucaauuccuaguga

SEQ ID NO: 1305275 - RNA, 19 nt, Homo sapiens
ccacuggaauuagccaaua

SEQ ID NO: 1305276 - RNA, 19 nt, Homo sapiens
gaagucaauuccuagugaa

SEQ ID NO: 1305277 - RNA, 19 nt, Homo sapiens
guauaugucuuccacuuuc

SEQ ID NO: 1305278 - RNA, 19 nt, Homo sapiens
ugauugacuuggaucuuua

SEQ ID NO: 1305279 - RNA, 19 nt, Homo sapiens
ggagaaugcggacuugauu

SEQ ID NO: 1305280 - RNA, 19 nt, Homo sapiens
agggagagcugucgagauu

SEQ ID NO: 1305281 - RNA, 19 nt, Homo sapiens
aaaugaacccugccauaua

SEQ ID NO: 1305282 - RNA, 19 nt, Homo sapiens
augagucgcuucaaguuua

SEQ ID NO: 1305283 - RNA, 19 nt, Homo sapiens
gauaaugucagcagugaga

SEQ ID NO: 1305284 - RNA, 19 nt, Homo sapiens
aaauagagaucggugugua

SEQ ID NO: 1305285 - RNA, 19 nt, Homo sapiens
ggagagcugucgagauugg

SEQ ID NO: 1305286 - RNA, 19 nt, Homo sapiens
uuaaaggaguugcuaaauc

SEQ ID NO: 1305287 - RNA, 19 nt, Homo sapiens
ccugauaguuucaauaaag

SEQ ID NO: 1305288 - RNA, 19 nt, Homo sapiens
gaaaucuacaagacaguaa

SEQ ID NO: 1305289 - RNA, 19 nt, Homo sapiens
ggaaaucuacaagacagua

SEQ ID NO: 1305290 - RNA, 19 nt, Homo sapiens
gacccuauguucagaggaa

SEQ ID NO: 1305291 - RNA, 19 nt, Homo sapiens
ggaaaguuguggcaauagg

SEQ ID NO: 1305292 - RNA, 19 nt, Homo sapiens
caagauguggugaauuuga

SEQ ID NO: 1305293 - RNA, 19 nt, Homo sapiens
gccaauacacuauauaaca

SEQ ID NO: 1305294 - RNA, 19 nt, Homo sapiens
ccaaagauacucaacucaa

SEQ ID NO: 1305295 - RNA, 19 nt, Homo sapiens
gagaaugcggacuugauuu

SEQ ID NO: 1305296 - RNA, 19 nt, Homo sapiens
gaacccugccauauaauuc

SEQ ID NO: 1305297 - RNA, 19 nt, Homo sapiens
gcuucaaguuuaucgauau

SEQ ID NO: 1305298 - RNA, 19 nt, Homo sapiens
gaauuagccaauacacuau

SEQ ID NO: 1305299 - RNA, 19 nt, Homo sapiens
agaaaugaacccugccaua

SEQ ID NO: 1305300 - RNA, 19 nt, Homo sapiens
gcacaaacaaaugguaugu

SEQ ID NO: 1305301 - RNA, 19 nt, Homo sapiens
guacacaugcuggaucaaa

SEQ ID NO: 1305302 - RNA, 19 nt, Homo sapiens
aaacugaagcuaauuugga

SEQ ID NO: 1305303 - RNA, 19 nt, Homo sapiens
uauaagaacugcauuuccu

SEQ ID NO: 1305304 - RNA, 19 nt, Homo sapiens
gaaaguuguggcaauagga

SEQ ID NO: 1305305 - RNA, 19 nt, Homo sapiens
uuuaaugguugcucacuga

SEQ ID NO: 1305306 - RNA, 19 nt, Homo sapiens
cuacaagacaguaaagaug

SEQ ID NO: 1305307 - RNA, 19 nt, Homo sapiens
gguauaugucuuccacuuu

SEQ ID NO: 1305308 - RNA, 19 nt, Homo sapiens
gugcauucauuugauggua

SEQ ID NO: 1305309 - RNA, 19 nt, Homo sapiens
agggaaaguuguggcaaua

SEQ ID NO: 1305310 - RNA, 19 nt, Homo sapiens
ggaguggugcauucauuug

SEQ ID NO: 1305311 - RNA, 19 nt, Homo sapiens
uugauugacuuggaucuuu

SEQ ID NO: 1305312 - RNA, 19 nt, Homo sapiens
gggaguggugcauucauuu

SEQ ID NO: 1305313 - RNA, 19 nt, Homo sapiens
aagauguggugaauuugaa

SEQ ID NO: 1305314 - RNA, 19 nt, Homo sapiens
gaaauagagaucggugugu

SEQ ID NO: 1305315 - RNA, 19 nt, Homo sapiens
ccuggaauauaauugguau

SEQ ID NO: 1305316 - RNA, 19 nt, Homo sapiens
ucaaguuuaucgauauugg

SEQ ID NO: 1305317 - RNA, 19 nt, Homo sapiens
gaacugucagaacaaacaa

SEQ ID NO: 1305318 - RNA, 19 nt, Homo sapiens
aacugaagcuaauuuggaa

SEQ ID NO: 1305319 - RNA, 19 nt, Homo sapiens
caauaaagggaaaguugug

SEQ ID NO: 1305320 - RNA, 19 nt, Homo sapiens
ugucgagauugguguuaaa

SEQ ID NO: 1305321 - RNA, 19 nt, Homo sapiens
guugcuaaaucuugcugaa

SEQ ID NO: 1305322 - RNA, 19 nt, Homo sapiens
ugucagcagugagagauga

SEQ ID NO: 1305323 - RNA, 19 nt, Homo sapiens
cagcugcuuugauugacuu

SEQ ID NO: 1305324 - RNA, 19 nt, Homo sapiens
gaguggugcauucauuuga

SEQ ID NO: 1305325 - RNA, 19 nt, Homo sapiens
caugcuggaucaaaauaua

SEQ ID NO: 1305326 - RNA, 19 nt, Homo sapiens
ccuacaagauguggugaau

SEQ ID NO: 1305327 - RNA, 19 nt, Homo sapiens
caugagucgcuucaaguuu

SEQ ID NO: 1305328 - RNA, 19 nt, Homo sapiens
gaaaacugaagcuaauuug

SEQ ID NO: 1305329 - RNA, 19 nt, Homo sapiens
ugguauaugucuuccacuu

SEQ ID NO: 1305330 - RNA, 19 nt, Homo sapiens
aacaauaaagggaaaguug

SEQ ID NO: 1305331 - RNA, 19 nt, Homo sapiens
ugagucgcuucaaguuuau

SEQ ID NO: 1305332 - RNA, 19 nt, Homo sapiens
ucaguacaguuggauguca

SEQ ID NO: 1305333 - RNA, 19 nt, Homo sapiens
ugaacccugccauauaauu

SEQ ID NO: 1305334 - RNA, 19 nt, Homo sapiens
ugaagcuaauuuggaaguu

SEQ ID NO: 1305335 - RNA, 19 nt, Homo sapiens
guggugcauucauuugaug

SEQ ID NO: 1305336 - RNA, 19 nt, Homo sapiens
aagggaaaguuguggcaau

SEQ ID NO: 1305337 - RNA, 19 nt, Homo sapiens
cacuuuccaucauguaugu

SEQ ID NO: 1305338 - RNA, 19 nt, Homo sapiens
aagaugacuuacaggaugu

SEQ ID NO: 1305339 - RNA, 19 nt, Homo sapiens
cgcuucaaguuuaucgaua

SEQ ID NO: 1305340 - RNA, 19 nt, Homo sapiens
ucccaaagauacucaacuc

SEQ ID NO: 1305341 - RNA, 19 nt, Homo sapiens
uaguaaaacuuccugauag

SEQ ID NO: 1305342 - RNA, 19 nt, Homo sapiens
aaguacacaugcuggauca

SEQ ID NO: 1305343 - RNA, 19 nt, Homo sapiens
gcagcugcuuugauugacu

SEQ ID NO: 1305344 - RNA, 19 nt, Homo sapiens
gcagucaugagucgcuuca

SEQ ID NO: 1305345 - RNA, 19 nt, Homo sapiens
acaagacaguaaagaugca

SEQ ID NO: 1305346 - RNA, 19 nt, Homo sapiens
ucaugagucgcuucaaguu

SEQ ID NO: 1305347 - RNA, 19 nt, Homo sapiens
ccacuuuccaucauguaug

SEQ ID NO: 1305348 - RNA, 19 nt, Homo sapiens
agucaugagucgcuucaag

SEQ ID NO: 1305349 - RNA, 19 nt, Homo sapiens
ucaagaugacuuacaggau

SEQ ID NO: 1305350 - RNA, 19 nt, Homo sapiens
ggggaguggugcauucauu

SEQ ID NO: 1305351 - RNA, 19 nt, Homo sapiens
gguggaaaucuacaagaca

SEQ ID NO: 1305352 - RNA, 19 nt, Homo sapiens
guggugaauuugaaaagaa

SEQ ID NO: 1305353 - RNA, 19 nt, Homo sapiens
gggcacugcuuaaaagaca

SEQ ID NO: 1305354 - RNA, 19 nt, Homo sapiens
agaacugcauuuccuacca

SEQ ID NO: 1305355 - RNA, 19 nt, Homo sapiens
uaaugguugcucacugaaa

SEQ ID NO: 1305356 - RNA, 19 nt, Homo sapiens
cugcuuugauugacuugga

SEQ ID NO: 1305357 - RNA, 19 nt, Homo sapiens
guucagaggaauuuauagg

SEQ ID NO: 1305358 - RNA, 19 nt, Homo sapiens
ccuauguucagaggaauuu

SEQ ID NO: 1305359 - RNA, 19 nt, Homo sapiens
caacauaacuuguaaggau

SEQ ID NO: 1305360 - RNA, 19 nt, Homo sapiens
gaacuggccucuauccuau

SEQ ID NO: 1305361 - RNA, 19 nt, Homo sapiens
ggaaguaguuacauuauag

SEQ ID NO: 1305362 - RNA, 19 nt, Homo sapiens
guaaauggcuauuccuaca

SEQ ID NO: 1305363 - RNA, 19 nt, Homo sapiens
gauggaaguaguuacauua

SEQ ID NO: 1305364 - RNA, 19 nt, Homo sapiens
gcccauaucuugccgaaau

SEQ ID NO: 1305365 - RNA, 19 nt, Homo sapiens
gagccuaauugauuucauu

SEQ ID NO: 1305366 - RNA, 19 nt, Homo sapiens
gcagucgcauugucucuuu

SEQ ID NO: 1305367 - RNA, 19 nt, Homo sapiens
gaaccagacuuacaagacu

SEQ ID NO: 1305368 - RNA, 19 nt, Homo sapiens
agacggaacuggccucuau

SEQ ID NO: 1305369 - RNA, 19 nt, Homo sapiens
gauuugagccuccuugauu

SEQ ID NO: 1305370 - RNA, 19 nt, Homo sapiens
ggaacuggccucuauccua

SEQ ID NO: 1305371 - RNA, 19 nt, Homo sapiens
cuccagcacucaaagauua

SEQ ID NO: 1305372 - RNA, 19 nt, Homo sapiens
cagcucauguuuccuguuu

SEQ ID NO: 1305373 - RNA, 19 nt, Homo sapiens
caaaguggcagucgcauug

SEQ ID NO: 1305374 - RNA, 19 nt, Homo sapiens
gcacccaacauaacuugua

SEQ ID NO: 1305375 - RNA, 19 nt, Homo sapiens
ugaaagcuguauaauagug

SEQ ID NO: 1305376 - RNA, 19 nt, Homo sapiens
cuuacaagacugaguauua

SEQ ID NO: 1305377 - RNA, 19 nt, Homo sapiens
uaaaugacgcuacgcaaga

SEQ ID NO: 1305378 - RNA, 19 nt, Homo sapiens
uuaagaaccucgcccuguu

SEQ ID NO: 1305379 - RNA, 19 nt, Homo sapiens
gcagauuguuggaccuuca

SEQ ID NO: 1305380 - RNA, 19 nt, Homo sapiens
acucaaagauuaaccuuag

SEQ ID NO: 1305381 - RNA, 19 nt, Homo sapiens
gggacuggguacaugcaua

SEQ ID NO: 1305382 - RNA, 19 nt, Homo sapiens
guugggagcagaucgauuu

SEQ ID NO: 1305383 - RNA, 19 nt, Homo sapiens
aaauggcuauuccuacaaa

SEQ ID NO: 1305384 - RNA, 19 nt, Homo sapiens
gaacuucuaguguauggau

SEQ ID NO: 1305385 - RNA, 19 nt, Homo sapiens
ggaaguggcgagaaagugu

SEQ ID NO: 1305386 - RNA, 19 nt, Homo sapiens
cuacacagcucauguuucc

SEQ ID NO: 1305387 - RNA, 19 nt, Homo sapiens
aagcggaaguggcgagaaa

SEQ ID NO: 1305388 - RNA, 19 nt, Homo sapiens
cacccaacauaacuuguaa

SEQ ID NO: 1305389 - RNA, 19 nt, Homo sapiens
ggacuggguacaugcauau

SEQ ID NO: 1305390 - RNA, 19 nt, Homo sapiens
ggauuccaguggcaaugaa

SEQ ID NO: 1305391 - RNA, 19 nt, Homo sapiens
agacuuacaagacugagua

SEQ ID NO: 1305392 - RNA, 19 nt, Homo sapiens
uuacaagacugaguauuac

SEQ ID NO: 1305393 - RNA, 19 nt, Homo sapiens
ccucaaagugggacaauau

SEQ ID NO: 1305394 - RNA, 19 nt, Homo sapiens
agauggaaguaguuacauu

SEQ ID NO: 1305395 - RNA, 19 nt, Homo sapiens
gaaauguaaauggcuauuc

SEQ ID NO: 1305396 - RNA, 19 nt, Homo sapiens
aaacuacacagcucauguu

SEQ ID NO: 1305397 - RNA, 19 nt, Homo sapiens
aaaugacgcuacgcaagaa

SEQ ID NO: 1305398 - RNA, 19 nt, Homo sapiens
gaaagcuguauaauagugu

SEQ ID NO: 1305399 - RNA, 19 nt, Homo sapiens
cuucuaguguauggauuua

SEQ ID NO: 1305400 - RNA, 19 nt, Homo sapiens
caaacuacacagcucaugu

SEQ ID NO: 1305401 - RNA, 19 nt, Homo sapiens
ggaaccagacuuacaagac

SEQ ID NO: 1305402 - RNA, 19 nt, Homo sapiens
ccuaugcgaggucccuuua

SEQ ID NO: 1305403 - RNA, 19 nt, Homo sapiens
cagaagaacacgcgaagag

SEQ ID NO: 1305404 - RNA, 19 nt, Homo sapiens
gggcuucugucucuaugag

SEQ ID NO: 1305405 - RNA, 19 nt, Homo sapiens
uaagaaccucgcccuguug

SEQ ID NO: 1305406 - RNA, 19 nt, Homo sapiens
gcacucaaagauuaaccuu

SEQ ID NO: 1305407 - RNA, 19 nt, Homo sapiens
uugggagccuaauugauuu

SEQ ID NO: 1305408 - RNA, 19 nt, Homo sapiens
gauagcuuauuacucugau

SEQ ID NO: 1305409 - RNA, 19 nt, Homo sapiens
agauuaaccuuagcuccuu

SEQ ID NO: 1305410 - RNA, 19 nt, Homo sapiens
uauggaaccagacuuacaa

SEQ ID NO: 1305411 - RNA, 19 nt, Homo sapiens
uacuauggaaccagacuua

SEQ ID NO: 1305412 - RNA, 19 nt, Homo sapiens
gcuacgcaagaaccaguua

SEQ ID NO: 1305413 - RNA, 19 nt, Homo sapiens
auugggagccuaauugauu

SEQ ID NO: 1305414 - RNA, 19 nt, Homo sapiens
uaaauggcuauuccuacaa

SEQ ID NO: 1305415 - RNA, 19 nt, Homo sapiens
uaugcgaggucccuuuaag

SEQ ID NO: 1305416 - RNA, 19 nt, Homo sapiens
uuaaaagggucucccaaug

SEQ ID NO: 1305417 - RNA, 19 nt, Homo sapiens
uguuggaccuucagaugga

SEQ ID NO: 1305418 - RNA, 19 nt, Homo sapiens
ucagauggaaguaguuaca

SEQ ID NO: 1305419 - RNA, 19 nt, Homo sapiens
auuugagccuccuugauuu

SEQ ID NO: 1305420 - RNA, 19 nt, Homo sapiens
aaauguaaauggcuauucc

SEQ ID NO: 1305421 - RNA, 19 nt, Homo sapiens
gcagaagaacacgcgaaga

SEQ ID NO: 1305422 - RNA, 19 nt, Homo sapiens
aaaagggucucccaaugug

SEQ ID NO: 1305423 - RNA, 19 nt, Homo sapiens
acucugauacucuuuaauc

SEQ ID NO: 1305424 - RNA, 19 nt, Homo sapiens
gggcucacgggcagaagaa

SEQ ID NO: 1305425 - RNA, 19 nt, Homo sapiens
guuaaaguuuugcacugua

SEQ ID NO: 1305426 - RNA, 19 nt, Homo sapiens
gcucauguuuccuguuuuc

SEQ ID NO: 1305427 - RNA, 19 nt, Homo sapiens
gcaccugauugccuaaacc

SEQ ID NO: 1305428 - RNA, 19 nt, Homo sapiens
gaagcaccugauugccuaa

SEQ ID NO: 1305429 - RNA, 19 nt, Homo sapiens
cagcacccaacauaacuug

SEQ ID NO: 1305430 - RNA, 19 nt, Homo sapiens
gagagauagcuuauuacuc

SEQ ID NO: 1305431 - RNA, 19 nt, Homo sapiens
uaucuugccgaaauguaaa

SEQ ID NO: 1305432 - RNA, 19 nt, Homo sapiens
ucgagggacuggguacaug

SEQ ID NO: 1305433 - RNA, 19 nt, Homo sapiens
uaaaagggucucccaaugu

SEQ ID NO: 1305434 - RNA, 19 nt, Homo sapiens
ugagagauagcuuauuacu

SEQ ID NO: 1305435 - RNA, 19 nt, Homo sapiens
uaccuuggauacccugcuu

SEQ ID NO: 1305436 - RNA, 19 nt, Homo sapiens
gggagcagaucgauuuuac

SEQ ID NO: 1305437 - RNA, 19 nt, Homo sapiens
agaagaacacgcgaagaga

SEQ ID NO: 1305438 - RNA, 19 nt, Homo sapiens
cauaucuugccgaaaugua

SEQ ID NO: 1305439 - RNA, 19 nt, Homo sapiens
gcuuauuacucugauacuc

SEQ ID NO: 1305440 - RNA, 19 nt, Homo sapiens
cgaaauguaaauggcuauu

SEQ ID NO: 1305441 - RNA, 19 nt, Homo sapiens
ugcgaggucccuuuaagaa

SEQ ID NO: 1305442 - RNA, 19 nt, Homo sapiens
aagugucggucuccaagau

SEQ ID NO: 1305443 - RNA, 19 nt, Homo sapiens
ggaaagacaagaagaaaua

SEQ ID NO: 1305444 - RNA, 19 nt, Homo sapiens
ggacgaagcucgcaagaag

SEQ ID NO: 1305445 - RNA, 19 nt, Homo sapiens
gcaaggaccucaucuacca

SEQ ID NO: 1305446 - RNA, 19 nt, Homo sapiens
ggaaggcagucccagauga

SEQ ID NO: 1305447 - RNA, 19 nt, Homo sapiens
gaaccuggcucugacaaga

SEQ ID NO: 1305448 - RNA, 19 nt, Homo sapiens
gacaaggacuucaacauca

SEQ ID NO: 1305449 - RNA, 19 nt, Homo sapiens
agauggagcucacggcuua

SEQ ID NO: 1305450 - RNA, 19 nt, Homo sapiens
ucaagaagaugcugcguau

SEQ ID NO: 1305451 - RNA, 19 nt, Homo sapiens
ggcaagauccauaaacuuu

SEQ ID NO: 1305452 - RNA, 19 nt, Homo sapiens
aaagaagccucaaaacaua

SEQ ID NO: 1305453 - RNA, 19 nt, Homo sapiens
aaccacugcuccaucauua

SEQ ID NO: 1305454 - RNA, 19 nt, Homo sapiens
ggaggaaagacaagaagaa

SEQ ID NO: 1305455 - RNA, 19 nt, Homo sapiens
gugacaaccuucuccuuga

SEQ ID NO: 1305456 - RNA, 19 nt, Homo sapiens
gaagaaauagaagcugauu

SEQ ID NO: 1305457 - RNA, 19 nt, Homo sapiens
ccaaaggacucucuaucca

SEQ ID NO: 1305458 - RNA, 19 nt, Homo sapiens
gaagcugauuuaacaccaa

SEQ ID NO: 1305459 - RNA, 19 nt, Homo sapiens
ggaugaggccaaagucaaa

SEQ ID NO: 1305460 - RNA, 19 nt, Homo sapiens
gaggaaagacaagaagaaa

SEQ ID NO: 1305461 - RNA, 19 nt, Homo sapiens
cauaugugcuucuuucagu

SEQ ID NO: 1305462 - RNA, 19 nt, Homo sapiens
gcuuuaaagugcuagaaau

SEQ ID NO: 1305463 - RNA, 19 nt, Homo sapiens
ggaugacaguggucgaaug

SEQ ID NO: 1305464 - RNA, 19 nt, Homo sapiens
uuaaaccacugcuccauca

SEQ ID NO: 1305465 - RNA, 19 nt, Homo sapiens
agucggagauccuggguuu

SEQ ID NO: 1305466 - RNA, 19 nt, Homo sapiens
ccagcaagccgucgacuau

SEQ ID NO: 1305467 - RNA, 19 nt, Homo sapiens
gaucaucgaccgcaagaag

SEQ ID NO: 1305468 - RNA, 19 nt, Homo sapiens
gagauucuggccauguuaa

SEQ ID NO: 1305469 - RNA, 19 nt, Homo sapiens
gcucugggcaagauccaua

SEQ ID NO: 1305470 - RNA, 19 nt, Homo sapiens
acaaggacuucaacaucaa

SEQ ID NO: 1305471 - RNA, 19 nt, Homo sapiens
ugacaaggacuucaacauc

SEQ ID NO: 1305472 - RNA, 19 nt, Homo sapiens
gaacuugguaacccacaug

SEQ ID NO: 1305473 - RNA, 19 nt, Homo sapiens
gaaagacaagaagaaauag

SEQ ID NO: 1305474 - RNA, 19 nt, Homo sapiens
gggcgaccuccucgaguua

SEQ ID NO: 1305475 - RNA, 19 nt, Homo sapiens
ccucaagugugacaaccuu

SEQ ID NO: 1305476 - RNA, 19 nt, Homo sapiens
acaucaagcuguccgacuu

SEQ ID NO: 1305477 - RNA, 19 nt, Homo sapiens
gcuccaucauuaagaccua

SEQ ID NO: 1305478 - RNA, 19 nt, Homo sapiens
cccaagcucugaagaaguc

SEQ ID NO: 1305479 - RNA, 19 nt, Homo sapiens
uaaagugcuagaaaucuug

SEQ ID NO: 1305480 - RNA, 19 nt, Homo sapiens
uaaagaagccucaaaacau

SEQ ID NO: 1305481 - RNA, 19 nt, Homo sapiens
ccaccuugggcaccauuua

SEQ ID NO: 1305482 - RNA, 19 nt, Homo sapiens
gcaggaagagcagcaggaa

SEQ ID NO: 1305483 - RNA, 19 nt, Homo sapiens
cgucgacuauggagacaga

SEQ ID NO: 1305484 - RNA, 19 nt, Homo sapiens
gggcaagauccauaaacuu

SEQ ID NO: 1305485 - RNA, 19 nt, Homo sapiens
cgagaucuuugagacauca

SEQ ID NO: 1305486 - RNA, 19 nt, Homo sapiens
aagcugauuuaacaccaaa

SEQ ID NO: 1305487 - RNA, 19 nt, Homo sapiens
gaaaaugggaggaaagaca

SEQ ID NO: 1305488 - RNA, 19 nt, Homo sapiens
gaaaucuugugccccauau

SEQ ID NO: 1305489 - RNA, 19 nt, Homo sapiens
uaaaaucugcuuacucuga

SEQ ID NO: 1305490 - RNA, 19 nt, Homo sapiens
ggauguaaaugagcacacu

SEQ ID NO: 1305491 - RNA, 19 nt, Homo sapiens
gagagggcuccuaugcaaa

SEQ ID NO: 1305492 - RNA, 19 nt, Homo sapiens
acucugagcgccugaaguu

SEQ ID NO: 1305493 - RNA, 19 nt, Homo sapiens
ugugcuucuuucaguauua

SEQ ID NO: 1305494 - RNA, 19 nt, Homo sapiens
ugacgcugcuguccucaag

SEQ ID NO: 1305495 - RNA, 19 nt, Homo sapiens
aaaccacugcuccaucauu

SEQ ID NO: 1305496 - RNA, 19 nt, Homo sapiens
uagcauggcaacuggagaa

SEQ ID NO: 1305497 - RNA, 19 nt, Homo sapiens
gugcuucuuucaguauuau

SEQ ID NO: 1305498 - RNA, 19 nt, Homo sapiens
cuagguggaugaggccaaa

SEQ ID NO: 1305499 - RNA, 19 nt, Homo sapiens
gcaagccgucgacuaugga

SEQ ID NO: 1305500 - RNA, 19 nt, Homo sapiens
ggaccucaucuaccacaug

SEQ ID NO: 1305501 - RNA, 19 nt, Homo sapiens
accgggaccucaaguguga

SEQ ID NO: 1305502 - RNA, 19 nt, Homo sapiens
gggcuccuaugcaaaagua

SEQ ID NO: 1305503 - RNA, 19 nt, Homo sapiens
cagaugagccucuauuuuc

SEQ ID NO: 1305504 - RNA, 19 nt, Homo sapiens
gaaggcagucccagaugag

SEQ ID NO: 1305505 - RNA, 19 nt, Homo sapiens
uacgacgacuccaacauca

SEQ ID NO: 1305506 - RNA, 19 nt, Homo sapiens
caagaaguuccaccagcuu

SEQ ID NO: 1305507 - RNA, 19 nt, Homo sapiens
gagaggaggcgggaaagag

SEQ ID NO: 1305508 - RNA, 19 nt, Homo sapiens
ggagaggaggcgggaaaga

SEQ ID NO: 1305509 - RNA, 19 nt, Homo sapiens
ccauuuauccuccuuucau

SEQ ID NO: 1305510 - RNA, 19 nt, Homo sapiens
caccauuuauccuccuuuc

SEQ ID NO: 1305511 - RNA, 19 nt, Homo sapiens
ggguggagccagagaagga

SEQ ID NO: 1305512 - RNA, 19 nt, Homo sapiens
acaagaagucugccaccaa

SEQ ID NO: 1305513 - RNA, 19 nt, Homo sapiens
gaugacaguggucgaaugg

SEQ ID NO: 1305514 - RNA, 19 nt, Homo sapiens
ugagauucuggccauguua

SEQ ID NO: 1305515 - RNA, 19 nt, Homo sapiens
gggaggaaagacaagaaga

SEQ ID NO: 1305516 - RNA, 19 nt, Homo sapiens
gcaagauccauaaacuuuu

SEQ ID NO: 1305517 - RNA, 19 nt, Homo sapiens
aggcaccgcuguccaccuu

SEQ ID NO: 1305518 - RNA, 19 nt, Homo sapiens
gugcaaggaccucaucuac

SEQ ID NO: 1305519 - RNA, 19 nt, Homo sapiens
ucauuaagaccuacgagau

SEQ ID NO: 1305520 - RNA, 19 nt, Homo sapiens
acuccaacaucaagaagau

SEQ ID NO: 1305521 - RNA, 19 nt, Homo sapiens
ccuaccagcccaaggugua

SEQ ID NO: 1305522 - RNA, 19 nt, Homo sapiens
ccacugcuccaucauuaag

SEQ ID NO: 1305523 - RNA, 19 nt, Homo sapiens
cagcuuuccuuggccauca

SEQ ID NO: 1305524 - RNA, 19 nt, Homo sapiens
caaggucuacaucgucaug

SEQ ID NO: 1305525 - RNA, 19 nt, Homo sapiens
ucaauguggcgaucaagau

SEQ ID NO: 1305526 - RNA, 19 nt, Homo sapiens
cauuuauccuccuuucauc

SEQ ID NO: 1305527 - RNA, 19 nt, Homo sapiens
gaaggagcaccgcgucaac

SEQ ID NO: 1305528 - RNA, 19 nt, Homo sapiens
uacgagaucuuugagacau

SEQ ID NO: 1305529 - RNA, 19 nt, Homo sapiens
auaugugcuucuuucagua

SEQ ID NO: 1305530 - RNA, 19 nt, Homo sapiens
gggcacagugagcuucuug

SEQ ID NO: 1305531 - RNA, 19 nt, Homo sapiens
gcccaaaggacucucuauc

SEQ ID NO: 1305532 - RNA, 19 nt, Homo sapiens
ggagcaccgcgucaacuuc

SEQ ID NO: 1305533 - RNA, 19 nt, Homo sapiens
cgacgacuccaacaucaag

SEQ ID NO: 1305534 - RNA, 19 nt, Homo sapiens
cuacgacgacuccaacauc

SEQ ID NO: 1305535 - RNA, 19 nt, Homo sapiens
agaccuacgagaucuuuga

SEQ ID NO: 1305536 - RNA, 19 nt, Homo sapiens
cauggcaacuggagaaaau

SEQ ID NO: 1305537 - RNA, 19 nt, Homo sapiens
cauuaagaccuacgagauc

SEQ ID NO: 1305538 - RNA, 19 nt, Homo sapiens
caucacauggcaaggucua

SEQ ID NO: 1305539 - RNA, 19 nt, Homo sapiens
gccuaggcgugauccucua

SEQ ID NO: 1305540 - RNA, 19 nt, Homo sapiens
ugacaaccuucuccuugac

SEQ ID NO: 1305541 - RNA, 19 nt, Homo sapiens
ccaccgggaccucaagugu

SEQ ID NO: 1305542 - RNA, 19 nt, Homo sapiens
gcgaccuccucgaguuaau

SEQ ID NO: 1305543 - RNA, 19 nt, Homo sapiens
ggaauuacauugugauuug

SEQ ID NO: 1305544 - RNA, 19 nt, Homo sapiens
gaacagaagaucauuaaga

SEQ ID NO: 1305545 - RNA, 19 nt, Homo sapiens
caagaaggaacacauauua

SEQ ID NO: 1305546 - RNA, 19 nt, Homo sapiens
gaagaacaguaaacaguga

SEQ ID NO: 1305547 - RNA, 19 nt, Homo sapiens
gaacaagaaggaacacaua

SEQ ID NO: 1305548 - RNA, 19 nt, Homo sapiens
gcacccacaugucuuaaug

SEQ ID NO: 1305549 - RNA, 19 nt, Homo sapiens
gcaugaaucuaccugaguu

SEQ ID NO: 1305550 - RNA, 19 nt, Homo sapiens
ggugcuugcugcugaaaua

SEQ ID NO: 1305551 - RNA, 19 nt, Homo sapiens
ugaaggagauauugucaga

SEQ ID NO: 1305552 - RNA, 19 nt, Homo sapiens
uuaguucccuguuguuuaa

SEQ ID NO: 1305553 - RNA, 19 nt, Homo sapiens
gaaauuggaaucuguucuu

SEQ ID NO: 1305554 - RNA, 19 nt, Homo sapiens
ccagagcgcuuaccaguac

SEQ ID NO: 1305555 - RNA, 19 nt, Homo sapiens
gaugggaauuacauuguga

SEQ ID NO: 1305556 - RNA, 19 nt, Homo sapiens
uaucauuggugucuccuaa

SEQ ID NO: 1305557 - RNA, 19 nt, Homo sapiens
gaaggaacacauauuauac

SEQ ID NO: 1305558 - RNA, 19 nt, Homo sapiens
gcagaccuuugggaauaua

SEQ ID NO: 1305559 - RNA, 19 nt, Homo sapiens
cagaacagaagaucauuaa

SEQ ID NO: 1305560 - RNA, 19 nt, Homo sapiens
guggugacauuguaucauu

SEQ ID NO: 1305561 - RNA, 19 nt, Homo sapiens
gaugcagccuucuuugaau

SEQ ID NO: 1305562 - RNA, 19 nt, Homo sapiens
augcagaccuuugggaaua

SEQ ID NO: 1305563 - RNA, 19 nt, Homo sapiens
ggacacaguuuugacagua

SEQ ID NO: 1305564 - RNA, 19 nt, Homo sapiens
ccagaacagaagaucauua

SEQ ID NO: 1305565 - RNA, 19 nt, Homo sapiens
uaagguagaacaagaagga

SEQ ID NO: 1305566 - RNA, 19 nt, Homo sapiens
gauauugucagaaccauag

SEQ ID NO: 1305567 - RNA, 19 nt, Homo sapiens
gcugugcgagaaauauuua

SEQ ID NO: 1305568 - RNA, 19 nt, Homo sapiens
ggucacaucuggguugaag

SEQ ID NO: 1305569 - RNA, 19 nt, Homo sapiens
gucacuugcuguuaaggua

SEQ ID NO: 1305570 - RNA, 19 nt, Homo sapiens
gcgcuuaccaguacagaga

SEQ ID NO: 1305571 - RNA, 19 nt, Homo sapiens
ggcagugacuuucuuggau

SEQ ID NO: 1305572 - RNA, 19 nt, Homo sapiens
ccaguuaggaagaacagua

SEQ ID NO: 1305573 - RNA, 19 nt, Homo sapiens
ggcauugggaggccaguua

SEQ ID NO: 1305574 - RNA, 19 nt, Homo sapiens
ggaaugacugcaugaaucu

SEQ ID NO: 1305575 - RNA, 19 nt, Homo sapiens
gcuugcugcugaaauaaau

SEQ ID NO: 1305576 - RNA, 19 nt, Homo sapiens
aacagaagaucauuaagag

SEQ ID NO: 1305577 - RNA, 19 nt, Homo sapiens
gggaauuacauugugauuu

SEQ ID NO: 1305578 - RNA, 19 nt, Homo sapiens
aggaaugacugcaugaauc

SEQ ID NO: 1305579 - RNA, 19 nt, Homo sapiens
uaccugaguugcuggcauu

SEQ ID NO: 1305580 - RNA, 19 nt, Homo sapiens
cgaugcagccuucuuugaa

SEQ ID NO: 1305581 - RNA, 19 nt, Homo sapiens
caucgaugcagccuucuuu

SEQ ID NO: 1305582 - RNA, 19 nt, Homo sapiens
acaagaaggaacacauauu

SEQ ID NO: 1305583 - RNA, 19 nt, Homo sapiens
gaggaaugacugcaugaau

SEQ ID NO: 1305584 - RNA, 19 nt, Homo sapiens
acuggaaagugaggaauuu

SEQ ID NO: 1305585 - RNA, 19 nt, Homo sapiens
acagagagaagaggaauga

SEQ ID NO: 1305586 - RNA, 19 nt, Homo sapiens
aaaccgguaugucaaaguc

SEQ ID NO: 1305587 - RNA, 19 nt, Homo sapiens
agugauugcucuugaagga

SEQ ID NO: 1305588 - RNA, 19 nt, Homo sapiens
gaacaguaaacagugaugu

SEQ ID NO: 1305589 - RNA, 19 nt, Homo sapiens
gaucaucauggacacaguu

SEQ ID NO: 1305590 - RNA, 19 nt, Homo sapiens
gcgucaggcuugaacaaca

SEQ ID NO: 1305591 - RNA, 19 nt, Homo sapiens
ggagauauugucagaacca

SEQ ID NO: 1305592 - RNA, 19 nt, Homo sapiens
ggcacaaaauaaccacuua

SEQ ID NO: 1305593 - RNA, 19 nt, Homo sapiens
aaggagauauugucagaac

SEQ ID NO: 1305594 - RNA, 19 nt, Homo sapiens
ggaaagugaggaauuuuga

SEQ ID NO: 1305595 - RNA, 19 nt, Homo sapiens
gggagagcgucaggcuuga

SEQ ID NO: 1305596 - RNA, 19 nt, Homo sapiens
gagcgucaggcuugaacaa

SEQ ID NO: 1305597 - RNA, 19 nt, Homo sapiens
cagccuaguccucuucuug

SEQ ID NO: 1305598 - RNA, 19 nt, Homo sapiens
caucaaggccuuuuguaaa

SEQ ID NO: 1305599 - RNA, 19 nt, Homo sapiens
ugaugggaauuacauugug

SEQ ID NO: 1305600 - RNA, 19 nt, Homo sapiens
gguagaacaagaaggaaca

SEQ ID NO: 1305601 - RNA, 19 nt, Homo sapiens
agaagaucauuaagagagu

SEQ ID NO: 1305602 - RNA, 19 nt, Homo sapiens
caguuaggaagaacaguaa

SEQ ID NO: 1305603 - RNA, 19 nt, Homo sapiens
guacagagagaagaggaau

SEQ ID NO: 1305604 - RNA, 19 nt, Homo sapiens
caucuggguugaaggugau

SEQ ID NO: 1305605 - RNA, 19 nt, Homo sapiens
aaauuggaaucuguucuuc

SEQ ID NO: 1305606 - RNA, 19 nt, Homo sapiens
gcucuugaaggagauauug

SEQ ID NO: 1305607 - RNA, 19 nt, Homo sapiens
uauuaaauggcaccugauu

SEQ ID NO: 1305608 - RNA, 19 nt, Homo sapiens
gaaugacugcaugaaucua

SEQ ID NO: 1305609 - RNA, 19 nt, Homo sapiens
gaaggagauauugucagaa

SEQ ID NO: 1305610 - RNA, 19 nt, Homo sapiens
ggcuugaacaacaugauuu

SEQ ID NO: 1305611 - RNA, 19 nt, Homo sapiens
cgaggaagagcgggagaaa

SEQ ID NO: 1305612 - RNA, 19 nt, Homo sapiens
cgucaggcuugaacaacau

SEQ ID NO: 1305613 - RNA, 19 nt, Homo sapiens
uuuaguucccuguuguuua

SEQ ID NO: 1305614 - RNA, 19 nt, Homo sapiens
ggaacacauauuauacaca

SEQ ID NO: 1305615 - RNA, 19 nt, Homo sapiens
aaaagaagccuccaaaagg

SEQ ID NO: 1305616 - RNA, 19 nt, Homo sapiens
guauuugucacuugcuguu

SEQ ID NO: 1305617 - RNA, 19 nt, Homo sapiens
aaauauugcacccacaugu

SEQ ID NO: 1305618 - RNA, 19 nt, Homo sapiens
gcuuaccaguacagagaga

SEQ ID NO: 1305619 - RNA, 19 nt, Homo sapiens
gagauauugucagaaccau

SEQ ID NO: 1305620 - RNA, 19 nt, Homo sapiens
aagggugggugaaaagaua

SEQ ID NO: 1305621 - RNA, 19 nt, Homo sapiens
auuugucacuugcuguuaa

SEQ ID NO: 1305622 - RNA, 19 nt, Homo sapiens
aggaagaacaguaaacagu

SEQ ID NO: 1305623 - RNA, 19 nt, Homo sapiens
caccugauuuuguguuaaa

SEQ ID NO: 1305624 - RNA, 19 nt, Homo sapiens
gaugcugugcgagaaauau

SEQ ID NO: 1305625 - RNA, 19 nt, Homo sapiens
gacacaguuuugacaguaa

SEQ ID NO: 1305626 - RNA, 19 nt, Homo sapiens
ucagaaccauaggacacaa

SEQ ID NO: 1305627 - RNA, 19 nt, Homo sapiens
ggagagcgucaggcuugaa

SEQ ID NO: 1305628 - RNA, 19 nt, Homo sapiens
gcaccugauuuuguguuaa

SEQ ID NO: 1305629 - RNA, 19 nt, Homo sapiens
uuaaagcacgugucugucu

SEQ ID NO: 1305630 - RNA, 19 nt, Homo sapiens
agugaggaauuuugaagua

SEQ ID NO: 1305631 - RNA, 19 nt, Homo sapiens
gaaagugaggaauuuugaa

SEQ ID NO: 1305632 - RNA, 19 nt, Homo sapiens
ggucgccuguguggcaaga

SEQ ID NO: 1305633 - RNA, 19 nt, Homo sapiens
gggcgagggcacaaaauaa

SEQ ID NO: 1305634 - RNA, 19 nt, Homo sapiens
aggaagagcgggagaaagg

SEQ ID NO: 1305635 - RNA, 19 nt, Homo sapiens
ucacaucuggguugaaggu

SEQ ID NO: 1305636 - RNA, 19 nt, Homo sapiens
ucauuggugucuccuaaaa

SEQ ID NO: 1305637 - RNA, 19 nt, Homo sapiens
ccaagaaagucaagcauua

SEQ ID NO: 1305638 - RNA, 19 nt, Homo sapiens
gaaagaugcuccaggauga

SEQ ID NO: 1305639 - RNA, 19 nt, Homo sapiens
ggagggagaugacaacuac

SEQ ID NO: 1305640 - RNA, 19 nt, Homo sapiens
gcagaagcauguccaauac

SEQ ID NO: 1305641 - RNA, 19 nt, Homo sapiens
gcacucagccucccauuca

SEQ ID NO: 1305642 - RNA, 19 nt, Homo sapiens
caggauagcucuugaugca

SEQ ID NO: 1305643 - RNA, 19 nt, Homo sapiens
guccaaaggugacaagaug

SEQ ID NO: 1305644 - RNA, 19 nt, Homo sapiens
ucaaagagcagaagcaugu

SEQ ID NO: 1305645 - RNA, 19 nt, Homo sapiens
caaagucagugcuguccuu

SEQ ID NO: 1305646 - RNA, 19 nt, Homo sapiens
ugacccaucuccuuccuuu

SEQ ID NO: 1305647 - RNA, 19 nt, Homo sapiens
gaaauccucccacaagcaa

SEQ ID NO: 1305648 - RNA, 19 nt, Homo sapiens
ggagaaggaccaagaucaa

SEQ ID NO: 1305649 - RNA, 19 nt, Homo sapiens
caagaacaguguaugaaac

SEQ ID NO: 1305650 - RNA, 19 nt, Homo sapiens
gcaugaaucugaccaucuc

SEQ ID NO: 1305651 - RNA, 19 nt, Homo sapiens
ccacagagaggcuuguuug

SEQ ID NO: 1305652 - RNA, 19 nt, Homo sapiens
aaaggagacuucaagaaca

SEQ ID NO: 1305653 - RNA, 19 nt, Homo sapiens
caaaggagacuucaagaac

SEQ ID NO: 1305654 - RNA, 19 nt, Homo sapiens
gaucuuguuucuggacuga

SEQ ID NO: 1305655 - RNA, 19 nt, Homo sapiens
gcaacaugcccagguuuaa

SEQ ID NO: 1305656 - RNA, 19 nt, Homo sapiens
agaagcauguccaauacaa

SEQ ID NO: 1305657 - RNA, 19 nt, Homo sapiens
gagaguccaccuucaaaga

SEQ ID NO: 1305658 - RNA, 19 nt, Homo sapiens
ucaagaacaguguaugaaa

SEQ ID NO: 1305659 - RNA, 19 nt, Homo sapiens
caaucaguguggaaaguga

SEQ ID NO: 1305660 - RNA, 19 nt, Homo sapiens
gagaaggaccaagaucaaa

SEQ ID NO: 1305661 - RNA, 19 nt, Homo sapiens
cagcaagacuacagcuuca

SEQ ID NO: 1305662 - RNA, 19 nt, Homo sapiens
gacaagaugacucaaagga

SEQ ID NO: 1305663 - RNA, 19 nt, Homo sapiens
gugacaagaugacucaaag

SEQ ID NO: 1305664 - RNA, 19 nt, Homo sapiens
gaacuccagcugcagaugu

SEQ ID NO: 1305665 - RNA, 19 nt, Homo sapiens
caugagauccuauggaaca

SEQ ID NO: 1305666 - RNA, 19 nt, Homo sapiens
ucaaaggagacuucaagaa

SEQ ID NO: 1305667 - RNA, 19 nt, Homo sapiens
caagaaagucaagcauuau

SEQ ID NO: 1305668 - RNA, 19 nt, Homo sapiens
cgagcaacaugcccagguu

SEQ ID NO: 1305669 - RNA, 19 nt, Homo sapiens
gggagaaggaccaagauca

SEQ ID NO: 1305670 - RNA, 19 nt, Homo sapiens
ggaaauccucccacaagca

SEQ ID NO: 1305671 - RNA, 19 nt, Homo sapiens
gugcuguccuuacccagaa

SEQ ID NO: 1305672 - RNA, 19 nt, Homo sapiens
gaugacacauuuucuggaa

SEQ ID NO: 1305673 - RNA, 19 nt, Homo sapiens
ccaccaaccaguauacuca

SEQ ID NO: 1305674 - RNA, 19 nt, Homo sapiens
uuaaggcaguaauugcauu

SEQ ID NO: 1305675 - RNA, 19 nt, Homo sapiens
ugacuacuguuagcacuca

SEQ ID NO: 1305676 - RNA, 19 nt, Homo sapiens
gagcaacaugcccagguuu

SEQ ID NO: 1305677 - RNA, 19 nt, Homo sapiens
agcagaagcauguccaaua

SEQ ID NO: 1305678 - RNA, 19 nt, Homo sapiens
ccagagaguccaccuucaa

SEQ ID NO: 1305679 - RNA, 19 nt, Homo sapiens
cccauucacauguauuaua

SEQ ID NO: 1305680 - RNA, 19 nt, Homo sapiens
gaaagucaagcauuaucca

SEQ ID NO: 1305681 - RNA, 19 nt, Homo sapiens
agugaagccuggagaacaa

SEQ ID NO: 1305682 - RNA, 19 nt, Homo sapiens
ggugacaagaugacucaaa

SEQ ID NO: 1305683 - RNA, 19 nt, Homo sapiens
gcuccaggaugacucucuu

SEQ ID NO: 1305684 - RNA, 19 nt, Homo sapiens
cagagaguccaccuucaaa

SEQ ID NO: 1305685 - RNA, 19 nt, Homo sapiens
guaccagccuugccuucuc

SEQ ID NO: 1305686 - RNA, 19 nt, Homo sapiens
gggaagagaagcugaugca

SEQ ID NO: 1305687 - RNA, 19 nt, Homo sapiens
gaaggaccaagaucaaagg

SEQ ID NO: 1305688 - RNA, 19 nt, Homo sapiens
caacuaccaaggcugauag

SEQ ID NO: 1305689 - RNA, 19 nt, Homo sapiens
gaggagcugucaccaucca

SEQ ID NO: 1305690 - RNA, 19 nt, Homo sapiens
gugaggcugucccaacugu

SEQ ID NO: 1305691 - RNA, 19 nt, Homo sapiens
agggucaccuuaauucaga

SEQ ID NO: 1305692 - RNA, 19 nt, Homo sapiens
gaaacuuuggccugggaaa

SEQ ID NO: 1305693 - RNA, 19 nt, Homo sapiens
ugaaauuuccauuccugaa

SEQ ID NO: 1305694 - RNA, 19 nt, Homo sapiens
caaccaguauacucaccau

SEQ ID NO: 1305695 - RNA, 19 nt, Homo sapiens
caacaugcccagguuuaag

SEQ ID NO: 1305696 - RNA, 19 nt, Homo sapiens
gcauguccaauacaacaga

SEQ ID NO: 1305697 - RNA, 19 nt, Homo sapiens
gaaccacccagaccuuagg

SEQ ID NO: 1305698 - RNA, 19 nt, Homo sapiens
ucaacaggcaccagaggaa

SEQ ID NO: 1305699 - RNA, 19 nt, Homo sapiens
gauggagaggccacaguga

SEQ ID NO: 1305700 - RNA, 19 nt, Homo sapiens
cacagacuuuccacagaga

SEQ ID NO: 1305701 - RNA, 19 nt, Homo sapiens
gcaugaaauuuccauuccu

SEQ ID NO: 1305702 - RNA, 19 nt, Homo sapiens
caugggagaaggaccaaga

SEQ ID NO: 1305703 - RNA, 19 nt, Homo sapiens
ggacagcaugggacacagu

SEQ ID NO: 1305704 - RNA, 19 nt, Homo sapiens
ggaaccacccagaccuuag

SEQ ID NO: 1305705 - RNA, 19 nt, Homo sapiens
cuucaagaacaguguauga

SEQ ID NO: 1305706 - RNA, 19 nt, Homo sapiens
agacagagguccccaagca

SEQ ID NO: 1305707 - RNA, 19 nt, Homo sapiens
ggccaagggaggacauaga

SEQ ID NO: 1305708 - RNA, 19 nt, Homo sapiens
gagcagaagcauguccaau

SEQ ID NO: 1305709 - RNA, 19 nt, Homo sapiens
agaggguucugucaaagca

SEQ ID NO: 1305710 - RNA, 19 nt, Homo sapiens
gcagcuccaaauucauuga

SEQ ID NO: 1305711 - RNA, 19 nt, Homo sapiens
cauguccaauacaacagaa

SEQ ID NO: 1305712 - RNA, 19 nt, Homo sapiens
uaccagccuugccuucuca

SEQ ID NO: 1305713 - RNA, 19 nt, Homo sapiens
gacaggagggagaugacaa

SEQ ID NO: 1305714 - RNA, 19 nt, Homo sapiens
ggacaggagggagaugaca

SEQ ID NO: 1305715 - RNA, 19 nt, Homo sapiens
gcaaggacaggagggagau

SEQ ID NO: 1305716 - RNA, 19 nt, Homo sapiens
aaagucagugcuguccuua

SEQ ID NO: 1305717 - RNA, 19 nt, Homo sapiens
aagcaugaaauuuccauuc

SEQ ID NO: 1305718 - RNA, 19 nt, Homo sapiens
cccaagaaagucaagcauu

SEQ ID NO: 1305719 - RNA, 19 nt, Homo sapiens
gggucaggauagcucuuga

SEQ ID NO: 1305720 - RNA, 19 nt, Homo sapiens
acaacuaccaaggcugaua

SEQ ID NO: 1305721 - RNA, 19 nt, Homo sapiens
acagagaggcuuguuugug

SEQ ID NO: 1305722 - RNA, 19 nt, Homo sapiens
uugcagcuccaaauucauu

SEQ ID NO: 1305723 - RNA, 19 nt, Homo sapiens
aagaacaguguaugaaaca

SEQ ID NO: 1305724 - RNA, 19 nt, Homo sapiens
caccuuaauucagaugaca

SEQ ID NO: 1305725 - RNA, 19 nt, Homo sapiens
agcaacaugcccagguuua

SEQ ID NO: 1305726 - RNA, 19 nt, Homo sapiens
aagcauguccaauacaaca

SEQ ID NO: 1305727 - RNA, 19 nt, Homo sapiens
gacagcaugggacacaguu

SEQ ID NO: 1305728 - RNA, 19 nt, Homo sapiens
aaggagacuucaagaacag

SEQ ID NO: 1305729 - RNA, 19 nt, Homo sapiens
ucaccauccagugccauua

SEQ ID NO: 1305730 - RNA, 19 nt, Homo sapiens
uuucuaagcaacaaucuca

SEQ ID NO: 1305731 - RNA, 19 nt, Homo sapiens
aaacagggcuauacauuua

SEQ ID NO: 1305732 - RNA, 19 nt, Homo sapiens
ccaauuaucuguacuuuga

SEQ ID NO: 1305733 - RNA, 19 nt, Homo sapiens
gcaaugauauuucaaagug

SEQ ID NO: 1305734 - RNA, 19 nt, Homo sapiens
ggacuuguauauucucuga

SEQ ID NO: 1305735 - RNA, 19 nt, Homo sapiens
uauauuagcuccauguaug

SEQ ID NO: 1305736 - RNA, 19 nt, Homo sapiens
ccacacagcuuucuauugc

SEQ ID NO: 1305737 - RNA, 19 nt, Homo sapiens
gggcauggcucaaacucaa

SEQ ID NO: 1305738 - RNA, 19 nt, Homo sapiens
uggagaacauuacuaguuu

SEQ ID NO: 1305739 - RNA, 19 nt, Homo sapiens
acaacaggcuaaucaauau

SEQ ID NO: 1305740 - RNA, 19 nt, Homo sapiens
ggacuaacgugugucuuuc

SEQ ID NO: 1305741 - RNA, 19 nt, Homo sapiens
gcaccuaacuuuggcuaau

SEQ ID NO: 1305742 - RNA, 19 nt, Homo sapiens
auacuaccaugcaaugaua

SEQ ID NO: 1305743 - RNA, 19 nt, Homo sapiens
aaucuuaccugucuuucaa

SEQ ID NO: 1305744 - RNA, 19 nt, Homo sapiens
caauaugugggucauuaua

SEQ ID NO: 1305745 - RNA, 19 nt, Homo sapiens
agauuaaccugugccauuu

SEQ ID NO: 1305746 - RNA, 19 nt, Homo sapiens
cagauuaaccugugccauu

SEQ ID NO: 1305747 - RNA, 19 nt, Homo sapiens
cagcaaauccacuaauguu

SEQ ID NO: 1305748 - RNA, 19 nt, Homo sapiens
gggacuaacgugugucuuu

SEQ ID NO: 1305749 - RNA, 19 nt, Homo sapiens
ggacuaguuucuacauggu

SEQ ID NO: 1305750 - RNA, 19 nt, Homo sapiens
aaagugccauguuuacuca

SEQ ID NO: 1305751 - RNA, 19 nt, Homo sapiens
aacaacaggcuaaucaaua

SEQ ID NO: 1305752 - RNA, 19 nt, Homo sapiens
cuaaacaacaggcuaauca

SEQ ID NO: 1305753 - RNA, 19 nt, Homo sapiens
gguguuccauauauaaugu

SEQ ID NO: 1305754 - RNA, 19 nt, Homo sapiens
gccaagaucacgccacuga

SEQ ID NO: 1305755 - RNA, 19 nt, Homo sapiens
ucaucuuccuacccaauua

SEQ ID NO: 1305756 - RNA, 19 nt, Homo sapiens
acgugugucuuuccacuua

SEQ ID NO: 1305757 - RNA, 19 nt, Homo sapiens
ccacuaauguuggacuugu

SEQ ID NO: 1305758 - RNA, 19 nt, Homo sapiens
ugugcuggcuucaaucaaa

SEQ ID NO: 1305759 - RNA, 19 nt, Homo sapiens
gggaacuuauugcuauuca

SEQ ID NO: 1305760 - RNA, 19 nt, Homo sapiens
acacaacacugggaaucuu

SEQ ID NO: 1305761 - RNA, 19 nt, Homo sapiens
acagaagccagucauguuu

SEQ ID NO: 1305762 - RNA, 19 nt, Homo sapiens
gaaacagaagccagucaug

SEQ ID NO: 1305763 - RNA, 19 nt, Homo sapiens
cauggugacuauuuucuua

SEQ ID NO: 1305764 - RNA, 19 nt, Homo sapiens
guuaucaucuguccuuguc

SEQ ID NO: 1305765 - RNA, 19 nt, Homo sapiens
ccacuuauauuagcuccau

SEQ ID NO: 1305766 - RNA, 19 nt, Homo sapiens
aucaauaugugggucauua

SEQ ID NO: 1305767 - RNA, 19 nt, Homo sapiens
guacauuucaggcuguuau

SEQ ID NO: 1305768 - RNA, 19 nt, Homo sapiens
cuggugagccgcuuuguuu

SEQ ID NO: 1305769 - RNA, 19 nt, Homo sapiens
gauuuggacuaguuucuac

SEQ ID NO: 1305770 - RNA, 19 nt, Homo sapiens
ccccauaaauuuucccuua

SEQ ID NO: 1305771 - RNA, 19 nt, Homo sapiens
gggaaucuuaccugucuuu

SEQ ID NO: 1305772 - RNA, 19 nt, Homo sapiens
ucaaaucuccccauaaauu

SEQ ID NO: 1305773 - RNA, 19 nt, Homo sapiens
guauucaagugacacaaca

SEQ ID NO: 1305774 - RNA, 19 nt, Homo sapiens
uauaaugucauccuucaga

SEQ ID NO: 1305775 - RNA, 19 nt, Homo sapiens
aaacucaaaucuccccaua

SEQ ID NO: 1305776 - RNA, 19 nt, Homo sapiens
caagugggcauggcucaaa

SEQ ID NO: 1305777 - RNA, 19 nt, Homo sapiens
ggagaacauuacuaguuuu

SEQ ID NO: 1305778 - RNA, 19 nt, Homo sapiens
gugugucuuuccacuuaua

SEQ ID NO: 1305779 - RNA, 19 nt, Homo sapiens
uuucaaagugccauguuua

SEQ ID NO: 1305780 - RNA, 19 nt, Homo sapiens
aaacaacaggcuaaucaau

SEQ ID NO: 1305781 - RNA, 19 nt, Homo sapiens
aaacagaagccagucaugu

SEQ ID NO: 1305782 - RNA, 19 nt, Homo sapiens
cauguuuacucaagguuuc

SEQ ID NO: 1305783 - RNA, 19 nt, Homo sapiens
caaagugccauguuuacuc

SEQ ID NO: 1305784 - RNA, 19 nt, Homo sapiens
acucaaaucuccccauaaa

SEQ ID NO: 1305785 - RNA, 19 nt, Homo sapiens
caucagggguguuccauau

SEQ ID NO: 1305786 - RNA, 19 nt, Homo sapiens
gugauucucaugcaccuaa

SEQ ID NO: 1305787 - RNA, 19 nt, Homo sapiens
ccaagaaaaccaugaauau

SEQ ID NO: 1305788 - RNA, 19 nt, Homo sapiens
gaaucuuaccugucuuuca

SEQ ID NO: 1305789 - RNA, 19 nt, Homo sapiens
cacaacacugggaaucuua

SEQ ID NO: 1305790 - RNA, 19 nt, Homo sapiens
gcauuuguguauguacuuc

SEQ ID NO: 1305791 - RNA, 19 nt, Homo sapiens
gcuguuaucaucuguccuu

SEQ ID NO: 1305792 - RNA, 19 nt, Homo sapiens
gaagaaccccuuagaugug

SEQ ID NO: 1305793 - RNA, 19 nt, Homo sapiens
guuucuacauggugacuau

SEQ ID NO: 1305794 - RNA, 19 nt, Homo sapiens
cuggagaacauuacuaguu

SEQ ID NO: 1305795 - RNA, 19 nt, Homo sapiens
caccguagccaccagcaaa

SEQ ID NO: 1305796 - RNA, 19 nt, Homo sapiens
uaaacaacaggcuaaucaa

SEQ ID NO: 1305797 - RNA, 19 nt, Homo sapiens
uaaaacagggcuauacauu

SEQ ID NO: 1305798 - RNA, 19 nt, Homo sapiens
caccuaacuuuggcuaaug

SEQ ID NO: 1305799 - RNA, 19 nt, Homo sapiens
acacagcuuucuauugcau

SEQ ID NO: 1305800 - RNA, 19 nt, Homo sapiens
ggaacuuauugcuauucau

SEQ ID NO: 1305801 - RNA, 19 nt, Homo sapiens
gaaguacuuuuguugauac

SEQ ID NO: 1305802 - RNA, 19 nt, Homo sapiens
cucaugauuuggacuaguu

SEQ ID NO: 1305803 - RNA, 19 nt, Homo sapiens
cacuaauguuggacuugua

SEQ ID NO: 1305804 - RNA, 19 nt, Homo sapiens
caacaggcuaaucaauaug

SEQ ID NO: 1305805 - RNA, 19 nt, Homo sapiens
aagguuuccucuucuuguu

SEQ ID NO: 1305806 - RNA, 19 nt, Homo sapiens
uauauacuaccaugcaaug

SEQ ID NO: 1305807 - RNA, 19 nt, Homo sapiens
uaucaucuguccuugucau

SEQ ID NO: 1305808 - RNA, 19 nt, Homo sapiens
caagaucacgccacugaac

SEQ ID NO: 1305809 - RNA, 19 nt, Homo sapiens
gagccgcuuuguuuucuuu

SEQ ID NO: 1305810 - RNA, 19 nt, Homo sapiens
cugggaaucuuaccugucu

SEQ ID NO: 1305811 - RNA, 19 nt, Homo sapiens
cuucuucucuccugaguac

SEQ ID NO: 1305812 - RNA, 19 nt, Homo sapiens
ggagguccaggcugcaaug

SEQ ID NO: 1305813 - RNA, 19 nt, Homo sapiens
cugcuuaccacacagcuuu

SEQ ID NO: 1305814 - RNA, 19 nt, Homo sapiens
uuagcuccauguaugagaa

SEQ ID NO: 1305815 - RNA, 19 nt, Homo sapiens
ggucuuucauauucacagu

SEQ ID NO: 1305816 - RNA, 19 nt, Homo sapiens
uagaugugauucucaugca

SEQ ID NO: 1305817 - RNA, 19 nt, Homo sapiens
aggcugugcuggcuucaau

SEQ ID NO: 1305818 - RNA, 19 nt, Homo sapiens
ccagcaaauccacuaaugu

SEQ ID NO: 1305819 - RNA, 19 nt, Homo sapiens
cagaagaaccccuuagaug

SEQ ID NO: 1305820 - RNA, 19 nt, Homo sapiens
gggcauuuguguauguacu

SEQ ID NO: 1305821 - RNA, 19 nt, Homo sapiens
gcauggcucaaacucaaau

SEQ ID NO: 1305822 - RNA, 19 nt, Homo sapiens
ucuuguuccucaugauuug

SEQ ID NO: 1305823 - RNA, 19 nt, Homo sapiens
accagcaaauccacuaaug

SEQ ID NO: 1305824 - RNA, 19 nt, Homo sapiens
gaguacauuucaggcuguu

SEQ ID NO: 1305825 - RNA, 19 nt, Homo sapiens
cagucugucuccacaaucu

SEQ ID NO: 1305826 - RNA, 19 nt, Homo sapiens
uacucaagguuuccucuuc

SEQ ID NO: 1305827 - RNA, 19 nt, Homo sapiens
ucucaugcaccuaacuuug

SEQ ID NO: 1305828 - RNA, 19 nt, Homo sapiens
aaaacagggcuauacauuu

SEQ ID NO: 1305829 - RNA, 19 nt, Homo sapiens
ucagggguguuccauauau

SEQ ID NO: 1305830 - RNA, 19 nt, Homo sapiens
accaugcaaugauauuuca

SEQ ID NO: 1305831 - RNA, 19 nt, Homo sapiens
ugaaacagguguagaaauu

SEQ ID NO: 1305832 - RNA, 19 nt, Homo sapiens
gaagauggcucugauuuca

SEQ ID NO: 1305833 - RNA, 19 nt, Homo sapiens
gaaacccugucucuacuaa

SEQ ID NO: 1305834 - RNA, 19 nt, Homo sapiens
gaagcugucucaaacauuc

SEQ ID NO: 1305835 - RNA, 19 nt, Homo sapiens
gcugagaaauucaaaguuc

SEQ ID NO: 1305836 - RNA, 19 nt, Homo sapiens
gaaacagguguagaaauua

SEQ ID NO: 1305837 - RNA, 19 nt, Homo sapiens
aaacagaggcggagugaaa

SEQ ID NO: 1305838 - RNA, 19 nt, Homo sapiens
caucugaggucaugaguuc

SEQ ID NO: 1305839 - RNA, 19 nt, Homo sapiens
gguagcagcugaaauugau

SEQ ID NO: 1305840 - RNA, 19 nt, Homo sapiens
aagccaagauugaagauuu

SEQ ID NO: 1305841 - RNA, 19 nt, Homo sapiens
cagcugaaauugaugaaga

SEQ ID NO: 1305842 - RNA, 19 nt, Homo sapiens
gcaggagaaucacuugaau

SEQ ID NO: 1305843 - RNA, 19 nt, Homo sapiens
uaccagagcuugaagaaca

SEQ ID NO: 1305844 - RNA, 19 nt, Homo sapiens
gcagugagcugagauugca

SEQ ID NO: 1305845 - RNA, 19 nt, Homo sapiens
gcagcuugguuugaaauuu

SEQ ID NO: 1305846 - RNA, 19 nt, Homo sapiens
ggugguagcagcugaaauu

SEQ ID NO: 1305847 - RNA, 19 nt, Homo sapiens
cagcuugguuugaaauuug

SEQ ID NO: 1305848 - RNA, 19 nt, Homo sapiens
cugaagaacaguaaugaua

SEQ ID NO: 1305849 - RNA, 19 nt, Homo sapiens
gaugaaacccugucucuac

SEQ ID NO: 1305850 - RNA, 19 nt, Homo sapiens
ucggauaccuacaugguuu

SEQ ID NO: 1305851 - RNA, 19 nt, Homo sapiens
gaagaaccagucaguaaag

SEQ ID NO: 1305852 - RNA, 19 nt, Homo sapiens
gaaauucaaaguucaaggu

SEQ ID NO: 1305853 - RNA, 19 nt, Homo sapiens
gaaccagucaguaaagcaa

SEQ ID NO: 1305854 - RNA, 19 nt, Homo sapiens
ggaagauggcucugauuuc

SEQ ID NO: 1305855 - RNA, 19 nt, Homo sapiens
cagaaaccgucccugcuau

SEQ ID NO: 1305856 - RNA, 19 nt, Homo sapiens
caacagguuacaggaguua

SEQ ID NO: 1305857 - RNA, 19 nt, Homo sapiens
ugaagaaccagucaguaaa

SEQ ID NO: 1305858 - RNA, 19 nt, Homo sapiens
ugaaauugaugaagaacca

SEQ ID NO: 1305859 - RNA, 19 nt, Homo sapiens
agccaagauugaagauuua

SEQ ID NO: 1305860 - RNA, 19 nt, Homo sapiens
caaacugggucuucaacag

SEQ ID NO: 1305861 - RNA, 19 nt, Homo sapiens
gaauugguccugucacaag

SEQ ID NO: 1305862 - RNA, 19 nt, Homo sapiens
gaugaaacagguguagaaa

SEQ ID NO: 1305863 - RNA, 19 nt, Homo sapiens
gugaagcugucucaaacau

SEQ ID NO: 1305864 - RNA, 19 nt, Homo sapiens
uuacaggaguuacuagagu

SEQ ID NO: 1305865 - RNA, 19 nt, Homo sapiens
gaugaagaaccagucagua

SEQ ID NO: 1305866 - RNA, 19 nt, Homo sapiens
guagguaacaauuaaaugg

SEQ ID NO: 1305867 - RNA, 19 nt, Homo sapiens
cgaugaaacagguguagaa

SEQ ID NO: 1305868 - RNA, 19 nt, Homo sapiens
gaauauccucuuugucauc

SEQ ID NO: 1305869 - RNA, 19 nt, Homo sapiens
auccggaaaucuaagaaua

SEQ ID NO: 1305870 - RNA, 19 nt, Homo sapiens
gcacggaaggcuagguuca

SEQ ID NO: 1305871 - RNA, 19 nt, Homo sapiens
uagaauugguccugucaca

SEQ ID NO: 1305872 - RNA, 19 nt, Homo sapiens
uggaagauggcucugauuu

SEQ ID NO: 1305873 - RNA, 19 nt, Homo sapiens
acagaaaccgucccugcua

SEQ ID NO: 1305874 - RNA, 19 nt, Homo sapiens
gguuugaaauuuguacugu

SEQ ID NO: 1305875 - RNA, 19 nt, Homo sapiens
gguguagaaauuaaggaua

SEQ ID NO: 1305876 - RNA, 19 nt, Homo sapiens
gaaaccgucccugcuauag

SEQ ID NO: 1305877 - RNA, 19 nt, Homo sapiens
ccagguaaccgcacaaguc

SEQ ID NO: 1305878 - RNA, 19 nt, Homo sapiens
cgaagaggucgaugaaaca

SEQ ID NO: 1305879 - RNA, 19 nt, Homo sapiens
acgaagaggucgaugaaac

SEQ ID NO: 1305880 - RNA, 19 nt, Homo sapiens
agacgaagaggucgaugaa

SEQ ID NO: 1305881 - RNA, 19 nt, Homo sapiens
ucaggaagcacaacuagca

SEQ ID NO: 1305882 - RNA, 19 nt, Homo sapiens
ggcaggagaaucacuugaa

SEQ ID NO: 1305883 - RNA, 19 nt, Homo sapiens
uaacugcagcuugguuuga

SEQ ID NO: 1305884 - RNA, 19 nt, Homo sapiens
caauguaaccaucugaaag

SEQ ID NO: 1305885 - RNA, 19 nt, Homo sapiens
ggaauuaacaauguaacca

SEQ ID NO: 1305886 - RNA, 19 nt, Homo sapiens
gggaagccaagauugaaga

SEQ ID NO: 1305887 - RNA, 19 nt, Homo sapiens
aaccagaugucuacaagag

SEQ ID NO: 1305888 - RNA, 19 nt, Homo sapiens
augaagaaccagucaguaa

SEQ ID NO: 1305889 - RNA, 19 nt, Homo sapiens
ggccaaggcaggcagauca

SEQ ID NO: 1305890 - RNA, 19 nt, Homo sapiens
agagggcagugaagacgaa

SEQ ID NO: 1305891 - RNA, 19 nt, Homo sapiens
ccggaaaucuaagaauauc

SEQ ID NO: 1305892 - RNA, 19 nt, Homo sapiens
acaccuguaaucccaguua

SEQ ID NO: 1305893 - RNA, 19 nt, Homo sapiens
agaaaccgucccugcuaua

SEQ ID NO: 1305894 - RNA, 19 nt, Homo sapiens
uaacaauguaaccaucuga

SEQ ID NO: 1305895 - RNA, 19 nt, Homo sapiens
ucaacagguuacaggaguu

SEQ ID NO: 1305896 - RNA, 19 nt, Homo sapiens
gaagccaagauugaagauu

SEQ ID NO: 1305897 - RNA, 19 nt, Homo sapiens
ggaaggcuagguucaaacu

SEQ ID NO: 1305898 - RNA, 19 nt, Homo sapiens
cugagaaauucaaaguuca

SEQ ID NO: 1305899 - RNA, 19 nt, Homo sapiens
aaaagagaguucaguggaa

SEQ ID NO: 1305900 - RNA, 19 nt, Homo sapiens
acaauguaaccaucugaaa

SEQ ID NO: 1305901 - RNA, 19 nt, Homo sapiens
guacaagagggcagugaag

SEQ ID NO: 1305902 - RNA, 19 nt, Homo sapiens
aauauccucuuugucauca

SEQ ID NO: 1305903 - RNA, 19 nt, Homo sapiens
ucaccauccggaaaucuaa

SEQ ID NO: 1305904 - RNA, 19 nt, Homo sapiens
acggaaggcuagguucaaa

SEQ ID NO: 1305905 - RNA, 19 nt, Homo sapiens
gguagguaacaauuaaaug

SEQ ID NO: 1305906 - RNA, 19 nt, Homo sapiens
gcaguccgagcccugaaga

SEQ ID NO: 1305907 - RNA, 19 nt, Homo sapiens
gagcuugaagaacaggauu

SEQ ID NO: 1305908 - RNA, 19 nt, Homo sapiens
agaauauccucuuugucau

SEQ ID NO: 1305909 - RNA, 19 nt, Homo sapiens
ggaaaucuaagaauauccu

SEQ ID NO: 1305910 - RNA, 19 nt, Homo sapiens
gcaaauguguggggagcaa

SEQ ID NO: 1305911 - RNA, 19 nt, Homo sapiens
aaggugaagcugucucaaa

SEQ ID NO: 1305912 - RNA, 19 nt, Homo sapiens
gaaaacacacagacuccaa

SEQ ID NO: 1305913 - RNA, 19 nt, Homo sapiens
ugaaacccugucucuacua

SEQ ID NO: 1305914 - RNA, 19 nt, Homo sapiens
gagcccugaagaacaguaa

SEQ ID NO: 1305915 - RNA, 19 nt, Homo sapiens
gacuccaacuguacaagag

SEQ ID NO: 1305916 - RNA, 19 nt, Homo sapiens
gguucaaacugggucuuca

SEQ ID NO: 1305917 - RNA, 19 nt, Homo sapiens
uagcagcugaaauugauga

SEQ ID NO: 1305918 - RNA, 19 nt, Homo sapiens
aaaauuagcugggcauggu

SEQ ID NO: 1305919 - RNA, 19 nt, Homo sapiens
guaacugcagcuugguuug

SEQ ID NO: 1305920 - RNA, 19 nt, Homo sapiens
uuaacaauguaaccaucug

SEQ ID NO: 1305921 - RNA, 19 nt, Homo sapiens
ccgcacaaguccaguuggu

SEQ ID NO: 1305922 - RNA, 19 nt, Homo sapiens
ggaagccaagauugaagau

SEQ ID NO: 1305923 - RNA, 19 nt, Homo sapiens
caggauuccacccagguaa

SEQ ID NO: 1305924 - RNA, 19 nt, Homo sapiens
gaguaacugcagcuugguu

SEQ ID NO: 1305925 - RNA, 19 nt, Homo sapiens
gguccugucacaagcaaau

SEQ ID NO: 1305926 - RNA, 19 nt, Homo sapiens
gaagaggucgaugaaacag

SEQ ID NO: 1305927 - RNA, 19 nt, Homo sapiens
ucacaaaaccagaugucua

SEQ ID NO: 1305928 - RNA, 19 nt, Homo sapiens
uagagucaccauccggaaa

SEQ ID NO: 1305929 - RNA, 19 nt, Homo sapiens
cagccuggccaacaugaug

SEQ ID NO: 1305930 - RNA, 19 nt, Homo sapiens
caggguaauaauaauggua

SEQ ID NO: 1305931 - RNA, 19 nt, Homo sapiens
gaacugagcuauaauaugg

SEQ ID NO: 1305932 - RNA, 19 nt, Homo sapiens
gaaacgaacuccaauuuau

SEQ ID NO: 1305933 - RNA, 19 nt, Homo sapiens
gaagugcucuggauguuaa

SEQ ID NO: 1305934 - RNA, 19 nt, Homo sapiens
gaaaguacaacgcauauuu

SEQ ID NO: 1305935 - RNA, 19 nt, Homo sapiens
aaagaacacucccagauuu

SEQ ID NO: 1305936 - RNA, 19 nt, Homo sapiens
ugacauaucuggcagcauu

SEQ ID NO: 1305937 - RNA, 19 nt, Homo sapiens
cagcauugauugacuauaa

SEQ ID NO: 1305938 - RNA, 19 nt, Homo sapiens
gaaacuaucucugaagugu

SEQ ID NO: 1305939 - RNA, 19 nt, Homo sapiens
ggaaacgaacuccaauuua

SEQ ID NO: 1305940 - RNA, 19 nt, Homo sapiens
cagcagaaaucacagauga

SEQ ID NO: 1305941 - RNA, 19 nt, Homo sapiens
gaacugagacagacaaugu

SEQ ID NO: 1305942 - RNA, 19 nt, Homo sapiens
ugaaugacuuugucucuaa

SEQ ID NO: 1305943 - RNA, 19 nt, Homo sapiens
caaucuggcugaagucuuu

SEQ ID NO: 1305944 - RNA, 19 nt, Homo sapiens
gggaaugaauccauaguug

SEQ ID NO: 1305945 - RNA, 19 nt, Homo sapiens
gaacgaucuuucucuaguu

SEQ ID NO: 1305946 - RNA, 19 nt, Homo sapiens
gcuuugauuuggaugauua

SEQ ID NO: 1305947 - RNA, 19 nt, Homo sapiens
ugaaggacuuugaggauuu

SEQ ID NO: 1305948 - RNA, 19 nt, Homo sapiens
gaacaccugucaagauugg

SEQ ID NO: 1305949 - RNA, 19 nt, Homo sapiens
gauuacaccagaagauuua

SEQ ID NO: 1305950 - RNA, 19 nt, Homo sapiens
gcucagaguccauauacua

SEQ ID NO: 1305951 - RNA, 19 nt, Homo sapiens
cagcauaucugccauguac

SEQ ID NO: 1305952 - RNA, 19 nt, Homo sapiens
gaaaacagguacuuuacaa

SEQ ID NO: 1305953 - RNA, 19 nt, Homo sapiens
caaagaacacucccagauu

SEQ ID NO: 1305954 - RNA, 19 nt, Homo sapiens
guacaacgcauauuuaucu

SEQ ID NO: 1305955 - RNA, 19 nt, Homo sapiens
gggaguauguguagcuuug

SEQ ID NO: 1305956 - RNA, 19 nt, Homo sapiens
gguaucagcuuugacaaga

SEQ ID NO: 1305957 - RNA, 19 nt, Homo sapiens
gcuauaauauggagcuuuc

SEQ ID NO: 1305958 - RNA, 19 nt, Homo sapiens
cgaugaaucugguuccauu

SEQ ID NO: 1305959 - RNA, 19 nt, Homo sapiens
ggagaggacugacuaugag

SEQ ID NO: 1305960 - RNA, 19 nt, Homo sapiens
gagaaauuccucagaguga

SEQ ID NO: 1305961 - RNA, 19 nt, Homo sapiens
ucaaagcugugcccacuau

SEQ ID NO: 1305962 - RNA, 19 nt, Homo sapiens
ggacuuugaggauuucuuu

SEQ ID NO: 1305963 - RNA, 19 nt, Homo sapiens
gaaagagaaauuccucaga

SEQ ID NO: 1305964 - RNA, 19 nt, Homo sapiens
ugucaggacuguuguguga

SEQ ID NO: 1305965 - RNA, 19 nt, Homo sapiens
aagaaaggaugcaccugua

SEQ ID NO: 1305966 - RNA, 19 nt, Homo sapiens
ggaugugccugaaugacuu

SEQ ID NO: 1305967 - RNA, 19 nt, Homo sapiens
gagagauguuccuguguga

SEQ ID NO: 1305968 - RNA, 19 nt, Homo sapiens
agacaucuuuccaggagua

SEQ ID NO: 1305969 - RNA, 19 nt, Homo sapiens
cuucugaccuuucgccuaa

SEQ ID NO: 1305970 - RNA, 19 nt, Homo sapiens
ggaaggaaacgaacuccaa

SEQ ID NO: 1305971 - RNA, 19 nt, Homo sapiens
gcauauuuaucucugaugu

SEQ ID NO: 1305972 - RNA, 19 nt, Homo sapiens
ggagucaguucucaauagu

SEQ ID NO: 1305973 - RNA, 19 nt, Homo sapiens
ggaagcagcagaaaucaca

SEQ ID NO: 1305974 - RNA, 19 nt, Homo sapiens
ugaauucuauguuccaugu

SEQ ID NO: 1305975 - RNA, 19 nt, Homo sapiens
ggauuacaccagaagauuu

SEQ ID NO: 1305976 - RNA, 19 nt, Homo sapiens
gaucaucagcuucucaaga

SEQ ID NO: 1305977 - RNA, 19 nt, Homo sapiens
gaaauuccucagagugaaa

SEQ ID NO: 1305978 - RNA, 19 nt, Homo sapiens
gggaaacuaucucugaagu

SEQ ID NO: 1305979 - RNA, 19 nt, Homo sapiens
caacagauucagcugauug

SEQ ID NO: 1305980 - RNA, 19 nt, Homo sapiens
gggagaggacugacuauga

SEQ ID NO: 1305981 - RNA, 19 nt, Homo sapiens
gucaauaugucguccuuug

SEQ ID NO: 1305982 - RNA, 19 nt, Homo sapiens
aggaacaccugucaagauu

SEQ ID NO: 1305983 - RNA, 19 nt, Homo sapiens
ucucuaagacgguuauuaa

SEQ ID NO: 1305984 - RNA, 19 nt, Homo sapiens
caucccaacuaacaauaaa

SEQ ID NO: 1305985 - RNA, 19 nt, Homo sapiens
guagaaggguuaguaugga

SEQ ID NO: 1305986 - RNA, 19 nt, Homo sapiens
caacagggacacauugguu

SEQ ID NO: 1305987 - RNA, 19 nt, Homo sapiens
aaagauggauacuacuaug

SEQ ID NO: 1305988 - RNA, 19 nt, Homo sapiens
gaagacaacagcauaucug

SEQ ID NO: 1305989 - RNA, 19 nt, Homo sapiens
gagcagagaggucuuacug

SEQ ID NO: 1305990 - RNA, 19 nt, Homo sapiens
gaauaugcggaaucuguuu

SEQ ID NO: 1305991 - RNA, 19 nt, Homo sapiens
gcgaagugcucuggauguu

SEQ ID NO: 1305992 - RNA, 19 nt, Homo sapiens
gccaaaugcugcucaugga

SEQ ID NO: 1305993 - RNA, 19 nt, Homo sapiens
guuccacccucacaaagaa

SEQ ID NO: 1305994 - RNA, 19 nt, Homo sapiens
ucagcaaaguggaugauau

SEQ ID NO: 1305995 - RNA, 19 nt, Homo sapiens
gugaaggacuuugaggauu

SEQ ID NO: 1305996 - RNA, 19 nt, Homo sapiens
aaaccugaauucuauguuc

SEQ ID NO: 1305997 - RNA, 19 nt, Homo sapiens
gauacuacuaugcugaaua

SEQ ID NO: 1305998 - RNA, 19 nt, Homo sapiens
gcgaaaagcuggagcaaca

SEQ ID NO: 1305999 - RNA, 19 nt, Homo sapiens
gaaggacuuugaggauuuc

SEQ ID NO: 1306000 - RNA, 19 nt, Homo sapiens
gagcccaacuuccaaaggu

SEQ ID NO: 1306001 - RNA, 19 nt, Homo sapiens
ugaacgaucuuucucuagu

SEQ ID NO: 1306002 - RNA, 19 nt, Homo sapiens
ccucuucucauuacuauuu

SEQ ID NO: 1306003 - RNA, 19 nt, Homo sapiens
ggaugcaccuguacucucu

SEQ ID NO: 1306004 - RNA, 19 nt, Homo sapiens
gaaggaaacgaacuccaau

SEQ ID NO: 1306005 - RNA, 19 nt, Homo sapiens
ugacagaaacccuaccuau

SEQ ID NO: 1306006 - RNA, 19 nt, Homo sapiens
aaugaacgaucuuucucua

SEQ ID NO: 1306007 - RNA, 19 nt, Homo sapiens
gcugaagucuuuggcucua

SEQ ID NO: 1306008 - RNA, 19 nt, Homo sapiens
gaaagcagauaaaauuugg

SEQ ID NO: 1306009 - RNA, 19 nt, Homo sapiens
gcaacagauucagcugauu

SEQ ID NO: 1306010 - RNA, 19 nt, Homo sapiens
uaauaucaguaccuuguuc

SEQ ID NO: 1306011 - RNA, 19 nt, Homo sapiens
cauaauaucaguaccuugu

SEQ ID NO: 1306012 - RNA, 19 nt, Homo sapiens
aaaugaauguugccaaucu

SEQ ID NO: 1306013 - RNA, 19 nt, Homo sapiens
uaucagguaucagcuuuga

SEQ ID NO: 1306014 - RNA, 19 nt, Homo sapiens
ggaaauacaaggaucuuuu

SEQ ID NO: 1306015 - RNA, 19 nt, Homo sapiens
gaaaggauuacaccagaag

SEQ ID NO: 1306016 - RNA, 19 nt, Homo sapiens
guugggagcuuuuagauga

SEQ ID NO: 1306017 - RNA, 19 nt, Homo sapiens
gaaggguuaguauggaauu

SEQ ID NO: 1306018 - RNA, 19 nt, Homo sapiens
uagaaggguuaguauggaa

SEQ ID NO: 1306019 - RNA, 19 nt, Homo sapiens
gauaggaacaccugucaag

SEQ ID NO: 1306020 - RNA, 19 nt, Homo sapiens
gaaugaauccauaguugca

SEQ ID NO: 1306021 - RNA, 19 nt, Homo sapiens
gaacuagugaugggaguau

SEQ ID NO: 1306022 - RNA, 19 nt, Homo sapiens
cagaaccagugacgauguu

SEQ ID NO: 1306023 - RNA, 19 nt, Homo sapiens
gaugaagacaacagcauau

SEQ ID NO: 1306024 - RNA, 19 nt, Homo sapiens
gcagaaaucacagaugaag

SEQ ID NO: 1306025 - RNA, 19 nt, Homo sapiens
ugugaucucucguccagaa

SEQ ID NO: 1306026 - RNA, 19 nt, Homo sapiens
ggauugcgacucuucuuug

SEQ ID NO: 1306027 - RNA, 19 nt, Homo sapiens
ccuuguaaaugugaaagua

SEQ ID NO: 1306028 - RNA, 19 nt, Homo sapiens
gaggacagaacuagugaug

SEQ ID NO: 1306029 - RNA, 19 nt, Homo sapiens
acagaaacccuaccuaucu

SEQ ID NO: 1306030 - RNA, 19 nt, Homo sapiens
uuacuaucccuuuggcuua

SEQ ID NO: 1306031 - RNA, 19 nt, Homo sapiens
ucaacaagcuccucaagau

SEQ ID NO: 1306032 - RNA, 19 nt, Homo sapiens
gcaggagccuugccucuca

SEQ ID NO: 1306033 - RNA, 19 nt, Homo sapiens
gccacaagcugcccuucua

SEQ ID NO: 1306034 - RNA, 19 nt, Homo sapiens
ggucacaccugucaacaag

SEQ ID NO: 1306035 - RNA, 19 nt, Homo sapiens
gcgccuaccuccucaagug

SEQ ID NO: 1306036 - RNA, 19 nt, Homo sapiens
cggcugacgugcugguaua

SEQ ID NO: 1306037 - RNA, 19 nt, Homo sapiens
gcgugcagcucgugaccua

SEQ ID NO: 1306038 - RNA, 19 nt, Homo sapiens
ugguauaccuggcagauga

SEQ ID NO: 1306039 - RNA, 19 nt, Homo sapiens
ccaagaaccagcccuacaa

SEQ ID NO: 1306040 - RNA, 19 nt, Homo sapiens
caagcaggccgaacugaug

SEQ ID NO: 1306041 - RNA, 19 nt, Homo sapiens
acaagcuccucaagaucua

SEQ ID NO: 1306042 - RNA, 19 nt, Homo sapiens
gagcaccacguccuucuuc

SEQ ID NO: 1306043 - RNA, 19 nt, Homo sapiens
caacaagcuccucaagauc

SEQ ID NO: 1306044 - RNA, 19 nt, Homo sapiens
ggugggcgcaaaucaguuu

SEQ ID NO: 1306045 - RNA, 19 nt, Homo sapiens
gcucugcgacccugugaga

SEQ ID NO: 1306046 - RNA, 19 nt, Homo sapiens
ggccauggaugagccuuuc

SEQ ID NO: 1306047 - RNA, 19 nt, Homo sapiens
gggcccugcugcuaucuca

SEQ ID NO: 1306048 - RNA, 19 nt, Homo sapiens
ucaggcgagugaagacgaa

SEQ ID NO: 1306049 - RNA, 19 nt, Homo sapiens
caacuggcucgcccucaga

SEQ ID NO: 1306050 - RNA, 19 nt, Homo sapiens
ucacaccugucaacaagcu

SEQ ID NO: 1306051 - RNA, 19 nt, Homo sapiens
ccacaagcugcccuucuau

SEQ ID NO: 1306052 - RNA, 19 nt, Homo sapiens
gagcugcugcugcgcuuca

SEQ ID NO: 1306053 - RNA, 19 nt, Homo sapiens
cgaagagcaccacguccuu

SEQ ID NO: 1306054 - RNA, 19 nt, Homo sapiens
gggaucaggcgagugaaga

SEQ ID NO: 1306055 - RNA, 19 nt, Homo sapiens
cuaugggugugccuucuuc

SEQ ID NO: 1306056 - RNA, 19 nt, Homo sapiens
caagaaccagcccuacaag

SEQ ID NO: 1306057 - RNA, 19 nt, Homo sapiens
ccaagcaggccgaacugau

SEQ ID NO: 1306058 - RNA, 19 nt, Homo sapiens
gcugcuaucucaggaccau

SEQ ID NO: 1306059 - RNA, 19 nt, Homo sapiens
gucaacaagcuccucaaga

SEQ ID NO: 1306060 - RNA, 19 nt, Homo sapiens
gggcgcaaaucaguuucug

SEQ ID NO: 1306061 - RNA, 19 nt, Homo sapiens
ucuccaccaucgccuaugu

SEQ ID NO: 1306062 - RNA, 19 nt, Homo sapiens
uccugcggcugcucuauga

SEQ ID NO: 1306063 - RNA, 19 nt, Homo sapiens
aagcaggccgaacugauga

SEQ ID NO: 1306064 - RNA, 19 nt, Homo sapiens
gaaaguaccugaaguuaaa

SEQ ID NO: 1306065 - RNA, 19 nt, Homo sapiens
ggacgcacauuaaagaaua

SEQ ID NO: 1306066 - RNA, 19 nt, Homo sapiens
gaauaaagcuccuguuucu

SEQ ID NO: 1306067 - RNA, 19 nt, Homo sapiens
ggacuucacugauggcauu

SEQ ID NO: 1306068 - RNA, 19 nt, Homo sapiens
gaucaucgcccucuucauu

SEQ ID NO: 1306069 - RNA, 19 nt, Homo sapiens
ggacugagcaggauggauu

SEQ ID NO: 1306070 - RNA, 19 nt, Homo sapiens
aaacaaggcugugggcaaa

SEQ ID NO: 1306071 - RNA, 19 nt, Homo sapiens
ccauuauccuuuagcuuua

SEQ ID NO: 1306072 - RNA, 19 nt, Homo sapiens
gcacagaggaggaauucaa

SEQ ID NO: 1306073 - RNA, 19 nt, Homo sapiens
ggacgggccuguggaauag

SEQ ID NO: 1306074 - RNA, 19 nt, Homo sapiens
gcacuaagacugcgaugga

SEQ ID NO: 1306075 - RNA, 19 nt, Homo sapiens
gcuacacccucuaccaauu

SEQ ID NO: 1306076 - RNA, 19 nt, Homo sapiens
acacaucuaugacacgauu

SEQ ID NO: 1306077 - RNA, 19 nt, Homo sapiens
cgaaaguaccugaaguuaa

SEQ ID NO: 1306078 - RNA, 19 nt, Homo sapiens
agaggaagauccacuacuu

SEQ ID NO: 1306079 - RNA, 19 nt, Homo sapiens
ggagaacggacacaucuau

SEQ ID NO: 1306080 - RNA, 19 nt, Homo sapiens
acaaggcugugggcaaaua

SEQ ID NO: 1306081 - RNA, 19 nt, Homo sapiens
ggacgacuaucacacaaaa

SEQ ID NO: 1306082 - RNA, 19 nt, Homo sapiens
ggucaugagucucuucaag

SEQ ID NO: 1306083 - RNA, 19 nt, Homo sapiens
ggagaauuccugugagguu

SEQ ID NO: 1306084 - RNA, 19 nt, Homo sapiens
ccaccaacacugagaauga

SEQ ID NO: 1306085 - RNA, 19 nt, Homo sapiens
gauucaagcuacuacaagu

SEQ ID NO: 1306086 - RNA, 19 nt, Homo sapiens
ccucucccauuauccuuua

SEQ ID NO: 1306087 - RNA, 19 nt, Homo sapiens
ggcauuacuuggacgacua

SEQ ID NO: 1306088 - RNA, 19 nt, Homo sapiens
ccaccacccuguuccucua

SEQ ID NO: 1306089 - RNA, 19 nt, Homo sapiens
acaaugagcccaacugcaa

SEQ ID NO: 1306090 - RNA, 19 nt, Homo sapiens
aagaauaaagcuccuguuu

SEQ ID NO: 1306091 - RNA, 19 nt, Homo sapiens
gcacaccucccgaaaguac

SEQ ID NO: 1306092 - RNA, 19 nt, Homo sapiens
gaauggauacuucgaggau

SEQ ID NO: 1306093 - RNA, 19 nt, Homo sapiens
gcuggacgcacauuaaaga

SEQ ID NO: 1306094 - RNA, 19 nt, Homo sapiens
gucgaugccugaaagagaa

SEQ ID NO: 1306095 - RNA, 19 nt, Homo sapiens
caccaacacugagaaugaa

SEQ ID NO: 1306096 - RNA, 19 nt, Homo sapiens
gacgcacauuaaagaauaa

SEQ ID NO: 1306097 - RNA, 19 nt, Homo sapiens
cccauuauccuuuagcuuu

SEQ ID NO: 1306098 - RNA, 19 nt, Homo sapiens
agagacagcugcucaccau

SEQ ID NO: 1306099 - RNA, 19 nt, Homo sapiens
ggacuucaacuccuucuac

SEQ ID NO: 1306100 - RNA, 19 nt, Homo sapiens
acuaugaccuggacuucaa

SEQ ID NO: 1306101 - RNA, 19 nt, Homo sapiens
gggcagccauuggugauuc

SEQ ID NO: 1306102 - RNA, 19 nt, Homo sapiens
gccaccauguucucggaua

SEQ ID NO: 1306103 - RNA, 19 nt, Homo sapiens
guuaaagaacuucaaggaa

SEQ ID NO: 1306104 - RNA, 19 nt, Homo sapiens
caucgugucuggcgagagu

SEQ ID NO: 1306105 - RNA, 19 nt, Homo sapiens
aaaucgagaugagcaaguu

SEQ ID NO: 1306106 - RNA, 19 nt, Homo sapiens
ccgaaaguaccugaaguua

SEQ ID NO: 1306107 - RNA, 19 nt, Homo sapiens
ccauuuccuugauugugua

SEQ ID NO: 1306108 - RNA, 19 nt, Homo sapiens
ccugaaagagaaaccauuu

SEQ ID NO: 1306109 - RNA, 19 nt, Homo sapiens
ucuauggccucuuccucua

SEQ ID NO: 1306110 - RNA, 19 nt, Homo sapiens
guacuacuaugggcauuac

SEQ ID NO: 1306111 - RNA, 19 nt, Homo sapiens
ggugauucgugucaucugu

SEQ ID NO: 1306112 - RNA, 19 nt, Homo sapiens
gcugucagauaccauccaa

SEQ ID NO: 1306113 - RNA, 19 nt, Homo sapiens
caggauggauuuucuuuug

SEQ ID NO: 1306114 - RNA, 19 nt, Homo sapiens
ggagaucaucgcccucuuc

SEQ ID NO: 1306115 - RNA, 19 nt, Homo sapiens
ccaccauguucucggauau

SEQ ID NO: 1306116 - RNA, 19 nt, Homo sapiens
gaacggacacaucuaugac

SEQ ID NO: 1306117 - RNA, 19 nt, Homo sapiens
gugcucagccuccucauca

SEQ ID NO: 1306118 - RNA, 19 nt, Homo sapiens
cggaagagcgaaggaauga

SEQ ID NO: 1306119 - RNA, 19 nt, Homo sapiens
gcacguuugccaccauguu

SEQ ID NO: 1306120 - RNA, 19 nt, Homo sapiens
ccaugaaggcccuacagaa

SEQ ID NO: 1306121 - RNA, 19 nt, Homo sapiens
cugcacaccucccgaaagu

SEQ ID NO: 1306122 - RNA, 19 nt, Homo sapiens
auaaagcuccuguuucuag

SEQ ID NO: 1306123 - RNA, 19 nt, Homo sapiens
ucaaugacgagaacacaga

SEQ ID NO: 1306124 - RNA, 19 nt, Homo sapiens
ccaagcccgugcucuaugg

SEQ ID NO: 1306125 - RNA, 19 nt, Homo sapiens
gaaaucgagaugagcaagu

SEQ ID NO: 1306126 - RNA, 19 nt, Homo sapiens
gagaucaucgcccucuuca

SEQ ID NO: 1306127 - RNA, 19 nt, Homo sapiens
caugaaggcccuacagaag

SEQ ID NO: 1306128 - RNA, 19 nt, Homo sapiens
ccaccucccuggauaacgu

SEQ ID NO: 1306129 - RNA, 19 nt, Homo sapiens
agaauaaagcuccuguuuc

SEQ ID NO: 1306130 - RNA, 19 nt, Homo sapiens
agaacggacacaucuauga

SEQ ID NO: 1306131 - RNA, 19 nt, Homo sapiens
gggcuacacccucuaccaa

SEQ ID NO: 1306132 - RNA, 19 nt, Homo sapiens
ucauuuccaucacguuugu

SEQ ID NO: 1306133 - RNA, 19 nt, Homo sapiens
guuucuuccuugcgcuuua

SEQ ID NO: 1306134 - RNA, 19 nt, Homo sapiens
uggacgggccuguggaaua

SEQ ID NO: 1306135 - RNA, 19 nt, Homo sapiens
cuucacugauggcauuauu

SEQ ID NO: 1306136 - RNA, 19 nt, Homo sapiens
aagagucgaugccugaaag

SEQ ID NO: 1306137 - RNA, 19 nt, Homo sapiens
gagaacggacacaucuaug

SEQ ID NO: 1306138 - RNA, 19 nt, Homo sapiens
ugauucgugucaucuguga

SEQ ID NO: 1306139 - RNA, 19 nt, Homo sapiens
gcacauuaaagaauaaagc

SEQ ID NO: 1306140 - RNA, 19 nt, Homo sapiens
ucaucgcccucuucauuuc

SEQ ID NO: 1306141 - RNA, 19 nt, Homo sapiens
gcuuucgggucucucaaug

SEQ ID NO: 1306142 - RNA, 19 nt, Homo sapiens
gcacgcagguuccccuugu

SEQ ID NO: 1306143 - RNA, 19 nt, Homo sapiens
caagcuacuacaaguguga

SEQ ID NO: 1306144 - RNA, 19 nt, Homo sapiens
uggaggagcguguggagaa

SEQ ID NO: 1306145 - RNA, 19 nt, Homo sapiens
ccaggugauucgugucauc

SEQ ID NO: 1306146 - RNA, 19 nt, Homo sapiens
ggaugaggccuucgacacu

SEQ ID NO: 1306147 - RNA, 19 nt, Homo sapiens
gcucuacgcgcucuucucu

SEQ ID NO: 1306148 - RNA, 19 nt, Homo sapiens
cagaggaggaauucaagga

SEQ ID NO: 1306149 - RNA, 19 nt, Homo sapiens
ucauugaagccaaguacuu

SEQ ID NO: 1306150 - RNA, 19 nt, Homo sapiens
ugagcaaguuccgcuacaa

SEQ ID NO: 1306151 - RNA, 19 nt, Homo sapiens
gcucagccuccucaucaug

SEQ ID NO: 1306152 - RNA, 19 nt, Homo sapiens
gcuggugaccuuucugcuu

SEQ ID NO: 1306153 - RNA, 19 nt, Homo sapiens
ggauucaagcuacuacaag

SEQ ID NO: 1306154 - RNA, 19 nt, Homo sapiens
gcugugggcaaauacauca

SEQ ID NO: 1306155 - RNA, 19 nt, Homo sapiens
gacagcugcucaccauggu

SEQ ID NO: 1306156 - RNA, 19 nt, Homo sapiens
gggcaucugggcauuguag

SEQ ID NO: 1306157 - RNA, 19 nt, Homo sapiens
ugagcucccugcccuacau

SEQ ID NO: 1306158 - RNA, 19 nt, Homo sapiens
cuacuaugggcauuacuug

SEQ ID NO: 1306159 - RNA, 19 nt, Homo sapiens
ucacugauggcauuauugg

SEQ ID NO: 1306160 - RNA, 19 nt, Homo sapiens
guccaccugcugucagaua

SEQ ID NO: 1306161 - RNA, 19 nt, Homo sapiens
gaaucauugaagccaagua

SEQ ID NO: 1306162 - RNA, 19 nt, Homo sapiens
caaccuggaccugcucaug

SEQ ID NO: 1306163 - RNA, 19 nt, Homo sapiens
gaacuugcuggacgcacau

SEQ ID NO: 1306164 - RNA, 19 nt, Homo sapiens
ggaaauagguacucucaua

SEQ ID NO: 1306165 - RNA, 19 nt, Homo sapiens
gaacuuaaccuucagauau

SEQ ID NO: 1306166 - RNA, 19 nt, Homo sapiens
gauuacaucugcaggauaa

SEQ ID NO: 1306167 - RNA, 19 nt, Homo sapiens
ccaauaauccuacuuacua

SEQ ID NO: 1306168 - RNA, 19 nt, Homo sapiens
ugacauacguaagaaguua

SEQ ID NO: 1306169 - RNA, 19 nt, Homo sapiens
gagaagcgguugucuguuc

SEQ ID NO: 1306170 - RNA, 19 nt, Homo sapiens
gaaauagguacucucauaa

SEQ ID NO: 1306171 - RNA, 19 nt, Homo sapiens
ugacagaaguacauauuga

SEQ ID NO: 1306172 - RNA, 19 nt, Homo sapiens
aauuagagcugccucauuu

SEQ ID NO: 1306173 - RNA, 19 nt, Homo sapiens
gcucuaaauuccuuaagaa

SEQ ID NO: 1306174 - RNA, 19 nt, Homo sapiens
cauaacagcugacagaagu

SEQ ID NO: 1306175 - RNA, 19 nt, Homo sapiens
ugacagacguuuccauugu

SEQ ID NO: 1306176 - RNA, 19 nt, Homo sapiens
gcaagcaugugggaaauag

SEQ ID NO: 1306177 - RNA, 19 nt, Homo sapiens
ccauauguaucaccuauuc

SEQ ID NO: 1306178 - RNA, 19 nt, Homo sapiens
guggauagguacaggauug

SEQ ID NO: 1306179 - RNA, 19 nt, Homo sapiens
gacagacguuuccauuguu

SEQ ID NO: 1306180 - RNA, 19 nt, Homo sapiens
ggaacuuaaccuucagaua

SEQ ID NO: 1306181 - RNA, 19 nt, Homo sapiens
gugaggaaacugagacaua

SEQ ID NO: 1306182 - RNA, 19 nt, Homo sapiens
gcacuacaccuucguaacu

SEQ ID NO: 1306183 - RNA, 19 nt, Homo sapiens
gaaaagggaggguugcaua

SEQ ID NO: 1306184 - RNA, 19 nt, Homo sapiens
ucuaggaacuuaaccuuca

SEQ ID NO: 1306185 - RNA, 19 nt, Homo sapiens
gugacaggguggauaggua

SEQ ID NO: 1306186 - RNA, 19 nt, Homo sapiens
ugaggaaacugagacauag

SEQ ID NO: 1306187 - RNA, 19 nt, Homo sapiens
gcuguauacuauuccauug

SEQ ID NO: 1306188 - RNA, 19 nt, Homo sapiens
cugccaaccuugagauauu

SEQ ID NO: 1306189 - RNA, 19 nt, Homo sapiens
ucugcaggauaaauucuua

SEQ ID NO: 1306190 - RNA, 19 nt, Homo sapiens
agagcugccucauuucauu

SEQ ID NO: 1306191 - RNA, 19 nt, Homo sapiens
ccaguaguuuccacuucua

SEQ ID NO: 1306192 - RNA, 19 nt, Homo sapiens
gcugacagaaguacauauu

SEQ ID NO: 1306193 - RNA, 19 nt, Homo sapiens
uaccauauguaucaccuau

SEQ ID NO: 1306194 - RNA, 19 nt, Homo sapiens
acagacguuuccauuguuu

SEQ ID NO: 1306195 - RNA, 19 nt, Homo sapiens
cuaacucuuugauccagua

SEQ ID NO: 1306196 - RNA, 19 nt, Homo sapiens
ugagugccauacauacauu

SEQ ID NO: 1306197 - RNA, 19 nt, Homo sapiens
ggaaacugagacauagaaa

SEQ ID NO: 1306198 - RNA, 19 nt, Homo sapiens
gugcugagugccauacaua

SEQ ID NO: 1306199 - RNA, 19 nt, Homo sapiens
agaaguacauauugaagag

SEQ ID NO: 1306200 - RNA, 19 nt, Homo sapiens
gacagaaguacauauugaa

SEQ ID NO: 1306201 - RNA, 19 nt, Homo sapiens
aaagguggcucuaaauucc

SEQ ID NO: 1306202 - RNA, 19 nt, Homo sapiens
ggauuacaucugcaggaua

SEQ ID NO: 1306203 - RNA, 19 nt, Homo sapiens
gggauuacaucugcaggau

SEQ ID NO: 1306204 - RNA, 19 nt, Homo sapiens
gagcugccucauuucauuu

SEQ ID NO: 1306205 - RNA, 19 nt, Homo sapiens
ggaaagagaagcgguuguc

SEQ ID NO: 1306206 - RNA, 19 nt, Homo sapiens
aauagguacucucauaaca

SEQ ID NO: 1306207 - RNA, 19 nt, Homo sapiens
guacaggauugggagacuu

SEQ ID NO: 1306208 - RNA, 19 nt, Homo sapiens
ggcucuaaauuccuuaaga

SEQ ID NO: 1306209 - RNA, 19 nt, Homo sapiens
gaaacugagacauagaaag

SEQ ID NO: 1306210 - RNA, 19 nt, Homo sapiens
caauuagagcugccucauu

SEQ ID NO: 1306211 - RNA, 19 nt, Homo sapiens
ucucauaacagcugacaga

SEQ ID NO: 1306212 - RNA, 19 nt, Homo sapiens
cagaaguacauauugaaga

SEQ ID NO: 1306213 - RNA, 19 nt, Homo sapiens
cuauuugucuaaagaaugg

SEQ ID NO: 1306214 - RNA, 19 nt, Homo sapiens
acucuuugauccaguaguu

SEQ ID NO: 1306215 - RNA, 19 nt, Homo sapiens
gcacuaacucuuugaucca

SEQ ID NO: 1306216 - RNA, 19 nt, Homo sapiens
gcuguaaugaauauucuug

SEQ ID NO: 1306217 - RNA, 19 nt, Homo sapiens
aagagaagcgguugucugu

SEQ ID NO: 1306218 - RNA, 19 nt, Homo sapiens
caacuuaaaaccauacuga

SEQ ID NO: 1306219 - RNA, 19 nt, Homo sapiens
ccaccuuccugccaaccuu

SEQ ID NO: 1306220 - RNA, 19 nt, Homo sapiens
aagggaggguugcauaaca

SEQ ID NO: 1306221 - RNA, 19 nt, Homo sapiens
uccauuguuuccugucuuu

SEQ ID NO: 1306222 - RNA, 19 nt, Homo sapiens
guuauuacugcaucauuug

SEQ ID NO: 1306223 - RNA, 19 nt, Homo sapiens
gcaugcuguucugcacuuu

SEQ ID NO: 1306224 - RNA, 19 nt, Homo sapiens
aaacugagacauagaaagc

SEQ ID NO: 1306225 - RNA, 19 nt, Homo sapiens
uuacaggugaggaaacuga

SEQ ID NO: 1306226 - RNA, 19 nt, Homo sapiens
cuugagauauuguaugcau

SEQ ID NO: 1306227 - RNA, 19 nt, Homo sapiens
gaggaaacugagacauaga

SEQ ID NO: 1306228 - RNA, 19 nt, Homo sapiens
ugagacauagaaagcuuaa

SEQ ID NO: 1306229 - RNA, 19 nt, Homo sapiens
gagggugacaggguggaua

SEQ ID NO: 1306230 - RNA, 19 nt, Homo sapiens
ucaauuuacaggugaggaa

SEQ ID NO: 1306231 - RNA, 19 nt, Homo sapiens
guaguuuccacuucuagga

SEQ ID NO: 1306232 - RNA, 19 nt, Homo sapiens
cagauuggcaaagaucaaa

SEQ ID NO: 1306233 - RNA, 19 nt, Homo sapiens
caaccuugagauauuguau

SEQ ID NO: 1306234 - RNA, 19 nt, Homo sapiens
acacuccaaucuccaccuu

SEQ ID NO: 1306235 - RNA, 19 nt, Homo sapiens
gaaagagaagcgguugucu

SEQ ID NO: 1306236 - RNA, 19 nt, Homo sapiens
cacuguaucuccuuuugua

SEQ ID NO: 1306237 - RNA, 19 nt, Homo sapiens
gcaauuagagcugccucau

SEQ ID NO: 1306238 - RNA, 19 nt, Homo sapiens
aaaccauacugagauccuu

SEQ ID NO: 1306239 - RNA, 19 nt, Homo sapiens
agaagcgguugucuguuca

SEQ ID NO: 1306240 - RNA, 19 nt, Homo sapiens
acuccuagcuggcaagcau

SEQ ID NO: 1306241 - RNA, 19 nt, Homo sapiens
cagcugacagaaguacaua

SEQ ID NO: 1306242 - RNA, 19 nt, Homo sapiens
acugagacauagaaagcuu

SEQ ID NO: 1306243 - RNA, 19 nt, Homo sapiens
gaaaugcaacuuaaaacca

SEQ ID NO: 1306244 - RNA, 19 nt, Homo sapiens
ggcaagcaugugggaaaua

SEQ ID NO: 1306245 - RNA, 19 nt, Homo sapiens
gcugagugccauacauaca

SEQ ID NO: 1306246 - RNA, 19 nt, Homo sapiens
acugucagauuggcaaaga

SEQ ID NO: 1306247 - RNA, 19 nt, Homo sapiens
caauuuacaggugaggaaa

SEQ ID NO: 1306248 - RNA, 19 nt, Homo sapiens
ugccaaccuugagauauug

SEQ ID NO: 1306249 - RNA, 19 nt, Homo sapiens
gccauacauacauuucauu

SEQ ID NO: 1306250 - RNA, 19 nt, Homo sapiens
gaaguuauuacugcaucau

SEQ ID NO: 1306251 - RNA, 19 nt, Homo sapiens
uggcaagcaugugggaaau

SEQ ID NO: 1306252 - RNA, 19 nt, Homo sapiens
gggagacuuuucacuguau

SEQ ID NO: 1306253 - RNA, 19 nt, Homo sapiens
uacaucugcaggauaaauu

SEQ ID NO: 1306254 - RNA, 19 nt, Homo sapiens
gucccuauacuaauugaga

SEQ ID NO: 1306255 - RNA, 19 nt, Homo sapiens
ugccauacauacauuucau

SEQ ID NO: 1306256 - RNA, 19 nt, Homo sapiens
uuagagcugccucauuuca

SEQ ID NO: 1306257 - RNA, 19 nt, Homo sapiens
agaaguuauuacugcauca

SEQ ID NO: 1306258 - RNA, 19 nt, Homo sapiens
gauccaguaguuuccacuu

SEQ ID NO: 1306259 - RNA, 19 nt, Homo sapiens
uaaagaagaugaggcaaga

SEQ ID NO: 1306260 - RNA, 19 nt, Homo sapiens
agagaaacaugaggaauaa

SEQ ID NO: 1306261 - RNA, 19 nt, Homo sapiens
ggaauucaccuucuucuuc

SEQ ID NO: 1306262 - RNA, 19 nt, Homo sapiens
cagagaaacaugaggaaua

SEQ ID NO: 1306263 - RNA, 19 nt, Homo sapiens
gaagaugaggcaagagaaa

SEQ ID NO: 1306264 - RNA, 19 nt, Homo sapiens
gaauucaccuucuucuucu

SEQ ID NO: 1306265 - RNA, 19 nt, Homo sapiens
cagcugaacccgaggcuaa

SEQ ID NO: 1306266 - RNA, 19 nt, Homo sapiens
ggaauaaaggucacaugca

SEQ ID NO: 1306267 - RNA, 19 nt, Homo sapiens
gaaacaugaggaauaaagg

SEQ ID NO: 1306268 - RNA, 19 nt, Homo sapiens
ucaagucagagaaacauga

SEQ ID NO: 1306269 - RNA, 19 nt, Homo sapiens
gauguccgcagcagccauu

SEQ ID NO: 1306270 - RNA, 19 nt, Homo sapiens
agaaacaugaggaauaaag

SEQ ID NO: 1306271 - RNA, 19 nt, Homo sapiens
aagaagaugaggcaagaga

SEQ ID NO: 1306272 - RNA, 19 nt, Homo sapiens
ccacucaagucagagaaac

SEQ ID NO: 1306273 - RNA, 19 nt, Homo sapiens
gggaauucaccuucuucuu

SEQ ID NO: 1306274 - RNA, 19 nt, Homo sapiens
gaggaauaaaggucacaug

SEQ ID NO: 1306275 - RNA, 19 nt, Homo sapiens
gagaaacaugaggaauaaa

SEQ ID NO: 1306276 - RNA, 19 nt, Homo sapiens
cuccauagcagccaagaug

SEQ ID NO: 1306277 - RNA, 19 nt, Homo sapiens
ggacggccucaccaugaug

SEQ ID NO: 1306278 - RNA, 19 nt, Homo sapiens
cauagcagccaagaugaug

SEQ ID NO: 1306279 - RNA, 19 nt, Homo sapiens
aaacaugaggaauaaaggu

SEQ ID NO: 1306280 - RNA, 19 nt, Homo sapiens
acccgaggcuaaagaagau

SEQ ID NO: 1306281 - RNA, 19 nt, Homo sapiens
ugagcgaacucgguuauaa

SEQ ID NO: 1306282 - RNA, 19 nt, Homo sapiens
gaagucaugcauuucuuga

SEQ ID NO: 1306283 - RNA, 19 nt, Homo sapiens
guuggaaccugcaauaaac

SEQ ID NO: 1306284 - RNA, 19 nt, Homo sapiens
ggaagucaugcauuucuug

SEQ ID NO: 1306285 - RNA, 19 nt, Homo sapiens
gggaagucaugcauuucuu

SEQ ID NO: 1306286 - RNA, 19 nt, Homo sapiens
gcgucaagcucaccgacuu

SEQ ID NO: 1306287 - RNA, 19 nt, Homo sapiens
gcaugggcgucgugcucua

SEQ ID NO: 1306288 - RNA, 19 nt, Homo sapiens
ccacauccaagaaguacaa

SEQ ID NO: 1306289 - RNA, 19 nt, Homo sapiens
gaaaacgagacaauugaaa

SEQ ID NO: 1306290 - RNA, 19 nt, Homo sapiens
ccgcuucccucccuuucuu

SEQ ID NO: 1306291 - RNA, 19 nt, Homo sapiens
gagcgaacucgguuauaag

SEQ ID NO: 1306292 - RNA, 19 nt, Homo sapiens
gugcacgucuucgaguuca

SEQ ID NO: 1306293 - RNA, 19 nt, Homo sapiens
gcagcuacuccaaggugaa

SEQ ID NO: 1306294 - RNA, 19 nt, Homo sapiens
guccgcaguugcccuuguu

SEQ ID NO: 1306295 - RNA, 19 nt, Homo sapiens
cgagacaauugaaaaguca

SEQ ID NO: 1306296 - RNA, 19 nt, Homo sapiens
gcuuagacccgagauugga

SEQ ID NO: 1306297 - RNA, 19 nt, Homo sapiens
gagagggcagcuacuccaa

SEQ ID NO: 1306298 - RNA, 19 nt, Homo sapiens
uggcuuagacccgagauug

SEQ ID NO: 1306299 - RNA, 19 nt, Homo sapiens
ccgggugguuccagccauu

SEQ ID NO: 1306300 - RNA, 19 nt, Homo sapiens
gaccugagcaccaccuacu

SEQ ID NO: 1306301 - RNA, 19 nt, Homo sapiens
gcaacgggaaacuguacau

SEQ ID NO: 1306302 - RNA, 19 nt, Homo sapiens
gcucauggcgaagagacuu

SEQ ID NO: 1306303 - RNA, 19 nt, Homo sapiens
ccagagcucauggcgaaga

SEQ ID NO: 1306304 - RNA, 19 nt, Homo sapiens
ccggggaagucaugcauuu

SEQ ID NO: 1306305 - RNA, 19 nt, Homo sapiens
gcaugcgcauccgcgauuc

SEQ ID NO: 1306306 - RNA, 19 nt, Homo sapiens
gaagaaagcagaauaaaca

SEQ ID NO: 1306307 - RNA, 19 nt, Homo sapiens
gaaagaaaaucgcaggaaa

SEQ ID NO: 1306308 - RNA, 19 nt, Homo sapiens
gaacgccggugcagaugug

SEQ ID NO: 1306309 - RNA, 19 nt, Homo sapiens
caaggaagaaagcagaaua

SEQ ID NO: 1306310 - RNA, 19 nt, Homo sapiens
gagcggccaucgcguagaa

SEQ ID NO: 1306311 - RNA, 19 nt, Homo sapiens
ggacuuagaggccgaaauc

SEQ ID NO: 1306312 - RNA, 19 nt, Homo sapiens
gcucacagguguccuuagu

SEQ ID NO: 1306313 - RNA, 19 nt, Homo sapiens
ggugugacuugguuccuuu

SEQ ID NO: 1306314 - RNA, 19 nt, Homo sapiens
ggaacuggcuguggaaugc

SEQ ID NO: 1306315 - RNA, 19 nt, Homo sapiens
gugcagaugugcuucuugu

SEQ ID NO: 1306316 - RNA, 19 nt, Homo sapiens
ggacaggauccaagauguu

SEQ ID NO: 1306317 - RNA, 19 nt, Homo sapiens
gaauguggaggauagacua

SEQ ID NO: 1306318 - RNA, 19 nt, Homo sapiens
cagcgaauguggaggauag

SEQ ID NO: 1306319 - RNA, 19 nt, Homo sapiens
gaaaaucgcaggaaaaucu

SEQ ID NO: 1306320 - RNA, 19 nt, Homo sapiens
ggaagaaagcagaauaaac

SEQ ID NO: 1306321 - RNA, 19 nt, Homo sapiens
ccagugaccaggaguuaaa

SEQ ID NO: 1306322 - RNA, 19 nt, Homo sapiens
gcaccagauuggccucaga

SEQ ID NO: 1306323 - RNA, 19 nt, Homo sapiens
gaacuggcaccgacagaca

SEQ ID NO: 1306324 - RNA, 19 nt, Homo sapiens
gggacaggauccaagaugu

SEQ ID NO: 1306325 - RNA, 19 nt, Homo sapiens
gugccgcuguuaucuauga

SEQ ID NO: 1306326 - RNA, 19 nt, Homo sapiens
caacagcagcaacaauuuc

SEQ ID NO: 1306327 - RNA, 19 nt, Homo sapiens
ccagacaccuuggcuguag

SEQ ID NO: 1306328 - RNA, 19 nt, Homo sapiens
gaccagugaccaggaguua

SEQ ID NO: 1306329 - RNA, 19 nt, Homo sapiens
ggacaggugcccacuacau

SEQ ID NO: 1306330 - RNA, 19 nt, Homo sapiens
agacccaguucuuucauug

SEQ ID NO: 1306331 - RNA, 19 nt, Homo sapiens
ccaacagcagcaacaauuu

SEQ ID NO: 1306332 - RNA, 19 nt, Homo sapiens
gcuguuaucuaugacuuuc

SEQ ID NO: 1306333 - RNA, 19 nt, Homo sapiens
cagugccgcuguuaucuau

SEQ ID NO: 1306334 - RNA, 19 nt, Homo sapiens
gaaauccaccccuugaaaa

SEQ ID NO: 1306335 - RNA, 19 nt, Homo sapiens
cagcccauguccugagaaa

SEQ ID NO: 1306336 - RNA, 19 nt, Homo sapiens
gggcagacccaguucuuuc

SEQ ID NO: 1306337 - RNA, 19 nt, Homo sapiens
gggaaacccuguggaacca

SEQ ID NO: 1306338 - RNA, 19 nt, Homo sapiens
gugaauaucccaaggaacu

SEQ ID NO: 1306339 - RNA, 19 nt, Homo sapiens
caggacaggugcccacuac

SEQ ID NO: 1306340 - RNA, 19 nt, Homo sapiens
ucauugcagucaacuuguu

SEQ ID NO: 1306341 - RNA, 19 nt, Homo sapiens
uaccaguccuccaugauca

SEQ ID NO: 1306342 - RNA, 19 nt, Homo sapiens
gcucagccuucuucuucug

SEQ ID NO: 1306343 - RNA, 19 nt, Homo sapiens
cagacccaguucuuucauu

SEQ ID NO: 1306344 - RNA, 19 nt, Homo sapiens
cagcaggaguccacaucga

SEQ ID NO: 1306345 - RNA, 19 nt, Homo sapiens
gggaugugcccgugauguu

SEQ ID NO: 1306346 - RNA, 19 nt, Homo sapiens
aaggaagaaagcagaauaa

SEQ ID NO: 1306347 - RNA, 19 nt, Homo sapiens
ggccaucgcguagaaagaa

SEQ ID NO: 1306348 - RNA, 19 nt, Homo sapiens
ggccuggucucugugauca

SEQ ID NO: 1306349 - RNA, 19 nt, Homo sapiens
ccgcucagccuucuucuuc

SEQ ID NO: 1306350 - RNA, 19 nt, Homo sapiens
gccagagccuguggagaga

SEQ ID NO: 1306351 - RNA, 19 nt, Homo sapiens
ggaugugcccgugauguug

SEQ ID NO: 1306352 - RNA, 19 nt, Homo sapiens
ccacagcucacgaccagau

SEQ ID NO: 1306353 - RNA, 19 nt, Homo sapiens
agccaaagcagccugauga

SEQ ID NO: 1306354 - RNA, 19 nt, Homo sapiens
ggucacagagccugagcuu

SEQ ID NO: 1306355 - RNA, 19 nt, Homo sapiens
ugcuggagcuggccaaugu

SEQ ID NO: 1306356 - RNA, 19 nt, Homo sapiens
gacaggauccaagauguuc

SEQ ID NO: 1306357 - RNA, 19 nt, Homo sapiens
gcaggaaaaucugggaaau

SEQ ID NO: 1306358 - RNA, 19 nt, Homo sapiens
gcuguggaaugcguguuug

SEQ ID NO: 1306359 - RNA, 19 nt, Homo sapiens
caaggaacuggcuguggaa

SEQ ID NO: 1306360 - RNA, 19 nt, Homo sapiens
cugcaugugcugugaauau

SEQ ID NO: 1306361 - RNA, 19 nt, Homo sapiens
gcuacaaaccagacaccuu

SEQ ID NO: 1306362 - RNA, 19 nt, Homo sapiens
agagaccuguggcccaaga

SEQ ID NO: 1306363 - RNA, 19 nt, Homo sapiens
augcaggacucaccucugu

SEQ ID NO: 1306364 - RNA, 19 nt, Homo sapiens
gaccaccgcucagccuucu

SEQ ID NO: 1306365 - RNA, 19 nt, Homo sapiens
gagcagugcgcuaccugau

SEQ ID NO: 1306366 - RNA, 19 nt, Homo sapiens
gacaggugcccacuacauc

SEQ ID NO: 1306367 - RNA, 19 nt, Homo sapiens
ggagcuggccaaugucucu

SEQ ID NO: 1306368 - RNA, 19 nt, Homo sapiens
aaaguggcuuccuccuuca

SEQ ID NO: 1306369 - RNA, 19 nt, Homo sapiens
ggcuguggaugauauaaac

SEQ ID NO: 1306370 - RNA, 19 nt, Homo sapiens
ucugugcccucucaguaga

SEQ ID NO: 1306371 - RNA, 19 nt, Homo sapiens
gucagucugugcccucuca

SEQ ID NO: 1306372 - RNA, 19 nt, Homo sapiens
ccacacagggccucacucu

SEQ ID NO: 1306373 - RNA, 19 nt, Homo sapiens
ggcagcccauguccugaga

SEQ ID NO: 1306374 - RNA, 19 nt, Homo sapiens
gcagccauggugcucugua

SEQ ID NO: 1306375 - RNA, 19 nt, Homo sapiens
accaacagcagcaacaauu

SEQ ID NO: 1306376 - RNA, 19 nt, Homo sapiens
cugugaauaucccaaggaa

SEQ ID NO: 1306377 - RNA, 19 nt, Homo sapiens
ccuuaccaguccuccauga

SEQ ID NO: 1306378 - RNA, 19 nt, Homo sapiens
gguguucgucgucucauuc

SEQ ID NO: 1306379 - RNA, 19 nt, Homo sapiens
cagcaccgggcaccagauu

SEQ ID NO: 1306380 - RNA, 19 nt, Homo sapiens
guucuuucauugcagucaa

SEQ ID NO: 1306381 - RNA, 19 nt, Homo sapiens
agucugugcccucucagua

SEQ ID NO: 1306382 - RNA, 19 nt, Homo sapiens
gggugugacuugguuccuu

SEQ ID NO: 1306383 - RNA, 19 nt, Homo sapiens
ggaacgccggugcagaugu

SEQ ID NO: 1306384 - RNA, 19 nt, Homo sapiens
cgaaauccaccccuugaaa

SEQ ID NO: 1306385 - RNA, 19 nt, Homo sapiens
ccgcuguuaucuaugacuu

SEQ ID NO: 1306386 - RNA, 19 nt, Homo sapiens
gauccuguuucuggaccuu

SEQ ID NO: 1306387 - RNA, 19 nt, Homo sapiens
ggaccacaaggacuuagag

SEQ ID NO: 1306388 - RNA, 19 nt, Homo sapiens
uuucauugcagucaacuug

SEQ ID NO: 1306389 - RNA, 19 nt, Homo sapiens
ggcagacccaguucuuuca

SEQ ID NO: 1306390 - RNA, 19 nt, Homo sapiens
cugggcagcagcagccuua

SEQ ID NO: 1306391 - RNA, 19 nt, Homo sapiens
ccaccgcucagccuucuuc

SEQ ID NO: 1306392 - RNA, 19 nt, Homo sapiens
ggucagagguuacagauaa

SEQ ID NO: 1306393 - RNA, 19 nt, Homo sapiens
ggaagaggcugcagauaau

SEQ ID NO: 1306394 - RNA, 19 nt, Homo sapiens
ggaagaggcugcagauaau

SEQ ID NO: 1306395 - RNA, 19 nt, Homo sapiens
ggaagaggcugcagauaau

SEQ ID NO: 1306396 - RNA, 19 nt, Homo sapiens
gaagcgaccuggagaguga

SEQ ID NO: 1306397 - RNA, 19 nt, Homo sapiens
gggaggacgucgacuauuu

SEQ ID NO: 1306398 - RNA, 19 nt, Homo sapiens
ggaaacaggucaagacagu

SEQ ID NO: 1306399 - RNA, 19 nt, Homo sapiens
ccaggaagcugaagucuca

SEQ ID NO: 1306400 - RNA, 19 nt, Homo sapiens
uaacaacccucuuuauucu

SEQ ID NO: 1306401 - RNA, 19 nt, Homo sapiens
gggaagaggcugcagauaa

SEQ ID NO: 1306402 - RNA, 19 nt, Homo sapiens
gggaagaggcugcagauaa

SEQ ID NO: 1306403 - RNA, 19 nt, Homo sapiens
gggaagaggcugcagauaa

SEQ ID NO: 1306404 - RNA, 19 nt, Homo sapiens
gagaugcucugccucugaa

SEQ ID NO: 1306405 - RNA, 19 nt, Homo sapiens
gggaagaggccguacauga

SEQ ID NO: 1306406 - RNA, 19 nt, Homo sapiens
gcaagaagaccagcuguga

SEQ ID NO: 1306407 - RNA, 19 nt, Homo sapiens
cuuaaagacucucgagaaa

SEQ ID NO: 1306408 - RNA, 19 nt, Homo sapiens
gaaguccugucccaaguuc

SEQ ID NO: 1306409 - RNA, 19 nt, Homo sapiens
gggagaggcugcagauagu

SEQ ID NO: 1306410 - RNA, 19 nt, Homo sapiens
ggucacagggcacagauaa

SEQ ID NO: 1306411 - RNA, 19 nt, Homo sapiens
acacacaccaucugauuaa

SEQ ID NO: 1306412 - RNA, 19 nt, Homo sapiens
gagugaggaugaugaggaa

SEQ ID NO: 1306413 - RNA, 19 nt, Homo sapiens
ccacacacaccaucugauu

SEQ ID NO: 1306414 - RNA, 19 nt, Homo sapiens
guacaugaccagagggaaa

SEQ ID NO: 1306415 - RNA, 19 nt, Homo sapiens
ggagugcaguggcaugauc

SEQ ID NO: 1306416 - RNA, 19 nt, Homo sapiens
ccucuuuauucucuuguua

SEQ ID NO: 1306417 - RNA, 19 nt, Homo sapiens
cuaacaacccucuuuauuc

SEQ ID NO: 1306418 - RNA, 19 nt, Homo sapiens
ccuaacaacccucuuuauu

SEQ ID NO: 1306419 - RNA, 19 nt, Homo sapiens
gcaagaaggugcgcaaaau

SEQ ID NO: 1306420 - RNA, 19 nt, Homo sapiens
gggaaacgcgggagauguu

SEQ ID NO: 1306421 - RNA, 19 nt, Homo sapiens
ggaggagagugcagcagau

SEQ ID NO: 1306422 - RNA, 19 nt, Homo sapiens
caccaaggaagcagaauuu

SEQ ID NO: 1306423 - RNA, 19 nt, Homo sapiens
ggaggacgucgacuauuug

SEQ ID NO: 1306424 - RNA, 19 nt, Homo sapiens
gaucaacugggccuccuuu

SEQ ID NO: 1306425 - RNA, 19 nt, Homo sapiens
gaagagauuggaggcguuu

SEQ ID NO: 1306426 - RNA, 19 nt, Homo sapiens
gcaguggcaugaucauaac

SEQ ID NO: 1306427 - RNA, 19 nt, Homo sapiens
ggaaggggcugcagguaau

SEQ ID NO: 1306428 - RNA, 19 nt, Homo sapiens
gcgaaguccugucccaagu

SEQ ID NO: 1306429 - RNA, 19 nt, Homo sapiens
gauggaggcccaagaucaa

SEQ ID NO: 1306430 - RNA, 19 nt, Homo sapiens
gucccucccucaagacuaa

SEQ ID NO: 1306431 - RNA, 19 nt, Homo sapiens
aaacaggucaagacaguga

SEQ ID NO: 1306432 - RNA, 19 nt, Homo sapiens
guaggcauccuggaaauug

SEQ ID NO: 1306433 - RNA, 19 nt, Homo sapiens
ccaccuaacaacccucuuu

SEQ ID NO: 1306434 - RNA, 19 nt, Homo sapiens
gagcugggacaccacguuu

SEQ ID NO: 1306435 - RNA, 19 nt, Homo sapiens
ggaagaggccguacaugac

SEQ ID NO: 1306436 - RNA, 19 nt, Homo sapiens
gagguuacagauaaucaaa

SEQ ID NO: 1306437 - RNA, 19 nt, Homo sapiens
gaagaucggcaagguguuc

SEQ ID NO: 1306438 - RNA, 19 nt, Homo sapiens
gcaagguguuccgcaagga

SEQ ID NO: 1306439 - RNA, 19 nt, Homo sapiens
uaaagacucucgagaaaag

SEQ ID NO: 1306440 - RNA, 19 nt, Homo sapiens
gcaaaaugcccgucagcua

SEQ ID NO: 1306441 - RNA, 19 nt, Homo sapiens
caccuaacaacccucuuua

SEQ ID NO: 1306442 - RNA, 19 nt, Homo sapiens
gguuacagauaaucaaagg

SEQ ID NO: 1306443 - RNA, 19 nt, Homo sapiens
ggccucagcuguccaaagc

SEQ ID NO: 1306444 - RNA, 19 nt, Homo sapiens
ucacguaggcauccuggaa

SEQ ID NO: 1306445 - RNA, 19 nt, Homo sapiens
ucaaacuucuggccucaag

SEQ ID NO: 1306446 - RNA, 19 nt, Homo sapiens
uuaagaagaucggcaaggu

SEQ ID NO: 1306447 - RNA, 19 nt, Homo sapiens
cccgaugucugcaaagaug

SEQ ID NO: 1306448 - RNA, 19 nt, Homo sapiens
ccgacugccucauucuuug

SEQ ID NO: 1306449 - RNA, 19 nt, Homo sapiens
cacacacaccaucugauua

SEQ ID NO: 1306450 - RNA, 19 nt, Homo sapiens
ccacgucuccaccuaacaa

SEQ ID NO: 1306451 - RNA, 19 nt, Homo sapiens
ucaaagggaagaggccaua

SEQ ID NO: 1306452 - RNA, 19 nt, Homo sapiens
ccaccaaggaagcagaauu

SEQ ID NO: 1306453 - RNA, 19 nt, Homo sapiens
gcagggagagcaagaagac

SEQ ID NO: 1306454 - RNA, 19 nt, Homo sapiens
ggacagguggcgggaguau

SEQ ID NO: 1306455 - RNA, 19 nt, Homo sapiens
aaauacugauucccuguag

SEQ ID NO: 1306456 - RNA, 19 nt, Homo sapiens
gacaccacguuuccagcuu

SEQ ID NO: 1306457 - RNA, 19 nt, Homo sapiens
gaggugagggcuagagaca

SEQ ID NO: 1306458 - RNA, 19 nt, Homo sapiens
cgauggaggcccaagauca

SEQ ID NO: 1306459 - RNA, 19 nt, Homo sapiens
ugcaguggcaugaucauaa

SEQ ID NO: 1306460 - RNA, 19 nt, Homo sapiens
ccacggugcagagcucuaa

SEQ ID NO: 1306461 - RNA, 19 nt, Homo sapiens
uaggcauccuggaaauuga

SEQ ID NO: 1306462 - RNA, 19 nt, Homo sapiens
ucacugcagccucaaacuu

SEQ ID NO: 1306463 - RNA, 19 nt, Homo sapiens
gagggaagaggcugcagau

SEQ ID NO: 1306464 - RNA, 19 nt, Homo sapiens
gagggaagaggcugcagau

SEQ ID NO: 1306465 - RNA, 19 nt, Homo sapiens
cagauaaucagagggaaga

SEQ ID NO: 1306466 - RNA, 19 nt, Homo sapiens
cuucuggccucaagugauc

SEQ ID NO: 1306467 - RNA, 19 nt, Homo sapiens
acaacccucuuuauucucu

SEQ ID NO: 1306468 - RNA, 19 nt, Homo sapiens
cgacuggaccgucuuuguc

SEQ ID NO: 1306469 - RNA, 19 nt, Homo sapiens
gaagaggcugcagauaauc

SEQ ID NO: 1306470 - RNA, 19 nt, Homo sapiens
gaagaggcugcagauaauc

SEQ ID NO: 1306471 - RNA, 19 nt, Homo sapiens
gaagaggcugcagauaauc

SEQ ID NO: 1306472 - RNA, 19 nt, Homo sapiens
gagaggcugcagauaguca

SEQ ID NO: 1306473 - RNA, 19 nt, Homo sapiens
ggagagugcagcagauggu

SEQ ID NO: 1306474 - RNA, 19 nt, Homo sapiens
gauaucacccuggagaucu

SEQ ID NO: 1306475 - RNA, 19 nt, Homo sapiens
uccagucccucccucaaga

SEQ ID NO: 1306476 - RNA, 19 nt, Homo sapiens
gcgccucggccauauugaa

SEQ ID NO: 1306477 - RNA, 19 nt, Homo sapiens
gcacguacgacagcagcaa

SEQ ID NO: 1306478 - RNA, 19 nt, Homo sapiens
cagauaaccacagggaaga

SEQ ID NO: 1306479 - RNA, 19 nt, Homo sapiens
cagauaaccagagggaaga

SEQ ID NO: 1306480 - RNA, 19 nt, Homo sapiens
ucagcuaccugggcagcaa

SEQ ID NO: 1306481 - RNA, 19 nt, Homo sapiens
ggagcugggacaccacguu

SEQ ID NO: 1306482 - RNA, 19 nt, Homo sapiens
gagcagggagagcaagaag

SEQ ID NO: 1306483 - RNA, 19 nt, Homo sapiens
gggcaggagaggucaggaa

SEQ ID NO: 1306484 - RNA, 19 nt, Homo sapiens
uguccagggugcagauaau

SEQ ID NO: 1306485 - RNA, 19 nt, Homo sapiens
acagguggcgggaguaugu

SEQ ID NO: 1306486 - RNA, 19 nt, Homo sapiens
cacacaccaucugauuaaa

SEQ ID NO: 1306487 - RNA, 19 nt, Homo sapiens
ccaagggaccacaggaaca

SEQ ID NO: 1306488 - RNA, 19 nt, Homo sapiens
gcccaagggaccacaggaa

SEQ ID NO: 1306489 - RNA, 19 nt, Homo sapiens
gaggagagugcagcagaug

SEQ ID NO: 1306490 - RNA, 19 nt, Homo sapiens
cagcgccucggccauauug

SEQ ID NO: 1306491 - RNA, 19 nt, Homo sapiens
augcugggauuacagaugu

SEQ ID NO: 1306492 - RNA, 19 nt, Homo sapiens
aaagauggcucagcuauuu

SEQ ID NO: 1306493 - RNA, 19 nt, Homo sapiens
ugagugagcugaauucuug

SEQ ID NO: 1306494 - RNA, 19 nt, Homo sapiens
ggaauaaaguggcuuacga

SEQ ID NO: 1306495 - RNA, 19 nt, Homo sapiens
ucagggaccuuuggaaaua

SEQ ID NO: 1306496 - RNA, 19 nt, Homo sapiens
ugaaaugcauguuuaguga

SEQ ID NO: 1306497 - RNA, 19 nt, Homo sapiens
ggacggaaauggcuauauc

SEQ ID NO: 1306498 - RNA, 19 nt, Homo sapiens
gcaaagggaggcccaaauu

SEQ ID NO: 1306499 - RNA, 19 nt, Homo sapiens
gagcacuaauacaaucuua

SEQ ID NO: 1306500 - RNA, 19 nt, Homo sapiens
ggacagacuucgugguguu

SEQ ID NO: 1306501 - RNA, 19 nt, Homo sapiens
gcacaaauguaccaaucga

SEQ ID NO: 1306502 - RNA, 19 nt, Homo sapiens
gacaauagacuuuagagaa

SEQ ID NO: 1306503 - RNA, 19 nt, Homo sapiens
uaagaugguuuccucugua

SEQ ID NO: 1306504 - RNA, 19 nt, Homo sapiens
gaacuugccacuaagagaa

SEQ ID NO: 1306505 - RNA, 19 nt, Homo sapiens
uaaucuaugugcaugguua

SEQ ID NO: 1306506 - RNA, 19 nt, Homo sapiens
gaauugaaagcuaagagua

SEQ ID NO: 1306507 - RNA, 19 nt, Homo sapiens
gcaagugugucugugguuu

SEQ ID NO: 1306508 - RNA, 19 nt, Homo sapiens
gaacuucccagugguuuaa

SEQ ID NO: 1306509 - RNA, 19 nt, Homo sapiens
cugcaugccucaagguuua

SEQ ID NO: 1306510 - RNA, 19 nt, Homo sapiens
gaagucauaucugucuuug

SEQ ID NO: 1306511 - RNA, 19 nt, Homo sapiens
gaccuagcaugcccuauug

SEQ ID NO: 1306512 - RNA, 19 nt, Homo sapiens
gagcauggacuguuaaauc

SEQ ID NO: 1306513 - RNA, 19 nt, Homo sapiens
aaauggagaugggacaaua

SEQ ID NO: 1306514 - RNA, 19 nt, Homo sapiens
ccaggaaggucuuuguaug

SEQ ID NO: 1306515 - RNA, 19 nt, Homo sapiens
ucaagggacuggaauaaag

SEQ ID NO: 1306516 - RNA, 19 nt, Homo sapiens
ucuaaugucucuguucuaa

SEQ ID NO: 1306517 - RNA, 19 nt, Homo sapiens
ccacugacccugucuguau

SEQ ID NO: 1306518 - RNA, 19 nt, Homo sapiens
cagaccaaauuaaguguuu

SEQ ID NO: 1306519 - RNA, 19 nt, Homo sapiens
guauaaaggcuucuugaga

SEQ ID NO: 1306520 - RNA, 19 nt, Homo sapiens
cgaauuaaccuaagacaca

SEQ ID NO: 1306521 - RNA, 19 nt, Homo sapiens
gaaugcagacuucuauuuc

SEQ ID NO: 1306522 - RNA, 19 nt, Homo sapiens
ugacuagggcccaacuuua

SEQ ID NO: 1306523 - RNA, 19 nt, Homo sapiens
gcucugcccuuagucauga

SEQ ID NO: 1306524 - RNA, 19 nt, Homo sapiens
gacuagggcccaacuuuaa

SEQ ID NO: 1306525 - RNA, 19 nt, Homo sapiens
augaaugucugucuuguuu

SEQ ID NO: 1306526 - RNA, 19 nt, Homo sapiens
guaauuggcagcagaaauc

SEQ ID NO: 1306527 - RNA, 19 nt, Homo sapiens
gaaugucugucuuguuugg

SEQ ID NO: 1306528 - RNA, 19 nt, Homo sapiens
gaaaaugccugaagaugag

SEQ ID NO: 1306529 - RNA, 19 nt, Homo sapiens
ccuguucugucccaaauaa

SEQ ID NO: 1306530 - RNA, 19 nt, Homo sapiens
guagaggucuccggcuauu

SEQ ID NO: 1306531 - RNA, 19 nt, Homo sapiens
ggaagucauaucugucuuu

SEQ ID NO: 1306532 - RNA, 19 nt, Homo sapiens
gaaccuagagcuggaguga

SEQ ID NO: 1306533 - RNA, 19 nt, Homo sapiens
gaaaagaacagaaaagauc

SEQ ID NO: 1306534 - RNA, 19 nt, Homo sapiens
cauggacuguuaaaucuug

SEQ ID NO: 1306535 - RNA, 19 nt, Homo sapiens
uuucuaagcugugaacauu

SEQ ID NO: 1306536 - RNA, 19 nt, Homo sapiens
ccaaauccauagggugaaa

SEQ ID NO: 1306537 - RNA, 19 nt, Homo sapiens
gaagaggaaccacagaaag

SEQ ID NO: 1306538 - RNA, 19 nt, Homo sapiens
guaccaaucgacaaguaua

SEQ ID NO: 1306539 - RNA, 19 nt, Homo sapiens
ucacagguuuacacuaguu

SEQ ID NO: 1306540 - RNA, 19 nt, Homo sapiens
uaccaaaacuugccaaauu

SEQ ID NO: 1306541 - RNA, 19 nt, Homo sapiens
ugaaugcagacuucuauuu

SEQ ID NO: 1306542 - RNA, 19 nt, Homo sapiens
ggccuggaauauucaguuu

SEQ ID NO: 1306543 - RNA, 19 nt, Homo sapiens
aaagacggcuguauauaac

SEQ ID NO: 1306544 - RNA, 19 nt, Homo sapiens
agaaagagagacaucauga

SEQ ID NO: 1306545 - RNA, 19 nt, Homo sapiens
ccaaucgacaaguauauuu

SEQ ID NO: 1306546 - RNA, 19 nt, Homo sapiens
uaauaugcgugucuuugga

SEQ ID NO: 1306547 - RNA, 19 nt, Homo sapiens
uacacuaguugagcuaaua

SEQ ID NO: 1306548 - RNA, 19 nt, Homo sapiens
ccagugcacucaaguuugg

SEQ ID NO: 1306549 - RNA, 19 nt, Homo sapiens
ggaaucaguuaauguuuug

SEQ ID NO: 1306550 - RNA, 19 nt, Homo sapiens
gaccucagacacacuaauu

SEQ ID NO: 1306551 - RNA, 19 nt, Homo sapiens
cacaaaugguaacauauuc

SEQ ID NO: 1306552 - RNA, 19 nt, Homo sapiens
gagcuaauaugcgugucuu

SEQ ID NO: 1306553 - RNA, 19 nt, Homo sapiens
ggacaauagacuuuagaga

SEQ ID NO: 1306554 - RNA, 19 nt, Homo sapiens
ugcagagcauggacuguua

SEQ ID NO: 1306555 - RNA, 19 nt, Homo sapiens
agucauaucugucuuugca

SEQ ID NO: 1306556 - RNA, 19 nt, Homo sapiens
ggaaauuaaacacaaaugg

SEQ ID NO: 1306557 - RNA, 19 nt, Homo sapiens
gcgugucuuuggaaauuaa

SEQ ID NO: 1306558 - RNA, 19 nt, Homo sapiens
caucaucgccuugagugua

SEQ ID NO: 1306559 - RNA, 19 nt, Homo sapiens
ucuaagcugugaacauuuc

SEQ ID NO: 1306560 - RNA, 19 nt, Homo sapiens
aagaugguuuccucuguaa

SEQ ID NO: 1306561 - RNA, 19 nt, Homo sapiens
gaugggacaauagacuuua

SEQ ID NO: 1306562 - RNA, 19 nt, Homo sapiens
caauggaagaguuuaagaa

SEQ ID NO: 1306563 - RNA, 19 nt, Homo sapiens
gguggaaucaguuaauguu

SEQ ID NO: 1306564 - RNA, 19 nt, Homo sapiens
cuuguugccuauugugaua

SEQ ID NO: 1306565 - RNA, 19 nt, Homo sapiens
cagacacacuaauuugaau

SEQ ID NO: 1306566 - RNA, 19 nt, Homo sapiens
gaagugacagcacaagucu

SEQ ID NO: 1306567 - RNA, 19 nt, Homo sapiens
ccauugccgugcucuuuga

SEQ ID NO: 1306568 - RNA, 19 nt, Homo sapiens
gcagagcauggacuguuaa

SEQ ID NO: 1306569 - RNA, 19 nt, Homo sapiens
gaugguuuccucuguaaug

SEQ ID NO: 1306570 - RNA, 19 nt, Homo sapiens
gaaauggcuauaucagcaa

SEQ ID NO: 1306571 - RNA, 19 nt, Homo sapiens
guucagggaccuuuggaaa

SEQ ID NO: 1306572 - RNA, 19 nt, Homo sapiens
gcugggcuguucauuguca

SEQ ID NO: 1306573 - RNA, 19 nt, Homo sapiens
ggaacuugccacuaagaga

SEQ ID NO: 1306574 - RNA, 19 nt, Homo sapiens
gcagucaucaaauucauca

SEQ ID NO: 1306575 - RNA, 19 nt, Homo sapiens
gcuaauaugcgugucuuug

SEQ ID NO: 1306576 - RNA, 19 nt, Homo sapiens
gugauucuauugcaagcuu

SEQ ID NO: 1306577 - RNA, 19 nt, Homo sapiens
aaaugggccuucagcaugu

SEQ ID NO: 1306578 - RNA, 19 nt, Homo sapiens
guucaagggacuggaauaa

SEQ ID NO: 1306579 - RNA, 19 nt, Homo sapiens
cugcugggcuguucauugu

SEQ ID NO: 1306580 - RNA, 19 nt, Homo sapiens
cuaguuccuuccuuugauu

SEQ ID NO: 1306581 - RNA, 19 nt, Homo sapiens
caaagggaggcccaaauuc

SEQ ID NO: 1306582 - RNA, 19 nt, Homo sapiens
aaaagacggcuguauauaa

SEQ ID NO: 1306583 - RNA, 19 nt, Homo sapiens
uuucacagguuuacacuag

SEQ ID NO: 1306584 - RNA, 19 nt, Homo sapiens
ccaguccugugauucuauu

SEQ ID NO: 1306585 - RNA, 19 nt, Homo sapiens
uguacgaccuggacggaaa

SEQ ID NO: 1306586 - RNA, 19 nt, Homo sapiens
gcucugaaucgaaguccua

SEQ ID NO: 1306587 - RNA, 19 nt, Homo sapiens
ucagacacacuaauuugaa

SEQ ID NO: 1306588 - RNA, 19 nt, Homo sapiens
auaaagacaugggcaagug

SEQ ID NO: 1306589 - RNA, 19 nt, Homo sapiens
caccuucgaugcaaaugga

SEQ ID NO: 1306590 - RNA, 19 nt, Homo sapiens
cuuacgaccugaaggauuc

SEQ ID NO: 1306591 - RNA, 19 nt, Homo sapiens
aaaccagccugugauguuc

SEQ ID NO: 1306592 - RNA, 19 nt, Homo sapiens
gaaaucaucucuccucuuu

SEQ ID NO: 1306593 - RNA, 19 nt, Homo sapiens
ggagaaagguuguuguuaa

SEQ ID NO: 1306594 - RNA, 19 nt, Homo sapiens
ggaaaggagugacugauaa

SEQ ID NO: 1306595 - RNA, 19 nt, Homo sapiens
ugaaggauauggaguaaua

SEQ ID NO: 1306596 - RNA, 19 nt, Homo sapiens
agagagaacuguuguaauu

SEQ ID NO: 1306597 - RNA, 19 nt, Homo sapiens
gaagauugaugucuauuuc

SEQ ID NO: 1306598 - RNA, 19 nt, Homo sapiens
gcacacagauaccguuuau

SEQ ID NO: 1306599 - RNA, 19 nt, Homo sapiens
gaaccgauuucaacaaguu

SEQ ID NO: 1306600 - RNA, 19 nt, Homo sapiens
acacagauaccguuuauua

SEQ ID NO: 1306601 - RNA, 19 nt, Homo sapiens
gcacuccgcuuccucugua

SEQ ID NO: 1306602 - RNA, 19 nt, Homo sapiens
gaagcgacgugauuucuau

SEQ ID NO: 1306603 - RNA, 19 nt, Homo sapiens
gcagggagguccagaugaa

SEQ ID NO: 1306604 - RNA, 19 nt, Homo sapiens
gugaucagauucuuuguaa

SEQ ID NO: 1306605 - RNA, 19 nt, Homo sapiens
gagaaagguuguuguuaau

SEQ ID NO: 1306606 - RNA, 19 nt, Homo sapiens
ggaaaaggauuguaauuug

SEQ ID NO: 1306607 - RNA, 19 nt, Homo sapiens
ggauaaacauggcacaaau

SEQ ID NO: 1306608 - RNA, 19 nt, Homo sapiens
gauuauggguuuguugaua

SEQ ID NO: 1306609 - RNA, 19 nt, Homo sapiens
gcucagguaugcauauauu

SEQ ID NO: 1306610 - RNA, 19 nt, Homo sapiens
uaaagugugugcaacaauu

SEQ ID NO: 1306611 - RNA, 19 nt, Homo sapiens
gaagauacacguacaguca

SEQ ID NO: 1306612 - RNA, 19 nt, Homo sapiens
ugaagaacaugcaaucuau

SEQ ID NO: 1306613 - RNA, 19 nt, Homo sapiens
gcaauuguauaucagagaa

SEQ ID NO: 1306614 - RNA, 19 nt, Homo sapiens
gaccauguaccuuuaauaa

SEQ ID NO: 1306615 - RNA, 19 nt, Homo sapiens
gagagaucaucacgaagua

SEQ ID NO: 1306616 - RNA, 19 nt, Homo sapiens
uuacacaagucucugauuu

SEQ ID NO: 1306617 - RNA, 19 nt, Homo sapiens
gagaauggaugagagagaa

SEQ ID NO: 1306618 - RNA, 19 nt, Homo sapiens
aaacuuaaaggccagauua

SEQ ID NO: 1306619 - RNA, 19 nt, Homo sapiens
gaguggagauuuaaaguca

SEQ ID NO: 1306620 - RNA, 19 nt, Homo sapiens
gcaguguuccggaaucuua

SEQ ID NO: 1306621 - RNA, 19 nt, Homo sapiens
agaagaccauguaccuuua

SEQ ID NO: 1306622 - RNA, 19 nt, Homo sapiens
gaucagauucuuuguaaug

SEQ ID NO: 1306623 - RNA, 19 nt, Homo sapiens
gaaaggagugacugauaaa

SEQ ID NO: 1306624 - RNA, 19 nt, Homo sapiens
gcagugggcuagaagacuu

SEQ ID NO: 1306625 - RNA, 19 nt, Homo sapiens
acaaguacauucauugguu

SEQ ID NO: 1306626 - RNA, 19 nt, Homo sapiens
ccagucagcgcucacauua

SEQ ID NO: 1306627 - RNA, 19 nt, Homo sapiens
uaggagagaucaucacgaa

SEQ ID NO: 1306628 - RNA, 19 nt, Homo sapiens
cuaccgcacugaaagauuu

SEQ ID NO: 1306629 - RNA, 19 nt, Homo sapiens
uccuugagcucuuuaauuu

SEQ ID NO: 1306630 - RNA, 19 nt, Homo sapiens
ggacaguggcacacagaua

SEQ ID NO: 1306631 - RNA, 19 nt, Homo sapiens
gggaaaggagugacugaua

SEQ ID NO: 1306632 - RNA, 19 nt, Homo sapiens
gagaaggacuuggugugaa

SEQ ID NO: 1306633 - RNA, 19 nt, Homo sapiens
uuaggagaguggagauuua

SEQ ID NO: 1306634 - RNA, 19 nt, Homo sapiens
agagcuauuugcaaacuua

SEQ ID NO: 1306635 - RNA, 19 nt, Homo sapiens
ugaaauacaggagauguua

SEQ ID NO: 1306636 - RNA, 19 nt, Homo sapiens
ggguuuagcccuacaguuu

SEQ ID NO: 1306637 - RNA, 19 nt, Homo sapiens
caaagaagcgacgugauuu

SEQ ID NO: 1306638 - RNA, 19 nt, Homo sapiens
uaacuaccgggaagauuua

SEQ ID NO: 1306639 - RNA, 19 nt, Homo sapiens
ggacaguuaagacacauaa

SEQ ID NO: 1306640 - RNA, 19 nt, Homo sapiens
gaaauacaggagauguuaa

SEQ ID NO: 1306641 - RNA, 19 nt, Homo sapiens
ccuacaguuugaacaauua

SEQ ID NO: 1306642 - RNA, 19 nt, Homo sapiens
gaagagcuuuccgucuauu

SEQ ID NO: 1306643 - RNA, 19 nt, Homo sapiens
guacuaaaucccaaugaaa

SEQ ID NO: 1306644 - RNA, 19 nt, Homo sapiens
gaacaaguagaaugggaaa

SEQ ID NO: 1306645 - RNA, 19 nt, Homo sapiens
caacacuugugcaaugcua

SEQ ID NO: 1306646 - RNA, 19 nt, Homo sapiens
ccauguaccuuuaauaacu

SEQ ID NO: 1306647 - RNA, 19 nt, Homo sapiens
uguguggcauuguaauuua

SEQ ID NO: 1306648 - RNA, 19 nt, Homo sapiens
ggagcaaacuucuauucca

SEQ ID NO: 1306649 - RNA, 19 nt, Homo sapiens
gcugaaggauauggaguaa

SEQ ID NO: 1306650 - RNA, 19 nt, Homo sapiens
gggaagauuuacacagaug

SEQ ID NO: 1306651 - RNA, 19 nt, Homo sapiens
guacauucauugguucuau

SEQ ID NO: 1306652 - RNA, 19 nt, Homo sapiens
uacaggagauguuaagguu

SEQ ID NO: 1306653 - RNA, 19 nt, Homo sapiens
agaaggacuuggugugaaa

SEQ ID NO: 1306654 - RNA, 19 nt, Homo sapiens
gaaagguuguuguuaaucc

SEQ ID NO: 1306655 - RNA, 19 nt, Homo sapiens
ucacgaaguauguauauga

SEQ ID NO: 1306656 - RNA, 19 nt, Homo sapiens
ggagagaucaucacgaagu

SEQ ID NO: 1306657 - RNA, 19 nt, Homo sapiens
gauaagugaucagauucuu

SEQ ID NO: 1306658 - RNA, 19 nt, Homo sapiens
ggccugguuuaacuauuua

SEQ ID NO: 1306659 - RNA, 19 nt, Homo sapiens
uaaaccaaaucacugcuau

SEQ ID NO: 1306660 - RNA, 19 nt, Homo sapiens
aaacuucuauuccagacuu

SEQ ID NO: 1306661 - RNA, 19 nt, Homo sapiens
uaggauagauuuggaugaa

SEQ ID NO: 1306662 - RNA, 19 nt, Homo sapiens
gaagaccauguaccuuuaa

SEQ ID NO: 1306663 - RNA, 19 nt, Homo sapiens
ggugaacuguguaaaauaa

SEQ ID NO: 1306664 - RNA, 19 nt, Homo sapiens
ucaguccaaugguauaauu

SEQ ID NO: 1306665 - RNA, 19 nt, Homo sapiens
acacaagucucugauuuca

SEQ ID NO: 1306666 - RNA, 19 nt, Homo sapiens
uauaugagcuccuggaaaa

SEQ ID NO: 1306667 - RNA, 19 nt, Homo sapiens
ggaaggauuugaauaugcu

SEQ ID NO: 1306668 - RNA, 19 nt, Homo sapiens
uaagugaucagauucuuug

SEQ ID NO: 1306669 - RNA, 19 nt, Homo sapiens
uaaaacuacuggaugguua

SEQ ID NO: 1306670 - RNA, 19 nt, Homo sapiens
cgacgugauuucuaugaga

SEQ ID NO: 1306671 - RNA, 19 nt, Homo sapiens
acaaagaagcgacgugauu

SEQ ID NO: 1306672 - RNA, 19 nt, Homo sapiens
cauugguucuauagucuua

SEQ ID NO: 1306673 - RNA, 19 nt, Homo sapiens
ucacugggauugacuuuac

SEQ ID NO: 1306674 - RNA, 19 nt, Homo sapiens
ucacagcuauggaggacuu

SEQ ID NO: 1306675 - RNA, 19 nt, Homo sapiens
gaaaaugguucuccugaag

SEQ ID NO: 1306676 - RNA, 19 nt, Homo sapiens
ccgggaagauuuacacaga

SEQ ID NO: 1306677 - RNA, 19 nt, Homo sapiens
agauuuggaugaacuaaug

SEQ ID NO: 1306678 - RNA, 19 nt, Homo sapiens
ggauagauuuggaugaacu

SEQ ID NO: 1306679 - RNA, 19 nt, Homo sapiens
ggagcuaggcaaacuauuc

SEQ ID NO: 1306680 - RNA, 19 nt, Homo sapiens
gguaacugcuguggcauug

SEQ ID NO: 1306681 - RNA, 19 nt, Homo sapiens
uguuugggaucauuucaua

SEQ ID NO: 1306682 - RNA, 19 nt, Homo sapiens
gaugaaccgccucuugauu

SEQ ID NO: 1306683 - RNA, 19 nt, Homo sapiens
uaaaagagcuguggcugaa

SEQ ID NO: 1306684 - RNA, 19 nt, Homo sapiens
aagaagaccauguaccuuu

SEQ ID NO: 1306685 - RNA, 19 nt, Homo sapiens
ggagagcuauuugcaaacu

SEQ ID NO: 1306686 - RNA, 19 nt, Homo sapiens
caacaucaagcacauuugu

SEQ ID NO: 1306687 - RNA, 19 nt, Homo sapiens
guuaauccuuuccagaaug

SEQ ID NO: 1306688 - RNA, 19 nt, Homo sapiens
gagcuguggcugaaggaua

SEQ ID NO: 1306689 - RNA, 19 nt, Homo sapiens
gcagggcagugggcuagaa

SEQ ID NO: 1306690 - RNA, 19 nt, Homo sapiens
gcacaagcuuuuccuguau

SEQ ID NO: 1306691 - RNA, 19 nt, Homo sapiens
caaguagaaugggaaagga

SEQ ID NO: 1306692 - RNA, 19 nt, Homo sapiens
gaacagaaguacacaauuu

SEQ ID NO: 1306693 - RNA, 19 nt, Homo sapiens
gaugaucgcuuuaggaaua

SEQ ID NO: 1306694 - RNA, 19 nt, Homo sapiens
gaagugaccucuuuaaagu

SEQ ID NO: 1306695 - RNA, 19 nt, Homo sapiens
gcucuuaacuuuacacaaa

SEQ ID NO: 1306696 - RNA, 19 nt, Homo sapiens
ggaaauagauuggcuaaca

SEQ ID NO: 1306697 - RNA, 19 nt, Homo sapiens
gaaaugcucuuaacuuuac

SEQ ID NO: 1306698 - RNA, 19 nt, Homo sapiens
cagagaagauggaaaguaa

SEQ ID NO: 1306699 - RNA, 19 nt, Homo sapiens
gaacuugguguuacauuua

SEQ ID NO: 1306700 - RNA, 19 nt, Homo sapiens
gaaaagaauucgacccuua

SEQ ID NO: 1306701 - RNA, 19 nt, Homo sapiens
gaaaugaaaugcucuuaac

SEQ ID NO: 1306702 - RNA, 19 nt, Homo sapiens
gaaacuacacagcagauua

SEQ ID NO: 1306703 - RNA, 19 nt, Homo sapiens
gaaauagauuggcuaacaa

SEQ ID NO: 1306704 - RNA, 19 nt, Homo sapiens
gaaguacaauugucauguu

SEQ ID NO: 1306705 - RNA, 19 nt, Homo sapiens
ccagaauacugaaacauuu

SEQ ID NO: 1306706 - RNA, 19 nt, Homo sapiens
gggaaaguauggauuuaaa

SEQ ID NO: 1306707 - RNA, 19 nt, Homo sapiens
ugaaagaucuacagguuga

SEQ ID NO: 1306708 - RNA, 19 nt, Homo sapiens
ggucaagcuuuaauucuuu

SEQ ID NO: 1306709 - RNA, 19 nt, Homo sapiens
gaaagaacagguugucauu

SEQ ID NO: 1306710 - RNA, 19 nt, Homo sapiens
ccucaaaucugacaguaaa

SEQ ID NO: 1306711 - RNA, 19 nt, Homo sapiens
gcuguagccucauuaauug

SEQ ID NO: 1306712 - RNA, 19 nt, Homo sapiens
cuaaaggccuguccauauu

SEQ ID NO: 1306713 - RNA, 19 nt, Homo sapiens
gauacaaaguugaauggaa

SEQ ID NO: 1306714 - RNA, 19 nt, Homo sapiens
gcaagagaaguaccuguua

SEQ ID NO: 1306715 - RNA, 19 nt, Homo sapiens
gauaguauggucaacaaua

SEQ ID NO: 1306716 - RNA, 19 nt, Homo sapiens
gcacaaauaagggaaagua

SEQ ID NO: 1306717 - RNA, 19 nt, Homo sapiens
gacaaugagucuacacuug

SEQ ID NO: 1306718 - RNA, 19 nt, Homo sapiens
gaaccaauauacaggacaa

SEQ ID NO: 1306719 - RNA, 19 nt, Homo sapiens
uaacccaagucgcuauaua

SEQ ID NO: 1306720 - RNA, 19 nt, Homo sapiens
uaacagcagucuaaucuag

SEQ ID NO: 1306721 - RNA, 19 nt, Homo sapiens
gauaaacaguccacuucaa

SEQ ID NO: 1306722 - RNA, 19 nt, Homo sapiens
gaacuacaguguccuaaaa

SEQ ID NO: 1306723 - RNA, 19 nt, Homo sapiens
aaagauauguguccaggaa

SEQ ID NO: 1306724 - RNA, 19 nt, Homo sapiens
ggaaaugaaaugcucuuaa

SEQ ID NO: 1306725 - RNA, 19 nt, Homo sapiens
guuaaacucuguuguaagu

SEQ ID NO: 1306726 - RNA, 19 nt, Homo sapiens
auacuuaacucucaagcua

SEQ ID NO: 1306727 - RNA, 19 nt, Homo sapiens
caagagaaguaccuguuau

SEQ ID NO: 1306728 - RNA, 19 nt, Homo sapiens
gcaaaguuaucugcuaaga

SEQ ID NO: 1306729 - RNA, 19 nt, Homo sapiens
caaggaacuucacgucauu

SEQ ID NO: 1306730 - RNA, 19 nt, Homo sapiens
uaaaccaucuccuuccaaa

SEQ ID NO: 1306731 - RNA, 19 nt, Homo sapiens
ugaauugucucuaguaagu

SEQ ID NO: 1306732 - RNA, 19 nt, Homo sapiens
uaucuggacuuucuaaaug

SEQ ID NO: 1306733 - RNA, 19 nt, Homo sapiens
gcugaggauugcauagaua

SEQ ID NO: 1306734 - RNA, 19 nt, Homo sapiens
gaagaugaagcaaagauau

SEQ ID NO: 1306735 - RNA, 19 nt, Homo sapiens
uuugacaucugguacauua

SEQ ID NO: 1306736 - RNA, 19 nt, Homo sapiens
ggacugugcucgggaauca

SEQ ID NO: 1306737 - RNA, 19 nt, Homo sapiens
ggaagaugaagcaaagaua

SEQ ID NO: 1306738 - RNA, 19 nt, Homo sapiens
gaagacagucauuguagaa

SEQ ID NO: 1306739 - RNA, 19 nt, Homo sapiens
gugcaaagccugggauaua

SEQ ID NO: 1306740 - RNA, 19 nt, Homo sapiens
cgaauaccauuaagaagga

SEQ ID NO: 1306741 - RNA, 19 nt, Homo sapiens
aaacaguccacuucaaaua

SEQ ID NO: 1306742 - RNA, 19 nt, Homo sapiens
gaucaugcccucaaucaga

SEQ ID NO: 1306743 - RNA, 19 nt, Homo sapiens
agaaguaccuguuauuagu

SEQ ID NO: 1306744 - RNA, 19 nt, Homo sapiens
gaacuucacgucauuucaa

SEQ ID NO: 1306745 - RNA, 19 nt, Homo sapiens
gaugagggcguaagugaaa

SEQ ID NO: 1306746 - RNA, 19 nt, Homo sapiens
ggaaagcacuaugucuuca

SEQ ID NO: 1306747 - RNA, 19 nt, Homo sapiens
ucagucauauuucgcuaua

SEQ ID NO: 1306748 - RNA, 19 nt, Homo sapiens
gcccuucacugauaaaugu

SEQ ID NO: 1306749 - RNA, 19 nt, Homo sapiens
gcagauuugcagaugauua

SEQ ID NO: 1306750 - RNA, 19 nt, Homo sapiens
guaaagaggaggcaagaga

SEQ ID NO: 1306751 - RNA, 19 nt, Homo sapiens
gaaacaggcauccauauac

SEQ ID NO: 1306752 - RNA, 19 nt, Homo sapiens
gaagauaaacaguccacuu

SEQ ID NO: 1306753 - RNA, 19 nt, Homo sapiens
gcacuucuaguuucacgua

SEQ ID NO: 1306754 - RNA, 19 nt, Homo sapiens
cuacacagcagauuagaaa

SEQ ID NO: 1306755 - RNA, 19 nt, Homo sapiens
cauauuaggugguucucuu

SEQ ID NO: 1306756 - RNA, 19 nt, Homo sapiens
ggacagaaccaauauacag

SEQ ID NO: 1306757 - RNA, 19 nt, Homo sapiens
uuacacagcccgagaacua

SEQ ID NO: 1306758 - RNA, 19 nt, Homo sapiens
uaaaggccuguccauauua

SEQ ID NO: 1306759 - RNA, 19 nt, Homo sapiens
uaagaaacaggcauccaua

SEQ ID NO: 1306760 - RNA, 19 nt, Homo sapiens
ucaauguggucugaauaua

SEQ ID NO: 1306761 - RNA, 19 nt, Homo sapiens
gcaccaccaugcccagcua

SEQ ID NO: 1306762 - RNA, 19 nt, Homo sapiens
ccagggcuccgcuuuauuu

SEQ ID NO: 1306763 - RNA, 19 nt, Homo sapiens
ggaagcagcaagucaucua

SEQ ID NO: 1306764 - RNA, 19 nt, Homo sapiens
ugugaaagaucuacagguu

SEQ ID NO: 1306765 - RNA, 19 nt, Homo sapiens
gaucagcacacauuacaga

SEQ ID NO: 1306766 - RNA, 19 nt, Homo sapiens
agucaagagucaucgaaua

SEQ ID NO: 1306767 - RNA, 19 nt, Homo sapiens
aaacaggcauccauauaca

SEQ ID NO: 1306768 - RNA, 19 nt, Homo sapiens
gagcucgggucaucagaga

SEQ ID NO: 1306769 - RNA, 19 nt, Homo sapiens
ccaagucgcuauauaucug

SEQ ID NO: 1306770 - RNA, 19 nt, Homo sapiens
cugaauaucuuguagaaag

SEQ ID NO: 1306771 - RNA, 19 nt, Homo sapiens
cgucacagcuugcuaugau

SEQ ID NO: 1306772 - RNA, 19 nt, Homo sapiens
gaagauacagaugaagaaa

SEQ ID NO: 1306773 - RNA, 19 nt, Homo sapiens
aaacagaagcagaagauga

SEQ ID NO: 1306774 - RNA, 19 nt, Homo sapiens
caacaaacaaacaaagaga

SEQ ID NO: 1306775 - RNA, 19 nt, Homo sapiens
ugugcuaccuuccagaaua

SEQ ID NO: 1306776 - RNA, 19 nt, Homo sapiens
uaagggaaaguauggauuu

SEQ ID NO: 1306777 - RNA, 19 nt, Homo sapiens
ucuucuagaugcacaaaua

SEQ ID NO: 1306778 - RNA, 19 nt, Homo sapiens
caacuuggauaaaugaacu

SEQ ID NO: 1306779 - RNA, 19 nt, Homo sapiens
uugcauagauacaaaguug

SEQ ID NO: 1306780 - RNA, 19 nt, Homo sapiens
gaaagcugaggauugcaua

SEQ ID NO: 1306781 - RNA, 19 nt, Homo sapiens
caaugagucuacacuugaa

SEQ ID NO: 1306782 - RNA, 19 nt, Homo sapiens
ggaggcuaaucauaucauu

SEQ ID NO: 1306783 - RNA, 19 nt, Homo sapiens
gaaaugagaagugcaugga

SEQ ID NO: 1306784 - RNA, 19 nt, Homo sapiens
gcagggaucauacuugugu

SEQ ID NO: 1306785 - RNA, 19 nt, Homo sapiens
cagcagggaucauacuugu

SEQ ID NO: 1306786 - RNA, 19 nt, Homo sapiens
gaaggaucauacagggaaa

SEQ ID NO: 1306787 - RNA, 19 nt, Homo sapiens
caucgaauaccauuaagaa

SEQ ID NO: 1306788 - RNA, 19 nt, Homo sapiens
agaaacaggcauccauaua

SEQ ID NO: 1306789 - RNA, 19 nt, Homo sapiens
aaaccacucuggcugcaaa

SEQ ID NO: 1306790 - RNA, 19 nt, Homo sapiens
ccaaggaacuucacgucau

SEQ ID NO: 1306791 - RNA, 19 nt, Homo sapiens
cuauauaucuggacuuucu

SEQ ID NO: 1306792 - RNA, 19 nt, Homo sapiens
gaaggaaaguugugaauaa

SEQ ID NO: 1306793 - RNA, 19 nt, Homo sapiens
caagaaggcugucucagua

SEQ ID NO: 1306794 - RNA, 19 nt, Homo sapiens
gcauacagcugauuucaaa

SEQ ID NO: 1306795 - RNA, 19 nt, Homo sapiens
ggauauagauaacugcaua

SEQ ID NO: 1306796 - RNA, 19 nt, Homo sapiens
uaucacagcugaauuguaa

SEQ ID NO: 1306797 - RNA, 19 nt, Homo sapiens
ggaacagggugaucaauga

SEQ ID NO: 1306798 - RNA, 19 nt, Homo sapiens
ggaaaguugugaauaaguu

SEQ ID NO: 1306799 - RNA, 19 nt, Homo sapiens
gaaggaagcuugcaagacu

SEQ ID NO: 1306800 - RNA, 19 nt, Homo sapiens
gaagaaggacuggacauua

SEQ ID NO: 1306801 - RNA, 19 nt, Homo sapiens
guacaaaguuggcuuagau

SEQ ID NO: 1306802 - RNA, 19 nt, Homo sapiens
uaucaaugcugcuuaauga

SEQ ID NO: 1306803 - RNA, 19 nt, Homo sapiens
ccagggaaaugucacuuua

SEQ ID NO: 1306804 - RNA, 19 nt, Homo sapiens
gcagcuagauuuagauuuc

SEQ ID NO: 1306805 - RNA, 19 nt, Homo sapiens
gaaacaaucucccaguaag

SEQ ID NO: 1306806 - RNA, 19 nt, Homo sapiens
caagcacugucaagauuua

SEQ ID NO: 1306807 - RNA, 19 nt, Homo sapiens
ggacaacaagauacaaaua

SEQ ID NO: 1306808 - RNA, 19 nt, Homo sapiens
aaacaacccuguacuuuca

SEQ ID NO: 1306809 - RNA, 19 nt, Homo sapiens
ggccaaaguugauaacaaa

SEQ ID NO: 1306810 - RNA, 19 nt, Homo sapiens
ggaaacaacccuguacuuu

SEQ ID NO: 1306811 - RNA, 19 nt, Homo sapiens
ccacauugcugcuuccaaa

SEQ ID NO: 1306812 - RNA, 19 nt, Homo sapiens
acaaauggcugcaggauuc

SEQ ID NO: 1306813 - RNA, 19 nt, Homo sapiens
aagaaggacuggacauuaa

SEQ ID NO: 1306814 - RNA, 19 nt, Homo sapiens
ccaagcagcuagauuuaga

SEQ ID NO: 1306815 - RNA, 19 nt, Homo sapiens
gcacaacugauaauauuga

SEQ ID NO: 1306816 - RNA, 19 nt, Homo sapiens
gaagcaauauugucaagag

SEQ ID NO: 1306817 - RNA, 19 nt, Homo sapiens
cuacuagaccuguucauua

SEQ ID NO: 1306818 - RNA, 19 nt, Homo sapiens
guaccuaaguggauauaga

SEQ ID NO: 1306819 - RNA, 19 nt, Homo sapiens
ccagaaaucauacugcaua

SEQ ID NO: 1306820 - RNA, 19 nt, Homo sapiens
gaaucugaaugcucuuaaa

SEQ ID NO: 1306821 - RNA, 19 nt, Homo sapiens
guauuaaacucuuguugga

SEQ ID NO: 1306822 - RNA, 19 nt, Homo sapiens
gcaauaacaccacugauuc

SEQ ID NO: 1306823 - RNA, 19 nt, Homo sapiens
uuuaagaacugccuagaaa

SEQ ID NO: 1306824 - RNA, 19 nt, Homo sapiens
guccgaauguuauuacuuu

SEQ ID NO: 1306825 - RNA, 19 nt, Homo sapiens
gugaaacaaucucccagua

SEQ ID NO: 1306826 - RNA, 19 nt, Homo sapiens
aaagauaggcguuugguuu

SEQ ID NO: 1306827 - RNA, 19 nt, Homo sapiens
aaauaaagcuguacugcau

SEQ ID NO: 1306828 - RNA, 19 nt, Homo sapiens
agacagaccuagugacaga

SEQ ID NO: 1306829 - RNA, 19 nt, Homo sapiens
uaagaugcuuugacacuga

SEQ ID NO: 1306830 - RNA, 19 nt, Homo sapiens
caaaagaagugaauuggaa

SEQ ID NO: 1306831 - RNA, 19 nt, Homo sapiens
ccagagaccuugucaucga

SEQ ID NO: 1306832 - RNA, 19 nt, Homo sapiens
ggaaggagguauuuaucca

SEQ ID NO: 1306833 - RNA, 19 nt, Homo sapiens
gaagacgugacuugcaaua

SEQ ID NO: 1306834 - RNA, 19 nt, Homo sapiens
ggagaaccuuccuaaguca

SEQ ID NO: 1306835 - RNA, 19 nt, Homo sapiens
ggaacgguaugggagauuu

SEQ ID NO: 1306836 - RNA, 19 nt, Homo sapiens
guacuuucagcaacuauua

SEQ ID NO: 1306837 - RNA, 19 nt, Homo sapiens
caaaauauuuccugucuug

SEQ ID NO: 1306838 - RNA, 19 nt, Homo sapiens
gggcacaccugaagcacuu

SEQ ID NO: 1306839 - RNA, 19 nt, Homo sapiens
gaaaaucgcagcacugaaa

SEQ ID NO: 1306840 - RNA, 19 nt, Homo sapiens
ugacuuggauggaggagaa

SEQ ID NO: 1306841 - RNA, 19 nt, Homo sapiens
gcaggaaggagguauuuau

SEQ ID NO: 1306842 - RNA, 19 nt, Homo sapiens
uuucgaguguguagaauua

SEQ ID NO: 1306843 - RNA, 19 nt, Homo sapiens
gggaaaugucacuuuauua

SEQ ID NO: 1306844 - RNA, 19 nt, Homo sapiens
acacaccacugaccucaaa

SEQ ID NO: 1306845 - RNA, 19 nt, Homo sapiens
gagaagaagccaguuugua

SEQ ID NO: 1306846 - RNA, 19 nt, Homo sapiens
gaaaucauacugcauacau

SEQ ID NO: 1306847 - RNA, 19 nt, Homo sapiens
gaauuggaacuuacacaaa

SEQ ID NO: 1306848 - RNA, 19 nt, Homo sapiens
gauccugugugcaagauug

SEQ ID NO: 1306849 - RNA, 19 nt, Homo sapiens
ggagguauuuauccaggaa

SEQ ID NO: 1306850 - RNA, 19 nt, Homo sapiens
cuagaccuguucauuagua

SEQ ID NO: 1306851 - RNA, 19 nt, Homo sapiens
uuaaauauccgcaaacaga

SEQ ID NO: 1306852 - RNA, 19 nt, Homo sapiens
gccucaagcuucuuaugua

SEQ ID NO: 1306853 - RNA, 19 nt, Homo sapiens
gaacgguaugggagauuua

SEQ ID NO: 1306854 - RNA, 19 nt, Homo sapiens
guuagugccucauccugua

SEQ ID NO: 1306855 - RNA, 19 nt, Homo sapiens
ucuaguagcacaacugaua

SEQ ID NO: 1306856 - RNA, 19 nt, Homo sapiens
ucaaggaacuucagagcau

SEQ ID NO: 1306857 - RNA, 19 nt, Homo sapiens
ggcaaucucuucugaugga

SEQ ID NO: 1306858 - RNA, 19 nt, Homo sapiens
gcaaucggacugugcauga

SEQ ID NO: 1306859 - RNA, 19 nt, Homo sapiens
gggccaaaguugauaacaa

SEQ ID NO: 1306860 - RNA, 19 nt, Homo sapiens
ggaauaagccagaccuaag

SEQ ID NO: 1306861 - RNA, 19 nt, Homo sapiens
cugcagagguucuuacgaa

SEQ ID NO: 1306862 - RNA, 19 nt, Homo sapiens
gcaacuaugguucugauga

SEQ ID NO: 1306863 - RNA, 19 nt, Homo sapiens
ucagacagccuccugguaa

SEQ ID NO: 1306864 - RNA, 19 nt, Homo sapiens
aaacaacuagcucggaaua

SEQ ID NO: 1306865 - RNA, 19 nt, Homo sapiens
aaacgaagaagcacagaaa

SEQ ID NO: 1306866 - RNA, 19 nt, Homo sapiens
gguagcaucauguauauau

SEQ ID NO: 1306867 - RNA, 19 nt, Homo sapiens
ugaguuggguguuucaaga

SEQ ID NO: 1306868 - RNA, 19 nt, Homo sapiens
agugagagcugaaguagau

SEQ ID NO: 1306869 - RNA, 19 nt, Homo sapiens
caugaucccucuccagaug

SEQ ID NO: 1306870 - RNA, 19 nt, Homo sapiens
gugguuacauugccauuug

SEQ ID NO: 1306871 - RNA, 19 nt, Homo sapiens
uuaaggaaguccagaaauc

SEQ ID NO: 1306872 - RNA, 19 nt, Homo sapiens
ggaaugcuucucugucaaa

SEQ ID NO: 1306873 - RNA, 19 nt, Homo sapiens
caggaaugcuucucuguca

SEQ ID NO: 1306874 - RNA, 19 nt, Homo sapiens
ccaguuauaacacuuguaa

SEQ ID NO: 1306875 - RNA, 19 nt, Homo sapiens
agagaguccugaaggcaua

SEQ ID NO: 1306876 - RNA, 19 nt, Homo sapiens
agucaaugcugcugauaaa

SEQ ID NO: 1306877 - RNA, 19 nt, Homo sapiens
cccaagcacugucaagauu

SEQ ID NO: 1306878 - RNA, 19 nt, Homo sapiens
gcaaauagaaaucaacaac

SEQ ID NO: 1306879 - RNA, 19 nt, Homo sapiens
ucacugacguugaauuugg

SEQ ID NO: 1306880 - RNA, 19 nt, Homo sapiens
gaacugccuagaaaucuug

SEQ ID NO: 1306881 - RNA, 19 nt, Homo sapiens
gaaggacuggacauuaauu

SEQ ID NO: 1306882 - RNA, 19 nt, Homo sapiens
uuuaaagacucauggugua

SEQ ID NO: 1306883 - RNA, 19 nt, Homo sapiens
aaaccaagccucucucuuc

SEQ ID NO: 1306884 - RNA, 19 nt, Homo sapiens
ucucugaguuugacacuga

SEQ ID NO: 1306885 - RNA, 19 nt, Homo sapiens
cgggaccacuauucaauuu

SEQ ID NO: 1306886 - RNA, 19 nt, Homo sapiens
gaaugcagcaacaguaaau

SEQ ID NO: 1306887 - RNA, 19 nt, Homo sapiens
gcaagaagcauacgaucca

SEQ ID NO: 1306888 - RNA, 19 nt, Homo sapiens
aaaagaagcuggaaaugga

SEQ ID NO: 1306889 - RNA, 19 nt, Homo sapiens
caaugcugcuuaaugaaga

SEQ ID NO: 1306890 - RNA, 19 nt, Homo sapiens
ccuaagcacugaagguaug

SEQ ID NO: 1306891 - RNA, 19 nt, Homo sapiens
uauccauaguuuccaguua

SEQ ID NO: 1306892 - RNA, 19 nt, Homo sapiens
gagaugagcuccaauaaca

SEQ ID NO: 1306893 - RNA, 19 nt, Homo sapiens
gacagaaacuuuagcauug

SEQ ID NO: 1306894 - RNA, 19 nt, Homo sapiens
guaaagauuugaagacaga

SEQ ID NO: 1306895 - RNA, 19 nt, Homo sapiens
gccauacauuccuuuaaua

SEQ ID NO: 1306896 - RNA, 19 nt, Homo sapiens
gcaucuauccugaguuuaa

SEQ ID NO: 1306897 - RNA, 19 nt, Homo sapiens
ugaaacagcugggucuuug

SEQ ID NO: 1306898 - RNA, 19 nt, Homo sapiens
ggccauacauuccuuuaau

SEQ ID NO: 1306899 - RNA, 19 nt, Homo sapiens
guagaauccuugcuagguu

SEQ ID NO: 1306900 - RNA, 19 nt, Homo sapiens
ggcuaaaucugcucauuau

SEQ ID NO: 1306901 - RNA, 19 nt, Homo sapiens
aaacagauuugcagaucaa

SEQ ID NO: 1306902 - RNA, 19 nt, Homo sapiens
auaggaagguuuaccagua

SEQ ID NO: 1306903 - RNA, 19 nt, Homo sapiens
gcuucuagcucuaaauguu

SEQ ID NO: 1306904 - RNA, 19 nt, Homo sapiens
gagcuccaauaacaacuuu

SEQ ID NO: 1306905 - RNA, 19 nt, Homo sapiens
gaccauagagcaagaauca

SEQ ID NO: 1306906 - RNA, 19 nt, Homo sapiens
gagcccaccuggcaucuau

SEQ ID NO: 1306907 - RNA, 19 nt, Homo sapiens
guacauaaguggcuaucag

SEQ ID NO: 1306908 - RNA, 19 nt, Homo sapiens
caaagaagcgcuaguaagg

SEQ ID NO: 1306909 - RNA, 19 nt, Homo sapiens
gcaugcggcugcuccuauu

SEQ ID NO: 1306910 - RNA, 19 nt, Homo sapiens
aaaggaagccagcaccaua

SEQ ID NO: 1306911 - RNA, 19 nt, Homo sapiens
uggcaucuauccugaguuu

SEQ ID NO: 1306912 - RNA, 19 nt, Homo sapiens
ccacucaacuccugcuugu

SEQ ID NO: 1306913 - RNA, 19 nt, Homo sapiens
gcaacaagcgccaacacuu

SEQ ID NO: 1306914 - RNA, 19 nt, Homo sapiens
gcuuagagacagaaacuuu

SEQ ID NO: 1306915 - RNA, 19 nt, Homo sapiens
gcugagaugagcuccaaua

SEQ ID NO: 1306916 - RNA, 19 nt, Homo sapiens
caccauagcagaguacaua

SEQ ID NO: 1306917 - RNA, 19 nt, Homo sapiens
caauugcuaugguuacuuc

SEQ ID NO: 1306918 - RNA, 19 nt, Homo sapiens
agacagaaacuuuagcauu

SEQ ID NO: 1306919 - RNA, 19 nt, Homo sapiens
caacaagcgccaacacuuc

SEQ ID NO: 1306920 - RNA, 19 nt, Homo sapiens
gccauaagaaguaaagauu

SEQ ID NO: 1306921 - RNA, 19 nt, Homo sapiens
ggagaacccaggaguuuca

SEQ ID NO: 1306922 - RNA, 19 nt, Homo sapiens
gaagccagccgauauggau

SEQ ID NO: 1306923 - RNA, 19 nt, Homo sapiens
auaaguggcuaucagagaa

SEQ ID NO: 1306924 - RNA, 19 nt, Homo sapiens
gagugcaucuccagccuau

SEQ ID NO: 1306925 - RNA, 19 nt, Homo sapiens
cagagaagccagccgauau

SEQ ID NO: 1306926 - RNA, 19 nt, Homo sapiens
gaagacagaaggaagaaac

SEQ ID NO: 1306927 - RNA, 19 nt, Homo sapiens
caucuauccugaguuuaaa

SEQ ID NO: 1306928 - RNA, 19 nt, Homo sapiens
ccacaaguccaauugcuau

SEQ ID NO: 1306929 - RNA, 19 nt, Homo sapiens
gaaguaaagauuugaagac

SEQ ID NO: 1306930 - RNA, 19 nt, Homo sapiens
cugaggaacuggucugaug

SEQ ID NO: 1306931 - RNA, 19 nt, Homo sapiens
ggggaaaccuagcaaacua

SEQ ID NO: 1306932 - RNA, 19 nt, Homo sapiens
gugcaucuccagccuauga

SEQ ID NO: 1306933 - RNA, 19 nt, Homo sapiens
gauaagggcccuacuacac

SEQ ID NO: 1306934 - RNA, 19 nt, Homo sapiens
uggcuaaaucugcucauua

SEQ ID NO: 1306935 - RNA, 19 nt, Homo sapiens
gcaaguaccgaccauagag

SEQ ID NO: 1306936 - RNA, 19 nt, Homo sapiens
acucaacuccugcuuguuu

SEQ ID NO: 1306937 - RNA, 19 nt, Homo sapiens
gggaaaccuagcaaacuaa

SEQ ID NO: 1306938 - RNA, 19 nt, Homo sapiens
guaguggcuucuagcucua

SEQ ID NO: 1306939 - RNA, 19 nt, Homo sapiens
gaacccaggaguuucaaag

SEQ ID NO: 1306940 - RNA, 19 nt, Homo sapiens
uaggaagguuuaccaguag

SEQ ID NO: 1306941 - RNA, 19 nt, Homo sapiens
gugcugagaugagcuccaa

SEQ ID NO: 1306942 - RNA, 19 nt, Homo sapiens
cuuagagacagaaacuuua

SEQ ID NO: 1306943 - RNA, 19 nt, Homo sapiens
uagcaaacuaagagugaua

SEQ ID NO: 1306944 - RNA, 19 nt, Homo sapiens
cauaaguggcuaucagaga

SEQ ID NO: 1306945 - RNA, 19 nt, Homo sapiens
ccagcaccauagcagagua

SEQ ID NO: 1306946 - RNA, 19 nt, Homo sapiens
cuucugcccucucuccauu

SEQ ID NO: 1306947 - RNA, 19 nt, Homo sapiens
gacagaaggaagaaacuca

SEQ ID NO: 1306948 - RNA, 19 nt, Homo sapiens
uauaaaagcuccagaaacg

SEQ ID NO: 1306949 - RNA, 19 nt, Homo sapiens
caaggagaacccaggaguu

SEQ ID NO: 1306950 - RNA, 19 nt, Homo sapiens
ucagagaagccagccgaua

SEQ ID NO: 1306951 - RNA, 19 nt, Homo sapiens
aaggagaacccaggaguuu

SEQ ID NO: 1306952 - RNA, 19 nt, Homo sapiens
gagcucgagugucagucuu

SEQ ID NO: 1306953 - RNA, 19 nt, Homo sapiens
ucaaagaagcgcuaguaag

SEQ ID NO: 1306954 - RNA, 19 nt, Homo sapiens
gccaacacuuccugugcaa

SEQ ID NO: 1306955 - RNA, 19 nt, Homo sapiens
acccaggaguuucaaagaa

SEQ ID NO: 1306956 - RNA, 19 nt, Homo sapiens
ggaagguuuaccaguagaa

SEQ ID NO: 1306957 - RNA, 19 nt, Homo sapiens
gccaucccuuuccacagua

SEQ ID NO: 1306958 - RNA, 19 nt, Homo sapiens
caaguccaauugcuauggu

SEQ ID NO: 1306959 - RNA, 19 nt, Homo sapiens
cgccaucccuuuccacagu

SEQ ID NO: 1306960 - RNA, 19 nt, Homo sapiens
gaaaccuagcaaacuaaga

SEQ ID NO: 1306961 - RNA, 19 nt, Homo sapiens
ccauagagcaagaaucaag

SEQ ID NO: 1306962 - RNA, 19 nt, Homo sapiens
gggccauacauuccuuuaa

SEQ ID NO: 1306963 - RNA, 19 nt, Homo sapiens
cagauuugcagaucaagga

SEQ ID NO: 1306964 - RNA, 19 nt, Homo sapiens
gcgcuaguaaggucucuga

SEQ ID NO: 1306965 - RNA, 19 nt, Homo sapiens
gcccaguaguggcuucuag

SEQ ID NO: 1306966 - RNA, 19 nt, Homo sapiens
ccuagcaaacuaagaguga

SEQ ID NO: 1306967 - RNA, 19 nt, Homo sapiens
gauauaaaagcuccagaaa

SEQ ID NO: 1306968 - RNA, 19 nt, Homo sapiens
cauagcagaguacauaagu

SEQ ID NO: 1306969 - RNA, 19 nt, Homo sapiens
aaaccuagcaaacuaagag

SEQ ID NO: 1306970 - RNA, 19 nt, Homo sapiens
gaugagcuccaauaacaac

SEQ ID NO: 1306971 - RNA, 19 nt, Homo sapiens
gaagguuuaccaguagaau

SEQ ID NO: 1306972 - RNA, 19 nt, Homo sapiens
uuucaaagaagcgcuagua

SEQ ID NO: 1306973 - RNA, 19 nt, Homo sapiens
cccaggaguuucaaagaag

SEQ ID NO: 1306974 - RNA, 19 nt, Homo sapiens
ggaaaccuagcaaacuaag

SEQ ID NO: 1306975 - RNA, 19 nt, Homo sapiens
aaaccauuguguacauaag

SEQ ID NO: 1306976 - RNA, 19 nt, Homo sapiens
gcuaaaucugcucauuauu

SEQ ID NO: 1306977 - RNA, 19 nt, Homo sapiens
augccgagcucgaguguca

SEQ ID NO: 1306978 - RNA, 19 nt, Homo sapiens
ggaccacuggagacacuga

SEQ ID NO: 1306979 - RNA, 19 nt, Homo sapiens
acagaaacuuuagcauugg

SEQ ID NO: 1306980 - RNA, 19 nt, Homo sapiens
ccacuggagacacugaaga

SEQ ID NO: 1306981 - RNA, 19 nt, Homo sapiens
ggccauaagaaguaaagau

SEQ ID NO: 1306982 - RNA, 19 nt, Homo sapiens
cauagagcaagaaucaaga

SEQ ID NO: 1306983 - RNA, 19 nt, Homo sapiens
gugcaaguaccgaccauag

SEQ ID NO: 1306984 - RNA, 19 nt, Homo sapiens
cagcaacgaaugcaacaag

SEQ ID NO: 1306985 - RNA, 19 nt, Homo sapiens
caguggcaguggauugaug

SEQ ID NO: 1306986 - RNA, 19 nt, Homo sapiens
gcaucuccagccuaugaaa

SEQ ID NO: 1306987 - RNA, 19 nt, Homo sapiens
cagcaguggcaguggauug

SEQ ID NO: 1306988 - RNA, 19 nt, Homo sapiens
uaaaagcuccagaaacguu

SEQ ID NO: 1306989 - RNA, 19 nt, Homo sapiens
uagcauuggcccaguagug

SEQ ID NO: 1306990 - RNA, 19 nt, Homo sapiens
agagaagccagccgauaug

SEQ ID NO: 1306991 - RNA, 19 nt, Homo sapiens
accauuguguacauaagaa

SEQ ID NO: 1306992 - RNA, 19 nt, Homo sapiens
gcacaacuauugcagaaau

SEQ ID NO: 1306993 - RNA, 19 nt, Homo sapiens
gagcacaacuauugcagaa

SEQ ID NO: 1306994 - RNA, 19 nt, Homo sapiens
gaacgagacuuuccagcau

SEQ ID NO: 1306995 - RNA, 19 nt, Homo sapiens
gaccucgucucuaagaaua

SEQ ID NO: 1306996 - RNA, 19 nt, Homo sapiens
ccucaggacuggccauaua

SEQ ID NO: 1306997 - RNA, 19 nt, Homo sapiens
gaugcuagauggaugugua

SEQ ID NO: 1306998 - RNA, 19 nt, Homo sapiens
gaaaacccaucucuacuaa

SEQ ID NO: 1306999 - RNA, 19 nt, Homo sapiens
gaacgguugugaagcuuug

SEQ ID NO: 1307000 - RNA, 19 nt, Homo sapiens
agaaguaucugacuguaga

SEQ ID NO: 1307001 - RNA, 19 nt, Homo sapiens
gcacgaggauggugucuac

SEQ ID NO: 1307002 - RNA, 19 nt, Homo sapiens
gaacuggacagcacuacaa

SEQ ID NO: 1307003 - RNA, 19 nt, Homo sapiens
ucacagccauuguagcaaa

SEQ ID NO: 1307004 - RNA, 19 nt, Homo sapiens
ccaacaaacucaccauaca

SEQ ID NO: 1307005 - RNA, 19 nt, Homo sapiens
ggaaacccaccuccucuaa

SEQ ID NO: 1307006 - RNA, 19 nt, Homo sapiens
gcaccuuucucaccuacuu

SEQ ID NO: 1307007 - RNA, 19 nt, Homo sapiens
cauacaacacucugaaaua

SEQ ID NO: 1307008 - RNA, 19 nt, Homo sapiens
caagguccaguaugaaaua

SEQ ID NO: 1307009 - RNA, 19 nt, Homo sapiens
caacgucucucuggacuuc

SEQ ID NO: 1307010 - RNA, 19 nt, Homo sapiens
gcagugagcugagauaacg

SEQ ID NO: 1307011 - RNA, 19 nt, Homo sapiens
gguccaguaugaaauaaga

SEQ ID NO: 1307012 - RNA, 19 nt, Homo sapiens
gaagcaggauuugggcauu

SEQ ID NO: 1307013 - RNA, 19 nt, Homo sapiens
gcccagggauuugcuguuu

SEQ ID NO: 1307014 - RNA, 19 nt, Homo sapiens
agucagagguucaaguuug

SEQ ID NO: 1307015 - RNA, 19 nt, Homo sapiens
ccacuucaauuuccaucuu

SEQ ID NO: 1307016 - RNA, 19 nt, Homo sapiens
cauacaaacuugcaucagu

SEQ ID NO: 1307017 - RNA, 19 nt, Homo sapiens
uuacaagccuuccacuuca

SEQ ID NO: 1307018 - RNA, 19 nt, Homo sapiens
gaugacgggugaugcuaga

SEQ ID NO: 1307019 - RNA, 19 nt, Homo sapiens
ucaacaagaugaccgcaau

SEQ ID NO: 1307020 - RNA, 19 nt, Homo sapiens
ggagucagagguucaaguu

SEQ ID NO: 1307021 - RNA, 19 nt, Homo sapiens
gaacuacucagccaugucu

SEQ ID NO: 1307022 - RNA, 19 nt, Homo sapiens
caacaaacucaccauacaa

SEQ ID NO: 1307023 - RNA, 19 nt, Homo sapiens
gaucagcagucaccauggu

SEQ ID NO: 1307024 - RNA, 19 nt, Homo sapiens
guucaugccuguaauacca

SEQ ID NO: 1307025 - RNA, 19 nt, Homo sapiens
gacauccaguugcaccuuu

SEQ ID NO: 1307026 - RNA, 19 nt, Homo sapiens
ggacuucgucaucuuguau

SEQ ID NO: 1307027 - RNA, 19 nt, Homo sapiens
cuacaaggaucauggaaac

SEQ ID NO: 1307028 - RNA, 19 nt, Homo sapiens
ccacacaacugggcauagu

SEQ ID NO: 1307029 - RNA, 19 nt, Homo sapiens
gcuggaagccacagaguug

SEQ ID NO: 1307030 - RNA, 19 nt, Homo sapiens
ucugcaagguccaguauga

SEQ ID NO: 1307031 - RNA, 19 nt, Homo sapiens
gauaccugcuugccagaug

SEQ ID NO: 1307032 - RNA, 19 nt, Homo sapiens
ccagggauuugcuguuuua

SEQ ID NO: 1307033 - RNA, 19 nt, Homo sapiens
aaacccaucucuacuaaaa

SEQ ID NO: 1307034 - RNA, 19 nt, Homo sapiens
cagcagaagaugaggauga

SEQ ID NO: 1307035 - RNA, 19 nt, Homo sapiens
gauggugucuacuggaagu

SEQ ID NO: 1307036 - RNA, 19 nt, Homo sapiens
caucuuguauuucuucucu

SEQ ID NO: 1307037 - RNA, 19 nt, Homo sapiens
ggucagagucaacaagaug

SEQ ID NO: 1307038 - RNA, 19 nt, Homo sapiens
ccaaaguccucuaugucau

SEQ ID NO: 1307039 - RNA, 19 nt, Homo sapiens
aaacucaccauacaaacuu

SEQ ID NO: 1307040 - RNA, 19 nt, Homo sapiens
auacaacacucugaaauac

SEQ ID NO: 1307041 - RNA, 19 nt, Homo sapiens
gcaagguccaguaugaaau

SEQ ID NO: 1307042 - RNA, 19 nt, Homo sapiens
ccuccaaaguccucuaugu

SEQ ID NO: 1307043 - RNA, 19 nt, Homo sapiens
ugaggaggguggaucacuu

SEQ ID NO: 1307044 - RNA, 19 nt, Homo sapiens
ggacuggccauauaaucug

SEQ ID NO: 1307045 - RNA, 19 nt, Homo sapiens
ccacaucccaugaucacuu

SEQ ID NO: 1307046 - RNA, 19 nt, Homo sapiens
cagccaauggugcggauua

SEQ ID NO: 1307047 - RNA, 19 nt, Homo sapiens
ccaauggugcggauuauag

SEQ ID NO: 1307048 - RNA, 19 nt, Homo sapiens
ugucuucuguggucuauuc

SEQ ID NO: 1307049 - RNA, 19 nt, Homo sapiens
guugaaggauggacagucu

SEQ ID NO: 1307050 - RNA, 19 nt, Homo sapiens
gcccaccucuguccuucaa

SEQ ID NO: 1307051 - RNA, 19 nt, Homo sapiens
aaacccaccuccucuaacu

SEQ ID NO: 1307052 - RNA, 19 nt, Homo sapiens
ggaccucgucucuaagaau

SEQ ID NO: 1307053 - RNA, 19 nt, Homo sapiens
guaucugacuguagacaca

SEQ ID NO: 1307054 - RNA, 19 nt, Homo sapiens
gcuacaaggaucauggaaa

SEQ ID NO: 1307055 - RNA, 19 nt, Homo sapiens
ugggugagcacaacuauug

SEQ ID NO: 1307056 - RNA, 19 nt, Homo sapiens
agaauaagcagcccacaca

SEQ ID NO: 1307057 - RNA, 19 nt, Homo sapiens
gggaagccaugucuguuuu

SEQ ID NO: 1307058 - RNA, 19 nt, Homo sapiens
gaaauggugggcucucucu

SEQ ID NO: 1307059 - RNA, 19 nt, Homo sapiens
gaauaagcagcccacacaa

SEQ ID NO: 1307060 - RNA, 19 nt, Homo sapiens
guugugaagcuuuguguga

SEQ ID NO: 1307061 - RNA, 19 nt, Homo sapiens
gcacagccggucagaacug

SEQ ID NO: 1307062 - RNA, 19 nt, Homo sapiens
agcgggaccucgucucuaa

SEQ ID NO: 1307063 - RNA, 19 nt, Homo sapiens
gaggaggguggaucacuug

SEQ ID NO: 1307064 - RNA, 19 nt, Homo sapiens
gcacgucacauucaaaucc

SEQ ID NO: 1307065 - RNA, 19 nt, Homo sapiens
cuggaaaccuuggcugcua

SEQ ID NO: 1307066 - RNA, 19 nt, Homo sapiens
auaccaagccgucaaggaa

SEQ ID NO: 1307067 - RNA, 19 nt, Homo sapiens
gaaguacugugagauaccu

SEQ ID NO: 1307068 - RNA, 19 nt, Homo sapiens
caaggcacccagcagaaga

SEQ ID NO: 1307069 - RNA, 19 nt, Homo sapiens
ccuuagggauugucaucaa

SEQ ID NO: 1307070 - RNA, 19 nt, Homo sapiens
gggauuugcuguuuuauac

SEQ ID NO: 1307071 - RNA, 19 nt, Homo sapiens
uaugcuugcuucuguggaa

SEQ ID NO: 1307072 - RNA, 19 nt, Homo sapiens
gugcgucugugucuuugug

SEQ ID NO: 1307073 - RNA, 19 nt, Homo sapiens
ggaacgguugugaagcuuu

SEQ ID NO: 1307074 - RNA, 19 nt, Homo sapiens
gaggcaggaccgagaguga

SEQ ID NO: 1307075 - RNA, 19 nt, Homo sapiens
caaaguccucuaugucauc

SEQ ID NO: 1307076 - RNA, 19 nt, Homo sapiens
ccuguaaucccagcacuuu

SEQ ID NO: 1307077 - RNA, 19 nt, Homo sapiens
cgggaagccaugucuguuu

SEQ ID NO: 1307078 - RNA, 19 nt, Homo sapiens
cacuucaauuuccaucuuu

SEQ ID NO: 1307079 - RNA, 19 nt, Homo sapiens
ccauacaacacucugaaau

SEQ ID NO: 1307080 - RNA, 19 nt, Homo sapiens
ucuuguauuucuucucuga

SEQ ID NO: 1307081 - RNA, 19 nt, Homo sapiens
cgaaaacccaucucuacua

SEQ ID NO: 1307082 - RNA, 19 nt, Homo sapiens
gcacccagcagaagaugag

SEQ ID NO: 1307083 - RNA, 19 nt, Homo sapiens
gcaaggcacccagcagaag

SEQ ID NO: 1307084 - RNA, 19 nt, Homo sapiens
agagugacauccaguugca

SEQ ID NO: 1307085 - RNA, 19 nt, Homo sapiens
ucuauggucuggcaacucu

SEQ ID NO: 1307086 - RNA, 19 nt, Homo sapiens
acucagccaugucuucugu

SEQ ID NO: 1307087 - RNA, 19 nt, Homo sapiens
gggaacuacucagccaugu

SEQ ID NO: 1307088 - RNA, 19 nt, Homo sapiens
aggcuaugcuugcuucugu

SEQ ID NO: 1307089 - RNA, 19 nt, Homo sapiens
aacaaacucaccauacaaa

SEQ ID NO: 1307090 - RNA, 19 nt, Homo sapiens
gaaagaaagaaagagaaac

SEQ ID NO: 1307091 - RNA, 19 nt, Homo sapiens
cacagucacagccauugua

SEQ ID NO: 1307092 - RNA, 19 nt, Homo sapiens
gcacaacuauugcagaaau

SEQ ID NO: 1307093 - RNA, 19 nt, Homo sapiens
gagcacaacuauugcagaa

SEQ ID NO: 1307094 - RNA, 19 nt, Homo sapiens
gaacgagacuuuccagcau

SEQ ID NO: 1307095 - RNA, 19 nt, Homo sapiens
gcacagggcucagguacau

SEQ ID NO: 1307096 - RNA, 19 nt, Homo sapiens
gcacgaggauggugucuac

SEQ ID NO: 1307097 - RNA, 19 nt, Homo sapiens
gaacuggacagcacuacaa

SEQ ID NO: 1307098 - RNA, 19 nt, Homo sapiens
ucacagccauuguagcaaa

SEQ ID NO: 1307099 - RNA, 19 nt, Homo sapiens
ccaacaaacucaccauaca

SEQ ID NO: 1307100 - RNA, 19 nt, Homo sapiens
ggaaacccaccuccucuaa

SEQ ID NO: 1307101 - RNA, 19 nt, Homo sapiens
cauacaacacucugaaaua

SEQ ID NO: 1307102 - RNA, 19 nt, Homo sapiens
guggguagcuuuaguuaca

SEQ ID NO: 1307103 - RNA, 19 nt, Homo sapiens
caacgucucucuggacuuc

SEQ ID NO: 1307104 - RNA, 19 nt, Homo sapiens
gcccagggauuugcuguuu

SEQ ID NO: 1307105 - RNA, 19 nt, Homo sapiens
agucagagguucaaguuug

SEQ ID NO: 1307106 - RNA, 19 nt, Homo sapiens
ccacuucaauuuccaucuu

SEQ ID NO: 1307107 - RNA, 19 nt, Homo sapiens
cauacaaacuugcaucagu

SEQ ID NO: 1307108 - RNA, 19 nt, Homo sapiens
uuacaagccuuccacuuca

SEQ ID NO: 1307109 - RNA, 19 nt, Homo sapiens
gggaaacccuccuccuaca

SEQ ID NO: 1307110 - RNA, 19 nt, Homo sapiens
ucaacaagaugaccgcaau

SEQ ID NO: 1307111 - RNA, 19 nt, Homo sapiens
ggagucagagguucaaguu

SEQ ID NO: 1307112 - RNA, 19 nt, Homo sapiens
gaacuacucagccaugucu

SEQ ID NO: 1307113 - RNA, 19 nt, Homo sapiens
caacaaacucaccauacaa

SEQ ID NO: 1307114 - RNA, 19 nt, Homo sapiens
gaaacccuccuccuacaga

SEQ ID NO: 1307115 - RNA, 19 nt, Homo sapiens
ggacuucgucaucuuguau

SEQ ID NO: 1307116 - RNA, 19 nt, Homo sapiens
cuacaaggaucauggaaac

SEQ ID NO: 1307117 - RNA, 19 nt, Homo sapiens
gcaauccccuugugaguga

SEQ ID NO: 1307118 - RNA, 19 nt, Homo sapiens
gcuggaagccacagaguug

SEQ ID NO: 1307119 - RNA, 19 nt, Homo sapiens
gggcucagguacauucuag

SEQ ID NO: 1307120 - RNA, 19 nt, Homo sapiens
gauaccugcuugccagaug

SEQ ID NO: 1307121 - RNA, 19 nt, Homo sapiens
ccagggauuugcuguuuua

SEQ ID NO: 1307122 - RNA, 19 nt, Homo sapiens
gauggugucuacuggaagu

SEQ ID NO: 1307123 - RNA, 19 nt, Homo sapiens
ggacagugaggcugagaug

SEQ ID NO: 1307124 - RNA, 19 nt, Homo sapiens
caucuuguauuucuucucu

SEQ ID NO: 1307125 - RNA, 19 nt, Homo sapiens
ggucagagucaacaagaug

SEQ ID NO: 1307126 - RNA, 19 nt, Homo sapiens
ccaaaguccucuaugucau

SEQ ID NO: 1307127 - RNA, 19 nt, Homo sapiens
aaacucaccauacaaacuu

SEQ ID NO: 1307128 - RNA, 19 nt, Homo sapiens
auacaacacucugaaauac

SEQ ID NO: 1307129 - RNA, 19 nt, Homo sapiens
ccuccaaaguccucuaugu

SEQ ID NO: 1307130 - RNA, 19 nt, Homo sapiens
ugucuucuguggucuauuc

SEQ ID NO: 1307131 - RNA, 19 nt, Homo sapiens
cagccaauggugcggauua

SEQ ID NO: 1307132 - RNA, 19 nt, Homo sapiens
ccaauggugcggauuauag

SEQ ID NO: 1307133 - RNA, 19 nt, Homo sapiens
guugaaggauggacagucu

SEQ ID NO: 1307134 - RNA, 19 nt, Homo sapiens
gcccaccucuguccuucaa

SEQ ID NO: 1307135 - RNA, 19 nt, Homo sapiens
aaacccaccuccucuaacu

SEQ ID NO: 1307136 - RNA, 19 nt, Homo sapiens
gcuacaaggaucauggaaa

SEQ ID NO: 1307137 - RNA, 19 nt, Homo sapiens
ugggugagcacaacuauug

SEQ ID NO: 1307138 - RNA, 19 nt, Homo sapiens
gcaucucucucugaucuag

SEQ ID NO: 1307139 - RNA, 19 nt, Homo sapiens
cuucaucgauugcacuuag

SEQ ID NO: 1307140 - RNA, 19 nt, Homo sapiens
gggaagccaugucuguuuu

SEQ ID NO: 1307141 - RNA, 19 nt, Homo sapiens
ggguagcuuuaguuacauu

SEQ ID NO: 1307142 - RNA, 19 nt, Homo sapiens
cgauugcacuuaggagaga

SEQ ID NO: 1307143 - RNA, 19 nt, Homo sapiens
gcacgucacauucaaaucc

SEQ ID NO: 1307144 - RNA, 19 nt, Homo sapiens
cuggaaaccuuggcugcua

SEQ ID NO: 1307145 - RNA, 19 nt, Homo sapiens
cugcaucucucucugaucu

SEQ ID NO: 1307146 - RNA, 19 nt, Homo sapiens
auaccaagccgucaaggaa

SEQ ID NO: 1307147 - RNA, 19 nt, Homo sapiens
gaaguacugugagauaccu

SEQ ID NO: 1307148 - RNA, 19 nt, Homo sapiens
ccuuagggauugucaucaa

SEQ ID NO: 1307149 - RNA, 19 nt, Homo sapiens
gggauuugcuguuuuauac

SEQ ID NO: 1307150 - RNA, 19 nt, Homo sapiens
uaugcuugcuucuguggaa

SEQ ID NO: 1307151 - RNA, 19 nt, Homo sapiens
ccacugugccuaggacuug

SEQ ID NO: 1307152 - RNA, 19 nt, Homo sapiens
caaaguccucuaugucauc

SEQ ID NO: 1307153 - RNA, 19 nt, Homo sapiens
gcucagguacauucuagau

SEQ ID NO: 1307154 - RNA, 19 nt, Homo sapiens
cacuucaauuuccaucuuu

SEQ ID NO: 1307155 - RNA, 19 nt, Homo sapiens
ccauacaacacucugaaau

SEQ ID NO: 1307156 - RNA, 19 nt, Homo sapiens
ucuuguauuucuucucuga

SEQ ID NO: 1307157 - RNA, 19 nt, Homo sapiens
cgggaagccaugucuguuu

SEQ ID NO: 1307158 - RNA, 19 nt, Homo sapiens
ggugguggguagcuuuagu

SEQ ID NO: 1307159 - RNA, 19 nt, Homo sapiens
ucuauggucuggcaacucu

SEQ ID NO: 1307160 - RNA, 19 nt, Homo sapiens
acucagccaugucuucugu

SEQ ID NO: 1307161 - RNA, 19 nt, Homo sapiens
gggaacuacucagccaugu

SEQ ID NO: 1307162 - RNA, 19 nt, Homo sapiens
aggcuaugcuugcuucugu

SEQ ID NO: 1307163 - RNA, 19 nt, Homo sapiens
aacaaacucaccauacaaa

SEQ ID NO: 1307164 - RNA, 19 nt, Homo sapiens
cacagucacagccauugua

SEQ ID NO: 1307165 - RNA, 19 nt, Homo sapiens
caaacucaccauacaaacu

SEQ ID NO: 1307166 - RNA, 19 nt, Homo sapiens
ugaaggauggacagucuau

SEQ ID NO: 1307167 - RNA, 19 nt, Homo sapiens
agacuuuccagcauccaua

SEQ ID NO: 1307168 - RNA, 19 nt, Homo sapiens
cuggaaguacugugagaua

SEQ ID NO: 1307169 - RNA, 19 nt, Homo sapiens
gaccuuagggauugucauc

SEQ ID NO: 1307170 - RNA, 19 nt, Homo sapiens
gggauggagucaggcuaug

SEQ ID NO: 1307171 - RNA, 19 nt, Homo sapiens
gccaauggugcggauuaua

SEQ ID NO: 1307172 - RNA, 19 nt, Homo sapiens
guccaacaaacucaccaua

SEQ ID NO: 1307173 - RNA, 19 nt, Homo sapiens
aggauggugucuacuggaa

SEQ ID NO: 1307174 - RNA, 19 nt, Homo sapiens
caggugguggguagcuuua

SEQ ID NO: 1307175 - RNA, 19 nt, Homo sapiens
ggauuccuccugcuucauc

SEQ ID NO: 1307176 - RNA, 19 nt, Homo sapiens
ccucagacugucccaggua

SEQ ID NO: 1307177 - RNA, 19 nt, Homo sapiens
aaaguccucuaugucauca

SEQ ID NO: 1307178 - RNA, 19 nt, Homo sapiens
ggagcaggccaaccucagu

SEQ ID NO: 1307179 - RNA, 19 nt, Homo sapiens
uacaagccuuccacuucaa

SEQ ID NO: 1307180 - RNA, 19 nt, Homo sapiens
uuuacaagccuuccacuuc

SEQ ID NO: 1307181 - RNA, 19 nt, Homo sapiens
ucuggcaacucuccucauc

SEQ ID NO: 1307182 - RNA, 19 nt, Homo sapiens
gaaacccaccuccucuaac

SEQ ID NO: 1307183 - RNA, 19 nt, Homo sapiens
cagugaggcugagaugaca

SEQ ID NO: 1307184 - RNA, 19 nt, Homo sapiens
ccuccugcuucaucgauug

SEQ ID NO: 1307185 - RNA, 19 nt, Homo sapiens
auucaaaucccaucguguu

SEQ ID NO: 1307186 - RNA, 19 nt, Homo sapiens
uccaaaguccucuauguca

SEQ ID NO: 1307187 - RNA, 19 nt, Homo sapiens
uggacuucgucaucuugua

SEQ ID NO: 1307188 - RNA, 19 nt, Homo sapiens
uugcuucuguggaaacaau

SEQ ID NO: 1307189 - RNA, 19 nt, Homo sapiens
gagucagagguucaaguuu

SEQ ID NO: 1307190 - RNA, 19 nt, Homo sapiens
gggucagagucaacaagau

SEQ ID NO: 1307191 - RNA, 19 nt, Homo sapiens
caaaucccaucguguuccu

SEQ ID NO: 1307192 - RNA, 19 nt, Homo sapiens
gaaauuaccuggagacaag

SEQ ID NO: 1307193 - RNA, 19 nt, Homo sapiens
gaaaugcaaugacuacuug

SEQ ID NO: 1307194 - RNA, 19 nt, Homo sapiens
ggacaagucucugcuuaaa

SEQ ID NO: 1307195 - RNA, 19 nt, Homo sapiens
gcgauggucuucagcaaua

SEQ ID NO: 1307196 - RNA, 19 nt, Homo sapiens
uaaccaggcugacaacuga

SEQ ID NO: 1307197 - RNA, 19 nt, Homo sapiens
ucaaggaacuggaugaaga

SEQ ID NO: 1307198 - RNA, 19 nt, Homo sapiens
aaacaaaccugguguguac

SEQ ID NO: 1307199 - RNA, 19 nt, Homo sapiens
gaaugcaucuccagcaaga

SEQ ID NO: 1307200 - RNA, 19 nt, Homo sapiens
ggagacagaugacaagaca

SEQ ID NO: 1307201 - RNA, 19 nt, Homo sapiens
caacugagaugaggauuca

SEQ ID NO: 1307202 - RNA, 19 nt, Homo sapiens
gcugucaacucuucucaaa

SEQ ID NO: 1307203 - RNA, 19 nt, Homo sapiens
gccaacagcuucucaaucu

SEQ ID NO: 1307204 - RNA, 19 nt, Homo sapiens
gaucuaaguuggcccuguu

SEQ ID NO: 1307205 - RNA, 19 nt, Homo sapiens
aaacugcuauggagagaaa

SEQ ID NO: 1307206 - RNA, 19 nt, Homo sapiens
gaaacaaaccuggugugua

SEQ ID NO: 1307207 - RNA, 19 nt, Homo sapiens
gaauauuucuggccucaag

SEQ ID NO: 1307208 - RNA, 19 nt, Homo sapiens
ugacgaaggcguuaagaaa

SEQ ID NO: 1307209 - RNA, 19 nt, Homo sapiens
ugaagagacuggacaaagu

SEQ ID NO: 1307210 - RNA, 19 nt, Homo sapiens
gagaugaggauucacugua

SEQ ID NO: 1307211 - RNA, 19 nt, Homo sapiens
gacccucacuuacagacua

SEQ ID NO: 1307212 - RNA, 19 nt, Homo sapiens
gaaacauagcaaugacaua

SEQ ID NO: 1307213 - RNA, 19 nt, Homo sapiens
gcccagagcccaaggaaga

SEQ ID NO: 1307214 - RNA, 19 nt, Homo sapiens
caacagcuucucaaucuug

SEQ ID NO: 1307215 - RNA, 19 nt, Homo sapiens
ggaaugacuccuacucaga

SEQ ID NO: 1307216 - RNA, 19 nt, Homo sapiens
cuacaggaguguccauaga

SEQ ID NO: 1307217 - RNA, 19 nt, Homo sapiens
aaugagaccugcuggauca

SEQ ID NO: 1307218 - RNA, 19 nt, Homo sapiens
ccagcaaccugcaccaguu

SEQ ID NO: 1307219 - RNA, 19 nt, Homo sapiens
gggaaugcaucuccagcaa

SEQ ID NO: 1307220 - RNA, 19 nt, Homo sapiens
ggaacuggaugaagagacu

SEQ ID NO: 1307221 - RNA, 19 nt, Homo sapiens
gggaagcaaauccuuguuu

SEQ ID NO: 1307222 - RNA, 19 nt, Homo sapiens
ugggacaagucucugcuua

SEQ ID NO: 1307223 - RNA, 19 nt, Homo sapiens
aggauucacuguacucauu

SEQ ID NO: 1307224 - RNA, 19 nt, Homo sapiens
guucuucccuggauuuaca

SEQ ID NO: 1307225 - RNA, 19 nt, Homo sapiens
ggaauucuugcuucucuga

SEQ ID NO: 1307226 - RNA, 19 nt, Homo sapiens
gcagcuggguuucgagagu

SEQ ID NO: 1307227 - RNA, 19 nt, Homo sapiens
gcaacuggaaugacuccua

SEQ ID NO: 1307228 - RNA, 19 nt, Homo sapiens
acacagggaucagguacaa

SEQ ID NO: 1307229 - RNA, 19 nt, Homo sapiens
ccaagucacuacagcaucu

SEQ ID NO: 1307230 - RNA, 19 nt, Homo sapiens
uuagaguccuacagaauau

SEQ ID NO: 1307231 - RNA, 19 nt, Homo sapiens
acugcaagcugaagaguga

SEQ ID NO: 1307232 - RNA, 19 nt, Homo sapiens
ggagagcccaguccaguuc

SEQ ID NO: 1307233 - RNA, 19 nt, Homo sapiens
guacucauuuggucacaag

SEQ ID NO: 1307234 - RNA, 19 nt, Homo sapiens
ugggauggaucguggguuu

SEQ ID NO: 1307235 - RNA, 19 nt, Homo sapiens
gcaaugacuacuuggucua

SEQ ID NO: 1307236 - RNA, 19 nt, Homo sapiens
caaccagaguguaccuugu

SEQ ID NO: 1307237 - RNA, 19 nt, Homo sapiens
cauggccgcucaagggaaa

SEQ ID NO: 1307238 - RNA, 19 nt, Homo sapiens
ggcaucaucugggcuaaug

SEQ ID NO: 1307239 - RNA, 19 nt, Homo sapiens
ggaggacgacuaugacauc

SEQ ID NO: 1307240 - RNA, 19 nt, Homo sapiens
gggauuucuucucagcuuu

SEQ ID NO: 1307241 - RNA, 19 nt, Homo sapiens
ggaaauuaccuggagacaa

SEQ ID NO: 1307242 - RNA, 19 nt, Homo sapiens
ucucaucgacuucaagaaa

SEQ ID NO: 1307243 - RNA, 19 nt, Homo sapiens
caagaaaugcaaugacuac

SEQ ID NO: 1307244 - RNA, 19 nt, Homo sapiens
gggacaagucucugcuuaa

SEQ ID NO: 1307245 - RNA, 19 nt, Homo sapiens
caaggaagagcugggaauu

SEQ ID NO: 1307246 - RNA, 19 nt, Homo sapiens
ugaagacucuggccauggu

SEQ ID NO: 1307247 - RNA, 19 nt, Homo sapiens
gcaagaccagggagacaga

SEQ ID NO: 1307248 - RNA, 19 nt, Homo sapiens
guauaucucccuccagugu

SEQ ID NO: 1307249 - RNA, 19 nt, Homo sapiens
gagagaaagcuaacauggu

SEQ ID NO: 1307250 - RNA, 19 nt, Homo sapiens
uuuagaguccuacagaaua

SEQ ID NO: 1307251 - RNA, 19 nt, Homo sapiens
gaucuucuccucgacauca

SEQ ID NO: 1307252 - RNA, 19 nt, Homo sapiens
gggaaagacugccccagaa

SEQ ID NO: 1307253 - RNA, 19 nt, Homo sapiens
gaggugcgauucagaaaau

SEQ ID NO: 1307254 - RNA, 19 nt, Homo sapiens
gcuauggagagaaagcuaa

SEQ ID NO: 1307255 - RNA, 19 nt, Homo sapiens
ggauucacuguacucauuu

SEQ ID NO: 1307256 - RNA, 19 nt, Homo sapiens
aggaagagcugggaauucu

SEQ ID NO: 1307257 - RNA, 19 nt, Homo sapiens
acaccaaagugacagaagu

SEQ ID NO: 1307258 - RNA, 19 nt, Homo sapiens
ucaagaaaugcaaugacua

SEQ ID NO: 1307259 - RNA, 19 nt, Homo sapiens
aaaguugugugaccuaaaa

SEQ ID NO: 1307260 - RNA, 19 nt, Homo sapiens
gauucacuguacucauuug

SEQ ID NO: 1307261 - RNA, 19 nt, Homo sapiens
ggacugugcuguggcuaac

SEQ ID NO: 1307262 - RNA, 19 nt, Homo sapiens
gagcugggaauucuugcuu

SEQ ID NO: 1307263 - RNA, 19 nt, Homo sapiens
acaggaguguccauagaug

SEQ ID NO: 1307264 - RNA, 19 nt, Homo sapiens
acaagucucugcuuaaaau

SEQ ID NO: 1307265 - RNA, 19 nt, Homo sapiens
cagcgauggucuucagcaa

SEQ ID NO: 1307266 - RNA, 19 nt, Homo sapiens
acgaaggcguuaagaaaca

SEQ ID NO: 1307267 - RNA, 19 nt, Homo sapiens
uugccacucucccaaguuu

SEQ ID NO: 1307268 - RNA, 19 nt, Homo sapiens
ucaucgacuucaagaaaug

SEQ ID NO: 1307269 - RNA, 19 nt, Homo sapiens
caacuccaccauccaggaa

SEQ ID NO: 1307270 - RNA, 19 nt, Homo sapiens
ggauuuacagcaagaugga

SEQ ID NO: 1307271 - RNA, 19 nt, Homo sapiens
accagaguguaccuuguua

SEQ ID NO: 1307272 - RNA, 19 nt, Homo sapiens
ccaacagcuucucaaucuu

SEQ ID NO: 1307273 - RNA, 19 nt, Homo sapiens
ucagaaacauagcaaugac

SEQ ID NO: 1307274 - RNA, 19 nt, Homo sapiens
ugucaacucuucucaaaau

SEQ ID NO: 1307275 - RNA, 19 nt, Homo sapiens
agaaaugcaaugacuacuu

SEQ ID NO: 1307276 - RNA, 19 nt, Homo sapiens
ccuuucaguuucucaguug

SEQ ID NO: 1307277 - RNA, 19 nt, Homo sapiens
ggagagcgaggugcgauuc

SEQ ID NO: 1307278 - RNA, 19 nt, Homo sapiens
gcucacauccacccugcuu

SEQ ID NO: 1307279 - RNA, 19 nt, Homo sapiens
cagaguguaccuuguuaga

SEQ ID NO: 1307280 - RNA, 19 nt, Homo sapiens
uggacugccucucucauuc

SEQ ID NO: 1307281 - RNA, 19 nt, Homo sapiens
acacgacgagguccacaaa

SEQ ID NO: 1307282 - RNA, 19 nt, Homo sapiens
gaugaagagacuggacaaa

SEQ ID NO: 1307283 - RNA, 19 nt, Homo sapiens
ggaugaagagacuggacaa

SEQ ID NO: 1307284 - RNA, 19 nt, Homo sapiens
gaugaggauucacuguacu

SEQ ID NO: 1307285 - RNA, 19 nt, Homo sapiens
gagcgaggugcgauucaga

SEQ ID NO: 1307286 - RNA, 19 nt, Homo sapiens
gucuaugacaguuaccuua

SEQ ID NO: 1307287 - RNA, 19 nt, Homo sapiens
ccagggagacagaugacaa

SEQ ID NO: 1307288 - RNA, 19 nt, Homo sapiens
gagguugcccacagggauu

SEQ ID NO: 1307289 - RNA, 19 nt, Homo sapiens
gaaagacugccccagaaga

SEQ ID NO: 1307290 - RNA, 19 nt, Homo sapiens
gcucuggcaucacuuucca

SEQ ID NO: 1307291 - RNA, 19 nt, Homo sapiens
gcgaggugcgauucagaaa

SEQ ID NO: 1307292 - RNA, 19 nt, Homo sapiens
gagaagaacuacaaagaaa

SEQ ID NO: 1307293 - RNA, 19 nt, Homo sapiens
gaaggaaguugcuagauga

SEQ ID NO: 1307294 - RNA, 19 nt, Homo sapiens
ccuaaugucuccauaauuu

SEQ ID NO: 1307295 - RNA, 19 nt, Homo sapiens
gaagauaauucuccuuugu

SEQ ID NO: 1307296 - RNA, 19 nt, Homo sapiens
gagaaaccauuguuaauuc

SEQ ID NO: 1307297 - RNA, 19 nt, Homo sapiens
ggacgaaagacaaauauuu

SEQ ID NO: 1307298 - RNA, 19 nt, Homo sapiens
gaagucauauucuuacaga

SEQ ID NO: 1307299 - RNA, 19 nt, Homo sapiens
gggcugcguuuaucuaaua

SEQ ID NO: 1307300 - RNA, 19 nt, Homo sapiens
gauaugagaauguugguua

SEQ ID NO: 1307301 - RNA, 19 nt, Homo sapiens
gauggucacuugaauagaa

SEQ ID NO: 1307302 - RNA, 19 nt, Homo sapiens
gaucgacguuccggaauua

SEQ ID NO: 1307303 - RNA, 19 nt, Homo sapiens
ggagagacuucaaauggaa

SEQ ID NO: 1307304 - RNA, 19 nt, Homo sapiens
ucacuuaucuacuucauug

SEQ ID NO: 1307305 - RNA, 19 nt, Homo sapiens
acagauaccucauaaauag

SEQ ID NO: 1307306 - RNA, 19 nt, Homo sapiens
gaaauuugaggcuuguuua

SEQ ID NO: 1307307 - RNA, 19 nt, Homo sapiens
gaaguucuauggucucgaa

SEQ ID NO: 1307308 - RNA, 19 nt, Homo sapiens
caacauguauuaagaugga

SEQ ID NO: 1307309 - RNA, 19 nt, Homo sapiens
gcuaugacuuugugaauga

SEQ ID NO: 1307310 - RNA, 19 nt, Homo sapiens
ggaaguugcuagaugauuc

SEQ ID NO: 1307311 - RNA, 19 nt, Homo sapiens
guacuugaauguuguaugu

SEQ ID NO: 1307312 - RNA, 19 nt, Homo sapiens
ggagaaaccauuguuaauu

SEQ ID NO: 1307313 - RNA, 19 nt, Homo sapiens
guauuaagauggacaccua

SEQ ID NO: 1307314 - RNA, 19 nt, Homo sapiens
gagagaaaguucaugaauc

SEQ ID NO: 1307315 - RNA, 19 nt, Homo sapiens
auacacaacugaaugauga

SEQ ID NO: 1307316 - RNA, 19 nt, Homo sapiens
ccacaugccaaauuucuua

SEQ ID NO: 1307317 - RNA, 19 nt, Homo sapiens
ugucagaggugaucuuuau

SEQ ID NO: 1307318 - RNA, 19 nt, Homo sapiens
gaagaugguuauacacagu

SEQ ID NO: 1307319 - RNA, 19 nt, Homo sapiens
cagaguagauacaggguuu

SEQ ID NO: 1307320 - RNA, 19 nt, Homo sapiens
gaaauuacuuaugcaguuc

SEQ ID NO: 1307321 - RNA, 19 nt, Homo sapiens
ggagaagaacuacaaagaa

SEQ ID NO: 1307322 - RNA, 19 nt, Homo sapiens
aaugauacccugucucuua

SEQ ID NO: 1307323 - RNA, 19 nt, Homo sapiens
ugaccaacauguauuaaga

SEQ ID NO: 1307324 - RNA, 19 nt, Homo sapiens
cuacagauccuaaaguaaa

SEQ ID NO: 1307325 - RNA, 19 nt, Homo sapiens
caauauuggucuguguuua

SEQ ID NO: 1307326 - RNA, 19 nt, Homo sapiens
cagcaagacuuuguugauu

SEQ ID NO: 1307327 - RNA, 19 nt, Homo sapiens
aaacagacuugaguggaua

SEQ ID NO: 1307328 - RNA, 19 nt, Homo sapiens
gagaagaguaucuguaaau

SEQ ID NO: 1307329 - RNA, 19 nt, Homo sapiens
aauaaugacuucagcaaga

SEQ ID NO: 1307330 - RNA, 19 nt, Homo sapiens
ccaacaaggucuuauaaac

SEQ ID NO: 1307331 - RNA, 19 nt, Homo sapiens
cagcuuggauggucacuug

SEQ ID NO: 1307332 - RNA, 19 nt, Homo sapiens
gcaaauacuacguguccua

SEQ ID NO: 1307333 - RNA, 19 nt, Homo sapiens
gggaaccaaucgauaauca

SEQ ID NO: 1307334 - RNA, 19 nt, Homo sapiens
gaauagaauggaacaaguu

SEQ ID NO: 1307335 - RNA, 19 nt, Homo sapiens
cagguaagcaaguuuauuu

SEQ ID NO: 1307336 - RNA, 19 nt, Homo sapiens
cauauauacuugaggugua

SEQ ID NO: 1307337 - RNA, 19 nt, Homo sapiens
ugaguaccuucaaaguuua

SEQ ID NO: 1307338 - RNA, 19 nt, Homo sapiens
gcagguuacauuugguuua

SEQ ID NO: 1307339 - RNA, 19 nt, Homo sapiens
aaagagaugugucugagau

SEQ ID NO: 1307340 - RNA, 19 nt, Homo sapiens
ggucaaauauacugcagau

SEQ ID NO: 1307341 - RNA, 19 nt, Homo sapiens
gaagaucaaagguacaaug

SEQ ID NO: 1307342 - RNA, 19 nt, Homo sapiens
agaaggaaguugcuagaug

SEQ ID NO: 1307343 - RNA, 19 nt, Homo sapiens
aaagugaucuuguuuacag

SEQ ID NO: 1307344 - RNA, 19 nt, Homo sapiens
ugacugaacucacucuaag

SEQ ID NO: 1307345 - RNA, 19 nt, Homo sapiens
cagguuacauuugguuuaa

SEQ ID NO: 1307346 - RNA, 19 nt, Homo sapiens
agagaaaguucaugaaucu

SEQ ID NO: 1307347 - RNA, 19 nt, Homo sapiens
ggagagaaaguucaugaau

SEQ ID NO: 1307348 - RNA, 19 nt, Homo sapiens
gacaucucauggacacuua

SEQ ID NO: 1307349 - RNA, 19 nt, Homo sapiens
gaaaaucagaugucucaua

SEQ ID NO: 1307350 - RNA, 19 nt, Homo sapiens
ccacagcacuuuguuccaa

SEQ ID NO: 1307351 - RNA, 19 nt, Homo sapiens
gcaagacuuuguugauucu

SEQ ID NO: 1307352 - RNA, 19 nt, Homo sapiens
gaaggaugcccguguggaa

SEQ ID NO: 1307353 - RNA, 19 nt, Homo sapiens
gcagggaaaggucagcaua

SEQ ID NO: 1307354 - RNA, 19 nt, Homo sapiens
gaagaucuccaggaccuuu

SEQ ID NO: 1307355 - RNA, 19 nt, Homo sapiens
uaucaucccugcaucuaug

SEQ ID NO: 1307356 - RNA, 19 nt, Homo sapiens
ugauguagcugccaaaguc

SEQ ID NO: 1307357 - RNA, 19 nt, Homo sapiens
gggagaagaacuacaaaga

SEQ ID NO: 1307358 - RNA, 19 nt, Homo sapiens
ggagggagaagaacuacaa

SEQ ID NO: 1307359 - RNA, 19 nt, Homo sapiens
aauacuacguguccuauga

SEQ ID NO: 1307360 - RNA, 19 nt, Homo sapiens
gcucuuguauggcaaaaua

SEQ ID NO: 1307361 - RNA, 19 nt, Homo sapiens
cuaacuaccucaucaccuu

SEQ ID NO: 1307362 - RNA, 19 nt, Homo sapiens
ucaaagugaucuuguuuac

SEQ ID NO: 1307363 - RNA, 19 nt, Homo sapiens
cuagggagauuauaugaag

SEQ ID NO: 1307364 - RNA, 19 nt, Homo sapiens
caaagucuaugaggcauca

SEQ ID NO: 1307365 - RNA, 19 nt, Homo sapiens
gcauguuccuuguaaucaa

SEQ ID NO: 1307366 - RNA, 19 nt, Homo sapiens
ccauguagcuacugguguu

SEQ ID NO: 1307367 - RNA, 19 nt, Homo sapiens
gaccagguaagcaaguuua

SEQ ID NO: 1307368 - RNA, 19 nt, Homo sapiens
caugccaaauuucuuauga

SEQ ID NO: 1307369 - RNA, 19 nt, Homo sapiens
gaaccaaucgauaaucaca

SEQ ID NO: 1307370 - RNA, 19 nt, Homo sapiens
ggacaccuacucuacgaaa

SEQ ID NO: 1307371 - RNA, 19 nt, Homo sapiens
ugugauagguggcauggaa

SEQ ID NO: 1307372 - RNA, 19 nt, Homo sapiens
gaaagacagaacauuacaa

SEQ ID NO: 1307373 - RNA, 19 nt, Homo sapiens
ucacagacacuaaauucaa

SEQ ID NO: 1307374 - RNA, 19 nt, Homo sapiens
gaaacacgaaguucuaugg

SEQ ID NO: 1307375 - RNA, 19 nt, Homo sapiens
aaacuacagugucaaacau

SEQ ID NO: 1307376 - RNA, 19 nt, Homo sapiens
ucagaggugaucuuuauuu

SEQ ID NO: 1307377 - RNA, 19 nt, Homo sapiens
ggaaagacagaacauuaca

SEQ ID NO: 1307378 - RNA, 19 nt, Homo sapiens
guguagagauguuauuaag

SEQ ID NO: 1307379 - RNA, 19 nt, Homo sapiens
agccggagcugccuaugua

SEQ ID NO: 1307380 - RNA, 19 nt, Homo sapiens
gcucaagacguccuccuuu

SEQ ID NO: 1307381 - RNA, 19 nt, Homo sapiens
ugagaagaguaucuguaaa

SEQ ID NO: 1307382 - RNA, 19 nt, Homo sapiens
gcccauauauacccugugu

SEQ ID NO: 1307383 - RNA, 19 nt, Homo sapiens
gagcucuucugaacugugu

SEQ ID NO: 1307384 - RNA, 19 nt, Homo sapiens
gaaguucaaguucucaugu

SEQ ID NO: 1307385 - RNA, 19 nt, Homo sapiens
ugccuaaguucauuucaaa

SEQ ID NO: 1307386 - RNA, 19 nt, Homo sapiens
gaagaaugcuacagauccu

SEQ ID NO: 1307387 - RNA, 19 nt, Homo sapiens
agaagcccgugccuguuua

SEQ ID NO: 1307388 - RNA, 19 nt, Homo sapiens
gggagaaaccauuguuaau

SEQ ID NO: 1307389 - RNA, 19 nt, Homo sapiens
gcccuaauacuuuauaugu

SEQ ID NO: 1307390 - RNA, 19 nt, Homo sapiens
cuaaagggaaguucaaguu

SEQ ID NO: 1307391 - RNA, 19 nt, Homo sapiens
gauucuagaagcuguuuaa

SEQ ID NO: 1307392 - RNA, 19 nt, Homo sapiens
gaacauggccacugacuuu

SEQ ID NO: 1307393 - RNA, 19 nt, Homo sapiens
gaagaacgcugaagaacau

SEQ ID NO: 1307394 - RNA, 19 nt, Homo sapiens
cgaaauagcuugaagaaag

SEQ ID NO: 1307395 - RNA, 19 nt, Homo sapiens
ggaaaggccuccaccugua

SEQ ID NO: 1307396 - RNA, 19 nt, Homo sapiens
ugaauuggcugaagucaaa

SEQ ID NO: 1307397 - RNA, 19 nt, Homo sapiens
gaacauugcuuuuacauug

SEQ ID NO: 1307398 - RNA, 19 nt, Homo sapiens
gaagaaagccacagauaau

SEQ ID NO: 1307399 - RNA, 19 nt, Homo sapiens
ggacggaguucaaguuguu

SEQ ID NO: 1307400 - RNA, 19 nt, Homo sapiens
gggcuagaguuuccacaua

SEQ ID NO: 1307401 - RNA, 19 nt, Homo sapiens
uggaagagcuggauggaaa

SEQ ID NO: 1307402 - RNA, 19 nt, Homo sapiens
ugaaggacaucaagucuga

SEQ ID NO: 1307403 - RNA, 19 nt, Homo sapiens
ugcaagaucuggucaaauu

SEQ ID NO: 1307404 - RNA, 19 nt, Homo sapiens
ggacaucaagucugaauug

SEQ ID NO: 1307405 - RNA, 19 nt, Homo sapiens
gaaaugagcaauuguagag

SEQ ID NO: 1307406 - RNA, 19 nt, Homo sapiens
gcagaaguuuaaacacuga

SEQ ID NO: 1307407 - RNA, 19 nt, Homo sapiens
gaacaaaccauccagaaac

SEQ ID NO: 1307408 - RNA, 19 nt, Homo sapiens
ggccugagcuugccacaga

SEQ ID NO: 1307409 - RNA, 19 nt, Homo sapiens
uaaggaaucuggcaugaag

SEQ ID NO: 1307410 - RNA, 19 nt, Homo sapiens
gcacaggaaguuucaagaa

SEQ ID NO: 1307411 - RNA, 19 nt, Homo sapiens
gucaacagaucaagacauu

SEQ ID NO: 1307412 - RNA, 19 nt, Homo sapiens
gaagucaccuccuguagcu

SEQ ID NO: 1307413 - RNA, 19 nt, Homo sapiens
caggaaaucuucagaggau

SEQ ID NO: 1307414 - RNA, 19 nt, Homo sapiens
aaagcuggcugaccugaaa

SEQ ID NO: 1307415 - RNA, 19 nt, Homo sapiens
ugaagaaagccacagauaa

SEQ ID NO: 1307416 - RNA, 19 nt, Homo sapiens
gaacuucagaccuagauau

SEQ ID NO: 1307417 - RNA, 19 nt, Homo sapiens
ggagaagaacgcugaagaa

SEQ ID NO: 1307418 - RNA, 19 nt, Homo sapiens
ugucuucucuggugucuuu

SEQ ID NO: 1307419 - RNA, 19 nt, Homo sapiens
gaaggacggaguucaaguu

SEQ ID NO: 1307420 - RNA, 19 nt, Homo sapiens
gaaagccacagauaaugaa

SEQ ID NO: 1307421 - RNA, 19 nt, Homo sapiens
caauuuaagugcaaagaca

SEQ ID NO: 1307422 - RNA, 19 nt, Homo sapiens
guuagagacuguucccaaa

SEQ ID NO: 1307423 - RNA, 19 nt, Homo sapiens
acacagacuuugaugaaau

SEQ ID NO: 1307424 - RNA, 19 nt, Homo sapiens
gagagacgccuacguggaa

SEQ ID NO: 1307425 - RNA, 19 nt, Homo sapiens
ccagauuucuacugauuug

SEQ ID NO: 1307426 - RNA, 19 nt, Homo sapiens
gcacagagaccccgacuuu

SEQ ID NO: 1307427 - RNA, 19 nt, Homo sapiens
gaugggcgcuaccugauca

SEQ ID NO: 1307428 - RNA, 19 nt, Homo sapiens
gcagcagugugaugacuau

SEQ ID NO: 1307429 - RNA, 19 nt, Homo sapiens
ggaauuaaaccaccugaag

SEQ ID NO: 1307430 - RNA, 19 nt, Homo sapiens
gaaggaaacaagccugaga

SEQ ID NO: 1307431 - RNA, 19 nt, Homo sapiens
ccaagaaggucccaaagac

SEQ ID NO: 1307432 - RNA, 19 nt, Homo sapiens
gcuggaugcuuguaaggaa

SEQ ID NO: 1307433 - RNA, 19 nt, Homo sapiens
caauuaaaccacacagaaa

SEQ ID NO: 1307434 - RNA, 19 nt, Homo sapiens
ggaucaaugugacggagaa

SEQ ID NO: 1307435 - RNA, 19 nt, Homo sapiens
gaggugcuguccuggcuuu

SEQ ID NO: 1307436 - RNA, 19 nt, Homo sapiens
ucacacagacuuugaugaa

SEQ ID NO: 1307437 - RNA, 19 nt, Homo sapiens
acaaagugcuggugaacga

SEQ ID NO: 1307438 - RNA, 19 nt, Homo sapiens
gaacgggucaugauggaau

SEQ ID NO: 1307439 - RNA, 19 nt, Homo sapiens
ggccagcugucugucuuua

SEQ ID NO: 1307440 - RNA, 19 nt, Homo sapiens
gaaaggccuccaccuguau

SEQ ID NO: 1307441 - RNA, 19 nt, Homo sapiens
uaaggugggugagcaagaa

SEQ ID NO: 1307442 - RNA, 19 nt, Homo sapiens
gcagcuuguugaucagaaa

SEQ ID NO: 1307443 - RNA, 19 nt, Homo sapiens
ggucaaauuucagccauca

SEQ ID NO: 1307444 - RNA, 19 nt, Homo sapiens
ggaaaugagcaauuguaga

SEQ ID NO: 1307445 - RNA, 19 nt, Homo sapiens
ucaauuaaaccacacagaa

SEQ ID NO: 1307446 - RNA, 19 nt, Homo sapiens
ccagaaacuucaacaggau

SEQ ID NO: 1307447 - RNA, 19 nt, Homo sapiens
aagccuauguggacaguaa

SEQ ID NO: 1307448 - RNA, 19 nt, Homo sapiens
gcgccuacaucgugaacaa

SEQ ID NO: 1307449 - RNA, 19 nt, Homo sapiens
gaaacaagccugagaaaag

SEQ ID NO: 1307450 - RNA, 19 nt, Homo sapiens
cagggagugucaauaaaga

SEQ ID NO: 1307451 - RNA, 19 nt, Homo sapiens
caaauagggaugcguuaga

SEQ ID NO: 1307452 - RNA, 19 nt, Homo sapiens
ccacauaggccccaacaua

SEQ ID NO: 1307453 - RNA, 19 nt, Homo sapiens
gcaagaucuggucaaauuu

SEQ ID NO: 1307454 - RNA, 19 nt, Homo sapiens
cgaacaaaccauccagaaa

SEQ ID NO: 1307455 - RNA, 19 nt, Homo sapiens
caacagaucaagacauugg

SEQ ID NO: 1307456 - RNA, 19 nt, Homo sapiens
gaacuggugcgccuacauc

SEQ ID NO: 1307457 - RNA, 19 nt, Homo sapiens
gaaaauacagucucuggaa

SEQ ID NO: 1307458 - RNA, 19 nt, Homo sapiens
ggccuucccucgcuguuga

SEQ ID NO: 1307459 - RNA, 19 nt, Homo sapiens
agaauucaguccagcaguu

SEQ ID NO: 1307460 - RNA, 19 nt, Homo sapiens
gagggcagggugucucaua

SEQ ID NO: 1307461 - RNA, 19 nt, Homo sapiens
uccuacagaugaccaauaa

SEQ ID NO: 1307462 - RNA, 19 nt, Homo sapiens
gauaugucacuagguauaa

SEQ ID NO: 1307463 - RNA, 19 nt, Homo sapiens
gcgcugguguaucgaguga

SEQ ID NO: 1307464 - RNA, 19 nt, Homo sapiens
gaugcaaggaucaauguga

SEQ ID NO: 1307465 - RNA, 19 nt, Homo sapiens
uaagaucgacgcccugaga

SEQ ID NO: 1307466 - RNA, 19 nt, Homo sapiens
gcaccaggauacccgaagu

SEQ ID NO: 1307467 - RNA, 19 nt, Homo sapiens
ucaagacauuggaccagaa

SEQ ID NO: 1307468 - RNA, 19 nt, Homo sapiens
ggaaaucuucagaggauca

SEQ ID NO: 1307469 - RNA, 19 nt, Homo sapiens
gauaaugaacccagccaau

SEQ ID NO: 1307470 - RNA, 19 nt, Homo sapiens
gagcuccggugucuucucu

SEQ ID NO: 1307471 - RNA, 19 nt, Homo sapiens
caagaucuggucaaauuuc

SEQ ID NO: 1307472 - RNA, 19 nt, Homo sapiens
ggagcuggaugcuuguaag

SEQ ID NO: 1307473 - RNA, 19 nt, Homo sapiens
auggaagacuggacaauga

SEQ ID NO: 1307474 - RNA, 19 nt, Homo sapiens
agaaagccacagauaauga

SEQ ID NO: 1307475 - RNA, 19 nt, Homo sapiens
caacaggauuuuaguuuuc

SEQ ID NO: 1307476 - RNA, 19 nt, Homo sapiens
gaagacuggacaaugaguu

SEQ ID NO: 1307477 - RNA, 19 nt, Homo sapiens
ccagcugucugucuuuaca

SEQ ID NO: 1307478 - RNA, 19 nt, Homo sapiens
ggcuagaguuuccacauag

SEQ ID NO: 1307479 - RNA, 19 nt, Homo sapiens
gaagugagaguuuuauuca

SEQ ID NO: 1307480 - RNA, 19 nt, Homo sapiens
cuacugauuugcaagaucu

SEQ ID NO: 1307481 - RNA, 19 nt, Homo sapiens
agacauuucuggccugaag

SEQ ID NO: 1307482 - RNA, 19 nt, Homo sapiens
gcauggguagguucacuaa

SEQ ID NO: 1307483 - RNA, 19 nt, Homo sapiens
cagggaagaccgcgcagua

SEQ ID NO: 1307484 - RNA, 19 nt, Homo sapiens
gaagaacauugcuuuuaca

SEQ ID NO: 1307485 - RNA, 19 nt, Homo sapiens
ccaccagaaugcugaaugg

SEQ ID NO: 1307486 - RNA, 19 nt, Homo sapiens
uaaugaacccagccaauuc

SEQ ID NO: 1307487 - RNA, 19 nt, Homo sapiens
agacuuugaugaaauguac

SEQ ID NO: 1307488 - RNA, 19 nt, Homo sapiens
cacagacuuugaugaaaug

SEQ ID NO: 1307489 - RNA, 19 nt, Homo sapiens
aaaaggaaaugagcaauug

SEQ ID NO: 1307490 - RNA, 19 nt, Homo sapiens
caaaccauccagaaacuuc

SEQ ID NO: 1307491 - RNA, 19 nt, Homo sapiens
cuacagaugaccaauaaca

SEQ ID NO: 1307492 - RNA, 19 nt, Homo sapiens
gaaguuaguucgucuguug

SEQ ID NO: 1307493 - RNA, 19 nt, Homo sapiens
cgaauuagauccugauauu

SEQ ID NO: 1307494 - RNA, 19 nt, Homo sapiens
ggaagaagcuaagaaguug

SEQ ID NO: 1307495 - RNA, 19 nt, Homo sapiens
ggaggaauaugaacaaguu

SEQ ID NO: 1307496 - RNA, 19 nt, Homo sapiens
gaagaaauccgugcacuuu

SEQ ID NO: 1307497 - RNA, 19 nt, Homo sapiens
ggacauugaugaagcuuug

SEQ ID NO: 1307498 - RNA, 19 nt, Homo sapiens
gaacuucagaugccuguua

SEQ ID NO: 1307499 - RNA, 19 nt, Homo sapiens
gagcacauccuauaucaaa

SEQ ID NO: 1307500 - RNA, 19 nt, Homo sapiens
gcaaugagacggcguauca

SEQ ID NO: 1307501 - RNA, 19 nt, Homo sapiens
ucugucagcucuuuaauuu

SEQ ID NO: 1307502 - RNA, 19 nt, Homo sapiens
gaaaagccuucuacaagua

SEQ ID NO: 1307503 - RNA, 19 nt, Homo sapiens
gaaggaagaauaugcaaga

SEQ ID NO: 1307504 - RNA, 19 nt, Homo sapiens
gaauuuggcugagauuugu

SEQ ID NO: 1307505 - RNA, 19 nt, Homo sapiens
gaaagaaauggcaggagua

SEQ ID NO: 1307506 - RNA, 19 nt, Homo sapiens
ugacaagccuccagauuuc

SEQ ID NO: 1307507 - RNA, 19 nt, Homo sapiens
gaauuucugucagcucuuu

SEQ ID NO: 1307508 - RNA, 19 nt, Homo sapiens
gaaauuacgacucaucaau

SEQ ID NO: 1307509 - RNA, 19 nt, Homo sapiens
gguauuggcugcuacuaau

SEQ ID NO: 1307510 - RNA, 19 nt, Homo sapiens
gaauaugcccuucuuggaa

SEQ ID NO: 1307511 - RNA, 19 nt, Homo sapiens
ucagaugccuguuaccaaa

SEQ ID NO: 1307512 - RNA, 19 nt, Homo sapiens
gcaaagaaaggaagagaau

SEQ ID NO: 1307513 - RNA, 19 nt, Homo sapiens
ugaauuggcccuaaagaaa

SEQ ID NO: 1307514 - RNA, 19 nt, Homo sapiens
ugacauagcagaucuggaa

SEQ ID NO: 1307515 - RNA, 19 nt, Homo sapiens
gaauuuggaucugcuugaa

SEQ ID NO: 1307516 - RNA, 19 nt, Homo sapiens
gaugaagcuuugcgaagaa

SEQ ID NO: 1307517 - RNA, 19 nt, Homo sapiens
cuaaagcuguugccacuga

SEQ ID NO: 1307518 - RNA, 19 nt, Homo sapiens
gguggaagcccuugaaaga

SEQ ID NO: 1307519 - RNA, 19 nt, Homo sapiens
gacaagggaaggaagaaua

SEQ ID NO: 1307520 - RNA, 19 nt, Homo sapiens
gaugaaccauuuagagauc

SEQ ID NO: 1307521 - RNA, 19 nt, Homo sapiens
gauucuaucugcagucgaa

SEQ ID NO: 1307522 - RNA, 19 nt, Homo sapiens
cuucuacacugacaucuaa

SEQ ID NO: 1307523 - RNA, 19 nt, Homo sapiens
ucagagacauugccaguca

SEQ ID NO: 1307524 - RNA, 19 nt, Homo sapiens
gacaaggacuauagagcaa

SEQ ID NO: 1307525 - RNA, 19 nt, Homo sapiens
uggcugagauuugugauaa

SEQ ID NO: 1307526 - RNA, 19 nt, Homo sapiens
guaaaacuaugcuagcuaa

SEQ ID NO: 1307527 - RNA, 19 nt, Homo sapiens
gcacauccuauaucaaaga

SEQ ID NO: 1307528 - RNA, 19 nt, Homo sapiens
uugcagggaugccucuuua

SEQ ID NO: 1307529 - RNA, 19 nt, Homo sapiens
gauauucaacuggaagaua

SEQ ID NO: 1307530 - RNA, 19 nt, Homo sapiens
cuaccacgaucuucauuga

SEQ ID NO: 1307531 - RNA, 19 nt, Homo sapiens
acacugacaucuaaauaca

SEQ ID NO: 1307532 - RNA, 19 nt, Homo sapiens
gaagauauagccgagaaga

SEQ ID NO: 1307533 - RNA, 19 nt, Homo sapiens
ucagauggauggaguugga

SEQ ID NO: 1307534 - RNA, 19 nt, Homo sapiens
gaaccucugaugaacauga

SEQ ID NO: 1307535 - RNA, 19 nt, Homo sapiens
gcugagauuugugauaaug

SEQ ID NO: 1307536 - RNA, 19 nt, Homo sapiens
uggcuuaaguccagaagaa

SEQ ID NO: 1307537 - RNA, 19 nt, Homo sapiens
ugaugaagcuuugcgaaga

SEQ ID NO: 1307538 - RNA, 19 nt, Homo sapiens
cauagcagaucuggaagaa

SEQ ID NO: 1307539 - RNA, 19 nt, Homo sapiens
uggaagcccuugaaagaga

SEQ ID NO: 1307540 - RNA, 19 nt, Homo sapiens
gcaagauggugcaagugau

SEQ ID NO: 1307541 - RNA, 19 nt, Homo sapiens
aauaugcccuucuuggaaa

SEQ ID NO: 1307542 - RNA, 19 nt, Homo sapiens
caacauucuucaacguuuc

SEQ ID NO: 1307543 - RNA, 19 nt, Homo sapiens
aagggaagcuguuguucuu

SEQ ID NO: 1307544 - RNA, 19 nt, Homo sapiens
caaggacuauagagcaaga

SEQ ID NO: 1307545 - RNA, 19 nt, Homo sapiens
gaucaggcgucccaaucga

SEQ ID NO: 1307546 - RNA, 19 nt, Homo sapiens
gcagggaugccucuuuaau

SEQ ID NO: 1307547 - RNA, 19 nt, Homo sapiens
caaagaaaggaagagaaua

SEQ ID NO: 1307548 - RNA, 19 nt, Homo sapiens
acaacauucuucaacguuu

SEQ ID NO: 1307549 - RNA, 19 nt, Homo sapiens
guacaacauucuucaacgu

SEQ ID NO: 1307550 - RNA, 19 nt, Homo sapiens
caauguggaugccugacuu

SEQ ID NO: 1307551 - RNA, 19 nt, Homo sapiens
gcucuuuaauuucugguau

SEQ ID NO: 1307552 - RNA, 19 nt, Homo sapiens
gaagcuaagaaguugcuaa

SEQ ID NO: 1307553 - RNA, 19 nt, Homo sapiens
gacauuguauccaggaauc

SEQ ID NO: 1307554 - RNA, 19 nt, Homo sapiens
ugucagcucuuuaauuucu

SEQ ID NO: 1307555 - RNA, 19 nt, Homo sapiens
guucgucuguuguuugaga

SEQ ID NO: 1307556 - RNA, 19 nt, Homo sapiens
gauauagccgagaagauug

SEQ ID NO: 1307557 - RNA, 19 nt, Homo sapiens
uaaagaggaacuucagaug

SEQ ID NO: 1307558 - RNA, 19 nt, Homo sapiens
uguuugagauggcuagauu

SEQ ID NO: 1307559 - RNA, 19 nt, Homo sapiens
aggugaaucugagaaguua

SEQ ID NO: 1307560 - RNA, 19 nt, Homo sapiens
gaggugaaucugagaaguu

SEQ ID NO: 1307561 - RNA, 19 nt, Homo sapiens
agaaauggcaggaguagga

SEQ ID NO: 1307562 - RNA, 19 nt, Homo sapiens
uggaagauauagccgagaa

SEQ ID NO: 1307563 - RNA, 19 nt, Homo sapiens
cuacacugacaucuaaaua

SEQ ID NO: 1307564 - RNA, 19 nt, Homo sapiens
ccgagcacauccuauauca

SEQ ID NO: 1307565 - RNA, 19 nt, Homo sapiens
uuagagauccugcuguuug

SEQ ID NO: 1307566 - RNA, 19 nt, Homo sapiens
gcguaucaauggcuuaagu

SEQ ID NO: 1307567 - RNA, 19 nt, Homo sapiens
agauauagccgagaagauu

SEQ ID NO: 1307568 - RNA, 19 nt, Homo sapiens
uggaagaagcuaagaaguu

SEQ ID NO: 1307569 - RNA, 19 nt, Homo sapiens
gcaacagguucggcaggaa

SEQ ID NO: 1307570 - RNA, 19 nt, Homo sapiens
gauaaugcaaagaaaggaa

SEQ ID NO: 1307571 - RNA, 19 nt, Homo sapiens
auauauaccucucccaaca

SEQ ID NO: 1307572 - RNA, 19 nt, Homo sapiens
ggaaggguguacugauggu

SEQ ID NO: 1307573 - RNA, 19 nt, Homo sapiens
gcuaagggaagcuguuguu

SEQ ID NO: 1307574 - RNA, 19 nt, Homo sapiens
gggaugacauagcagaucu

SEQ ID NO: 1307575 - RNA, 19 nt, Homo sapiens
caaguagggacaaggacua

SEQ ID NO: 1307576 - RNA, 19 nt, Homo sapiens
caagaugaaccauuuagag

SEQ ID NO: 1307577 - RNA, 19 nt, Homo sapiens
caaaaugguuaugguauug

SEQ ID NO: 1307578 - RNA, 19 nt, Homo sapiens
aaaugaugauccuuccaaa

SEQ ID NO: 1307579 - RNA, 19 nt, Homo sapiens
ugagauggcuagauuuuau

SEQ ID NO: 1307580 - RNA, 19 nt, Homo sapiens
ggaaauuacgacucaucaa

SEQ ID NO: 1307581 - RNA, 19 nt, Homo sapiens
acgaagaaauuccugcaau

SEQ ID NO: 1307582 - RNA, 19 nt, Homo sapiens
gaagauugagggcuauucu

SEQ ID NO: 1307583 - RNA, 19 nt, Homo sapiens
ccaaaaugguuaugguauu

SEQ ID NO: 1307584 - RNA, 19 nt, Homo sapiens
uggaggagcuuuagaaaau

SEQ ID NO: 1307585 - RNA, 19 nt, Homo sapiens
ugaauuuggcugagauuug

SEQ ID NO: 1307586 - RNA, 19 nt, Homo sapiens
ugaaagaagaugaauuugg

SEQ ID NO: 1307587 - RNA, 19 nt, Homo sapiens
agucagagauccagcuauc

SEQ ID NO: 1307588 - RNA, 19 nt, Homo sapiens
uuacgacucaucaauggua

SEQ ID NO: 1307589 - RNA, 19 nt, Homo sapiens
aaacuaugcuagcuaaagc

SEQ ID NO: 1307590 - RNA, 19 nt, Homo sapiens
ugauaaggaucugguggaa

SEQ ID NO: 1307591 - RNA, 19 nt, Homo sapiens
ucagagauccagcuaucaa

SEQ ID NO: 1307592 - RNA, 19 nt, Homo sapiens
caaagaagcugcuaacaga

SEQ ID NO: 1307593 - RNA, 19 nt, Homo sapiens
gaucggaacuucuaauuau

SEQ ID NO: 1307594 - RNA, 19 nt, Homo sapiens
gcuaacagauggacugaua

SEQ ID NO: 1307595 - RNA, 19 nt, Homo sapiens
gaaauacgccaagcaaaua

SEQ ID NO: 1307596 - RNA, 19 nt, Homo sapiens
cagauggacugauaacaua

SEQ ID NO: 1307597 - RNA, 19 nt, Homo sapiens
caaauaaaguagccaaaga

SEQ ID NO: 1307598 - RNA, 19 nt, Homo sapiens
gaagauugcucccaaagag

SEQ ID NO: 1307599 - RNA, 19 nt, Homo sapiens
aaagagaacucgcaugaug

SEQ ID NO: 1307600 - RNA, 19 nt, Homo sapiens
gagaaaggcauuacugcua

SEQ ID NO: 1307601 - RNA, 19 nt, Homo sapiens
gaacucgcaugauggaaau

SEQ ID NO: 1307602 - RNA, 19 nt, Homo sapiens
gaagaaauacgccaagcaa

SEQ ID NO: 1307603 - RNA, 19 nt, Homo sapiens
gcuaaaggcagaaguagaa

SEQ ID NO: 1307604 - RNA, 19 nt, Homo sapiens
gcaaguuguggaagaaaua

SEQ ID NO: 1307605 - RNA, 19 nt, Homo sapiens
agaagacuuugacuacaua

SEQ ID NO: 1307606 - RNA, 19 nt, Homo sapiens
ggaucggaacuucuaauua

SEQ ID NO: 1307607 - RNA, 19 nt, Homo sapiens
gaaaagagaacucgcauga

SEQ ID NO: 1307608 - RNA, 19 nt, Homo sapiens
gagaggaucggaacuucua

SEQ ID NO: 1307609 - RNA, 19 nt, Homo sapiens
gaaccaggcuagcaaaaga

SEQ ID NO: 1307610 - RNA, 19 nt, Homo sapiens
gaaaggcauuacugcuaug

SEQ ID NO: 1307611 - RNA, 19 nt, Homo sapiens
agaaaggcauuacugcuau

SEQ ID NO: 1307612 - RNA, 19 nt, Homo sapiens
cagaagacuuugacuacau

SEQ ID NO: 1307613 - RNA, 19 nt, Homo sapiens
gaccaaagggaacagcuaa

SEQ ID NO: 1307614 - RNA, 19 nt, Homo sapiens
caaggaaacauaaguugga

SEQ ID NO: 1307615 - RNA, 19 nt, Homo sapiens
ggacugagugcagaagaaa

SEQ ID NO: 1307616 - RNA, 19 nt, Homo sapiens
uaaaguagccaaagaagcu

SEQ ID NO: 1307617 - RNA, 19 nt, Homo sapiens
gcaaauaaaguagccaaag

SEQ ID NO: 1307618 - RNA, 19 nt, Homo sapiens
agaaauacgccaagcaaau

SEQ ID NO: 1307619 - RNA, 19 nt, Homo sapiens
aaguaaagcucuucaugca

SEQ ID NO: 1307620 - RNA, 19 nt, Homo sapiens
ggugaaggauguacaagcu

SEQ ID NO: 1307621 - RNA, 19 nt, Homo sapiens
gagcgaaccaggcuagcaa

SEQ ID NO: 1307622 - RNA, 19 nt, Homo sapiens
ccaaguaaagcucuucaug

SEQ ID NO: 1307623 - RNA, 19 nt, Homo sapiens
ccagaagacuuugacuaca

SEQ ID NO: 1307624 - RNA, 19 nt, Homo sapiens
uaaaagacuuggagaagau

SEQ ID NO: 1307625 - RNA, 19 nt, Homo sapiens
gcaugcaagccuacagaaa

SEQ ID NO: 1307626 - RNA, 19 nt, Homo sapiens
gauggacugauaacauauu

SEQ ID NO: 1307627 - RNA, 19 nt, Homo sapiens
ccaaagaagcugcuaacag

SEQ ID NO: 1307628 - RNA, 19 nt, Homo sapiens
ggaagaaauacgccaagca

SEQ ID NO: 1307629 - RNA, 19 nt, Homo sapiens
aaaauuggccgaugugaaa

SEQ ID NO: 1307630 - RNA, 19 nt, Homo sapiens
guucuggaaucucaguugu

SEQ ID NO: 1307631 - RNA, 19 nt, Homo sapiens
uaaguuggagguucuggaa

SEQ ID NO: 1307632 - RNA, 19 nt, Homo sapiens
gugagaggaucggaacuuc

SEQ ID NO: 1307633 - RNA, 19 nt, Homo sapiens
aggcauuacugcuauguca

SEQ ID NO: 1307634 - RNA, 19 nt, Homo sapiens
aauauuccaugguggugaa

SEQ ID NO: 1307635 - RNA, 19 nt, Homo sapiens
gauagaacuuuuggaauuc

SEQ ID NO: 1307636 - RNA, 19 nt, Homo sapiens
gagaagauugcucccaaag

SEQ ID NO: 1307637 - RNA, 19 nt, Homo sapiens
aaauacgccaagcaaauaa

SEQ ID NO: 1307638 - RNA, 19 nt, Homo sapiens
aaagagaaaggcauuacug

SEQ ID NO: 1307639 - RNA, 19 nt, Homo sapiens
agacugugauccgcaaguu

SEQ ID NO: 1307640 - RNA, 19 nt, Homo sapiens
aagcuuaguugaugauggu

SEQ ID NO: 1307641 - RNA, 19 nt, Homo sapiens
ucgcaugauggaaauauuu

SEQ ID NO: 1307642 - RNA, 19 nt, Homo sapiens
acgccaagcaaauaaagua

SEQ ID NO: 1307643 - RNA, 19 nt, Homo sapiens
cuucaugcaaggaaacaua

SEQ ID NO: 1307644 - RNA, 19 nt, Homo sapiens
ccaugguggugaaggaugu

SEQ ID NO: 1307645 - RNA, 19 nt, Homo sapiens
agaacucgcaugauggaaa

SEQ ID NO: 1307646 - RNA, 19 nt, Homo sapiens
uggagguucuggaaucuca

SEQ ID NO: 1307647 - RNA, 19 nt, Homo sapiens
gaaaauuuggguuugaaga

SEQ ID NO: 1307648 - RNA, 19 nt, Homo sapiens
acagauggacugauaacau

SEQ ID NO: 1307649 - RNA, 19 nt, Homo sapiens
acagcuaaaggcagaagua

SEQ ID NO: 1307650 - RNA, 19 nt, Homo sapiens
ccaaagggaacagcuaaag

SEQ ID NO: 1307651 - RNA, 19 nt, Homo sapiens
gaauuccagaagacuuuga

SEQ ID NO: 1307652 - RNA, 19 nt, Homo sapiens
cugauaacauauucgcaau

SEQ ID NO: 1307653 - RNA, 19 nt, Homo sapiens
uaacagauggacugauaac

SEQ ID NO: 1307654 - RNA, 19 nt, Homo sapiens
aagaagcugcuaacagaug

SEQ ID NO: 1307655 - RNA, 19 nt, Homo sapiens
gaacagcuaaaggcagaag

SEQ ID NO: 1307656 - RNA, 19 nt, Homo sapiens
caaagggaacagcuaaagg

SEQ ID NO: 1307657 - RNA, 19 nt, Homo sapiens
gaggaucggaacuucuaau

SEQ ID NO: 1307658 - RNA, 19 nt, Homo sapiens
uuaaaagacuuggagaaga

SEQ ID NO: 1307659 - RNA, 19 nt, Homo sapiens
cuuaguugaugaugguaug

SEQ ID NO: 1307660 - RNA, 19 nt, Homo sapiens
ggaauuccagaagacuuug

SEQ ID NO: 1307661 - RNA, 19 nt, Homo sapiens
ccaaagagaaaggcauuac

SEQ ID NO: 1307662 - RNA, 19 nt, Homo sapiens
cgcaaguuguggaagaaau

SEQ ID NO: 1307663 - RNA, 19 nt, Homo sapiens
aggacugagugcagaagaa

SEQ ID NO: 1307664 - RNA, 19 nt, Homo sapiens
agaagauugcucccaaaga

SEQ ID NO: 1307665 - RNA, 19 nt, Homo sapiens
caaagagaaaggcauuacu

SEQ ID NO: 1307666 - RNA, 19 nt, Homo sapiens
gaaacauaaguuggagguu

SEQ ID NO: 1307667 - RNA, 19 nt, Homo sapiens
gacuuugacuacauagacu

SEQ ID NO: 1307668 - RNA, 19 nt, Homo sapiens
agagaacucgcaugaugga

SEQ ID NO: 1307669 - RNA, 19 nt, Homo sapiens
gaaaagcauugagaaagcu

SEQ ID NO: 1307670 - RNA, 19 nt, Homo sapiens
ucuggaaucucaguugucu

SEQ ID NO: 1307671 - RNA, 19 nt, Homo sapiens
agauugcucccaaagagaa

SEQ ID NO: 1307672 - RNA, 19 nt, Homo sapiens
caagcuugugaauauguaa

SEQ ID NO: 1307673 - RNA, 19 nt, Homo sapiens
aagaaauacgccaagcaaa

SEQ ID NO: 1307674 - RNA, 19 nt, Homo sapiens
agaccaaagggaacagcua

SEQ ID NO: 1307675 - RNA, 19 nt, Homo sapiens
aacauaaguuggagguucu

SEQ ID NO: 1307676 - RNA, 19 nt, Homo sapiens
gaggacaccuuugugcaua

SEQ ID NO: 1307677 - RNA, 19 nt, Homo sapiens
gcaaagggucccaacauug

SEQ ID NO: 1307678 - RNA, 19 nt, Homo sapiens
ggccagaauucacauuauu

SEQ ID NO: 1307679 - RNA, 19 nt, Homo sapiens
gcacuggacucuggagaug

SEQ ID NO: 1307680 - RNA, 19 nt, Homo sapiens
gcuaugaccuugcggagau

SEQ ID NO: 1307681 - RNA, 19 nt, Homo sapiens
gacaagugcaucuauauga

SEQ ID NO: 1307682 - RNA, 19 nt, Homo sapiens
gcuguguggugcucgauuu

SEQ ID NO: 1307683 - RNA, 19 nt, Homo sapiens
ggacaagugcaucuauaug

SEQ ID NO: 1307684 - RNA, 19 nt, Homo sapiens
caaagggucccaacauugu

SEQ ID NO: 1307685 - RNA, 19 nt, Homo sapiens
ggagggugcuggagugagu

SEQ ID NO: 1307686 - RNA, 19 nt, Homo sapiens
gaacggacaagugcaucua

SEQ ID NO: 1307687 - RNA, 19 nt, Homo sapiens
gggccagaauucacauuau

SEQ ID NO: 1307688 - RNA, 19 nt, Homo sapiens
gagcagaaacccagagagu

SEQ ID NO: 1307689 - RNA, 19 nt, Homo sapiens
ccagagaguggcuacauug

SEQ ID NO: 1307690 - RNA, 19 nt, Homo sapiens
ccagaauucacauuauuga

SEQ ID NO: 1307691 - RNA, 19 nt, Homo sapiens
ucacaucgaggaauacaga

SEQ ID NO: 1307692 - RNA, 19 nt, Homo sapiens
gacccgcauuccaggauuu

SEQ ID NO: 1307693 - RNA, 19 nt, Homo sapiens
gcucgcaaccucacguauu

SEQ ID NO: 1307694 - RNA, 19 nt, Homo sapiens
gccgggugcugguguuuga

SEQ ID NO: 1307695 - RNA, 19 nt, Homo sapiens
gagauucagcaguguguga

SEQ ID NO: 1307696 - RNA, 19 nt, Homo sapiens
cucgcaaccucacguauuu

SEQ ID NO: 1307697 - RNA, 19 nt, Homo sapiens
ggacaccuuugugcauauc

SEQ ID NO: 1307698 - RNA, 19 nt, Homo sapiens
cuacauguccagaucaaug

SEQ ID NO: 1307699 - RNA, 19 nt, Homo sapiens
acggacaagugcaucuaua

SEQ ID NO: 1307700 - RNA, 19 nt, Homo sapiens
agcaaagggucccaacauu

SEQ ID NO: 1307701 - RNA, 19 nt, Homo sapiens
gccagaauucacauuauug

SEQ ID NO: 1307702 - RNA, 19 nt, Homo sapiens
gcuacaccauggucuacug

SEQ ID NO: 1307703 - RNA, 19 nt, Homo sapiens
ccugugguauucauaaagu

SEQ ID NO: 1307704 - RNA, 19 nt, Homo sapiens
acaagugcaucuauaugag

SEQ ID NO: 1307705 - RNA, 19 nt, Homo sapiens
cagcaaagggucccaacau

SEQ ID NO: 1307706 - RNA, 19 nt, Homo sapiens
cccagagaguggcuacauu

SEQ ID NO: 1307707 - RNA, 19 nt, Homo sapiens
uacaggaaaucuacauguc

SEQ ID NO: 1307708 - RNA, 19 nt, Homo sapiens
aagagcagccuuccuuugu

SEQ ID NO: 1307709 - RNA, 19 nt, Homo sapiens
cccuggaccuggcuucuga

SEQ ID NO: 1307710 - RNA, 19 nt, Homo sapiens
cuacaggaaaucuacaugu

SEQ ID NO: 1307711 - RNA, 19 nt, Homo sapiens
ugaggccacuacaggaaau

SEQ ID NO: 1307712 - RNA, 19 nt, Homo sapiens
ggugacggcagaugacuca

SEQ ID NO: 1307713 - RNA, 19 nt, Homo sapiens
caacuccuuugcugugacu

SEQ ID NO: 1307714 - RNA, 19 nt, Homo sapiens
cagagaguggcuacauuga

SEQ ID NO: 1307715 - RNA, 19 nt, Homo sapiens
ugacccgcauuccaggauu

SEQ ID NO: 1307716 - RNA, 19 nt, Homo sapiens
aaagggucccaacauugua

SEQ ID NO: 1307717 - RNA, 19 nt, Homo sapiens
gcggucagggccagaauuc

SEQ ID NO: 1307718 - RNA, 19 nt, Homo sapiens
ggugcucgauuuugugauu

SEQ ID NO: 1307719 - RNA, 19 nt, Homo sapiens
uaugaggccacuacaggaa

SEQ ID NO: 1307720 - RNA, 19 nt, Homo sapiens
cggacaagugcaucuauau

SEQ ID NO: 1307721 - RNA, 19 nt, Homo sapiens
gagguggaacacugucaug

SEQ ID NO: 1307722 - RNA, 19 nt, Homo sapiens
aguacccgcuccacccaaa

SEQ ID NO: 1307723 - RNA, 19 nt, Homo sapiens
ucccugugguauucauaaa

SEQ ID NO: 1307724 - RNA, 19 nt, Homo sapiens
ggucccaacauuguacuga

SEQ ID NO: 1307725 - RNA, 19 nt, Homo sapiens
gaagauggcuuauuuguug

SEQ ID NO: 1307726 - RNA, 19 nt, Homo sapiens
gaaaggagaagcuaaauua

SEQ ID NO: 1307727 - RNA, 19 nt, Homo sapiens
ggaggaaggucaagauuua

SEQ ID NO: 1307728 - RNA, 19 nt, Homo sapiens
ggaaauagcugagauaaug

SEQ ID NO: 1307729 - RNA, 19 nt, Homo sapiens
ggaaggagcuguuaugaga

SEQ ID NO: 1307730 - RNA, 19 nt, Homo sapiens
acaaauagcucgagauaaa

SEQ ID NO: 1307731 - RNA, 19 nt, Homo sapiens
gaaagaaguuccugugcua

SEQ ID NO: 1307732 - RNA, 19 nt, Homo sapiens
gaacaucacacuaucaaua

SEQ ID NO: 1307733 - RNA, 19 nt, Homo sapiens
guauagcacuguuacauua

SEQ ID NO: 1307734 - RNA, 19 nt, Homo sapiens
gaauuguacuggaugauua

SEQ ID NO: 1307735 - RNA, 19 nt, Homo sapiens
gaacaaacucuuacccuua

SEQ ID NO: 1307736 - RNA, 19 nt, Homo sapiens
ggaauuaaguagugaguuu

SEQ ID NO: 1307737 - RNA, 19 nt, Homo sapiens
guagaaauaucuccaguaa

SEQ ID NO: 1307738 - RNA, 19 nt, Homo sapiens
gguagugcaucaauaauua

SEQ ID NO: 1307739 - RNA, 19 nt, Homo sapiens
ggaaaugaaugaaacugua

SEQ ID NO: 1307740 - RNA, 19 nt, Homo sapiens
ggaaaguucucaaguaaga

SEQ ID NO: 1307741 - RNA, 19 nt, Homo sapiens
gagcagagauuggcauuaa

SEQ ID NO: 1307742 - RNA, 19 nt, Homo sapiens
gcaggaaggugaugaauuc

SEQ ID NO: 1307743 - RNA, 19 nt, Homo sapiens
gaggaaauguuacuguuaa

SEQ ID NO: 1307744 - RNA, 19 nt, Homo sapiens
guaaagccgugccaauaua

SEQ ID NO: 1307745 - RNA, 19 nt, Homo sapiens
gggaauggauguuguguuu

SEQ ID NO: 1307746 - RNA, 19 nt, Homo sapiens
gacaaaugcugcagaaauu

SEQ ID NO: 1307747 - RNA, 19 nt, Homo sapiens
caacaucacucuugucuca

SEQ ID NO: 1307748 - RNA, 19 nt, Homo sapiens
ccacagcgaucuuauuaaa

SEQ ID NO: 1307749 - RNA, 19 nt, Homo sapiens
ggaauuugcugaaacauca

SEQ ID NO: 1307750 - RNA, 19 nt, Homo sapiens
gaagugaauuccucaaaug

SEQ ID NO: 1307751 - RNA, 19 nt, Homo sapiens
gaaugaaacuguaacacuu

SEQ ID NO: 1307752 - RNA, 19 nt, Homo sapiens
gaaaggacaguuauaauug

SEQ ID NO: 1307753 - RNA, 19 nt, Homo sapiens
gacaaugcauuuggaauua

SEQ ID NO: 1307754 - RNA, 19 nt, Homo sapiens
gaaacaaguacaacaguua

SEQ ID NO: 1307755 - RNA, 19 nt, Homo sapiens
ggacuaaugaugucuguua

SEQ ID NO: 1307756 - RNA, 19 nt, Homo sapiens
gaggagggaucaaccauuu

SEQ ID NO: 1307757 - RNA, 19 nt, Homo sapiens
agacaacagucaugaaaua

SEQ ID NO: 1307758 - RNA, 19 nt, Homo sapiens
gaugugagguugcuuuauu

SEQ ID NO: 1307759 - RNA, 19 nt, Homo sapiens
gcaaugaauucuauggaaa

SEQ ID NO: 1307760 - RNA, 19 nt, Homo sapiens
gaagaaaucacagugguua

SEQ ID NO: 1307761 - RNA, 19 nt, Homo sapiens
gauuggaucugaugaauau

SEQ ID NO: 1307762 - RNA, 19 nt, Homo sapiens
gagacaggaucuuuaaauu

SEQ ID NO: 1307763 - RNA, 19 nt, Homo sapiens
acagagacguucaauauuu

SEQ ID NO: 1307764 - RNA, 19 nt, Homo sapiens
ccaaauauuucuacaguug

SEQ ID NO: 1307765 - RNA, 19 nt, Homo sapiens
ggaggaagauggagaaauc

SEQ ID NO: 1307766 - RNA, 19 nt, Homo sapiens
ggaaacagaugagcccuuu

SEQ ID NO: 1307767 - RNA, 19 nt, Homo sapiens
ggaaggagauuacauucga

SEQ ID NO: 1307768 - RNA, 19 nt, Homo sapiens
caucauaucuccagcuauu

SEQ ID NO: 1307769 - RNA, 19 nt, Homo sapiens
ucacaugguucucuguuua

SEQ ID NO: 1307770 - RNA, 19 nt, Homo sapiens
uaccagagcuagaagaaua

SEQ ID NO: 1307771 - RNA, 19 nt, Homo sapiens
uggaguagcuacaguaaua

SEQ ID NO: 1307772 - RNA, 19 nt, Homo sapiens
gacaggaucuuuaaauuca

SEQ ID NO: 1307773 - RNA, 19 nt, Homo sapiens
ggagcaagauagccuagua

SEQ ID NO: 1307774 - RNA, 19 nt, Homo sapiens
gaaaaguccuugucucaua

SEQ ID NO: 1307775 - RNA, 19 nt, Homo sapiens
cagaagaaauggaagaauu

SEQ ID NO: 1307776 - RNA, 19 nt, Homo sapiens
guucacaacuccugacuaa

SEQ ID NO: 1307777 - RNA, 19 nt, Homo sapiens
gaggagugcugaaacaauu

SEQ ID NO: 1307778 - RNA, 19 nt, Homo sapiens
gaucgccagucaauacuua

SEQ ID NO: 1307779 - RNA, 19 nt, Homo sapiens
ugacauuacugaagacuuu

SEQ ID NO: 1307780 - RNA, 19 nt, Homo sapiens
gaacagcuacugaagguuu

SEQ ID NO: 1307781 - RNA, 19 nt, Homo sapiens
gcaagcagcguuccacaua

SEQ ID NO: 1307782 - RNA, 19 nt, Homo sapiens
gaaggaugauacuggauuu

SEQ ID NO: 1307783 - RNA, 19 nt, Homo sapiens
caauaaccauucugucuaa

SEQ ID NO: 1307784 - RNA, 19 nt, Homo sapiens
gaagguggaaguagaauuu

SEQ ID NO: 1307785 - RNA, 19 nt, Homo sapiens
gaugaugucuucagaggaa

SEQ ID NO: 1307786 - RNA, 19 nt, Homo sapiens
ggacaggcguuucaccauu

SEQ ID NO: 1307787 - RNA, 19 nt, Homo sapiens
uaacaacuuugcccaauga

SEQ ID NO: 1307788 - RNA, 19 nt, Homo sapiens
guaauugaauggcaacaaa

SEQ ID NO: 1307789 - RNA, 19 nt, Homo sapiens
caacagugguuuauaagug

SEQ ID NO: 1307790 - RNA, 19 nt, Homo sapiens
gaggaaggauuuauuguca

SEQ ID NO: 1307791 - RNA, 19 nt, Homo sapiens
gaagaaauggagcaagaua

SEQ ID NO: 1307792 - RNA, 19 nt, Homo sapiens
gaggagcucuggauuaugu

SEQ ID NO: 1307793 - RNA, 19 nt, Homo sapiens
gggagaaacuaacaaauca

SEQ ID NO: 1307794 - RNA, 19 nt, Homo sapiens
ggcagaagcuuaucuacuu

SEQ ID NO: 1307795 - RNA, 19 nt, Homo sapiens
ccaaggauauuaguuguuu

SEQ ID NO: 1307796 - RNA, 19 nt, Homo sapiens
gaaacagccuuuggcauga

SEQ ID NO: 1307797 - RNA, 19 nt, Homo sapiens
gaugaucccuuuggaguuu

SEQ ID NO: 1307798 - RNA, 19 nt, Homo sapiens
ggacaguuauaauugauga

SEQ ID NO: 1307799 - RNA, 19 nt, Homo sapiens
ccuaaacgcuuccagauug

SEQ ID NO: 1307800 - RNA, 19 nt, Homo sapiens
gagaagcacuguauuggau

SEQ ID NO: 1307801 - RNA, 19 nt, Homo sapiens
gaacaaaggaaaggaguuu

SEQ ID NO: 1307802 - RNA, 19 nt, Homo sapiens
gagagcaacucaaggaaga

SEQ ID NO: 1307803 - RNA, 19 nt, Homo sapiens
gagcacacuuucauauuug

SEQ ID NO: 1307804 - RNA, 19 nt, Homo sapiens
gcaaaucaauggacacaag

SEQ ID NO: 1307805 - RNA, 19 nt, Homo sapiens
aaagauaacuacugaagga

SEQ ID NO: 1307806 - RNA, 19 nt, Homo sapiens
gaaagagaacguaaaguau

SEQ ID NO: 1307807 - RNA, 19 nt, Homo sapiens
gcauugcccuuucguggua

SEQ ID NO: 1307808 - RNA, 19 nt, Homo sapiens
cagauuacauguacaaaga

SEQ ID NO: 1307809 - RNA, 19 nt, Homo sapiens
ugacagagacguucaauau

SEQ ID NO: 1307810 - RNA, 19 nt, Homo sapiens
caggugaacugauauuuga

SEQ ID NO: 1307811 - RNA, 19 nt, Homo sapiens
ggagaguguugcaguauug

SEQ ID NO: 1307812 - RNA, 19 nt, Homo sapiens
gaucaaccauuucuugugu

SEQ ID NO: 1307813 - RNA, 19 nt, Homo sapiens
cgaggaaggagaagaauua

SEQ ID NO: 1307814 - RNA, 19 nt, Homo sapiens
gaacggaugcuuuguacuu

SEQ ID NO: 1307815 - RNA, 19 nt, Homo sapiens
aaauggagcucacuuucua

SEQ ID NO: 1307816 - RNA, 19 nt, Homo sapiens
gaagaccacauacucauaa

SEQ ID NO: 1307817 - RNA, 19 nt, Homo sapiens
gaaagcauaugaugauguc

SEQ ID NO: 1307818 - RNA, 19 nt, Homo sapiens
ccgaagaacugguggguuu

SEQ ID NO: 1307819 - RNA, 19 nt, Homo sapiens
gggaggcucuguguucuua

SEQ ID NO: 1307820 - RNA, 19 nt, Homo sapiens
guuuaaagcugugccaaua

SEQ ID NO: 1307821 - RNA, 19 nt, Homo sapiens
gaugagcccuuuuauauaa

SEQ ID NO: 1307822 - RNA, 19 nt, Homo sapiens
gcagagcaacaguaauuua

SEQ ID NO: 1307823 - RNA, 19 nt, Homo sapiens
ugagcacacuuucauauuu

SEQ ID NO: 1307824 - RNA, 19 nt, Homo sapiens
gagguucucuacaggauuu

SEQ ID NO: 1307825 - RNA, 19 nt, Homo sapiens
gcacuccucuuuguaauuu

SEQ ID NO: 1307826 - RNA, 19 nt, Homo sapiens
guacaaugcucuagaugaa

SEQ ID NO: 1307827 - RNA, 19 nt, Homo sapiens
gaacucaaauccuuaucuu

SEQ ID NO: 1307828 - RNA, 19 nt, Homo sapiens
cagcgucuguuuccaauua

SEQ ID NO: 1307829 - RNA, 19 nt, Homo sapiens
gcagggaacucaaauccuu

SEQ ID NO: 1307830 - RNA, 19 nt, Homo sapiens
gaagagaagaugaucguaa

SEQ ID NO: 1307831 - RNA, 19 nt, Homo sapiens
gcagaagacuuuacugaag

SEQ ID NO: 1307832 - RNA, 19 nt, Homo sapiens
ggacaagccagaagaugua

SEQ ID NO: 1307833 - RNA, 19 nt, Homo sapiens
gcauaaacuuaaagaggua

SEQ ID NO: 1307834 - RNA, 19 nt, Homo sapiens
gugaauugccuuuauguua

SEQ ID NO: 1307835 - RNA, 19 nt, Homo sapiens
gugcuaugcuccagaauuu

SEQ ID NO: 1307836 - RNA, 19 nt, Homo sapiens
caaacaaacccaacuggua

SEQ ID NO: 1307837 - RNA, 19 nt, Homo sapiens
acaaugcucuagaugaaua

SEQ ID NO: 1307838 - RNA, 19 nt, Homo sapiens
gaauacaacggcgaauuua

SEQ ID NO: 1307839 - RNA, 19 nt, Homo sapiens
acauacaagucauccauua

SEQ ID NO: 1307840 - RNA, 19 nt, Homo sapiens
aaacaaacccaacugguaa

SEQ ID NO: 1307841 - RNA, 19 nt, Homo sapiens
gaagaugaucguaaacuug

SEQ ID NO: 1307842 - RNA, 19 nt, Homo sapiens
gaaggcauauguaguaaaa

SEQ ID NO: 1307843 - RNA, 19 nt, Homo sapiens
gcggaaggcauauguagua

SEQ ID NO: 1307844 - RNA, 19 nt, Homo sapiens
aagagaagaugaucguaaa

SEQ ID NO: 1307845 - RNA, 19 nt, Homo sapiens
gacaagacuuccacucaga

SEQ ID NO: 1307846 - RNA, 19 nt, Homo sapiens
ggaaucucaguacuuauua

SEQ ID NO: 1307847 - RNA, 19 nt, Homo sapiens
cagcagcaacuuaguauuu

SEQ ID NO: 1307848 - RNA, 19 nt, Homo sapiens
caccaugccuggcuaaguu

SEQ ID NO: 1307849 - RNA, 19 nt, Homo sapiens
ggaaugcaguggcgugauc

SEQ ID NO: 1307850 - RNA, 19 nt, Homo sapiens
gaaauugguuacagagcau

SEQ ID NO: 1307851 - RNA, 19 nt, Homo sapiens
gauggagucuugcucuguu

SEQ ID NO: 1307852 - RNA, 19 nt, Homo sapiens
aaagagguauuucaucugu

SEQ ID NO: 1307853 - RNA, 19 nt, Homo sapiens
gcaccagacuccucuaagg

SEQ ID NO: 1307854 - RNA, 19 nt, Homo sapiens
ugaauacaacggcgaauuu

SEQ ID NO: 1307855 - RNA, 19 nt, Homo sapiens
uaaagaccauuacgugaca

SEQ ID NO: 1307856 - RNA, 19 nt, Homo sapiens
ccauuugucuaaagucauu

SEQ ID NO: 1307857 - RNA, 19 nt, Homo sapiens
gaucaaaguaggcaagaug

SEQ ID NO: 1307858 - RNA, 19 nt, Homo sapiens
agaagaaauugguuacaga

SEQ ID NO: 1307859 - RNA, 19 nt, Homo sapiens
ccagggaguuuauuugauc

SEQ ID NO: 1307860 - RNA, 19 nt, Homo sapiens
gugaagguauauacaauca

SEQ ID NO: 1307861 - RNA, 19 nt, Homo sapiens
uaaccacaaugacucuuug

SEQ ID NO: 1307862 - RNA, 19 nt, Homo sapiens
gaugcacuccucuuuguaa

SEQ ID NO: 1307863 - RNA, 19 nt, Homo sapiens
cagaggcaguugacagauu

SEQ ID NO: 1307864 - RNA, 19 nt, Homo sapiens
gcaaggacagccaagagaa

SEQ ID NO: 1307865 - RNA, 19 nt, Homo sapiens
uuuggaaucucaguacuua

SEQ ID NO: 1307866 - RNA, 19 nt, Homo sapiens
agaggcaguugacagauuu

SEQ ID NO: 1307867 - RNA, 19 nt, Homo sapiens
gcaaauauggaaacuuuac

SEQ ID NO: 1307868 - RNA, 19 nt, Homo sapiens
uaccagacaucucuaaagu

SEQ ID NO: 1307869 - RNA, 19 nt, Homo sapiens
agacaucucuaaaguggau

SEQ ID NO: 1307870 - RNA, 19 nt, Homo sapiens
agaagaugaucguaaacuu

SEQ ID NO: 1307871 - RNA, 19 nt, Homo sapiens
caaugacucuuugcggaaa

SEQ ID NO: 1307872 - RNA, 19 nt, Homo sapiens
cagcagaagacuuuacuga

SEQ ID NO: 1307873 - RNA, 19 nt, Homo sapiens
caaucaauuuggaaucuca

SEQ ID NO: 1307874 - RNA, 19 nt, Homo sapiens
gcuaugcuccagaauuuga

SEQ ID NO: 1307875 - RNA, 19 nt, Homo sapiens
gcauaaagacacagaggau

SEQ ID NO: 1307876 - RNA, 19 nt, Homo sapiens
gcgacacacgggccaaaua

SEQ ID NO: 1307877 - RNA, 19 nt, Homo sapiens
caaggacagccaagagaaa

SEQ ID NO: 1307878 - RNA, 19 nt, Homo sapiens
ggagccagggaguuuauuu

SEQ ID NO: 1307879 - RNA, 19 nt, Homo sapiens
gaucguaaacuuggaacuu

SEQ ID NO: 1307880 - RNA, 19 nt, Homo sapiens
cgacacacgggccaaauau

SEQ ID NO: 1307881 - RNA, 19 nt, Homo sapiens
auaaagacacagaggauuu

SEQ ID NO: 1307882 - RNA, 19 nt, Homo sapiens
ucucucauguacaguaauu

SEQ ID NO: 1307883 - RNA, 19 nt, Homo sapiens
gagcaccagacuccucuaa

SEQ ID NO: 1307884 - RNA, 19 nt, Homo sapiens
ggauaugcacgaugacuca

SEQ ID NO: 1307885 - RNA, 19 nt, Homo sapiens
gaccauuacgugacaaaga

SEQ ID NO: 1307886 - RNA, 19 nt, Homo sapiens
uaucucucauguacaguaa

SEQ ID NO: 1307887 - RNA, 19 nt, Homo sapiens
ugacaaagaagaaauuggu

SEQ ID NO: 1307888 - RNA, 19 nt, Homo sapiens
ggaaggcauauguaguaaa

SEQ ID NO: 1307889 - RNA, 19 nt, Homo sapiens
caagccauuugucuaaagu

SEQ ID NO: 1307890 - RNA, 19 nt, Homo sapiens
cauacaagucauccauuaa

SEQ ID NO: 1307891 - RNA, 19 nt, Homo sapiens
guacauacaagucauccau

SEQ ID NO: 1307892 - RNA, 19 nt, Homo sapiens
gcaguugacagauuuaugc

SEQ ID NO: 1307893 - RNA, 19 nt, Homo sapiens
acacagauaaacucuuuga

SEQ ID NO: 1307894 - RNA, 19 nt, Homo sapiens
cggaaggcauauguaguaa

SEQ ID NO: 1307895 - RNA, 19 nt, Homo sapiens
gcgucuguuuccaauuaua

SEQ ID NO: 1307896 - RNA, 19 nt, Homo sapiens
uuugggagauggagucuug

SEQ ID NO: 1307897 - RNA, 19 nt, Homo sapiens
gagccagggaguuuauuug

SEQ ID NO: 1307898 - RNA, 19 nt, Homo sapiens
uaaaguggauaugcacgau

SEQ ID NO: 1307899 - RNA, 19 nt, Homo sapiens
uaugauuggaccucuguua

SEQ ID NO: 1307900 - RNA, 19 nt, Homo sapiens
aaacccaacugguaaugag

SEQ ID NO: 1307901 - RNA, 19 nt, Homo sapiens
accauuacgugacaaagaa

SEQ ID NO: 1307902 - RNA, 19 nt, Homo sapiens
gguagaaaccaucauaaaa

SEQ ID NO: 1307903 - RNA, 19 nt, Homo sapiens
auccuuaucuuccguauuc

SEQ ID NO: 1307904 - RNA, 19 nt, Homo sapiens
caaagaagaaauugguuac

SEQ ID NO: 1307905 - RNA, 19 nt, Homo sapiens
acaguacaaugcucuagau

SEQ ID NO: 1307906 - RNA, 19 nt, Homo sapiens
cauuaucucucauguacag

SEQ ID NO: 1307907 - RNA, 19 nt, Homo sapiens
aaguggauaugcacgauga

SEQ ID NO: 1307908 - RNA, 19 nt, Homo sapiens
uggaaucucaguacuuauu

SEQ ID NO: 1307909 - RNA, 19 nt, Homo sapiens
gcgccuggcccauuucuuc

SEQ ID NO: 1307910 - RNA, 19 nt, Homo sapiens
gauuggaccucuguuacca

SEQ ID NO: 1307911 - RNA, 19 nt, Homo sapiens
gccagggaguuuauuugau

SEQ ID NO: 1307912 - RNA, 19 nt, Homo sapiens
cauacuuaauguugcagaa

SEQ ID NO: 1307913 - RNA, 19 nt, Homo sapiens
auacaacggcgaauuuaau

SEQ ID NO: 1307914 - RNA, 19 nt, Homo sapiens
gaacaguacaaugcucuag

SEQ ID NO: 1307915 - RNA, 19 nt, Homo sapiens
gcugugaagguauauacaa

SEQ ID NO: 1307916 - RNA, 19 nt, Homo sapiens
ugacccauacuuaauguug

SEQ ID NO: 1307917 - RNA, 19 nt, Homo sapiens
ccuggcccauuucuucuuu

SEQ ID NO: 1307918 - RNA, 19 nt, Homo sapiens
ccugugaauugccuuuaug

SEQ ID NO: 1307919 - RNA, 19 nt, Homo sapiens
ggaacucaaauccuuaucu

SEQ ID NO: 1307920 - RNA, 19 nt, Homo sapiens
ucaagccauuugucuaaag

SEQ ID NO: 1307921 - RNA, 19 nt, Homo sapiens
ucucuaaaguggauaugca

SEQ ID NO: 1307922 - RNA, 19 nt, Homo sapiens
cgcuuuauauggugcaauu

SEQ ID NO: 1307923 - RNA, 19 nt, Homo sapiens
gccagcgucuguuuccaau

SEQ ID NO: 1307924 - RNA, 19 nt, Homo sapiens
aaagaagaagagaagauga

SEQ ID NO: 1307925 - RNA, 19 nt, Homo sapiens
gcacgagacuugcuuaaua

SEQ ID NO: 1307926 - RNA, 19 nt, Homo sapiens
gaacugaugucaauauuag

SEQ ID NO: 1307927 - RNA, 19 nt, Homo sapiens
gaagauguguagugccuua

SEQ ID NO: 1307928 - RNA, 19 nt, Homo sapiens
caagcaagcugaugaagaa

SEQ ID NO: 1307929 - RNA, 19 nt, Homo sapiens
ggucaaauguggaaccaua

SEQ ID NO: 1307930 - RNA, 19 nt, Homo sapiens
ugaaggcucugauguauuu

SEQ ID NO: 1307931 - RNA, 19 nt, Homo sapiens
gaacaaagcucaaaacuac

SEQ ID NO: 1307932 - RNA, 19 nt, Homo sapiens
gaaauuaugugugucaugu

SEQ ID NO: 1307933 - RNA, 19 nt, Homo sapiens
caaaagaccuguaauaaga

SEQ ID NO: 1307934 - RNA, 19 nt, Homo sapiens
ccauacagcuuucugauga

SEQ ID NO: 1307935 - RNA, 19 nt, Homo sapiens
gaauucagcuccaacuuuc

SEQ ID NO: 1307936 - RNA, 19 nt, Homo sapiens
ugucacagcuucccaagua

SEQ ID NO: 1307937 - RNA, 19 nt, Homo sapiens
guagagaaauuaugugugu

SEQ ID NO: 1307938 - RNA, 19 nt, Homo sapiens
gaccagguguucccacaua

SEQ ID NO: 1307939 - RNA, 19 nt, Homo sapiens
gaugaaggcucugauguau

SEQ ID NO: 1307940 - RNA, 19 nt, Homo sapiens
gcucaugccuauaauccua

SEQ ID NO: 1307941 - RNA, 19 nt, Homo sapiens
gaagaaugcaacuuguaua

SEQ ID NO: 1307942 - RNA, 19 nt, Homo sapiens
ggaguuaccuuaggaaugg

SEQ ID NO: 1307943 - RNA, 19 nt, Homo sapiens
gcaagcugaugaagaauuc

SEQ ID NO: 1307944 - RNA, 19 nt, Homo sapiens
gagcucggcugacugcaaa

SEQ ID NO: 1307945 - RNA, 19 nt, Homo sapiens
gaaagaaggagaugguguu

SEQ ID NO: 1307946 - RNA, 19 nt, Homo sapiens
gguguuaacuaccuuguau

SEQ ID NO: 1307947 - RNA, 19 nt, Homo sapiens
ggacuuguguaucuucgaa

SEQ ID NO: 1307948 - RNA, 19 nt, Homo sapiens
acagauaacuacauuagga

SEQ ID NO: 1307949 - RNA, 19 nt, Homo sapiens
ccaaguagcugggauuuac

SEQ ID NO: 1307950 - RNA, 19 nt, Homo sapiens
guauuggacuuguuguauu

SEQ ID NO: 1307951 - RNA, 19 nt, Homo sapiens
acacauuguucuucuguuu

SEQ ID NO: 1307952 - RNA, 19 nt, Homo sapiens
ggaaagcgaaagauaaugu

SEQ ID NO: 1307953 - RNA, 19 nt, Homo sapiens
acacgggacaugugaauua

SEQ ID NO: 1307954 - RNA, 19 nt, Homo sapiens
caagcaauccucugucaaa

SEQ ID NO: 1307955 - RNA, 19 nt, Homo sapiens
gcucaucguuugcgacguu

SEQ ID NO: 1307956 - RNA, 19 nt, Homo sapiens
agaaggagaugguguuauc

SEQ ID NO: 1307957 - RNA, 19 nt, Homo sapiens
ucaguuggaugcucucuau

SEQ ID NO: 1307958 - RNA, 19 nt, Homo sapiens
cagaacugaugucaauauu

SEQ ID NO: 1307959 - RNA, 19 nt, Homo sapiens
ggaauggacuaacaaaaga

SEQ ID NO: 1307960 - RNA, 19 nt, Homo sapiens
gcacgagaaucacuugaac

SEQ ID NO: 1307961 - RNA, 19 nt, Homo sapiens
acagcuuucugaugaguua

SEQ ID NO: 1307962 - RNA, 19 nt, Homo sapiens
ccuguaaucucagcacuuu

SEQ ID NO: 1307963 - RNA, 19 nt, Homo sapiens
guguggauguguauacuuu

SEQ ID NO: 1307964 - RNA, 19 nt, Homo sapiens
gaauggugcuuuuauguga

SEQ ID NO: 1307965 - RNA, 19 nt, Homo sapiens
cgggacaugugaauuauau

SEQ ID NO: 1307966 - RNA, 19 nt, Homo sapiens
gcaagcaagcugaugaaga

SEQ ID NO: 1307967 - RNA, 19 nt, Homo sapiens
uuagucagcugauggaaug

SEQ ID NO: 1307968 - RNA, 19 nt, Homo sapiens
ugacauggauauuggaaag

SEQ ID NO: 1307969 - RNA, 19 nt, Homo sapiens
caaauguggaaccauauaa

SEQ ID NO: 1307970 - RNA, 19 nt, Homo sapiens
uaacuuggucaucugauuu

SEQ ID NO: 1307971 - RNA, 19 nt, Homo sapiens
aaagaagaaugcaacuugu

SEQ ID NO: 1307972 - RNA, 19 nt, Homo sapiens
ccgagaaauuacuccguua

SEQ ID NO: 1307973 - RNA, 19 nt, Homo sapiens
uaaggugacccaucuguga

SEQ ID NO: 1307974 - RNA, 19 nt, Homo sapiens
cgauagcugugaacaugaa

SEQ ID NO: 1307975 - RNA, 19 nt, Homo sapiens
uauauugccuuauccaaag

SEQ ID NO: 1307976 - RNA, 19 nt, Homo sapiens
ccaaagaagauguguagug

SEQ ID NO: 1307977 - RNA, 19 nt, Homo sapiens
ucgaagaaguaauauggaa

SEQ ID NO: 1307978 - RNA, 19 nt, Homo sapiens
ugaauucagcuccaacuuu

SEQ ID NO: 1307979 - RNA, 19 nt, Homo sapiens
cauuccaucuccuuaguuu

SEQ ID NO: 1307980 - RNA, 19 nt, Homo sapiens
uauaagaggaccaccauau

SEQ ID NO: 1307981 - RNA, 19 nt, Homo sapiens
uauagacacuggaguacug

SEQ ID NO: 1307982 - RNA, 19 nt, Homo sapiens
gaaugaauggagacaaguu

SEQ ID NO: 1307983 - RNA, 19 nt, Homo sapiens
caacagagcgagacuccau

SEQ ID NO: 1307984 - RNA, 19 nt, Homo sapiens
gugcgaggaugacaugugu

SEQ ID NO: 1307985 - RNA, 19 nt, Homo sapiens
gacaggguuucgccaaguu

SEQ ID NO: 1307986 - RNA, 19 nt, Homo sapiens
gauauuggaaagcgaaaga

SEQ ID NO: 1307987 - RNA, 19 nt, Homo sapiens
ucaaauguggaaccauaua

SEQ ID NO: 1307988 - RNA, 19 nt, Homo sapiens
gcaaacuccuggcgauacu

SEQ ID NO: 1307989 - RNA, 19 nt, Homo sapiens
guuugucacuuauuccauu

SEQ ID NO: 1307990 - RNA, 19 nt, Homo sapiens
gauuucagauucauuccau

SEQ ID NO: 1307991 - RNA, 19 nt, Homo sapiens
cgaggcagguggauugcuu

SEQ ID NO: 1307992 - RNA, 19 nt, Homo sapiens
gcaauccucugucaaaauc

SEQ ID NO: 1307993 - RNA, 19 nt, Homo sapiens
guauuauucuucaguugga

SEQ ID NO: 1307994 - RNA, 19 nt, Homo sapiens
ugaugaaggcucugaugua

SEQ ID NO: 1307995 - RNA, 19 nt, Homo sapiens
gaaaccccgucucuacuaa

SEQ ID NO: 1307996 - RNA, 19 nt, Homo sapiens
aaaauaggcucaguuagaa

SEQ ID NO: 1307997 - RNA, 19 nt, Homo sapiens
ggugacccaucugugauaa

SEQ ID NO: 1307998 - RNA, 19 nt, Homo sapiens
gaaaaucguguguguuuga

SEQ ID NO: 1307999 - RNA, 19 nt, Homo sapiens
ccagagauauauagacacu

SEQ ID NO: 1308000 - RNA, 19 nt, Homo sapiens
cauguucacugcucuccaa

SEQ ID NO: 1308001 - RNA, 19 nt, Homo sapiens
gaaauuacuccguuaucgu

SEQ ID NO: 1308002 - RNA, 19 nt, Homo sapiens
gagauggagguuucaguga

SEQ ID NO: 1308003 - RNA, 19 nt, Homo sapiens
uagaguuugucacuuauuc

SEQ ID NO: 1308004 - RNA, 19 nt, Homo sapiens
aaccuucucuucccaguga

SEQ ID NO: 1308005 - RNA, 19 nt, Homo sapiens
gauguguagugccuuaaca

SEQ ID NO: 1308006 - RNA, 19 nt, Homo sapiens
gguguuaucugaaaagguu

SEQ ID NO: 1308007 - RNA, 19 nt, Homo sapiens
gcagugacuuacgccugua

SEQ ID NO: 1308008 - RNA, 19 nt, Homo sapiens
uaacuuauacauggccuaa

SEQ ID NO: 1308009 - RNA, 19 nt, Homo sapiens
auucuuagcuucuucaucu

SEQ ID NO: 1308010 - RNA, 19 nt, Homo sapiens
gcgaggaugacauguguga

SEQ ID NO: 1308011 - RNA, 19 nt, Homo sapiens
uuaacuuggucaucugauu

SEQ ID NO: 1308012 - RNA, 19 nt, Homo sapiens
gaaagcgaaagauaaugug

SEQ ID NO: 1308013 - RNA, 19 nt, Homo sapiens
gucauguggucuucugaaa

SEQ ID NO: 1308014 - RNA, 19 nt, Homo sapiens
ggaguacuggaaauugaaa

SEQ ID NO: 1308015 - RNA, 19 nt, Homo sapiens
aaagaaggagaugguguua

SEQ ID NO: 1308016 - RNA, 19 nt, Homo sapiens
uaauguguguggcugguau

SEQ ID NO: 1308017 - RNA, 19 nt, Homo sapiens
gauggaauggacuaacaaa

SEQ ID NO: 1308018 - RNA, 19 nt, Homo sapiens
caaacggggugauacauau

SEQ ID NO: 1308019 - RNA, 19 nt, Homo sapiens
gagccgagaucacgcuacu

SEQ ID NO: 1308020 - RNA, 19 nt, Homo sapiens
gaaggaagaggagcgaaca

SEQ ID NO: 1308021 - RNA, 19 nt, Homo sapiens
gaguagagaaauuaugugu

SEQ ID NO: 1308022 - RNA, 19 nt, Homo sapiens
gguauuggacuuguuguau

SEQ ID NO: 1308023 - RNA, 19 nt, Homo sapiens
ccucugacauggauauugg

SEQ ID NO: 1308024 - RNA, 19 nt, Homo sapiens
guucacugcucuccaacug

SEQ ID NO: 1308025 - RNA, 19 nt, Homo sapiens
ggacagcgacucuuaaauu

SEQ ID NO: 1308026 - RNA, 19 nt, Homo sapiens
aaaguacucugcuggauua

SEQ ID NO: 1308027 - RNA, 19 nt, Homo sapiens
ccaaaucccucagaauuaa

SEQ ID NO: 1308028 - RNA, 19 nt, Homo sapiens
gacagcgacucuuaaauug

SEQ ID NO: 1308029 - RNA, 19 nt, Homo sapiens
guacucugcuggauuagaa

SEQ ID NO: 1308030 - RNA, 19 nt, Homo sapiens
gaacagcuaacaauaaagu

SEQ ID NO: 1308031 - RNA, 19 nt, Homo sapiens
gugagaaacuuaaagaaca

SEQ ID NO: 1308032 - RNA, 19 nt, Homo sapiens
gagcacacccagcaaauga

SEQ ID NO: 1308033 - RNA, 19 nt, Homo sapiens
ugaaggagcggcagaaguu

SEQ ID NO: 1308034 - RNA, 19 nt, Homo sapiens
ccuccgggcugaagacuuu

SEQ ID NO: 1308035 - RNA, 19 nt, Homo sapiens
uagaauccaugacagcaaa

SEQ ID NO: 1308036 - RNA, 19 nt, Homo sapiens
ggauuagaauuacuuagca

SEQ ID NO: 1308037 - RNA, 19 nt, Homo sapiens
cagaagagccaaagacugu

SEQ ID NO: 1308038 - RNA, 19 nt, Homo sapiens
uagaauuacuuagcaggua

SEQ ID NO: 1308039 - RNA, 19 nt, Homo sapiens
gaggacagcgacucuuaaa

SEQ ID NO: 1308040 - RNA, 19 nt, Homo sapiens
caaaguacucugcuggauu

SEQ ID NO: 1308041 - RNA, 19 nt, Homo sapiens
ggaaagccagguuguuuua

SEQ ID NO: 1308042 - RNA, 19 nt, Homo sapiens
cuggagagcugguggauag

SEQ ID NO: 1308043 - RNA, 19 nt, Homo sapiens
ccugaacucuggaggagaa

SEQ ID NO: 1308044 - RNA, 19 nt, Homo sapiens
acccaggacuguuccauuu

SEQ ID NO: 1308045 - RNA, 19 nt, Homo sapiens
gugaggacagcgacucuua

SEQ ID NO: 1308046 - RNA, 19 nt, Homo sapiens
gagccaagccaccuucuuc

SEQ ID NO: 1308047 - RNA, 19 nt, Homo sapiens
uccaaaucccucagaauua

SEQ ID NO: 1308048 - RNA, 19 nt, Homo sapiens
gaaagaugcaaacauaugc

SEQ ID NO: 1308049 - RNA, 19 nt, Homo sapiens
gcagugugaauuagaaaga

SEQ ID NO: 1308050 - RNA, 19 nt, Homo sapiens
gccaaagacugugcaagug

SEQ ID NO: 1308051 - RNA, 19 nt, Homo sapiens
gaaacuuaaagaacagcua

SEQ ID NO: 1308052 - RNA, 19 nt, Homo sapiens
uccaguaccugucagaaug

SEQ ID NO: 1308053 - RNA, 19 nt, Homo sapiens
agaacaaccugcugcaucu

SEQ ID NO: 1308054 - RNA, 19 nt, Homo sapiens
ccaauaaugugugagaaac

SEQ ID NO: 1308055 - RNA, 19 nt, Homo sapiens
uaaagugugaggacgguaa

SEQ ID NO: 1308056 - RNA, 19 nt, Homo sapiens
gaggagaagagaacacugu

SEQ ID NO: 1308057 - RNA, 19 nt, Homo sapiens
gaaggagcggcagaaguuu

SEQ ID NO: 1308058 - RNA, 19 nt, Homo sapiens
agaaagaugcaaacauaug

SEQ ID NO: 1308059 - RNA, 19 nt, Homo sapiens
agaauuacuuagcagguau

SEQ ID NO: 1308060 - RNA, 19 nt, Homo sapiens
ccaaaguacucugcuggau

SEQ ID NO: 1308061 - RNA, 19 nt, Homo sapiens
gccaauaaugugugagaaa

SEQ ID NO: 1308062 - RNA, 19 nt, Homo sapiens
acacugcccuggccacauc

SEQ ID NO: 1308063 - RNA, 19 nt, Homo sapiens
aaagccagguuguuuuaua

SEQ ID NO: 1308064 - RNA, 19 nt, Homo sapiens
gcgagguggucaugcuuuc

SEQ ID NO: 1308065 - RNA, 19 nt, Homo sapiens
caucacacacugacagaga

SEQ ID NO: 1308066 - RNA, 19 nt, Homo sapiens
ugucauccauggaagugaa

SEQ ID NO: 1308067 - RNA, 19 nt, Homo sapiens
agaagguccuggaaaugga

SEQ ID NO: 1308068 - RNA, 19 nt, Homo sapiens
uaagaggaaggaacuugaa

SEQ ID NO: 1308069 - RNA, 19 nt, Homo sapiens
agacuuaugugggcagugu

SEQ ID NO: 1308070 - RNA, 19 nt, Homo sapiens
uuuaaucgcagacuuagaa

SEQ ID NO: 1308071 - RNA, 19 nt, Homo sapiens
ccaagccaccuucuucuuc

SEQ ID NO: 1308072 - RNA, 19 nt, Homo sapiens
ggaagugaacguggacaug

SEQ ID NO: 1308073 - RNA, 19 nt, Homo sapiens
gcccauaggcagcauguca

SEQ ID NO: 1308074 - RNA, 19 nt, Homo sapiens
agcaggacauggagcagua

SEQ ID NO: 1308075 - RNA, 19 nt, Homo sapiens
acuggagaauuacaagaaa

SEQ ID NO: 1308076 - RNA, 19 nt, Homo sapiens
caacuggagaauuacaaga

SEQ ID NO: 1308077 - RNA, 19 nt, Homo sapiens
ugagaaacuuaaagaacag

SEQ ID NO: 1308078 - RNA, 19 nt, Homo sapiens
uuccaaaucccucagaauu

SEQ ID NO: 1308079 - RNA, 19 nt, Homo sapiens
uugaggagguagagaacaa

SEQ ID NO: 1308080 - RNA, 19 nt, Homo sapiens
agacuuagaauccaugaca

SEQ ID NO: 1308081 - RNA, 19 nt, Homo sapiens
ggagcacacccagcaaaug

SEQ ID NO: 1308082 - RNA, 19 nt, Homo sapiens
ugacagcaaaucugacuca

SEQ ID NO: 1308083 - RNA, 19 nt, Homo sapiens
gcaucuggaagacuuaugu

SEQ ID NO: 1308084 - RNA, 19 nt, Homo sapiens
cagcuuuaaucgcagacuu

SEQ ID NO: 1308085 - RNA, 19 nt, Homo sapiens
ugaggacagcgacucuuaa

SEQ ID NO: 1308086 - RNA, 19 nt, Homo sapiens
ugagauuacccuccagguu

SEQ ID NO: 1308087 - RNA, 19 nt, Homo sapiens
agauggaccugauggacau

SEQ ID NO: 1308088 - RNA, 19 nt, Homo sapiens
gcuggauuagaauuacuua

SEQ ID NO: 1308089 - RNA, 19 nt, Homo sapiens
gcacacccagcaaaugaag

SEQ ID NO: 1308090 - RNA, 19 nt, Homo sapiens
acucuuaaauugggacaug

SEQ ID NO: 1308091 - RNA, 19 nt, Homo sapiens
gguuccaaaucccucagaa

SEQ ID NO: 1308092 - RNA, 19 nt, Homo sapiens
guaccugucagaaugagau

SEQ ID NO: 1308093 - RNA, 19 nt, Homo sapiens
ccaguaccugucagaauga

SEQ ID NO: 1308094 - RNA, 19 nt, Homo sapiens
cagaagguccuggaaaugg

SEQ ID NO: 1308095 - RNA, 19 nt, Homo sapiens
gcaacuggagaauuacaag

SEQ ID NO: 1308096 - RNA, 19 nt, Homo sapiens
cuuagcagguaugaggaua

SEQ ID NO: 1308097 - RNA, 19 nt, Homo sapiens
gaauuagaaagaugcaaac

SEQ ID NO: 1308098 - RNA, 19 nt, Homo sapiens
ggauacaugggcugcacuu

SEQ ID NO: 1308099 - RNA, 19 nt, Homo sapiens
aagcaaaagugaaaagcaa

SEQ ID NO: 1308100 - RNA, 19 nt, Homo sapiens
ucaguccgaugaggaggaa

SEQ ID NO: 1308101 - RNA, 19 nt, Homo sapiens
gaauccaguaccugucaga

SEQ ID NO: 1308102 - RNA, 19 nt, Homo sapiens
ugggcagugugaauuagaa

SEQ ID NO: 1308103 - RNA, 19 nt, Homo sapiens
gaauuacuuagcagguaug

SEQ ID NO: 1308104 - RNA, 19 nt, Homo sapiens
gcagacuuagaauccauga

SEQ ID NO: 1308105 - RNA, 19 nt, Homo sapiens
ggauagcgagguggucaug

SEQ ID NO: 1308106 - RNA, 19 nt, Homo sapiens
ucacagaagagccaaagac

SEQ ID NO: 1308107 - RNA, 19 nt, Homo sapiens
auacaugggcugcacuuca

SEQ ID NO: 1308108 - RNA, 19 nt, Homo sapiens
gggcagugugaauuagaaa

SEQ ID NO: 1308109 - RNA, 19 nt, Homo sapiens
gccaagccaccuucuucuu

SEQ ID NO: 1308110 - RNA, 19 nt, Homo sapiens
aauaagaggaaggaacuug

SEQ ID NO: 1308111 - RNA, 19 nt, Homo sapiens
ugagcgugcagcaggauuu

SEQ ID NO: 1308112 - RNA, 19 nt, Homo sapiens
ugugugagaaacuuaaaga

SEQ ID NO: 1308113 - RNA, 19 nt, Homo sapiens
uggagcagauggaccugau

SEQ ID NO: 1308114 - RNA, 19 nt, Homo sapiens
auaagaggaaggaacuuga

SEQ ID NO: 1308115 - RNA, 19 nt, Homo sapiens
gaacaaccugcugcaucug

SEQ ID NO: 1308116 - RNA, 19 nt, Homo sapiens
ggaaagaucauuacauuug

SEQ ID NO: 1308117 - RNA, 19 nt, Homo sapiens
caacauggccacccaauau

SEQ ID NO: 1308118 - RNA, 19 nt, Homo sapiens
gaggaaagguagcauagga

SEQ ID NO: 1308119 - RNA, 19 nt, Homo sapiens
gaacuuugcucggccaaug

SEQ ID NO: 1308120 - RNA, 19 nt, Homo sapiens
uaggauagaugaagaugaa

SEQ ID NO: 1308121 - RNA, 19 nt, Homo sapiens
ggaaagguagcauaggaua

SEQ ID NO: 1308122 - RNA, 19 nt, Homo sapiens
ggauuguucugauuucuga

SEQ ID NO: 1308123 - RNA, 19 nt, Homo sapiens
gaagauauuucaagaugac

SEQ ID NO: 1308124 - RNA, 19 nt, Homo sapiens
ggauggaaguuguuucuag

SEQ ID NO: 1308125 - RNA, 19 nt, Homo sapiens
agggaaagaucauuacauu

SEQ ID NO: 1308126 - RNA, 19 nt, Homo sapiens
caucaaacccacauccuuu

SEQ ID NO: 1308127 - RNA, 19 nt, Homo sapiens
cauaauggauuguucugau

SEQ ID NO: 1308128 - RNA, 19 nt, Homo sapiens
gcaacauggccacccaaua

SEQ ID NO: 1308129 - RNA, 19 nt, Homo sapiens
gagcauuuguauacaguca

SEQ ID NO: 1308130 - RNA, 19 nt, Homo sapiens
gaggcgugcuugagaggaa

SEQ ID NO: 1308131 - RNA, 19 nt, Homo sapiens
ggaacuggcaggcguuuca

SEQ ID NO: 1308132 - RNA, 19 nt, Homo sapiens
gggaaagaucauuacauuu

SEQ ID NO: 1308133 - RNA, 19 nt, Homo sapiens
cgucagaggcugcggauga

SEQ ID NO: 1308134 - RNA, 19 nt, Homo sapiens
agacuaggcugggcgaaga

SEQ ID NO: 1308135 - RNA, 19 nt, Homo sapiens
ggacaaguuggcgaccuua

SEQ ID NO: 1308136 - RNA, 19 nt, Homo sapiens
gccauauacucccuaggaa

SEQ ID NO: 1308137 - RNA, 19 nt, Homo sapiens
ccacugaaagaagauauuu

SEQ ID NO: 1308138 - RNA, 19 nt, Homo sapiens
uaaagacucagaaagacuu

SEQ ID NO: 1308139 - RNA, 19 nt, Homo sapiens
ugugacaucuuuccaaugg

SEQ ID NO: 1308140 - RNA, 19 nt, Homo sapiens
ccuuaaagacucagaaaga

SEQ ID NO: 1308141 - RNA, 19 nt, Homo sapiens
gagaggaaagguagcauag

SEQ ID NO: 1308142 - RNA, 19 nt, Homo sapiens
ggacagggcaguggguguu

SEQ ID NO: 1308143 - RNA, 19 nt, Homo sapiens
ggccauauacucccuagga

SEQ ID NO: 1308144 - RNA, 19 nt, Homo sapiens
ggauagaugaagaugaaga

SEQ ID NO: 1308145 - RNA, 19 nt, Homo sapiens
caaaggagaugccccaagu

SEQ ID NO: 1308146 - RNA, 19 nt, Homo sapiens
ggggauacagugagaauua

SEQ ID NO: 1308147 - RNA, 19 nt, Homo sapiens
gauggcagguaggcccuuu

SEQ ID NO: 1308148 - RNA, 19 nt, Homo sapiens
gaaagguagcauaggauag

SEQ ID NO: 1308149 - RNA, 19 nt, Homo sapiens
aaaagaaccugaugcgaau

SEQ ID NO: 1308150 - RNA, 19 nt, Homo sapiens
cggcaaaucucgugaaccu

SEQ ID NO: 1308151 - RNA, 19 nt, Homo sapiens
gguagcauaggauagauga

SEQ ID NO: 1308152 - RNA, 19 nt, Homo sapiens
aaagguagcauaggauaga

SEQ ID NO: 1308153 - RNA, 19 nt, Homo sapiens
cacccaauaugcccaccua

SEQ ID NO: 1308154 - RNA, 19 nt, Homo sapiens
guccugggaucuccaacuu

SEQ ID NO: 1308155 - RNA, 19 nt, Homo sapiens
ucuagccacugaaagaaga

SEQ ID NO: 1308156 - RNA, 19 nt, Homo sapiens
ugagaggaaagguagcaua

SEQ ID NO: 1308157 - RNA, 19 nt, Homo sapiens
gaggagccaggacaaguug

SEQ ID NO: 1308158 - RNA, 19 nt, Homo sapiens
gaucuccaacuugccauaa

SEQ ID NO: 1308159 - RNA, 19 nt, Homo sapiens
agaugaagaugaagagcau

SEQ ID NO: 1308160 - RNA, 19 nt, Homo sapiens
gucaggagcauuuguauac

SEQ ID NO: 1308161 - RNA, 19 nt, Homo sapiens
cgugugacaucuuuccaau

SEQ ID NO: 1308162 - RNA, 19 nt, Homo sapiens
ggcaaaauauugggauaaa

SEQ ID NO: 1308163 - RNA, 19 nt, Homo sapiens
gggauacagugagaauuac

SEQ ID NO: 1308164 - RNA, 19 nt, Homo sapiens
ucuccaacuugccauaaug

SEQ ID NO: 1308165 - RNA, 19 nt, Homo sapiens
gaagaugaagagcauacca

SEQ ID NO: 1308166 - RNA, 19 nt, Homo sapiens
gagggaaagaucauuacau

SEQ ID NO: 1308167 - RNA, 19 nt, Homo sapiens
ggagggaaagaucauuaca

SEQ ID NO: 1308168 - RNA, 19 nt, Homo sapiens
ccacagugaucugguucug

SEQ ID NO: 1308169 - RNA, 19 nt, Homo sapiens
ccaucugcauugagaggaa

SEQ ID NO: 1308170 - RNA, 19 nt, Homo sapiens
acagucagcucagccaaag

SEQ ID NO: 1308171 - RNA, 19 nt, Homo sapiens
gaacacaaggggagggaaa

SEQ ID NO: 1308172 - RNA, 19 nt, Homo sapiens
caucugcauugagaggaaa

SEQ ID NO: 1308173 - RNA, 19 nt, Homo sapiens
acauuugucaggagcauuu

SEQ ID NO: 1308174 - RNA, 19 nt, Homo sapiens
ugaggagccaggacaaguu

SEQ ID NO: 1308175 - RNA, 19 nt, Homo sapiens
aagggacucuggagaccaa

SEQ ID NO: 1308176 - RNA, 19 nt, Homo sapiens
gauagaugaagaugaagag

SEQ ID NO: 1308177 - RNA, 19 nt, Homo sapiens
gcauaggauagaugaagau

SEQ ID NO: 1308178 - RNA, 19 nt, Homo sapiens
ugucaggagcauuuguaua

SEQ ID NO: 1308179 - RNA, 19 nt, Homo sapiens
gcgaagagucgagcgugaa

SEQ ID NO: 1308180 - RNA, 19 nt, Homo sapiens
ggaucuccaacuugccaua

SEQ ID NO: 1308181 - RNA, 19 nt, Homo sapiens
ccagugcgacggcaaaucu

SEQ ID NO: 1308182 - RNA, 19 nt, Homo sapiens
cacgagguccugaagaaga

SEQ ID NO: 1308183 - RNA, 19 nt, Homo sapiens
gugagaauuaccacuguug

SEQ ID NO: 1308184 - RNA, 19 nt, Homo sapiens
ugacaggaggcgugcuuga

SEQ ID NO: 1308185 - RNA, 19 nt, Homo sapiens
ggacucuggagaccaagga

SEQ ID NO: 1308186 - RNA, 19 nt, Homo sapiens
caguggguguugggaguuu

SEQ ID NO: 1308187 - RNA, 19 nt, Homo sapiens
cagcucagccaaaggagau

SEQ ID NO: 1308188 - RNA, 19 nt, Homo sapiens
ucaggagcauuuguauaca

SEQ ID NO: 1308189 - RNA, 19 nt, Homo sapiens
acaggaggcgugcuugaga

SEQ ID NO: 1308190 - RNA, 19 nt, Homo sapiens
gacggcaaaucucgugaac

SEQ ID NO: 1308191 - RNA, 19 nt, Homo sapiens
caggagcauuuguauacag

SEQ ID NO: 1308192 - RNA, 19 nt, Homo sapiens
guccuccucuucugcuuca

SEQ ID NO: 1308193 - RNA, 19 nt, Homo sapiens
cgaccuuacuccuccaaaa

SEQ ID NO: 1308194 - RNA, 19 nt, Homo sapiens
caaguuggcgaccuuacuc

SEQ ID NO: 1308195 - RNA, 19 nt, Homo sapiens
ggaagaguccugggaucuc

SEQ ID NO: 1308196 - RNA, 19 nt, Homo sapiens
cuuaaagacucagaaagac

SEQ ID NO: 1308197 - RNA, 19 nt, Homo sapiens
agcauaggauagaugaaga

SEQ ID NO: 1308198 - RNA, 19 nt, Homo sapiens
aauggauuguucugauuuc

SEQ ID NO: 1308199 - RNA, 19 nt, Homo sapiens
ccaagauggccauauacuc

SEQ ID NO: 1308200 - RNA, 19 nt, Homo sapiens
uagcauaggauagaugaag

SEQ ID NO: 1308201 - RNA, 19 nt, Homo sapiens
gaagcucacucugauguua

SEQ ID NO: 1308202 - RNA, 19 nt, Homo sapiens
gcagauaccuauuauacug

SEQ ID NO: 1308203 - RNA, 19 nt, Homo sapiens
gcauuaggcuguaguucua

SEQ ID NO: 1308204 - RNA, 19 nt, Homo sapiens
gaaaugcagcuucuuauug

SEQ ID NO: 1308205 - RNA, 19 nt, Homo sapiens
aaacuagaaucaagccuua

SEQ ID NO: 1308206 - RNA, 19 nt, Homo sapiens
ugaggaggcugucaugaua

SEQ ID NO: 1308207 - RNA, 19 nt, Homo sapiens
ccuauuaacuguacauuug

SEQ ID NO: 1308208 - RNA, 19 nt, Homo sapiens
aaugaaaucucgucuugua

SEQ ID NO: 1308209 - RNA, 19 nt, Homo sapiens
uaauccaccuccuuacuua

SEQ ID NO: 1308210 - RNA, 19 nt, Homo sapiens
ggauggagcaccucugaua

SEQ ID NO: 1308211 - RNA, 19 nt, Homo sapiens
agccagagaugacuaauuu

SEQ ID NO: 1308212 - RNA, 19 nt, Homo sapiens
ggaaauaucgagcaucaga

SEQ ID NO: 1308213 - RNA, 19 nt, Homo sapiens
gaaauauucacaucucuga

SEQ ID NO: 1308214 - RNA, 19 nt, Homo sapiens
gcucuugggcauugaauua

SEQ ID NO: 1308215 - RNA, 19 nt, Homo sapiens
gcauuugcauacugugaua

SEQ ID NO: 1308216 - RNA, 19 nt, Homo sapiens
gagcaagcaagaccuguua

SEQ ID NO: 1308217 - RNA, 19 nt, Homo sapiens
gaacagugcagaaacuaga

SEQ ID NO: 1308218 - RNA, 19 nt, Homo sapiens
ggcacuaccugauuucaaa

SEQ ID NO: 1308219 - RNA, 19 nt, Homo sapiens
cagcacgggugacuucuuu

SEQ ID NO: 1308220 - RNA, 19 nt, Homo sapiens
guacagugaauuugcuuua

SEQ ID NO: 1308221 - RNA, 19 nt, Homo sapiens
gaagacagaaagcaacaaa

SEQ ID NO: 1308222 - RNA, 19 nt, Homo sapiens
gaauuugcuuuaacagaug

SEQ ID NO: 1308223 - RNA, 19 nt, Homo sapiens
gaagaugagacccaaagaa

SEQ ID NO: 1308224 - RNA, 19 nt, Homo sapiens
ggaauuugauaucucugaa

SEQ ID NO: 1308225 - RNA, 19 nt, Homo sapiens
ggauuauucuucucauguu

SEQ ID NO: 1308226 - RNA, 19 nt, Homo sapiens
ccagagaugacuaauuuaa

SEQ ID NO: 1308227 - RNA, 19 nt, Homo sapiens
gaaagggaaagcugagauu

SEQ ID NO: 1308228 - RNA, 19 nt, Homo sapiens
gagcaccucugauagcaau

SEQ ID NO: 1308229 - RNA, 19 nt, Homo sapiens
aaaugcagcuucuuauugu

SEQ ID NO: 1308230 - RNA, 19 nt, Homo sapiens
uuacuuaacuugugagagu

SEQ ID NO: 1308231 - RNA, 19 nt, Homo sapiens
gaccauuugugacugcuuu

SEQ ID NO: 1308232 - RNA, 19 nt, Homo sapiens
caagaggaaagauggcuua

SEQ ID NO: 1308233 - RNA, 19 nt, Homo sapiens
ccaaagagagcaagcaaga

SEQ ID NO: 1308234 - RNA, 19 nt, Homo sapiens
gagggaacaaagcuaaaua

SEQ ID NO: 1308235 - RNA, 19 nt, Homo sapiens
ggcuguaguucuaauauug

SEQ ID NO: 1308236 - RNA, 19 nt, Homo sapiens
gaaagcaacaaagugaauu

SEQ ID NO: 1308237 - RNA, 19 nt, Homo sapiens
gaaaucucgucuuguagca

SEQ ID NO: 1308238 - RNA, 19 nt, Homo sapiens
caagugguacagugaauuu

SEQ ID NO: 1308239 - RNA, 19 nt, Homo sapiens
aaauuaauccaccuccuua

SEQ ID NO: 1308240 - RNA, 19 nt, Homo sapiens
ugaagcaacuugaaaugca

SEQ ID NO: 1308241 - RNA, 19 nt, Homo sapiens
ugggacagauucaagcuuu

SEQ ID NO: 1308242 - RNA, 19 nt, Homo sapiens
ggaaugaaucccuuaccaa

SEQ ID NO: 1308243 - RNA, 19 nt, Homo sapiens
gggaacaaagcuaaauaaa

SEQ ID NO: 1308244 - RNA, 19 nt, Homo sapiens
cuugggcauugaauuauua

SEQ ID NO: 1308245 - RNA, 19 nt, Homo sapiens
gggacuaaauagguaauga

SEQ ID NO: 1308246 - RNA, 19 nt, Homo sapiens
acagaaagcaacaaaguga

SEQ ID NO: 1308247 - RNA, 19 nt, Homo sapiens
acaaacaagugauccuaau

SEQ ID NO: 1308248 - RNA, 19 nt, Homo sapiens
aguaaagacugggaaauau

SEQ ID NO: 1308249 - RNA, 19 nt, Homo sapiens
aaaaugaaaucucgucuug

SEQ ID NO: 1308250 - RNA, 19 nt, Homo sapiens
gaaaguugaauggugguuu

SEQ ID NO: 1308251 - RNA, 19 nt, Homo sapiens
uaguaaagacugggaaaua

SEQ ID NO: 1308252 - RNA, 19 nt, Homo sapiens
gacccaugcugcuaguuga

SEQ ID NO: 1308253 - RNA, 19 nt, Homo sapiens
uagcauggauuauucuucu

SEQ ID NO: 1308254 - RNA, 19 nt, Homo sapiens
aagaugagacccaaagaaa

SEQ ID NO: 1308255 - RNA, 19 nt, Homo sapiens
ucaaaggaauacaaacaag

SEQ ID NO: 1308256 - RNA, 19 nt, Homo sapiens
aagcaagaccuguuagaaa

SEQ ID NO: 1308257 - RNA, 19 nt, Homo sapiens
gaauugcggcuagccagua

SEQ ID NO: 1308258 - RNA, 19 nt, Homo sapiens
gaucgggcacuaccugauu

SEQ ID NO: 1308259 - RNA, 19 nt, Homo sapiens
gaagcuauugggacagauu

SEQ ID NO: 1308260 - RNA, 19 nt, Homo sapiens
caguaagccuugcuaaucu

SEQ ID NO: 1308261 - RNA, 19 nt, Homo sapiens
ccaguaagccuugcuaauc

SEQ ID NO: 1308262 - RNA, 19 nt, Homo sapiens
ugaaaugcagcuucuuauu

SEQ ID NO: 1308263 - RNA, 19 nt, Homo sapiens
gagaucagcagucuuggau

SEQ ID NO: 1308264 - RNA, 19 nt, Homo sapiens
ucuuauagaccaugcauuu

SEQ ID NO: 1308265 - RNA, 19 nt, Homo sapiens
gaugagacccaaagaaagg

SEQ ID NO: 1308266 - RNA, 19 nt, Homo sapiens
gcaagcaagaccuguuaga

SEQ ID NO: 1308267 - RNA, 19 nt, Homo sapiens
cuuauugucuggaaugaau

SEQ ID NO: 1308268 - RNA, 19 nt, Homo sapiens
gaagcaaugugugcaucug

SEQ ID NO: 1308269 - RNA, 19 nt, Homo sapiens
ugggaaauaucgagcauca

SEQ ID NO: 1308270 - RNA, 19 nt, Homo sapiens
ggcauugaauuauuaggau

SEQ ID NO: 1308271 - RNA, 19 nt, Homo sapiens
ggacuaaauagguaaugau

SEQ ID NO: 1308272 - RNA, 19 nt, Homo sapiens
ucauugcagauaccuauua

SEQ ID NO: 1308273 - RNA, 19 nt, Homo sapiens
caagcaagaccuguuagaa

SEQ ID NO: 1308274 - RNA, 19 nt, Homo sapiens
ggaauacaaacaagugauc

SEQ ID NO: 1308275 - RNA, 19 nt, Homo sapiens
guggcacacuucacauuga

SEQ ID NO: 1308276 - RNA, 19 nt, Homo sapiens
uuagagaucagcagucuug

SEQ ID NO: 1308277 - RNA, 19 nt, Homo sapiens
guuaaugagcuucggguuu

SEQ ID NO: 1308278 - RNA, 19 nt, Homo sapiens
ggaaaccagagaagacguu

SEQ ID NO: 1308279 - RNA, 19 nt, Homo sapiens
gauuggcaccagaacauuu

SEQ ID NO: 1308280 - RNA, 19 nt, Homo sapiens
gacugcagccagaaguuua

SEQ ID NO: 1308281 - RNA, 19 nt, Homo sapiens
uauugaagcucacucugau

SEQ ID NO: 1308282 - RNA, 19 nt, Homo sapiens
uaacaggaacagugcagaa

SEQ ID NO: 1308283 - RNA, 19 nt, Homo sapiens
aagccuugcuaaucucuuu

SEQ ID NO: 1308284 - RNA, 19 nt, Homo sapiens
caucugaagcaacuugaaa

SEQ ID NO: 1308285 - RNA, 19 nt, Homo sapiens
guaaagacugggaaauauc

SEQ ID NO: 1308286 - RNA, 19 nt, Homo sapiens
ccacaaagccagguauuac

SEQ ID NO: 1308287 - RNA, 19 nt, Homo sapiens
caccagaacauuuucauua

SEQ ID NO: 1308288 - RNA, 19 nt, Homo sapiens
caaauggagaagacagaaa

SEQ ID NO: 1308289 - RNA, 19 nt, Homo sapiens
aaagccagguauuacaaga

SEQ ID NO: 1308290 - RNA, 19 nt, Homo sapiens
caaacaagugauccuaaug

SEQ ID NO: 1308291 - RNA, 19 nt, Homo sapiens
cgucuuguagcauggauua

SEQ ID NO: 1308292 - RNA, 19 nt, Homo sapiens
uaacuguacauuugcaaga

SEQ ID NO: 1308293 - RNA, 19 nt, Homo sapiens
cauugcagauaccuauuau

SEQ ID NO: 1308294 - RNA, 19 nt, Homo sapiens
gcacaggaagcucuuaaaa

SEQ ID NO: 1308295 - RNA, 19 nt, Homo sapiens
cuugaaaugcagcuucuua

SEQ ID NO: 1308296 - RNA, 19 nt, Homo sapiens
ugugacugcuuuagaguau

SEQ ID NO: 1308297 - RNA, 19 nt, Homo sapiens
ggagggaacaaagcuaaau

SEQ ID NO: 1308298 - RNA, 19 nt, Homo sapiens
agcaagaccuguuagaaag

SEQ ID NO: 1308299 - RNA, 19 nt, Homo sapiens
gggcauugaauuauuagga

SEQ ID NO: 1308300 - RNA, 19 nt, Homo sapiens
uagaagcuauugggacaga

SEQ ID NO: 1308301 - RNA, 19 nt, Homo sapiens
agacggacaugaagcaaua

SEQ ID NO: 1308302 - RNA, 19 nt, Homo sapiens
gcaggacaauaaagaguuu

SEQ ID NO: 1308303 - RNA, 19 nt, Homo sapiens
ggacugaggaccagcauga

SEQ ID NO: 1308304 - RNA, 19 nt, Homo sapiens
ggacaugugugcccaucug

SEQ ID NO: 1308305 - RNA, 19 nt, Homo sapiens
ccacuggccucuagaaugg

SEQ ID NO: 1308306 - RNA, 19 nt, Homo sapiens
gaguaaccguguagacaga

SEQ ID NO: 1308307 - RNA, 19 nt, Homo sapiens
ggacaugaagcaauaucaa

SEQ ID NO: 1308308 - RNA, 19 nt, Homo sapiens
gcauuggcccugaaucuga

SEQ ID NO: 1308309 - RNA, 19 nt, Homo sapiens
ccugacaagugccagagua

SEQ ID NO: 1308310 - RNA, 19 nt, Homo sapiens
cacuuaacgugucucuaua

SEQ ID NO: 1308311 - RNA, 19 nt, Homo sapiens
cauuugggcucaccuguca

SEQ ID NO: 1308312 - RNA, 19 nt, Homo sapiens
aaacagccgccaucccuuu

SEQ ID NO: 1308313 - RNA, 19 nt, Homo sapiens
caacagcaccaacuggaau

SEQ ID NO: 1308314 - RNA, 19 nt, Homo sapiens
gaaagccugccaaguacug

SEQ ID NO: 1308315 - RNA, 19 nt, Homo sapiens
uggaaagccugccaaguac

SEQ ID NO: 1308316 - RNA, 19 nt, Homo sapiens
ggacaacauggccuuugga

SEQ ID NO: 1308317 - RNA, 19 nt, Homo sapiens
gacaacauggccuuuggaa

SEQ ID NO: 1308318 - RNA, 19 nt, Homo sapiens
agacagagcaguguagaca

SEQ ID NO: 1308319 - RNA, 19 nt, Homo sapiens
ccgucagccuggucuuuaa

SEQ ID NO: 1308320 - RNA, 19 nt, Homo sapiens
ugaguggaccugacaagug

SEQ ID NO: 1308321 - RNA, 19 nt, Homo sapiens
cccagugccucccagcauu

SEQ ID NO: 1308322 - RNA, 19 nt, Homo sapiens
gguugggccugcuguugug

SEQ ID NO: 1308323 - RNA, 19 nt, Homo sapiens
agaccuggcugcccuucau

SEQ ID NO: 1308324 - RNA, 19 nt, Homo sapiens
cugaugcgcuacaacaaca

SEQ ID NO: 1308325 - RNA, 19 nt, Homo sapiens
ggcaggacaauaaagaguu

SEQ ID NO: 1308326 - RNA, 19 nt, Homo sapiens
gacaugaagcaauaucaag

SEQ ID NO: 1308327 - RNA, 19 nt, Homo sapiens
cuucaccacuggccucuag

SEQ ID NO: 1308328 - RNA, 19 nt, Homo sapiens
gaggacaacauggccuuug

SEQ ID NO: 1308329 - RNA, 19 nt, Homo sapiens
cagaguaaccguguagaca

SEQ ID NO: 1308330 - RNA, 19 nt, Homo sapiens
caaguugcuucaggaccuu

SEQ ID NO: 1308331 - RNA, 19 nt, Homo sapiens
gugcaccggguacacuuaa

SEQ ID NO: 1308332 - RNA, 19 nt, Homo sapiens
ggugcaccggguacacuua

SEQ ID NO: 1308333 - RNA, 19 nt, Homo sapiens
ccuuuguucuucuguugaa

SEQ ID NO: 1308334 - RNA, 19 nt, Homo sapiens
ugaaucugaugcgcuacaa

SEQ ID NO: 1308335 - RNA, 19 nt, Homo sapiens
gggcaggacaauaaagagu

SEQ ID NO: 1308336 - RNA, 19 nt, Homo sapiens
gagacggacaugaagcaau

SEQ ID NO: 1308337 - RNA, 19 nt, Homo sapiens
gugccagaguaaccgugua

SEQ ID NO: 1308338 - RNA, 19 nt, Homo sapiens
aguccgcucuucacuguuc

SEQ ID NO: 1308339 - RNA, 19 nt, Homo sapiens
guagacagagcaguguaga

SEQ ID NO: 1308340 - RNA, 19 nt, Homo sapiens
cauuggcccugaaucugau

SEQ ID NO: 1308341 - RNA, 19 nt, Homo sapiens
gugacgcucugcuucuucu

SEQ ID NO: 1308342 - RNA, 19 nt, Homo sapiens
ucccggugcucacgugguu

SEQ ID NO: 1308343 - RNA, 19 nt, Homo sapiens
gcugggucccuuugucaga

SEQ ID NO: 1308344 - RNA, 19 nt, Homo sapiens
ucuuuaaccuccggugaug

SEQ ID NO: 1308345 - RNA, 19 nt, Homo sapiens
gagaagagcucaaggagaa

SEQ ID NO: 1308346 - RNA, 19 nt, Homo sapiens
gaaaugagaguaaagaaga

SEQ ID NO: 1308347 - RNA, 19 nt, Homo sapiens
gagggaaggugaagcuuaa

SEQ ID NO: 1308348 - RNA, 19 nt, Homo sapiens
gggaaagacucacagagaa

SEQ ID NO: 1308349 - RNA, 19 nt, Homo sapiens
ggacaaggauuuugauaaa

SEQ ID NO: 1308350 - RNA, 19 nt, Homo sapiens
ugaaggaaaugcagaaaga

SEQ ID NO: 1308351 - RNA, 19 nt, Homo sapiens
agaaagauauggaugagaa

SEQ ID NO: 1308352 - RNA, 19 nt, Homo sapiens
uaaaggaucuaauggacaa

SEQ ID NO: 1308353 - RNA, 19 nt, Homo sapiens
caaagcaguuaaacaagaa

SEQ ID NO: 1308354 - RNA, 19 nt, Homo sapiens
uaaagaagauacagagcaa

SEQ ID NO: 1308355 - RNA, 19 nt, Homo sapiens
gaagggcgguuuaccaaag

SEQ ID NO: 1308356 - RNA, 19 nt, Homo sapiens
cacaggaccuaaagaauga

SEQ ID NO: 1308357 - RNA, 19 nt, Homo sapiens
acaaagcaguuaaacaaga

SEQ ID NO: 1308358 - RNA, 19 nt, Homo sapiens
cgagaaauguuuguugugu

SEQ ID NO: 1308359 - RNA, 19 nt, Homo sapiens
gcccucaccuugaccugua

SEQ ID NO: 1308360 - RNA, 19 nt, Homo sapiens
gcagaaagauauggaugag

SEQ ID NO: 1308361 - RNA, 19 nt, Homo sapiens
gaugagaagauggacauuu

SEQ ID NO: 1308362 - RNA, 19 nt, Homo sapiens
ugacacaggaccuaaagaa

SEQ ID NO: 1308363 - RNA, 19 nt, Homo sapiens
ggaaaugcagaaagauaug

SEQ ID NO: 1308364 - RNA, 19 nt, Homo sapiens
gaaaauggaggagauaaaa

SEQ ID NO: 1308365 - RNA, 19 nt, Homo sapiens
acacaggaccuaaagaaug

SEQ ID NO: 1308366 - RNA, 19 nt, Homo sapiens
caagagggcagaauugaag

SEQ ID NO: 1308367 - RNA, 19 nt, Homo sapiens
gaggaaugaugggauuuca

SEQ ID NO: 1308368 - RNA, 19 nt, Homo sapiens
gcaguuugccuggaauuga

SEQ ID NO: 1308369 - RNA, 19 nt, Homo sapiens
caaaggagcagcaggaacu

SEQ ID NO: 1308370 - RNA, 19 nt, Homo sapiens
agaaugaacucagggaagu

SEQ ID NO: 1308371 - RNA, 19 nt, Homo sapiens
ugagggaaggugaagcuua

SEQ ID NO: 1308372 - RNA, 19 nt, Homo sapiens
caguuugccuggaauugaa

SEQ ID NO: 1308373 - RNA, 19 nt, Homo sapiens
uguuucaucucuuugcuaa

SEQ ID NO: 1308374 - RNA, 19 nt, Homo sapiens
aaggaaaugcagaaagaua

SEQ ID NO: 1308375 - RNA, 19 nt, Homo sapiens
gaucuaauggacaaggauu

SEQ ID NO: 1308376 - RNA, 19 nt, Homo sapiens
uaacugccagcuugaaaug

SEQ ID NO: 1308377 - RNA, 19 nt, Homo sapiens
ccacagcucaggcccaaga

SEQ ID NO: 1308378 - RNA, 19 nt, Homo sapiens
gaagauacagagcaaacag

SEQ ID NO: 1308379 - RNA, 19 nt, Homo sapiens
cagcuugaaaugagaguaa

SEQ ID NO: 1308380 - RNA, 19 nt, Homo sapiens
cuaaagaacaacuacaauc

SEQ ID NO: 1308381 - RNA, 19 nt, Homo sapiens
ucagggaagugagagaaga

SEQ ID NO: 1308382 - RNA, 19 nt, Homo sapiens
cugcuucuaccaucuaaua

SEQ ID NO: 1308383 - RNA, 19 nt, Homo sapiens
caccaguuccuccuuguuu

SEQ ID NO: 1308384 - RNA, 19 nt, Homo sapiens
uaaagaacaacuacaaucg

SEQ ID NO: 1308385 - RNA, 19 nt, Homo sapiens
ccaagagggcagaauugaa

SEQ ID NO: 1308386 - RNA, 19 nt, Homo sapiens
gaaauuaugaaggaaaugc

SEQ ID NO: 1308387 - RNA, 19 nt, Homo sapiens
caagaagggcgguuuacca

SEQ ID NO: 1308388 - RNA, 19 nt, Homo sapiens
gugauucuuuggcuucaau

SEQ ID NO: 1308389 - RNA, 19 nt, Homo sapiens
ggagugacacaggaccuaa

SEQ ID NO: 1308390 - RNA, 19 nt, Homo sapiens
caccuugaccuguaaguug

SEQ ID NO: 1308391 - RNA, 19 nt, Homo sapiens
ggaaagacucacagagaac

SEQ ID NO: 1308392 - RNA, 19 nt, Homo sapiens
gagaagauggacauuuuaa

SEQ ID NO: 1308393 - RNA, 19 nt, Homo sapiens
agauauggaugagaagaug

SEQ ID NO: 1308394 - RNA, 19 nt, Homo sapiens
gcuucuaccaucuaauaaa

SEQ ID NO: 1308395 - RNA, 19 nt, Homo sapiens
gccaagagggcagaauuga

SEQ ID NO: 1308396 - RNA, 19 nt, Homo sapiens
ggaaggugaagcuuaacug

SEQ ID NO: 1308397 - RNA, 19 nt, Homo sapiens
gaaggaaaugcagaaagau

SEQ ID NO: 1308398 - RNA, 19 nt, Homo sapiens
ugggaaagacucacagaga

SEQ ID NO: 1308399 - RNA, 19 nt, Homo sapiens
gauaaacuucacgaauuug

SEQ ID NO: 1308400 - RNA, 19 nt, Homo sapiens
ggccaagagggcagaauug

SEQ ID NO: 1308401 - RNA, 19 nt, Homo sapiens
uaccaaagcaggagugaca

SEQ ID NO: 1308402 - RNA, 19 nt, Homo sapiens
gagggcagaauugaagaaa

SEQ ID NO: 1308403 - RNA, 19 nt, Homo sapiens
ugugugcucuaaagaacaa

SEQ ID NO: 1308404 - RNA, 19 nt, Homo sapiens
gaaaugcagaaagauaugg

SEQ ID NO: 1308405 - RNA, 19 nt, Homo sapiens
gacacaggaccuaaagaau

SEQ ID NO: 1308406 - RNA, 19 nt, Homo sapiens
ugaaaugagaguaaagaag

SEQ ID NO: 1308407 - RNA, 19 nt, Homo sapiens
ccagugaccacccaaccuu

SEQ ID NO: 1308408 - RNA, 19 nt, Homo sapiens
guugugugcucuaaagaac

SEQ ID NO: 1308409 - RNA, 19 nt, Homo sapiens
aagaagggcgguuuaccaa

SEQ ID NO: 1308410 - RNA, 19 nt, Homo sapiens
cuccuuguuucaucucuuu

SEQ ID NO: 1308411 - RNA, 19 nt, Homo sapiens
ugcgagaaauguuuguugu

SEQ ID NO: 1308412 - RNA, 19 nt, Homo sapiens
gaugggaaagacucacaga

SEQ ID NO: 1308413 - RNA, 19 nt, Homo sapiens
gaaagauauggaugagaag

SEQ ID NO: 1308414 - RNA, 19 nt, Homo sapiens
gcccugggugugauucuuu

SEQ ID NO: 1308415 - RNA, 19 nt, Homo sapiens
acagaagaacuauaagcuu

SEQ ID NO: 1308416 - RNA, 19 nt, Homo sapiens
gaggagauaaaacagauaa

SEQ ID NO: 1308417 - RNA, 19 nt, Homo sapiens
gagugacacaggaccuaaa

SEQ ID NO: 1308418 - RNA, 19 nt, Homo sapiens
ggaccugcugcgagaaaug

SEQ ID NO: 1308419 - RNA, 19 nt, Homo sapiens
guaaguugccuaggacagu

SEQ ID NO: 1308420 - RNA, 19 nt, Homo sapiens
aggaaaugcagaaagauau

SEQ ID NO: 1308421 - RNA, 19 nt, Homo sapiens
guggaaauuaugaaggaaa

SEQ ID NO: 1308422 - RNA, 19 nt, Homo sapiens
gaagacgauggcaccacaa

SEQ ID NO: 1308423 - RNA, 19 nt, Homo sapiens
gaagccagagccgaccaaa

SEQ ID NO: 1308424 - RNA, 19 nt, Homo sapiens
augagaagauggacauuuu

SEQ ID NO: 1308425 - RNA, 19 nt, Homo sapiens
gggcagaauugaagaaaac

SEQ ID NO: 1308426 - RNA, 19 nt, Homo sapiens
gcgagaaauguuuguugug

SEQ ID NO: 1308427 - RNA, 19 nt, Homo sapiens
ggaccuaaagaaugaacuc

SEQ ID NO: 1308428 - RNA, 19 nt, Homo sapiens
gauucuuuggcuucaauuu

SEQ ID NO: 1308429 - RNA, 19 nt, Homo sapiens
gauacagagcaaacagugu

SEQ ID NO: 1308430 - RNA, 19 nt, Homo sapiens
ggaaauuaugaaggaaaug

SEQ ID NO: 1308431 - RNA, 19 nt, Homo sapiens
uuguggaaauuaugaagga

SEQ ID NO: 1308432 - RNA, 19 nt, Homo sapiens
ggagaaaauggaggagaua

SEQ ID NO: 1308433 - RNA, 19 nt, Homo sapiens
cggccaagagggcagaauu

SEQ ID NO: 1308434 - RNA, 19 nt, Homo sapiens
aaagauauggaugagaaga

SEQ ID NO: 1308435 - RNA, 19 nt, Homo sapiens
gaaacuauuugaagugcua

SEQ ID NO: 1308436 - RNA, 19 nt, Homo sapiens
agaagcaguugguugauua

SEQ ID NO: 1308437 - RNA, 19 nt, Homo sapiens
caagaaugcugucuacugu

SEQ ID NO: 1308438 - RNA, 19 nt, Homo sapiens
caaccacacuuaccagaug

SEQ ID NO: 1308439 - RNA, 19 nt, Homo sapiens
acaauuaccuggaguaucu

SEQ ID NO: 1308440 - RNA, 19 nt, Homo sapiens
gaacuuguugcaauaugua

SEQ ID NO: 1308441 - RNA, 19 nt, Homo sapiens
gcaguugguugauuauauc

SEQ ID NO: 1308442 - RNA, 19 nt, Homo sapiens
gaagcagacuggagacaca

SEQ ID NO: 1308443 - RNA, 19 nt, Homo sapiens
ggccugaacucaccuaaca

SEQ ID NO: 1308444 - RNA, 19 nt, Homo sapiens
gccaagaaguaccucauug

SEQ ID NO: 1308445 - RNA, 19 nt, Homo sapiens
acgagcagcugacaaguuu

SEQ ID NO: 1308446 - RNA, 19 nt, Homo sapiens
uggagaacuuguugcaaua

SEQ ID NO: 1308447 - RNA, 19 nt, Homo sapiens
cuucauggcugugcucuuu

SEQ ID NO: 1308448 - RNA, 19 nt, Homo sapiens
caacugaaacuauuugaag

SEQ ID NO: 1308449 - RNA, 19 nt, Homo sapiens
gagaacuuguugcaauaug

SEQ ID NO: 1308450 - RNA, 19 nt, Homo sapiens
gguaucuuguuccauguaa

SEQ ID NO: 1308451 - RNA, 19 nt, Homo sapiens
cagaagcaguugguugauu

SEQ ID NO: 1308452 - RNA, 19 nt, Homo sapiens
cuggagagcuggaagacaa

SEQ ID NO: 1308453 - RNA, 19 nt, Homo sapiens
gaagccggcuguucgugau

SEQ ID NO: 1308454 - RNA, 19 nt, Homo sapiens
gcagcugguucucagguau

SEQ ID NO: 1308455 - RNA, 19 nt, Homo sapiens
guuggagacuucagaggaa

SEQ ID NO: 1308456 - RNA, 19 nt, Homo sapiens
gcagaacuccgucuauguc

SEQ ID NO: 1308457 - RNA, 19 nt, Homo sapiens
ugacauggcagcugcaaug

SEQ ID NO: 1308458 - RNA, 19 nt, Homo sapiens
acucaucacugccucgaaa

SEQ ID NO: 1308459 - RNA, 19 nt, Homo sapiens
gcggaucacucuuacuucu

SEQ ID NO: 1308460 - RNA, 19 nt, Homo sapiens
guucucagguaucuuguuc

SEQ ID NO: 1308461 - RNA, 19 nt, Homo sapiens
gagcaggacuuggccuaag

SEQ ID NO: 1308462 - RNA, 19 nt, Homo sapiens
gugcugggcucugugaaga

SEQ ID NO: 1308463 - RNA, 19 nt, Homo sapiens
gagagcuggaagacaauua

SEQ ID NO: 1308464 - RNA, 19 nt, Homo sapiens
gaacuuuuccuacggagua

SEQ ID NO: 1308465 - RNA, 19 nt, Homo sapiens
gagcaacugaaacuauuug

SEQ ID NO: 1308466 - RNA, 19 nt, Homo sapiens
cugagcaacugaaacuauu

SEQ ID NO: 1308467 - RNA, 19 nt, Homo sapiens
ucgagaacaugcugcagaa

SEQ ID NO: 1308468 - RNA, 19 nt, Homo sapiens
ucagugcccuguacucauc

SEQ ID NO: 1308469 - RNA, 19 nt, Homo sapiens
gcaacugaaacuauuugaa

SEQ ID NO: 1308470 - RNA, 19 nt, Homo sapiens
caccucgccuuucuuguug

SEQ ID NO: 1308471 - RNA, 19 nt, Homo sapiens
ugagugaacgauuuagaaa

SEQ ID NO: 1308472 - RNA, 19 nt, Homo sapiens
cugaauuucucaaggaguu

SEQ ID NO: 1308473 - RNA, 19 nt, Homo sapiens
ggaugaaggcuuggugcua

SEQ ID NO: 1308474 - RNA, 19 nt, Homo sapiens
gaagcucgccagccacugu

SEQ ID NO: 1308475 - RNA, 19 nt, Homo sapiens
gcugagcaacugaaacuau

SEQ ID NO: 1308476 - RNA, 19 nt, Homo sapiens
gcagaggaccgugcaguuc

SEQ ID NO: 1308477 - RNA, 19 nt, Homo sapiens
ggcaaauccucagagugua

SEQ ID NO: 1308478 - RNA, 19 nt, Homo sapiens
ucaccucgccuuucuuguu

SEQ ID NO: 1308479 - RNA, 19 nt, Homo sapiens
ccucaauccuuaacuuucu

SEQ ID NO: 1308480 - RNA, 19 nt, Homo sapiens
cuucauugcucgaguucuu

SEQ ID NO: 1308481 - RNA, 19 nt, Homo sapiens
gcaaauccucagaguguag

SEQ ID NO: 1308482 - RNA, 19 nt, Homo sapiens
uggcaaauccucagagugu

SEQ ID NO: 1308483 - RNA, 19 nt, Homo sapiens
acaaguuucucucccuaau

SEQ ID NO: 1308484 - RNA, 19 nt, Homo sapiens
gaggagaugaucgccagua

SEQ ID NO: 1308485 - RNA, 19 nt, Homo sapiens
ggagaacuuguugcaauau

SEQ ID NO: 1308486 - RNA, 19 nt, Homo sapiens
ucaagaaugcugucuacug

SEQ ID NO: 1308487 - RNA, 19 nt, Homo sapiens
ugggcucugugaagaauaa

SEQ ID NO: 1308488 - RNA, 19 nt, Homo sapiens
gugagugaacgauuuagaa

SEQ ID NO: 1308489 - RNA, 19 nt, Homo sapiens
guggacuccucuucuguga

SEQ ID NO: 1308490 - RNA, 19 nt, Homo sapiens
ugaauuggcugagcagacu

SEQ ID NO: 1308491 - RNA, 19 nt, Homo sapiens
cuacagaccggaugaagca

SEQ ID NO: 1308492 - RNA, 19 nt, Homo sapiens
ggagacacaaguggagaaa

SEQ ID NO: 1308493 - RNA, 19 nt, Homo sapiens
gcugggcucugugaagaau

SEQ ID NO: 1308494 - RNA, 19 nt, Homo sapiens
gacgagcagcugacaaguu

SEQ ID NO: 1308495 - RNA, 19 nt, Homo sapiens
ugaguucccuggaguucug

SEQ ID NO: 1308496 - RNA, 19 nt, Homo sapiens
gggcauggcaggacuagag

SEQ ID NO: 1308497 - RNA, 19 nt, Homo sapiens
agaacuuguugcaauaugu

SEQ ID NO: 1308498 - RNA, 19 nt, Homo sapiens
gaacuccgucuaugucaac

SEQ ID NO: 1308499 - RNA, 19 nt, Homo sapiens
caucucgucugguucucuu

SEQ ID NO: 1308500 - RNA, 19 nt, Homo sapiens
gaagcaguugguugauuau

SEQ ID NO: 1308501 - RNA, 19 nt, Homo sapiens
ggucccagguggugcgaau

SEQ ID NO: 1308502 - RNA, 19 nt, Homo sapiens
uguccaaagccaagaagua

SEQ ID NO: 1308503 - RNA, 19 nt, Homo sapiens
cugcagaacuccgucuaug

SEQ ID NO: 1308504 - RNA, 19 nt, Homo sapiens
ggagcuagagguggcauug

SEQ ID NO: 1308505 - RNA, 19 nt, Homo sapiens
gaggugggccuagcagaga

SEQ ID NO: 1308506 - RNA, 19 nt, Homo sapiens
gcuggcaaauccucagagu

SEQ ID NO: 1308507 - RNA, 19 nt, Homo sapiens
gcaaccacacuuaccagau

SEQ ID NO: 1308508 - RNA, 19 nt, Homo sapiens
auggagaacuuguugcaau

SEQ ID NO: 1308509 - RNA, 19 nt, Homo sapiens
uuucuuccauggacaauca

SEQ ID NO: 1308510 - RNA, 19 nt, Homo sapiens
ggagcaggacuuggccuaa

SEQ ID NO: 1308511 - RNA, 19 nt, Homo sapiens
gagaacaugcugcagaacu

SEQ ID NO: 1308512 - RNA, 19 nt, Homo sapiens
uaagaaacgcagccuacug

SEQ ID NO: 1308513 - RNA, 19 nt, Homo sapiens
gcagagagacagggagaag

SEQ ID NO: 1308514 - RNA, 19 nt, Homo sapiens
cuacaucgcggaucacucu

SEQ ID NO: 1308515 - RNA, 19 nt, Homo sapiens
gacaaguuucucucccuaa

SEQ ID NO: 1308516 - RNA, 19 nt, Homo sapiens
agcaguugguugauuauau

SEQ ID NO: 1308517 - RNA, 19 nt, Homo sapiens
gcccuugcacucuucauga

SEQ ID NO: 1308518 - RNA, 19 nt, Homo sapiens
gcucagugcccuguacuca

SEQ ID NO: 1308519 - RNA, 19 nt, Homo sapiens
gggcugagcaacugaaacu

SEQ ID NO: 1308520 - RNA, 19 nt, Homo sapiens
gagcagcugacaaguuucu

SEQ ID NO: 1308521 - RNA, 19 nt, Homo sapiens
ucacugccucgaaagauug

SEQ ID NO: 1308522 - RNA, 19 nt, Homo sapiens
uuucucgccuugucccuuu

SEQ ID NO: 1308523 - RNA, 19 nt, Homo sapiens
agaacaugcugcagaacuc

SEQ ID NO: 1308524 - RNA, 19 nt, Homo sapiens
cgugaugcccuacuucuuc

SEQ ID NO: 1308525 - RNA, 19 nt, Homo sapiens
gaucuggcccucucaucuc

SEQ ID NO: 1308526 - RNA, 19 nt, Homo sapiens
ggaucuggcccucucaucu

SEQ ID NO: 1308527 - RNA, 19 nt, Homo sapiens
ucccugaauuucucaagga

SEQ ID NO: 1308528 - RNA, 19 nt, Homo sapiens
uuccgugagugaacgauuu

SEQ ID NO: 1308529 - RNA, 19 nt, Homo sapiens
agucaagaaugcugucuac

SEQ ID NO: 1308530 - RNA, 19 nt, Homo sapiens
cggcacaauugguccuuca

SEQ ID NO: 1308531 - RNA, 19 nt, Homo sapiens
ggagagcuggaagacaauu

SEQ ID NO: 1308532 - RNA, 19 nt, Homo sapiens
ugacccguguguugacaug

SEQ ID NO: 1308533 - RNA, 19 nt, Homo sapiens
ucagaugaauguuuuaugg

SEQ ID NO: 1308534 - RNA, 19 nt, Homo sapiens
gcucuuuccugcucaacac

SEQ ID NO: 1308535 - RNA, 19 nt, Homo sapiens
gaaagggaaugcuaauuua

SEQ ID NO: 1308536 - RNA, 19 nt, Homo sapiens
gcaaguaaauguuguaucu

SEQ ID NO: 1308537 - RNA, 19 nt, Homo sapiens
gaaaggaagauaugacuaa

SEQ ID NO: 1308538 - RNA, 19 nt, Homo sapiens
ugaggcagcugcaauauuu

SEQ ID NO: 1308539 - RNA, 19 nt, Homo sapiens
gaucggagcuugaaaagaa

SEQ ID NO: 1308540 - RNA, 19 nt, Homo sapiens
aggaagauaugacuaauga

SEQ ID NO: 1308541 - RNA, 19 nt, Homo sapiens
gaucuuuacucuugcauuc

SEQ ID NO: 1308542 - RNA, 19 nt, Homo sapiens
augcauagcuuauauccua

SEQ ID NO: 1308543 - RNA, 19 nt, Homo sapiens
ucacauagccuuacagagu

SEQ ID NO: 1308544 - RNA, 19 nt, Homo sapiens
gauauguagugcagugauu

SEQ ID NO: 1308545 - RNA, 19 nt, Homo sapiens
gaaccaauauaaggacguu

SEQ ID NO: 1308546 - RNA, 19 nt, Homo sapiens
gaagauaugacuaaugagu

SEQ ID NO: 1308547 - RNA, 19 nt, Homo sapiens
agaaagggaaugcuaauuu

SEQ ID NO: 1308548 - RNA, 19 nt, Homo sapiens
agugaaagcuggauuuguu

SEQ ID NO: 1308549 - RNA, 19 nt, Homo sapiens
gaaaugaggcagcugcaau

SEQ ID NO: 1308550 - RNA, 19 nt, Homo sapiens
auucagaucuuuacucuug

SEQ ID NO: 1308551 - RNA, 19 nt, Homo sapiens
guagugcagugauuuacaa

SEQ ID NO: 1308552 - RNA, 19 nt, Homo sapiens
ggcgaucgcuggagcuaaa

SEQ ID NO: 1308553 - RNA, 19 nt, Homo sapiens
guucaugagucuagguaaa

SEQ ID NO: 1308554 - RNA, 19 nt, Homo sapiens
ugagaaaucuaugugagaa

SEQ ID NO: 1308555 - RNA, 19 nt, Homo sapiens
gcaaauguucucuuacaau

SEQ ID NO: 1308556 - RNA, 19 nt, Homo sapiens
ccacugaagccagaaauaa

SEQ ID NO: 1308557 - RNA, 19 nt, Homo sapiens
uaaacuaguucaugagucu

SEQ ID NO: 1308558 - RNA, 19 nt, Homo sapiens
uaacagaggcuugauuugu

SEQ ID NO: 1308559 - RNA, 19 nt, Homo sapiens
acauuucacugucaaagaa

SEQ ID NO: 1308560 - RNA, 19 nt, Homo sapiens
caaggcaguugguggaaau

SEQ ID NO: 1308561 - RNA, 19 nt, Homo sapiens
ccacccacccuaacgaaua

SEQ ID NO: 1308562 - RNA, 19 nt, Homo sapiens
guugacaugccauuuauuu

SEQ ID NO: 1308563 - RNA, 19 nt, Homo sapiens
aagcaaauguucucuuaca

SEQ ID NO: 1308564 - RNA, 19 nt, Homo sapiens
cagcugcaauauuuaauuc

SEQ ID NO: 1308565 - RNA, 19 nt, Homo sapiens
cacauagccuuacagaguu

SEQ ID NO: 1308566 - RNA, 19 nt, Homo sapiens
gaauaaagcaaauguucuc

SEQ ID NO: 1308567 - RNA, 19 nt, Homo sapiens
ggacguuguuuuagcauuu

SEQ ID NO: 1308568 - RNA, 19 nt, Homo sapiens
ggucagaaagggaaugcua

SEQ ID NO: 1308569 - RNA, 19 nt, Homo sapiens
cacuaugugucuccuuaua

SEQ ID NO: 1308570 - RNA, 19 nt, Homo sapiens
ucagugauguauaaacuag

SEQ ID NO: 1308571 - RNA, 19 nt, Homo sapiens
ucacacccaucaacgaaug

SEQ ID NO: 1308572 - RNA, 19 nt, Homo sapiens
uaacaguggacuaucauug

SEQ ID NO: 1308573 - RNA, 19 nt, Homo sapiens
gaggaaagacugguucaug

SEQ ID NO: 1308574 - RNA, 19 nt, Homo sapiens
uaguucagcuuucauaagu

SEQ ID NO: 1308575 - RNA, 19 nt, Homo sapiens
ggucuuuacuuuacaaucg

SEQ ID NO: 1308576 - RNA, 19 nt, Homo sapiens
gcagcugcaauauuuaauu

SEQ ID NO: 1308577 - RNA, 19 nt, Homo sapiens
aaaugaggcagcugcaaua

SEQ ID NO: 1308578 - RNA, 19 nt, Homo sapiens
cauaacucauuagcagaua

SEQ ID NO: 1308579 - RNA, 19 nt, Homo sapiens
guucagcuuucauaaguag

SEQ ID NO: 1308580 - RNA, 19 nt, Homo sapiens
acacagugcuacacagcuu

SEQ ID NO: 1308581 - RNA, 19 nt, Homo sapiens
ggaaugcuaauuuacuugu

SEQ ID NO: 1308582 - RNA, 19 nt, Homo sapiens
gugcuuuggugcaucuaaa

SEQ ID NO: 1308583 - RNA, 19 nt, Homo sapiens
acaguggacuaucauugaa

SEQ ID NO: 1308584 - RNA, 19 nt, Homo sapiens
gaagccagaaauaacugua

SEQ ID NO: 1308585 - RNA, 19 nt, Homo sapiens
gcauaacucauuagcagau

SEQ ID NO: 1308586 - RNA, 19 nt, Homo sapiens
uguaacagaggcuugauuu

SEQ ID NO: 1308587 - RNA, 19 nt, Homo sapiens
gaaagcuggauuuguuuua

SEQ ID NO: 1308588 - RNA, 19 nt, Homo sapiens
ugaaagauuuagugaaagc

SEQ ID NO: 1308589 - RNA, 19 nt, Homo sapiens
aacagaggcuugauuugug

SEQ ID NO: 1308590 - RNA, 19 nt, Homo sapiens
gcuacuggcuuggaugcuu

SEQ ID NO: 1308591 - RNA, 19 nt, Homo sapiens
caacgaauggcuuuuaaaa

SEQ ID NO: 1308592 - RNA, 19 nt, Homo sapiens
gacuugcucugcugcaugu

SEQ ID NO: 1308593 - RNA, 19 nt, Homo sapiens
gagaaaucuaugugagaaa

SEQ ID NO: 1308594 - RNA, 19 nt, Homo sapiens
uaauucagccuuuggaagu

SEQ ID NO: 1308595 - RNA, 19 nt, Homo sapiens
cagaaauaacuguauccua

SEQ ID NO: 1308596 - RNA, 19 nt, Homo sapiens
cacccacccuaacgaauau

SEQ ID NO: 1308597 - RNA, 19 nt, Homo sapiens
ggaaagacugguucauggu

SEQ ID NO: 1308598 - RNA, 19 nt, Homo sapiens
caauauaaggacguuguuu

SEQ ID NO: 1308599 - RNA, 19 nt, Homo sapiens
ccaggucuuuacuuuacaa

SEQ ID NO: 1308600 - RNA, 19 nt, Homo sapiens
gaaugaggaaagacugguu

SEQ ID NO: 1308601 - RNA, 19 nt, Homo sapiens
uauguagugcagugauuua

SEQ ID NO: 1308602 - RNA, 19 nt, Homo sapiens
acagaggcuugauuugugu

SEQ ID NO: 1308603 - RNA, 19 nt, Homo sapiens
acauagccuuacagaguuu

SEQ ID NO: 1308604 - RNA, 19 nt, Homo sapiens
ugaaaggaagauaugacua

SEQ ID NO: 1308605 - RNA, 19 nt, Homo sapiens
gugaaagcuggauuuguuu

SEQ ID NO: 1308606 - RNA, 19 nt, Homo sapiens
gaggcagcugcaauauuua

SEQ ID NO: 1308607 - RNA, 19 nt, Homo sapiens
ggcuugauuuguguuauga

SEQ ID NO: 1308608 - RNA, 19 nt, Homo sapiens
guaacagaggcuugauuug

SEQ ID NO: 1308609 - RNA, 19 nt, Homo sapiens
ugaggcugcuggagagaau

SEQ ID NO: 1308610 - RNA, 19 nt, Homo sapiens
guucauggucggaauagug

SEQ ID NO: 1308611 - RNA, 19 nt, Homo sapiens
cuuguugacaugccauuua

SEQ ID NO: 1308612 - RNA, 19 nt, Homo sapiens
agggaaugcuaauuuacuu

SEQ ID NO: 1308613 - RNA, 19 nt, Homo sapiens
uguagcaucugcaaaauau

SEQ ID NO: 1308614 - RNA, 19 nt, Homo sapiens
gcugcaauauuuaauucag

SEQ ID NO: 1308615 - RNA, 19 nt, Homo sapiens
ccagcaacaauauggcuuu

SEQ ID NO: 1308616 - RNA, 19 nt, Homo sapiens
cuguauuacuucuggguuu

SEQ ID NO: 1308617 - RNA, 19 nt, Homo sapiens
cagaaagggaaugcuaauu

SEQ ID NO: 1308618 - RNA, 19 nt, Homo sapiens
ggaaaugaggcagcugcaa

SEQ ID NO: 1308619 - RNA, 19 nt, Homo sapiens
caucuaaaacugcaucuuu

SEQ ID NO: 1308620 - RNA, 19 nt, Homo sapiens
ggagcugaccagugcuuug

SEQ ID NO: 1308621 - RNA, 19 nt, Homo sapiens
uauagagccaguaaugguu

SEQ ID NO: 1308622 - RNA, 19 nt, Homo sapiens
uaacucauuagcagauaug

SEQ ID NO: 1308623 - RNA, 19 nt, Homo sapiens
gaggcuugauuuguguuau

SEQ ID NO: 1308624 - RNA, 19 nt, Homo sapiens
guaguucagcuuucauaag

SEQ ID NO: 1308625 - RNA, 19 nt, Homo sapiens
ucaugugccaguauccaua

SEQ ID NO: 1308626 - RNA, 19 nt, Homo sapiens
cuuuaacaguggacuauca

SEQ ID NO: 1308627 - RNA, 19 nt, Homo sapiens
gagagaaugaggaaagacu

SEQ ID NO: 1308628 - RNA, 19 nt, Homo sapiens
uggagagaaugaggaaaga

SEQ ID NO: 1308629 - RNA, 19 nt, Homo sapiens
gggaaugcuaauuuacuug

SEQ ID NO: 1308630 - RNA, 19 nt, Homo sapiens
aaucacacccaucaacgaa

SEQ ID NO: 1308631 - RNA, 19 nt, Homo sapiens
ggaccacugaagccagaaa

SEQ ID NO: 1308632 - RNA, 19 nt, Homo sapiens
gagucuagguaaaauauca

SEQ ID NO: 1308633 - RNA, 19 nt, Homo sapiens
gacaugccauuuauuuugu

SEQ ID NO: 1308634 - RNA, 19 nt, Homo sapiens
ucagaaagggaaugcuaau

SEQ ID NO: 1308635 - RNA, 19 nt, Homo sapiens
ccaacaagcucuuccacua

SEQ ID NO: 1308636 - RNA, 19 nt, Homo sapiens
gagcacgccuuccagauca

SEQ ID NO: 1308637 - RNA, 19 nt, Homo sapiens
cggaaggacucacauuuca

SEQ ID NO: 1308638 - RNA, 19 nt, Homo sapiens
ccagaaagcccucgcugaa

SEQ ID NO: 1308639 - RNA, 19 nt, Homo sapiens
gagcuggaccgcuggcuuu

SEQ ID NO: 1308640 - RNA, 19 nt, Homo sapiens
ucuaacccacuucaaauua

SEQ ID NO: 1308641 - RNA, 19 nt, Homo sapiens
gaaggucggaggacagaga

SEQ ID NO: 1308642 - RNA, 19 nt, Homo sapiens
gauccgcuccuuccugauu

SEQ ID NO: 1308643 - RNA, 19 nt, Homo sapiens
ggacgggcuuugcuucaag

SEQ ID NO: 1308644 - RNA, 19 nt, Homo sapiens
ggagggugccugugaggaa

SEQ ID NO: 1308645 - RNA, 19 nt, Homo sapiens
cagaguaugugaggucaga

SEQ ID NO: 1308646 - RNA, 19 nt, Homo sapiens
ugggaaaaguugugcauua

SEQ ID NO: 1308647 - RNA, 19 nt, Homo sapiens
ggucacaggucagcaaggu

SEQ ID NO: 1308648 - RNA, 19 nt, Homo sapiens
ggucagcagggucagagua

SEQ ID NO: 1308649 - RNA, 19 nt, Homo sapiens
uaacccacuucaaauuaca

SEQ ID NO: 1308650 - RNA, 19 nt, Homo sapiens
acaucaaccuggaggagaa

SEQ ID NO: 1308651 - RNA, 19 nt, Homo sapiens
caacguccuuggccauuuu

SEQ ID NO: 1308652 - RNA, 19 nt, Homo sapiens
gaacccuggcugccucuga

SEQ ID NO: 1308653 - RNA, 19 nt, Homo sapiens
ugacaccaccggacgagaa

SEQ ID NO: 1308654 - RNA, 19 nt, Homo sapiens
caacaagcucuuccacuac

SEQ ID NO: 1308655 - RNA, 19 nt, Homo sapiens
ugaccacacuucggaaaca

SEQ ID NO: 1308656 - RNA, 19 nt, Homo sapiens
cuaacccacuucaaauuac

SEQ ID NO: 1308657 - RNA, 19 nt, Homo sapiens
aacaagcucuuccacuaca

SEQ ID NO: 1308658 - RNA, 19 nt, Homo sapiens
ccucuaacccacuucaaau

SEQ ID NO: 1308659 - RNA, 19 nt, Homo sapiens
gcucggaaggacucacauu

SEQ ID NO: 1308660 - RNA, 19 nt, Homo sapiens
agaagcagauccgcuccuu

SEQ ID NO: 1308661 - RNA, 19 nt, Homo sapiens
acugcuaccuggagcuauu

SEQ ID NO: 1308662 - RNA, 19 nt, Homo sapiens
gacaccaccggacgagaaa

SEQ ID NO: 1308663 - RNA, 19 nt, Homo sapiens
gagagcacgccuuccagau

SEQ ID NO: 1308664 - RNA, 19 nt, Homo sapiens
cagcagggucagaguaugu

SEQ ID NO: 1308665 - RNA, 19 nt, Homo sapiens
ccacacuucggaaacauca

SEQ ID NO: 1308666 - RNA, 19 nt, Homo sapiens
gaccacacuucggaaacau

SEQ ID NO: 1308667 - RNA, 19 nt, Homo sapiens
ccaccggacgagaaagaaa

SEQ ID NO: 1308668 - RNA, 19 nt, Homo sapiens
gagggucacaggucagcaa

SEQ ID NO: 1308669 - RNA, 19 nt, Homo sapiens
cagcacagccaggauguca

SEQ ID NO: 1308670 - RNA, 19 nt, Homo sapiens
ugucugugccugccucuga

SEQ ID NO: 1308671 - RNA, 19 nt, Homo sapiens
ggucugaacccagugugau

SEQ ID NO: 1308672 - RNA, 19 nt, Homo sapiens
uucccagggucgcagguua

SEQ ID NO: 1308673 - RNA, 19 nt, Homo sapiens
cgacugcuaccuggagcua

SEQ ID NO: 1308674 - RNA, 19 nt, Homo sapiens
ggagcagccauuccugagu

SEQ ID NO: 1308675 - RNA, 19 nt, Homo sapiens
ucggaaggacucacauuuc

SEQ ID NO: 1308676 - RNA, 19 nt, Homo sapiens
caagaaaucugccuccuuu

SEQ ID NO: 1308677 - RNA, 19 nt, Homo sapiens
caaauuaaguuccacugua

SEQ ID NO: 1308678 - RNA, 19 nt, Homo sapiens
gcaagcagcugucucuaga

SEQ ID NO: 1308679 - RNA, 19 nt, Homo sapiens
gaaggcagagcuaucauua

SEQ ID NO: 1308680 - RNA, 19 nt, Homo sapiens
gaucgcagguuuccuaaga

SEQ ID NO: 1308681 - RNA, 19 nt, Homo sapiens
gaucaaccauguacaaauc

SEQ ID NO: 1308682 - RNA, 19 nt, Homo sapiens
ccacaaagcccaagaaauc

SEQ ID NO: 1308683 - RNA, 19 nt, Homo sapiens
ggagauggguccagcuaga

SEQ ID NO: 1308684 - RNA, 19 nt, Homo sapiens
gagagacccucccaaggaa

SEQ ID NO: 1308685 - RNA, 19 nt, Homo sapiens
ggaaagcagagaccuauga

SEQ ID NO: 1308686 - RNA, 19 nt, Homo sapiens
ggauugaagugacggagaa

SEQ ID NO: 1308687 - RNA, 19 nt, Homo sapiens
ggaagaagcccacagacau

SEQ ID NO: 1308688 - RNA, 19 nt, Homo sapiens
ccaaagaugcuaugaugaa

SEQ ID NO: 1308689 - RNA, 19 nt, Homo sapiens
gcagagaccuaugaguuca

SEQ ID NO: 1308690 - RNA, 19 nt, Homo sapiens
gaagaaggcucagaaugcu

SEQ ID NO: 1308691 - RNA, 19 nt, Homo sapiens
cagcagcucuggacgaaug

SEQ ID NO: 1308692 - RNA, 19 nt, Homo sapiens
ggaaagaaacagucaugga

SEQ ID NO: 1308693 - RNA, 19 nt, Homo sapiens
gugacacucugaccuauga

SEQ ID NO: 1308694 - RNA, 19 nt, Homo sapiens
guagaucgcagguuuccua

SEQ ID NO: 1308695 - RNA, 19 nt, Homo sapiens
cuuaguagaucgcagguuu

SEQ ID NO: 1308696 - RNA, 19 nt, Homo sapiens
ggaaagaccgguggcagaa

SEQ ID NO: 1308697 - RNA, 19 nt, Homo sapiens
ggacaguggugcuauagcu

SEQ ID NO: 1308698 - RNA, 19 nt, Homo sapiens
gacccaaucugcucaccaa

SEQ ID NO: 1308699 - RNA, 19 nt, Homo sapiens
gagaagcaccuguaugaca

SEQ ID NO: 1308700 - RNA, 19 nt, Homo sapiens
gaagaagguguaccacaug

SEQ ID NO: 1308701 - RNA, 19 nt, Homo sapiens
ggaggaaagccaacaggaa

SEQ ID NO: 1308702 - RNA, 19 nt, Homo sapiens
aaacggaggcuuccuacaa

SEQ ID NO: 1308703 - RNA, 19 nt, Homo sapiens
ggagaaggcagagcuauca

SEQ ID NO: 1308704 - RNA, 19 nt, Homo sapiens
uggcugagguuucuguuga

SEQ ID NO: 1308705 - RNA, 19 nt, Homo sapiens
ccacuaagcccagaacaga

SEQ ID NO: 1308706 - RNA, 19 nt, Homo sapiens
gaagaagcccacagacauc

SEQ ID NO: 1308707 - RNA, 19 nt, Homo sapiens
aagaagcgaucaaccaugu

SEQ ID NO: 1308708 - RNA, 19 nt, Homo sapiens
gcucgagggucgcagaugu

SEQ ID NO: 1308709 - RNA, 19 nt, Homo sapiens
aagcagcccuuucugucua

SEQ ID NO: 1308710 - RNA, 19 nt, Homo sapiens
aaauuaaguuccacuguag

SEQ ID NO: 1308711 - RNA, 19 nt, Homo sapiens
gcagggcaccagccacuuu

SEQ ID NO: 1308712 - RNA, 19 nt, Homo sapiens
agaagaagguguaccacau

SEQ ID NO: 1308713 - RNA, 19 nt, Homo sapiens
acaaagaccaggaggacua

SEQ ID NO: 1308714 - RNA, 19 nt, Homo sapiens
ccaggaagaauuaggauau

SEQ ID NO: 1308715 - RNA, 19 nt, Homo sapiens
gcaagaagcgaucaaccau

SEQ ID NO: 1308716 - RNA, 19 nt, Homo sapiens
caggaagagugaagaggaa

SEQ ID NO: 1308717 - RNA, 19 nt, Homo sapiens
gaaggagaagcaccuguau

SEQ ID NO: 1308718 - RNA, 19 nt, Homo sapiens
cuccaaagaugcuaugaug

SEQ ID NO: 1308719 - RNA, 19 nt, Homo sapiens
gaagcagguagagaucuua

SEQ ID NO: 1308720 - RNA, 19 nt, Homo sapiens
gagauugggcccaggaaga

SEQ ID NO: 1308721 - RNA, 19 nt, Homo sapiens
aggcagagcuaucauuagu

SEQ ID NO: 1308722 - RNA, 19 nt, Homo sapiens
ucagguacauggccacugu

SEQ ID NO: 1308723 - RNA, 19 nt, Homo sapiens
caaagggcaagaagagauu

SEQ ID NO: 1308724 - RNA, 19 nt, Homo sapiens
aaaucucucuccaggcuuu

SEQ ID NO: 1308725 - RNA, 19 nt, Homo sapiens
aagcagagaccuaugaguu

SEQ ID NO: 1308726 - RNA, 19 nt, Homo sapiens
gcccuuugcuccacucuca

SEQ ID NO: 1308727 - RNA, 19 nt, Homo sapiens
ggacgaauggauugaagug

SEQ ID NO: 1308728 - RNA, 19 nt, Homo sapiens
ugaaggagaagcaccugua

SEQ ID NO: 1308729 - RNA, 19 nt, Homo sapiens
caaagaugcuaugaugaag

SEQ ID NO: 1308730 - RNA, 19 nt, Homo sapiens
gugcgaggcugauggucaa

SEQ ID NO: 1308731 - RNA, 19 nt, Homo sapiens
cgccaaagccaaagaaaug

SEQ ID NO: 1308732 - RNA, 19 nt, Homo sapiens
ugaagcagguagagaucuu

SEQ ID NO: 1308733 - RNA, 19 nt, Homo sapiens
ugcaguaccugugccauaa

SEQ ID NO: 1308734 - RNA, 19 nt, Homo sapiens
gaaagaccgguggcagaaa

SEQ ID NO: 1308735 - RNA, 19 nt, Homo sapiens
gaaacagucauggaggaaa

SEQ ID NO: 1308736 - RNA, 19 nt, Homo sapiens
gaagcaggccuuggaguuc

SEQ ID NO: 1308737 - RNA, 19 nt, Homo sapiens
ggagggaugcucugcugaa

SEQ ID NO: 1308738 - RNA, 19 nt, Homo sapiens
ggaagaauuaggauaugau

SEQ ID NO: 1308739 - RNA, 19 nt, Homo sapiens
cccagaaccucuacaucuu

SEQ ID NO: 1308740 - RNA, 19 nt, Homo sapiens
guuggugacucccacauca

SEQ ID NO: 1308741 - RNA, 19 nt, Homo sapiens
gaagugacggagaaagugu

SEQ ID NO: 1308742 - RNA, 19 nt, Homo sapiens
aggagaagcaccuguauga

SEQ ID NO: 1308743 - RNA, 19 nt, Homo sapiens
aaacagucauggaggaaag

SEQ ID NO: 1308744 - RNA, 19 nt, Homo sapiens
agagagacccucccaagga

SEQ ID NO: 1308745 - RNA, 19 nt, Homo sapiens
gcaccuguaugacauucuc

SEQ ID NO: 1308746 - RNA, 19 nt, Homo sapiens
agaagcaccuguaugacau

SEQ ID NO: 1308747 - RNA, 19 nt, Homo sapiens
aagaugcuaugaugaagga

SEQ ID NO: 1308748 - RNA, 19 nt, Homo sapiens
gagggucgcagauguguuc

SEQ ID NO: 1308749 - RNA, 19 nt, Homo sapiens
ugaaggaggagcaguuguu

SEQ ID NO: 1308750 - RNA, 19 nt, Homo sapiens
ugaagaaggcucagaaugc

SEQ ID NO: 1308751 - RNA, 19 nt, Homo sapiens
ggucacaaguguccaaacg

SEQ ID NO: 1308752 - RNA, 19 nt, Homo sapiens
guaguccuccugccacaaa

SEQ ID NO: 1308753 - RNA, 19 nt, Homo sapiens
gcccagaaccucuacaucu

SEQ ID NO: 1308754 - RNA, 19 nt, Homo sapiens
gggaagaagcccacagaca

SEQ ID NO: 1308755 - RNA, 19 nt, Homo sapiens
caaagcaggcaacauugug

SEQ ID NO: 1308756 - RNA, 19 nt, Homo sapiens
aaagaccgguggcagaaag

SEQ ID NO: 1308757 - RNA, 19 nt, Homo sapiens
caggaagaauuaggauaug

SEQ ID NO: 1308758 - RNA, 19 nt, Homo sapiens
gaccagaaacacaggaugu

SEQ ID NO: 1308759 - RNA, 19 nt, Homo sapiens
gaaggaggagcaguuguuc

SEQ ID NO: 1308760 - RNA, 19 nt, Homo sapiens
ugaagcaggccuuggaguu

SEQ ID NO: 1308761 - RNA, 19 nt, Homo sapiens
gcaaaugcaggcgaccaaa

SEQ ID NO: 1308762 - RNA, 19 nt, Homo sapiens
ccaaagggcaagaagagau

SEQ ID NO: 1308763 - RNA, 19 nt, Homo sapiens
cgaggcugauggucaaugu

SEQ ID NO: 1308764 - RNA, 19 nt, Homo sapiens
gagagugccugagcagcau

SEQ ID NO: 1308765 - RNA, 19 nt, Homo sapiens
cuacccagcucucagacau

SEQ ID NO: 1308766 - RNA, 19 nt, Homo sapiens
gauccaaagggcaagaaga

SEQ ID NO: 1308767 - RNA, 19 nt, Homo sapiens
gaagcgaucaaccauguac

SEQ ID NO: 1308768 - RNA, 19 nt, Homo sapiens
gccauaaguacaucuucua

SEQ ID NO: 1308769 - RNA, 19 nt, Homo sapiens
gaaagcagagaccuaugag

SEQ ID NO: 1308770 - RNA, 19 nt, Homo sapiens
ccaaucugcucaccaaagc

SEQ ID NO: 1308771 - RNA, 19 nt, Homo sapiens
gcccuuaaccuccaaagca

SEQ ID NO: 1308772 - RNA, 19 nt, Homo sapiens
ggcagcagcggcagaagaa

SEQ ID NO: 1308773 - RNA, 19 nt, Homo sapiens
cuacaggucaggcagaaga

SEQ ID NO: 1308774 - RNA, 19 nt, Homo sapiens
gaagcaccuguaugacauu

SEQ ID NO: 1308775 - RNA, 19 nt, Homo sapiens
gccaaagaaaugcaaguug

SEQ ID NO: 1308776 - RNA, 19 nt, Homo sapiens
gugaguagcugaaguauuu

SEQ ID NO: 1308777 - RNA, 19 nt, Homo sapiens
gaaacaugcuuggaaauaa

SEQ ID NO: 1308778 - RNA, 19 nt, Homo sapiens
gaaagaugcugucuccaaa

SEQ ID NO: 1308779 - RNA, 19 nt, Homo sapiens
cauaggaucuguacuaauu

SEQ ID NO: 1308780 - RNA, 19 nt, Homo sapiens
gugaagaccugcaaacuaa

SEQ ID NO: 1308781 - RNA, 19 nt, Homo sapiens
uaaaugaacugugcaauga

SEQ ID NO: 1308782 - RNA, 19 nt, Homo sapiens
aaugaaggcuguuagauua

SEQ ID NO: 1308783 - RNA, 19 nt, Homo sapiens
ucagcaaacuuacuucuua

SEQ ID NO: 1308784 - RNA, 19 nt, Homo sapiens
caaaggugcuguggaaaua

SEQ ID NO: 1308785 - RNA, 19 nt, Homo sapiens
caagaaauguucaaaggaa

SEQ ID NO: 1308786 - RNA, 19 nt, Homo sapiens
caacauaggaucuguacua

SEQ ID NO: 1308787 - RNA, 19 nt, Homo sapiens
gcacggcaauggaacagua

SEQ ID NO: 1308788 - RNA, 19 nt, Homo sapiens
gaaguaaguuccuaaacau

SEQ ID NO: 1308789 - RNA, 19 nt, Homo sapiens
cuuaaugucugcaaacuua

SEQ ID NO: 1308790 - RNA, 19 nt, Homo sapiens
aaacuaacauggaagcuuu

SEQ ID NO: 1308791 - RNA, 19 nt, Homo sapiens
ugagagaaauguaagauga

SEQ ID NO: 1308792 - RNA, 19 nt, Homo sapiens
ggaaacaugcuuggaaaua

SEQ ID NO: 1308793 - RNA, 19 nt, Homo sapiens
gugcagaaaucauaaguga

SEQ ID NO: 1308794 - RNA, 19 nt, Homo sapiens
cuuaagaacugguaacaaa

SEQ ID NO: 1308795 - RNA, 19 nt, Homo sapiens
agaaggagguggcauuaaa

SEQ ID NO: 1308796 - RNA, 19 nt, Homo sapiens
cagcgacaaucaacaauuu

SEQ ID NO: 1308797 - RNA, 19 nt, Homo sapiens
gaaagaaggagguggcauu

SEQ ID NO: 1308798 - RNA, 19 nt, Homo sapiens
uaaagcuucuugucaguaa

SEQ ID NO: 1308799 - RNA, 19 nt, Homo sapiens
ggacgucuguaccaauauu

SEQ ID NO: 1308800 - RNA, 19 nt, Homo sapiens
gaaggaaacaugcuuggaa

SEQ ID NO: 1308801 - RNA, 19 nt, Homo sapiens
gaaauaaaggagcaagaaa

SEQ ID NO: 1308802 - RNA, 19 nt, Homo sapiens
gaagaccagugcagaaauc

SEQ ID NO: 1308803 - RNA, 19 nt, Homo sapiens
uaaccaggcucgugaacaa

SEQ ID NO: 1308804 - RNA, 19 nt, Homo sapiens
guaacaaacgugaacauuu

SEQ ID NO: 1308805 - RNA, 19 nt, Homo sapiens
caaagaaacaguuaugaug

SEQ ID NO: 1308806 - RNA, 19 nt, Homo sapiens
gcacagccuuggccagcua

SEQ ID NO: 1308807 - RNA, 19 nt, Homo sapiens
gaaacuugguugauucauc

SEQ ID NO: 1308808 - RNA, 19 nt, Homo sapiens
ggaccugcauccucaagaa

SEQ ID NO: 1308809 - RNA, 19 nt, Homo sapiens
uaaaugaggacaucaagaa

SEQ ID NO: 1308810 - RNA, 19 nt, Homo sapiens
ggaaagaugcugucuccaa

SEQ ID NO: 1308811 - RNA, 19 nt, Homo sapiens
aaacucugcugucauuauu

SEQ ID NO: 1308812 - RNA, 19 nt, Homo sapiens
ccaggugacugcuacauug

SEQ ID NO: 1308813 - RNA, 19 nt, Homo sapiens
uggaacacguuacaacaua

SEQ ID NO: 1308814 - RNA, 19 nt, Homo sapiens
cacauuauauuuccuguug

SEQ ID NO: 1308815 - RNA, 19 nt, Homo sapiens
gugaggagcuggugaucaa

SEQ ID NO: 1308816 - RNA, 19 nt, Homo sapiens
cagauguuaugccuuauuu

SEQ ID NO: 1308817 - RNA, 19 nt, Homo sapiens
guaccaauauugccagaau

SEQ ID NO: 1308818 - RNA, 19 nt, Homo sapiens
gcaggaaugagaagaauga

SEQ ID NO: 1308819 - RNA, 19 nt, Homo sapiens
ggacgcagaaauagaagua

SEQ ID NO: 1308820 - RNA, 19 nt, Homo sapiens
gcaagaagaggacgcagaa

SEQ ID NO: 1308821 - RNA, 19 nt, Homo sapiens
gcaagaaaugcauuaagaa

SEQ ID NO: 1308822 - RNA, 19 nt, Homo sapiens
aaucauaagugaagcaaga

SEQ ID NO: 1308823 - RNA, 19 nt, Homo sapiens
ugaaggcuguuagauuaua

SEQ ID NO: 1308824 - RNA, 19 nt, Homo sapiens
agaaguaaguuccuaaaca

SEQ ID NO: 1308825 - RNA, 19 nt, Homo sapiens
ggaacaacaucuuuaccau

SEQ ID NO: 1308826 - RNA, 19 nt, Homo sapiens
gcagaaaucauaagugaag

SEQ ID NO: 1308827 - RNA, 19 nt, Homo sapiens
ugaccacgcuggaauacaa

SEQ ID NO: 1308828 - RNA, 19 nt, Homo sapiens
agaagaggacgcagaaaua

SEQ ID NO: 1308829 - RNA, 19 nt, Homo sapiens
gaccagugcagaaaucaua

SEQ ID NO: 1308830 - RNA, 19 nt, Homo sapiens
caaugaaggcuguuagauu

SEQ ID NO: 1308831 - RNA, 19 nt, Homo sapiens
cagcuggccugcuugguuu

SEQ ID NO: 1308832 - RNA, 19 nt, Homo sapiens
caacaucuuuaccaucuca

SEQ ID NO: 1308833 - RNA, 19 nt, Homo sapiens
ggaucuguacuaauucuua

SEQ ID NO: 1308834 - RNA, 19 nt, Homo sapiens
gaaggcuguuagauuauau

SEQ ID NO: 1308835 - RNA, 19 nt, Homo sapiens
caucucaucucaagaaugg

SEQ ID NO: 1308836 - RNA, 19 nt, Homo sapiens
uaaaggagcaagaaauguu

SEQ ID NO: 1308837 - RNA, 19 nt, Homo sapiens
guaacaacauggauggaau

SEQ ID NO: 1308838 - RNA, 19 nt, Homo sapiens
ugagaaacuugguugauuc

SEQ ID NO: 1308839 - RNA, 19 nt, Homo sapiens
gcaaaggugcuguggaaau

SEQ ID NO: 1308840 - RNA, 19 nt, Homo sapiens
gaaguauucuccugaagac

SEQ ID NO: 1308841 - RNA, 19 nt, Homo sapiens
gacgaagucuuuuggaaua

SEQ ID NO: 1308842 - RNA, 19 nt, Homo sapiens
aagcugaccugcaagaaga

SEQ ID NO: 1308843 - RNA, 19 nt, Homo sapiens
cuaacaugaugcagauuaa

SEQ ID NO: 1308844 - RNA, 19 nt, Homo sapiens
caacacacucuuacucuug

SEQ ID NO: 1308845 - RNA, 19 nt, Homo sapiens
gcuauauauugcugaauug

SEQ ID NO: 1308846 - RNA, 19 nt, Homo sapiens
aaggacgucuguaccaaua

SEQ ID NO: 1308847 - RNA, 19 nt, Homo sapiens
gcgaagauuagaagaguaa

SEQ ID NO: 1308848 - RNA, 19 nt, Homo sapiens
gugucuaucugaagaauau

SEQ ID NO: 1308849 - RNA, 19 nt, Homo sapiens
cgccagggcucgcuuauuc

SEQ ID NO: 1308850 - RNA, 19 nt, Homo sapiens
gaacucacgucucccucau

SEQ ID NO: 1308851 - RNA, 19 nt, Homo sapiens
aaaguuaguggacuguuua

SEQ ID NO: 1308852 - RNA, 19 nt, Homo sapiens
gcaucaggauaucugcuuu

SEQ ID NO: 1308853 - RNA, 19 nt, Homo sapiens
uuccagauguuaugccuua

SEQ ID NO: 1308854 - RNA, 19 nt, Homo sapiens
agaaauagaaguagacgaa

SEQ ID NO: 1308855 - RNA, 19 nt, Homo sapiens
gaagaggacgcagaaauag

SEQ ID NO: 1308856 - RNA, 19 nt, Homo sapiens
gcaagaaauguucaaagga

SEQ ID NO: 1308857 - RNA, 19 nt, Homo sapiens
gagcugaaaccgaaaguuc

SEQ ID NO: 1308858 - RNA, 19 nt, Homo sapiens
gcagaagaccagugcagaa

SEQ ID NO: 1308859 - RNA, 19 nt, Homo sapiens
ggaacacguuacaacauag

SEQ ID NO: 1308860 - RNA, 19 nt, Homo sapiens
caagugaagaauuccauaa

SEQ ID NO: 1308861 - RNA, 19 nt, Homo sapiens
gagaaagggagcauccaaa

SEQ ID NO: 1308862 - RNA, 19 nt, Homo sapiens
gaagcaagaaaugcauuaa

SEQ ID NO: 1308863 - RNA, 19 nt, Homo sapiens
aaggaaacaugcuuggaaa

SEQ ID NO: 1308864 - RNA, 19 nt, Homo sapiens
caaagaagacaguggaauc

SEQ ID NO: 1308865 - RNA, 19 nt, Homo sapiens
gaaagaaggguaggcaaca

SEQ ID NO: 1308866 - RNA, 19 nt, Homo sapiens
uccaaacucugcugucauu

SEQ ID NO: 1308867 - RNA, 19 nt, Homo sapiens
agcaagaaaugcauuaaga

SEQ ID NO: 1308868 - RNA, 19 nt, Homo sapiens
uguuaugccuuauuucuga

SEQ ID NO: 1308869 - RNA, 19 nt, Homo sapiens
guaagaaguaaguuccuaa

SEQ ID NO: 1308870 - RNA, 19 nt, Homo sapiens
acaaauaaaugaggacauc

SEQ ID NO: 1308871 - RNA, 19 nt, Homo sapiens
uaaacuaguugauguuggu

SEQ ID NO: 1308872 - RNA, 19 nt, Homo sapiens
uauauuuccuguugagaga

SEQ ID NO: 1308873 - RNA, 19 nt, Homo sapiens
gcagaggacgugcucauca

SEQ ID NO: 1308874 - RNA, 19 nt, Homo sapiens
gaagaagcaggauuuaguc

SEQ ID NO: 1308875 - RNA, 19 nt, Homo sapiens
acaacuucaucaugcuuua

SEQ ID NO: 1308876 - RNA, 19 nt, Homo sapiens
ggacaaagauguagaagau

SEQ ID NO: 1308877 - RNA, 19 nt, Homo sapiens
gaagagaagucaacaugaa

SEQ ID NO: 1308878 - RNA, 19 nt, Homo sapiens
ccaauaagauaucaacuga

SEQ ID NO: 1308879 - RNA, 19 nt, Homo sapiens
ggaacaagauaucuagaug

SEQ ID NO: 1308880 - RNA, 19 nt, Homo sapiens
gaagaaccaaguuuaguuu

SEQ ID NO: 1308881 - RNA, 19 nt, Homo sapiens
uaaagcaguuuguacacua

SEQ ID NO: 1308882 - RNA, 19 nt, Homo sapiens
ugaggaagaugaaauuaug

SEQ ID NO: 1308883 - RNA, 19 nt, Homo sapiens
acaaagauguagaagauga

SEQ ID NO: 1308884 - RNA, 19 nt, Homo sapiens
gaacaagauaucuagauga

SEQ ID NO: 1308885 - RNA, 19 nt, Homo sapiens
guccagaucuuucuauuuc

SEQ ID NO: 1308886 - RNA, 19 nt, Homo sapiens
gaaauuaugaggucuaaag

SEQ ID NO: 1308887 - RNA, 19 nt, Homo sapiens
gggaaccuauguauuuaaa

SEQ ID NO: 1308888 - RNA, 19 nt, Homo sapiens
gugaaggaguuauauuuga

SEQ ID NO: 1308889 - RNA, 19 nt, Homo sapiens
gaagauccucagacaauuu

SEQ ID NO: 1308890 - RNA, 19 nt, Homo sapiens
gaauaguccuccaucacuu

SEQ ID NO: 1308891 - RNA, 19 nt, Homo sapiens
gaaccaaguuuaguuugug

SEQ ID NO: 1308892 - RNA, 19 nt, Homo sapiens
gaacaggagcauuauacaa

SEQ ID NO: 1308893 - RNA, 19 nt, Homo sapiens
ugacucaacuauacuauca

SEQ ID NO: 1308894 - RNA, 19 nt, Homo sapiens
aaauggaaaucaaccagua

SEQ ID NO: 1308895 - RNA, 19 nt, Homo sapiens
caacuauacuaucaccaaa

SEQ ID NO: 1308896 - RNA, 19 nt, Homo sapiens
cccaggaucuacacaguua

SEQ ID NO: 1308897 - RNA, 19 nt, Homo sapiens
caacaugaaucugggagaa

SEQ ID NO: 1308898 - RNA, 19 nt, Homo sapiens
gaguucuucucaccauuua

SEQ ID NO: 1308899 - RNA, 19 nt, Homo sapiens
gaaccaaaggaacauauau

SEQ ID NO: 1308900 - RNA, 19 nt, Homo sapiens
ugauaugucugaaagcaaa

SEQ ID NO: 1308901 - RNA, 19 nt, Homo sapiens
caucugaacuugauauguc

SEQ ID NO: 1308902 - RNA, 19 nt, Homo sapiens
gaacuugauaugucugaaa

SEQ ID NO: 1308903 - RNA, 19 nt, Homo sapiens
agaaugcgcuuauggaaca

SEQ ID NO: 1308904 - RNA, 19 nt, Homo sapiens
uauccuguaucacguauuu

SEQ ID NO: 1308905 - RNA, 19 nt, Homo sapiens
gugaugauuuggacauuga

SEQ ID NO: 1308906 - RNA, 19 nt, Homo sapiens
aagaugaacaggagcauua

SEQ ID NO: 1308907 - RNA, 19 nt, Homo sapiens
gaaucuagcauguugucua

SEQ ID NO: 1308908 - RNA, 19 nt, Homo sapiens
gaauuggugcuuuaccuuu

SEQ ID NO: 1308909 - RNA, 19 nt, Homo sapiens
acaugaaucugggagaaua

SEQ ID NO: 1308910 - RNA, 19 nt, Homo sapiens
ggaagagaagucaacauga

SEQ ID NO: 1308911 - RNA, 19 nt, Homo sapiens
gauguuuguuugaccauga

SEQ ID NO: 1308912 - RNA, 19 nt, Homo sapiens
cagaagauccucagacaau

SEQ ID NO: 1308913 - RNA, 19 nt, Homo sapiens
cuacacaguuagugaaaug

SEQ ID NO: 1308914 - RNA, 19 nt, Homo sapiens
ucaaauacaccaauaaugg

SEQ ID NO: 1308915 - RNA, 19 nt, Homo sapiens
gcagaguucuucucaccau

SEQ ID NO: 1308916 - RNA, 19 nt, Homo sapiens
ucagacaauuucagaaugu

SEQ ID NO: 1308917 - RNA, 19 nt, Homo sapiens
acugaaggacccuauauua

SEQ ID NO: 1308918 - RNA, 19 nt, Homo sapiens
ggauggugauugugaagga

SEQ ID NO: 1308919 - RNA, 19 nt, Homo sapiens
gaaaguuuagugaaccaaa

SEQ ID NO: 1308920 - RNA, 19 nt, Homo sapiens
aauuggugcuuuaccuuua

SEQ ID NO: 1308921 - RNA, 19 nt, Homo sapiens
caaauacaccaauaaugga

SEQ ID NO: 1308922 - RNA, 19 nt, Homo sapiens
ccucagacguaauguugaa

SEQ ID NO: 1308923 - RNA, 19 nt, Homo sapiens
guauuuaaaugugggagaa

SEQ ID NO: 1308924 - RNA, 19 nt, Homo sapiens
gaugguuguucuagcugua

SEQ ID NO: 1308925 - RNA, 19 nt, Homo sapiens
aaagcaguuuguacacuaa

SEQ ID NO: 1308926 - RNA, 19 nt, Homo sapiens
ugaagaaccaaguuuaguu

SEQ ID NO: 1308927 - RNA, 19 nt, Homo sapiens
gagaacgaauggaaaauau

SEQ ID NO: 1308928 - RNA, 19 nt, Homo sapiens
gaugaacaggagcauuaua

SEQ ID NO: 1308929 - RNA, 19 nt, Homo sapiens
gagagagaacgaauggaaa

SEQ ID NO: 1308930 - RNA, 19 nt, Homo sapiens
uaaggauggugauugugaa

SEQ ID NO: 1308931 - RNA, 19 nt, Homo sapiens
gcgcuuauggaacaagaua

SEQ ID NO: 1308932 - RNA, 19 nt, Homo sapiens
uaugaggucuaaagaaagu

SEQ ID NO: 1308933 - RNA, 19 nt, Homo sapiens
gaacgaauggaaaauauug

SEQ ID NO: 1308934 - RNA, 19 nt, Homo sapiens
ugagagagaacgaauggaa

SEQ ID NO: 1308935 - RNA, 19 nt, Homo sapiens
cgcaagauuuauauccuaa

SEQ ID NO: 1308936 - RNA, 19 nt, Homo sapiens
gaucuacacaguuagugaa

SEQ ID NO: 1308937 - RNA, 19 nt, Homo sapiens
ucgcaagauuuauauccua

SEQ ID NO: 1308938 - RNA, 19 nt, Homo sapiens
gcaagcauucuccucauuc

SEQ ID NO: 1308939 - RNA, 19 nt, Homo sapiens
guuaugaugcuuuacagaa

SEQ ID NO: 1308940 - RNA, 19 nt, Homo sapiens
gaaauggaugcuaggaugu

SEQ ID NO: 1308941 - RNA, 19 nt, Homo sapiens
cccuaacucugaagaugua

SEQ ID NO: 1308942 - RNA, 19 nt, Homo sapiens
ccauuuaacuggcucuuuu

SEQ ID NO: 1308943 - RNA, 19 nt, Homo sapiens
gagaaaguuuagugaacca

SEQ ID NO: 1308944 - RNA, 19 nt, Homo sapiens
gccuuuaccuaaugauguu

SEQ ID NO: 1308945 - RNA, 19 nt, Homo sapiens
gcuucuagcaguuucagua

SEQ ID NO: 1308946 - RNA, 19 nt, Homo sapiens
guucuucucaccauuuaaa

SEQ ID NO: 1308947 - RNA, 19 nt, Homo sapiens
gaugaaauuaugaggucua

SEQ ID NO: 1308948 - RNA, 19 nt, Homo sapiens
agaagauccucagacaauu

SEQ ID NO: 1308949 - RNA, 19 nt, Homo sapiens
gcuaggauguuaugaugcu

SEQ ID NO: 1308950 - RNA, 19 nt, Homo sapiens
aaacugaaggacccuauau

SEQ ID NO: 1308951 - RNA, 19 nt, Homo sapiens
gaaaucaaccaguaaaauc

SEQ ID NO: 1308952 - RNA, 19 nt, Homo sapiens
gaagaugaacaggagcauu

SEQ ID NO: 1308953 - RNA, 19 nt, Homo sapiens
aggauguuaugaugcuuua

SEQ ID NO: 1308954 - RNA, 19 nt, Homo sapiens
aauggaugcuaggauguua

SEQ ID NO: 1308955 - RNA, 19 nt, Homo sapiens
ucacuuugauucuucuagu

SEQ ID NO: 1308956 - RNA, 19 nt, Homo sapiens
gaggaagaugaaauuauga

SEQ ID NO: 1308957 - RNA, 19 nt, Homo sapiens
agaaccaaguuuaguuugu

SEQ ID NO: 1308958 - RNA, 19 nt, Homo sapiens
ccagaaugcgcuuauggaa

SEQ ID NO: 1308959 - RNA, 19 nt, Homo sapiens
cucugaagauguauaugua

SEQ ID NO: 1308960 - RNA, 19 nt, Homo sapiens
ugaaccaaaggaacauaua

SEQ ID NO: 1308961 - RNA, 19 nt, Homo sapiens
ucccaugagugcacuggua

SEQ ID NO: 1308962 - RNA, 19 nt, Homo sapiens
cggaagagaagucaacaug

SEQ ID NO: 1308963 - RNA, 19 nt, Homo sapiens
caaagaaaaucggaagaga

SEQ ID NO: 1308964 - RNA, 19 nt, Homo sapiens
uauauuucccuaacucuga

SEQ ID NO: 1308965 - RNA, 19 nt, Homo sapiens
uaaacugaaggacccuaua

SEQ ID NO: 1308966 - RNA, 19 nt, Homo sapiens
ccacucauggacuucauaa

SEQ ID NO: 1308967 - RNA, 19 nt, Homo sapiens
cccagaagauccucagaca

SEQ ID NO: 1308968 - RNA, 19 nt, Homo sapiens
gucauugugcuguuauuaa

SEQ ID NO: 1308969 - RNA, 19 nt, Homo sapiens
gagauaaauccaauagaac

SEQ ID NO: 1308970 - RNA, 19 nt, Homo sapiens
cugaaggacccuauauuau

SEQ ID NO: 1308971 - RNA, 19 nt, Homo sapiens
ggaucuacacaguuaguga

SEQ ID NO: 1308972 - RNA, 19 nt, Homo sapiens
gugaggaagaugaaauuau

SEQ ID NO: 1308973 - RNA, 19 nt, Homo sapiens
aaguuuaguuugugaggaa

SEQ ID NO: 1308974 - RNA, 19 nt, Homo sapiens
gagggacaaagauguagaa

SEQ ID NO: 1308975 - RNA, 19 nt, Homo sapiens
uuaaggauggugauuguga

SEQ ID NO: 1308976 - RNA, 19 nt, Homo sapiens
gcaaggagcugcagagaau

SEQ ID NO: 1308977 - RNA, 19 nt, Homo sapiens
gaaauccuccgcugcauua

SEQ ID NO: 1308978 - RNA, 19 nt, Homo sapiens
uaaagaaccuucaaguuuc

SEQ ID NO: 1308979 - RNA, 19 nt, Homo sapiens
gaaaggagcagcccaggaa

SEQ ID NO: 1308980 - RNA, 19 nt, Homo sapiens
ccacaaagccucuggacua

SEQ ID NO: 1308981 - RNA, 19 nt, Homo sapiens
gaaggagagucaaagcaaa

SEQ ID NO: 1308982 - RNA, 19 nt, Homo sapiens
gcaagaagcacaaggcaaa

SEQ ID NO: 1308983 - RNA, 19 nt, Homo sapiens
ggaaaguacuggagagcaa

SEQ ID NO: 1308984 - RNA, 19 nt, Homo sapiens
ggaagagccugaaccuguu

SEQ ID NO: 1308985 - RNA, 19 nt, Homo sapiens
ggcaaaggaugacaagaaa

SEQ ID NO: 1308986 - RNA, 19 nt, Homo sapiens
gaauaacuccgaccagauu

SEQ ID NO: 1308987 - RNA, 19 nt, Homo sapiens
uaaagaagccagugaguga

SEQ ID NO: 1308988 - RNA, 19 nt, Homo sapiens
agaaggagaccaucuauuu

SEQ ID NO: 1308989 - RNA, 19 nt, Homo sapiens
gaaugugccugaagagcaa

SEQ ID NO: 1308990 - RNA, 19 nt, Homo sapiens
gagaaggccucugugaaug

SEQ ID NO: 1308991 - RNA, 19 nt, Homo sapiens
gaacccauccuacucuauu

SEQ ID NO: 1308992 - RNA, 19 nt, Homo sapiens
ggagucgacuggaauacuu

SEQ ID NO: 1308993 - RNA, 19 nt, Homo sapiens
gaaggagaccaucuauuug

SEQ ID NO: 1308994 - RNA, 19 nt, Homo sapiens
ugaagacacagcauacuua

SEQ ID NO: 1308995 - RNA, 19 nt, Homo sapiens
caacacauuccucgccuua

SEQ ID NO: 1308996 - RNA, 19 nt, Homo sapiens
gaagauaaacgugucauca

SEQ ID NO: 1308997 - RNA, 19 nt, Homo sapiens
gaacaacccacacccacaa

SEQ ID NO: 1308998 - RNA, 19 nt, Homo sapiens
gaucggagucuguuucuga

SEQ ID NO: 1308999 - RNA, 19 nt, Homo sapiens
acaaggagaugacauucuu

SEQ ID NO: 1309000 - RNA, 19 nt, Homo sapiens
agacaaagaagacaagaaa

SEQ ID NO: 1309001 - RNA, 19 nt, Homo sapiens
gagaccaucuauuugaaug

SEQ ID NO: 1309002 - RNA, 19 nt, Homo sapiens
ugaagucucuaaagaagga

SEQ ID NO: 1309003 - RNA, 19 nt, Homo sapiens
gaagagccugaaccuguua

SEQ ID NO: 1309004 - RNA, 19 nt, Homo sapiens
ccucaucucugcugaagga

SEQ ID NO: 1309005 - RNA, 19 nt, Homo sapiens
caugaagucucuaaagaag

SEQ ID NO: 1309006 - RNA, 19 nt, Homo sapiens
uaucauccguaaacucaaa

SEQ ID NO: 1309007 - RNA, 19 nt, Homo sapiens
ugugaaugcugagcuguua

SEQ ID NO: 1309008 - RNA, 19 nt, Homo sapiens
cagggaagcuccucugaag

SEQ ID NO: 1309009 - RNA, 19 nt, Homo sapiens
ccaagcaaccuucuggaaa

SEQ ID NO: 1309010 - RNA, 19 nt, Homo sapiens
gcaguaauccacaggacaa

SEQ ID NO: 1309011 - RNA, 19 nt, Homo sapiens
acacagcccugcggaagaa

SEQ ID NO: 1309012 - RNA, 19 nt, Homo sapiens
caaaggaugacaagaaagu

SEQ ID NO: 1309013 - RNA, 19 nt, Homo sapiens
gaucaaagacaaagaagac

SEQ ID NO: 1309014 - RNA, 19 nt, Homo sapiens
caaagccucuggacuacuc

SEQ ID NO: 1309015 - RNA, 19 nt, Homo sapiens
caagcaaccuucuggaaaa

SEQ ID NO: 1309016 - RNA, 19 nt, Homo sapiens
caaagaagacaagaaagga

SEQ ID NO: 1309017 - RNA, 19 nt, Homo sapiens
gagcuguuaccacgcuuua

SEQ ID NO: 1309018 - RNA, 19 nt, Homo sapiens
acauuuaccuucuucuuca

SEQ ID NO: 1309019 - RNA, 19 nt, Homo sapiens
ccucagagaaugucaaaga

SEQ ID NO: 1309020 - RNA, 19 nt, Homo sapiens
ggagucuguuucugaucua

SEQ ID NO: 1309021 - RNA, 19 nt, Homo sapiens
gaagguaccuguggggaaa

SEQ ID NO: 1309022 - RNA, 19 nt, Homo sapiens
gaaggauucccgccucaga

SEQ ID NO: 1309023 - RNA, 19 nt, Homo sapiens
gaagacacagcauacuuag

SEQ ID NO: 1309024 - RNA, 19 nt, Homo sapiens
gauuucagccagcaggaua

SEQ ID NO: 1309025 - RNA, 19 nt, Homo sapiens
uggaagagcuggauuucag

SEQ ID NO: 1309026 - RNA, 19 nt, Homo sapiens
caauaaagaaccuucaagu

SEQ ID NO: 1309027 - RNA, 19 nt, Homo sapiens
ggacagguuuucuuuggaa

SEQ ID NO: 1309028 - RNA, 19 nt, Homo sapiens
gaccaucuauuugaaugug

SEQ ID NO: 1309029 - RNA, 19 nt, Homo sapiens
ugauggugcucccugauga

SEQ ID NO: 1309030 - RNA, 19 nt, Homo sapiens
gcaccguggccauuuggua

SEQ ID NO: 1309031 - RNA, 19 nt, Homo sapiens
gagaaggagaccaucuauu

SEQ ID NO: 1309032 - RNA, 19 nt, Homo sapiens
gagaaaaccuccucagaac

SEQ ID NO: 1309033 - RNA, 19 nt, Homo sapiens
gcugcucacuugaccuuug

SEQ ID NO: 1309034 - RNA, 19 nt, Homo sapiens
ugggauugcugcucacuug

SEQ ID NO: 1309035 - RNA, 19 nt, Homo sapiens
gucaucacccagaaauuua

SEQ ID NO: 1309036 - RNA, 19 nt, Homo sapiens
ggaaaacggguuaauaaau

SEQ ID NO: 1309037 - RNA, 19 nt, Homo sapiens
cagagaaugucaaagaaaa

SEQ ID NO: 1309038 - RNA, 19 nt, Homo sapiens
ccaugaagucucuaaagaa

SEQ ID NO: 1309039 - RNA, 19 nt, Homo sapiens
ugucaucacccagaaauuu

SEQ ID NO: 1309040 - RNA, 19 nt, Homo sapiens
ccaagcugcucgggaaaga

SEQ ID NO: 1309041 - RNA, 19 nt, Homo sapiens
ggaggaaagcccagaugug

SEQ ID NO: 1309042 - RNA, 19 nt, Homo sapiens
gcaagcugacugcccauga

SEQ ID NO: 1309043 - RNA, 19 nt, Homo sapiens
cagcauacuuaggcacauu

SEQ ID NO: 1309044 - RNA, 19 nt, Homo sapiens
guucuggagucgacuggaa

SEQ ID NO: 1309045 - RNA, 19 nt, Homo sapiens
aaggagaccaucuauuuga

SEQ ID NO: 1309046 - RNA, 19 nt, Homo sapiens
ucagagaaugucaaagaaa

SEQ ID NO: 1309047 - RNA, 19 nt, Homo sapiens
caacccacacccacaauuc

SEQ ID NO: 1309048 - RNA, 19 nt, Homo sapiens
aaaaucaccuccuaucaug

SEQ ID NO: 1309049 - RNA, 19 nt, Homo sapiens
cagagaggaugcguugaug

SEQ ID NO: 1309050 - RNA, 19 nt, Homo sapiens
ucuauuaggaggugcuaua

SEQ ID NO: 1309051 - RNA, 19 nt, Homo sapiens
aacccauccuacucuauua

SEQ ID NO: 1309052 - RNA, 19 nt, Homo sapiens
caaccgggaaggugugauu

SEQ ID NO: 1309053 - RNA, 19 nt, Homo sapiens
accaugaagucucuaaaga

SEQ ID NO: 1309054 - RNA, 19 nt, Homo sapiens
ugaaggagagucaaagcaa

SEQ ID NO: 1309055 - RNA, 19 nt, Homo sapiens
uaagagaauugcacuugcu

SEQ ID NO: 1309056 - RNA, 19 nt, Homo sapiens
auucuugccuuggccauua

SEQ ID NO: 1309057 - RNA, 19 nt, Homo sapiens
gaucagaggcaguaaucca

SEQ ID NO: 1309058 - RNA, 19 nt, Homo sapiens
uggaauacuugggagauga

SEQ ID NO: 1309059 - RNA, 19 nt, Homo sapiens
gagcucagccccauaaaga

SEQ ID NO: 1309060 - RNA, 19 nt, Homo sapiens
gccugaaccuguuagcaau

SEQ ID NO: 1309061 - RNA, 19 nt, Homo sapiens
ugaugguccuggcugauga

SEQ ID NO: 1309062 - RNA, 19 nt, Homo sapiens
ggagaccaucuauuugaau

SEQ ID NO: 1309063 - RNA, 19 nt, Homo sapiens
ccauguggcugaggucugu

SEQ ID NO: 1309064 - RNA, 19 nt, Homo sapiens
gcaaagggaccugaacaac

SEQ ID NO: 1309065 - RNA, 19 nt, Homo sapiens
ggaagcuccucugaagaca

SEQ ID NO: 1309066 - RNA, 19 nt, Homo sapiens
uuagaggccucagagaaug

SEQ ID NO: 1309067 - RNA, 19 nt, Homo sapiens
aggcaaaggaugacaagaa

SEQ ID NO: 1309068 - RNA, 19 nt, Homo sapiens
gaaggaggagcggaaagga

SEQ ID NO: 1309069 - RNA, 19 nt, Homo sapiens
gauguggacagcaccaaga

SEQ ID NO: 1309070 - RNA, 19 nt, Homo sapiens
uaacuccgaccagauuauu

SEQ ID NO: 1309071 - RNA, 19 nt, Homo sapiens
caagcugacugcccaugag

SEQ ID NO: 1309072 - RNA, 19 nt, Homo sapiens
caagaggcagguugggauu

SEQ ID NO: 1309073 - RNA, 19 nt, Homo sapiens
gcccuucucugcuguucug

SEQ ID NO: 1309074 - RNA, 19 nt, Homo sapiens
ucagcgaacaccuaaagaa

SEQ ID NO: 1309075 - RNA, 19 nt, Homo sapiens
uaagaaggaagacuugaag

SEQ ID NO: 1309076 - RNA, 19 nt, Homo sapiens
ugacagauauggcugauua

SEQ ID NO: 1309077 - RNA, 19 nt, Homo sapiens
gcacagagcagcaugauuu

SEQ ID NO: 1309078 - RNA, 19 nt, Homo sapiens
gagcggagguguaaauaaa

SEQ ID NO: 1309079 - RNA, 19 nt, Homo sapiens
ucacagagauggacaacaa

SEQ ID NO: 1309080 - RNA, 19 nt, Homo sapiens
uaaagacgcuagccaaaga

SEQ ID NO: 1309081 - RNA, 19 nt, Homo sapiens
gagcaggacuggcagaaga

SEQ ID NO: 1309082 - RNA, 19 nt, Homo sapiens
gagacaaccuggugcauau

SEQ ID NO: 1309083 - RNA, 19 nt, Homo sapiens
gcacaggucagcaugauuu

SEQ ID NO: 1309084 - RNA, 19 nt, Homo sapiens
uagagaagcuauucaaaga

SEQ ID NO: 1309085 - RNA, 19 nt, Homo sapiens
ccacagagcgcccagauuu

SEQ ID NO: 1309086 - RNA, 19 nt, Homo sapiens
gguccaaccuggcagauuu

SEQ ID NO: 1309087 - RNA, 19 nt, Homo sapiens
cagaaacacuuaugggauu

SEQ ID NO: 1309088 - RNA, 19 nt, Homo sapiens
gaccauaccuccugaacug

SEQ ID NO: 1309089 - RNA, 19 nt, Homo sapiens
gagaagcuauucaaagauc

SEQ ID NO: 1309090 - RNA, 19 nt, Homo sapiens
gaauggaucaguaugguuu

SEQ ID NO: 1309091 - RNA, 19 nt, Homo sapiens
gguacaaccuggugcauau

SEQ ID NO: 1309092 - RNA, 19 nt, Homo sapiens
ggagcgaagucucgaguga

SEQ ID NO: 1309093 - RNA, 19 nt, Homo sapiens
gaauggaucagucugguuu

SEQ ID NO: 1309094 - RNA, 19 nt, Homo sapiens
gaauggaucagucugguuu

SEQ ID NO: 1309095 - RNA, 19 nt, Homo sapiens
gcaacuggcuucauacaac

SEQ ID NO: 1309096 - RNA, 19 nt, Homo sapiens
gagcagguccggcagcaua

SEQ ID NO: 1309097 - RNA, 19 nt, Homo sapiens
ggaagggaaucaagaagca

SEQ ID NO: 1309098 - RNA, 19 nt, Homo sapiens
guggagacauuucaucuga

SEQ ID NO: 1309099 - RNA, 19 nt, Homo sapiens
cgagugaaguccugaguga

SEQ ID NO: 1309100 - RNA, 19 nt, Homo sapiens
guagagaucagcaugguuu

SEQ ID NO: 1309101 - RNA, 19 nt, Homo sapiens
ggugcaaccugguauaguu

SEQ ID NO: 1309102 - RNA, 19 nt, Homo sapiens
gcagagaccagcaaggauu

SEQ ID NO: 1309103 - RNA, 19 nt, Homo sapiens
caccguggcugacauagaa

SEQ ID NO: 1309104 - RNA, 19 nt, Homo sapiens
ucaaagaucgggagcaauu

SEQ ID NO: 1309105 - RNA, 19 nt, Homo sapiens
gauccaaccuggugcagau

SEQ ID NO: 1309106 - RNA, 19 nt, Homo sapiens
gguacaaccuggugccuau

SEQ ID NO: 1309107 - RNA, 19 nt, Homo sapiens
gguccaaccuggugcaguu

SEQ ID NO: 1309108 - RNA, 19 nt, Homo sapiens
ggcacaaccuggugaaguu

SEQ ID NO: 1309109 - RNA, 19 nt, Homo sapiens
acaaacgggugacagauau

SEQ ID NO: 1309110 - RNA, 19 nt, Homo sapiens
ccaagaugcugaugaacau

SEQ ID NO: 1309111 - RNA, 19 nt, Homo sapiens
uaaaggagaguaugaagga

SEQ ID NO: 1309112 - RNA, 19 nt, Homo sapiens
gaucagcguggauguguaa

SEQ ID NO: 1309113 - RNA, 19 nt, Homo sapiens
gcagcuggguguccucaga

SEQ ID NO: 1309114 - RNA, 19 nt, Homo sapiens
ggacauugcuaugcuguac

SEQ ID NO: 1309115 - RNA, 19 nt, Homo sapiens
guacguccauaucaacaug

SEQ ID NO: 1309116 - RNA, 19 nt, Homo sapiens
ggaauaggucagcaaggua

SEQ ID NO: 1309117 - RNA, 19 nt, Homo sapiens
gcguggauguguaauauca

SEQ ID NO: 1309118 - RNA, 19 nt, Homo sapiens
cagcguggauguguaauau

SEQ ID NO: 1309119 - RNA, 19 nt, Homo sapiens
ggacugggaguaucaugaa

SEQ ID NO: 1309120 - RNA, 19 nt, Homo sapiens
gaccgagucuuaucagaag

SEQ ID NO: 1309121 - RNA, 19 nt, Homo sapiens
gaauaggucagcaagguau

SEQ ID NO: 1309122 - RNA, 19 nt, Homo sapiens
ggcaucaccugguauagau

SEQ ID NO: 1309123 - RNA, 19 nt, Homo sapiens
gugcagaucagcaugguuu

SEQ ID NO: 1309124 - RNA, 19 nt, Homo sapiens
gugcagaucagcaugguuu

SEQ ID NO: 1309125 - RNA, 19 nt, Homo sapiens
gugcagaucagcaagguuu

SEQ ID NO: 1309126 - RNA, 19 nt, Homo sapiens
gggaauugauaccauuugu

SEQ ID NO: 1309127 - RNA, 19 nt, Homo sapiens
gggagcaccuggagaugga

SEQ ID NO: 1309128 - RNA, 19 nt, Homo sapiens
gcgagaagcucaacaucac

SEQ ID NO: 1309129 - RNA, 19 nt, Homo sapiens
gauuacaccuacucaacug

SEQ ID NO: 1309130 - RNA, 19 nt, Homo sapiens
ggaaaauucugucucugaa

SEQ ID NO: 1309131 - RNA, 19 nt, Homo sapiens
aaaaggagcuggccgaguu

SEQ ID NO: 1309132 - RNA, 19 nt, Homo sapiens
gguccaaccuggugcagau

SEQ ID NO: 1309133 - RNA, 19 nt, Homo sapiens
gguccaaccuggugcagau

SEQ ID NO: 1309134 - RNA, 19 nt, Homo sapiens
gguccaaccuggugcagau

SEQ ID NO: 1309135 - RNA, 19 nt, Homo sapiens
ggucuggccuggaauggau

SEQ ID NO: 1309136 - RNA, 19 nt, Homo sapiens
gguccaaccuggugcagau

SEQ ID NO: 1309137 - RNA, 19 nt, Homo sapiens
gcacagaccaacgcaguau

SEQ ID NO: 1309138 - RNA, 19 nt, Homo sapiens
ggaucaguaugguuugaga

SEQ ID NO: 1309139 - RNA, 19 nt, Homo sapiens
gugcagaucagccugguuu

SEQ ID NO: 1309140 - RNA, 19 nt, Homo sapiens
gaucgggaauugauaccau

SEQ ID NO: 1309141 - RNA, 19 nt, Homo sapiens
cagaagaagucaccauggu

SEQ ID NO: 1309142 - RNA, 19 nt, Homo sapiens
gcuaugagcaacuccaaga

SEQ ID NO: 1309143 - RNA, 19 nt, Homo sapiens
uggaaaggcugcagaggau

SEQ ID NO: 1309144 - RNA, 19 nt, Homo sapiens
gaccagguauacccagaug

SEQ ID NO: 1309145 - RNA, 19 nt, Homo sapiens
caacauggccugguucuac

SEQ ID NO: 1309146 - RNA, 19 nt, Homo sapiens
guauagaccagcaaggauu

SEQ ID NO: 1309147 - RNA, 19 nt, Homo sapiens
caacaccucagaaagauag

SEQ ID NO: 1309148 - RNA, 19 nt, Homo sapiens
gaacuagagaagcuauuca

SEQ ID NO: 1309149 - RNA, 19 nt, Homo sapiens
gcggagguguaaauaaaca

SEQ ID NO: 1309150 - RNA, 19 nt, Homo sapiens
ggcaacaccucagaaagau

SEQ ID NO: 1309151 - RNA, 19 nt, Homo sapiens
guaugaaggaucuggauga

SEQ ID NO: 1309152 - RNA, 19 nt, Homo sapiens
ggaucagcguggaugugua

SEQ ID NO: 1309153 - RNA, 19 nt, Homo sapiens
gcaacaccucagaaagaua

SEQ ID NO: 1309154 - RNA, 19 nt, Homo sapiens
gguuuggcaucaccuggua

SEQ ID NO: 1309155 - RNA, 19 nt, Homo sapiens
caacauuccaggcagauuc

SEQ ID NO: 1309156 - RNA, 19 nt, Homo sapiens
gaguggaucagcaugguuu

SEQ ID NO: 1309157 - RNA, 19 nt, Homo sapiens
gugcauaucagcaugguau

SEQ ID NO: 1309158 - RNA, 19 nt, Homo sapiens
agaaccaacuggcaugaau

SEQ ID NO: 1309159 - RNA, 19 nt, Homo sapiens
gccagaucgucguggguua

SEQ ID NO: 1309160 - RNA, 19 nt, Homo sapiens
aaacagaaggacauugcua

SEQ ID NO: 1309161 - RNA, 19 nt, Homo sapiens
caaaccgacuuggagaaga

SEQ ID NO: 1309162 - RNA, 19 nt, Homo sapiens
gaaguucagcguaguuugg

SEQ ID NO: 1309163 - RNA, 19 nt, Homo sapiens
cgacacaaccaagaagaaa

SEQ ID NO: 1309164 - RNA, 19 nt, Homo sapiens
ccaucagucuucuacauuc

SEQ ID NO: 1309165 - RNA, 19 nt, Homo sapiens
ucagugagcggagguguaa

SEQ ID NO: 1309166 - RNA, 19 nt, Homo sapiens
agauggagaucgaugugaa

SEQ ID NO: 1309167 - RNA, 19 nt, Homo sapiens
gacaagcucaggaugauca

SEQ ID NO: 1309168 - RNA, 19 nt, Homo sapiens
aaaccgacuuggagaagau

SEQ ID NO: 1309169 - RNA, 19 nt, Homo sapiens
gugccuauccucuugguuu

SEQ ID NO: 1309170 - RNA, 19 nt, Homo sapiens
gguuuggucuggccuggaa

SEQ ID NO: 1309171 - RNA, 19 nt, Homo sapiens
ggaggguucacuuccuuaa

SEQ ID NO: 1309172 - RNA, 19 nt, Homo sapiens
ggagguguaaauaaacauu

SEQ ID NO: 1309173 - RNA, 19 nt, Homo sapiens
gacgcuagccaaagaaguu

SEQ ID NO: 1309174 - RNA, 19 nt, Homo sapiens
agaaacacuuaugggauuu

SEQ ID NO: 1309175 - RNA, 19 nt, Homo sapiens
gggcuaaaggagaguauga

SEQ ID NO: 1309176 - RNA, 19 nt, Homo sapiens
ggaaguagcuuugucaaua

SEQ ID NO: 1309177 - RNA, 19 nt, Homo sapiens
gaaguagcuuugucaauaa

SEQ ID NO: 1309178 - RNA, 19 nt, Homo sapiens
gaagaugcccugaaacaua

SEQ ID NO: 1309179 - RNA, 19 nt, Homo sapiens
gaaugugucuacagaauuu

SEQ ID NO: 1309180 - RNA, 19 nt, Homo sapiens
ccagcaaacugauguaaua

SEQ ID NO: 1309181 - RNA, 19 nt, Homo sapiens
ggaagaacauacuuuagaa

SEQ ID NO: 1309182 - RNA, 19 nt, Homo sapiens
ggagaauucuguuaaaguu

SEQ ID NO: 1309183 - RNA, 19 nt, Homo sapiens
gaacaacagacauacuuua

SEQ ID NO: 1309184 - RNA, 19 nt, Homo sapiens
aaacauaccuucaguucaa

SEQ ID NO: 1309185 - RNA, 19 nt, Homo sapiens
gacaggaaaugacuaguaa

SEQ ID NO: 1309186 - RNA, 19 nt, Homo sapiens
ggaaugcaauagcuuauga

SEQ ID NO: 1309187 - RNA, 19 nt, Homo sapiens
gcaagaaauucgaaagaga

SEQ ID NO: 1309188 - RNA, 19 nt, Homo sapiens
caacagacauacuuuagug

SEQ ID NO: 1309189 - RNA, 19 nt, Homo sapiens
uagagaagcugcuauugaa

SEQ ID NO: 1309190 - RNA, 19 nt, Homo sapiens
gaaguucaaucuccauuag

SEQ ID NO: 1309191 - RNA, 19 nt, Homo sapiens
aaaggaagaugcccugaaa

SEQ ID NO: 1309192 - RNA, 19 nt, Homo sapiens
caacaagaguguaguaugg

SEQ ID NO: 1309193 - RNA, 19 nt, Homo sapiens
ccagauaguucuucuacaa

SEQ ID NO: 1309194 - RNA, 19 nt, Homo sapiens
ggaagaaagugaugacucu

SEQ ID NO: 1309195 - RNA, 19 nt, Homo sapiens
gagaaugugucuacagaau

SEQ ID NO: 1309196 - RNA, 19 nt, Homo sapiens
ggacaggaaaugacuagua

SEQ ID NO: 1309197 - RNA, 19 nt, Homo sapiens
gaagcucggucuccacuau

SEQ ID NO: 1309198 - RNA, 19 nt, Homo sapiens
ugaagaggcuccuagagaa

SEQ ID NO: 1309199 - RNA, 19 nt, Homo sapiens
gagaaagcauggacaggaa

SEQ ID NO: 1309200 - RNA, 19 nt, Homo sapiens
gcaaaucccagcaaacuga

SEQ ID NO: 1309201 - RNA, 19 nt, Homo sapiens
gaagaggccucagcuaaag

SEQ ID NO: 1309202 - RNA, 19 nt, Homo sapiens
aaagucagcugauguuaga

SEQ ID NO: 1309203 - RNA, 19 nt, Homo sapiens
ugaaaucacuacucuuaga

SEQ ID NO: 1309204 - RNA, 19 nt, Homo sapiens
gaacuguagucagguugua

SEQ ID NO: 1309205 - RNA, 19 nt, Homo sapiens
ucaauucuguccuuaaaga

SEQ ID NO: 1309206 - RNA, 19 nt, Homo sapiens
cagcaaacuuggacaaaga

SEQ ID NO: 1309207 - RNA, 19 nt, Homo sapiens
gaagcucagucuccacuau

SEQ ID NO: 1309208 - RNA, 19 nt, Homo sapiens
gaagagacccuugcugaug

SEQ ID NO: 1309209 - RNA, 19 nt, Homo sapiens
aagaugcccugaaacauaa

SEQ ID NO: 1309210 - RNA, 19 nt, Homo sapiens
agaaguaacuguaccuguu

SEQ ID NO: 1309211 - RNA, 19 nt, Homo sapiens
gaagaggccuccguugaca

SEQ ID NO: 1309212 - RNA, 19 nt, Homo sapiens
agaagaggcucgagaacuu

SEQ ID NO: 1309213 - RNA, 19 nt, Homo sapiens
caacaaacagcaaugaaga

SEQ ID NO: 1309214 - RNA, 19 nt, Homo sapiens
gagaagcugcuauugaauu

SEQ ID NO: 1309215 - RNA, 19 nt, Homo sapiens
gcaaacugauguaauagag

SEQ ID NO: 1309216 - RNA, 19 nt, Homo sapiens
cagcagaacuucauuuacu

SEQ ID NO: 1309217 - RNA, 19 nt, Homo sapiens
cagaagaggcuccuacuga

SEQ ID NO: 1309218 - RNA, 19 nt, Homo sapiens
uagaguaucuucugagcuu

SEQ ID NO: 1309219 - RNA, 19 nt, Homo sapiens
guacagccaucaacugaag

SEQ ID NO: 1309220 - RNA, 19 nt, Homo sapiens
gagccuccaucaacagaaa

SEQ ID NO: 1309221 - RNA, 19 nt, Homo sapiens
gaaaucacuacucuuagaa

SEQ ID NO: 1309222 - RNA, 19 nt, Homo sapiens
agaagaggcucaugcugaa

SEQ ID NO: 1309223 - RNA, 19 nt, Homo sapiens
agaagaggcuccuacugaa

SEQ ID NO: 1309224 - RNA, 19 nt, Homo sapiens
gcuauugaauugccagaga

SEQ ID NO: 1309225 - RNA, 19 nt, Homo sapiens
gaauuucagucuccauuac

SEQ ID NO: 1309226 - RNA, 19 nt, Homo sapiens
gaaauagagccuccaucaa

SEQ ID NO: 1309227 - RNA, 19 nt, Homo sapiens
gaaauuccaccaaacauac

SEQ ID NO: 1309228 - RNA, 19 nt, Homo sapiens
caagaaauucgaaagagaa

SEQ ID NO: 1309229 - RNA, 19 nt, Homo sapiens
gaaguaacuguaccuguug

SEQ ID NO: 1309230 - RNA, 19 nt, Homo sapiens
gaaauucgaaagagaagau

SEQ ID NO: 1309231 - RNA, 19 nt, Homo sapiens
agaagaggcuccugcugaa

SEQ ID NO: 1309232 - RNA, 19 nt, Homo sapiens
agaagaggcuccugcugaa

SEQ ID NO: 1309233 - RNA, 19 nt, Homo sapiens
gcccagaccugcugaagag

SEQ ID NO: 1309234 - RNA, 19 nt, Homo sapiens
aagaugagcuuagggaaga

SEQ ID NO: 1309235 - RNA, 19 nt, Homo sapiens
ucaacagaaugacaccuaa

SEQ ID NO: 1309236 - RNA, 19 nt, Homo sapiens
ggaacaacagacauacuuu

SEQ ID NO: 1309237 - RNA, 19 nt, Homo sapiens
guaggcaaaucccagcaaa

SEQ ID NO: 1309238 - RNA, 19 nt, Homo sapiens
ggcaggaauuccagcagua

SEQ ID NO: 1309239 - RNA, 19 nt, Homo sapiens
ggacaaggaacaacagaca

SEQ ID NO: 1309240 - RNA, 19 nt, Homo sapiens
gagaagaugacccagcaaa

SEQ ID NO: 1309241 - RNA, 19 nt, Homo sapiens
ugaauaaggugggauccaa

SEQ ID NO: 1309242 - RNA, 19 nt, Homo sapiens
cuaagggaguuucuauaga

SEQ ID NO: 1309243 - RNA, 19 nt, Homo sapiens
ccacugcaguugcggagaa

SEQ ID NO: 1309244 - RNA, 19 nt, Homo sapiens
uaaaauacagccuccauua

SEQ ID NO: 1309245 - RNA, 19 nt, Homo sapiens
ugaaauagagccuccauca

SEQ ID NO: 1309246 - RNA, 19 nt, Homo sapiens
aaauuaggaucgguuguuu

SEQ ID NO: 1309247 - RNA, 19 nt, Homo sapiens
ugaagaggccucagcuaaa

SEQ ID NO: 1309248 - RNA, 19 nt, Homo sapiens
agagacccauguccaagua

SEQ ID NO: 1309249 - RNA, 19 nt, Homo sapiens
cagaaugacaccuaagaaa

SEQ ID NO: 1309250 - RNA, 19 nt, Homo sapiens
agaagcugcuauugaauug

SEQ ID NO: 1309251 - RNA, 19 nt, Homo sapiens
ggacaggcucccacucuug

SEQ ID NO: 1309252 - RNA, 19 nt, Homo sapiens
ucacuacucuuagaaaugg

SEQ ID NO: 1309253 - RNA, 19 nt, Homo sapiens
cagaagaggccuccguuga

SEQ ID NO: 1309254 - RNA, 19 nt, Homo sapiens
gcuaagggaguuucuauag

SEQ ID NO: 1309255 - RNA, 19 nt, Homo sapiens
uauagaggcuccugcagau

SEQ ID NO: 1309256 - RNA, 19 nt, Homo sapiens
gaagagucccuuucagaag

SEQ ID NO: 1309257 - RNA, 19 nt, Homo sapiens
ugaagaaauugggcagaaa

SEQ ID NO: 1309258 - RNA, 19 nt, Homo sapiens
acaaggaacaacagacaua

SEQ ID NO: 1309259 - RNA, 19 nt, Homo sapiens
gaaauggaagaaagugaug

SEQ ID NO: 1309260 - RNA, 19 nt, Homo sapiens
ccauugaaguacagccuuu

SEQ ID NO: 1309261 - RNA, 19 nt, Homo sapiens
aagagucccuuucagaaga

SEQ ID NO: 1309262 - RNA, 19 nt, Homo sapiens
ccaaacauaccuucaguuc

SEQ ID NO: 1309263 - RNA, 19 nt, Homo sapiens
agaaauuccaccaaacaua

SEQ ID NO: 1309264 - RNA, 19 nt, Homo sapiens
gaagaaaagucagcugaug

SEQ ID NO: 1309265 - RNA, 19 nt, Homo sapiens
gaaguucagucuccaucag

SEQ ID NO: 1309266 - RNA, 19 nt, Homo sapiens
gaagaggcuccuacugaau

SEQ ID NO: 1309267 - RNA, 19 nt, Homo sapiens
gcaacaaacagcaaugaag

SEQ ID NO: 1309268 - RNA, 19 nt, Homo sapiens
aaacuuggacaaagagaaa

SEQ ID NO: 1309269 - RNA, 19 nt, Homo sapiens
gaauacagguuggaaaaug

SEQ ID NO: 1309270 - RNA, 19 nt, Homo sapiens
cugauuugcuucugacuga

SEQ ID NO: 1309271 - RNA, 19 nt, Homo sapiens
gaaugacaccuaagaaagg

SEQ ID NO: 1309272 - RNA, 19 nt, Homo sapiens
gaacuucagcuuucaacag

SEQ ID NO: 1309273 - RNA, 19 nt, Homo sapiens
agaaagugaugacucuaau

SEQ ID NO: 1309274 - RNA, 19 nt, Homo sapiens
aauacagccuccauuaguu

SEQ ID NO: 1309275 - RNA, 19 nt, Homo sapiens
gagcuuagggaagaaguaa

SEQ ID NO: 1309276 - RNA, 19 nt, Homo sapiens
gaacaagccuacugcuaua

SEQ ID NO: 1309277 - RNA, 19 nt, Homo sapiens
caagauagcuacucagaaa

SEQ ID NO: 1309278 - RNA, 19 nt, Homo sapiens
cgacagagcaugcuauuua

SEQ ID NO: 1309279 - RNA, 19 nt, Homo sapiens
caaauaagcgucacagaua

SEQ ID NO: 1309280 - RNA, 19 nt, Homo sapiens
caaaguuggugacaagaua

SEQ ID NO: 1309281 - RNA, 19 nt, Homo sapiens
gaaguaaacuaggcuuauu

SEQ ID NO: 1309282 - RNA, 19 nt, Homo sapiens
gcagacaucuaccagaauu

SEQ ID NO: 1309283 - RNA, 19 nt, Homo sapiens
ggaagacucaccucaaaua

SEQ ID NO: 1309284 - RNA, 19 nt, Homo sapiens
gcacugguaucuuuguauu

SEQ ID NO: 1309285 - RNA, 19 nt, Homo sapiens
gcaaagccauuuaacaucu

SEQ ID NO: 1309286 - RNA, 19 nt, Homo sapiens
agagguaacuguaucuuaa

SEQ ID NO: 1309287 - RNA, 19 nt, Homo sapiens
gaauugcugugaagccuuu

SEQ ID NO: 1309288 - RNA, 19 nt, Homo sapiens
gcgcagacaucuaccagaa

SEQ ID NO: 1309289 - RNA, 19 nt, Homo sapiens
gugaagugaugaaaguaua

SEQ ID NO: 1309290 - RNA, 19 nt, Homo sapiens
gcaguugccuuggaaauuc

SEQ ID NO: 1309291 - RNA, 19 nt, Homo sapiens
gaguaugauuuccuuguaa

SEQ ID NO: 1309292 - RNA, 19 nt, Homo sapiens
agaaagagcagaugcaauu

SEQ ID NO: 1309293 - RNA, 19 nt, Homo sapiens
gaagacucaccucaaauaa

SEQ ID NO: 1309294 - RNA, 19 nt, Homo sapiens
gugaauugcuggauauguu

SEQ ID NO: 1309295 - RNA, 19 nt, Homo sapiens
uaaaguagagguaacugua

SEQ ID NO: 1309296 - RNA, 19 nt, Homo sapiens
caagucaagugaagaacaa

SEQ ID NO: 1309297 - RNA, 19 nt, Homo sapiens
gcaagcaagucaagugaag

SEQ ID NO: 1309298 - RNA, 19 nt, Homo sapiens
gauaaagucacaguaauug

SEQ ID NO: 1309299 - RNA, 19 nt, Homo sapiens
guggaagacucaccucaaa

SEQ ID NO: 1309300 - RNA, 19 nt, Homo sapiens
gaaaguauaacugguucua

SEQ ID NO: 1309301 - RNA, 19 nt, Homo sapiens
gacagagcaugcuauuuau

SEQ ID NO: 1309302 - RNA, 19 nt, Homo sapiens
gcaaaugaaagaguuauug

SEQ ID NO: 1309303 - RNA, 19 nt, Homo sapiens
gggauuagguacugcaugu

SEQ ID NO: 1309304 - RNA, 19 nt, Homo sapiens
ugaaggauguuugagcuuu

SEQ ID NO: 1309305 - RNA, 19 nt, Homo sapiens
ggucgugucuguccucuuc

SEQ ID NO: 1309306 - RNA, 19 nt, Homo sapiens
ugaguaugauuuccuugua

SEQ ID NO: 1309307 - RNA, 19 nt, Homo sapiens
ggaggugggugacaucagu

SEQ ID NO: 1309308 - RNA, 19 nt, Homo sapiens
guaauuggagcuggaguua

SEQ ID NO: 1309309 - RNA, 19 nt, Homo sapiens
ccacaugcuuacaaaguug

SEQ ID NO: 1309310 - RNA, 19 nt, Homo sapiens
uggauggaauacuuacuua

SEQ ID NO: 1309311 - RNA, 19 nt, Homo sapiens
aaauaagcgucacagauau

SEQ ID NO: 1309312 - RNA, 19 nt, Homo sapiens
cagcggaggucgugucugu

SEQ ID NO: 1309313 - RNA, 19 nt, Homo sapiens
gaugaaaguauaacugguu

SEQ ID NO: 1309314 - RNA, 19 nt, Homo sapiens
ugaaagaguuauuguucug

SEQ ID NO: 1309315 - RNA, 19 nt, Homo sapiens
gaugaaguauaaacagaca

SEQ ID NO: 1309316 - RNA, 19 nt, Homo sapiens
uuacaaaguuggugacaag

SEQ ID NO: 1309317 - RNA, 19 nt, Homo sapiens
caucucuccucuacaguuu

SEQ ID NO: 1309318 - RNA, 19 nt, Homo sapiens
gugaaccgcuugggacaaa

SEQ ID NO: 1309319 - RNA, 19 nt, Homo sapiens
gagagaugauggccaacga

SEQ ID NO: 1309320 - RNA, 19 nt, Homo sapiens
ggauauguuuggaaucagu

SEQ ID NO: 1309321 - RNA, 19 nt, Homo sapiens
agucaagucuauuggcuuu

SEQ ID NO: 1309322 - RNA, 19 nt, Homo sapiens
cuagugaauugcuggauau

SEQ ID NO: 1309323 - RNA, 19 nt, Homo sapiens
gccacggugucaaugauaa

SEQ ID NO: 1309324 - RNA, 19 nt, Homo sapiens
caaagccauuuaacaucuu

SEQ ID NO: 1309325 - RNA, 19 nt, Homo sapiens
uccacacgaugaaguauaa

SEQ ID NO: 1309326 - RNA, 19 nt, Homo sapiens
gacaagauagcuacucaga

SEQ ID NO: 1309327 - RNA, 19 nt, Homo sapiens
gaaagccagugccaaaaga

SEQ ID NO: 1309328 - RNA, 19 nt, Homo sapiens
gcagaaaauuggcauggaa

SEQ ID NO: 1309329 - RNA, 19 nt, Homo sapiens
ggucagggauuagguacug

SEQ ID NO: 1309330 - RNA, 19 nt, Homo sapiens
cagggaagguggcauugga

SEQ ID NO: 1309331 - RNA, 19 nt, Homo sapiens
gaaagaguuauuguucuga

SEQ ID NO: 1309332 - RNA, 19 nt, Homo sapiens
ucaaauaagcgucacagau

SEQ ID NO: 1309333 - RNA, 19 nt, Homo sapiens
caaaaucgccuguggaaga

SEQ ID NO: 1309334 - RNA, 19 nt, Homo sapiens
gaaagagcagaugcaauug

SEQ ID NO: 1309335 - RNA, 19 nt, Homo sapiens
caagccuacugcuauaguu

SEQ ID NO: 1309336 - RNA, 19 nt, Homo sapiens
agaacaagccuacugcuau

SEQ ID NO: 1309337 - RNA, 19 nt, Homo sapiens
uaccggguguucugccuua

SEQ ID NO: 1309338 - RNA, 19 nt, Homo sapiens
gaccaucuuucucaacaag

SEQ ID NO: 1309339 - RNA, 19 nt, Homo sapiens
uaaagucacaguaauugga

SEQ ID NO: 1309340 - RNA, 19 nt, Homo sapiens
gugacaagauagcuacuca

SEQ ID NO: 1309341 - RNA, 19 nt, Homo sapiens
gagguaacuguaucuuaaa

SEQ ID NO: 1309342 - RNA, 19 nt, Homo sapiens
caucuuucuucauuccuaa

SEQ ID NO: 1309343 - RNA, 19 nt, Homo sapiens
ggacaacgaccgguucauc

SEQ ID NO: 1309344 - RNA, 19 nt, Homo sapiens
acuagugaauugcuggaua

SEQ ID NO: 1309345 - RNA, 19 nt, Homo sapiens
gaacaaaacaugguaagug

SEQ ID NO: 1309346 - RNA, 19 nt, Homo sapiens
aaaaugaccuccccacaug

SEQ ID NO: 1309347 - RNA, 19 nt, Homo sapiens
gauggaauacuuacuuagu

SEQ ID NO: 1309348 - RNA, 19 nt, Homo sapiens
caucugcuaaugauacuaa

SEQ ID NO: 1309349 - RNA, 19 nt, Homo sapiens
gaaggauguuugagcuuuu

SEQ ID NO: 1309350 - RNA, 19 nt, Homo sapiens
uagagguaacuguaucuua

SEQ ID NO: 1309351 - RNA, 19 nt, Homo sapiens
cgaaccagccaaccagaaa

SEQ ID NO: 1309352 - RNA, 19 nt, Homo sapiens
cgaagcauucccaauugua

SEQ ID NO: 1309353 - RNA, 19 nt, Homo sapiens
uggaggaucuagccauguu

SEQ ID NO: 1309354 - RNA, 19 nt, Homo sapiens
aaacugggccgugcaaaug

SEQ ID NO: 1309355 - RNA, 19 nt, Homo sapiens
ugacugcaguugccuugga

SEQ ID NO: 1309356 - RNA, 19 nt, Homo sapiens
uuacugagcuggggauuaa

SEQ ID NO: 1309357 - RNA, 19 nt, Homo sapiens
ccauuuaacaucuuucuuc

SEQ ID NO: 1309358 - RNA, 19 nt, Homo sapiens
aagcaaagccauuuaacau

SEQ ID NO: 1309359 - RNA, 19 nt, Homo sapiens
cuuagaagcugcugaccau

SEQ ID NO: 1309360 - RNA, 19 nt, Homo sapiens
aagaacacccugagcguuu

SEQ ID NO: 1309361 - RNA, 19 nt, Homo sapiens
agacucaccucaaauaagc

SEQ ID NO: 1309362 - RNA, 19 nt, Homo sapiens
gagcagaugcaauugucaa

SEQ ID NO: 1309363 - RNA, 19 nt, Homo sapiens
uguaagcaauagaauagga

SEQ ID NO: 1309364 - RNA, 19 nt, Homo sapiens
uaacaucuuucuucauucc

SEQ ID NO: 1309365 - RNA, 19 nt, Homo sapiens
cauuauagcagccguaaca

SEQ ID NO: 1309366 - RNA, 19 nt, Homo sapiens
gcaagucaagugaagaaca

SEQ ID NO: 1309367 - RNA, 19 nt, Homo sapiens
gcauguggaauggcuuaua

SEQ ID NO: 1309368 - RNA, 19 nt, Homo sapiens
cuacuuguguugugugaag

SEQ ID NO: 1309369 - RNA, 19 nt, Homo sapiens
aagccaauaucaaccuuau

SEQ ID NO: 1309370 - RNA, 19 nt, Homo sapiens
ggaagguggcauuggagaa

SEQ ID NO: 1309371 - RNA, 19 nt, Homo sapiens
aauaagcgucacagauaua

SEQ ID NO: 1309372 - RNA, 19 nt, Homo sapiens
cauguggaauggcuuauac

SEQ ID NO: 1309373 - RNA, 19 nt, Homo sapiens
aaguauaacugguucuagu

SEQ ID NO: 1309374 - RNA, 19 nt, Homo sapiens
gggauuaaaguagagguaa

SEQ ID NO: 1309375 - RNA, 19 nt, Homo sapiens
uauagcagccguaacacuu

SEQ ID NO: 1309376 - RNA, 19 nt, Homo sapiens
gggaagagcucaucaguga

SEQ ID NO: 1309377 - RNA, 19 nt, Homo sapiens
ccuccaagcuucuauaaua

SEQ ID NO: 1309378 - RNA, 19 nt, Homo sapiens
gggagaagcugcaggaguu

SEQ ID NO: 1309379 - RNA, 19 nt, Homo sapiens
ggaagcagcuccucauugg

SEQ ID NO: 1309380 - RNA, 19 nt, Homo sapiens
caagaguaaccuagaauua

SEQ ID NO: 1309381 - RNA, 19 nt, Homo sapiens
ggaaaugaaacuaaaggua

SEQ ID NO: 1309382 - RNA, 19 nt, Homo sapiens
gcaggucuguuuaccauug

SEQ ID NO: 1309383 - RNA, 19 nt, Homo sapiens
gcaaacauguccgccauug

SEQ ID NO: 1309384 - RNA, 19 nt, Homo sapiens
gaaggucccucucaugagu

SEQ ID NO: 1309385 - RNA, 19 nt, Homo sapiens
ggaaagagucccucgcaaa

SEQ ID NO: 1309386 - RNA, 19 nt, Homo sapiens
ucagaaacaucuuugaguu

SEQ ID NO: 1309387 - RNA, 19 nt, Homo sapiens
ucaccugccucuuuaauga

SEQ ID NO: 1309388 - RNA, 19 nt, Homo sapiens
ggacagagacccugcuuuc

SEQ ID NO: 1309389 - RNA, 19 nt, Homo sapiens
ccaaagagaaccagugaaa

SEQ ID NO: 1309390 - RNA, 19 nt, Homo sapiens
caagcuaaguuuauacuca

SEQ ID NO: 1309391 - RNA, 19 nt, Homo sapiens
ugacucaguucauuaauuc

SEQ ID NO: 1309392 - RNA, 19 nt, Homo sapiens
gacaagguguauaagauga

SEQ ID NO: 1309393 - RNA, 19 nt, Homo sapiens
caagaaagccgagucagaa

SEQ ID NO: 1309394 - RNA, 19 nt, Homo sapiens
gcacauccauucuguccau

SEQ ID NO: 1309395 - RNA, 19 nt, Homo sapiens
ggaagaagcaggccuccaa

SEQ ID NO: 1309396 - RNA, 19 nt, Homo sapiens
gaaaagaagccaagaagaa

SEQ ID NO: 1309397 - RNA, 19 nt, Homo sapiens
ggcaagcaguuccuauaaa

SEQ ID NO: 1309398 - RNA, 19 nt, Homo sapiens
gcaagcaguuccuauaaaa

SEQ ID NO: 1309399 - RNA, 19 nt, Homo sapiens
gcccauaugucuuaaucuu

SEQ ID NO: 1309400 - RNA, 19 nt, Homo sapiens
gacagugacucaguucauu

SEQ ID NO: 1309401 - RNA, 19 nt, Homo sapiens
ggacaguuguggaaagagu

SEQ ID NO: 1309402 - RNA, 19 nt, Homo sapiens
caucaagaguaaccuagaa

SEQ ID NO: 1309403 - RNA, 19 nt, Homo sapiens
ucaagaagcgguuucagaa

SEQ ID NO: 1309404 - RNA, 19 nt, Homo sapiens
ucaacaggauuacaagaug

SEQ ID NO: 1309405 - RNA, 19 nt, Homo sapiens
gaacuaagucgguuauucg

SEQ ID NO: 1309406 - RNA, 19 nt, Homo sapiens
aagaagcgguuucagaaga

SEQ ID NO: 1309407 - RNA, 19 nt, Homo sapiens
ugacggagcuccucagacu

SEQ ID NO: 1309408 - RNA, 19 nt, Homo sapiens
uggcuaagauguacacguu

SEQ ID NO: 1309409 - RNA, 19 nt, Homo sapiens
gugacucaguucauuaauu

SEQ ID NO: 1309410 - RNA, 19 nt, Homo sapiens
cauuacaccuucuaugaug

SEQ ID NO: 1309411 - RNA, 19 nt, Homo sapiens
gaaacuacaaggcaaagau

SEQ ID NO: 1309412 - RNA, 19 nt, Homo sapiens
gaagauauccaaggaagca

SEQ ID NO: 1309413 - RNA, 19 nt, Homo sapiens
caaggugaaugaggaaaug

SEQ ID NO: 1309414 - RNA, 19 nt, Homo sapiens
gaaagagucccucgcaaac

SEQ ID NO: 1309415 - RNA, 19 nt, Homo sapiens
aaaggaggaggaagaauuu

SEQ ID NO: 1309416 - RNA, 19 nt, Homo sapiens
gaaaauaggcaaaucuaga

SEQ ID NO: 1309417 - RNA, 19 nt, Homo sapiens
gcucaucagugacccuuca

SEQ ID NO: 1309418 - RNA, 19 nt, Homo sapiens
gaaccagugaaacaucuuu

SEQ ID NO: 1309419 - RNA, 19 nt, Homo sapiens
gagaaccagugaaacaucu

SEQ ID NO: 1309420 - RNA, 19 nt, Homo sapiens
caccuggaauccucaauug

SEQ ID NO: 1309421 - RNA, 19 nt, Homo sapiens
gaaagggccacauggaaag

SEQ ID NO: 1309422 - RNA, 19 nt, Homo sapiens
ugaaagggccacauggaaa

SEQ ID NO: 1309423 - RNA, 19 nt, Homo sapiens
gcaaaucuagaacuacaga

SEQ ID NO: 1309424 - RNA, 19 nt, Homo sapiens
agaaacaucuuugaguuca

SEQ ID NO: 1309425 - RNA, 19 nt, Homo sapiens
cagcagggacagcaagaua

SEQ ID NO: 1309426 - RNA, 19 nt, Homo sapiens
gacaagagagccugaagug

SEQ ID NO: 1309427 - RNA, 19 nt, Homo sapiens
cagagacuuugaaggauga

SEQ ID NO: 1309428 - RNA, 19 nt, Homo sapiens
ggacaucaccaggcgcuuu

SEQ ID NO: 1309429 - RNA, 19 nt, Homo sapiens
acagcaagauaacuaguug

SEQ ID NO: 1309430 - RNA, 19 nt, Homo sapiens
ggaagacuauguggagaag

SEQ ID NO: 1309431 - RNA, 19 nt, Homo sapiens
gaaagccgagucagaagau

SEQ ID NO: 1309432 - RNA, 19 nt, Homo sapiens
gacuacaaauucaguguuc

SEQ ID NO: 1309433 - RNA, 19 nt, Homo sapiens
gauauggccucagcaagca

SEQ ID NO: 1309434 - RNA, 19 nt, Homo sapiens
gcugaacacucucuacaac

SEQ ID NO: 1309435 - RNA, 19 nt, Homo sapiens
ggaagcucaugcucaagga

SEQ ID NO: 1309436 - RNA, 19 nt, Homo sapiens
aaagagaaccagugaaaca

SEQ ID NO: 1309437 - RNA, 19 nt, Homo sapiens
ugaacuaagucgguuauuc

SEQ ID NO: 1309438 - RNA, 19 nt, Homo sapiens
uuaaugacauaccuggauu

SEQ ID NO: 1309439 - RNA, 19 nt, Homo sapiens
gaagcaggccuccaagaag

SEQ ID NO: 1309440 - RNA, 19 nt, Homo sapiens
ggaggaggaagaauuuguu

SEQ ID NO: 1309441 - RNA, 19 nt, Homo sapiens
agaagacagugacucaguu

SEQ ID NO: 1309442 - RNA, 19 nt, Homo sapiens
gauggcuccuccuucguuu

SEQ ID NO: 1309443 - RNA, 19 nt, Homo sapiens
gcucauggaacccaccuuu

SEQ ID NO: 1309444 - RNA, 19 nt, Homo sapiens
cuccaagcuucuauaauaa

SEQ ID NO: 1309445 - RNA, 19 nt, Homo sapiens
gcagguucuuaaugauuga

SEQ ID NO: 1309446 - RNA, 19 nt, Homo sapiens
gucagaagauauccaagga

SEQ ID NO: 1309447 - RNA, 19 nt, Homo sapiens
cauugaauaucccaccaaa

SEQ ID NO: 1309448 - RNA, 19 nt, Homo sapiens
ccacauagaagcugaaagg

SEQ ID NO: 1309449 - RNA, 19 nt, Homo sapiens
gcuacuuccugccggauga

SEQ ID NO: 1309450 - RNA, 19 nt, Homo sapiens
uggaauggcauaugacaaa

SEQ ID NO: 1309451 - RNA, 19 nt, Homo sapiens
gcuccuccuucguuuacua

SEQ ID NO: 1309452 - RNA, 19 nt, Homo sapiens
accaucaccugccucuuua

SEQ ID NO: 1309453 - RNA, 19 nt, Homo sapiens
auaggcaaaucuagaacua

SEQ ID NO: 1309454 - RNA, 19 nt, Homo sapiens
cagcugaucuaccacucuu

SEQ ID NO: 1309455 - RNA, 19 nt, Homo sapiens
gcggacaguuguggaaaga

SEQ ID NO: 1309456 - RNA, 19 nt, Homo sapiens
ucuugcagguucuuaauga

SEQ ID NO: 1309457 - RNA, 19 nt, Homo sapiens
gaagacagugacucaguuc

SEQ ID NO: 1309458 - RNA, 19 nt, Homo sapiens
ucggaucucuagcuacaaa

SEQ ID NO: 1309459 - RNA, 19 nt, Homo sapiens
ucaagaaagccgagucaga

SEQ ID NO: 1309460 - RNA, 19 nt, Homo sapiens
aagaugagauccagaacuc

SEQ ID NO: 1309461 - RNA, 19 nt, Homo sapiens
uggaauacaaggugaauga

SEQ ID NO: 1309462 - RNA, 19 nt, Homo sapiens
gcuauguaguccacaagug

SEQ ID NO: 1309463 - RNA, 19 nt, Homo sapiens
ccucggaucucuagcuaca

SEQ ID NO: 1309464 - RNA, 19 nt, Homo sapiens
cauuggcccuggaagacua

SEQ ID NO: 1309465 - RNA, 19 nt, Homo sapiens
ccggaugacuacaaauuca

SEQ ID NO: 1309466 - RNA, 19 nt, Homo sapiens
gaauuuguucgguucaaga

SEQ ID NO: 1309467 - RNA, 19 nt, Homo sapiens
cgacaagguguauaagaug

SEQ ID NO: 1309468 - RNA, 19 nt, Homo sapiens
ggaaagggaggaauaucuc

SEQ ID NO: 1309469 - RNA, 19 nt, Homo sapiens
aagcaggccuccaagaagu

SEQ ID NO: 1309470 - RNA, 19 nt, Homo sapiens
ggucucaacaggauuacaa

SEQ ID NO: 1309471 - RNA, 19 nt, Homo sapiens
cggcaagcaguuccuauaa

SEQ ID NO: 1309472 - RNA, 19 nt, Homo sapiens
cggcugaaccgcagaauca

SEQ ID NO: 1309473 - RNA, 19 nt, Homo sapiens
cccaugaucuuacgaaacu

SEQ ID NO: 1309474 - RNA, 19 nt, Homo sapiens
ccaaacuccucaugaucug

SEQ ID NO: 1309475 - RNA, 19 nt, Homo sapiens
ggaugauucugauguuugc

SEQ ID NO: 1309476 - RNA, 19 nt, Homo sapiens
gaagaucaguggauuaaua

SEQ ID NO: 1309477 - RNA, 19 nt, Homo sapiens
gaacugugcuucucuuaaa

SEQ ID NO: 1309478 - RNA, 19 nt, Homo sapiens
gaaaucgaccuguuuaaua

SEQ ID NO: 1309479 - RNA, 19 nt, Homo sapiens
ggaaagaccucugggugua

SEQ ID NO: 1309480 - RNA, 19 nt, Homo sapiens
cuacauagcucacaacuuc

SEQ ID NO: 1309481 - RNA, 19 nt, Homo sapiens
ggacuuagauggauucagu

SEQ ID NO: 1309482 - RNA, 19 nt, Homo sapiens
ccacagauuugguuuagaa

SEQ ID NO: 1309483 - RNA, 19 nt, Homo sapiens
gaauggaggcggauuagua

SEQ ID NO: 1309484 - RNA, 19 nt, Homo sapiens
gcaggguucuuuguaaaua

SEQ ID NO: 1309485 - RNA, 19 nt, Homo sapiens
uaagguuacugcauaauga

SEQ ID NO: 1309486 - RNA, 19 nt, Homo sapiens
ccacaaggaauuuaacuuu

SEQ ID NO: 1309487 - RNA, 19 nt, Homo sapiens
gcaugugucuucaaugaug

SEQ ID NO: 1309488 - RNA, 19 nt, Homo sapiens
ugaaggaaguggaaugcua

SEQ ID NO: 1309489 - RNA, 19 nt, Homo sapiens
gaucaggacuacuuagaag

SEQ ID NO: 1309490 - RNA, 19 nt, Homo sapiens
ggaagcaagaacuauauaa

SEQ ID NO: 1309491 - RNA, 19 nt, Homo sapiens
cagcaacucucuuguaucu

SEQ ID NO: 1309492 - RNA, 19 nt, Homo sapiens
uaagauguuucuacugcua

SEQ ID NO: 1309493 - RNA, 19 nt, Homo sapiens
ggagaauggaggcggauua

SEQ ID NO: 1309494 - RNA, 19 nt, Homo sapiens
aagcaugugucuucaauga

SEQ ID NO: 1309495 - RNA, 19 nt, Homo sapiens
ggaggagacucuagcagau

SEQ ID NO: 1309496 - RNA, 19 nt, Homo sapiens
gcaccgccauccucaaguu

SEQ ID NO: 1309497 - RNA, 19 nt, Homo sapiens
gcacggagugagucuagua

SEQ ID NO: 1309498 - RNA, 19 nt, Homo sapiens
gauccuagccacaauaugu

SEQ ID NO: 1309499 - RNA, 19 nt, Homo sapiens
uagaagggcugcugaccaa

SEQ ID NO: 1309500 - RNA, 19 nt, Homo sapiens
cagcaggguucuuuguaaa

SEQ ID NO: 1309501 - RNA, 19 nt, Homo sapiens
ucagcaggguucuuuguaa

SEQ ID NO: 1309502 - RNA, 19 nt, Homo sapiens
gagugacaguguaugagua

SEQ ID NO: 1309503 - RNA, 19 nt, Homo sapiens
gcauggauguggcauaucu

SEQ ID NO: 1309504 - RNA, 19 nt, Homo sapiens
gcuggaggcugcugccaaa

SEQ ID NO: 1309505 - RNA, 19 nt, Homo sapiens
gggaagaucaguggauuaa

SEQ ID NO: 1309506 - RNA, 19 nt, Homo sapiens
gggcauggauguggcauau

SEQ ID NO: 1309507 - RNA, 19 nt, Homo sapiens
aaacugaacuaggaauugu

SEQ ID NO: 1309508 - RNA, 19 nt, Homo sapiens
caugaaaucgaccuguuua

SEQ ID NO: 1309509 - RNA, 19 nt, Homo sapiens
gcuacaguguucagagaaa

SEQ ID NO: 1309510 - RNA, 19 nt, Homo sapiens
ggacgagacccuauuacug

SEQ ID NO: 1309511 - RNA, 19 nt, Homo sapiens
gauguguacuuuccuucaa

SEQ ID NO: 1309512 - RNA, 19 nt, Homo sapiens
gaaugggacuuagauggau

SEQ ID NO: 1309513 - RNA, 19 nt, Homo sapiens
aaagaccucuggguguaua

SEQ ID NO: 1309514 - RNA, 19 nt, Homo sapiens
gcgcuauggugaccuguug

SEQ ID NO: 1309515 - RNA, 19 nt, Homo sapiens
gaucaguggauuaauauag

SEQ ID NO: 1309516 - RNA, 19 nt, Homo sapiens
ccaagcccaucgugaagaa

SEQ ID NO: 1309517 - RNA, 19 nt, Homo sapiens
uccugaaaguccagaauua

SEQ ID NO: 1309518 - RNA, 19 nt, Homo sapiens
ucaggaaguucaaguucuu

SEQ ID NO: 1309519 - RNA, 19 nt, Homo sapiens
guaauauuccuuuggauuc

SEQ ID NO: 1309520 - RNA, 19 nt, Homo sapiens
gaguuaaguugaaggaagu

SEQ ID NO: 1309521 - RNA, 19 nt, Homo sapiens
gaucucaggcccaguccua

SEQ ID NO: 1309522 - RNA, 19 nt, Homo sapiens
uggcacagcucaaguccuu

SEQ ID NO: 1309523 - RNA, 19 nt, Homo sapiens
ggagugagucuaguacuga

SEQ ID NO: 1309524 - RNA, 19 nt, Homo sapiens
gcaguuugacucuggcuuu

SEQ ID NO: 1309525 - RNA, 19 nt, Homo sapiens
ggacgcggcuugucuuagc

SEQ ID NO: 1309526 - RNA, 19 nt, Homo sapiens
uaaaccagcucagaauagu

SEQ ID NO: 1309527 - RNA, 19 nt, Homo sapiens
ccucauaagcucacagaaa

SEQ ID NO: 1309528 - RNA, 19 nt, Homo sapiens
uuacuggaguuaaguugaa

SEQ ID NO: 1309529 - RNA, 19 nt, Homo sapiens
ugaagaagaucaggacuac

SEQ ID NO: 1309530 - RNA, 19 nt, Homo sapiens
guuugacucuggcuuuauu

SEQ ID NO: 1309531 - RNA, 19 nt, Homo sapiens
gauguggcauaucucaaug

SEQ ID NO: 1309532 - RNA, 19 nt, Homo sapiens
uauaaaccagcucagaaua

SEQ ID NO: 1309533 - RNA, 19 nt, Homo sapiens
guucacagguggcauguac

SEQ ID NO: 1309534 - RNA, 19 nt, Homo sapiens
acacuaagauguuucuacu

SEQ ID NO: 1309535 - RNA, 19 nt, Homo sapiens
caguuugacucuggcuuua

SEQ ID NO: 1309536 - RNA, 19 nt, Homo sapiens
gaaccgagugacaguguau

SEQ ID NO: 1309537 - RNA, 19 nt, Homo sapiens
uaaaggacacggcccauuc

SEQ ID NO: 1309538 - RNA, 19 nt, Homo sapiens
guauaaaccagcucagaau

SEQ ID NO: 1309539 - RNA, 19 nt, Homo sapiens
cagcagcaacucucuugua

SEQ ID NO: 1309540 - RNA, 19 nt, Homo sapiens
uggauagucuggacauaga

SEQ ID NO: 1309541 - RNA, 19 nt, Homo sapiens
ggauguggcauaucucaau

SEQ ID NO: 1309542 - RNA, 19 nt, Homo sapiens
ucuuaaacguagugacuuu

SEQ ID NO: 1309543 - RNA, 19 nt, Homo sapiens
gccacugucuaugcaauaa

SEQ ID NO: 1309544 - RNA, 19 nt, Homo sapiens
uauggaagcaagaacuaua

SEQ ID NO: 1309545 - RNA, 19 nt, Homo sapiens
gauuaggaccacagauuug

SEQ ID NO: 1309546 - RNA, 19 nt, Homo sapiens
ggaaguggaaugcuacagu

SEQ ID NO: 1309547 - RNA, 19 nt, Homo sapiens
gaccaugacaucuaucuag

SEQ ID NO: 1309548 - RNA, 19 nt, Homo sapiens
uggcacgggucgccucuuu

SEQ ID NO: 1309549 - RNA, 19 nt, Homo sapiens
ggaggcugcugccaaagag

SEQ ID NO: 1309550 - RNA, 19 nt, Homo sapiens
gagagugagcggacuguau

SEQ ID NO: 1309551 - RNA, 19 nt, Homo sapiens
ucaagcagcucagccgaau

SEQ ID NO: 1309552 - RNA, 19 nt, Homo sapiens
gaaauacuacaagguuuag

SEQ ID NO: 1309553 - RNA, 19 nt, Homo sapiens
gagugagucuaguacugaa

SEQ ID NO: 1309554 - RNA, 19 nt, Homo sapiens
gaccaaaaguugcuucuca

SEQ ID NO: 1309555 - RNA, 19 nt, Homo sapiens
gcgcaugcuuugcuaugau

SEQ ID NO: 1309556 - RNA, 19 nt, Homo sapiens
ugaccaagcccaucgugaa

SEQ ID NO: 1309557 - RNA, 19 nt, Homo sapiens
cucauaagcucacagaaag

SEQ ID NO: 1309558 - RNA, 19 nt, Homo sapiens
uaggaugcuugguagguuu

SEQ ID NO: 1309559 - RNA, 19 nt, Homo sapiens
ugauuaggaccacagauuu

SEQ ID NO: 1309560 - RNA, 19 nt, Homo sapiens
ggucagaguuuuauuacug

SEQ ID NO: 1309561 - RNA, 19 nt, Homo sapiens
guggaaugcuacaguguuc

SEQ ID NO: 1309562 - RNA, 19 nt, Homo sapiens
gaaagaccucuggguguau

SEQ ID NO: 1309563 - RNA, 19 nt, Homo sapiens
cagauuugguuuagaaagg

SEQ ID NO: 1309564 - RNA, 19 nt, Homo sapiens
uagggaagaucaguggauu

SEQ ID NO: 1309565 - RNA, 19 nt, Homo sapiens
gcugaacugugcuucucuu

SEQ ID NO: 1309566 - RNA, 19 nt, Homo sapiens
aagaagaucaggacuacuu

SEQ ID NO: 1309567 - RNA, 19 nt, Homo sapiens
gugcagaauggccucauaa

SEQ ID NO: 1309568 - RNA, 19 nt, Homo sapiens
gaucagcaggguucuuugu

SEQ ID NO: 1309569 - RNA, 19 nt, Homo sapiens
acacuagucaguucuuuau

SEQ ID NO: 1309570 - RNA, 19 nt, Homo sapiens
uuugaaggauguguacuuu

SEQ ID NO: 1309571 - RNA, 19 nt, Homo sapiens
ugaaaucgaccuguuuaau

SEQ ID NO: 1309572 - RNA, 19 nt, Homo sapiens
guacugaaugggacuuaga

SEQ ID NO: 1309573 - RNA, 19 nt, Homo sapiens
ugacaguguaugaguauga

SEQ ID NO: 1309574 - RNA, 19 nt, Homo sapiens
cagcuuugcucacacuaag

SEQ ID NO: 1309575 - RNA, 19 nt, Homo sapiens
ugcuacagcuggaauaugu

SEQ ID NO: 1309576 - RNA, 19 nt, Homo sapiens
gaacacaucugagaacuaa

SEQ ID NO: 1309577 - RNA, 19 nt, Homo sapiens
uaacauaccucgugccaaa

SEQ ID NO: 1309578 - RNA, 19 nt, Homo sapiens
ccacucagcuggucaguuu

SEQ ID NO: 1309579 - RNA, 19 nt, Homo sapiens
aaacggagaucccuaauug

SEQ ID NO: 1309580 - RNA, 19 nt, Homo sapiens
ggagagaaguaaguaauuu

SEQ ID NO: 1309581 - RNA, 19 nt, Homo sapiens
gcauuaaacucaaagauuc

SEQ ID NO: 1309582 - RNA, 19 nt, Homo sapiens
gaacaggauuaaauuagga

SEQ ID NO: 1309583 - RNA, 19 nt, Homo sapiens
gcugaaaugucauaucuga

SEQ ID NO: 1309584 - RNA, 19 nt, Homo sapiens
gcacgaggcugugauugaa

SEQ ID NO: 1309585 - RNA, 19 nt, Homo sapiens
gaaagauauuggugugaaa

SEQ ID NO: 1309586 - RNA, 19 nt, Homo sapiens
ggauuaagcuggagagaag

SEQ ID NO: 1309587 - RNA, 19 nt, Homo sapiens
ugaaggcucugguuuacua

SEQ ID NO: 1309588 - RNA, 19 nt, Homo sapiens
uaaaugugcuuccaugaga

SEQ ID NO: 1309589 - RNA, 19 nt, Homo sapiens
caaaugaccuugugauagg

SEQ ID NO: 1309590 - RNA, 19 nt, Homo sapiens
gaaagggugguuaucauuu

SEQ ID NO: 1309591 - RNA, 19 nt, Homo sapiens
gaacaucgccucuuuccau

SEQ ID NO: 1309592 - RNA, 19 nt, Homo sapiens
gaaccucccuugaaugucu

SEQ ID NO: 1309593 - RNA, 19 nt, Homo sapiens
caaggaagccucucugcua

SEQ ID NO: 1309594 - RNA, 19 nt, Homo sapiens
gauacugccugaccucauu

SEQ ID NO: 1309595 - RNA, 19 nt, Homo sapiens
gagggacucucaccugaaa

SEQ ID NO: 1309596 - RNA, 19 nt, Homo sapiens
ggacaauguuucuuugcaa

SEQ ID NO: 1309597 - RNA, 19 nt, Homo sapiens
ugucauaucugaaggaaga

SEQ ID NO: 1309598 - RNA, 19 nt, Homo sapiens
gagauuauggcaagagaua

SEQ ID NO: 1309599 - RNA, 19 nt, Homo sapiens
ggaguucagcuuuaacaua

SEQ ID NO: 1309600 - RNA, 19 nt, Homo sapiens
acaaguagguacagauauu

SEQ ID NO: 1309601 - RNA, 19 nt, Homo sapiens
ugaagugucuguuagauuc

SEQ ID NO: 1309602 - RNA, 19 nt, Homo sapiens
ccaaguuccugaaagcuuu

SEQ ID NO: 1309603 - RNA, 19 nt, Homo sapiens
ggaaugaggaguuguugaa

SEQ ID NO: 1309604 - RNA, 19 nt, Homo sapiens
uaacaaguagguacagaua

SEQ ID NO: 1309605 - RNA, 19 nt, Homo sapiens
gccuagagcuacacguaua

SEQ ID NO: 1309606 - RNA, 19 nt, Homo sapiens
gaaacacgccccucauuua

SEQ ID NO: 1309607 - RNA, 19 nt, Homo sapiens
gauagaagugucccuaauu

SEQ ID NO: 1309608 - RNA, 19 nt, Homo sapiens
ugauggagaucuagaaaug

SEQ ID NO: 1309609 - RNA, 19 nt, Homo sapiens
ucaaagauucugucuguaa

SEQ ID NO: 1309610 - RNA, 19 nt, Homo sapiens
gagccuccgucaccacaua

SEQ ID NO: 1309611 - RNA, 19 nt, Homo sapiens
ggaaagggugguuaucauu

SEQ ID NO: 1309612 - RNA, 19 nt, Homo sapiens
uaacaggaaugaggaguug

SEQ ID NO: 1309613 - RNA, 19 nt, Homo sapiens
cauuaacgcuucuaacaau

SEQ ID NO: 1309614 - RNA, 19 nt, Homo sapiens
caaagauucugucuguaau

SEQ ID NO: 1309615 - RNA, 19 nt, Homo sapiens
aaaccggaguucagcuuua

SEQ ID NO: 1309616 - RNA, 19 nt, Homo sapiens
cgaaugcucucuacaccaa

SEQ ID NO: 1309617 - RNA, 19 nt, Homo sapiens
gacaauguuucuuugcaaa

SEQ ID NO: 1309618 - RNA, 19 nt, Homo sapiens
auagaagugucccuaauuu

SEQ ID NO: 1309619 - RNA, 19 nt, Homo sapiens
gcacaaaccaggucagagu

SEQ ID NO: 1309620 - RNA, 19 nt, Homo sapiens
ggaauugcuucagguggua

SEQ ID NO: 1309621 - RNA, 19 nt, Homo sapiens
gcgcacggcuguagacugu

SEQ ID NO: 1309622 - RNA, 19 nt, Homo sapiens
gaguucagcuuuaacauac

SEQ ID NO: 1309623 - RNA, 19 nt, Homo sapiens
ggaacaggauuaaauuagg

SEQ ID NO: 1309624 - RNA, 19 nt, Homo sapiens
uuucagaccuuaaauggaa

SEQ ID NO: 1309625 - RNA, 19 nt, Homo sapiens
caucagaccuguuccacau

SEQ ID NO: 1309626 - RNA, 19 nt, Homo sapiens
acaggaacaucgccucuuu

SEQ ID NO: 1309627 - RNA, 19 nt, Homo sapiens
agaagugucccuaauuuaa

SEQ ID NO: 1309628 - RNA, 19 nt, Homo sapiens
gaagcgauguagccuuuua

SEQ ID NO: 1309629 - RNA, 19 nt, Homo sapiens
uggcucagcugaacaaaug

SEQ ID NO: 1309630 - RNA, 19 nt, Homo sapiens
agauauacguccaucauga

SEQ ID NO: 1309631 - RNA, 19 nt, Homo sapiens
caagggaacaggauuaaau

SEQ ID NO: 1309632 - RNA, 19 nt, Homo sapiens
aagcaacacucgaaccaaa

SEQ ID NO: 1309633 - RNA, 19 nt, Homo sapiens
aaacugaccgcaaggagua

SEQ ID NO: 1309634 - RNA, 19 nt, Homo sapiens
gcagcaaaguggcccaaau

SEQ ID NO: 1309635 - RNA, 19 nt, Homo sapiens
gccaagaggaccaugauaa

SEQ ID NO: 1309636 - RNA, 19 nt, Homo sapiens
acucaaagauucugucugu

SEQ ID NO: 1309637 - RNA, 19 nt, Homo sapiens
ccaagaggaccaugauaaa

SEQ ID NO: 1309638 - RNA, 19 nt, Homo sapiens
ggauggcaaauuugaguua

SEQ ID NO: 1309639 - RNA, 19 nt, Homo sapiens
gagaaccucccuugaaugu

SEQ ID NO: 1309640 - RNA, 19 nt, Homo sapiens
aagcaaggaugcaacaaga

SEQ ID NO: 1309641 - RNA, 19 nt, Homo sapiens
uaucaguccuguuauacuu

SEQ ID NO: 1309642 - RNA, 19 nt, Homo sapiens
ccacauagacucagcgaau

SEQ ID NO: 1309643 - RNA, 19 nt, Homo sapiens
gaaggacuacagagaggua

SEQ ID NO: 1309644 - RNA, 19 nt, Homo sapiens
auacguccaucaugaaauu

SEQ ID NO: 1309645 - RNA, 19 nt, Homo sapiens
gaagcaggcaguggagaua

SEQ ID NO: 1309646 - RNA, 19 nt, Homo sapiens
ccagucuacuugucaguuu

SEQ ID NO: 1309647 - RNA, 19 nt, Homo sapiens
gagaguagauuuggcacau

SEQ ID NO: 1309648 - RNA, 19 nt, Homo sapiens
cgggaugguuacuggauua

SEQ ID NO: 1309649 - RNA, 19 nt, Homo sapiens
gggaaagggugguuaucau

SEQ ID NO: 1309650 - RNA, 19 nt, Homo sapiens
caccaucucucuccucuuc

SEQ ID NO: 1309651 - RNA, 19 nt, Homo sapiens
gcaaggaugcaacaagaug

SEQ ID NO: 1309652 - RNA, 19 nt, Homo sapiens
guaugucacuguuaagauc

SEQ ID NO: 1309653 - RNA, 19 nt, Homo sapiens
caaggaguaugucacuguu

SEQ ID NO: 1309654 - RNA, 19 nt, Homo sapiens
aaggaagccucucugcuaa

SEQ ID NO: 1309655 - RNA, 19 nt, Homo sapiens
gaagcugccauugaauaua

SEQ ID NO: 1309656 - RNA, 19 nt, Homo sapiens
gcaccaaguuccugaaagc

SEQ ID NO: 1309657 - RNA, 19 nt, Homo sapiens
agaaggaccucaguggaaa

SEQ ID NO: 1309658 - RNA, 19 nt, Homo sapiens
gauucugucuguaauggaa

SEQ ID NO: 1309659 - RNA, 19 nt, Homo sapiens
aagcugccauugaauauau

SEQ ID NO: 1309660 - RNA, 19 nt, Homo sapiens
ggaugcggccuuuaacaaa

SEQ ID NO: 1309661 - RNA, 19 nt, Homo sapiens
gagagagaguucagaagag

SEQ ID NO: 1309662 - RNA, 19 nt, Homo sapiens
guacagauauucgguuacu

SEQ ID NO: 1309663 - RNA, 19 nt, Homo sapiens
caggaaagaaugcaacaaa

SEQ ID NO: 1309664 - RNA, 19 nt, Homo sapiens
gcaaggaguaugucacugu

SEQ ID NO: 1309665 - RNA, 19 nt, Homo sapiens
ccaaauccauggcauuguc

SEQ ID NO: 1309666 - RNA, 19 nt, Homo sapiens
caaaggaugaacugggaua

SEQ ID NO: 1309667 - RNA, 19 nt, Homo sapiens
agaaagauauuggugugaa

SEQ ID NO: 1309668 - RNA, 19 nt, Homo sapiens
aaaccucucugaccugugu

SEQ ID NO: 1309669 - RNA, 19 nt, Homo sapiens
ccauguggcugcugucugu

SEQ ID NO: 1309670 - RNA, 19 nt, Homo sapiens
ccauggcauugucuuagua

SEQ ID NO: 1309671 - RNA, 19 nt, Homo sapiens
caaaguggcccaaauccau

SEQ ID NO: 1309672 - RNA, 19 nt, Homo sapiens
gcuggacaauguuucuuug

SEQ ID NO: 1309673 - RNA, 19 nt, Homo sapiens
uagaagugucccuaauuua

SEQ ID NO: 1309674 - RNA, 19 nt, Homo sapiens
aggaguaugucacuguuaa

SEQ ID NO: 1309675 - RNA, 19 nt, Homo sapiens
ccaagaaggacuacagaga

SEQ ID NO: 1309676 - RNA, 19 nt, Homo sapiens
ggacuucauucgucacaau

SEQ ID NO: 1309677 - RNA, 19 nt, Homo sapiens
ggcaaaaccucucgaguga

SEQ ID NO: 1309678 - RNA, 19 nt, Homo sapiens
ggaagcuggugcagguaga

SEQ ID NO: 1309679 - RNA, 19 nt, Homo sapiens
cuaaggaccaugagaagga

SEQ ID NO: 1309680 - RNA, 19 nt, Homo sapiens
caccaggucccgaagcuaa

SEQ ID NO: 1309681 - RNA, 19 nt, Homo sapiens
gaaggacccuaaggaccau

SEQ ID NO: 1309682 - RNA, 19 nt, Homo sapiens
ucaagaggaaggacccuaa

SEQ ID NO: 1309683 - RNA, 19 nt, Homo sapiens
ggagcuccaugcugaggau

SEQ ID NO: 1309684 - RNA, 19 nt, Homo sapiens
aagcuggacuugcugacuu

SEQ ID NO: 1309685 - RNA, 19 nt, Homo sapiens
ugcacgagcugccaagaga

SEQ ID NO: 1309686 - RNA, 19 nt, Homo sapiens
uagaggaggccaucaagau

SEQ ID NO: 1309687 - RNA, 19 nt, Homo sapiens
ggcccaaagucuucgugaa

SEQ ID NO: 1309688 - RNA, 19 nt, Homo sapiens
gggccacccuagccuuuua

SEQ ID NO: 1309689 - RNA, 19 nt, Homo sapiens
guagaggaggccaucaaga

SEQ ID NO: 1309690 - RNA, 19 nt, Homo sapiens
uggaaacacugaccaagcu

SEQ ID NO: 1309691 - RNA, 19 nt, Homo sapiens
gaucagggagauucagaag

SEQ ID NO: 1309692 - RNA, 19 nt, Homo sapiens
gaggaggccaucaagaucu

SEQ ID NO: 1309693 - RNA, 19 nt, Homo sapiens
acacgcgcaugccugagaa

SEQ ID NO: 1309694 - RNA, 19 nt, Homo sapiens
gggacgugcuguugcaacu

SEQ ID NO: 1309695 - RNA, 19 nt, Homo sapiens
ggaucagggagauucagaa

SEQ ID NO: 1309696 - RNA, 19 nt, Homo sapiens
gagaaccugaggcggauca

SEQ ID NO: 1309697 - RNA, 19 nt, Homo sapiens
agaggaaggacccuaagga

SEQ ID NO: 1309698 - RNA, 19 nt, Homo sapiens
gcugcugcgugagcuggua

SEQ ID NO: 1309699 - RNA, 19 nt, Homo sapiens
gguggccagugucccuaga

SEQ ID NO: 1309700 - RNA, 19 nt, Homo sapiens
cuaaauagcuuacagcaua

SEQ ID NO: 1309701 - RNA, 19 nt, Homo sapiens
gcaaagaccuauauugaga

SEQ ID NO: 1309702 - RNA, 19 nt, Homo sapiens
ggagaaauauucccaaaga

SEQ ID NO: 1309703 - RNA, 19 nt, Homo sapiens
gaaagcagcccaaauucua

SEQ ID NO: 1309704 - RNA, 19 nt, Homo sapiens
agagagagcugaagaagaa

SEQ ID NO: 1309705 - RNA, 19 nt, Homo sapiens
gaagaaagagggcacagua

SEQ ID NO: 1309706 - RNA, 19 nt, Homo sapiens
gaagaggcaugaacaggaa

SEQ ID NO: 1309707 - RNA, 19 nt, Homo sapiens
ugaagaaacuguaauguca

SEQ ID NO: 1309708 - RNA, 19 nt, Homo sapiens
agaaagaagugacagagua

SEQ ID NO: 1309709 - RNA, 19 nt, Homo sapiens
gaccuugucucuauuuaaa

SEQ ID NO: 1309710 - RNA, 19 nt, Homo sapiens
ggagaaagauagggagaaa

SEQ ID NO: 1309711 - RNA, 19 nt, Homo sapiens
ggaguuugaugauaaagaa

SEQ ID NO: 1309712 - RNA, 19 nt, Homo sapiens
cagcauaguuggcuuaaau

SEQ ID NO: 1309713 - RNA, 19 nt, Homo sapiens
agaaagaaaucaagacaga

SEQ ID NO: 1309714 - RNA, 19 nt, Homo sapiens
ggaagagcauaugaaagua

SEQ ID NO: 1309715 - RNA, 19 nt, Homo sapiens
ggaagcauguuuggaugua

SEQ ID NO: 1309716 - RNA, 19 nt, Homo sapiens
gagggaagcugcuaagaag

SEQ ID NO: 1309717 - RNA, 19 nt, Homo sapiens
gaacaaugaagaaacugua

SEQ ID NO: 1309718 - RNA, 19 nt, Homo sapiens
caagaaagauccaacaaaa

SEQ ID NO: 1309719 - RNA, 19 nt, Homo sapiens
agaaagagauagacaacaa

SEQ ID NO: 1309720 - RNA, 19 nt, Homo sapiens
gaaauauucccaaagagaa

SEQ ID NO: 1309721 - RNA, 19 nt, Homo sapiens
acagaaagcccaaguauau

SEQ ID NO: 1309722 - RNA, 19 nt, Homo sapiens
ccaaagagaacaagaaaga

SEQ ID NO: 1309723 - RNA, 19 nt, Homo sapiens
agaaagauagggagaaaua

SEQ ID NO: 1309724 - RNA, 19 nt, Homo sapiens
gaaaugcauucuucaaacu

SEQ ID NO: 1309725 - RNA, 19 nt, Homo sapiens
ggauaaauuucuugaccaa

SEQ ID NO: 1309726 - RNA, 19 nt, Homo sapiens
gaagagcauaugaaaguaa

SEQ ID NO: 1309727 - RNA, 19 nt, Homo sapiens
gaaccgacccagugagaaa

SEQ ID NO: 1309728 - RNA, 19 nt, Homo sapiens
caagaaccguuaagagugu

SEQ ID NO: 1309729 - RNA, 19 nt, Homo sapiens
aaacugaugugaaaguaga

SEQ ID NO: 1309730 - RNA, 19 nt, Homo sapiens
agaaagaucucaguggauu

SEQ ID NO: 1309731 - RNA, 19 nt, Homo sapiens
ugagaaacauggcaaagga

SEQ ID NO: 1309732 - RNA, 19 nt, Homo sapiens
gaaagaagugacagaguau

SEQ ID NO: 1309733 - RNA, 19 nt, Homo sapiens
gaaacccucuaauucugaa

SEQ ID NO: 1309734 - RNA, 19 nt, Homo sapiens
ggacaaagaaagaaaccaa

SEQ ID NO: 1309735 - RNA, 19 nt, Homo sapiens
cagaauaccacaagagaaa

SEQ ID NO: 1309736 - RNA, 19 nt, Homo sapiens
gaagaggaaguaccuaaau

SEQ ID NO: 1309737 - RNA, 19 nt, Homo sapiens
uaaagaagcauuugugaca

SEQ ID NO: 1309738 - RNA, 19 nt, Homo sapiens
guagguacauaaugaggaa

SEQ ID NO: 1309739 - RNA, 19 nt, Homo sapiens
agaccuauauugagaaaga

SEQ ID NO: 1309740 - RNA, 19 nt, Homo sapiens
gcaaaggaagagcauauga

SEQ ID NO: 1309741 - RNA, 19 nt, Homo sapiens
gauaaagaagcauuuguga

SEQ ID NO: 1309742 - RNA, 19 nt, Homo sapiens
ggaaaauaaucccaaauug

SEQ ID NO: 1309743 - RNA, 19 nt, Homo sapiens
agaaagaaaccaagagaaa

SEQ ID NO: 1309744 - RNA, 19 nt, Homo sapiens
gaaagagauagacaacaaa

SEQ ID NO: 1309745 - RNA, 19 nt, Homo sapiens
gaucugguauaaaggaaga

SEQ ID NO: 1309746 - RNA, 19 nt, Homo sapiens
gaagaagaagaaagagaaa

SEQ ID NO: 1309747 - RNA, 19 nt, Homo sapiens
ccuauuaaaucaagcaguu

SEQ ID NO: 1309748 - RNA, 19 nt, Homo sapiens
ugagaaagaagaugauuga

SEQ ID NO: 1309749 - RNA, 19 nt, Homo sapiens
ucaaacugaugugaaagua

SEQ ID NO: 1309750 - RNA, 19 nt, Homo sapiens
guaccuaaaugcagcuuuc

SEQ ID NO: 1309751 - RNA, 19 nt, Homo sapiens
gguguucagucuucagaaa

SEQ ID NO: 1309752 - RNA, 19 nt, Homo sapiens
gaagcauguuuggauguaa

SEQ ID NO: 1309753 - RNA, 19 nt, Homo sapiens
gacagaaagcccaaguaua

SEQ ID NO: 1309754 - RNA, 19 nt, Homo sapiens
gaaacagaccaaacuggaa

SEQ ID NO: 1309755 - RNA, 19 nt, Homo sapiens
gcaagagaaggguaaagaa

SEQ ID NO: 1309756 - RNA, 19 nt, Homo sapiens
ccuggaaccugcugcguaa

SEQ ID NO: 1309757 - RNA, 19 nt, Homo sapiens
ggcaugaacaggaagauaa

SEQ ID NO: 1309758 - RNA, 19 nt, Homo sapiens
cagugcggaugaugaaaua

SEQ ID NO: 1309759 - RNA, 19 nt, Homo sapiens
caaaggacaaagaaagaaa

SEQ ID NO: 1309760 - RNA, 19 nt, Homo sapiens
caaaggaagagcauaugaa

SEQ ID NO: 1309761 - RNA, 19 nt, Homo sapiens
gacagugacuucgaugcua

SEQ ID NO: 1309762 - RNA, 19 nt, Homo sapiens
cagaagaugcuacugugua

SEQ ID NO: 1309763 - RNA, 19 nt, Homo sapiens
ccacauucuuuguuguauu

SEQ ID NO: 1309764 - RNA, 19 nt, Homo sapiens
gaaacuguaaugucagcua

SEQ ID NO: 1309765 - RNA, 19 nt, Homo sapiens
gcaaaggacaaagaaagaa

SEQ ID NO: 1309766 - RNA, 19 nt, Homo sapiens
ccaagaaagauccaacaaa

SEQ ID NO: 1309767 - RNA, 19 nt, Homo sapiens
ggcaaaggauaaauuucuu

SEQ ID NO: 1309768 - RNA, 19 nt, Homo sapiens
gaaaguaaggaaggaaaga

SEQ ID NO: 1309769 - RNA, 19 nt, Homo sapiens
aaaggaagagcauaugaaa

SEQ ID NO: 1309770 - RNA, 19 nt, Homo sapiens
ucauagagauucccauugg

SEQ ID NO: 1309771 - RNA, 19 nt, Homo sapiens
aaggaaagcagcccaaauu

SEQ ID NO: 1309772 - RNA, 19 nt, Homo sapiens
gaacaggaagauaaaccaa

SEQ ID NO: 1309773 - RNA, 19 nt, Homo sapiens
gagaccaagagaaccauua

SEQ ID NO: 1309774 - RNA, 19 nt, Homo sapiens
agaagaugcuacuguguau

SEQ ID NO: 1309775 - RNA, 19 nt, Homo sapiens
ugaagaagaagaaagagaa

SEQ ID NO: 1309776 - RNA, 19 nt, Homo sapiens
gcaagagagagcugaagaa

SEQ ID NO: 1309777 - RNA, 19 nt, Homo sapiens
caucuugucuaaauagcuu

SEQ ID NO: 1309778 - RNA, 19 nt, Homo sapiens
gccuaggaauuugauguua

SEQ ID NO: 1309779 - RNA, 19 nt, Homo sapiens
gaaaggaaagcagcccaaa

SEQ ID NO: 1309780 - RNA, 19 nt, Homo sapiens
aaacagaccaaacuggaaa

SEQ ID NO: 1309781 - RNA, 19 nt, Homo sapiens
uugcaaagcggaacaauga

SEQ ID NO: 1309782 - RNA, 19 nt, Homo sapiens
agagaaggguaaagaacaa

SEQ ID NO: 1309783 - RNA, 19 nt, Homo sapiens
gcaaaggauaaauuucuug

SEQ ID NO: 1309784 - RNA, 19 nt, Homo sapiens
gaagugacagaguauggaa

SEQ ID NO: 1309785 - RNA, 19 nt, Homo sapiens
gcaugaacaggaagauaaa

SEQ ID NO: 1309786 - RNA, 19 nt, Homo sapiens
gaaagaucucaguggauuu

SEQ ID NO: 1309787 - RNA, 19 nt, Homo sapiens
caaggcagaaggauauuga

SEQ ID NO: 1309788 - RNA, 19 nt, Homo sapiens
caagagaaagauuuaagga

SEQ ID NO: 1309789 - RNA, 19 nt, Homo sapiens
ggaaagcagcccaaauucu

SEQ ID NO: 1309790 - RNA, 19 nt, Homo sapiens
gaaagaaaucaagacagaa

SEQ ID NO: 1309791 - RNA, 19 nt, Homo sapiens
gaagcaauccagagaccaa

SEQ ID NO: 1309792 - RNA, 19 nt, Homo sapiens
gagcagugcggaugaugaa

SEQ ID NO: 1309793 - RNA, 19 nt, Homo sapiens
acagugacuucgaugcuaa

SEQ ID NO: 1309794 - RNA, 19 nt, Homo sapiens
cuaagaagcaggccaugaa

SEQ ID NO: 1309795 - RNA, 19 nt, Homo sapiens
gagagaacgagaaauggaa

SEQ ID NO: 1309796 - RNA, 19 nt, Homo sapiens
gcucgugccuguaauacca

SEQ ID NO: 1309797 - RNA, 19 nt, Homo sapiens
caucaauaccacauucuuu

SEQ ID NO: 1309798 - RNA, 19 nt, Homo sapiens
ucuuacagcuuggauguuu

SEQ ID NO: 1309799 - RNA, 19 nt, Homo sapiens
gaaagaaaccaagagaaac

SEQ ID NO: 1309800 - RNA, 19 nt, Homo sapiens
caagagauaucaucgauua

SEQ ID NO: 1309801 - RNA, 19 nt, Homo sapiens
gaaccaaacugauuaaagu

SEQ ID NO: 1309802 - RNA, 19 nt, Homo sapiens
caauaucgcucacugauuu

SEQ ID NO: 1309803 - RNA, 19 nt, Homo sapiens
ccacucaucuuaauccuua

SEQ ID NO: 1309804 - RNA, 19 nt, Homo sapiens
guagagggcuggcaaugua

SEQ ID NO: 1309805 - RNA, 19 nt, Homo sapiens
gcaccuauaucaauaauuc

SEQ ID NO: 1309806 - RNA, 19 nt, Homo sapiens
gaucagacaucacacgauu

SEQ ID NO: 1309807 - RNA, 19 nt, Homo sapiens
cagaugagcuguaauuuca

SEQ ID NO: 1309808 - RNA, 19 nt, Homo sapiens
ggauucacaucuauacuaa

SEQ ID NO: 1309809 - RNA, 19 nt, Homo sapiens
guacaguggugucaucaaa

SEQ ID NO: 1309810 - RNA, 19 nt, Homo sapiens
gcaaauagauagccucaac

SEQ ID NO: 1309811 - RNA, 19 nt, Homo sapiens
caagacagcacuccagaua

SEQ ID NO: 1309812 - RNA, 19 nt, Homo sapiens
gacaaucucuagcaucaaa

SEQ ID NO: 1309813 - RNA, 19 nt, Homo sapiens
gaaagaagacggacuuaca

SEQ ID NO: 1309814 - RNA, 19 nt, Homo sapiens
ggaauacgccaauaccuuu

SEQ ID NO: 1309815 - RNA, 19 nt, Homo sapiens
ccucaaagcugcaugaauc

SEQ ID NO: 1309816 - RNA, 19 nt, Homo sapiens
cuucaaagcucccauuaga

SEQ ID NO: 1309817 - RNA, 19 nt, Homo sapiens
gaaagaagccaggugagaa

SEQ ID NO: 1309818 - RNA, 19 nt, Homo sapiens
gaucagcgcaggugucaaa

SEQ ID NO: 1309819 - RNA, 19 nt, Homo sapiens
gccaauaccuuuaacuaca

SEQ ID NO: 1309820 - RNA, 19 nt, Homo sapiens
guacagauguguggaauac

SEQ ID NO: 1309821 - RNA, 19 nt, Homo sapiens
gcagugcuguuaugcaaau

SEQ ID NO: 1309822 - RNA, 19 nt, Homo sapiens
ugucagcucuguaauguga

SEQ ID NO: 1309823 - RNA, 19 nt, Homo sapiens
ccugagagccaaaguauuu

SEQ ID NO: 1309824 - RNA, 19 nt, Homo sapiens
gcaugaaucacacaaggua

SEQ ID NO: 1309825 - RNA, 19 nt, Homo sapiens
auagauagccucaaccaua

SEQ ID NO: 1309826 - RNA, 19 nt, Homo sapiens
gguaucaagucaacaugaa

SEQ ID NO: 1309827 - RNA, 19 nt, Homo sapiens
gcagguggaucacaucaag

SEQ ID NO: 1309828 - RNA, 19 nt, Homo sapiens
gaaaugucaggaagaguuu

SEQ ID NO: 1309829 - RNA, 19 nt, Homo sapiens
uagauagccucaaccauau

SEQ ID NO: 1309830 - RNA, 19 nt, Homo sapiens
agaguuaccuuauugugaa

SEQ ID NO: 1309831 - RNA, 19 nt, Homo sapiens
gguaacaggugccgagcaa

SEQ ID NO: 1309832 - RNA, 19 nt, Homo sapiens
agagagaacugccagacaa

SEQ ID NO: 1309833 - RNA, 19 nt, Homo sapiens
gaacagcuaaaugaaauga

SEQ ID NO: 1309834 - RNA, 19 nt, Homo sapiens
caucguagguaucaaguca

SEQ ID NO: 1309835 - RNA, 19 nt, Homo sapiens
gcgaucauacucaagaaua

SEQ ID NO: 1309836 - RNA, 19 nt, Homo sapiens
aaagcgaacucuugggauu

SEQ ID NO: 1309837 - RNA, 19 nt, Homo sapiens
ccagaacaguggaagaguu

SEQ ID NO: 1309838 - RNA, 19 nt, Homo sapiens
cauaucccaugcuguuuaa

SEQ ID NO: 1309839 - RNA, 19 nt, Homo sapiens
gaauacgccaauaccuuua

SEQ ID NO: 1309840 - RNA, 19 nt, Homo sapiens
agacuaagcaagcauguaa

SEQ ID NO: 1309841 - RNA, 19 nt, Homo sapiens
uguagucucugcaccuaua

SEQ ID NO: 1309842 - RNA, 19 nt, Homo sapiens
agacgaggcuucccagugu

SEQ ID NO: 1309843 - RNA, 19 nt, Homo sapiens
gagcaaggucugcagguuu

SEQ ID NO: 1309844 - RNA, 19 nt, Homo sapiens
ggaaagaagccaggugaga

SEQ ID NO: 1309845 - RNA, 19 nt, Homo sapiens
gucagaaccuggccaguug

SEQ ID NO: 1309846 - RNA, 19 nt, Homo sapiens
ggaguacaguggugucauc

SEQ ID NO: 1309847 - RNA, 19 nt, Homo sapiens
gaagcccucuacauccaaa

SEQ ID NO: 1309848 - RNA, 19 nt, Homo sapiens
uggaagagaucacaaagca

SEQ ID NO: 1309849 - RNA, 19 nt, Homo sapiens
gaagaguucagacacuuug

SEQ ID NO: 1309850 - RNA, 19 nt, Homo sapiens
ggaaaauacuguaguguca

SEQ ID NO: 1309851 - RNA, 19 nt, Homo sapiens
ccacaguccuagaaucaau

SEQ ID NO: 1309852 - RNA, 19 nt, Homo sapiens
cagacaagcuaaggaaaga

SEQ ID NO: 1309853 - RNA, 19 nt, Homo sapiens
gcuguuaugcaaauagaua

SEQ ID NO: 1309854 - RNA, 19 nt, Homo sapiens
cagcgcaggugucaaagga

SEQ ID NO: 1309855 - RNA, 19 nt, Homo sapiens
gaacugccagacaagcuaa

SEQ ID NO: 1309856 - RNA, 19 nt, Homo sapiens
uaacugccaugaagcaaag

SEQ ID NO: 1309857 - RNA, 19 nt, Homo sapiens
caucauguucucaagauaa

SEQ ID NO: 1309858 - RNA, 19 nt, Homo sapiens
aagacaaucucuagcauca

SEQ ID NO: 1309859 - RNA, 19 nt, Homo sapiens
ucacaaagcaacaaaccaa

SEQ ID NO: 1309860 - RNA, 19 nt, Homo sapiens
gagauuuguucgagaaugg

SEQ ID NO: 1309861 - RNA, 19 nt, Homo sapiens
uuaauguucugugcaagua

SEQ ID NO: 1309862 - RNA, 19 nt, Homo sapiens
ggaagaguucagacacuuu

SEQ ID NO: 1309863 - RNA, 19 nt, Homo sapiens
ucaaggcagugcuguuaug

SEQ ID NO: 1309864 - RNA, 19 nt, Homo sapiens
uggauucgaucuaauaaca

SEQ ID NO: 1309865 - RNA, 19 nt, Homo sapiens
ucauuccucuggauauaaa

SEQ ID NO: 1309866 - RNA, 19 nt, Homo sapiens
gcaaggaagaaacaccaaa

SEQ ID NO: 1309867 - RNA, 19 nt, Homo sapiens
guggcuagguucccaaguu

SEQ ID NO: 1309868 - RNA, 19 nt, Homo sapiens
caucaaagcauggaucaga

SEQ ID NO: 1309869 - RNA, 19 nt, Homo sapiens
ugaaaugucaggaagaguu

SEQ ID NO: 1309870 - RNA, 19 nt, Homo sapiens
caacccacuugccagacua

SEQ ID NO: 1309871 - RNA, 19 nt, Homo sapiens
ugcaagcuguggauaauga

SEQ ID NO: 1309872 - RNA, 19 nt, Homo sapiens
ucacaucuauacuaaggau

SEQ ID NO: 1309873 - RNA, 19 nt, Homo sapiens
ucauaucccaugcuguuua

SEQ ID NO: 1309874 - RNA, 19 nt, Homo sapiens
ccuaagcgaucauacucaa

SEQ ID NO: 1309875 - RNA, 19 nt, Homo sapiens
gaagcagccacuuacagaa

SEQ ID NO: 1309876 - RNA, 19 nt, Homo sapiens
gaagccaggugagaagaca

SEQ ID NO: 1309877 - RNA, 19 nt, Homo sapiens
ugaaggaaauccacuuugc

SEQ ID NO: 1309878 - RNA, 19 nt, Homo sapiens
gaacaccgcaggauuucuc

SEQ ID NO: 1309879 - RNA, 19 nt, Homo sapiens
gagaaagaagacggacuua

SEQ ID NO: 1309880 - RNA, 19 nt, Homo sapiens
ccucaaggcagugcuguua

SEQ ID NO: 1309881 - RNA, 19 nt, Homo sapiens
ggaaccaaacugauuaaag

SEQ ID NO: 1309882 - RNA, 19 nt, Homo sapiens
uggccuggguuuccucaua

SEQ ID NO: 1309883 - RNA, 19 nt, Homo sapiens
caaacaaaauugcaccaaa

SEQ ID NO: 1309884 - RNA, 19 nt, Homo sapiens
auucagaguuaccuuauug

SEQ ID NO: 1309885 - RNA, 19 nt, Homo sapiens
gaccuccugugacgaauca

SEQ ID NO: 1309886 - RNA, 19 nt, Homo sapiens
ggacuucaaagcucccauu

SEQ ID NO: 1309887 - RNA, 19 nt, Homo sapiens
gauucgaucuaauaacagu

SEQ ID NO: 1309888 - RNA, 19 nt, Homo sapiens
ggacaaagugaagaauguu

SEQ ID NO: 1309889 - RNA, 19 nt, Homo sapiens
ucagaaagacaccuccaaa

SEQ ID NO: 1309890 - RNA, 19 nt, Homo sapiens
agacagcacuccagauagg

SEQ ID NO: 1309891 - RNA, 19 nt, Homo sapiens
guagcccaauucuugcuuu

SEQ ID NO: 1309892 - RNA, 19 nt, Homo sapiens
cgagaauggaguagucuaa

SEQ ID NO: 1309893 - RNA, 19 nt, Homo sapiens
uuaauacugcugaggauuu

SEQ ID NO: 1309894 - RNA, 19 nt, Homo sapiens
caagaauaguacagaugug

SEQ ID NO: 1309895 - RNA, 19 nt, Homo sapiens
ugaagcagccacuuacaga

SEQ ID NO: 1309896 - RNA, 19 nt, Homo sapiens
gaugaccuccugugacgaa

SEQ ID NO: 1309897 - RNA, 19 nt, Homo sapiens
caaagcaacaaaccaaaca

SEQ ID NO: 1309898 - RNA, 19 nt, Homo sapiens
uguugaaccugaaacgaaa

SEQ ID NO: 1309899 - RNA, 19 nt, Homo sapiens
gccaugaagcaaaggauaa

SEQ ID NO: 1309900 - RNA, 19 nt, Homo sapiens
gaacagaucuugcugacaa

SEQ ID NO: 1309901 - RNA, 19 nt, Homo sapiens
gagaaaugcuuacagauaa

SEQ ID NO: 1309902 - RNA, 19 nt, Homo sapiens
gcagauuuaugccuuauuu

SEQ ID NO: 1309903 - RNA, 19 nt, Homo sapiens
ggaaaagccugcugaauuu

SEQ ID NO: 1309904 - RNA, 19 nt, Homo sapiens
gcaaacaaauauacuagga

SEQ ID NO: 1309905 - RNA, 19 nt, Homo sapiens
ccacuggaauuauccuuua

SEQ ID NO: 1309906 - RNA, 19 nt, Homo sapiens
ggaauccgcugaggaaauu

SEQ ID NO: 1309907 - RNA, 19 nt, Homo sapiens
ucagagagcacuuggauua

SEQ ID NO: 1309908 - RNA, 19 nt, Homo sapiens
gaaagaggaagugauguua

SEQ ID NO: 1309909 - RNA, 19 nt, Homo sapiens
caaaguggauugaugaugu

SEQ ID NO: 1309910 - RNA, 19 nt, Homo sapiens
ggaaaucucaacaguauga

SEQ ID NO: 1309911 - RNA, 19 nt, Homo sapiens
gcacuuggauuauggaucu

SEQ ID NO: 1309912 - RNA, 19 nt, Homo sapiens
accaagauguccagaauua

SEQ ID NO: 1309913 - RNA, 19 nt, Homo sapiens
aauauuggcuugaaccuuu

SEQ ID NO: 1309914 - RNA, 19 nt, Homo sapiens
ggaaauagaacagaucuug

SEQ ID NO: 1309915 - RNA, 19 nt, Homo sapiens
caacaccuaucaggcaaua

SEQ ID NO: 1309916 - RNA, 19 nt, Homo sapiens
ccaaagggcugaauguuac

SEQ ID NO: 1309917 - RNA, 19 nt, Homo sapiens
gcagaaauaacgauaucua

SEQ ID NO: 1309918 - RNA, 19 nt, Homo sapiens
ucguggaggugaucuauua

SEQ ID NO: 1309919 - RNA, 19 nt, Homo sapiens
gccaaagggcugaauguua

SEQ ID NO: 1309920 - RNA, 19 nt, Homo sapiens
aagaugggauggaguuaua

SEQ ID NO: 1309921 - RNA, 19 nt, Homo sapiens
gaucagguaagcauacaua

SEQ ID NO: 1309922 - RNA, 19 nt, Homo sapiens
uaacacaaaugguccuuuc

SEQ ID NO: 1309923 - RNA, 19 nt, Homo sapiens
gaaaggagagaauggaaau

SEQ ID NO: 1309924 - RNA, 19 nt, Homo sapiens
cagguaagcauacauagua

SEQ ID NO: 1309925 - RNA, 19 nt, Homo sapiens
ggcgacagcuccucuaguu

SEQ ID NO: 1309926 - RNA, 19 nt, Homo sapiens
uaagaaaccucuguaagca

SEQ ID NO: 1309927 - RNA, 19 nt, Homo sapiens
gucaagaguuauucuguuu

SEQ ID NO: 1309928 - RNA, 19 nt, Homo sapiens
agagaaaugcuuacagaua

SEQ ID NO: 1309929 - RNA, 19 nt, Homo sapiens
caagauguccagaauuauu

SEQ ID NO: 1309930 - RNA, 19 nt, Homo sapiens
ccacauaccaguaacuuau

SEQ ID NO: 1309931 - RNA, 19 nt, Homo sapiens
caaaugguccuuucacaug

SEQ ID NO: 1309932 - RNA, 19 nt, Homo sapiens
caaaaugaguccuaaagaa

SEQ ID NO: 1309933 - RNA, 19 nt, Homo sapiens
ggcgauauuucuuugcuuu

SEQ ID NO: 1309934 - RNA, 19 nt, Homo sapiens
aaacuuugcucaggacauu

SEQ ID NO: 1309935 - RNA, 19 nt, Homo sapiens
caagaguuauucuguuugu

SEQ ID NO: 1309936 - RNA, 19 nt, Homo sapiens
gaacagaaagaggaaguga

SEQ ID NO: 1309937 - RNA, 19 nt, Homo sapiens
gaugaugucagaacagaaa

SEQ ID NO: 1309938 - RNA, 19 nt, Homo sapiens
gggauggaguuauaaagug

SEQ ID NO: 1309939 - RNA, 19 nt, Homo sapiens
aggcaaggguugacucuuu

SEQ ID NO: 1309940 - RNA, 19 nt, Homo sapiens
gauuauggaucugaauaga

SEQ ID NO: 1309941 - RNA, 19 nt, Homo sapiens
ggaaaggagagaauggaaa

SEQ ID NO: 1309942 - RNA, 19 nt, Homo sapiens
agacugcuguguaagcuaa

SEQ ID NO: 1309943 - RNA, 19 nt, Homo sapiens
guaaccaagugcuucagaa

SEQ ID NO: 1309944 - RNA, 19 nt, Homo sapiens
gauguuucguugaaucuau

SEQ ID NO: 1309945 - RNA, 19 nt, Homo sapiens
auagagaaaugcuuacaga

SEQ ID NO: 1309946 - RNA, 19 nt, Homo sapiens
gauggaaaucucaacagua

SEQ ID NO: 1309947 - RNA, 19 nt, Homo sapiens
uuauggaucugaauagaga

SEQ ID NO: 1309948 - RNA, 19 nt, Homo sapiens
ggcauguccugaaauaaau

SEQ ID NO: 1309949 - RNA, 19 nt, Homo sapiens
gguaggcagugcuugaaug

SEQ ID NO: 1309950 - RNA, 19 nt, Homo sapiens
cuacaaaguggauugauga

SEQ ID NO: 1309951 - RNA, 19 nt, Homo sapiens
gagagcacuuggauuaugg

SEQ ID NO: 1309952 - RNA, 19 nt, Homo sapiens
ggcaaggguugacucuuug

SEQ ID NO: 1309953 - RNA, 19 nt, Homo sapiens
uagcagaaauaacgauauc

SEQ ID NO: 1309954 - RNA, 19 nt, Homo sapiens
agaaaccucuguaagcaau

SEQ ID NO: 1309955 - RNA, 19 nt, Homo sapiens
guaagaaaccucuguaagc

SEQ ID NO: 1309956 - RNA, 19 nt, Homo sapiens
cugcugaauuuauguugua

SEQ ID NO: 1309957 - RNA, 19 nt, Homo sapiens
aaagaacccucagcagaau

SEQ ID NO: 1309958 - RNA, 19 nt, Homo sapiens
gaaccaguggaagaauuua

SEQ ID NO: 1309959 - RNA, 19 nt, Homo sapiens
cagaagaaccaguggaaga

SEQ ID NO: 1309960 - RNA, 19 nt, Homo sapiens
ucacaugugcuuuauuaga

SEQ ID NO: 1309961 - RNA, 19 nt, Homo sapiens
ggucagaauucagcgauca

SEQ ID NO: 1309962 - RNA, 19 nt, Homo sapiens
auggaaaucucaacaguau

SEQ ID NO: 1309963 - RNA, 19 nt, Homo sapiens
cuucaacccuuccucagaa

SEQ ID NO: 1309964 - RNA, 19 nt, Homo sapiens
gggcugaauguuacguuua

SEQ ID NO: 1309965 - RNA, 19 nt, Homo sapiens
gagcuucaccauggcaaua

SEQ ID NO: 1309966 - RNA, 19 nt, Homo sapiens
cuugagcacugauguaaau

SEQ ID NO: 1309967 - RNA, 19 nt, Homo sapiens
ugacugcagugugaauauu

SEQ ID NO: 1309968 - RNA, 19 nt, Homo sapiens
ggaucugaauagagaaaug

SEQ ID NO: 1309969 - RNA, 19 nt, Homo sapiens
ggauacaucugcgguuugg

SEQ ID NO: 1309970 - RNA, 19 nt, Homo sapiens
aacaagagauggcaaagca

SEQ ID NO: 1309971 - RNA, 19 nt, Homo sapiens
guaugaguauggcuugguu

SEQ ID NO: 1309972 - RNA, 19 nt, Homo sapiens
gggcuucggcugugggaua

SEQ ID NO: 1309973 - RNA, 19 nt, Homo sapiens
gcagcucuuucgacgugua

SEQ ID NO: 1309974 - RNA, 19 nt, Homo sapiens
cugcagcuguaguaguuua

SEQ ID NO: 1309975 - RNA, 19 nt, Homo sapiens
cugaauagagaaaugcuua

SEQ ID NO: 1309976 - RNA, 19 nt, Homo sapiens
gaccaagcccacuggaauu

SEQ ID NO: 1309977 - RNA, 19 nt, Homo sapiens
uggcauguccugaaauaaa

SEQ ID NO: 1309978 - RNA, 19 nt, Homo sapiens
gcacuacgaucaaaacuac

SEQ ID NO: 1309979 - RNA, 19 nt, Homo sapiens
aagaaccaguggaagaauu

SEQ ID NO: 1309980 - RNA, 19 nt, Homo sapiens
guucacagccugcuuuauc

SEQ ID NO: 1309981 - RNA, 19 nt, Homo sapiens
ggcugaauguuacguuuau

SEQ ID NO: 1309982 - RNA, 19 nt, Homo sapiens
guggauugaugaugucaga

SEQ ID NO: 1309983 - RNA, 19 nt, Homo sapiens
agagagcacuuggauuaug

SEQ ID NO: 1309984 - RNA, 19 nt, Homo sapiens
aggcagugcuugaaugaga

SEQ ID NO: 1309985 - RNA, 19 nt, Homo sapiens
uguaguaguuuacgauauc

SEQ ID NO: 1309986 - RNA, 19 nt, Homo sapiens
gaucuucuuugaggucaga

SEQ ID NO: 1309987 - RNA, 19 nt, Homo sapiens
ugagcacugauguaaauua

SEQ ID NO: 1309988 - RNA, 19 nt, Homo sapiens
ugaauuagcagaaauaacg

SEQ ID NO: 1309989 - RNA, 19 nt, Homo sapiens
cuacugaauuagcagaaau

SEQ ID NO: 1309990 - RNA, 19 nt, Homo sapiens
gcaggcaagacaccauaaa

SEQ ID NO: 1309991 - RNA, 19 nt, Homo sapiens
gaaauucaagcugguguuc

SEQ ID NO: 1309992 - RNA, 19 nt, Homo sapiens
ugucaagaguuauucuguu

SEQ ID NO: 1309993 - RNA, 19 nt, Homo sapiens
cgaccaagcccacuggaau

SEQ ID NO: 1309994 - RNA, 19 nt, Homo sapiens
ccagguacauccgugauuc

SEQ ID NO: 1309995 - RNA, 19 nt, Homo sapiens
aagaggaagugauguuauc

SEQ ID NO: 1309996 - RNA, 19 nt, Homo sapiens
aggagagaauggaaauaaa

SEQ ID NO: 1309997 - RNA, 19 nt, Homo sapiens
ggaagacggaaaccggaaa

SEQ ID NO: 1309998 - RNA, 19 nt, Homo sapiens
gcauguccugaaauaaaua

SEQ ID NO: 1309999 - RNA, 19 nt, Homo sapiens
cuccuccacuucccacuua

SEQ ID NO: 1310000 - RNA, 19 nt, Homo sapiens
gcaaagggcuugacuauua

SEQ ID NO: 1310001 - RNA, 19 nt, Homo sapiens
gagcaaagauuauacauga

SEQ ID NO: 1310002 - RNA, 19 nt, Homo sapiens
gaacagaggugcccuuuag

SEQ ID NO: 1310003 - RNA, 19 nt, Homo sapiens
gaaauuugcugacauccua

SEQ ID NO: 1310004 - RNA, 19 nt, Homo sapiens
uaacauggcucaauaacuu

SEQ ID NO: 1310005 - RNA, 19 nt, Homo sapiens
gcacaaaugaucucuaaua

SEQ ID NO: 1310006 - RNA, 19 nt, Homo sapiens
ggugacagauuacuuguua

SEQ ID NO: 1310007 - RNA, 19 nt, Homo sapiens
guuaagcacugccauaaua

SEQ ID NO: 1310008 - RNA, 19 nt, Homo sapiens
gcaagcaccuaguauaauu

SEQ ID NO: 1310009 - RNA, 19 nt, Homo sapiens
gaaaugcaguuacaauguu

SEQ ID NO: 1310010 - RNA, 19 nt, Homo sapiens
gaaaagguauggcgauuua

SEQ ID NO: 1310011 - RNA, 19 nt, Homo sapiens
guaaugcaguuuaucguuu

SEQ ID NO: 1310012 - RNA, 19 nt, Homo sapiens
ugagaguacuccacgauua

SEQ ID NO: 1310013 - RNA, 19 nt, Homo sapiens
gcaaaggugggaauauaua

SEQ ID NO: 1310014 - RNA, 19 nt, Homo sapiens
caaagggcuugacuauuaa

SEQ ID NO: 1310015 - RNA, 19 nt, Homo sapiens
ggacaguuauuuagaagga

SEQ ID NO: 1310016 - RNA, 19 nt, Homo sapiens
gaagauaaagcaguagaua

SEQ ID NO: 1310017 - RNA, 19 nt, Homo sapiens
gcacugccauaauaucauu

SEQ ID NO: 1310018 - RNA, 19 nt, Homo sapiens
gaaacuguguguugggauu

SEQ ID NO: 1310019 - RNA, 19 nt, Homo sapiens
aaaggaagauaaagcagua

SEQ ID NO: 1310020 - RNA, 19 nt, Homo sapiens
uaggauagcacaagcauua

SEQ ID NO: 1310021 - RNA, 19 nt, Homo sapiens
gcagaccacuugaagaaau

SEQ ID NO: 1310022 - RNA, 19 nt, Homo sapiens
ccgcauggcugauauuuau

SEQ ID NO: 1310023 - RNA, 19 nt, Homo sapiens
gaauguggaugucuuaucu

SEQ ID NO: 1310024 - RNA, 19 nt, Homo sapiens
gaaggugaauuguguugga

SEQ ID NO: 1310025 - RNA, 19 nt, Homo sapiens
ggacagggugauuuaauuu

SEQ ID NO: 1310026 - RNA, 19 nt, Homo sapiens
cacgagaacucacuaaaga

SEQ ID NO: 1310027 - RNA, 19 nt, Homo sapiens
ggaaguauccagaaggaaa

SEQ ID NO: 1310028 - RNA, 19 nt, Homo sapiens
gaagaaaugcaguuacaau

SEQ ID NO: 1310029 - RNA, 19 nt, Homo sapiens
aagcagcguucaauguuua

SEQ ID NO: 1310030 - RNA, 19 nt, Homo sapiens
gggcuugacuauuaaaugu

SEQ ID NO: 1310031 - RNA, 19 nt, Homo sapiens
aaaguugccuuaauguuug

SEQ ID NO: 1310032 - RNA, 19 nt, Homo sapiens
cugaaauggugacagauua

SEQ ID NO: 1310033 - RNA, 19 nt, Homo sapiens
gcaagccugugaauauaau

SEQ ID NO: 1310034 - RNA, 19 nt, Homo sapiens
cauaaugaccaucuaagua

SEQ ID NO: 1310035 - RNA, 19 nt, Homo sapiens
caagcagcguucaauguuu

SEQ ID NO: 1310036 - RNA, 19 nt, Homo sapiens
gcacaagcauuaacuuuug

SEQ ID NO: 1310037 - RNA, 19 nt, Homo sapiens
gaauugggcguauugugua

SEQ ID NO: 1310038 - RNA, 19 nt, Homo sapiens
gaaacugcuccugguauua

SEQ ID NO: 1310039 - RNA, 19 nt, Homo sapiens
aagcaagccugugaauaua

SEQ ID NO: 1310040 - RNA, 19 nt, Homo sapiens
aaagcaagccugugaauau

SEQ ID NO: 1310041 - RNA, 19 nt, Homo sapiens
gugcuucccuauacaauug

SEQ ID NO: 1310042 - RNA, 19 nt, Homo sapiens
cacacuggauuaugagaua

SEQ ID NO: 1310043 - RNA, 19 nt, Homo sapiens
uaaagaaggacguucacua

SEQ ID NO: 1310044 - RNA, 19 nt, Homo sapiens
gcaauauuagcuacaagua

SEQ ID NO: 1310045 - RNA, 19 nt, Homo sapiens
ugaaacugcuccugguauu

SEQ ID NO: 1310046 - RNA, 19 nt, Homo sapiens
guggaugucuuaucuuuca

SEQ ID NO: 1310047 - RNA, 19 nt, Homo sapiens
ugucagcucucauguguau

SEQ ID NO: 1310048 - RNA, 19 nt, Homo sapiens
guucugaagcuuaagauuu

SEQ ID NO: 1310049 - RNA, 19 nt, Homo sapiens
agagaguucugaagcuuaa

SEQ ID NO: 1310050 - RNA, 19 nt, Homo sapiens
uugcaaaggugggaauaua

SEQ ID NO: 1310051 - RNA, 19 nt, Homo sapiens
gaauggaaauuugcugaca

SEQ ID NO: 1310052 - RNA, 19 nt, Homo sapiens
auacaaggagcaaagauua

SEQ ID NO: 1310053 - RNA, 19 nt, Homo sapiens
gacaaucucuuugaaacau

SEQ ID NO: 1310054 - RNA, 19 nt, Homo sapiens
gcacaacuuagggaaauaa

SEQ ID NO: 1310055 - RNA, 19 nt, Homo sapiens
uaaacagucucuauuucug

SEQ ID NO: 1310056 - RNA, 19 nt, Homo sapiens
caacugugagauugaauaa

SEQ ID NO: 1310057 - RNA, 19 nt, Homo sapiens
gggcguauuguguaaauuu

SEQ ID NO: 1310058 - RNA, 19 nt, Homo sapiens
ggaggaagcaaucccuuug

SEQ ID NO: 1310059 - RNA, 19 nt, Homo sapiens
ccacagcuuucaaauccaa

SEQ ID NO: 1310060 - RNA, 19 nt, Homo sapiens
guagauacaucagauuugg

SEQ ID NO: 1310061 - RNA, 19 nt, Homo sapiens
aagaaugugucugugguua

SEQ ID NO: 1310062 - RNA, 19 nt, Homo sapiens
aaacagagcauuaaagacu

SEQ ID NO: 1310063 - RNA, 19 nt, Homo sapiens
aggcguuccuuaagcauua

SEQ ID NO: 1310064 - RNA, 19 nt, Homo sapiens
guucuugauucccuuauau

SEQ ID NO: 1310065 - RNA, 19 nt, Homo sapiens
caacuuagggaaauaauac

SEQ ID NO: 1310066 - RNA, 19 nt, Homo sapiens
gaucaagguauaauggaaa

SEQ ID NO: 1310067 - RNA, 19 nt, Homo sapiens
uaugucagcucucaugugu

SEQ ID NO: 1310068 - RNA, 19 nt, Homo sapiens
cagcacaacuuagggaaau

SEQ ID NO: 1310069 - RNA, 19 nt, Homo sapiens
gcgauuuaguacugcauuu

SEQ ID NO: 1310070 - RNA, 19 nt, Homo sapiens
uggaaugugucgcuaggua

SEQ ID NO: 1310071 - RNA, 19 nt, Homo sapiens
ucacuuccaucugcaauau

SEQ ID NO: 1310072 - RNA, 19 nt, Homo sapiens
ggucuaaaccaaaggaaga

SEQ ID NO: 1310073 - RNA, 19 nt, Homo sapiens
gagauugaauaaacagucu

SEQ ID NO: 1310074 - RNA, 19 nt, Homo sapiens
gcagaggcguuccuuaagc

SEQ ID NO: 1310075 - RNA, 19 nt, Homo sapiens
gaaaguaagaauugcaucu

SEQ ID NO: 1310076 - RNA, 19 nt, Homo sapiens
uggacagggugauuuaauu

SEQ ID NO: 1310077 - RNA, 19 nt, Homo sapiens
ggaacagaggugcccuuua

SEQ ID NO: 1310078 - RNA, 19 nt, Homo sapiens
ccaagcagcguucaauguu

SEQ ID NO: 1310079 - RNA, 19 nt, Homo sapiens
acagagcauuaaagacuaa

SEQ ID NO: 1310080 - RNA, 19 nt, Homo sapiens
ugaugaaggugaaggugaa

SEQ ID NO: 1310081 - RNA, 19 nt, Homo sapiens
guauggcgauuuaguacug

SEQ ID NO: 1310082 - RNA, 19 nt, Homo sapiens
ucauguguauccaaguuaa

SEQ ID NO: 1310083 - RNA, 19 nt, Homo sapiens
ggaguucagccauguguau

SEQ ID NO: 1310084 - RNA, 19 nt, Homo sapiens
acuuccaucugcaauauua

SEQ ID NO: 1310085 - RNA, 19 nt, Homo sapiens
aaaguacuguuuaguugga

SEQ ID NO: 1310086 - RNA, 19 nt, Homo sapiens
uaaguagucuuccuuuuga

SEQ ID NO: 1310087 - RNA, 19 nt, Homo sapiens
acaaggagcaaagauuaua

SEQ ID NO: 1310088 - RNA, 19 nt, Homo sapiens
augcacaaaugaucucuaa

SEQ ID NO: 1310089 - RNA, 19 nt, Homo sapiens
agaggugcccuuuagcuua

SEQ ID NO: 1310090 - RNA, 19 nt, Homo sapiens
gguucuugauucccuuaua

SEQ ID NO: 1310091 - RNA, 19 nt, Homo sapiens
ucacauacuuacaacucaa

SEQ ID NO: 1310092 - RNA, 19 nt, Homo sapiens
gcaccuaguauaauuucuu

SEQ ID NO: 1310093 - RNA, 19 nt, Homo sapiens
ucacuacgcucaguuuuaa

SEQ ID NO: 1310094 - RNA, 19 nt, Homo sapiens
gaaguauccagaaggaaau

SEQ ID NO: 1310095 - RNA, 19 nt, Homo sapiens
gaggugcccuuuagcuuac

SEQ ID NO: 1310096 - RNA, 19 nt, Homo sapiens
gaagaaugugucugugguu

SEQ ID NO: 1310097 - RNA, 19 nt, Homo sapiens
gcagauaaaagaaaaggua

SEQ ID NO: 1310098 - RNA, 19 nt, Homo sapiens
guucaauguuuaccuuugu

SEQ ID NO: 1310099 - RNA, 19 nt, Homo sapiens
guucagccauguguaucua

SEQ ID NO: 1310100 - RNA, 19 nt, Homo sapiens
gauaaacccuggcauauuu

SEQ ID NO: 1310101 - RNA, 19 nt, Homo sapiens
gaacauaggacuucaggua

SEQ ID NO: 1310102 - RNA, 19 nt, Homo sapiens
ggagaaggcuugcaagaag

SEQ ID NO: 1310103 - RNA, 19 nt, Homo sapiens
gaccauggguaauuaauau

SEQ ID NO: 1310104 - RNA, 19 nt, Homo sapiens
caaggaagauacagaaauc

SEQ ID NO: 1310105 - RNA, 19 nt, Homo sapiens
aaacgacgaucauuaacaa

SEQ ID NO: 1310106 - RNA, 19 nt, Homo sapiens
gagacggcuuugcucauua

SEQ ID NO: 1310107 - RNA, 19 nt, Homo sapiens
gauuguacguagaauguuu

SEQ ID NO: 1310108 - RNA, 19 nt, Homo sapiens
aaagaaggccaagcuauua

SEQ ID NO: 1310109 - RNA, 19 nt, Homo sapiens
caagcugguuuguaaauau

SEQ ID NO: 1310110 - RNA, 19 nt, Homo sapiens
gaagaaggagguucauguu

SEQ ID NO: 1310111 - RNA, 19 nt, Homo sapiens
uaaagaaggccaagcuauu

SEQ ID NO: 1310112 - RNA, 19 nt, Homo sapiens
ggaccauggguaauuaaua

SEQ ID NO: 1310113 - RNA, 19 nt, Homo sapiens
gauggaaagucacaauaca

SEQ ID NO: 1310114 - RNA, 19 nt, Homo sapiens
aaagauaaacccuggcaua

SEQ ID NO: 1310115 - RNA, 19 nt, Homo sapiens
gaaggccaagcuauuauuu

SEQ ID NO: 1310116 - RNA, 19 nt, Homo sapiens
gaaaagugauggaaaguca

SEQ ID NO: 1310117 - RNA, 19 nt, Homo sapiens
gcaaaacgacgaucauuaa

SEQ ID NO: 1310118 - RNA, 19 nt, Homo sapiens
caaggaaucuaucuaagac

SEQ ID NO: 1310119 - RNA, 19 nt, Homo sapiens
gugaagacaugaaaagaua

SEQ ID NO: 1310120 - RNA, 19 nt, Homo sapiens
aagaagaacucgauacucu

SEQ ID NO: 1310121 - RNA, 19 nt, Homo sapiens
gaaugguuguggccaaaga

SEQ ID NO: 1310122 - RNA, 19 nt, Homo sapiens
gaaggucuacauuugauug

SEQ ID NO: 1310123 - RNA, 19 nt, Homo sapiens
acaauaggauucagcauag

SEQ ID NO: 1310124 - RNA, 19 nt, Homo sapiens
ucgauacucuucugaauca

SEQ ID NO: 1310125 - RNA, 19 nt, Homo sapiens
ucauccaguuugucauuua

SEQ ID NO: 1310126 - RNA, 19 nt, Homo sapiens
caaaauauccuuccaacaa

SEQ ID NO: 1310127 - RNA, 19 nt, Homo sapiens
uagugaaggucuacauuug

SEQ ID NO: 1310128 - RNA, 19 nt, Homo sapiens
uuggaaaccucagcaauuu

SEQ ID NO: 1310129 - RNA, 19 nt, Homo sapiens
cagcauagagaaauucaaa

SEQ ID NO: 1310130 - RNA, 19 nt, Homo sapiens
uagacuggcuucaagauca

SEQ ID NO: 1310131 - RNA, 19 nt, Homo sapiens
ucucaucccaucauaauuu

SEQ ID NO: 1310132 - RNA, 19 nt, Homo sapiens
agugauagauuaagaaugg

SEQ ID NO: 1310133 - RNA, 19 nt, Homo sapiens
gcauagagaaauucaaauc

SEQ ID NO: 1310134 - RNA, 19 nt, Homo sapiens
gaaggagguucauguuuug

SEQ ID NO: 1310135 - RNA, 19 nt, Homo sapiens
gauauuaaacaccgucgaa

SEQ ID NO: 1310136 - RNA, 19 nt, Homo sapiens
uauaagggaccauggguaa

SEQ ID NO: 1310137 - RNA, 19 nt, Homo sapiens
caugucaggucaaggaaga

SEQ ID NO: 1310138 - RNA, 19 nt, Homo sapiens
ugccugcucuucuaaauug

SEQ ID NO: 1310139 - RNA, 19 nt, Homo sapiens
cuucagguaugcuaauuug

SEQ ID NO: 1310140 - RNA, 19 nt, Homo sapiens
ucaaggaaucuaucuaaga

SEQ ID NO: 1310141 - RNA, 19 nt, Homo sapiens
ugucucaguugcuguguuu

SEQ ID NO: 1310142 - RNA, 19 nt, Homo sapiens
gugaaggucuacauuugau

SEQ ID NO: 1310143 - RNA, 19 nt, Homo sapiens
ggucaaggaagauacagaa

SEQ ID NO: 1310144 - RNA, 19 nt, Homo sapiens
guuggaaaccucagcaauu

SEQ ID NO: 1310145 - RNA, 19 nt, Homo sapiens
ucugggaacacuauuauaa

SEQ ID NO: 1310146 - RNA, 19 nt, Homo sapiens
agagacggcuuugcucauu

SEQ ID NO: 1310147 - RNA, 19 nt, Homo sapiens
gauaauccauggaaaagug

SEQ ID NO: 1310148 - RNA, 19 nt, Homo sapiens
caagugauaauccauggaa

SEQ ID NO: 1310149 - RNA, 19 nt, Homo sapiens
aagggaccauggguaauua

SEQ ID NO: 1310150 - RNA, 19 nt, Homo sapiens
ugacuuugcaguaugaauu

SEQ ID NO: 1310151 - RNA, 19 nt, Homo sapiens
gauucagcauagagaaauu

SEQ ID NO: 1310152 - RNA, 19 nt, Homo sapiens
agaaggagguucauguuuu

SEQ ID NO: 1310153 - RNA, 19 nt, Homo sapiens
uaagggaccauggguaauu

SEQ ID NO: 1310154 - RNA, 19 nt, Homo sapiens
gguguagacuggcuucaag

SEQ ID NO: 1310155 - RNA, 19 nt, Homo sapiens
gaacucgauacucuucuga

SEQ ID NO: 1310156 - RNA, 19 nt, Homo sapiens
uaaauugugugucccaaaa

SEQ ID NO: 1310157 - RNA, 19 nt, Homo sapiens
aacaauaggauucagcaua

SEQ ID NO: 1310158 - RNA, 19 nt, Homo sapiens
guuuaugacuuugcaguau

SEQ ID NO: 1310159 - RNA, 19 nt, Homo sapiens
caaagaagaacucgauacu

SEQ ID NO: 1310160 - RNA, 19 nt, Homo sapiens
gauccagacugugaagaca

SEQ ID NO: 1310161 - RNA, 19 nt, Homo sapiens
gggaacacuauuauaaaga

SEQ ID NO: 1310162 - RNA, 19 nt, Homo sapiens
gacgaucauuaacaaacuu

SEQ ID NO: 1310163 - RNA, 19 nt, Homo sapiens
cucaucccaucauaauuua

SEQ ID NO: 1310164 - RNA, 19 nt, Homo sapiens
caucucaucccaucauaau

SEQ ID NO: 1310165 - RNA, 19 nt, Homo sapiens
guuuagagaacaucaaaga

SEQ ID NO: 1310166 - RNA, 19 nt, Homo sapiens
gaaagucacaauacaagcu

SEQ ID NO: 1310167 - RNA, 19 nt, Homo sapiens
gccaucucaucccaucaua

SEQ ID NO: 1310168 - RNA, 19 nt, Homo sapiens
gcauauuugugcuagugau

SEQ ID NO: 1310169 - RNA, 19 nt, Homo sapiens
ccgucgaauuccaaucuua

SEQ ID NO: 1310170 - RNA, 19 nt, Homo sapiens
gcuagauaauaguggcaaa

SEQ ID NO: 1310171 - RNA, 19 nt, Homo sapiens
gccuugggcuagauaauag

SEQ ID NO: 1310172 - RNA, 19 nt, Homo sapiens
gcugguuuguaaauauuug

SEQ ID NO: 1310173 - RNA, 19 nt, Homo sapiens
ggaaucuaucuaagacaaa

SEQ ID NO: 1310174 - RNA, 19 nt, Homo sapiens
ccaaucuuauucuuugcaa

SEQ ID NO: 1310175 - RNA, 19 nt, Homo sapiens
ugggaacacuauuauaaag

SEQ ID NO: 1310176 - RNA, 19 nt, Homo sapiens
caauaggauucagcauaga

SEQ ID NO: 1310177 - RNA, 19 nt, Homo sapiens
cgacgaucauuaacaaacu

SEQ ID NO: 1310178 - RNA, 19 nt, Homo sapiens
gacuucagguaugcuaauu

SEQ ID NO: 1310179 - RNA, 19 nt, Homo sapiens
ggacuucagguaugcuaau

SEQ ID NO: 1310180 - RNA, 19 nt, Homo sapiens
aggaaucuaucuaagacaa

SEQ ID NO: 1310181 - RNA, 19 nt, Homo sapiens
ucaaggaagauacagaaau

SEQ ID NO: 1310182 - RNA, 19 nt, Homo sapiens
uuagugaaggucuacauuu

SEQ ID NO: 1310183 - RNA, 19 nt, Homo sapiens
ucuuagagaugcagugaca

SEQ ID NO: 1310184 - RNA, 19 nt, Homo sapiens
uauuaaacaccgucgaauu

SEQ ID NO: 1310185 - RNA, 19 nt, Homo sapiens
ucaaaugcucaaucucaaa

SEQ ID NO: 1310186 - RNA, 19 nt, Homo sapiens
uuaugacuuugcaguauga

SEQ ID NO: 1310187 - RNA, 19 nt, Homo sapiens
caggcauccuucccaugua

SEQ ID NO: 1310188 - RNA, 19 nt, Homo sapiens
agaagaaggagguucaugu

SEQ ID NO: 1310189 - RNA, 19 nt, Homo sapiens
ccuccggacuaaccucaaa

SEQ ID NO: 1310190 - RNA, 19 nt, Homo sapiens
gguuguggccaaagaagaa

SEQ ID NO: 1310191 - RNA, 19 nt, Homo sapiens
ggauucagcauagagaaau

SEQ ID NO: 1310192 - RNA, 19 nt, Homo sapiens
aagaaggagguucauguuu

SEQ ID NO: 1310193 - RNA, 19 nt, Homo sapiens
aaacugccugcucuucuaa

SEQ ID NO: 1310194 - RNA, 19 nt, Homo sapiens
caguaugaauugugcuugu

SEQ ID NO: 1310195 - RNA, 19 nt, Homo sapiens
agauaaacccuggcauauu

SEQ ID NO: 1310196 - RNA, 19 nt, Homo sapiens
caguugcuguguuuagaga

SEQ ID NO: 1310197 - RNA, 19 nt, Homo sapiens
cugaaucauccagauauua

SEQ ID NO: 1310198 - RNA, 19 nt, Homo sapiens
ggccaaagaagaacucgau

SEQ ID NO: 1310199 - RNA, 19 nt, Homo sapiens
agaaaucucugggaacacu

SEQ ID NO: 1310200 - RNA, 19 nt, Homo sapiens
ggaaauacuugcuauauga

SEQ ID NO: 1310201 - RNA, 19 nt, Homo sapiens
gaaagagguugauuuguaa

SEQ ID NO: 1310202 - RNA, 19 nt, Homo sapiens
ugaaagagguugauuugua

SEQ ID NO: 1310203 - RNA, 19 nt, Homo sapiens
gaacaugguuugaacaauc

SEQ ID NO: 1310204 - RNA, 19 nt, Homo sapiens
guagaaagauggaacuuau

SEQ ID NO: 1310205 - RNA, 19 nt, Homo sapiens
gaauuggaguaucaaguua

SEQ ID NO: 1310206 - RNA, 19 nt, Homo sapiens
gaagauugguguucauguu

SEQ ID NO: 1310207 - RNA, 19 nt, Homo sapiens
gcugauaccucgucuaaug

SEQ ID NO: 1310208 - RNA, 19 nt, Homo sapiens
guaacaggauugagaaauu

SEQ ID NO: 1310209 - RNA, 19 nt, Homo sapiens
gaaaguaugccuccaagaa

SEQ ID NO: 1310210 - RNA, 19 nt, Homo sapiens
uacagaaacugaagcuuua

SEQ ID NO: 1310211 - RNA, 19 nt, Homo sapiens
gaaggauacuaauggguaa

SEQ ID NO: 1310212 - RNA, 19 nt, Homo sapiens
ggacugaccucugaguuau

SEQ ID NO: 1310213 - RNA, 19 nt, Homo sapiens
agacugauguuaccucuuu

SEQ ID NO: 1310214 - RNA, 19 nt, Homo sapiens
caagaaagaguuuacguuu

SEQ ID NO: 1310215 - RNA, 19 nt, Homo sapiens
aaaggaaacucaucaaaca

SEQ ID NO: 1310216 - RNA, 19 nt, Homo sapiens
acaagacgcucaggaauuu

SEQ ID NO: 1310217 - RNA, 19 nt, Homo sapiens
aaacgaaggccaauaguaa

SEQ ID NO: 1310218 - RNA, 19 nt, Homo sapiens
caaauaccauagaaccuuu

SEQ ID NO: 1310219 - RNA, 19 nt, Homo sapiens
guacaggugaugauucuua

SEQ ID NO: 1310220 - RNA, 19 nt, Homo sapiens
ucaaacaaguucugaaugu

SEQ ID NO: 1310221 - RNA, 19 nt, Homo sapiens
cagaaugcuuuaucuauga

SEQ ID NO: 1310222 - RNA, 19 nt, Homo sapiens
gggaaauacuugcuauaug

SEQ ID NO: 1310223 - RNA, 19 nt, Homo sapiens
ggaauuggaguaucaaguu

SEQ ID NO: 1310224 - RNA, 19 nt, Homo sapiens
ccagaaacaacuuaugaua

SEQ ID NO: 1310225 - RNA, 19 nt, Homo sapiens
aauaguaacuccuggugua

SEQ ID NO: 1310226 - RNA, 19 nt, Homo sapiens
gcaaucuucuaccaacaaa

SEQ ID NO: 1310227 - RNA, 19 nt, Homo sapiens
aaacuaagcaugugcacua

SEQ ID NO: 1310228 - RNA, 19 nt, Homo sapiens
ccagaaugcuuuaucuaug

SEQ ID NO: 1310229 - RNA, 19 nt, Homo sapiens
cagcuagacuaaauaaaug

SEQ ID NO: 1310230 - RNA, 19 nt, Homo sapiens
gagccaacaucccaaugaa

SEQ ID NO: 1310231 - RNA, 19 nt, Homo sapiens
gagagaagauugguguuca

SEQ ID NO: 1310232 - RNA, 19 nt, Homo sapiens
aaagacugauguaccauuu

SEQ ID NO: 1310233 - RNA, 19 nt, Homo sapiens
gaacuugugcaaucuucua

SEQ ID NO: 1310234 - RNA, 19 nt, Homo sapiens
agaaagaguuuacguuuac

SEQ ID NO: 1310235 - RNA, 19 nt, Homo sapiens
gaagaucaacuguauacug

SEQ ID NO: 1310236 - RNA, 19 nt, Homo sapiens
ggaauuucuuugugaacuu

SEQ ID NO: 1310237 - RNA, 19 nt, Homo sapiens
gcucaggaauuucuuugug

SEQ ID NO: 1310238 - RNA, 19 nt, Homo sapiens
caagucauguggucuggaa

SEQ ID NO: 1310239 - RNA, 19 nt, Homo sapiens
caaaggagccaacuucaca

SEQ ID NO: 1310240 - RNA, 19 nt, Homo sapiens
gaaagcagucauccuguug

SEQ ID NO: 1310241 - RNA, 19 nt, Homo sapiens
gcaaggcucaagcuuauau

SEQ ID NO: 1310242 - RNA, 19 nt, Homo sapiens
ggacuugucauuggaguuu

SEQ ID NO: 1310243 - RNA, 19 nt, Homo sapiens
gggacugaccucugaguua

SEQ ID NO: 1310244 - RNA, 19 nt, Homo sapiens
ggccaggacuuuucacuua

SEQ ID NO: 1310245 - RNA, 19 nt, Homo sapiens
gucaugaauugcauacuuu

SEQ ID NO: 1310246 - RNA, 19 nt, Homo sapiens
agucacagauacaguagua

SEQ ID NO: 1310247 - RNA, 19 nt, Homo sapiens
uacauuaagugccaucaaa

SEQ ID NO: 1310248 - RNA, 19 nt, Homo sapiens
gcagucauccuguugcauu

SEQ ID NO: 1310249 - RNA, 19 nt, Homo sapiens
aagcagaauuggaaaguau

SEQ ID NO: 1310250 - RNA, 19 nt, Homo sapiens
uuacagaaacugaagcuuu

SEQ ID NO: 1310251 - RNA, 19 nt, Homo sapiens
ccagaaagguaucaaugca

SEQ ID NO: 1310252 - RNA, 19 nt, Homo sapiens
gacaacaaaucaaauacca

SEQ ID NO: 1310253 - RNA, 19 nt, Homo sapiens
ggaaacucaucaaacaagu

SEQ ID NO: 1310254 - RNA, 19 nt, Homo sapiens
uaaacgaaggccaauagua

SEQ ID NO: 1310255 - RNA, 19 nt, Homo sapiens
ugaaugagauguacguuuu

SEQ ID NO: 1310256 - RNA, 19 nt, Homo sapiens
caacugaagguaacuacuu

SEQ ID NO: 1310257 - RNA, 19 nt, Homo sapiens
cuacguaugugaccagugu

SEQ ID NO: 1310258 - RNA, 19 nt, Homo sapiens
guacauuucucuuugucau

SEQ ID NO: 1310259 - RNA, 19 nt, Homo sapiens
cacaguacauuucucuuug

SEQ ID NO: 1310260 - RNA, 19 nt, Homo sapiens
caacuucacaguacauuuc

SEQ ID NO: 1310261 - RNA, 19 nt, Homo sapiens
caaguggcaucauuuuaua

SEQ ID NO: 1310262 - RNA, 19 nt, Homo sapiens
caacuucuuagucagguua

SEQ ID NO: 1310263 - RNA, 19 nt, Homo sapiens
ggagccaacuucacaguac

SEQ ID NO: 1310264 - RNA, 19 nt, Homo sapiens
gguagaaagauggaacuua

SEQ ID NO: 1310265 - RNA, 19 nt, Homo sapiens
acacugcaaugauuccaaa

SEQ ID NO: 1310266 - RNA, 19 nt, Homo sapiens
gaauuagagacaacuggua

SEQ ID NO: 1310267 - RNA, 19 nt, Homo sapiens
caacgugaauuagagacaa

SEQ ID NO: 1310268 - RNA, 19 nt, Homo sapiens
ucacaguacauuucucuuu

SEQ ID NO: 1310269 - RNA, 19 nt, Homo sapiens
gguguugagucauuuacuu

SEQ ID NO: 1310270 - RNA, 19 nt, Homo sapiens
gguaaaaucuuucgaacau

SEQ ID NO: 1310271 - RNA, 19 nt, Homo sapiens
ucagaugcuucaaguguug

SEQ ID NO: 1310272 - RNA, 19 nt, Homo sapiens
uaaaugcuagcaauggaua

SEQ ID NO: 1310273 - RNA, 19 nt, Homo sapiens
acagagacuuguuuggauu

SEQ ID NO: 1310274 - RNA, 19 nt, Homo sapiens
gcccagaaacaacuuauga

SEQ ID NO: 1310275 - RNA, 19 nt, Homo sapiens
caaaccaguuguacucaca

SEQ ID NO: 1310276 - RNA, 19 nt, Homo sapiens
gagacucauuccugccuuu

SEQ ID NO: 1310277 - RNA, 19 nt, Homo sapiens
ggcaggaauuggaguauca

SEQ ID NO: 1310278 - RNA, 19 nt, Homo sapiens
cugcaaugauuccaaacua

SEQ ID NO: 1310279 - RNA, 19 nt, Homo sapiens
cauguuggcuuugaggaaa

SEQ ID NO: 1310280 - RNA, 19 nt, Homo sapiens
ugaauugcauacuuuguuc

SEQ ID NO: 1310281 - RNA, 19 nt, Homo sapiens
caggugaugauucuuauuu

SEQ ID NO: 1310282 - RNA, 19 nt, Homo sapiens
uuaauuggcucggaugaug

SEQ ID NO: 1310283 - RNA, 19 nt, Homo sapiens
ggagccaacaucccaauga

SEQ ID NO: 1310284 - RNA, 19 nt, Homo sapiens
ugucaugaauugcauacuu

SEQ ID NO: 1310285 - RNA, 19 nt, Homo sapiens
agaaagcagucauccuguu

SEQ ID NO: 1310286 - RNA, 19 nt, Homo sapiens
gugaaucaguguauacuac

SEQ ID NO: 1310287 - RNA, 19 nt, Homo sapiens
ccucagaccagaaugcuuu

SEQ ID NO: 1310288 - RNA, 19 nt, Homo sapiens
guaauaaccgagagaagau

SEQ ID NO: 1310289 - RNA, 19 nt, Homo sapiens
ucacagaagcccagaaaca

SEQ ID NO: 1310290 - RNA, 19 nt, Homo sapiens
caacaagacgcucaggaau

SEQ ID NO: 1310291 - RNA, 19 nt, Homo sapiens
gaaagaguuuacguuuaca

SEQ ID NO: 1310292 - RNA, 19 nt, Homo sapiens
aaagcaagaagaaccauuu

SEQ ID NO: 1310293 - RNA, 19 nt, Homo sapiens
aagugaagaucaacuguau

SEQ ID NO: 1310294 - RNA, 19 nt, Homo sapiens
gcauuugcccugauggaaa

SEQ ID NO: 1310295 - RNA, 19 nt, Homo sapiens
agacugauguaccauuuua

SEQ ID NO: 1310296 - RNA, 19 nt, Homo sapiens
ccaacgaguuacugagaau

SEQ ID NO: 1310297 - RNA, 19 nt, Homo sapiens
gaaacaacuuaugauaugc

SEQ ID NO: 1310298 - RNA, 19 nt, Homo sapiens
ucaaaggaaacucaucaaa

SEQ ID NO: 1310299 - RNA, 19 nt, Homo sapiens
ucaggaauuucuuugugaa

SEQ ID NO: 1310300 - RNA, 19 nt, Homo sapiens
gaagaucuauuaccgauaa

SEQ ID NO: 1310301 - RNA, 19 nt, Homo sapiens
gaaaggacccggauaguuu

SEQ ID NO: 1310302 - RNA, 19 nt, Homo sapiens
ggucauacuucuuuaacua

SEQ ID NO: 1310303 - RNA, 19 nt, Homo sapiens
gaggauaaauuuaccaguu

SEQ ID NO: 1310304 - RNA, 19 nt, Homo sapiens
agaaaccacugccauguua

SEQ ID NO: 1310305 - RNA, 19 nt, Homo sapiens
gcaaauacuugugcccuuu

SEQ ID NO: 1310306 - RNA, 19 nt, Homo sapiens
uauaauagcugccaaacau

SEQ ID NO: 1310307 - RNA, 19 nt, Homo sapiens
gcucugaaauuaauuagga

SEQ ID NO: 1310308 - RNA, 19 nt, Homo sapiens
uaauaagucugcucaaguu

SEQ ID NO: 1310309 - RNA, 19 nt, Homo sapiens
caagauggauuaucaacug

SEQ ID NO: 1310310 - RNA, 19 nt, Homo sapiens
aagcagagcucuaguuuag

SEQ ID NO: 1310311 - RNA, 19 nt, Homo sapiens
gacauuggcauccagauua

SEQ ID NO: 1310312 - RNA, 19 nt, Homo sapiens
aaagggaacuuggaaauga

SEQ ID NO: 1310313 - RNA, 19 nt, Homo sapiens
caacugcaguacagacuuu

SEQ ID NO: 1310314 - RNA, 19 nt, Homo sapiens
ugaugaagaugcuauugua

SEQ ID NO: 1310315 - RNA, 19 nt, Homo sapiens
cuacauuucuccauuaguu

SEQ ID NO: 1310316 - RNA, 19 nt, Homo sapiens
ccacaaacauagcagaaau

SEQ ID NO: 1310317 - RNA, 19 nt, Homo sapiens
uauaggauguuuacaguga

SEQ ID NO: 1310318 - RNA, 19 nt, Homo sapiens
ccuuauaacucuugccaua

SEQ ID NO: 1310319 - RNA, 19 nt, Homo sapiens
gauuggacuuuacguuuaa

SEQ ID NO: 1310320 - RNA, 19 nt, Homo sapiens
caaagaagacugguauaaa

SEQ ID NO: 1310321 - RNA, 19 nt, Homo sapiens
ugaagaugcuauuguagaa

SEQ ID NO: 1310322 - RNA, 19 nt, Homo sapiens
gaagcagagcucuaguuua

SEQ ID NO: 1310323 - RNA, 19 nt, Homo sapiens
agauuggacuuuacguuua

SEQ ID NO: 1310324 - RNA, 19 nt, Homo sapiens
caucauggcauugcaaaua

SEQ ID NO: 1310325 - RNA, 19 nt, Homo sapiens
uaacaaugcccaccucuau

SEQ ID NO: 1310326 - RNA, 19 nt, Homo sapiens
ggaaaggacccggauaguu

SEQ ID NO: 1310327 - RNA, 19 nt, Homo sapiens
ccuaauaauuggcaacuug

SEQ ID NO: 1310328 - RNA, 19 nt, Homo sapiens
gaguaugguuccagugauu

SEQ ID NO: 1310329 - RNA, 19 nt, Homo sapiens
guccaggaguaaauaauaa

SEQ ID NO: 1310330 - RNA, 19 nt, Homo sapiens
uccauuaguugguguauuu

SEQ ID NO: 1310331 - RNA, 19 nt, Homo sapiens
guaauuugguggccauuca

SEQ ID NO: 1310332 - RNA, 19 nt, Homo sapiens
ggaauccaguggcaucaug

SEQ ID NO: 1310333 - RNA, 19 nt, Homo sapiens
ccacugccauguuacaaga

SEQ ID NO: 1310334 - RNA, 19 nt, Homo sapiens
uaagucugcucaaguucua

SEQ ID NO: 1310335 - RNA, 19 nt, Homo sapiens
gcucucaaguuaccaagga

SEQ ID NO: 1310336 - RNA, 19 nt, Homo sapiens
gguccaggaguaaauaaua

SEQ ID NO: 1310337 - RNA, 19 nt, Homo sapiens
ugagaccuauuacuacauu

SEQ ID NO: 1310338 - RNA, 19 nt, Homo sapiens
cauauuggcuuggauaagu

SEQ ID NO: 1310339 - RNA, 19 nt, Homo sapiens
ucaaagaagacugguauaa

SEQ ID NO: 1310340 - RNA, 19 nt, Homo sapiens
ucccgaagcuugagaucua

SEQ ID NO: 1310341 - RNA, 19 nt, Homo sapiens
aaaccagaaugaagaguau

SEQ ID NO: 1310342 - RNA, 19 nt, Homo sapiens
agugauuccuggacauuua

SEQ ID NO: 1310343 - RNA, 19 nt, Homo sapiens
gguuguuacuacccauuua

SEQ ID NO: 1310344 - RNA, 19 nt, Homo sapiens
gaauauaggauguuuacag

SEQ ID NO: 1310345 - RNA, 19 nt, Homo sapiens
cagauuauccacugcagua

SEQ ID NO: 1310346 - RNA, 19 nt, Homo sapiens
ucaucaagcugcagccaaa

SEQ ID NO: 1310347 - RNA, 19 nt, Homo sapiens
ccucuacacuauucauuug

SEQ ID NO: 1310348 - RNA, 19 nt, Homo sapiens
guuggagacuaauaaauuc

SEQ ID NO: 1310349 - RNA, 19 nt, Homo sapiens
cuaccuaccuccauuuaca

SEQ ID NO: 1310350 - RNA, 19 nt, Homo sapiens
uaugcuagcugaggauaaa

SEQ ID NO: 1310351 - RNA, 19 nt, Homo sapiens
caaccaagcuuugaaucgu

SEQ ID NO: 1310352 - RNA, 19 nt, Homo sapiens
gagcucuaguuuagccuuu

SEQ ID NO: 1310353 - RNA, 19 nt, Homo sapiens
gaucugagcaacacaugga

SEQ ID NO: 1310354 - RNA, 19 nt, Homo sapiens
gugaugacaauaugacuaa

SEQ ID NO: 1310355 - RNA, 19 nt, Homo sapiens
ggaaagaauauaggauguu

SEQ ID NO: 1310356 - RNA, 19 nt, Homo sapiens
cagcuaugguuauaaguag

SEQ ID NO: 1310357 - RNA, 19 nt, Homo sapiens
ccaaaaguaugaugacuau

SEQ ID NO: 1310358 - RNA, 19 nt, Homo sapiens
accaguugcucauauuuaa

SEQ ID NO: 1310359 - RNA, 19 nt, Homo sapiens
ugguugggauuguuguuua

SEQ ID NO: 1310360 - RNA, 19 nt, Homo sapiens
uuaccuugaucauuccaua

SEQ ID NO: 1310361 - RNA, 19 nt, Homo sapiens
gaaaaguggaaccuaauaa

SEQ ID NO: 1310362 - RNA, 19 nt, Homo sapiens
ccaguggcaucauggcauu

SEQ ID NO: 1310363 - RNA, 19 nt, Homo sapiens
ugauucaucugcugugguu

SEQ ID NO: 1310364 - RNA, 19 nt, Homo sapiens
uagauuggacuuuacguuu

SEQ ID NO: 1310365 - RNA, 19 nt, Homo sapiens
guucaaagaagacugguau

SEQ ID NO: 1310366 - RNA, 19 nt, Homo sapiens
gcaugguacuggauauagu

SEQ ID NO: 1310367 - RNA, 19 nt, Homo sapiens
ccaggguaaucuucaguug

SEQ ID NO: 1310368 - RNA, 19 nt, Homo sapiens
gcucaaguucuacugcuuu

SEQ ID NO: 1310369 - RNA, 19 nt, Homo sapiens
cuagcaggauuucuaccua

SEQ ID NO: 1310370 - RNA, 19 nt, Homo sapiens
gaucauuccauacuucugu

SEQ ID NO: 1310371 - RNA, 19 nt, Homo sapiens
acugggagguguucagaaa

SEQ ID NO: 1310372 - RNA, 19 nt, Homo sapiens
aggauaaauuuaccaguug

SEQ ID NO: 1310373 - RNA, 19 nt, Homo sapiens
aaacuugguugggauuguu

SEQ ID NO: 1310374 - RNA, 19 nt, Homo sapiens
aaacauccagccacaagaa

SEQ ID NO: 1310375 - RNA, 19 nt, Homo sapiens
ugaugacuaugccaauuau

SEQ ID NO: 1310376 - RNA, 19 nt, Homo sapiens
agaagcagagcucuaguuu

SEQ ID NO: 1310377 - RNA, 19 nt, Homo sapiens
ggauguuuacagugaauaa

SEQ ID NO: 1310378 - RNA, 19 nt, Homo sapiens
ggaagaaaauacacgacaa

SEQ ID NO: 1310379 - RNA, 19 nt, Homo sapiens
gagauguuggagacuaaua

SEQ ID NO: 1310380 - RNA, 19 nt, Homo sapiens
uuaaugguauuggugguaa

SEQ ID NO: 1310381 - RNA, 19 nt, Homo sapiens
agaagugaccccaaaauua

SEQ ID NO: 1310382 - RNA, 19 nt, Homo sapiens
uaugaugacuaugccaauu

SEQ ID NO: 1310383 - RNA, 19 nt, Homo sapiens
guaugguuccagugauuua

SEQ ID NO: 1310384 - RNA, 19 nt, Homo sapiens
gauguuggagacuaauaaa

SEQ ID NO: 1310385 - RNA, 19 nt, Homo sapiens
caaagggaacuuggaaaug

SEQ ID NO: 1310386 - RNA, 19 nt, Homo sapiens
ucaaagggaacuuggaaau

SEQ ID NO: 1310387 - RNA, 19 nt, Homo sapiens
aaccaagcuuugaaucgua

SEQ ID NO: 1310388 - RNA, 19 nt, Homo sapiens
ccagcucugaaauuaauua

SEQ ID NO: 1310389 - RNA, 19 nt, Homo sapiens
aguuccagcucugaaauua

SEQ ID NO: 1310390 - RNA, 19 nt, Homo sapiens
aaguggaaccuaauaauug

SEQ ID NO: 1310391 - RNA, 19 nt, Homo sapiens
ccacugcaguaaauauugg

SEQ ID NO: 1310392 - RNA, 19 nt, Homo sapiens
cagaaaaguuacagaaguu

SEQ ID NO: 1310393 - RNA, 19 nt, Homo sapiens
ggaagaucuauuaccgaua

SEQ ID NO: 1310394 - RNA, 19 nt, Homo sapiens
ccaagaagacaggcacaaa

SEQ ID NO: 1310395 - RNA, 19 nt, Homo sapiens
uaccaguugcucauauuua

SEQ ID NO: 1310396 - RNA, 19 nt, Homo sapiens
gcuagcugaggauaaauuu

SEQ ID NO: 1310397 - RNA, 19 nt, Homo sapiens
ugaaucguauuaacaaugc

SEQ ID NO: 1310398 - RNA, 19 nt, Homo sapiens
caaguuaccaaggaagaaa

SEQ ID NO: 1310399 - RNA, 19 nt, Homo sapiens
ggagacuaauaaauucuac

SEQ ID NO: 1310400 - RNA, 19 nt, Homo sapiens
gcaaagcucuguagcauuu

SEQ ID NO: 1310401 - RNA, 19 nt, Homo sapiens
gagaaucccuuaguaauua

SEQ ID NO: 1310402 - RNA, 19 nt, Homo sapiens
gcacaagccuccacuacuu

SEQ ID NO: 1310403 - RNA, 19 nt, Homo sapiens
gaaaauaccuguugcagaa

SEQ ID NO: 1310404 - RNA, 19 nt, Homo sapiens
gaagugaggucaaucaagu

SEQ ID NO: 1310405 - RNA, 19 nt, Homo sapiens
ggcaaaggcagccauauua

SEQ ID NO: 1310406 - RNA, 19 nt, Homo sapiens
gaauaugagcuucacauuu

SEQ ID NO: 1310407 - RNA, 19 nt, Homo sapiens
caaggaguauacaagaaua

SEQ ID NO: 1310408 - RNA, 19 nt, Homo sapiens
caacagacuugaguucuug

SEQ ID NO: 1310409 - RNA, 19 nt, Homo sapiens
gaagaaacaccucaaugga

SEQ ID NO: 1310410 - RNA, 19 nt, Homo sapiens
gugagaaacuggaugaaga

SEQ ID NO: 1310411 - RNA, 19 nt, Homo sapiens
ggaguaagagugugagaaa

SEQ ID NO: 1310412 - RNA, 19 nt, Homo sapiens
ccacaaacaugaaccucaa

SEQ ID NO: 1310413 - RNA, 19 nt, Homo sapiens
caaagagcauguuauccuu

SEQ ID NO: 1310414 - RNA, 19 nt, Homo sapiens
agaaugaugugaaagcaaa

SEQ ID NO: 1310415 - RNA, 19 nt, Homo sapiens
agauaaaccuguuaacuca

SEQ ID NO: 1310416 - RNA, 19 nt, Homo sapiens
gaagaacaggauaccauuu

SEQ ID NO: 1310417 - RNA, 19 nt, Homo sapiens
uagcuuaagugcagagauu

SEQ ID NO: 1310418 - RNA, 19 nt, Homo sapiens
gggaagccacccacaguua

SEQ ID NO: 1310419 - RNA, 19 nt, Homo sapiens
ugacaaguaccaagaauga

SEQ ID NO: 1310420 - RNA, 19 nt, Homo sapiens
ggauaccauuugccaauug

SEQ ID NO: 1310421 - RNA, 19 nt, Homo sapiens
ggaaucaagugguccucuu

SEQ ID NO: 1310422 - RNA, 19 nt, Homo sapiens
uagacugggugaauucuuu

SEQ ID NO: 1310423 - RNA, 19 nt, Homo sapiens
aaauaccuguugcagaaua

SEQ ID NO: 1310424 - RNA, 19 nt, Homo sapiens
ggaagccacccacaguuaa

SEQ ID NO: 1310425 - RNA, 19 nt, Homo sapiens
cagcuuugauucauucuga

SEQ ID NO: 1310426 - RNA, 19 nt, Homo sapiens
gcaaaggcagccauauuau

SEQ ID NO: 1310427 - RNA, 19 nt, Homo sapiens
aaacacaccacaaacauga

SEQ ID NO: 1310428 - RNA, 19 nt, Homo sapiens
gcaaggaguauacaagaau

SEQ ID NO: 1310429 - RNA, 19 nt, Homo sapiens
gagauaaaccuguuaacuc

SEQ ID NO: 1310430 - RNA, 19 nt, Homo sapiens
ggaagaaauuaaggccaaa

SEQ ID NO: 1310431 - RNA, 19 nt, Homo sapiens
gcacugcaguccagaagag

SEQ ID NO: 1310432 - RNA, 19 nt, Homo sapiens
caaccagagugucaaguca

SEQ ID NO: 1310433 - RNA, 19 nt, Homo sapiens
uaccaagaaugaugugaaa

SEQ ID NO: 1310434 - RNA, 19 nt, Homo sapiens
gaugacaaguaccaagaau

SEQ ID NO: 1310435 - RNA, 19 nt, Homo sapiens
agaagagucugccacauca

SEQ ID NO: 1310436 - RNA, 19 nt, Homo sapiens
gggcaaaggcagccauauu

SEQ ID NO: 1310437 - RNA, 19 nt, Homo sapiens
ggucugagcacaucuggaa

SEQ ID NO: 1310438 - RNA, 19 nt, Homo sapiens
gaugaagacagcuguauuc

SEQ ID NO: 1310439 - RNA, 19 nt, Homo sapiens
gguggcacauguaaaucua

SEQ ID NO: 1310440 - RNA, 19 nt, Homo sapiens
caaaagugcugaccagaga

SEQ ID NO: 1310441 - RNA, 19 nt, Homo sapiens
gaaucaagugguccucuuu

SEQ ID NO: 1310442 - RNA, 19 nt, Homo sapiens
ugagaaucccuuaguaauu

SEQ ID NO: 1310443 - RNA, 19 nt, Homo sapiens
gagaaugcauuuggaacau

SEQ ID NO: 1310444 - RNA, 19 nt, Homo sapiens
gagcuucacauuuacauca

SEQ ID NO: 1310445 - RNA, 19 nt, Homo sapiens
gaagccacccacaguuaaa

SEQ ID NO: 1310446 - RNA, 19 nt, Homo sapiens
aagagugggucucagcuuu

SEQ ID NO: 1310447 - RNA, 19 nt, Homo sapiens
uggccagucuaacuacuua

SEQ ID NO: 1310448 - RNA, 19 nt, Homo sapiens
guucuagacugggugaauu

SEQ ID NO: 1310449 - RNA, 19 nt, Homo sapiens
cagugagaaucccuuagua

SEQ ID NO: 1310450 - RNA, 19 nt, Homo sapiens
gagaagaacaggauaccau

SEQ ID NO: 1310451 - RNA, 19 nt, Homo sapiens
ccaaaggcaugcucuacuc

SEQ ID NO: 1310452 - RNA, 19 nt, Homo sapiens
ugaggucaaucaaguuaga

SEQ ID NO: 1310453 - RNA, 19 nt, Homo sapiens
caacacaccggagguagaa

SEQ ID NO: 1310454 - RNA, 19 nt, Homo sapiens
caagugguccucuuuaugg

SEQ ID NO: 1310455 - RNA, 19 nt, Homo sapiens
caagaaugaugugaaagca

SEQ ID NO: 1310456 - RNA, 19 nt, Homo sapiens
ggaugaagacagcuguauu

SEQ ID NO: 1310457 - RNA, 19 nt, Homo sapiens
caagaucaccugcuuuuaa

SEQ ID NO: 1310458 - RNA, 19 nt, Homo sapiens
ggucucagcuuugauucau

SEQ ID NO: 1310459 - RNA, 19 nt, Homo sapiens
gagugggucucagcuuuga

SEQ ID NO: 1310460 - RNA, 19 nt, Homo sapiens
gcagagauuuaaggagauc

SEQ ID NO: 1310461 - RNA, 19 nt, Homo sapiens
gcuuaagugcagagauuua

SEQ ID NO: 1310462 - RNA, 19 nt, Homo sapiens
gauuuaaggagaucaacaa

SEQ ID NO: 1310463 - RNA, 19 nt, Homo sapiens
gaauauuucagcaaaccaa

SEQ ID NO: 1310464 - RNA, 19 nt, Homo sapiens
uaaaucaccacccacaguu

SEQ ID NO: 1310465 - RNA, 19 nt, Homo sapiens
gaggguaucaacagacuug

SEQ ID NO: 1310466 - RNA, 19 nt, Homo sapiens
guacugugaaugaugauga

SEQ ID NO: 1310467 - RNA, 19 nt, Homo sapiens
guaagagugugagaaacug

SEQ ID NO: 1310468 - RNA, 19 nt, Homo sapiens
uaacucaucacagaagaaa

SEQ ID NO: 1310469 - RNA, 19 nt, Homo sapiens
ggaacauugugggaaguug

SEQ ID NO: 1310470 - RNA, 19 nt, Homo sapiens
gaugagaaugcauuuggaa

SEQ ID NO: 1310471 - RNA, 19 nt, Homo sapiens
ugcagaauauuucagcaaa

SEQ ID NO: 1310472 - RNA, 19 nt, Homo sapiens
agucaaggaucugaagaaa

SEQ ID NO: 1310473 - RNA, 19 nt, Homo sapiens
cuaucuggaucaggaaaua

SEQ ID NO: 1310474 - RNA, 19 nt, Homo sapiens
guaccaagaaugaugugaa

SEQ ID NO: 1310475 - RNA, 19 nt, Homo sapiens
ccagaagagcccuguaaga

SEQ ID NO: 1310476 - RNA, 19 nt, Homo sapiens
gaaaauaaacacaccacaa

SEQ ID NO: 1310477 - RNA, 19 nt, Homo sapiens
cagcaaggaguauacaaga

SEQ ID NO: 1310478 - RNA, 19 nt, Homo sapiens
cacaagccuccacuacuua

SEQ ID NO: 1310479 - RNA, 19 nt, Homo sapiens
aagaaacaccucaauggaa

SEQ ID NO: 1310480 - RNA, 19 nt, Homo sapiens
gcagaauauuucagcaaac

SEQ ID NO: 1310481 - RNA, 19 nt, Homo sapiens
gugagaaucccuuaguaau

SEQ ID NO: 1310482 - RNA, 19 nt, Homo sapiens
cccaaacggugccaaagug

SEQ ID NO: 1310483 - RNA, 19 nt, Homo sapiens
auuccaaucuguacuguga

SEQ ID NO: 1310484 - RNA, 19 nt, Homo sapiens
uggcacauguaaaucuaaa

SEQ ID NO: 1310485 - RNA, 19 nt, Homo sapiens
gaucaaccaaccagagugu

SEQ ID NO: 1310486 - RNA, 19 nt, Homo sapiens
cagaagaaacaccucaaug

SEQ ID NO: 1310487 - RNA, 19 nt, Homo sapiens
uggcaaagcucuguagcau

SEQ ID NO: 1310488 - RNA, 19 nt, Homo sapiens
cagaagagcccuguaagag

SEQ ID NO: 1310489 - RNA, 19 nt, Homo sapiens
aaucaagugguccucuuua

SEQ ID NO: 1310490 - RNA, 19 nt, Homo sapiens
aaaacucagucuagacaua

SEQ ID NO: 1310491 - RNA, 19 nt, Homo sapiens
aaagagugcuucaaaacuu

SEQ ID NO: 1310492 - RNA, 19 nt, Homo sapiens
ucuguacugugaaugauga

SEQ ID NO: 1310493 - RNA, 19 nt, Homo sapiens
caaucuguacugugaauga

SEQ ID NO: 1310494 - RNA, 19 nt, Homo sapiens
ccaaagagcauguuauccu

SEQ ID NO: 1310495 - RNA, 19 nt, Homo sapiens
caaaagaggcugagcacaa

SEQ ID NO: 1310496 - RNA, 19 nt, Homo sapiens
agaagaaacaccucaaugg

SEQ ID NO: 1310497 - RNA, 19 nt, Homo sapiens
ucucagcuuugauucauuc

SEQ ID NO: 1310498 - RNA, 19 nt, Homo sapiens
ggaugacaaguaccaagaa

SEQ ID NO: 1310499 - RNA, 19 nt, Homo sapiens
gggaugacaaguaccaaga

SEQ ID NO: 1310500 - RNA, 19 nt, Homo sapiens
gaugauaauugaucgcuua

SEQ ID NO: 1310501 - RNA, 19 nt, Homo sapiens
gaaccuccuuguuggaaua

SEQ ID NO: 1310502 - RNA, 19 nt, Homo sapiens
ucaagaaccuaaauaguga

SEQ ID NO: 1310503 - RNA, 19 nt, Homo sapiens
gcagaaaggaucauugaaa

SEQ ID NO: 1310504 - RNA, 19 nt, Homo sapiens
gaaccuaaauagugagaau

SEQ ID NO: 1310505 - RNA, 19 nt, Homo sapiens
gauaugacaugugauaaga

SEQ ID NO: 1310506 - RNA, 19 nt, Homo sapiens
guaagagucauacgaauaa

SEQ ID NO: 1310507 - RNA, 19 nt, Homo sapiens
gauaauugaucgcuuagau

SEQ ID NO: 1310508 - RNA, 19 nt, Homo sapiens
gcuaucaaauucuacauga

SEQ ID NO: 1310509 - RNA, 19 nt, Homo sapiens
gcaaagagaauguuaccaa

SEQ ID NO: 1310510 - RNA, 19 nt, Homo sapiens
ugaaggaaaucagucauaa

SEQ ID NO: 1310511 - RNA, 19 nt, Homo sapiens
caaacugguugcucuacua

SEQ ID NO: 1310512 - RNA, 19 nt, Homo sapiens
caauaaaccugugauaagu

SEQ ID NO: 1310513 - RNA, 19 nt, Homo sapiens
caaaucagacagaauauug

SEQ ID NO: 1310514 - RNA, 19 nt, Homo sapiens
cuacagagaaggcaagaua

SEQ ID NO: 1310515 - RNA, 19 nt, Homo sapiens
gcaugagaauggugcagua

SEQ ID NO: 1310516 - RNA, 19 nt, Homo sapiens
ucauggaguuguuccuuua

SEQ ID NO: 1310517 - RNA, 19 nt, Homo sapiens
uaucacagaucauggaguu

SEQ ID NO: 1310518 - RNA, 19 nt, Homo sapiens
uaaagaagccauccgcaaa

SEQ ID NO: 1310519 - RNA, 19 nt, Homo sapiens
ccucaaaucagacagaaua

SEQ ID NO: 1310520 - RNA, 19 nt, Homo sapiens
cgagauaugacaugugaua

SEQ ID NO: 1310521 - RNA, 19 nt, Homo sapiens
gcgguuagcugcugucaca

SEQ ID NO: 1310522 - RNA, 19 nt, Homo sapiens
ggagaaugcugccaagaac

SEQ ID NO: 1310523 - RNA, 19 nt, Homo sapiens
cuaccgggcugcaaucaaa

SEQ ID NO: 1310524 - RNA, 19 nt, Homo sapiens
gcaguaagagucauacgaa

SEQ ID NO: 1310525 - RNA, 19 nt, Homo sapiens
gaauacaaagccauugaaa

SEQ ID NO: 1310526 - RNA, 19 nt, Homo sapiens
aagagaauguuaccaaguu

SEQ ID NO: 1310527 - RNA, 19 nt, Homo sapiens
uaagauggaaagccaauaa

SEQ ID NO: 1310528 - RNA, 19 nt, Homo sapiens
guaaagcuucuacuggaua

SEQ ID NO: 1310529 - RNA, 19 nt, Homo sapiens
gaaauguuccaucagcaaa

SEQ ID NO: 1310530 - RNA, 19 nt, Homo sapiens
gaaccugaaaguaugauga

SEQ ID NO: 1310531 - RNA, 19 nt, Homo sapiens
gaaaugguucguuccuuug

SEQ ID NO: 1310532 - RNA, 19 nt, Homo sapiens
ccaauaaaccugugauaag

SEQ ID NO: 1310533 - RNA, 19 nt, Homo sapiens
ggaauaaaccaagcucuuc

SEQ ID NO: 1310534 - RNA, 19 nt, Homo sapiens
aagaaguacuugugaaugu

SEQ ID NO: 1310535 - RNA, 19 nt, Homo sapiens
gaagaaguacuugugaaug

SEQ ID NO: 1310536 - RNA, 19 nt, Homo sapiens
ggaaaucagucauaauccu

SEQ ID NO: 1310537 - RNA, 19 nt, Homo sapiens
gagacuaucgcgaauguug

SEQ ID NO: 1310538 - RNA, 19 nt, Homo sapiens
cgacagcucaggccuugua

SEQ ID NO: 1310539 - RNA, 19 nt, Homo sapiens
gaaaaugcacagaauguuu

SEQ ID NO: 1310540 - RNA, 19 nt, Homo sapiens
ugcguuaucugaaaucaaa

SEQ ID NO: 1310541 - RNA, 19 nt, Homo sapiens
gaaguucuggcaaguguau

SEQ ID NO: 1310542 - RNA, 19 nt, Homo sapiens
gcaguagaaccugaaagua

SEQ ID NO: 1310543 - RNA, 19 nt, Homo sapiens
acaaagccauugaaaccuu

SEQ ID NO: 1310544 - RNA, 19 nt, Homo sapiens
gacauuacaagcuaucaaa

SEQ ID NO: 1310545 - RNA, 19 nt, Homo sapiens
ggaauacaaagccauugaa

SEQ ID NO: 1310546 - RNA, 19 nt, Homo sapiens
cagaaaggaucauugaaaa

SEQ ID NO: 1310547 - RNA, 19 nt, Homo sapiens
gccaauaaaccugugauaa

SEQ ID NO: 1310548 - RNA, 19 nt, Homo sapiens
uaugacaugugauaagaug

SEQ ID NO: 1310549 - RNA, 19 nt, Homo sapiens
ucauaauccucaaaucaga

SEQ ID NO: 1310550 - RNA, 19 nt, Homo sapiens
uaaagcuucuacuggauau

SEQ ID NO: 1310551 - RNA, 19 nt, Homo sapiens
gggagaaugcugccaagaa

SEQ ID NO: 1310552 - RNA, 19 nt, Homo sapiens
gucaagaaccuaaauagug

SEQ ID NO: 1310553 - RNA, 19 nt, Homo sapiens
ggccagaaagccuaaauug

SEQ ID NO: 1310554 - RNA, 19 nt, Homo sapiens
guuggugguuuggaacuua

SEQ ID NO: 1310555 - RNA, 19 nt, Homo sapiens
caguagaaccugaaaguau

SEQ ID NO: 1310556 - RNA, 19 nt, Homo sapiens
gcucuucuugugaauguua

SEQ ID NO: 1310557 - RNA, 19 nt, Homo sapiens
uuaccaaguuucgggaaua

SEQ ID NO: 1310558 - RNA, 19 nt, Homo sapiens
ucgcgaauguugccaaguu

SEQ ID NO: 1310559 - RNA, 19 nt, Homo sapiens
gaaggaaaucagucauaau

SEQ ID NO: 1310560 - RNA, 19 nt, Homo sapiens
ugaccaggaucuccaggaa

SEQ ID NO: 1310561 - RNA, 19 nt, Homo sapiens
ugagaauggugcaguaaag

SEQ ID NO: 1310562 - RNA, 19 nt, Homo sapiens
ccacuagugcguuaucuga

SEQ ID NO: 1310563 - RNA, 19 nt, Homo sapiens
gcgaauguugccaaguuua

SEQ ID NO: 1310564 - RNA, 19 nt, Homo sapiens
agauggaguucguuuguug

SEQ ID NO: 1310565 - RNA, 19 nt, Homo sapiens
aguagaaccugaaaguaug

SEQ ID NO: 1310566 - RNA, 19 nt, Homo sapiens
uggccagucuacucaauaa

SEQ ID NO: 1310567 - RNA, 19 nt, Homo sapiens
ccagugugcugaagauaag

SEQ ID NO: 1310568 - RNA, 19 nt, Homo sapiens
cgaauguugccaaguuuaa

SEQ ID NO: 1310569 - RNA, 19 nt, Homo sapiens
ccaauuauggugaauauac

SEQ ID NO: 1310570 - RNA, 19 nt, Homo sapiens
aaaauugcauggagacuuu

SEQ ID NO: 1310571 - RNA, 19 nt, Homo sapiens
ucacucccauggccagaaa

SEQ ID NO: 1310572 - RNA, 19 nt, Homo sapiens
gagacaucaucuagcagaa

SEQ ID NO: 1310573 - RNA, 19 nt, Homo sapiens
ccugaaaguaugaugauaa

SEQ ID NO: 1310574 - RNA, 19 nt, Homo sapiens
gggaauacaaagccauuga

SEQ ID NO: 1310575 - RNA, 19 nt, Homo sapiens
agagaauguuaccaaguuu

SEQ ID NO: 1310576 - RNA, 19 nt, Homo sapiens
gaaacccgggaccucguua

SEQ ID NO: 1310577 - RNA, 19 nt, Homo sapiens
cuguggagcugcaguaaga

SEQ ID NO: 1310578 - RNA, 19 nt, Homo sapiens
cuacuagacugugcacaug

SEQ ID NO: 1310579 - RNA, 19 nt, Homo sapiens
caaacuggcaaauacaaau

SEQ ID NO: 1310580 - RNA, 19 nt, Homo sapiens
uguccaaacuggcaaauac

SEQ ID NO: 1310581 - RNA, 19 nt, Homo sapiens
guuuggaacuuauugucaa

SEQ ID NO: 1310582 - RNA, 19 nt, Homo sapiens
gaauguugccaaguuuaaa

SEQ ID NO: 1310583 - RNA, 19 nt, Homo sapiens
ucagacagaauauuguuga

SEQ ID NO: 1310584 - RNA, 19 nt, Homo sapiens
aguaagagucauacgaaua

SEQ ID NO: 1310585 - RNA, 19 nt, Homo sapiens
ggauauggccuucccaaaa

SEQ ID NO: 1310586 - RNA, 19 nt, Homo sapiens
ggacauuacaagcuaucaa

SEQ ID NO: 1310587 - RNA, 19 nt, Homo sapiens
ggccuucggugagcacaaa

SEQ ID NO: 1310588 - RNA, 19 nt, Homo sapiens
gaagcuauuucacguugcu

SEQ ID NO: 1310589 - RNA, 19 nt, Homo sapiens
gaauaaaccaagcucuucu

SEQ ID NO: 1310590 - RNA, 19 nt, Homo sapiens
gcacugcgccauggccauu

SEQ ID NO: 1310591 - RNA, 19 nt, Homo sapiens
gauaagauggaaagccaau

SEQ ID NO: 1310592 - RNA, 19 nt, Homo sapiens
ccgagacuaucgcgaaugu

SEQ ID NO: 1310593 - RNA, 19 nt, Homo sapiens
gagauaugacaugugauaa

SEQ ID NO: 1310594 - RNA, 19 nt, Homo sapiens
gaaagccuaaauugggaaa

SEQ ID NO: 1310595 - RNA, 19 nt, Homo sapiens
acuagugcguuaucugaaa

SEQ ID NO: 1310596 - RNA, 19 nt, Homo sapiens
uggaguuguuccuuuauug

SEQ ID NO: 1310597 - RNA, 19 nt, Homo sapiens
uagcaaacccuuucaacca

SEQ ID NO: 1310598 - RNA, 19 nt, Homo sapiens
gagaaggcaagauacacuu

SEQ ID NO: 1310599 - RNA, 19 nt, Homo sapiens
gaauggugcaguaaagcuu

SEQ ID NO: 1310600 - RNA, 19 nt, Homo sapiens
cagaaugguucaauguaua

SEQ ID NO: 1310601 - RNA, 19 nt, Homo sapiens
ggaauuaagugagagagau

SEQ ID NO: 1310602 - RNA, 19 nt, Homo sapiens
ccagaaugguucaauguau

SEQ ID NO: 1310603 - RNA, 19 nt, Homo sapiens
ggagaggaaccaagcuaua

SEQ ID NO: 1310604 - RNA, 19 nt, Homo sapiens
gcaggauggucggaauuaa

SEQ ID NO: 1310605 - RNA, 19 nt, Homo sapiens
aaucaggcauuuggcuuua

SEQ ID NO: 1310606 - RNA, 19 nt, Homo sapiens
aagcuauacuugaccuuaa

SEQ ID NO: 1310607 - RNA, 19 nt, Homo sapiens
gaagcuggccaaguuuauu

SEQ ID NO: 1310608 - RNA, 19 nt, Homo sapiens
gcagcaggauggucggaau

SEQ ID NO: 1310609 - RNA, 19 nt, Homo sapiens
aagcagagaagaugaauca

SEQ ID NO: 1310610 - RNA, 19 nt, Homo sapiens
gaggagaggaaccaagcua

SEQ ID NO: 1310611 - RNA, 19 nt, Homo sapiens
gugaagcuggccaaguuua

SEQ ID NO: 1310612 - RNA, 19 nt, Homo sapiens
gaauuaagugagagagaug

SEQ ID NO: 1310613 - RNA, 19 nt, Homo sapiens
gcggccaugucaucaggua

SEQ ID NO: 1310614 - RNA, 19 nt, Homo sapiens
agauaacucucaccucaca

SEQ ID NO: 1310615 - RNA, 19 nt, Homo sapiens
ggcuuuaugucccgaguug

SEQ ID NO: 1310616 - RNA, 19 nt, Homo sapiens
acaacaagguccagauaac

SEQ ID NO: 1310617 - RNA, 19 nt, Homo sapiens
agaauucuccuuccacaau

SEQ ID NO: 1310618 - RNA, 19 nt, Homo sapiens
auacaacaagguccagaua

SEQ ID NO: 1310619 - RNA, 19 nt, Homo sapiens
acaaagaauucuccuucca

SEQ ID NO: 1310620 - RNA, 19 nt, Homo sapiens
caucagguacucacagguu

SEQ ID NO: 1310621 - RNA, 19 nt, Homo sapiens
ugaaucaucacccagaaug

SEQ ID NO: 1310622 - RNA, 19 nt, Homo sapiens
gauggucggaauuaaguga

SEQ ID NO: 1310623 - RNA, 19 nt, Homo sapiens
gaggaaccaagcuauacuu

SEQ ID NO: 1310624 - RNA, 19 nt, Homo sapiens
gagaggaaccaagcuauac

SEQ ID NO: 1310625 - RNA, 19 nt, Homo sapiens
gguucaauguauacaacaa

SEQ ID NO: 1310626 - RNA, 19 nt, Homo sapiens
ucaggcauuuggcuuuaug

SEQ ID NO: 1310627 - RNA, 19 nt, Homo sapiens
uaaucaggcauuuggcuuu

SEQ ID NO: 1310628 - RNA, 19 nt, Homo sapiens
gguacucacagguugauug

SEQ ID NO: 1310629 - RNA, 19 nt, Homo sapiens
augugaagcuggccaaguu

SEQ ID NO: 1310630 - RNA, 19 nt, Homo sapiens
uacaacaagguccagauaa

SEQ ID NO: 1310631 - RNA, 19 nt, Homo sapiens
caacaagguccagauaacu

SEQ ID NO: 1310632 - RNA, 19 nt, Homo sapiens
gcuucugugugauuucuuc

SEQ ID NO: 1310633 - RNA, 19 nt, Homo sapiens
uaacucucaccucacauga

SEQ ID NO: 1310634 - RNA, 19 nt, Homo sapiens
cuacaagcagagaagauga

SEQ ID NO: 1310635 - RNA, 19 nt, Homo sapiens
cacccagaaugguucaaug

SEQ ID NO: 1310636 - RNA, 19 nt, Homo sapiens
gucccgaguugcccuacaa

SEQ ID NO: 1310637 - RNA, 19 nt, Homo sapiens
cagcugcuucugugugauu

SEQ ID NO: 1310638 - RNA, 19 nt, Homo sapiens
cccagaaugguucaaugua

SEQ ID NO: 1310639 - RNA, 19 nt, Homo sapiens
cuggccaaguuuauugaaa

SEQ ID NO: 1310640 - RNA, 19 nt, Homo sapiens
aagcuggccaaguuuauug

SEQ ID NO: 1310641 - RNA, 19 nt, Homo sapiens
ugaagcuggccaaguuuau

SEQ ID NO: 1310642 - RNA, 19 nt, Homo sapiens
agcuauacuugaccuuaaa

SEQ ID NO: 1310643 - RNA, 19 nt, Homo sapiens
cagcaggauggucggaauu

SEQ ID NO: 1310644 - RNA, 19 nt, Homo sapiens
ucugugugauuucuuccaa

SEQ ID NO: 1310645 - RNA, 19 nt, Homo sapiens
ucaaagcgcucuccaagaa

SEQ ID NO: 1310646 - RNA, 19 nt, Homo sapiens
ugagugaccucuccaagaa

SEQ ID NO: 1310647 - RNA, 19 nt, Homo sapiens
agacggagguguacgauga

SEQ ID NO: 1310648 - RNA, 19 nt, Homo sapiens
cggaagaaguucaaguuug

SEQ ID NO: 1310649 - RNA, 19 nt, Homo sapiens
guacgaugaugucgacuuc

SEQ ID NO: 1310650 - RNA, 19 nt, Homo sapiens
gagagggaguuccggaaga

SEQ ID NO: 1310651 - RNA, 19 nt, Homo sapiens
acacgaagaugaugaucga

SEQ ID NO: 1310652 - RNA, 19 nt, Homo sapiens
ugagugacuuucccaagaa

SEQ ID NO: 1310653 - RNA, 19 nt, Homo sapiens
ggagagccaucaggacuuc

SEQ ID NO: 1310654 - RNA, 19 nt, Homo sapiens
ccaagaagccguccaaacu

SEQ ID NO: 1310655 - RNA, 19 nt, Homo sapiens
ccacugaccuccccaagaa

SEQ ID NO: 1310656 - RNA, 19 nt, Homo sapiens
uugaguaccuuucccaaga

SEQ ID NO: 1310657 - RNA, 19 nt, Homo sapiens
ccucagagcccgaguucaa

SEQ ID NO: 1310658 - RNA, 19 nt, Homo sapiens
ucacugaccuccccaagaa

SEQ ID NO: 1310659 - RNA, 19 nt, Homo sapiens
ucacugaccuccccaagaa

SEQ ID NO: 1310660 - RNA, 19 nt, Homo sapiens
ucacugaccuccccaagaa

SEQ ID NO: 1310661 - RNA, 19 nt, Homo sapiens
ucacugaccuccccaagaa

SEQ ID NO: 1310662 - RNA, 19 nt, Homo sapiens
ucacugaccuccccaagaa

SEQ ID NO: 1310663 - RNA, 19 nt, Homo sapiens
ucacugaccuccccaagaa

SEQ ID NO: 1310664 - RNA, 19 nt, Homo sapiens
ucacugaccuccccaagaa

SEQ ID NO: 1310665 - RNA, 19 nt, Homo sapiens
gagcaucaaagcaaaguuc

SEQ ID NO: 1310666 - RNA, 19 nt, Homo sapiens
gcucagcccuggguuugga

SEQ ID NO: 1310667 - RNA, 19 nt, Homo sapiens
ucggugaucucccucgaaa

SEQ ID NO: 1310668 - RNA, 19 nt, Homo sapiens
ugaguaccuuucccaagaa

SEQ ID NO: 1310669 - RNA, 19 nt, Homo sapiens
uuuguacccuggccacaua

SEQ ID NO: 1310670 - RNA, 19 nt, Homo sapiens
cugagugacuuucccaaga

SEQ ID NO: 1310671 - RNA, 19 nt, Homo sapiens
ggacuuccggagcaucaaa

SEQ ID NO: 1310672 - RNA, 19 nt, Homo sapiens
caagaagccguccaaacug

SEQ ID NO: 1310673 - RNA, 19 nt, Homo sapiens
gaugaagcgcccucaguuc

SEQ ID NO: 1310674 - RNA, 19 nt, Homo sapiens
gagaugaagcgcccucagu

SEQ ID NO: 1310675 - RNA, 19 nt, Homo sapiens
agagggaguuccggaagaa

SEQ ID NO: 1310676 - RNA, 19 nt, Homo sapiens
ucgguggccucccuaagaa

SEQ ID NO: 1310677 - RNA, 19 nt, Homo sapiens
gcaggucccagaugagauc

SEQ ID NO: 1310678 - RNA, 19 nt, Homo sapiens
ccaggaggccaccacaaga

SEQ ID NO: 1310679 - RNA, 19 nt, Homo sapiens
gauguggaacccagagaug

SEQ ID NO: 1310680 - RNA, 19 nt, Homo sapiens
caaaguuccaggccucuca

SEQ ID NO: 1310681 - RNA, 19 nt, Homo sapiens
ccacauaaagccccaguuu

SEQ ID NO: 1310682 - RNA, 19 nt, Homo sapiens
gcagaagccacagucacuu

SEQ ID NO: 1310683 - RNA, 19 nt, Homo sapiens
gggagauccuggaggugau

SEQ ID NO: 1310684 - RNA, 19 nt, Homo sapiens
ucccgcaggucccagauga

SEQ ID NO: 1310685 - RNA, 19 nt, Homo sapiens
agccugaguucaacgugua

SEQ ID NO: 1310686 - RNA, 19 nt, Homo sapiens
gggaguuccggaagaaguu

SEQ ID NO: 1310687 - RNA, 19 nt, Homo sapiens
cgagcuguaugacgaugug

SEQ ID NO: 1310688 - RNA, 19 nt, Homo sapiens
gccacuccguuuccaagga

SEQ ID NO: 1310689 - RNA, 19 nt, Homo sapiens
ggagguguacgaugauguc

SEQ ID NO: 1310690 - RNA, 19 nt, Homo sapiens
caccagcaaugaggagaug

SEQ ID NO: 1310691 - RNA, 19 nt, Homo sapiens
ccggaagaaguucaaguuu

SEQ ID NO: 1310692 - RNA, 19 nt, Homo sapiens
ccgacagccugaagacauc

SEQ ID NO: 1310693 - RNA, 19 nt, Homo sapiens
cgaagccugaguuugguaa

SEQ ID NO: 1310694 - RNA, 19 nt, Homo sapiens
ugaucgaguucaccagcaa

SEQ ID NO: 1310695 - RNA, 19 nt, Homo sapiens
gugguucacacgaagauga

SEQ ID NO: 1310696 - RNA, 19 nt, Homo sapiens
agaugaagcgcccucaguu

SEQ ID NO: 1310697 - RNA, 19 nt, Homo sapiens
gcuguaugacgauguggaa

SEQ ID NO: 1310698 - RNA, 19 nt, Homo sapiens
gaagccugaguuugguaaa

SEQ ID NO: 1310699 - RNA, 19 nt, Homo sapiens
gagugacuuucccaagaag

SEQ ID NO: 1310700 - RNA, 19 nt, Homo sapiens
guucacacgaagaugauga

SEQ ID NO: 1310701 - RNA, 19 nt, Homo sapiens
ucagcgugcuucccaagag

SEQ ID NO: 1310702 - RNA, 19 nt, Homo sapiens
gucgguggccucccuaaga

SEQ ID NO: 1310703 - RNA, 19 nt, Homo sapiens
ugagaucuacgagcuguau

SEQ ID NO: 1310704 - RNA, 19 nt, Homo sapiens
ggugaucucccucgaaagc

SEQ ID NO: 1310705 - RNA, 19 nt, Homo sapiens
gaguaccuuucccaagaag

SEQ ID NO: 1310706 - RNA, 19 nt, Homo sapiens
acgaugaugucgacuucug

SEQ ID NO: 1310707 - RNA, 19 nt, Homo sapiens
acccagcgcucaggaagga

SEQ ID NO: 1310708 - RNA, 19 nt, Homo sapiens
cuccagcgccuuucccaaa

SEQ ID NO: 1310709 - RNA, 19 nt, Homo sapiens
ccguggauaugcagagcuu

SEQ ID NO: 1310710 - RNA, 19 nt, Homo sapiens
gaaaugaugugcagaaaug

SEQ ID NO: 1310711 - RNA, 19 nt, Homo sapiens
gaagauggcaggaaaguua

SEQ ID NO: 1310712 - RNA, 19 nt, Homo sapiens
gcaccaacgugacauauaa

SEQ ID NO: 1310713 - RNA, 19 nt, Homo sapiens
gaucaggagugaaagauuu

SEQ ID NO: 1310714 - RNA, 19 nt, Homo sapiens
ggagaaaggucuaaucaag

SEQ ID NO: 1310715 - RNA, 19 nt, Homo sapiens
ggauggaggcuuaaauuua

SEQ ID NO: 1310716 - RNA, 19 nt, Homo sapiens
caaagaggcuccaggauca

SEQ ID NO: 1310717 - RNA, 19 nt, Homo sapiens
gcgaggaaaugguuuguaa

SEQ ID NO: 1310718 - RNA, 19 nt, Homo sapiens
gaacaggccaaccacauuu

SEQ ID NO: 1310719 - RNA, 19 nt, Homo sapiens
gcacugaaauccugaaagg

SEQ ID NO: 1310720 - RNA, 19 nt, Homo sapiens
uaacaacgcugaugaaacg

SEQ ID NO: 1310721 - RNA, 19 nt, Homo sapiens
ugaguaggauggaggcuua

SEQ ID NO: 1310722 - RNA, 19 nt, Homo sapiens
gcaugaaccugacggugaa

SEQ ID NO: 1310723 - RNA, 19 nt, Homo sapiens
gauuacggcuuuaccgaaa

SEQ ID NO: 1310724 - RNA, 19 nt, Homo sapiens
agaaguccauguucccuua

SEQ ID NO: 1310725 - RNA, 19 nt, Homo sapiens
gaaggucuuugcuagauca

SEQ ID NO: 1310726 - RNA, 19 nt, Homo sapiens
cagacacucuauuaagaua

SEQ ID NO: 1310727 - RNA, 19 nt, Homo sapiens
caacgcugaugaaacguaa

SEQ ID NO: 1310728 - RNA, 19 nt, Homo sapiens
gcacaaagcaguguuucuu

SEQ ID NO: 1310729 - RNA, 19 nt, Homo sapiens
gcucauuucugcuucauca

SEQ ID NO: 1310730 - RNA, 19 nt, Homo sapiens
uaaauuuaauggcgacuug

SEQ ID NO: 1310731 - RNA, 19 nt, Homo sapiens
gcaaaucgccuuucugacu

SEQ ID NO: 1310732 - RNA, 19 nt, Homo sapiens
gaaaagagccgcuugaauc

SEQ ID NO: 1310733 - RNA, 19 nt, Homo sapiens
gcaucuucaugguaaguua

SEQ ID NO: 1310734 - RNA, 19 nt, Homo sapiens
gcugagaaaucuuugaagu

SEQ ID NO: 1310735 - RNA, 19 nt, Homo sapiens
guuauuaucugagacauuc

SEQ ID NO: 1310736 - RNA, 19 nt, Homo sapiens
guauauacuuccuuucuag

SEQ ID NO: 1310737 - RNA, 19 nt, Homo sapiens
gaggaaaugguuuguaaga

SEQ ID NO: 1310738 - RNA, 19 nt, Homo sapiens
caucauacauucccuaacu

SEQ ID NO: 1310739 - RNA, 19 nt, Homo sapiens
cuccgaagcuuaacaaaug

SEQ ID NO: 1310740 - RNA, 19 nt, Homo sapiens
uacagacacucuauuaaga

SEQ ID NO: 1310741 - RNA, 19 nt, Homo sapiens
ggaaacgauuacggcuuua

SEQ ID NO: 1310742 - RNA, 19 nt, Homo sapiens
gcgcugaccuuugcuuuca

SEQ ID NO: 1310743 - RNA, 19 nt, Homo sapiens
ggucuuugcuagaucagaa

SEQ ID NO: 1310744 - RNA, 19 nt, Homo sapiens
ggaacaggccaaccacauu

SEQ ID NO: 1310745 - RNA, 19 nt, Homo sapiens
gggaaggucuuugcuagau

SEQ ID NO: 1310746 - RNA, 19 nt, Homo sapiens
aaggagaagugaaggauga

SEQ ID NO: 1310747 - RNA, 19 nt, Homo sapiens
gaagugggaguuauuaucu

SEQ ID NO: 1310748 - RNA, 19 nt, Homo sapiens
gaauuuccacucuggcuuu

SEQ ID NO: 1310749 - RNA, 19 nt, Homo sapiens
gugcaaaucgccuuucuga

SEQ ID NO: 1310750 - RNA, 19 nt, Homo sapiens
cuucaaagccaaauacaaa

SEQ ID NO: 1310751 - RNA, 19 nt, Homo sapiens
aggaaacgauuacggcuuu

SEQ ID NO: 1310752 - RNA, 19 nt, Homo sapiens
gugccacucuucuuccuuu

SEQ ID NO: 1310753 - RNA, 19 nt, Homo sapiens
ggauuucuauggcaaugug

SEQ ID NO: 1310754 - RNA, 19 nt, Homo sapiens
gagcugagaaaucuuugaa

SEQ ID NO: 1310755 - RNA, 19 nt, Homo sapiens
gaugguccgcuuucuauug

SEQ ID NO: 1310756 - RNA, 19 nt, Homo sapiens
aaacaguggagucuucuuu

SEQ ID NO: 1310757 - RNA, 19 nt, Homo sapiens
uaaucaagcucggguuguu

SEQ ID NO: 1310758 - RNA, 19 nt, Homo sapiens
aacaggagcucaucugcaa

SEQ ID NO: 1310759 - RNA, 19 nt, Homo sapiens
uaaguuaggauuucuaugg

SEQ ID NO: 1310760 - RNA, 19 nt, Homo sapiens
caaggacucugugcaucuu

SEQ ID NO: 1310761 - RNA, 19 nt, Homo sapiens
gcuuucacgccauuuaaua

SEQ ID NO: 1310762 - RNA, 19 nt, Homo sapiens
ggauaauaaugugaaggaa

SEQ ID NO: 1310763 - RNA, 19 nt, Homo sapiens
cgugacauauaagccauua

SEQ ID NO: 1310764 - RNA, 19 nt, Homo sapiens
cuauugagcugagaaaucu

SEQ ID NO: 1310765 - RNA, 19 nt, Homo sapiens
cauguucccuuaauugucu

SEQ ID NO: 1310766 - RNA, 19 nt, Homo sapiens
ggaaggucuuugcuagauc

SEQ ID NO: 1310767 - RNA, 19 nt, Homo sapiens
ggugaugaggaaacgauua

SEQ ID NO: 1310768 - RNA, 19 nt, Homo sapiens
gauuuguucuccucucugu

SEQ ID NO: 1310769 - RNA, 19 nt, Homo sapiens
aaaguuagaaguccauguu

SEQ ID NO: 1310770 - RNA, 19 nt, Homo sapiens
cacuacagacacucuauua

SEQ ID NO: 1310771 - RNA, 19 nt, Homo sapiens
uaaaggcgaggaaaugguu

SEQ ID NO: 1310772 - RNA, 19 nt, Homo sapiens
gacacucuauuaagauaca

SEQ ID NO: 1310773 - RNA, 19 nt, Homo sapiens
gcccuucccuuguccuuuc

SEQ ID NO: 1310774 - RNA, 19 nt, Homo sapiens
gcguuaggcucgccaugga

SEQ ID NO: 1310775 - RNA, 19 nt, Homo sapiens
uaaggcaggguguguggua

SEQ ID NO: 1310776 - RNA, 19 nt, Homo sapiens
uaggauggaggcuuaaauu

SEQ ID NO: 1310777 - RNA, 19 nt, Homo sapiens
cuacagacacucuauuaag

SEQ ID NO: 1310778 - RNA, 19 nt, Homo sapiens
agaaaggucuaaucaagcu

SEQ ID NO: 1310779 - RNA, 19 nt, Homo sapiens
caugguaaguuaggauuuc

SEQ ID NO: 1310780 - RNA, 19 nt, Homo sapiens
cggugcaucuucaugguaa

SEQ ID NO: 1310781 - RNA, 19 nt, Homo sapiens
aaagccaaauacaaacuug

SEQ ID NO: 1310782 - RNA, 19 nt, Homo sapiens
ccugaaagcuggaaaagga

SEQ ID NO: 1310783 - RNA, 19 nt, Homo sapiens
ccgaaaugaugugcagaaa

SEQ ID NO: 1310784 - RNA, 19 nt, Homo sapiens
guugaaagugugaguuuga

SEQ ID NO: 1310785 - RNA, 19 nt, Homo sapiens
ugacgcggacuaaaucauu

SEQ ID NO: 1310786 - RNA, 19 nt, Homo sapiens
uagcagcucuggacaccau

SEQ ID NO: 1310787 - RNA, 19 nt, Homo sapiens
ucauuucugcuucaucaua

SEQ ID NO: 1310788 - RNA, 19 nt, Homo sapiens
aguccuagaugcaaacuca

SEQ ID NO: 1310789 - RNA, 19 nt, Homo sapiens
uaaagcagccuccgaagcu

SEQ ID NO: 1310790 - RNA, 19 nt, Homo sapiens
ucccuuaauugucuuguug

SEQ ID NO: 1310791 - RNA, 19 nt, Homo sapiens
gaaguccauguucccuuaa

SEQ ID NO: 1310792 - RNA, 19 nt, Homo sapiens
cggcacacuucacuacaga

SEQ ID NO: 1310793 - RNA, 19 nt, Homo sapiens
uguacccgaucauaauaaa

SEQ ID NO: 1310794 - RNA, 19 nt, Homo sapiens
ggaguuauuaucugagaca

SEQ ID NO: 1310795 - RNA, 19 nt, Homo sapiens
acaguggagucuucuuuag

SEQ ID NO: 1310796 - RNA, 19 nt, Homo sapiens
ccuaacugcuuccugaaag

SEQ ID NO: 1310797 - RNA, 19 nt, Homo sapiens
ggaucaggagugaaagauu

SEQ ID NO: 1310798 - RNA, 19 nt, Homo sapiens
gguugaaagugugaguuug

SEQ ID NO: 1310799 - RNA, 19 nt, Homo sapiens
ggguugaaagugugaguuu

SEQ ID NO: 1310800 - RNA, 19 nt, Homo sapiens
cguccaggcuuuucauuaa

SEQ ID NO: 1310801 - RNA, 19 nt, Homo sapiens
gguaaguuaggauuucuau

SEQ ID NO: 1310802 - RNA, 19 nt, Homo sapiens
cgacuugagcgaaugaugu

SEQ ID NO: 1310803 - RNA, 19 nt, Homo sapiens
gaacucacacaggcgagaa

SEQ ID NO: 1310804 - RNA, 19 nt, Homo sapiens
caaagccaaauacaaacuu

SEQ ID NO: 1310805 - RNA, 19 nt, Homo sapiens
acugugcccuugggaauuu

SEQ ID NO: 1310806 - RNA, 19 nt, Homo sapiens
ucacgccauuuaauacugu

SEQ ID NO: 1310807 - RNA, 19 nt, Homo sapiens
gauggcgaguuucuaaagg

SEQ ID NO: 1310808 - RNA, 19 nt, Homo sapiens
uggguuugauggcgaguuu

SEQ ID NO: 1310809 - RNA, 19 nt, Homo sapiens
gcagcgaccguaagaagca

SEQ ID NO: 1310810 - RNA, 19 nt, Homo sapiens
gaagauaacuugaagauuc

SEQ ID NO: 1310811 - RNA, 19 nt, Homo sapiens
agaaagaggucuagaagua

SEQ ID NO: 1310812 - RNA, 19 nt, Homo sapiens
gaaugcaucuguuacuaga

SEQ ID NO: 1310813 - RNA, 19 nt, Homo sapiens
agacacaaccucuuuauaa

SEQ ID NO: 1310814 - RNA, 19 nt, Homo sapiens
gagcucaccuccaugcaaa

SEQ ID NO: 1310815 - RNA, 19 nt, Homo sapiens
caccaaagauuuccaugaa

SEQ ID NO: 1310816 - RNA, 19 nt, Homo sapiens
ggaaauccgacgugcaaua

SEQ ID NO: 1310817 - RNA, 19 nt, Homo sapiens
gauauaaucuguggugauc

SEQ ID NO: 1310818 - RNA, 19 nt, Homo sapiens
caacuaccaucacagaaug

SEQ ID NO: 1310819 - RNA, 19 nt, Homo sapiens
aaggagaaguuacucauuu

SEQ ID NO: 1310820 - RNA, 19 nt, Homo sapiens
cagaaugucuucauaccuu

SEQ ID NO: 1310821 - RNA, 19 nt, Homo sapiens
caauacaucuuccaauaag

SEQ ID NO: 1310822 - RNA, 19 nt, Homo sapiens
gaaguuuguucgaguuuca

SEQ ID NO: 1310823 - RNA, 19 nt, Homo sapiens
guucagccauuucaaguug

SEQ ID NO: 1310824 - RNA, 19 nt, Homo sapiens
gaagauucuaggcacauua

SEQ ID NO: 1310825 - RNA, 19 nt, Homo sapiens
gaggaggagcgccugauua

SEQ ID NO: 1310826 - RNA, 19 nt, Homo sapiens
gcaaagacuucaguuuuaa

SEQ ID NO: 1310827 - RNA, 19 nt, Homo sapiens
guugauaccuugcaauagu

SEQ ID NO: 1310828 - RNA, 19 nt, Homo sapiens
gaggagcgccugauuaauc

SEQ ID NO: 1310829 - RNA, 19 nt, Homo sapiens
gcaauauaguaguacauca

SEQ ID NO: 1310830 - RNA, 19 nt, Homo sapiens
uaggagaauuugagaaguu

SEQ ID NO: 1310831 - RNA, 19 nt, Homo sapiens
uaaagaaagaggucuagaa

SEQ ID NO: 1310832 - RNA, 19 nt, Homo sapiens
gaagagaagugugcuuuug

SEQ ID NO: 1310833 - RNA, 19 nt, Homo sapiens
ggagcaguaucaaacucua

SEQ ID NO: 1310834 - RNA, 19 nt, Homo sapiens
uagaaucaguguuucguau

SEQ ID NO: 1310835 - RNA, 19 nt, Homo sapiens
uguaaaagcugcaucguaa

SEQ ID NO: 1310836 - RNA, 19 nt, Homo sapiens
gcaacuaccaucacagaau

SEQ ID NO: 1310837 - RNA, 19 nt, Homo sapiens
ugauccagcuugucaggua

SEQ ID NO: 1310838 - RNA, 19 nt, Homo sapiens
gccagucccuucaagcaaa

SEQ ID NO: 1310839 - RNA, 19 nt, Homo sapiens
gacugcaucucaccaaaga

SEQ ID NO: 1310840 - RNA, 19 nt, Homo sapiens
aaagaaguuuguucgaguu

SEQ ID NO: 1310841 - RNA, 19 nt, Homo sapiens
caucagacacaaccucuuu

SEQ ID NO: 1310842 - RNA, 19 nt, Homo sapiens
gcaaagguuacuuaauaga

SEQ ID NO: 1310843 - RNA, 19 nt, Homo sapiens
gacacaaccucuuuauaac

SEQ ID NO: 1310844 - RNA, 19 nt, Homo sapiens
guuauuaugugugaagaga

SEQ ID NO: 1310845 - RNA, 19 nt, Homo sapiens
gaaauccgacgugcaauag

SEQ ID NO: 1310846 - RNA, 19 nt, Homo sapiens
guacauagugugguuguug

SEQ ID NO: 1310847 - RNA, 19 nt, Homo sapiens
ccacuuugcuguucaagac

SEQ ID NO: 1310848 - RNA, 19 nt, Homo sapiens
ggaguucauuggugcuaau

SEQ ID NO: 1310849 - RNA, 19 nt, Homo sapiens
caccugaacuugauauguc

SEQ ID NO: 1310850 - RNA, 19 nt, Homo sapiens
gacauaguguacaaauuag

SEQ ID NO: 1310851 - RNA, 19 nt, Homo sapiens
ggacgaggacgaggaguug

SEQ ID NO: 1310852 - RNA, 19 nt, Homo sapiens
caacagauguccaaaaugc

SEQ ID NO: 1310853 - RNA, 19 nt, Homo sapiens
uuucaucacugcaauaaag

SEQ ID NO: 1310854 - RNA, 19 nt, Homo sapiens
ggacgaggaguuggaagaa

SEQ ID NO: 1310855 - RNA, 19 nt, Homo sapiens
ggaaugcaucuguuacuag

SEQ ID NO: 1310856 - RNA, 19 nt, Homo sapiens
uguaauugcuaccacuuug

SEQ ID NO: 1310857 - RNA, 19 nt, Homo sapiens
gauucuaggcacauuauga

SEQ ID NO: 1310858 - RNA, 19 nt, Homo sapiens
gaccgacaguuacaagaca

SEQ ID NO: 1310859 - RNA, 19 nt, Homo sapiens
cacaaccucuuuauaacau

SEQ ID NO: 1310860 - RNA, 19 nt, Homo sapiens
ugcaaagacuucaguuuua

SEQ ID NO: 1310861 - RNA, 19 nt, Homo sapiens
uaguauugcuucugaaagu

SEQ ID NO: 1310862 - RNA, 19 nt, Homo sapiens
caagacauaacuuaccuau

SEQ ID NO: 1310863 - RNA, 19 nt, Homo sapiens
caagacauaguguacaaau

SEQ ID NO: 1310864 - RNA, 19 nt, Homo sapiens
ucccaucuuugaaguaauu

SEQ ID NO: 1310865 - RNA, 19 nt, Homo sapiens
uggaaugcaucuguuacua

SEQ ID NO: 1310866 - RNA, 19 nt, Homo sapiens
ccaagaauuauagcguuua

SEQ ID NO: 1310867 - RNA, 19 nt, Homo sapiens
gagaaguuacucauuucaa

SEQ ID NO: 1310868 - RNA, 19 nt, Homo sapiens
caaguuggugguugggaua

SEQ ID NO: 1310869 - RNA, 19 nt, Homo sapiens
ggagaauuugagaaguuua

SEQ ID NO: 1310870 - RNA, 19 nt, Homo sapiens
ucucugagcugaccccaua

SEQ ID NO: 1310871 - RNA, 19 nt, Homo sapiens
uaucaaacucuaagggaaa

SEQ ID NO: 1310872 - RNA, 19 nt, Homo sapiens
gagcaguaucaaacucuaa

SEQ ID NO: 1310873 - RNA, 19 nt, Homo sapiens
gaaagaggucuagaaguac

SEQ ID NO: 1310874 - RNA, 19 nt, Homo sapiens
aaagaaagaggucuagaag

SEQ ID NO: 1310875 - RNA, 19 nt, Homo sapiens
aagguuggaccgacaguua

SEQ ID NO: 1310876 - RNA, 19 nt, Homo sapiens
cagacacaaccucuuuaua

SEQ ID NO: 1310877 - RNA, 19 nt, Homo sapiens
gaucugugccauaaaauuu

SEQ ID NO: 1310878 - RNA, 19 nt, Homo sapiens
ggagaaguuacucauuuca

SEQ ID NO: 1310879 - RNA, 19 nt, Homo sapiens
caacuuggaacgauggaau

SEQ ID NO: 1310880 - RNA, 19 nt, Homo sapiens
ccauacaucuuguguucca

SEQ ID NO: 1310881 - RNA, 19 nt, Homo sapiens
aggaggagcgccugauuaa

SEQ ID NO: 1310882 - RNA, 19 nt, Homo sapiens
agaaugucuucauaccuuu

SEQ ID NO: 1310883 - RNA, 19 nt, Homo sapiens
guauugcuucugaaaguaa

SEQ ID NO: 1310884 - RNA, 19 nt, Homo sapiens
uugauaccuugcaauagua

SEQ ID NO: 1310885 - RNA, 19 nt, Homo sapiens
caaaggagaaguuacucau

SEQ ID NO: 1310886 - RNA, 19 nt, Homo sapiens
gaaggcacgggacauuuua

SEQ ID NO: 1310887 - RNA, 19 nt, Homo sapiens
uacauagugugguuguuga

SEQ ID NO: 1310888 - RNA, 19 nt, Homo sapiens
acgaggaguuggaagaaga

SEQ ID NO: 1310889 - RNA, 19 nt, Homo sapiens
gccauaaaauuucagugua

SEQ ID NO: 1310890 - RNA, 19 nt, Homo sapiens
gcaacacuacaaaggagaa

SEQ ID NO: 1310891 - RNA, 19 nt, Homo sapiens
ugaagauucuaggcacauu

SEQ ID NO: 1310892 - RNA, 19 nt, Homo sapiens
ucaccaaagauuuccauga

SEQ ID NO: 1310893 - RNA, 19 nt, Homo sapiens
cagcuugucagguagauau

SEQ ID NO: 1310894 - RNA, 19 nt, Homo sapiens
gcaacuauuggacauguag

SEQ ID NO: 1310895 - RNA, 19 nt, Homo sapiens
caaucuagaggaaagagaa

SEQ ID NO: 1310896 - RNA, 19 nt, Homo sapiens
uaaagaauaaggguguuug

SEQ ID NO: 1310897 - RNA, 19 nt, Homo sapiens
gagaauuugagaaguuuag

SEQ ID NO: 1310898 - RNA, 19 nt, Homo sapiens
aggagaauuugagaaguuu

SEQ ID NO: 1310899 - RNA, 19 nt, Homo sapiens
ucauuauggucuugugguu

SEQ ID NO: 1310900 - RNA, 19 nt, Homo sapiens
ggaguuggaagaagaagag

SEQ ID NO: 1310901 - RNA, 19 nt, Homo sapiens
cauuugcaaagguuacuua

SEQ ID NO: 1310902 - RNA, 19 nt, Homo sapiens
gugcuucuuugugacagua

SEQ ID NO: 1310903 - RNA, 19 nt, Homo sapiens
caguugggcagucaucuuu

SEQ ID NO: 1310904 - RNA, 19 nt, Homo sapiens
aauaggugaugcagcaaug

SEQ ID NO: 1310905 - RNA, 19 nt, Homo sapiens
agaagcaacuauuggacau

SEQ ID NO: 1310906 - RNA, 19 nt, Homo sapiens
ucaaagaccaaaacuauug

SEQ ID NO: 1310907 - RNA, 19 nt, Homo sapiens
guuacuagagacuguauau

SEQ ID NO: 1310908 - RNA, 19 nt, Homo sapiens
agugaucaaucuagaggaa

SEQ ID NO: 1310909 - RNA, 19 nt, Homo sapiens
caucuuguguuccauuugc

SEQ ID NO: 1310910 - RNA, 19 nt, Homo sapiens
gcagugagcugugauuuga

SEQ ID NO: 1310911 - RNA, 19 nt, Homo sapiens
aaacugggauuucagauaa

SEQ ID NO: 1310912 - RNA, 19 nt, Homo sapiens
gcacucauguguuugaaau

SEQ ID NO: 1310913 - RNA, 19 nt, Homo sapiens
ccugguggcugcuugauua

SEQ ID NO: 1310914 - RNA, 19 nt, Homo sapiens
ggacagugguggagaguca

SEQ ID NO: 1310915 - RNA, 19 nt, Homo sapiens
gugcacgucuuccucuuua

SEQ ID NO: 1310916 - RNA, 19 nt, Homo sapiens
gcagggauguguuuaaguc

SEQ ID NO: 1310917 - RNA, 19 nt, Homo sapiens
ggugaaaccucaucucuac

SEQ ID NO: 1310918 - RNA, 19 nt, Homo sapiens
caaagguugugguugcuaa

SEQ ID NO: 1310919 - RNA, 19 nt, Homo sapiens
ugacuucucuggugcaaga

SEQ ID NO: 1310920 - RNA, 19 nt, Homo sapiens
gaaaccucaucucuacaaa

SEQ ID NO: 1310921 - RNA, 19 nt, Homo sapiens
gcgcacaccuguagucaca

SEQ ID NO: 1310922 - RNA, 19 nt, Homo sapiens
gagcccaucaccucuguua

SEQ ID NO: 1310923 - RNA, 19 nt, Homo sapiens
aaugaggcguccuguauuu

SEQ ID NO: 1310924 - RNA, 19 nt, Homo sapiens
uaaacugggauuucagaua

SEQ ID NO: 1310925 - RNA, 19 nt, Homo sapiens
gaagggcagggauguguuu

SEQ ID NO: 1310926 - RNA, 19 nt, Homo sapiens
gaaugaggcguccuguauu

SEQ ID NO: 1310927 - RNA, 19 nt, Homo sapiens
cgaagggccaugagaagua

SEQ ID NO: 1310928 - RNA, 19 nt, Homo sapiens
caucauccguucacaaagu

SEQ ID NO: 1310929 - RNA, 19 nt, Homo sapiens
ugaaugaggcguccuguau

SEQ ID NO: 1310930 - RNA, 19 nt, Homo sapiens
gcucacagccuuacagauc

SEQ ID NO: 1310931 - RNA, 19 nt, Homo sapiens
acagaucgcccacacguuu

SEQ ID NO: 1310932 - RNA, 19 nt, Homo sapiens
ggaaauuucaggaaucaag

SEQ ID NO: 1310933 - RNA, 19 nt, Homo sapiens
ccacacguuugucuguuga

SEQ ID NO: 1310934 - RNA, 19 nt, Homo sapiens
gguggcugcuugauuaugu

SEQ ID NO: 1310935 - RNA, 19 nt, Homo sapiens
ucucuugacucuugacuuc

SEQ ID NO: 1310936 - RNA, 19 nt, Homo sapiens
auacagagugccuauuuaa

SEQ ID NO: 1310937 - RNA, 19 nt, Homo sapiens
cacgugcccuuuacugauu

SEQ ID NO: 1310938 - RNA, 19 nt, Homo sapiens
gaagggccaugagaaguac

SEQ ID NO: 1310939 - RNA, 19 nt, Homo sapiens
gaagcugucucugacucuu

SEQ ID NO: 1310940 - RNA, 19 nt, Homo sapiens
gggcagggauguguuuaag

SEQ ID NO: 1310941 - RNA, 19 nt, Homo sapiens
gagcugugauuugauuaca

SEQ ID NO: 1310942 - RNA, 19 nt, Homo sapiens
guaugacccaugcaacuuu

SEQ ID NO: 1310943 - RNA, 19 nt, Homo sapiens
uacuugcacucauguguuu

SEQ ID NO: 1310944 - RNA, 19 nt, Homo sapiens
uuacugccauuucccauuc

SEQ ID NO: 1310945 - RNA, 19 nt, Homo sapiens
cagagugccuauuuaaacu

SEQ ID NO: 1310946 - RNA, 19 nt, Homo sapiens
ccugagcucucuggcagua

SEQ ID NO: 1310947 - RNA, 19 nt, Homo sapiens
ccuccgaguuccuccauug

SEQ ID NO: 1310948 - RNA, 19 nt, Homo sapiens
gauccaaacguaccuacug

SEQ ID NO: 1310949 - RNA, 19 nt, Homo sapiens
uccaugagcucccaagaag

SEQ ID NO: 1310950 - RNA, 19 nt, Homo sapiens
gaaaugguucagcccucua

SEQ ID NO: 1310951 - RNA, 19 nt, Homo sapiens
agugagcugugauuugauu

SEQ ID NO: 1310952 - RNA, 19 nt, Homo sapiens
gcaccugccugagcucucu

SEQ ID NO: 1310953 - RNA, 19 nt, Homo sapiens
ugaaaccucaucucuacaa

SEQ ID NO: 1310954 - RNA, 19 nt, Homo sapiens
ggcgggaauuggcuuaugu

SEQ ID NO: 1310955 - RNA, 19 nt, Homo sapiens
gauuacaaccucgguaugu

SEQ ID NO: 1310956 - RNA, 19 nt, Homo sapiens
gcucuacucaccucccaaa

SEQ ID NO: 1310957 - RNA, 19 nt, Homo sapiens
aaauuagucagguguggua

SEQ ID NO: 1310958 - RNA, 19 nt, Homo sapiens
cgccauggcuuccuuuagg

SEQ ID NO: 1310959 - RNA, 19 nt, Homo sapiens
ccgaguuccuccauuguca

SEQ ID NO: 1310960 - RNA, 19 nt, Homo sapiens
ggaggugagugagucucuu

SEQ ID NO: 1310961 - RNA, 19 nt, Homo sapiens
gcuuguuccugcuccagaa

SEQ ID NO: 1310962 - RNA, 19 nt, Homo sapiens
uuaagucauccuuguguuu

SEQ ID NO: 1310963 - RNA, 19 nt, Homo sapiens
ccuguaaucccagcacuuu

SEQ ID NO: 1310964 - RNA, 19 nt, Homo sapiens
ucauguguuugaaaugguu

SEQ ID NO: 1310965 - RNA, 19 nt, Homo sapiens
gaggugagugagucucuug

SEQ ID NO: 1310966 - RNA, 19 nt, Homo sapiens
gagcuaaggguggcacuag

SEQ ID NO: 1310967 - RNA, 19 nt, Homo sapiens
guguuuaagucauccuugu

SEQ ID NO: 1310968 - RNA, 19 nt, Homo sapiens
ucucugaagcugucucuga

SEQ ID NO: 1310969 - RNA, 19 nt, Homo sapiens
ugggaaauuucaggaauca

SEQ ID NO: 1310970 - RNA, 19 nt, Homo sapiens
ccucagcccucuccuagcu

SEQ ID NO: 1310971 - RNA, 19 nt, Homo sapiens
ugccgaugauccaaacgua

SEQ ID NO: 1310972 - RNA, 19 nt, Homo sapiens
ggcuguaccugccgaugau

SEQ ID NO: 1310973 - RNA, 19 nt, Homo sapiens
ggacucaugcccgaagugu

SEQ ID NO: 1310974 - RNA, 19 nt, Homo sapiens
gcccuuuacugauuacaac

SEQ ID NO: 1310975 - RNA, 19 nt, Homo sapiens
acagagugccuauuuaaac

SEQ ID NO: 1310976 - RNA, 19 nt, Homo sapiens
gcccacacguuugucuguu

SEQ ID NO: 1310977 - RNA, 19 nt, Homo sapiens
cagccucgccuccacauca

SEQ ID NO: 1310978 - RNA, 19 nt, Homo sapiens
cuggagaacucuuagucau

SEQ ID NO: 1310979 - RNA, 19 nt, Homo sapiens
aaacuugauuguggugaca

SEQ ID NO: 1310980 - RNA, 19 nt, Homo sapiens
cagacucuuucagcaugua

SEQ ID NO: 1310981 - RNA, 19 nt, Homo sapiens
ucuccuagcucuccccuaa

SEQ ID NO: 1310982 - RNA, 19 nt, Homo sapiens
uaagucauccuuguguuuc

SEQ ID NO: 1310983 - RNA, 19 nt, Homo sapiens
acuuucaccuccucucuga

SEQ ID NO: 1310984 - RNA, 19 nt, Homo sapiens
ccuguuguucucccuguua

SEQ ID NO: 1310985 - RNA, 19 nt, Homo sapiens
caguuccucucuccugguu

SEQ ID NO: 1310986 - RNA, 19 nt, Homo sapiens
gauuaugucaccagacucu

SEQ ID NO: 1310987 - RNA, 19 nt, Homo sapiens
uacagagugccuauuuaaa

SEQ ID NO: 1310988 - RNA, 19 nt, Homo sapiens
ccucgaagggccaugagaa

SEQ ID NO: 1310989 - RNA, 19 nt, Homo sapiens
ccaagaagggcagggaugu

SEQ ID NO: 1310990 - RNA, 19 nt, Homo sapiens
guccaugagcucccaagaa

SEQ ID NO: 1310991 - RNA, 19 nt, Homo sapiens
gcacuuucaccuccucucu

SEQ ID NO: 1310992 - RNA, 19 nt, Homo sapiens
gguugugguugcuaauugg

SEQ ID NO: 1310993 - RNA, 19 nt, Homo sapiens
cuugaacacucuuacaaaa

SEQ ID NO: 1310994 - RNA, 19 nt, Homo sapiens
ccuugaacacucuuacaaa

SEQ ID NO: 1310995 - RNA, 19 nt, Homo sapiens
ggauuucagauaaacaagu

SEQ ID NO: 1310996 - RNA, 19 nt, Homo sapiens
gaccccagcuacagaauuc

SEQ ID NO: 1310997 - RNA, 19 nt, Homo sapiens
ugcaucauccguucacaaa

SEQ ID NO: 1310998 - RNA, 19 nt, Homo sapiens
gcacgucuuccucuuuacu

SEQ ID NO: 1310999 - RNA, 19 nt, Homo sapiens
ccagacucuuucagcaugu

SEQ ID NO: 1311000 - RNA, 19 nt, Homo sapiens
gucaccagacuaaguuuga

SEQ ID NO: 1311001 - RNA, 19 nt, Homo sapiens
cccacacguuugucuguug

SEQ ID NO: 1311002 - RNA, 19 nt, Homo sapiens
gaguguagaggagaugaga

SEQ ID NO: 1311003 - RNA, 19 nt, Homo sapiens
acucauguguuugaaaugg

SEQ ID NO: 1311004 - RNA, 19 nt, Homo sapiens
ugugucauccucugccuuu

SEQ ID NO: 1311005 - RNA, 19 nt, Homo sapiens
uuaugucaccagacucuuu

SEQ ID NO: 1311006 - RNA, 19 nt, Homo sapiens
ucucgucaccugcuggaaa

SEQ ID NO: 1311007 - RNA, 19 nt, Homo sapiens
gcccaucaccucuguuacu

SEQ ID NO: 1311008 - RNA, 19 nt, Homo sapiens
agguugugguugcuaauug

SEQ ID NO: 1311009 - RNA, 19 nt, Homo sapiens
ugauuguccaccugaaauu

SEQ ID NO: 1311010 - RNA, 19 nt, Homo sapiens
gaaauaaagugcugucauu

SEQ ID NO: 1311011 - RNA, 19 nt, Homo sapiens
gggaaacgcuucaaucaga

SEQ ID NO: 1311012 - RNA, 19 nt, Homo sapiens
ggaaagacccuauaagugu

SEQ ID NO: 1311013 - RNA, 19 nt, Homo sapiens
ggagacaguuuccaucauu

SEQ ID NO: 1311014 - RNA, 19 nt, Homo sapiens
gcagugagcugagaucaug

SEQ ID NO: 1311015 - RNA, 19 nt, Homo sapiens
ggaaagauuuagacaaagu

SEQ ID NO: 1311016 - RNA, 19 nt, Homo sapiens
gcucugaccucuuuaaaca

SEQ ID NO: 1311017 - RNA, 19 nt, Homo sapiens
gcaggcagaucauuugaga

SEQ ID NO: 1311018 - RNA, 19 nt, Homo sapiens
ggaaaagccuuacaaaugu

SEQ ID NO: 1311019 - RNA, 19 nt, Homo sapiens
ggggaaaccugucauauuu

SEQ ID NO: 1311020 - RNA, 19 nt, Homo sapiens
gcucugaccucuuuagaca

SEQ ID NO: 1311021 - RNA, 19 nt, Homo sapiens
gcacaguuccgccgaguuu

SEQ ID NO: 1311022 - RNA, 19 nt, Homo sapiens
ucucagaugucaauaagaa

SEQ ID NO: 1311023 - RNA, 19 nt, Homo sapiens
gugcaacccucauuaaaca

SEQ ID NO: 1311024 - RNA, 19 nt, Homo sapiens
gaaagaccuuauaaaugug

SEQ ID NO: 1311025 - RNA, 19 nt, Homo sapiens
gcugaaaccucacaagucu

SEQ ID NO: 1311026 - RNA, 19 nt, Homo sapiens
gggaacaagugcaagcaaa

SEQ ID NO: 1311027 - RNA, 19 nt, Homo sapiens
gcgcaaagcugaggaaagg

SEQ ID NO: 1311028 - RNA, 19 nt, Homo sapiens
gcagcuccaugaagaaaga

SEQ ID NO: 1311029 - RNA, 19 nt, Homo sapiens
acaaagaguugauuccaau

SEQ ID NO: 1311030 - RNA, 19 nt, Homo sapiens
gaaaguggaggaagacuca

SEQ ID NO: 1311031 - RNA, 19 nt, Homo sapiens
caagcaaaguuuccacaug

SEQ ID NO: 1311032 - RNA, 19 nt, Homo sapiens
cgagagcacugcccagaga

SEQ ID NO: 1311033 - RNA, 19 nt, Homo sapiens
gcagagagagugcgcagaa

SEQ ID NO: 1311034 - RNA, 19 nt, Homo sapiens
agacaaaguacacaccuua

SEQ ID NO: 1311035 - RNA, 19 nt, Homo sapiens
ggagaagcccuauggaugu

SEQ ID NO: 1311036 - RNA, 19 nt, Homo sapiens
acaacgcucugaccucuuu

SEQ ID NO: 1311037 - RNA, 19 nt, Homo sapiens
caucagagacuacauaaag

SEQ ID NO: 1311038 - RNA, 19 nt, Homo sapiens
ugucauauuuccaaccuuu

SEQ ID NO: 1311039 - RNA, 19 nt, Homo sapiens
ggggaaagauuuagacaaa

SEQ ID NO: 1311040 - RNA, 19 nt, Homo sapiens
gagaagcccuauggauguu

SEQ ID NO: 1311041 - RNA, 19 nt, Homo sapiens
gcagagaggcccacugaca

SEQ ID NO: 1311042 - RNA, 19 nt, Homo sapiens
gggaaagacccuauaagug

SEQ ID NO: 1311043 - RNA, 19 nt, Homo sapiens
agaggcagcuccaugaaga

SEQ ID NO: 1311044 - RNA, 19 nt, Homo sapiens
cauuugagaucaggaguuu

SEQ ID NO: 1311045 - RNA, 19 nt, Homo sapiens
caccaaagaauucaucaaa

SEQ ID NO: 1311046 - RNA, 19 nt, Homo sapiens
gggaaaagccuuacaaaug

SEQ ID NO: 1311047 - RNA, 19 nt, Homo sapiens
caucaaaguacccacagua

SEQ ID NO: 1311048 - RNA, 19 nt, Homo sapiens
cuaaaucgucaucaaagua

SEQ ID NO: 1311049 - RNA, 19 nt, Homo sapiens
gcagaauucacaccuaaau

SEQ ID NO: 1311050 - RNA, 19 nt, Homo sapiens
guacaccugucugaaaugu

SEQ ID NO: 1311051 - RNA, 19 nt, Homo sapiens
caaggcaggcagaucauuu

SEQ ID NO: 1311052 - RNA, 19 nt, Homo sapiens
guugacggcugaugaguuc

SEQ ID NO: 1311053 - RNA, 19 nt, Homo sapiens
guuccaaccuuguucuaug

SEQ ID NO: 1311054 - RNA, 19 nt, Homo sapiens
gaacaaagaguugauucca

SEQ ID NO: 1311055 - RNA, 19 nt, Homo sapiens
cagaaggacucaacagcau

SEQ ID NO: 1311056 - RNA, 19 nt, Homo sapiens
gguaggagaaucacuugaa

SEQ ID NO: 1311057 - RNA, 19 nt, Homo sapiens
gaaagaugaauuccagcuu

SEQ ID NO: 1311058 - RNA, 19 nt, Homo sapiens
gcagaguggagaacaaaga

SEQ ID NO: 1311059 - RNA, 19 nt, Homo sapiens
acagcgcucugaccucuuu

SEQ ID NO: 1311060 - RNA, 19 nt, Homo sapiens
agacaucagagacuacaua

SEQ ID NO: 1311061 - RNA, 19 nt, Homo sapiens
caaaguacccacaguagag

SEQ ID NO: 1311062 - RNA, 19 nt, Homo sapiens
caacagagcgagacuccau

SEQ ID NO: 1311063 - RNA, 19 nt, Homo sapiens
aggcagaauucacaccuaa

SEQ ID NO: 1311064 - RNA, 19 nt, Homo sapiens
gagacaguuuccaucauuc

SEQ ID NO: 1311065 - RNA, 19 nt, Homo sapiens
ggagggacuucugcagaga

SEQ ID NO: 1311066 - RNA, 19 nt, Homo sapiens
gagugcaacccucauuaaa

SEQ ID NO: 1311067 - RNA, 19 nt, Homo sapiens
gaaaagaagacuccaggaa

SEQ ID NO: 1311068 - RNA, 19 nt, Homo sapiens
gacaucagagacuacauaa

SEQ ID NO: 1311069 - RNA, 19 nt, Homo sapiens
caugaagaaagaccuuaua

SEQ ID NO: 1311070 - RNA, 19 nt, Homo sapiens
gaacaagugcaagcaaagu

SEQ ID NO: 1311071 - RNA, 19 nt, Homo sapiens
ccuauaaucccagcacuuu

SEQ ID NO: 1311072 - RNA, 19 nt, Homo sapiens
gcacaugccggagaaagau

SEQ ID NO: 1311073 - RNA, 19 nt, Homo sapiens
cagagugcaacccucauua

SEQ ID NO: 1311074 - RNA, 19 nt, Homo sapiens
acaccuaaaucgucaucaa

SEQ ID NO: 1311075 - RNA, 19 nt, Homo sapiens
aagaugaauuccagcuuga

SEQ ID NO: 1311076 - RNA, 19 nt, Homo sapiens
ugaaaccucacaagucuga

SEQ ID NO: 1311077 - RNA, 19 nt, Homo sapiens
ggagaacaaagaguugauu

SEQ ID NO: 1311078 - RNA, 19 nt, Homo sapiens
caccuuauccgacaccaaa

SEQ ID NO: 1311079 - RNA, 19 nt, Homo sapiens
gaaagcagaguggagaaca

SEQ ID NO: 1311080 - RNA, 19 nt, Homo sapiens
guaggagaaucacuugaac

SEQ ID NO: 1311081 - RNA, 19 nt, Homo sapiens
ggaagacucacccggaagu

SEQ ID NO: 1311082 - RNA, 19 nt, Homo sapiens
gagaacaaagaguugauuc

SEQ ID NO: 1311083 - RNA, 19 nt, Homo sapiens
gaguggagaacaaagaguu

SEQ ID NO: 1311084 - RNA, 19 nt, Homo sapiens
gagagagugcgcagaagga

SEQ ID NO: 1311085 - RNA, 19 nt, Homo sapiens
ccuaaaucgucaucaaagu

SEQ ID NO: 1311086 - RNA, 19 nt, Homo sapiens
aaagcagaguggagaacaa

SEQ ID NO: 1311087 - RNA, 19 nt, Homo sapiens
ccguacaccugucugaaau

SEQ ID NO: 1311088 - RNA, 19 nt, Homo sapiens
aagcagagaggcccacuga

SEQ ID NO: 1311089 - RNA, 19 nt, Homo sapiens
aaaauccugucucuacuaa

SEQ ID NO: 1311090 - RNA, 19 nt, Homo sapiens
gggaaagauuuagacaaag

SEQ ID NO: 1311091 - RNA, 19 nt, Homo sapiens
cuauggauguuccgucugu

SEQ ID NO: 1311092 - RNA, 19 nt, Homo sapiens
ucaaaguacccacaguaga

SEQ ID NO: 1311093 - RNA, 19 nt, Homo sapiens
acaagugcaagcaaaguuu

SEQ ID NO: 1311094 - RNA, 19 nt, Homo sapiens
ggaacaagugcaagcaaag

SEQ ID NO: 1311095 - RNA, 19 nt, Homo sapiens
aacaaagaguugauuccaa

SEQ ID NO: 1311096 - RNA, 19 nt, Homo sapiens
auaaagugcugucauuuug

SEQ ID NO: 1311097 - RNA, 19 nt, Homo sapiens
ggccaaggcaggcagauca

SEQ ID NO: 1311098 - RNA, 19 nt, Homo sapiens
ccuuacaaaugucuugaau

SEQ ID NO: 1311099 - RNA, 19 nt, Homo sapiens
gugggaaacgcuucaauca

SEQ ID NO: 1311100 - RNA, 19 nt, Homo sapiens
gagguaggagaaucacuug

SEQ ID NO: 1311101 - RNA, 19 nt, Homo sapiens
cagccuggccaacauggua

SEQ ID NO: 1311102 - RNA, 19 nt, Homo sapiens
uauccgacaccaaagaauu

SEQ ID NO: 1311103 - RNA, 19 nt, Homo sapiens
gacaaaguacacaccuuau

SEQ ID NO: 1311104 - RNA, 19 nt, Homo sapiens
gaauguggggaaagauuua

SEQ ID NO: 1311105 - RNA, 19 nt, Homo sapiens
agagugcaacccucauuaa

SEQ ID NO: 1311106 - RNA, 19 nt, Homo sapiens
caggcagaauucacaccua

SEQ ID NO: 1311107 - RNA, 19 nt, Homo sapiens
gaggaacacgggaacaagu

SEQ ID NO: 1311108 - RNA, 19 nt, Homo sapiens
gaaggacucaacagcaucu

SEQ ID NO: 1311109 - RNA, 19 nt, Homo sapiens
gaacccaggaggcggaagu

SEQ ID NO: 1311110 - RNA, 19 nt, Homo sapiens
gaacaggacuaucaacuga

SEQ ID NO: 1311111 - RNA, 19 nt, Homo sapiens
gcaguucugugcuuuauua

SEQ ID NO: 1311112 - RNA, 19 nt, Homo sapiens
aauaugagguccuugauua

SEQ ID NO: 1311113 - RNA, 19 nt, Homo sapiens
gaagaauaauggacgauga

SEQ ID NO: 1311114 - RNA, 19 nt, Homo sapiens
gaaacaaacucucaaagcu

SEQ ID NO: 1311115 - RNA, 19 nt, Homo sapiens
gcucaaagcagaaauagaa

SEQ ID NO: 1311116 - RNA, 19 nt, Homo sapiens
gaguaaagcuguugaagag

SEQ ID NO: 1311117 - RNA, 19 nt, Homo sapiens
guucugugcuuuauuauga

SEQ ID NO: 1311118 - RNA, 19 nt, Homo sapiens
ggaagaaauugacugugaa

SEQ ID NO: 1311119 - RNA, 19 nt, Homo sapiens
gaagaaaguucagagcaau

SEQ ID NO: 1311120 - RNA, 19 nt, Homo sapiens
caugagaaccuuagaauau

SEQ ID NO: 1311121 - RNA, 19 nt, Homo sapiens
cagaaggaauuagaagaua

SEQ ID NO: 1311122 - RNA, 19 nt, Homo sapiens
gaggacauuucauuucuug

SEQ ID NO: 1311123 - RNA, 19 nt, Homo sapiens
guauaucgguauugagaaa

SEQ ID NO: 1311124 - RNA, 19 nt, Homo sapiens
aagaagacauugagaguga

SEQ ID NO: 1311125 - RNA, 19 nt, Homo sapiens
agaaauagaagcugaauug

SEQ ID NO: 1311126 - RNA, 19 nt, Homo sapiens
caucauggauagccugaaa

SEQ ID NO: 1311127 - RNA, 19 nt, Homo sapiens
aauagaagcugaauuggau

SEQ ID NO: 1311128 - RNA, 19 nt, Homo sapiens
uaacaggcaugacugacuu

SEQ ID NO: 1311129 - RNA, 19 nt, Homo sapiens
ggaauuagaagauaaagag

SEQ ID NO: 1311130 - RNA, 19 nt, Homo sapiens
uugagaaacugguggauuu

SEQ ID NO: 1311131 - RNA, 19 nt, Homo sapiens
guucuucacuguauuaaca

SEQ ID NO: 1311132 - RNA, 19 nt, Homo sapiens
ucagagggauagagaagaa

SEQ ID NO: 1311133 - RNA, 19 nt, Homo sapiens
gaaacagaaggaauuagaa

SEQ ID NO: 1311134 - RNA, 19 nt, Homo sapiens
ggaguaaagcuguugaaga

SEQ ID NO: 1311135 - RNA, 19 nt, Homo sapiens
ggacgaugaugaugcaaag

SEQ ID NO: 1311136 - RNA, 19 nt, Homo sapiens
auggauagccugaaauuua

SEQ ID NO: 1311137 - RNA, 19 nt, Homo sapiens
ccaguggagucuaugaauu

SEQ ID NO: 1311138 - RNA, 19 nt, Homo sapiens
aggaagaaauugacuguga

SEQ ID NO: 1311139 - RNA, 19 nt, Homo sapiens
caacaaagccaaggaaucu

SEQ ID NO: 1311140 - RNA, 19 nt, Homo sapiens
guucaaccauuuagaguca

SEQ ID NO: 1311141 - RNA, 19 nt, Homo sapiens
cgacauugcuggaugaaac

SEQ ID NO: 1311142 - RNA, 19 nt, Homo sapiens
gaacauguuuuaccagaug

SEQ ID NO: 1311143 - RNA, 19 nt, Homo sapiens
guuugaguguugcauauaa

SEQ ID NO: 1311144 - RNA, 19 nt, Homo sapiens
gaucauaguggugguauau

SEQ ID NO: 1311145 - RNA, 19 nt, Homo sapiens
ccuaggagauccacacaau

SEQ ID NO: 1311146 - RNA, 19 nt, Homo sapiens
cagauugagcuuaauagua

SEQ ID NO: 1311147 - RNA, 19 nt, Homo sapiens
gaacauucagaagguauuu

SEQ ID NO: 1311148 - RNA, 19 nt, Homo sapiens
cagaugaugcugauauaaa

SEQ ID NO: 1311149 - RNA, 19 nt, Homo sapiens
gaauaauggacgaugauga

SEQ ID NO: 1311150 - RNA, 19 nt, Homo sapiens
gaaaguucagagcaauuaa

SEQ ID NO: 1311151 - RNA, 19 nt, Homo sapiens
ggugguauaucgguauuga

SEQ ID NO: 1311152 - RNA, 19 nt, Homo sapiens
ugagguccuugauuaguuu

SEQ ID NO: 1311153 - RNA, 19 nt, Homo sapiens
ggauuguguugcagauuga

SEQ ID NO: 1311154 - RNA, 19 nt, Homo sapiens
uaugggcgcugucuuacaa

SEQ ID NO: 1311155 - RNA, 19 nt, Homo sapiens
ccucaugacuugccuaugg

SEQ ID NO: 1311156 - RNA, 19 nt, Homo sapiens
ugaauuaccagaaucaguu

SEQ ID NO: 1311157 - RNA, 19 nt, Homo sapiens
ggagcaguuucuaauaauc

SEQ ID NO: 1311158 - RNA, 19 nt, Homo sapiens
gaugauagugauacagauu

SEQ ID NO: 1311159 - RNA, 19 nt, Homo sapiens
ugacugacuucucuaucuu

SEQ ID NO: 1311160 - RNA, 19 nt, Homo sapiens
gggcaguucugugcuuuau

SEQ ID NO: 1311161 - RNA, 19 nt, Homo sapiens
ucuguggucuggcauauga

SEQ ID NO: 1311162 - RNA, 19 nt, Homo sapiens
gaagaaauugacugugaau

SEQ ID NO: 1311163 - RNA, 19 nt, Homo sapiens
guagcuaccucugaagaau

SEQ ID NO: 1311164 - RNA, 19 nt, Homo sapiens
gcaaagcucaaagcagaaa

SEQ ID NO: 1311165 - RNA, 19 nt, Homo sapiens
gaagguauuuugcuuuugu

SEQ ID NO: 1311166 - RNA, 19 nt, Homo sapiens
agaaaguucagagcaauua

SEQ ID NO: 1311167 - RNA, 19 nt, Homo sapiens
cgagacggguguauaacga

SEQ ID NO: 1311168 - RNA, 19 nt, Homo sapiens
ucaagggucaucauggaua

SEQ ID NO: 1311169 - RNA, 19 nt, Homo sapiens
gaaauuagagaacauucag

SEQ ID NO: 1311170 - RNA, 19 nt, Homo sapiens
ucaguugaauuaccagaau

SEQ ID NO: 1311171 - RNA, 19 nt, Homo sapiens
uagagaacauucagaaggu

SEQ ID NO: 1311172 - RNA, 19 nt, Homo sapiens
gacuaucaacugaauauga

SEQ ID NO: 1311173 - RNA, 19 nt, Homo sapiens
caguggagucuaugaauuu

SEQ ID NO: 1311174 - RNA, 19 nt, Homo sapiens
ucugauagaggaagaaauu

SEQ ID NO: 1311175 - RNA, 19 nt, Homo sapiens
gccuauggaugaacauguu

SEQ ID NO: 1311176 - RNA, 19 nt, Homo sapiens
gaaaccccgucucuacuaa

SEQ ID NO: 1311177 - RNA, 19 nt, Homo sapiens
gagggcaguucugugcuuu

SEQ ID NO: 1311178 - RNA, 19 nt, Homo sapiens
ggagauccacacaaucaga

SEQ ID NO: 1311179 - RNA, 19 nt, Homo sapiens
ucuggcauaugacauguaa

SEQ ID NO: 1311180 - RNA, 19 nt, Homo sapiens
ggcgcugucuuacaacaaa

SEQ ID NO: 1311181 - RNA, 19 nt, Homo sapiens
gagcaguuucuaauaauca

SEQ ID NO: 1311182 - RNA, 19 nt, Homo sapiens
auggagcaguuucuaauaa

SEQ ID NO: 1311183 - RNA, 19 nt, Homo sapiens
uggauaaacucagcauuuc

SEQ ID NO: 1311184 - RNA, 19 nt, Homo sapiens
aaucagaaacccagaguga

SEQ ID NO: 1311185 - RNA, 19 nt, Homo sapiens
ggauaacaggcaugacuga

SEQ ID NO: 1311186 - RNA, 19 nt, Homo sapiens
gaagcugaauuggauaaac

SEQ ID NO: 1311187 - RNA, 19 nt, Homo sapiens
ggccgagacggguguauaa

SEQ ID NO: 1311188 - RNA, 19 nt, Homo sapiens
ggguuugaguguugcauau

SEQ ID NO: 1311189 - RNA, 19 nt, Homo sapiens
ugacuucucuaucuuucau

SEQ ID NO: 1311190 - RNA, 19 nt, Homo sapiens
caagggucaucauggauag

SEQ ID NO: 1311191 - RNA, 19 nt, Homo sapiens
uggauuguguugcagauug

SEQ ID NO: 1311192 - RNA, 19 nt, Homo sapiens
ggcuaugggcgcugucuua

SEQ ID NO: 1311193 - RNA, 19 nt, Homo sapiens
agaaacagaaggaauuaga

SEQ ID NO: 1311194 - RNA, 19 nt, Homo sapiens
agagaaacagaaggaauua

SEQ ID NO: 1311195 - RNA, 19 nt, Homo sapiens
aagagaaacagaaggaauu

SEQ ID NO: 1311196 - RNA, 19 nt, Homo sapiens
caagagaaacagaaggaau

SEQ ID NO: 1311197 - RNA, 19 nt, Homo sapiens
ggaccuggaagauauuuua

SEQ ID NO: 1311198 - RNA, 19 nt, Homo sapiens
ucagaaacccagagugaug

SEQ ID NO: 1311199 - RNA, 19 nt, Homo sapiens
gcaggagaauggcgugaac

SEQ ID NO: 1311200 - RNA, 19 nt, Homo sapiens
uccuugaacuggcaacuuu

SEQ ID NO: 1311201 - RNA, 19 nt, Homo sapiens
gaguguugcauauaaagaa

SEQ ID NO: 1311202 - RNA, 19 nt, Homo sapiens
uaggagauccacacaauca

SEQ ID NO: 1311203 - RNA, 19 nt, Homo sapiens
uuucauuucugucguaugu

SEQ ID NO: 1311204 - RNA, 19 nt, Homo sapiens
cagaagguauuuugcuuuu

SEQ ID NO: 1311205 - RNA, 19 nt, Homo sapiens
ugacuugccuauggaugaa

SEQ ID NO: 1311206 - RNA, 19 nt, Homo sapiens
ucauaaagaacaggaguaa

SEQ ID NO: 1311207 - RNA, 19 nt, Homo sapiens
ccagagugaugauagugau

SEQ ID NO: 1311208 - RNA, 19 nt, Homo sapiens
ucaugagaaccuuagaaua

SEQ ID NO: 1311209 - RNA, 19 nt, Homo sapiens
agacacacuucugaucuug

SEQ ID NO: 1311210 - RNA, 19 nt, Homo sapiens
gagaaucgcuugaauauga

SEQ ID NO: 1311211 - RNA, 19 nt, Homo sapiens
gaaguaaguuuguguguaa

SEQ ID NO: 1311212 - RNA, 19 nt, Homo sapiens
gaagaaagguccaguaugc

SEQ ID NO: 1311213 - RNA, 19 nt, Homo sapiens
gaagaggagucgaggauug

SEQ ID NO: 1311214 - RNA, 19 nt, Homo sapiens
aaacgaagaugacguguau

SEQ ID NO: 1311215 - RNA, 19 nt, Homo sapiens
gaagaaagugaccaacaua

SEQ ID NO: 1311216 - RNA, 19 nt, Homo sapiens
gagccaagaugaugccauu

SEQ ID NO: 1311217 - RNA, 19 nt, Homo sapiens
gaagaugacguguauggaa

SEQ ID NO: 1311218 - RNA, 19 nt, Homo sapiens
gaaagugaccaacauaauc

SEQ ID NO: 1311219 - RNA, 19 nt, Homo sapiens
gagaauaguugugguaugg

SEQ ID NO: 1311220 - RNA, 19 nt, Homo sapiens
ugagggcacuuaauacaaa

SEQ ID NO: 1311221 - RNA, 19 nt, Homo sapiens
aaauaggucugcaagcuuu

SEQ ID NO: 1311222 - RNA, 19 nt, Homo sapiens
cagaaugugugccuugaaa

SEQ ID NO: 1311223 - RNA, 19 nt, Homo sapiens
ggaagaagaagaagaaagu

SEQ ID NO: 1311224 - RNA, 19 nt, Homo sapiens
gaaggcagcguuaggagaa

SEQ ID NO: 1311225 - RNA, 19 nt, Homo sapiens
ggucugaacuccauacucu

SEQ ID NO: 1311226 - RNA, 19 nt, Homo sapiens
uauggugacuucuguguuu

SEQ ID NO: 1311227 - RNA, 19 nt, Homo sapiens
caaaguuaaugucagaaug

SEQ ID NO: 1311228 - RNA, 19 nt, Homo sapiens
gaaugugugccuugaaauu

SEQ ID NO: 1311229 - RNA, 19 nt, Homo sapiens
gcaggagaaucgcuugaau

SEQ ID NO: 1311230 - RNA, 19 nt, Homo sapiens
gaugagacugugccuguua

SEQ ID NO: 1311231 - RNA, 19 nt, Homo sapiens
uauggaaacucaucaggaa

SEQ ID NO: 1311232 - RNA, 19 nt, Homo sapiens
ucugcaagcuuuauauuug

SEQ ID NO: 1311233 - RNA, 19 nt, Homo sapiens
ccagaagcuugaugugaaa

SEQ ID NO: 1311234 - RNA, 19 nt, Homo sapiens
ggagaauaguugugguaug

SEQ ID NO: 1311235 - RNA, 19 nt, Homo sapiens
ugaccaacauaaucucauu

SEQ ID NO: 1311236 - RNA, 19 nt, Homo sapiens
agaaguaaguuugugugua

SEQ ID NO: 1311237 - RNA, 19 nt, Homo sapiens
ugacguguauggaaacuca

SEQ ID NO: 1311238 - RNA, 19 nt, Homo sapiens
gagcagcaacucauggaaa

SEQ ID NO: 1311239 - RNA, 19 nt, Homo sapiens
ggagugagcagccuguuca

SEQ ID NO: 1311240 - RNA, 19 nt, Homo sapiens
gcggaucacagaacaauga

SEQ ID NO: 1311241 - RNA, 19 nt, Homo sapiens
gggaagggaguacauuuga

SEQ ID NO: 1311242 - RNA, 19 nt, Homo sapiens
aagaugacguguauggaaa

SEQ ID NO: 1311243 - RNA, 19 nt, Homo sapiens
ccaacauaaucucauuuga

SEQ ID NO: 1311244 - RNA, 19 nt, Homo sapiens
gaucacagaacaaugacaa

SEQ ID NO: 1311245 - RNA, 19 nt, Homo sapiens
acaggaagcucaggacgaa

SEQ ID NO: 1311246 - RNA, 19 nt, Homo sapiens
cauuugagggcacuuaaua

SEQ ID NO: 1311247 - RNA, 19 nt, Homo sapiens
caggagaaucgcuugaaua

SEQ ID NO: 1311248 - RNA, 19 nt, Homo sapiens
gcaucugacuugccacuag

SEQ ID NO: 1311249 - RNA, 19 nt, Homo sapiens
gccuugaaauucuugcuuu

SEQ ID NO: 1311250 - RNA, 19 nt, Homo sapiens
gaaaauugauucccugucu

SEQ ID NO: 1311251 - RNA, 19 nt, Homo sapiens
agaagaaagugaccaacau

SEQ ID NO: 1311252 - RNA, 19 nt, Homo sapiens
uccauacucuuugcgauua

SEQ ID NO: 1311253 - RNA, 19 nt, Homo sapiens
gcugcaggcugagcacuuu

SEQ ID NO: 1311254 - RNA, 19 nt, Homo sapiens
ccuugaaauucuugcuuua

SEQ ID NO: 1311255 - RNA, 19 nt, Homo sapiens
cggagucgcccgagaagua

SEQ ID NO: 1311256 - RNA, 19 nt, Homo sapiens
gaugaagaaagguccagua

SEQ ID NO: 1311257 - RNA, 19 nt, Homo sapiens
gacugugccuguuauuguu

SEQ ID NO: 1311258 - RNA, 19 nt, Homo sapiens
gccugcaccugcugccuua

SEQ ID NO: 1311259 - RNA, 19 nt, Homo sapiens
ucacaggguuucacagucu

SEQ ID NO: 1311260 - RNA, 19 nt, Homo sapiens
caccacacccagcuaauuu

SEQ ID NO: 1311261 - RNA, 19 nt, Homo sapiens
cagcaggucugaacuccau

SEQ ID NO: 1311262 - RNA, 19 nt, Homo sapiens
ggaagggaguacauuugag

SEQ ID NO: 1311263 - RNA, 19 nt, Homo sapiens
ggaaacucaucaggaagga

SEQ ID NO: 1311264 - RNA, 19 nt, Homo sapiens
ggacgggcagaguaaguuu

SEQ ID NO: 1311265 - RNA, 19 nt, Homo sapiens
ggaguauuauuugcucuuc

SEQ ID NO: 1311266 - RNA, 19 nt, Homo sapiens
ccgaguagcugggauuaca

SEQ ID NO: 1311267 - RNA, 19 nt, Homo sapiens
ugaugaagauguggaugaa

SEQ ID NO: 1311268 - RNA, 19 nt, Homo sapiens
accagaagcuugaugugaa

SEQ ID NO: 1311269 - RNA, 19 nt, Homo sapiens
uaucauguccgccuuugaa

SEQ ID NO: 1311270 - RNA, 19 nt, Homo sapiens
gcugugcccucaacgaaca

SEQ ID NO: 1311271 - RNA, 19 nt, Homo sapiens
ugacuucuguguuuaucug

SEQ ID NO: 1311272 - RNA, 19 nt, Homo sapiens
guacauuugagggcacuua

SEQ ID NO: 1311273 - RNA, 19 nt, Homo sapiens
ggaguguuauuuggaagga

SEQ ID NO: 1311274 - RNA, 19 nt, Homo sapiens
gggguuaaguucacuguuu

SEQ ID NO: 1311275 - RNA, 19 nt, Homo sapiens
uguguaagguggagucuca

SEQ ID NO: 1311276 - RNA, 19 nt, Homo sapiens
uaacaucgacaacaaggau

SEQ ID NO: 1311277 - RNA, 19 nt, Homo sapiens
uuaggaguguuauuuggaa

SEQ ID NO: 1311278 - RNA, 19 nt, Homo sapiens
gauuuaggaguguuauuug

SEQ ID NO: 1311279 - RNA, 19 nt, Homo sapiens
ggagucgcccgagaaguaa

SEQ ID NO: 1311280 - RNA, 19 nt, Homo sapiens
ccaguaugcuuccuaccau

SEQ ID NO: 1311281 - RNA, 19 nt, Homo sapiens
ccaagaugaugccauugca

SEQ ID NO: 1311282 - RNA, 19 nt, Homo sapiens
ggucugcaagcuuuauauu

SEQ ID NO: 1311283 - RNA, 19 nt, Homo sapiens
uugauucccugucuuugaa

SEQ ID NO: 1311284 - RNA, 19 nt, Homo sapiens
aaauugauucccugucuuu

SEQ ID NO: 1311285 - RNA, 19 nt, Homo sapiens
gagcggaucacagaacaau

SEQ ID NO: 1311286 - RNA, 19 nt, Homo sapiens
aagaaagugaccaacauaa

SEQ ID NO: 1311287 - RNA, 19 nt, Homo sapiens
ggacgaaggcagcguuagg

SEQ ID NO: 1311288 - RNA, 19 nt, Homo sapiens
gauuuggacgggcagagua

SEQ ID NO: 1311289 - RNA, 19 nt, Homo sapiens
aggagaaucgcuugaauau

SEQ ID NO: 1311290 - RNA, 19 nt, Homo sapiens
ggagggagaaaggagauug

SEQ ID NO: 1311291 - RNA, 19 nt, Homo sapiens
guugugguauggugacuuc

SEQ ID NO: 1311292 - RNA, 19 nt, Homo sapiens
gccuuggccucccagauug

SEQ ID NO: 1311293 - RNA, 19 nt, Homo sapiens
gaccaacauaaucucauuu

SEQ ID NO: 1311294 - RNA, 19 nt, Homo sapiens
gcgcugugcccucaacgaa

SEQ ID NO: 1311295 - RNA, 19 nt, Homo sapiens
gaagaagaagaagaaagug

SEQ ID NO: 1311296 - RNA, 19 nt, Homo sapiens
gagcggaagaagaagaaga

SEQ ID NO: 1311297 - RNA, 19 nt, Homo sapiens
aaaaggagcggaagaagaa

SEQ ID NO: 1311298 - RNA, 19 nt, Homo sapiens
ccauacucuuugcgauuaa

SEQ ID NO: 1311299 - RNA, 19 nt, Homo sapiens
gagaggcggagccaagaug

SEQ ID NO: 1311300 - RNA, 19 nt, Homo sapiens
ggauuuuccuugcaucuga

SEQ ID NO: 1311301 - RNA, 19 nt, Homo sapiens
ggaaggaguauuauuugcu

SEQ ID NO: 1311302 - RNA, 19 nt, Homo sapiens
gagaaguaaguuugugugu

SEQ ID NO: 1311303 - RNA, 19 nt, Homo sapiens
agaaagugaccaacauaau

SEQ ID NO: 1311304 - RNA, 19 nt, Homo sapiens
ugugauggaugaagaaagg

SEQ ID NO: 1311305 - RNA, 19 nt, Homo sapiens
ggguaucauucauucuuca

SEQ ID NO: 1311306 - RNA, 19 nt, Homo sapiens
ucugaacuccauacucuuu

SEQ ID NO: 1311307 - RNA, 19 nt, Homo sapiens
gaaaccccuucucuacgua

SEQ ID NO: 1311308 - RNA, 19 nt, Homo sapiens
ccuguaaucccagcacuuu

SEQ ID NO: 1311309 - RNA, 19 nt, Homo sapiens
agacugugccuguuauugu

SEQ ID NO: 1311310 - RNA, 19 nt, Homo sapiens
gaacacaccuggaguaaaa

SEQ ID NO: 1311311 - RNA, 19 nt, Homo sapiens
gcagaaacucuccuuuaua

SEQ ID NO: 1311312 - RNA, 19 nt, Homo sapiens
gcacaugcuuguaguccua

SEQ ID NO: 1311313 - RNA, 19 nt, Homo sapiens
gcacaggguuaauuauuca

SEQ ID NO: 1311314 - RNA, 19 nt, Homo sapiens
gagaagauccgcuuguuga

SEQ ID NO: 1311315 - RNA, 19 nt, Homo sapiens
uaagauggcuggaauagca

SEQ ID NO: 1311316 - RNA, 19 nt, Homo sapiens
gaaacucuccuuuauacaa

SEQ ID NO: 1311317 - RNA, 19 nt, Homo sapiens
ggucaggaaguucuuauua

SEQ ID NO: 1311318 - RNA, 19 nt, Homo sapiens
ggcagaaacucuccuuuau

SEQ ID NO: 1311319 - RNA, 19 nt, Homo sapiens
gaaagagauugcaaugauc

SEQ ID NO: 1311320 - RNA, 19 nt, Homo sapiens
agaaagagauugcaaugau

SEQ ID NO: 1311321 - RNA, 19 nt, Homo sapiens
cuacaacucuccaaacgaa

SEQ ID NO: 1311322 - RNA, 19 nt, Homo sapiens
cagaaacucuccuuuauac

SEQ ID NO: 1311323 - RNA, 19 nt, Homo sapiens
gaggauugcuugagucuag

SEQ ID NO: 1311324 - RNA, 19 nt, Homo sapiens
gcuaacauguaugcuauaa

SEQ ID NO: 1311325 - RNA, 19 nt, Homo sapiens
cgagugagacuguuucuaa

SEQ ID NO: 1311326 - RNA, 19 nt, Homo sapiens
ggauagcuuucaagaagaa

SEQ ID NO: 1311327 - RNA, 19 nt, Homo sapiens
gauaucuucugggaaauaa

SEQ ID NO: 1311328 - RNA, 19 nt, Homo sapiens
uggaagaacugauuucaau

SEQ ID NO: 1311329 - RNA, 19 nt, Homo sapiens
ggcuauaucugguccuuaa

SEQ ID NO: 1311330 - RNA, 19 nt, Homo sapiens
gggaaaaccuuuagugauu

SEQ ID NO: 1311331 - RNA, 19 nt, Homo sapiens
gucaggaaguucuuauuaa

SEQ ID NO: 1311332 - RNA, 19 nt, Homo sapiens
ggcagaaacuggacuacaa

SEQ ID NO: 1311333 - RNA, 19 nt, Homo sapiens
ugacgaaguucaucuuuca

SEQ ID NO: 1311334 - RNA, 19 nt, Homo sapiens
gaaaugcuguagcuguugu

SEQ ID NO: 1311335 - RNA, 19 nt, Homo sapiens
gagcacaggguuaauuauu

SEQ ID NO: 1311336 - RNA, 19 nt, Homo sapiens
gaagugaggaacagaagaa

SEQ ID NO: 1311337 - RNA, 19 nt, Homo sapiens
ggaagaacugauuucaaua

SEQ ID NO: 1311338 - RNA, 19 nt, Homo sapiens
ggacaguuccaaugauaaa

SEQ ID NO: 1311339 - RNA, 19 nt, Homo sapiens
gagugagacuguuucuaaa

SEQ ID NO: 1311340 - RNA, 19 nt, Homo sapiens
gcaggaggauugcuugagu

SEQ ID NO: 1311341 - RNA, 19 nt, Homo sapiens
aaggauagcuuucaagaag

SEQ ID NO: 1311342 - RNA, 19 nt, Homo sapiens
caagugaugccacgaauau

SEQ ID NO: 1311343 - RNA, 19 nt, Homo sapiens
ucaaggaaauggccaaagu

SEQ ID NO: 1311344 - RNA, 19 nt, Homo sapiens
ggaauuaaaggcuauaucu

SEQ ID NO: 1311345 - RNA, 19 nt, Homo sapiens
gaaguuguaugcacaugag

SEQ ID NO: 1311346 - RNA, 19 nt, Homo sapiens
ggacaguuguuuguacaga

SEQ ID NO: 1311347 - RNA, 19 nt, Homo sapiens
aaggacaguuccaaugaua

SEQ ID NO: 1311348 - RNA, 19 nt, Homo sapiens
gaacgcgcuuugcagauca

SEQ ID NO: 1311349 - RNA, 19 nt, Homo sapiens
caaacgaacuuucaguacu

SEQ ID NO: 1311350 - RNA, 19 nt, Homo sapiens
ggaacgcgcuuugcagauc

SEQ ID NO: 1311351 - RNA, 19 nt, Homo sapiens
guacuaccacagauugaua

SEQ ID NO: 1311352 - RNA, 19 nt, Homo sapiens
cagcacagcaugauucuug

SEQ ID NO: 1311353 - RNA, 19 nt, Homo sapiens
agaugaagauagcuaugua

SEQ ID NO: 1311354 - RNA, 19 nt, Homo sapiens
gacagaaccugauguagcu

SEQ ID NO: 1311355 - RNA, 19 nt, Homo sapiens
ccaaggacaguuccaauga

SEQ ID NO: 1311356 - RNA, 19 nt, Homo sapiens
gcacagggaguauauagca

SEQ ID NO: 1311357 - RNA, 19 nt, Homo sapiens
agauggaccugacgaaguu

SEQ ID NO: 1311358 - RNA, 19 nt, Homo sapiens
gcauugccauugagaagau

SEQ ID NO: 1311359 - RNA, 19 nt, Homo sapiens
gguuguggcucacuggauu

SEQ ID NO: 1311360 - RNA, 19 nt, Homo sapiens
gaaagccgcauugccauug

SEQ ID NO: 1311361 - RNA, 19 nt, Homo sapiens
ucaagguucuuauagugaa

SEQ ID NO: 1311362 - RNA, 19 nt, Homo sapiens
gagggucucuggaacuugu

SEQ ID NO: 1311363 - RNA, 19 nt, Homo sapiens
aaacgaacuuucaguacug

SEQ ID NO: 1311364 - RNA, 19 nt, Homo sapiens
gaauagcacagggaguaua

SEQ ID NO: 1311365 - RNA, 19 nt, Homo sapiens
uggcagaaacucuccuuua

SEQ ID NO: 1311366 - RNA, 19 nt, Homo sapiens
ugauguagcuucaagugau

SEQ ID NO: 1311367 - RNA, 19 nt, Homo sapiens
aaucaagguucuuauagug

SEQ ID NO: 1311368 - RNA, 19 nt, Homo sapiens
gaaacuggacuacaacucu

SEQ ID NO: 1311369 - RNA, 19 nt, Homo sapiens
ugucagacuuagcucauuu

SEQ ID NO: 1311370 - RNA, 19 nt, Homo sapiens
guggauaaaucuuguaacu

SEQ ID NO: 1311371 - RNA, 19 nt, Homo sapiens
aagaaaugcuguagcuguu

SEQ ID NO: 1311372 - RNA, 19 nt, Homo sapiens
uaacauguaugcuauaacc

SEQ ID NO: 1311373 - RNA, 19 nt, Homo sapiens
uaagaaagagauugcaaug

SEQ ID NO: 1311374 - RNA, 19 nt, Homo sapiens
ugccacaaaucuaauacua

SEQ ID NO: 1311375 - RNA, 19 nt, Homo sapiens
caaggacaguuccaaugau

SEQ ID NO: 1311376 - RNA, 19 nt, Homo sapiens
ugaaguggauaaaucuugu

SEQ ID NO: 1311377 - RNA, 19 nt, Homo sapiens
gaauuugaccuggcucuga

SEQ ID NO: 1311378 - RNA, 19 nt, Homo sapiens
ggaguuugagguuacagua

SEQ ID NO: 1311379 - RNA, 19 nt, Homo sapiens
gaugaagauagcuauguaa

SEQ ID NO: 1311380 - RNA, 19 nt, Homo sapiens
gauguagcuucaagugaug

SEQ ID NO: 1311381 - RNA, 19 nt, Homo sapiens
ucugaucccugguguguug

SEQ ID NO: 1311382 - RNA, 19 nt, Homo sapiens
gugcggaggugcugguguu

SEQ ID NO: 1311383 - RNA, 19 nt, Homo sapiens
gcagaauccaccacuguau

SEQ ID NO: 1311384 - RNA, 19 nt, Homo sapiens
gcgaguuccugccacaaau

SEQ ID NO: 1311385 - RNA, 19 nt, Homo sapiens
aaacagcacagcaugauuc

SEQ ID NO: 1311386 - RNA, 19 nt, Homo sapiens
aagggaacauuaccucuug

SEQ ID NO: 1311387 - RNA, 19 nt, Homo sapiens
gcauugguguuaacauuuu

SEQ ID NO: 1311388 - RNA, 19 nt, Homo sapiens
ggguuaaguucaguaagaa

SEQ ID NO: 1311389 - RNA, 19 nt, Homo sapiens
uggcuaacauguaugcuau

SEQ ID NO: 1311390 - RNA, 19 nt, Homo sapiens
aauaaggccuuugucaguu

SEQ ID NO: 1311391 - RNA, 19 nt, Homo sapiens
uaauaaggccuuugucagu

SEQ ID NO: 1311392 - RNA, 19 nt, Homo sapiens
gcaccagacacagggaaua

SEQ ID NO: 1311393 - RNA, 19 nt, Homo sapiens
gaaaaccuuuagugauuga

SEQ ID NO: 1311394 - RNA, 19 nt, Homo sapiens
uuagaagacaggauuguuu

SEQ ID NO: 1311395 - RNA, 19 nt, Homo sapiens
gaaguggauaaaucuugua

SEQ ID NO: 1311396 - RNA, 19 nt, Homo sapiens
gaaguucaucuuucagcaa

SEQ ID NO: 1311397 - RNA, 19 nt, Homo sapiens
gaagguaggggauuugaaa

SEQ ID NO: 1311398 - RNA, 19 nt, Homo sapiens
ggaaaggucaggaaguucu

SEQ ID NO: 1311399 - RNA, 19 nt, Homo sapiens
acgcauugguguuaacauu

SEQ ID NO: 1311400 - RNA, 19 nt, Homo sapiens
gugggccucuuuaacguuu

SEQ ID NO: 1311401 - RNA, 19 nt, Homo sapiens
ugcuguagcuguugucauu

SEQ ID NO: 1311402 - RNA, 19 nt, Homo sapiens
auaaggccuuugucaguuu

SEQ ID NO: 1311403 - RNA, 19 nt, Homo sapiens
ucggaaaggucaggaaguu

SEQ ID NO: 1311404 - RNA, 19 nt, Homo sapiens
uaccacagauugauacuac

SEQ ID NO: 1311405 - RNA, 19 nt, Homo sapiens
ccaacgagaugaagauagc

SEQ ID NO: 1311406 - RNA, 19 nt, Homo sapiens
caagguucuuauagugaaa

SEQ ID NO: 1311407 - RNA, 19 nt, Homo sapiens
gaggguuuguugugagaau

SEQ ID NO: 1311408 - RNA, 19 nt, Homo sapiens
aggguuaaguucaguaaga

SEQ ID NO: 1311409 - RNA, 19 nt, Homo sapiens
ggucacacaggguuaaguu

SEQ ID NO: 1311410 - RNA, 19 nt, Homo sapiens
gaagaaagcuccagacuug

SEQ ID NO: 1311411 - RNA, 19 nt, Homo sapiens
gaggagagcuaguuuauca

SEQ ID NO: 1311412 - RNA, 19 nt, Homo sapiens
gauaguaacugguguguag

SEQ ID NO: 1311413 - RNA, 19 nt, Homo sapiens
gaacuggcuuugaccauga

SEQ ID NO: 1311414 - RNA, 19 nt, Homo sapiens
gaagguggauguguucuau

SEQ ID NO: 1311415 - RNA, 19 nt, Homo sapiens
ccacugggcucccuuugaa

SEQ ID NO: 1311416 - RNA, 19 nt, Homo sapiens
gaucaugguugcucacuuc

SEQ ID NO: 1311417 - RNA, 19 nt, Homo sapiens
gaaaugagaaaucgaagga

SEQ ID NO: 1311418 - RNA, 19 nt, Homo sapiens
gcaguuugauggcgaguau

SEQ ID NO: 1311419 - RNA, 19 nt, Homo sapiens
gcaauagcguccuuucaca

SEQ ID NO: 1311420 - RNA, 19 nt, Homo sapiens
gaagccaggucugaacauu

SEQ ID NO: 1311421 - RNA, 19 nt, Homo sapiens
gagugaagcucguugucaa

SEQ ID NO: 1311422 - RNA, 19 nt, Homo sapiens
uaucagagguuccaaaggu

SEQ ID NO: 1311423 - RNA, 19 nt, Homo sapiens
ggucugaacauuagagaaa

SEQ ID NO: 1311424 - RNA, 19 nt, Homo sapiens
ggagcuucuuuaccucuua

SEQ ID NO: 1311425 - RNA, 19 nt, Homo sapiens
ccucugagcuacuacuuug

SEQ ID NO: 1311426 - RNA, 19 nt, Homo sapiens
gauguguucuaugguauaa

SEQ ID NO: 1311427 - RNA, 19 nt, Homo sapiens
guggauguguucuauggua

SEQ ID NO: 1311428 - RNA, 19 nt, Homo sapiens
caacauucuccuuugguua

SEQ ID NO: 1311429 - RNA, 19 nt, Homo sapiens
ccaaccauguggaaucuga

SEQ ID NO: 1311430 - RNA, 19 nt, Homo sapiens
acagaaaccuuuggaggaa

SEQ ID NO: 1311431 - RNA, 19 nt, Homo sapiens
gugcugugcuggagaagaa

SEQ ID NO: 1311432 - RNA, 19 nt, Homo sapiens
gaggcuugguggauaguaa

SEQ ID NO: 1311433 - RNA, 19 nt, Homo sapiens
gacacaacauucuccuuug

SEQ ID NO: 1311434 - RNA, 19 nt, Homo sapiens
gcaugaagaggcaguuauu

SEQ ID NO: 1311435 - RNA, 19 nt, Homo sapiens
ggacuaagggagaaggauu

SEQ ID NO: 1311436 - RNA, 19 nt, Homo sapiens
gcguuagucuggagaaguu

SEQ ID NO: 1311437 - RNA, 19 nt, Homo sapiens
gaauggcccuaacuucaag

SEQ ID NO: 1311438 - RNA, 19 nt, Homo sapiens
gaacuauuccucagugaag

SEQ ID NO: 1311439 - RNA, 19 nt, Homo sapiens
gauaaaucacagacuauug

SEQ ID NO: 1311440 - RNA, 19 nt, Homo sapiens
gaaaacaggagggaaauaa

SEQ ID NO: 1311441 - RNA, 19 nt, Homo sapiens
ggagggaaauaaggcaguu

SEQ ID NO: 1311442 - RNA, 19 nt, Homo sapiens
cagcaggccuagcaacuuc

SEQ ID NO: 1311443 - RNA, 19 nt, Homo sapiens
gacuaagggagaaggauua

SEQ ID NO: 1311444 - RNA, 19 nt, Homo sapiens
ggauaaaucacagacuauu

SEQ ID NO: 1311445 - RNA, 19 nt, Homo sapiens
agaggcaguuauugcuuua

SEQ ID NO: 1311446 - RNA, 19 nt, Homo sapiens
gaagaggcaguuauugcuu

SEQ ID NO: 1311447 - RNA, 19 nt, Homo sapiens
uugcaucuguacugaauaa

SEQ ID NO: 1311448 - RNA, 19 nt, Homo sapiens
cuggauaaaucacagacua

SEQ ID NO: 1311449 - RNA, 19 nt, Homo sapiens
cauuguggcuucagcauca

SEQ ID NO: 1311450 - RNA, 19 nt, Homo sapiens
agacacaacauucuccuuu

SEQ ID NO: 1311451 - RNA, 19 nt, Homo sapiens
gggaggagagcuaguuuau

SEQ ID NO: 1311452 - RNA, 19 nt, Homo sapiens
cuacuacuuugcaucugua

SEQ ID NO: 1311453 - RNA, 19 nt, Homo sapiens
cuagugagguaauggaugu

SEQ ID NO: 1311454 - RNA, 19 nt, Homo sapiens
ucuagaagguggauguguu

SEQ ID NO: 1311455 - RNA, 19 nt, Homo sapiens
aagaggcaguuauugcuuu

SEQ ID NO: 1311456 - RNA, 19 nt, Homo sapiens
gaccaugcccuccucagaa

SEQ ID NO: 1311457 - RNA, 19 nt, Homo sapiens
ccucagagccuggauaaau

SEQ ID NO: 1311458 - RNA, 19 nt, Homo sapiens
cugaagggcuagauguuug

SEQ ID NO: 1311459 - RNA, 19 nt, Homo sapiens
ccagguggcgcacacuaua

SEQ ID NO: 1311460 - RNA, 19 nt, Homo sapiens
gcuacuacuuugcaucugu

SEQ ID NO: 1311461 - RNA, 19 nt, Homo sapiens
ggagaaguuggacuaguga

SEQ ID NO: 1311462 - RNA, 19 nt, Homo sapiens
caagggaaaugagaaaucg

SEQ ID NO: 1311463 - RNA, 19 nt, Homo sapiens
gcuguacacuggguagcua

SEQ ID NO: 1311464 - RNA, 19 nt, Homo sapiens
aaugagaaaucgaaggaau

SEQ ID NO: 1311465 - RNA, 19 nt, Homo sapiens
caacuucgcauacagaaac

SEQ ID NO: 1311466 - RNA, 19 nt, Homo sapiens
gcugaagggcuagauguuu

SEQ ID NO: 1311467 - RNA, 19 nt, Homo sapiens
ggaccaugcccuccucaga

SEQ ID NO: 1311468 - RNA, 19 nt, Homo sapiens
uggagaaguuggacuagug

SEQ ID NO: 1311469 - RNA, 19 nt, Homo sapiens
ggauguguucuaugguaua

SEQ ID NO: 1311470 - RNA, 19 nt, Homo sapiens
gcaaacacaaggcuacaag

SEQ ID NO: 1311471 - RNA, 19 nt, Homo sapiens
aaacagaagcggugcauac

SEQ ID NO: 1311472 - RNA, 19 nt, Homo sapiens
gcacagauggagggaguga

SEQ ID NO: 1311473 - RNA, 19 nt, Homo sapiens
uuuagaggcuugguggaua

SEQ ID NO: 1311474 - RNA, 19 nt, Homo sapiens
gggagucggugaucauggu

SEQ ID NO: 1311475 - RNA, 19 nt, Homo sapiens
ugagaaaucgaaggaauug

SEQ ID NO: 1311476 - RNA, 19 nt, Homo sapiens
cgcaacagauuccauugug

SEQ ID NO: 1311477 - RNA, 19 nt, Homo sapiens
acaacauucuccuuugguu

SEQ ID NO: 1311478 - RNA, 19 nt, Homo sapiens
cagggcaaaugaacagguu

SEQ ID NO: 1311479 - RNA, 19 nt, Homo sapiens
cuggguagcuacauugaau

SEQ ID NO: 1311480 - RNA, 19 nt, Homo sapiens
ggacuagugagguaaugga

SEQ ID NO: 1311481 - RNA, 19 nt, Homo sapiens
gagagccgagugugaagaa

SEQ ID NO: 1311482 - RNA, 19 nt, Homo sapiens
gcuuuagucuuucauugca

SEQ ID NO: 1311483 - RNA, 19 nt, Homo sapiens
ugaagaaagcuccagacuu

SEQ ID NO: 1311484 - RNA, 19 nt, Homo sapiens
caccgucuaugcaaagaug

SEQ ID NO: 1311485 - RNA, 19 nt, Homo sapiens
gcuacaagacacaacauuc

SEQ ID NO: 1311486 - RNA, 19 nt, Homo sapiens
ggagugaagcucguuguca

SEQ ID NO: 1311487 - RNA, 19 nt, Homo sapiens
gagcuaaggcugucuucca

SEQ ID NO: 1311488 - RNA, 19 nt, Homo sapiens
ugucaucaaucucaggaau

SEQ ID NO: 1311489 - RNA, 19 nt, Homo sapiens
gaaaggccaagggaagaga

SEQ ID NO: 1311490 - RNA, 19 nt, Homo sapiens
gcuccagacuuggccagaa

SEQ ID NO: 1311491 - RNA, 19 nt, Homo sapiens
gagcuucuuuaccucuuag

SEQ ID NO: 1311492 - RNA, 19 nt, Homo sapiens
acacaacauucuccuuugg

SEQ ID NO: 1311493 - RNA, 19 nt, Homo sapiens
agacgcagcaggccaaguu

SEQ ID NO: 1311494 - RNA, 19 nt, Homo sapiens
guacccguaggccucauua

SEQ ID NO: 1311495 - RNA, 19 nt, Homo sapiens
caggcuuccuucuuccuuu

SEQ ID NO: 1311496 - RNA, 19 nt, Homo sapiens
gagcuacuacuuugcaucu

SEQ ID NO: 1311497 - RNA, 19 nt, Homo sapiens
gaaccuggaacuggcuuug

SEQ ID NO: 1311498 - RNA, 19 nt, Homo sapiens
ugacagacuaucagagguu

SEQ ID NO: 1311499 - RNA, 19 nt, Homo sapiens
ggccucagcugcagaucuc

SEQ ID NO: 1311500 - RNA, 19 nt, Homo sapiens
uaagggagaaggauuaagg

SEQ ID NO: 1311501 - RNA, 19 nt, Homo sapiens
ucuuguggcuguggacuaa

SEQ ID NO: 1311502 - RNA, 19 nt, Homo sapiens
cugcagagccucacucauc

SEQ ID NO: 1311503 - RNA, 19 nt, Homo sapiens
gaugagcugcaccgucuau

SEQ ID NO: 1311504 - RNA, 19 nt, Homo sapiens
gcgcacacuauacacauga

SEQ ID NO: 1311505 - RNA, 19 nt, Homo sapiens
aagccaggucugaacauua

SEQ ID NO: 1311506 - RNA, 19 nt, Homo sapiens
gcaguuauugcuuuagucu

SEQ ID NO: 1311507 - RNA, 19 nt, Homo sapiens
caaacacaaggcuacaaga

SEQ ID NO: 1311508 - RNA, 19 nt, Homo sapiens
gacacuggcugggaaguac

SEQ ID NO: 1311509 - RNA, 19 nt, Homo sapiens
aaguuggacuagugaggua

SEQ ID NO: 1311510 - RNA, 19 nt, Homo sapiens
ggaagagacuggaauaauu

SEQ ID NO: 1311511 - RNA, 19 nt, Homo sapiens
gaagagacuggaauaauua

SEQ ID NO: 1311512 - RNA, 19 nt, Homo sapiens
cauagugucugcuaaauaa

SEQ ID NO: 1311513 - RNA, 19 nt, Homo sapiens
gauaaucauuggcuaguaa

SEQ ID NO: 1311514 - RNA, 19 nt, Homo sapiens
aaucaaugcugcugaaaua

SEQ ID NO: 1311515 - RNA, 19 nt, Homo sapiens
gcauaucgaaccuuuauua

SEQ ID NO: 1311516 - RNA, 19 nt, Homo sapiens
gacaauugcuaguaucuuu

SEQ ID NO: 1311517 - RNA, 19 nt, Homo sapiens
caaagaagcaccuagaauu

SEQ ID NO: 1311518 - RNA, 19 nt, Homo sapiens
gacacuagcuagauuugua

SEQ ID NO: 1311519 - RNA, 19 nt, Homo sapiens
ggagcaaagccuuguauua

SEQ ID NO: 1311520 - RNA, 19 nt, Homo sapiens
gaugggaauucaaauauga

SEQ ID NO: 1311521 - RNA, 19 nt, Homo sapiens
ggaaaucagucauguucuu

SEQ ID NO: 1311522 - RNA, 19 nt, Homo sapiens
gaagauagaaucauagugu

SEQ ID NO: 1311523 - RNA, 19 nt, Homo sapiens
acagggaucugaaacauuu

SEQ ID NO: 1311524 - RNA, 19 nt, Homo sapiens
cagcacaacuuccuacaaa

SEQ ID NO: 1311525 - RNA, 19 nt, Homo sapiens
ggaauagauuugacuguau

SEQ ID NO: 1311526 - RNA, 19 nt, Homo sapiens
guacagguaugcuuggaaa

SEQ ID NO: 1311527 - RNA, 19 nt, Homo sapiens
caacagccuuucagacuau

SEQ ID NO: 1311528 - RNA, 19 nt, Homo sapiens
gaaaucagucauguucuua

SEQ ID NO: 1311529 - RNA, 19 nt, Homo sapiens
ggaggacaauugcuaguau

SEQ ID NO: 1311530 - RNA, 19 nt, Homo sapiens
guacagugaugcaaucuca

SEQ ID NO: 1311531 - RNA, 19 nt, Homo sapiens
uagaagaucucaauugucu

SEQ ID NO: 1311532 - RNA, 19 nt, Homo sapiens
caaugcugcugaaauaauu

SEQ ID NO: 1311533 - RNA, 19 nt, Homo sapiens
gaagaaggccugcauaucg

SEQ ID NO: 1311534 - RNA, 19 nt, Homo sapiens
ucagaggaaugauagaauu

SEQ ID NO: 1311535 - RNA, 19 nt, Homo sapiens
gaauaauuauggccggaaa

SEQ ID NO: 1311536 - RNA, 19 nt, Homo sapiens
gaagaugagacaauaguug

SEQ ID NO: 1311537 - RNA, 19 nt, Homo sapiens
cgaaucuccucucauaauu

SEQ ID NO: 1311538 - RNA, 19 nt, Homo sapiens
gaagaagaaggccugcaua

SEQ ID NO: 1311539 - RNA, 19 nt, Homo sapiens
auaggaaggugaaaguaua

SEQ ID NO: 1311540 - RNA, 19 nt, Homo sapiens
caccacgccuggcuaauuu

SEQ ID NO: 1311541 - RNA, 19 nt, Homo sapiens
cacaguggcuuauaaggaa

SEQ ID NO: 1311542 - RNA, 19 nt, Homo sapiens
uaaagucugggacauguua

SEQ ID NO: 1311543 - RNA, 19 nt, Homo sapiens
agaagcaccuagaauugua

SEQ ID NO: 1311544 - RNA, 19 nt, Homo sapiens
ccuagaagaucucaauugu

SEQ ID NO: 1311545 - RNA, 19 nt, Homo sapiens
gcaaagaagcaccuagaau

SEQ ID NO: 1311546 - RNA, 19 nt, Homo sapiens
uaaggaaccagcaguguuu

SEQ ID NO: 1311547 - RNA, 19 nt, Homo sapiens
gcacaguggcuuauaagga

SEQ ID NO: 1311548 - RNA, 19 nt, Homo sapiens
cuucauauguuucaagcua

SEQ ID NO: 1311549 - RNA, 19 nt, Homo sapiens
gaagaacugacacuagcua

SEQ ID NO: 1311550 - RNA, 19 nt, Homo sapiens
gagcaaagccuuguauuac

SEQ ID NO: 1311551 - RNA, 19 nt, Homo sapiens
acaaaguaguccacaguuu

SEQ ID NO: 1311552 - RNA, 19 nt, Homo sapiens
uggaauagauuugacugua

SEQ ID NO: 1311553 - RNA, 19 nt, Homo sapiens
uaaggacucugaaguugga

SEQ ID NO: 1311554 - RNA, 19 nt, Homo sapiens
uauaaggacucugaaguug

SEQ ID NO: 1311555 - RNA, 19 nt, Homo sapiens
ccaaagagaauuguuagaa

SEQ ID NO: 1311556 - RNA, 19 nt, Homo sapiens
ggucccacuuguacaauaa

SEQ ID NO: 1311557 - RNA, 19 nt, Homo sapiens
guugagaagaguucauuua

SEQ ID NO: 1311558 - RNA, 19 nt, Homo sapiens
ggaguacagugaugcaauc

SEQ ID NO: 1311559 - RNA, 19 nt, Homo sapiens
agagauugauuaccaaaga

SEQ ID NO: 1311560 - RNA, 19 nt, Homo sapiens
acaugaagaugagacaaua

SEQ ID NO: 1311561 - RNA, 19 nt, Homo sapiens
augcgaaucuccucucaua

SEQ ID NO: 1311562 - RNA, 19 nt, Homo sapiens
gaacugacacuagcuagau

SEQ ID NO: 1311563 - RNA, 19 nt, Homo sapiens
gauaucuacacuugucuua

SEQ ID NO: 1311564 - RNA, 19 nt, Homo sapiens
gggaugacauuuugauuaa

SEQ ID NO: 1311565 - RNA, 19 nt, Homo sapiens
gaaguuggaauagauuuga

SEQ ID NO: 1311566 - RNA, 19 nt, Homo sapiens
ggaaaucugaagcaaagaa

SEQ ID NO: 1311567 - RNA, 19 nt, Homo sapiens
gaacuuagucaagaucaga

SEQ ID NO: 1311568 - RNA, 19 nt, Homo sapiens
gaggaaugauagaauuugu

SEQ ID NO: 1311569 - RNA, 19 nt, Homo sapiens
caacugggaauccugcuaa

SEQ ID NO: 1311570 - RNA, 19 nt, Homo sapiens
gauaggaaggugaaaguau

SEQ ID NO: 1311571 - RNA, 19 nt, Homo sapiens
gaaucauagugucugcuaa

SEQ ID NO: 1311572 - RNA, 19 nt, Homo sapiens
ggaaugauagaauuuguca

SEQ ID NO: 1311573 - RNA, 19 nt, Homo sapiens
gauagaccuuauuggacua

SEQ ID NO: 1311574 - RNA, 19 nt, Homo sapiens
ucagaugggaauucaaaua

SEQ ID NO: 1311575 - RNA, 19 nt, Homo sapiens
gauuaugcagcuucaauuu

SEQ ID NO: 1311576 - RNA, 19 nt, Homo sapiens
gaaucuccucucauaauuu

SEQ ID NO: 1311577 - RNA, 19 nt, Homo sapiens
gcgaaucuccucucauaau

SEQ ID NO: 1311578 - RNA, 19 nt, Homo sapiens
gacagggucucgcuuuauc

SEQ ID NO: 1311579 - RNA, 19 nt, Homo sapiens
acaacagccuuucagacua

SEQ ID NO: 1311580 - RNA, 19 nt, Homo sapiens
gaucucaauugucuuaguc

SEQ ID NO: 1311581 - RNA, 19 nt, Homo sapiens
aaagaagcaccuagaauug

SEQ ID NO: 1311582 - RNA, 19 nt, Homo sapiens
uauagcaucuucaccuaga

SEQ ID NO: 1311583 - RNA, 19 nt, Homo sapiens
ggacucugaaguuggaaua

SEQ ID NO: 1311584 - RNA, 19 nt, Homo sapiens
gaagcaacgggaugacauu

SEQ ID NO: 1311585 - RNA, 19 nt, Homo sapiens
gagaauuguuagaaaccuu

SEQ ID NO: 1311586 - RNA, 19 nt, Homo sapiens
aauggaauacugaguguua

SEQ ID NO: 1311587 - RNA, 19 nt, Homo sapiens
acagcacaguggcuuauaa

SEQ ID NO: 1311588 - RNA, 19 nt, Homo sapiens
gaaggaaaucagucauguu

SEQ ID NO: 1311589 - RNA, 19 nt, Homo sapiens
gcaaagccuuguauuaccu

SEQ ID NO: 1311590 - RNA, 19 nt, Homo sapiens
guuaaagucugggacaugu

SEQ ID NO: 1311591 - RNA, 19 nt, Homo sapiens
gacucucuuugauacauua

SEQ ID NO: 1311592 - RNA, 19 nt, Homo sapiens
agacauauaaggacucuga

SEQ ID NO: 1311593 - RNA, 19 nt, Homo sapiens
gaaaguauacagcacaacu

SEQ ID NO: 1311594 - RNA, 19 nt, Homo sapiens
auaaagacacccgagauua

SEQ ID NO: 1311595 - RNA, 19 nt, Homo sapiens
uuaaacaucggaaaucuga

SEQ ID NO: 1311596 - RNA, 19 nt, Homo sapiens
gcaacgggaugacauuuug

SEQ ID NO: 1311597 - RNA, 19 nt, Homo sapiens
ccaauggaauacugagugu

SEQ ID NO: 1311598 - RNA, 19 nt, Homo sapiens
gagacgggguuucaccuua

SEQ ID NO: 1311599 - RNA, 19 nt, Homo sapiens
cuacagauagaccuuauug

SEQ ID NO: 1311600 - RNA, 19 nt, Homo sapiens
cagaugggaauucaaauau

SEQ ID NO: 1311601 - RNA, 19 nt, Homo sapiens
gccaagauuugcuccuguu

SEQ ID NO: 1311602 - RNA, 19 nt, Homo sapiens
ucggaaaucugaagcaaag

SEQ ID NO: 1311603 - RNA, 19 nt, Homo sapiens
gaccuuauuggacuacuuu

SEQ ID NO: 1311604 - RNA, 19 nt, Homo sapiens
gagaaggaaaucagucaug

SEQ ID NO: 1311605 - RNA, 19 nt, Homo sapiens
ugacagggaucugaaacau

SEQ ID NO: 1311606 - RNA, 19 nt, Homo sapiens
cuaguacacugguuucaca

SEQ ID NO: 1311607 - RNA, 19 nt, Homo sapiens
acagauagaccuuauugga

SEQ ID NO: 1311608 - RNA, 19 nt, Homo sapiens
aagauuugcuccuguuuua

SEQ ID NO: 1311609 - RNA, 19 nt, Homo sapiens
gagauuacgguguccauca

SEQ ID NO: 1311610 - RNA, 19 nt, Homo sapiens
gaaaguggcugaugaaauu

SEQ ID NO: 1311611 - RNA, 19 nt, Homo sapiens
gaccagaaaugaacuauaa

SEQ ID NO: 1311612 - RNA, 19 nt, Homo sapiens
ggaaaccgcugaaguugaa

SEQ ID NO: 1311613 - RNA, 19 nt, Homo sapiens
ggaacuagaugaauauaug

SEQ ID NO: 1311614 - RNA, 19 nt, Homo sapiens
gaugauagcugucuuugga

SEQ ID NO: 1311615 - RNA, 19 nt, Homo sapiens
gaaacuucaucucuacuaa

SEQ ID NO: 1311616 - RNA, 19 nt, Homo sapiens
acaaggaacuagaugaaua

SEQ ID NO: 1311617 - RNA, 19 nt, Homo sapiens
gaaaggaaugcaauugaua

SEQ ID NO: 1311618 - RNA, 19 nt, Homo sapiens
gaaacccugucucuauuaa

SEQ ID NO: 1311619 - RNA, 19 nt, Homo sapiens
gaaggaaucucaagagcau

SEQ ID NO: 1311620 - RNA, 19 nt, Homo sapiens
ucaagaagcugaugauaca

SEQ ID NO: 1311621 - RNA, 19 nt, Homo sapiens
gguggucucuuuauaauga

SEQ ID NO: 1311622 - RNA, 19 nt, Homo sapiens
ggaaaggaaugcaauugau

SEQ ID NO: 1311623 - RNA, 19 nt, Homo sapiens
gaaacgaccugucaaagac

SEQ ID NO: 1311624 - RNA, 19 nt, Homo sapiens
gacccugucucuaauuuaa

SEQ ID NO: 1311625 - RNA, 19 nt, Homo sapiens
ggacuaagccuuucuaaaa

SEQ ID NO: 1311626 - RNA, 19 nt, Homo sapiens
guauauagcacaggauuua

SEQ ID NO: 1311627 - RNA, 19 nt, Homo sapiens
ggaaacgaccugucaaaga

SEQ ID NO: 1311628 - RNA, 19 nt, Homo sapiens
gaauggaggccacuauuga

SEQ ID NO: 1311629 - RNA, 19 nt, Homo sapiens
ugagacagguagaucauuu

SEQ ID NO: 1311630 - RNA, 19 nt, Homo sapiens
caauugaacuucugaugga

SEQ ID NO: 1311631 - RNA, 19 nt, Homo sapiens
ccaagaaacuuaggaagga

SEQ ID NO: 1311632 - RNA, 19 nt, Homo sapiens
gcuuaaauuugacguguuu

SEQ ID NO: 1311633 - RNA, 19 nt, Homo sapiens
ggucauaacauaccauuug

SEQ ID NO: 1311634 - RNA, 19 nt, Homo sapiens
gaacagaccagaaaugaac

SEQ ID NO: 1311635 - RNA, 19 nt, Homo sapiens
ggaggaaagacaauuguuu

SEQ ID NO: 1311636 - RNA, 19 nt, Homo sapiens
gugaaacccugucucuauu

SEQ ID NO: 1311637 - RNA, 19 nt, Homo sapiens
uuacugagauugcaacguu

SEQ ID NO: 1311638 - RNA, 19 nt, Homo sapiens
uuaaggaagucagguauuu

SEQ ID NO: 1311639 - RNA, 19 nt, Homo sapiens
ggaaagaagauuaacaaca

SEQ ID NO: 1311640 - RNA, 19 nt, Homo sapiens
gauggaaaccgcugaaguu

SEQ ID NO: 1311641 - RNA, 19 nt, Homo sapiens
gaggaaagaagauuaacaa

SEQ ID NO: 1311642 - RNA, 19 nt, Homo sapiens
ggaaugcaauugauagaac

SEQ ID NO: 1311643 - RNA, 19 nt, Homo sapiens
guagugaggauuauuggua

SEQ ID NO: 1311644 - RNA, 19 nt, Homo sapiens
caaaagaucuagacaagga

SEQ ID NO: 1311645 - RNA, 19 nt, Homo sapiens
gaaauuucauucagguuac

SEQ ID NO: 1311646 - RNA, 19 nt, Homo sapiens
aauccgagaccuacaauua

SEQ ID NO: 1311647 - RNA, 19 nt, Homo sapiens
ggugaaacccugucucuau

SEQ ID NO: 1311648 - RNA, 19 nt, Homo sapiens
ucuaagaacucaggcaauu

SEQ ID NO: 1311649 - RNA, 19 nt, Homo sapiens
ccacugaacuugguaucuu

SEQ ID NO: 1311650 - RNA, 19 nt, Homo sapiens
gugcaccaguaucacauua

SEQ ID NO: 1311651 - RNA, 19 nt, Homo sapiens
gaggauuauugguaacaaa

SEQ ID NO: 1311652 - RNA, 19 nt, Homo sapiens
gcaccaguaucacauuauc

SEQ ID NO: 1311653 - RNA, 19 nt, Homo sapiens
gcacaggauuuaauuucuc

SEQ ID NO: 1311654 - RNA, 19 nt, Homo sapiens
aaaugguggucucuuuaua

SEQ ID NO: 1311655 - RNA, 19 nt, Homo sapiens
uggauuaccacaugcauua

SEQ ID NO: 1311656 - RNA, 19 nt, Homo sapiens
cgugaucuccuguggauua

SEQ ID NO: 1311657 - RNA, 19 nt, Homo sapiens
ccauugaaguugaucauuc

SEQ ID NO: 1311658 - RNA, 19 nt, Homo sapiens
aagagaaaguggcugauga

SEQ ID NO: 1311659 - RNA, 19 nt, Homo sapiens
ggaauggaggccacuauug

SEQ ID NO: 1311660 - RNA, 19 nt, Homo sapiens
gaacacggcaacugcaugu

SEQ ID NO: 1311661 - RNA, 19 nt, Homo sapiens
gaaugcaauugauagaaca

SEQ ID NO: 1311662 - RNA, 19 nt, Homo sapiens
ggaacaaauuaaggacauu

SEQ ID NO: 1311663 - RNA, 19 nt, Homo sapiens
gaaugguagucgaagaaga

SEQ ID NO: 1311664 - RNA, 19 nt, Homo sapiens
gaccuacaauuauuugcuu

SEQ ID NO: 1311665 - RNA, 19 nt, Homo sapiens
ggaggccacuauugacaga

SEQ ID NO: 1311666 - RNA, 19 nt, Homo sapiens
aaauauguguggaaaggaa

SEQ ID NO: 1311667 - RNA, 19 nt, Homo sapiens
gggaacagaccagaaauga

SEQ ID NO: 1311668 - RNA, 19 nt, Homo sapiens
gaaacgcaaacgacagaaa

SEQ ID NO: 1311669 - RNA, 19 nt, Homo sapiens
gcacugauaaacaugagaa

SEQ ID NO: 1311670 - RNA, 19 nt, Homo sapiens
gcgggaagauggcguugga

SEQ ID NO: 1311671 - RNA, 19 nt, Homo sapiens
gaucacagcggaagauucu

SEQ ID NO: 1311672 - RNA, 19 nt, Homo sapiens
ggaacagaaucaagaugca

SEQ ID NO: 1311673 - RNA, 19 nt, Homo sapiens
uaaggaagucagguauuua

SEQ ID NO: 1311674 - RNA, 19 nt, Homo sapiens
guggcaggaucucagcuua

SEQ ID NO: 1311675 - RNA, 19 nt, Homo sapiens
ccuguaaucccaacacuuu

SEQ ID NO: 1311676 - RNA, 19 nt, Homo sapiens
ggaggucggcgauauggaa

SEQ ID NO: 1311677 - RNA, 19 nt, Homo sapiens
caagaaacuuaggaaggaa

SEQ ID NO: 1311678 - RNA, 19 nt, Homo sapiens
ugaaacccugucucuauua

SEQ ID NO: 1311679 - RNA, 19 nt, Homo sapiens
ggaggcggguggaucacaa

SEQ ID NO: 1311680 - RNA, 19 nt, Homo sapiens
ccaaagugcugggaucaca

SEQ ID NO: 1311681 - RNA, 19 nt, Homo sapiens
caagcgaucaugugccuaa

SEQ ID NO: 1311682 - RNA, 19 nt, Homo sapiens
uaucagcgaggaacaaauu

SEQ ID NO: 1311683 - RNA, 19 nt, Homo sapiens
uagugaggauuauugguaa

SEQ ID NO: 1311684 - RNA, 19 nt, Homo sapiens
caaggaacuagaugaauau

SEQ ID NO: 1311685 - RNA, 19 nt, Homo sapiens
gcaggagaaucacuugaac

SEQ ID NO: 1311686 - RNA, 19 nt, Homo sapiens
ugauagcugucuuuggaaa

SEQ ID NO: 1311687 - RNA, 19 nt, Homo sapiens
gaaaccccaucucaacuaa

SEQ ID NO: 1311688 - RNA, 19 nt, Homo sapiens
gaagaggaagauugcuuga

SEQ ID NO: 1311689 - RNA, 19 nt, Homo sapiens
ggaacagaccagaaaugaa

SEQ ID NO: 1311690 - RNA, 19 nt, Homo sapiens
gccuuauucugcuuaaauu

SEQ ID NO: 1311691 - RNA, 19 nt, Homo sapiens
gauaaucaguuuugucuag

SEQ ID NO: 1311692 - RNA, 19 nt, Homo sapiens
agaggaagccauugaaguu

SEQ ID NO: 1311693 - RNA, 19 nt, Homo sapiens
gaaaguguggauucaagug

SEQ ID NO: 1311694 - RNA, 19 nt, Homo sapiens
ggaagccauugaaguugau

SEQ ID NO: 1311695 - RNA, 19 nt, Homo sapiens
gcagacaauccgagaccua

SEQ ID NO: 1311696 - RNA, 19 nt, Homo sapiens
gaagauuaacaacauaugg

SEQ ID NO: 1311697 - RNA, 19 nt, Homo sapiens
gaugaugauagcugucuuu

SEQ ID NO: 1311698 - RNA, 19 nt, Homo sapiens
ccugauagcccgaguagug

SEQ ID NO: 1311699 - RNA, 19 nt, Homo sapiens
uccgagaccuacaauuauu

SEQ ID NO: 1311700 - RNA, 19 nt, Homo sapiens
gcuggaggaaagaagauua

SEQ ID NO: 1311701 - RNA, 19 nt, Homo sapiens
gucaagagaucgagaccau

SEQ ID NO: 1311702 - RNA, 19 nt, Homo sapiens
uuaucgagcuguugaaagu

SEQ ID NO: 1311703 - RNA, 19 nt, Homo sapiens
gaagaggagaacacaagug

SEQ ID NO: 1311704 - RNA, 19 nt, Homo sapiens
gcgacaggccgcugcaauu

SEQ ID NO: 1311705 - RNA, 19 nt, Homo sapiens
gccaagaagaggaagauug

SEQ ID NO: 1311706 - RNA, 19 nt, Homo sapiens
ugccuaagccuccugagua

SEQ ID NO: 1311707 - RNA, 19 nt, Homo sapiens
gaguauauagcacaggauu

SEQ ID NO: 1311708 - RNA, 19 nt, Homo sapiens
gcgaggaacaaauuaagga

SEQ ID NO: 1311709 - RNA, 19 nt, Homo sapiens
cgcaguggcucaugugugu

SEQ ID NO: 1311710 - RNA, 19 nt, Homo sapiens
gaagguuucuuuagcuuua

SEQ ID NO: 1311711 - RNA, 19 nt, Homo sapiens
gagaauaacuggcgcaaug

SEQ ID NO: 1311712 - RNA, 19 nt, Homo sapiens
gauaacgguugugaaauua

SEQ ID NO: 1311713 - RNA, 19 nt, Homo sapiens
ugauaacgguugugaaauu

SEQ ID NO: 1311714 - RNA, 19 nt, Homo sapiens
aaugggagcuggugaauga

SEQ ID NO: 1311715 - RNA, 19 nt, Homo sapiens
gcaaguacccucuggaugu

SEQ ID NO: 1311716 - RNA, 19 nt, Homo sapiens
gaugugauccucugcaauu

SEQ ID NO: 1311717 - RNA, 19 nt, Homo sapiens
ggagguucccauuucauua

SEQ ID NO: 1311718 - RNA, 19 nt, Homo sapiens
ugaaauuacugacugacuu

SEQ ID NO: 1311719 - RNA, 19 nt, Homo sapiens
uaacugcccugcugacauc

SEQ ID NO: 1311720 - RNA, 19 nt, Homo sapiens
ggagagcagugauggagau

SEQ ID NO: 1311721 - RNA, 19 nt, Homo sapiens
aauacagacuggauaguaa

SEQ ID NO: 1311722 - RNA, 19 nt, Homo sapiens
gcaauucuguagaguugau

SEQ ID NO: 1311723 - RNA, 19 nt, Homo sapiens
agaauaaugucuuccacuu

SEQ ID NO: 1311724 - RNA, 19 nt, Homo sapiens
caauacagacuggauagua

SEQ ID NO: 1311725 - RNA, 19 nt, Homo sapiens
agaaggaguucggcuauga

SEQ ID NO: 1311726 - RNA, 19 nt, Homo sapiens
ggacauuuacgacgaugaa

SEQ ID NO: 1311727 - RNA, 19 nt, Homo sapiens
gaauaaugucuuccacuug

SEQ ID NO: 1311728 - RNA, 19 nt, Homo sapiens
gacgagaacagugagaaua

SEQ ID NO: 1311729 - RNA, 19 nt, Homo sapiens
gaaauuacugacugacuuc

SEQ ID NO: 1311730 - RNA, 19 nt, Homo sapiens
guaugacauuuacuacuug

SEQ ID NO: 1311731 - RNA, 19 nt, Homo sapiens
aaaucuagcuuugaacaug

SEQ ID NO: 1311732 - RNA, 19 nt, Homo sapiens
ggccaagaaacaauauaua

SEQ ID NO: 1311733 - RNA, 19 nt, Homo sapiens
aaagugacccuacaguuug

SEQ ID NO: 1311734 - RNA, 19 nt, Homo sapiens
gcagaaggaguucggcuau

SEQ ID NO: 1311735 - RNA, 19 nt, Homo sapiens
cagaagacgucggaggauu

SEQ ID NO: 1311736 - RNA, 19 nt, Homo sapiens
gagcagugauggagaugag

SEQ ID NO: 1311737 - RNA, 19 nt, Homo sapiens
gcugacauccuguuagguu

SEQ ID NO: 1311738 - RNA, 19 nt, Homo sapiens
gggagcuggugaaugauga

SEQ ID NO: 1311739 - RNA, 19 nt, Homo sapiens
ggaagguuucuuuagcuuu

SEQ ID NO: 1311740 - RNA, 19 nt, Homo sapiens
cugcaauucuguagaguug

SEQ ID NO: 1311741 - RNA, 19 nt, Homo sapiens
ccaccacagugaaaacuua

SEQ ID NO: 1311742 - RNA, 19 nt, Homo sapiens
caaguacccucuggaugug

SEQ ID NO: 1311743 - RNA, 19 nt, Homo sapiens
cuuaacauguggaaggaaa

SEQ ID NO: 1311744 - RNA, 19 nt, Homo sapiens
gaagacgucggaggauuug

SEQ ID NO: 1311745 - RNA, 19 nt, Homo sapiens
cgugagcgauugacugugu

SEQ ID NO: 1311746 - RNA, 19 nt, Homo sapiens
gaaaagcauaucaagcaua

SEQ ID NO: 1311747 - RNA, 19 nt, Homo sapiens
cagcggauguggagcaagu

SEQ ID NO: 1311748 - RNA, 19 nt, Homo sapiens
cgaugaagaugacgagaac

SEQ ID NO: 1311749 - RNA, 19 nt, Homo sapiens
gggccaagaaacaauauau

SEQ ID NO: 1311750 - RNA, 19 nt, Homo sapiens
uuuccuagcuuaacaugug

SEQ ID NO: 1311751 - RNA, 19 nt, Homo sapiens
ucugauaacgguugugaaa

SEQ ID NO: 1311752 - RNA, 19 nt, Homo sapiens
gccauuagggcagaaagua

SEQ ID NO: 1311753 - RNA, 19 nt, Homo sapiens
agaagacgucggaggauuu

SEQ ID NO: 1311754 - RNA, 19 nt, Homo sapiens
gagcaaguacccucuggau

SEQ ID NO: 1311755 - RNA, 19 nt, Homo sapiens
ucaagaaccagaggacauu

SEQ ID NO: 1311756 - RNA, 19 nt, Homo sapiens
uagcaauacagacuggaua

SEQ ID NO: 1311757 - RNA, 19 nt, Homo sapiens
gagguucccauuucauuag

SEQ ID NO: 1311758 - RNA, 19 nt, Homo sapiens
gcucagcggcagccacuau

SEQ ID NO: 1311759 - RNA, 19 nt, Homo sapiens
uaacgguugugaaauuacu

SEQ ID NO: 1311760 - RNA, 19 nt, Homo sapiens
gacccuacaguuugaaaga

SEQ ID NO: 1311761 - RNA, 19 nt, Homo sapiens
cccacgaccuggauucaga

SEQ ID NO: 1311762 - RNA, 19 nt, Homo sapiens
acgagaacagugagaauaa

SEQ ID NO: 1311763 - RNA, 19 nt, Homo sapiens
cuucuuggcccaggaauuu

SEQ ID NO: 1311764 - RNA, 19 nt, Homo sapiens
ggucuugugauguccauga

SEQ ID NO: 1311765 - RNA, 19 nt, Homo sapiens
gugauacauguguuuagua

SEQ ID NO: 1311766 - RNA, 19 nt, Homo sapiens
gugggucccuuguagcaau

SEQ ID NO: 1311767 - RNA, 19 nt, Homo sapiens
aaaagugacccuacaguuu

SEQ ID NO: 1311768 - RNA, 19 nt, Homo sapiens
aagaaccagaggacauuua

SEQ ID NO: 1311769 - RNA, 19 nt, Homo sapiens
guugauccgugagcgauug

SEQ ID NO: 1311770 - RNA, 19 nt, Homo sapiens
cccuacaguuugaaagaaa

SEQ ID NO: 1311771 - RNA, 19 nt, Homo sapiens
ucugagcagugggagauuu

SEQ ID NO: 1311772 - RNA, 19 nt, Homo sapiens
gacugauggucuugugaug

SEQ ID NO: 1311773 - RNA, 19 nt, Homo sapiens
cagaaggaguucggcuaug

SEQ ID NO: 1311774 - RNA, 19 nt, Homo sapiens
gaggauggaccaggaguca

SEQ ID NO: 1311775 - RNA, 19 nt, Homo sapiens
caccaucccaccacaguga

SEQ ID NO: 1311776 - RNA, 19 nt, Homo sapiens
auaacuggcgcaaugagua

SEQ ID NO: 1311777 - RNA, 19 nt, Homo sapiens
caagaaccagaggacauuu

SEQ ID NO: 1311778 - RNA, 19 nt, Homo sapiens
gauccucugcaauucugua

SEQ ID NO: 1311779 - RNA, 19 nt, Homo sapiens
gugauccucugcaauucug

SEQ ID NO: 1311780 - RNA, 19 nt, Homo sapiens
cagcguguccgccguaauc

SEQ ID NO: 1311781 - RNA, 19 nt, Homo sapiens
ggaaaagcauaucaagcau

SEQ ID NO: 1311782 - RNA, 19 nt, Homo sapiens
gcucuugugcucgcuugua

SEQ ID NO: 1311783 - RNA, 19 nt, Homo sapiens
gaggaggagagcagugaug

SEQ ID NO: 1311784 - RNA, 19 nt, Homo sapiens
cgagaacagugagaauaac

SEQ ID NO: 1311785 - RNA, 19 nt, Homo sapiens
aagugacccuacaguuuga

SEQ ID NO: 1311786 - RNA, 19 nt, Homo sapiens
cugacauccuguuagguuu

SEQ ID NO: 1311787 - RNA, 19 nt, Homo sapiens
aagaugacgagaacaguga

SEQ ID NO: 1311788 - RNA, 19 nt, Homo sapiens
uuacgacgaugaagaugac

SEQ ID NO: 1311789 - RNA, 19 nt, Homo sapiens
caggcuggauugagaacau

SEQ ID NO: 1311790 - RNA, 19 nt, Homo sapiens
ugugauacauguguuuagu

SEQ ID NO: 1311791 - RNA, 19 nt, Homo sapiens
aagcuucugcugugccaua

SEQ ID NO: 1311792 - RNA, 19 nt, Homo sapiens
cagaggaggagagcaguga

SEQ ID NO: 1311793 - RNA, 19 nt, Homo sapiens
gaauaacuggcgcaaugag

SEQ ID NO: 1311794 - RNA, 19 nt, Homo sapiens
gagaacagugagaauaacu

SEQ ID NO: 1311795 - RNA, 19 nt, Homo sapiens
ggcggagaauaaugucuuc

SEQ ID NO: 1311796 - RNA, 19 nt, Homo sapiens
gaaugggagcuggugaaug

SEQ ID NO: 1311797 - RNA, 19 nt, Homo sapiens
aaacucugauaacgguugu

SEQ ID NO: 1311798 - RNA, 19 nt, Homo sapiens
cugauggucuugugauguc

SEQ ID NO: 1311799 - RNA, 19 nt, Homo sapiens
gacagcggauguggagcaa

SEQ ID NO: 1311800 - RNA, 19 nt, Homo sapiens
aggaagguuucuuuagcuu

SEQ ID NO: 1311801 - RNA, 19 nt, Homo sapiens
caaaagugacccuacaguu

SEQ ID NO: 1311802 - RNA, 19 nt, Homo sapiens
agugggagauuuuaguuaa

SEQ ID NO: 1311803 - RNA, 19 nt, Homo sapiens
cgagucagcggcacagaag

SEQ ID NO: 1311804 - RNA, 19 nt, Homo sapiens
cccauuucauuagcaguaa

SEQ ID NO: 1311805 - RNA, 19 nt, Homo sapiens
ggaaggaaaagcauaucaa

SEQ ID NO: 1311806 - RNA, 19 nt, Homo sapiens
ggaggagagcagugaugga

SEQ ID NO: 1311807 - RNA, 19 nt, Homo sapiens
cucuugugcucgcuuguaa

SEQ ID NO: 1311808 - RNA, 19 nt, Homo sapiens
gcaauacagacuggauagu

SEQ ID NO: 1311809 - RNA, 19 nt, Homo sapiens
ugggucccuuguagcaaua

SEQ ID NO: 1311810 - RNA, 19 nt, Homo sapiens
gaacccagcucugcuaaua

SEQ ID NO: 1311811 - RNA, 19 nt, Homo sapiens
gaacuuaacccaauaaaug

SEQ ID NO: 1311812 - RNA, 19 nt, Homo sapiens
ccaaauguauggagaagua

SEQ ID NO: 1311813 - RNA, 19 nt, Homo sapiens
gaagauggguugguacuga

SEQ ID NO: 1311814 - RNA, 19 nt, Homo sapiens
ugacauggcugaagcagaa

SEQ ID NO: 1311815 - RNA, 19 nt, Homo sapiens
gaaaugagagguaaggauu

SEQ ID NO: 1311816 - RNA, 19 nt, Homo sapiens
gaauggaaaugagagguaa

SEQ ID NO: 1311817 - RNA, 19 nt, Homo sapiens
gaggaggaaugaucacaaa

SEQ ID NO: 1311818 - RNA, 19 nt, Homo sapiens
gagaggacuuugaacaaga

SEQ ID NO: 1311819 - RNA, 19 nt, Homo sapiens
gaaggagaguggccacguu

SEQ ID NO: 1311820 - RNA, 19 nt, Homo sapiens
ggaaagaucauuauagcau

SEQ ID NO: 1311821 - RNA, 19 nt, Homo sapiens
aaaguuaggaugggaauua

SEQ ID NO: 1311822 - RNA, 19 nt, Homo sapiens
gcagcucuguacuuuguuu

SEQ ID NO: 1311823 - RNA, 19 nt, Homo sapiens
gaauagcagggugaacuua

SEQ ID NO: 1311824 - RNA, 19 nt, Homo sapiens
ggaggaaugaucacaaaga

SEQ ID NO: 1311825 - RNA, 19 nt, Homo sapiens
aagcaaagccaguuaaaga

SEQ ID NO: 1311826 - RNA, 19 nt, Homo sapiens
cgacugugguuucucuuga

SEQ ID NO: 1311827 - RNA, 19 nt, Homo sapiens
gagccugaaucgcuacuau

SEQ ID NO: 1311828 - RNA, 19 nt, Homo sapiens
gcaaaaggaaagaucauua

SEQ ID NO: 1311829 - RNA, 19 nt, Homo sapiens
gccugaaucgcuacuauua

SEQ ID NO: 1311830 - RNA, 19 nt, Homo sapiens
gaggaaugaucacaaagag

SEQ ID NO: 1311831 - RNA, 19 nt, Homo sapiens
aaugagagguaaggauuaa

SEQ ID NO: 1311832 - RNA, 19 nt, Homo sapiens
gguaaggauuaaagccaaa

SEQ ID NO: 1311833 - RNA, 19 nt, Homo sapiens
gagaaacgcgacugugguu

SEQ ID NO: 1311834 - RNA, 19 nt, Homo sapiens
ggacuuugaacaagaaugu

SEQ ID NO: 1311835 - RNA, 19 nt, Homo sapiens
gaggugauucugauucaaa

SEQ ID NO: 1311836 - RNA, 19 nt, Homo sapiens
agggagaucuggaugaaug

SEQ ID NO: 1311837 - RNA, 19 nt, Homo sapiens
ucagggagaucuggaugaa

SEQ ID NO: 1311838 - RNA, 19 nt, Homo sapiens
gaggaucucagaaguuuca

SEQ ID NO: 1311839 - RNA, 19 nt, Homo sapiens
cugcuaauauugugauuuc

SEQ ID NO: 1311840 - RNA, 19 nt, Homo sapiens
gcaaagccaguuaaagaag

SEQ ID NO: 1311841 - RNA, 19 nt, Homo sapiens
ggaaaugagagguaaggau

SEQ ID NO: 1311842 - RNA, 19 nt, Homo sapiens
cucaaaggaugaaggguuu

SEQ ID NO: 1311843 - RNA, 19 nt, Homo sapiens
ggacagugggcacaaggaa

SEQ ID NO: 1311844 - RNA, 19 nt, Homo sapiens
ggaauagcagggugaacuu

SEQ ID NO: 1311845 - RNA, 19 nt, Homo sapiens
cgagaggacuuugaacaag

SEQ ID NO: 1311846 - RNA, 19 nt, Homo sapiens
acccagcucugcuaauauu

SEQ ID NO: 1311847 - RNA, 19 nt, Homo sapiens
ucacaaagagucugagaag

SEQ ID NO: 1311848 - RNA, 19 nt, Homo sapiens
gauuaaagccaaaguuagg

SEQ ID NO: 1311849 - RNA, 19 nt, Homo sapiens
aggauuaaagccaaaguua

SEQ ID NO: 1311850 - RNA, 19 nt, Homo sapiens
gaaaagaauggaaaugaga

SEQ ID NO: 1311851 - RNA, 19 nt, Homo sapiens
gagaguggccacguugauu

SEQ ID NO: 1311852 - RNA, 19 nt, Homo sapiens
ucacagaggaggaaugauc

SEQ ID NO: 1311853 - RNA, 19 nt, Homo sapiens
ggauuaaagccaaaguuag

SEQ ID NO: 1311854 - RNA, 19 nt, Homo sapiens
ggucacagaggaggaauga

SEQ ID NO: 1311855 - RNA, 19 nt, Homo sapiens
aaaugagagguaaggauua

SEQ ID NO: 1311856 - RNA, 19 nt, Homo sapiens
agaggacuuugaacaagaa

SEQ ID NO: 1311857 - RNA, 19 nt, Homo sapiens
gucaauaaccucaaaggau

SEQ ID NO: 1311858 - RNA, 19 nt, Homo sapiens
ggagaugugucagugaacu

SEQ ID NO: 1311859 - RNA, 19 nt, Homo sapiens
agggcaaccucguccauuu

SEQ ID NO: 1311860 - RNA, 19 nt, Homo sapiens
ggauggagaucggagaaac

SEQ ID NO: 1311861 - RNA, 19 nt, Homo sapiens
gaaggucacagaggaggaa

SEQ ID NO: 1311862 - RNA, 19 nt, Homo sapiens
ccaagcaaagccaguuaaa

SEQ ID NO: 1311863 - RNA, 19 nt, Homo sapiens
aaggaaagaucauuauagc

SEQ ID NO: 1311864 - RNA, 19 nt, Homo sapiens
ggaggugauucugauucaa

SEQ ID NO: 1311865 - RNA, 19 nt, Homo sapiens
aaggaucucuugccacaca

SEQ ID NO: 1311866 - RNA, 19 nt, Homo sapiens
gaucacaaagagucugaga

SEQ ID NO: 1311867 - RNA, 19 nt, Homo sapiens
ugggagaugugucagugaa

SEQ ID NO: 1311868 - RNA, 19 nt, Homo sapiens
acuggcaccucagggauua

SEQ ID NO: 1311869 - RNA, 19 nt, Homo sapiens
ggacaugccccuuuucuag

SEQ ID NO: 1311870 - RNA, 19 nt, Homo sapiens
ucagugaacuagaaaaugu

SEQ ID NO: 1311871 - RNA, 19 nt, Homo sapiens
gcuauggaggugauucuga

SEQ ID NO: 1311872 - RNA, 19 nt, Homo sapiens
gcucuguguuauuccuuug

SEQ ID NO: 1311873 - RNA, 19 nt, Homo sapiens
gcccagagcacguggagau

SEQ ID NO: 1311874 - RNA, 19 nt, Homo sapiens
ugaaugguugggagagaua

SEQ ID NO: 1311875 - RNA, 19 nt, Homo sapiens
gagaugugucagugaacua

SEQ ID NO: 1311876 - RNA, 19 nt, Homo sapiens
guaguucccaccucauuca

SEQ ID NO: 1311877 - RNA, 19 nt, Homo sapiens
ccuauuccuuugucucaga

SEQ ID NO: 1311878 - RNA, 19 nt, Homo sapiens
ccuagcggccuauuccuuu

SEQ ID NO: 1311879 - RNA, 19 nt, Homo sapiens
gaaccucuacuggcugaug

SEQ ID NO: 1311880 - RNA, 19 nt, Homo sapiens
aaguuaggaugggaauuaa

SEQ ID NO: 1311881 - RNA, 19 nt, Homo sapiens
agaauggaaaugagaggua

SEQ ID NO: 1311882 - RNA, 19 nt, Homo sapiens
cuauggaggugauucugau

SEQ ID NO: 1311883 - RNA, 19 nt, Homo sapiens
ggugaacuuaacccaauaa

SEQ ID NO: 1311884 - RNA, 19 nt, Homo sapiens
ggagaguggccacguugau

SEQ ID NO: 1311885 - RNA, 19 nt, Homo sapiens
ggcaaccccugaagcauuu

SEQ ID NO: 1311886 - RNA, 19 nt, Homo sapiens
agacuuccuugcucugugu

SEQ ID NO: 1311887 - RNA, 19 nt, Homo sapiens
cugaaucgcuacuauuagg

SEQ ID NO: 1311888 - RNA, 19 nt, Homo sapiens
agcagaagauggguuggua

SEQ ID NO: 1311889 - RNA, 19 nt, Homo sapiens
caauaaccucaaaggauga

SEQ ID NO: 1311890 - RNA, 19 nt, Homo sapiens
aagauggguugguacugaa

SEQ ID NO: 1311891 - RNA, 19 nt, Homo sapiens
cagcucugcuaauauugug

SEQ ID NO: 1311892 - RNA, 19 nt, Homo sapiens
uggaggugauucugauuca

SEQ ID NO: 1311893 - RNA, 19 nt, Homo sapiens
uguagcggcugacccugaa

SEQ ID NO: 1311894 - RNA, 19 nt, Homo sapiens
aauagcagggugaacuuaa

SEQ ID NO: 1311895 - RNA, 19 nt, Homo sapiens
uggcugcucuggugauaag

SEQ ID NO: 1311896 - RNA, 19 nt, Homo sapiens
ggugauucugauucaaaua

SEQ ID NO: 1311897 - RNA, 19 nt, Homo sapiens
gggaauagcagggugaacu

SEQ ID NO: 1311898 - RNA, 19 nt, Homo sapiens
ugugguuucucuugauuuc

SEQ ID NO: 1311899 - RNA, 19 nt, Homo sapiens
ggccaaauguauggagaag

SEQ ID NO: 1311900 - RNA, 19 nt, Homo sapiens
gcucuguacuuuguuucug

SEQ ID NO: 1311901 - RNA, 19 nt, Homo sapiens
gugauucugauucaaauag

SEQ ID NO: 1311902 - RNA, 19 nt, Homo sapiens
gcaugagggcugggaauag

SEQ ID NO: 1311903 - RNA, 19 nt, Homo sapiens
uaccaagcaaagccaguua

SEQ ID NO: 1311904 - RNA, 19 nt, Homo sapiens
gcaaccucguccauuuuaa

SEQ ID NO: 1311905 - RNA, 19 nt, Homo sapiens
gauucugauucaaauagca

SEQ ID NO: 1311906 - RNA, 19 nt, Homo sapiens
gacugugguuucucuugau

SEQ ID NO: 1311907 - RNA, 19 nt, Homo sapiens
ccuggcugcucuggugaua

SEQ ID NO: 1311908 - RNA, 19 nt, Homo sapiens
cuagcggccuauuccuuug

SEQ ID NO: 1311909 - RNA, 19 nt, Homo sapiens
uuagugaugcgaacagaug

SEQ ID NO: 1311910 - RNA, 19 nt, Homo sapiens
gcauaaagccuuagacuua

SEQ ID NO: 1311911 - RNA, 19 nt, Homo sapiens
caagagaucucgguuguua

SEQ ID NO: 1311912 - RNA, 19 nt, Homo sapiens
gcaguaaguucauuuguuu

SEQ ID NO: 1311913 - RNA, 19 nt, Homo sapiens
ugaagaagauggauccuua

SEQ ID NO: 1311914 - RNA, 19 nt, Homo sapiens
caagaggaauuaaagagua

SEQ ID NO: 1311915 - RNA, 19 nt, Homo sapiens
gcaggauccuuguauguaa

SEQ ID NO: 1311916 - RNA, 19 nt, Homo sapiens
ccaaauggaugauguugaa

SEQ ID NO: 1311917 - RNA, 19 nt, Homo sapiens
ccacaaaucauuaagcaua

SEQ ID NO: 1311918 - RNA, 19 nt, Homo sapiens
guugagguauucuuucuua

SEQ ID NO: 1311919 - RNA, 19 nt, Homo sapiens
cauaaacccuguaaagaga

SEQ ID NO: 1311920 - RNA, 19 nt, Homo sapiens
gagagaggcugcuucacaa

SEQ ID NO: 1311921 - RNA, 19 nt, Homo sapiens
gaugacagauggcaauuca

SEQ ID NO: 1311922 - RNA, 19 nt, Homo sapiens
uaaaggagguacauaagau

SEQ ID NO: 1311923 - RNA, 19 nt, Homo sapiens
gaaagcugcucuacucauc

SEQ ID NO: 1311924 - RNA, 19 nt, Homo sapiens
uaacacaacacaaacagua

SEQ ID NO: 1311925 - RNA, 19 nt, Homo sapiens
gcuauuaacaccaaguaua

SEQ ID NO: 1311926 - RNA, 19 nt, Homo sapiens
caaauuccgucgucauuca

SEQ ID NO: 1311927 - RNA, 19 nt, Homo sapiens
caauucaguuguugaggua

SEQ ID NO: 1311928 - RNA, 19 nt, Homo sapiens
ggaagacagugaacaagca

SEQ ID NO: 1311929 - RNA, 19 nt, Homo sapiens
gauaaagcauccaaaauga

SEQ ID NO: 1311930 - RNA, 19 nt, Homo sapiens
acacacagcucuaaauuuu

SEQ ID NO: 1311931 - RNA, 19 nt, Homo sapiens
gggcaugucugaacaacug

SEQ ID NO: 1311932 - RNA, 19 nt, Homo sapiens
ggagguacauaagauaaau

SEQ ID NO: 1311933 - RNA, 19 nt, Homo sapiens
ucaccuguuugcaguaaua

SEQ ID NO: 1311934 - RNA, 19 nt, Homo sapiens
caggguaccuuuagugguu

SEQ ID NO: 1311935 - RNA, 19 nt, Homo sapiens
acagaaagcugcucuacuc

SEQ ID NO: 1311936 - RNA, 19 nt, Homo sapiens
cugaacaacuggguuauaa

SEQ ID NO: 1311937 - RNA, 19 nt, Homo sapiens
uaaccaggcauacuuauau

SEQ ID NO: 1311938 - RNA, 19 nt, Homo sapiens
guacaagccugguaaucca

SEQ ID NO: 1311939 - RNA, 19 nt, Homo sapiens
ggcuagaguugccagauaa

SEQ ID NO: 1311940 - RNA, 19 nt, Homo sapiens
gcauaaacccuguaaagag

SEQ ID NO: 1311941 - RNA, 19 nt, Homo sapiens
gugguaacgugauagaauu

SEQ ID NO: 1311942 - RNA, 19 nt, Homo sapiens
ugaacaagcaguagauaaa

SEQ ID NO: 1311943 - RNA, 19 nt, Homo sapiens
gaagaagauggauccuuaa

SEQ ID NO: 1311944 - RNA, 19 nt, Homo sapiens
gauaaaaugugaugagugu

SEQ ID NO: 1311945 - RNA, 19 nt, Homo sapiens
caaugucuauuagguguaa

SEQ ID NO: 1311946 - RNA, 19 nt, Homo sapiens
gaagacaagucaggaggau

SEQ ID NO: 1311947 - RNA, 19 nt, Homo sapiens
ucagcuagcucaauucagu

SEQ ID NO: 1311948 - RNA, 19 nt, Homo sapiens
uuauuuggcugauggguaa

SEQ ID NO: 1311949 - RNA, 19 nt, Homo sapiens
uagacaaucugaccuuaau

SEQ ID NO: 1311950 - RNA, 19 nt, Homo sapiens
uaaacccuguaaagagaua

SEQ ID NO: 1311951 - RNA, 19 nt, Homo sapiens
gcugauggguaaagccaaa

SEQ ID NO: 1311952 - RNA, 19 nt, Homo sapiens
guacaccacaaaucauuaa

SEQ ID NO: 1311953 - RNA, 19 nt, Homo sapiens
aaacacacagcucuaaauu

SEQ ID NO: 1311954 - RNA, 19 nt, Homo sapiens
gcuaguacaccacaaauca

SEQ ID NO: 1311955 - RNA, 19 nt, Homo sapiens
aguaaaggauguaaacaga

SEQ ID NO: 1311956 - RNA, 19 nt, Homo sapiens
gaacaacuggguuauaaaa

SEQ ID NO: 1311957 - RNA, 19 nt, Homo sapiens
ccaagaacagcauuacuga

SEQ ID NO: 1311958 - RNA, 19 nt, Homo sapiens
gauaacucuuagugcauuu

SEQ ID NO: 1311959 - RNA, 19 nt, Homo sapiens
agcaguagauaaacuagua

SEQ ID NO: 1311960 - RNA, 19 nt, Homo sapiens
gaagccaagaacagcauua

SEQ ID NO: 1311961 - RNA, 19 nt, Homo sapiens
uaaaugacaaucacacaga

SEQ ID NO: 1311962 - RNA, 19 nt, Homo sapiens
guacaaacacacagcucua

SEQ ID NO: 1311963 - RNA, 19 nt, Homo sapiens
uuacacagacacauucuuu

SEQ ID NO: 1311964 - RNA, 19 nt, Homo sapiens
uuacuauguucaccuguuu

SEQ ID NO: 1311965 - RNA, 19 nt, Homo sapiens
gguaguaguaaccaagaua

SEQ ID NO: 1311966 - RNA, 19 nt, Homo sapiens
aagaacagcauuacugauu

SEQ ID NO: 1311967 - RNA, 19 nt, Homo sapiens
gugaugaguguuaacauuu

SEQ ID NO: 1311968 - RNA, 19 nt, Homo sapiens
guaguaguaaccaagauaa

SEQ ID NO: 1311969 - RNA, 19 nt, Homo sapiens
caagacaaacgaucuaaag

SEQ ID NO: 1311970 - RNA, 19 nt, Homo sapiens
cauaaagccuuagacuuag

SEQ ID NO: 1311971 - RNA, 19 nt, Homo sapiens
ugugaugaguguuaacauu

SEQ ID NO: 1311972 - RNA, 19 nt, Homo sapiens
guaaaucaucucuucaugu

SEQ ID NO: 1311973 - RNA, 19 nt, Homo sapiens
caagucaggaggauugauu

SEQ ID NO: 1311974 - RNA, 19 nt, Homo sapiens
ggaugauguugaaguuguu

SEQ ID NO: 1311975 - RNA, 19 nt, Homo sapiens
ggguaaagccaaacauuuc

SEQ ID NO: 1311976 - RNA, 19 nt, Homo sapiens
gaacagcauuacugauucc

SEQ ID NO: 1311977 - RNA, 19 nt, Homo sapiens
gaauauucacggucuccua

SEQ ID NO: 1311978 - RNA, 19 nt, Homo sapiens
uaaagcagauacugguagu

SEQ ID NO: 1311979 - RNA, 19 nt, Homo sapiens
caaucugaccuuaauggua

SEQ ID NO: 1311980 - RNA, 19 nt, Homo sapiens
guagacaaucugaccuuaa

SEQ ID NO: 1311981 - RNA, 19 nt, Homo sapiens
caaacacacagcucuaaau

SEQ ID NO: 1311982 - RNA, 19 nt, Homo sapiens
guccuuugcaugaaauuua

SEQ ID NO: 1311983 - RNA, 19 nt, Homo sapiens
caccaaguauaauaacaga

SEQ ID NO: 1311984 - RNA, 19 nt, Homo sapiens
cccgauaucugauguuaca

SEQ ID NO: 1311985 - RNA, 19 nt, Homo sapiens
ggggaagugucauucuuua

SEQ ID NO: 1311986 - RNA, 19 nt, Homo sapiens
aaaugacaaucacacagaa

SEQ ID NO: 1311987 - RNA, 19 nt, Homo sapiens
uagaguccuuugcaugaaa

SEQ ID NO: 1311988 - RNA, 19 nt, Homo sapiens
ucaggaggauugauugaag

SEQ ID NO: 1311989 - RNA, 19 nt, Homo sapiens
guucaccuguuugcaguaa

SEQ ID NO: 1311990 - RNA, 19 nt, Homo sapiens
gguagaacacacugacauu

SEQ ID NO: 1311991 - RNA, 19 nt, Homo sapiens
ggaauuaaagaguauaugc

SEQ ID NO: 1311992 - RNA, 19 nt, Homo sapiens
uauuagugguaacgugaua

SEQ ID NO: 1311993 - RNA, 19 nt, Homo sapiens
uaaaagacacuacugguuu

SEQ ID NO: 1311994 - RNA, 19 nt, Homo sapiens
acacaacuauaacacaaca

SEQ ID NO: 1311995 - RNA, 19 nt, Homo sapiens
aaucuggcagccuuaauua

SEQ ID NO: 1311996 - RNA, 19 nt, Homo sapiens
gauugaagcuaggaguuag

SEQ ID NO: 1311997 - RNA, 19 nt, Homo sapiens
ccuguaaucccagcacuua

SEQ ID NO: 1311998 - RNA, 19 nt, Homo sapiens
guaaagccaaacauuucua

SEQ ID NO: 1311999 - RNA, 19 nt, Homo sapiens
caccacaaaucauuaagca

SEQ ID NO: 1312000 - RNA, 19 nt, Homo sapiens
ugacauuccugaagcuagu

SEQ ID NO: 1312001 - RNA, 19 nt, Homo sapiens
ugagcucucuuaauugcuu

SEQ ID NO: 1312002 - RNA, 19 nt, Homo sapiens
ggcauaaacccuguaaaga

SEQ ID NO: 1312003 - RNA, 19 nt, Homo sapiens
gguaacgugauagaauuua

SEQ ID NO: 1312004 - RNA, 19 nt, Homo sapiens
ggcaucauacaaccacuua

SEQ ID NO: 1312005 - RNA, 19 nt, Homo sapiens
ccaggcauacuuauauuug

SEQ ID NO: 1312006 - RNA, 19 nt, Homo sapiens
agacaagucaggaggauug

SEQ ID NO: 1312007 - RNA, 19 nt, Homo sapiens
gaacaagcaguagauaaac

SEQ ID NO: 1312008 - RNA, 19 nt, Homo sapiens
gugaacaagcaguagauaa

SEQ ID NO: 1312009 - RNA, 19 nt, Homo sapiens
aaaggagguacauaagaua

SEQ ID NO: 1312010 - RNA, 19 nt, Homo sapiens
gaauagacguucucauuua

SEQ ID NO: 1312011 - RNA, 19 nt, Homo sapiens
gaaaugggaugcucacaaa

SEQ ID NO: 1312012 - RNA, 19 nt, Homo sapiens
gaugaaaccuauagugaua

SEQ ID NO: 1312013 - RNA, 19 nt, Homo sapiens
agaagaagcuaguucauua

SEQ ID NO: 1312014 - RNA, 19 nt, Homo sapiens
gaaaggaauucugcuauuu

SEQ ID NO: 1312015 - RNA, 19 nt, Homo sapiens
gaaagacucuguaguagga

SEQ ID NO: 1312016 - RNA, 19 nt, Homo sapiens
uaaaggcaguguuucauua

SEQ ID NO: 1312017 - RNA, 19 nt, Homo sapiens
caacaaagaugcuauuuac

SEQ ID NO: 1312018 - RNA, 19 nt, Homo sapiens
gaagagaguucaccuguuc

SEQ ID NO: 1312019 - RNA, 19 nt, Homo sapiens
uaaaggagcugcuguuaau

SEQ ID NO: 1312020 - RNA, 19 nt, Homo sapiens
gaacagucgucguauuauu

SEQ ID NO: 1312021 - RNA, 19 nt, Homo sapiens
guacauaguucuggaaauu

SEQ ID NO: 1312022 - RNA, 19 nt, Homo sapiens
gaugaaaguuccugggaua

SEQ ID NO: 1312023 - RNA, 19 nt, Homo sapiens
gcacauggauacuuauaga

SEQ ID NO: 1312024 - RNA, 19 nt, Homo sapiens
guaaacaugugcaaucaaa

SEQ ID NO: 1312025 - RNA, 19 nt, Homo sapiens
ggauaugcauugauucuuu

SEQ ID NO: 1312026 - RNA, 19 nt, Homo sapiens
caaaacagcucuccucaua

SEQ ID NO: 1312027 - RNA, 19 nt, Homo sapiens
gaaccgacauaacagaauu

SEQ ID NO: 1312028 - RNA, 19 nt, Homo sapiens
ucacaaaucuccaaucugu

SEQ ID NO: 1312029 - RNA, 19 nt, Homo sapiens
gaggauugcuuuagugauu

SEQ ID NO: 1312030 - RNA, 19 nt, Homo sapiens
ggagggagauuuguuuaaa

SEQ ID NO: 1312031 - RNA, 19 nt, Homo sapiens
uaaaugggcuugccaacaa

SEQ ID NO: 1312032 - RNA, 19 nt, Homo sapiens
ccaaggauaugcauugauu

SEQ ID NO: 1312033 - RNA, 19 nt, Homo sapiens
gaaggaaaguucuguugga

SEQ ID NO: 1312034 - RNA, 19 nt, Homo sapiens
ccaacaauauggaugauuu

SEQ ID NO: 1312035 - RNA, 19 nt, Homo sapiens
gaaagagauucguucagaa

SEQ ID NO: 1312036 - RNA, 19 nt, Homo sapiens
ggacugauuugucucuuga

SEQ ID NO: 1312037 - RNA, 19 nt, Homo sapiens
gaaagcaagucaacaccaa

SEQ ID NO: 1312038 - RNA, 19 nt, Homo sapiens
aagaagaacuccuagauga

SEQ ID NO: 1312039 - RNA, 19 nt, Homo sapiens
gagaagaaaucguguccuu

SEQ ID NO: 1312040 - RNA, 19 nt, Homo sapiens
gaagauaaacaccgauauu

SEQ ID NO: 1312041 - RNA, 19 nt, Homo sapiens
gaacaaauagccacaagug

SEQ ID NO: 1312042 - RNA, 19 nt, Homo sapiens
gaaaguuccugggauaaug

SEQ ID NO: 1312043 - RNA, 19 nt, Homo sapiens
gcaguagacucacagaaau

SEQ ID NO: 1312044 - RNA, 19 nt, Homo sapiens
ggaguaauauaaagucaga

SEQ ID NO: 1312045 - RNA, 19 nt, Homo sapiens
caucagagcaaauugaaua

SEQ ID NO: 1312046 - RNA, 19 nt, Homo sapiens
guaauggccuaaagacuga

SEQ ID NO: 1312047 - RNA, 19 nt, Homo sapiens
gaucgcaauucacuucuaa

SEQ ID NO: 1312048 - RNA, 19 nt, Homo sapiens
ggacggacauuucgagauc

SEQ ID NO: 1312049 - RNA, 19 nt, Homo sapiens
gaaccaaggauaugcauug

SEQ ID NO: 1312050 - RNA, 19 nt, Homo sapiens
ugaaauaaaugugcuguga

SEQ ID NO: 1312051 - RNA, 19 nt, Homo sapiens
gaaccgcugacuaaauuua

SEQ ID NO: 1312052 - RNA, 19 nt, Homo sapiens
aggaagaagugcacgauua

SEQ ID NO: 1312053 - RNA, 19 nt, Homo sapiens
ucagauggcacuuuaauaa

SEQ ID NO: 1312054 - RNA, 19 nt, Homo sapiens
aagaaccgcugacuaaauu

SEQ ID NO: 1312055 - RNA, 19 nt, Homo sapiens
caugaaagacucuguagua

SEQ ID NO: 1312056 - RNA, 19 nt, Homo sapiens
gaauuacagugacaucaga

SEQ ID NO: 1312057 - RNA, 19 nt, Homo sapiens
gcacucagccuuagauugu

SEQ ID NO: 1312058 - RNA, 19 nt, Homo sapiens
ccaaucagguguaaacaug

SEQ ID NO: 1312059 - RNA, 19 nt, Homo sapiens
gcagcaagauguuaauaag

SEQ ID NO: 1312060 - RNA, 19 nt, Homo sapiens
ugaggauggugaagauuua

SEQ ID NO: 1312061 - RNA, 19 nt, Homo sapiens
guaagcagccauuaauaaa

SEQ ID NO: 1312062 - RNA, 19 nt, Homo sapiens
gggaagacuuggauagcua

SEQ ID NO: 1312063 - RNA, 19 nt, Homo sapiens
gcaggugucuuggucauga

SEQ ID NO: 1312064 - RNA, 19 nt, Homo sapiens
aaacaaugcucacuacaca

SEQ ID NO: 1312065 - RNA, 19 nt, Homo sapiens
aaucauauccugugcauuu

SEQ ID NO: 1312066 - RNA, 19 nt, Homo sapiens
ugaagaaccuguagauagu

SEQ ID NO: 1312067 - RNA, 19 nt, Homo sapiens
guacuugcauucaucauca

SEQ ID NO: 1312068 - RNA, 19 nt, Homo sapiens
gaagguagcagcugaucuu

SEQ ID NO: 1312069 - RNA, 19 nt, Homo sapiens
gcuaagaaccgacauaaca

SEQ ID NO: 1312070 - RNA, 19 nt, Homo sapiens
gcacuuacaacgacauauu

SEQ ID NO: 1312071 - RNA, 19 nt, Homo sapiens
gaagaagcuaguucauuaa

SEQ ID NO: 1312072 - RNA, 19 nt, Homo sapiens
caaagugcaaugugaauuu

SEQ ID NO: 1312073 - RNA, 19 nt, Homo sapiens
agaaagagauucguucaga

SEQ ID NO: 1312074 - RNA, 19 nt, Homo sapiens
gaauaaaggcaguguuuca

SEQ ID NO: 1312075 - RNA, 19 nt, Homo sapiens
ggaaagugaauuacaguga

SEQ ID NO: 1312076 - RNA, 19 nt, Homo sapiens
caauauggaugauuugaag

SEQ ID NO: 1312077 - RNA, 19 nt, Homo sapiens
aaacagcucuccucauaag

SEQ ID NO: 1312078 - RNA, 19 nt, Homo sapiens
gauaugcauugauucuuug

SEQ ID NO: 1312079 - RNA, 19 nt, Homo sapiens
aaucaaggcucuguuuauu

SEQ ID NO: 1312080 - RNA, 19 nt, Homo sapiens
gaagaagaagggcugaauu

SEQ ID NO: 1312081 - RNA, 19 nt, Homo sapiens
gcagaguacuauucuaucu

SEQ ID NO: 1312082 - RNA, 19 nt, Homo sapiens
ggaucaaccucacaaucaa

SEQ ID NO: 1312083 - RNA, 19 nt, Homo sapiens
aaagaaaugugaagagagu

SEQ ID NO: 1312084 - RNA, 19 nt, Homo sapiens
cugaagaacugucaaagga

SEQ ID NO: 1312085 - RNA, 19 nt, Homo sapiens
aaagagagcggaguucaua

SEQ ID NO: 1312086 - RNA, 19 nt, Homo sapiens
gaaucaaggcucuguuuau

SEQ ID NO: 1312087 - RNA, 19 nt, Homo sapiens
gaagaaaucguguccuuac

SEQ ID NO: 1312088 - RNA, 19 nt, Homo sapiens
guaaagagaguaauuaagg

SEQ ID NO: 1312089 - RNA, 19 nt, Homo sapiens
gcaauucacuucuaaaaca

SEQ ID NO: 1312090 - RNA, 19 nt, Homo sapiens
ucacacuccuccuuaacua

SEQ ID NO: 1312091 - RNA, 19 nt, Homo sapiens
ugucaaacaucauuucaga

SEQ ID NO: 1312092 - RNA, 19 nt, Homo sapiens
gcucacaaaucuccaaucu

SEQ ID NO: 1312093 - RNA, 19 nt, Homo sapiens
ccacggagccugagguuug

SEQ ID NO: 1312094 - RNA, 19 nt, Homo sapiens
caaccacauuuccaaagaa

SEQ ID NO: 1312095 - RNA, 19 nt, Homo sapiens
gcaagucaacaccaaguuu

SEQ ID NO: 1312096 - RNA, 19 nt, Homo sapiens
caaauagggcagaguacua

SEQ ID NO: 1312097 - RNA, 19 nt, Homo sapiens
ggacuugacuaugcacuca

SEQ ID NO: 1312098 - RNA, 19 nt, Homo sapiens
gcauugaacagucgucgua

SEQ ID NO: 1312099 - RNA, 19 nt, Homo sapiens
gaagaugaaaccuauagug

SEQ ID NO: 1312100 - RNA, 19 nt, Homo sapiens
gacuaaauguguuaaaugg

SEQ ID NO: 1312101 - RNA, 19 nt, Homo sapiens
aaaaucagcuaccuacaua

SEQ ID NO: 1312102 - RNA, 19 nt, Homo sapiens
gaagacagaaguugaugga

SEQ ID NO: 1312103 - RNA, 19 nt, Homo sapiens
acuaagacuuccaauauga

SEQ ID NO: 1312104 - RNA, 19 nt, Homo sapiens
cgacauaacagaauuacug

SEQ ID NO: 1312105 - RNA, 19 nt, Homo sapiens
uaaaagagcaguacaugua

SEQ ID NO: 1312106 - RNA, 19 nt, Homo sapiens
caaucuguguucugaauga

SEQ ID NO: 1312107 - RNA, 19 nt, Homo sapiens
gguguuggguuaucaaauc

SEQ ID NO: 1312108 - RNA, 19 nt, Homo sapiens
uaaggaaucuaagaaggaa

SEQ ID NO: 1312109 - RNA, 19 nt, Homo sapiens
gaagcgaacauuuggauca

SEQ ID NO: 1312110 - RNA, 19 nt, Homo sapiens
gcaaagaccauaagauuua

SEQ ID NO: 1312111 - RNA, 19 nt, Homo sapiens
gcacgaaguugauggcaaa

SEQ ID NO: 1312112 - RNA, 19 nt, Homo sapiens
caagaucacucgcaaccaa

SEQ ID NO: 1312113 - RNA, 19 nt, Homo sapiens
gaaggaugcuguacagaag

SEQ ID NO: 1312114 - RNA, 19 nt, Homo sapiens
ggaauucuauguacacuac

SEQ ID NO: 1312115 - RNA, 19 nt, Homo sapiens
aaagagaucuaccgcaaga

SEQ ID NO: 1312116 - RNA, 19 nt, Homo sapiens
ccucaucgcuuucaguuau

SEQ ID NO: 1312117 - RNA, 19 nt, Homo sapiens
gaaacaauguggccugcau

SEQ ID NO: 1312118 - RNA, 19 nt, Homo sapiens
cgaaauugaugccugguau

SEQ ID NO: 1312119 - RNA, 19 nt, Homo sapiens
ugaaguauguggacaagau

SEQ ID NO: 1312120 - RNA, 19 nt, Homo sapiens
gaagacuuaugcagagaug

SEQ ID NO: 1312121 - RNA, 19 nt, Homo sapiens
auaagacacuguacuuuga

SEQ ID NO: 1312122 - RNA, 19 nt, Homo sapiens
cauaagauuuacugucaga

SEQ ID NO: 1312123 - RNA, 19 nt, Homo sapiens
gauagcaccuggcauucug

SEQ ID NO: 1312124 - RNA, 19 nt, Homo sapiens
cagaagaacucagagaagu

SEQ ID NO: 1312125 - RNA, 19 nt, Homo sapiens
gcucccagccuguaaauau

SEQ ID NO: 1312126 - RNA, 19 nt, Homo sapiens
gagaggaauucuauguaca

SEQ ID NO: 1312127 - RNA, 19 nt, Homo sapiens
ccacauuguuggcuacuuc

SEQ ID NO: 1312128 - RNA, 19 nt, Homo sapiens
ggcaaagaccauaagauuu

SEQ ID NO: 1312129 - RNA, 19 nt, Homo sapiens
ugaaauaugagaagagcua

SEQ ID NO: 1312130 - RNA, 19 nt, Homo sapiens
cauaagacacuguacuuug

SEQ ID NO: 1312131 - RNA, 19 nt, Homo sapiens
uggcaaagaccauaagauu

SEQ ID NO: 1312132 - RNA, 19 nt, Homo sapiens
gcgcaagcaugaugagauc

SEQ ID NO: 1312133 - RNA, 19 nt, Homo sapiens
cgagaggaauucuauguac

SEQ ID NO: 1312134 - RNA, 19 nt, Homo sapiens
cggagaagccgcugucuga

SEQ ID NO: 1312135 - RNA, 19 nt, Homo sapiens
caacaucuccgugcacgaa

SEQ ID NO: 1312136 - RNA, 19 nt, Homo sapiens
gaaauugaugccugguauu

SEQ ID NO: 1312137 - RNA, 19 nt, Homo sapiens
guauagaccuguuuuguca

SEQ ID NO: 1312138 - RNA, 19 nt, Homo sapiens
aagucaagcucuccaagaa

SEQ ID NO: 1312139 - RNA, 19 nt, Homo sapiens
uaagaaaccacccaucaca

SEQ ID NO: 1312140 - RNA, 19 nt, Homo sapiens
ucaauauggucaaguacug

SEQ ID NO: 1312141 - RNA, 19 nt, Homo sapiens
gaucaaccaugugcagaag

SEQ ID NO: 1312142 - RNA, 19 nt, Homo sapiens
gcauucugcugaagugauc

SEQ ID NO: 1312143 - RNA, 19 nt, Homo sapiens
guacagaagaacucagaga

SEQ ID NO: 1312144 - RNA, 19 nt, Homo sapiens
ugaaggaugcuguacagaa

SEQ ID NO: 1312145 - RNA, 19 nt, Homo sapiens
uauaagaaaccacccauca

SEQ ID NO: 1312146 - RNA, 19 nt, Homo sapiens
ucagccagaugaccaguau

SEQ ID NO: 1312147 - RNA, 19 nt, Homo sapiens
ucaaggaccucagccagau

SEQ ID NO: 1312148 - RNA, 19 nt, Homo sapiens
gagcuaccgcuuccacuug

SEQ ID NO: 1312149 - RNA, 19 nt, Homo sapiens
gauccagucucgagugaac

SEQ ID NO: 1312150 - RNA, 19 nt, Homo sapiens
accauaagauuuacuguca

SEQ ID NO: 1312151 - RNA, 19 nt, Homo sapiens
caucgggaacuacgaaauu

SEQ ID NO: 1312152 - RNA, 19 nt, Homo sapiens
gucaagcucuccaagaagu

SEQ ID NO: 1312153 - RNA, 19 nt, Homo sapiens
gaagaacucagagaaguac

SEQ ID NO: 1312154 - RNA, 19 nt, Homo sapiens
ccacagcagccuuggagaa

SEQ ID NO: 1312155 - RNA, 19 nt, Homo sapiens
aaagugcccaguauaagaa

SEQ ID NO: 1312156 - RNA, 19 nt, Homo sapiens
guacaugaaauaugagaag

SEQ ID NO: 1312157 - RNA, 19 nt, Homo sapiens
caagucaagcucuccaaga

SEQ ID NO: 1312158 - RNA, 19 nt, Homo sapiens
caucaucaguacccugcaa

SEQ ID NO: 1312159 - RNA, 19 nt, Homo sapiens
caaagaccauaagauuuac

SEQ ID NO: 1312160 - RNA, 19 nt, Homo sapiens
agaagaacucagagaagua

SEQ ID NO: 1312161 - RNA, 19 nt, Homo sapiens
gcgcugaccaagacaguga

SEQ ID NO: 1312162 - RNA, 19 nt, Homo sapiens
gugauccagucucgaguga

SEQ ID NO: 1312163 - RNA, 19 nt, Homo sapiens
gcacacuguccaucaagga

SEQ ID NO: 1312164 - RNA, 19 nt, Homo sapiens
cgaaguugauggcaaagac

SEQ ID NO: 1312165 - RNA, 19 nt, Homo sapiens
cagaagacuuaugcagaga

SEQ ID NO: 1312166 - RNA, 19 nt, Homo sapiens
gggccgagaggaauucuau

SEQ ID NO: 1312167 - RNA, 19 nt, Homo sapiens
ucaaaagugcccaguauaa

SEQ ID NO: 1312168 - RNA, 19 nt, Homo sapiens
gccagcacgugaucugugu

SEQ ID NO: 1312169 - RNA, 19 nt, Homo sapiens
ccauaagacacuguacuuu

SEQ ID NO: 1312170 - RNA, 19 nt, Homo sapiens
ccacaucgggaacuacgaa

SEQ ID NO: 1312171 - RNA, 19 nt, Homo sapiens
ccggauagcaccuggcauu

SEQ ID NO: 1312172 - RNA, 19 nt, Homo sapiens
guacacuacgugggcuuua

SEQ ID NO: 1312173 - RNA, 19 nt, Homo sapiens
acccugcaaucccucaaua

SEQ ID NO: 1312174 - RNA, 19 nt, Homo sapiens
ccgagaggaauucuaugua

SEQ ID NO: 1312175 - RNA, 19 nt, Homo sapiens
acgaguggguagacaagaa

SEQ ID NO: 1312176 - RNA, 19 nt, Homo sapiens
uacacuacgugggcuuuaa

SEQ ID NO: 1312177 - RNA, 19 nt, Homo sapiens
cccucaauauggucaagua

SEQ ID NO: 1312178 - RNA, 19 nt, Homo sapiens
ccugggugcugcuggagaa

SEQ ID NO: 1312179 - RNA, 19 nt, Homo sapiens
ugaccaagacagugaagga

SEQ ID NO: 1312180 - RNA, 19 nt, Homo sapiens
ccucaaaagugcccaguau

SEQ ID NO: 1312181 - RNA, 19 nt, Homo sapiens
ggugaaguauguggacaag

SEQ ID NO: 1312182 - RNA, 19 nt, Homo sapiens
ggacgaguggguagacaag

SEQ ID NO: 1312183 - RNA, 19 nt, Homo sapiens
gaagggccagcacgugauc

SEQ ID NO: 1312184 - RNA, 19 nt, Homo sapiens
ggaagggccagcacgugau

SEQ ID NO: 1312185 - RNA, 19 nt, Homo sapiens
ggaagucacgguggagauc

SEQ ID NO: 1312186 - RNA, 19 nt, Homo sapiens
gaaguauguggacaagauc

SEQ ID NO: 1312187 - RNA, 19 nt, Homo sapiens
caccuggcauucugcugaa

SEQ ID NO: 1312188 - RNA, 19 nt, Homo sapiens
gccgagaggaauucuaugu

SEQ ID NO: 1312189 - RNA, 19 nt, Homo sapiens
uacagaagaacucagagaa

SEQ ID NO: 1312190 - RNA, 19 nt, Homo sapiens
ugcaaucccucaauauggu

SEQ ID NO: 1312191 - RNA, 19 nt, Homo sapiens
gaaguuccucaucgcuuuc

SEQ ID NO: 1312192 - RNA, 19 nt, Homo sapiens
gccucaaguacaugaaaua

SEQ ID NO: 1312193 - RNA, 19 nt, Homo sapiens
uggagaaccugcgggacuu

SEQ ID NO: 1312194 - RNA, 19 nt, Homo sapiens
cgaagacuaugggaaacag

SEQ ID NO: 1312195 - RNA, 19 nt, Homo sapiens
aggaugcuguacagaagaa

SEQ ID NO: 1312196 - RNA, 19 nt, Homo sapiens
caaaagcgcaagcaugaug

SEQ ID NO: 1312197 - RNA, 19 nt, Homo sapiens
ggacuccgucugccucaag

SEQ ID NO: 1312198 - RNA, 19 nt, Homo sapiens
agaaaccacccaucacagu

SEQ ID NO: 1312199 - RNA, 19 nt, Homo sapiens
ggauagcaccuggcauucu

SEQ ID NO: 1312200 - RNA, 19 nt, Homo sapiens
gaggaauucuauguacacu

SEQ ID NO: 1312201 - RNA, 19 nt, Homo sapiens
caagcucuccaagaaguga

SEQ ID NO: 1312202 - RNA, 19 nt, Homo sapiens
accaugugcagaagacuua

SEQ ID NO: 1312203 - RNA, 19 nt, Homo sapiens
ucaaccaugugcagaagac

SEQ ID NO: 1312204 - RNA, 19 nt, Homo sapiens
cccagccuguaaauaugua

SEQ ID NO: 1312205 - RNA, 19 nt, Homo sapiens
ccugcaaucccucaauaug

SEQ ID NO: 1312206 - RNA, 19 nt, Homo sapiens
cguggagccguucgucuuu

SEQ ID NO: 1312207 - RNA, 19 nt, Homo sapiens
ccucaaguacaugaaauau

SEQ ID NO: 1312208 - RNA, 19 nt, Homo sapiens
agacuuaugcagagaugga

SEQ ID NO: 1312209 - RNA, 19 nt, Homo sapiens
gccuguaaauauguauaga

SEQ ID NO: 1312210 - RNA, 19 nt, Homo sapiens
ggagggagguggagaagga

SEQ ID NO: 1312211 - RNA, 19 nt, Homo sapiens
gauuugcccuucacaauuc

SEQ ID NO: 1312212 - RNA, 19 nt, Homo sapiens
ggagcuggguuauccaaga

SEQ ID NO: 1312213 - RNA, 19 nt, Homo sapiens
ggucuguguuugcuuguuu

SEQ ID NO: 1312214 - RNA, 19 nt, Homo sapiens
gacuaaggcuggucugugu

SEQ ID NO: 1312215 - RNA, 19 nt, Homo sapiens
ggaaugccgccuaguuuau

SEQ ID NO: 1312216 - RNA, 19 nt, Homo sapiens
ggauuugcccuucacaauu

SEQ ID NO: 1312217 - RNA, 19 nt, Homo sapiens
cagagaaccugggcacuug

SEQ ID NO: 1312218 - RNA, 19 nt, Homo sapiens
ugaagaagaggaagaagaa

SEQ ID NO: 1312219 - RNA, 19 nt, Homo sapiens
agaggaggaugaugaagaa

SEQ ID NO: 1312220 - RNA, 19 nt, Homo sapiens
gaagauggacuggcagaga

SEQ ID NO: 1312221 - RNA, 19 nt, Homo sapiens
ggaagaggaggaugaugaa

SEQ ID NO: 1312222 - RNA, 19 nt, Homo sapiens
cuccauagccucaacauuu

SEQ ID NO: 1312223 - RNA, 19 nt, Homo sapiens
ggaggaugaugaagaagag

SEQ ID NO: 1312224 - RNA, 19 nt, Homo sapiens
ggaagacccagcacuaagu

SEQ ID NO: 1312225 - RNA, 19 nt, Homo sapiens
ccucugagccuggcacaua

SEQ ID NO: 1312226 - RNA, 19 nt, Homo sapiens
caggaaugccgccuaguuu

SEQ ID NO: 1312227 - RNA, 19 nt, Homo sapiens
gagguacccuuagauccuu

SEQ ID NO: 1312228 - RNA, 19 nt, Homo sapiens
ccaaggaccgcaagaagau

SEQ ID NO: 1312229 - RNA, 19 nt, Homo sapiens
ucagcaauuugaaugagaa

SEQ ID NO: 1312230 - RNA, 19 nt, Homo sapiens
ggcaccaucucaagucgaa

SEQ ID NO: 1312231 - RNA, 19 nt, Homo sapiens
ugagacagcccacauugga

SEQ ID NO: 1312232 - RNA, 19 nt, Homo sapiens
agaggaagaugaggaggaa

SEQ ID NO: 1312233 - RNA, 19 nt, Homo sapiens
ccaggaaugccgccuaguu

SEQ ID NO: 1312234 - RNA, 19 nt, Homo sapiens
agucucaccugcagucuau

SEQ ID NO: 1312235 - RNA, 19 nt, Homo sapiens
gggauuugcccuucacaau

SEQ ID NO: 1312236 - RNA, 19 nt, Homo sapiens
gaggagacacgcagagaca

SEQ ID NO: 1312237 - RNA, 19 nt, Homo sapiens
gagcuggguuauccaagag

SEQ ID NO: 1312238 - RNA, 19 nt, Homo sapiens
gaaugccgccuaguuuaug

SEQ ID NO: 1312239 - RNA, 19 nt, Homo sapiens
gggcaggacccuaagaucu

SEQ ID NO: 1312240 - RNA, 19 nt, Homo sapiens
agacagcccacauuggaaa

SEQ ID NO: 1312241 - RNA, 19 nt, Homo sapiens
aggaaugccgccuaguuua

SEQ ID NO: 1312242 - RNA, 19 nt, Homo sapiens
agaccucuuuguugcguuu

SEQ ID NO: 1312243 - RNA, 19 nt, Homo sapiens
gagaggagacacgcagaga

SEQ ID NO: 1312244 - RNA, 19 nt, Homo sapiens
aggaagaggaggaugauga

SEQ ID NO: 1312245 - RNA, 19 nt, Homo sapiens
ugcagucuaucagcaauuu

SEQ ID NO: 1312246 - RNA, 19 nt, Homo sapiens
gagacagcccacauuggaa

SEQ ID NO: 1312247 - RNA, 19 nt, Homo sapiens
gccagucauuccuccauuc

SEQ ID NO: 1312248 - RNA, 19 nt, Homo sapiens
cuaaggcuggucuguguuu

SEQ ID NO: 1312249 - RNA, 19 nt, Homo sapiens
guggaagacccagcacuaa

SEQ ID NO: 1312250 - RNA, 19 nt, Homo sapiens
gcaauuugaaugagaacca

SEQ ID NO: 1312251 - RNA, 19 nt, Homo sapiens
ggaggugggaugugagaca

SEQ ID NO: 1312252 - RNA, 19 nt, Homo sapiens
gugcuguaauaaaucuuug

SEQ ID NO: 1312253 - RNA, 19 nt, Homo sapiens
gugcuuugaugccaggaau

SEQ ID NO: 1312254 - RNA, 19 nt, Homo sapiens
aagaagaggaagaagaaga

SEQ ID NO: 1312255 - RNA, 19 nt, Homo sapiens
aagaggaggaugaugaaga

SEQ ID NO: 1312256 - RNA, 19 nt, Homo sapiens
gacgggagaggcagagaga

SEQ ID NO: 1312257 - RNA, 19 nt, Homo sapiens
gggcugcggcuucugacuu

SEQ ID NO: 1312258 - RNA, 19 nt, Homo sapiens
ggaggaagaggaggaugau

SEQ ID NO: 1312259 - RNA, 19 nt, Homo sapiens
cacaccaccuucgcugaaa

SEQ ID NO: 1312260 - RNA, 19 nt, Homo sapiens
gagggagggagguggagaa

SEQ ID NO: 1312261 - RNA, 19 nt, Homo sapiens
ggcugcggcuucugacuuc

SEQ ID NO: 1312262 - RNA, 19 nt, Homo sapiens
ccagaaacccacucuaucc

SEQ ID NO: 1312263 - RNA, 19 nt, Homo sapiens
ggaugaugaagaagaggaa

SEQ ID NO: 1312264 - RNA, 19 nt, Homo sapiens
ggcaggacccuaagaucug

SEQ ID NO: 1312265 - RNA, 19 nt, Homo sapiens
gaccaacgccugccaugcu

SEQ ID NO: 1312266 - RNA, 19 nt, Homo sapiens
uaucagcaauuugaaugag

SEQ ID NO: 1312267 - RNA, 19 nt, Homo sapiens
acacaccaccuucgcugaa

SEQ ID NO: 1312268 - RNA, 19 nt, Homo sapiens
cagucuaucagcaauuuga

SEQ ID NO: 1312269 - RNA, 19 nt, Homo sapiens
cccaaggaccgcaagaaga

SEQ ID NO: 1312270 - RNA, 19 nt, Homo sapiens
uaaggcuggucuguguuug

SEQ ID NO: 1312271 - RNA, 19 nt, Homo sapiens
aggcugaaguccugaaggu

SEQ ID NO: 1312272 - RNA, 19 nt, Homo sapiens
ucuaucagcaauuugaaug

SEQ ID NO: 1312273 - RNA, 19 nt, Homo sapiens
caacgccugccaugcuguu

SEQ ID NO: 1312274 - RNA, 19 nt, Homo sapiens
aaaccgggaacagggauuu

SEQ ID NO: 1312275 - RNA, 19 nt, Homo sapiens
gaagaagaggaagaagaag

SEQ ID NO: 1312276 - RNA, 19 nt, Homo sapiens
ugaugaagaagaggaagaa

SEQ ID NO: 1312277 - RNA, 19 nt, Homo sapiens
cucccgugcuguaauaaau

SEQ ID NO: 1312278 - RNA, 19 nt, Homo sapiens
uccauagccucaacauuuu

SEQ ID NO: 1312279 - RNA, 19 nt, Homo sapiens
cuacccacuuuccuaugga

SEQ ID NO: 1312280 - RNA, 19 nt, Homo sapiens
gaugaguccgagagagaug

SEQ ID NO: 1312281 - RNA, 19 nt, Homo sapiens
uggaugaguccgagagaga

SEQ ID NO: 1312282 - RNA, 19 nt, Homo sapiens
ggacuucgaccgcuucauu

SEQ ID NO: 1312283 - RNA, 19 nt, Homo sapiens
gcaguaaaccagcucuuug

SEQ ID NO: 1312284 - RNA, 19 nt, Homo sapiens
ggacugagaaccagagcuu

SEQ ID NO: 1312285 - RNA, 19 nt, Homo sapiens
gauacgugauggugacaga

SEQ ID NO: 1312286 - RNA, 19 nt, Homo sapiens
gaaccagagcuugaaauuc

SEQ ID NO: 1312287 - RNA, 19 nt, Homo sapiens
guaaaccagcucuuuggaa

SEQ ID NO: 1312288 - RNA, 19 nt, Homo sapiens
aaggagcucuucacagcaa

SEQ ID NO: 1312289 - RNA, 19 nt, Homo sapiens
cagaagagaaggugucgau

SEQ ID NO: 1312290 - RNA, 19 nt, Homo sapiens
agaaccagagcuugaaauu

SEQ ID NO: 1312291 - RNA, 19 nt, Homo sapiens
caaagugcguggggccuua

SEQ ID NO: 1312292 - RNA, 19 nt, Homo sapiens
aagcugcgaucccuucaca

SEQ ID NO: 1312293 - RNA, 19 nt, Homo sapiens
gagaaccagagcuugaaau

SEQ ID NO: 1312294 - RNA, 19 nt, Homo sapiens
gauggagagcggcgacgaa

SEQ ID NO: 1312295 - RNA, 19 nt, Homo sapiens
uggagccacugccaacuuc

SEQ ID NO: 1312296 - RNA, 19 nt, Homo sapiens
gauggugacagaagagaag

SEQ ID NO: 1312297 - RNA, 19 nt, Homo sapiens
ccaauaaaggagcucuuca

SEQ ID NO: 1312298 - RNA, 19 nt, Homo sapiens
ggacucgaagugucguuuc

SEQ ID NO: 1312299 - RNA, 19 nt, Homo sapiens
ugagaaccagagcuugaaa

SEQ ID NO: 1312300 - RNA, 19 nt, Homo sapiens
aauaaaggagcucuucaca

SEQ ID NO: 1312301 - RNA, 19 nt, Homo sapiens
gaacaucccuugcuaucug

SEQ ID NO: 1312302 - RNA, 19 nt, Homo sapiens
gagcagauauuguggauuc

SEQ ID NO: 1312303 - RNA, 19 nt, Homo sapiens
uuacaagaaucuccuguua

SEQ ID NO: 1312304 - RNA, 19 nt, Homo sapiens
ggaugacucugauucaauu

SEQ ID NO: 1312305 - RNA, 19 nt, Homo sapiens
gcugagugcuggcagaaua

SEQ ID NO: 1312306 - RNA, 19 nt, Homo sapiens
gaagggauuacaccaaaua

SEQ ID NO: 1312307 - RNA, 19 nt, Homo sapiens
ggaaguguguuacaagaau

SEQ ID NO: 1312308 - RNA, 19 nt, Homo sapiens
aaacguagcuugguaacuu

SEQ ID NO: 1312309 - RNA, 19 nt, Homo sapiens
gaggaaacguagcuuggua

SEQ ID NO: 1312310 - RNA, 19 nt, Homo sapiens
caucagugcuguuguaaug

SEQ ID NO: 1312311 - RNA, 19 nt, Homo sapiens
uaaagggcauucacccaua

SEQ ID NO: 1312312 - RNA, 19 nt, Homo sapiens
ggaccaacaaugagaauaa

SEQ ID NO: 1312313 - RNA, 19 nt, Homo sapiens
ggaagguacuccucagaga

SEQ ID NO: 1312314 - RNA, 19 nt, Homo sapiens
guaaaguuguguuugagaa

SEQ ID NO: 1312315 - RNA, 19 nt, Homo sapiens
gaggaaguguguuacaaga

SEQ ID NO: 1312316 - RNA, 19 nt, Homo sapiens
cauguaaaguuguguuuga

SEQ ID NO: 1312317 - RNA, 19 nt, Homo sapiens
ggaaaagucuucagaaaca

SEQ ID NO: 1312318 - RNA, 19 nt, Homo sapiens
gaacaagacaacagcaguu

SEQ ID NO: 1312319 - RNA, 19 nt, Homo sapiens
aggaagaucugaaagaaga

SEQ ID NO: 1312320 - RNA, 19 nt, Homo sapiens
acaagaaucuccuguuaca

SEQ ID NO: 1312321 - RNA, 19 nt, Homo sapiens
aaaggaaucucgaaacaag

SEQ ID NO: 1312322 - RNA, 19 nt, Homo sapiens
gcaauagaguaaauaaugc

SEQ ID NO: 1312323 - RNA, 19 nt, Homo sapiens
ucagcaagcgguauuauaa

SEQ ID NO: 1312324 - RNA, 19 nt, Homo sapiens
ucauggcugugaauuauuu

SEQ ID NO: 1312325 - RNA, 19 nt, Homo sapiens
gaacaaacggaccaacaau

SEQ ID NO: 1312326 - RNA, 19 nt, Homo sapiens
caaaccagcauuaauguug

SEQ ID NO: 1312327 - RNA, 19 nt, Homo sapiens
gcauguuacucuaauagug

SEQ ID NO: 1312328 - RNA, 19 nt, Homo sapiens
gacaacagcaguuugacua

SEQ ID NO: 1312329 - RNA, 19 nt, Homo sapiens
ggcaauagaguaaauaaug

SEQ ID NO: 1312330 - RNA, 19 nt, Homo sapiens
caagacaacagcaguuuga

SEQ ID NO: 1312331 - RNA, 19 nt, Homo sapiens
cacugcaacuuuacuauuu

SEQ ID NO: 1312332 - RNA, 19 nt, Homo sapiens
gagaacaggaaauacagua

SEQ ID NO: 1312333 - RNA, 19 nt, Homo sapiens
aguagccacugauauguua

SEQ ID NO: 1312334 - RNA, 19 nt, Homo sapiens
auauacaacuggaggauuu

SEQ ID NO: 1312335 - RNA, 19 nt, Homo sapiens
gcacaaugauagaugacau

SEQ ID NO: 1312336 - RNA, 19 nt, Homo sapiens
guucaaaccagcauuaaug

SEQ ID NO: 1312337 - RNA, 19 nt, Homo sapiens
gagaacaccuuucauuuuc

SEQ ID NO: 1312338 - RNA, 19 nt, Homo sapiens
caaaagaugugguggauca

SEQ ID NO: 1312339 - RNA, 19 nt, Homo sapiens
gaagguacuccucagagaa

SEQ ID NO: 1312340 - RNA, 19 nt, Homo sapiens
aacaagaguuucuguaugu

SEQ ID NO: 1312341 - RNA, 19 nt, Homo sapiens
ugacuaagacucagaggaa

SEQ ID NO: 1312342 - RNA, 19 nt, Homo sapiens
ucacuuaucuccgauccaa

SEQ ID NO: 1312343 - RNA, 19 nt, Homo sapiens
gcuggcagaauauguauaa

SEQ ID NO: 1312344 - RNA, 19 nt, Homo sapiens
gaaacaagaauucauuagg

SEQ ID NO: 1312345 - RNA, 19 nt, Homo sapiens
uuaggaagaucugaaagaa

SEQ ID NO: 1312346 - RNA, 19 nt, Homo sapiens
gcauguagauauggcuuug

SEQ ID NO: 1312347 - RNA, 19 nt, Homo sapiens
ggagaacaccuuucauuuu

SEQ ID NO: 1312348 - RNA, 19 nt, Homo sapiens
ucaauaagccagcauguag

SEQ ID NO: 1312349 - RNA, 19 nt, Homo sapiens
gcaaggccaugugaaucuu

SEQ ID NO: 1312350 - RNA, 19 nt, Homo sapiens
ucaagccucuucugaguca

SEQ ID NO: 1312351 - RNA, 19 nt, Homo sapiens
aagaaucuccuguuacaaa

SEQ ID NO: 1312352 - RNA, 19 nt, Homo sapiens
caucaucugugaguuucua

SEQ ID NO: 1312353 - RNA, 19 nt, Homo sapiens
gacuaacaauggaaucaga

SEQ ID NO: 1312354 - RNA, 19 nt, Homo sapiens
gcagauauugguggacuaa

SEQ ID NO: 1312355 - RNA, 19 nt, Homo sapiens
caacaggaauauuggaaaa

SEQ ID NO: 1312356 - RNA, 19 nt, Homo sapiens
acaaacggaccaacaauga

SEQ ID NO: 1312357 - RNA, 19 nt, Homo sapiens
aaaaguagcucccuaacga

SEQ ID NO: 1312358 - RNA, 19 nt, Homo sapiens
ggacacauucucagcauag

SEQ ID NO: 1312359 - RNA, 19 nt, Homo sapiens
gaaguguguuacaagaauc

SEQ ID NO: 1312360 - RNA, 19 nt, Homo sapiens
gacuuuagccgcaguucua

SEQ ID NO: 1312361 - RNA, 19 nt, Homo sapiens
ccucagauuucaacacugu

SEQ ID NO: 1312362 - RNA, 19 nt, Homo sapiens
gggauuacaccaaauauac

SEQ ID NO: 1312363 - RNA, 19 nt, Homo sapiens
gaauguacuuuggagaaca

SEQ ID NO: 1312364 - RNA, 19 nt, Homo sapiens
cacccaaucuuccaacaau

SEQ ID NO: 1312365 - RNA, 19 nt, Homo sapiens
gaaagaagaacaucaaaag

SEQ ID NO: 1312366 - RNA, 19 nt, Homo sapiens
caagaauucauuaggaaga

SEQ ID NO: 1312367 - RNA, 19 nt, Homo sapiens
aaacuuagcagauauacag

SEQ ID NO: 1312368 - RNA, 19 nt, Homo sapiens
gggacacauucucagcaua

SEQ ID NO: 1312369 - RNA, 19 nt, Homo sapiens
caucugugaguuucuauaa

SEQ ID NO: 1312370 - RNA, 19 nt, Homo sapiens
ggcauucacccauaucauu

SEQ ID NO: 1312371 - RNA, 19 nt, Homo sapiens
uugaagggauuacaccaaa

SEQ ID NO: 1312372 - RNA, 19 nt, Homo sapiens
aaagaugacugagacuugu

SEQ ID NO: 1312373 - RNA, 19 nt, Homo sapiens
cuaauaguguuugggauug

SEQ ID NO: 1312374 - RNA, 19 nt, Homo sapiens
caacagcaguuugacuaag

SEQ ID NO: 1312375 - RNA, 19 nt, Homo sapiens
caauuacagugucagaaca

SEQ ID NO: 1312376 - RNA, 19 nt, Homo sapiens
cccaacaccuaccuucaaa

SEQ ID NO: 1312377 - RNA, 19 nt, Homo sapiens
gcaguuugacuaagacuca

SEQ ID NO: 1312378 - RNA, 19 nt, Homo sapiens
ugaguucaaaccagcauua

SEQ ID NO: 1312379 - RNA, 19 nt, Homo sapiens
agacacagccaaagagaga

SEQ ID NO: 1312380 - RNA, 19 nt, Homo sapiens
gacuaagacucagaggaaa

SEQ ID NO: 1312381 - RNA, 19 nt, Homo sapiens
gguauuauaacaccuuuca

SEQ ID NO: 1312382 - RNA, 19 nt, Homo sapiens
gaucucagcaagcgguauu

SEQ ID NO: 1312383 - RNA, 19 nt, Homo sapiens
gcuguaauauaggcccuuu

SEQ ID NO: 1312384 - RNA, 19 nt, Homo sapiens
caaguacagccaaacaaga

SEQ ID NO: 1312385 - RNA, 19 nt, Homo sapiens
ucagcauguuacucuaaua

SEQ ID NO: 1312386 - RNA, 19 nt, Homo sapiens
caucaaaagugucuaggaa

SEQ ID NO: 1312387 - RNA, 19 nt, Homo sapiens
cuaacgagaacaggaaaua

SEQ ID NO: 1312388 - RNA, 19 nt, Homo sapiens
cagauauuguggauucaga

SEQ ID NO: 1312389 - RNA, 19 nt, Homo sapiens
ccucagagcagauauugug

SEQ ID NO: 1312390 - RNA, 19 nt, Homo sapiens
uggagaacaccuuucauuu

SEQ ID NO: 1312391 - RNA, 19 nt, Homo sapiens
auacagggauccagucaca

SEQ ID NO: 1312392 - RNA, 19 nt, Homo sapiens
ugucaaaugcuguggguaa

SEQ ID NO: 1312393 - RNA, 19 nt, Homo sapiens
ggcugugaauuauuuaguu

SEQ ID NO: 1312394 - RNA, 19 nt, Homo sapiens
auaauuggaugucaaaugc

SEQ ID NO: 1312395 - RNA, 19 nt, Homo sapiens
gauauugguggacuaacaa

SEQ ID NO: 1312396 - RNA, 19 nt, Homo sapiens
guagcuugguaacuucuga

SEQ ID NO: 1312397 - RNA, 19 nt, Homo sapiens
uaagccagcauguagauau

SEQ ID NO: 1312398 - RNA, 19 nt, Homo sapiens
uaucugagccaucaucugu

SEQ ID NO: 1312399 - RNA, 19 nt, Homo sapiens
aaagggcauucacccauau

SEQ ID NO: 1312400 - RNA, 19 nt, Homo sapiens
uaaucgaggaaguguguua

SEQ ID NO: 1312401 - RNA, 19 nt, Homo sapiens
caacugagcuccauagauu

SEQ ID NO: 1312402 - RNA, 19 nt, Homo sapiens
gaaauuggcuuccagaaau

SEQ ID NO: 1312403 - RNA, 19 nt, Homo sapiens
gaacaucucucuccaagga

SEQ ID NO: 1312404 - RNA, 19 nt, Homo sapiens
ggaccuagcugggaacuua

SEQ ID NO: 1312405 - RNA, 19 nt, Homo sapiens
ggaauaaucuggcccacuu

SEQ ID NO: 1312406 - RNA, 19 nt, Homo sapiens
gaacugaaguccaucuguu

SEQ ID NO: 1312407 - RNA, 19 nt, Homo sapiens
caacaugucucauaugcaa

SEQ ID NO: 1312408 - RNA, 19 nt, Homo sapiens
gaaagauuaucaagcauug

SEQ ID NO: 1312409 - RNA, 19 nt, Homo sapiens
gaaaucgacuccuucaugu

SEQ ID NO: 1312410 - RNA, 19 nt, Homo sapiens
gggaaaggcuggagucuuc

SEQ ID NO: 1312411 - RNA, 19 nt, Homo sapiens
caccaugccuggcuaauuu

SEQ ID NO: 1312412 - RNA, 19 nt, Homo sapiens
gagauuaaguggcucaguu

SEQ ID NO: 1312413 - RNA, 19 nt, Homo sapiens
ggagagagcguauuucuuc

SEQ ID NO: 1312414 - RNA, 19 nt, Homo sapiens
ccacgaagaucgacagugu

SEQ ID NO: 1312415 - RNA, 19 nt, Homo sapiens
gaagauggaccacgucaug

SEQ ID NO: 1312416 - RNA, 19 nt, Homo sapiens
gaugagaucacggauauaa

SEQ ID NO: 1312417 - RNA, 19 nt, Homo sapiens
gcaacgugauggagagaaa

SEQ ID NO: 1312418 - RNA, 19 nt, Homo sapiens
ucacaaccuugcucuauga

SEQ ID NO: 1312419 - RNA, 19 nt, Homo sapiens
uaccagaauucuacaagua

SEQ ID NO: 1312420 - RNA, 19 nt, Homo sapiens
gcagauguaugaccugauc

SEQ ID NO: 1312421 - RNA, 19 nt, Homo sapiens
aaacaaagcaugucugugu

SEQ ID NO: 1312422 - RNA, 19 nt, Homo sapiens
cagcuguucuccauuauga

SEQ ID NO: 1312423 - RNA, 19 nt, Homo sapiens
ggaaagauuaucaagcauu

SEQ ID NO: 1312424 - RNA, 19 nt, Homo sapiens
guccaucuguuguauaauu

SEQ ID NO: 1312425 - RNA, 19 nt, Homo sapiens
gcucaggaaguaucucuua

SEQ ID NO: 1312426 - RNA, 19 nt, Homo sapiens
agaaaaggcugucugauuu

SEQ ID NO: 1312427 - RNA, 19 nt, Homo sapiens
gcaugucuguguccaaaga

SEQ ID NO: 1312428 - RNA, 19 nt, Homo sapiens
cagcuaagagaacaaguua

SEQ ID NO: 1312429 - RNA, 19 nt, Homo sapiens
ccacuuugaaucagaaaua

SEQ ID NO: 1312430 - RNA, 19 nt, Homo sapiens
uaaauaauaccacccaguu

SEQ ID NO: 1312431 - RNA, 19 nt, Homo sapiens
cgaaauacaagcaccauug

SEQ ID NO: 1312432 - RNA, 19 nt, Homo sapiens
gcuaagagaacaaguuaau

SEQ ID NO: 1312433 - RNA, 19 nt, Homo sapiens
cgaugcaucugaacgcuuu

SEQ ID NO: 1312434 - RNA, 19 nt, Homo sapiens
gagaucacggauauaaaua

SEQ ID NO: 1312435 - RNA, 19 nt, Homo sapiens
ucgaugagaucacggauau

SEQ ID NO: 1312436 - RNA, 19 nt, Homo sapiens
ccaaucacagcaagcauua

SEQ ID NO: 1312437 - RNA, 19 nt, Homo sapiens
gaugagguuucaccauguu

SEQ ID NO: 1312438 - RNA, 19 nt, Homo sapiens
ucacaaagugcugggauua

SEQ ID NO: 1312439 - RNA, 19 nt, Homo sapiens
aaggaaagauuaucaagca

SEQ ID NO: 1312440 - RNA, 19 nt, Homo sapiens
acaaguuaaugaccucuuu

SEQ ID NO: 1312441 - RNA, 19 nt, Homo sapiens
caaggacacucccaaaucg

SEQ ID NO: 1312442 - RNA, 19 nt, Homo sapiens
gcaaacaaagcaugucugu

SEQ ID NO: 1312443 - RNA, 19 nt, Homo sapiens
gaugagaauuucgaugugu

SEQ ID NO: 1312444 - RNA, 19 nt, Homo sapiens
ugggagaaguuacgugaaa

SEQ ID NO: 1312445 - RNA, 19 nt, Homo sapiens
aaagcgaacugacucuguu

SEQ ID NO: 1312446 - RNA, 19 nt, Homo sapiens
gcgauggccugaacuacau

SEQ ID NO: 1312447 - RNA, 19 nt, Homo sapiens
gaaguccaucuguuguaua

SEQ ID NO: 1312448 - RNA, 19 nt, Homo sapiens
ugaaauuggcuuccagaaa

SEQ ID NO: 1312449 - RNA, 19 nt, Homo sapiens
ccacccaguuggccauauu

SEQ ID NO: 1312450 - RNA, 19 nt, Homo sapiens
gcaagcauuaugaccagua

SEQ ID NO: 1312451 - RNA, 19 nt, Homo sapiens
uacagaauauuccaacaug

SEQ ID NO: 1312452 - RNA, 19 nt, Homo sapiens
ggagugcaguggcgugauc

SEQ ID NO: 1312453 - RNA, 19 nt, Homo sapiens
guagcuacccgaaauacaa

SEQ ID NO: 1312454 - RNA, 19 nt, Homo sapiens
gcaacacgguccugaagac

SEQ ID NO: 1312455 - RNA, 19 nt, Homo sapiens
gaaagcgaacugacucugu

SEQ ID NO: 1312456 - RNA, 19 nt, Homo sapiens
ugucucauaugcaaacaaa

SEQ ID NO: 1312457 - RNA, 19 nt, Homo sapiens
gcaccuacaucugcgaaca

SEQ ID NO: 1312458 - RNA, 19 nt, Homo sapiens
ugaaagcgauggccugaac

SEQ ID NO: 1312459 - RNA, 19 nt, Homo sapiens
caaguuaaugaccucuuua

SEQ ID NO: 1312460 - RNA, 19 nt, Homo sapiens
cuaagacgccacuaucaaa

SEQ ID NO: 1312461 - RNA, 19 nt, Homo sapiens
gaaaggcuggagucuucua

SEQ ID NO: 1312462 - RNA, 19 nt, Homo sapiens
caagaccgaauuccagaaa

SEQ ID NO: 1312463 - RNA, 19 nt, Homo sapiens
gaacuacauucccaaaauc

SEQ ID NO: 1312464 - RNA, 19 nt, Homo sapiens
uggaagaaaucgacuccuu

SEQ ID NO: 1312465 - RNA, 19 nt, Homo sapiens
aaguccaucuguuguauaa

SEQ ID NO: 1312466 - RNA, 19 nt, Homo sapiens
ggcuugagcucaguaaugu

SEQ ID NO: 1312467 - RNA, 19 nt, Homo sapiens
gauuaaacagcuaagagaa

SEQ ID NO: 1312468 - RNA, 19 nt, Homo sapiens
gcacgaggagcuccagaug

SEQ ID NO: 1312469 - RNA, 19 nt, Homo sapiens
agaaaucgacuccuucaug

SEQ ID NO: 1312470 - RNA, 19 nt, Homo sapiens
ugaaguccaucuguuguau

SEQ ID NO: 1312471 - RNA, 19 nt, Homo sapiens
gaugguggaugccaauaac

SEQ ID NO: 1312472 - RNA, 19 nt, Homo sapiens
ugagaucacggauauaaau

SEQ ID NO: 1312473 - RNA, 19 nt, Homo sapiens
guccaaagaauauaaccua

SEQ ID NO: 1312474 - RNA, 19 nt, Homo sapiens
gagaaggaaagauuaucaa

SEQ ID NO: 1312475 - RNA, 19 nt, Homo sapiens
ccaaggacacucccaaauc

SEQ ID NO: 1312476 - RNA, 19 nt, Homo sapiens
uuaaacagcuaagagaaca

SEQ ID NO: 1312477 - RNA, 19 nt, Homo sapiens
gugcggaacugaaguccau

SEQ ID NO: 1312478 - RNA, 19 nt, Homo sapiens
caagcauuaugaccaguau

SEQ ID NO: 1312479 - RNA, 19 nt, Homo sapiens
ccaggagggccguguguuu

SEQ ID NO: 1312480 - RNA, 19 nt, Homo sapiens
aagcaugucuguguccaaa

SEQ ID NO: 1312481 - RNA, 19 nt, Homo sapiens
gggauugggagaugacaaa

SEQ ID NO: 1312482 - RNA, 19 nt, Homo sapiens
gacaugacgaugcaucuga

SEQ ID NO: 1312483 - RNA, 19 nt, Homo sapiens
gccaauaacgggcuuguca

SEQ ID NO: 1312484 - RNA, 19 nt, Homo sapiens
ccagugggauucuguacuc

SEQ ID NO: 1312485 - RNA, 19 nt, Homo sapiens
gcuguucuccauuaugaaa

SEQ ID NO: 1312486 - RNA, 19 nt, Homo sapiens
acacgguccugaagacgaa

SEQ ID NO: 1312487 - RNA, 19 nt, Homo sapiens
gcaagggugcggaacugaa

SEQ ID NO: 1312488 - RNA, 19 nt, Homo sapiens
acaaagugcugggauuaca

SEQ ID NO: 1312489 - RNA, 19 nt, Homo sapiens
guacagaauauuccaacau

SEQ ID NO: 1312490 - RNA, 19 nt, Homo sapiens
aaggcugucugauuucaaa

SEQ ID NO: 1312491 - RNA, 19 nt, Homo sapiens
ugacuguuccagauaauga

SEQ ID NO: 1312492 - RNA, 19 nt, Homo sapiens
ugaaguccgugaacuggau

SEQ ID NO: 1312493 - RNA, 19 nt, Homo sapiens
cauauucuaucgcaaucga

SEQ ID NO: 1312494 - RNA, 19 nt, Homo sapiens
uaguagagaugagguuuca

SEQ ID NO: 1312495 - RNA, 19 nt, Homo sapiens
gaaauacaagcaccauugc

SEQ ID NO: 1312496 - RNA, 19 nt, Homo sapiens
ugucugauuucaaacucua

SEQ ID NO: 1312497 - RNA, 19 nt, Homo sapiens
agacucauuugacgaggaa

SEQ ID NO: 1312498 - RNA, 19 nt, Homo sapiens
guugcgggcucgugcuaaa

SEQ ID NO: 1312499 - RNA, 19 nt, Homo sapiens
gggcuugagcucaguaaug

SEQ ID NO: 1312500 - RNA, 19 nt, Homo sapiens
gaauaaucuggcccacuuu

SEQ ID NO: 1312501 - RNA, 19 nt, Homo sapiens
gaaauggagucugcaauua

SEQ ID NO: 1312502 - RNA, 19 nt, Homo sapiens
gagaaauccucuacaauaa

SEQ ID NO: 1312503 - RNA, 19 nt, Homo sapiens
ggagaaauccucuacaaua

SEQ ID NO: 1312504 - RNA, 19 nt, Homo sapiens
ggaagaagcuaauggagau

SEQ ID NO: 1312505 - RNA, 19 nt, Homo sapiens
gaaccaaagugccuagaga

SEQ ID NO: 1312506 - RNA, 19 nt, Homo sapiens
gaacuggacucucucaucu

SEQ ID NO: 1312507 - RNA, 19 nt, Homo sapiens
gaaagcagcugugacaaca

SEQ ID NO: 1312508 - RNA, 19 nt, Homo sapiens
ggaaaccuguauauucaaa

SEQ ID NO: 1312509 - RNA, 19 nt, Homo sapiens
uaaaggacauuguucucua

SEQ ID NO: 1312510 - RNA, 19 nt, Homo sapiens
ggacuaugaugcacucuuc

SEQ ID NO: 1312511 - RNA, 19 nt, Homo sapiens
uacaauaacuuccucuuug

SEQ ID NO: 1312512 - RNA, 19 nt, Homo sapiens
ugacaugccucuccuggaa

SEQ ID NO: 1312513 - RNA, 19 nt, Homo sapiens
cuucaggucuucagcaaua

SEQ ID NO: 1312514 - RNA, 19 nt, Homo sapiens
gaaauccucuacaauaacu

SEQ ID NO: 1312515 - RNA, 19 nt, Homo sapiens
ggaguuugcugaacgacaa

SEQ ID NO: 1312516 - RNA, 19 nt, Homo sapiens
uuacacagcagccaaguua

SEQ ID NO: 1312517 - RNA, 19 nt, Homo sapiens
ggacauuguucucuaccuu

SEQ ID NO: 1312518 - RNA, 19 nt, Homo sapiens
ggaauuaaaggacauuguu

SEQ ID NO: 1312519 - RNA, 19 nt, Homo sapiens
ccaaagaucacuucauuuc

SEQ ID NO: 1312520 - RNA, 19 nt, Homo sapiens
gagcaggugaucaacaaua

SEQ ID NO: 1312521 - RNA, 19 nt, Homo sapiens
acaauaacuuccucuuuga

SEQ ID NO: 1312522 - RNA, 19 nt, Homo sapiens
gaacacacagugccuuaug

SEQ ID NO: 1312523 - RNA, 19 nt, Homo sapiens
caggaaagcugaggacuuc

SEQ ID NO: 1312524 - RNA, 19 nt, Homo sapiens
ggaaagccacagaugcuaa

SEQ ID NO: 1312525 - RNA, 19 nt, Homo sapiens
ggccuugccucacgauaaa

SEQ ID NO: 1312526 - RNA, 19 nt, Homo sapiens
ggaggaggaugacgacgau

SEQ ID NO: 1312527 - RNA, 19 nt, Homo sapiens
cagacuagcuuccuucuac

SEQ ID NO: 1312528 - RNA, 19 nt, Homo sapiens
cagagcaggugaucaacaa

SEQ ID NO: 1312529 - RNA, 19 nt, Homo sapiens
gaaagccacagaugcuaaa

SEQ ID NO: 1312530 - RNA, 19 nt, Homo sapiens
cgaaauggagucugcaauu

SEQ ID NO: 1312531 - RNA, 19 nt, Homo sapiens
agaagugccuggacuccua

SEQ ID NO: 1312532 - RNA, 19 nt, Homo sapiens
gcagaaggcagaccgguau

SEQ ID NO: 1312533 - RNA, 19 nt, Homo sapiens
ggaacgcgccaccuucgua

SEQ ID NO: 1312534 - RNA, 19 nt, Homo sapiens
caaccuagacagagaaaug

SEQ ID NO: 1312535 - RNA, 19 nt, Homo sapiens
ggaagaaggaagccaacaa

SEQ ID NO: 1312536 - RNA, 19 nt, Homo sapiens
agaggaggcuugaagauag

SEQ ID NO: 1312537 - RNA, 19 nt, Homo sapiens
gaagaaggaagccaacaag

SEQ ID NO: 1312538 - RNA, 19 nt, Homo sapiens
ucucucaucucccaaguga

SEQ ID NO: 1312539 - RNA, 19 nt, Homo sapiens
aagcagcugugacaacauu

SEQ ID NO: 1312540 - RNA, 19 nt, Homo sapiens
uaggaaacaucuuuacaca

SEQ ID NO: 1312541 - RNA, 19 nt, Homo sapiens
cagaagcgccuccaucgaa

SEQ ID NO: 1312542 - RNA, 19 nt, Homo sapiens
ugacgagacucuacagaag

SEQ ID NO: 1312543 - RNA, 19 nt, Homo sapiens
cagcugcgcuagcgggaaa

SEQ ID NO: 1312544 - RNA, 19 nt, Homo sapiens
gaagaggaggcuugaagau

SEQ ID NO: 1312545 - RNA, 19 nt, Homo sapiens
ggugccaggugaucuuuga

SEQ ID NO: 1312546 - RNA, 19 nt, Homo sapiens
cagcaggccucaucagucu

SEQ ID NO: 1312547 - RNA, 19 nt, Homo sapiens
uccagaagaugauaggaaa

SEQ ID NO: 1312548 - RNA, 19 nt, Homo sapiens
aaauggagucugcaauuaa

SEQ ID NO: 1312549 - RNA, 19 nt, Homo sapiens
auccaaagaucacuucauu

SEQ ID NO: 1312550 - RNA, 19 nt, Homo sapiens
ggaaagagauggggaugga

SEQ ID NO: 1312551 - RNA, 19 nt, Homo sapiens
cacaacgucuuccagaaug

SEQ ID NO: 1312552 - RNA, 19 nt, Homo sapiens
gaugaaacccugccuacca

SEQ ID NO: 1312553 - RNA, 19 nt, Homo sapiens
uaacuuccucuuugacauu

SEQ ID NO: 1312554 - RNA, 19 nt, Homo sapiens
cuacaauaacuuccucuuu

SEQ ID NO: 1312555 - RNA, 19 nt, Homo sapiens
cagaacacacagugccuua

SEQ ID NO: 1312556 - RNA, 19 nt, Homo sapiens
ugaguacgaugacacauac

SEQ ID NO: 1312557 - RNA, 19 nt, Homo sapiens
ugacgaguuugauguguuc

SEQ ID NO: 1312558 - RNA, 19 nt, Homo sapiens
gaauuaaaggacauuguuc

SEQ ID NO: 1312559 - RNA, 19 nt, Homo sapiens
gcagccaaguuacuacagu

SEQ ID NO: 1312560 - RNA, 19 nt, Homo sapiens
ccacugcuccagaagauga

SEQ ID NO: 1312561 - RNA, 19 nt, Homo sapiens
gauaggaaacaucuuuaca

SEQ ID NO: 1312562 - RNA, 19 nt, Homo sapiens
ggaugacgacgaugaggaa

SEQ ID NO: 1312563 - RNA, 19 nt, Homo sapiens
ccacaacgucuuccagaau

SEQ ID NO: 1312564 - RNA, 19 nt, Homo sapiens
gccacaacgucuuccagaa

SEQ ID NO: 1312565 - RNA, 19 nt, Homo sapiens
ggaacuggacucucucauc

SEQ ID NO: 1312566 - RNA, 19 nt, Homo sapiens
gacaagagccaaccacaac

SEQ ID NO: 1312567 - RNA, 19 nt, Homo sapiens
aagcagcaauucccgaaau

SEQ ID NO: 1312568 - RNA, 19 nt, Homo sapiens
agacaccacuuccccuuua

SEQ ID NO: 1312569 - RNA, 19 nt, Homo sapiens
gaaugacgaguuugaugug

SEQ ID NO: 1312570 - RNA, 19 nt, Homo sapiens
ggcagucagucaagcauca

SEQ ID NO: 1312571 - RNA, 19 nt, Homo sapiens
cuagaaagcagcugugaca

SEQ ID NO: 1312572 - RNA, 19 nt, Homo sapiens
aagaggaggcuugaagaua

SEQ ID NO: 1312573 - RNA, 19 nt, Homo sapiens
acagugaccuggaugaaac

SEQ ID NO: 1312574 - RNA, 19 nt, Homo sapiens
ggguggaacuggacucucu

SEQ ID NO: 1312575 - RNA, 19 nt, Homo sapiens
caucaucacauccggagaa

SEQ ID NO: 1312576 - RNA, 19 nt, Homo sapiens
cuggauaucuucccuuugg

SEQ ID NO: 1312577 - RNA, 19 nt, Homo sapiens
ggaccgcaaccuagacaga

SEQ ID NO: 1312578 - RNA, 19 nt, Homo sapiens
cagcagaggcagucaguca

SEQ ID NO: 1312579 - RNA, 19 nt, Homo sapiens
gcaggccucaucagucuug

SEQ ID NO: 1312580 - RNA, 19 nt, Homo sapiens
cgacaagagccaaccacaa

SEQ ID NO: 1312581 - RNA, 19 nt, Homo sapiens
uggccugccuggaguacua

SEQ ID NO: 1312582 - RNA, 19 nt, Homo sapiens
gcacgacuuuuguuacaga

SEQ ID NO: 1312583 - RNA, 19 nt, Homo sapiens
gacauuguucucuaccuuu

SEQ ID NO: 1312584 - RNA, 19 nt, Homo sapiens
uuggagaaauccucuacaa

SEQ ID NO: 1312585 - RNA, 19 nt, Homo sapiens
ggaauccaaagaucacuuc

SEQ ID NO: 1312586 - RNA, 19 nt, Homo sapiens
ccaccuucguagccaauga

SEQ ID NO: 1312587 - RNA, 19 nt, Homo sapiens
uaaagacccaucggugauu

SEQ ID NO: 1312588 - RNA, 19 nt, Homo sapiens
guucucuaccuuugugaua

SEQ ID NO: 1312589 - RNA, 19 nt, Homo sapiens
caccacugcuccagaagau

SEQ ID NO: 1312590 - RNA, 19 nt, Homo sapiens
ggaccucugcgugcucuuu

SEQ ID NO: 1312591 - RNA, 19 nt, Homo sapiens
aaagacccaucggugauug

SEQ ID NO: 1312592 - RNA, 19 nt, Homo sapiens
gaagcagcaauucccgaaa

SEQ ID NO: 1312593 - RNA, 19 nt, Homo sapiens
gggccuuucuggauaucuu

SEQ ID NO: 1312594 - RNA, 19 nt, Homo sapiens
gauaccugcaccacacuuu

SEQ ID NO: 1312595 - RNA, 19 nt, Homo sapiens
gcaagagcaccaggaagga

SEQ ID NO: 1312596 - RNA, 19 nt, Homo sapiens
cuuccagaaugacgaguuu

SEQ ID NO: 1312597 - RNA, 19 nt, Homo sapiens
agaccgguauuuuguguua

SEQ ID NO: 1312598 - RNA, 19 nt, Homo sapiens
ccaggaagaagcuaaugga

SEQ ID NO: 1312599 - RNA, 19 nt, Homo sapiens
acaugccucuccuggaauu

SEQ ID NO: 1312600 - RNA, 19 nt, Homo sapiens
acucaccacugcuccagaa

SEQ ID NO: 1312601 - RNA, 19 nt, Homo sapiens
gaacaagaauuccacauga

SEQ ID NO: 1312602 - RNA, 19 nt, Homo sapiens
ggaaggaacuuauauaaca

SEQ ID NO: 1312603 - RNA, 19 nt, Homo sapiens
caagauaccuguagaaaga

SEQ ID NO: 1312604 - RNA, 19 nt, Homo sapiens
caaggaagcuaguauuuaa

SEQ ID NO: 1312605 - RNA, 19 nt, Homo sapiens
gaucacaaguggacaaauu

SEQ ID NO: 1312606 - RNA, 19 nt, Homo sapiens
gaugaggagugacagaaua

SEQ ID NO: 1312607 - RNA, 19 nt, Homo sapiens
gaacaacuuuaucaaggaa

SEQ ID NO: 1312608 - RNA, 19 nt, Homo sapiens
gaacauggaaugccugaaa

SEQ ID NO: 1312609 - RNA, 19 nt, Homo sapiens
caacuuaaacgccacauaa

SEQ ID NO: 1312610 - RNA, 19 nt, Homo sapiens
gaauguggcuuucuucagu

SEQ ID NO: 1312611 - RNA, 19 nt, Homo sapiens
ggaagaagaacaagaauuc

SEQ ID NO: 1312612 - RNA, 19 nt, Homo sapiens
guacggaaauuuaggguau

SEQ ID NO: 1312613 - RNA, 19 nt, Homo sapiens
uaaaacagcuccuaauuga

SEQ ID NO: 1312614 - RNA, 19 nt, Homo sapiens
gaggcuauuugaugacaua

SEQ ID NO: 1312615 - RNA, 19 nt, Homo sapiens
gcugaugucuaugguguua

SEQ ID NO: 1312616 - RNA, 19 nt, Homo sapiens
ggagaaagacuguuaagag

SEQ ID NO: 1312617 - RNA, 19 nt, Homo sapiens
gaauauauugcaggcauua

SEQ ID NO: 1312618 - RNA, 19 nt, Homo sapiens
gagcucagaugaugaugau

SEQ ID NO: 1312619 - RNA, 19 nt, Homo sapiens
guaaggguacuguauguaa

SEQ ID NO: 1312620 - RNA, 19 nt, Homo sapiens
ggaaaacaguuguggaauu

SEQ ID NO: 1312621 - RNA, 19 nt, Homo sapiens
gaauccagcugaagggaau

SEQ ID NO: 1312622 - RNA, 19 nt, Homo sapiens
gauagacaguaaacuugaa

SEQ ID NO: 1312623 - RNA, 19 nt, Homo sapiens
uaaacaaacacucaacgua

SEQ ID NO: 1312624 - RNA, 19 nt, Homo sapiens
gaucaugagcuguuucuug

SEQ ID NO: 1312625 - RNA, 19 nt, Homo sapiens
cuacaggguugcucuaaga

SEQ ID NO: 1312626 - RNA, 19 nt, Homo sapiens
gcugaagauuggaauacua

SEQ ID NO: 1312627 - RNA, 19 nt, Homo sapiens
ggaacaaugaaguagaaua

SEQ ID NO: 1312628 - RNA, 19 nt, Homo sapiens
gaagaacaacuuuaucaag

SEQ ID NO: 1312629 - RNA, 19 nt, Homo sapiens
ucaaggaagcuaguauuua

SEQ ID NO: 1312630 - RNA, 19 nt, Homo sapiens
uaaggguacuguauguaaa

SEQ ID NO: 1312631 - RNA, 19 nt, Homo sapiens
gcuauuugaugacauaaca

SEQ ID NO: 1312632 - RNA, 19 nt, Homo sapiens
gauggcaccuuggaaagaa

SEQ ID NO: 1312633 - RNA, 19 nt, Homo sapiens
gaauuccacaugagaagua

SEQ ID NO: 1312634 - RNA, 19 nt, Homo sapiens
agaggaggcuauuugauga

SEQ ID NO: 1312635 - RNA, 19 nt, Homo sapiens
ggaauauauugcaggcauu

SEQ ID NO: 1312636 - RNA, 19 nt, Homo sapiens
guggaauucuuacuucauu

SEQ ID NO: 1312637 - RNA, 19 nt, Homo sapiens
ccaggagacucacaucuuc

SEQ ID NO: 1312638 - RNA, 19 nt, Homo sapiens
gguccgaugugccaaguga

SEQ ID NO: 1312639 - RNA, 19 nt, Homo sapiens
gaaaacaguuguggaauuc

SEQ ID NO: 1312640 - RNA, 19 nt, Homo sapiens
cagcagauagcaacucuuu

SEQ ID NO: 1312641 - RNA, 19 nt, Homo sapiens
uaaagaaccaccucguuug

SEQ ID NO: 1312642 - RNA, 19 nt, Homo sapiens
caagugagcauagcuauca

SEQ ID NO: 1312643 - RNA, 19 nt, Homo sapiens
ggucaggacuguaaaucuc

SEQ ID NO: 1312644 - RNA, 19 nt, Homo sapiens
guuaagaggaggcuauuug

SEQ ID NO: 1312645 - RNA, 19 nt, Homo sapiens
gaucaugauucugcuggaa

SEQ ID NO: 1312646 - RNA, 19 nt, Homo sapiens
ggagugacagaauaucaaa

SEQ ID NO: 1312647 - RNA, 19 nt, Homo sapiens
uaaaggaucaugagcuguu

SEQ ID NO: 1312648 - RNA, 19 nt, Homo sapiens
aaggaacaaugaaguagaa

SEQ ID NO: 1312649 - RNA, 19 nt, Homo sapiens
aaacagcuccuaauugaca

SEQ ID NO: 1312650 - RNA, 19 nt, Homo sapiens
guacagaaccauaaagaac

SEQ ID NO: 1312651 - RNA, 19 nt, Homo sapiens
gaauuggugguuaacauga

SEQ ID NO: 1312652 - RNA, 19 nt, Homo sapiens
aaacaguuguggaauucuu

SEQ ID NO: 1312653 - RNA, 19 nt, Homo sapiens
acuaagggauuucaaguuc

SEQ ID NO: 1312654 - RNA, 19 nt, Homo sapiens
gugaacacuuaaugaaaga

SEQ ID NO: 1312655 - RNA, 19 nt, Homo sapiens
ggauggaccuaauagaaaa

SEQ ID NO: 1312656 - RNA, 19 nt, Homo sapiens
uaacaagugagcauagcua

SEQ ID NO: 1312657 - RNA, 19 nt, Homo sapiens
uauacgaauuggugguuaa

SEQ ID NO: 1312658 - RNA, 19 nt, Homo sapiens
uggcuaaguggauaauuua

SEQ ID NO: 1312659 - RNA, 19 nt, Homo sapiens
gggcaaaguacagcagaua

SEQ ID NO: 1312660 - RNA, 19 nt, Homo sapiens
caggauggaccuaauagaa

SEQ ID NO: 1312661 - RNA, 19 nt, Homo sapiens
ccagcuguacggaaauuua

SEQ ID NO: 1312662 - RNA, 19 nt, Homo sapiens
cgugauggcuaaguggaua

SEQ ID NO: 1312663 - RNA, 19 nt, Homo sapiens
gagcauagcuaucaaaagc

SEQ ID NO: 1312664 - RNA, 19 nt, Homo sapiens
auaaagaaccaccucguuu

SEQ ID NO: 1312665 - RNA, 19 nt, Homo sapiens
gaaaagaccaagaucaaau

SEQ ID NO: 1312666 - RNA, 19 nt, Homo sapiens
agaaauauguacagaacca

SEQ ID NO: 1312667 - RNA, 19 nt, Homo sapiens
ccacauauccuaaaauuuc

SEQ ID NO: 1312668 - RNA, 19 nt, Homo sapiens
ugagcaagcugcaaaugag

SEQ ID NO: 1312669 - RNA, 19 nt, Homo sapiens
agaacaacuuuaucaagga

SEQ ID NO: 1312670 - RNA, 19 nt, Homo sapiens
gcagcucaaucuccuuaca

SEQ ID NO: 1312671 - RNA, 19 nt, Homo sapiens
caaguggacaaauuucuga

SEQ ID NO: 1312672 - RNA, 19 nt, Homo sapiens
gaagauuggaauacuaaag

SEQ ID NO: 1312673 - RNA, 19 nt, Homo sapiens
cagcugggaugaggaguga

SEQ ID NO: 1312674 - RNA, 19 nt, Homo sapiens
gcaggcauuaagcucauua

SEQ ID NO: 1312675 - RNA, 19 nt, Homo sapiens
gcucagaugaugaugaugu

SEQ ID NO: 1312676 - RNA, 19 nt, Homo sapiens
ggccuuauauuuugaugua

SEQ ID NO: 1312677 - RNA, 19 nt, Homo sapiens
cacuguacauucagauauu

SEQ ID NO: 1312678 - RNA, 19 nt, Homo sapiens
ugauccagcuguacggaaa

SEQ ID NO: 1312679 - RNA, 19 nt, Homo sapiens
gccaaggaacaaugaagua

SEQ ID NO: 1312680 - RNA, 19 nt, Homo sapiens
guaaguguguaugcuuguu

SEQ ID NO: 1312681 - RNA, 19 nt, Homo sapiens
acaguuugauccugaguau

SEQ ID NO: 1312682 - RNA, 19 nt, Homo sapiens
cagcaggauggaccuaaua

SEQ ID NO: 1312683 - RNA, 19 nt, Homo sapiens
caagaauuccacaugagaa

SEQ ID NO: 1312684 - RNA, 19 nt, Homo sapiens
guuguggaauucuuacuuc

SEQ ID NO: 1312685 - RNA, 19 nt, Homo sapiens
uguguuauaugccaaggaa

SEQ ID NO: 1312686 - RNA, 19 nt, Homo sapiens
caaucuccuuacacacaua

SEQ ID NO: 1312687 - RNA, 19 nt, Homo sapiens
ggcuacagcugaagauugg

SEQ ID NO: 1312688 - RNA, 19 nt, Homo sapiens
gaugaugauguuaguaguu

SEQ ID NO: 1312689 - RNA, 19 nt, Homo sapiens
ccugggagcucagaugaug

SEQ ID NO: 1312690 - RNA, 19 nt, Homo sapiens
ugaaaccaaaggcaacuaa

SEQ ID NO: 1312691 - RNA, 19 nt, Homo sapiens
gaugacauaacacuugaau

SEQ ID NO: 1312692 - RNA, 19 nt, Homo sapiens
ugaguaugcuugguguuug

SEQ ID NO: 1312693 - RNA, 19 nt, Homo sapiens
gccaagugaucaugauucu

SEQ ID NO: 1312694 - RNA, 19 nt, Homo sapiens
cauaaagaaccaccucguu

SEQ ID NO: 1312695 - RNA, 19 nt, Homo sapiens
gggcuacagcugaagauug

SEQ ID NO: 1312696 - RNA, 19 nt, Homo sapiens
caaggaacaaugaaguaga

SEQ ID NO: 1312697 - RNA, 19 nt, Homo sapiens
gaggagugacagaauauca

SEQ ID NO: 1312698 - RNA, 19 nt, Homo sapiens
uaauugacaugggcaaagu

SEQ ID NO: 1312699 - RNA, 19 nt, Homo sapiens
ccacuguacauucagauau

SEQ ID NO: 1312700 - RNA, 19 nt, Homo sapiens
aagaggaggcuauuugaug

SEQ ID NO: 1312701 - RNA, 19 nt, Homo sapiens
gagcagagcuuccggauuc

SEQ ID NO: 1312702 - RNA, 19 nt, Homo sapiens
gaagaacgcugaccaaguc

SEQ ID NO: 1312703 - RNA, 19 nt, Homo sapiens
ggaaccagcuggaagauga

SEQ ID NO: 1312704 - RNA, 19 nt, Homo sapiens
ggaaauggaugcuaaagag

SEQ ID NO: 1312705 - RNA, 19 nt, Homo sapiens
caacugcccuuccacaauu

SEQ ID NO: 1312706 - RNA, 19 nt, Homo sapiens
ggagagggcugcauuucuu

SEQ ID NO: 1312707 - RNA, 19 nt, Homo sapiens
ggaugaggcugacacauug

SEQ ID NO: 1312708 - RNA, 19 nt, Homo sapiens
caacaugacucagcucuau

SEQ ID NO: 1312709 - RNA, 19 nt, Homo sapiens
gagcuggacuugucuaaca

SEQ ID NO: 1312710 - RNA, 19 nt, Homo sapiens
ucucugagcugaagacauu

SEQ ID NO: 1312711 - RNA, 19 nt, Homo sapiens
gaguggaccuggagaagaa

SEQ ID NO: 1312712 - RNA, 19 nt, Homo sapiens
caacagcauuucucaggaa

SEQ ID NO: 1312713 - RNA, 19 nt, Homo sapiens
agaaucagaucacagcuuu

SEQ ID NO: 1312714 - RNA, 19 nt, Homo sapiens
gagaucagcuuggcggaaa

SEQ ID NO: 1312715 - RNA, 19 nt, Homo sapiens
acacuuacccaguauguua

SEQ ID NO: 1312716 - RNA, 19 nt, Homo sapiens
gcaagaagcagcagcuaga

SEQ ID NO: 1312717 - RNA, 19 nt, Homo sapiens
gcaauuguccugugaguuc

SEQ ID NO: 1312718 - RNA, 19 nt, Homo sapiens
ccucugagcucccgaagga

SEQ ID NO: 1312719 - RNA, 19 nt, Homo sapiens
agagacaacugcagagcua

SEQ ID NO: 1312720 - RNA, 19 nt, Homo sapiens
gggaagacacucaggcuaa

SEQ ID NO: 1312721 - RNA, 19 nt, Homo sapiens
ugacucagcucuauaugca

SEQ ID NO: 1312722 - RNA, 19 nt, Homo sapiens
aaacugugaucuucauguu

SEQ ID NO: 1312723 - RNA, 19 nt, Homo sapiens
ggagaagaaucagaucaca

SEQ ID NO: 1312724 - RNA, 19 nt, Homo sapiens
ggaagagaauccagaagcu

SEQ ID NO: 1312725 - RNA, 19 nt, Homo sapiens
gacaagacaagcagggaua

SEQ ID NO: 1312726 - RNA, 19 nt, Homo sapiens
gcagacaggcuaugcuuuc

SEQ ID NO: 1312727 - RNA, 19 nt, Homo sapiens
guccacagcugaaagaagu

SEQ ID NO: 1312728 - RNA, 19 nt, Homo sapiens
gguaggcugugggcagaua

SEQ ID NO: 1312729 - RNA, 19 nt, Homo sapiens
guacagcggaccaaagcua

SEQ ID NO: 1312730 - RNA, 19 nt, Homo sapiens
gcuggacuuugccuucuuu

SEQ ID NO: 1312731 - RNA, 19 nt, Homo sapiens
gaccugguuuccuguaaga

SEQ ID NO: 1312732 - RNA, 19 nt, Homo sapiens
uagaggagcuggacuugag

SEQ ID NO: 1312733 - RNA, 19 nt, Homo sapiens
aagguuaucuucuaugcaa

SEQ ID NO: 1312734 - RNA, 19 nt, Homo sapiens
ggaagacacucaggcuaag

SEQ ID NO: 1312735 - RNA, 19 nt, Homo sapiens
aagacacacuuacccagua

SEQ ID NO: 1312736 - RNA, 19 nt, Homo sapiens
gaacaaagacacacuuacc

SEQ ID NO: 1312737 - RNA, 19 nt, Homo sapiens
gagcaucucggaccucuuc

SEQ ID NO: 1312738 - RNA, 19 nt, Homo sapiens
ccugugaguuccugaguga

SEQ ID NO: 1312739 - RNA, 19 nt, Homo sapiens
accaucaucuuccuucuuu

SEQ ID NO: 1312740 - RNA, 19 nt, Homo sapiens
ggaacaguaucggugaugu

SEQ ID NO: 1312741 - RNA, 19 nt, Homo sapiens
cuguggagcugucuuguga

SEQ ID NO: 1312742 - RNA, 19 nt, Homo sapiens
acugugaucuucauguuug

SEQ ID NO: 1312743 - RNA, 19 nt, Homo sapiens
gcuccacccuugauagcuu

SEQ ID NO: 1312744 - RNA, 19 nt, Homo sapiens
ggcagucuuucauucauug

SEQ ID NO: 1312745 - RNA, 19 nt, Homo sapiens
gugaacaaagacacacuua

SEQ ID NO: 1312746 - RNA, 19 nt, Homo sapiens
ggagaagaacgcugaccaa

SEQ ID NO: 1312747 - RNA, 19 nt, Homo sapiens
gaggugcuucugcuaagua

SEQ ID NO: 1312748 - RNA, 19 nt, Homo sapiens
uaaucuugcuguccuggaa

SEQ ID NO: 1312749 - RNA, 19 nt, Homo sapiens
ggaccucagucaccuucug

SEQ ID NO: 1312750 - RNA, 19 nt, Homo sapiens
gaggggaaauggaugcuaa

SEQ ID NO: 1312751 - RNA, 19 nt, Homo sapiens
uggaggagcuggacuuguc

SEQ ID NO: 1312752 - RNA, 19 nt, Homo sapiens
gcacucagguuggcucacu

SEQ ID NO: 1312753 - RNA, 19 nt, Homo sapiens
gggaaauggaugcuaaaga

SEQ ID NO: 1312754 - RNA, 19 nt, Homo sapiens
caacuuugcacuucagauc

SEQ ID NO: 1312755 - RNA, 19 nt, Homo sapiens
caacagcaucugcguguca

SEQ ID NO: 1312756 - RNA, 19 nt, Homo sapiens
gcacaaagccuccccuauc

SEQ ID NO: 1312757 - RNA, 19 nt, Homo sapiens
gugcagguguugaagaagu

SEQ ID NO: 1312758 - RNA, 19 nt, Homo sapiens
uagugcagguguugaagaa

SEQ ID NO: 1312759 - RNA, 19 nt, Homo sapiens
gcagggcaaugaggacugu

SEQ ID NO: 1312760 - RNA, 19 nt, Homo sapiens
gacuuugccuucuuugaca

SEQ ID NO: 1312761 - RNA, 19 nt, Homo sapiens
auagaccucucagggaaua

SEQ ID NO: 1312762 - RNA, 19 nt, Homo sapiens
uccaggagcuugccgacaa

SEQ ID NO: 1312763 - RNA, 19 nt, Homo sapiens
ugccagagcucaggaagau

SEQ ID NO: 1312764 - RNA, 19 nt, Homo sapiens
caccaaagacccagaaugg

SEQ ID NO: 1312765 - RNA, 19 nt, Homo sapiens
gcuuggacaucagcuuuga

SEQ ID NO: 1312766 - RNA, 19 nt, Homo sapiens
gggacaaccagcucaguga

SEQ ID NO: 1312767 - RNA, 19 nt, Homo sapiens
agacacacuuacccaguau

SEQ ID NO: 1312768 - RNA, 19 nt, Homo sapiens
gguggaagaauaugugaau

SEQ ID NO: 1312769 - RNA, 19 nt, Homo sapiens
gaagcagcagcuagaguug

SEQ ID NO: 1312770 - RNA, 19 nt, Homo sapiens
gucauccgccucuggaaua

SEQ ID NO: 1312771 - RNA, 19 nt, Homo sapiens
gcccugcccuggaaguaau

SEQ ID NO: 1312772 - RNA, 19 nt, Homo sapiens
ccuguaagauugacaacca

SEQ ID NO: 1312773 - RNA, 19 nt, Homo sapiens
cagugaaccugggcucuga

SEQ ID NO: 1312774 - RNA, 19 nt, Homo sapiens
gcucacagggccaaagguu

SEQ ID NO: 1312775 - RNA, 19 nt, Homo sapiens
uagaguuggccaagaagua

SEQ ID NO: 1312776 - RNA, 19 nt, Homo sapiens
ggacuuugccuucuuugac

SEQ ID NO: 1312777 - RNA, 19 nt, Homo sapiens
ggacagagccaggguucuc

SEQ ID NO: 1312778 - RNA, 19 nt, Homo sapiens
cauuguggccuccaagaaa

SEQ ID NO: 1312779 - RNA, 19 nt, Homo sapiens
gaccaaguccugcugaucu

SEQ ID NO: 1312780 - RNA, 19 nt, Homo sapiens
gcaccaaggcgcugaugag

SEQ ID NO: 1312781 - RNA, 19 nt, Homo sapiens
gcugugggcagauagagaa

SEQ ID NO: 1312782 - RNA, 19 nt, Homo sapiens
ucacagggccaaagguugu

SEQ ID NO: 1312783 - RNA, 19 nt, Homo sapiens
agaagcagcagcuagaguu

SEQ ID NO: 1312784 - RNA, 19 nt, Homo sapiens
agacagauagaccugguuu

SEQ ID NO: 1312785 - RNA, 19 nt, Homo sapiens
gauauugcuccacccuuga

SEQ ID NO: 1312786 - RNA, 19 nt, Homo sapiens
ggaggugcuucugcuaagu

SEQ ID NO: 1312787 - RNA, 19 nt, Homo sapiens
uagaccugguuuccuguaa

SEQ ID NO: 1312788 - RNA, 19 nt, Homo sapiens
gguccugcguuucuguaug

SEQ ID NO: 1312789 - RNA, 19 nt, Homo sapiens
ggagugcaguuggcagagu

SEQ ID NO: 1312790 - RNA, 19 nt, Homo sapiens
ccagagcucaggaagauag

SEQ ID NO: 1312791 - RNA, 19 nt, Homo sapiens
gucgguugcugccaccuuu

SEQ ID NO: 1312792 - RNA, 19 nt, Homo sapiens
gaacaguaucggugauguc

SEQ ID NO: 1312793 - RNA, 19 nt, Homo sapiens
gcuaaguacuuuuggcuau

SEQ ID NO: 1312794 - RNA, 19 nt, Homo sapiens
gaaccagcuggaagaugaa

SEQ ID NO: 1312795 - RNA, 19 nt, Homo sapiens
ugucaacccuacucugcuu

SEQ ID NO: 1312796 - RNA, 19 nt, Homo sapiens
ggaguuacagacaaaugga

SEQ ID NO: 1312797 - RNA, 19 nt, Homo sapiens
ggaagcagugcaagaagca

SEQ ID NO: 1312798 - RNA, 19 nt, Homo sapiens
gguccuacaccuaccauuc

SEQ ID NO: 1312799 - RNA, 19 nt, Homo sapiens
ccaggaagagaauccagaa

SEQ ID NO: 1312800 - RNA, 19 nt, Homo sapiens
aggaugaggcugacacauu

SEQ ID NO: 1312801 - RNA, 19 nt, Homo sapiens
gaaagaaccugcuagaaca

SEQ ID NO: 1312802 - RNA, 19 nt, Homo sapiens
ggucauagcagauuucuaa

SEQ ID NO: 1312803 - RNA, 19 nt, Homo sapiens
aaagagagcugacagaauc

SEQ ID NO: 1312804 - RNA, 19 nt, Homo sapiens
guacgagccugaagacuug

SEQ ID NO: 1312805 - RNA, 19 nt, Homo sapiens
gguaccaaguuccuaaaua

SEQ ID NO: 1312806 - RNA, 19 nt, Homo sapiens
guaccaaguuccuaaauag

SEQ ID NO: 1312807 - RNA, 19 nt, Homo sapiens
caaacucagugucuuuaaa

SEQ ID NO: 1312808 - RNA, 19 nt, Homo sapiens
ggaaagugcucagagacaa

SEQ ID NO: 1312809 - RNA, 19 nt, Homo sapiens
ucacagcacucgcucaaga

SEQ ID NO: 1312810 - RNA, 19 nt, Homo sapiens
gucaguagguuucuaaaga

SEQ ID NO: 1312811 - RNA, 19 nt, Homo sapiens
gaaaccaaacucuagauga

SEQ ID NO: 1312812 - RNA, 19 nt, Homo sapiens
gaagaacgcccucgacucu

SEQ ID NO: 1312813 - RNA, 19 nt, Homo sapiens
acagaacacuggacgcuuu

SEQ ID NO: 1312814 - RNA, 19 nt, Homo sapiens
gaaucaagcccgugaacuu

SEQ ID NO: 1312815 - RNA, 19 nt, Homo sapiens
ugacgaagaagaaaugaaa

SEQ ID NO: 1312816 - RNA, 19 nt, Homo sapiens
caguagaaaucuuaccaaa

SEQ ID NO: 1312817 - RNA, 19 nt, Homo sapiens
agacagaccuuccacaaac

SEQ ID NO: 1312818 - RNA, 19 nt, Homo sapiens
gaacucgcgucccagaaca

SEQ ID NO: 1312819 - RNA, 19 nt, Homo sapiens
cacagaaccuuggagagua

SEQ ID NO: 1312820 - RNA, 19 nt, Homo sapiens
gaagccaaagaguacauua

SEQ ID NO: 1312821 - RNA, 19 nt, Homo sapiens
ggaccaagguggccagcau

SEQ ID NO: 1312822 - RNA, 19 nt, Homo sapiens
ggagugaggcugagacugu

SEQ ID NO: 1312823 - RNA, 19 nt, Homo sapiens
cgacacccaucgccaauca

SEQ ID NO: 1312824 - RNA, 19 nt, Homo sapiens
gcaaagccuucucagacau

SEQ ID NO: 1312825 - RNA, 19 nt, Homo sapiens
gaaggucaguagguuucua

SEQ ID NO: 1312826 - RNA, 19 nt, Homo sapiens
ccacaaggaagucgugaaa

SEQ ID NO: 1312827 - RNA, 19 nt, Homo sapiens
gaauucaggccuuguggaa

SEQ ID NO: 1312828 - RNA, 19 nt, Homo sapiens
caacugagagcauuuacug

SEQ ID NO: 1312829 - RNA, 19 nt, Homo sapiens
ggaggaagccaaagaguac

SEQ ID NO: 1312830 - RNA, 19 nt, Homo sapiens
gaaagugcucagagacaaa

SEQ ID NO: 1312831 - RNA, 19 nt, Homo sapiens
aaaccaaacucuagaugag

SEQ ID NO: 1312832 - RNA, 19 nt, Homo sapiens
ucugaugugucuccauuaa

SEQ ID NO: 1312833 - RNA, 19 nt, Homo sapiens
cagcaacgguaccaaguuc

SEQ ID NO: 1312834 - RNA, 19 nt, Homo sapiens
gaaaacauauccccugaag

SEQ ID NO: 1312835 - RNA, 19 nt, Homo sapiens
ggacgagccagucucagaa

SEQ ID NO: 1312836 - RNA, 19 nt, Homo sapiens
cgaagaagaaaugaaagua

SEQ ID NO: 1312837 - RNA, 19 nt, Homo sapiens
cacggaaucugacucaaug

SEQ ID NO: 1312838 - RNA, 19 nt, Homo sapiens
ucagugauguuuccuugga

SEQ ID NO: 1312839 - RNA, 19 nt, Homo sapiens
ccaaguuccuaaauagugu

SEQ ID NO: 1312840 - RNA, 19 nt, Homo sapiens
uggaggaggugaacaagga

SEQ ID NO: 1312841 - RNA, 19 nt, Homo sapiens
ucagugagaacuccgauuu

SEQ ID NO: 1312842 - RNA, 19 nt, Homo sapiens
gcaggcacgugacaagagu

SEQ ID NO: 1312843 - RNA, 19 nt, Homo sapiens
gaacuccgauuuggaacag

SEQ ID NO: 1312844 - RNA, 19 nt, Homo sapiens
uggaggaucuugaguugga

SEQ ID NO: 1312845 - RNA, 19 nt, Homo sapiens
gcaugcagccaccaucuga

SEQ ID NO: 1312846 - RNA, 19 nt, Homo sapiens
agaggaaagugcucagaga

SEQ ID NO: 1312847 - RNA, 19 nt, Homo sapiens
ggaagcugcagaggaauuu

SEQ ID NO: 1312848 - RNA, 19 nt, Homo sapiens
agaacgcccucgacucuug

SEQ ID NO: 1312849 - RNA, 19 nt, Homo sapiens
ugagaacuccgauuuggaa

SEQ ID NO: 1312850 - RNA, 19 nt, Homo sapiens
gaaacacuuacuccugaaa

SEQ ID NO: 1312851 - RNA, 19 nt, Homo sapiens
gccagcagguggagcuuga

SEQ ID NO: 1312852 - RNA, 19 nt, Homo sapiens
cagcuuauucggaggauuu

SEQ ID NO: 1312853 - RNA, 19 nt, Homo sapiens
cuuggaagauucaacaaug

SEQ ID NO: 1312854 - RNA, 19 nt, Homo sapiens
gaacuuccugucaccgaaa

SEQ ID NO: 1312855 - RNA, 19 nt, Homo sapiens
agacaaaacuucccagaau

SEQ ID NO: 1312856 - RNA, 19 nt, Homo sapiens
caaagagagcugacagaau

SEQ ID NO: 1312857 - RNA, 19 nt, Homo sapiens
uggaagaaaucagaaacuu

SEQ ID NO: 1312858 - RNA, 19 nt, Homo sapiens
ccaaagagagcugacagaa

SEQ ID NO: 1312859 - RNA, 19 nt, Homo sapiens
gaacugggaaacaggaaca

SEQ ID NO: 1312860 - RNA, 19 nt, Homo sapiens
caguagagcuugguucagu

SEQ ID NO: 1312861 - RNA, 19 nt, Homo sapiens
gcucccagccuucacugua

SEQ ID NO: 1312862 - RNA, 19 nt, Homo sapiens
aaacagaaagaaccugcua

SEQ ID NO: 1312863 - RNA, 19 nt, Homo sapiens
gcagacagaacccuucaca

SEQ ID NO: 1312864 - RNA, 19 nt, Homo sapiens
ggaagaagaaagaaaacua

SEQ ID NO: 1312865 - RNA, 19 nt, Homo sapiens
gaaccugcuagaacauuug

SEQ ID NO: 1312866 - RNA, 19 nt, Homo sapiens
cuucugaugugucuccauu

SEQ ID NO: 1312867 - RNA, 19 nt, Homo sapiens
gagcaugggcgcaguagag

SEQ ID NO: 1312868 - RNA, 19 nt, Homo sapiens
gacagaccuuccacaaaca

SEQ ID NO: 1312869 - RNA, 19 nt, Homo sapiens
gaaacuuccagaucaguag

SEQ ID NO: 1312870 - RNA, 19 nt, Homo sapiens
agaaccugcuagaacauuu

SEQ ID NO: 1312871 - RNA, 19 nt, Homo sapiens
ccacagaaccuuggagagu

SEQ ID NO: 1312872 - RNA, 19 nt, Homo sapiens
ggaagauucaacaauggaa

SEQ ID NO: 1312873 - RNA, 19 nt, Homo sapiens
agacagugacgaagaagaa

SEQ ID NO: 1312874 - RNA, 19 nt, Homo sapiens
agaaagaaccugcuagaac

SEQ ID NO: 1312875 - RNA, 19 nt, Homo sapiens
gaagaggaaagugcucaga

SEQ ID NO: 1312876 - RNA, 19 nt, Homo sapiens
caccuucccuaacuucuuc

SEQ ID NO: 1312877 - RNA, 19 nt, Homo sapiens
caccgcagcuucccagagu

SEQ ID NO: 1312878 - RNA, 19 nt, Homo sapiens
acugagagcauuuacugua

SEQ ID NO: 1312879 - RNA, 19 nt, Homo sapiens
aaagaaaccaaacucuaga

SEQ ID NO: 1312880 - RNA, 19 nt, Homo sapiens
gccaaugccgcacucauga

SEQ ID NO: 1312881 - RNA, 19 nt, Homo sapiens
ggguggacgugaugagugu

SEQ ID NO: 1312882 - RNA, 19 nt, Homo sapiens
ggacggcgugggaagagaa

SEQ ID NO: 1312883 - RNA, 19 nt, Homo sapiens
ccgcagcuucccagaguua

SEQ ID NO: 1312884 - RNA, 19 nt, Homo sapiens
gaacaggaagaggaaagug

SEQ ID NO: 1312885 - RNA, 19 nt, Homo sapiens
cgcaaagccuucucagaca

SEQ ID NO: 1312886 - RNA, 19 nt, Homo sapiens
ggucugcucccacccauca

SEQ ID NO: 1312887 - RNA, 19 nt, Homo sapiens
cgagccugcugcuguguga

SEQ ID NO: 1312888 - RNA, 19 nt, Homo sapiens
cuuggaggaucuugaguug

SEQ ID NO: 1312889 - RNA, 19 nt, Homo sapiens
gcgaggaagaagaaagaaa

SEQ ID NO: 1312890 - RNA, 19 nt, Homo sapiens
ugaugugucuccauuaaaa

SEQ ID NO: 1312891 - RNA, 19 nt, Homo sapiens
gccaaagaguacauuaggu

SEQ ID NO: 1312892 - RNA, 19 nt, Homo sapiens
caauggaagaaaucagaaa

SEQ ID NO: 1312893 - RNA, 19 nt, Homo sapiens
gaauggcuucugcaaggaa

SEQ ID NO: 1312894 - RNA, 19 nt, Homo sapiens
cagcgaggaagaagaaaga

SEQ ID NO: 1312895 - RNA, 19 nt, Homo sapiens
gcgaaggucaguagguuuc

SEQ ID NO: 1312896 - RNA, 19 nt, Homo sapiens
cuggaaacccggaucauga

SEQ ID NO: 1312897 - RNA, 19 nt, Homo sapiens
uggaggaagccaaagagua

SEQ ID NO: 1312898 - RNA, 19 nt, Homo sapiens
gaaacccggaucaugaauc

SEQ ID NO: 1312899 - RNA, 19 nt, Homo sapiens
aaacaggaacacugacuca

SEQ ID NO: 1312900 - RNA, 19 nt, Homo sapiens
guuaccagcgcagcacuua

SEQ ID NO: 1312901 - RNA, 19 nt, Homo sapiens
gaaaggagcagcaguguuu

SEQ ID NO: 1312902 - RNA, 19 nt, Homo sapiens
ccagugagcagauuuauua

SEQ ID NO: 1312903 - RNA, 19 nt, Homo sapiens
gugagcagauuuauuauga

SEQ ID NO: 1312904 - RNA, 19 nt, Homo sapiens
gcacuuuauuggcuacaua

SEQ ID NO: 1312905 - RNA, 19 nt, Homo sapiens
gcuaauaggucucgagauc

SEQ ID NO: 1312906 - RNA, 19 nt, Homo sapiens
ggaagauacuuauuuacug

SEQ ID NO: 1312907 - RNA, 19 nt, Homo sapiens
gaagaaguccugcaucgaa

SEQ ID NO: 1312908 - RNA, 19 nt, Homo sapiens
ggaacaaccuuaaugaaac

SEQ ID NO: 1312909 - RNA, 19 nt, Homo sapiens
uaaaggccauguugauuga

SEQ ID NO: 1312910 - RNA, 19 nt, Homo sapiens
uagaagaacuccagaaagu

SEQ ID NO: 1312911 - RNA, 19 nt, Homo sapiens
uaaugaaacugacagaaga

SEQ ID NO: 1312912 - RNA, 19 nt, Homo sapiens
ggagagucauuucaaguug

SEQ ID NO: 1312913 - RNA, 19 nt, Homo sapiens
gagaauguccuuuauuguu

SEQ ID NO: 1312914 - RNA, 19 nt, Homo sapiens
gagaugcuuucauuauuga

SEQ ID NO: 1312915 - RNA, 19 nt, Homo sapiens
uuacaugcaugaaggauuu

SEQ ID NO: 1312916 - RNA, 19 nt, Homo sapiens
cagagaaugucaucccuaa

SEQ ID NO: 1312917 - RNA, 19 nt, Homo sapiens
caagagaugcuuucauuau

SEQ ID NO: 1312918 - RNA, 19 nt, Homo sapiens
ggacagcacacuccugaaa

SEQ ID NO: 1312919 - RNA, 19 nt, Homo sapiens
gcagagggaauuaaagaaa

SEQ ID NO: 1312920 - RNA, 19 nt, Homo sapiens
gcaagagaugcuuucauua

SEQ ID NO: 1312921 - RNA, 19 nt, Homo sapiens
gcaauuguuuacuguguug

SEQ ID NO: 1312922 - RNA, 19 nt, Homo sapiens
ccacuggaaugaaaucuau

SEQ ID NO: 1312923 - RNA, 19 nt, Homo sapiens
caguaaggaucauguguuu

SEQ ID NO: 1312924 - RNA, 19 nt, Homo sapiens
gaacaaccuuaaugaaacu

SEQ ID NO: 1312925 - RNA, 19 nt, Homo sapiens
acaguuggcucacaaauuc

SEQ ID NO: 1312926 - RNA, 19 nt, Homo sapiens
ggauuucacaguuucuuua

SEQ ID NO: 1312927 - RNA, 19 nt, Homo sapiens
gagaaugucaucccuaaug

SEQ ID NO: 1312928 - RNA, 19 nt, Homo sapiens
gagcagagggaauuaaaga

SEQ ID NO: 1312929 - RNA, 19 nt, Homo sapiens
gguuuacacuuuccuuauu

SEQ ID NO: 1312930 - RNA, 19 nt, Homo sapiens
gagcauuugacaagacuua

SEQ ID NO: 1312931 - RNA, 19 nt, Homo sapiens
gcagggauuuggccauuca

SEQ ID NO: 1312932 - RNA, 19 nt, Homo sapiens
aacaagcccuggcaagaua

SEQ ID NO: 1312933 - RNA, 19 nt, Homo sapiens
gagcagcaguguuugauac

SEQ ID NO: 1312934 - RNA, 19 nt, Homo sapiens
agagaugcuuucauuauug

SEQ ID NO: 1312935 - RNA, 19 nt, Homo sapiens
gcugaaccauccaccauau

SEQ ID NO: 1312936 - RNA, 19 nt, Homo sapiens
uaauaggucucgagaucuu

SEQ ID NO: 1312937 - RNA, 19 nt, Homo sapiens
gaaacugacagaagacaga

SEQ ID NO: 1312938 - RNA, 19 nt, Homo sapiens
gguggaggauuucacaguu

SEQ ID NO: 1312939 - RNA, 19 nt, Homo sapiens
caugcucgguuuacacuuu

SEQ ID NO: 1312940 - RNA, 19 nt, Homo sapiens
gcaggagagucauuucaag

SEQ ID NO: 1312941 - RNA, 19 nt, Homo sapiens
gaucuuggugcaauuguuu

SEQ ID NO: 1312942 - RNA, 19 nt, Homo sapiens
uaauuccucuccauucuau

SEQ ID NO: 1312943 - RNA, 19 nt, Homo sapiens
uugagaauguccuuuauug

SEQ ID NO: 1312944 - RNA, 19 nt, Homo sapiens
gauuugaccuguacuucau

SEQ ID NO: 1312945 - RNA, 19 nt, Homo sapiens
acagugccuucucgucuua

SEQ ID NO: 1312946 - RNA, 19 nt, Homo sapiens
caaacaagcccuggcaaga

SEQ ID NO: 1312947 - RNA, 19 nt, Homo sapiens
cugguucucucccauuaua

SEQ ID NO: 1312948 - RNA, 19 nt, Homo sapiens
guggaggauuucacaguuu

SEQ ID NO: 1312949 - RNA, 19 nt, Homo sapiens
ggagagaggagccaaacau

SEQ ID NO: 1312950 - RNA, 19 nt, Homo sapiens
gagagucauuucaaguugu

SEQ ID NO: 1312951 - RNA, 19 nt, Homo sapiens
gaggaacaaccuuaaugaa

SEQ ID NO: 1312952 - RNA, 19 nt, Homo sapiens
aaaagaaguuggcaugaaa

SEQ ID NO: 1312953 - RNA, 19 nt, Homo sapiens
guccagcgccuaucuuaaa

SEQ ID NO: 1312954 - RNA, 19 nt, Homo sapiens
gaacaguuggcucacaaau

SEQ ID NO: 1312955 - RNA, 19 nt, Homo sapiens
gaaguccugcaucgaaauu

SEQ ID NO: 1312956 - RNA, 19 nt, Homo sapiens
ggcaucauccacucaauuu

SEQ ID NO: 1312957 - RNA, 19 nt, Homo sapiens
cgaggaacaaccuuaauga

SEQ ID NO: 1312958 - RNA, 19 nt, Homo sapiens
gccugguucucucccauua

SEQ ID NO: 1312959 - RNA, 19 nt, Homo sapiens
acacuuuccuuauuuacug

SEQ ID NO: 1312960 - RNA, 19 nt, Homo sapiens
aagaaguccugcaucgaaa

SEQ ID NO: 1312961 - RNA, 19 nt, Homo sapiens
gacagaagacagagaacaa

SEQ ID NO: 1312962 - RNA, 19 nt, Homo sapiens
ggagcagcaguguuugaua

SEQ ID NO: 1312963 - RNA, 19 nt, Homo sapiens
guguuggugugaaagauuu

SEQ ID NO: 1312964 - RNA, 19 nt, Homo sapiens
cugcaccacuggaaugaaa

SEQ ID NO: 1312965 - RNA, 19 nt, Homo sapiens
uuaaaggccauguugauug

SEQ ID NO: 1312966 - RNA, 19 nt, Homo sapiens
cagagggaauuaaagaaag

SEQ ID NO: 1312967 - RNA, 19 nt, Homo sapiens
acuuugagguggaggauuu

SEQ ID NO: 1312968 - RNA, 19 nt, Homo sapiens
caacauggaaagaaacauc

SEQ ID NO: 1312969 - RNA, 19 nt, Homo sapiens
caguugagaauguccuuua

SEQ ID NO: 1312970 - RNA, 19 nt, Homo sapiens
gcauuugacaagacuuaaa

SEQ ID NO: 1312971 - RNA, 19 nt, Homo sapiens
gggagcagagggaauuaaa

SEQ ID NO: 1312972 - RNA, 19 nt, Homo sapiens
ccacuaauuccucuccauu

SEQ ID NO: 1312973 - RNA, 19 nt, Homo sapiens
caaguugucgugagaggaa

SEQ ID NO: 1312974 - RNA, 19 nt, Homo sapiens
gugcaauuguuuacugugu

SEQ ID NO: 1312975 - RNA, 19 nt, Homo sapiens
aggaacaaccuuaaugaaa

SEQ ID NO: 1312976 - RNA, 19 nt, Homo sapiens
agagacaggccuggaguua

SEQ ID NO: 1312977 - RNA, 19 nt, Homo sapiens
gagagaggagccaaacaug

SEQ ID NO: 1312978 - RNA, 19 nt, Homo sapiens
caugaacgauggccucucu

SEQ ID NO: 1312979 - RNA, 19 nt, Homo sapiens
uaaaagaaguuggcaugaa

SEQ ID NO: 1312980 - RNA, 19 nt, Homo sapiens
ucagagagggaggcuaaua

SEQ ID NO: 1312981 - RNA, 19 nt, Homo sapiens
ggauuugaccuguacuuca

SEQ ID NO: 1312982 - RNA, 19 nt, Homo sapiens
uaaagaaagccaugaugca

SEQ ID NO: 1312983 - RNA, 19 nt, Homo sapiens
uuacuguguuggugugaaa

SEQ ID NO: 1312984 - RNA, 19 nt, Homo sapiens
ccuagaagaacuccagaaa

SEQ ID NO: 1312985 - RNA, 19 nt, Homo sapiens
gcaugaaggauuugaaagg

SEQ ID NO: 1312986 - RNA, 19 nt, Homo sapiens
gaggagacacuuacaugca

SEQ ID NO: 1312987 - RNA, 19 nt, Homo sapiens
uugccugucugccuccuua

SEQ ID NO: 1312988 - RNA, 19 nt, Homo sapiens
gaauuaaagaaagccauga

SEQ ID NO: 1312989 - RNA, 19 nt, Homo sapiens
gcacuccaggucagcauga

SEQ ID NO: 1312990 - RNA, 19 nt, Homo sapiens
ugaacgauggccucucuuu

SEQ ID NO: 1312991 - RNA, 19 nt, Homo sapiens
gggccagugagcagauuua

SEQ ID NO: 1312992 - RNA, 19 nt, Homo sapiens
gaagacagagaacaaaucc

SEQ ID NO: 1312993 - RNA, 19 nt, Homo sapiens
gauuugaaagggccaguga

SEQ ID NO: 1312994 - RNA, 19 nt, Homo sapiens
aaugacacaugcccgaaug

SEQ ID NO: 1312995 - RNA, 19 nt, Homo sapiens
ucuauuacuuuguggaaca

SEQ ID NO: 1312996 - RNA, 19 nt, Homo sapiens
aaacaagcccuggcaagau

SEQ ID NO: 1312997 - RNA, 19 nt, Homo sapiens
gagaggagccaaacaugcu

SEQ ID NO: 1312998 - RNA, 19 nt, Homo sapiens
gaacgauggccucucuuuu

SEQ ID NO: 1312999 - RNA, 19 nt, Homo sapiens
gaaccauccaccauaugug

SEQ ID NO: 1313000 - RNA, 19 nt, Homo sapiens
ggacaguaaggaucaugug

SEQ ID NO: 1313001 - RNA, 19 nt, Homo sapiens
gaacagagcugguggauua

SEQ ID NO: 1313002 - RNA, 19 nt, Homo sapiens
gaacaagucuuuccaguua

SEQ ID NO: 1313003 - RNA, 19 nt, Homo sapiens
gaacaaggcagaauauaaa

SEQ ID NO: 1313004 - RNA, 19 nt, Homo sapiens
gaaaugcucugccugaaau

SEQ ID NO: 1313005 - RNA, 19 nt, Homo sapiens
gaagaggaguggugauaaa

SEQ ID NO: 1313006 - RNA, 19 nt, Homo sapiens
ccagugagcagauuuauua

SEQ ID NO: 1313007 - RNA, 19 nt, Homo sapiens
uaucugagcucuccuauau

SEQ ID NO: 1313008 - RNA, 19 nt, Homo sapiens
gaaauacauugcuggguuu

SEQ ID NO: 1313009 - RNA, 19 nt, Homo sapiens
ccacugaccuucacacauu

SEQ ID NO: 1313010 - RNA, 19 nt, Homo sapiens
cauagaaccucagcuguua

SEQ ID NO: 1313011 - RNA, 19 nt, Homo sapiens
ucugagcucuccuauauua

SEQ ID NO: 1313012 - RNA, 19 nt, Homo sapiens
ucacaauccuucucaaauu

SEQ ID NO: 1313013 - RNA, 19 nt, Homo sapiens
ggaacaaggcagaauauaa

SEQ ID NO: 1313014 - RNA, 19 nt, Homo sapiens
ggaagaagaugaugauggu

SEQ ID NO: 1313015 - RNA, 19 nt, Homo sapiens
cacaauccuucucaaauua

SEQ ID NO: 1313016 - RNA, 19 nt, Homo sapiens
ucaauaagcccuauaauca

SEQ ID NO: 1313017 - RNA, 19 nt, Homo sapiens
caaugguccugacauaaua

SEQ ID NO: 1313018 - RNA, 19 nt, Homo sapiens
gugagcagauuuauuauga

SEQ ID NO: 1313019 - RNA, 19 nt, Homo sapiens
gauauuucauggcagguua

SEQ ID NO: 1313020 - RNA, 19 nt, Homo sapiens
aaacagagaucauugucuu

SEQ ID NO: 1313021 - RNA, 19 nt, Homo sapiens
gcaacuacagucagauuua

SEQ ID NO: 1313022 - RNA, 19 nt, Homo sapiens
gcuaauaggucucgagauc

SEQ ID NO: 1313023 - RNA, 19 nt, Homo sapiens
agaagaaggugcuaaguug

SEQ ID NO: 1313024 - RNA, 19 nt, Homo sapiens
ggaagauacuuauuuacug

SEQ ID NO: 1313025 - RNA, 19 nt, Homo sapiens
gaagaaguccugcaucgaa

SEQ ID NO: 1313026 - RNA, 19 nt, Homo sapiens
gaauuacaguuaagaagga

SEQ ID NO: 1313027 - RNA, 19 nt, Homo sapiens
gaaaugcagaguuggauaa

SEQ ID NO: 1313028 - RNA, 19 nt, Homo sapiens
ggaacaaccuuaaugaaac

SEQ ID NO: 1313029 - RNA, 19 nt, Homo sapiens
uagaagaacuccagaaagu

SEQ ID NO: 1313030 - RNA, 19 nt, Homo sapiens
uaaugaaacugacagaaga

SEQ ID NO: 1313031 - RNA, 19 nt, Homo sapiens
gagcagguguuuacugaug

SEQ ID NO: 1313032 - RNA, 19 nt, Homo sapiens
ggagagucauuucaaguug

SEQ ID NO: 1313033 - RNA, 19 nt, Homo sapiens
gagaauguccuuuauuguu

SEQ ID NO: 1313034 - RNA, 19 nt, Homo sapiens
ggaguguucuaaccaauug

SEQ ID NO: 1313035 - RNA, 19 nt, Homo sapiens
caucaauacuugugucauu

SEQ ID NO: 1313036 - RNA, 19 nt, Homo sapiens
agacaaugguccugacaua

SEQ ID NO: 1313037 - RNA, 19 nt, Homo sapiens
uuacaugcaugaaggauuu

SEQ ID NO: 1313038 - RNA, 19 nt, Homo sapiens
gggagcagguguuuacuga

SEQ ID NO: 1313039 - RNA, 19 nt, Homo sapiens
ggagacaugugauuaugau

SEQ ID NO: 1313040 - RNA, 19 nt, Homo sapiens
gcauguguguguauacaaa

SEQ ID NO: 1313041 - RNA, 19 nt, Homo sapiens
gggcagagcugagagacaa

SEQ ID NO: 1313042 - RNA, 19 nt, Homo sapiens
gcaauuguuuacuguguug

SEQ ID NO: 1313043 - RNA, 19 nt, Homo sapiens
ccacuggaaugaaaucuau

SEQ ID NO: 1313044 - RNA, 19 nt, Homo sapiens
ugaacaaggugauaucuuc

SEQ ID NO: 1313045 - RNA, 19 nt, Homo sapiens
gaaauuuccagacucauga

SEQ ID NO: 1313046 - RNA, 19 nt, Homo sapiens
acagcacuauuuccuauua

SEQ ID NO: 1313047 - RNA, 19 nt, Homo sapiens
gaaaagggcuccacagaag

SEQ ID NO: 1313048 - RNA, 19 nt, Homo sapiens
caguaaggaucauguguuu

SEQ ID NO: 1313049 - RNA, 19 nt, Homo sapiens
gaacaaccuuaaugaaacu

SEQ ID NO: 1313050 - RNA, 19 nt, Homo sapiens
acaguuggcucacaaauuc

SEQ ID NO: 1313051 - RNA, 19 nt, Homo sapiens
uaaagccgaugauauuuca

SEQ ID NO: 1313052 - RNA, 19 nt, Homo sapiens
ggccagacauggacccuaa

SEQ ID NO: 1313053 - RNA, 19 nt, Homo sapiens
guaagaaacucaacaucag

SEQ ID NO: 1313054 - RNA, 19 nt, Homo sapiens
gagaagaggaguggugaua

SEQ ID NO: 1313055 - RNA, 19 nt, Homo sapiens
cgaaaucucaacaacaaua

SEQ ID NO: 1313056 - RNA, 19 nt, Homo sapiens
guagacgccucuuauuaug

SEQ ID NO: 1313057 - RNA, 19 nt, Homo sapiens
aaacuuugccuacaacuuu

SEQ ID NO: 1313058 - RNA, 19 nt, Homo sapiens
auagggaacugcaaaugua

SEQ ID NO: 1313059 - RNA, 19 nt, Homo sapiens
ucacagcacuauuuccuau

SEQ ID NO: 1313060 - RNA, 19 nt, Homo sapiens
gaaaucaguugugugcaau

SEQ ID NO: 1313061 - RNA, 19 nt, Homo sapiens
aaagguauguugcuauguu

SEQ ID NO: 1313062 - RNA, 19 nt, Homo sapiens
caacuacagucagauuuau

SEQ ID NO: 1313063 - RNA, 19 nt, Homo sapiens
gcaacgagauggugagcau

SEQ ID NO: 1313064 - RNA, 19 nt, Homo sapiens
gaacccaacagucagauga

SEQ ID NO: 1313065 - RNA, 19 nt, Homo sapiens
ggcaaaaccuguacaauga

SEQ ID NO: 1313066 - RNA, 19 nt, Homo sapiens
gcucuccuauauuaucaua

SEQ ID NO: 1313067 - RNA, 19 nt, Homo sapiens
acacuaggcuucuucuuuc

SEQ ID NO: 1313068 - RNA, 19 nt, Homo sapiens
ccagaaauuuccagacuca

SEQ ID NO: 1313069 - RNA, 19 nt, Homo sapiens
ccacugauuucuucacaau

SEQ ID NO: 1313070 - RNA, 19 nt, Homo sapiens
uuaaaucacuugagguaug

SEQ ID NO: 1313071 - RNA, 19 nt, Homo sapiens
gguagacgccucuuauuau

SEQ ID NO: 1313072 - RNA, 19 nt, Homo sapiens
caaaauccaucaauacuug

SEQ ID NO: 1313073 - RNA, 19 nt, Homo sapiens
cagcaggauuuguucuuaa

SEQ ID NO: 1313074 - RNA, 19 nt, Homo sapiens
gaaaugaacccuacuugcu

SEQ ID NO: 1313075 - RNA, 19 nt, Homo sapiens
cacacaauaucacuaguuu

SEQ ID NO: 1313076 - RNA, 19 nt, Homo sapiens
gaucuugaagugucacaua

SEQ ID NO: 1313077 - RNA, 19 nt, Homo sapiens
gaacugcaaauguaugaug

SEQ ID NO: 1313078 - RNA, 19 nt, Homo sapiens
cuauuaagcccacugauuu

SEQ ID NO: 1313079 - RNA, 19 nt, Homo sapiens
uggcagacauugcuaauca

SEQ ID NO: 1313080 - RNA, 19 nt, Homo sapiens
ggccugggaugcauuuauu

SEQ ID NO: 1313081 - RNA, 19 nt, Homo sapiens
gcuauggucuccaaagauc

SEQ ID NO: 1313082 - RNA, 19 nt, Homo sapiens
uaaaucacuugagguauga

SEQ ID NO: 1313083 - RNA, 19 nt, Homo sapiens
ugaaaucaguugugugcaa

SEQ ID NO: 1313084 - RNA, 19 nt, Homo sapiens
gguaagaaacucaacauca

SEQ ID NO: 1313085 - RNA, 19 nt, Homo sapiens
acaaggugauaucuucaua

SEQ ID NO: 1313086 - RNA, 19 nt, Homo sapiens
ucagcaggauuuguucuua

SEQ ID NO: 1313087 - RNA, 19 nt, Homo sapiens
ccaaagagccgccacucaa

SEQ ID NO: 1313088 - RNA, 19 nt, Homo sapiens
ucacucacuuuacuuagaa

SEQ ID NO: 1313089 - RNA, 19 nt, Homo sapiens
gaaaagguauguugcuaug

SEQ ID NO: 1313090 - RNA, 19 nt, Homo sapiens
gcugaaccauccaccauau

SEQ ID NO: 1313091 - RNA, 19 nt, Homo sapiens
uaauaggucucgagaucuu

SEQ ID NO: 1313092 - RNA, 19 nt, Homo sapiens
gaaacugacagaagacaga

SEQ ID NO: 1313093 - RNA, 19 nt, Homo sapiens
gaagagcaaccuguuaaug

SEQ ID NO: 1313094 - RNA, 19 nt, Homo sapiens
ucauuuaucugaaggugaa

SEQ ID NO: 1313095 - RNA, 19 nt, Homo sapiens
gauaugaucgugugucugu

SEQ ID NO: 1313096 - RNA, 19 nt, Homo sapiens
gcaaagaaugcaagaguca

SEQ ID NO: 1313097 - RNA, 19 nt, Homo sapiens
gagaggcguuggaggcauu

SEQ ID NO: 1313098 - RNA, 19 nt, Homo sapiens
gggcuauggucuccaaaga

SEQ ID NO: 1313099 - RNA, 19 nt, Homo sapiens
guaugaaguuuauccuguu

SEQ ID NO: 1313100 - RNA, 19 nt, Homo sapiens
ggccauggguaaccucauu

SEQ ID NO: 1313101 - RNA, 19 nt, Homo sapiens
ccagugagcagauuuauua

SEQ ID NO: 1313102 - RNA, 19 nt, Homo sapiens
ggaagacacuuauuuacug

SEQ ID NO: 1313103 - RNA, 19 nt, Homo sapiens
gaaagaaaucccacagaaa

SEQ ID NO: 1313104 - RNA, 19 nt, Homo sapiens
gugagcagauuuauuauga

SEQ ID NO: 1313105 - RNA, 19 nt, Homo sapiens
gcuaauaggucucgagauc

SEQ ID NO: 1313106 - RNA, 19 nt, Homo sapiens
gaagaaguccugcaucgaa

SEQ ID NO: 1313107 - RNA, 19 nt, Homo sapiens
ggaacaaccuuaaugaaac

SEQ ID NO: 1313108 - RNA, 19 nt, Homo sapiens
uagaagaacuccagaaagu

SEQ ID NO: 1313109 - RNA, 19 nt, Homo sapiens
uaaugaaacugacagaaga

SEQ ID NO: 1313110 - RNA, 19 nt, Homo sapiens
ggagagucauuucaaguug

SEQ ID NO: 1313111 - RNA, 19 nt, Homo sapiens
gagaauguccuuuauuguu

SEQ ID NO: 1313112 - RNA, 19 nt, Homo sapiens
agaaagaaaucccacagaa

SEQ ID NO: 1313113 - RNA, 19 nt, Homo sapiens
uuacaugcaugaaggauuu

SEQ ID NO: 1313114 - RNA, 19 nt, Homo sapiens
gaagacacuuauuuacugu

SEQ ID NO: 1313115 - RNA, 19 nt, Homo sapiens
gcaauuguuuacuguguug

SEQ ID NO: 1313116 - RNA, 19 nt, Homo sapiens
ccacuggaaugaaaucuau

SEQ ID NO: 1313117 - RNA, 19 nt, Homo sapiens
caguaaggaucauguguuu

SEQ ID NO: 1313118 - RNA, 19 nt, Homo sapiens
gaacaaccuuaaugaaacu

SEQ ID NO: 1313119 - RNA, 19 nt, Homo sapiens
acaguuggcucacaaauuc

SEQ ID NO: 1313120 - RNA, 19 nt, Homo sapiens
cuaguucccuguauucaaa

SEQ ID NO: 1313121 - RNA, 19 nt, Homo sapiens
agaaacagauaaccuaaca

SEQ ID NO: 1313122 - RNA, 19 nt, Homo sapiens
gcugaaccauccaccauau

SEQ ID NO: 1313123 - RNA, 19 nt, Homo sapiens
uaauaggucucgagaucuu

SEQ ID NO: 1313124 - RNA, 19 nt, Homo sapiens
gaaacugacagaagacaga

SEQ ID NO: 1313125 - RNA, 19 nt, Homo sapiens
gcaggagagucauuucaag

SEQ ID NO: 1313126 - RNA, 19 nt, Homo sapiens
gaucuuggugcaauuguuu

SEQ ID NO: 1313127 - RNA, 19 nt, Homo sapiens
gauuugaccuguacuucau

SEQ ID NO: 1313128 - RNA, 19 nt, Homo sapiens
uugagaauguccuuuauug

SEQ ID NO: 1313129 - RNA, 19 nt, Homo sapiens
gagagucauuucaaguugu

SEQ ID NO: 1313130 - RNA, 19 nt, Homo sapiens
gaggaacaaccuuaaugaa

SEQ ID NO: 1313131 - RNA, 19 nt, Homo sapiens
aaaagaaguuggcaugaaa

SEQ ID NO: 1313132 - RNA, 19 nt, Homo sapiens
guccagcgccuaucuuaaa

SEQ ID NO: 1313133 - RNA, 19 nt, Homo sapiens
gaaguccugcaucgaaauu

SEQ ID NO: 1313134 - RNA, 19 nt, Homo sapiens
ggcaucauccacucaauuu

SEQ ID NO: 1313135 - RNA, 19 nt, Homo sapiens
cgaggaacaaccuuaauga

SEQ ID NO: 1313136 - RNA, 19 nt, Homo sapiens
gaacaguuggcucacaaau

SEQ ID NO: 1313137 - RNA, 19 nt, Homo sapiens
uguggaagacacuuauuua

SEQ ID NO: 1313138 - RNA, 19 nt, Homo sapiens
gaaaucccacagaaacaga

SEQ ID NO: 1313139 - RNA, 19 nt, Homo sapiens
aagaaguccugcaucgaaa

SEQ ID NO: 1313140 - RNA, 19 nt, Homo sapiens
gacagaagacagagaacaa

SEQ ID NO: 1313141 - RNA, 19 nt, Homo sapiens
caagaagaagaaagaaaga

SEQ ID NO: 1313142 - RNA, 19 nt, Homo sapiens
cugcaccacuggaaugaaa

SEQ ID NO: 1313143 - RNA, 19 nt, Homo sapiens
guguuggugugaaagauuu

SEQ ID NO: 1313144 - RNA, 19 nt, Homo sapiens
aaacagauaaccuaacaca

SEQ ID NO: 1313145 - RNA, 19 nt, Homo sapiens
aaagaaaucccacagaaac

SEQ ID NO: 1313146 - RNA, 19 nt, Homo sapiens
caguugagaauguccuuua

SEQ ID NO: 1313147 - RNA, 19 nt, Homo sapiens
caaguugucgugagaggaa

SEQ ID NO: 1313148 - RNA, 19 nt, Homo sapiens
gugcaauuguuuacugugu

SEQ ID NO: 1313149 - RNA, 19 nt, Homo sapiens
aggaacaaccuuaaugaaa

SEQ ID NO: 1313150 - RNA, 19 nt, Homo sapiens
acacagcccgugcaacgua

SEQ ID NO: 1313151 - RNA, 19 nt, Homo sapiens
caugaacgauggccucucu

SEQ ID NO: 1313152 - RNA, 19 nt, Homo sapiens
uaaaagaaguuggcaugaa

SEQ ID NO: 1313153 - RNA, 19 nt, Homo sapiens
ucagagagggaggcuaaua

SEQ ID NO: 1313154 - RNA, 19 nt, Homo sapiens
ggauuugaccuguacuuca

SEQ ID NO: 1313155 - RNA, 19 nt, Homo sapiens
cacagaaacagauaaccua

SEQ ID NO: 1313156 - RNA, 19 nt, Homo sapiens
uuacuguguuggugugaaa

SEQ ID NO: 1313157 - RNA, 19 nt, Homo sapiens
ccuagaagaacuccagaaa

SEQ ID NO: 1313158 - RNA, 19 nt, Homo sapiens
aaucauagucucaaucuag

SEQ ID NO: 1313159 - RNA, 19 nt, Homo sapiens
gcaugaaggauuugaaagg

SEQ ID NO: 1313160 - RNA, 19 nt, Homo sapiens
gaggagacacuuacaugca

SEQ ID NO: 1313161 - RNA, 19 nt, Homo sapiens
gcacuccaggucagcauga

SEQ ID NO: 1313162 - RNA, 19 nt, Homo sapiens
ugaacgauggccucucuuu

SEQ ID NO: 1313163 - RNA, 19 nt, Homo sapiens
gggccagugagcagauuua

SEQ ID NO: 1313164 - RNA, 19 nt, Homo sapiens
gaagacagagaacaaaucc

SEQ ID NO: 1313165 - RNA, 19 nt, Homo sapiens
gauuugaaagggccaguga

SEQ ID NO: 1313166 - RNA, 19 nt, Homo sapiens
acagaaacagauaaccuaa

SEQ ID NO: 1313167 - RNA, 19 nt, Homo sapiens
ucuauuacuuuguggaaca

SEQ ID NO: 1313168 - RNA, 19 nt, Homo sapiens
acaagaagaagaaagaaag

SEQ ID NO: 1313169 - RNA, 19 nt, Homo sapiens
gaacgauggccucucuuuu

SEQ ID NO: 1313170 - RNA, 19 nt, Homo sapiens
uggaacaguuggcucacaa

SEQ ID NO: 1313171 - RNA, 19 nt, Homo sapiens
gaaccauccaccauaugug

SEQ ID NO: 1313172 - RNA, 19 nt, Homo sapiens
ggacaguaaggaucaugug

SEQ ID NO: 1313173 - RNA, 19 nt, Homo sapiens
ccagcgucaucauugcuuu

SEQ ID NO: 1313174 - RNA, 19 nt, Homo sapiens
ggaacaguuggcucacaaa

SEQ ID NO: 1313175 - RNA, 19 nt, Homo sapiens
gcagcuucaagaucaauga

SEQ ID NO: 1313176 - RNA, 19 nt, Homo sapiens
guaaggaucauguguuucc

SEQ ID NO: 1313177 - RNA, 19 nt, Homo sapiens
guugagaauguccuuuauu

SEQ ID NO: 1313178 - RNA, 19 nt, Homo sapiens
auaaaggacccgcgaggaa

SEQ ID NO: 1313179 - RNA, 19 nt, Homo sapiens
gcucuccucuggugguucu

SEQ ID NO: 1313180 - RNA, 19 nt, Homo sapiens
gcaaggcaucauccacuca

SEQ ID NO: 1313181 - RNA, 19 nt, Homo sapiens
cagaagacagagaacaaau

SEQ ID NO: 1313182 - RNA, 19 nt, Homo sapiens
caaaucccagugucuaaca

SEQ ID NO: 1313183 - RNA, 19 nt, Homo sapiens
guguccagcgccuaucuua

SEQ ID NO: 1313184 - RNA, 19 nt, Homo sapiens
ggacagccagcgucaucau

SEQ ID NO: 1313185 - RNA, 19 nt, Homo sapiens
uuaaugaaacugacagaag

SEQ ID NO: 1313186 - RNA, 19 nt, Homo sapiens
ugaaccauccaccauaugu

SEQ ID NO: 1313187 - RNA, 19 nt, Homo sapiens
cagagagggaggcuaauag

SEQ ID NO: 1313188 - RNA, 19 nt, Homo sapiens
ccgaggaacaaccuuaaug

SEQ ID NO: 1313189 - RNA, 19 nt, Homo sapiens
cagugucuaacauucaaua

SEQ ID NO: 1313190 - RNA, 19 nt, Homo sapiens
caaggcaucauccacucaa

SEQ ID NO: 1313191 - RNA, 19 nt, Homo sapiens
cccagugucuaacauucaa

SEQ ID NO: 1313192 - RNA, 19 nt, Homo sapiens
uaucuccaguucugucauc

SEQ ID NO: 1313193 - RNA, 19 nt, Homo sapiens
cauaugugcaggagaguca

SEQ ID NO: 1313194 - RNA, 19 nt, Homo sapiens
acaguaaggaucauguguu

SEQ ID NO: 1313195 - RNA, 19 nt, Homo sapiens
gacagccagcgucaucauu

SEQ ID NO: 1313196 - RNA, 19 nt, Homo sapiens
gagacacuuacaugcauga

SEQ ID NO: 1313197 - RNA, 19 nt, Homo sapiens
acagaagacagagaacaaa

SEQ ID NO: 1313198 - RNA, 19 nt, Homo sapiens
gaaauucuagcagcugaac

SEQ ID NO: 1313199 - RNA, 19 nt, Homo sapiens
gacaguaaggaucaugugu

SEQ ID NO: 1313200 - RNA, 19 nt, Homo sapiens
cggcggauuugaccuguac

SEQ ID NO: 1313201 - RNA, 19 nt, Homo sapiens
gugcaaaucucaucacuuc

SEQ ID NO: 1313202 - RNA, 19 nt, Homo sapiens
ugaaaucggugagaaauga

SEQ ID NO: 1313203 - RNA, 19 nt, Homo sapiens
ggaaugaaaucggugagaa

SEQ ID NO: 1313204 - RNA, 19 nt, Homo sapiens
gacaaggucucuccauguu

SEQ ID NO: 1313205 - RNA, 19 nt, Homo sapiens
ucaauuggccagacauuua

SEQ ID NO: 1313206 - RNA, 19 nt, Homo sapiens
gaaaccucgucucuacuaa

SEQ ID NO: 1313207 - RNA, 19 nt, Homo sapiens
gcaagguuguggaucacua

SEQ ID NO: 1313208 - RNA, 19 nt, Homo sapiens
ucacuacaccugaagcuua

SEQ ID NO: 1313209 - RNA, 19 nt, Homo sapiens
ggugaaaccucgucucuac

SEQ ID NO: 1313210 - RNA, 19 nt, Homo sapiens
ccacuuauacuucugauug

SEQ ID NO: 1313211 - RNA, 19 nt, Homo sapiens
ucccaaagcguuaggauua

SEQ ID NO: 1313212 - RNA, 19 nt, Homo sapiens
gauacagggucuuguguca

SEQ ID NO: 1313213 - RNA, 19 nt, Homo sapiens
gcacuaaagcgggacgaua

SEQ ID NO: 1313214 - RNA, 19 nt, Homo sapiens
gaaugaaaucggugagaaa

SEQ ID NO: 1313215 - RNA, 19 nt, Homo sapiens
cuucuauacugccuuauuu

SEQ ID NO: 1313216 - RNA, 19 nt, Homo sapiens
aaacagaaggcacagcuaa

SEQ ID NO: 1313217 - RNA, 19 nt, Homo sapiens
cgacuacgcccagcuaauu

SEQ ID NO: 1313218 - RNA, 19 nt, Homo sapiens
gcgggcagauuacaugaga

SEQ ID NO: 1313219 - RNA, 19 nt, Homo sapiens
gcccaccugucacaucuuu

SEQ ID NO: 1313220 - RNA, 19 nt, Homo sapiens
ggagugcaauggcgcaauc

SEQ ID NO: 1313221 - RNA, 19 nt, Homo sapiens
caauuggccagacauuuaa

SEQ ID NO: 1313222 - RNA, 19 nt, Homo sapiens
uuaaggcaauaugguguua

SEQ ID NO: 1313223 - RNA, 19 nt, Homo sapiens
cacuacaccugaagcuuaa

SEQ ID NO: 1313224 - RNA, 19 nt, Homo sapiens
auacagugcuaaucuuguu

SEQ ID NO: 1313225 - RNA, 19 nt, Homo sapiens
gugcaauggcgcaaucaua

SEQ ID NO: 1313226 - RNA, 19 nt, Homo sapiens
ggaagccucgccauaaugu

SEQ ID NO: 1313227 - RNA, 19 nt, Homo sapiens
ccuccaaugucaauaacaa

SEQ ID NO: 1313228 - RNA, 19 nt, Homo sapiens
ugaaaccucgucucuacua

SEQ ID NO: 1313229 - RNA, 19 nt, Homo sapiens
ccaaagcguuaggauuaug

SEQ ID NO: 1313230 - RNA, 19 nt, Homo sapiens
gcaaucaauggcugucuug

SEQ ID NO: 1313231 - RNA, 19 nt, Homo sapiens
gcacagcuaacggccagua

SEQ ID NO: 1313232 - RNA, 19 nt, Homo sapiens
ccuucuaauuugccacuua

SEQ ID NO: 1313233 - RNA, 19 nt, Homo sapiens
gcaaucauagcacacugaa

SEQ ID NO: 1313234 - RNA, 19 nt, Homo sapiens
uaacuugucccucaucucu

SEQ ID NO: 1313235 - RNA, 19 nt, Homo sapiens
ucacugcgcccaccuguca

SEQ ID NO: 1313236 - RNA, 19 nt, Homo sapiens
ggaauacuuggaaccuuga

SEQ ID NO: 1313237 - RNA, 19 nt, Homo sapiens
gcaccgacaccgcccaaau

SEQ ID NO: 1313238 - RNA, 19 nt, Homo sapiens
ugccuaggcuggucuugaa

SEQ ID NO: 1313239 - RNA, 19 nt, Homo sapiens
gaaccuugacaccgcugua

SEQ ID NO: 1313240 - RNA, 19 nt, Homo sapiens
ccggaagccucgccauaau

SEQ ID NO: 1313241 - RNA, 19 nt, Homo sapiens
uuucuucuauacugccuua

SEQ ID NO: 1313242 - RNA, 19 nt, Homo sapiens
ggcaaucaauggcugucuu

SEQ ID NO: 1313243 - RNA, 19 nt, Homo sapiens
guggaucacuacaccugaa

SEQ ID NO: 1313244 - RNA, 19 nt, Homo sapiens
gcguuaggauuauguaaaa

SEQ ID NO: 1313245 - RNA, 19 nt, Homo sapiens
uaucccaacuuaacugaag

SEQ ID NO: 1313246 - RNA, 19 nt, Homo sapiens
uuacaaacccaaccauaca

SEQ ID NO: 1313247 - RNA, 19 nt, Homo sapiens
ggagccguaacgacaauaa

SEQ ID NO: 1313248 - RNA, 19 nt, Homo sapiens
guaguaggcaacacagaug

SEQ ID NO: 1313249 - RNA, 19 nt, Homo sapiens
cacuuauacuucugauuga

SEQ ID NO: 1313250 - RNA, 19 nt, Homo sapiens
cuucuaauuugccacuuau

SEQ ID NO: 1313251 - RNA, 19 nt, Homo sapiens
gcgcccaccugucacaucu

SEQ ID NO: 1313252 - RNA, 19 nt, Homo sapiens
caauggcugucuugcucaa

SEQ ID NO: 1313253 - RNA, 19 nt, Homo sapiens
guagcuauuuucucguaua

SEQ ID NO: 1313254 - RNA, 19 nt, Homo sapiens
gacuacgcccagcuaauuu

SEQ ID NO: 1313255 - RNA, 19 nt, Homo sapiens
gcaaaucucaucacuuccu

SEQ ID NO: 1313256 - RNA, 19 nt, Homo sapiens
cgagggcauuaaggcaaua

SEQ ID NO: 1313257 - RNA, 19 nt, Homo sapiens
caaacagaaggcacagcua

SEQ ID NO: 1313258 - RNA, 19 nt, Homo sapiens
gacuuguccuccaauguca

SEQ ID NO: 1313259 - RNA, 19 nt, Homo sapiens
ggagagagagagagagacu

SEQ ID NO: 1313260 - RNA, 19 nt, Homo sapiens
ccaaguaguaggcaacaca

SEQ ID NO: 1313261 - RNA, 19 nt, Homo sapiens
aaggcaauaugguguuaug

SEQ ID NO: 1313262 - RNA, 19 nt, Homo sapiens
ccauacagugcuaaucuug

SEQ ID NO: 1313263 - RNA, 19 nt, Homo sapiens
gcuauuuucucguauaaca

SEQ ID NO: 1313264 - RNA, 19 nt, Homo sapiens
gucaauaacaacaaacuag

SEQ ID NO: 1313265 - RNA, 19 nt, Homo sapiens
gaucaaugagugcgggaau

SEQ ID NO: 1313266 - RNA, 19 nt, Homo sapiens
caugagaccaggcguucaa

SEQ ID NO: 1313267 - RNA, 19 nt, Homo sapiens
gcccugcacccuacguaaa

SEQ ID NO: 1313268 - RNA, 19 nt, Homo sapiens
gcucaauuggccagacauu

SEQ ID NO: 1313269 - RNA, 19 nt, Homo sapiens
gugacuccgucucaaaaua

SEQ ID NO: 1313270 - RNA, 19 nt, Homo sapiens
aaaccucgucucuacuaaa

SEQ ID NO: 1313271 - RNA, 19 nt, Homo sapiens
caauaaucguguccaccau

SEQ ID NO: 1313272 - RNA, 19 nt, Homo sapiens
ucugauugauuccuuugug

SEQ ID NO: 1313273 - RNA, 19 nt, Homo sapiens
guuacaaacccaaccauac

SEQ ID NO: 1313274 - RNA, 19 nt, Homo sapiens
ccucaucucuguuuugugu

SEQ ID NO: 1313275 - RNA, 19 nt, Homo sapiens
cccaaagcguuaggauuau

SEQ ID NO: 1313276 - RNA, 19 nt, Homo sapiens
gcacacugaagccuugaca

SEQ ID NO: 1313277 - RNA, 19 nt, Homo sapiens
gauugauuccuuuguguag

SEQ ID NO: 1313278 - RNA, 19 nt, Homo sapiens
ugauugauuccuuugugua

SEQ ID NO: 1313279 - RNA, 19 nt, Homo sapiens
caaagcguuaggauuaugu

SEQ ID NO: 1313280 - RNA, 19 nt, Homo sapiens
ggcagagaauugcuugaac

SEQ ID NO: 1313281 - RNA, 19 nt, Homo sapiens
ccuccgcauuccgacauua

SEQ ID NO: 1313282 - RNA, 19 nt, Homo sapiens
aaacuucgagggcauuaag

SEQ ID NO: 1313283 - RNA, 19 nt, Homo sapiens
ccaaugucaauaacaacaa

SEQ ID NO: 1313284 - RNA, 19 nt, Homo sapiens
aggcugaggcagagaauug

SEQ ID NO: 1313285 - RNA, 19 nt, Homo sapiens
auaaucguguccaccauuc

SEQ ID NO: 1313286 - RNA, 19 nt, Homo sapiens
uaggagccguaacgacaau

SEQ ID NO: 1313287 - RNA, 19 nt, Homo sapiens
ucaucucuguuuuguguua

SEQ ID NO: 1313288 - RNA, 19 nt, Homo sapiens
ccacccaggcccaacaugu

SEQ ID NO: 1313289 - RNA, 19 nt, Homo sapiens
ucaaugagugcgggaauuc

SEQ ID NO: 1313290 - RNA, 19 nt, Homo sapiens
caucacuuccugucugguu

SEQ ID NO: 1313291 - RNA, 19 nt, Homo sapiens
ugccacaggucagcuaugu

SEQ ID NO: 1313292 - RNA, 19 nt, Homo sapiens
gagaaaugaggguccuaca

SEQ ID NO: 1313293 - RNA, 19 nt, Homo sapiens
guagauuagaguuacacaa

SEQ ID NO: 1313294 - RNA, 19 nt, Homo sapiens
uggcugucuugcucaauug

SEQ ID NO: 1313295 - RNA, 19 nt, Homo sapiens
cacuaaagcgggacgauag

SEQ ID NO: 1313296 - RNA, 19 nt, Homo sapiens
cccggaagccucgccauaa

SEQ ID NO: 1313297 - RNA, 19 nt, Homo sapiens
cugauugauuccuuugugu

SEQ ID NO: 1313298 - RNA, 19 nt, Homo sapiens
cugcuucuguggauguaga

SEQ ID NO: 1313299 - RNA, 19 nt, Homo sapiens
ucgagggcauuaaggcaau

SEQ ID NO: 1313300 - RNA, 19 nt, Homo sapiens
caaggucaggcccgacuuc

SEQ ID NO: 1313301 - RNA, 19 nt, Homo sapiens
ucacagaaauggccagaua

SEQ ID NO: 1313302 - RNA, 19 nt, Homo sapiens
ugaagagccugacgaauaa

SEQ ID NO: 1313303 - RNA, 19 nt, Homo sapiens
cagaaagacugcugaggua

SEQ ID NO: 1313304 - RNA, 19 nt, Homo sapiens
ggaacagucaguuuaguua

SEQ ID NO: 1313305 - RNA, 19 nt, Homo sapiens
ucagauuucuccaacaaua

SEQ ID NO: 1313306 - RNA, 19 nt, Homo sapiens
ggaacaaccucaucugaag

SEQ ID NO: 1313307 - RNA, 19 nt, Homo sapiens
ccagauaccucagcuuauu

SEQ ID NO: 1313308 - RNA, 19 nt, Homo sapiens
ggaaagaacaucaaacaag

SEQ ID NO: 1313309 - RNA, 19 nt, Homo sapiens
cuacagagcagcaagagua

SEQ ID NO: 1313310 - RNA, 19 nt, Homo sapiens
gaacagucaguuuaguuaa

SEQ ID NO: 1313311 - RNA, 19 nt, Homo sapiens
cugaagagccugacgaaua

SEQ ID NO: 1313312 - RNA, 19 nt, Homo sapiens
gcacaaggccagcuucugu

SEQ ID NO: 1313313 - RNA, 19 nt, Homo sapiens
gcacagagagcuccuugga

SEQ ID NO: 1313314 - RNA, 19 nt, Homo sapiens
cuacgcaugugccaacuuu

SEQ ID NO: 1313315 - RNA, 19 nt, Homo sapiens
caaaugucuuggaggagua

SEQ ID NO: 1313316 - RNA, 19 nt, Homo sapiens
gaacagcgucucaggaaca

SEQ ID NO: 1313317 - RNA, 19 nt, Homo sapiens
uaacaugggcuuucagaau

SEQ ID NO: 1313318 - RNA, 19 nt, Homo sapiens
ggccucagcuguccuugaa

SEQ ID NO: 1313319 - RNA, 19 nt, Homo sapiens
aaucacaacuggcagagaa

SEQ ID NO: 1313320 - RNA, 19 nt, Homo sapiens
gggccaacaccaacaguua

SEQ ID NO: 1313321 - RNA, 19 nt, Homo sapiens
gcucaaagcaacacaacuu

SEQ ID NO: 1313322 - RNA, 19 nt, Homo sapiens
ggauuggucuaaacuucaa

SEQ ID NO: 1313323 - RNA, 19 nt, Homo sapiens
caccagauaccucagcuua

SEQ ID NO: 1313324 - RNA, 19 nt, Homo sapiens
ccaagugucugaagugaac

SEQ ID NO: 1313325 - RNA, 19 nt, Homo sapiens
ccguggaggugaaguauga

SEQ ID NO: 1313326 - RNA, 19 nt, Homo sapiens
ugacaugauucuugaucuu

SEQ ID NO: 1313327 - RNA, 19 nt, Homo sapiens
gacagaagaccguggagaa

SEQ ID NO: 1313328 - RNA, 19 nt, Homo sapiens
gagcuccucuucuguaagg

SEQ ID NO: 1313329 - RNA, 19 nt, Homo sapiens
ccaucuggcuggacaaugu

SEQ ID NO: 1313330 - RNA, 19 nt, Homo sapiens
caggauuggucuaaacuuc

SEQ ID NO: 1313331 - RNA, 19 nt, Homo sapiens
gcugagcuccucuucugua

SEQ ID NO: 1313332 - RNA, 19 nt, Homo sapiens
ccaaagacuggacgcgaua

SEQ ID NO: 1313333 - RNA, 19 nt, Homo sapiens
cacauggguguuucuauua

SEQ ID NO: 1313334 - RNA, 19 nt, Homo sapiens
gcaggagacggccuacuug

SEQ ID NO: 1313335 - RNA, 19 nt, Homo sapiens
guaaggaaacccagucauc

SEQ ID NO: 1313336 - RNA, 19 nt, Homo sapiens
ggacuggcccuacggauac

SEQ ID NO: 1313337 - RNA, 19 nt, Homo sapiens
gggagcgugugcagugaaa

SEQ ID NO: 1313338 - RNA, 19 nt, Homo sapiens
gacaaagccacaacgcaaa

SEQ ID NO: 1313339 - RNA, 19 nt, Homo sapiens
cgugugugaugacaacuuu

SEQ ID NO: 1313340 - RNA, 19 nt, Homo sapiens
agaagaccguggagaaauc

SEQ ID NO: 1313341 - RNA, 19 nt, Homo sapiens
guccuuaccuuuaucuuac

SEQ ID NO: 1313342 - RNA, 19 nt, Homo sapiens
aauauguccuccaggcuuu

SEQ ID NO: 1313343 - RNA, 19 nt, Homo sapiens
ggguggauaucacagaugu

SEQ ID NO: 1313344 - RNA, 19 nt, Homo sapiens
gaugaacgcccagcuagug

SEQ ID NO: 1313345 - RNA, 19 nt, Homo sapiens
ggguggaagugcucaugaa

SEQ ID NO: 1313346 - RNA, 19 nt, Homo sapiens
gaaagucugggaucugaag

SEQ ID NO: 1313347 - RNA, 19 nt, Homo sapiens
gaugacaacuuugcuaucc

SEQ ID NO: 1313348 - RNA, 19 nt, Homo sapiens
gacaugauucuugaucuuu

SEQ ID NO: 1313349 - RNA, 19 nt, Homo sapiens
gggaacagucaguuuaguu

SEQ ID NO: 1313350 - RNA, 19 nt, Homo sapiens
gauccaauccuuucuucau

SEQ ID NO: 1313351 - RNA, 19 nt, Homo sapiens
uuaguguccuuaccuuuau

SEQ ID NO: 1313352 - RNA, 19 nt, Homo sapiens
gccuguggccuauggaaua

SEQ ID NO: 1313353 - RNA, 19 nt, Homo sapiens
agucagauuucuccaacaa

SEQ ID NO: 1313354 - RNA, 19 nt, Homo sapiens
gaaguggcagagucagauu

SEQ ID NO: 1313355 - RNA, 19 nt, Homo sapiens
cauuauggacugcuacaaa

SEQ ID NO: 1313356 - RNA, 19 nt, Homo sapiens
cuucaagucucaaccaagu

SEQ ID NO: 1313357 - RNA, 19 nt, Homo sapiens
caagaucaccaauccagau

SEQ ID NO: 1313358 - RNA, 19 nt, Homo sapiens
aacaugggcuuucagaauc

SEQ ID NO: 1313359 - RNA, 19 nt, Homo sapiens
caucguggcuaccuuucug

SEQ ID NO: 1313360 - RNA, 19 nt, Homo sapiens
uuuaguguccuuaccuuua

SEQ ID NO: 1313361 - RNA, 19 nt, Homo sapiens
ccaucuaaguggugcuuug

SEQ ID NO: 1313362 - RNA, 19 nt, Homo sapiens
gccaugcccuucacagagu

SEQ ID NO: 1313363 - RNA, 19 nt, Homo sapiens
ccacagcauugaggucuuc

SEQ ID NO: 1313364 - RNA, 19 nt, Homo sapiens
gaagggucccagaaugguu

SEQ ID NO: 1313365 - RNA, 19 nt, Homo sapiens
aggaaagucugggaucuga

SEQ ID NO: 1313366 - RNA, 19 nt, Homo sapiens
caaccaagugucugaagug

SEQ ID NO: 1313367 - RNA, 19 nt, Homo sapiens
cagccacccucuuucuguu

SEQ ID NO: 1313368 - RNA, 19 nt, Homo sapiens
ccacgcaucucaggauugg

SEQ ID NO: 1313369 - RNA, 19 nt, Homo sapiens
aaagacugcugagguaaca

SEQ ID NO: 1313370 - RNA, 19 nt, Homo sapiens
gaaagacugcugagguaac

SEQ ID NO: 1313371 - RNA, 19 nt, Homo sapiens
acauggguguuucuauuau

SEQ ID NO: 1313372 - RNA, 19 nt, Homo sapiens
ggacagaggaccaaaauac

SEQ ID NO: 1313373 - RNA, 19 nt, Homo sapiens
gaacugccucuccaagucu

SEQ ID NO: 1313374 - RNA, 19 nt, Homo sapiens
ccacugagacacacuuaag

SEQ ID NO: 1313375 - RNA, 19 nt, Homo sapiens
caggagcucucaguuucuu

SEQ ID NO: 1313376 - RNA, 19 nt, Homo sapiens
gagccaugcccuucacaga

SEQ ID NO: 1313377 - RNA, 19 nt, Homo sapiens
caggaacaaccucaucuga

SEQ ID NO: 1313378 - RNA, 19 nt, Homo sapiens
gaauucauacccagccaau

SEQ ID NO: 1313379 - RNA, 19 nt, Homo sapiens
acaagccacucaucucuac

SEQ ID NO: 1313380 - RNA, 19 nt, Homo sapiens
caaacaagccacucaucuc

SEQ ID NO: 1313381 - RNA, 19 nt, Homo sapiens
aagaguaggccaagcagaa

SEQ ID NO: 1313382 - RNA, 19 nt, Homo sapiens
caacaguuacggagugcuu

SEQ ID NO: 1313383 - RNA, 19 nt, Homo sapiens
uguccuuaccuuuaucuua

SEQ ID NO: 1313384 - RNA, 19 nt, Homo sapiens
ucucacacucuguucuuua

SEQ ID NO: 1313385 - RNA, 19 nt, Homo sapiens
agaacugccucuccaaguc

SEQ ID NO: 1313386 - RNA, 19 nt, Homo sapiens
gaagaccguggagaaauca

SEQ ID NO: 1313387 - RNA, 19 nt, Homo sapiens
aaacaagccacucaucucu

SEQ ID NO: 1313388 - RNA, 19 nt, Homo sapiens
ccucagcuguccuugaagu

SEQ ID NO: 1313389 - RNA, 19 nt, Homo sapiens
guuacggagugcuugagaa

SEQ ID NO: 1313390 - RNA, 19 nt, Homo sapiens
ucuaaguggugcuuugcaa

SEQ ID NO: 1313391 - RNA, 19 nt, Homo sapiens
uucaggagcucucaguuuc

SEQ ID NO: 1313392 - RNA, 19 nt, Homo sapiens
gagcaggaacagcgucuca

SEQ ID NO: 1313393 - RNA, 19 nt, Homo sapiens
aaaaguugcucauuaugga

SEQ ID NO: 1313394 - RNA, 19 nt, Homo sapiens
ucaaccaagugucugaagu

SEQ ID NO: 1313395 - RNA, 19 nt, Homo sapiens
uaaguggugcuuugcaaau

SEQ ID NO: 1313396 - RNA, 19 nt, Homo sapiens
ggugaugaacgcccagcua

SEQ ID NO: 1313397 - RNA, 19 nt, Homo sapiens
caccacgcaucucaggauu

SEQ ID NO: 1313398 - RNA, 19 nt, Homo sapiens
cagggccucugccaaggaa

SEQ ID NO: 1313399 - RNA, 19 nt, Homo sapiens
gagccguggaggugaagua

SEQ ID NO: 1313400 - RNA, 19 nt, Homo sapiens
gggcucugauuugcucuug

SEQ ID NO: 1313401 - RNA, 19 nt, Homo sapiens
gaacagaucuucaugaaug

SEQ ID NO: 1313402 - RNA, 19 nt, Homo sapiens
ggacaguacuauacaaaua

SEQ ID NO: 1313403 - RNA, 19 nt, Homo sapiens
gcaaagaggccaauguuua

SEQ ID NO: 1313404 - RNA, 19 nt, Homo sapiens
gaaguacaguuguuacaua

SEQ ID NO: 1313405 - RNA, 19 nt, Homo sapiens
caaauauucuggugacuua

SEQ ID NO: 1313406 - RNA, 19 nt, Homo sapiens
caacagaucuuuagaccuu

SEQ ID NO: 1313407 - RNA, 19 nt, Homo sapiens
uaagaggacuaucagauua

SEQ ID NO: 1313408 - RNA, 19 nt, Homo sapiens
gauggucugucacuaauua

SEQ ID NO: 1313409 - RNA, 19 nt, Homo sapiens
gaaguuagaugacgaugga

SEQ ID NO: 1313410 - RNA, 19 nt, Homo sapiens
gaugagagcuuuccuaagg

SEQ ID NO: 1313411 - RNA, 19 nt, Homo sapiens
guaacuggauguuguuuaa

SEQ ID NO: 1313412 - RNA, 19 nt, Homo sapiens
ggacaauccugauaguuug

SEQ ID NO: 1313413 - RNA, 19 nt, Homo sapiens
gacgauggauugccguuua

SEQ ID NO: 1313414 - RNA, 19 nt, Homo sapiens
uugcauaacugaagcuuua

SEQ ID NO: 1313415 - RNA, 19 nt, Homo sapiens
ggucagcucuuccuuaugu

SEQ ID NO: 1313416 - RNA, 19 nt, Homo sapiens
guaauucuuuccugaguuu

SEQ ID NO: 1313417 - RNA, 19 nt, Homo sapiens
cuacaagucugaguucaua

SEQ ID NO: 1313418 - RNA, 19 nt, Homo sapiens
gaagaugccaugauuguga

SEQ ID NO: 1313419 - RNA, 19 nt, Homo sapiens
gaccuacccucuuaacaaa

SEQ ID NO: 1313420 - RNA, 19 nt, Homo sapiens
gaacuuagcauugggcaaa

SEQ ID NO: 1313421 - RNA, 19 nt, Homo sapiens
caugaacacugacaauuug

SEQ ID NO: 1313422 - RNA, 19 nt, Homo sapiens
aaugcaagcuguaauguaa

SEQ ID NO: 1313423 - RNA, 19 nt, Homo sapiens
gacccuccauguaugauua

SEQ ID NO: 1313424 - RNA, 19 nt, Homo sapiens
gagcguaucucuuuuacua

SEQ ID NO: 1313425 - RNA, 19 nt, Homo sapiens
ccaccuaacugccguaugu

SEQ ID NO: 1313426 - RNA, 19 nt, Homo sapiens
gcacaugccuguaguucca

SEQ ID NO: 1313427 - RNA, 19 nt, Homo sapiens
ugacaagucuccuuuccaa

SEQ ID NO: 1313428 - RNA, 19 nt, Homo sapiens
gaacauuccgcugucaaua

SEQ ID NO: 1313429 - RNA, 19 nt, Homo sapiens
ucugguagauuaacuauug

SEQ ID NO: 1313430 - RNA, 19 nt, Homo sapiens
gcuuuccacuucucacuua

SEQ ID NO: 1313431 - RNA, 19 nt, Homo sapiens
caaagaggccaauguuuau

SEQ ID NO: 1313432 - RNA, 19 nt, Homo sapiens
ugacuuaucuuuggccauu

SEQ ID NO: 1313433 - RNA, 19 nt, Homo sapiens
cagauucucuucgucauuu

SEQ ID NO: 1313434 - RNA, 19 nt, Homo sapiens
ucucagauguuaaggauug

SEQ ID NO: 1313435 - RNA, 19 nt, Homo sapiens
acaccuaacucaagaccua

SEQ ID NO: 1313436 - RNA, 19 nt, Homo sapiens
guaauaaacauaccuguca

SEQ ID NO: 1313437 - RNA, 19 nt, Homo sapiens
gcacacaccuuugauacca

SEQ ID NO: 1313438 - RNA, 19 nt, Homo sapiens
ggacagccuggguaauaua

SEQ ID NO: 1313439 - RNA, 19 nt, Homo sapiens
ggauggaagugguccuuau

SEQ ID NO: 1313440 - RNA, 19 nt, Homo sapiens
gaucauacagugagugcua

SEQ ID NO: 1313441 - RNA, 19 nt, Homo sapiens
uaaagacccugaccucaag

SEQ ID NO: 1313442 - RNA, 19 nt, Homo sapiens
gaaugcaagcuguaaugua

SEQ ID NO: 1313443 - RNA, 19 nt, Homo sapiens
gauaguagccugguguuug

SEQ ID NO: 1313444 - RNA, 19 nt, Homo sapiens
gaaugucgcuaucuuugag

SEQ ID NO: 1313445 - RNA, 19 nt, Homo sapiens
gaggguugguugacacaaa

SEQ ID NO: 1313446 - RNA, 19 nt, Homo sapiens
auagugggaucaugcaaua

SEQ ID NO: 1313447 - RNA, 19 nt, Homo sapiens
gguaagaacaccuaacuca

SEQ ID NO: 1313448 - RNA, 19 nt, Homo sapiens
gcaggacaguacuauacaa

SEQ ID NO: 1313449 - RNA, 19 nt, Homo sapiens
uuagaacucucaaccaaga

SEQ ID NO: 1313450 - RNA, 19 nt, Homo sapiens
ccagguuacucuugagauu

SEQ ID NO: 1313451 - RNA, 19 nt, Homo sapiens
caaagaagagcuaauugga

SEQ ID NO: 1313452 - RNA, 19 nt, Homo sapiens
gcucagaagaccaguguuu

SEQ ID NO: 1313453 - RNA, 19 nt, Homo sapiens
gauaagaaggcucagaaga

SEQ ID NO: 1313454 - RNA, 19 nt, Homo sapiens
gcaucuguauccacuugua

SEQ ID NO: 1313455 - RNA, 19 nt, Homo sapiens
gcacgauauaguauuguua

SEQ ID NO: 1313456 - RNA, 19 nt, Homo sapiens
ggugagacccuccauguau

SEQ ID NO: 1313457 - RNA, 19 nt, Homo sapiens
gauggaagugguccuuaua

SEQ ID NO: 1313458 - RNA, 19 nt, Homo sapiens
ggaagaggguugguugaca

SEQ ID NO: 1313459 - RNA, 19 nt, Homo sapiens
gaagaacauuccgcuguca

SEQ ID NO: 1313460 - RNA, 19 nt, Homo sapiens
gagcuuuccuaagguaauu

SEQ ID NO: 1313461 - RNA, 19 nt, Homo sapiens
ugagagcuuuccuaaggua

SEQ ID NO: 1313462 - RNA, 19 nt, Homo sapiens
ggcuauaccucccuuugaa

SEQ ID NO: 1313463 - RNA, 19 nt, Homo sapiens
uggaacagaucuucaugaa

SEQ ID NO: 1313464 - RNA, 19 nt, Homo sapiens
gcaaagaagagcuaauugg

SEQ ID NO: 1313465 - RNA, 19 nt, Homo sapiens
ccaugaacacugacaauuu

SEQ ID NO: 1313466 - RNA, 19 nt, Homo sapiens
gaagguugguuagugucua

SEQ ID NO: 1313467 - RNA, 19 nt, Homo sapiens
gcagauaggaacagacaga

SEQ ID NO: 1313468 - RNA, 19 nt, Homo sapiens
gaucggauaacaaacugua

SEQ ID NO: 1313469 - RNA, 19 nt, Homo sapiens
gaagagcuaauuggaacua

SEQ ID NO: 1313470 - RNA, 19 nt, Homo sapiens
gggcaaagaagagcuaauu

SEQ ID NO: 1313471 - RNA, 19 nt, Homo sapiens
cggcaucuauuccagcuuu

SEQ ID NO: 1313472 - RNA, 19 nt, Homo sapiens
gcacuuaaggcacuuguca

SEQ ID NO: 1313473 - RNA, 19 nt, Homo sapiens
gagagugcauggaggacaa

SEQ ID NO: 1313474 - RNA, 19 nt, Homo sapiens
ggucugucacuaauuauaa

SEQ ID NO: 1313475 - RNA, 19 nt, Homo sapiens
gaugaggaccaccacagua

SEQ ID NO: 1313476 - RNA, 19 nt, Homo sapiens
gaacacugacaauuugaug

SEQ ID NO: 1313477 - RNA, 19 nt, Homo sapiens
guuaaggauuguaauggaa

SEQ ID NO: 1313478 - RNA, 19 nt, Homo sapiens
gcacagaggggcugauuuu

SEQ ID NO: 1313479 - RNA, 19 nt, Homo sapiens
cugcggaguuccuguuuaa

SEQ ID NO: 1313480 - RNA, 19 nt, Homo sapiens
uaaggcacuugucagcuuu

SEQ ID NO: 1313481 - RNA, 19 nt, Homo sapiens
aagaacaccuaacucaaga

SEQ ID NO: 1313482 - RNA, 19 nt, Homo sapiens
ucacacaccuguuaaucca

SEQ ID NO: 1313483 - RNA, 19 nt, Homo sapiens
cuacaagauucuggacuuu

SEQ ID NO: 1313484 - RNA, 19 nt, Homo sapiens
gcugcggaguuccuguuua

SEQ ID NO: 1313485 - RNA, 19 nt, Homo sapiens
gaaguugacagcugauauc

SEQ ID NO: 1313486 - RNA, 19 nt, Homo sapiens
gagcaggacaguacuauac

SEQ ID NO: 1313487 - RNA, 19 nt, Homo sapiens
gcauggugcugugcaucua

SEQ ID NO: 1313488 - RNA, 19 nt, Homo sapiens
gugggaucaugcaauauuu

SEQ ID NO: 1313489 - RNA, 19 nt, Homo sapiens
ccugucaucuccacaaguu

SEQ ID NO: 1313490 - RNA, 19 nt, Homo sapiens
caagaccgaucggauaaca

SEQ ID NO: 1313491 - RNA, 19 nt, Homo sapiens
gugcagaacuuagcauugg

SEQ ID NO: 1313492 - RNA, 19 nt, Homo sapiens
uauaugcuuugucucauga

SEQ ID NO: 1313493 - RNA, 19 nt, Homo sapiens
gugcaucuguauccacuug

SEQ ID NO: 1313494 - RNA, 19 nt, Homo sapiens
gauuaugccucggagaaau

SEQ ID NO: 1313495 - RNA, 19 nt, Homo sapiens
cccauaaucccaacacuuu

SEQ ID NO: 1313496 - RNA, 19 nt, Homo sapiens
ccacuaaucccaacauuuu

SEQ ID NO: 1313497 - RNA, 19 nt, Homo sapiens
gguaauucuuuccugaguu

SEQ ID NO: 1313498 - RNA, 19 nt, Homo sapiens
gcaaauauucuggugacuu

SEQ ID NO: 1313499 - RNA, 19 nt, Homo sapiens
gaagcuuuauaccuguuga

SEQ ID NO: 1313500 - RNA, 19 nt, Homo sapiens
uuacuugucuugcauaacu

SEQ ID NO: 1313501 - RNA, 19 nt, Homo sapiens
ggacaguacuauacaaaua

SEQ ID NO: 1313502 - RNA, 19 nt, Homo sapiens
gaaguacaguuguuacaua

SEQ ID NO: 1313503 - RNA, 19 nt, Homo sapiens
caaauauucuggugacuua

SEQ ID NO: 1313504 - RNA, 19 nt, Homo sapiens
caacagaucuuuagaccuu

SEQ ID NO: 1313505 - RNA, 19 nt, Homo sapiens
gaaguuagaugacgaugga

SEQ ID NO: 1313506 - RNA, 19 nt, Homo sapiens
uaucagcgcuuacgccaua

SEQ ID NO: 1313507 - RNA, 19 nt, Homo sapiens
ucauaggagugguuuauua

SEQ ID NO: 1313508 - RNA, 19 nt, Homo sapiens
gacgauggauugccguuua

SEQ ID NO: 1313509 - RNA, 19 nt, Homo sapiens
uugcauaacugaagcuuua

SEQ ID NO: 1313510 - RNA, 19 nt, Homo sapiens
acacuuaacucaagaccua

SEQ ID NO: 1313511 - RNA, 19 nt, Homo sapiens
cuacaagucugaguucaua

SEQ ID NO: 1313512 - RNA, 19 nt, Homo sapiens
gaagaugccaugauuguga

SEQ ID NO: 1313513 - RNA, 19 nt, Homo sapiens
gaccuacccucuuaacaaa

SEQ ID NO: 1313514 - RNA, 19 nt, Homo sapiens
aaugcaagcuguaauguaa

SEQ ID NO: 1313515 - RNA, 19 nt, Homo sapiens
gacccuccauguaugauua

SEQ ID NO: 1313516 - RNA, 19 nt, Homo sapiens
gaacucggccuuagaauac

SEQ ID NO: 1313517 - RNA, 19 nt, Homo sapiens
ugacaagucuccuuuccaa

SEQ ID NO: 1313518 - RNA, 19 nt, Homo sapiens
ucugguagauuaacuauug

SEQ ID NO: 1313519 - RNA, 19 nt, Homo sapiens
gcuuuccacuucucacuua

SEQ ID NO: 1313520 - RNA, 19 nt, Homo sapiens
ugacuuaucuuuggccauu

SEQ ID NO: 1313521 - RNA, 19 nt, Homo sapiens
guaauaaacauaccuguca

SEQ ID NO: 1313522 - RNA, 19 nt, Homo sapiens
gcacacaccuuugauacca

SEQ ID NO: 1313523 - RNA, 19 nt, Homo sapiens
gcuaugaacaucaaaguga

SEQ ID NO: 1313524 - RNA, 19 nt, Homo sapiens
ccauugggauguuaauuga

SEQ ID NO: 1313525 - RNA, 19 nt, Homo sapiens
gaacccaacuaucggagau

SEQ ID NO: 1313526 - RNA, 19 nt, Homo sapiens
ggacagccuggguaauaua

SEQ ID NO: 1313527 - RNA, 19 nt, Homo sapiens
ggagaacucggccuuagaa

SEQ ID NO: 1313528 - RNA, 19 nt, Homo sapiens
gaaugcaagcuguaaugua

SEQ ID NO: 1313529 - RNA, 19 nt, Homo sapiens
gauaguagccugguguuug

SEQ ID NO: 1313530 - RNA, 19 nt, Homo sapiens
gaaugucgcuaucuuugag

SEQ ID NO: 1313531 - RNA, 19 nt, Homo sapiens
auagugggaucaugcaaua

SEQ ID NO: 1313532 - RNA, 19 nt, Homo sapiens
gcaggacaguacuauacaa

SEQ ID NO: 1313533 - RNA, 19 nt, Homo sapiens
uuagaacucucaaccaaga

SEQ ID NO: 1313534 - RNA, 19 nt, Homo sapiens
ccagguuacucuugagauu

SEQ ID NO: 1313535 - RNA, 19 nt, Homo sapiens
gcaccgagagguuauauag

SEQ ID NO: 1313536 - RNA, 19 nt, Homo sapiens
gcacgauauaguauuguua

SEQ ID NO: 1313537 - RNA, 19 nt, Homo sapiens
ggugagacccuccauguau

SEQ ID NO: 1313538 - RNA, 19 nt, Homo sapiens
ggauguuaauugagaguau

SEQ ID NO: 1313539 - RNA, 19 nt, Homo sapiens
gaucggauaacaaacugua

SEQ ID NO: 1313540 - RNA, 19 nt, Homo sapiens
gaggagaacucggccuuag

SEQ ID NO: 1313541 - RNA, 19 nt, Homo sapiens
ugugaaguguggcaguuua

SEQ ID NO: 1313542 - RNA, 19 nt, Homo sapiens
agacaaauuucaaguaagg

SEQ ID NO: 1313543 - RNA, 19 nt, Homo sapiens
uaaggggacuaucagauua

SEQ ID NO: 1313544 - RNA, 19 nt, Homo sapiens
uaggagugguuuauuauca

SEQ ID NO: 1313545 - RNA, 19 nt, Homo sapiens
ucacacaccuguuaaucca

SEQ ID NO: 1313546 - RNA, 19 nt, Homo sapiens
gagcaggacaguacuauac

SEQ ID NO: 1313547 - RNA, 19 nt, Homo sapiens
auacuuuggugagauguua

SEQ ID NO: 1313548 - RNA, 19 nt, Homo sapiens
ugaagacccugaccucaag

SEQ ID NO: 1313549 - RNA, 19 nt, Homo sapiens
gcauggugcugugcaucua

SEQ ID NO: 1313550 - RNA, 19 nt, Homo sapiens
gugggaucaugcaauauuu

SEQ ID NO: 1313551 - RNA, 19 nt, Homo sapiens
ccugucaucuccacaaguu

SEQ ID NO: 1313552 - RNA, 19 nt, Homo sapiens
caagaccgaucggauaaca

SEQ ID NO: 1313553 - RNA, 19 nt, Homo sapiens
gcaaauauucuggugacuu

SEQ ID NO: 1313554 - RNA, 19 nt, Homo sapiens
gaagcuuuauaccuguuga

SEQ ID NO: 1313555 - RNA, 19 nt, Homo sapiens
ggaacgggaugcgcuuuua

SEQ ID NO: 1313556 - RNA, 19 nt, Homo sapiens
uuacuugucuugcauaacu

SEQ ID NO: 1313557 - RNA, 19 nt, Homo sapiens
uuaagugcacgauauagua

SEQ ID NO: 1313558 - RNA, 19 nt, Homo sapiens
aaacaaacagguacagugu

SEQ ID NO: 1313559 - RNA, 19 nt, Homo sapiens
acuaugggcuuuccacuuc

SEQ ID NO: 1313560 - RNA, 19 nt, Homo sapiens
ugcaauauuuguccuguga

SEQ ID NO: 1313561 - RNA, 19 nt, Homo sapiens
uugaacaacucuccauuuc

SEQ ID NO: 1313562 - RNA, 19 nt, Homo sapiens
ugaugggucugacuauaug

SEQ ID NO: 1313563 - RNA, 19 nt, Homo sapiens
uaccagcuuuauagaagua

SEQ ID NO: 1313564 - RNA, 19 nt, Homo sapiens
gaacaucaaagugaaacug

SEQ ID NO: 1313565 - RNA, 19 nt, Homo sapiens
gaacuggcagcuaugaaca

SEQ ID NO: 1313566 - RNA, 19 nt, Homo sapiens
gacacuaucgauacuguuu

SEQ ID NO: 1313567 - RNA, 19 nt, Homo sapiens
auguugaucugcuuucaua

SEQ ID NO: 1313568 - RNA, 19 nt, Homo sapiens
aaggacagccuggguaaua

SEQ ID NO: 1313569 - RNA, 19 nt, Homo sapiens
gaguuugacuauuacagau

SEQ ID NO: 1313570 - RNA, 19 nt, Homo sapiens
gauguuguuuaacuugaug

SEQ ID NO: 1313571 - RNA, 19 nt, Homo sapiens
agaacucggccuuagaaua

SEQ ID NO: 1313572 - RNA, 19 nt, Homo sapiens
cgggaagucugcagcuuug

SEQ ID NO: 1313573 - RNA, 19 nt, Homo sapiens
ucauagaccucucugaaaa

SEQ ID NO: 1313574 - RNA, 19 nt, Homo sapiens
ucguugcugugauuucuua

SEQ ID NO: 1313575 - RNA, 19 nt, Homo sapiens
gugagacccuccauguaug

SEQ ID NO: 1313576 - RNA, 19 nt, Homo sapiens
cgaaagugcuaggauuaca

SEQ ID NO: 1313577 - RNA, 19 nt, Homo sapiens
gauaccaucaccacaauca

SEQ ID NO: 1313578 - RNA, 19 nt, Homo sapiens
gagcauacggugacaaguc

SEQ ID NO: 1313579 - RNA, 19 nt, Homo sapiens
guucaugucuucucaaaau

SEQ ID NO: 1313580 - RNA, 19 nt, Homo sapiens
uguuagaacucucaaccaa

SEQ ID NO: 1313581 - RNA, 19 nt, Homo sapiens
gauguuaauugagaguaug

SEQ ID NO: 1313582 - RNA, 19 nt, Homo sapiens
agucuacacuuccauacuu

SEQ ID NO: 1313583 - RNA, 19 nt, Homo sapiens
agauaucauuaccagguua

SEQ ID NO: 1313584 - RNA, 19 nt, Homo sapiens
ugcaagcuguaauguaauu

SEQ ID NO: 1313585 - RNA, 19 nt, Homo sapiens
ugagugugauugccaacuu

SEQ ID NO: 1313586 - RNA, 19 nt, Homo sapiens
cuaugaacaucaaagugaa

SEQ ID NO: 1313587 - RNA, 19 nt, Homo sapiens
cauaggagugguuuauuau

SEQ ID NO: 1313588 - RNA, 19 nt, Homo sapiens
agaauacuuuggugagaug

SEQ ID NO: 1313589 - RNA, 19 nt, Homo sapiens
caugaccauugggauguua

SEQ ID NO: 1313590 - RNA, 19 nt, Homo sapiens
ucaugaaugucgcuaucuu

SEQ ID NO: 1313591 - RNA, 19 nt, Homo sapiens
uuugguugcuguugaguuu

SEQ ID NO: 1313592 - RNA, 19 nt, Homo sapiens
uaugcaagguuucugaauc

SEQ ID NO: 1313593 - RNA, 19 nt, Homo sapiens
ggauguuguuuaacuugau

SEQ ID NO: 1313594 - RNA, 19 nt, Homo sapiens
ccacggaacauguaccaau

SEQ ID NO: 1313595 - RNA, 19 nt, Homo sapiens
gaggugggaggaucauuug

SEQ ID NO: 1313596 - RNA, 19 nt, Homo sapiens
cacggaacauguaccaaug

SEQ ID NO: 1313597 - RNA, 19 nt, Homo sapiens
gaccuuacuugucuugcau

SEQ ID NO: 1313598 - RNA, 19 nt, Homo sapiens
agaccuacccucuuaacaa

SEQ ID NO: 1313599 - RNA, 19 nt, Homo sapiens
gcaugaccauugggauguu

SEQ ID NO: 1313600 - RNA, 19 nt, Homo sapiens
guggauaacaucaaagugu

SEQ ID NO: 1313601 - RNA, 19 nt, Homo sapiens
ggacaaagcucacaugaac

SEQ ID NO: 1313602 - RNA, 19 nt, Homo sapiens
gcaauucccuuucuguuug

SEQ ID NO: 1313603 - RNA, 19 nt, Homo sapiens
ggucagagcccaagaagaa

SEQ ID NO: 1313604 - RNA, 19 nt, Homo sapiens
caaagggacuguuuucuua

SEQ ID NO: 1313605 - RNA, 19 nt, Homo sapiens
cgagaugaauggaggcuua

SEQ ID NO: 1313606 - RNA, 19 nt, Homo sapiens
ccacauagcuucugaucuc

SEQ ID NO: 1313607 - RNA, 19 nt, Homo sapiens
ggagaauucugccuuaauc

SEQ ID NO: 1313608 - RNA, 19 nt, Homo sapiens
cacagaagcuuaugaaugg

SEQ ID NO: 1313609 - RNA, 19 nt, Homo sapiens
ggacuucucucagcacuca

SEQ ID NO: 1313610 - RNA, 19 nt, Homo sapiens
ugacaagcauauauucuga

SEQ ID NO: 1313611 - RNA, 19 nt, Homo sapiens
gagccaggguccaauaguu

SEQ ID NO: 1313612 - RNA, 19 nt, Homo sapiens
gggagugaauggaucauga

SEQ ID NO: 1313613 - RNA, 19 nt, Homo sapiens
ucaagacccuggagcugua

SEQ ID NO: 1313614 - RNA, 19 nt, Homo sapiens
ccacagaagcuuaugaaug

SEQ ID NO: 1313615 - RNA, 19 nt, Homo sapiens
gaucucagaccuuacuaaa

SEQ ID NO: 1313616 - RNA, 19 nt, Homo sapiens
gaagugcuaugggccagaa

SEQ ID NO: 1313617 - RNA, 19 nt, Homo sapiens
acaagaguguucuggcuuu

SEQ ID NO: 1313618 - RNA, 19 nt, Homo sapiens
aagauugucugcuggauau

SEQ ID NO: 1313619 - RNA, 19 nt, Homo sapiens
agagugaccugcagucuca

SEQ ID NO: 1313620 - RNA, 19 nt, Homo sapiens
aaaucuugcucuuuccaua

SEQ ID NO: 1313621 - RNA, 19 nt, Homo sapiens
cauccacacuuucucaaau

SEQ ID NO: 1313622 - RNA, 19 nt, Homo sapiens
ggacacagcggaagaccau

SEQ ID NO: 1313623 - RNA, 19 nt, Homo sapiens
gggaggaccugggcuuuca

SEQ ID NO: 1313624 - RNA, 19 nt, Homo sapiens
gaaauucauaccagcaguu

SEQ ID NO: 1313625 - RNA, 19 nt, Homo sapiens
ggaggagauucccaaguag

SEQ ID NO: 1313626 - RNA, 19 nt, Homo sapiens
gagcgaauccagccacaga

SEQ ID NO: 1313627 - RNA, 19 nt, Homo sapiens
guuggacuauucaaaguug

SEQ ID NO: 1313628 - RNA, 19 nt, Homo sapiens
ggucuuauacuuaugacaa

SEQ ID NO: 1313629 - RNA, 19 nt, Homo sapiens
uuucucaaauuccagcuua

SEQ ID NO: 1313630 - RNA, 19 nt, Homo sapiens
gaaggcguauggcugaucu

SEQ ID NO: 1313631 - RNA, 19 nt, Homo sapiens
gaaagauugucugcuggau

SEQ ID NO: 1313632 - RNA, 19 nt, Homo sapiens
ggaaggaggaaauucauac

SEQ ID NO: 1313633 - RNA, 19 nt, Homo sapiens
aagcucacaugaacaaaug

SEQ ID NO: 1313634 - RNA, 19 nt, Homo sapiens
gggaaggaggaaauucaua

SEQ ID NO: 1313635 - RNA, 19 nt, Homo sapiens
caaauuccagcuuaccaaa

SEQ ID NO: 1313636 - RNA, 19 nt, Homo sapiens
gaaucccuaucucagaguu

SEQ ID NO: 1313637 - RNA, 19 nt, Homo sapiens
gaauucugccuuaaucugu

SEQ ID NO: 1313638 - RNA, 19 nt, Homo sapiens
uugcagaguuggaaguauu

SEQ ID NO: 1313639 - RNA, 19 nt, Homo sapiens
gaaugggagccacguguug

SEQ ID NO: 1313640 - RNA, 19 nt, Homo sapiens
gaccacagaagcuuaugaa

SEQ ID NO: 1313641 - RNA, 19 nt, Homo sapiens
gagggaaggaggaaauuca

SEQ ID NO: 1313642 - RNA, 19 nt, Homo sapiens
ggguugaauuccaguguau

SEQ ID NO: 1313643 - RNA, 19 nt, Homo sapiens
gggacaggccuccuuguug

SEQ ID NO: 1313644 - RNA, 19 nt, Homo sapiens
cuugaggccuugacuguug

SEQ ID NO: 1313645 - RNA, 19 nt, Homo sapiens
cagacaagguagagugugu

SEQ ID NO: 1313646 - RNA, 19 nt, Homo sapiens
gaggaaucccuaucucaga

SEQ ID NO: 1313647 - RNA, 19 nt, Homo sapiens
ucacuuacccacucucuuc

SEQ ID NO: 1313648 - RNA, 19 nt, Homo sapiens
ucucagaccuuacuaaaau

SEQ ID NO: 1313649 - RNA, 19 nt, Homo sapiens
caaggaaggcaaagguaga

SEQ ID NO: 1313650 - RNA, 19 nt, Homo sapiens
ggugguugcuagacugguu

SEQ ID NO: 1313651 - RNA, 19 nt, Homo sapiens
caauucccuuucuguuuga

SEQ ID NO: 1313652 - RNA, 19 nt, Homo sapiens
gcugaccggcuccaaguuu

SEQ ID NO: 1313653 - RNA, 19 nt, Homo sapiens
acaaagcucacaugaacaa

SEQ ID NO: 1313654 - RNA, 19 nt, Homo sapiens
uaccagcaguuuucaaaua

SEQ ID NO: 1313655 - RNA, 19 nt, Homo sapiens
accagugucuguguuguua

SEQ ID NO: 1313656 - RNA, 19 nt, Homo sapiens
cagcagaugggauauagga

SEQ ID NO: 1313657 - RNA, 19 nt, Homo sapiens
gagcugaggcuucgaagac

SEQ ID NO: 1313658 - RNA, 19 nt, Homo sapiens
ccacugcggcugcucaaga

SEQ ID NO: 1313659 - RNA, 19 nt, Homo sapiens
gggaagcuguggacaccau

SEQ ID NO: 1313660 - RNA, 19 nt, Homo sapiens
gaaggcaaagguagagcaa

SEQ ID NO: 1313661 - RNA, 19 nt, Homo sapiens
ggacagggugaaagauugu

SEQ ID NO: 1313662 - RNA, 19 nt, Homo sapiens
gaggagauucccaaguaga

SEQ ID NO: 1313663 - RNA, 19 nt, Homo sapiens
gagaggcgcaggcuuccuu

SEQ ID NO: 1313664 - RNA, 19 nt, Homo sapiens
gugaggcccugcagcacuu

SEQ ID NO: 1313665 - RNA, 19 nt, Homo sapiens
ggagccacguguugugagu

SEQ ID NO: 1313666 - RNA, 19 nt, Homo sapiens
ucucagaguugaagaacca

SEQ ID NO: 1313667 - RNA, 19 nt, Homo sapiens
aaagauugucugcuggaua

SEQ ID NO: 1313668 - RNA, 19 nt, Homo sapiens
uggacagggugaaagauug

SEQ ID NO: 1313669 - RNA, 19 nt, Homo sapiens
guagaggcagccagaauuc

SEQ ID NO: 1313670 - RNA, 19 nt, Homo sapiens
cugagugacugccaaggaa

SEQ ID NO: 1313671 - RNA, 19 nt, Homo sapiens
gaaguauuggccaagaaga

SEQ ID NO: 1313672 - RNA, 19 nt, Homo sapiens
caucauaugacaaggacaa

SEQ ID NO: 1313673 - RNA, 19 nt, Homo sapiens
ggaaguauuggccaagaag

SEQ ID NO: 1313674 - RNA, 19 nt, Homo sapiens
acaagcauauauucugauc

SEQ ID NO: 1313675 - RNA, 19 nt, Homo sapiens
gcaccagugucuguguugu

SEQ ID NO: 1313676 - RNA, 19 nt, Homo sapiens
cggguugaauuccagugua

SEQ ID NO: 1313677 - RNA, 19 nt, Homo sapiens
ugucucagcagaugggaua

SEQ ID NO: 1313678 - RNA, 19 nt, Homo sapiens
auucaaaguugcaauugug

SEQ ID NO: 1313679 - RNA, 19 nt, Homo sapiens
uccagaccaucuauaagaa

SEQ ID NO: 1313680 - RNA, 19 nt, Homo sapiens
ucucagcacucacagaaac

SEQ ID NO: 1313681 - RNA, 19 nt, Homo sapiens
guuucuggccauucacuua

SEQ ID NO: 1313682 - RNA, 19 nt, Homo sapiens
gcuccagucuccggguuga

SEQ ID NO: 1313683 - RNA, 19 nt, Homo sapiens
agaccugccuccagagcaa

SEQ ID NO: 1313684 - RNA, 19 nt, Homo sapiens
gccaaggaaggcaaaggua

SEQ ID NO: 1313685 - RNA, 19 nt, Homo sapiens
gagcagccugggcagcuaa

SEQ ID NO: 1313686 - RNA, 19 nt, Homo sapiens
gacaaggacaagaguguuc

SEQ ID NO: 1313687 - RNA, 19 nt, Homo sapiens
augaguuucuggccuaauu

SEQ ID NO: 1313688 - RNA, 19 nt, Homo sapiens
cagugucuguguuguuaga

SEQ ID NO: 1313689 - RNA, 19 nt, Homo sapiens
gagaugaauggaggcuuaa

SEQ ID NO: 1313690 - RNA, 19 nt, Homo sapiens
gcccuuuucuggucuuaua

SEQ ID NO: 1313691 - RNA, 19 nt, Homo sapiens
ccaaggugguugcuagacu

SEQ ID NO: 1313692 - RNA, 19 nt, Homo sapiens
aaagaauccagccaacuau

SEQ ID NO: 1313693 - RNA, 19 nt, Homo sapiens
caagaguguucuggcuuuc

SEQ ID NO: 1313694 - RNA, 19 nt, Homo sapiens
guacuuggccaggguguca

SEQ ID NO: 1313695 - RNA, 19 nt, Homo sapiens
cagcaauucccuuucuguu

SEQ ID NO: 1313696 - RNA, 19 nt, Homo sapiens
gcacaaagggacuguuuuc

SEQ ID NO: 1313697 - RNA, 19 nt, Homo sapiens
gagacagggagccaagcua

SEQ ID NO: 1313698 - RNA, 19 nt, Homo sapiens
gaugaauggaggcuuaaag

SEQ ID NO: 1313699 - RNA, 19 nt, Homo sapiens
guaaucggcagcagaaggu

SEQ ID NO: 1313700 - RNA, 19 nt, Homo sapiens
acugugcccuucauggaaa

SEQ ID NO: 1313701 - RNA, 19 nt, Homo sapiens
aagcugagaugaugucuua

SEQ ID NO: 1313702 - RNA, 19 nt, Homo sapiens
gcagacagaugcugagcua

SEQ ID NO: 1313703 - RNA, 19 nt, Homo sapiens
ggacaccacucaacuggaa

SEQ ID NO: 1313704 - RNA, 19 nt, Homo sapiens
caccaugccuggcuaauuu

SEQ ID NO: 1313705 - RNA, 19 nt, Homo sapiens
uaacaccucuuaagucuag

SEQ ID NO: 1313706 - RNA, 19 nt, Homo sapiens
cuaguuaguucuugaguuu

SEQ ID NO: 1313707 - RNA, 19 nt, Homo sapiens
ugacgaggcugucucuuug

SEQ ID NO: 1313708 - RNA, 19 nt, Homo sapiens
cagaggaacugcuguuguu

SEQ ID NO: 1313709 - RNA, 19 nt, Homo sapiens
gcucucagaucucuauuuc

SEQ ID NO: 1313710 - RNA, 19 nt, Homo sapiens
cagaauagcugggauuaca

SEQ ID NO: 1313711 - RNA, 19 nt, Homo sapiens
ggacggugcugucugaagu

SEQ ID NO: 1313712 - RNA, 19 nt, Homo sapiens
ucaacagguucucaauuaa

SEQ ID NO: 1313713 - RNA, 19 nt, Homo sapiens
ggaggagucucuucucagu

SEQ ID NO: 1313714 - RNA, 19 nt, Homo sapiens
gacaauggcuggcuguaca

SEQ ID NO: 1313715 - RNA, 19 nt, Homo sapiens
aucaacagguucucaauua

SEQ ID NO: 1313716 - RNA, 19 nt, Homo sapiens
caacagguucucaauuaaa

SEQ ID NO: 1313717 - RNA, 19 nt, Homo sapiens
gaaaggaaagcugagauga

SEQ ID NO: 1313718 - RNA, 19 nt, Homo sapiens
gaccacagccuacaccaaa

SEQ ID NO: 1313719 - RNA, 19 nt, Homo sapiens
acucugagcuggcggauga

SEQ ID NO: 1313720 - RNA, 19 nt, Homo sapiens
caauuucccucgaugaugu

SEQ ID NO: 1313721 - RNA, 19 nt, Homo sapiens
caaggacacuggcagacuu

SEQ ID NO: 1313722 - RNA, 19 nt, Homo sapiens
gagaaagacuucggacagu

SEQ ID NO: 1313723 - RNA, 19 nt, Homo sapiens
gagcaaagagaaagacuuc

SEQ ID NO: 1313724 - RNA, 19 nt, Homo sapiens
gguggacggugcugucuga

SEQ ID NO: 1313725 - RNA, 19 nt, Homo sapiens
aaggaaagcugagaugaug

SEQ ID NO: 1313726 - RNA, 19 nt, Homo sapiens
aaccaaggcugcacaccua

SEQ ID NO: 1313727 - RNA, 19 nt, Homo sapiens
ucucagaucucuauuucau

SEQ ID NO: 1313728 - RNA, 19 nt, Homo sapiens
cagccuagcucucagaucu

SEQ ID NO: 1313729 - RNA, 19 nt, Homo sapiens
ggaaaggaaagcugagaug

SEQ ID NO: 1313730 - RNA, 19 nt, Homo sapiens
ugagugcucugcugaggaa

SEQ ID NO: 1313731 - RNA, 19 nt, Homo sapiens
aauaacaccucuuaagucu

SEQ ID NO: 1313732 - RNA, 19 nt, Homo sapiens
ccaaagugcugggauuaca

SEQ ID NO: 1313733 - RNA, 19 nt, Homo sapiens
ggagaaagcagaggaacug

SEQ ID NO: 1313734 - RNA, 19 nt, Homo sapiens
ggacacagaggugcaucua

SEQ ID NO: 1313735 - RNA, 19 nt, Homo sapiens
agaaagaggucugcuggau

SEQ ID NO: 1313736 - RNA, 19 nt, Homo sapiens
uaugugaccuccagagcaa

SEQ ID NO: 1313737 - RNA, 19 nt, Homo sapiens
ugaccuaguuaguucuuga

SEQ ID NO: 1313738 - RNA, 19 nt, Homo sapiens
gaugaugccuaggcccaaa

SEQ ID NO: 1313739 - RNA, 19 nt, Homo sapiens
gacaucugcugccuacuca

SEQ ID NO: 1313740 - RNA, 19 nt, Homo sapiens
aggagucucuucucaguga

SEQ ID NO: 1313741 - RNA, 19 nt, Homo sapiens
cagucuagguccucaaaug

SEQ ID NO: 1313742 - RNA, 19 nt, Homo sapiens
ggugcugucugaagucuca

SEQ ID NO: 1313743 - RNA, 19 nt, Homo sapiens
gacggagucuugcccuguu

SEQ ID NO: 1313744 - RNA, 19 nt, Homo sapiens
ucagggagaggaagaaaga

SEQ ID NO: 1313745 - RNA, 19 nt, Homo sapiens
cagaaucccuaaggagaau

SEQ ID NO: 1313746 - RNA, 19 nt, Homo sapiens
gaaacaaccccuagaguca

SEQ ID NO: 1313747 - RNA, 19 nt, Homo sapiens
ucccucagcuucuacauca

SEQ ID NO: 1313748 - RNA, 19 nt, Homo sapiens
caucaacagguucucaauu

SEQ ID NO: 1313749 - RNA, 19 nt, Homo sapiens
gcacccagccuagcucuca

SEQ ID NO: 1313750 - RNA, 19 nt, Homo sapiens
gaccauggaagcagagaga

SEQ ID NO: 1313751 - RNA, 19 nt, Homo sapiens
caaaccaauuucccucgau

SEQ ID NO: 1313752 - RNA, 19 nt, Homo sapiens
ccagaaucccuaaggagaa

SEQ ID NO: 1313753 - RNA, 19 nt, Homo sapiens
ggaaagcugagaugauguc

SEQ ID NO: 1313754 - RNA, 19 nt, Homo sapiens
uggaugcccugccuguuga

SEQ ID NO: 1313755 - RNA, 19 nt, Homo sapiens
uaucagguaucaucaacag

SEQ ID NO: 1313756 - RNA, 19 nt, Homo sapiens
uaagcccucucuccacaau

SEQ ID NO: 1313757 - RNA, 19 nt, Homo sapiens
ugccucagccuccagaaua

SEQ ID NO: 1313758 - RNA, 19 nt, Homo sapiens
cauugaccaucgucucuga

SEQ ID NO: 1313759 - RNA, 19 nt, Homo sapiens
aaauaacaccucuuaaguc

SEQ ID NO: 1313760 - RNA, 19 nt, Homo sapiens
caccuagccucucccugaa

SEQ ID NO: 1313761 - RNA, 19 nt, Homo sapiens
ucucuuagcccuuagaagu

SEQ ID NO: 1313762 - RNA, 19 nt, Homo sapiens
gaggaacaaugggaagucu

SEQ ID NO: 1313763 - RNA, 19 nt, Homo sapiens
gaucagggagaggaagaaa

SEQ ID NO: 1313764 - RNA, 19 nt, Homo sapiens
caccaaauccagcccuuga

SEQ ID NO: 1313765 - RNA, 19 nt, Homo sapiens
ccaccaccauaccucagaa

SEQ ID NO: 1313766 - RNA, 19 nt, Homo sapiens
ccuagccucucccugaaga

SEQ ID NO: 1313767 - RNA, 19 nt, Homo sapiens
gugcagaggacaccacuca

SEQ ID NO: 1313768 - RNA, 19 nt, Homo sapiens
ucuccuggauucaaacaau

SEQ ID NO: 1313769 - RNA, 19 nt, Homo sapiens
ccuaguuaguucuugaguu

SEQ ID NO: 1313770 - RNA, 19 nt, Homo sapiens
aggcaaggcugugcacuca

SEQ ID NO: 1313771 - RNA, 19 nt, Homo sapiens
gacagucuagguccucaaa

SEQ ID NO: 1313772 - RNA, 19 nt, Homo sapiens
ccuguacccuugcucuuuc

SEQ ID NO: 1313773 - RNA, 19 nt, Homo sapiens
gcagaggacaccacucaac

SEQ ID NO: 1313774 - RNA, 19 nt, Homo sapiens
gauauaccccuaccuguga

SEQ ID NO: 1313775 - RNA, 19 nt, Homo sapiens
ccaccaugccuggcuaauu

SEQ ID NO: 1313776 - RNA, 19 nt, Homo sapiens
caaggcugcacaccuagaa

SEQ ID NO: 1313777 - RNA, 19 nt, Homo sapiens
cagguaucaucaacagguu

SEQ ID NO: 1313778 - RNA, 19 nt, Homo sapiens
ccuacugguucccaagcua

SEQ ID NO: 1313779 - RNA, 19 nt, Homo sapiens
aaaggaaagcugagaugau

SEQ ID NO: 1313780 - RNA, 19 nt, Homo sapiens
uuuccucucuuagcccuua

SEQ ID NO: 1313781 - RNA, 19 nt, Homo sapiens
gaaugacgaggcugucucu

SEQ ID NO: 1313782 - RNA, 19 nt, Homo sapiens
gauccacugccuugacaau

SEQ ID NO: 1313783 - RNA, 19 nt, Homo sapiens
aacagguucucaauuaaag

SEQ ID NO: 1313784 - RNA, 19 nt, Homo sapiens
caacagccccagcucuuuu

SEQ ID NO: 1313785 - RNA, 19 nt, Homo sapiens
cuugcucuuuccucucuua

SEQ ID NO: 1313786 - RNA, 19 nt, Homo sapiens
gaccaucgucucugaggau

SEQ ID NO: 1313787 - RNA, 19 nt, Homo sapiens
ccugcugccuccauaaaca

SEQ ID NO: 1313788 - RNA, 19 nt, Homo sapiens
gaugguccaggcucuaugu

SEQ ID NO: 1313789 - RNA, 19 nt, Homo sapiens
gaccggaucagacacuaca

SEQ ID NO: 1313790 - RNA, 19 nt, Homo sapiens
gggaccggaucagacacua

SEQ ID NO: 1313791 - RNA, 19 nt, Homo sapiens
gcugagcuacccaaaccaa

SEQ ID NO: 1313792 - RNA, 19 nt, Homo sapiens
gcucuuacucucugucagu

SEQ ID NO: 1313793 - RNA, 19 nt, Homo sapiens
gaggaacugcuguuguuac

SEQ ID NO: 1313794 - RNA, 19 nt, Homo sapiens
ucccauggguggcuguaug

SEQ ID NO: 1313795 - RNA, 19 nt, Homo sapiens
ccacagccuacaccaaauc

SEQ ID NO: 1313796 - RNA, 19 nt, Homo sapiens
gccucagccuccagaauag

SEQ ID NO: 1313797 - RNA, 19 nt, Homo sapiens
uaccguagcagcagaucuu

SEQ ID NO: 1313798 - RNA, 19 nt, Homo sapiens
gcccaaaggagaggccaaa

SEQ ID NO: 1313799 - RNA, 19 nt, Homo sapiens
gugcucugcugaggaacaa

SEQ ID NO: 1313800 - RNA, 19 nt, Homo sapiens
auccaucccugguguacaa

SEQ ID NO: 1313801 - RNA, 19 nt, Homo sapiens
aagcugagaugaugucuua

SEQ ID NO: 1313802 - RNA, 19 nt, Homo sapiens
gcagacagaugcugagcua

SEQ ID NO: 1313803 - RNA, 19 nt, Homo sapiens
ggacaccacucaacuggaa

SEQ ID NO: 1313804 - RNA, 19 nt, Homo sapiens
caccaugccuggcuaauuu

SEQ ID NO: 1313805 - RNA, 19 nt, Homo sapiens
uaacaccucuuaagucuag

SEQ ID NO: 1313806 - RNA, 19 nt, Homo sapiens
cuaguuaguucuugaguuu

SEQ ID NO: 1313807 - RNA, 19 nt, Homo sapiens
ugacgaggcugucucuuug

SEQ ID NO: 1313808 - RNA, 19 nt, Homo sapiens
cagaggaacugcuguuguu

SEQ ID NO: 1313809 - RNA, 19 nt, Homo sapiens
gcucucagaucucuauuuc

SEQ ID NO: 1313810 - RNA, 19 nt, Homo sapiens
cagaauagcugggauuaca

SEQ ID NO: 1313811 - RNA, 19 nt, Homo sapiens
ggacggugcugucugaagu

SEQ ID NO: 1313812 - RNA, 19 nt, Homo sapiens
ucaacagguucucaauuaa

SEQ ID NO: 1313813 - RNA, 19 nt, Homo sapiens
ggaggagucucuucucagu

SEQ ID NO: 1313814 - RNA, 19 nt, Homo sapiens
gacaauggcuggcuguaca

SEQ ID NO: 1313815 - RNA, 19 nt, Homo sapiens
aucaacagguucucaauua

SEQ ID NO: 1313816 - RNA, 19 nt, Homo sapiens
caacagguucucaauuaaa

SEQ ID NO: 1313817 - RNA, 19 nt, Homo sapiens
gaaaggaaagcugagauga

SEQ ID NO: 1313818 - RNA, 19 nt, Homo sapiens
gaccacagccuacaccaaa

SEQ ID NO: 1313819 - RNA, 19 nt, Homo sapiens
caauuucccucgaugaugu

SEQ ID NO: 1313820 - RNA, 19 nt, Homo sapiens
caaggacacuggcagacuu

SEQ ID NO: 1313821 - RNA, 19 nt, Homo sapiens
gagaaagacuucggacagu

SEQ ID NO: 1313822 - RNA, 19 nt, Homo sapiens
gagcaaagagaaagacuuc

SEQ ID NO: 1313823 - RNA, 19 nt, Homo sapiens
gguggacggugcugucuga

SEQ ID NO: 1313824 - RNA, 19 nt, Homo sapiens
aaggaaagcugagaugaug

SEQ ID NO: 1313825 - RNA, 19 nt, Homo sapiens
aaccaaggcugcacaccua

SEQ ID NO: 1313826 - RNA, 19 nt, Homo sapiens
ucucagaucucuauuucau

SEQ ID NO: 1313827 - RNA, 19 nt, Homo sapiens
cagccuagcucucagaucu

SEQ ID NO: 1313828 - RNA, 19 nt, Homo sapiens
ggaaaggaaagcugagaug

SEQ ID NO: 1313829 - RNA, 19 nt, Homo sapiens
ugagugcucugcugaggaa

SEQ ID NO: 1313830 - RNA, 19 nt, Homo sapiens
aauaacaccucuuaagucu

SEQ ID NO: 1313831 - RNA, 19 nt, Homo sapiens
ccaaagugcugggauuaca

SEQ ID NO: 1313832 - RNA, 19 nt, Homo sapiens
ggagaaagcagaggaacug

SEQ ID NO: 1313833 - RNA, 19 nt, Homo sapiens
ggacacagaggugcaucua

SEQ ID NO: 1313834 - RNA, 19 nt, Homo sapiens
agaaagaggucugcuggau

SEQ ID NO: 1313835 - RNA, 19 nt, Homo sapiens
uaugugaccuccagagcaa

SEQ ID NO: 1313836 - RNA, 19 nt, Homo sapiens
ugaccuaguuaguucuuga

SEQ ID NO: 1313837 - RNA, 19 nt, Homo sapiens
gaugaugccuaggcccaaa

SEQ ID NO: 1313838 - RNA, 19 nt, Homo sapiens
aggagucucuucucaguga

SEQ ID NO: 1313839 - RNA, 19 nt, Homo sapiens
cagucuagguccucaaaug

SEQ ID NO: 1313840 - RNA, 19 nt, Homo sapiens
ggugcugucugaagucuca

SEQ ID NO: 1313841 - RNA, 19 nt, Homo sapiens
gacggagucuugcccuguu

SEQ ID NO: 1313842 - RNA, 19 nt, Homo sapiens
ucagggagaggaagaaaga

SEQ ID NO: 1313843 - RNA, 19 nt, Homo sapiens
cagaaucccuaaggagaau

SEQ ID NO: 1313844 - RNA, 19 nt, Homo sapiens
gaaacaaccccuagaguca

SEQ ID NO: 1313845 - RNA, 19 nt, Homo sapiens
ucccucagcuucuacauca

SEQ ID NO: 1313846 - RNA, 19 nt, Homo sapiens
caucaacagguucucaauu

SEQ ID NO: 1313847 - RNA, 19 nt, Homo sapiens
gcacccagccuagcucuca

SEQ ID NO: 1313848 - RNA, 19 nt, Homo sapiens
gaccauggaagcagagaga

SEQ ID NO: 1313849 - RNA, 19 nt, Homo sapiens
caaaccaauuucccucgau

SEQ ID NO: 1313850 - RNA, 19 nt, Homo sapiens
ccagaaucccuaaggagaa

SEQ ID NO: 1313851 - RNA, 19 nt, Homo sapiens
ggaaagcugagaugauguc

SEQ ID NO: 1313852 - RNA, 19 nt, Homo sapiens
uggaugcccugccuguuga

SEQ ID NO: 1313853 - RNA, 19 nt, Homo sapiens
uaucagguaucaucaacag

SEQ ID NO: 1313854 - RNA, 19 nt, Homo sapiens
uaagcccucucuccacaau

SEQ ID NO: 1313855 - RNA, 19 nt, Homo sapiens
ugccucagccuccagaaua

SEQ ID NO: 1313856 - RNA, 19 nt, Homo sapiens
cauugaccaucgucucuga

SEQ ID NO: 1313857 - RNA, 19 nt, Homo sapiens
aaauaacaccucuuaaguc

SEQ ID NO: 1313858 - RNA, 19 nt, Homo sapiens
caccuagccucucccugaa

SEQ ID NO: 1313859 - RNA, 19 nt, Homo sapiens
ucucuuagcccuuagaagu

SEQ ID NO: 1313860 - RNA, 19 nt, Homo sapiens
gaggaacaaugggaagucu

SEQ ID NO: 1313861 - RNA, 19 nt, Homo sapiens
gaucagggagaggaagaaa

SEQ ID NO: 1313862 - RNA, 19 nt, Homo sapiens
caccaaauccagcccuuga

SEQ ID NO: 1313863 - RNA, 19 nt, Homo sapiens
ccaccaccauaccucagaa

SEQ ID NO: 1313864 - RNA, 19 nt, Homo sapiens
ccuagccucucccugaaga

SEQ ID NO: 1313865 - RNA, 19 nt, Homo sapiens
gugcagaggacaccacuca

SEQ ID NO: 1313866 - RNA, 19 nt, Homo sapiens
ucuccuggauucaaacaau

SEQ ID NO: 1313867 - RNA, 19 nt, Homo sapiens
ccuaguuaguucuugaguu

SEQ ID NO: 1313868 - RNA, 19 nt, Homo sapiens
aggcaaggcugugcacuca

SEQ ID NO: 1313869 - RNA, 19 nt, Homo sapiens
gacagucuagguccucaaa

SEQ ID NO: 1313870 - RNA, 19 nt, Homo sapiens
ccuguacccuugcucuuuc

SEQ ID NO: 1313871 - RNA, 19 nt, Homo sapiens
gcagaggacaccacucaac

SEQ ID NO: 1313872 - RNA, 19 nt, Homo sapiens
gauauaccccuaccuguga

SEQ ID NO: 1313873 - RNA, 19 nt, Homo sapiens
ccaccaugccuggcuaauu

SEQ ID NO: 1313874 - RNA, 19 nt, Homo sapiens
caaggcugcacaccuagaa

SEQ ID NO: 1313875 - RNA, 19 nt, Homo sapiens
cagguaucaucaacagguu

SEQ ID NO: 1313876 - RNA, 19 nt, Homo sapiens
ccuacugguucccaagcua

SEQ ID NO: 1313877 - RNA, 19 nt, Homo sapiens
aaaggaaagcugagaugau

SEQ ID NO: 1313878 - RNA, 19 nt, Homo sapiens
uuuccucucuuagcccuua

SEQ ID NO: 1313879 - RNA, 19 nt, Homo sapiens
gaaugacgaggcugucucu

SEQ ID NO: 1313880 - RNA, 19 nt, Homo sapiens
gauccacugccuugacaau

SEQ ID NO: 1313881 - RNA, 19 nt, Homo sapiens
aacagguucucaauuaaag

SEQ ID NO: 1313882 - RNA, 19 nt, Homo sapiens
caacagccccagcucuuuu

SEQ ID NO: 1313883 - RNA, 19 nt, Homo sapiens
cuugcucuuuccucucuua

SEQ ID NO: 1313884 - RNA, 19 nt, Homo sapiens
gaccaucgucucugaggau

SEQ ID NO: 1313885 - RNA, 19 nt, Homo sapiens
ccugcugccuccauaaaca

SEQ ID NO: 1313886 - RNA, 19 nt, Homo sapiens
gaugguccaggcucuaugu

SEQ ID NO: 1313887 - RNA, 19 nt, Homo sapiens
gaccggaucagacacuaca

SEQ ID NO: 1313888 - RNA, 19 nt, Homo sapiens
gggaccggaucagacacua

SEQ ID NO: 1313889 - RNA, 19 nt, Homo sapiens
gcucuuacucucugucagu

SEQ ID NO: 1313890 - RNA, 19 nt, Homo sapiens
gaggaacugcuguuguuac

SEQ ID NO: 1313891 - RNA, 19 nt, Homo sapiens
gcugagcuacccaaaccaa

SEQ ID NO: 1313892 - RNA, 19 nt, Homo sapiens
ucccauggguggcuguaug

SEQ ID NO: 1313893 - RNA, 19 nt, Homo sapiens
gugcucugcugaggaacaa

SEQ ID NO: 1313894 - RNA, 19 nt, Homo sapiens
ccacagccuacaccaaauc

SEQ ID NO: 1313895 - RNA, 19 nt, Homo sapiens
gccucagccuccagaauag

SEQ ID NO: 1313896 - RNA, 19 nt, Homo sapiens
uaccguagcagcagaucuu

SEQ ID NO: 1313897 - RNA, 19 nt, Homo sapiens
gcccaaaggagaggccaaa

SEQ ID NO: 1313898 - RNA, 19 nt, Homo sapiens
auccaucccugguguacaa

SEQ ID NO: 1313899 - RNA, 19 nt, Homo sapiens
gggaaaggaaagcugagau

SEQ ID NO: 1313900 - RNA, 19 nt, Homo sapiens
guugagaccaccaccauac

SEQ ID NO: 1313901 - RNA, 19 nt, Homo sapiens
gaacaaggccuaugucauc

SEQ ID NO: 1313902 - RNA, 19 nt, Homo sapiens
ggaccaagcacuucacuga

SEQ ID NO: 1313903 - RNA, 19 nt, Homo sapiens
caagaagggugaggacauu

SEQ ID NO: 1313904 - RNA, 19 nt, Homo sapiens
ccacaggcaugaucuuugu

SEQ ID NO: 1313905 - RNA, 19 nt, Homo sapiens
guccaagcguccagguuua

SEQ ID NO: 1313906 - RNA, 19 nt, Homo sapiens
gugaggacauuccguuaau

SEQ ID NO: 1313907 - RNA, 19 nt, Homo sapiens
gaggcgaacuggaacaucu

SEQ ID NO: 1313908 - RNA, 19 nt, Homo sapiens
ucaagcugcucauguggaa

SEQ ID NO: 1313909 - RNA, 19 nt, Homo sapiens
gguccaagcguccagguuu

SEQ ID NO: 1313910 - RNA, 19 nt, Homo sapiens
ggaguuggcggucgagugu

SEQ ID NO: 1313911 - RNA, 19 nt, Homo sapiens
cgucauugcugaggacuug

SEQ ID NO: 1313912 - RNA, 19 nt, Homo sapiens
ggugaggacauuccguuaa

SEQ ID NO: 1313913 - RNA, 19 nt, Homo sapiens
ucacugaggccaccaagau

SEQ ID NO: 1313914 - RNA, 19 nt, Homo sapiens
gugcguggcugaacuuugc

SEQ ID NO: 1313915 - RNA, 19 nt, Homo sapiens
ggaacaaggccuaugucau

SEQ ID NO: 1313916 - RNA, 19 nt, Homo sapiens
gcagaucaacuggcuguca

SEQ ID NO: 1313917 - RNA, 19 nt, Homo sapiens
cgauggaggcgaacuggaa

SEQ ID NO: 1313918 - RNA, 19 nt, Homo sapiens
ggcucaagcugcucaugug

SEQ ID NO: 1313919 - RNA, 19 nt, Homo sapiens
ccaacaugcucgccaccau

SEQ ID NO: 1313920 - RNA, 19 nt, Homo sapiens
caagcguccagguuuauug

SEQ ID NO: 1313921 - RNA, 19 nt, Homo sapiens
gggugaggacauuccguua

SEQ ID NO: 1313922 - RNA, 19 nt, Homo sapiens
ccauggagcagaucaacug

SEQ ID NO: 1313923 - RNA, 19 nt, Homo sapiens
gcgaucagccugcucaacu

SEQ ID NO: 1313924 - RNA, 19 nt, Homo sapiens
guuaaugcucggugucuau

SEQ ID NO: 1313925 - RNA, 19 nt, Homo sapiens
gaucucugccagcuucuca

SEQ ID NO: 1313926 - RNA, 19 nt, Homo sapiens
cgaucagccugcucaacug

SEQ ID NO: 1313927 - RNA, 19 nt, Homo sapiens
gggcucaagcugcucaugu

SEQ ID NO: 1313928 - RNA, 19 nt, Homo sapiens
uuaaugcucggugucuaua

SEQ ID NO: 1313929 - RNA, 19 nt, Homo sapiens
ucaagaagggugaggacau

SEQ ID NO: 1313930 - RNA, 19 nt, Homo sapiens
ggagugugcuacgcauggu

SEQ ID NO: 1313931 - RNA, 19 nt, Homo sapiens
cauccuggcggucuucuuc

SEQ ID NO: 1313932 - RNA, 19 nt, Homo sapiens
uagcugagcgccuuguagu

SEQ ID NO: 1313933 - RNA, 19 nt, Homo sapiens
gccacaggcaugaucuuug

SEQ ID NO: 1313934 - RNA, 19 nt, Homo sapiens
cgagggaauacucaucaug

SEQ ID NO: 1313935 - RNA, 19 nt, Homo sapiens
accuguggcugacgucauu

SEQ ID NO: 1313936 - RNA, 19 nt, Homo sapiens
caaugacggcacugacugu

SEQ ID NO: 1313937 - RNA, 19 nt, Homo sapiens
gccgagggaauacucauca

SEQ ID NO: 1313938 - RNA, 19 nt, Homo sapiens
gaccggaccaagcacuuca

SEQ ID NO: 1313939 - RNA, 19 nt, Homo sapiens
ggaccggaccaagcacuuc

SEQ ID NO: 1313940 - RNA, 19 nt, Homo sapiens
ggaaacagccuucguuaga

SEQ ID NO: 1313941 - RNA, 19 nt, Homo sapiens
ggaccucgguguucacuga

SEQ ID NO: 1313942 - RNA, 19 nt, Homo sapiens
ggaacacgauugucucaga

SEQ ID NO: 1313943 - RNA, 19 nt, Homo sapiens
gaaugguucuuccggguuu

SEQ ID NO: 1313944 - RNA, 19 nt, Homo sapiens
gacgaugacuuguccauuc

SEQ ID NO: 1313945 - RNA, 19 nt, Homo sapiens
gaggaaacagccuucguua

SEQ ID NO: 1313946 - RNA, 19 nt, Homo sapiens
gaacacgauugucucagau

SEQ ID NO: 1313947 - RNA, 19 nt, Homo sapiens
gcauuucccugcacugugu

SEQ ID NO: 1313948 - RNA, 19 nt, Homo sapiens
gagcaaagccacagacgau

SEQ ID NO: 1313949 - RNA, 19 nt, Homo sapiens
ggucagacgugcuguuaag

SEQ ID NO: 1313950 - RNA, 19 nt, Homo sapiens
gaaacagccuucguuagag

SEQ ID NO: 1313951 - RNA, 19 nt, Homo sapiens
gcaaagccacagacgauga

SEQ ID NO: 1313952 - RNA, 19 nt, Homo sapiens
cagaagcgcagccuuugua

SEQ ID NO: 1313953 - RNA, 19 nt, Homo sapiens
gguguucacugaccuuugu

SEQ ID NO: 1313954 - RNA, 19 nt, Homo sapiens
ggacacauugccaugguuu

SEQ ID NO: 1313955 - RNA, 19 nt, Homo sapiens
uguggcaucugauauuaaa

SEQ ID NO: 1313956 - RNA, 19 nt, Homo sapiens
gcugcucugugucguguuu

SEQ ID NO: 1313957 - RNA, 19 nt, Homo sapiens
uguguggcaucugauauua

SEQ ID NO: 1313958 - RNA, 19 nt, Homo sapiens
gaacuuuucugcuguugug

SEQ ID NO: 1313959 - RNA, 19 nt, Homo sapiens
uuucugcuguugugaagua

SEQ ID NO: 1313960 - RNA, 19 nt, Homo sapiens
ugcgacaguuccagaauuu

SEQ ID NO: 1313961 - RNA, 19 nt, Homo sapiens
gaugacuuguccauucuca

SEQ ID NO: 1313962 - RNA, 19 nt, Homo sapiens
ggagugacaaaccgcauug

SEQ ID NO: 1313963 - RNA, 19 nt, Homo sapiens
guuguucgagguggaauua

SEQ ID NO: 1313964 - RNA, 19 nt, Homo sapiens
guauguguggcaucugaua

SEQ ID NO: 1313965 - RNA, 19 nt, Homo sapiens
uguucgagguggaauuaaa

SEQ ID NO: 1313966 - RNA, 19 nt, Homo sapiens
ugaggaaacagccuucguu

SEQ ID NO: 1313967 - RNA, 19 nt, Homo sapiens
gcucagcagcguugcaugu

SEQ ID NO: 1313968 - RNA, 19 nt, Homo sapiens
gcuggaggccuugcuuuga

SEQ ID NO: 1313969 - RNA, 19 nt, Homo sapiens
cugcgacaguuccagaauu

SEQ ID NO: 1313970 - RNA, 19 nt, Homo sapiens
gaagcgcagccuuuguaug

SEQ ID NO: 1313971 - RNA, 19 nt, Homo sapiens
gcagaagcgcagccuuugu

SEQ ID NO: 1313972 - RNA, 19 nt, Homo sapiens
gaauuugcucucccacuca

SEQ ID NO: 1313973 - RNA, 19 nt, Homo sapiens
uggcagaagcgcagccuuu

SEQ ID NO: 1313974 - RNA, 19 nt, Homo sapiens
agaagcgucugccgugauc

SEQ ID NO: 1313975 - RNA, 19 nt, Homo sapiens
cugcugacccugccaaguu

SEQ ID NO: 1313976 - RNA, 19 nt, Homo sapiens
cgcaaggacucucguaucg

SEQ ID NO: 1313977 - RNA, 19 nt, Homo sapiens
ccacagacgaugacuuguc

SEQ ID NO: 1313978 - RNA, 19 nt, Homo sapiens
ucguauguguggcaucuga

SEQ ID NO: 1313979 - RNA, 19 nt, Homo sapiens
gcucugcagcugugaggaa

SEQ ID NO: 1313980 - RNA, 19 nt, Homo sapiens
aaacaccucccagaccaaa

SEQ ID NO: 1313981 - RNA, 19 nt, Homo sapiens
ucacugaccuuuguuucac

SEQ ID NO: 1313982 - RNA, 19 nt, Homo sapiens
aagcgcagccuuuguaugg

SEQ ID NO: 1313983 - RNA, 19 nt, Homo sapiens
ccugagaguaggacacauu

SEQ ID NO: 1313984 - RNA, 19 nt, Homo sapiens
cgucugccgugaucaugga

SEQ ID NO: 1313985 - RNA, 19 nt, Homo sapiens
ugacuuguccauucucagu

SEQ ID NO: 1313986 - RNA, 19 nt, Homo sapiens
ggcagaagcgcagccuuug

SEQ ID NO: 1313987 - RNA, 19 nt, Homo sapiens
uaggacacauugccauggu

SEQ ID NO: 1313988 - RNA, 19 nt, Homo sapiens
gcucuggaccucgguguuc

SEQ ID NO: 1313989 - RNA, 19 nt, Homo sapiens
ggccuguccugagugcauu

SEQ ID NO: 1313990 - RNA, 19 nt, Homo sapiens
gugcacaucgaucucguau

SEQ ID NO: 1313991 - RNA, 19 nt, Homo sapiens
gaacagauauuuccuuaga

SEQ ID NO: 1313992 - RNA, 19 nt, Homo sapiens
gaagugagcucaaaucaga

SEQ ID NO: 1313993 - RNA, 19 nt, Homo sapiens
gaagaagaauccaguaauu

SEQ ID NO: 1313994 - RNA, 19 nt, Homo sapiens
guagauaugugcagucuua

SEQ ID NO: 1313995 - RNA, 19 nt, Homo sapiens
ggaaaucucuguugccuuu

SEQ ID NO: 1313996 - RNA, 19 nt, Homo sapiens
gaaaguggguuuguagaua

SEQ ID NO: 1313997 - RNA, 19 nt, Homo sapiens
gaaguaagcucaugguuca

SEQ ID NO: 1313998 - RNA, 19 nt, Homo sapiens
gaagagauguucaggagaa

SEQ ID NO: 1313999 - RNA, 19 nt, Homo sapiens
uaaagaaacugcagucuau

SEQ ID NO: 1314000 - RNA, 19 nt, Homo sapiens
gggaugaacuggcuucuuu

SEQ ID NO: 1314001 - RNA, 19 nt, Homo sapiens
gagaagcaguugucaaauu

SEQ ID NO: 1314002 - RNA, 19 nt, Homo sapiens
gggaggagguaacacauua

SEQ ID NO: 1314003 - RNA, 19 nt, Homo sapiens
gaaacuacauugcaaguca

SEQ ID NO: 1314004 - RNA, 19 nt, Homo sapiens
gagcuaaacuucaccaaau

SEQ ID NO: 1314005 - RNA, 19 nt, Homo sapiens
gcaaagcugugaaggugua

SEQ ID NO: 1314006 - RNA, 19 nt, Homo sapiens
gaaagaggcaacacagaua

SEQ ID NO: 1314007 - RNA, 19 nt, Homo sapiens
cagaacagauauuuccuua

SEQ ID NO: 1314008 - RNA, 19 nt, Homo sapiens
aaagaaaccugucaucaga

SEQ ID NO: 1314009 - RNA, 19 nt, Homo sapiens
gaaccuugcucccaaacaa

SEQ ID NO: 1314010 - RNA, 19 nt, Homo sapiens
gaaagcagaccaaacacua

SEQ ID NO: 1314011 - RNA, 19 nt, Homo sapiens
gcugaaagaugauguggaa

SEQ ID NO: 1314012 - RNA, 19 nt, Homo sapiens
ggaagaagaagaagacaaa

SEQ ID NO: 1314013 - RNA, 19 nt, Homo sapiens
gaacauaaagugcuucuca

SEQ ID NO: 1314014 - RNA, 19 nt, Homo sapiens
gauauuggguucaggaaga

SEQ ID NO: 1314015 - RNA, 19 nt, Homo sapiens
ggaaacagaacagauauuu

SEQ ID NO: 1314016 - RNA, 19 nt, Homo sapiens
uggaggagcucuucaguuu

SEQ ID NO: 1314017 - RNA, 19 nt, Homo sapiens
ggaaauguugcaaguguua

SEQ ID NO: 1314018 - RNA, 19 nt, Homo sapiens
ggacaaggcuguucuucag

SEQ ID NO: 1314019 - RNA, 19 nt, Homo sapiens
ucacggagcccacuacuaa

SEQ ID NO: 1314020 - RNA, 19 nt, Homo sapiens
agaagcaguugucaaauuu

SEQ ID NO: 1314021 - RNA, 19 nt, Homo sapiens
gaaagcuuguguugauuga

SEQ ID NO: 1314022 - RNA, 19 nt, Homo sapiens
caaguucucccugaaauua

SEQ ID NO: 1314023 - RNA, 19 nt, Homo sapiens
guacuggagugaagaagaa

SEQ ID NO: 1314024 - RNA, 19 nt, Homo sapiens
gaacuaugguaacagaugu

SEQ ID NO: 1314025 - RNA, 19 nt, Homo sapiens
gaucacaccuaccaaagau

SEQ ID NO: 1314026 - RNA, 19 nt, Homo sapiens
guaccgcauugaacuguua

SEQ ID NO: 1314027 - RNA, 19 nt, Homo sapiens
caggaaagcuuguguugau

SEQ ID NO: 1314028 - RNA, 19 nt, Homo sapiens
gaggagcucuucaguuugu

SEQ ID NO: 1314029 - RNA, 19 nt, Homo sapiens
gauaaguguugucuaccua

SEQ ID NO: 1314030 - RNA, 19 nt, Homo sapiens
gaaaugcugcucucucuau

SEQ ID NO: 1314031 - RNA, 19 nt, Homo sapiens
gaagugcuggugcauauuu

SEQ ID NO: 1314032 - RNA, 19 nt, Homo sapiens
cuucuuagcuccaguauuc

SEQ ID NO: 1314033 - RNA, 19 nt, Homo sapiens
gaacaagcagacuucuaua

SEQ ID NO: 1314034 - RNA, 19 nt, Homo sapiens
gaaauggaccucaucaaca

SEQ ID NO: 1314035 - RNA, 19 nt, Homo sapiens
cagaagaucaagcgauuua

SEQ ID NO: 1314036 - RNA, 19 nt, Homo sapiens
gcuaguagguccuuugauc

SEQ ID NO: 1314037 - RNA, 19 nt, Homo sapiens
gaaccaaggcuuccaagau

SEQ ID NO: 1314038 - RNA, 19 nt, Homo sapiens
gaucaagaguuucauuugg

SEQ ID NO: 1314039 - RNA, 19 nt, Homo sapiens
aaacugcagucuauccuaa

SEQ ID NO: 1314040 - RNA, 19 nt, Homo sapiens
ucaaagugguggaugauga

SEQ ID NO: 1314041 - RNA, 19 nt, Homo sapiens
gcggaaacauguugaagga

SEQ ID NO: 1314042 - RNA, 19 nt, Homo sapiens
gaaagcauuugaaggaucu

SEQ ID NO: 1314043 - RNA, 19 nt, Homo sapiens
caaagaagucuguuaaauc

SEQ ID NO: 1314044 - RNA, 19 nt, Homo sapiens
cauaaagguuuguuacuuc

SEQ ID NO: 1314045 - RNA, 19 nt, Homo sapiens
ccucgagaaugaugaauuu

SEQ ID NO: 1314046 - RNA, 19 nt, Homo sapiens
gucaucagaucagcaauua

SEQ ID NO: 1314047 - RNA, 19 nt, Homo sapiens
aaacagcacugcaacaaag

SEQ ID NO: 1314048 - RNA, 19 nt, Homo sapiens
acgagaagaucaagaguuu

SEQ ID NO: 1314049 - RNA, 19 nt, Homo sapiens
ggagcugugugauaauuga

SEQ ID NO: 1314050 - RNA, 19 nt, Homo sapiens
guucaugaauggacugauu

SEQ ID NO: 1314051 - RNA, 19 nt, Homo sapiens
cgagaaugaugaauuugaa

SEQ ID NO: 1314052 - RNA, 19 nt, Homo sapiens
caaaagagguggacuagga

SEQ ID NO: 1314053 - RNA, 19 nt, Homo sapiens
gaugaaggcuccaaguucu

SEQ ID NO: 1314054 - RNA, 19 nt, Homo sapiens
guaaagaaacugcagucua

SEQ ID NO: 1314055 - RNA, 19 nt, Homo sapiens
gcaaaugaguauuauagac

SEQ ID NO: 1314056 - RNA, 19 nt, Homo sapiens
agaaagcugucuaggguuu

SEQ ID NO: 1314057 - RNA, 19 nt, Homo sapiens
gaaccuguguuuccauaag

SEQ ID NO: 1314058 - RNA, 19 nt, Homo sapiens
ccaacaacgacaccaauua

SEQ ID NO: 1314059 - RNA, 19 nt, Homo sapiens
gaguagccaugaugugaaa

SEQ ID NO: 1314060 - RNA, 19 nt, Homo sapiens
ccucacagcucgucucaga

SEQ ID NO: 1314061 - RNA, 19 nt, Homo sapiens
gagguggucuugcaugaug

SEQ ID NO: 1314062 - RNA, 19 nt, Homo sapiens
uagcugaacuagacacuga

SEQ ID NO: 1314063 - RNA, 19 nt, Homo sapiens
gaagguguaucgccucauc

SEQ ID NO: 1314064 - RNA, 19 nt, Homo sapiens
gcaggacccuuggaaaugu

SEQ ID NO: 1314065 - RNA, 19 nt, Homo sapiens
cuucagaacaugagaaaua

SEQ ID NO: 1314066 - RNA, 19 nt, Homo sapiens
ccacaaggagagcuucuua

SEQ ID NO: 1314067 - RNA, 19 nt, Homo sapiens
auaauuaaccgccuagaua

SEQ ID NO: 1314068 - RNA, 19 nt, Homo sapiens
gaaccgcacugacuguuac

SEQ ID NO: 1314069 - RNA, 19 nt, Homo sapiens
aaauggaccucaucaacaa

SEQ ID NO: 1314070 - RNA, 19 nt, Homo sapiens
caacacagauaaagaagac

SEQ ID NO: 1314071 - RNA, 19 nt, Homo sapiens
gaugauggcuauaagaaac

SEQ ID NO: 1314072 - RNA, 19 nt, Homo sapiens
gcuaaaggaugcagauugg

SEQ ID NO: 1314073 - RNA, 19 nt, Homo sapiens
aauaggaacugcaaacuuc

SEQ ID NO: 1314074 - RNA, 19 nt, Homo sapiens
gaagaauccaguaauugaa

SEQ ID NO: 1314075 - RNA, 19 nt, Homo sapiens
ucagagauauaaaccagaa

SEQ ID NO: 1314076 - RNA, 19 nt, Homo sapiens
ccauaaagguuuguuacuu

SEQ ID NO: 1314077 - RNA, 19 nt, Homo sapiens
cgacaccaauuagaacuuu

SEQ ID NO: 1314078 - RNA, 19 nt, Homo sapiens
gggagaagcagcugagaaa

SEQ ID NO: 1314079 - RNA, 19 nt, Homo sapiens
gagaagaaccugcucaucu

SEQ ID NO: 1314080 - RNA, 19 nt, Homo sapiens
aagcuuguguugauugaua

SEQ ID NO: 1314081 - RNA, 19 nt, Homo sapiens
ggacauggacagagaugaa

SEQ ID NO: 1314082 - RNA, 19 nt, Homo sapiens
gcucugcucucaccugguu

SEQ ID NO: 1314083 - RNA, 19 nt, Homo sapiens
aagaagaaauacugacuga

SEQ ID NO: 1314084 - RNA, 19 nt, Homo sapiens
ucagacaccugcagcaaga

SEQ ID NO: 1314085 - RNA, 19 nt, Homo sapiens
gaaaacaaguucaaucaca

SEQ ID NO: 1314086 - RNA, 19 nt, Homo sapiens
aaagaaccuuggaaagaaa

SEQ ID NO: 1314087 - RNA, 19 nt, Homo sapiens
ggaaaggccagagguauug

SEQ ID NO: 1314088 - RNA, 19 nt, Homo sapiens
ugagaaagcauuugaagga

SEQ ID NO: 1314089 - RNA, 19 nt, Homo sapiens
gcacugaucaagaagagaa

SEQ ID NO: 1314090 - RNA, 19 nt, Homo sapiens
caucacaguuuccuucaga

SEQ ID NO: 1314091 - RNA, 19 nt, Homo sapiens
gaagagagaucagguguaa

SEQ ID NO: 1314092 - RNA, 19 nt, Homo sapiens
cuaaugagcugguugauaa

SEQ ID NO: 1314093 - RNA, 19 nt, Homo sapiens
ggucagaggucaucacuuu

SEQ ID NO: 1314094 - RNA, 19 nt, Homo sapiens
gaagacagauuuccuaaac

SEQ ID NO: 1314095 - RNA, 19 nt, Homo sapiens
gaaaagaacuauccaguau

SEQ ID NO: 1314096 - RNA, 19 nt, Homo sapiens
gguauaaacugguccauca

SEQ ID NO: 1314097 - RNA, 19 nt, Homo sapiens
gaugugaaguagaugauaa

SEQ ID NO: 1314098 - RNA, 19 nt, Homo sapiens
gaaagaauguuagaguuca

SEQ ID NO: 1314099 - RNA, 19 nt, Homo sapiens
gaaaagaacucugggaauu

SEQ ID NO: 1314100 - RNA, 19 nt, Homo sapiens
ccgcaaagcuauacagauu

SEQ ID NO: 1314101 - RNA, 19 nt, Homo sapiens
gggccucgcuucaagguua

SEQ ID NO: 1314102 - RNA, 19 nt, Homo sapiens
gaauugagcuucagcaaaa

SEQ ID NO: 1314103 - RNA, 19 nt, Homo sapiens
ggaaaggacaauaacuaua

SEQ ID NO: 1314104 - RNA, 19 nt, Homo sapiens
gcacuguguuuauuaucua

SEQ ID NO: 1314105 - RNA, 19 nt, Homo sapiens
cauccaagcuaccuuauau

SEQ ID NO: 1314106 - RNA, 19 nt, Homo sapiens
aaacaucacuagcugacua

SEQ ID NO: 1314107 - RNA, 19 nt, Homo sapiens
ugacagacaucgugaagug

SEQ ID NO: 1314108 - RNA, 19 nt, Homo sapiens
gaacuauccaguauaaaug

SEQ ID NO: 1314109 - RNA, 19 nt, Homo sapiens
ggaagaugaugacaaugau

SEQ ID NO: 1314110 - RNA, 19 nt, Homo sapiens
acacgaauguccagaaaga

SEQ ID NO: 1314111 - RNA, 19 nt, Homo sapiens
caaacguggucauuuauca

SEQ ID NO: 1314112 - RNA, 19 nt, Homo sapiens
ggaggaagagcaugaagaa

SEQ ID NO: 1314113 - RNA, 19 nt, Homo sapiens
cagauuuccuaaacaagua

SEQ ID NO: 1314114 - RNA, 19 nt, Homo sapiens
agacagauuuccuaaacaa

SEQ ID NO: 1314115 - RNA, 19 nt, Homo sapiens
cuucuucucuucaaucuaa

SEQ ID NO: 1314116 - RNA, 19 nt, Homo sapiens
gcaaagcuauacagauuuu

SEQ ID NO: 1314117 - RNA, 19 nt, Homo sapiens
gggaagaugaugacaauga

SEQ ID NO: 1314118 - RNA, 19 nt, Homo sapiens
ccaacaggauauuagguaa

SEQ ID NO: 1314119 - RNA, 19 nt, Homo sapiens
gaagaugaugacaaugaua

SEQ ID NO: 1314120 - RNA, 19 nt, Homo sapiens
ggaaagaauguuagaguuc

SEQ ID NO: 1314121 - RNA, 19 nt, Homo sapiens
gccuaaaucugaagagaga

SEQ ID NO: 1314122 - RNA, 19 nt, Homo sapiens
gcuacuaugaugacaaaua

SEQ ID NO: 1314123 - RNA, 19 nt, Homo sapiens
gaagagagcaccauuucag

SEQ ID NO: 1314124 - RNA, 19 nt, Homo sapiens
caguauaaaugucagaaga

SEQ ID NO: 1314125 - RNA, 19 nt, Homo sapiens
ggaauugagcuucagcaaa

SEQ ID NO: 1314126 - RNA, 19 nt, Homo sapiens
ggaagagaaauuaacacua

SEQ ID NO: 1314127 - RNA, 19 nt, Homo sapiens
ggacuucuccuauuccaau

SEQ ID NO: 1314128 - RNA, 19 nt, Homo sapiens
ugaaggagaagaugguaua

SEQ ID NO: 1314129 - RNA, 19 nt, Homo sapiens
gaaaugcaagagugauauu

SEQ ID NO: 1314130 - RNA, 19 nt, Homo sapiens
gaaauucaggagagagaaa

SEQ ID NO: 1314131 - RNA, 19 nt, Homo sapiens
gagaggucaugauuauaga

SEQ ID NO: 1314132 - RNA, 19 nt, Homo sapiens
gguggaauuucaacucuau

SEQ ID NO: 1314133 - RNA, 19 nt, Homo sapiens
ggacccagcgguacuauuc

SEQ ID NO: 1314134 - RNA, 19 nt, Homo sapiens
guaguaaaccaaaucagaa

SEQ ID NO: 1314135 - RNA, 19 nt, Homo sapiens
caucaaagguaauuuaucc

SEQ ID NO: 1314136 - RNA, 19 nt, Homo sapiens
uaugucaucuuuacucaga

SEQ ID NO: 1314137 - RNA, 19 nt, Homo sapiens
gaauauccauggagaucuc

SEQ ID NO: 1314138 - RNA, 19 nt, Homo sapiens
caucagccuuagcauauug

SEQ ID NO: 1314139 - RNA, 19 nt, Homo sapiens
gaccaucagccuuagcaua

SEQ ID NO: 1314140 - RNA, 19 nt, Homo sapiens
gagaagaugguauaaacug

SEQ ID NO: 1314141 - RNA, 19 nt, Homo sapiens
gaacugaguguugauagug

SEQ ID NO: 1314142 - RNA, 19 nt, Homo sapiens
gucagaaucuuccuuugga

SEQ ID NO: 1314143 - RNA, 19 nt, Homo sapiens
ugagaagccuaaaucugaa

SEQ ID NO: 1314144 - RNA, 19 nt, Homo sapiens
gcaagagugauauugagaa

SEQ ID NO: 1314145 - RNA, 19 nt, Homo sapiens
cuaaucguccuuucagaua

SEQ ID NO: 1314146 - RNA, 19 nt, Homo sapiens
ucaacucuauagccaaauu

SEQ ID NO: 1314147 - RNA, 19 nt, Homo sapiens
cugcagagaugaauauuac

SEQ ID NO: 1314148 - RNA, 19 nt, Homo sapiens
gcaggaagagaaauuaaca

SEQ ID NO: 1314149 - RNA, 19 nt, Homo sapiens
gguaagaaaguacaaagau

SEQ ID NO: 1314150 - RNA, 19 nt, Homo sapiens
gagaggugcugggaagaug

SEQ ID NO: 1314151 - RNA, 19 nt, Homo sapiens
caacagguggccucaagaa

SEQ ID NO: 1314152 - RNA, 19 nt, Homo sapiens
caacuaccgcaaagcuaua

SEQ ID NO: 1314153 - RNA, 19 nt, Homo sapiens
cuagugaacugaguguuga

SEQ ID NO: 1314154 - RNA, 19 nt, Homo sapiens
ggaaaagaacuauccagua

SEQ ID NO: 1314155 - RNA, 19 nt, Homo sapiens
ccauggagaucucaauucu

SEQ ID NO: 1314156 - RNA, 19 nt, Homo sapiens
gcacaggaaggcugacaga

SEQ ID NO: 1314157 - RNA, 19 nt, Homo sapiens
uaaacagugugaccgaugu

SEQ ID NO: 1314158 - RNA, 19 nt, Homo sapiens
caagagugauauugagaag

SEQ ID NO: 1314159 - RNA, 19 nt, Homo sapiens
auagugagguggaauuuca

SEQ ID NO: 1314160 - RNA, 19 nt, Homo sapiens
agggauagguagaagaauu

SEQ ID NO: 1314161 - RNA, 19 nt, Homo sapiens
caggaaggcugacagacau

SEQ ID NO: 1314162 - RNA, 19 nt, Homo sapiens
uauagaagcauacgaagau

SEQ ID NO: 1314163 - RNA, 19 nt, Homo sapiens
gaaggagaagaugguauaa

SEQ ID NO: 1314164 - RNA, 19 nt, Homo sapiens
gaggaagagagcaccauuu

SEQ ID NO: 1314165 - RNA, 19 nt, Homo sapiens
guaaaccaaaucagaagaa

SEQ ID NO: 1314166 - RNA, 19 nt, Homo sapiens
ucacucagaucugcagaga

SEQ ID NO: 1314167 - RNA, 19 nt, Homo sapiens
ccauucaucugcuacuaug

SEQ ID NO: 1314168 - RNA, 19 nt, Homo sapiens
cgagaggucaugauuauag

SEQ ID NO: 1314169 - RNA, 19 nt, Homo sapiens
uccgagaggucaugauuau

SEQ ID NO: 1314170 - RNA, 19 nt, Homo sapiens
uugagaagccuaaaucuga

SEQ ID NO: 1314171 - RNA, 19 nt, Homo sapiens
uaaccuaaugucagacuaa

SEQ ID NO: 1314172 - RNA, 19 nt, Homo sapiens
cuucaagguuacugacuuu

SEQ ID NO: 1314173 - RNA, 19 nt, Homo sapiens
acagaugcuugcacagaaa

SEQ ID NO: 1314174 - RNA, 19 nt, Homo sapiens
guacuauucagccaacaaa

SEQ ID NO: 1314175 - RNA, 19 nt, Homo sapiens
gagguggaauuucaacucu

SEQ ID NO: 1314176 - RNA, 19 nt, Homo sapiens
ugagcugguugauaagaaa

SEQ ID NO: 1314177 - RNA, 19 nt, Homo sapiens
gaagcuaaucguccuuuca

SEQ ID NO: 1314178 - RNA, 19 nt, Homo sapiens
caaaucagaagaagcuaau

SEQ ID NO: 1314179 - RNA, 19 nt, Homo sapiens
ccuaaugucagacuaagaa

SEQ ID NO: 1314180 - RNA, 19 nt, Homo sapiens
ucagaagacagauuuccua

SEQ ID NO: 1314181 - RNA, 19 nt, Homo sapiens
cuaaugccgugauucuaga

SEQ ID NO: 1314182 - RNA, 19 nt, Homo sapiens
gcuaaugccgugauucuag

SEQ ID NO: 1314183 - RNA, 19 nt, Homo sapiens
aggaaagaauguuagaguu

SEQ ID NO: 1314184 - RNA, 19 nt, Homo sapiens
guacuucucauaaccuaau

SEQ ID NO: 1314185 - RNA, 19 nt, Homo sapiens
cagaagacagauuuccuaa

SEQ ID NO: 1314186 - RNA, 19 nt, Homo sapiens
ccaagcuaccuuauauaaa

SEQ ID NO: 1314187 - RNA, 19 nt, Homo sapiens
uacagaugcuugcacagaa

SEQ ID NO: 1314188 - RNA, 19 nt, Homo sapiens
uaaccgaacaccuggaaga

SEQ ID NO: 1314189 - RNA, 19 nt, Homo sapiens
ugaaaacucuguuacugaa

SEQ ID NO: 1314190 - RNA, 19 nt, Homo sapiens
gauuauagaggucaguuca

SEQ ID NO: 1314191 - RNA, 19 nt, Homo sapiens
guaauucaguguccuauga

SEQ ID NO: 1314192 - RNA, 19 nt, Homo sapiens
gugauaggcugaucuguaa

SEQ ID NO: 1314193 - RNA, 19 nt, Homo sapiens
gaagagggcaguuuccuuu

SEQ ID NO: 1314194 - RNA, 19 nt, Homo sapiens
gcagucgccuuuggaaaua

SEQ ID NO: 1314195 - RNA, 19 nt, Homo sapiens
cuaaacagcagcaggcuua

SEQ ID NO: 1314196 - RNA, 19 nt, Homo sapiens
caggguagcccaccuuaua

SEQ ID NO: 1314197 - RNA, 19 nt, Homo sapiens
gcaguuuccuuucaaaugg

SEQ ID NO: 1314198 - RNA, 19 nt, Homo sapiens
ccaguuugcucaccucuug

SEQ ID NO: 1314199 - RNA, 19 nt, Homo sapiens
gaaccagucuuuguacucu

SEQ ID NO: 1314200 - RNA, 19 nt, Homo sapiens
gucaggagcuuagcaaaug

SEQ ID NO: 1314201 - RNA, 19 nt, Homo sapiens
cacaguggcuucccuuaga

SEQ ID NO: 1314202 - RNA, 19 nt, Homo sapiens
gcucucgucugugacauuu

SEQ ID NO: 1314203 - RNA, 19 nt, Homo sapiens
gaucuguaaugguuucugu

SEQ ID NO: 1314204 - RNA, 19 nt, Homo sapiens
gaccaugugugaugcuguu

SEQ ID NO: 1314205 - RNA, 19 nt, Homo sapiens
guacaggagugagggagaa

SEQ ID NO: 1314206 - RNA, 19 nt, Homo sapiens
agacuuccuuggauuugua

SEQ ID NO: 1314207 - RNA, 19 nt, Homo sapiens
ccucaaacuucaucgcauu

SEQ ID NO: 1314208 - RNA, 19 nt, Homo sapiens
aggcugaucuguaaugguu

SEQ ID NO: 1314209 - RNA, 19 nt, Homo sapiens
aaacuucaucgcauucaua

SEQ ID NO: 1314210 - RNA, 19 nt, Homo sapiens
guacuuagcauucugaaaa

SEQ ID NO: 1314211 - RNA, 19 nt, Homo sapiens
cagucuagcugucagauca

SEQ ID NO: 1314212 - RNA, 19 nt, Homo sapiens
gagggcaguuuccuuucaa

SEQ ID NO: 1314213 - RNA, 19 nt, Homo sapiens
gaucaccccuuuugcugua

SEQ ID NO: 1314214 - RNA, 19 nt, Homo sapiens
gcgaauuuaccguacagua

SEQ ID NO: 1314215 - RNA, 19 nt, Homo sapiens
ccaagucagcaaucucuuu

SEQ ID NO: 1314216 - RNA, 19 nt, Homo sapiens
gauaggcugaucuguaaug

SEQ ID NO: 1314217 - RNA, 19 nt, Homo sapiens
agacaaagccccaugaaaa

SEQ ID NO: 1314218 - RNA, 19 nt, Homo sapiens
gcagcaggcuuaggauuuu

SEQ ID NO: 1314219 - RNA, 19 nt, Homo sapiens
uauauagagugagcugauu

SEQ ID NO: 1314220 - RNA, 19 nt, Homo sapiens
cuucaucgcauucauagaa

SEQ ID NO: 1314221 - RNA, 19 nt, Homo sapiens
guaacauguuccucuguca

SEQ ID NO: 1314222 - RNA, 19 nt, Homo sapiens
gcugaucuguaaugguuuc

SEQ ID NO: 1314223 - RNA, 19 nt, Homo sapiens
ccacagagagcaaguuguc

SEQ ID NO: 1314224 - RNA, 19 nt, Homo sapiens
ugugauaggcugaucugua

SEQ ID NO: 1314225 - RNA, 19 nt, Homo sapiens
caugugugaugcuguuaga

SEQ ID NO: 1314226 - RNA, 19 nt, Homo sapiens
cagcugggauugcuaugca

SEQ ID NO: 1314227 - RNA, 19 nt, Homo sapiens
gcuuguugcucucgucugu

SEQ ID NO: 1314228 - RNA, 19 nt, Homo sapiens
acaagacacugacgcugau

SEQ ID NO: 1314229 - RNA, 19 nt, Homo sapiens
cuuagaaccagucuuugua

SEQ ID NO: 1314230 - RNA, 19 nt, Homo sapiens
ccagggaugugggccaaga

SEQ ID NO: 1314231 - RNA, 19 nt, Homo sapiens
caagucagcaaucucuuuc

SEQ ID NO: 1314232 - RNA, 19 nt, Homo sapiens
gaggguguuuguagaagag

SEQ ID NO: 1314233 - RNA, 19 nt, Homo sapiens
acaguggcuucccuuagaa

SEQ ID NO: 1314234 - RNA, 19 nt, Homo sapiens
uuuguacacugguuugcua

SEQ ID NO: 1314235 - RNA, 19 nt, Homo sapiens
ugaggguguuuguagaaga

SEQ ID NO: 1314236 - RNA, 19 nt, Homo sapiens
gcacagcuccccacagaga

SEQ ID NO: 1314237 - RNA, 19 nt, Homo sapiens
agagggcaguuuccuuuca

SEQ ID NO: 1314238 - RNA, 19 nt, Homo sapiens
cacugacgcugauuaugga

SEQ ID NO: 1314239 - RNA, 19 nt, Homo sapiens
gugaugcuguuagacaaga

SEQ ID NO: 1314240 - RNA, 19 nt, Homo sapiens
cuguggagcuggccaacuu

SEQ ID NO: 1314241 - RNA, 19 nt, Homo sapiens
ggcaguuuccuuucaaaug

SEQ ID NO: 1314242 - RNA, 19 nt, Homo sapiens
gagcucugcgcguguguga

SEQ ID NO: 1314243 - RNA, 19 nt, Homo sapiens
guauauagagugagcugau

SEQ ID NO: 1314244 - RNA, 19 nt, Homo sapiens
acacugacgcugauuaugg

SEQ ID NO: 1314245 - RNA, 19 nt, Homo sapiens
ccagggugaucggcgaauu

SEQ ID NO: 1314246 - RNA, 19 nt, Homo sapiens
gcaaucucuuucucucucu

SEQ ID NO: 1314247 - RNA, 19 nt, Homo sapiens
cccagaggcacaacaguaa

SEQ ID NO: 1314248 - RNA, 19 nt, Homo sapiens
caaacuucaucgcauucau

SEQ ID NO: 1314249 - RNA, 19 nt, Homo sapiens
uagugaagagaaugugaua

SEQ ID NO: 1314250 - RNA, 19 nt, Homo sapiens
gugugaugcuguuagacaa

SEQ ID NO: 1314251 - RNA, 19 nt, Homo sapiens
ugugaucauugguaauuca

SEQ ID NO: 1314252 - RNA, 19 nt, Homo sapiens
ucccuuagaaccagucuuu

SEQ ID NO: 1314253 - RNA, 19 nt, Homo sapiens
gcugucagaucaccccuuu

SEQ ID NO: 1314254 - RNA, 19 nt, Homo sapiens
gguaucugcagucgccuuu

SEQ ID NO: 1314255 - RNA, 19 nt, Homo sapiens
uuuguacucucccuaaaca

SEQ ID NO: 1314256 - RNA, 19 nt, Homo sapiens
gugaagagaaugugauagg

SEQ ID NO: 1314257 - RNA, 19 nt, Homo sapiens
guacacugguuugcuacuc

SEQ ID NO: 1314258 - RNA, 19 nt, Homo sapiens
gugugaggguguuuguaga

SEQ ID NO: 1314259 - RNA, 19 nt, Homo sapiens
ucccagaggcacaacagua

SEQ ID NO: 1314260 - RNA, 19 nt, Homo sapiens
uaucugcagucgccuuugg

SEQ ID NO: 1314261 - RNA, 19 nt, Homo sapiens
ccuuggauuuguagauguu

SEQ ID NO: 1314262 - RNA, 19 nt, Homo sapiens
cagggugaucggcgaauuu

SEQ ID NO: 1314263 - RNA, 19 nt, Homo sapiens
guuauuguagugaagagaa

SEQ ID NO: 1314264 - RNA, 19 nt, Homo sapiens
uuacugguuucuacugaag

SEQ ID NO: 1314265 - RNA, 19 nt, Homo sapiens
cagcagcaggcuuaggauu

SEQ ID NO: 1314266 - RNA, 19 nt, Homo sapiens
agacacugacgcugauuau

SEQ ID NO: 1314267 - RNA, 19 nt, Homo sapiens
guagugaagagaaugugau

SEQ ID NO: 1314268 - RNA, 19 nt, Homo sapiens
uauagagugagcugauuug

SEQ ID NO: 1314269 - RNA, 19 nt, Homo sapiens
gcgcgugugugaggguguu

SEQ ID NO: 1314270 - RNA, 19 nt, Homo sapiens
uggcauccacuccaaauag

SEQ ID NO: 1314271 - RNA, 19 nt, Homo sapiens
aagacacugacgcugauua

SEQ ID NO: 1314272 - RNA, 19 nt, Homo sapiens
ucuuacugguuucuacuga

SEQ ID NO: 1314273 - RNA, 19 nt, Homo sapiens
uacacugguuugcuacuca

SEQ ID NO: 1314274 - RNA, 19 nt, Homo sapiens
uuguugcucucgucuguga

SEQ ID NO: 1314275 - RNA, 19 nt, Homo sapiens
ucccugcccucaguauuug

SEQ ID NO: 1314276 - RNA, 19 nt, Homo sapiens
ggaugugggccaagaacag

SEQ ID NO: 1314277 - RNA, 19 nt, Homo sapiens
guugucagcaggucucugu

SEQ ID NO: 1314278 - RNA, 19 nt, Homo sapiens
agggugaucggcgaauuua

SEQ ID NO: 1314279 - RNA, 19 nt, Homo sapiens
gggcaguuuccuuucaaau

SEQ ID NO: 1314280 - RNA, 19 nt, Homo sapiens
guaauucaguguccuauga

SEQ ID NO: 1314281 - RNA, 19 nt, Homo sapiens
gugauaggcugaucuguaa

SEQ ID NO: 1314282 - RNA, 19 nt, Homo sapiens
gaaaggaggugcuuacacu

SEQ ID NO: 1314283 - RNA, 19 nt, Homo sapiens
gcagucgccuuuggaaaua

SEQ ID NO: 1314284 - RNA, 19 nt, Homo sapiens
gaagugaauuugaacaaca

SEQ ID NO: 1314285 - RNA, 19 nt, Homo sapiens
caacuggccucauguucuu

SEQ ID NO: 1314286 - RNA, 19 nt, Homo sapiens
cuaaacagcagcaggcuua

SEQ ID NO: 1314287 - RNA, 19 nt, Homo sapiens
ccaguuugcucaccucuug

SEQ ID NO: 1314288 - RNA, 19 nt, Homo sapiens
uaggauguuugguguauuu

SEQ ID NO: 1314289 - RNA, 19 nt, Homo sapiens
guacccaucuaccugcuuu

SEQ ID NO: 1314290 - RNA, 19 nt, Homo sapiens
gaaccagucuuuguacucu

SEQ ID NO: 1314291 - RNA, 19 nt, Homo sapiens
gggaaccacugcaucaugu

SEQ ID NO: 1314292 - RNA, 19 nt, Homo sapiens
gcugggcccuuguguaaau

SEQ ID NO: 1314293 - RNA, 19 nt, Homo sapiens
gucaggagcuuagcaaaug

SEQ ID NO: 1314294 - RNA, 19 nt, Homo sapiens
ggagagggcaguaggaugu

SEQ ID NO: 1314295 - RNA, 19 nt, Homo sapiens
cacaguggcuucccuuaga

SEQ ID NO: 1314296 - RNA, 19 nt, Homo sapiens
gcucucgucugugacauuu

SEQ ID NO: 1314297 - RNA, 19 nt, Homo sapiens
ccuuugaauuggagauuua

SEQ ID NO: 1314298 - RNA, 19 nt, Homo sapiens
gaucuguaaugguuucugu

SEQ ID NO: 1314299 - RNA, 19 nt, Homo sapiens
gaccaugugugaugcuguu

SEQ ID NO: 1314300 - RNA, 19 nt, Homo sapiens
gauguuugguguauuucuu

SEQ ID NO: 1314301 - RNA, 19 nt, Homo sapiens
agacugaaggugcuuauuu

SEQ ID NO: 1314302 - RNA, 19 nt, Homo sapiens
gcaaggagagccugagcaa

SEQ ID NO: 1314303 - RNA, 19 nt, Homo sapiens
agacuuccuuggauuugua

SEQ ID NO: 1314304 - RNA, 19 nt, Homo sapiens
ccucaaacuucaucgcauu

SEQ ID NO: 1314305 - RNA, 19 nt, Homo sapiens
ccaucuaccugcuuuggaa

SEQ ID NO: 1314306 - RNA, 19 nt, Homo sapiens
ggaggugggcuuuaaguuc

SEQ ID NO: 1314307 - RNA, 19 nt, Homo sapiens
aggcugaucuguaaugguu

SEQ ID NO: 1314308 - RNA, 19 nt, Homo sapiens
aaacuucaucgcauucaua

SEQ ID NO: 1314309 - RNA, 19 nt, Homo sapiens
gggcuuguguuccaucuca

SEQ ID NO: 1314310 - RNA, 19 nt, Homo sapiens
guacuuagcauucugaaaa

SEQ ID NO: 1314311 - RNA, 19 nt, Homo sapiens
ccacgcgguugcaggagua

SEQ ID NO: 1314312 - RNA, 19 nt, Homo sapiens
ggaagcuggucauccuguu

SEQ ID NO: 1314313 - RNA, 19 nt, Homo sapiens
cagucuagcugucagauca

SEQ ID NO: 1314314 - RNA, 19 nt, Homo sapiens
ggguggaggugggcuuuaa

SEQ ID NO: 1314315 - RNA, 19 nt, Homo sapiens
ggacaccagacucucauga

SEQ ID NO: 1314316 - RNA, 19 nt, Homo sapiens
ccaccaagaccgucaucua

SEQ ID NO: 1314317 - RNA, 19 nt, Homo sapiens
acacccaguucuugauaaa

SEQ ID NO: 1314318 - RNA, 19 nt, Homo sapiens
gaucaccccuuuugcugua

SEQ ID NO: 1314319 - RNA, 19 nt, Homo sapiens
gauaggcugaucuguaaug

SEQ ID NO: 1314320 - RNA, 19 nt, Homo sapiens
agacaaagccccaugaaaa

SEQ ID NO: 1314321 - RNA, 19 nt, Homo sapiens
aaggagagccugagcaaga

SEQ ID NO: 1314322 - RNA, 19 nt, Homo sapiens
gcagcaggcuuaggauuuu

SEQ ID NO: 1314323 - RNA, 19 nt, Homo sapiens
ugacuugacuuggagaaca

SEQ ID NO: 1314324 - RNA, 19 nt, Homo sapiens
uauauagagugagcugauu

SEQ ID NO: 1314325 - RNA, 19 nt, Homo sapiens
cuucaucgcauucauagaa

SEQ ID NO: 1314326 - RNA, 19 nt, Homo sapiens
gacugaaggugcuuauuuu

SEQ ID NO: 1314327 - RNA, 19 nt, Homo sapiens
uggcugggcccuuguguaa

SEQ ID NO: 1314328 - RNA, 19 nt, Homo sapiens
ccggugggcucuucucuca

SEQ ID NO: 1314329 - RNA, 19 nt, Homo sapiens
gcugaucuguaaugguuuc

SEQ ID NO: 1314330 - RNA, 19 nt, Homo sapiens
ccacagagagcaaguuguc

SEQ ID NO: 1314331 - RNA, 19 nt, Homo sapiens
ucucucaacuggccucaug

SEQ ID NO: 1314332 - RNA, 19 nt, Homo sapiens
gcuuuaaguucgccaccaa

SEQ ID NO: 1314333 - RNA, 19 nt, Homo sapiens
ugugauaggcugaucugua

SEQ ID NO: 1314334 - RNA, 19 nt, Homo sapiens
caugugugaugcuguuaga

SEQ ID NO: 1314335 - RNA, 19 nt, Homo sapiens
gccaacggcuccuuucaac

SEQ ID NO: 1314336 - RNA, 19 nt, Homo sapiens
cagcugggauugcuaugca

SEQ ID NO: 1314337 - RNA, 19 nt, Homo sapiens
gcuuguugcucucgucugu

SEQ ID NO: 1314338 - RNA, 19 nt, Homo sapiens
acaagacacugacgcugau

SEQ ID NO: 1314339 - RNA, 19 nt, Homo sapiens
cuuagaaccagucuuugua

SEQ ID NO: 1314340 - RNA, 19 nt, Homo sapiens
aguuagagccagcacuuua

SEQ ID NO: 1314341 - RNA, 19 nt, Homo sapiens
gcucucuccucaaacuuca

SEQ ID NO: 1314342 - RNA, 19 nt, Homo sapiens
gugcugccuuccucucuug

SEQ ID NO: 1314343 - RNA, 19 nt, Homo sapiens
acaguggcuucccuuagaa

SEQ ID NO: 1314344 - RNA, 19 nt, Homo sapiens
uuuguacacugguuugcua

SEQ ID NO: 1314345 - RNA, 19 nt, Homo sapiens
gcacagcuccccacagaga

SEQ ID NO: 1314346 - RNA, 19 nt, Homo sapiens
ggugggcucuucucucaac

SEQ ID NO: 1314347 - RNA, 19 nt, Homo sapiens
cacugacgcugauuaugga

SEQ ID NO: 1314348 - RNA, 19 nt, Homo sapiens
gugaugcuguuagacaaga

SEQ ID NO: 1314349 - RNA, 19 nt, Homo sapiens
gcaacccucugggcuugug

SEQ ID NO: 1314350 - RNA, 19 nt, Homo sapiens
guauauagagugagcugau

SEQ ID NO: 1314351 - RNA, 19 nt, Homo sapiens
acacugacgcugauuaugg

SEQ ID NO: 1314352 - RNA, 19 nt, Homo sapiens
ugcaucaugucccgguaua

SEQ ID NO: 1314353 - RNA, 19 nt, Homo sapiens
guaggauguuugguguauu

SEQ ID NO: 1314354 - RNA, 19 nt, Homo sapiens
cgaagugaauuugaacaac

SEQ ID NO: 1314355 - RNA, 19 nt, Homo sapiens
ccucugggcuuguguucca

SEQ ID NO: 1314356 - RNA, 19 nt, Homo sapiens
caaacuucaucgcauucau

SEQ ID NO: 1314357 - RNA, 19 nt, Homo sapiens
aguaggauguuugguguau

SEQ ID NO: 1314358 - RNA, 19 nt, Homo sapiens
uagugaagagaaugugaua

SEQ ID NO: 1314359 - RNA, 19 nt, Homo sapiens
gugugaugcuguuagacaa

SEQ ID NO: 1314360 - RNA, 19 nt, Homo sapiens
ugugaucauugguaauuca

SEQ ID NO: 1314361 - RNA, 19 nt, Homo sapiens
cgaacuuuaccguacagua

SEQ ID NO: 1314362 - RNA, 19 nt, Homo sapiens
ggugaucggcgaacuuuac

SEQ ID NO: 1314363 - RNA, 19 nt, Homo sapiens
gaagcuggucauccuguuc

SEQ ID NO: 1314364 - RNA, 19 nt, Homo sapiens
ucccuuagaaccagucuuu

SEQ ID NO: 1314365 - RNA, 19 nt, Homo sapiens
ggccaacggcuccuuucaa

SEQ ID NO: 1314366 - RNA, 19 nt, Homo sapiens
gcugucagaucaccccuuu

SEQ ID NO: 1314367 - RNA, 19 nt, Homo sapiens
ggccaucucagacccauuc

SEQ ID NO: 1314368 - RNA, 19 nt, Homo sapiens
gguaucugcagucgccuuu

SEQ ID NO: 1314369 - RNA, 19 nt, Homo sapiens
uuuguacucucccuaaaca

SEQ ID NO: 1314370 - RNA, 19 nt, Homo sapiens
gugaagagaaugugauagg

SEQ ID NO: 1314371 - RNA, 19 nt, Homo sapiens
guacacugguuugcuacuc

SEQ ID NO: 1314372 - RNA, 19 nt, Homo sapiens
gaauuggagauuuacuaca

SEQ ID NO: 1314373 - RNA, 19 nt, Homo sapiens
ccaagaccgucaucuaccu

SEQ ID NO: 1314374 - RNA, 19 nt, Homo sapiens
uaucugcagucgccuuugg

SEQ ID NO: 1314375 - RNA, 19 nt, Homo sapiens
ccuuggauuuguagauguu

SEQ ID NO: 1314376 - RNA, 19 nt, Homo sapiens
caucucagacccauucuac

SEQ ID NO: 1314377 - RNA, 19 nt, Homo sapiens
aggagagccugagcaagaa

SEQ ID NO: 1314378 - RNA, 19 nt, Homo sapiens
guuauuguagugaagagaa

SEQ ID NO: 1314379 - RNA, 19 nt, Homo sapiens
uuacugguuucuacugaag

SEQ ID NO: 1314380 - RNA, 19 nt, Homo sapiens
gaagaaggaucguuuauga

SEQ ID NO: 1314381 - RNA, 19 nt, Homo sapiens
gaaauucucuguccagguu

SEQ ID NO: 1314382 - RNA, 19 nt, Homo sapiens
guccauaccuuguaaauaa

SEQ ID NO: 1314383 - RNA, 19 nt, Homo sapiens
gcagcaacaucuucaauaa

SEQ ID NO: 1314384 - RNA, 19 nt, Homo sapiens
gaacaugccuccacagucu

SEQ ID NO: 1314385 - RNA, 19 nt, Homo sapiens
gaaccaaucaacagaauuu

SEQ ID NO: 1314386 - RNA, 19 nt, Homo sapiens
gaugguaucugaaauaagu

SEQ ID NO: 1314387 - RNA, 19 nt, Homo sapiens
gaaaugcugugauucuguu

SEQ ID NO: 1314388 - RNA, 19 nt, Homo sapiens
gagcugaaguuaauggaaa

SEQ ID NO: 1314389 - RNA, 19 nt, Homo sapiens
gaauugaaagcccuaaaua

SEQ ID NO: 1314390 - RNA, 19 nt, Homo sapiens
guaaccaccugaccaaauu

SEQ ID NO: 1314391 - RNA, 19 nt, Homo sapiens
gcgcaacauugaaagcuua

SEQ ID NO: 1314392 - RNA, 19 nt, Homo sapiens
caauacaccuuggauuuaa

SEQ ID NO: 1314393 - RNA, 19 nt, Homo sapiens
ugaaagcccuaaauaguga

SEQ ID NO: 1314394 - RNA, 19 nt, Homo sapiens
ugagauaggugcauuuaau

SEQ ID NO: 1314395 - RNA, 19 nt, Homo sapiens
gcuaauaaauugugaagca

SEQ ID NO: 1314396 - RNA, 19 nt, Homo sapiens
caccuuggauuuaacaaua

SEQ ID NO: 1314397 - RNA, 19 nt, Homo sapiens
gccacugucuguucuaaua

SEQ ID NO: 1314398 - RNA, 19 nt, Homo sapiens
ggccugcaauugugacuua

SEQ ID NO: 1314399 - RNA, 19 nt, Homo sapiens
ugacgaugcuucacacaaa

SEQ ID NO: 1314400 - RNA, 19 nt, Homo sapiens
gaaccugacuauuuagaag

SEQ ID NO: 1314401 - RNA, 19 nt, Homo sapiens
agauugaccuugaggauaa

SEQ ID NO: 1314402 - RNA, 19 nt, Homo sapiens
ccaggaaccuuuaauccaa

SEQ ID NO: 1314403 - RNA, 19 nt, Homo sapiens
acgaagagcugaaguuaau

SEQ ID NO: 1314404 - RNA, 19 nt, Homo sapiens
uuacaaacauugccuuaug

SEQ ID NO: 1314405 - RNA, 19 nt, Homo sapiens
caaauacggcugauacuau

SEQ ID NO: 1314406 - RNA, 19 nt, Homo sapiens
uaacaccuccuccaaguuu

SEQ ID NO: 1314407 - RNA, 19 nt, Homo sapiens
ggaccuuacugcccuauuc

SEQ ID NO: 1314408 - RNA, 19 nt, Homo sapiens
gaacacauuggccgaauau

SEQ ID NO: 1314409 - RNA, 19 nt, Homo sapiens
gaagucugaucuaguggaa

SEQ ID NO: 1314410 - RNA, 19 nt, Homo sapiens
caucaggacuucuaauaca

SEQ ID NO: 1314411 - RNA, 19 nt, Homo sapiens
caaaugggccugcaauugu

SEQ ID NO: 1314412 - RNA, 19 nt, Homo sapiens
gcaagcagauaacaauuuu

SEQ ID NO: 1314413 - RNA, 19 nt, Homo sapiens
acaaguagaugagcaaaug

SEQ ID NO: 1314414 - RNA, 19 nt, Homo sapiens
uaacccagauugaccuuga

SEQ ID NO: 1314415 - RNA, 19 nt, Homo sapiens
gauagugguucuuguucuu

SEQ ID NO: 1314416 - RNA, 19 nt, Homo sapiens
gaaccuaacgagauuacaa

SEQ ID NO: 1314417 - RNA, 19 nt, Homo sapiens
agucugaucuaguggaaua

SEQ ID NO: 1314418 - RNA, 19 nt, Homo sapiens
ucaauacaccuuggauuua

SEQ ID NO: 1314419 - RNA, 19 nt, Homo sapiens
ucgcagaaaugcugugauu

SEQ ID NO: 1314420 - RNA, 19 nt, Homo sapiens
ccacgaagagcugaaguua

SEQ ID NO: 1314421 - RNA, 19 nt, Homo sapiens
cuauagaaguccauccuuu

SEQ ID NO: 1314422 - RNA, 19 nt, Homo sapiens
gugauucucuuugcaauug

SEQ ID NO: 1314423 - RNA, 19 nt, Homo sapiens
aauauuggaucuucaguug

SEQ ID NO: 1314424 - RNA, 19 nt, Homo sapiens
aaagauggcacaaugcuaa

SEQ ID NO: 1314425 - RNA, 19 nt, Homo sapiens
ucacgaccuuuccaacuaa

SEQ ID NO: 1314426 - RNA, 19 nt, Homo sapiens
caacaaauacggcugauac

SEQ ID NO: 1314427 - RNA, 19 nt, Homo sapiens
uaaaggaaguauacucagu

SEQ ID NO: 1314428 - RNA, 19 nt, Homo sapiens
gaagaagagaggaaugaga

SEQ ID NO: 1314429 - RNA, 19 nt, Homo sapiens
gcaacaucuucaauaaaug

SEQ ID NO: 1314430 - RNA, 19 nt, Homo sapiens
cgaacacauuggccgaaua

SEQ ID NO: 1314431 - RNA, 19 nt, Homo sapiens
ugcugaaccugacuauuua

SEQ ID NO: 1314432 - RNA, 19 nt, Homo sapiens
gaaaaucauucaccacuca

SEQ ID NO: 1314433 - RNA, 19 nt, Homo sapiens
gcaagaacacagugacaga

SEQ ID NO: 1314434 - RNA, 19 nt, Homo sapiens
ccacucacagggucaaaua

SEQ ID NO: 1314435 - RNA, 19 nt, Homo sapiens
uuaaguccauaccuuguaa

SEQ ID NO: 1314436 - RNA, 19 nt, Homo sapiens
gggaaucacagaauaccua

SEQ ID NO: 1314437 - RNA, 19 nt, Homo sapiens
gaaacaaguagaugagcaa

SEQ ID NO: 1314438 - RNA, 19 nt, Homo sapiens
ggaauugaaagcccuaaau

SEQ ID NO: 1314439 - RNA, 19 nt, Homo sapiens
gauggcacaaugcuaauaa

SEQ ID NO: 1314440 - RNA, 19 nt, Homo sapiens
gaaccuaagcacagcaguu

SEQ ID NO: 1314441 - RNA, 19 nt, Homo sapiens
gugagugugucaucaauca

SEQ ID NO: 1314442 - RNA, 19 nt, Homo sapiens
guucaugucuauagaaguc

SEQ ID NO: 1314443 - RNA, 19 nt, Homo sapiens
aaugaagucugaucuagug

SEQ ID NO: 1314444 - RNA, 19 nt, Homo sapiens
caaaacaucuccaaagaag

SEQ ID NO: 1314445 - RNA, 19 nt, Homo sapiens
uuacaaagccauccacuca

SEQ ID NO: 1314446 - RNA, 19 nt, Homo sapiens
ucaguagacuaaagaagga

SEQ ID NO: 1314447 - RNA, 19 nt, Homo sapiens
ggaaucacagaauaccuaa

SEQ ID NO: 1314448 - RNA, 19 nt, Homo sapiens
aaagggaacuucagcaacu

SEQ ID NO: 1314449 - RNA, 19 nt, Homo sapiens
gaugccagcucauuguaca

SEQ ID NO: 1314450 - RNA, 19 nt, Homo sapiens
gaaagaaggaagugaugca

SEQ ID NO: 1314451 - RNA, 19 nt, Homo sapiens
ggucaccacuccugcaaca

SEQ ID NO: 1314452 - RNA, 19 nt, Homo sapiens
acacagacuaguuaccuua

SEQ ID NO: 1314453 - RNA, 19 nt, Homo sapiens
uaaauaacaccuccuccaa

SEQ ID NO: 1314454 - RNA, 19 nt, Homo sapiens
gaaauaagugugccaccau

SEQ ID NO: 1314455 - RNA, 19 nt, Homo sapiens
ccacucaucacacuacuga

SEQ ID NO: 1314456 - RNA, 19 nt, Homo sapiens
aauccaaugccuaaacuua

SEQ ID NO: 1314457 - RNA, 19 nt, Homo sapiens
caacuaagaccacguccau

SEQ ID NO: 1314458 - RNA, 19 nt, Homo sapiens
gaauauuggaucuucaguu

SEQ ID NO: 1314459 - RNA, 19 nt, Homo sapiens
uuaugaaccuaacgagauu

SEQ ID NO: 1314460 - RNA, 19 nt, Homo sapiens
auugaaagcuuaucagauc

SEQ ID NO: 1314461 - RNA, 19 nt, Homo sapiens
ggcagcaacaucuucaaua

SEQ ID NO: 1314462 - RNA, 19 nt, Homo sapiens
aaacuugguuggagaacau

SEQ ID NO: 1314463 - RNA, 19 nt, Homo sapiens
gagaaagaaggaagugaug

SEQ ID NO: 1314464 - RNA, 19 nt, Homo sapiens
cugcagcaauggauacaaa

SEQ ID NO: 1314465 - RNA, 19 nt, Homo sapiens
aauaacaccuccuccaagu

SEQ ID NO: 1314466 - RNA, 19 nt, Homo sapiens
uccaaugccuaaacuuaaa

SEQ ID NO: 1314467 - RNA, 19 nt, Homo sapiens
caacauugaaagcuuauca

SEQ ID NO: 1314468 - RNA, 19 nt, Homo sapiens
ggcacaaugcuaauaaauu

SEQ ID NO: 1314469 - RNA, 19 nt, Homo sapiens
caacaaaugggccugcaau

SEQ ID NO: 1314470 - RNA, 19 nt, Homo sapiens
acacauuggccgaauauug

SEQ ID NO: 1314471 - RNA, 19 nt, Homo sapiens
caacugggaaucacagaau

SEQ ID NO: 1314472 - RNA, 19 nt, Homo sapiens
gcaaaugagagacaacagu

SEQ ID NO: 1314473 - RNA, 19 nt, Homo sapiens
guucuaauauugggacuuc

SEQ ID NO: 1314474 - RNA, 19 nt, Homo sapiens
agaacacagugacagauga

SEQ ID NO: 1314475 - RNA, 19 nt, Homo sapiens
ccaucuaccuguaaguaau

SEQ ID NO: 1314476 - RNA, 19 nt, Homo sapiens
gacuaaagaaggaaucuau

SEQ ID NO: 1314477 - RNA, 19 nt, Homo sapiens
ccuccacagucuauaauug

SEQ ID NO: 1314478 - RNA, 19 nt, Homo sapiens
gaaccaagugccuuuagca

SEQ ID NO: 1314479 - RNA, 19 nt, Homo sapiens
gggcuuaccaaugcuauuu

SEQ ID NO: 1314480 - RNA, 19 nt, Homo sapiens
ggagauaaaugaagaagaa

SEQ ID NO: 1314481 - RNA, 19 nt, Homo sapiens
gaagaagaauaucugguua

SEQ ID NO: 1314482 - RNA, 19 nt, Homo sapiens
agaaagcgcuagagguuua

SEQ ID NO: 1314483 - RNA, 19 nt, Homo sapiens
gcagauaaaugacaaagag

SEQ ID NO: 1314484 - RNA, 19 nt, Homo sapiens
gggcugugcuuaagaguaa

SEQ ID NO: 1314485 - RNA, 19 nt, Homo sapiens
gaaguggucucggaaaguu

SEQ ID NO: 1314486 - RNA, 19 nt, Homo sapiens
ccacuggccuguaauuguu

SEQ ID NO: 1314487 - RNA, 19 nt, Homo sapiens
cagaagaagacaucaauaa

SEQ ID NO: 1314488 - RNA, 19 nt, Homo sapiens
gcuagagguuuaugauuug

SEQ ID NO: 1314489 - RNA, 19 nt, Homo sapiens
cagcgauguuuaccauuua

SEQ ID NO: 1314490 - RNA, 19 nt, Homo sapiens
gcccaauacuuuagaagaa

SEQ ID NO: 1314491 - RNA, 19 nt, Homo sapiens
gucagagacucauguuuaa

SEQ ID NO: 1314492 - RNA, 19 nt, Homo sapiens
ugucagagacucauguuua

SEQ ID NO: 1314493 - RNA, 19 nt, Homo sapiens
ggaaaguuguguggaaguu

SEQ ID NO: 1314494 - RNA, 19 nt, Homo sapiens
cagagacucauguuuaaua

SEQ ID NO: 1314495 - RNA, 19 nt, Homo sapiens
ggaacaguguguccuugaa

SEQ ID NO: 1314496 - RNA, 19 nt, Homo sapiens
gagagacgguggcgcgauu

SEQ ID NO: 1314497 - RNA, 19 nt, Homo sapiens
guaccuaauuuguucaaug

SEQ ID NO: 1314498 - RNA, 19 nt, Homo sapiens
ucagcgauguuuaccauuu

SEQ ID NO: 1314499 - RNA, 19 nt, Homo sapiens
cgcuagagguuuaugauuu

SEQ ID NO: 1314500 - RNA, 19 nt, Homo sapiens
acacuuaaaugaucagaca

SEQ ID NO: 1314501 - RNA, 19 nt, Homo sapiens
ggccuguaauuguuugaua

SEQ ID NO: 1314502 - RNA, 19 nt, Homo sapiens
agacaucaauaagcagaua

SEQ ID NO: 1314503 - RNA, 19 nt, Homo sapiens
aagaagacaucaauaagca

SEQ ID NO: 1314504 - RNA, 19 nt, Homo sapiens
gaagaagacaucaauaagc

SEQ ID NO: 1314505 - RNA, 19 nt, Homo sapiens
guauaacauucucaggauu

SEQ ID NO: 1314506 - RNA, 19 nt, Homo sapiens
ggaacccacucaacagaag

SEQ ID NO: 1314507 - RNA, 19 nt, Homo sapiens
ugaagaagaauaucugguu

SEQ ID NO: 1314508 - RNA, 19 nt, Homo sapiens
uaucuacugugcccaaaug

SEQ ID NO: 1314509 - RNA, 19 nt, Homo sapiens
gaaguucaggagauaaaug

SEQ ID NO: 1314510 - RNA, 19 nt, Homo sapiens
agagaaagcgcuagagguu

SEQ ID NO: 1314511 - RNA, 19 nt, Homo sapiens
guaagaugaguugcuauuu

SEQ ID NO: 1314512 - RNA, 19 nt, Homo sapiens
caacuuacgggaaauugug

SEQ ID NO: 1314513 - RNA, 19 nt, Homo sapiens
caacagaagaagacaucaa

SEQ ID NO: 1314514 - RNA, 19 nt, Homo sapiens
gaaggaacccacucaacag

SEQ ID NO: 1314515 - RNA, 19 nt, Homo sapiens
ugaaggaacccacucaaca

SEQ ID NO: 1314516 - RNA, 19 nt, Homo sapiens
gagaaagcgcuagagguuu

SEQ ID NO: 1314517 - RNA, 19 nt, Homo sapiens
acugauagcuguuuuaaga

SEQ ID NO: 1314518 - RNA, 19 nt, Homo sapiens
aaaguuguguggaaguuca

SEQ ID NO: 1314519 - RNA, 19 nt, Homo sapiens
caggauuuguaacacuuaa

SEQ ID NO: 1314520 - RNA, 19 nt, Homo sapiens
uguauaacauucucaggau

SEQ ID NO: 1314521 - RNA, 19 nt, Homo sapiens
uccaagcgagauuuaauua

SEQ ID NO: 1314522 - RNA, 19 nt, Homo sapiens
ggaaauuguggaacagugu

SEQ ID NO: 1314523 - RNA, 19 nt, Homo sapiens
uguggaaguucaggagaua

SEQ ID NO: 1314524 - RNA, 19 nt, Homo sapiens
ccaggaaguugaucaaucc

SEQ ID NO: 1314525 - RNA, 19 nt, Homo sapiens
uguguaagaugaguugcua

SEQ ID NO: 1314526 - RNA, 19 nt, Homo sapiens
gccuguaauuguuugauau

SEQ ID NO: 1314527 - RNA, 19 nt, Homo sapiens
ccuugaaccugacugauag

SEQ ID NO: 1314528 - RNA, 19 nt, Homo sapiens
gcgaguggcagcugcaaug

SEQ ID NO: 1314529 - RNA, 19 nt, Homo sapiens
aguggcagcugcaauggaa

SEQ ID NO: 1314530 - RNA, 19 nt, Homo sapiens
gcgcuagagguuuaugauu

SEQ ID NO: 1314531 - RNA, 19 nt, Homo sapiens
aaucuacauuucugaagga

SEQ ID NO: 1314532 - RNA, 19 nt, Homo sapiens
ucccgaggcugcugagaga

SEQ ID NO: 1314533 - RNA, 19 nt, Homo sapiens
cugcucuccugaaccuuua

SEQ ID NO: 1314534 - RNA, 19 nt, Homo sapiens
acagaagaagacaucaaua

SEQ ID NO: 1314535 - RNA, 19 nt, Homo sapiens
gaacccacucaacagaaga

SEQ ID NO: 1314536 - RNA, 19 nt, Homo sapiens
gugcccaaauguacucaau

SEQ ID NO: 1314537 - RNA, 19 nt, Homo sapiens
gaacaguguguccuugaac

SEQ ID NO: 1314538 - RNA, 19 nt, Homo sapiens
agaagaagacaucaauaag

SEQ ID NO: 1314539 - RNA, 19 nt, Homo sapiens
guaccucauugcucuuugg

SEQ ID NO: 1314540 - RNA, 19 nt, Homo sapiens
ggaaguggucucggaaagu

SEQ ID NO: 1314541 - RNA, 19 nt, Homo sapiens
cuucagcgauguuuaccau

SEQ ID NO: 1314542 - RNA, 19 nt, Homo sapiens
cgccaacaguaccucauug

SEQ ID NO: 1314543 - RNA, 19 nt, Homo sapiens
cagguucacgccaacagua

SEQ ID NO: 1314544 - RNA, 19 nt, Homo sapiens
uguaagaugaguugcuauu

SEQ ID NO: 1314545 - RNA, 19 nt, Homo sapiens
ccaagcgagauuuaauuau

SEQ ID NO: 1314546 - RNA, 19 nt, Homo sapiens
gaaaguuguguggaaguuc

SEQ ID NO: 1314547 - RNA, 19 nt, Homo sapiens
cuuaaaugaucagacagaa

SEQ ID NO: 1314548 - RNA, 19 nt, Homo sapiens
cuagagguuuaugauuuga

SEQ ID NO: 1314549 - RNA, 19 nt, Homo sapiens
gacaucaauaagcagauaa

SEQ ID NO: 1314550 - RNA, 19 nt, Homo sapiens
cuuauugggcugugcuuaa

SEQ ID NO: 1314551 - RNA, 19 nt, Homo sapiens
gcucuuuggcgacucuuau

SEQ ID NO: 1314552 - RNA, 19 nt, Homo sapiens
ccaauacuuuagaagaacu

SEQ ID NO: 1314553 - RNA, 19 nt, Homo sapiens
gaugcucauucugauacaa

SEQ ID NO: 1314554 - RNA, 19 nt, Homo sapiens
ucaggauuuguaacacuua

SEQ ID NO: 1314555 - RNA, 19 nt, Homo sapiens
agagacucauguuuaauac

SEQ ID NO: 1314556 - RNA, 19 nt, Homo sapiens
uacgggaaauuguggaaca

SEQ ID NO: 1314557 - RNA, 19 nt, Homo sapiens
ggaaguucaggagauaaau

SEQ ID NO: 1314558 - RNA, 19 nt, Homo sapiens
uuucugaugcucauucuga

SEQ ID NO: 1314559 - RNA, 19 nt, Homo sapiens
aacauucucaggauuugua

SEQ ID NO: 1314560 - RNA, 19 nt, Homo sapiens
uccuugaaccugacugaua

SEQ ID NO: 1314561 - RNA, 19 nt, Homo sapiens
uugaagaccaggaaguuga

SEQ ID NO: 1314562 - RNA, 19 nt, Homo sapiens
cuacugugcccaaauguac

SEQ ID NO: 1314563 - RNA, 19 nt, Homo sapiens
guguggaaguucaggagau

SEQ ID NO: 1314564 - RNA, 19 nt, Homo sapiens
uggaaguggucucggaaag

SEQ ID NO: 1314565 - RNA, 19 nt, Homo sapiens
gaaagcgcuagagguuuau

SEQ ID NO: 1314566 - RNA, 19 nt, Homo sapiens
cgugucaaauaucuacugu

SEQ ID NO: 1314567 - RNA, 19 nt, Homo sapiens
auaacauucucaggauuug

SEQ ID NO: 1314568 - RNA, 19 nt, Homo sapiens
ccacucaacagaagaagac

SEQ ID NO: 1314569 - RNA, 19 nt, Homo sapiens
uggaaguucaggagauaaa

SEQ ID NO: 1314570 - RNA, 19 nt, Homo sapiens
accaggaaguugaucaauc

SEQ ID NO: 1314571 - RNA, 19 nt, Homo sapiens
cucggaaaguuguguggaa

SEQ ID NO: 1314572 - RNA, 19 nt, Homo sapiens
gaagagggcuuugguuuga

SEQ ID NO: 1314573 - RNA, 19 nt, Homo sapiens
gauagagccucacuucuuu

SEQ ID NO: 1314574 - RNA, 19 nt, Homo sapiens
ggagacagcgcuauugaua

SEQ ID NO: 1314575 - RNA, 19 nt, Homo sapiens
gaagauuacuuuccugauc

SEQ ID NO: 1314576 - RNA, 19 nt, Homo sapiens
gcuaaugacuguugaaucu

SEQ ID NO: 1314577 - RNA, 19 nt, Homo sapiens
aaacaacuauugaggaaga

SEQ ID NO: 1314578 - RNA, 19 nt, Homo sapiens
aaacacagcucgacaguac

SEQ ID NO: 1314579 - RNA, 19 nt, Homo sapiens
gaaagucucaaucaagaaa

SEQ ID NO: 1314580 - RNA, 19 nt, Homo sapiens
guuacaaccuggaagauga

SEQ ID NO: 1314581 - RNA, 19 nt, Homo sapiens
uaacaaacaaccacaagaa

SEQ ID NO: 1314582 - RNA, 19 nt, Homo sapiens
aagaagaacugaaagaaca

SEQ ID NO: 1314583 - RNA, 19 nt, Homo sapiens
ggagagcagauuuacauuu

SEQ ID NO: 1314584 - RNA, 19 nt, Homo sapiens
ugacacuccucucuacuuu

SEQ ID NO: 1314585 - RNA, 19 nt, Homo sapiens
gcacuggccuuucauuugc

SEQ ID NO: 1314586 - RNA, 19 nt, Homo sapiens
gagagcagauuuacauuuu

SEQ ID NO: 1314587 - RNA, 19 nt, Homo sapiens
gaaaauugcuaaugacugu

SEQ ID NO: 1314588 - RNA, 19 nt, Homo sapiens
gaauucaguucccgucuca

SEQ ID NO: 1314589 - RNA, 19 nt, Homo sapiens
ggacaacgaggucaaacuu

SEQ ID NO: 1314590 - RNA, 19 nt, Homo sapiens
ccaacaaacuacccuugaa

SEQ ID NO: 1314591 - RNA, 19 nt, Homo sapiens
ccaaauaugaagagaguaa

SEQ ID NO: 1314592 - RNA, 19 nt, Homo sapiens
gaaggauucuuucacuuac

SEQ ID NO: 1314593 - RNA, 19 nt, Homo sapiens
gcagaccuauuguggguau

SEQ ID NO: 1314594 - RNA, 19 nt, Homo sapiens
gaagaugaccgcugugagu

SEQ ID NO: 1314595 - RNA, 19 nt, Homo sapiens
uaucaaggcagaagaauug

SEQ ID NO: 1314596 - RNA, 19 nt, Homo sapiens
ccacacaagcuauacauga

SEQ ID NO: 1314597 - RNA, 19 nt, Homo sapiens
ccacgaaaauugcuaauga

SEQ ID NO: 1314598 - RNA, 19 nt, Homo sapiens
caaggcagaagaauuguuu

SEQ ID NO: 1314599 - RNA, 19 nt, Homo sapiens
gaaaugggccucugaaaau

SEQ ID NO: 1314600 - RNA, 19 nt, Homo sapiens
gcagagaggaagauauguu

SEQ ID NO: 1314601 - RNA, 19 nt, Homo sapiens
ggaauacuaucgccaacag

SEQ ID NO: 1314602 - RNA, 19 nt, Homo sapiens
acacuccucucuacuuuga

SEQ ID NO: 1314603 - RNA, 19 nt, Homo sapiens
gggcuucugucgaggguuu

SEQ ID NO: 1314604 - RNA, 19 nt, Homo sapiens
gaaaagagugggaagagua

SEQ ID NO: 1314605 - RNA, 19 nt, Homo sapiens
ggcagucucuucuguuaug

SEQ ID NO: 1314606 - RNA, 19 nt, Homo sapiens
uuacuuuccugaucuaaug

SEQ ID NO: 1314607 - RNA, 19 nt, Homo sapiens
agauaaauccgucuugaaa

SEQ ID NO: 1314608 - RNA, 19 nt, Homo sapiens
ggaagaguaugugcagauc

SEQ ID NO: 1314609 - RNA, 19 nt, Homo sapiens
uggcagcccuauauucaaa

SEQ ID NO: 1314610 - RNA, 19 nt, Homo sapiens
gcaaagcaaaggccacaga

SEQ ID NO: 1314611 - RNA, 19 nt, Homo sapiens
aaaccacgaucuuucuguu

SEQ ID NO: 1314612 - RNA, 19 nt, Homo sapiens
gaagaagaacugaaagaac

SEQ ID NO: 1314613 - RNA, 19 nt, Homo sapiens
gcccaucucugcucagcuu

SEQ ID NO: 1314614 - RNA, 19 nt, Homo sapiens
ugggcagucucuucuguua

SEQ ID NO: 1314615 - RNA, 19 nt, Homo sapiens
caacuauugaggaagauaa

SEQ ID NO: 1314616 - RNA, 19 nt, Homo sapiens
cagagaggaagauauguuu

SEQ ID NO: 1314617 - RNA, 19 nt, Homo sapiens
ucgcuguguuuccuuguua

SEQ ID NO: 1314618 - RNA, 19 nt, Homo sapiens
aggaguagcucgaggugaa

SEQ ID NO: 1314619 - RNA, 19 nt, Homo sapiens
gcgcuuaggugagaaagag

SEQ ID NO: 1314620 - RNA, 19 nt, Homo sapiens
gggcuggagagcagauuua

SEQ ID NO: 1314621 - RNA, 19 nt, Homo sapiens
guguggcucugcaggauuu

SEQ ID NO: 1314622 - RNA, 19 nt, Homo sapiens
ggaaguugcacagcagaaa

SEQ ID NO: 1314623 - RNA, 19 nt, Homo sapiens
gagccucacuucuuuuaaa

SEQ ID NO: 1314624 - RNA, 19 nt, Homo sapiens
gaucacuacugguuacaac

SEQ ID NO: 1314625 - RNA, 19 nt, Homo sapiens
aaacaucgcacuggccuuu

SEQ ID NO: 1314626 - RNA, 19 nt, Homo sapiens
augaaagucucaaucaaga

SEQ ID NO: 1314627 - RNA, 19 nt, Homo sapiens
aaauugcgcuuaggugaga

SEQ ID NO: 1314628 - RNA, 19 nt, Homo sapiens
gacagacucuacgccauga

SEQ ID NO: 1314629 - RNA, 19 nt, Homo sapiens
guacgccuacuucuauaaa

SEQ ID NO: 1314630 - RNA, 19 nt, Homo sapiens
gaauaugacacuccucucu

SEQ ID NO: 1314631 - RNA, 19 nt, Homo sapiens
aagaagagggcuuugguuu

SEQ ID NO: 1314632 - RNA, 19 nt, Homo sapiens
ugaagaagaacugaaagaa

SEQ ID NO: 1314633 - RNA, 19 nt, Homo sapiens
cuguaugacugaagaagaa

SEQ ID NO: 1314634 - RNA, 19 nt, Homo sapiens
caauaacucacacgacaga

SEQ ID NO: 1314635 - RNA, 19 nt, Homo sapiens
ccaacggccugaucacuac

SEQ ID NO: 1314636 - RNA, 19 nt, Homo sapiens
cacacaagcuauacaugau

SEQ ID NO: 1314637 - RNA, 19 nt, Homo sapiens
gaagaugaaguucgguauc

SEQ ID NO: 1314638 - RNA, 19 nt, Homo sapiens
gaaaacagaauugaaguug

SEQ ID NO: 1314639 - RNA, 19 nt, Homo sapiens
caaacaaccacaagaaagg

SEQ ID NO: 1314640 - RNA, 19 nt, Homo sapiens
ccaaaggaucuucuucaga

SEQ ID NO: 1314641 - RNA, 19 nt, Homo sapiens
agauagagccucacuucuu

SEQ ID NO: 1314642 - RNA, 19 nt, Homo sapiens
caacgcagaguuugugauc

SEQ ID NO: 1314643 - RNA, 19 nt, Homo sapiens
gcccuuauauucucaagac

SEQ ID NO: 1314644 - RNA, 19 nt, Homo sapiens
cugcuggaguuaaggagua

SEQ ID NO: 1314645 - RNA, 19 nt, Homo sapiens
caaagcaaaggccacagaa

SEQ ID NO: 1314646 - RNA, 19 nt, Homo sapiens
gaacaucagagaggcaauc

SEQ ID NO: 1314647 - RNA, 19 nt, Homo sapiens
gacaacgaggucaaacuuu

SEQ ID NO: 1314648 - RNA, 19 nt, Homo sapiens
caacaaacuacccuugaag

SEQ ID NO: 1314649 - RNA, 19 nt, Homo sapiens
gccaacagauggaggaaaa

SEQ ID NO: 1314650 - RNA, 19 nt, Homo sapiens
gacugaagaagaacugaaa

SEQ ID NO: 1314651 - RNA, 19 nt, Homo sapiens
gccaaaggaucuucuucag

SEQ ID NO: 1314652 - RNA, 19 nt, Homo sapiens
guaaagagugcagcuguca

SEQ ID NO: 1314653 - RNA, 19 nt, Homo sapiens
aaacuuuggacauuucuug

SEQ ID NO: 1314654 - RNA, 19 nt, Homo sapiens
uuccugaucuaaugaaaug

SEQ ID NO: 1314655 - RNA, 19 nt, Homo sapiens
ggugggcagucucuucugu

SEQ ID NO: 1314656 - RNA, 19 nt, Homo sapiens
agaguaaccuugggcuguu

SEQ ID NO: 1314657 - RNA, 19 nt, Homo sapiens
ucccaaauaugaagagagu

SEQ ID NO: 1314658 - RNA, 19 nt, Homo sapiens
cugauuccuuuaugggaua

SEQ ID NO: 1314659 - RNA, 19 nt, Homo sapiens
gcagucucuucuguuauga

SEQ ID NO: 1314660 - RNA, 19 nt, Homo sapiens
cgucucagcuguacuuuug

SEQ ID NO: 1314661 - RNA, 19 nt, Homo sapiens
cuccgaguauucuguauga

SEQ ID NO: 1314662 - RNA, 19 nt, Homo sapiens
caugaaggccgaggucuug

SEQ ID NO: 1314663 - RNA, 19 nt, Homo sapiens
ucagagaggcaaucagcaa

SEQ ID NO: 1314664 - RNA, 19 nt, Homo sapiens
ugucaacccgggaauacua

SEQ ID NO: 1314665 - RNA, 19 nt, Homo sapiens
gccaucaaauugcgcuuag

SEQ ID NO: 1314666 - RNA, 19 nt, Homo sapiens
ggacucugguugagaaaau

SEQ ID NO: 1314667 - RNA, 19 nt, Homo sapiens
agaagagggcuuugguuug

SEQ ID NO: 1314668 - RNA, 19 nt, Homo sapiens
gggaagaguaugugcagau

SEQ ID NO: 1314669 - RNA, 19 nt, Homo sapiens
ggccugaucacuacugguu

SEQ ID NO: 1314670 - RNA, 19 nt, Homo sapiens
gccaacaaacuacccuuga

SEQ ID NO: 1314671 - RNA, 19 nt, Homo sapiens
gcacugcuggaguuaagga

SEQ ID NO: 1314672 - RNA, 19 nt, Homo sapiens
gaacuaaaccagacuguaa

SEQ ID NO: 1314673 - RNA, 19 nt, Homo sapiens
guagcaggcuuguuaaaua

SEQ ID NO: 1314674 - RNA, 19 nt, Homo sapiens
caacaagugucccuuaauu

SEQ ID NO: 1314675 - RNA, 19 nt, Homo sapiens
ccaaugaacugguuguaaa

SEQ ID NO: 1314676 - RNA, 19 nt, Homo sapiens
gaucaagacuagaaccaaa

SEQ ID NO: 1314677 - RNA, 19 nt, Homo sapiens
gagcauagccugugagaug

SEQ ID NO: 1314678 - RNA, 19 nt, Homo sapiens
gagauaagaucagaaacaa

SEQ ID NO: 1314679 - RNA, 19 nt, Homo sapiens
ucaagaacaugcaaauuug

SEQ ID NO: 1314680 - RNA, 19 nt, Homo sapiens
ccaaggagaugcuaaguag

SEQ ID NO: 1314681 - RNA, 19 nt, Homo sapiens
ugaaugaacuuucuuguac

SEQ ID NO: 1314682 - RNA, 19 nt, Homo sapiens
gaaggcaucuaaucuacug

SEQ ID NO: 1314683 - RNA, 19 nt, Homo sapiens
agaaaugacugaaggauca

SEQ ID NO: 1314684 - RNA, 19 nt, Homo sapiens
aaaccagacuguaaacauu

SEQ ID NO: 1314685 - RNA, 19 nt, Homo sapiens
gaaaggagcaggauguauc

SEQ ID NO: 1314686 - RNA, 19 nt, Homo sapiens
ggauucagauuucccaguu

SEQ ID NO: 1314687 - RNA, 19 nt, Homo sapiens
uaaagugaguuacacauca

SEQ ID NO: 1314688 - RNA, 19 nt, Homo sapiens
gaucacugcugccaaggaa

SEQ ID NO: 1314689 - RNA, 19 nt, Homo sapiens
gaacuuucuuguaccaaug

SEQ ID NO: 1314690 - RNA, 19 nt, Homo sapiens
caagaugucugguugugau

SEQ ID NO: 1314691 - RNA, 19 nt, Homo sapiens
gaacaacuggucaggauuc

SEQ ID NO: 1314692 - RNA, 19 nt, Homo sapiens
gcagaugucauugcugaua

SEQ ID NO: 1314693 - RNA, 19 nt, Homo sapiens
guaaguauaacaucucuga

SEQ ID NO: 1314694 - RNA, 19 nt, Homo sapiens
aaacguaugcagaucuuua

SEQ ID NO: 1314695 - RNA, 19 nt, Homo sapiens
uaaaggaacaucucucaga

SEQ ID NO: 1314696 - RNA, 19 nt, Homo sapiens
ggagauaagaucagaaaca

SEQ ID NO: 1314697 - RNA, 19 nt, Homo sapiens
gcagcuggcuuuccucaag

SEQ ID NO: 1314698 - RNA, 19 nt, Homo sapiens
caaaguagaaagugaaugu

SEQ ID NO: 1314699 - RNA, 19 nt, Homo sapiens
aguaauaacucacuaccuu

SEQ ID NO: 1314700 - RNA, 19 nt, Homo sapiens
uaacaucucugaucaugcu

SEQ ID NO: 1314701 - RNA, 19 nt, Homo sapiens
gaacuugaugggaaagaaa

SEQ ID NO: 1314702 - RNA, 19 nt, Homo sapiens
ugucauugcugauauacaa

SEQ ID NO: 1314703 - RNA, 19 nt, Homo sapiens
gauaaaggaacaucucuca

SEQ ID NO: 1314704 - RNA, 19 nt, Homo sapiens
gcacauacaggaacaacug

SEQ ID NO: 1314705 - RNA, 19 nt, Homo sapiens
aaaagcagcuguaaaguga

SEQ ID NO: 1314706 - RNA, 19 nt, Homo sapiens
caaacugucccaccuuaaa

SEQ ID NO: 1314707 - RNA, 19 nt, Homo sapiens
guagaaagugaauguguuu

SEQ ID NO: 1314708 - RNA, 19 nt, Homo sapiens
gcagaucaugaaccaaaua

SEQ ID NO: 1314709 - RNA, 19 nt, Homo sapiens
gauucagauuucccaguua

SEQ ID NO: 1314710 - RNA, 19 nt, Homo sapiens
aaugguagcaggcuuguua

SEQ ID NO: 1314711 - RNA, 19 nt, Homo sapiens
ggaacuugaugggaaagaa

SEQ ID NO: 1314712 - RNA, 19 nt, Homo sapiens
gaacaaaagcucuacauuc

SEQ ID NO: 1314713 - RNA, 19 nt, Homo sapiens
uauaacaucucugaucaug

SEQ ID NO: 1314714 - RNA, 19 nt, Homo sapiens
aggcugcgcucaaauaaga

SEQ ID NO: 1314715 - RNA, 19 nt, Homo sapiens
cagagaaacacaagaaaug

SEQ ID NO: 1314716 - RNA, 19 nt, Homo sapiens
aggaagggcuggaaggaaa

SEQ ID NO: 1314717 - RNA, 19 nt, Homo sapiens
ggguagagcagaugucauu

SEQ ID NO: 1314718 - RNA, 19 nt, Homo sapiens
gcuaaguagugaccagaga

SEQ ID NO: 1314719 - RNA, 19 nt, Homo sapiens
caaguggucucugucauag

SEQ ID NO: 1314720 - RNA, 19 nt, Homo sapiens
ucaaguggucucugucaua

SEQ ID NO: 1314721 - RNA, 19 nt, Homo sapiens
gagguaaaccacaaccaaa

SEQ ID NO: 1314722 - RNA, 19 nt, Homo sapiens
cagaccagaugaaugcaaa

SEQ ID NO: 1314723 - RNA, 19 nt, Homo sapiens
caucucugaucaugcuaua

SEQ ID NO: 1314724 - RNA, 19 nt, Homo sapiens
agagaugccuuuagcaaca

SEQ ID NO: 1314725 - RNA, 19 nt, Homo sapiens
caacuggucaggauucaga

SEQ ID NO: 1314726 - RNA, 19 nt, Homo sapiens
ggacuguaguaauaagcuu

SEQ ID NO: 1314727 - RNA, 19 nt, Homo sapiens
ggagguaaaccacaaccaa

SEQ ID NO: 1314728 - RNA, 19 nt, Homo sapiens
cauuauggccagcaagaua

SEQ ID NO: 1314729 - RNA, 19 nt, Homo sapiens
uagcaggcuuguuaaauag

SEQ ID NO: 1314730 - RNA, 19 nt, Homo sapiens
caguaagccuagagagaaa

SEQ ID NO: 1314731 - RNA, 19 nt, Homo sapiens
gaacuggaugcugcacaua

SEQ ID NO: 1314732 - RNA, 19 nt, Homo sapiens
cucaagaacaugcaaauuu

SEQ ID NO: 1314733 - RNA, 19 nt, Homo sapiens
uugaaacacucgaucagaa

SEQ ID NO: 1314734 - RNA, 19 nt, Homo sapiens
ccaguaagccuagagagaa

SEQ ID NO: 1314735 - RNA, 19 nt, Homo sapiens
ugaaggaucaagacuagaa

SEQ ID NO: 1314736 - RNA, 19 nt, Homo sapiens
ugagaugaaugaacuuucu

SEQ ID NO: 1314737 - RNA, 19 nt, Homo sapiens
gaaaacguaugcagaucuu

SEQ ID NO: 1314738 - RNA, 19 nt, Homo sapiens
gcaagagaaacuggcauuu

SEQ ID NO: 1314739 - RNA, 19 nt, Homo sapiens
aaacagaccagaugaaugc

SEQ ID NO: 1314740 - RNA, 19 nt, Homo sapiens
gacuagaaccaaacucuga

SEQ ID NO: 1314741 - RNA, 19 nt, Homo sapiens
gcaggcuuguuaaauagug

SEQ ID NO: 1314742 - RNA, 19 nt, Homo sapiens
gugaaggcaucuaaucuac

SEQ ID NO: 1314743 - RNA, 19 nt, Homo sapiens
guuauguucuccaguuuua

SEQ ID NO: 1314744 - RNA, 19 nt, Homo sapiens
aguauaacaucucugauca

SEQ ID NO: 1314745 - RNA, 19 nt, Homo sapiens
cagaugucauugcugauau

SEQ ID NO: 1314746 - RNA, 19 nt, Homo sapiens
gcauuuaaacaaagagaug

SEQ ID NO: 1314747 - RNA, 19 nt, Homo sapiens
ccagcaagauaaaggaaca

SEQ ID NO: 1314748 - RNA, 19 nt, Homo sapiens
gcagcuguaaagugaguua

SEQ ID NO: 1314749 - RNA, 19 nt, Homo sapiens
ccacagaagguaugguaga

SEQ ID NO: 1314750 - RNA, 19 nt, Homo sapiens
caggagauaagaucagaaa

SEQ ID NO: 1314751 - RNA, 19 nt, Homo sapiens
ggauaucucuagcugucau

SEQ ID NO: 1314752 - RNA, 19 nt, Homo sapiens
uacaaaccauucccauuca

SEQ ID NO: 1314753 - RNA, 19 nt, Homo sapiens
agaugucauugcugauaua

SEQ ID NO: 1314754 - RNA, 19 nt, Homo sapiens
gagccaucacccuccauua

SEQ ID NO: 1314755 - RNA, 19 nt, Homo sapiens
cagaagguaugguagacau

SEQ ID NO: 1314756 - RNA, 19 nt, Homo sapiens
gccaaggagaugcuaagua

SEQ ID NO: 1314757 - RNA, 19 nt, Homo sapiens
gaucagaaacaaaauggua

SEQ ID NO: 1314758 - RNA, 19 nt, Homo sapiens
gcugauauacaaaccauuc

SEQ ID NO: 1314759 - RNA, 19 nt, Homo sapiens
gaagaaaacguaugcagau

SEQ ID NO: 1314760 - RNA, 19 nt, Homo sapiens
ggaaaggagcaggauguau

SEQ ID NO: 1314761 - RNA, 19 nt, Homo sapiens
gcugucaucguguaagaaa

SEQ ID NO: 1314762 - RNA, 19 nt, Homo sapiens
uucaaacugucccaccuua

SEQ ID NO: 1314763 - RNA, 19 nt, Homo sapiens
auacaaaccauucccauuc

SEQ ID NO: 1314764 - RNA, 19 nt, Homo sapiens
aaacacaagaaaugacuga

SEQ ID NO: 1314765 - RNA, 19 nt, Homo sapiens
aaaucagccugcaaguuga

SEQ ID NO: 1314766 - RNA, 19 nt, Homo sapiens
aguggucucugucauagaa

SEQ ID NO: 1314767 - RNA, 19 nt, Homo sapiens
aaucaacaagugucccuua

SEQ ID NO: 1314768 - RNA, 19 nt, Homo sapiens
ccauucccauucagacaaa

SEQ ID NO: 1314769 - RNA, 19 nt, Homo sapiens
caugaugaaagcucuguuu

SEQ ID NO: 1314770 - RNA, 19 nt, Homo sapiens
cagaucaugaaccaaauaa

SEQ ID NO: 1314771 - RNA, 19 nt, Homo sapiens
ggaaaaguguccagacucu

SEQ ID NO: 1314772 - RNA, 19 nt, Homo sapiens
gaagaaggguuuaaaggua

SEQ ID NO: 1314773 - RNA, 19 nt, Homo sapiens
ggaauuaugucucauguuu

SEQ ID NO: 1314774 - RNA, 19 nt, Homo sapiens
gcaggaugcucaagaauuu

SEQ ID NO: 1314775 - RNA, 19 nt, Homo sapiens
ccaaaugccuuaugucaaa

SEQ ID NO: 1314776 - RNA, 19 nt, Homo sapiens
ggaagaagcuaaaccagau

SEQ ID NO: 1314777 - RNA, 19 nt, Homo sapiens
ggauggagaacauuuauua

SEQ ID NO: 1314778 - RNA, 19 nt, Homo sapiens
agacuucucucccaaauuu

SEQ ID NO: 1314779 - RNA, 19 nt, Homo sapiens
gaugaacgguagcaccuua

SEQ ID NO: 1314780 - RNA, 19 nt, Homo sapiens
gaagauacuuugucuaaac

SEQ ID NO: 1314781 - RNA, 19 nt, Homo sapiens
caaauuuguuccaggauaa

SEQ ID NO: 1314782 - RNA, 19 nt, Homo sapiens
ggaagaaaaugaagccuua

SEQ ID NO: 1314783 - RNA, 19 nt, Homo sapiens
gaacaaagcaacggaaaga

SEQ ID NO: 1314784 - RNA, 19 nt, Homo sapiens
uaaggaauguguaguagaa

SEQ ID NO: 1314785 - RNA, 19 nt, Homo sapiens
ugaagaggauaucugaaua

SEQ ID NO: 1314786 - RNA, 19 nt, Homo sapiens
gggaagaaauuacaacuag

SEQ ID NO: 1314787 - RNA, 19 nt, Homo sapiens
caauaaagcaugaaaguga

SEQ ID NO: 1314788 - RNA, 19 nt, Homo sapiens
gaaaggauggagaacauuu

SEQ ID NO: 1314789 - RNA, 19 nt, Homo sapiens
gaaauuacaacuagggauu

SEQ ID NO: 1314790 - RNA, 19 nt, Homo sapiens
gacauaaccugcuuaccaa

SEQ ID NO: 1314791 - RNA, 19 nt, Homo sapiens
ccaaauuuguuccaggaua

SEQ ID NO: 1314792 - RNA, 19 nt, Homo sapiens
gcaagauggugaugcagaa

SEQ ID NO: 1314793 - RNA, 19 nt, Homo sapiens
gagcugagcccuaugaguu

SEQ ID NO: 1314794 - RNA, 19 nt, Homo sapiens
caacacauuucuucaagug

SEQ ID NO: 1314795 - RNA, 19 nt, Homo sapiens
gauguaaacccuucagaaa

SEQ ID NO: 1314796 - RNA, 19 nt, Homo sapiens
agacgaaacugcaaaggaa

SEQ ID NO: 1314797 - RNA, 19 nt, Homo sapiens
gaggagugguguauugaaa

SEQ ID NO: 1314798 - RNA, 19 nt, Homo sapiens
gaaggcugaugaaccaauu

SEQ ID NO: 1314799 - RNA, 19 nt, Homo sapiens
gcaaaggaaauccgaauug

SEQ ID NO: 1314800 - RNA, 19 nt, Homo sapiens
uaaagaggcuuggagcaaa

SEQ ID NO: 1314801 - RNA, 19 nt, Homo sapiens
gguagcaccuuaaauaaag

SEQ ID NO: 1314802 - RNA, 19 nt, Homo sapiens
guagaacguugucgcauau

SEQ ID NO: 1314803 - RNA, 19 nt, Homo sapiens
ggugaaugguauaaguuua

SEQ ID NO: 1314804 - RNA, 19 nt, Homo sapiens
gaagaggaguuugacaugu

SEQ ID NO: 1314805 - RNA, 19 nt, Homo sapiens
gaacagugcucuuuugugu

SEQ ID NO: 1314806 - RNA, 19 nt, Homo sapiens
ggaagauacuuugucuaaa

SEQ ID NO: 1314807 - RNA, 19 nt, Homo sapiens
aaauguaccuggcacguuu

SEQ ID NO: 1314808 - RNA, 19 nt, Homo sapiens
ggacaacauucugcucuga

SEQ ID NO: 1314809 - RNA, 19 nt, Homo sapiens
ugaggaagaucuagcagaa

SEQ ID NO: 1314810 - RNA, 19 nt, Homo sapiens
ggacaaggaagaagcuaaa

SEQ ID NO: 1314811 - RNA, 19 nt, Homo sapiens
gaagaguggcggaaauuug

SEQ ID NO: 1314812 - RNA, 19 nt, Homo sapiens
cauaaaggauuguaucaag

SEQ ID NO: 1314813 - RNA, 19 nt, Homo sapiens
uccaaaggcuccugaguuu

SEQ ID NO: 1314814 - RNA, 19 nt, Homo sapiens
gaaggcuuguuucuaaaga

SEQ ID NO: 1314815 - RNA, 19 nt, Homo sapiens
ggagugguguauugaaaug

SEQ ID NO: 1314816 - RNA, 19 nt, Homo sapiens
ggaaaagugucuucagauu

SEQ ID NO: 1314817 - RNA, 19 nt, Homo sapiens
aaacgugacugucccaaau

SEQ ID NO: 1314818 - RNA, 19 nt, Homo sapiens
uuaaggagcuguaccaaag

SEQ ID NO: 1314819 - RNA, 19 nt, Homo sapiens
caaacagaaugcaacaaga

SEQ ID NO: 1314820 - RNA, 19 nt, Homo sapiens
guacuuguuugccuuguug

SEQ ID NO: 1314821 - RNA, 19 nt, Homo sapiens
cagaugcguugguccauaa

SEQ ID NO: 1314822 - RNA, 19 nt, Homo sapiens
guaaagacggaacaaguuu

SEQ ID NO: 1314823 - RNA, 19 nt, Homo sapiens
gaagaaccaacuaaaugaa

SEQ ID NO: 1314824 - RNA, 19 nt, Homo sapiens
cuaccaaaccuauugauaa

SEQ ID NO: 1314825 - RNA, 19 nt, Homo sapiens
cgagaacugucaaagcaaa

SEQ ID NO: 1314826 - RNA, 19 nt, Homo sapiens
ggaaagauuuuaagugaug

SEQ ID NO: 1314827 - RNA, 19 nt, Homo sapiens
caucgugucucaguucuuu

SEQ ID NO: 1314828 - RNA, 19 nt, Homo sapiens
caaagcaacggaaagauga

SEQ ID NO: 1314829 - RNA, 19 nt, Homo sapiens
cacaaacaguuaacagauu

SEQ ID NO: 1314830 - RNA, 19 nt, Homo sapiens
cuacaucgcccacgugaaa

SEQ ID NO: 1314831 - RNA, 19 nt, Homo sapiens
gcaaugagcaaggaauuau

SEQ ID NO: 1314832 - RNA, 19 nt, Homo sapiens
gugaagaacuuguccuaag

SEQ ID NO: 1314833 - RNA, 19 nt, Homo sapiens
caucagacuugaaggaaau

SEQ ID NO: 1314834 - RNA, 19 nt, Homo sapiens
gaauugaagugggagaugu

SEQ ID NO: 1314835 - RNA, 19 nt, Homo sapiens
acucugaacuugcagcuaa

SEQ ID NO: 1314836 - RNA, 19 nt, Homo sapiens
acaaacaguuaacagauug

SEQ ID NO: 1314837 - RNA, 19 nt, Homo sapiens
uggagaauaugccuaugua

SEQ ID NO: 1314838 - RNA, 19 nt, Homo sapiens
gcacucuacuuauguccaa

SEQ ID NO: 1314839 - RNA, 19 nt, Homo sapiens
aggcagaaauccauucaaa

SEQ ID NO: 1314840 - RNA, 19 nt, Homo sapiens
agaggaguuugacauguua

SEQ ID NO: 1314841 - RNA, 19 nt, Homo sapiens
agagggaccugcgugaaua

SEQ ID NO: 1314842 - RNA, 19 nt, Homo sapiens
guagaagaguggcggaaau

SEQ ID NO: 1314843 - RNA, 19 nt, Homo sapiens
gaaaaugaagccuuacaua

SEQ ID NO: 1314844 - RNA, 19 nt, Homo sapiens
guaauaggcgauacauuga

SEQ ID NO: 1314845 - RNA, 19 nt, Homo sapiens
cagaaaggauggagaacau

SEQ ID NO: 1314846 - RNA, 19 nt, Homo sapiens
gcaguaauaguaaaucaug

SEQ ID NO: 1314847 - RNA, 19 nt, Homo sapiens
uaaagcagauugcacugau

SEQ ID NO: 1314848 - RNA, 19 nt, Homo sapiens
gcaaagguggauuuaagaa

SEQ ID NO: 1314849 - RNA, 19 nt, Homo sapiens
aagcaaagguggauuuaag

SEQ ID NO: 1314850 - RNA, 19 nt, Homo sapiens
uuagaaagccuacaagaug

SEQ ID NO: 1314851 - RNA, 19 nt, Homo sapiens
ugaagaaccaacuaaauga

SEQ ID NO: 1314852 - RNA, 19 nt, Homo sapiens
ugaaagcccuguguaagga

SEQ ID NO: 1314853 - RNA, 19 nt, Homo sapiens
ggaggagguccaagacuaa

SEQ ID NO: 1314854 - RNA, 19 nt, Homo sapiens
gaauaugccuauguaacug

SEQ ID NO: 1314855 - RNA, 19 nt, Homo sapiens
uaaagguacuggucuucuu

SEQ ID NO: 1314856 - RNA, 19 nt, Homo sapiens
uguaaacccuucagaaaca

SEQ ID NO: 1314857 - RNA, 19 nt, Homo sapiens
cuccugaguuuccaaguua

SEQ ID NO: 1314858 - RNA, 19 nt, Homo sapiens
ggaagaggaguuugacaug

SEQ ID NO: 1314859 - RNA, 19 nt, Homo sapiens
guaagcaaaguguggauaa

SEQ ID NO: 1314860 - RNA, 19 nt, Homo sapiens
ggaacucauugcucucgaa

SEQ ID NO: 1314861 - RNA, 19 nt, Homo sapiens
gcaaacagaaugcaacaag

SEQ ID NO: 1314862 - RNA, 19 nt, Homo sapiens
uggaagauacuuugucuaa

SEQ ID NO: 1314863 - RNA, 19 nt, Homo sapiens
ggacaucagacuugaagga

SEQ ID NO: 1314864 - RNA, 19 nt, Homo sapiens
gucaauugauggaaagauu

SEQ ID NO: 1314865 - RNA, 19 nt, Homo sapiens
gagaaggcuuauuguguca

SEQ ID NO: 1314866 - RNA, 19 nt, Homo sapiens
gcauauugcgucugaagaa

SEQ ID NO: 1314867 - RNA, 19 nt, Homo sapiens
ggagcuguaccaaagguua

SEQ ID NO: 1314868 - RNA, 19 nt, Homo sapiens
gugagcaucuccaguacuu

SEQ ID NO: 1314869 - RNA, 19 nt, Homo sapiens
aaacagaggaggacaagga

SEQ ID NO: 1314870 - RNA, 19 nt, Homo sapiens
gaaugugaguaguucugaa

SEQ ID NO: 1314871 - RNA, 19 nt, Homo sapiens
ccgaauugcuugguuggua

SEQ ID NO: 1314872 - RNA, 19 nt, Homo sapiens
ggaaggagcuguaaagaga

SEQ ID NO: 1314873 - RNA, 19 nt, Homo sapiens
caagagagaugcugugaaa

SEQ ID NO: 1314874 - RNA, 19 nt, Homo sapiens
gcacaaaguugcacucuca

SEQ ID NO: 1314875 - RNA, 19 nt, Homo sapiens
gaagaaacacuaaaccuuu

SEQ ID NO: 1314876 - RNA, 19 nt, Homo sapiens
acacuaugcuuacugaaua

SEQ ID NO: 1314877 - RNA, 19 nt, Homo sapiens
gaccugagcuggagaagga

SEQ ID NO: 1314878 - RNA, 19 nt, Homo sapiens
ccacauugguuguuagauu

SEQ ID NO: 1314879 - RNA, 19 nt, Homo sapiens
ggagugauaugguccgauu

SEQ ID NO: 1314880 - RNA, 19 nt, Homo sapiens
acaagcaacuucagcauuu

SEQ ID NO: 1314881 - RNA, 19 nt, Homo sapiens
gaugacaacacuaugcuua

SEQ ID NO: 1314882 - RNA, 19 nt, Homo sapiens
gaauaucacccucuagguu

SEQ ID NO: 1314883 - RNA, 19 nt, Homo sapiens
gcgaggagcugagaacaga

SEQ ID NO: 1314884 - RNA, 19 nt, Homo sapiens
ggaagaaacacuaaaccuu

SEQ ID NO: 1314885 - RNA, 19 nt, Homo sapiens
gagaugcgcuugggaggaa

SEQ ID NO: 1314886 - RNA, 19 nt, Homo sapiens
gagaauggacugcaagaga

SEQ ID NO: 1314887 - RNA, 19 nt, Homo sapiens
gauccuguuugcuguguaa

SEQ ID NO: 1314888 - RNA, 19 nt, Homo sapiens
cacauugguuguuagauuu

SEQ ID NO: 1314889 - RNA, 19 nt, Homo sapiens
gagccagacucccucagaa

SEQ ID NO: 1314890 - RNA, 19 nt, Homo sapiens
gagcaacuguggcccuaug

SEQ ID NO: 1314891 - RNA, 19 nt, Homo sapiens
gaugaauacucuacucuac

SEQ ID NO: 1314892 - RNA, 19 nt, Homo sapiens
ggucuuggauacacuuaga

SEQ ID NO: 1314893 - RNA, 19 nt, Homo sapiens
gacuaugucagcaucauua

SEQ ID NO: 1314894 - RNA, 19 nt, Homo sapiens
ggagugcagugaugugauc

SEQ ID NO: 1314895 - RNA, 19 nt, Homo sapiens
ucccagacaucuccaguuu

SEQ ID NO: 1314896 - RNA, 19 nt, Homo sapiens
gccuggagaugaaagauga

SEQ ID NO: 1314897 - RNA, 19 nt, Homo sapiens
uuacagcauucuacucuga

SEQ ID NO: 1314898 - RNA, 19 nt, Homo sapiens
gaugagaagauugacauuu

SEQ ID NO: 1314899 - RNA, 19 nt, Homo sapiens
caacuagaguauggacuga

SEQ ID NO: 1314900 - RNA, 19 nt, Homo sapiens
ccucuagguuccuugagua

SEQ ID NO: 1314901 - RNA, 19 nt, Homo sapiens
augagaagauugacauuug

SEQ ID NO: 1314902 - RNA, 19 nt, Homo sapiens
ugaguaaccuggaagaaac

SEQ ID NO: 1314903 - RNA, 19 nt, Homo sapiens
acaacacuaugcuuacuga

SEQ ID NO: 1314904 - RNA, 19 nt, Homo sapiens
gcugagaacagaagugaga

SEQ ID NO: 1314905 - RNA, 19 nt, Homo sapiens
aguauggacugaccaggua

SEQ ID NO: 1314906 - RNA, 19 nt, Homo sapiens
gggaaucuauuguggaaac

SEQ ID NO: 1314907 - RNA, 19 nt, Homo sapiens
gagcugagaacagaaguga

SEQ ID NO: 1314908 - RNA, 19 nt, Homo sapiens
cuucaucgcuccucgacaa

SEQ ID NO: 1314909 - RNA, 19 nt, Homo sapiens
cgauuccauuuguuugaua

SEQ ID NO: 1314910 - RNA, 19 nt, Homo sapiens
gaugcggucuugcucuguu

SEQ ID NO: 1314911 - RNA, 19 nt, Homo sapiens
caugaugucucaggcaaga

SEQ ID NO: 1314912 - RNA, 19 nt, Homo sapiens
cauaugaugagaagauuga

SEQ ID NO: 1314913 - RNA, 19 nt, Homo sapiens
gagaggacgugccuuucca

SEQ ID NO: 1314914 - RNA, 19 nt, Homo sapiens
ucacgcugcuuggcuauug

SEQ ID NO: 1314915 - RNA, 19 nt, Homo sapiens
uauggucacuucaggauag

SEQ ID NO: 1314916 - RNA, 19 nt, Homo sapiens
cauguacguuuguauguag

SEQ ID NO: 1314917 - RNA, 19 nt, Homo sapiens
ccacauguacguuuguaug

SEQ ID NO: 1314918 - RNA, 19 nt, Homo sapiens
gguccgauuccauuuguuu

SEQ ID NO: 1314919 - RNA, 19 nt, Homo sapiens
gaucucaugcccucauaug

SEQ ID NO: 1314920 - RNA, 19 nt, Homo sapiens
ccaacgaccugccgaagac

SEQ ID NO: 1314921 - RNA, 19 nt, Homo sapiens
gacugcagaugcugaaauc

SEQ ID NO: 1314922 - RNA, 19 nt, Homo sapiens
gugcagugaugugaucuug

SEQ ID NO: 1314923 - RNA, 19 nt, Homo sapiens
cccaguaucugcuaacaag

SEQ ID NO: 1314924 - RNA, 19 nt, Homo sapiens
ggacuaugucagcaucauu

SEQ ID NO: 1314925 - RNA, 19 nt, Homo sapiens
ggacugcagaugcugaaau

SEQ ID NO: 1314926 - RNA, 19 nt, Homo sapiens
ccagacaucuccaguuucc

SEQ ID NO: 1314927 - RNA, 19 nt, Homo sapiens
uaaccuggaagaaacacua

SEQ ID NO: 1314928 - RNA, 19 nt, Homo sapiens
aaaccaguccagccaauga

SEQ ID NO: 1314929 - RNA, 19 nt, Homo sapiens
gaaaaccaguccagccaau

SEQ ID NO: 1314930 - RNA, 19 nt, Homo sapiens
gcaagagagaugcugugaa

SEQ ID NO: 1314931 - RNA, 19 nt, Homo sapiens
acuuagagaugccaugaug

SEQ ID NO: 1314932 - RNA, 19 nt, Homo sapiens
gcuccgggaugcuggugaa

SEQ ID NO: 1314933 - RNA, 19 nt, Homo sapiens
ugagaagauugacauuugg

SEQ ID NO: 1314934 - RNA, 19 nt, Homo sapiens
ggaaguuacagcauucuac

SEQ ID NO: 1314935 - RNA, 19 nt, Homo sapiens
gaaguuacagcauucuacu

SEQ ID NO: 1314936 - RNA, 19 nt, Homo sapiens
cagaggccgucaacaugga

SEQ ID NO: 1314937 - RNA, 19 nt, Homo sapiens
uaccagaaggucuuggaua

SEQ ID NO: 1314938 - RNA, 19 nt, Homo sapiens
gagaagauugacauuugga

SEQ ID NO: 1314939 - RNA, 19 nt, Homo sapiens
agagagucuuucugucuga

SEQ ID NO: 1314940 - RNA, 19 nt, Homo sapiens
caggauaggacagaugaaa

SEQ ID NO: 1314941 - RNA, 19 nt, Homo sapiens
gcuguguaauccugagaau

SEQ ID NO: 1314942 - RNA, 19 nt, Homo sapiens
gaaggucuuggauacacuu

SEQ ID NO: 1314943 - RNA, 19 nt, Homo sapiens
ggauugaagggcugaaugg

SEQ ID NO: 1314944 - RNA, 19 nt, Homo sapiens
ccagacucccucagaaaga

SEQ ID NO: 1314945 - RNA, 19 nt, Homo sapiens
ugacaacacuaugcuuacu

SEQ ID NO: 1314946 - RNA, 19 nt, Homo sapiens
gugaggaugacaacacuau

SEQ ID NO: 1314947 - RNA, 19 nt, Homo sapiens
guggaaggagcacaaaguu

SEQ ID NO: 1314948 - RNA, 19 nt, Homo sapiens
uugggaaucuauuguggaa

SEQ ID NO: 1314949 - RNA, 19 nt, Homo sapiens
ugaauacucuacucuaccu

SEQ ID NO: 1314950 - RNA, 19 nt, Homo sapiens
cacauugaagggagugaua

SEQ ID NO: 1314951 - RNA, 19 nt, Homo sapiens
agacaucuccaguuuccuu

SEQ ID NO: 1314952 - RNA, 19 nt, Homo sapiens
ccgggaugcuggugaagug

SEQ ID NO: 1314953 - RNA, 19 nt, Homo sapiens
gggaaggagcuguaaagag

SEQ ID NO: 1314954 - RNA, 19 nt, Homo sapiens
ggagaccugagcuggagaa

SEQ ID NO: 1314955 - RNA, 19 nt, Homo sapiens
ugaugaauacucuacucua

SEQ ID NO: 1314956 - RNA, 19 nt, Homo sapiens
uaguccacauugguuguua

SEQ ID NO: 1314957 - RNA, 19 nt, Homo sapiens
cagaaggucuuggauacac

SEQ ID NO: 1314958 - RNA, 19 nt, Homo sapiens
ggagcuggccauggacuau

SEQ ID NO: 1314959 - RNA, 19 nt, Homo sapiens
gaaggagcacaaaguugca

SEQ ID NO: 1314960 - RNA, 19 nt, Homo sapiens
gaaaagcagccccagaaca

SEQ ID NO: 1314961 - RNA, 19 nt, Homo sapiens
uugccugaguuucguguuu

SEQ ID NO: 1314962 - RNA, 19 nt, Homo sapiens
agauugacauuuggaagau

SEQ ID NO: 1314963 - RNA, 19 nt, Homo sapiens
aagauugacauuuggaaga

SEQ ID NO: 1314964 - RNA, 19 nt, Homo sapiens
uaacaagcaacuucagcau

SEQ ID NO: 1314965 - RNA, 19 nt, Homo sapiens
ucuuugagaugcggucuug

SEQ ID NO: 1314966 - RNA, 19 nt, Homo sapiens
uguguaauccugagaaugg

SEQ ID NO: 1314967 - RNA, 19 nt, Homo sapiens
gaagggcugaauggaaguu

SEQ ID NO: 1314968 - RNA, 19 nt, Homo sapiens
cacuaugcuuacugaauau

SEQ ID NO: 1314969 - RNA, 19 nt, Homo sapiens
ggauccuguuugcugugua

SEQ ID NO: 1314970 - RNA, 19 nt, Homo sapiens
gcuuggcuauugugaggau

SEQ ID NO: 1314971 - RNA, 19 nt, Homo sapiens
ccucccagguucaagcaau

SEQ ID NO: 1314972 - RNA, 19 nt, Homo sapiens
ggaauagucuguuguaaac

SEQ ID NO: 1314973 - RNA, 19 nt, Homo sapiens
ggccaacucucucacauuu

SEQ ID NO: 1314974 - RNA, 19 nt, Homo sapiens
caacugggauggcucagaa

SEQ ID NO: 1314975 - RNA, 19 nt, Homo sapiens
ugggaaaugucacaaauaa

SEQ ID NO: 1314976 - RNA, 19 nt, Homo sapiens
cuagguagguggaaaggua

SEQ ID NO: 1314977 - RNA, 19 nt, Homo sapiens
caacauauggaaugaaaug

SEQ ID NO: 1314978 - RNA, 19 nt, Homo sapiens
ggaaugcuuuacagauguu

SEQ ID NO: 1314979 - RNA, 19 nt, Homo sapiens
caggaaugcuuuacagaug

SEQ ID NO: 1314980 - RNA, 19 nt, Homo sapiens
gucaacauauggaaugaaa

SEQ ID NO: 1314981 - RNA, 19 nt, Homo sapiens
ccaacucucucacauuuua

SEQ ID NO: 1314982 - RNA, 19 nt, Homo sapiens
cauauggaaugaaaugaug

SEQ ID NO: 1314983 - RNA, 19 nt, Homo sapiens
gagaagagcaagagcaaca

SEQ ID NO: 1314984 - RNA, 19 nt, Homo sapiens
gcacauggaacagucauug

SEQ ID NO: 1314985 - RNA, 19 nt, Homo sapiens
aaacgcuucugcaaacauu

SEQ ID NO: 1314986 - RNA, 19 nt, Homo sapiens
guaaggugccuaaaucuuc

SEQ ID NO: 1314987 - RNA, 19 nt, Homo sapiens
agaagcccaugguggaaua

SEQ ID NO: 1314988 - RNA, 19 nt, Homo sapiens
gcugggaccacauguguaa

SEQ ID NO: 1314989 - RNA, 19 nt, Homo sapiens
aaauuaagcuccgauugug

SEQ ID NO: 1314990 - RNA, 19 nt, Homo sapiens
ccacauguguaagucacua

SEQ ID NO: 1314991 - RNA, 19 nt, Homo sapiens
auggaacagucauugauua

SEQ ID NO: 1314992 - RNA, 19 nt, Homo sapiens
gcaggaaugcuuuacagau

SEQ ID NO: 1314993 - RNA, 19 nt, Homo sapiens
ggaacagucauugauuaaa

SEQ ID NO: 1314994 - RNA, 19 nt, Homo sapiens
ucacuuagaaggagcaaga

SEQ ID NO: 1314995 - RNA, 19 nt, Homo sapiens
caggugagguucucuaggu

SEQ ID NO: 1314996 - RNA, 19 nt, Homo sapiens
gcaaacucacuuagaagga

SEQ ID NO: 1314997 - RNA, 19 nt, Homo sapiens
gguggaauagucuguugua

SEQ ID NO: 1314998 - RNA, 19 nt, Homo sapiens
caccugggcugcaguugga

SEQ ID NO: 1314999 - RNA, 19 nt, Homo sapiens
gcaguacuccauccuguca

SEQ ID NO: 1315000 - RNA, 19 nt, Homo sapiens
gaaacgauccccaugcauu

SEQ ID NO: 1315001 - RNA, 19 nt, Homo sapiens
gauugugcauaucacuuga

SEQ ID NO: 1315002 - RNA, 19 nt, Homo sapiens
cuuguaaggugccuaaauc

SEQ ID NO: 1315003 - RNA, 19 nt, Homo sapiens
aaugggaaaugucacaaau

SEQ ID NO: 1315004 - RNA, 19 nt, Homo sapiens
aaaguggcguguacaaugg

SEQ ID NO: 1315005 - RNA, 19 nt, Homo sapiens
uggaauagucuguuguaaa

SEQ ID NO: 1315006 - RNA, 19 nt, Homo sapiens
gccugacucuguugaucua

SEQ ID NO: 1315007 - RNA, 19 nt, Homo sapiens
uaauagcuaugcaguacuc

SEQ ID NO: 1315008 - RNA, 19 nt, Homo sapiens
gagccugacucuguugauc

SEQ ID NO: 1315009 - RNA, 19 nt, Homo sapiens
aagcuccgauugugcauau

SEQ ID NO: 1315010 - RNA, 19 nt, Homo sapiens
cuccugagcucaagcaauc

SEQ ID NO: 1315011 - RNA, 19 nt, Homo sapiens
acacaaagucacuccuuga

SEQ ID NO: 1315012 - RNA, 19 nt, Homo sapiens
gaaggucagacacaaaguc

SEQ ID NO: 1315013 - RNA, 19 nt, Homo sapiens
aauagucuguuguaaacga

SEQ ID NO: 1315014 - RNA, 19 nt, Homo sapiens
guggaauagucuguuguaa

SEQ ID NO: 1315015 - RNA, 19 nt, Homo sapiens
uuggcaaacucacuuagaa

SEQ ID NO: 1315016 - RNA, 19 nt, Homo sapiens
guagaauguugggaaaaua

SEQ ID NO: 1315017 - RNA, 19 nt, Homo sapiens
gggaaaugucacaaauaaa

SEQ ID NO: 1315018 - RNA, 19 nt, Homo sapiens
ccuugacccuauuuauuga

SEQ ID NO: 1315019 - RNA, 19 nt, Homo sapiens
gagcacuguuggccuacug

SEQ ID NO: 1315020 - RNA, 19 nt, Homo sapiens
acuccauccugucaacaua

SEQ ID NO: 1315021 - RNA, 19 nt, Homo sapiens
caagacugggcuguaguua

SEQ ID NO: 1315022 - RNA, 19 nt, Homo sapiens
gcucagaaggucagacaca

SEQ ID NO: 1315023 - RNA, 19 nt, Homo sapiens
uuuaauagcuaugcaguac

SEQ ID NO: 1315024 - RNA, 19 nt, Homo sapiens
cauggaacagucauugauu

SEQ ID NO: 1315025 - RNA, 19 nt, Homo sapiens
ccaagacugggcuguaguu

SEQ ID NO: 1315026 - RNA, 19 nt, Homo sapiens
ucacuuguaaggugccuaa

SEQ ID NO: 1315027 - RNA, 19 nt, Homo sapiens
uggaacagucauugauuaa

SEQ ID NO: 1315028 - RNA, 19 nt, Homo sapiens
caauccugcugccucaguu

SEQ ID NO: 1315029 - RNA, 19 nt, Homo sapiens
caaugggaaaugucacaaa

SEQ ID NO: 1315030 - RNA, 19 nt, Homo sapiens
gagcucagaaggucagaca

SEQ ID NO: 1315031 - RNA, 19 nt, Homo sapiens
gaacuccugagcucaagca

SEQ ID NO: 1315032 - RNA, 19 nt, Homo sapiens
ucagaaggucagacacaaa

SEQ ID NO: 1315033 - RNA, 19 nt, Homo sapiens
agaggugccugguguuugg

SEQ ID NO: 1315034 - RNA, 19 nt, Homo sapiens
ugccucaguucuccgagua

SEQ ID NO: 1315035 - RNA, 19 nt, Homo sapiens
caucgagucucuggucucu

SEQ ID NO: 1315036 - RNA, 19 nt, Homo sapiens
cgauugugcauaucacuug

SEQ ID NO: 1315037 - RNA, 19 nt, Homo sapiens
uagagaagagcaagagcaa

SEQ ID NO: 1315038 - RNA, 19 nt, Homo sapiens
gugcaguggugcgaucaug

SEQ ID NO: 1315039 - RNA, 19 nt, Homo sapiens
cagaaggucagacacaaag

SEQ ID NO: 1315040 - RNA, 19 nt, Homo sapiens
acaaaacgcuucugcaaac

SEQ ID NO: 1315041 - RNA, 19 nt, Homo sapiens
aggaaugcuuuacagaugu

SEQ ID NO: 1315042 - RNA, 19 nt, Homo sapiens
gcaauccugcugccucagu

SEQ ID NO: 1315043 - RNA, 19 nt, Homo sapiens
acacuacuuucugcuacaa

SEQ ID NO: 1315044 - RNA, 19 nt, Homo sapiens
guuaaaugcucuggguuuu

SEQ ID NO: 1315045 - RNA, 19 nt, Homo sapiens
gcucccugcuccuccugaa

SEQ ID NO: 1315046 - RNA, 19 nt, Homo sapiens
ccagaaaguggccgguguu

SEQ ID NO: 1315047 - RNA, 19 nt, Homo sapiens
gaagagcaagagcaacaac

SEQ ID NO: 1315048 - RNA, 19 nt, Homo sapiens
gguuuucucugauaauaga

SEQ ID NO: 1315049 - RNA, 19 nt, Homo sapiens
ggaccacauguguaaguca

SEQ ID NO: 1315050 - RNA, 19 nt, Homo sapiens
uccuugacccuauuuauug

SEQ ID NO: 1315051 - RNA, 19 nt, Homo sapiens
gaaggagcaagaagcaacu

SEQ ID NO: 1315052 - RNA, 19 nt, Homo sapiens
cuuggagagucccagguaa

SEQ ID NO: 1315053 - RNA, 19 nt, Homo sapiens
cccaugcauugcucuaaau

SEQ ID NO: 1315054 - RNA, 19 nt, Homo sapiens
uagcugggaccacaugugu

SEQ ID NO: 1315055 - RNA, 19 nt, Homo sapiens
ggucagacacaaagucacu

SEQ ID NO: 1315056 - RNA, 19 nt, Homo sapiens
gcaacugggauggcucaga

SEQ ID NO: 1315057 - RNA, 19 nt, Homo sapiens
aaacaaaacgcuucugcaa

SEQ ID NO: 1315058 - RNA, 19 nt, Homo sapiens
caacaacaggcacggaacu

SEQ ID NO: 1315059 - RNA, 19 nt, Homo sapiens
cagaaaguggccgguguuu

SEQ ID NO: 1315060 - RNA, 19 nt, Homo sapiens
cguguacaaugggaaaugu

SEQ ID NO: 1315061 - RNA, 19 nt, Homo sapiens
gcuccgauugugcauauca

SEQ ID NO: 1315062 - RNA, 19 nt, Homo sapiens
cuccuugacccuauuuauu

SEQ ID NO: 1315063 - RNA, 19 nt, Homo sapiens
agacacaaagucacuccuu

SEQ ID NO: 1315064 - RNA, 19 nt, Homo sapiens
acagaggugccugguguuu

SEQ ID NO: 1315065 - RNA, 19 nt, Homo sapiens
acaauuagcuguccuuuaa

SEQ ID NO: 1315066 - RNA, 19 nt, Homo sapiens
gguaggagcugcaguugga

SEQ ID NO: 1315067 - RNA, 19 nt, Homo sapiens
cuacacagcuagaauagau

SEQ ID NO: 1315068 - RNA, 19 nt, Homo sapiens
ggacggcaguggugaugaa

SEQ ID NO: 1315069 - RNA, 19 nt, Homo sapiens
guacauauacggcuauuuc

SEQ ID NO: 1315070 - RNA, 19 nt, Homo sapiens
agacaaagcccacaauuag

SEQ ID NO: 1315071 - RNA, 19 nt, Homo sapiens
ccacaggccucaugaagca

SEQ ID NO: 1315072 - RNA, 19 nt, Homo sapiens
gaugcuggcuucagguuga

SEQ ID NO: 1315073 - RNA, 19 nt, Homo sapiens
auacggcuauuuccuauuu

SEQ ID NO: 1315074 - RNA, 19 nt, Homo sapiens
ccacugugcuccuaacugu

SEQ ID NO: 1315075 - RNA, 19 nt, Homo sapiens
cgcaagcacuuuagcagua

SEQ ID NO: 1315076 - RNA, 19 nt, Homo sapiens
gcaaggaucaagccgacua

SEQ ID NO: 1315077 - RNA, 19 nt, Homo sapiens
gcaagcacuuuagcaguau

SEQ ID NO: 1315078 - RNA, 19 nt, Homo sapiens
gagcugaggccaguccaua

SEQ ID NO: 1315079 - RNA, 19 nt, Homo sapiens
gagccuggccucuugauau

SEQ ID NO: 1315080 - RNA, 19 nt, Homo sapiens
aagacaaagcccacaauua

SEQ ID NO: 1315081 - RNA, 19 nt, Homo sapiens
cauauacggcuauuuccua

SEQ ID NO: 1315082 - RNA, 19 nt, Homo sapiens
gugcuacacagcuagaaua

SEQ ID NO: 1315083 - RNA, 19 nt, Homo sapiens
uaagacaaagcccacaauu

SEQ ID NO: 1315084 - RNA, 19 nt, Homo sapiens
agccuggccucuugauaua

SEQ ID NO: 1315085 - RNA, 19 nt, Homo sapiens
agcaguaucuguuuacaug

SEQ ID NO: 1315086 - RNA, 19 nt, Homo sapiens
uaaacacacacauuaagga

SEQ ID NO: 1315087 - RNA, 19 nt, Homo sapiens
ugcaucaccuucagaauca

SEQ ID NO: 1315088 - RNA, 19 nt, Homo sapiens
gcugaggccaguccauauu

SEQ ID NO: 1315089 - RNA, 19 nt, Homo sapiens
cacaauuagcuguccuuua

SEQ ID NO: 1315090 - RNA, 19 nt, Homo sapiens
gcucaggagugcuggaaaa

SEQ ID NO: 1315091 - RNA, 19 nt, Homo sapiens
uccaguuccucacggguua

SEQ ID NO: 1315092 - RNA, 19 nt, Homo sapiens
cccaaagucuucccuggau

SEQ ID NO: 1315093 - RNA, 19 nt, Homo sapiens
cuuuagcaguaucuguuua

SEQ ID NO: 1315094 - RNA, 19 nt, Homo sapiens
gguaggggcuccugcauca

SEQ ID NO: 1315095 - RNA, 19 nt, Homo sapiens
ggagccuggccucuugaua

SEQ ID NO: 1315096 - RNA, 19 nt, Homo sapiens
acacauuaaggagagauua

SEQ ID NO: 1315097 - RNA, 19 nt, Homo sapiens
aauuagcuguccuuuaaca

SEQ ID NO: 1315098 - RNA, 19 nt, Homo sapiens
gacagcagucuccgagcua

SEQ ID NO: 1315099 - RNA, 19 nt, Homo sapiens
gcacuuuagcaguaucugu

SEQ ID NO: 1315100 - RNA, 19 nt, Homo sapiens
ucuaggcgcaagcacuuua

SEQ ID NO: 1315101 - RNA, 19 nt, Homo sapiens
cugaggccaguccauauua

SEQ ID NO: 1315102 - RNA, 19 nt, Homo sapiens
auauacggcuauuuccuau

SEQ ID NO: 1315103 - RNA, 19 nt, Homo sapiens
gcaccacaggccucaugaa

SEQ ID NO: 1315104 - RNA, 19 nt, Homo sapiens
ccacucuccuuaggcuuug

SEQ ID NO: 1315105 - RNA, 19 nt, Homo sapiens
aggcugcccuuguccaugu

SEQ ID NO: 1315106 - RNA, 19 nt, Homo sapiens
acacagcuagaauagauau

SEQ ID NO: 1315107 - RNA, 19 nt, Homo sapiens
cuucagauuuaguacuugu

SEQ ID NO: 1315108 - RNA, 19 nt, Homo sapiens
gccuccaccucccuucuga

SEQ ID NO: 1315109 - RNA, 19 nt, Homo sapiens
ccaccucccuucugaugcu

SEQ ID NO: 1315110 - RNA, 19 nt, Homo sapiens
guuccucacggguuaggua

SEQ ID NO: 1315111 - RNA, 19 nt, Homo sapiens
gcaguuggaggccguucug

SEQ ID NO: 1315112 - RNA, 19 nt, Homo sapiens
gaugcuuccuggcuauggu

SEQ ID NO: 1315113 - RNA, 19 nt, Homo sapiens
augaagcaguucccacaug

SEQ ID NO: 1315114 - RNA, 19 nt, Homo sapiens
ccacaauuagcuguccuuu

SEQ ID NO: 1315115 - RNA, 19 nt, Homo sapiens
ugaggccaguccauauuac

SEQ ID NO: 1315116 - RNA, 19 nt, Homo sapiens
ugucacugguucccacugu

SEQ ID NO: 1315117 - RNA, 19 nt, Homo sapiens
cugcaucaccuucagaauc

SEQ ID NO: 1315118 - RNA, 19 nt, Homo sapiens
ggaaauagcccaggccaaa

SEQ ID NO: 1315119 - RNA, 19 nt, Homo sapiens
ccuaaagccugaagaagaa

SEQ ID NO: 1315120 - RNA, 19 nt, Homo sapiens
uaacgugccacccaaauaa

SEQ ID NO: 1315121 - RNA, 19 nt, Homo sapiens
gaaaugaugccagugaaug

SEQ ID NO: 1315122 - RNA, 19 nt, Homo sapiens
gugaggagguggugagaga

SEQ ID NO: 1315123 - RNA, 19 nt, Homo sapiens
gguggacgcugacaacugu

SEQ ID NO: 1315124 - RNA, 19 nt, Homo sapiens
gaaaccauccaauccaaga

SEQ ID NO: 1315125 - RNA, 19 nt, Homo sapiens
gaaaccauccaauccaaga

SEQ ID NO: 1315126 - RNA, 19 nt, Homo sapiens
gaagaaaccauccaaucca

SEQ ID NO: 1315127 - RNA, 19 nt, Homo sapiens
gaagaaaccauccaaucca

SEQ ID NO: 1315128 - RNA, 19 nt, Homo sapiens
guaacgugccacccaaaua

SEQ ID NO: 1315129 - RNA, 19 nt, Homo sapiens
ugaaagugauccugagcaa

SEQ ID NO: 1315130 - RNA, 19 nt, Homo sapiens
gcgaugaccuacccaaguc

SEQ ID NO: 1315131 - RNA, 19 nt, Homo sapiens
gaaaccauccagcccaaga

SEQ ID NO: 1315132 - RNA, 19 nt, Homo sapiens
ucucaaauaucacuguugu

SEQ ID NO: 1315133 - RNA, 19 nt, Homo sapiens
gaagccauccagccuaaga

SEQ ID NO: 1315134 - RNA, 19 nt, Homo sapiens
gcaggaccaucagaccauu

SEQ ID NO: 1315135 - RNA, 19 nt, Homo sapiens
gcaugaggaugugguguuc

SEQ ID NO: 1315136 - RNA, 19 nt, Homo sapiens
gggacaaggugaaagugau

SEQ ID NO: 1315137 - RNA, 19 nt, Homo sapiens
gcccuagaguucuuggaaa

SEQ ID NO: 1315138 - RNA, 19 nt, Homo sapiens
agcagucauugcagaauua

SEQ ID NO: 1315139 - RNA, 19 nt, Homo sapiens
gcugguggcuguggacuuc

SEQ ID NO: 1315140 - RNA, 19 nt, Homo sapiens
ggaaaugaugccagugaau

SEQ ID NO: 1315141 - RNA, 19 nt, Homo sapiens
gcucucaaauaucacuguu

SEQ ID NO: 1315142 - RNA, 19 nt, Homo sapiens
aagcagucauugcagaauu

SEQ ID NO: 1315143 - RNA, 19 nt, Homo sapiens
aagaaaccauccaauccaa

SEQ ID NO: 1315144 - RNA, 19 nt, Homo sapiens
cagaagaaaccauccaauc

SEQ ID NO: 1315145 - RNA, 19 nt, Homo sapiens
aagaaaccauccaauccaa

SEQ ID NO: 1315146 - RNA, 19 nt, Homo sapiens
cagaagaaaccauccaauc

SEQ ID NO: 1315147 - RNA, 19 nt, Homo sapiens
cuagaguucuuggaaauag

SEQ ID NO: 1315148 - RNA, 19 nt, Homo sapiens
aggaagccauccagccuaa

SEQ ID NO: 1315149 - RNA, 19 nt, Homo sapiens
gagagagugcgccaucaug

SEQ ID NO: 1315150 - RNA, 19 nt, Homo sapiens
ggaggacuuugaggcauca

SEQ ID NO: 1315151 - RNA, 19 nt, Homo sapiens
ccaaauaaagcucauuacu

SEQ ID NO: 1315152 - RNA, 19 nt, Homo sapiens
ggacaaggugaaagugauc

SEQ ID NO: 1315153 - RNA, 19 nt, Homo sapiens
ucagugguuuguuguguuc

SEQ ID NO: 1315154 - RNA, 19 nt, Homo sapiens
gaaauagcccaggccaaag

SEQ ID NO: 1315155 - RNA, 19 nt, Homo sapiens
caucagaccauucuuccau

SEQ ID NO: 1315156 - RNA, 19 nt, Homo sapiens
gcccaaggagggugacauu

SEQ ID NO: 1315157 - RNA, 19 nt, Homo sapiens
gcccaaggagggugacauu

SEQ ID NO: 1315158 - RNA, 19 nt, Homo sapiens
gcagucauugcagaauuaa

SEQ ID NO: 1315159 - RNA, 19 nt, Homo sapiens
uaggaaaugaugccaguga

SEQ ID NO: 1315160 - RNA, 19 nt, Homo sapiens
gaccaucagaccauucuuc

SEQ ID NO: 1315161 - RNA, 19 nt, Homo sapiens
gagggaaaaccaacuguaa

SEQ ID NO: 1315162 - RNA, 19 nt, Homo sapiens
gagcaaggaggacuuugag

SEQ ID NO: 1315163 - RNA, 19 nt, Homo sapiens
aagaagaaacaauggaguu

SEQ ID NO: 1315164 - RNA, 19 nt, Homo sapiens
aaauagcccaggccaaaga

SEQ ID NO: 1315165 - RNA, 19 nt, Homo sapiens
gcccaaagagggugacauc

SEQ ID NO: 1315166 - RNA, 19 nt, Homo sapiens
gaagcagucauugcagaau

SEQ ID NO: 1315167 - RNA, 19 nt, Homo sapiens
ugucccaaccuuucaguuu

SEQ ID NO: 1315168 - RNA, 19 nt, Homo sapiens
gagagugcgccaucaugug

SEQ ID NO: 1315169 - RNA, 19 nt, Homo sapiens
ugagcaaggaggacuuuga

SEQ ID NO: 1315170 - RNA, 19 nt, Homo sapiens
cauccuaaagccugaagaa

SEQ ID NO: 1315171 - RNA, 19 nt, Homo sapiens
guuguguucuaggaaauga

SEQ ID NO: 1315172 - RNA, 19 nt, Homo sapiens
cccaaguccucagaagaaa

SEQ ID NO: 1315173 - RNA, 19 nt, Homo sapiens
acccaaauaaagcucauua

SEQ ID NO: 1315174 - RNA, 19 nt, Homo sapiens
gguuuguuguguucuagga

SEQ ID NO: 1315175 - RNA, 19 nt, Homo sapiens
ggagguggacgcugacaac

SEQ ID NO: 1315176 - RNA, 19 nt, Homo sapiens
gugaauacagagagggaaa

SEQ ID NO: 1315177 - RNA, 19 nt, Homo sapiens
aggaaaugaugccagugaa

SEQ ID NO: 1315178 - RNA, 19 nt, Homo sapiens
gaagccauccagcccaaag

SEQ ID NO: 1315179 - RNA, 19 nt, Homo sapiens
cccuagaguucuuggaaau

SEQ ID NO: 1315180 - RNA, 19 nt, Homo sapiens
uccuaaagccugaagaaga

SEQ ID NO: 1315181 - RNA, 19 nt, Homo sapiens
gcccaaagagaguaacauc

SEQ ID NO: 1315182 - RNA, 19 nt, Homo sapiens
cuacccaaguccucagcaa

SEQ ID NO: 1315183 - RNA, 19 nt, Homo sapiens
auaaagcucauuacuaguc

SEQ ID NO: 1315184 - RNA, 19 nt, Homo sapiens
ccuagaguucuuggaaaua

SEQ ID NO: 1315185 - RNA, 19 nt, Homo sapiens
ugaagcagucauugcagaa

SEQ ID NO: 1315186 - RNA, 19 nt, Homo sapiens
ggaaaagguggaugaacuu

SEQ ID NO: 1315187 - RNA, 19 nt, Homo sapiens
ucaugugugucccaaccuu

SEQ ID NO: 1315188 - RNA, 19 nt, Homo sapiens
ggagggugacauccuaaag

SEQ ID NO: 1315189 - RNA, 19 nt, Homo sapiens
ccauccagcccaagaagga

SEQ ID NO: 1315190 - RNA, 19 nt, Homo sapiens
aaacuugaagcagucauug

SEQ ID NO: 1315191 - RNA, 19 nt, Homo sapiens
ggcccuagaguucuuggaa

SEQ ID NO: 1315192 - RNA, 19 nt, Homo sapiens
uccaugcccugucugugaa

SEQ ID NO: 1315193 - RNA, 19 nt, Homo sapiens
gagggugacauucccaagu

SEQ ID NO: 1315194 - RNA, 19 nt, Homo sapiens
gagggugacauucccaagu

SEQ ID NO: 1315195 - RNA, 19 nt, Homo sapiens
gagggugacaucuccaagu

SEQ ID NO: 1315196 - RNA, 19 nt, Homo sapiens
acaggagggcgaugaccua

SEQ ID NO: 1315197 - RNA, 19 nt, Homo sapiens
gucccaaccuuucaguuuu

SEQ ID NO: 1315198 - RNA, 19 nt, Homo sapiens
uuuguuguguucuaggaaa

SEQ ID NO: 1315199 - RNA, 19 nt, Homo sapiens
gugagagagugcgccauca

SEQ ID NO: 1315200 - RNA, 19 nt, Homo sapiens
ccaaggagggugacaucuc

SEQ ID NO: 1315201 - RNA, 19 nt, Homo sapiens
gaagcucucaaauaucacu

SEQ ID NO: 1315202 - RNA, 19 nt, Homo sapiens
ccagaagaaaccauccaau

SEQ ID NO: 1315203 - RNA, 19 nt, Homo sapiens
ccagaagaaaccauccaau

SEQ ID NO: 1315204 - RNA, 19 nt, Homo sapiens
agagugcgccaucaugugu

SEQ ID NO: 1315205 - RNA, 19 nt, Homo sapiens
ggacaaaguucuagcugau

SEQ ID NO: 1315206 - RNA, 19 nt, Homo sapiens
acaaaguucuagcugauua

SEQ ID NO: 1315207 - RNA, 19 nt, Homo sapiens
ggaaacugauccuucaugu

SEQ ID NO: 1315208 - RNA, 19 nt, Homo sapiens
gauccuucauguuucaaua

SEQ ID NO: 1315209 - RNA, 19 nt, Homo sapiens
ggaauuaugaagcuaagaa

SEQ ID NO: 1315210 - RNA, 19 nt, Homo sapiens
uucaauagcuguuguuguu

SEQ ID NO: 1315211 - RNA, 19 nt, Homo sapiens
ugaaugaagccaugacuug

SEQ ID NO: 1315212 - RNA, 19 nt, Homo sapiens
aggcguguguucccauuua

SEQ ID NO: 1315213 - RNA, 19 nt, Homo sapiens
gaaacugauccuucauguu

SEQ ID NO: 1315214 - RNA, 19 nt, Homo sapiens
ccugacagcuuccaaagag

SEQ ID NO: 1315215 - RNA, 19 nt, Homo sapiens
ccaaggggcugucaguuga

SEQ ID NO: 1315216 - RNA, 19 nt, Homo sapiens
ucccagagcuccgaggaaa

SEQ ID NO: 1315217 - RNA, 19 nt, Homo sapiens
caauagcuguuguuguuuu

SEQ ID NO: 1315218 - RNA, 19 nt, Homo sapiens
caaaguucuagcugauuaa

SEQ ID NO: 1315219 - RNA, 19 nt, Homo sapiens
ccggugaggugggaugauu

SEQ ID NO: 1315220 - RNA, 19 nt, Homo sapiens
ggauggcggcugugacuca

SEQ ID NO: 1315221 - RNA, 19 nt, Homo sapiens
gggagaacagaaaugcaaa

SEQ ID NO: 1315222 - RNA, 19 nt, Homo sapiens
gacaaaguucuagcugauu

SEQ ID NO: 1315223 - RNA, 19 nt, Homo sapiens
ugaggcguguguucccauu

SEQ ID NO: 1315224 - RNA, 19 nt, Homo sapiens
gcagggagaacagaaaugc

SEQ ID NO: 1315225 - RNA, 19 nt, Homo sapiens
augaagccaugacuuggaa

SEQ ID NO: 1315226 - RNA, 19 nt, Homo sapiens
ucuagcugauuaaauaugg

SEQ ID NO: 1315227 - RNA, 19 nt, Homo sapiens
gaagccaugacuuggaaag

SEQ ID NO: 1315228 - RNA, 19 nt, Homo sapiens
ggugaggugggaugauuuc

SEQ ID NO: 1315229 - RNA, 19 nt, Homo sapiens
ucaauagcuguuguuguuu

SEQ ID NO: 1315230 - RNA, 19 nt, Homo sapiens
guugguggacaaaguucua

SEQ ID NO: 1315231 - RNA, 19 nt, Homo sapiens
acugauccuucauguuuca

SEQ ID NO: 1315232 - RNA, 19 nt, Homo sapiens
uaacauaccugcugacuga

SEQ ID NO: 1315233 - RNA, 19 nt, Homo sapiens
ggaaagagguuuaauugau

SEQ ID NO: 1315234 - RNA, 19 nt, Homo sapiens
ggagugaucuuucaaccua

SEQ ID NO: 1315235 - RNA, 19 nt, Homo sapiens
caaaguggcuguaucaguu

SEQ ID NO: 1315236 - RNA, 19 nt, Homo sapiens
gaacauggaaggcacauuu

SEQ ID NO: 1315237 - RNA, 19 nt, Homo sapiens
gguaagagcuuuggaaauc

SEQ ID NO: 1315238 - RNA, 19 nt, Homo sapiens
gaucauugcugcauuuauc

SEQ ID NO: 1315239 - RNA, 19 nt, Homo sapiens
uuacugcccuucugaauuu

SEQ ID NO: 1315240 - RNA, 19 nt, Homo sapiens
ggaagcauguuaggucuuu

SEQ ID NO: 1315241 - RNA, 19 nt, Homo sapiens
aaagagacaugcuaacaga

SEQ ID NO: 1315242 - RNA, 19 nt, Homo sapiens
caaaccauaucaaaugcua

SEQ ID NO: 1315243 - RNA, 19 nt, Homo sapiens
ggacaaaguggcuguauca

SEQ ID NO: 1315244 - RNA, 19 nt, Homo sapiens
gagcuuugauggccauaaa

SEQ ID NO: 1315245 - RNA, 19 nt, Homo sapiens
gccauaaacugggauauug

SEQ ID NO: 1315246 - RNA, 19 nt, Homo sapiens
gaaauccguguguaacaua

SEQ ID NO: 1315247 - RNA, 19 nt, Homo sapiens
cagacuggguaauuuauaa

SEQ ID NO: 1315248 - RNA, 19 nt, Homo sapiens
ucagaucucguaacacuua

SEQ ID NO: 1315249 - RNA, 19 nt, Homo sapiens
ggagcaaaaucaugucuua

SEQ ID NO: 1315250 - RNA, 19 nt, Homo sapiens
gcacagagguagcccaaaa

SEQ ID NO: 1315251 - RNA, 19 nt, Homo sapiens
uaacagaaauuugcaagag

SEQ ID NO: 1315252 - RNA, 19 nt, Homo sapiens
caaaugcuauacugacuuc

SEQ ID NO: 1315253 - RNA, 19 nt, Homo sapiens
gcucugcuuuggaagauuu

SEQ ID NO: 1315254 - RNA, 19 nt, Homo sapiens
gguaucaucuauugacuuc

SEQ ID NO: 1315255 - RNA, 19 nt, Homo sapiens
gcaggaggaucacuugagu

SEQ ID NO: 1315256 - RNA, 19 nt, Homo sapiens
caucagaucucguaacacu

SEQ ID NO: 1315257 - RNA, 19 nt, Homo sapiens
ugagaucauugcugcauuu

SEQ ID NO: 1315258 - RNA, 19 nt, Homo sapiens
gguggaacccugucucuaa

SEQ ID NO: 1315259 - RNA, 19 nt, Homo sapiens
acacagagccaaaccauau

SEQ ID NO: 1315260 - RNA, 19 nt, Homo sapiens
uagcccagcugcuuggaua

SEQ ID NO: 1315261 - RNA, 19 nt, Homo sapiens
ucucuacguuucaacuuua

SEQ ID NO: 1315262 - RNA, 19 nt, Homo sapiens
ggaaauccguguguaacau

SEQ ID NO: 1315263 - RNA, 19 nt, Homo sapiens
ccucuguccuccuaauaua

SEQ ID NO: 1315264 - RNA, 19 nt, Homo sapiens
caugguggcucacacuuau

SEQ ID NO: 1315265 - RNA, 19 nt, Homo sapiens
ucucgaauuucucaacuuu

SEQ ID NO: 1315266 - RNA, 19 nt, Homo sapiens
ucagugaugugcuuugaug

SEQ ID NO: 1315267 - RNA, 19 nt, Homo sapiens
uacuguaucucaugucuuu

SEQ ID NO: 1315268 - RNA, 19 nt, Homo sapiens
gcauaauguucuucucuca

SEQ ID NO: 1315269 - RNA, 19 nt, Homo sapiens
ucuauugacuucucucuau

SEQ ID NO: 1315270 - RNA, 19 nt, Homo sapiens
gacaacugcuuccaucugu

SEQ ID NO: 1315271 - RNA, 19 nt, Homo sapiens
gaaaugcugagcuuugaug

SEQ ID NO: 1315272 - RNA, 19 nt, Homo sapiens
gugaaaugcugagcuuuga

SEQ ID NO: 1315273 - RNA, 19 nt, Homo sapiens
guggaacccugucucuaaa

SEQ ID NO: 1315274 - RNA, 19 nt, Homo sapiens
uugauuggcugacuagaaa

SEQ ID NO: 1315275 - RNA, 19 nt, Homo sapiens
gcaugguggcucacacuua

SEQ ID NO: 1315276 - RNA, 19 nt, Homo sapiens
gaacacagagccaaaccau

SEQ ID NO: 1315277 - RNA, 19 nt, Homo sapiens
ggaacucucucuuuucuug

SEQ ID NO: 1315278 - RNA, 19 nt, Homo sapiens
ggaauucauugcccuuucu

SEQ ID NO: 1315279 - RNA, 19 nt, Homo sapiens
acucaugccuguaauccua

SEQ ID NO: 1315280 - RNA, 19 nt, Homo sapiens
gagacaugcuaacagaaau

SEQ ID NO: 1315281 - RNA, 19 nt, Homo sapiens
gaaggugaaugaggagcaa

SEQ ID NO: 1315282 - RNA, 19 nt, Homo sapiens
uagauuuggugguuugauu

SEQ ID NO: 1315283 - RNA, 19 nt, Homo sapiens
gagauagauuuggugguuu

SEQ ID NO: 1315284 - RNA, 19 nt, Homo sapiens
ucacuugaguccuggaguu

SEQ ID NO: 1315285 - RNA, 19 nt, Homo sapiens
guucucaugcugcuaauaa

SEQ ID NO: 1315286 - RNA, 19 nt, Homo sapiens
cuagauuagucuuugguuu

SEQ ID NO: 1315287 - RNA, 19 nt, Homo sapiens
ugaauucucucagugaugu

SEQ ID NO: 1315288 - RNA, 19 nt, Homo sapiens
guguaaagcuuuguaucuu

SEQ ID NO: 1315289 - RNA, 19 nt, Homo sapiens
cauaucaaaugcuauacug

SEQ ID NO: 1315290 - RNA, 19 nt, Homo sapiens
ggaagauuuucucgaauuu

SEQ ID NO: 1315291 - RNA, 19 nt, Homo sapiens
gaagcauguuaggucuuua

SEQ ID NO: 1315292 - RNA, 19 nt, Homo sapiens
ugcaagagagggagaaaua

SEQ ID NO: 1315293 - RNA, 19 nt, Homo sapiens
aaggaaagagguuuaauug

SEQ ID NO: 1315294 - RNA, 19 nt, Homo sapiens
gugaugugcuuugauguga

SEQ ID NO: 1315295 - RNA, 19 nt, Homo sapiens
ccagugcucugaauucucu

SEQ ID NO: 1315296 - RNA, 19 nt, Homo sapiens
cacccauaguuaauacuua

SEQ ID NO: 1315297 - RNA, 19 nt, Homo sapiens
uuacugccauuucucuaaa

SEQ ID NO: 1315298 - RNA, 19 nt, Homo sapiens
gcaggagaauugcuugaac

SEQ ID NO: 1315299 - RNA, 19 nt, Homo sapiens
ucgcagggcuuucagcaau

SEQ ID NO: 1315300 - RNA, 19 nt, Homo sapiens
ccucagacuggguaauuua

SEQ ID NO: 1315301 - RNA, 19 nt, Homo sapiens
gcguuagucuguucucaug

SEQ ID NO: 1315302 - RNA, 19 nt, Homo sapiens
gcacccacccucaucaaau

SEQ ID NO: 1315303 - RNA, 19 nt, Homo sapiens
ccagaggcguauaauuuag

SEQ ID NO: 1315304 - RNA, 19 nt, Homo sapiens
gagccaaaccauaucaaau

SEQ ID NO: 1315305 - RNA, 19 nt, Homo sapiens
gaaaacagcacaggaaaga

SEQ ID NO: 1315306 - RNA, 19 nt, Homo sapiens
ucguaacacuuauucacua

SEQ ID NO: 1315307 - RNA, 19 nt, Homo sapiens
ccacguaugucugaaaguc

SEQ ID NO: 1315308 - RNA, 19 nt, Homo sapiens
ggagcucccuuuuauagaa

SEQ ID NO: 1315309 - RNA, 19 nt, Homo sapiens
uugggaaacucagaauaua

SEQ ID NO: 1315310 - RNA, 19 nt, Homo sapiens
ggauuguugucuaugucua

SEQ ID NO: 1315311 - RNA, 19 nt, Homo sapiens
gaaaccccgucucuacuaa

SEQ ID NO: 1315312 - RNA, 19 nt, Homo sapiens
uccagaggcguauaauuua

SEQ ID NO: 1315313 - RNA, 19 nt, Homo sapiens
uuccagaggcguauaauuu

SEQ ID NO: 1315314 - RNA, 19 nt, Homo sapiens
ucgaauuucucaacuuuag

SEQ ID NO: 1315315 - RNA, 19 nt, Homo sapiens
ccuauaaucccagcacuuu

SEQ ID NO: 1315316 - RNA, 19 nt, Homo sapiens
gagaaauagcacagaggua

SEQ ID NO: 1315317 - RNA, 19 nt, Homo sapiens
caagcagaguaggagaaua

SEQ ID NO: 1315318 - RNA, 19 nt, Homo sapiens
gggaauucauugcccuuuc

SEQ ID NO: 1315319 - RNA, 19 nt, Homo sapiens
gcauguuaggucuuuauuu

SEQ ID NO: 1315320 - RNA, 19 nt, Homo sapiens
ccaguaauuuccugagaag

SEQ ID NO: 1315321 - RNA, 19 nt, Homo sapiens
gaagcacauuuuccaguaa

SEQ ID NO: 1315322 - RNA, 19 nt, Homo sapiens
uaucucaugucuuucacuu

SEQ ID NO: 1315323 - RNA, 19 nt, Homo sapiens
uaucaaaguuacagaugca

SEQ ID NO: 1315324 - RNA, 19 nt, Homo sapiens
gcagugagccaagauugug

SEQ ID NO: 1315325 - RNA, 19 nt, Homo sapiens
caauucaggguaagauuug

SEQ ID NO: 1315326 - RNA, 19 nt, Homo sapiens
agauagauuuggugguuug

SEQ ID NO: 1315327 - RNA, 19 nt, Homo sapiens
guugggaaacucagaauau

SEQ ID NO: 1315328 - RNA, 19 nt, Homo sapiens
uuuaggugcuugugaaaug

SEQ ID NO: 1315329 - RNA, 19 nt, Homo sapiens
gagaucauugcugcauuua

SEQ ID NO: 1315330 - RNA, 19 nt, Homo sapiens
auaauguucuucucucaug

SEQ ID NO: 1315331 - RNA, 19 nt, Homo sapiens
cacccacccucaucaaaug

SEQ ID NO: 1315332 - RNA, 19 nt, Homo sapiens
gaaagaaaccaaacaagga

SEQ ID NO: 1315333 - RNA, 19 nt, Homo sapiens
ccuagaagcuuuaauugaa

SEQ ID NO: 1315334 - RNA, 19 nt, Homo sapiens
gauauuagcaggcuucaaa

SEQ ID NO: 1315335 - RNA, 19 nt, Homo sapiens
gaaugaaaguuccuaguag

SEQ ID NO: 1315336 - RNA, 19 nt, Homo sapiens
ggacacucauucagucuuu

SEQ ID NO: 1315337 - RNA, 19 nt, Homo sapiens
gaaaggaggauguuaaagu

SEQ ID NO: 1315338 - RNA, 19 nt, Homo sapiens
cagcuagucugccauguaa

SEQ ID NO: 1315339 - RNA, 19 nt, Homo sapiens
gcagugagccuuuguuugu

SEQ ID NO: 1315340 - RNA, 19 nt, Homo sapiens
agagacaacuuucuuauca

SEQ ID NO: 1315341 - RNA, 19 nt, Homo sapiens
cuaaguagcugacauaaaa

SEQ ID NO: 1315342 - RNA, 19 nt, Homo sapiens
aaaggaggauguuaaaguu

SEQ ID NO: 1315343 - RNA, 19 nt, Homo sapiens
cagauggccuuggaaauaa

SEQ ID NO: 1315344 - RNA, 19 nt, Homo sapiens
gaucuuaauucaggaggua

SEQ ID NO: 1315345 - RNA, 19 nt, Homo sapiens
gaaaguuccuaguagaucu

SEQ ID NO: 1315346 - RNA, 19 nt, Homo sapiens
gaaugccagugaacuuauu

SEQ ID NO: 1315347 - RNA, 19 nt, Homo sapiens
gaucaagccucaguguaug

SEQ ID NO: 1315348 - RNA, 19 nt, Homo sapiens
ucaguacccucauagugua

SEQ ID NO: 1315349 - RNA, 19 nt, Homo sapiens
gcacagaugguaauguaga

SEQ ID NO: 1315350 - RNA, 19 nt, Homo sapiens
caaaccagaauaugaguaa

SEQ ID NO: 1315351 - RNA, 19 nt, Homo sapiens
ugaaugaaaguuccuagua

SEQ ID NO: 1315352 - RNA, 19 nt, Homo sapiens
ggagcucaguacccucaua

SEQ ID NO: 1315353 - RNA, 19 nt, Homo sapiens
acagauggccuuggaaaua

SEQ ID NO: 1315354 - RNA, 19 nt, Homo sapiens
aggcacagaugguaaugua

SEQ ID NO: 1315355 - RNA, 19 nt, Homo sapiens
gagguagaauggagcuuga

SEQ ID NO: 1315356 - RNA, 19 nt, Homo sapiens
gcugggacuuccuguacua

SEQ ID NO: 1315357 - RNA, 19 nt, Homo sapiens
gauguuaaaguuccuagaa

SEQ ID NO: 1315358 - RNA, 19 nt, Homo sapiens
caucuaaguagcugacaua

SEQ ID NO: 1315359 - RNA, 19 nt, Homo sapiens
gagauugagucuugcucuu

SEQ ID NO: 1315360 - RNA, 19 nt, Homo sapiens
ccuaguagaucuguaccua

SEQ ID NO: 1315361 - RNA, 19 nt, Homo sapiens
gaaugaaaggaggauguua

SEQ ID NO: 1315362 - RNA, 19 nt, Homo sapiens
gcugaacagugguggaguu

SEQ ID NO: 1315363 - RNA, 19 nt, Homo sapiens
caagaguccuaauccugaa

SEQ ID NO: 1315364 - RNA, 19 nt, Homo sapiens
aagugugccuggcuaauuu

SEQ ID NO: 1315365 - RNA, 19 nt, Homo sapiens
ugucugggcugcuguacaa

SEQ ID NO: 1315366 - RNA, 19 nt, Homo sapiens
gauugagucuugcucuugu

SEQ ID NO: 1315367 - RNA, 19 nt, Homo sapiens
uggcacagcuucaaaauga

SEQ ID NO: 1315368 - RNA, 19 nt, Homo sapiens
gaccuuggccaaaguguug

SEQ ID NO: 1315369 - RNA, 19 nt, Homo sapiens
aaugaaaguuccuaguaga

SEQ ID NO: 1315370 - RNA, 19 nt, Homo sapiens
uguuugagauugagucuug

SEQ ID NO: 1315371 - RNA, 19 nt, Homo sapiens
ccacagauggccuuggaaa

SEQ ID NO: 1315372 - RNA, 19 nt, Homo sapiens
gggcugguuucuccucuug

SEQ ID NO: 1315373 - RNA, 19 nt, Homo sapiens
ucacauugcuggaggaaaa

SEQ ID NO: 1315374 - RNA, 19 nt, Homo sapiens
uagcaggcuucaaauacaa

SEQ ID NO: 1315375 - RNA, 19 nt, Homo sapiens
guuccuagaagcuuuaauu

SEQ ID NO: 1315376 - RNA, 19 nt, Homo sapiens
caagugugccuggcuaauu

SEQ ID NO: 1315377 - RNA, 19 nt, Homo sapiens
ggaaugccagugaacuuau

SEQ ID NO: 1315378 - RNA, 19 nt, Homo sapiens
gguguaugcuugcuucucu

SEQ ID NO: 1315379 - RNA, 19 nt, Homo sapiens
ggucacuccugcuggaugu

SEQ ID NO: 1315380 - RNA, 19 nt, Homo sapiens
aaagcugacucuagcacuu

SEQ ID NO: 1315381 - RNA, 19 nt, Homo sapiens
aaugaaaggaggauguuaa

SEQ ID NO: 1315382 - RNA, 19 nt, Homo sapiens
ucagaaagaaaccaaacaa

SEQ ID NO: 1315383 - RNA, 19 nt, Homo sapiens
ugaucaagccucaguguau

SEQ ID NO: 1315384 - RNA, 19 nt, Homo sapiens
gcucaguacccucauagug

SEQ ID NO: 1315385 - RNA, 19 nt, Homo sapiens
ggagcuuugugcggaauga

SEQ ID NO: 1315386 - RNA, 19 nt, Homo sapiens
uuagcaggcuucaaauaca

SEQ ID NO: 1315387 - RNA, 19 nt, Homo sapiens
gcuucggacuucauugaug

SEQ ID NO: 1315388 - RNA, 19 nt, Homo sapiens
acuuauugcugacaucuug

SEQ ID NO: 1315389 - RNA, 19 nt, Homo sapiens
gagccuuuguuuguucuga

SEQ ID NO: 1315390 - RNA, 19 nt, Homo sapiens
uuaucaggcucaaaugaau

SEQ ID NO: 1315391 - RNA, 19 nt, Homo sapiens
uccaggagauaucaaagga

SEQ ID NO: 1315392 - RNA, 19 nt, Homo sapiens
gagacaacuuucuuaucag

SEQ ID NO: 1315393 - RNA, 19 nt, Homo sapiens
ucuccaggaucuuaauuca

SEQ ID NO: 1315394 - RNA, 19 nt, Homo sapiens
gaucagagaggaaaaguca

SEQ ID NO: 1315395 - RNA, 19 nt, Homo sapiens
uugaauggaucaugaggau

SEQ ID NO: 1315396 - RNA, 19 nt, Homo sapiens
ccaggguguugaugacuuc

SEQ ID NO: 1315397 - RNA, 19 nt, Homo sapiens
gccaggguguugaugacuu

SEQ ID NO: 1315398 - RNA, 19 nt, Homo sapiens
gaacuuauugcugacaucu

SEQ ID NO: 1315399 - RNA, 19 nt, Homo sapiens
uuacaggcauaagccauug

SEQ ID NO: 1315400 - RNA, 19 nt, Homo sapiens
acacauuguuaacacugaa

SEQ ID NO: 1315401 - RNA, 19 nt, Homo sapiens
guagaccuaaccucuuuga

SEQ ID NO: 1315402 - RNA, 19 nt, Homo sapiens
caaaaugacaucuaaguag

SEQ ID NO: 1315403 - RNA, 19 nt, Homo sapiens
cuacguggccaccagaaga

SEQ ID NO: 1315404 - RNA, 19 nt, Homo sapiens
ggaggccugguacuaggua

SEQ ID NO: 1315405 - RNA, 19 nt, Homo sapiens
cagcaccgcacccucacua

SEQ ID NO: 1315406 - RNA, 19 nt, Homo sapiens
cccuacagaucauaaagga

SEQ ID NO: 1315407 - RNA, 19 nt, Homo sapiens
ucauaaaggagaagagcaa

SEQ ID NO: 1315408 - RNA, 19 nt, Homo sapiens
aggaaugccagugaacuua

SEQ ID NO: 1315409 - RNA, 19 nt, Homo sapiens
gcacauccuaggcacagau

SEQ ID NO: 1315410 - RNA, 19 nt, Homo sapiens
gcuucaaaaugacaucuaa

SEQ ID NO: 1315411 - RNA, 19 nt, Homo sapiens
gucuugacuuccugcuaua

SEQ ID NO: 1315412 - RNA, 19 nt, Homo sapiens
gccagccugugaugcaaga

SEQ ID NO: 1315413 - RNA, 19 nt, Homo sapiens
cuggcugccucuuaggaua

SEQ ID NO: 1315414 - RNA, 19 nt, Homo sapiens
auucaaggcuucggacuuc

SEQ ID NO: 1315415 - RNA, 19 nt, Homo sapiens
gugacuuggugcacaacuu

SEQ ID NO: 1315416 - RNA, 19 nt, Homo sapiens
gacucuagcacuuguacuu

SEQ ID NO: 1315417 - RNA, 19 nt, Homo sapiens
gguagaauggagcuugaga

SEQ ID NO: 1315418 - RNA, 19 nt, Homo sapiens
gagcucaguacccucauag

SEQ ID NO: 1315419 - RNA, 19 nt, Homo sapiens
uaaaggagaagagcaagag

SEQ ID NO: 1315420 - RNA, 19 nt, Homo sapiens
cagugagccuuuguuuguu

SEQ ID NO: 1315421 - RNA, 19 nt, Homo sapiens
guuuggugguugccauuug

SEQ ID NO: 1315422 - RNA, 19 nt, Homo sapiens
cuucaaauacaaaccagaa

SEQ ID NO: 1315423 - RNA, 19 nt, Homo sapiens
ccgaguagcugggauucca

SEQ ID NO: 1315424 - RNA, 19 nt, Homo sapiens
acagcuagucugccaugua

SEQ ID NO: 1315425 - RNA, 19 nt, Homo sapiens
gcucaaaugaaugaaagga

SEQ ID NO: 1315426 - RNA, 19 nt, Homo sapiens
cugcaggaaugccagugaa

SEQ ID NO: 1315427 - RNA, 19 nt, Homo sapiens
auacaaaccagaauaugag

SEQ ID NO: 1315428 - RNA, 19 nt, Homo sapiens
gguacagccuuuccaugcu

SEQ ID NO: 1315429 - RNA, 19 nt, Homo sapiens
uagaauggagcuugagauc

SEQ ID NO: 1315430 - RNA, 19 nt, Homo sapiens
gcaagugugccuggcuaau

SEQ ID NO: 1315431 - RNA, 19 nt, Homo sapiens
ugccucagccucccgagua

SEQ ID NO: 1315432 - RNA, 19 nt, Homo sapiens
gaccaaaugugcuccuuua

SEQ ID NO: 1315433 - RNA, 19 nt, Homo sapiens
gaaagccucucaaagaaau

SEQ ID NO: 1315434 - RNA, 19 nt, Homo sapiens
cuagaaaggugauaagaug

SEQ ID NO: 1315435 - RNA, 19 nt, Homo sapiens
ccaggaauguuaaacuauu

SEQ ID NO: 1315436 - RNA, 19 nt, Homo sapiens
gugauaagaugaagcacaa

SEQ ID NO: 1315437 - RNA, 19 nt, Homo sapiens
caaaugugcuccuuuacca

SEQ ID NO: 1315438 - RNA, 19 nt, Homo sapiens
ggaaaccaccagaagcuaa

SEQ ID NO: 1315439 - RNA, 19 nt, Homo sapiens
ggaaggucgugggaacaua

SEQ ID NO: 1315440 - RNA, 19 nt, Homo sapiens
gcauuagggugggcuguaa

SEQ ID NO: 1315441 - RNA, 19 nt, Homo sapiens
aggcagaacucauuauguu

SEQ ID NO: 1315442 - RNA, 19 nt, Homo sapiens
cugaaagccucucaaagaa

SEQ ID NO: 1315443 - RNA, 19 nt, Homo sapiens
ccugaaagccucucaaaga

SEQ ID NO: 1315444 - RNA, 19 nt, Homo sapiens
ugauacacaugaagccaua

SEQ ID NO: 1315445 - RNA, 19 nt, Homo sapiens
uuacaggcaugaccaaaug

SEQ ID NO: 1315446 - RNA, 19 nt, Homo sapiens
gcccugaacuauuuaucaa

SEQ ID NO: 1315447 - RNA, 19 nt, Homo sapiens
gaguuacgcugccuacagu

SEQ ID NO: 1315448 - RNA, 19 nt, Homo sapiens
ugaauagugucccgcagaa

SEQ ID NO: 1315449 - RNA, 19 nt, Homo sapiens
ugucaacucuccaugcuau

SEQ ID NO: 1315450 - RNA, 19 nt, Homo sapiens
ucaacuggcucacauuucu

SEQ ID NO: 1315451 - RNA, 19 nt, Homo sapiens
gaacauacagagaccuaca

SEQ ID NO: 1315452 - RNA, 19 nt, Homo sapiens
gaaaggugauaagaugaag

SEQ ID NO: 1315453 - RNA, 19 nt, Homo sapiens
ugauguacaugcccuucua

SEQ ID NO: 1315454 - RNA, 19 nt, Homo sapiens
gacaaggucacaaugcauu

SEQ ID NO: 1315455 - RNA, 19 nt, Homo sapiens
guacaugcccuucuaucau

SEQ ID NO: 1315456 - RNA, 19 nt, Homo sapiens
caauggcuguguccuuuca

SEQ ID NO: 1315457 - RNA, 19 nt, Homo sapiens
gaauugguuucuuguugca

SEQ ID NO: 1315458 - RNA, 19 nt, Homo sapiens
aggaauugguuucuuguug

SEQ ID NO: 1315459 - RNA, 19 nt, Homo sapiens
gaaaucaaucauacucaca

SEQ ID NO: 1315460 - RNA, 19 nt, Homo sapiens
ugaaagccucucaaagaaa

SEQ ID NO: 1315461 - RNA, 19 nt, Homo sapiens
caugaagccauauaccuuu

SEQ ID NO: 1315462 - RNA, 19 nt, Homo sapiens
acccaggaauguuaaacua

SEQ ID NO: 1315463 - RNA, 19 nt, Homo sapiens
acaaagugcugggauuaca

SEQ ID NO: 1315464 - RNA, 19 nt, Homo sapiens
gaagcuaagaaggagauuu

SEQ ID NO: 1315465 - RNA, 19 nt, Homo sapiens
aacagggucucugcagaua

SEQ ID NO: 1315466 - RNA, 19 nt, Homo sapiens
gauaagaugaagcacaaag

SEQ ID NO: 1315467 - RNA, 19 nt, Homo sapiens
caccagaagcuaagaagga

SEQ ID NO: 1315468 - RNA, 19 nt, Homo sapiens
gggaacauacagagaccua

SEQ ID NO: 1315469 - RNA, 19 nt, Homo sapiens
uaagaugaagcacaaagug

SEQ ID NO: 1315470 - RNA, 19 nt, Homo sapiens
gaaaccaccagaagcuaag

SEQ ID NO: 1315471 - RNA, 19 nt, Homo sapiens
gaagacggccaugggacaa

SEQ ID NO: 1315472 - RNA, 19 nt, Homo sapiens
guuaagacaaggucacaau

SEQ ID NO: 1315473 - RNA, 19 nt, Homo sapiens
uaacagaggcagaacucau

SEQ ID NO: 1315474 - RNA, 19 nt, Homo sapiens
ucucugcagauaacacuua

SEQ ID NO: 1315475 - RNA, 19 nt, Homo sapiens
acagaggcagaacucauua

SEQ ID NO: 1315476 - RNA, 19 nt, Homo sapiens
gaaggagauuuuaccugaa

SEQ ID NO: 1315477 - RNA, 19 nt, Homo sapiens
caacuggcucacauuucua

SEQ ID NO: 1315478 - RNA, 19 nt, Homo sapiens
acaaggucacaaugcauua

SEQ ID NO: 1315479 - RNA, 19 nt, Homo sapiens
ccucaacuggcucacauuu

SEQ ID NO: 1315480 - RNA, 19 nt, Homo sapiens
agaaaggugauaagaugaa

SEQ ID NO: 1315481 - RNA, 19 nt, Homo sapiens
ucaacucuccaugcuauuu

SEQ ID NO: 1315482 - RNA, 19 nt, Homo sapiens
aaauuucugucgucuuaag

SEQ ID NO: 1315483 - RNA, 19 nt, Homo sapiens
ggaguuacgcugccuacag

SEQ ID NO: 1315484 - RNA, 19 nt, Homo sapiens
gaaggucgugggaacauac

SEQ ID NO: 1315485 - RNA, 19 nt, Homo sapiens
gcuccuuuaccaauuguuu

SEQ ID NO: 1315486 - RNA, 19 nt, Homo sapiens
gaauagugucccgcagaaa

SEQ ID NO: 1315487 - RNA, 19 nt, Homo sapiens
aagacaaggucacaaugca

SEQ ID NO: 1315488 - RNA, 19 nt, Homo sapiens
aaacagggucucugcagau

SEQ ID NO: 1315489 - RNA, 19 nt, Homo sapiens
gaggcagaacucauuaugu

SEQ ID NO: 1315490 - RNA, 19 nt, Homo sapiens
cugcagauaacacuuaguu

SEQ ID NO: 1315491 - RNA, 19 nt, Homo sapiens
gaauuucuggccucgugaa

SEQ ID NO: 1315492 - RNA, 19 nt, Homo sapiens
cagggucucugcagauaac

SEQ ID NO: 1315493 - RNA, 19 nt, Homo sapiens
cucaggaauugguuucuug

SEQ ID NO: 1315494 - RNA, 19 nt, Homo sapiens
uagaaaggugauaagauga

SEQ ID NO: 1315495 - RNA, 19 nt, Homo sapiens
guuucugucucaggaauug

SEQ ID NO: 1315496 - RNA, 19 nt, Homo sapiens
cuacuuagagcucugucaa

SEQ ID NO: 1315497 - RNA, 19 nt, Homo sapiens
auacacaugaagccauaua

SEQ ID NO: 1315498 - RNA, 19 nt, Homo sapiens
uuucuggccucgugaaugg

SEQ ID NO: 1315499 - RNA, 19 nt, Homo sapiens
acaugaagccauauaccuu

SEQ ID NO: 1315500 - RNA, 19 nt, Homo sapiens
aacagaggcagaacucauu

SEQ ID NO: 1315501 - RNA, 19 nt, Homo sapiens
gacaagggaggcagagucu

SEQ ID NO: 1315502 - RNA, 19 nt, Homo sapiens
ugaccaaaugugcuccuuu

SEQ ID NO: 1315503 - RNA, 19 nt, Homo sapiens
uaagacaaggucacaaugc

SEQ ID NO: 1315504 - RNA, 19 nt, Homo sapiens
ggaacccaggaauguuaaa

SEQ ID NO: 1315505 - RNA, 19 nt, Homo sapiens
ucucaggaauugguuucuu

SEQ ID NO: 1315506 - RNA, 19 nt, Homo sapiens
gauguacaugcccuucuau

SEQ ID NO: 1315507 - RNA, 19 nt, Homo sapiens
uaccugaaagccucucaaa

SEQ ID NO: 1315508 - RNA, 19 nt, Homo sapiens
ggucgugggaacauacaga

SEQ ID NO: 1315509 - RNA, 19 nt, Homo sapiens
gauuacaggcaugaccaaa

SEQ ID NO: 1315510 - RNA, 19 nt, Homo sapiens
aaggagauuuuaccugaaa

SEQ ID NO: 1315511 - RNA, 19 nt, Homo sapiens
ugugcuccuuuaccaauug

SEQ ID NO: 1315512 - RNA, 19 nt, Homo sapiens
ggaauguuaaacuauuugg

SEQ ID NO: 1315513 - RNA, 19 nt, Homo sapiens
ggauuacaggcaugaccaa

SEQ ID NO: 1315514 - RNA, 19 nt, Homo sapiens
guaagaagcuaaugaauga

SEQ ID NO: 1315515 - RNA, 19 nt, Homo sapiens
gagaagaagucaccaauau

SEQ ID NO: 1315516 - RNA, 19 nt, Homo sapiens
gaaaggagcaguacaaaga

SEQ ID NO: 1315517 - RNA, 19 nt, Homo sapiens
gaaggcagauauugcuaua

SEQ ID NO: 1315518 - RNA, 19 nt, Homo sapiens
gaaagaggaucauaaagag

SEQ ID NO: 1315519 - RNA, 19 nt, Homo sapiens
gaaaucagauguuggaagu

SEQ ID NO: 1315520 - RNA, 19 nt, Homo sapiens
gacaaagacuugaauguug

SEQ ID NO: 1315521 - RNA, 19 nt, Homo sapiens
gaagaagucaccaauauga

SEQ ID NO: 1315522 - RNA, 19 nt, Homo sapiens
uaaaggcaccuacuuguua

SEQ ID NO: 1315523 - RNA, 19 nt, Homo sapiens
caggaaauauguacaauga

SEQ ID NO: 1315524 - RNA, 19 nt, Homo sapiens
ugaaaggucugauggauga

SEQ ID NO: 1315525 - RNA, 19 nt, Homo sapiens
gcacaacucaguaaaugua

SEQ ID NO: 1315526 - RNA, 19 nt, Homo sapiens
ggugagagaugauuuacuu

SEQ ID NO: 1315527 - RNA, 19 nt, Homo sapiens
ggaagauccugcugugaaa

SEQ ID NO: 1315528 - RNA, 19 nt, Homo sapiens
aagcugacauugaaucuua

SEQ ID NO: 1315529 - RNA, 19 nt, Homo sapiens
aaacagaacgccuuugaua

SEQ ID NO: 1315530 - RNA, 19 nt, Homo sapiens
gaaagaaguugaagcaaaa

SEQ ID NO: 1315531 - RNA, 19 nt, Homo sapiens
caacacugcucuccauuau

SEQ ID NO: 1315532 - RNA, 19 nt, Homo sapiens
gagagaugauuuacuuuga

SEQ ID NO: 1315533 - RNA, 19 nt, Homo sapiens
aaacaugccucauuucuag

SEQ ID NO: 1315534 - RNA, 19 nt, Homo sapiens
gcacagaacugcucuacac

SEQ ID NO: 1315535 - RNA, 19 nt, Homo sapiens
uaagguagauaguucugua

SEQ ID NO: 1315536 - RNA, 19 nt, Homo sapiens
gauaaguucuguaagacaa

SEQ ID NO: 1315537 - RNA, 19 nt, Homo sapiens
agaaagaaguugaagcaaa

SEQ ID NO: 1315538 - RNA, 19 nt, Homo sapiens
gaacauggcgccaauccaa

SEQ ID NO: 1315539 - RNA, 19 nt, Homo sapiens
gaagaggcuugugccguua

SEQ ID NO: 1315540 - RNA, 19 nt, Homo sapiens
uuagaaacaugccucauuu

SEQ ID NO: 1315541 - RNA, 19 nt, Homo sapiens
gagaagaauuagaaaggaa

SEQ ID NO: 1315542 - RNA, 19 nt, Homo sapiens
ccagaugaauugaagugua

SEQ ID NO: 1315543 - RNA, 19 nt, Homo sapiens
agaaagaccucgugcuaga

SEQ ID NO: 1315544 - RNA, 19 nt, Homo sapiens
gcagaagauuaugcuauuu

SEQ ID NO: 1315545 - RNA, 19 nt, Homo sapiens
gcaacacugcucuccauua

SEQ ID NO: 1315546 - RNA, 19 nt, Homo sapiens
gcaaacacaggaaaugaaa

SEQ ID NO: 1315547 - RNA, 19 nt, Homo sapiens
aaacguauccucagcaauu

SEQ ID NO: 1315548 - RNA, 19 nt, Homo sapiens
gagaagggccuccugcaaa

SEQ ID NO: 1315549 - RNA, 19 nt, Homo sapiens
gcaagaaaggcaugaaaga

SEQ ID NO: 1315550 - RNA, 19 nt, Homo sapiens
ucaaagacugcaagaaaua

SEQ ID NO: 1315551 - RNA, 19 nt, Homo sapiens
guauugcugugucuuguaa

SEQ ID NO: 1315552 - RNA, 19 nt, Homo sapiens
gagaugauuuacuuugaga

SEQ ID NO: 1315553 - RNA, 19 nt, Homo sapiens
gaaacagaauagucaaugg

SEQ ID NO: 1315554 - RNA, 19 nt, Homo sapiens
cacuagagaugaaaucaaa

SEQ ID NO: 1315555 - RNA, 19 nt, Homo sapiens
cagauuaacccaacaaaga

SEQ ID NO: 1315556 - RNA, 19 nt, Homo sapiens
ggagaaaucagauguugga

SEQ ID NO: 1315557 - RNA, 19 nt, Homo sapiens
gguagauaguucuguauug

SEQ ID NO: 1315558 - RNA, 19 nt, Homo sapiens
gagagcagaacaagccuua

SEQ ID NO: 1315559 - RNA, 19 nt, Homo sapiens
cagaugaauugaaguguau

SEQ ID NO: 1315560 - RNA, 19 nt, Homo sapiens
cagaacugcucuacacuug

SEQ ID NO: 1315561 - RNA, 19 nt, Homo sapiens
uagacuggcugcugcuaua

SEQ ID NO: 1315562 - RNA, 19 nt, Homo sapiens
gaggaaaugauaacagaaa

SEQ ID NO: 1315563 - RNA, 19 nt, Homo sapiens
gacgagaugcagaagauua

SEQ ID NO: 1315564 - RNA, 19 nt, Homo sapiens
aaagaaagaccucgugcua

SEQ ID NO: 1315565 - RNA, 19 nt, Homo sapiens
agaaagaggaucauaaaga

SEQ ID NO: 1315566 - RNA, 19 nt, Homo sapiens
aacaagagcuuaaugaucu

SEQ ID NO: 1315567 - RNA, 19 nt, Homo sapiens
ggauacauguugaacuuag

SEQ ID NO: 1315568 - RNA, 19 nt, Homo sapiens
aaucaaagacugcaagaaa

SEQ ID NO: 1315569 - RNA, 19 nt, Homo sapiens
gaaaggaaagagaaacaau

SEQ ID NO: 1315570 - RNA, 19 nt, Homo sapiens
ucagaaagaggaucauaaa

SEQ ID NO: 1315571 - RNA, 19 nt, Homo sapiens
gaaugaguuucuuacugaa

SEQ ID NO: 1315572 - RNA, 19 nt, Homo sapiens
gaaacagcauuccgguauc

SEQ ID NO: 1315573 - RNA, 19 nt, Homo sapiens
gcaccuacuuguuauaaaa

SEQ ID NO: 1315574 - RNA, 19 nt, Homo sapiens
gcucaaugccgaacuguug

SEQ ID NO: 1315575 - RNA, 19 nt, Homo sapiens
gagaauacaaggcucaaug

SEQ ID NO: 1315576 - RNA, 19 nt, Homo sapiens
aaacaaaugcugcccuuga

SEQ ID NO: 1315577 - RNA, 19 nt, Homo sapiens
gcuaaugaaugaaugugau

SEQ ID NO: 1315578 - RNA, 19 nt, Homo sapiens
caagaaaggcaugaaagaa

SEQ ID NO: 1315579 - RNA, 19 nt, Homo sapiens
gcuauaauuugcaagaaag

SEQ ID NO: 1315580 - RNA, 19 nt, Homo sapiens
gcacagagucauauuuuaa

SEQ ID NO: 1315581 - RNA, 19 nt, Homo sapiens
caacaagagcuuaaugauc

SEQ ID NO: 1315582 - RNA, 19 nt, Homo sapiens
ggaaacagaauagucaaug

SEQ ID NO: 1315583 - RNA, 19 nt, Homo sapiens
uguaauaccuugcuuuaac

SEQ ID NO: 1315584 - RNA, 19 nt, Homo sapiens
aaaguuggauuguagagau

SEQ ID NO: 1315585 - RNA, 19 nt, Homo sapiens
ugaggaaucuuacagugau

SEQ ID NO: 1315586 - RNA, 19 nt, Homo sapiens
gaagaaaugaaaggucuga

SEQ ID NO: 1315587 - RNA, 19 nt, Homo sapiens
gagcaagaaaggcaugaaa

SEQ ID NO: 1315588 - RNA, 19 nt, Homo sapiens
ugacaaagacuugaauguu

SEQ ID NO: 1315589 - RNA, 19 nt, Homo sapiens
gcgccaauccaaacuuuaa

SEQ ID NO: 1315590 - RNA, 19 nt, Homo sapiens
agauguuucuguacaagua

SEQ ID NO: 1315591 - RNA, 19 nt, Homo sapiens
gacauugaaucuuaucagu

SEQ ID NO: 1315592 - RNA, 19 nt, Homo sapiens
acuggaagcugacauugaa

SEQ ID NO: 1315593 - RNA, 19 nt, Homo sapiens
gcagauauugcuauacuca

SEQ ID NO: 1315594 - RNA, 19 nt, Homo sapiens
agauagaggugagagauga

SEQ ID NO: 1315595 - RNA, 19 nt, Homo sapiens
ggaaaugaaagagauguau

SEQ ID NO: 1315596 - RNA, 19 nt, Homo sapiens
caagaaauacuccaaaucg

SEQ ID NO: 1315597 - RNA, 19 nt, Homo sapiens
gcaagaaauacuccaaauc

SEQ ID NO: 1315598 - RNA, 19 nt, Homo sapiens
gaaaucaaagacugcaaga

SEQ ID NO: 1315599 - RNA, 19 nt, Homo sapiens
uaagaaagaaguugaagca

SEQ ID NO: 1315600 - RNA, 19 nt, Homo sapiens
ucaauauccuucuuaagca

SEQ ID NO: 1315601 - RNA, 19 nt, Homo sapiens
gaaaacagaacgccuuuga

SEQ ID NO: 1315602 - RNA, 19 nt, Homo sapiens
ugcagaagauuaugcuauu

SEQ ID NO: 1315603 - RNA, 19 nt, Homo sapiens
caauauccuucuuaagcaa

SEQ ID NO: 1315604 - RNA, 19 nt, Homo sapiens
guaauaccuugcuuuaacu

SEQ ID NO: 1315605 - RNA, 19 nt, Homo sapiens
gaaaaugcguggcuuguac

SEQ ID NO: 1315606 - RNA, 19 nt, Homo sapiens
gaaaugaaagagauguauc

SEQ ID NO: 1315607 - RNA, 19 nt, Homo sapiens
ccucagcaauuucccaaga

SEQ ID NO: 1315608 - RNA, 19 nt, Homo sapiens
agaaaggcaugaaagaagu

SEQ ID NO: 1315609 - RNA, 19 nt, Homo sapiens
gcacuggacaaggacaaua

SEQ ID NO: 1315610 - RNA, 19 nt, Homo sapiens
aaaggcaccuacuuguuau

SEQ ID NO: 1315611 - RNA, 19 nt, Homo sapiens
agagauggcugcacaacuc

SEQ ID NO: 1315612 - RNA, 19 nt, Homo sapiens
aaacacaggaaaugaaaga

SEQ ID NO: 1315613 - RNA, 19 nt, Homo sapiens
aaacacagcagcaaacaca

SEQ ID NO: 1315614 - RNA, 19 nt, Homo sapiens
gcucaucuaugguuuguua

SEQ ID NO: 1315615 - RNA, 19 nt, Homo sapiens
gaucagaaguaaccaguuu

SEQ ID NO: 1315616 - RNA, 19 nt, Homo sapiens
cugcaaaccuucugaguaa

SEQ ID NO: 1315617 - RNA, 19 nt, Homo sapiens
gcagucauuucauaccuuu

SEQ ID NO: 1315618 - RNA, 19 nt, Homo sapiens
agaaacagauccagaccua

SEQ ID NO: 1315619 - RNA, 19 nt, Homo sapiens
ggaacagauucaucauauu

SEQ ID NO: 1315620 - RNA, 19 nt, Homo sapiens
guaaagugcuuggaagaug

SEQ ID NO: 1315621 - RNA, 19 nt, Homo sapiens
cggaacagauucaucauau

SEQ ID NO: 1315622 - RNA, 19 nt, Homo sapiens
gaaguaaccaguuuaugga

SEQ ID NO: 1315623 - RNA, 19 nt, Homo sapiens
uaacauacacagcugcaua

SEQ ID NO: 1315624 - RNA, 19 nt, Homo sapiens
uuaaacggcugagugauaa

SEQ ID NO: 1315625 - RNA, 19 nt, Homo sapiens
gagcucgucuccuaucaau

SEQ ID NO: 1315626 - RNA, 19 nt, Homo sapiens
ggagucugcucaucuaugg

SEQ ID NO: 1315627 - RNA, 19 nt, Homo sapiens
gcugagggccgacacaauu

SEQ ID NO: 1315628 - RNA, 19 nt, Homo sapiens
cagcuagugugcagucauu

SEQ ID NO: 1315629 - RNA, 19 nt, Homo sapiens
gcaaaccuucugaguaaga

SEQ ID NO: 1315630 - RNA, 19 nt, Homo sapiens
gaauggugccuacagcaaa

SEQ ID NO: 1315631 - RNA, 19 nt, Homo sapiens
gcucgucuccuaucaauca

SEQ ID NO: 1315632 - RNA, 19 nt, Homo sapiens
uagaaacagugccuuaaag

SEQ ID NO: 1315633 - RNA, 19 nt, Homo sapiens
cgacacaauucacggaaca

SEQ ID NO: 1315634 - RNA, 19 nt, Homo sapiens
cuuaaacggcugagugaua

SEQ ID NO: 1315635 - RNA, 19 nt, Homo sapiens
gugggagucugcucaucua

SEQ ID NO: 1315636 - RNA, 19 nt, Homo sapiens
ucacggaacagauucauca

SEQ ID NO: 1315637 - RNA, 19 nt, Homo sapiens
cgaccucacuguuccuuag

SEQ ID NO: 1315638 - RNA, 19 nt, Homo sapiens
ggacauacgaugcauuugc

SEQ ID NO: 1315639 - RNA, 19 nt, Homo sapiens
gcucagaaguugggcaaag

SEQ ID NO: 1315640 - RNA, 19 nt, Homo sapiens
guuccaggaucagaaguaa

SEQ ID NO: 1315641 - RNA, 19 nt, Homo sapiens
auucagagcuaaguucaaa

SEQ ID NO: 1315642 - RNA, 19 nt, Homo sapiens
gguucaagaugcagaaugg

SEQ ID NO: 1315643 - RNA, 19 nt, Homo sapiens
agugugcagucauuucaua

SEQ ID NO: 1315644 - RNA, 19 nt, Homo sapiens
aaacagauccagaccuauc

SEQ ID NO: 1315645 - RNA, 19 nt, Homo sapiens
acaauucacggaacagauu

SEQ ID NO: 1315646 - RNA, 19 nt, Homo sapiens
agaaguaaccaguuuaugg

SEQ ID NO: 1315647 - RNA, 19 nt, Homo sapiens
gacauacgaugcauuugcu

SEQ ID NO: 1315648 - RNA, 19 nt, Homo sapiens
agaaacagugccuuaaaga

SEQ ID NO: 1315649 - RNA, 19 nt, Homo sapiens
ccagaccuaucaugugaag

SEQ ID NO: 1315650 - RNA, 19 nt, Homo sapiens
gauccagaccuaucaugug

SEQ ID NO: 1315651 - RNA, 19 nt, Homo sapiens
gaaacagugccuuaaagac

SEQ ID NO: 1315652 - RNA, 19 nt, Homo sapiens
uuagaaacagugccuuaaa

SEQ ID NO: 1315653 - RNA, 19 nt, Homo sapiens
gugauaauccagcuagugu

SEQ ID NO: 1315654 - RNA, 19 nt, Homo sapiens
auccagaccuaucauguga

SEQ ID NO: 1315655 - RNA, 19 nt, Homo sapiens
cacagcagacuuccugaaa

SEQ ID NO: 1315656 - RNA, 19 nt, Homo sapiens
uuuacaaacugcaaaccuu

SEQ ID NO: 1315657 - RNA, 19 nt, Homo sapiens
ccucccuucuuuaccauuu

SEQ ID NO: 1315658 - RNA, 19 nt, Homo sapiens
ccuucuggauaguaacaua

SEQ ID NO: 1315659 - RNA, 19 nt, Homo sapiens
ucagaaguaaccaguuuau

SEQ ID NO: 1315660 - RNA, 19 nt, Homo sapiens
gaaguccacguuccaggau

SEQ ID NO: 1315661 - RNA, 19 nt, Homo sapiens
acacccuccucccuucuuu

SEQ ID NO: 1315662 - RNA, 19 nt, Homo sapiens
acagauucaucauauuugg

SEQ ID NO: 1315663 - RNA, 19 nt, Homo sapiens
gcgcuuugcugcggucaca

SEQ ID NO: 1315664 - RNA, 19 nt, Homo sapiens
ggauucagagcuaaguuca

SEQ ID NO: 1315665 - RNA, 19 nt, Homo sapiens
cgcaggaccucucccaaag

SEQ ID NO: 1315666 - RNA, 19 nt, Homo sapiens
gcaccuuccaucugugaga

SEQ ID NO: 1315667 - RNA, 19 nt, Homo sapiens
gacuccuucuggauaguaa

SEQ ID NO: 1315668 - RNA, 19 nt, Homo sapiens
gagaggcacacuucagucu

SEQ ID NO: 1315669 - RNA, 19 nt, Homo sapiens
cuuaaagacgggcaagaaa

SEQ ID NO: 1315670 - RNA, 19 nt, Homo sapiens
gugugcaccuuccaucugu

SEQ ID NO: 1315671 - RNA, 19 nt, Homo sapiens
gagcuuacacgggaaaguc

SEQ ID NO: 1315672 - RNA, 19 nt, Homo sapiens
caaacugcaaaccuucuga

SEQ ID NO: 1315673 - RNA, 19 nt, Homo sapiens
gaaacagauccagaccuau

SEQ ID NO: 1315674 - RNA, 19 nt, Homo sapiens
gaucccaacagaaacagau

SEQ ID NO: 1315675 - RNA, 19 nt, Homo sapiens
gcaaaggucacagcagacu

SEQ ID NO: 1315676 - RNA, 19 nt, Homo sapiens
aaaggucacagcagacuuc

SEQ ID NO: 1315677 - RNA, 19 nt, Homo sapiens
aacauacacagcugcauaa

SEQ ID NO: 1315678 - RNA, 19 nt, Homo sapiens
gggauucagagcuaaguuc

SEQ ID NO: 1315679 - RNA, 19 nt, Homo sapiens
ucacacacacggucucagu

SEQ ID NO: 1315680 - RNA, 19 nt, Homo sapiens
ccacguuccaggaucagaa

SEQ ID NO: 1315681 - RNA, 19 nt, Homo sapiens
aagcagacacugaggaaca

SEQ ID NO: 1315682 - RNA, 19 nt, Homo sapiens
gggagucugcucaucuaug

SEQ ID NO: 1315683 - RNA, 19 nt, Homo sapiens
uuaaauuccuagguaccaa

SEQ ID NO: 1315684 - RNA, 19 nt, Homo sapiens
gcuagugugcagucauuuc

SEQ ID NO: 1315685 - RNA, 19 nt, Homo sapiens
cgugaugguuuugcuuuua

SEQ ID NO: 1315686 - RNA, 19 nt, Homo sapiens
acugcaaaccuucugagua

SEQ ID NO: 1315687 - RNA, 19 nt, Homo sapiens
ucacagcagacuuccugaa

SEQ ID NO: 1315688 - RNA, 19 nt, Homo sapiens
uugcugugcucaaguucuu

SEQ ID NO: 1315689 - RNA, 19 nt, Homo sapiens
caagugaacguggcagagu

SEQ ID NO: 1315690 - RNA, 19 nt, Homo sapiens
auuccaagguaucuguaaa

SEQ ID NO: 1315691 - RNA, 19 nt, Homo sapiens
agaccuaucaugugaaguc

SEQ ID NO: 1315692 - RNA, 19 nt, Homo sapiens
cagcagacuuccugaaaag

SEQ ID NO: 1315693 - RNA, 19 nt, Homo sapiens
ccuuaaagacgggcaagaa

SEQ ID NO: 1315694 - RNA, 19 nt, Homo sapiens
cgacuccuucuggauagua

SEQ ID NO: 1315695 - RNA, 19 nt, Homo sapiens
ccuccucccuucuuuacca

SEQ ID NO: 1315696 - RNA, 19 nt, Homo sapiens
acacuucagucuggguuca

SEQ ID NO: 1315697 - RNA, 19 nt, Homo sapiens
gugagaggcacacuucagu

SEQ ID NO: 1315698 - RNA, 19 nt, Homo sapiens
acggaacagauucaucaua

SEQ ID NO: 1315699 - RNA, 19 nt, Homo sapiens
ucagucacgugaugguuuu

SEQ ID NO: 1315700 - RNA, 19 nt, Homo sapiens
acacacacggucucaguca

SEQ ID NO: 1315701 - RNA, 19 nt, Homo sapiens
acgcaggaccucucccaaa

SEQ ID NO: 1315702 - RNA, 19 nt, Homo sapiens
ggcgacagcagcucagcaa

SEQ ID NO: 1315703 - RNA, 19 nt, Homo sapiens
gcccugcucuugccucuua

SEQ ID NO: 1315704 - RNA, 19 nt, Homo sapiens
gagaguggauuucugacaa

SEQ ID NO: 1315705 - RNA, 19 nt, Homo sapiens
caaauuggccucuucuuuc

SEQ ID NO: 1315706 - RNA, 19 nt, Homo sapiens
ccaaaucauccucaaauug

SEQ ID NO: 1315707 - RNA, 19 nt, Homo sapiens
ucugacaaaucgauaguaa

SEQ ID NO: 1315708 - RNA, 19 nt, Homo sapiens
ucaaauuggccucuucuuu

SEQ ID NO: 1315709 - RNA, 19 nt, Homo sapiens
gcccagcucuugccucaug

SEQ ID NO: 1315710 - RNA, 19 nt, Homo sapiens
gcucauuccucuugucauc

SEQ ID NO: 1315711 - RNA, 19 nt, Homo sapiens
caaaucauccucaaauugg

SEQ ID NO: 1315712 - RNA, 19 nt, Homo sapiens
ccaaaucguccuccaguug

SEQ ID NO: 1315713 - RNA, 19 nt, Homo sapiens
gccgagguccuuucucaua

SEQ ID NO: 1315714 - RNA, 19 nt, Homo sapiens
gcccaucucuugccucaca

SEQ ID NO: 1315715 - RNA, 19 nt, Homo sapiens
ccucaagucggccucuuua

SEQ ID NO: 1315716 - RNA, 19 nt, Homo sapiens
aagcccagcuccugccuuu

SEQ ID NO: 1315717 - RNA, 19 nt, Homo sapiens
gcccaaaucauccucaaau

SEQ ID NO: 1315718 - RNA, 19 nt, Homo sapiens
cccaaaucauccucaaauu

SEQ ID NO: 1315719 - RNA, 19 nt, Homo sapiens
ccuggacucucauuuguuc

SEQ ID NO: 1315720 - RNA, 19 nt, Homo sapiens
gccuuucaaugaccucuuu

SEQ ID NO: 1315721 - RNA, 19 nt, Homo sapiens
gccaagcgccugccuuuca

SEQ ID NO: 1315722 - RNA, 19 nt, Homo sapiens
ggccaaguuuccaccuauu

SEQ ID NO: 1315723 - RNA, 19 nt, Homo sapiens
aagcuucccuggacucuca

SEQ ID NO: 1315724 - RNA, 19 nt, Homo sapiens
agaguggauuucugacaaa

SEQ ID NO: 1315725 - RNA, 19 nt, Homo sapiens
ccacucaaggcccaucuuu

SEQ ID NO: 1315726 - RNA, 19 nt, Homo sapiens
ccucaagucaagcucuuua

SEQ ID NO: 1315727 - RNA, 19 nt, Homo sapiens
acucucauuuguucacuuu

SEQ ID NO: 1315728 - RNA, 19 nt, Homo sapiens
gcccaucuccuaccucaga

SEQ ID NO: 1315729 - RNA, 19 nt, Homo sapiens
guccaaaacuccugccuuu

SEQ ID NO: 1315730 - RNA, 19 nt, Homo sapiens
gcagagugccuuagcaaaa

SEQ ID NO: 1315731 - RNA, 19 nt, Homo sapiens
gaccaacuccugccucaca

SEQ ID NO: 1315732 - RNA, 19 nt, Homo sapiens
aaccuucccuggccaaguu

SEQ ID NO: 1315733 - RNA, 19 nt, Homo sapiens
acaguugccucuuccagau

SEQ ID NO: 1315734 - RNA, 19 nt, Homo sapiens
cccagcuccugccuucuua

SEQ ID NO: 1315735 - RNA, 19 nt, Homo sapiens
ggccuccucugaccagguu

SEQ ID NO: 1315736 - RNA, 19 nt, Homo sapiens
gcccagcucauuccucuug

SEQ ID NO: 1315737 - RNA, 19 nt, Homo sapiens
ucucauacuggccuguuua

SEQ ID NO: 1315738 - RNA, 19 nt, Homo sapiens
gccaaguuuccaccuauuu

SEQ ID NO: 1315739 - RNA, 19 nt, Homo sapiens
ucuuccagauccagcuuua

SEQ ID NO: 1315740 - RNA, 19 nt, Homo sapiens
ucacaacaaccuccuugga

SEQ ID NO: 1315741 - RNA, 19 nt, Homo sapiens
gcccagcuccugccuuuca

SEQ ID NO: 1315742 - RNA, 19 nt, Homo sapiens
gcccagcucaugccucuug

SEQ ID NO: 1315743 - RNA, 19 nt, Homo sapiens
gguagccucuucugguuuu

SEQ ID NO: 1315744 - RNA, 19 nt, Homo sapiens
cagcagagugccuuagcaa

SEQ ID NO: 1315745 - RNA, 19 nt, Homo sapiens
uggccaaguuuccaccuau

SEQ ID NO: 1315746 - RNA, 19 nt, Homo sapiens
ucccuggacucucauuugu

SEQ ID NO: 1315747 - RNA, 19 nt, Homo sapiens
ucagaucugccucccaaga

SEQ ID NO: 1315748 - RNA, 19 nt, Homo sapiens
ccaaguuuccaccuauuuc

SEQ ID NO: 1315749 - RNA, 19 nt, Homo sapiens
gcuccugccuuucaaugac

SEQ ID NO: 1315750 - RNA, 19 nt, Homo sapiens
aagccaagcgccugccuuu

SEQ ID NO: 1315751 - RNA, 19 nt, Homo sapiens
gagguccuuucucauacug

SEQ ID NO: 1315752 - RNA, 19 nt, Homo sapiens
aggccgagguccuuucuca

SEQ ID NO: 1315753 - RNA, 19 nt, Homo sapiens
uaaccuugagaguggauuu

SEQ ID NO: 1315754 - RNA, 19 nt, Homo sapiens
gcccaacuccugccucaca

SEQ ID NO: 1315755 - RNA, 19 nt, Homo sapiens
gcccagcuccugccuucuu

SEQ ID NO: 1315756 - RNA, 19 nt, Homo sapiens
ucucauuuguucacuuuac

SEQ ID NO: 1315757 - RNA, 19 nt, Homo sapiens
gcucagcuccugcccaacu

SEQ ID NO: 1315758 - RNA, 19 nt, Homo sapiens
cugccugugugguuucaaa

SEQ ID NO: 1315759 - RNA, 19 nt, Homo sapiens
aaaacugucucuuaaccuu

SEQ ID NO: 1315760 - RNA, 19 nt, Homo sapiens
ccaagcgccugccuuucag

SEQ ID NO: 1315761 - RNA, 19 nt, Homo sapiens
caacuccugccucacaaca

SEQ ID NO: 1315762 - RNA, 19 nt, Homo sapiens
ccgagguccuuucucauac

SEQ ID NO: 1315763 - RNA, 19 nt, Homo sapiens
caacuccugccucacaaca

SEQ ID NO: 1315764 - RNA, 19 nt, Homo sapiens
aacugucucuuaaccuuga

SEQ ID NO: 1315765 - RNA, 19 nt, Homo sapiens
ccauguuccuaucugacuu

SEQ ID NO: 1315766 - RNA, 19 nt, Homo sapiens
ucuccaggcccaucucuug

SEQ ID NO: 1315767 - RNA, 19 nt, Homo sapiens
ccucguggcagccuaaaca

SEQ ID NO: 1315768 - RNA, 19 nt, Homo sapiens
cuugagaguggauuucuga

SEQ ID NO: 1315769 - RNA, 19 nt, Homo sapiens
cggccauguuccuaucuga

SEQ ID NO: 1315770 - RNA, 19 nt, Homo sapiens
cccaaaucguccuccaguu

SEQ ID NO: 1315771 - RNA, 19 nt, Homo sapiens
aaauuggccucuucuuucc

SEQ ID NO: 1315772 - RNA, 19 nt, Homo sapiens
aggccuagcuuucgcuuuu

SEQ ID NO: 1315773 - RNA, 19 nt, Homo sapiens
caucaucuccaggcccaaa

SEQ ID NO: 1315774 - RNA, 19 nt, Homo sapiens
gcuccugguggccuuugua

SEQ ID NO: 1315775 - RNA, 19 nt, Homo sapiens
gcaaaacuuccucccauca

SEQ ID NO: 1315776 - RNA, 19 nt, Homo sapiens
ggguagcucuuaaaucuua

SEQ ID NO: 1315777 - RNA, 19 nt, Homo sapiens
gaaaggguguuugacaaga

SEQ ID NO: 1315778 - RNA, 19 nt, Homo sapiens
gaugaauucugcauuguuc

SEQ ID NO: 1315779 - RNA, 19 nt, Homo sapiens
ggaaagagaaggcgaagau

SEQ ID NO: 1315780 - RNA, 19 nt, Homo sapiens
gcagagagccagggcauuu

SEQ ID NO: 1315781 - RNA, 19 nt, Homo sapiens
caaccugccugcaaacaug

SEQ ID NO: 1315782 - RNA, 19 nt, Homo sapiens
gaacugcagccagauguuu

SEQ ID NO: 1315783 - RNA, 19 nt, Homo sapiens
gguuucauguguuagauaa

SEQ ID NO: 1315784 - RNA, 19 nt, Homo sapiens
gguuugguuucauguguua

SEQ ID NO: 1315785 - RNA, 19 nt, Homo sapiens
gugaaaggguguuugacaa

SEQ ID NO: 1315786 - RNA, 19 nt, Homo sapiens
aguccaagcugacaauauu

SEQ ID NO: 1315787 - RNA, 19 nt, Homo sapiens
ugaccgagcucugcaaugu

SEQ ID NO: 1315788 - RNA, 19 nt, Homo sapiens
acaagaugauccagacaaa

SEQ ID NO: 1315789 - RNA, 19 nt, Homo sapiens
gcuccacucuccuuagguu

SEQ ID NO: 1315790 - RNA, 19 nt, Homo sapiens
gacuaucgcuacacagguu

SEQ ID NO: 1315791 - RNA, 19 nt, Homo sapiens
uagcuucucuggucuggaa

SEQ ID NO: 1315792 - RNA, 19 nt, Homo sapiens
ucaaguggauggguccuuu

SEQ ID NO: 1315793 - RNA, 19 nt, Homo sapiens
gccaagacuuagagaauca

SEQ ID NO: 1315794 - RNA, 19 nt, Homo sapiens
gcaggaaccgcagguguuu

SEQ ID NO: 1315795 - RNA, 19 nt, Homo sapiens
caugucaacucguaaaucu

SEQ ID NO: 1315796 - RNA, 19 nt, Homo sapiens
aguuaaagaccaagaguua

SEQ ID NO: 1315797 - RNA, 19 nt, Homo sapiens
cagcugcgauccucuaaag

SEQ ID NO: 1315798 - RNA, 19 nt, Homo sapiens
guacaugucaacucguaaa

SEQ ID NO: 1315799 - RNA, 19 nt, Homo sapiens
ggacucuaccuuccagauu

SEQ ID NO: 1315800 - RNA, 19 nt, Homo sapiens
gagagcagccagcagagaa

SEQ ID NO: 1315801 - RNA, 19 nt, Homo sapiens
cuggguagcucuuaaaucu

SEQ ID NO: 1315802 - RNA, 19 nt, Homo sapiens
gacaagaucaagagucgaa

SEQ ID NO: 1315803 - RNA, 19 nt, Homo sapiens
gcucagagacacaggauag

SEQ ID NO: 1315804 - RNA, 19 nt, Homo sapiens
caauauaggaagccgguuu

SEQ ID NO: 1315805 - RNA, 19 nt, Homo sapiens
gacucuaccuuccagauuc

SEQ ID NO: 1315806 - RNA, 19 nt, Homo sapiens
gagucgaaaugcccauaug

SEQ ID NO: 1315807 - RNA, 19 nt, Homo sapiens
gagaaggcgaagauggaua

SEQ ID NO: 1315808 - RNA, 19 nt, Homo sapiens
ggccaagacuuagagaauc

SEQ ID NO: 1315809 - RNA, 19 nt, Homo sapiens
gcaaacauggagggcauuu

SEQ ID NO: 1315810 - RNA, 19 nt, Homo sapiens
gcaucuguguggugaagga

SEQ ID NO: 1315811 - RNA, 19 nt, Homo sapiens
ccagugacccgacacauag

SEQ ID NO: 1315812 - RNA, 19 nt, Homo sapiens
aaucuuagccucaguugug

SEQ ID NO: 1315813 - RNA, 19 nt, Homo sapiens
gcacgagacgagacgcaaa

SEQ ID NO: 1315814 - RNA, 19 nt, Homo sapiens
gcgaugaauucugcauugu

SEQ ID NO: 1315815 - RNA, 19 nt, Homo sapiens
gagggcauuuggccacaga

SEQ ID NO: 1315816 - RNA, 19 nt, Homo sapiens
agagagagccggaggaagu

SEQ ID NO: 1315817 - RNA, 19 nt, Homo sapiens
aagaugauccagacaaaga

SEQ ID NO: 1315818 - RNA, 19 nt, Homo sapiens
gcuccaugcucgaucaagu

SEQ ID NO: 1315819 - RNA, 19 nt, Homo sapiens
gaaagagaaggcgaagaug

SEQ ID NO: 1315820 - RNA, 19 nt, Homo sapiens
ugucaacucguaaaucuga

SEQ ID NO: 1315821 - RNA, 19 nt, Homo sapiens
uggccaaccugccugcaaa

SEQ ID NO: 1315822 - RNA, 19 nt, Homo sapiens
ggagagacccagccaccau

SEQ ID NO: 1315823 - RNA, 19 nt, Homo sapiens
caagagagagccggaggaa

SEQ ID NO: 1315824 - RNA, 19 nt, Homo sapiens
aggcgaagauggauaugug

SEQ ID NO: 1315825 - RNA, 19 nt, Homo sapiens
ggaccuggaggacaucuuc

SEQ ID NO: 1315826 - RNA, 19 nt, Homo sapiens
gggcauuuggccacagaua

SEQ ID NO: 1315827 - RNA, 19 nt, Homo sapiens
ggccaugggacaagagaaa

SEQ ID NO: 1315828 - RNA, 19 nt, Homo sapiens
gauuaaauuggguucuuga

SEQ ID NO: 1315829 - RNA, 19 nt, Homo sapiens
ucagugcguugaguauuau

SEQ ID NO: 1315830 - RNA, 19 nt, Homo sapiens
ugauuaaauuggguucuug

SEQ ID NO: 1315831 - RNA, 19 nt, Homo sapiens
cagauucagucccuagucu

SEQ ID NO: 1315832 - RNA, 19 nt, Homo sapiens
aaaagagggucaagagaga

SEQ ID NO: 1315833 - RNA, 19 nt, Homo sapiens
gaugaucagcucagagaca

SEQ ID NO: 1315834 - RNA, 19 nt, Homo sapiens
ggaauccagacaucucuuc

SEQ ID NO: 1315835 - RNA, 19 nt, Homo sapiens
aaaggguguuugacaagau

SEQ ID NO: 1315836 - RNA, 19 nt, Homo sapiens
cagcagagaaagcggaaga

SEQ ID NO: 1315837 - RNA, 19 nt, Homo sapiens
aggcagagguaaccagcaa

SEQ ID NO: 1315838 - RNA, 19 nt, Homo sapiens
ucccuagucuugcgaugaa

SEQ ID NO: 1315839 - RNA, 19 nt, Homo sapiens
gauucagucccuagucuug

SEQ ID NO: 1315840 - RNA, 19 nt, Homo sapiens
ggcaggaggagcucaguug

SEQ ID NO: 1315841 - RNA, 19 nt, Homo sapiens
caagaacugcagccagaug

SEQ ID NO: 1315842 - RNA, 19 nt, Homo sapiens
cggcagaucccuccaaguc

SEQ ID NO: 1315843 - RNA, 19 nt, Homo sapiens
ugcgaugaauucugcauug

SEQ ID NO: 1315844 - RNA, 19 nt, Homo sapiens
ggguuugguuucauguguu

SEQ ID NO: 1315845 - RNA, 19 nt, Homo sapiens
gcucuggguagcucuuaaa

SEQ ID NO: 1315846 - RNA, 19 nt, Homo sapiens
aaacauggagggcauuugg

SEQ ID NO: 1315847 - RNA, 19 nt, Homo sapiens
ucucuucucuggccaagca

SEQ ID NO: 1315848 - RNA, 19 nt, Homo sapiens
gggaggagcgagacagcaa

SEQ ID NO: 1315849 - RNA, 19 nt, Homo sapiens
gcagccagauguuuuauac

SEQ ID NO: 1315850 - RNA, 19 nt, Homo sapiens
augcagguguuccagauga

SEQ ID NO: 1315851 - RNA, 19 nt, Homo sapiens
agaaggcgaagauggauau

SEQ ID NO: 1315852 - RNA, 19 nt, Homo sapiens
ugacgagcauguagcuucu

SEQ ID NO: 1315853 - RNA, 19 nt, Homo sapiens
ggagagcagccagcagaga

SEQ ID NO: 1315854 - RNA, 19 nt, Homo sapiens
gcaggaggagcucaguugu

SEQ ID NO: 1315855 - RNA, 19 nt, Homo sapiens
agggugaaguggccaguga

SEQ ID NO: 1315856 - RNA, 19 nt, Homo sapiens
caagaucaagagucgaaau

SEQ ID NO: 1315857 - RNA, 19 nt, Homo sapiens
ggaacugacgagcauguag

SEQ ID NO: 1315858 - RNA, 19 nt, Homo sapiens
ucuguguggugaaggauga

SEQ ID NO: 1315859 - RNA, 19 nt, Homo sapiens
guacuucaacacccucugu

SEQ ID NO: 1315860 - RNA, 19 nt, Homo sapiens
uuguacaugucaacucgua

SEQ ID NO: 1315861 - RNA, 19 nt, Homo sapiens
cuccuuagguucauagucu

SEQ ID NO: 1315862 - RNA, 19 nt, Homo sapiens
ccaacggcagacccaguua

SEQ ID NO: 1315863 - RNA, 19 nt, Homo sapiens
uaaagaccaagaguuauag

SEQ ID NO: 1315864 - RNA, 19 nt, Homo sapiens
aggcagagaucccggaacu

SEQ ID NO: 1315865 - RNA, 19 nt, Homo sapiens
aagagaaggcgaagaugga

SEQ ID NO: 1315866 - RNA, 19 nt, Homo sapiens
caugcucgaucaaguggau

SEQ ID NO: 1315867 - RNA, 19 nt, Homo sapiens
ucagcuccaugcucgauca

SEQ ID NO: 1315868 - RNA, 19 nt, Homo sapiens
gcagagaaagcggaagaag

SEQ ID NO: 1315869 - RNA, 19 nt, Homo sapiens
uccagugacccgacacaua

SEQ ID NO: 1315870 - RNA, 19 nt, Homo sapiens
ugagcagccacauguguuu

SEQ ID NO: 1315871 - RNA, 19 nt, Homo sapiens
gucgaaaugcccauaugaa

SEQ ID NO: 1315872 - RNA, 19 nt, Homo sapiens
gguguuuggcacagaguuu

SEQ ID NO: 1315873 - RNA, 19 nt, Homo sapiens
cgaugaauucugcauuguu

SEQ ID NO: 1315874 - RNA, 19 nt, Homo sapiens
caaguuaaagaccaagagu

SEQ ID NO: 1315875 - RNA, 19 nt, Homo sapiens
caaguccaagcugacaaua

SEQ ID NO: 1315876 - RNA, 19 nt, Homo sapiens
gaacaaagguuaagagaca

SEQ ID NO: 1315877 - RNA, 19 nt, Homo sapiens
ggaguuggcuggaggauuu

SEQ ID NO: 1315878 - RNA, 19 nt, Homo sapiens
acuaauagcuggcaaauuu

SEQ ID NO: 1315879 - RNA, 19 nt, Homo sapiens
gagcauauaucauuacaga

SEQ ID NO: 1315880 - RNA, 19 nt, Homo sapiens
ggaaguaucucuugguuuc

SEQ ID NO: 1315881 - RNA, 19 nt, Homo sapiens
gaaagacucagaaaguuua

SEQ ID NO: 1315882 - RNA, 19 nt, Homo sapiens
gcaaauuucuguuccauca

SEQ ID NO: 1315883 - RNA, 19 nt, Homo sapiens
caacuggacugcagagaaa

SEQ ID NO: 1315884 - RNA, 19 nt, Homo sapiens
gcaaaugguuuaacuaugg

SEQ ID NO: 1315885 - RNA, 19 nt, Homo sapiens
caacaguccucuagagauu

SEQ ID NO: 1315886 - RNA, 19 nt, Homo sapiens
gagauagacuuggagauaa

SEQ ID NO: 1315887 - RNA, 19 nt, Homo sapiens
cagcagaguuggugacuuu

SEQ ID NO: 1315888 - RNA, 19 nt, Homo sapiens
ggagauagacuuggagaua

SEQ ID NO: 1315889 - RNA, 19 nt, Homo sapiens
gcaaauauggcucuggaua

SEQ ID NO: 1315890 - RNA, 19 nt, Homo sapiens
gaaugacccuucuuugguu

SEQ ID NO: 1315891 - RNA, 19 nt, Homo sapiens
aaagcaaccuugaguguaa

SEQ ID NO: 1315892 - RNA, 19 nt, Homo sapiens
ucaaugagaucgucuacaa

SEQ ID NO: 1315893 - RNA, 19 nt, Homo sapiens
gaacuagacucggagauag

SEQ ID NO: 1315894 - RNA, 19 nt, Homo sapiens
cagaagauauauacaguga

SEQ ID NO: 1315895 - RNA, 19 nt, Homo sapiens
caugggagauguugaugua

SEQ ID NO: 1315896 - RNA, 19 nt, Homo sapiens
gcacaauucucuuucucuu

SEQ ID NO: 1315897 - RNA, 19 nt, Homo sapiens
cagcacaucccaccauuua

SEQ ID NO: 1315898 - RNA, 19 nt, Homo sapiens
uaucugauguucaaccaua

SEQ ID NO: 1315899 - RNA, 19 nt, Homo sapiens
gaaaugaggugaugauacc

SEQ ID NO: 1315900 - RNA, 19 nt, Homo sapiens
cuacaagucuucccaccua

SEQ ID NO: 1315901 - RNA, 19 nt, Homo sapiens
caacagaagcugaucaaga

SEQ ID NO: 1315902 - RNA, 19 nt, Homo sapiens
gauggucacugauaugaug

SEQ ID NO: 1315903 - RNA, 19 nt, Homo sapiens
ggagacauguucuuacaca

SEQ ID NO: 1315904 - RNA, 19 nt, Homo sapiens
caacacgauucuucuaaug

SEQ ID NO: 1315905 - RNA, 19 nt, Homo sapiens
uaaauacccuagaggaguu

SEQ ID NO: 1315906 - RNA, 19 nt, Homo sapiens
gcaagagcuuucuggaaga

SEQ ID NO: 1315907 - RNA, 19 nt, Homo sapiens
gaacaugggagcauauauc

SEQ ID NO: 1315908 - RNA, 19 nt, Homo sapiens
ggcgaacucucaaauuuau

SEQ ID NO: 1315909 - RNA, 19 nt, Homo sapiens
gaaauguuaggaucacuuu

SEQ ID NO: 1315910 - RNA, 19 nt, Homo sapiens
gggcgaacucucaaauuua

SEQ ID NO: 1315911 - RNA, 19 nt, Homo sapiens
gaaaugaaguguggaacag

SEQ ID NO: 1315912 - RNA, 19 nt, Homo sapiens
ggucguggaugacaauguu

SEQ ID NO: 1315913 - RNA, 19 nt, Homo sapiens
cagcuuggauggucacuga

SEQ ID NO: 1315914 - RNA, 19 nt, Homo sapiens
uuacugacuuuacagcaua

SEQ ID NO: 1315915 - RNA, 19 nt, Homo sapiens
ccacaacggugcucaacau

SEQ ID NO: 1315916 - RNA, 19 nt, Homo sapiens
gugaaagacucagaaaguu

SEQ ID NO: 1315917 - RNA, 19 nt, Homo sapiens
ccauguaucugauguucaa

SEQ ID NO: 1315918 - RNA, 19 nt, Homo sapiens
ggaauucccacauuucaug

SEQ ID NO: 1315919 - RNA, 19 nt, Homo sapiens
ucacugauaugaugcuuca

SEQ ID NO: 1315920 - RNA, 19 nt, Homo sapiens
gagaagccgugcaugaaag

SEQ ID NO: 1315921 - RNA, 19 nt, Homo sapiens
guagagaagccgugcauga

SEQ ID NO: 1315922 - RNA, 19 nt, Homo sapiens
ugggcgaacucucaaauuu

SEQ ID NO: 1315923 - RNA, 19 nt, Homo sapiens
ucaagugucuggccuuugu

SEQ ID NO: 1315924 - RNA, 19 nt, Homo sapiens
uggaagaaaggaaauguua

SEQ ID NO: 1315925 - RNA, 19 nt, Homo sapiens
acaauucucuuucucuuca

SEQ ID NO: 1315926 - RNA, 19 nt, Homo sapiens
gaucaagacccaacgacuu

SEQ ID NO: 1315927 - RNA, 19 nt, Homo sapiens
gcucacaguugaacgaauc

SEQ ID NO: 1315928 - RNA, 19 nt, Homo sapiens
gcacaucccaccauuuaca

SEQ ID NO: 1315929 - RNA, 19 nt, Homo sapiens
ggagauccauaacccaaca

SEQ ID NO: 1315930 - RNA, 19 nt, Homo sapiens
aaaugugacucaggaagua

SEQ ID NO: 1315931 - RNA, 19 nt, Homo sapiens
ucguauaucuuucugcaaa

SEQ ID NO: 1315932 - RNA, 19 nt, Homo sapiens
caugggagcauauaucauu

SEQ ID NO: 1315933 - RNA, 19 nt, Homo sapiens
uaagguuuacguaguguua

SEQ ID NO: 1315934 - RNA, 19 nt, Homo sapiens
aaaguacaccuacgaacua

SEQ ID NO: 1315935 - RNA, 19 nt, Homo sapiens
cauggagaaucaagacaaa

SEQ ID NO: 1315936 - RNA, 19 nt, Homo sapiens
ugaaagacucagaaaguuu

SEQ ID NO: 1315937 - RNA, 19 nt, Homo sapiens
guggaagaaccaaauauuu

SEQ ID NO: 1315938 - RNA, 19 nt, Homo sapiens
acaaauaaauacccuagag

SEQ ID NO: 1315939 - RNA, 19 nt, Homo sapiens
cacccaggcuucaguagaa

SEQ ID NO: 1315940 - RNA, 19 nt, Homo sapiens
ucacauaacaggcaaaugg

SEQ ID NO: 1315941 - RNA, 19 nt, Homo sapiens
caggaaguaucucuugguu

SEQ ID NO: 1315942 - RNA, 19 nt, Homo sapiens
aaccuugaguguaacuuua

SEQ ID NO: 1315943 - RNA, 19 nt, Homo sapiens
cgaacuagacucggagaua

SEQ ID NO: 1315944 - RNA, 19 nt, Homo sapiens
ggagguccaaucacacuaa

SEQ ID NO: 1315945 - RNA, 19 nt, Homo sapiens
gggagauguugauguaaau

SEQ ID NO: 1315946 - RNA, 19 nt, Homo sapiens
gaagaaaggaaauguuagg

SEQ ID NO: 1315947 - RNA, 19 nt, Homo sapiens
gugcuucuauggcuacuug

SEQ ID NO: 1315948 - RNA, 19 nt, Homo sapiens
gaagaauggguaaagacuu

SEQ ID NO: 1315949 - RNA, 19 nt, Homo sapiens
ggcagaagauauauacagu

SEQ ID NO: 1315950 - RNA, 19 nt, Homo sapiens
caaaugguuuaacuaugga

SEQ ID NO: 1315951 - RNA, 19 nt, Homo sapiens
aguaauaggagauccauaa

SEQ ID NO: 1315952 - RNA, 19 nt, Homo sapiens
uaauacacgugccuacugu

SEQ ID NO: 1315953 - RNA, 19 nt, Homo sapiens
ggucugacuucaaugagau

SEQ ID NO: 1315954 - RNA, 19 nt, Homo sapiens
gaaaagaaaaucuccauca

SEQ ID NO: 1315955 - RNA, 19 nt, Homo sapiens
ggcaaaugguuuaacuaug

SEQ ID NO: 1315956 - RNA, 19 nt, Homo sapiens
cauaacaggcaaaugguuu

SEQ ID NO: 1315957 - RNA, 19 nt, Homo sapiens
ugggagauguugauguaaa

SEQ ID NO: 1315958 - RNA, 19 nt, Homo sapiens
ucacauauacaacacgauu

SEQ ID NO: 1315959 - RNA, 19 nt, Homo sapiens
caucagaacauagcaaaga

SEQ ID NO: 1315960 - RNA, 19 nt, Homo sapiens
gaacagaaccaagcuaucc

SEQ ID NO: 1315961 - RNA, 19 nt, Homo sapiens
acacuaacccucggacuaa

SEQ ID NO: 1315962 - RNA, 19 nt, Homo sapiens
uaauugaaaugaggugaug

SEQ ID NO: 1315963 - RNA, 19 nt, Homo sapiens
gcaaagacaugggaaucac

SEQ ID NO: 1315964 - RNA, 19 nt, Homo sapiens
ugagggagacauguucuua

SEQ ID NO: 1315965 - RNA, 19 nt, Homo sapiens
gcauauaucauuacagacu

SEQ ID NO: 1315966 - RNA, 19 nt, Homo sapiens
acagcauaguggaagauua

SEQ ID NO: 1315967 - RNA, 19 nt, Homo sapiens
cacaagcuauuacugacuu

SEQ ID NO: 1315968 - RNA, 19 nt, Homo sapiens
caacggugcucaacaugcu

SEQ ID NO: 1315969 - RNA, 19 nt, Homo sapiens
caaccuugaguguaacuuu

SEQ ID NO: 1315970 - RNA, 19 nt, Homo sapiens
gcaugauuguggcuuacuu

SEQ ID NO: 1315971 - RNA, 19 nt, Homo sapiens
ggucaguugcuccgauuaa

SEQ ID NO: 1315972 - RNA, 19 nt, Homo sapiens
aaauauggcucuggauagu

SEQ ID NO: 1315973 - RNA, 19 nt, Homo sapiens
caaauauggcucuggauag

SEQ ID NO: 1315974 - RNA, 19 nt, Homo sapiens
caucccaccauuuacaaua

SEQ ID NO: 1315975 - RNA, 19 nt, Homo sapiens
aagaaaaucuccaucagaa

SEQ ID NO: 1315976 - RNA, 19 nt, Homo sapiens
ggacuucucuauauagcua

SEQ ID NO: 1315977 - RNA, 19 nt, Homo sapiens
gcaauacacccagauguua

SEQ ID NO: 1315978 - RNA, 19 nt, Homo sapiens
gcacaacugcuuugaggua

SEQ ID NO: 1315979 - RNA, 19 nt, Homo sapiens
gcacuuccaugcccuucua

SEQ ID NO: 1315980 - RNA, 19 nt, Homo sapiens
ucagaucacuaauauggua

SEQ ID NO: 1315981 - RNA, 19 nt, Homo sapiens
gaucuggcaugcauauuug

SEQ ID NO: 1315982 - RNA, 19 nt, Homo sapiens
gcagaaguauuugauugaa

SEQ ID NO: 1315983 - RNA, 19 nt, Homo sapiens
gaaaauaugucagcucuug

SEQ ID NO: 1315984 - RNA, 19 nt, Homo sapiens
ccaccuggcuaauauauuc

SEQ ID NO: 1315985 - RNA, 19 nt, Homo sapiens
caaaucaacugacuguagu

SEQ ID NO: 1315986 - RNA, 19 nt, Homo sapiens
gcacacauagcuguuauuu

SEQ ID NO: 1315987 - RNA, 19 nt, Homo sapiens
gcacaggaauauggcauga

SEQ ID NO: 1315988 - RNA, 19 nt, Homo sapiens
gaaugacacuggcuuggau

SEQ ID NO: 1315989 - RNA, 19 nt, Homo sapiens
ucaacugacuguaguaaug

SEQ ID NO: 1315990 - RNA, 19 nt, Homo sapiens
ugaguaauauguagucaga

SEQ ID NO: 1315991 - RNA, 19 nt, Homo sapiens
gagcaaagcaccauucaag

SEQ ID NO: 1315992 - RNA, 19 nt, Homo sapiens
gaagaggcccguuaucauc

SEQ ID NO: 1315993 - RNA, 19 nt, Homo sapiens
caagaguuauuaagucuca

SEQ ID NO: 1315994 - RNA, 19 nt, Homo sapiens
ccaagaagcagaagccauu

SEQ ID NO: 1315995 - RNA, 19 nt, Homo sapiens
ggacagcauccaugagaaa

SEQ ID NO: 1315996 - RNA, 19 nt, Homo sapiens
cauccugacuucaaucuug

SEQ ID NO: 1315997 - RNA, 19 nt, Homo sapiens
gaaacacgaagaugcugua

SEQ ID NO: 1315998 - RNA, 19 nt, Homo sapiens
cggcagaaguauuugauug

SEQ ID NO: 1315999 - RNA, 19 nt, Homo sapiens
gaacaaucacuaucaaguc

SEQ ID NO: 1316000 - RNA, 19 nt, Homo sapiens
ggaccuggcagacacauug

SEQ ID NO: 1316001 - RNA, 19 nt, Homo sapiens
guaaugccacccacucuuu

SEQ ID NO: 1316002 - RNA, 19 nt, Homo sapiens
ggaugaagcccaagaagca

SEQ ID NO: 1316003 - RNA, 19 nt, Homo sapiens
ccagaaauaccucuuugaa

SEQ ID NO: 1316004 - RNA, 19 nt, Homo sapiens
ccugcacagucacuuauua

SEQ ID NO: 1316005 - RNA, 19 nt, Homo sapiens
aagcaccauucaagaguua

SEQ ID NO: 1316006 - RNA, 19 nt, Homo sapiens
gcaaagcaccauucaagag

SEQ ID NO: 1316007 - RNA, 19 nt, Homo sapiens
ccaaagaacaacagcuuga

SEQ ID NO: 1316008 - RNA, 19 nt, Homo sapiens
gcccagaaauaccucuuug

SEQ ID NO: 1316009 - RNA, 19 nt, Homo sapiens
gacuuuguaugacugagua

SEQ ID NO: 1316010 - RNA, 19 nt, Homo sapiens
gucaugaccuuuguacuug

SEQ ID NO: 1316011 - RNA, 19 nt, Homo sapiens
gaauucugcuacaccauag

SEQ ID NO: 1316012 - RNA, 19 nt, Homo sapiens
acacgaagaugcuguacca

SEQ ID NO: 1316013 - RNA, 19 nt, Homo sapiens
ugaauucugcuacaccaua

SEQ ID NO: 1316014 - RNA, 19 nt, Homo sapiens
ucugggacuucucuauaua

SEQ ID NO: 1316015 - RNA, 19 nt, Homo sapiens
aagaccaucccauuacuua

SEQ ID NO: 1316016 - RNA, 19 nt, Homo sapiens
cuucaaaggcacaggaaua

SEQ ID NO: 1316017 - RNA, 19 nt, Homo sapiens
uaagucucauuucaacuga

SEQ ID NO: 1316018 - RNA, 19 nt, Homo sapiens
caaaggcacaggaauaugg

SEQ ID NO: 1316019 - RNA, 19 nt, Homo sapiens
gcaugcauauuugaacaau

SEQ ID NO: 1316020 - RNA, 19 nt, Homo sapiens
gaccuuuguacuugauuua

SEQ ID NO: 1316021 - RNA, 19 nt, Homo sapiens
gaagaccaucccauuacuu

SEQ ID NO: 1316022 - RNA, 19 nt, Homo sapiens
gaaucuacaucugacaaag

SEQ ID NO: 1316023 - RNA, 19 nt, Homo sapiens
ucccuucgcuuccguguga

SEQ ID NO: 1316024 - RNA, 19 nt, Homo sapiens
cagaggacauuaggacuuc

SEQ ID NO: 1316025 - RNA, 19 nt, Homo sapiens
uaaugccacccacucuuua

SEQ ID NO: 1316026 - RNA, 19 nt, Homo sapiens
ucaaaucaacugacuguag

SEQ ID NO: 1316027 - RNA, 19 nt, Homo sapiens
uccaugcccuucuacaauu

SEQ ID NO: 1316028 - RNA, 19 nt, Homo sapiens
gggacagcauccaugagaa

SEQ ID NO: 1316029 - RNA, 19 nt, Homo sapiens
caaagcaccauucaagagu

SEQ ID NO: 1316030 - RNA, 19 nt, Homo sapiens
uuuacuaccugaugaugaa

SEQ ID NO: 1316031 - RNA, 19 nt, Homo sapiens
gagaaucuacaucugacaa

SEQ ID NO: 1316032 - RNA, 19 nt, Homo sapiens
ggauuuacugggcaaacua

SEQ ID NO: 1316033 - RNA, 19 nt, Homo sapiens
gcucacauccaacaaaugg

SEQ ID NO: 1316034 - RNA, 19 nt, Homo sapiens
ugaccuuuguacuugauuu

SEQ ID NO: 1316035 - RNA, 19 nt, Homo sapiens
aaagcaccauucaagaguu

SEQ ID NO: 1316036 - RNA, 19 nt, Homo sapiens
aaucugggacuucucuaua

SEQ ID NO: 1316037 - RNA, 19 nt, Homo sapiens
cagcauccaugagaaaaua

SEQ ID NO: 1316038 - RNA, 19 nt, Homo sapiens
gaaucugggacuucucuau

SEQ ID NO: 1316039 - RNA, 19 nt, Homo sapiens
gaagggaaacacgaagaug

SEQ ID NO: 1316040 - RNA, 19 nt, Homo sapiens
ggcagaaguauuugauuga

SEQ ID NO: 1316041 - RNA, 19 nt, Homo sapiens
acuguagacugcugaaguu

SEQ ID NO: 1316042 - RNA, 19 nt, Homo sapiens
caccauagcccagaaauac

SEQ ID NO: 1316043 - RNA, 19 nt, Homo sapiens
ugucaugaccuuuguacuu

SEQ ID NO: 1316044 - RNA, 19 nt, Homo sapiens
gaagauccuggucaugcuu

SEQ ID NO: 1316045 - RNA, 19 nt, Homo sapiens
gcaccaugaaugugaucua

SEQ ID NO: 1316046 - RNA, 19 nt, Homo sapiens
aguaauauguagucagauc

SEQ ID NO: 1316047 - RNA, 19 nt, Homo sapiens
ucugagaucuggcaugcau

SEQ ID NO: 1316048 - RNA, 19 nt, Homo sapiens
uagagcuugugccugcuua

SEQ ID NO: 1316049 - RNA, 19 nt, Homo sapiens
caacugcuuugagguacug

SEQ ID NO: 1316050 - RNA, 19 nt, Homo sapiens
cccaugagcucugcaucaa

SEQ ID NO: 1316051 - RNA, 19 nt, Homo sapiens
gaccaucccauuacuuagu

SEQ ID NO: 1316052 - RNA, 19 nt, Homo sapiens
acugaagaccaucccauua

SEQ ID NO: 1316053 - RNA, 19 nt, Homo sapiens
gacacuggcuuggaugaag

SEQ ID NO: 1316054 - RNA, 19 nt, Homo sapiens
cuucuacaauucagaggaa

SEQ ID NO: 1316055 - RNA, 19 nt, Homo sapiens
uuauuacuguggcguggua

SEQ ID NO: 1316056 - RNA, 19 nt, Homo sapiens
gcaccauucaagaguuauu

SEQ ID NO: 1316057 - RNA, 19 nt, Homo sapiens
cacagcauauuaagggaau

SEQ ID NO: 1316058 - RNA, 19 nt, Homo sapiens
guagacugcugaaguuucc

SEQ ID NO: 1316059 - RNA, 19 nt, Homo sapiens
ugaagaccaucccauuacu

SEQ ID NO: 1316060 - RNA, 19 nt, Homo sapiens
ccgugggacuuguggguuu

SEQ ID NO: 1316061 - RNA, 19 nt, Homo sapiens
agaucuggcaugcauauuu

SEQ ID NO: 1316062 - RNA, 19 nt, Homo sapiens
ugaagaggcccguuaucau

SEQ ID NO: 1316063 - RNA, 19 nt, Homo sapiens
ugaacaaucacuaucaagu

SEQ ID NO: 1316064 - RNA, 19 nt, Homo sapiens
caucuggccaaugauauuu

SEQ ID NO: 1316065 - RNA, 19 nt, Homo sapiens
cagaaauaccucuuugaag

SEQ ID NO: 1316066 - RNA, 19 nt, Homo sapiens
cagcagcggcagaaguauu

SEQ ID NO: 1316067 - RNA, 19 nt, Homo sapiens
agucagaucacuaauaugg

SEQ ID NO: 1316068 - RNA, 19 nt, Homo sapiens
ucaugaccuuuguacuuga

SEQ ID NO: 1316069 - RNA, 19 nt, Homo sapiens
caauacacccagauguuag

SEQ ID NO: 1316070 - RNA, 19 nt, Homo sapiens
caccauucaagaguuauua

SEQ ID NO: 1316071 - RNA, 19 nt, Homo sapiens
acugcuggcugcaccauga

SEQ ID NO: 1316072 - RNA, 19 nt, Homo sapiens
uugaaaugcuggcaaguac

SEQ ID NO: 1316073 - RNA, 19 nt, Homo sapiens
ccucaaaucaacugacugu

SEQ ID NO: 1316074 - RNA, 19 nt, Homo sapiens
guaauauguagucagauca

SEQ ID NO: 1316075 - RNA, 19 nt, Homo sapiens
aaagaacaacagcuugaug

SEQ ID NO: 1316076 - RNA, 19 nt, Homo sapiens
gcucauggcuggauaauuu

SEQ ID NO: 1316077 - RNA, 19 nt, Homo sapiens
uaacaagaaucgccuuuaa

SEQ ID NO: 1316078 - RNA, 19 nt, Homo sapiens
gaagauaccagaucaugaa

SEQ ID NO: 1316079 - RNA, 19 nt, Homo sapiens
cgagagagauucagagaug

SEQ ID NO: 1316080 - RNA, 19 nt, Homo sapiens
caacggaccuggacguaga

SEQ ID NO: 1316081 - RNA, 19 nt, Homo sapiens
gauaaccaccuucauguuu

SEQ ID NO: 1316082 - RNA, 19 nt, Homo sapiens
ggacguaagcgggacauua

SEQ ID NO: 1316083 - RNA, 19 nt, Homo sapiens
ggacguguaucugguagaa

SEQ ID NO: 1316084 - RNA, 19 nt, Homo sapiens
gauaccagaucaugaagga

SEQ ID NO: 1316085 - RNA, 19 nt, Homo sapiens
caacaacgucgaucauuug

SEQ ID NO: 1316086 - RNA, 19 nt, Homo sapiens
acaacaacgucgaucauuu

SEQ ID NO: 1316087 - RNA, 19 nt, Homo sapiens
gaagucaucugagcacauc

SEQ ID NO: 1316088 - RNA, 19 nt, Homo sapiens
ggacaagaaagaucuaugu

SEQ ID NO: 1316089 - RNA, 19 nt, Homo sapiens
gacguaagcgggacauuaa

SEQ ID NO: 1316090 - RNA, 19 nt, Homo sapiens
gagugcagcucgagagaga

SEQ ID NO: 1316091 - RNA, 19 nt, Homo sapiens
gcagcucuguggacucaaa

SEQ ID NO: 1316092 - RNA, 19 nt, Homo sapiens
ucaaacucauggaaggaua

SEQ ID NO: 1316093 - RNA, 19 nt, Homo sapiens
caucuuagggccucuauga

SEQ ID NO: 1316094 - RNA, 19 nt, Homo sapiens
ggaagauaccagaucauga

SEQ ID NO: 1316095 - RNA, 19 nt, Homo sapiens
gaaacuaacaagaaagaag

SEQ ID NO: 1316096 - RNA, 19 nt, Homo sapiens
gcaaguggguggauaugcu

SEQ ID NO: 1316097 - RNA, 19 nt, Homo sapiens
cagaagcgccucacgaaga

SEQ ID NO: 1316098 - RNA, 19 nt, Homo sapiens
ggacauuaaggaagcauau

SEQ ID NO: 1316099 - RNA, 19 nt, Homo sapiens
gagcgagaggacaucauua

SEQ ID NO: 1316100 - RNA, 19 nt, Homo sapiens
gcccuugguuccgccauua

SEQ ID NO: 1316101 - RNA, 19 nt, Homo sapiens
gagccugccuuuguacuuc

SEQ ID NO: 1316102 - RNA, 19 nt, Homo sapiens
ggauaaccaccuucauguu

SEQ ID NO: 1316103 - RNA, 19 nt, Homo sapiens
gauaacaagaaucgccuuu

SEQ ID NO: 1316104 - RNA, 19 nt, Homo sapiens
ucuguggacucaaagguuu

SEQ ID NO: 1316105 - RNA, 19 nt, Homo sapiens
cugaggaaaugaaguugaa

SEQ ID NO: 1316106 - RNA, 19 nt, Homo sapiens
acaagggaaugcccaugaa

SEQ ID NO: 1316107 - RNA, 19 nt, Homo sapiens
gaagaaacuaacaagaaag

SEQ ID NO: 1316108 - RNA, 19 nt, Homo sapiens
gcgcugaugccgauaacaa

SEQ ID NO: 1316109 - RNA, 19 nt, Homo sapiens
ccugaacacugaggaaaug

SEQ ID NO: 1316110 - RNA, 19 nt, Homo sapiens
cgaccaucguucugaauuc

SEQ ID NO: 1316111 - RNA, 19 nt, Homo sapiens
gaacacugaggaaaugaag

SEQ ID NO: 1316112 - RNA, 19 nt, Homo sapiens
guacuucaaacucauggaa

SEQ ID NO: 1316113 - RNA, 19 nt, Homo sapiens
cuucagagcuagggacgaa

SEQ ID NO: 1316114 - RNA, 19 nt, Homo sapiens
cuuagggccucuaugaaga

SEQ ID NO: 1316115 - RNA, 19 nt, Homo sapiens
caaacucauggaaggauaa

SEQ ID NO: 1316116 - RNA, 19 nt, Homo sapiens
ccaucguucugaauucuga

SEQ ID NO: 1316117 - RNA, 19 nt, Homo sapiens
caacaacaacgucgaucau

SEQ ID NO: 1316118 - RNA, 19 nt, Homo sapiens
uuucgaagcuacaacaaca

SEQ ID NO: 1316119 - RNA, 19 nt, Homo sapiens
cauuaugauuucagacaga

SEQ ID NO: 1316120 - RNA, 19 nt, Homo sapiens
ccaacaggagcauguggua

SEQ ID NO: 1316121 - RNA, 19 nt, Homo sapiens
acacugaggaaaugaaguu

SEQ ID NO: 1316122 - RNA, 19 nt, Homo sapiens
cagcagaaagcucauagau

SEQ ID NO: 1316123 - RNA, 19 nt, Homo sapiens
ccgugagccugccuuugua

SEQ ID NO: 1316124 - RNA, 19 nt, Homo sapiens
gaccaucguucugaauucu

SEQ ID NO: 1316125 - RNA, 19 nt, Homo sapiens
gacauuaaggaagcauaua

SEQ ID NO: 1316126 - RNA, 19 nt, Homo sapiens
gagacugggagaaauacaa

SEQ ID NO: 1316127 - RNA, 19 nt, Homo sapiens
guuccgccauuaugauuuc

SEQ ID NO: 1316128 - RNA, 19 nt, Homo sapiens
ggagaagggcaagaaguca

SEQ ID NO: 1316129 - RNA, 19 nt, Homo sapiens
ugaaggagaagggcaagaa

SEQ ID NO: 1316130 - RNA, 19 nt, Homo sapiens
gcgagaggacaucauuaug

SEQ ID NO: 1316131 - RNA, 19 nt, Homo sapiens
aagcuucgcauccucguuu

SEQ ID NO: 1316132 - RNA, 19 nt, Homo sapiens
cuuggaaaguucucaguuc

SEQ ID NO: 1316133 - RNA, 19 nt, Homo sapiens
gaaccaagcagcgggaacu

SEQ ID NO: 1316134 - RNA, 19 nt, Homo sapiens
guaagcgggacauuaagga

SEQ ID NO: 1316135 - RNA, 19 nt, Homo sapiens
gcugggagacugggagaaa

SEQ ID NO: 1316136 - RNA, 19 nt, Homo sapiens
cgggagaucagccgaaaga

SEQ ID NO: 1316137 - RNA, 19 nt, Homo sapiens
ggcgggagaucagccgaaa

SEQ ID NO: 1316138 - RNA, 19 nt, Homo sapiens
gcaguuggugggcacaaga

SEQ ID NO: 1316139 - RNA, 19 nt, Homo sapiens
gacaagaaagaucuaugug

SEQ ID NO: 1316140 - RNA, 19 nt, Homo sapiens
ggcaucaggacaagaaaga

SEQ ID NO: 1316141 - RNA, 19 nt, Homo sapiens
gaaggagaagggcaagaag

SEQ ID NO: 1316142 - RNA, 19 nt, Homo sapiens
gcgggaagacccucugcaa

SEQ ID NO: 1316143 - RNA, 19 nt, Homo sapiens
gggccucuaugaagaaacu

SEQ ID NO: 1316144 - RNA, 19 nt, Homo sapiens
aagagcaaguggguggaua

SEQ ID NO: 1316145 - RNA, 19 nt, Homo sapiens
gaagcuacaacaacaacgu

SEQ ID NO: 1316146 - RNA, 19 nt, Homo sapiens
gagauucagagauggaaca

SEQ ID NO: 1316147 - RNA, 19 nt, Homo sapiens
gcugaugccgauaacaaga

SEQ ID NO: 1316148 - RNA, 19 nt, Homo sapiens
agacugggagaaauacaaa

SEQ ID NO: 1316149 - RNA, 19 nt, Homo sapiens
ugggagacugggagaaaua

SEQ ID NO: 1316150 - RNA, 19 nt, Homo sapiens
gugcagcucgagagagauu

SEQ ID NO: 1316151 - RNA, 19 nt, Homo sapiens
gagaagggcaagaagucau

SEQ ID NO: 1316152 - RNA, 19 nt, Homo sapiens
uacaagggaaugcccauga

SEQ ID NO: 1316153 - RNA, 19 nt, Homo sapiens
ucauagaucgagcguacaa

SEQ ID NO: 1316154 - RNA, 19 nt, Homo sapiens
auaacaagaaucgccuuua

SEQ ID NO: 1316155 - RNA, 19 nt, Homo sapiens
cccggaagauaccagauca

SEQ ID NO: 1316156 - RNA, 19 nt, Homo sapiens
gcagcagaaagcucauaga

SEQ ID NO: 1316157 - RNA, 19 nt, Homo sapiens
uggcauaugaggaguacaa

SEQ ID NO: 1316158 - RNA, 19 nt, Homo sapiens
gagcaaguggguggauaug

SEQ ID NO: 1316159 - RNA, 19 nt, Homo sapiens
gccauuaugauuucagaca

SEQ ID NO: 1316160 - RNA, 19 nt, Homo sapiens
ucauccggauauugauuga

SEQ ID NO: 1316161 - RNA, 19 nt, Homo sapiens
caucaggacaagaaagauc

SEQ ID NO: 1316162 - RNA, 19 nt, Homo sapiens
uaagcgggacauuaaggaa

SEQ ID NO: 1316163 - RNA, 19 nt, Homo sapiens
gacccaggccagcugauuc

SEQ ID NO: 1316164 - RNA, 19 nt, Homo sapiens
cggaagauaccagaucaug

SEQ ID NO: 1316165 - RNA, 19 nt, Homo sapiens
agagcgagaggacaucauu

SEQ ID NO: 1316166 - RNA, 19 nt, Homo sapiens
gagagauucagagauggaa

SEQ ID NO: 1316167 - RNA, 19 nt, Homo sapiens
ugaugccgauaacaagaau

SEQ ID NO: 1316168 - RNA, 19 nt, Homo sapiens
ccacauccuccuggcauau

SEQ ID NO: 1316169 - RNA, 19 nt, Homo sapiens
ggcccuugguuccgccauu

SEQ ID NO: 1316170 - RNA, 19 nt, Homo sapiens
ccagggaugaggacacugu

SEQ ID NO: 1316171 - RNA, 19 nt, Homo sapiens
agaagcgccucacgaagac

SEQ ID NO: 1316172 - RNA, 19 nt, Homo sapiens
uaaccaccuucauguuuug

SEQ ID NO: 1316173 - RNA, 19 nt, Homo sapiens
gcagcucgagagagauuca

SEQ ID NO: 1316174 - RNA, 19 nt, Homo sapiens
ccgccauuaugauuucaga

SEQ ID NO: 1316175 - RNA, 19 nt, Homo sapiens
ccacgggcaccucguucuu

SEQ ID NO: 1316176 - RNA, 19 nt, Homo sapiens
gagaagaugucccguguga

SEQ ID NO: 1316177 - RNA, 19 nt, Homo sapiens
ggacacagcugagcguuau

SEQ ID NO: 1316178 - RNA, 19 nt, Homo sapiens
gaacacaagcgcacgguaa

SEQ ID NO: 1316179 - RNA, 19 nt, Homo sapiens
ccaaggagaugcacugugu

SEQ ID NO: 1316180 - RNA, 19 nt, Homo sapiens
cgacguaccugccgacuac

SEQ ID NO: 1316181 - RNA, 19 nt, Homo sapiens
ggacaaccgugcgcuuuua

SEQ ID NO: 1316182 - RNA, 19 nt, Homo sapiens
gguggaaggucugaacuga

SEQ ID NO: 1316183 - RNA, 19 nt, Homo sapiens
gacagacuccagugaauuu

SEQ ID NO: 1316184 - RNA, 19 nt, Homo sapiens
gugaaggucugggacauga

SEQ ID NO: 1316185 - RNA, 19 nt, Homo sapiens
gcgacaugcugcacuucua

SEQ ID NO: 1316186 - RNA, 19 nt, Homo sapiens
uggaaggucugaacugaug

SEQ ID NO: 1316187 - RNA, 19 nt, Homo sapiens
caaugaggauaacgaggaa

SEQ ID NO: 1316188 - RNA, 19 nt, Homo sapiens
gcgacaagauggugaaggu

SEQ ID NO: 1316189 - RNA, 19 nt, Homo sapiens
gugaugggcuggacugaca

SEQ ID NO: 1316190 - RNA, 19 nt, Homo sapiens
caggagcacugguacacuu

SEQ ID NO: 1316191 - RNA, 19 nt, Homo sapiens
cgugccagcugccauguuu

SEQ ID NO: 1316192 - RNA, 19 nt, Homo sapiens
aauuugagcuugccuguca

SEQ ID NO: 1316193 - RNA, 19 nt, Homo sapiens
gcuuugaccuccgcagaaa

SEQ ID NO: 1316194 - RNA, 19 nt, Homo sapiens
gauagacagcccuggauug

SEQ ID NO: 1316195 - RNA, 19 nt, Homo sapiens
gcaaccagguggcgcaaac

SEQ ID NO: 1316196 - RNA, 19 nt, Homo sapiens
gugcagccauggagaagau

SEQ ID NO: 1316197 - RNA, 19 nt, Homo sapiens
ggaaggcagcucccacugu

SEQ ID NO: 1316198 - RNA, 19 nt, Homo sapiens
ccaacgagguggucaagcu

SEQ ID NO: 1316199 - RNA, 19 nt, Homo sapiens
ggcaccagauggaugagaa

SEQ ID NO: 1316200 - RNA, 19 nt, Homo sapiens
gaaacugacaggccuaagg

SEQ ID NO: 1316201 - RNA, 19 nt, Homo sapiens
caccuucgccuccaccuuu

SEQ ID NO: 1316202 - RNA, 19 nt, Homo sapiens
caagcgcacgguaaacaaa

SEQ ID NO: 1316203 - RNA, 19 nt, Homo sapiens
ccaccacccugcacgucaa

SEQ ID NO: 1316204 - RNA, 19 nt, Homo sapiens
guggaagucagacaugaaa

SEQ ID NO: 1316205 - RNA, 19 nt, Homo sapiens
ccgagcaccugcaggacaa

SEQ ID NO: 1316206 - RNA, 19 nt, Homo sapiens
accucgagcuccuuaagua

SEQ ID NO: 1316207 - RNA, 19 nt, Homo sapiens
uggauuggcucacuaagac

SEQ ID NO: 1316208 - RNA, 19 nt, Homo sapiens
ugacagacuccagugaauu

SEQ ID NO: 1316209 - RNA, 19 nt, Homo sapiens
ccacagcagccaccaaugg

SEQ ID NO: 1316210 - RNA, 19 nt, Homo sapiens
gaagucagacaugaaacug

SEQ ID NO: 1316211 - RNA, 19 nt, Homo sapiens
ggaagucagacaugaaacu

SEQ ID NO: 1316212 - RNA, 19 nt, Homo sapiens
gcccuggauuggcucacua

SEQ ID NO: 1316213 - RNA, 19 nt, Homo sapiens
gugaggaggacgagcugua

SEQ ID NO: 1316214 - RNA, 19 nt, Homo sapiens
ggaccaugcugcggaucau

SEQ ID NO: 1316215 - RNA, 19 nt, Homo sapiens
agacaccucgagcuccuua

SEQ ID NO: 1316216 - RNA, 19 nt, Homo sapiens
gggaauguccagcuagagu

SEQ ID NO: 1316217 - RNA, 19 nt, Homo sapiens
gaccgagcguuuagugacu

SEQ ID NO: 1316218 - RNA, 19 nt, Homo sapiens
gccaaugccaucagugugu

SEQ ID NO: 1316219 - RNA, 19 nt, Homo sapiens
ccgggaauguccagcuaga

SEQ ID NO: 1316220 - RNA, 19 nt, Homo sapiens
gugaacgggugcgcaagga

SEQ ID NO: 1316221 - RNA, 19 nt, Homo sapiens
cggccacacucaucaccaa

SEQ ID NO: 1316222 - RNA, 19 nt, Homo sapiens
ggacgugcaguucaguauc

SEQ ID NO: 1316223 - RNA, 19 nt, Homo sapiens
uaaacaaagucugcuucca

SEQ ID NO: 1316224 - RNA, 19 nt, Homo sapiens
ugacugaccgagcguuuag

SEQ ID NO: 1316225 - RNA, 19 nt, Homo sapiens
ccagugcccucagugucuu

SEQ ID NO: 1316226 - RNA, 19 nt, Homo sapiens
uuuagugacugcccagauc

SEQ ID NO: 1316227 - RNA, 19 nt, Homo sapiens
ggccacagcagccaccaau

SEQ ID NO: 1316228 - RNA, 19 nt, Homo sapiens
ggcaggccguagcaucuuc

SEQ ID NO: 1316229 - RNA, 19 nt, Homo sapiens
cugacagacuccagugaau

SEQ ID NO: 1316230 - RNA, 19 nt, Homo sapiens
cugguacacuuccuacauc

SEQ ID NO: 1316231 - RNA, 19 nt, Homo sapiens
gggacgugcaguucaguau

SEQ ID NO: 1316232 - RNA, 19 nt, Homo sapiens
gcugauuggcugauagaca

SEQ ID NO: 1316233 - RNA, 19 nt, Homo sapiens
gaauguccagcuagagucu

SEQ ID NO: 1316234 - RNA, 19 nt, Homo sapiens
uaaguagcucgguccuuga

SEQ ID NO: 1316235 - RNA, 19 nt, Homo sapiens
caaccgugcgcuuuuagua

SEQ ID NO: 1316236 - RNA, 19 nt, Homo sapiens
ugauagacagcccuggauu

SEQ ID NO: 1316237 - RNA, 19 nt, Homo sapiens
ugcagcacaucaugaagug

SEQ ID NO: 1316238 - RNA, 19 nt, Homo sapiens
ccuucucgcuccugucugu

SEQ ID NO: 1316239 - RNA, 19 nt, Homo sapiens
ccugcugggugacguggaa

SEQ ID NO: 1316240 - RNA, 19 nt, Homo sapiens
ccguggaagucagacauga

SEQ ID NO: 1316241 - RNA, 19 nt, Homo sapiens
gacgugcaguucaguaucc

SEQ ID NO: 1316242 - RNA, 19 nt, Homo sapiens
ggaaggucugaacugauga

SEQ ID NO: 1316243 - RNA, 19 nt, Homo sapiens
gcucaguggcucccaggau

SEQ ID NO: 1316244 - RNA, 19 nt, Homo sapiens
gagcagaccuccaccaagu

SEQ ID NO: 1316245 - RNA, 19 nt, Homo sapiens
ucaaugagauccagagcuu

SEQ ID NO: 1316246 - RNA, 19 nt, Homo sapiens
acacugaguuccagauuuc

SEQ ID NO: 1316247 - RNA, 19 nt, Homo sapiens
gagaugguccggccuaaga

SEQ ID NO: 1316248 - RNA, 19 nt, Homo sapiens
caagaaacaacacugaguu

SEQ ID NO: 1316249 - RNA, 19 nt, Homo sapiens
ggccuaagaagguguguuu

SEQ ID NO: 1316250 - RNA, 19 nt, Homo sapiens
ggaagguucacgaguguug

SEQ ID NO: 1316251 - RNA, 19 nt, Homo sapiens
caacacugaguuccagauu

SEQ ID NO: 1316252 - RNA, 19 nt, Homo sapiens
gaaacaacacugaguucca

SEQ ID NO: 1316253 - RNA, 19 nt, Homo sapiens
ggagcuacuaccucaauga

SEQ ID NO: 1316254 - RNA, 19 nt, Homo sapiens
caucaacaccuacggaauc

SEQ ID NO: 1316255 - RNA, 19 nt, Homo sapiens
ugugcgagcucuccaagga

SEQ ID NO: 1316256 - RNA, 19 nt, Homo sapiens
gggagaugguccggccuaa

SEQ ID NO: 1316257 - RNA, 19 nt, Homo sapiens
ucagcgaguuccucaucaa

SEQ ID NO: 1316258 - RNA, 19 nt, Homo sapiens
ggaccaggaggagcuacua

SEQ ID NO: 1316259 - RNA, 19 nt, Homo sapiens
ccaagaaacaacacugagu

SEQ ID NO: 1316260 - RNA, 19 nt, Homo sapiens
aacacugaguuccagauuu

SEQ ID NO: 1316261 - RNA, 19 nt, Homo sapiens
cauccuggccuacguguuc

SEQ ID NO: 1316262 - RNA, 19 nt, Homo sapiens
aagacucacugguggacaa

SEQ ID NO: 1316263 - RNA, 19 nt, Homo sapiens
ccucccaacugcagacauc

SEQ ID NO: 1316264 - RNA, 19 nt, Homo sapiens
gcgaguuccucaucaacac

SEQ ID NO: 1316265 - RNA, 19 nt, Homo sapiens
ucggaagguucacgagugu

SEQ ID NO: 1316266 - RNA, 19 nt, Homo sapiens
uggagaagcugggcuacag

SEQ ID NO: 1316267 - RNA, 19 nt, Homo sapiens
gacccucggagccaagaaa

SEQ ID NO: 1316268 - RNA, 19 nt, Homo sapiens
cuucaaggccuuccucagu

SEQ ID NO: 1316269 - RNA, 19 nt, Homo sapiens
cgccuugccugcaguaaac

SEQ ID NO: 1316270 - RNA, 19 nt, Homo sapiens
ccucggagccaagaaacaa

SEQ ID NO: 1316271 - RNA, 19 nt, Homo sapiens
guucagcgaguuccucauc

SEQ ID NO: 1316272 - RNA, 19 nt, Homo sapiens
ccagauuucggaagguuca

SEQ ID NO: 1316273 - RNA, 19 nt, Homo sapiens
ggaucuugcucauguauuu

SEQ ID NO: 1316274 - RNA, 19 nt, Homo sapiens
ggauuucuguuucccuuua

SEQ ID NO: 1316275 - RNA, 19 nt, Homo sapiens
cacaagagaucgaucaguu

SEQ ID NO: 1316276 - RNA, 19 nt, Homo sapiens
ggaccugccucuaaaauaa

SEQ ID NO: 1316277 - RNA, 19 nt, Homo sapiens
gcucuaggcauaccacaua

SEQ ID NO: 1316278 - RNA, 19 nt, Homo sapiens
gcauccaaguucauaauug

SEQ ID NO: 1316279 - RNA, 19 nt, Homo sapiens
gcaacucgcagcccaauug

SEQ ID NO: 1316280 - RNA, 19 nt, Homo sapiens
gcagaaggauaaccgagau

SEQ ID NO: 1316281 - RNA, 19 nt, Homo sapiens
gaacaacacugauuuucug

SEQ ID NO: 1316282 - RNA, 19 nt, Homo sapiens
uuacggaucuugcucaugu

SEQ ID NO: 1316283 - RNA, 19 nt, Homo sapiens
caacuugccugcauuuggu

SEQ ID NO: 1316284 - RNA, 19 nt, Homo sapiens
gaguuuaccuacagucuca

SEQ ID NO: 1316285 - RNA, 19 nt, Homo sapiens
guggaguucuucccuguuu

SEQ ID NO: 1316286 - RNA, 19 nt, Homo sapiens
gggaaccaaucuucaacuu

SEQ ID NO: 1316287 - RNA, 19 nt, Homo sapiens
caagagaucgaucaguuug

SEQ ID NO: 1316288 - RNA, 19 nt, Homo sapiens
cauccaaguucauaauugu

SEQ ID NO: 1316289 - RNA, 19 nt, Homo sapiens
ggaagcaggagcuagagaa

SEQ ID NO: 1316290 - RNA, 19 nt, Homo sapiens
ccacuucagcgaaccauuu

SEQ ID NO: 1316291 - RNA, 19 nt, Homo sapiens
gaacugcagagccagaaga

SEQ ID NO: 1316292 - RNA, 19 nt, Homo sapiens
ggacaaauaaaggcagauu

SEQ ID NO: 1316293 - RNA, 19 nt, Homo sapiens
ggacaaguugggaggcuaa

SEQ ID NO: 1316294 - RNA, 19 nt, Homo sapiens
cuaggcauaccacauaaua

SEQ ID NO: 1316295 - RNA, 19 nt, Homo sapiens
auaaacuccucaagggaua

SEQ ID NO: 1316296 - RNA, 19 nt, Homo sapiens
uggugacgcugcagaauga

SEQ ID NO: 1316297 - RNA, 19 nt, Homo sapiens
cauaauacccaagcacauu

SEQ ID NO: 1316298 - RNA, 19 nt, Homo sapiens
gcaaugaaagagcuuaucu

SEQ ID NO: 1316299 - RNA, 19 nt, Homo sapiens
ggaaccaaucuucaacuug

SEQ ID NO: 1316300 - RNA, 19 nt, Homo sapiens
ggacgaguuuaccuacagu

SEQ ID NO: 1316301 - RNA, 19 nt, Homo sapiens
ggacuugaagcccgguaaa

SEQ ID NO: 1316302 - RNA, 19 nt, Homo sapiens
gccccuagcucuucuacua

SEQ ID NO: 1316303 - RNA, 19 nt, Homo sapiens
ccagggcaccggcuuuauu

SEQ ID NO: 1316304 - RNA, 19 nt, Homo sapiens
cagggcaccggcuuuauuu

SEQ ID NO: 1316305 - RNA, 19 nt, Homo sapiens
gcaccgagucgcucaugga

SEQ ID NO: 1316306 - RNA, 19 nt, Homo sapiens
gaagagcacggagcagcaa

SEQ ID NO: 1316307 - RNA, 19 nt, Homo sapiens
gcgaaccauuuagugugua

SEQ ID NO: 1316308 - RNA, 19 nt, Homo sapiens
caacacugauuuucugaug

SEQ ID NO: 1316309 - RNA, 19 nt, Homo sapiens
ugaugaacaacacugauuu

SEQ ID NO: 1316310 - RNA, 19 nt, Homo sapiens
acaagagaucgaucaguuu

SEQ ID NO: 1316311 - RNA, 19 nt, Homo sapiens
uuacggcucuuugacacaa

SEQ ID NO: 1316312 - RNA, 19 nt, Homo sapiens
uugccugcauuugguauua

SEQ ID NO: 1316313 - RNA, 19 nt, Homo sapiens
ggaguucuucccuguuugu

SEQ ID NO: 1316314 - RNA, 19 nt, Homo sapiens
gaagcaggagcuagagaag

SEQ ID NO: 1316315 - RNA, 19 nt, Homo sapiens
guguaguggguuuaaauuu

SEQ ID NO: 1316316 - RNA, 19 nt, Homo sapiens
ccuacagucucaccaagca

SEQ ID NO: 1316317 - RNA, 19 nt, Homo sapiens
cgaaccauuuaguguguag

SEQ ID NO: 1316318 - RNA, 19 nt, Homo sapiens
cacuucagcgaaccauuua

SEQ ID NO: 1316319 - RNA, 19 nt, Homo sapiens
auaauacccaagcacauuu

SEQ ID NO: 1316320 - RNA, 19 nt, Homo sapiens
agugauggacuaaguguga

SEQ ID NO: 1316321 - RNA, 19 nt, Homo sapiens
agagaucgaucaguuugca

SEQ ID NO: 1316322 - RNA, 19 nt, Homo sapiens
guaacuggacaaauaaagg

SEQ ID NO: 1316323 - RNA, 19 nt, Homo sapiens
uuccauggauuucuguuuc

SEQ ID NO: 1316324 - RNA, 19 nt, Homo sapiens
ucuguuucccuuuagauuu

SEQ ID NO: 1316325 - RNA, 19 nt, Homo sapiens
ggagcuggcggagaccaaa

SEQ ID NO: 1316326 - RNA, 19 nt, Homo sapiens
gaaggauaaccgagauggu

SEQ ID NO: 1316327 - RNA, 19 nt, Homo sapiens
gaugaacaacacugauuuu

SEQ ID NO: 1316328 - RNA, 19 nt, Homo sapiens
uuuaguguguaguggguuu

SEQ ID NO: 1316329 - RNA, 19 nt, Homo sapiens
ucagcgaaccauuuagugu

SEQ ID NO: 1316330 - RNA, 19 nt, Homo sapiens
gauuucuguuucccuuuag

SEQ ID NO: 1316331 - RNA, 19 nt, Homo sapiens
acacugauuuucugauguu

SEQ ID NO: 1316332 - RNA, 19 nt, Homo sapiens
gcucuggacggugcuguug

SEQ ID NO: 1316333 - RNA, 19 nt, Homo sapiens
uggcuacuguaaccacuuc

SEQ ID NO: 1316334 - RNA, 19 nt, Homo sapiens
aaaggcagauuuuaaaagg

SEQ ID NO: 1316335 - RNA, 19 nt, Homo sapiens
ucuggacggugcuguugga

SEQ ID NO: 1316336 - RNA, 19 nt, Homo sapiens
guccauaugaugaacaaca

SEQ ID NO: 1316337 - RNA, 19 nt, Homo sapiens
ggaaggacuuggagaguua

SEQ ID NO: 1316338 - RNA, 19 nt, Homo sapiens
uaacgaagcuacagaagaa

SEQ ID NO: 1316339 - RNA, 19 nt, Homo sapiens
gaacgaaucuagacaaacu

SEQ ID NO: 1316340 - RNA, 19 nt, Homo sapiens
gcagagaaaugaaucuaga

SEQ ID NO: 1316341 - RNA, 19 nt, Homo sapiens
caagaugccuaaagacaaa

SEQ ID NO: 1316342 - RNA, 19 nt, Homo sapiens
gaccagcucucuauucuga

SEQ ID NO: 1316343 - RNA, 19 nt, Homo sapiens
gaaggaauaccuaaagaaa

SEQ ID NO: 1316344 - RNA, 19 nt, Homo sapiens
ggagagaaauuggugguuu

SEQ ID NO: 1316345 - RNA, 19 nt, Homo sapiens
ggacccaacuugccagaaa

SEQ ID NO: 1316346 - RNA, 19 nt, Homo sapiens
caauuugucuguagugaaa

SEQ ID NO: 1316347 - RNA, 19 nt, Homo sapiens
ccaauggccucaacaauca

SEQ ID NO: 1316348 - RNA, 19 nt, Homo sapiens
acacagaaaugaaacagaa

SEQ ID NO: 1316349 - RNA, 19 nt, Homo sapiens
ggaauuaaagagcguuaua

SEQ ID NO: 1316350 - RNA, 19 nt, Homo sapiens
gaaaggagcagcagaaacu

SEQ ID NO: 1316351 - RNA, 19 nt, Homo sapiens
ucacuuugccuguuaauuu

SEQ ID NO: 1316352 - RNA, 19 nt, Homo sapiens
ggauuacaccauugacuua

SEQ ID NO: 1316353 - RNA, 19 nt, Homo sapiens
uggcaaagaugauaagaga

SEQ ID NO: 1316354 - RNA, 19 nt, Homo sapiens
ugaacuaaaugcucucaaa

SEQ ID NO: 1316355 - RNA, 19 nt, Homo sapiens
gauuucacuuugccuguua

SEQ ID NO: 1316356 - RNA, 19 nt, Homo sapiens
aagaagaagugaccaaguu

SEQ ID NO: 1316357 - RNA, 19 nt, Homo sapiens
cauugaagaucguauagaa

SEQ ID NO: 1316358 - RNA, 19 nt, Homo sapiens
gaacaggucaucauugaag

SEQ ID NO: 1316359 - RNA, 19 nt, Homo sapiens
caggaucucuuggaauuaa

SEQ ID NO: 1316360 - RNA, 19 nt, Homo sapiens
gaaauacgauaaggacaca

SEQ ID NO: 1316361 - RNA, 19 nt, Homo sapiens
gagaaucgcuacaugaaaa

SEQ ID NO: 1316362 - RNA, 19 nt, Homo sapiens
gaagaaggaauaccuaaag

SEQ ID NO: 1316363 - RNA, 19 nt, Homo sapiens
gaagaagaaggaauaccua

SEQ ID NO: 1316364 - RNA, 19 nt, Homo sapiens
gauuuaggauuacaccauu

SEQ ID NO: 1316365 - RNA, 19 nt, Homo sapiens
aaacccugauuuaggauua

SEQ ID NO: 1316366 - RNA, 19 nt, Homo sapiens
agaaaugaaucuagaagga

SEQ ID NO: 1316367 - RNA, 19 nt, Homo sapiens
gagauugaaauguuccuua

SEQ ID NO: 1316368 - RNA, 19 nt, Homo sapiens
ccugguaccucaaagauga

SEQ ID NO: 1316369 - RNA, 19 nt, Homo sapiens
caaguucucuuuuguguuu

SEQ ID NO: 1316370 - RNA, 19 nt, Homo sapiens
cacaaaggccagugacuua

SEQ ID NO: 1316371 - RNA, 19 nt, Homo sapiens
ggaagaagacagccuggaa

SEQ ID NO: 1316372 - RNA, 19 nt, Homo sapiens
gauaaggacacagaaauga

SEQ ID NO: 1316373 - RNA, 19 nt, Homo sapiens
acucaaaccuuccuccaaa

SEQ ID NO: 1316374 - RNA, 19 nt, Homo sapiens
caaagaugauaagagagua

SEQ ID NO: 1316375 - RNA, 19 nt, Homo sapiens
gcaaagaugauaagagagu

SEQ ID NO: 1316376 - RNA, 19 nt, Homo sapiens
cagaaugaguauauugcua

SEQ ID NO: 1316377 - RNA, 19 nt, Homo sapiens
gaaaugaaucuagaaggaa

SEQ ID NO: 1316378 - RNA, 19 nt, Homo sapiens
ccacagaccagcucucuau

SEQ ID NO: 1316379 - RNA, 19 nt, Homo sapiens
caacgggaauugaauaggu

SEQ ID NO: 1316380 - RNA, 19 nt, Homo sapiens
gcaaaaguauucaguagga

SEQ ID NO: 1316381 - RNA, 19 nt, Homo sapiens
aacaggaucucuuggaauu

SEQ ID NO: 1316382 - RNA, 19 nt, Homo sapiens
gggaaggacuuggagaguu

SEQ ID NO: 1316383 - RNA, 19 nt, Homo sapiens
ucacugagcuggaagucau

SEQ ID NO: 1316384 - RNA, 19 nt, Homo sapiens
ggauggagaaauacgauaa

SEQ ID NO: 1316385 - RNA, 19 nt, Homo sapiens
uuaaggaguugcaagauuc

SEQ ID NO: 1316386 - RNA, 19 nt, Homo sapiens
ggacuuggagaguuaagaa

SEQ ID NO: 1316387 - RNA, 19 nt, Homo sapiens
ggaguucacuggcuuagcu

SEQ ID NO: 1316388 - RNA, 19 nt, Homo sapiens
gaaaugaaacagaaugaac

SEQ ID NO: 1316389 - RNA, 19 nt, Homo sapiens
ggacucauacagagauuga

SEQ ID NO: 1316390 - RNA, 19 nt, Homo sapiens
ugcaagagaugaaggcaaa

SEQ ID NO: 1316391 - RNA, 19 nt, Homo sapiens
cagauaccauuaaggaguu

SEQ ID NO: 1316392 - RNA, 19 nt, Homo sapiens
gcaggaucuugucuucaaa

SEQ ID NO: 1316393 - RNA, 19 nt, Homo sapiens
gaaacagacauagaaauca

SEQ ID NO: 1316394 - RNA, 19 nt, Homo sapiens
cguagaagaagaaggaaua

SEQ ID NO: 1316395 - RNA, 19 nt, Homo sapiens
gaagccugauuucacuuug

SEQ ID NO: 1316396 - RNA, 19 nt, Homo sapiens
uggaagagauugagaaacu

SEQ ID NO: 1316397 - RNA, 19 nt, Homo sapiens
caacuugccagaaaucaga

SEQ ID NO: 1316398 - RNA, 19 nt, Homo sapiens
aggaauaccuaaagaaaca

SEQ ID NO: 1316399 - RNA, 19 nt, Homo sapiens
gauaagagaguaugaacag

SEQ ID NO: 1316400 - RNA, 19 nt, Homo sapiens
ggagaaucgcuacaugaaa

SEQ ID NO: 1316401 - RNA, 19 nt, Homo sapiens
acagaagaauggaagaaga

SEQ ID NO: 1316402 - RNA, 19 nt, Homo sapiens
ggaagccugauuucacuuu

SEQ ID NO: 1316403 - RNA, 19 nt, Homo sapiens
gaacuaaaugcucucaaag

SEQ ID NO: 1316404 - RNA, 19 nt, Homo sapiens
uaaggacacagaaaugaaa

SEQ ID NO: 1316405 - RNA, 19 nt, Homo sapiens
gaaacugagccgugaggaa

SEQ ID NO: 1316406 - RNA, 19 nt, Homo sapiens
gauaagaggagaggcaaga

SEQ ID NO: 1316407 - RNA, 19 nt, Homo sapiens
caaaguugauagcaaggau

SEQ ID NO: 1316408 - RNA, 19 nt, Homo sapiens
uaaagagcguuauaaagcu

SEQ ID NO: 1316409 - RNA, 19 nt, Homo sapiens
ggagcaagaagaagguaaa

SEQ ID NO: 1316410 - RNA, 19 nt, Homo sapiens
ugacuuagcacaccuucaa

SEQ ID NO: 1316411 - RNA, 19 nt, Homo sapiens
aagaaggaauaccuaaaga

SEQ ID NO: 1316412 - RNA, 19 nt, Homo sapiens
uagcuacagugacgcauug

SEQ ID NO: 1316413 - RNA, 19 nt, Homo sapiens
guuucaagaugccuaaaga

SEQ ID NO: 1316414 - RNA, 19 nt, Homo sapiens
gaagggagacagagcaucu

SEQ ID NO: 1316415 - RNA, 19 nt, Homo sapiens
gaauagguaacugcacuuu

SEQ ID NO: 1316416 - RNA, 19 nt, Homo sapiens
ggaauugaauagguaacug

SEQ ID NO: 1316417 - RNA, 19 nt, Homo sapiens
gcacuaugauacggagaga

SEQ ID NO: 1316418 - RNA, 19 nt, Homo sapiens
guaacgaagcuacagaaga

SEQ ID NO: 1316419 - RNA, 19 nt, Homo sapiens
uaacugcacuuuugugaga

SEQ ID NO: 1316420 - RNA, 19 nt, Homo sapiens
caguaggaauuacaauaug

SEQ ID NO: 1316421 - RNA, 19 nt, Homo sapiens
guauauugcuaaccucaag

SEQ ID NO: 1316422 - RNA, 19 nt, Homo sapiens
gcaaagagagggaaaacaa

SEQ ID NO: 1316423 - RNA, 19 nt, Homo sapiens
gaagacagccuggaagacu

SEQ ID NO: 1316424 - RNA, 19 nt, Homo sapiens
ugacucaucuacagguugu

SEQ ID NO: 1316425 - RNA, 19 nt, Homo sapiens
gaagugaccaaguucucuu

SEQ ID NO: 1316426 - RNA, 19 nt, Homo sapiens
aaagguaaaggcaaggaua

SEQ ID NO: 1316427 - RNA, 19 nt, Homo sapiens
uuacaacagucuccugcaa

SEQ ID NO: 1316428 - RNA, 19 nt, Homo sapiens
ccgguucgcuguggaguuu

SEQ ID NO: 1316429 - RNA, 19 nt, Homo sapiens
cagaccagcucucuauucu

SEQ ID NO: 1316430 - RNA, 19 nt, Homo sapiens
cuaaagaaacagacauaga

SEQ ID NO: 1316431 - RNA, 19 nt, Homo sapiens
gagcaaaaguauucaguag

SEQ ID NO: 1316432 - RNA, 19 nt, Homo sapiens
caucauugaagaucguaua

SEQ ID NO: 1316433 - RNA, 19 nt, Homo sapiens
cuacggagacacugaagaa

SEQ ID NO: 1316434 - RNA, 19 nt, Homo sapiens
cuacagugacgcauugaaa

SEQ ID NO: 1316435 - RNA, 19 nt, Homo sapiens
uuaaagagcguuauaaagc

SEQ ID NO: 1316436 - RNA, 19 nt, Homo sapiens
ucagauugauaggcaguuu

SEQ ID NO: 1316437 - RNA, 19 nt, Homo sapiens
gaaauuugcugccucaaug

SEQ ID NO: 1316438 - RNA, 19 nt, Homo sapiens
ggaugaagauguuaaaguu

SEQ ID NO: 1316439 - RNA, 19 nt, Homo sapiens
guagaaauguccuguauuc

SEQ ID NO: 1316440 - RNA, 19 nt, Homo sapiens
gggcauggcucuauuccua

SEQ ID NO: 1316441 - RNA, 19 nt, Homo sapiens
ucagaaaccucaaacagaa

SEQ ID NO: 1316442 - RNA, 19 nt, Homo sapiens
gcaaagaccucauaaaauc

SEQ ID NO: 1316443 - RNA, 19 nt, Homo sapiens
agagacaccuuacuuauga

SEQ ID NO: 1316444 - RNA, 19 nt, Homo sapiens
caaggucagugucaucuuu

SEQ ID NO: 1316445 - RNA, 19 nt, Homo sapiens
cggcuuggcucuugacaua

SEQ ID NO: 1316446 - RNA, 19 nt, Homo sapiens
agaaaugucuuguaacuca

SEQ ID NO: 1316447 - RNA, 19 nt, Homo sapiens
gagaugaacauucuagaaa

SEQ ID NO: 1316448 - RNA, 19 nt, Homo sapiens
gaaggcaaauccuguuuag

SEQ ID NO: 1316449 - RNA, 19 nt, Homo sapiens
ggaagaacacguuggcuuu

SEQ ID NO: 1316450 - RNA, 19 nt, Homo sapiens
uaucaggacugguuacuug

SEQ ID NO: 1316451 - RNA, 19 nt, Homo sapiens
ccaaauauuuccucaucuu

SEQ ID NO: 1316452 - RNA, 19 nt, Homo sapiens
cagagaaggucuaguuugu

SEQ ID NO: 1316453 - RNA, 19 nt, Homo sapiens
ugacguggaugaaauugaa

SEQ ID NO: 1316454 - RNA, 19 nt, Homo sapiens
ugaggaggcugagaaagua

SEQ ID NO: 1316455 - RNA, 19 nt, Homo sapiens
ccacuaggcuccuuugagu

SEQ ID NO: 1316456 - RNA, 19 nt, Homo sapiens
gccaucacuuguucaaaua

SEQ ID NO: 1316457 - RNA, 19 nt, Homo sapiens
gaggguaucuggagcuuca

SEQ ID NO: 1316458 - RNA, 19 nt, Homo sapiens
gacauggacuuguuuguag

SEQ ID NO: 1316459 - RNA, 19 nt, Homo sapiens
gagcaccuuucacucagua

SEQ ID NO: 1316460 - RNA, 19 nt, Homo sapiens
ucucuacgcuggaaauuug

SEQ ID NO: 1316461 - RNA, 19 nt, Homo sapiens
gaggagcucaggcaauaua

SEQ ID NO: 1316462 - RNA, 19 nt, Homo sapiens
gaugaacauucuagaaauc

SEQ ID NO: 1316463 - RNA, 19 nt, Homo sapiens
ccacgaaucacacaacaaa

SEQ ID NO: 1316464 - RNA, 19 nt, Homo sapiens
caacuuacuuucaacuaca

SEQ ID NO: 1316465 - RNA, 19 nt, Homo sapiens
ggaacugccugacuuaugc

SEQ ID NO: 1316466 - RNA, 19 nt, Homo sapiens
ugacaugucugccucauac

SEQ ID NO: 1316467 - RNA, 19 nt, Homo sapiens
gaacaccagaaucacauuu

SEQ ID NO: 1316468 - RNA, 19 nt, Homo sapiens
uuacuaagcugagagaugu

SEQ ID NO: 1316469 - RNA, 19 nt, Homo sapiens
gcagaaggcugaagaaaag

SEQ ID NO: 1316470 - RNA, 19 nt, Homo sapiens
gcuaguguguguuguugaa

SEQ ID NO: 1316471 - RNA, 19 nt, Homo sapiens
gcauggcucuauuccuauu

SEQ ID NO: 1316472 - RNA, 19 nt, Homo sapiens
caagucgacucaacucuca

SEQ ID NO: 1316473 - RNA, 19 nt, Homo sapiens
ugagaaaguacaggaauua

SEQ ID NO: 1316474 - RNA, 19 nt, Homo sapiens
acaaacagcaguucagaaa

SEQ ID NO: 1316475 - RNA, 19 nt, Homo sapiens
gggcagagaaggucuaguu

SEQ ID NO: 1316476 - RNA, 19 nt, Homo sapiens
gcacauguagguuugaaug

SEQ ID NO: 1316477 - RNA, 19 nt, Homo sapiens
uggcuuggcucuugacuug

SEQ ID NO: 1316478 - RNA, 19 nt, Homo sapiens
gaucauccucuaaacguuu

SEQ ID NO: 1316479 - RNA, 19 nt, Homo sapiens
gcagagaaggucuaguuug

SEQ ID NO: 1316480 - RNA, 19 nt, Homo sapiens
cauguagguuugaaugaaa

SEQ ID NO: 1316481 - RNA, 19 nt, Homo sapiens
ugaaagugaucaugagcaa

SEQ ID NO: 1316482 - RNA, 19 nt, Homo sapiens
gaaaugucuuguaacucaa

SEQ ID NO: 1316483 - RNA, 19 nt, Homo sapiens
cugccugugucuauuauua

SEQ ID NO: 1316484 - RNA, 19 nt, Homo sapiens
ccuaaacguuucaucaaga

SEQ ID NO: 1316485 - RNA, 19 nt, Homo sapiens
ggacccaaguuagguguga

SEQ ID NO: 1316486 - RNA, 19 nt, Homo sapiens
ucaacuacaugccucauuc

SEQ ID NO: 1316487 - RNA, 19 nt, Homo sapiens
gauagauguuauucgacua

SEQ ID NO: 1316488 - RNA, 19 nt, Homo sapiens
gcacagcaccucguccaaa

SEQ ID NO: 1316489 - RNA, 19 nt, Homo sapiens
gccugugucuauuauuaua

SEQ ID NO: 1316490 - RNA, 19 nt, Homo sapiens
ucaauuccauccuguaaag

SEQ ID NO: 1316491 - RNA, 19 nt, Homo sapiens
ugccagacauucuaauuug

SEQ ID NO: 1316492 - RNA, 19 nt, Homo sapiens
gcucuugacuuggacagaa

SEQ ID NO: 1316493 - RNA, 19 nt, Homo sapiens
ggacucacuggauagauuu

SEQ ID NO: 1316494 - RNA, 19 nt, Homo sapiens
cuaaacguuucaucaagaa

SEQ ID NO: 1316495 - RNA, 19 nt, Homo sapiens
aaauucagccuaaacguuu

SEQ ID NO: 1316496 - RNA, 19 nt, Homo sapiens
guagcuacauuucuuuagu

SEQ ID NO: 1316497 - RNA, 19 nt, Homo sapiens
ccgaggcccugauguagaa

SEQ ID NO: 1316498 - RNA, 19 nt, Homo sapiens
uugcaggacucacuggaua

SEQ ID NO: 1316499 - RNA, 19 nt, Homo sapiens
uugcaggacucacuggaua

SEQ ID NO: 1316500 - RNA, 19 nt, Homo sapiens
uugcaggacucacuggaua

SEQ ID NO: 1316501 - RNA, 19 nt, Homo sapiens
gaaggugauuggacucucu

SEQ ID NO: 1316502 - RNA, 19 nt, Homo sapiens
aacgagagcugacccaguu

SEQ ID NO: 1316503 - RNA, 19 nt, Homo sapiens
caggcaaucugaaggcaaa

SEQ ID NO: 1316504 - RNA, 19 nt, Homo sapiens
ugacauggacuuguuugua

SEQ ID NO: 1316505 - RNA, 19 nt, Homo sapiens
ucaacgaggugcugaugga

SEQ ID NO: 1316506 - RNA, 19 nt, Homo sapiens
gaaucacauuugaggaaga

SEQ ID NO: 1316507 - RNA, 19 nt, Homo sapiens
cgaugaggaugaagauguu

SEQ ID NO: 1316508 - RNA, 19 nt, Homo sapiens
acagaaaugucuuguaacu

SEQ ID NO: 1316509 - RNA, 19 nt, Homo sapiens
gaacacuacagagucgaua

SEQ ID NO: 1316510 - RNA, 19 nt, Homo sapiens
ggaaauuugcugccucaau

SEQ ID NO: 1316511 - RNA, 19 nt, Homo sapiens
uaaauucagccuaaacguu

SEQ ID NO: 1316512 - RNA, 19 nt, Homo sapiens
guguuuagcucauccaaag

SEQ ID NO: 1316513 - RNA, 19 nt, Homo sapiens
gccagacauucuaauuuga

SEQ ID NO: 1316514 - RNA, 19 nt, Homo sapiens
gcacaugccgggagugauc

SEQ ID NO: 1316515 - RNA, 19 nt, Homo sapiens
gaaguugcuuuuacucauu

SEQ ID NO: 1316516 - RNA, 19 nt, Homo sapiens
gcugagagaugucauugcu

SEQ ID NO: 1316517 - RNA, 19 nt, Homo sapiens
gggagcugcuggaugagaa

SEQ ID NO: 1316518 - RNA, 19 nt, Homo sapiens
ggaaucugcaggagucuga

SEQ ID NO: 1316519 - RNA, 19 nt, Homo sapiens
acaccagaaucacauuuga

SEQ ID NO: 1316520 - RNA, 19 nt, Homo sapiens
aaguagaaauguccuguau

SEQ ID NO: 1316521 - RNA, 19 nt, Homo sapiens
guucagaagaaguaaauga

SEQ ID NO: 1316522 - RNA, 19 nt, Homo sapiens
uaucuucaguguugguuug

SEQ ID NO: 1316523 - RNA, 19 nt, Homo sapiens
gaugguauucgacuccuuu

SEQ ID NO: 1316524 - RNA, 19 nt, Homo sapiens
ggaccaagaagaggaagaa

SEQ ID NO: 1316525 - RNA, 19 nt, Homo sapiens
caaacagaaaugucuugua

SEQ ID NO: 1316526 - RNA, 19 nt, Homo sapiens
ccagugaucauccucuaaa

SEQ ID NO: 1316527 - RNA, 19 nt, Homo sapiens
ggacugguuacuugguuaa

SEQ ID NO: 1316528 - RNA, 19 nt, Homo sapiens
gaaguugucugaaaauguc

SEQ ID NO: 1316529 - RNA, 19 nt, Homo sapiens
ggagucauauucccacacu

SEQ ID NO: 1316530 - RNA, 19 nt, Homo sapiens
gaagugccuuuuacucauu

SEQ ID NO: 1316531 - RNA, 19 nt, Homo sapiens
ugaaggcaaauccuguuua

SEQ ID NO: 1316532 - RNA, 19 nt, Homo sapiens
cagaaucacauuugaggaa

SEQ ID NO: 1316533 - RNA, 19 nt, Homo sapiens
aauauaaaguccugguuca

SEQ ID NO: 1316534 - RNA, 19 nt, Homo sapiens
cuuuguaucuucaguguug

SEQ ID NO: 1316535 - RNA, 19 nt, Homo sapiens
gcccugauguagaaacuuc

SEQ ID NO: 1316536 - RNA, 19 nt, Homo sapiens
ccagaugggagucauauuc

SEQ ID NO: 1316537 - RNA, 19 nt, Homo sapiens
ggaggaagaugaagaagaa

SEQ ID NO: 1316538 - RNA, 19 nt, Homo sapiens
gggaugaguuccuugauuu

SEQ ID NO: 1316539 - RNA, 19 nt, Homo sapiens
gcacguuuccugucucuua

SEQ ID NO: 1316540 - RNA, 19 nt, Homo sapiens
guagugcugucuuguauug

SEQ ID NO: 1316541 - RNA, 19 nt, Homo sapiens
gcucgaaccugccaugugu

SEQ ID NO: 1316542 - RNA, 19 nt, Homo sapiens
ccgcagaggugaccaguga

SEQ ID NO: 1316543 - RNA, 19 nt, Homo sapiens
ggauuuaacuccggguuug

SEQ ID NO: 1316544 - RNA, 19 nt, Homo sapiens
gaaugcugauacccuagua

SEQ ID NO: 1316545 - RNA, 19 nt, Homo sapiens
guacugcaaugccuucauc

SEQ ID NO: 1316546 - RNA, 19 nt, Homo sapiens
gcccaagccugaccugguu

SEQ ID NO: 1316547 - RNA, 19 nt, Homo sapiens
ggaagaggaggaagaugaa

SEQ ID NO: 1316548 - RNA, 19 nt, Homo sapiens
cccaaacacugaaaggaaa

SEQ ID NO: 1316549 - RNA, 19 nt, Homo sapiens
ggaaaugaaugcugauacc

SEQ ID NO: 1316550 - RNA, 19 nt, Homo sapiens
ugaccugguuauuggauuu

SEQ ID NO: 1316551 - RNA, 19 nt, Homo sapiens
gaaccugccauguguguca

SEQ ID NO: 1316552 - RNA, 19 nt, Homo sapiens
gcagaggugaccagugaaa

SEQ ID NO: 1316553 - RNA, 19 nt, Homo sapiens
aaggcuaggugugaaguua

SEQ ID NO: 1316554 - RNA, 19 nt, Homo sapiens
guguagugcugucuuguau

SEQ ID NO: 1316555 - RNA, 19 nt, Homo sapiens
agacgggacugcccugaug

SEQ ID NO: 1316556 - RNA, 19 nt, Homo sapiens
ccuaugcucuccucuguca

SEQ ID NO: 1316557 - RNA, 19 nt, Homo sapiens
cugaagacauggaguuugu

SEQ ID NO: 1316558 - RNA, 19 nt, Homo sapiens
acaacugcauguccuggua

SEQ ID NO: 1316559 - RNA, 19 nt, Homo sapiens
cgggaugaguuccuugauu

SEQ ID NO: 1316560 - RNA, 19 nt, Homo sapiens
ggcaggagguggcaaggau

SEQ ID NO: 1316561 - RNA, 19 nt, Homo sapiens
gaagacauggaguuugugu

SEQ ID NO: 1316562 - RNA, 19 nt, Homo sapiens
gggccucacucguggcuau

SEQ ID NO: 1316563 - RNA, 19 nt, Homo sapiens
gaagcgaagcugacaccuu

SEQ ID NO: 1316564 - RNA, 19 nt, Homo sapiens
ggccuaugcucuccucugu

SEQ ID NO: 1316565 - RNA, 19 nt, Homo sapiens
ggaagggacagaggaguga

SEQ ID NO: 1316566 - RNA, 19 nt, Homo sapiens
gaacuggcaacccuaccuu

SEQ ID NO: 1316567 - RNA, 19 nt, Homo sapiens
gggcauugaucugcuagug

SEQ ID NO: 1316568 - RNA, 19 nt, Homo sapiens
gcaaugccuucaucuucca

SEQ ID NO: 1316569 - RNA, 19 nt, Homo sapiens
gaaagcgacgagcagcauu

SEQ ID NO: 1316570 - RNA, 19 nt, Homo sapiens
ccaguguagugcugucuug

SEQ ID NO: 1316571 - RNA, 19 nt, Homo sapiens
gaaacaagaccccagaaga

SEQ ID NO: 1316572 - RNA, 19 nt, Homo sapiens
cggccaggcuucaccuuug

SEQ ID NO: 1316573 - RNA, 19 nt, Homo sapiens
gagaggacaggguggagaa

SEQ ID NO: 1316574 - RNA, 19 nt, Homo sapiens
ggcagagcguggagcugua

SEQ ID NO: 1316575 - RNA, 19 nt, Homo sapiens
gguuugcucucaaggauac

SEQ ID NO: 1316576 - RNA, 19 nt, Homo sapiens
gaagaugaagaagaagaga

SEQ ID NO: 1316577 - RNA, 19 nt, Homo sapiens
ggaggaagaggaggaagau

SEQ ID NO: 1316578 - RNA, 19 nt, Homo sapiens
gggaggacagguugguaaa

SEQ ID NO: 1316579 - RNA, 19 nt, Homo sapiens
uggaguuugugucuggaua

SEQ ID NO: 1316580 - RNA, 19 nt, Homo sapiens
ggacaggguggagaacgaa

SEQ ID NO: 1316581 - RNA, 19 nt, Homo sapiens
ugaagaagaagagaagaga

SEQ ID NO: 1316582 - RNA, 19 nt, Homo sapiens
ggaagaugaagaagaagag

SEQ ID NO: 1316583 - RNA, 19 nt, Homo sapiens
gcucuggcacuaaggagaa

SEQ ID NO: 1316584 - RNA, 19 nt, Homo sapiens
ggacccagcucagcaugcu

SEQ ID NO: 1316585 - RNA, 19 nt, Homo sapiens
aggaagaggaggaagauga

SEQ ID NO: 1316586 - RNA, 19 nt, Homo sapiens
gcggaaaugaaugcugaua

SEQ ID NO: 1316587 - RNA, 19 nt, Homo sapiens
gaugaguuccuugauuuca

SEQ ID NO: 1316588 - RNA, 19 nt, Homo sapiens
ggcaccaucuugggcauug

SEQ ID NO: 1316589 - RNA, 19 nt, Homo sapiens
cccuggagcugcaguuugu

SEQ ID NO: 1316590 - RNA, 19 nt, Homo sapiens
gcaccaucuugggcauuga

SEQ ID NO: 1316591 - RNA, 19 nt, Homo sapiens
aagaagaagagaagagaga

SEQ ID NO: 1316592 - RNA, 19 nt, Homo sapiens
gaccugguuauuggauuua

SEQ ID NO: 1316593 - RNA, 19 nt, Homo sapiens
gcccagaugaugugaguca

SEQ ID NO: 1316594 - RNA, 19 nt, Homo sapiens
aaagcgacgagcagcauuu

SEQ ID NO: 1316595 - RNA, 19 nt, Homo sapiens
gugcccagaugaugugagu

SEQ ID NO: 1316596 - RNA, 19 nt, Homo sapiens
ucacaggcacagcuuugaa

SEQ ID NO: 1316597 - RNA, 19 nt, Homo sapiens
ggaugaguuccuugauuuc

SEQ ID NO: 1316598 - RNA, 19 nt, Homo sapiens
gguggagaacgaaacaaga

SEQ ID NO: 1316599 - RNA, 19 nt, Homo sapiens
gaaaggaaaacgugaaaac

SEQ ID NO: 1316600 - RNA, 19 nt, Homo sapiens
cgaguacagcugugugaug

SEQ ID NO: 1316601 - RNA, 19 nt, Homo sapiens
ucccugagcucaacaucca

SEQ ID NO: 1316602 - RNA, 19 nt, Homo sapiens
agaggaggaagaugaagaa

SEQ ID NO: 1316603 - RNA, 19 nt, Homo sapiens
cggguuugcucucaaggau

SEQ ID NO: 1316604 - RNA, 19 nt, Homo sapiens
uccugucucuuacuuguga

SEQ ID NO: 1316605 - RNA, 19 nt, Homo sapiens
gaccugagccccuacauca

SEQ ID NO: 1316606 - RNA, 19 nt, Homo sapiens
ggaggaggaagaggaggaa

SEQ ID NO: 1316607 - RNA, 19 nt, Homo sapiens
ucccaaacacugaaaggaa

SEQ ID NO: 1316608 - RNA, 19 nt, Homo sapiens
cugcaaugccuucaucuuc

SEQ ID NO: 1316609 - RNA, 19 nt, Homo sapiens
auacguggcugaggucucu

SEQ ID NO: 1316610 - RNA, 19 nt, Homo sapiens
agccugaccugguuauugg

SEQ ID NO: 1316611 - RNA, 19 nt, Homo sapiens
ucaccgagagcagcgagua

SEQ ID NO: 1316612 - RNA, 19 nt, Homo sapiens
gcugaagacauggaguuug

SEQ ID NO: 1316613 - RNA, 19 nt, Homo sapiens
ggugugaaguuagccaaaa

SEQ ID NO: 1316614 - RNA, 19 nt, Homo sapiens
ugauuucacugcccuucuc

SEQ ID NO: 1316615 - RNA, 19 nt, Homo sapiens
cggcugguuccgaaaguuu

SEQ ID NO: 1316616 - RNA, 19 nt, Homo sapiens
ggaauuagcagcccauuua

SEQ ID NO: 1316617 - RNA, 19 nt, Homo sapiens
ggacuuaauugccaucaua

SEQ ID NO: 1316618 - RNA, 19 nt, Homo sapiens
gagaaugggucuguaauuu

SEQ ID NO: 1316619 - RNA, 19 nt, Homo sapiens
ggacaaggccagacaauuu

SEQ ID NO: 1316620 - RNA, 19 nt, Homo sapiens
gagaagaucuuguuccaau

SEQ ID NO: 1316621 - RNA, 19 nt, Homo sapiens
ccagcaggcucaaccauua

SEQ ID NO: 1316622 - RNA, 19 nt, Homo sapiens
cagcaggccugacuuagua

SEQ ID NO: 1316623 - RNA, 19 nt, Homo sapiens
gacaaguacugccucuuua

SEQ ID NO: 1316624 - RNA, 19 nt, Homo sapiens
gaucccaaaucucaaagua

SEQ ID NO: 1316625 - RNA, 19 nt, Homo sapiens
uagaagaucugcagcuaaa

SEQ ID NO: 1316626 - RNA, 19 nt, Homo sapiens
ggagagaggcccagccaua

SEQ ID NO: 1316627 - RNA, 19 nt, Homo sapiens
ggaagaauccuaccugguu

SEQ ID NO: 1316628 - RNA, 19 nt, Homo sapiens
ggccuuaucuucuuaucua

SEQ ID NO: 1316629 - RNA, 19 nt, Homo sapiens
gagguucgguugcaucuug

SEQ ID NO: 1316630 - RNA, 19 nt, Homo sapiens
gaaugggucuguaauuucu

SEQ ID NO: 1316631 - RNA, 19 nt, Homo sapiens
caaaguaucgugaaagaga

SEQ ID NO: 1316632 - RNA, 19 nt, Homo sapiens
gcuagaagaucugcagcua

SEQ ID NO: 1316633 - RNA, 19 nt, Homo sapiens
ugaaagcacucagaaugaa

SEQ ID NO: 1316634 - RNA, 19 nt, Homo sapiens
gagagaagccaacgcaguu

SEQ ID NO: 1316635 - RNA, 19 nt, Homo sapiens
gaggagccaucguaggauu

SEQ ID NO: 1316636 - RNA, 19 nt, Homo sapiens
ggccaagacugacuucuca

SEQ ID NO: 1316637 - RNA, 19 nt, Homo sapiens
gagaggagccaucguagga

SEQ ID NO: 1316638 - RNA, 19 nt, Homo sapiens
gcacacagaguuauagcuu

SEQ ID NO: 1316639 - RNA, 19 nt, Homo sapiens
gagaggagccaucgcaguu

SEQ ID NO: 1316640 - RNA, 19 nt, Homo sapiens
ggacaguaguagcagauca

SEQ ID NO: 1316641 - RNA, 19 nt, Homo sapiens
ccaaacagcacacagaguu

SEQ ID NO: 1316642 - RNA, 19 nt, Homo sapiens
gaaagcacucagaaugaaa

SEQ ID NO: 1316643 - RNA, 19 nt, Homo sapiens
gcccacagauucccaaagu

SEQ ID NO: 1316644 - RNA, 19 nt, Homo sapiens
gaauuagcagcccauuuaa

SEQ ID NO: 1316645 - RNA, 19 nt, Homo sapiens
caaacagcacacagaguua

SEQ ID NO: 1316646 - RNA, 19 nt, Homo sapiens
gaagaggauuggagcaacu

SEQ ID NO: 1316647 - RNA, 19 nt, Homo sapiens
gccugaagcuacucgauga

SEQ ID NO: 1316648 - RNA, 19 nt, Homo sapiens
gagaggagaggacacaguu

SEQ ID NO: 1316649 - RNA, 19 nt, Homo sapiens
ucucuaagaugaauaaagg

SEQ ID NO: 1316650 - RNA, 19 nt, Homo sapiens
cauaguuugucuagagauu

SEQ ID NO: 1316651 - RNA, 19 nt, Homo sapiens
caaguacugccucuuuaaa

SEQ ID NO: 1316652 - RNA, 19 nt, Homo sapiens
gacaaggccagacaauuug

SEQ ID NO: 1316653 - RNA, 19 nt, Homo sapiens
agacaaguacugccucuuu

SEQ ID NO: 1316654 - RNA, 19 nt, Homo sapiens
gucuagagauuucaagaau

SEQ ID NO: 1316655 - RNA, 19 nt, Homo sapiens
ucacacacaaggagcauaa

SEQ ID NO: 1316656 - RNA, 19 nt, Homo sapiens
ugaaggccauggugagguu

SEQ ID NO: 1316657 - RNA, 19 nt, Homo sapiens
gagaggcccagccauaguu

SEQ ID NO: 1316658 - RNA, 19 nt, Homo sapiens
caucgcaguuccugugaga

SEQ ID NO: 1316659 - RNA, 19 nt, Homo sapiens
ucacagucccucagagaaa

SEQ ID NO: 1316660 - RNA, 19 nt, Homo sapiens
aagacaaacucacacacaa

SEQ ID NO: 1316661 - RNA, 19 nt, Homo sapiens
ggagagaagacaucacagu

SEQ ID NO: 1316662 - RNA, 19 nt, Homo sapiens
gaagaucuuguuccaaugg

SEQ ID NO: 1316663 - RNA, 19 nt, Homo sapiens
agaaucaccaagcgacuua

SEQ ID NO: 1316664 - RNA, 19 nt, Homo sapiens
gggcuaaagugagaaccaa

SEQ ID NO: 1316665 - RNA, 19 nt, Homo sapiens
guucacaaccuaccagaga

SEQ ID NO: 1316666 - RNA, 19 nt, Homo sapiens
cacaauagauuugcagucu

SEQ ID NO: 1316667 - RNA, 19 nt, Homo sapiens
gaagucacagucccucaga

SEQ ID NO: 1316668 - RNA, 19 nt, Homo sapiens
caucacagucccucuaaga

SEQ ID NO: 1316669 - RNA, 19 nt, Homo sapiens
cgauagagaagaucuuguu

SEQ ID NO: 1316670 - RNA, 19 nt, Homo sapiens
ccaggagucuaagaacuug

SEQ ID NO: 1316671 - RNA, 19 nt, Homo sapiens
gagcaacucagacaaguac

SEQ ID NO: 1316672 - RNA, 19 nt, Homo sapiens
ggagcaacucagacaagua

SEQ ID NO: 1316673 - RNA, 19 nt, Homo sapiens
uagagaagaucuuguucca

SEQ ID NO: 1316674 - RNA, 19 nt, Homo sapiens
gagaguccuucuagggaau

SEQ ID NO: 1316675 - RNA, 19 nt, Homo sapiens
ucaccaagcgacuuagaaa

SEQ ID NO: 1316676 - RNA, 19 nt, Homo sapiens
gaguccuacuuccacaaua

SEQ ID NO: 1316677 - RNA, 19 nt, Homo sapiens
ucccaaaucucaaaguauc

SEQ ID NO: 1316678 - RNA, 19 nt, Homo sapiens
uaaaggggcaguuaauuaa

SEQ ID NO: 1316679 - RNA, 19 nt, Homo sapiens
ggugagaaugggucuguaa

SEQ ID NO: 1316680 - RNA, 19 nt, Homo sapiens
ccaccucagucccuuggaa

SEQ ID NO: 1316681 - RNA, 19 nt, Homo sapiens
caucguaggauuucugaga

SEQ ID NO: 1316682 - RNA, 19 nt, Homo sapiens
gaucucacagguccuuuga

SEQ ID NO: 1316683 - RNA, 19 nt, Homo sapiens
gcaguuccuuggagagaag

SEQ ID NO: 1316684 - RNA, 19 nt, Homo sapiens
gcuaaaaucuauacucaag

SEQ ID NO: 1316685 - RNA, 19 nt, Homo sapiens
caucacaaaggaaagcuaa

SEQ ID NO: 1316686 - RNA, 19 nt, Homo sapiens
uuaaggagggacucaagua

SEQ ID NO: 1316687 - RNA, 19 nt, Homo sapiens
aguaguagcagaucaaaga

SEQ ID NO: 1316688 - RNA, 19 nt, Homo sapiens
gguauugcuuuccaaacug

SEQ ID NO: 1316689 - RNA, 19 nt, Homo sapiens
gagcaccugggcacuauga

SEQ ID NO: 1316690 - RNA, 19 nt, Homo sapiens
cgaugugccuccaccucua

SEQ ID NO: 1316691 - RNA, 19 nt, Homo sapiens
ucugagagaacccgucaua

SEQ ID NO: 1316692 - RNA, 19 nt, Homo sapiens
cuucaggucuaguccuaaa

SEQ ID NO: 1316693 - RNA, 19 nt, Homo sapiens
gccauaguuugucuagaga

SEQ ID NO: 1316694 - RNA, 19 nt, Homo sapiens
cacagucccucugagauga

SEQ ID NO: 1316695 - RNA, 19 nt, Homo sapiens
ugagagaacccgucacagu

SEQ ID NO: 1316696 - RNA, 19 nt, Homo sapiens
gacaucacagucccucuaa

SEQ ID NO: 1316697 - RNA, 19 nt, Homo sapiens
acacagaguuauagcuucu

SEQ ID NO: 1316698 - RNA, 19 nt, Homo sapiens
aaagaccucugauucaaaa

SEQ ID NO: 1316699 - RNA, 19 nt, Homo sapiens
cuacuuccacaauagauuu

SEQ ID NO: 1316700 - RNA, 19 nt, Homo sapiens
cucaaaguaucgugaaaga

SEQ ID NO: 1316701 - RNA, 19 nt, Homo sapiens
ggcuuuaggcugagaauug

SEQ ID NO: 1316702 - RNA, 19 nt, Homo sapiens
ggccgauguucaggacuua

SEQ ID NO: 1316703 - RNA, 19 nt, Homo sapiens
ugagaaugggucuguaauu

SEQ ID NO: 1316704 - RNA, 19 nt, Homo sapiens
caacagccaagaagagcuu

SEQ ID NO: 1316705 - RNA, 19 nt, Homo sapiens
uaagcaggaggacauauug

SEQ ID NO: 1316706 - RNA, 19 nt, Homo sapiens
ugccagggacuauugcuua

SEQ ID NO: 1316707 - RNA, 19 nt, Homo sapiens
gcagcaggccugacuuagu

SEQ ID NO: 1316708 - RNA, 19 nt, Homo sapiens
gagagaggcccagccauag

SEQ ID NO: 1316709 - RNA, 19 nt, Homo sapiens
cuaaagcgggcauuccaaa

SEQ ID NO: 1316710 - RNA, 19 nt, Homo sapiens
acaaguacugccucuuuaa

SEQ ID NO: 1316711 - RNA, 19 nt, Homo sapiens
uagagcaccugggcacuau

SEQ ID NO: 1316712 - RNA, 19 nt, Homo sapiens
ggacucaaguacaguuucc

SEQ ID NO: 1316713 - RNA, 19 nt, Homo sapiens
ucacagucccucagagaga

SEQ ID NO: 1316714 - RNA, 19 nt, Homo sapiens
gcagcccauuuaagaagga

SEQ ID NO: 1316715 - RNA, 19 nt, Homo sapiens
aaacaguagaaccacaaua

SEQ ID NO: 1316716 - RNA, 19 nt, Homo sapiens
gaaaguggcucuguucaaa

SEQ ID NO: 1316717 - RNA, 19 nt, Homo sapiens
ugaagaagcugaauuugaa

SEQ ID NO: 1316718 - RNA, 19 nt, Homo sapiens
agaaauaccuuguaacuug

SEQ ID NO: 1316719 - RNA, 19 nt, Homo sapiens
gaaugggaaugcaaucuuu

SEQ ID NO: 1316720 - RNA, 19 nt, Homo sapiens
gaaauaccuuguaacuuga

SEQ ID NO: 1316721 - RNA, 19 nt, Homo sapiens
guaacuugauugccaaaua

SEQ ID NO: 1316722 - RNA, 19 nt, Homo sapiens
gcuagaggaugaagucuuu

SEQ ID NO: 1316723 - RNA, 19 nt, Homo sapiens
ggaagaagaaagaguaauu

SEQ ID NO: 1316724 - RNA, 19 nt, Homo sapiens
gaagaggacuacugguuuc

SEQ ID NO: 1316725 - RNA, 19 nt, Homo sapiens
gaaaauggcuucuucaaag

SEQ ID NO: 1316726 - RNA, 19 nt, Homo sapiens
gaaggugguuauacaaaug

SEQ ID NO: 1316727 - RNA, 19 nt, Homo sapiens
acaaaugccuucccugaaa

SEQ ID NO: 1316728 - RNA, 19 nt, Homo sapiens
uaagaugacuuuggugaaa

SEQ ID NO: 1316729 - RNA, 19 nt, Homo sapiens
gugaagaauugguggauuu

SEQ ID NO: 1316730 - RNA, 19 nt, Homo sapiens
gagccaagaugaugagaug

SEQ ID NO: 1316731 - RNA, 19 nt, Homo sapiens
gcagauugguccgugcuua

SEQ ID NO: 1316732 - RNA, 19 nt, Homo sapiens
gaaaaggacucagugcaua

SEQ ID NO: 1316733 - RNA, 19 nt, Homo sapiens
ggccagaaauaccuuguaa

SEQ ID NO: 1316734 - RNA, 19 nt, Homo sapiens
gaaggagauuugcaagaug

SEQ ID NO: 1316735 - RNA, 19 nt, Homo sapiens
guaacccucuguaacauga

SEQ ID NO: 1316736 - RNA, 19 nt, Homo sapiens
gaugaagucuuugccgauu

SEQ ID NO: 1316737 - RNA, 19 nt, Homo sapiens
gaguucaucaguuucauua

SEQ ID NO: 1316738 - RNA, 19 nt, Homo sapiens
ccgauuaccuuucuucugu

SEQ ID NO: 1316739 - RNA, 19 nt, Homo sapiens
gagggaagaagaaagagua

SEQ ID NO: 1316740 - RNA, 19 nt, Homo sapiens
ggagacauguccucaagag

SEQ ID NO: 1316741 - RNA, 19 nt, Homo sapiens
gagaacauccugagcauag

SEQ ID NO: 1316742 - RNA, 19 nt, Homo sapiens
gucaggaguucaucaguuu

SEQ ID NO: 1316743 - RNA, 19 nt, Homo sapiens
gagcuuguggccagaaaua

SEQ ID NO: 1316744 - RNA, 19 nt, Homo sapiens
gagaaggugguuauacaaa

SEQ ID NO: 1316745 - RNA, 19 nt, Homo sapiens
aggguuauguguuaaagua

SEQ ID NO: 1316746 - RNA, 19 nt, Homo sapiens
gaagcugaauuugaaagug

SEQ ID NO: 1316747 - RNA, 19 nt, Homo sapiens
uaacuugauugccaaauac

SEQ ID NO: 1316748 - RNA, 19 nt, Homo sapiens
cauggucccuguuguucua

SEQ ID NO: 1316749 - RNA, 19 nt, Homo sapiens
gaugagggaagaagaaaga

SEQ ID NO: 1316750 - RNA, 19 nt, Homo sapiens
gucaaucacuccuccaaga

SEQ ID NO: 1316751 - RNA, 19 nt, Homo sapiens
gcaggaaagccaagaggaa

SEQ ID NO: 1316752 - RNA, 19 nt, Homo sapiens
gccauggucugaugcaaga

SEQ ID NO: 1316753 - RNA, 19 nt, Homo sapiens
gaaggagccaagaugauga

SEQ ID NO: 1316754 - RNA, 19 nt, Homo sapiens
gaacaugagcaucaagaag

SEQ ID NO: 1316755 - RNA, 19 nt, Homo sapiens
uaggaaggacuuuggguua

SEQ ID NO: 1316756 - RNA, 19 nt, Homo sapiens
agaaggagauuugcaagau

SEQ ID NO: 1316757 - RNA, 19 nt, Homo sapiens
cagugcaggugaagaauug

SEQ ID NO: 1316758 - RNA, 19 nt, Homo sapiens
gaaggacuuuggguuagga

SEQ ID NO: 1316759 - RNA, 19 nt, Homo sapiens
ugaagaggacuacugguuu

SEQ ID NO: 1316760 - RNA, 19 nt, Homo sapiens
gaagaagcugaauuugaaa

SEQ ID NO: 1316761 - RNA, 19 nt, Homo sapiens
aagagaaggugguuauaca

SEQ ID NO: 1316762 - RNA, 19 nt, Homo sapiens
ggauguggcgcuucuauuc

SEQ ID NO: 1316763 - RNA, 19 nt, Homo sapiens
uaugaugaguuucuagaug

SEQ ID NO: 1316764 - RNA, 19 nt, Homo sapiens
ccuccaagaugacaauuca

SEQ ID NO: 1316765 - RNA, 19 nt, Homo sapiens
guucaucaguuucauuaag

SEQ ID NO: 1316766 - RNA, 19 nt, Homo sapiens
uuauugaccugguuggaaa

SEQ ID NO: 1316767 - RNA, 19 nt, Homo sapiens
agacauguccucaagagaa

SEQ ID NO: 1316768 - RNA, 19 nt, Homo sapiens
ggaaaaggauaugcauuau

SEQ ID NO: 1316769 - RNA, 19 nt, Homo sapiens
agaaggugguuauacaaau

SEQ ID NO: 1316770 - RNA, 19 nt, Homo sapiens
cagaaacgguacucaagca

SEQ ID NO: 1316771 - RNA, 19 nt, Homo sapiens
ggacucagugcauaagaug

SEQ ID NO: 1316772 - RNA, 19 nt, Homo sapiens
gagauaauugguucuacaa

SEQ ID NO: 1316773 - RNA, 19 nt, Homo sapiens
gguccgugcuuaccacuca

SEQ ID NO: 1316774 - RNA, 19 nt, Homo sapiens
gagauggaccuggaaguga

SEQ ID NO: 1316775 - RNA, 19 nt, Homo sapiens
ugagauaauugguucuaca

SEQ ID NO: 1316776 - RNA, 19 nt, Homo sapiens
ggucagacaccauuuuaua

SEQ ID NO: 1316777 - RNA, 19 nt, Homo sapiens
gcaggagaauggugugaac

SEQ ID NO: 1316778 - RNA, 19 nt, Homo sapiens
gaaaccccgucucuacuaa

SEQ ID NO: 1316779 - RNA, 19 nt, Homo sapiens
ucaaaggaaacaagaauca

SEQ ID NO: 1316780 - RNA, 19 nt, Homo sapiens
ccaagaugaugagauggaa

SEQ ID NO: 1316781 - RNA, 19 nt, Homo sapiens
ccagaaggagccaagauga

SEQ ID NO: 1316782 - RNA, 19 nt, Homo sapiens
ggugaagaauugguggauu

SEQ ID NO: 1316783 - RNA, 19 nt, Homo sapiens
gcagugcaggugaagaauu

SEQ ID NO: 1316784 - RNA, 19 nt, Homo sapiens
ugucaggaguucaucaguu

SEQ ID NO: 1316785 - RNA, 19 nt, Homo sapiens
gaggaugagggaagaagaa

SEQ ID NO: 1316786 - RNA, 19 nt, Homo sapiens
augaugaguuucuagauga

SEQ ID NO: 1316787 - RNA, 19 nt, Homo sapiens
acucaaaucccaaaccauu

SEQ ID NO: 1316788 - RNA, 19 nt, Homo sapiens
ccacucaaaucccaaacca

SEQ ID NO: 1316789 - RNA, 19 nt, Homo sapiens
aaucacuccuccaagauga

SEQ ID NO: 1316790 - RNA, 19 nt, Homo sapiens
uaauucugcuagaggauga

SEQ ID NO: 1316791 - RNA, 19 nt, Homo sapiens
ccagaaauaccuuguaacu

SEQ ID NO: 1316792 - RNA, 19 nt, Homo sapiens
gacauguccucaagagaag

SEQ ID NO: 1316793 - RNA, 19 nt, Homo sapiens
gaacauccugagcauagau

SEQ ID NO: 1316794 - RNA, 19 nt, Homo sapiens
aagcuaaaccucucaagga

SEQ ID NO: 1316795 - RNA, 19 nt, Homo sapiens
cugaagaagcugaauuuga

SEQ ID NO: 1316796 - RNA, 19 nt, Homo sapiens
caagagccaccuccacaug

SEQ ID NO: 1316797 - RNA, 19 nt, Homo sapiens
cgauuaccuuucuucugua

SEQ ID NO: 1316798 - RNA, 19 nt, Homo sapiens
ggaaggacuuuggguuagg

SEQ ID NO: 1316799 - RNA, 19 nt, Homo sapiens
gacuacugguuucuccuuu

SEQ ID NO: 1316800 - RNA, 19 nt, Homo sapiens
cagaaggccaucaagcaaa

SEQ ID NO: 1316801 - RNA, 19 nt, Homo sapiens
caagccagaugcuauuggu

SEQ ID NO: 1316802 - RNA, 19 nt, Homo sapiens
gauccuugcugagaacauc

SEQ ID NO: 1316803 - RNA, 19 nt, Homo sapiens
cuaaaccucucaaggaaaa

SEQ ID NO: 1316804 - RNA, 19 nt, Homo sapiens
gcuaaaccucucaaggaaa

SEQ ID NO: 1316805 - RNA, 19 nt, Homo sapiens
ggacuacugguuucuccuu

SEQ ID NO: 1316806 - RNA, 19 nt, Homo sapiens
ucccugguaugaugaguuu

SEQ ID NO: 1316807 - RNA, 19 nt, Homo sapiens
gaugcucagucccugguau

SEQ ID NO: 1316808 - RNA, 19 nt, Homo sapiens
caucuggcaucccaaccaa

SEQ ID NO: 1316809 - RNA, 19 nt, Homo sapiens
ggaguucaucaguuucauu

SEQ ID NO: 1316810 - RNA, 19 nt, Homo sapiens
uccauuacauucucuguca

SEQ ID NO: 1316811 - RNA, 19 nt, Homo sapiens
gguaugaugaguuucuaga

SEQ ID NO: 1316812 - RNA, 19 nt, Homo sapiens
caaaugccuucccugaaaa

SEQ ID NO: 1316813 - RNA, 19 nt, Homo sapiens
ucuguaacaugaacaucaa

SEQ ID NO: 1316814 - RNA, 19 nt, Homo sapiens
ccaaagcccagaaggagau

SEQ ID NO: 1316815 - RNA, 19 nt, Homo sapiens
ucaaaucccaaaccauuca

SEQ ID NO: 1316816 - RNA, 19 nt, Homo sapiens
ggaagaaggugauucagua

SEQ ID NO: 1316817 - RNA, 19 nt, Homo sapiens
ggacagcugugcccaguuu

SEQ ID NO: 1316818 - RNA, 19 nt, Homo sapiens
gggcaaagcuggagaagug

SEQ ID NO: 1316819 - RNA, 19 nt, Homo sapiens
ccacagaccugaagacaga

SEQ ID NO: 1316820 - RNA, 19 nt, Homo sapiens
ucagagaccuggagaagaa

SEQ ID NO: 1316821 - RNA, 19 nt, Homo sapiens
gcaaggaggaugaggauaa

SEQ ID NO: 1316822 - RNA, 19 nt, Homo sapiens
ccaagaagcugcucuacca

SEQ ID NO: 1316823 - RNA, 19 nt, Homo sapiens
agaagaagcugucagagau

SEQ ID NO: 1316824 - RNA, 19 nt, Homo sapiens
ccaaggagaccaucaagaa

SEQ ID NO: 1316825 - RNA, 19 nt, Homo sapiens
gagaagaagcugucagaga

SEQ ID NO: 1316826 - RNA, 19 nt, Homo sapiens
ggacaaugacagaguacua

SEQ ID NO: 1316827 - RNA, 19 nt, Homo sapiens
ggaucaacaugcaggauug

SEQ ID NO: 1316828 - RNA, 19 nt, Homo sapiens
cgaccacugugcucaagua

SEQ ID NO: 1316829 - RNA, 19 nt, Homo sapiens
gaagaccuguaccugaguu

SEQ ID NO: 1316830 - RNA, 19 nt, Homo sapiens
ccaggacaaugacagagua

SEQ ID NO: 1316831 - RNA, 19 nt, Homo sapiens
gauaaacgaugaggaugau

SEQ ID NO: 1316832 - RNA, 19 nt, Homo sapiens
cgccagagcugccagagaa

SEQ ID NO: 1316833 - RNA, 19 nt, Homo sapiens
cagagacgcuccagaaugg

SEQ ID NO: 1316834 - RNA, 19 nt, Homo sapiens
uaugaggacuugcagugua

SEQ ID NO: 1316835 - RNA, 19 nt, Homo sapiens
cacaagaacuacuggauca

SEQ ID NO: 1316836 - RNA, 19 nt, Homo sapiens
gccaaugccuguuuacaca

SEQ ID NO: 1316837 - RNA, 19 nt, Homo sapiens
ggauaaacgaugaggauga

SEQ ID NO: 1316838 - RNA, 19 nt, Homo sapiens
caacaaggccaaccucauc

SEQ ID NO: 1316839 - RNA, 19 nt, Homo sapiens
gacuugcaguguaccaaua

SEQ ID NO: 1316840 - RNA, 19 nt, Homo sapiens
gaacuccuuugacuucagu

SEQ ID NO: 1316841 - RNA, 19 nt, Homo sapiens
caaggacacuauugacauc

SEQ ID NO: 1316842 - RNA, 19 nt, Homo sapiens
agaagcugcucuaccagua

SEQ ID NO: 1316843 - RNA, 19 nt, Homo sapiens
gaagacgacagugggauaa

SEQ ID NO: 1316844 - RNA, 19 nt, Homo sapiens
guaccuggcucuggaggaa

SEQ ID NO: 1316845 - RNA, 19 nt, Homo sapiens
ccuaagaaguauaccauca

SEQ ID NO: 1316846 - RNA, 19 nt, Homo sapiens
gcccagacuuccucuccua

SEQ ID NO: 1316847 - RNA, 19 nt, Homo sapiens
gaucagagcccaggagaag

SEQ ID NO: 1316848 - RNA, 19 nt, Homo sapiens
ggaaugagaagagcaagga

SEQ ID NO: 1316849 - RNA, 19 nt, Homo sapiens
gcagguggcagacaacuuc

SEQ ID NO: 1316850 - RNA, 19 nt, Homo sapiens
cgaugaggaugauguggaa

SEQ ID NO: 1316851 - RNA, 19 nt, Homo sapiens
caauagcaauggccuugug

SEQ ID NO: 1316852 - RNA, 19 nt, Homo sapiens
ucuccaagcugcccauuuc

SEQ ID NO: 1316853 - RNA, 19 nt, Homo sapiens
aggaggaaaucaccuuaaa

SEQ ID NO: 1316854 - RNA, 19 nt, Homo sapiens
gagcugaaacacauaaaca

SEQ ID NO: 1316855 - RNA, 19 nt, Homo sapiens
agaaggugauucaguacaa

SEQ ID NO: 1316856 - RNA, 19 nt, Homo sapiens
ccacugugcucaaguacca

SEQ ID NO: 1316857 - RNA, 19 nt, Homo sapiens
gaaaauauucgcuugaugu

SEQ ID NO: 1316858 - RNA, 19 nt, Homo sapiens
gagacacccaggacaauga

SEQ ID NO: 1316859 - RNA, 19 nt, Homo sapiens
ugagauggaccgugucauu

SEQ ID NO: 1316860 - RNA, 19 nt, Homo sapiens
acagugggauaaacgauga

SEQ ID NO: 1316861 - RNA, 19 nt, Homo sapiens
gaacuacuggaucaacaug

SEQ ID NO: 1316862 - RNA, 19 nt, Homo sapiens
gaaaaggugcugccuaaga

SEQ ID NO: 1316863 - RNA, 19 nt, Homo sapiens
ccauggagcacaccaagaa

SEQ ID NO: 1316864 - RNA, 19 nt, Homo sapiens
uaaaggagugguaccagaa

SEQ ID NO: 1316865 - RNA, 19 nt, Homo sapiens
gcuccuguguucccucuau

SEQ ID NO: 1316866 - RNA, 19 nt, Homo sapiens
gacauuccaucuccagaca

SEQ ID NO: 1316867 - RNA, 19 nt, Homo sapiens
gagauggaccgugucauug

SEQ ID NO: 1316868 - RNA, 19 nt, Homo sapiens
gagaagagcaaggaauauc

SEQ ID NO: 1316869 - RNA, 19 nt, Homo sapiens
ggauaagagcuucgacaug

SEQ ID NO: 1316870 - RNA, 19 nt, Homo sapiens
ccagagacgcuccagaaug

SEQ ID NO: 1316871 - RNA, 19 nt, Homo sapiens
gaaggugauucaguacaag

SEQ ID NO: 1316872 - RNA, 19 nt, Homo sapiens
ugaagaagcagcaggagau

SEQ ID NO: 1316873 - RNA, 19 nt, Homo sapiens
gaggagacacccaggacaa

SEQ ID NO: 1316874 - RNA, 19 nt, Homo sapiens
gaggaaaucaccuuaaagc

SEQ ID NO: 1316875 - RNA, 19 nt, Homo sapiens
caaggaggaugaggauaag

SEQ ID NO: 1316876 - RNA, 19 nt, Homo sapiens
cugcucugcuccaugcuua

SEQ ID NO: 1316877 - RNA, 19 nt, Homo sapiens
caacuucucccgccaguac

SEQ ID NO: 1316878 - RNA, 19 nt, Homo sapiens
ggagagaaacuaacaugcu

SEQ ID NO: 1316879 - RNA, 19 nt, Homo sapiens
gucaagaagcucacucuga

SEQ ID NO: 1316880 - RNA, 19 nt, Homo sapiens
ugaaacacauaaacaagac

SEQ ID NO: 1316881 - RNA, 19 nt, Homo sapiens
cgaggugccugagaacuuc

SEQ ID NO: 1316882 - RNA, 19 nt, Homo sapiens
aaaaggugcugccuaagaa

SEQ ID NO: 1316883 - RNA, 19 nt, Homo sapiens
uaucggcucuggcuaugau

SEQ ID NO: 1316884 - RNA, 19 nt, Homo sapiens
ggacagcaaaggcaacaag

SEQ ID NO: 1316885 - RNA, 19 nt, Homo sapiens
ggagggagacauuccaucu

SEQ ID NO: 1316886 - RNA, 19 nt, Homo sapiens
caacacacccaaggaggaa

SEQ ID NO: 1316887 - RNA, 19 nt, Homo sapiens
aggaaaagcucuacaagga

SEQ ID NO: 1316888 - RNA, 19 nt, Homo sapiens
aaaagaagcagcaguggua

SEQ ID NO: 1316889 - RNA, 19 nt, Homo sapiens
acaccaagcggaaugagaa

SEQ ID NO: 1316890 - RNA, 19 nt, Homo sapiens
cagcaaaggcaacaagauc

SEQ ID NO: 1316891 - RNA, 19 nt, Homo sapiens
gacaaugacagaguacuau

SEQ ID NO: 1316892 - RNA, 19 nt, Homo sapiens
ccaagcugcccauuuccua

SEQ ID NO: 1316893 - RNA, 19 nt, Homo sapiens
gcaaaggcaacaagaucau

SEQ ID NO: 1316894 - RNA, 19 nt, Homo sapiens
gacagaguacuaucaagga

SEQ ID NO: 1316895 - RNA, 19 nt, Homo sapiens
gaagaagcugucagagauc

SEQ ID NO: 1316896 - RNA, 19 nt, Homo sapiens
ucagagcccaggagaagaa

SEQ ID NO: 1316897 - RNA, 19 nt, Homo sapiens
gaagaaggugauucaguac

SEQ ID NO: 1316898 - RNA, 19 nt, Homo sapiens
gcgaggugccugagaacuu

SEQ ID NO: 1316899 - RNA, 19 nt, Homo sapiens
gguuugagcaggagcaaga

SEQ ID NO: 1316900 - RNA, 19 nt, Homo sapiens
ucaaggacgcccagacuuc

SEQ ID NO: 1316901 - RNA, 19 nt, Homo sapiens
ggaggaaaucaccuuaaag

SEQ ID NO: 1316902 - RNA, 19 nt, Homo sapiens
ggacuugcaguguaccaau

SEQ ID NO: 1316903 - RNA, 19 nt, Homo sapiens
gggaagaaggugauucagu

SEQ ID NO: 1316904 - RNA, 19 nt, Homo sapiens
gaacgggaagaaggugauu

SEQ ID NO: 1316905 - RNA, 19 nt, Homo sapiens
agaagacgacagugggaua

SEQ ID NO: 1316906 - RNA, 19 nt, Homo sapiens
agcaagaggugaagaagca

SEQ ID NO: 1316907 - RNA, 19 nt, Homo sapiens
gcucuggcuaugaugcuua

SEQ ID NO: 1316908 - RNA, 19 nt, Homo sapiens
ggagacacccaggacaaug

SEQ ID NO: 1316909 - RNA, 19 nt, Homo sapiens
ggaccgugucauugaguuu

SEQ ID NO: 1316910 - RNA, 19 nt, Homo sapiens
ccaaggacacuauugacau

SEQ ID NO: 1316911 - RNA, 19 nt, Homo sapiens
gauggaccgugucauugag

SEQ ID NO: 1316912 - RNA, 19 nt, Homo sapiens
agugugaagugcccaaguu

SEQ ID NO: 1316913 - RNA, 19 nt, Homo sapiens
guuccugcuucucaugauu

SEQ ID NO: 1316914 - RNA, 19 nt, Homo sapiens
cccaggagcugcaaaagaa

SEQ ID NO: 1316915 - RNA, 19 nt, Homo sapiens
ucaagcagcggcucaucaa

SEQ ID NO: 1316916 - RNA, 19 nt, Homo sapiens
ggacaugacuggauauaaa

SEQ ID NO: 1316917 - RNA, 19 nt, Homo sapiens
gaagcgagcugguuuaguu

SEQ ID NO: 1316918 - RNA, 19 nt, Homo sapiens
uaaagcagcugaacuuaaa

SEQ ID NO: 1316919 - RNA, 19 nt, Homo sapiens
ggaauugccucuuaucaug

SEQ ID NO: 1316920 - RNA, 19 nt, Homo sapiens
gaacuuaaauaacgaaugg

SEQ ID NO: 1316921 - RNA, 19 nt, Homo sapiens
ggauugacgugccuuuaua

SEQ ID NO: 1316922 - RNA, 19 nt, Homo sapiens
cgacuggaauugccucuua

SEQ ID NO: 1316923 - RNA, 19 nt, Homo sapiens
ggucaacucucagucuuua

SEQ ID NO: 1316924 - RNA, 19 nt, Homo sapiens
gaaauuggaguucuacaaa

SEQ ID NO: 1316925 - RNA, 19 nt, Homo sapiens
gaagagcuguaccuaguug

SEQ ID NO: 1316926 - RNA, 19 nt, Homo sapiens
cgaauggacuccugauaaa

SEQ ID NO: 1316927 - RNA, 19 nt, Homo sapiens
gaaugucucucaagcaguu

SEQ ID NO: 1316928 - RNA, 19 nt, Homo sapiens
gaacucuacuucugcaaga

SEQ ID NO: 1316929 - RNA, 19 nt, Homo sapiens
ggcagaagcuacagacaaa

SEQ ID NO: 1316930 - RNA, 19 nt, Homo sapiens
gaagacagauuuggaccuu

SEQ ID NO: 1316931 - RNA, 19 nt, Homo sapiens
uguagaagaugcucuguuu

SEQ ID NO: 1316932 - RNA, 19 nt, Homo sapiens
ugaaaggccugaagacaga

SEQ ID NO: 1316933 - RNA, 19 nt, Homo sapiens
gcaacaagauccgauacuu

SEQ ID NO: 1316934 - RNA, 19 nt, Homo sapiens
gcaccaguguucugucaaa

SEQ ID NO: 1316935 - RNA, 19 nt, Homo sapiens
caagagauuugcaguguuc

SEQ ID NO: 1316936 - RNA, 19 nt, Homo sapiens
gggauguguuuaccgauua

SEQ ID NO: 1316937 - RNA, 19 nt, Homo sapiens
ccagaaaugucacccuuga

SEQ ID NO: 1316938 - RNA, 19 nt, Homo sapiens
gaaaugaaaggccugaaga

SEQ ID NO: 1316939 - RNA, 19 nt, Homo sapiens
gcuauuucuuuccuacuua

SEQ ID NO: 1316940 - RNA, 19 nt, Homo sapiens
gcucaugauuggcguguuu

SEQ ID NO: 1316941 - RNA, 19 nt, Homo sapiens
gaagaugcucuguuugaaa

SEQ ID NO: 1316942 - RNA, 19 nt, Homo sapiens
uaaaguccauuccugagaa

SEQ ID NO: 1316943 - RNA, 19 nt, Homo sapiens
gaacauuucaucuccauuc

SEQ ID NO: 1316944 - RNA, 19 nt, Homo sapiens
caguacagcuuuauaaauc

SEQ ID NO: 1316945 - RNA, 19 nt, Homo sapiens
cagaaccacucuucccuuu

SEQ ID NO: 1316946 - RNA, 19 nt, Homo sapiens
gcaagaaacuuaaaacucu

SEQ ID NO: 1316947 - RNA, 19 nt, Homo sapiens
gaacgccuguccuuuaguc

SEQ ID NO: 1316948 - RNA, 19 nt, Homo sapiens
uagaagaaaucguuagcuu

SEQ ID NO: 1316949 - RNA, 19 nt, Homo sapiens
uaucugugcuuuguuagua

SEQ ID NO: 1316950 - RNA, 19 nt, Homo sapiens
ccacugguaugccaaguau

SEQ ID NO: 1316951 - RNA, 19 nt, Homo sapiens
cagccuaucuguacuuuca

SEQ ID NO: 1316952 - RNA, 19 nt, Homo sapiens
gaaccacucuucccuuucg

SEQ ID NO: 1316953 - RNA, 19 nt, Homo sapiens
gaauuggaccugaaggaaa

SEQ ID NO: 1316954 - RNA, 19 nt, Homo sapiens
guaccuaguuggcucucua

SEQ ID NO: 1316955 - RNA, 19 nt, Homo sapiens
gaauauuccuuugaguaug

SEQ ID NO: 1316956 - RNA, 19 nt, Homo sapiens
ugacgugccuuuauaccuu

SEQ ID NO: 1316957 - RNA, 19 nt, Homo sapiens
gauccgauacuuggacuua

SEQ ID NO: 1316958 - RNA, 19 nt, Homo sapiens
agacuggaauugaugauau

SEQ ID NO: 1316959 - RNA, 19 nt, Homo sapiens
gacgugccuuuauaccuua

SEQ ID NO: 1316960 - RNA, 19 nt, Homo sapiens
guuaguaucuauggauuga

SEQ ID NO: 1316961 - RNA, 19 nt, Homo sapiens
gcaguacagcuuuauaaau

SEQ ID NO: 1316962 - RNA, 19 nt, Homo sapiens
cguuaaaguuugacugaaa

SEQ ID NO: 1316963 - RNA, 19 nt, Homo sapiens
cagcugaacuuaaauaacg

SEQ ID NO: 1316964 - RNA, 19 nt, Homo sapiens
gauaaucugccuuccgaaa

SEQ ID NO: 1316965 - RNA, 19 nt, Homo sapiens
gaaaguugacagugcuaaa

SEQ ID NO: 1316966 - RNA, 19 nt, Homo sapiens
ggucaugcaagacaagaua

SEQ ID NO: 1316967 - RNA, 19 nt, Homo sapiens
uggaagagcuguaccuagu

SEQ ID NO: 1316968 - RNA, 19 nt, Homo sapiens
uagaagaugcucuguuuga

SEQ ID NO: 1316969 - RNA, 19 nt, Homo sapiens
uugagaaggugaagaaguu

SEQ ID NO: 1316970 - RNA, 19 nt, Homo sapiens
cagcaguacagcuuuauaa

SEQ ID NO: 1316971 - RNA, 19 nt, Homo sapiens
uugaaacucugccuucuga

SEQ ID NO: 1316972 - RNA, 19 nt, Homo sapiens
gcgagcugguuuaguugua

SEQ ID NO: 1316973 - RNA, 19 nt, Homo sapiens
caucacauguaacaaagug

SEQ ID NO: 1316974 - RNA, 19 nt, Homo sapiens
cuaguuggcucucuaaguc

SEQ ID NO: 1316975 - RNA, 19 nt, Homo sapiens
ccuaaaccaucuccugcua

SEQ ID NO: 1316976 - RNA, 19 nt, Homo sapiens
gagcauauaaagaaacuca

SEQ ID NO: 1316977 - RNA, 19 nt, Homo sapiens
ccacacgggcuuuaucuga

SEQ ID NO: 1316978 - RNA, 19 nt, Homo sapiens
ggaauuggaccugaaggaa

SEQ ID NO: 1316979 - RNA, 19 nt, Homo sapiens
gacuggaauugaugauauu

SEQ ID NO: 1316980 - RNA, 19 nt, Homo sapiens
agacagauuuggaccuuca

SEQ ID NO: 1316981 - RNA, 19 nt, Homo sapiens
cucaacaacuuaaagaaga

SEQ ID NO: 1316982 - RNA, 19 nt, Homo sapiens
uauaauagugcucugguuu

SEQ ID NO: 1316983 - RNA, 19 nt, Homo sapiens
gguaaucacuuugaaaucc

SEQ ID NO: 1316984 - RNA, 19 nt, Homo sapiens
aaacaugauucccgugaca

SEQ ID NO: 1316985 - RNA, 19 nt, Homo sapiens
cuucagcaguacagcuuua

SEQ ID NO: 1316986 - RNA, 19 nt, Homo sapiens
ggacuuaucguacaaugac

SEQ ID NO: 1316987 - RNA, 19 nt, Homo sapiens
ucccagagcauauaaagaa

SEQ ID NO: 1316988 - RNA, 19 nt, Homo sapiens
ugacagaauuccggcaguu

SEQ ID NO: 1316989 - RNA, 19 nt, Homo sapiens
acagacaaaugcccauaau

SEQ ID NO: 1316990 - RNA, 19 nt, Homo sapiens
ucaggagacuggaauugau

SEQ ID NO: 1316991 - RNA, 19 nt, Homo sapiens
cugagaaguuuguaguuga

SEQ ID NO: 1316992 - RNA, 19 nt, Homo sapiens
ccugagaaguuuguaguug

SEQ ID NO: 1316993 - RNA, 19 nt, Homo sapiens
agaagaugcucuguuugaa

SEQ ID NO: 1316994 - RNA, 19 nt, Homo sapiens
ccaagagauuugcaguguu

SEQ ID NO: 1316995 - RNA, 19 nt, Homo sapiens
gacccucucuauuccaaga

SEQ ID NO: 1316996 - RNA, 19 nt, Homo sapiens
gaugauauuccagauguga

SEQ ID NO: 1316997 - RNA, 19 nt, Homo sapiens
cuggaacgccuguccuuua

SEQ ID NO: 1316998 - RNA, 19 nt, Homo sapiens
ggugaugcucaacaacuua

SEQ ID NO: 1316999 - RNA, 19 nt, Homo sapiens
gcacagcuagacaaucuuc

SEQ ID NO: 1317000 - RNA, 19 nt, Homo sapiens
acucuucccuuucgaaugu

SEQ ID NO: 1317001 - RNA, 19 nt, Homo sapiens
guauuucccuuaccuuguc

SEQ ID NO: 1317002 - RNA, 19 nt, Homo sapiens
gaaauccucccuccugaac

SEQ ID NO: 1317003 - RNA, 19 nt, Homo sapiens
cuacaucccagagcauaua

SEQ ID NO: 1317004 - RNA, 19 nt, Homo sapiens
agaagaaaucguuagcuuu

SEQ ID NO: 1317005 - RNA, 19 nt, Homo sapiens
ggaagagcuguaccuaguu

SEQ ID NO: 1317006 - RNA, 19 nt, Homo sapiens
gagacuggaauugaugaua

SEQ ID NO: 1317007 - RNA, 19 nt, Homo sapiens
ugcuaucugugcuuuguua

SEQ ID NO: 1317008 - RNA, 19 nt, Homo sapiens
ucgccagacuguacuuaaa

SEQ ID NO: 1317009 - RNA, 19 nt, Homo sapiens
guccauuccugagaaguuu

SEQ ID NO: 1317010 - RNA, 19 nt, Homo sapiens
ggaaaugaaaggccugaag

SEQ ID NO: 1317011 - RNA, 19 nt, Homo sapiens
acgaauggacuccugauaa

SEQ ID NO: 1317012 - RNA, 19 nt, Homo sapiens
uggcacacuuguucucaaa

SEQ ID NO: 1317013 - RNA, 19 nt, Homo sapiens
cacacgggcuuuaucugaa

SEQ ID NO: 1317014 - RNA, 19 nt, Homo sapiens
gagcugguuuaguuguaga

SEQ ID NO: 1317015 - RNA, 19 nt, Homo sapiens
ggaagaacaacaugaacag

SEQ ID NO: 1317016 - RNA, 19 nt, Homo sapiens
gcacugagcugaaguugaa

SEQ ID NO: 1317017 - RNA, 19 nt, Homo sapiens
gcagagaacuuaggagaga

SEQ ID NO: 1317018 - RNA, 19 nt, Homo sapiens
gcucauucccaauaaauua

SEQ ID NO: 1317019 - RNA, 19 nt, Homo sapiens
uaagaaacgucaaaguugu

SEQ ID NO: 1317020 - RNA, 19 nt, Homo sapiens
gaaauaaaugcuccacaga

SEQ ID NO: 1317021 - RNA, 19 nt, Homo sapiens
ggauagcacugugaagguu

SEQ ID NO: 1317022 - RNA, 19 nt, Homo sapiens
gggcacacguucuguagga

SEQ ID NO: 1317023 - RNA, 19 nt, Homo sapiens
gcgggacgcauccauguua

SEQ ID NO: 1317024 - RNA, 19 nt, Homo sapiens
acgcauccauguuaaauga

SEQ ID NO: 1317025 - RNA, 19 nt, Homo sapiens
gagccaggcaccucuguuu

SEQ ID NO: 1317026 - RNA, 19 nt, Homo sapiens
gcccagagcuaccuguaca

SEQ ID NO: 1317027 - RNA, 19 nt, Homo sapiens
uuaagaaacgucaaaguug

SEQ ID NO: 1317028 - RNA, 19 nt, Homo sapiens
acacagccuuggaccauga

SEQ ID NO: 1317029 - RNA, 19 nt, Homo sapiens
ccucagcucauucccaaua

SEQ ID NO: 1317030 - RNA, 19 nt, Homo sapiens
aaagggagggcgagaauga

SEQ ID NO: 1317031 - RNA, 19 nt, Homo sapiens
ccauugcugugacaaauca

SEQ ID NO: 1317032 - RNA, 19 nt, Homo sapiens
agacccaccuggagacuug

SEQ ID NO: 1317033 - RNA, 19 nt, Homo sapiens
ggagaccagucaguacuuc

SEQ ID NO: 1317034 - RNA, 19 nt, Homo sapiens
gaucagcaaacacgauaga

SEQ ID NO: 1317035 - RNA, 19 nt, Homo sapiens
uagacuguauguagauuug

SEQ ID NO: 1317036 - RNA, 19 nt, Homo sapiens
gacgagcugucccacauca

SEQ ID NO: 1317037 - RNA, 19 nt, Homo sapiens
ggacgcauccauguuaaau

SEQ ID NO: 1317038 - RNA, 19 nt, Homo sapiens
ggagaagaucgaccagcua

SEQ ID NO: 1317039 - RNA, 19 nt, Homo sapiens
gagaugcgccuugaaguca

SEQ ID NO: 1317040 - RNA, 19 nt, Homo sapiens
gaaauccgccucagcucau

SEQ ID NO: 1317041 - RNA, 19 nt, Homo sapiens
ggcacaaccucgaguucuu

SEQ ID NO: 1317042 - RNA, 19 nt, Homo sapiens
ggacagcuccucgggacaa

SEQ ID NO: 1317043 - RNA, 19 nt, Homo sapiens
gaagaucgaccagcuagag

SEQ ID NO: 1317044 - RNA, 19 nt, Homo sapiens
gcacaaccucgaguucuug

SEQ ID NO: 1317045 - RNA, 19 nt, Homo sapiens
gcacgcuggucuccucaca

SEQ ID NO: 1317046 - RNA, 19 nt, Homo sapiens
gguaaaugguuuucuauag

SEQ ID NO: 1317047 - RNA, 19 nt, Homo sapiens
caacacagccuuggaccau

SEQ ID NO: 1317048 - RNA, 19 nt, Homo sapiens
gggcgagaaugaccacaca

SEQ ID NO: 1317049 - RNA, 19 nt, Homo sapiens
ggagaugcgccuugaaguc

SEQ ID NO: 1317050 - RNA, 19 nt, Homo sapiens
gagggcagcugugacuaca

SEQ ID NO: 1317051 - RNA, 19 nt, Homo sapiens
ucgggaaccaggacacuua

SEQ ID NO: 1317052 - RNA, 19 nt, Homo sapiens
uagaggagaccagucagua

SEQ ID NO: 1317053 - RNA, 19 nt, Homo sapiens
aauaaaugcuccacagacu

SEQ ID NO: 1317054 - RNA, 19 nt, Homo sapiens
ccuccugguugaaauaaau

SEQ ID NO: 1317055 - RNA, 19 nt, Homo sapiens
ucgagggccugaaggaguu

SEQ ID NO: 1317056 - RNA, 19 nt, Homo sapiens
gauagcacugugaagguuu

SEQ ID NO: 1317057 - RNA, 19 nt, Homo sapiens
ggcagcgucuacuccauug

SEQ ID NO: 1317058 - RNA, 19 nt, Homo sapiens
ucucugcgcuccacauucu

SEQ ID NO: 1317059 - RNA, 19 nt, Homo sapiens
ucagcucauucccaauaaa

SEQ ID NO: 1317060 - RNA, 19 nt, Homo sapiens
ggcacuggcugcugugagu

SEQ ID NO: 1317061 - RNA, 19 nt, Homo sapiens
uugguuaccuccugguuga

SEQ ID NO: 1317062 - RNA, 19 nt, Homo sapiens
guggacaacgucaaacuga

SEQ ID NO: 1317063 - RNA, 19 nt, Homo sapiens
uguaggagaugcgccuuga

SEQ ID NO: 1317064 - RNA, 19 nt, Homo sapiens
cgauagaggagaccaguca

SEQ ID NO: 1317065 - RNA, 19 nt, Homo sapiens
gaagguuuggacuugcuaa

SEQ ID NO: 1317066 - RNA, 19 nt, Homo sapiens
ucacacaacgugcucuuca

SEQ ID NO: 1317067 - RNA, 19 nt, Homo sapiens
ggaaccaggacacuuacga

SEQ ID NO: 1317068 - RNA, 19 nt, Homo sapiens
ugaccgugguggugaacaa

SEQ ID NO: 1317069 - RNA, 19 nt, Homo sapiens
gaaaagggagggcgagaau

SEQ ID NO: 1317070 - RNA, 19 nt, Homo sapiens
cgggacgcauccauguuaa

SEQ ID NO: 1317071 - RNA, 19 nt, Homo sapiens
gcaagagugcccgcuacaa

SEQ ID NO: 1317072 - RNA, 19 nt, Homo sapiens
gaugcgccuugaagucaga

SEQ ID NO: 1317073 - RNA, 19 nt, Homo sapiens
agaaugaccacacaacaca

SEQ ID NO: 1317074 - RNA, 19 nt, Homo sapiens
ucuguuuccugcuguuuau

SEQ ID NO: 1317075 - RNA, 19 nt, Homo sapiens
caagagugcccgcuacaac

SEQ ID NO: 1317076 - RNA, 19 nt, Homo sapiens
gaccuucggacccgccuuu

SEQ ID NO: 1317077 - RNA, 19 nt, Homo sapiens
gcugacacacccacauuca

SEQ ID NO: 1317078 - RNA, 19 nt, Homo sapiens
acagggaccagaauggaaa

SEQ ID NO: 1317079 - RNA, 19 nt, Homo sapiens
agcaugagcucaggcaaga

SEQ ID NO: 1317080 - RNA, 19 nt, Homo sapiens
gguuuggacuugcuaacag

SEQ ID NO: 1317081 - RNA, 19 nt, Homo sapiens
gcuccuaccagacaaucaa

SEQ ID NO: 1317082 - RNA, 19 nt, Homo sapiens
cuacgacccucagcagauc

SEQ ID NO: 1317083 - RNA, 19 nt, Homo sapiens
cggugaagcugugcuguca

SEQ ID NO: 1317084 - RNA, 19 nt, Homo sapiens
ccacagggaccagaaugga

SEQ ID NO: 1317085 - RNA, 19 nt, Homo sapiens
ggaccagcaccuacaagca

SEQ ID NO: 1317086 - RNA, 19 nt, Homo sapiens
cagagaacuuaggagagaa

SEQ ID NO: 1317087 - RNA, 19 nt, Homo sapiens
gagaaugaccacacaacac

SEQ ID NO: 1317088 - RNA, 19 nt, Homo sapiens
gaccagucaguacuucuug

SEQ ID NO: 1317089 - RNA, 19 nt, Homo sapiens
uggaucagcaaacacgaua

SEQ ID NO: 1317090 - RNA, 19 nt, Homo sapiens
gaguauggacaacaugauc

SEQ ID NO: 1317091 - RNA, 19 nt, Homo sapiens
caaucaagaucugggacau

SEQ ID NO: 1317092 - RNA, 19 nt, Homo sapiens
cagcucauucccaauaaau

SEQ ID NO: 1317093 - RNA, 19 nt, Homo sapiens
guugguaaaugguuuucua

SEQ ID NO: 1317094 - RNA, 19 nt, Homo sapiens
cuucguguccuuucaguug

SEQ ID NO: 1317095 - RNA, 19 nt, Homo sapiens
cgagaaugaccacacaaca

SEQ ID NO: 1317096 - RNA, 19 nt, Homo sapiens
cucagcagaucuucaagug

SEQ ID NO: 1317097 - RNA, 19 nt, Homo sapiens
caaggcacaaccucgaguu

SEQ ID NO: 1317098 - RNA, 19 nt, Homo sapiens
gaggagaccagucaguacu

SEQ ID NO: 1317099 - RNA, 19 nt, Homo sapiens
guuuccugcuguuuauuga

SEQ ID NO: 1317100 - RNA, 19 nt, Homo sapiens
ggaguauggacaacaugau

SEQ ID NO: 1317101 - RNA, 19 nt, Homo sapiens
agacagccugggccucuaa

SEQ ID NO: 1317102 - RNA, 19 nt, Homo sapiens
gcagaucuucaagugcaaa

SEQ ID NO: 1317103 - RNA, 19 nt, Homo sapiens
guccggagcuagacuucgu

SEQ ID NO: 1317104 - RNA, 19 nt, Homo sapiens
gacuguauguagauuuggu

SEQ ID NO: 1317105 - RNA, 19 nt, Homo sapiens
acgcuggucuccucacaca

SEQ ID NO: 1317106 - RNA, 19 nt, Homo sapiens
ccugugcggugucccaaca

SEQ ID NO: 1317107 - RNA, 19 nt, Homo sapiens
cagacagccugggccucua

SEQ ID NO: 1317108 - RNA, 19 nt, Homo sapiens
uuaccuccugguugaaaua

SEQ ID NO: 1317109 - RNA, 19 nt, Homo sapiens
cugugaagguuuggacuug

SEQ ID NO: 1317110 - RNA, 19 nt, Homo sapiens
cagcggcuccuaccagaca

SEQ ID NO: 1317111 - RNA, 19 nt, Homo sapiens
gggacgcauccauguuaaa

SEQ ID NO: 1317112 - RNA, 19 nt, Homo sapiens
gaucgaccagcuagagaag

SEQ ID NO: 1317113 - RNA, 19 nt, Homo sapiens
ccuuucaguugguaaaugg

SEQ ID NO: 1317114 - RNA, 19 nt, Homo sapiens
gggcgcagagaacuuagga

SEQ ID NO: 1317115 - RNA, 19 nt, Homo sapiens
guuaccuccugguugaaau

SEQ ID NO: 1317116 - RNA, 19 nt, Homo sapiens
gcaacgagcuggacaugga

SEQ ID NO: 1317117 - RNA, 19 nt, Homo sapiens
ccaaagacaugaagcuauu

SEQ ID NO: 1317118 - RNA, 19 nt, Homo sapiens
gcucguuucuuuccaauaa

SEQ ID NO: 1317119 - RNA, 19 nt, Homo sapiens
cgacugcccugcccaaaug

SEQ ID NO: 1317120 - RNA, 19 nt, Homo sapiens
ccagugaucuguauuugau

SEQ ID NO: 1317121 - RNA, 19 nt, Homo sapiens
gagagcuacucauguaaga

SEQ ID NO: 1317122 - RNA, 19 nt, Homo sapiens
ccacaucauuggcaggauu

SEQ ID NO: 1317123 - RNA, 19 nt, Homo sapiens
acaugaagcuauuggagaa

SEQ ID NO: 1317124 - RNA, 19 nt, Homo sapiens
aagcgaaucgucuucuuua

SEQ ID NO: 1317125 - RNA, 19 nt, Homo sapiens
ucaacuacuucuucuacaa

SEQ ID NO: 1317126 - RNA, 19 nt, Homo sapiens
caacugcagucuguucuca

SEQ ID NO: 1317127 - RNA, 19 nt, Homo sapiens
ugugacaucuacagcuaua

SEQ ID NO: 1317128 - RNA, 19 nt, Homo sapiens
gcagcucguuucuuuccaa

SEQ ID NO: 1317129 - RNA, 19 nt, Homo sapiens
gagcuacucauguaagaug

SEQ ID NO: 1317130 - RNA, 19 nt, Homo sapiens
cagcuggaccgcagaguuu

SEQ ID NO: 1317131 - RNA, 19 nt, Homo sapiens
ggagaacucgagcuuugaa

SEQ ID NO: 1317132 - RNA, 19 nt, Homo sapiens
caagcgaaucgucuucuuu

SEQ ID NO: 1317133 - RNA, 19 nt, Homo sapiens
cgaaucgucuucuuuagcu

SEQ ID NO: 1317134 - RNA, 19 nt, Homo sapiens
uuggagaacucgagcuuug

SEQ ID NO: 1317135 - RNA, 19 nt, Homo sapiens
acaagcggcucaagcgaau

SEQ ID NO: 1317136 - RNA, 19 nt, Homo sapiens
gguagccucugguccuuca

SEQ ID NO: 1317137 - RNA, 19 nt, Homo sapiens
aggaggagguggaggaaga

SEQ ID NO: 1317138 - RNA, 19 nt, Homo sapiens
gcuauaacccagacuugga

SEQ ID NO: 1317139 - RNA, 19 nt, Homo sapiens
gggaggacuucaaggaucu

SEQ ID NO: 1317140 - RNA, 19 nt, Homo sapiens
gauggcaggagacgacaaa

SEQ ID NO: 1317141 - RNA, 19 nt, Homo sapiens
ugcugcagcucguuucuuu

SEQ ID NO: 1317142 - RNA, 19 nt, Homo sapiens
ucauccagcuucaaccaau

SEQ ID NO: 1317143 - RNA, 19 nt, Homo sapiens
ucaagcgaaucgucuucuu

SEQ ID NO: 1317144 - RNA, 19 nt, Homo sapiens
gacaagugcagccgcaaga

SEQ ID NO: 1317145 - RNA, 19 nt, Homo sapiens
agugaucuguauuugauga

SEQ ID NO: 1317146 - RNA, 19 nt, Homo sapiens
ggagacgacaaacacaugu

SEQ ID NO: 1317147 - RNA, 19 nt, Homo sapiens
cauccagcuucaaccaaug

SEQ ID NO: 1317148 - RNA, 19 nt, Homo sapiens
ccaauaaaaguuucuguga

SEQ ID NO: 1317149 - RNA, 19 nt, Homo sapiens
uagcugccguuccaucagu

SEQ ID NO: 1317150 - RNA, 19 nt, Homo sapiens
ggagaucugccuggcugaa

SEQ ID NO: 1317151 - RNA, 19 nt, Homo sapiens
gcaggagacgacaaacaca

SEQ ID NO: 1317152 - RNA, 19 nt, Homo sapiens
gaggaagaaagcagaagca

SEQ ID NO: 1317153 - RNA, 19 nt, Homo sapiens
caacuacuucuucuacaac

SEQ ID NO: 1317154 - RNA, 19 nt, Homo sapiens
gaucugccuggcugaaugu

SEQ ID NO: 1317155 - RNA, 19 nt, Homo sapiens
gguggugaaugcagucaac

SEQ ID NO: 1317156 - RNA, 19 nt, Homo sapiens
ggaggagguggaggaagaa

SEQ ID NO: 1317157 - RNA, 19 nt, Homo sapiens
ggaggaggagguggaggaa

SEQ ID NO: 1317158 - RNA, 19 nt, Homo sapiens
caaagacaugaagcuauug

SEQ ID NO: 1317159 - RNA, 19 nt, Homo sapiens
agaucugccuggcugaaug

SEQ ID NO: 1317160 - RNA, 19 nt, Homo sapiens
gcgacugcccugcccaaau

SEQ ID NO: 1317161 - RNA, 19 nt, Homo sapiens
ggagguggaggaagaaagc

SEQ ID NO: 1317162 - RNA, 19 nt, Homo sapiens
ccaccuacacacccucaga

SEQ ID NO: 1317163 - RNA, 19 nt, Homo sapiens
acccagacuuggacucaga

SEQ ID NO: 1317164 - RNA, 19 nt, Homo sapiens
uaacccagacuuggacuca

SEQ ID NO: 1317165 - RNA, 19 nt, Homo sapiens
cagcuauaacccagacuug

SEQ ID NO: 1317166 - RNA, 19 nt, Homo sapiens
gcacacuccagcccaaagg

SEQ ID NO: 1317167 - RNA, 19 nt, Homo sapiens
ucccagugaucuguauuug

SEQ ID NO: 1317168 - RNA, 19 nt, Homo sapiens
cagcucguuucuuuccaau

SEQ ID NO: 1317169 - RNA, 19 nt, Homo sapiens
auaccugccuagcccuuug

SEQ ID NO: 1317170 - RNA, 19 nt, Homo sapiens
gcucaagcgaaucgucuuc

SEQ ID NO: 1317171 - RNA, 19 nt, Homo sapiens
gcaaagaaauucacugauu

SEQ ID NO: 1317172 - RNA, 19 nt, Homo sapiens
ucgcauagcugcuggcuua

SEQ ID NO: 1317173 - RNA, 19 nt, Homo sapiens
gaaaggaaucuacuugaaa

SEQ ID NO: 1317174 - RNA, 19 nt, Homo sapiens
cgacgcaucuugaauguga

SEQ ID NO: 1317175 - RNA, 19 nt, Homo sapiens
gaauacaggugauuuggau

SEQ ID NO: 1317176 - RNA, 19 nt, Homo sapiens
ugugaaaccuguaccauaa

SEQ ID NO: 1317177 - RNA, 19 nt, Homo sapiens
agacuuaacuuacagaugu

SEQ ID NO: 1317178 - RNA, 19 nt, Homo sapiens
ggacugacuggucuuguua

SEQ ID NO: 1317179 - RNA, 19 nt, Homo sapiens
aagggaacaucuuaaguua

SEQ ID NO: 1317180 - RNA, 19 nt, Homo sapiens
cagcauaccuugggucuga

SEQ ID NO: 1317181 - RNA, 19 nt, Homo sapiens
caucuuaaguuacuggauu

SEQ ID NO: 1317182 - RNA, 19 nt, Homo sapiens
acacaaagggaacaucuua

SEQ ID NO: 1317183 - RNA, 19 nt, Homo sapiens
gcagaaaggaaucuacuug

SEQ ID NO: 1317184 - RNA, 19 nt, Homo sapiens
gagcaaaggccacagugaa

SEQ ID NO: 1317185 - RNA, 19 nt, Homo sapiens
agaaaggaaucuacuugaa

SEQ ID NO: 1317186 - RNA, 19 nt, Homo sapiens
gggaacaucuuaaguuacu

SEQ ID NO: 1317187 - RNA, 19 nt, Homo sapiens
gacaaaggcucgcauagcu

SEQ ID NO: 1317188 - RNA, 19 nt, Homo sapiens
gaaaauggaucgguuuaug

SEQ ID NO: 1317189 - RNA, 19 nt, Homo sapiens
guaucaaucagcucuguua

SEQ ID NO: 1317190 - RNA, 19 nt, Homo sapiens
ugacuggucuuguuauugg

SEQ ID NO: 1317191 - RNA, 19 nt, Homo sapiens
caacagacuuaacuuacag

SEQ ID NO: 1317192 - RNA, 19 nt, Homo sapiens
aaagggaacaucuuaaguu

SEQ ID NO: 1317193 - RNA, 19 nt, Homo sapiens
gcagggauaccuuuucuua

SEQ ID NO: 1317194 - RNA, 19 nt, Homo sapiens
caggugauuuggauuguga

SEQ ID NO: 1317195 - RNA, 19 nt, Homo sapiens
gguggucuauacccuguuu

SEQ ID NO: 1317196 - RNA, 19 nt, Homo sapiens
gcauaaggcucaaaaugga

SEQ ID NO: 1317197 - RNA, 19 nt, Homo sapiens
gauuaaaugcugcucuuug

SEQ ID NO: 1317198 - RNA, 19 nt, Homo sapiens
gaaccuggcaaagaaauuc

SEQ ID NO: 1317199 - RNA, 19 nt, Homo sapiens
gcugcuggcuuaccaaugg

SEQ ID NO: 1317200 - RNA, 19 nt, Homo sapiens
acaacagacuuaacuuaca

SEQ ID NO: 1317201 - RNA, 19 nt, Homo sapiens
ccuugggucugaacaauau

SEQ ID NO: 1317202 - RNA, 19 nt, Homo sapiens
ucaaucagcucuguuacca

SEQ ID NO: 1317203 - RNA, 19 nt, Homo sapiens
cagaaaggaaucuacuuga

SEQ ID NO: 1317204 - RNA, 19 nt, Homo sapiens
ugaaaccuguaccauaaca

SEQ ID NO: 1317205 - RNA, 19 nt, Homo sapiens
gaacuucuaagccugucuu

SEQ ID NO: 1317206 - RNA, 19 nt, Homo sapiens
ggcuauaccuguaaauggu

SEQ ID NO: 1317207 - RNA, 19 nt, Homo sapiens
uuucuuggcuauaccugua

SEQ ID NO: 1317208 - RNA, 19 nt, Homo sapiens
uaucugaaccuggcaaaga

SEQ ID NO: 1317209 - RNA, 19 nt, Homo sapiens
caaagggaacaucuuaagu

SEQ ID NO: 1317210 - RNA, 19 nt, Homo sapiens
auuaaaugcugcucuuugu

SEQ ID NO: 1317211 - RNA, 19 nt, Homo sapiens
aaauggaucgguuuauguu

SEQ ID NO: 1317212 - RNA, 19 nt, Homo sapiens
uggcaaagaaauucacuga

SEQ ID NO: 1317213 - RNA, 19 nt, Homo sapiens
ggaaucuacuugaaaaugg

SEQ ID NO: 1317214 - RNA, 19 nt, Homo sapiens
guuacuggauuagaacuuc

SEQ ID NO: 1317215 - RNA, 19 nt, Homo sapiens
uggauuaaaugcugcucuu

SEQ ID NO: 1317216 - RNA, 19 nt, Homo sapiens
ggucugaacaauauaaacu

SEQ ID NO: 1317217 - RNA, 19 nt, Homo sapiens
gacuuaacuuacagauguu

SEQ ID NO: 1317218 - RNA, 19 nt, Homo sapiens
ggauuaaaugcugcucuuu

SEQ ID NO: 1317219 - RNA, 19 nt, Homo sapiens
uguaaaugguggucuagca

SEQ ID NO: 1317220 - RNA, 19 nt, Homo sapiens
uggacugacuggucuuguu

SEQ ID NO: 1317221 - RNA, 19 nt, Homo sapiens
cacaaagggaacaucuuaa

SEQ ID NO: 1317222 - RNA, 19 nt, Homo sapiens
caucuugaaugugacaaag

SEQ ID NO: 1317223 - RNA, 19 nt, Homo sapiens
acaaagggaacaucuuaag

SEQ ID NO: 1317224 - RNA, 19 nt, Homo sapiens
ccucauagcaaacagucuu

SEQ ID NO: 1317225 - RNA, 19 nt, Homo sapiens
gcaaaggccacagugaacu

SEQ ID NO: 1317226 - RNA, 19 nt, Homo sapiens
gaagcagaaaggaaucuac

SEQ ID NO: 1317227 - RNA, 19 nt, Homo sapiens
caauggcagggauaccuuu

SEQ ID NO: 1317228 - RNA, 19 nt, Homo sapiens
cauagcugcuggcuuacca

SEQ ID NO: 1317229 - RNA, 19 nt, Homo sapiens
ccacacaaagggaacaucu

SEQ ID NO: 1317230 - RNA, 19 nt, Homo sapiens
gcagccagguaucaaucag

SEQ ID NO: 1317231 - RNA, 19 nt, Homo sapiens
gaaucuacuugaaaaugga

SEQ ID NO: 1317232 - RNA, 19 nt, Homo sapiens
ucuauacccuguuuucuug

SEQ ID NO: 1317233 - RNA, 19 nt, Homo sapiens
auacaggugauuuggauug

SEQ ID NO: 1317234 - RNA, 19 nt, Homo sapiens
gcaucuugaaugugacaaa

SEQ ID NO: 1317235 - RNA, 19 nt, Homo sapiens
uaccuugggucugaacaau

SEQ ID NO: 1317236 - RNA, 19 nt, Homo sapiens
ucagcucuguuaccacaca

SEQ ID NO: 1317237 - RNA, 19 nt, Homo sapiens
acugacuggucuuguuauu

SEQ ID NO: 1317238 - RNA, 19 nt, Homo sapiens
ugaauacaggugauuugga

SEQ ID NO: 1317239 - RNA, 19 nt, Homo sapiens
uugugaaaccuguaccaua

SEQ ID NO: 1317240 - RNA, 19 nt, Homo sapiens
cacgaggcccagguaauuu

SEQ ID NO: 1317241 - RNA, 19 nt, Homo sapiens
uguuauugguggucuauac

SEQ ID NO: 1317242 - RNA, 19 nt, Homo sapiens
ugauuuggauugugaaacc

SEQ ID NO: 1317243 - RNA, 19 nt, Homo sapiens
gggauaccuuuucuuacaa

SEQ ID NO: 1317244 - RNA, 19 nt, Homo sapiens
uaacuaagcagcacaauaa

SEQ ID NO: 1317245 - RNA, 19 nt, Homo sapiens
caacugggcucuaccuuug

SEQ ID NO: 1317246 - RNA, 19 nt, Homo sapiens
gaagaaggugccagcugua

SEQ ID NO: 1317247 - RNA, 19 nt, Homo sapiens
uaaccgacuuagcgaauuc

SEQ ID NO: 1317248 - RNA, 19 nt, Homo sapiens
gggcucuaccuuugaguua

SEQ ID NO: 1317249 - RNA, 19 nt, Homo sapiens
ggugccagcuguagccuau

SEQ ID NO: 1317250 - RNA, 19 nt, Homo sapiens
uagaaggaacguuuaggua

SEQ ID NO: 1317251 - RNA, 19 nt, Homo sapiens
ucagguagaaggaacguuu

SEQ ID NO: 1317252 - RNA, 19 nt, Homo sapiens
ccucuagaguuacugagaa

SEQ ID NO: 1317253 - RNA, 19 nt, Homo sapiens
cuaccuaccuaaggagaaa

SEQ ID NO: 1317254 - RNA, 19 nt, Homo sapiens
cuucaggcauuaaucauuc

SEQ ID NO: 1317255 - RNA, 19 nt, Homo sapiens
caaacacccuacacaacca

SEQ ID NO: 1317256 - RNA, 19 nt, Homo sapiens
ccauacuccugucuaccua

SEQ ID NO: 1317257 - RNA, 19 nt, Homo sapiens
gggcacaacugggcucuac

SEQ ID NO: 1317258 - RNA, 19 nt, Homo sapiens
gcagcacaauaaccgacuu

SEQ ID NO: 1317259 - RNA, 19 nt, Homo sapiens
guagaaggaacguuuaggu

SEQ ID NO: 1317260 - RNA, 19 nt, Homo sapiens
cagcacaauaaccgacuua

SEQ ID NO: 1317261 - RNA, 19 nt, Homo sapiens
gggaagaacggcagaugca

SEQ ID NO: 1317262 - RNA, 19 nt, Homo sapiens
gguggccacuucucugauc

SEQ ID NO: 1317263 - RNA, 19 nt, Homo sapiens
guucauugagcaccuacua

SEQ ID NO: 1317264 - RNA, 19 nt, Homo sapiens
cagguagaaggaacguuua

SEQ ID NO: 1317265 - RNA, 19 nt, Homo sapiens
cagcagugcccacauccaa

SEQ ID NO: 1317266 - RNA, 19 nt, Homo sapiens
acaacugggcucuaccuuu

SEQ ID NO: 1317267 - RNA, 19 nt, Homo sapiens
auaacuaagcagcacaaua

SEQ ID NO: 1317268 - RNA, 19 nt, Homo sapiens
ggcauuaaucauucacuga

SEQ ID NO: 1317269 - RNA, 19 nt, Homo sapiens
gcugggagguguguuugca

SEQ ID NO: 1317270 - RNA, 19 nt, Homo sapiens
ucauugagcaccuacuaug

SEQ ID NO: 1317271 - RNA, 19 nt, Homo sapiens
gcucuaccuuugaguuagg

SEQ ID NO: 1317272 - RNA, 19 nt, Homo sapiens
ucacugaccguucauugag

SEQ ID NO: 1317273 - RNA, 19 nt, Homo sapiens
cuagaguuacugagaauca

SEQ ID NO: 1317274 - RNA, 19 nt, Homo sapiens
gcacaauaaccgacuuagc

SEQ ID NO: 1317275 - RNA, 19 nt, Homo sapiens
gcgaauucagguagaagga

SEQ ID NO: 1317276 - RNA, 19 nt, Homo sapiens
gcagugcccacauccaaac

SEQ ID NO: 1317277 - RNA, 19 nt, Homo sapiens
cagguggccacuucucuga

SEQ ID NO: 1317278 - RNA, 19 nt, Homo sapiens
aacggcagaugcagagaga

SEQ ID NO: 1317279 - RNA, 19 nt, Homo sapiens
gcaccuauuuuguacugau

SEQ ID NO: 1317280 - RNA, 19 nt, Homo sapiens
auaaccgacuuagcgaauu

SEQ ID NO: 1317281 - RNA, 19 nt, Homo sapiens
cauccaaacacccuacaca

SEQ ID NO: 1317282 - RNA, 19 nt, Homo sapiens
ccaggucccuagguucaca

SEQ ID NO: 1317283 - RNA, 19 nt, Homo sapiens
uuagcgaauucagguagaa

SEQ ID NO: 1317284 - RNA, 19 nt, Homo sapiens
cuaugugccaggccaauug

SEQ ID NO: 1317285 - RNA, 19 nt, Homo sapiens
acuccugucuaccuaccua

SEQ ID NO: 1317286 - RNA, 19 nt, Homo sapiens
gcaugcacacgcacacaca

SEQ ID NO: 1317287 - RNA, 19 nt, Homo sapiens
gcacaacugggcucuaccu

SEQ ID NO: 1317288 - RNA, 19 nt, Homo sapiens
gaacauggauugugaauga

SEQ ID NO: 1317289 - RNA, 19 nt, Homo sapiens
gcaaacaucuggaaagaaa

SEQ ID NO: 1317290 - RNA, 19 nt, Homo sapiens
ggagauaggacaucauuua

SEQ ID NO: 1317291 - RNA, 19 nt, Homo sapiens
ggaaagaaauauacccaaa

SEQ ID NO: 1317292 - RNA, 19 nt, Homo sapiens
caauaaagauguucuggaa

SEQ ID NO: 1317293 - RNA, 19 nt, Homo sapiens
guauugcucugccuuuaua

SEQ ID NO: 1317294 - RNA, 19 nt, Homo sapiens
gggaagacauggccuauuc

SEQ ID NO: 1317295 - RNA, 19 nt, Homo sapiens
uaucugagcuccuuugguu

SEQ ID NO: 1317296 - RNA, 19 nt, Homo sapiens
gaagauuagucccucauuc

SEQ ID NO: 1317297 - RNA, 19 nt, Homo sapiens
ucacuugaguccacuagua

SEQ ID NO: 1317298 - RNA, 19 nt, Homo sapiens
ccagugagguggcaucuug

SEQ ID NO: 1317299 - RNA, 19 nt, Homo sapiens
guacuuccuugcucuguuu

SEQ ID NO: 1317300 - RNA, 19 nt, Homo sapiens
uaaugaggccugagucuua

SEQ ID NO: 1317301 - RNA, 19 nt, Homo sapiens
gugaaugacucuguaauga

SEQ ID NO: 1317302 - RNA, 19 nt, Homo sapiens
gagcuccuuugguuaauuu

SEQ ID NO: 1317303 - RNA, 19 nt, Homo sapiens
gacagcggcuucacagauu

SEQ ID NO: 1317304 - RNA, 19 nt, Homo sapiens
ucuagaagcuuuaaaugug

SEQ ID NO: 1317305 - RNA, 19 nt, Homo sapiens
gagauaggacaucauuuaa

SEQ ID NO: 1317306 - RNA, 19 nt, Homo sapiens
ggacaaagucagaagauca

SEQ ID NO: 1317307 - RNA, 19 nt, Homo sapiens
uuaguuaucuuuccacuca

SEQ ID NO: 1317308 - RNA, 19 nt, Homo sapiens
gcauggaaaugagcuaaga

SEQ ID NO: 1317309 - RNA, 19 nt, Homo sapiens
gauaggacaucauuuaacg

SEQ ID NO: 1317310 - RNA, 19 nt, Homo sapiens
gauaggggcucacuaaaug

SEQ ID NO: 1317311 - RNA, 19 nt, Homo sapiens
gcacauugaccauggaguu

SEQ ID NO: 1317312 - RNA, 19 nt, Homo sapiens
guugauacauucagcaaau

SEQ ID NO: 1317313 - RNA, 19 nt, Homo sapiens
gacauggccuauucgugua

SEQ ID NO: 1317314 - RNA, 19 nt, Homo sapiens
gauugugaaugacucugua

SEQ ID NO: 1317315 - RNA, 19 nt, Homo sapiens
cagauucgauagccaguga

SEQ ID NO: 1317316 - RNA, 19 nt, Homo sapiens
gugggaacauggauuguga

SEQ ID NO: 1317317 - RNA, 19 nt, Homo sapiens
cgaggaaauaccagaaaua

SEQ ID NO: 1317318 - RNA, 19 nt, Homo sapiens
aauacuauguguccauuga

SEQ ID NO: 1317319 - RNA, 19 nt, Homo sapiens
guggaucggucacuagaga

SEQ ID NO: 1317320 - RNA, 19 nt, Homo sapiens
uuacugcucucucccaaau

SEQ ID NO: 1317321 - RNA, 19 nt, Homo sapiens
uggaagauguguuuaugug

SEQ ID NO: 1317322 - RNA, 19 nt, Homo sapiens
ugaagaaguguaagaaaga

SEQ ID NO: 1317323 - RNA, 19 nt, Homo sapiens
gaguggaacaucuuaguga

SEQ ID NO: 1317324 - RNA, 19 nt, Homo sapiens
caaagacacgggauuagau

SEQ ID NO: 1317325 - RNA, 19 nt, Homo sapiens
gugcacagcuacacaaagg

SEQ ID NO: 1317326 - RNA, 19 nt, Homo sapiens
gaggaaauaccagaaauag

SEQ ID NO: 1317327 - RNA, 19 nt, Homo sapiens
auacaaagacacgggauua

SEQ ID NO: 1317328 - RNA, 19 nt, Homo sapiens
uaacacaucuugccccuau

SEQ ID NO: 1317329 - RNA, 19 nt, Homo sapiens
caaauuuggagcacauuga

SEQ ID NO: 1317330 - RNA, 19 nt, Homo sapiens
ggauuuugcuuucuucauu

SEQ ID NO: 1317331 - RNA, 19 nt, Homo sapiens
uaaaagugccucuuaauug

SEQ ID NO: 1317332 - RNA, 19 nt, Homo sapiens
cagaagaaaugaggagaca

SEQ ID NO: 1317333 - RNA, 19 nt, Homo sapiens
acacacaccauuaguauca

SEQ ID NO: 1317334 - RNA, 19 nt, Homo sapiens
acgcauggcuguugaugga

SEQ ID NO: 1317335 - RNA, 19 nt, Homo sapiens
caucuugccccuauuauua

SEQ ID NO: 1317336 - RNA, 19 nt, Homo sapiens
aaucugaauuuaccuggaa

SEQ ID NO: 1317337 - RNA, 19 nt, Homo sapiens
gaagaaguguaagaaagac

SEQ ID NO: 1317338 - RNA, 19 nt, Homo sapiens
gaguagagcgaaggcauuu

SEQ ID NO: 1317339 - RNA, 19 nt, Homo sapiens
cuacacacaccauuaguau

SEQ ID NO: 1317340 - RNA, 19 nt, Homo sapiens
guaauucugcuauaacaca

SEQ ID NO: 1317341 - RNA, 19 nt, Homo sapiens
cuagaagcuuuaaaugugu

SEQ ID NO: 1317342 - RNA, 19 nt, Homo sapiens
gaucuaucuugcagaaagu

SEQ ID NO: 1317343 - RNA, 19 nt, Homo sapiens
guguaauuauugcccauuu

SEQ ID NO: 1317344 - RNA, 19 nt, Homo sapiens
guaaguuugacucccguua

SEQ ID NO: 1317345 - RNA, 19 nt, Homo sapiens
cagcaaauuuggagcacau

SEQ ID NO: 1317346 - RNA, 19 nt, Homo sapiens
gugcuuguguuccaugaau

SEQ ID NO: 1317347 - RNA, 19 nt, Homo sapiens
ggaagauuagucccucauu

SEQ ID NO: 1317348 - RNA, 19 nt, Homo sapiens
acaccagucgggaagauua

SEQ ID NO: 1317349 - RNA, 19 nt, Homo sapiens
gccuuguucuugcucauaa

SEQ ID NO: 1317350 - RNA, 19 nt, Homo sapiens
gcaaauuuggagcacauug

SEQ ID NO: 1317351 - RNA, 19 nt, Homo sapiens
uaacgcaucagcaaaguag

SEQ ID NO: 1317352 - RNA, 19 nt, Homo sapiens
gaugugagaaaggucauuu

SEQ ID NO: 1317353 - RNA, 19 nt, Homo sapiens
aguaauaucugagcuccuu

SEQ ID NO: 1317354 - RNA, 19 nt, Homo sapiens
cuugacaccugcauggaaa

SEQ ID NO: 1317355 - RNA, 19 nt, Homo sapiens
aggcaaacaucuggaaaga

SEQ ID NO: 1317356 - RNA, 19 nt, Homo sapiens
guaacuucuuuguuucaug

SEQ ID NO: 1317357 - RNA, 19 nt, Homo sapiens
ccucuuaauuggccauugu

SEQ ID NO: 1317358 - RNA, 19 nt, Homo sapiens
caggagauaggacaucauu

SEQ ID NO: 1317359 - RNA, 19 nt, Homo sapiens
gcagaguacaccgguauug

SEQ ID NO: 1317360 - RNA, 19 nt, Homo sapiens
gauacauucagcaaauuug

SEQ ID NO: 1317361 - RNA, 19 nt, Homo sapiens
gauaugccuuccagaugca

SEQ ID NO: 1317362 - RNA, 19 nt, Homo sapiens
gacaucauuuaacgcauca

SEQ ID NO: 1317363 - RNA, 19 nt, Homo sapiens
uugaagaaguguaagaaag

SEQ ID NO: 1317364 - RNA, 19 nt, Homo sapiens
ccgaggaaauaccagaaau

SEQ ID NO: 1317365 - RNA, 19 nt, Homo sapiens
ugagaaaggucauuuuagu

SEQ ID NO: 1317366 - RNA, 19 nt, Homo sapiens
aaagacacgggauuagauu

SEQ ID NO: 1317367 - RNA, 19 nt, Homo sapiens
gauacaaagacacgggauu

SEQ ID NO: 1317368 - RNA, 19 nt, Homo sapiens
cacuguauauggaaguauu

SEQ ID NO: 1317369 - RNA, 19 nt, Homo sapiens
uagcagcagaugccacaua

SEQ ID NO: 1317370 - RNA, 19 nt, Homo sapiens
cuacggguuucaucucuca

SEQ ID NO: 1317371 - RNA, 19 nt, Homo sapiens
gccuauucguguaauuauu

SEQ ID NO: 1317372 - RNA, 19 nt, Homo sapiens
gagucuagaagcuuuaaau

SEQ ID NO: 1317373 - RNA, 19 nt, Homo sapiens
gaaaugagcuaagaaaacc

SEQ ID NO: 1317374 - RNA, 19 nt, Homo sapiens
ggagcacauugaccaugga

SEQ ID NO: 1317375 - RNA, 19 nt, Homo sapiens
ggaagauguguuuaugugu

SEQ ID NO: 1317376 - RNA, 19 nt, Homo sapiens
ucauaaaagugccucuuaa

SEQ ID NO: 1317377 - RNA, 19 nt, Homo sapiens
ugguauugcucugccuuua

SEQ ID NO: 1317378 - RNA, 19 nt, Homo sapiens
gcucugcucugguauugcu

SEQ ID NO: 1317379 - RNA, 19 nt, Homo sapiens
ggaguggaacaucuuagug

SEQ ID NO: 1317380 - RNA, 19 nt, Homo sapiens
guguuucaccaaaguauuu

SEQ ID NO: 1317381 - RNA, 19 nt, Homo sapiens
guccaaauccaaucugaau

SEQ ID NO: 1317382 - RNA, 19 nt, Homo sapiens
guaccagccacuuguccua

SEQ ID NO: 1317383 - RNA, 19 nt, Homo sapiens
gcgaaggcauuugguggau

SEQ ID NO: 1317384 - RNA, 19 nt, Homo sapiens
caggucacuuccuccauga

SEQ ID NO: 1317385 - RNA, 19 nt, Homo sapiens
cccaaaggcucacgauagg

SEQ ID NO: 1317386 - RNA, 19 nt, Homo sapiens
uguaauuauugcccauuug

SEQ ID NO: 1317387 - RNA, 19 nt, Homo sapiens
ucccaaauucuguaaguuu

SEQ ID NO: 1317388 - RNA, 19 nt, Homo sapiens
gcuuauaccuugauuagua

SEQ ID NO: 1317389 - RNA, 19 nt, Homo sapiens
gauauagcaugucucuuua

SEQ ID NO: 1317390 - RNA, 19 nt, Homo sapiens
gcaagaagauugggagaaa

SEQ ID NO: 1317391 - RNA, 19 nt, Homo sapiens
gcugucaucuccuauaaua

SEQ ID NO: 1317392 - RNA, 19 nt, Homo sapiens
agacagaacuuagacauaa

SEQ ID NO: 1317393 - RNA, 19 nt, Homo sapiens
uagcaugucucuuuaguuu

SEQ ID NO: 1317394 - RNA, 19 nt, Homo sapiens
ggacuaugcuguagauauc

SEQ ID NO: 1317395 - RNA, 19 nt, Homo sapiens
uaaaggacaugauuucugu

SEQ ID NO: 1317396 - RNA, 19 nt, Homo sapiens
ggaaguaagggaagaaauu

SEQ ID NO: 1317397 - RNA, 19 nt, Homo sapiens
guacuuaaaugaagaugug

SEQ ID NO: 1317398 - RNA, 19 nt, Homo sapiens
ggacaugauuucuguauac

SEQ ID NO: 1317399 - RNA, 19 nt, Homo sapiens
gagcugucaucuccuauaa

SEQ ID NO: 1317400 - RNA, 19 nt, Homo sapiens
aaagaaagauugcccugaa

SEQ ID NO: 1317401 - RNA, 19 nt, Homo sapiens
gugaaggccuacgauauua

SEQ ID NO: 1317402 - RNA, 19 nt, Homo sapiens
gcuguugaccuaaauguua

SEQ ID NO: 1317403 - RNA, 19 nt, Homo sapiens
gccaggaaauuucaacaaa

SEQ ID NO: 1317404 - RNA, 19 nt, Homo sapiens
ccacuucacccucuugaua

SEQ ID NO: 1317405 - RNA, 19 nt, Homo sapiens
aaacaaagggaacaaauga

SEQ ID NO: 1317406 - RNA, 19 nt, Homo sapiens
gggaaugagugcagacuau

SEQ ID NO: 1317407 - RNA, 19 nt, Homo sapiens
uaacugguguggcagcuuu

SEQ ID NO: 1317408 - RNA, 19 nt, Homo sapiens
ugauauagcaugucucuuu

SEQ ID NO: 1317409 - RNA, 19 nt, Homo sapiens
gcaugugacuagcugauga

SEQ ID NO: 1317410 - RNA, 19 nt, Homo sapiens
gcacuaucaugaguuacua

SEQ ID NO: 1317411 - RNA, 19 nt, Homo sapiens
gauaagguaccacugauga

SEQ ID NO: 1317412 - RNA, 19 nt, Homo sapiens
cguaugggauagccuguua

SEQ ID NO: 1317413 - RNA, 19 nt, Homo sapiens
gaaauugcaguugcuuuaa

SEQ ID NO: 1317414 - RNA, 19 nt, Homo sapiens
gaaugugggaggaauaauu

SEQ ID NO: 1317415 - RNA, 19 nt, Homo sapiens
gcuacaaagucaauaggaa

SEQ ID NO: 1317416 - RNA, 19 nt, Homo sapiens
gaaguagcuuauaccuuga

SEQ ID NO: 1317417 - RNA, 19 nt, Homo sapiens
gugacuagcugaugaaucu

SEQ ID NO: 1317418 - RNA, 19 nt, Homo sapiens
gaaauaaccaaguguaagg

SEQ ID NO: 1317419 - RNA, 19 nt, Homo sapiens
gaaguaagggaagaaauug

SEQ ID NO: 1317420 - RNA, 19 nt, Homo sapiens
gauuauggcugaauguucu

SEQ ID NO: 1317421 - RNA, 19 nt, Homo sapiens
cuagcacuaucaugaguua

SEQ ID NO: 1317422 - RNA, 19 nt, Homo sapiens
agaaauugcaguugcuuua

SEQ ID NO: 1317423 - RNA, 19 nt, Homo sapiens
aaacuaagacacacacauu

SEQ ID NO: 1317424 - RNA, 19 nt, Homo sapiens
guaaaaggaugguguguau

SEQ ID NO: 1317425 - RNA, 19 nt, Homo sapiens
guaguuguauaccugauug

SEQ ID NO: 1317426 - RNA, 19 nt, Homo sapiens
gagacagaacuuagacaua

SEQ ID NO: 1317427 - RNA, 19 nt, Homo sapiens
gcagcauauuauagcauua

SEQ ID NO: 1317428 - RNA, 19 nt, Homo sapiens
guaaucugcuaugcaaauu

SEQ ID NO: 1317429 - RNA, 19 nt, Homo sapiens
ugaaaucacugggcuggaa

SEQ ID NO: 1317430 - RNA, 19 nt, Homo sapiens
ugaccuaaauguuauguag

SEQ ID NO: 1317431 - RNA, 19 nt, Homo sapiens
uauaaaugcgguaugcuua

SEQ ID NO: 1317432 - RNA, 19 nt, Homo sapiens
gucgguagcuauuaaguga

SEQ ID NO: 1317433 - RNA, 19 nt, Homo sapiens
uuaguaaucugcuaugcaa

SEQ ID NO: 1317434 - RNA, 19 nt, Homo sapiens
gaguuaguaccacauauaa

SEQ ID NO: 1317435 - RNA, 19 nt, Homo sapiens
gguaagugguagauuuaug

SEQ ID NO: 1317436 - RNA, 19 nt, Homo sapiens
ggagccaaaucauuagugu

SEQ ID NO: 1317437 - RNA, 19 nt, Homo sapiens
gaaggccuacgauauuauu

SEQ ID NO: 1317438 - RNA, 19 nt, Homo sapiens
gcaccugucuagaucuugu

SEQ ID NO: 1317439 - RNA, 19 nt, Homo sapiens
ucacaaugggcaaauuaua

SEQ ID NO: 1317440 - RNA, 19 nt, Homo sapiens
cgaguuaguaccacauaua

SEQ ID NO: 1317441 - RNA, 19 nt, Homo sapiens
ucugguaagugguagauuu

SEQ ID NO: 1317442 - RNA, 19 nt, Homo sapiens
cagggaugcuggucuuaaa

SEQ ID NO: 1317443 - RNA, 19 nt, Homo sapiens
agagugcgcugguaaagug

SEQ ID NO: 1317444 - RNA, 19 nt, Homo sapiens
guauacagauaucuaacug

SEQ ID NO: 1317445 - RNA, 19 nt, Homo sapiens
uaugagggcuacaaaguca

SEQ ID NO: 1317446 - RNA, 19 nt, Homo sapiens
gagcaucaauaucacucuu

SEQ ID NO: 1317447 - RNA, 19 nt, Homo sapiens
caaagggaacaaaugaauu

SEQ ID NO: 1317448 - RNA, 19 nt, Homo sapiens
guucacaaugggcaaauua

SEQ ID NO: 1317449 - RNA, 19 nt, Homo sapiens
uaacuuugccaggaaauuu

SEQ ID NO: 1317450 - RNA, 19 nt, Homo sapiens
cuacacagcugggccguau

SEQ ID NO: 1317451 - RNA, 19 nt, Homo sapiens
gaaugagugcagacuauga

SEQ ID NO: 1317452 - RNA, 19 nt, Homo sapiens
ggaagaaauugcaguugcu

SEQ ID NO: 1317453 - RNA, 19 nt, Homo sapiens
gcagaaugugggaggaaua

SEQ ID NO: 1317454 - RNA, 19 nt, Homo sapiens
ggaaauuucaacaaacuuc

SEQ ID NO: 1317455 - RNA, 19 nt, Homo sapiens
agccaaaucauuaguguua

SEQ ID NO: 1317456 - RNA, 19 nt, Homo sapiens
ccaaagugcugggauuaca

SEQ ID NO: 1317457 - RNA, 19 nt, Homo sapiens
gaacaucauaguguacuug

SEQ ID NO: 1317458 - RNA, 19 nt, Homo sapiens
gagaauaaacagggauuug

SEQ ID NO: 1317459 - RNA, 19 nt, Homo sapiens
gagcgaauggucacaguug

SEQ ID NO: 1317460 - RNA, 19 nt, Homo sapiens
ccacagagcacgaaauaac

SEQ ID NO: 1317461 - RNA, 19 nt, Homo sapiens
caaauuauagcaacagaca

SEQ ID NO: 1317462 - RNA, 19 nt, Homo sapiens
ggcucaaaguaucaauuua

SEQ ID NO: 1317463 - RNA, 19 nt, Homo sapiens
ggagaaaauugaagaaaag

SEQ ID NO: 1317464 - RNA, 19 nt, Homo sapiens
ccucauuguuacuuucuaa

SEQ ID NO: 1317465 - RNA, 19 nt, Homo sapiens
gaaagauugcccugaaagu

SEQ ID NO: 1317466 - RNA, 19 nt, Homo sapiens
uaaacaacuugaagccaau

SEQ ID NO: 1317467 - RNA, 19 nt, Homo sapiens
ggagugcaguggcgcaauc

SEQ ID NO: 1317468 - RNA, 19 nt, Homo sapiens
gaugguguguaucuaaaca

SEQ ID NO: 1317469 - RNA, 19 nt, Homo sapiens
aaaaggugguggcuuaaua

SEQ ID NO: 1317470 - RNA, 19 nt, Homo sapiens
gaauaccuaagacagaauu

SEQ ID NO: 1317471 - RNA, 19 nt, Homo sapiens
gcaugucucuuuaguuuug

SEQ ID NO: 1317472 - RNA, 19 nt, Homo sapiens
gcgaagagugcgcugguaa

SEQ ID NO: 1317473 - RNA, 19 nt, Homo sapiens
gaauugaagaugaugugaa

SEQ ID NO: 1317474 - RNA, 19 nt, Homo sapiens
cuaauguguuguauagcua

SEQ ID NO: 1317475 - RNA, 19 nt, Homo sapiens
ggaaggggucuuucuguua

SEQ ID NO: 1317476 - RNA, 19 nt, Homo sapiens
gaaauauccauuguucguu

SEQ ID NO: 1317477 - RNA, 19 nt, Homo sapiens
uaaacaaagggaacaaaug

SEQ ID NO: 1317478 - RNA, 19 nt, Homo sapiens
aagaaagauugcccugaaa

SEQ ID NO: 1317479 - RNA, 19 nt, Homo sapiens
gguggcgguugcaaacuuu

SEQ ID NO: 1317480 - RNA, 19 nt, Homo sapiens
guccacagagcacgaaaua

SEQ ID NO: 1317481 - RNA, 19 nt, Homo sapiens
ugcaguugcuuuaaagaaa

SEQ ID NO: 1317482 - RNA, 19 nt, Homo sapiens
caacagacagugaggaagu

SEQ ID NO: 1317483 - RNA, 19 nt, Homo sapiens
uaaaugaagaugugaaugg

SEQ ID NO: 1317484 - RNA, 19 nt, Homo sapiens
agacgaagcaagaagauug

SEQ ID NO: 1317485 - RNA, 19 nt, Homo sapiens
caacaacgaccacaacaac

SEQ ID NO: 1317486 - RNA, 19 nt, Homo sapiens
guacuucuaccacuguuug

SEQ ID NO: 1317487 - RNA, 19 nt, Homo sapiens
ccaggacuaugcuguagau

SEQ ID NO: 1317488 - RNA, 19 nt, Homo sapiens
gcucuugucuugagaauuu

SEQ ID NO: 1317489 - RNA, 19 nt, Homo sapiens
ggacagggauagacagaaa

SEQ ID NO: 1317490 - RNA, 19 nt, Homo sapiens
gaauuuagcuucuuguagu

SEQ ID NO: 1317491 - RNA, 19 nt, Homo sapiens
ggacauccguguauauuuc

SEQ ID NO: 1317492 - RNA, 19 nt, Homo sapiens
gaaguggaaucauuaaagu

SEQ ID NO: 1317493 - RNA, 19 nt, Homo sapiens
gcacaugcauugagacaca

SEQ ID NO: 1317494 - RNA, 19 nt, Homo sapiens
guaaggacauccguguaua

SEQ ID NO: 1317495 - RNA, 19 nt, Homo sapiens
gaauguagcgauagauauu

SEQ ID NO: 1317496 - RNA, 19 nt, Homo sapiens
ccaguuaacuuucuuguac

SEQ ID NO: 1317497 - RNA, 19 nt, Homo sapiens
ggacacagaccacagaugu

SEQ ID NO: 1317498 - RNA, 19 nt, Homo sapiens
ugaaaucccuagcuuguuc

SEQ ID NO: 1317499 - RNA, 19 nt, Homo sapiens
gagacaugguuaugccuaa

SEQ ID NO: 1317500 - RNA, 19 nt, Homo sapiens
acacgugaauguagcgaua

SEQ ID NO: 1317501 - RNA, 19 nt, Homo sapiens
ggaaguggaaucauuaaag

SEQ ID NO: 1317502 - RNA, 19 nt, Homo sapiens
ccaggaacacgcagacaua

SEQ ID NO: 1317503 - RNA, 19 nt, Homo sapiens
gcagggcguccgagcaaua

SEQ ID NO: 1317504 - RNA, 19 nt, Homo sapiens
gacuuuagcuauaguuaag

SEQ ID NO: 1317505 - RNA, 19 nt, Homo sapiens
acacgaaccuauuuauucu

SEQ ID NO: 1317506 - RNA, 19 nt, Homo sapiens
gcaauaagggcuggguuug

SEQ ID NO: 1317507 - RNA, 19 nt, Homo sapiens
gugaauguagcgauagaua

SEQ ID NO: 1317508 - RNA, 19 nt, Homo sapiens
ggugaaaucccuagcuugu

SEQ ID NO: 1317509 - RNA, 19 nt, Homo sapiens
gacaccaggucacggagaa

SEQ ID NO: 1317510 - RNA, 19 nt, Homo sapiens
cagcgcacaugcauugaga

SEQ ID NO: 1317511 - RNA, 19 nt, Homo sapiens
gauacacgaaccuauuuau

SEQ ID NO: 1317512 - RNA, 19 nt, Homo sapiens
acaugguuaugccuaauuu

SEQ ID NO: 1317513 - RNA, 19 nt, Homo sapiens
cgacuuuagcuauaguuaa

SEQ ID NO: 1317514 - RNA, 19 nt, Homo sapiens
cgauagauauuuggacauc

SEQ ID NO: 1317515 - RNA, 19 nt, Homo sapiens
guuaaaggaacgacaaugu

SEQ ID NO: 1317516 - RNA, 19 nt, Homo sapiens
acacacagaagagauuuaa

SEQ ID NO: 1317517 - RNA, 19 nt, Homo sapiens
gagcuucugcugcaaggaa

SEQ ID NO: 1317518 - RNA, 19 nt, Homo sapiens
ggaacacgcagacauaugc

SEQ ID NO: 1317519 - RNA, 19 nt, Homo sapiens
gguuucaaaucacgacaga

SEQ ID NO: 1317520 - RNA, 19 nt, Homo sapiens
caaguuaaaggaacgacaa

SEQ ID NO: 1317521 - RNA, 19 nt, Homo sapiens
ucauccgguuugcaaguua

SEQ ID NO: 1317522 - RNA, 19 nt, Homo sapiens
cauccgguuugcaaguuaa

SEQ ID NO: 1317523 - RNA, 19 nt, Homo sapiens
uacacgaaccuauuuauuc

SEQ ID NO: 1317524 - RNA, 19 nt, Homo sapiens
uaaggacauccguguauau

SEQ ID NO: 1317525 - RNA, 19 nt, Homo sapiens
caucggaacugagaauugc

SEQ ID NO: 1317526 - RNA, 19 nt, Homo sapiens
ccacuugucaccuaccuau

SEQ ID NO: 1317527 - RNA, 19 nt, Homo sapiens
uuaaaggaacgacaauguu

SEQ ID NO: 1317528 - RNA, 19 nt, Homo sapiens
cagguuauguuuaccaacu

SEQ ID NO: 1317529 - RNA, 19 nt, Homo sapiens
gauagauauuuggacauca

SEQ ID NO: 1317530 - RNA, 19 nt, Homo sapiens
aauaagggcuggguuuguc

SEQ ID NO: 1317531 - RNA, 19 nt, Homo sapiens
ugauacacgaaccuauuua

SEQ ID NO: 1317532 - RNA, 19 nt, Homo sapiens
gcauugagacacacgauac

SEQ ID NO: 1317533 - RNA, 19 nt, Homo sapiens
uucggaagguuucaaauca

SEQ ID NO: 1317534 - RNA, 19 nt, Homo sapiens
gggaaguggaaucauuaaa

SEQ ID NO: 1317535 - RNA, 19 nt, Homo sapiens
gacaugguuaugccuaauu

SEQ ID NO: 1317536 - RNA, 19 nt, Homo sapiens
ucuccucguugcccuguaa

SEQ ID NO: 1317537 - RNA, 19 nt, Homo sapiens
aaacgucuguggagcuucu

SEQ ID NO: 1317538 - RNA, 19 nt, Homo sapiens
cccuucauccuguuauuua

SEQ ID NO: 1317539 - RNA, 19 nt, Homo sapiens
gacauugcaucgcccuagu

SEQ ID NO: 1317540 - RNA, 19 nt, Homo sapiens
ucacggagaaacacaaaca

SEQ ID NO: 1317541 - RNA, 19 nt, Homo sapiens
aaacaaccacgcagacagu

SEQ ID NO: 1317542 - RNA, 19 nt, Homo sapiens
aaacacacagaagagauuu

SEQ ID NO: 1317543 - RNA, 19 nt, Homo sapiens
ggucacggagaaacacaaa

SEQ ID NO: 1317544 - RNA, 19 nt, Homo sapiens
ugaauguagcgauagauau

SEQ ID NO: 1317545 - RNA, 19 nt, Homo sapiens
ggucaccaaugggauucuu

SEQ ID NO: 1317546 - RNA, 19 nt, Homo sapiens
ggauagacagaaagagaca

SEQ ID NO: 1317547 - RNA, 19 nt, Homo sapiens
uuaaacgucuguggagcuu

SEQ ID NO: 1317548 - RNA, 19 nt, Homo sapiens
aucccuagcuuguucuuga

SEQ ID NO: 1317549 - RNA, 19 nt, Homo sapiens
uguaaggacauccguguau

SEQ ID NO: 1317550 - RNA, 19 nt, Homo sapiens
ggcagguuauguuuaccaa

SEQ ID NO: 1317551 - RNA, 19 nt, Homo sapiens
ccaggucaccaaugggauu

SEQ ID NO: 1317552 - RNA, 19 nt, Homo sapiens
ucaccuaccuauccccuuu

SEQ ID NO: 1317553 - RNA, 19 nt, Homo sapiens
caauaagggcuggguuugu

SEQ ID NO: 1317554 - RNA, 19 nt, Homo sapiens
acgcagcgcacaugcauug

SEQ ID NO: 1317555 - RNA, 19 nt, Homo sapiens
cauugcaucgcccuaguuu

SEQ ID NO: 1317556 - RNA, 19 nt, Homo sapiens
gggacugguuggccaaacu

SEQ ID NO: 1317557 - RNA, 19 nt, Homo sapiens
ugaauuuagcuucuuguag

SEQ ID NO: 1317558 - RNA, 19 nt, Homo sapiens
gcaccaguuaacuuucuug

SEQ ID NO: 1317559 - RNA, 19 nt, Homo sapiens
gaaaacacacagaagagau

SEQ ID NO: 1317560 - RNA, 19 nt, Homo sapiens
aaagaaaacacacagaaga

SEQ ID NO: 1317561 - RNA, 19 nt, Homo sapiens
caaacaccacccaggaaca

SEQ ID NO: 1317562 - RNA, 19 nt, Homo sapiens
cacaaacaccacccaggaa

SEQ ID NO: 1317563 - RNA, 19 nt, Homo sapiens
ccuauuuauucucgugguu

SEQ ID NO: 1317564 - RNA, 19 nt, Homo sapiens
cuugauacacgaaccuauu

SEQ ID NO: 1317565 - RNA, 19 nt, Homo sapiens
cucccgguguuguuauuaa

SEQ ID NO: 1317566 - RNA, 19 nt, Homo sapiens
gcccuaguuuucuuucuuu

SEQ ID NO: 1317567 - RNA, 19 nt, Homo sapiens
cacgacagaguccauguug

SEQ ID NO: 1317568 - RNA, 19 nt, Homo sapiens
uugauacacgaaccuauuu

SEQ ID NO: 1317569 - RNA, 19 nt, Homo sapiens
cuggugaaaucccuagcuu

SEQ ID NO: 1317570 - RNA, 19 nt, Homo sapiens
caugguuaugccuaauuua

SEQ ID NO: 1317571 - RNA, 19 nt, Homo sapiens
agacaugguuaugccuaau

SEQ ID NO: 1317572 - RNA, 19 nt, Homo sapiens
aaggacauccguguauauu

SEQ ID NO: 1317573 - RNA, 19 nt, Homo sapiens
ccaucggaacugagaauug

SEQ ID NO: 1317574 - RNA, 19 nt, Homo sapiens
cacaacacuugaggccaaa

SEQ ID NO: 1317575 - RNA, 19 nt, Homo sapiens
ccacacagagaaacaacca

SEQ ID NO: 1317576 - RNA, 19 nt, Homo sapiens
ucccgguguuguuauuaaa

SEQ ID NO: 1317577 - RNA, 19 nt, Homo sapiens
gaacugagaauugcaaaac

SEQ ID NO: 1317578 - RNA, 19 nt, Homo sapiens
gcgcacaugcauugagaca

SEQ ID NO: 1317579 - RNA, 19 nt, Homo sapiens
ucacgacagaguccauguu

SEQ ID NO: 1317580 - RNA, 19 nt, Homo sapiens
ccuucauccuguuauuuau

SEQ ID NO: 1317581 - RNA, 19 nt, Homo sapiens
cagggcguccgagcaauaa

SEQ ID NO: 1317582 - RNA, 19 nt, Homo sapiens
gcaaggagaucauuauuga

SEQ ID NO: 1317583 - RNA, 19 nt, Homo sapiens
cacauaagcucucaauaaa

SEQ ID NO: 1317584 - RNA, 19 nt, Homo sapiens
acacauaagcucucaauaa

SEQ ID NO: 1317585 - RNA, 19 nt, Homo sapiens
ccuuugagcuggucuauga

SEQ ID NO: 1317586 - RNA, 19 nt, Homo sapiens
gccaggagcugaccgaugu

SEQ ID NO: 1317587 - RNA, 19 nt, Homo sapiens
cacuaugccuggcuaauuu

SEQ ID NO: 1317588 - RNA, 19 nt, Homo sapiens
gcacuaugccuggcuaauu

SEQ ID NO: 1317589 - RNA, 19 nt, Homo sapiens
gaacuccugacucaaauga

SEQ ID NO: 1317590 - RNA, 19 nt, Homo sapiens
acuaguaccucccucuuaa

SEQ ID NO: 1317591 - RNA, 19 nt, Homo sapiens
gacagggccuuccaucuag

SEQ ID NO: 1317592 - RNA, 19 nt, Homo sapiens
cauaagcucucaauaaacg

SEQ ID NO: 1317593 - RNA, 19 nt, Homo sapiens
gaugcagugugcuuugauu

SEQ ID NO: 1317594 - RNA, 19 nt, Homo sapiens
agacagggccuuccaucua

SEQ ID NO: 1317595 - RNA, 19 nt, Homo sapiens
gcccaccgcugucaacaug

SEQ ID NO: 1317596 - RNA, 19 nt, Homo sapiens
gaucucggcucacugaaac

SEQ ID NO: 1317597 - RNA, 19 nt, Homo sapiens
gcucagcaaccaagauaaa

SEQ ID NO: 1317598 - RNA, 19 nt, Homo sapiens
aacguuagcuuaucauugu

SEQ ID NO: 1317599 - RNA, 19 nt, Homo sapiens
acaaugagcugggcaugga

SEQ ID NO: 1317600 - RNA, 19 nt, Homo sapiens
gcucaugccuguaauucca

SEQ ID NO: 1317601 - RNA, 19 nt, Homo sapiens
ggagaucauuauugaagag

SEQ ID NO: 1317602 - RNA, 19 nt, Homo sapiens
ggauggaacccuagaugga

SEQ ID NO: 1317603 - RNA, 19 nt, Homo sapiens
gacaugauuucgccguguu

SEQ ID NO: 1317604 - RNA, 19 nt, Homo sapiens
cacaagaucgggagauuga

SEQ ID NO: 1317605 - RNA, 19 nt, Homo sapiens
cgaggcagguggaucacaa

SEQ ID NO: 1317606 - RNA, 19 nt, Homo sapiens
cgaccuggcugauguugca

SEQ ID NO: 1317607 - RNA, 19 nt, Homo sapiens
gaaccuucuuaaauucugu

SEQ ID NO: 1317608 - RNA, 19 nt, Homo sapiens
cucaauaaacguuagcuua

SEQ ID NO: 1317609 - RNA, 19 nt, Homo sapiens
gcgggagaguggcgugaaa

SEQ ID NO: 1317610 - RNA, 19 nt, Homo sapiens
gcagugugcuuugauugca

SEQ ID NO: 1317611 - RNA, 19 nt, Homo sapiens
uaacauaggaagagcuugu

SEQ ID NO: 1317612 - RNA, 19 nt, Homo sapiens
gccuugguuuccucauuua

SEQ ID NO: 1317613 - RNA, 19 nt, Homo sapiens
ucugcaggauguaguuuaa

SEQ ID NO: 1317614 - RNA, 19 nt, Homo sapiens
uauuggagacaccauguua

SEQ ID NO: 1317615 - RNA, 19 nt, Homo sapiens
ggagcugaccgauguuaau

SEQ ID NO: 1317616 - RNA, 19 nt, Homo sapiens
ggcaaggagaucauuauug

SEQ ID NO: 1317617 - RNA, 19 nt, Homo sapiens
gcaccugggauuggaguuu

SEQ ID NO: 1317618 - RNA, 19 nt, Homo sapiens
ccuaccagcuggccauugu

SEQ ID NO: 1317619 - RNA, 19 nt, Homo sapiens
gugcaguggugccgucuca

SEQ ID NO: 1317620 - RNA, 19 nt, Homo sapiens
gaaaccccaucucuacuga

SEQ ID NO: 1317621 - RNA, 19 nt, Homo sapiens
caagaucgggagauugaga

SEQ ID NO: 1317622 - RNA, 19 nt, Homo sapiens
ugccuugguuuccucauuu

SEQ ID NO: 1317623 - RNA, 19 nt, Homo sapiens
uagccugccucucuagguu

SEQ ID NO: 1317624 - RNA, 19 nt, Homo sapiens
gagcugaccgauguuaaug

SEQ ID NO: 1317625 - RNA, 19 nt, Homo sapiens
aaacguuagcuuaucauug

SEQ ID NO: 1317626 - RNA, 19 nt, Homo sapiens
aaacacauaagcucucaau

SEQ ID NO: 1317627 - RNA, 19 nt, Homo sapiens
caccaugcccagcugauuu

SEQ ID NO: 1317628 - RNA, 19 nt, Homo sapiens
ggaauccugccuucgaugu

SEQ ID NO: 1317629 - RNA, 19 nt, Homo sapiens
gagaccaguuuggguaaca

SEQ ID NO: 1317630 - RNA, 19 nt, Homo sapiens
ugaccuuacagcaguauuu

SEQ ID NO: 1317631 - RNA, 19 nt, Homo sapiens
ugccacagccuccugagua

SEQ ID NO: 1317632 - RNA, 19 nt, Homo sapiens
aagcucagcaaccaagaua

SEQ ID NO: 1317633 - RNA, 19 nt, Homo sapiens
gugccuugguuuccucauu

SEQ ID NO: 1317634 - RNA, 19 nt, Homo sapiens
cugaguagcugggauuaca

SEQ ID NO: 1317635 - RNA, 19 nt, Homo sapiens
agucguggcuggucuccaa

SEQ ID NO: 1317636 - RNA, 19 nt, Homo sapiens
ccgaguagcugggauugca

SEQ ID NO: 1317637 - RNA, 19 nt, Homo sapiens
gaccacacuuguuccuagu

SEQ ID NO: 1317638 - RNA, 19 nt, Homo sapiens
gagcugggcauggaacuca

SEQ ID NO: 1317639 - RNA, 19 nt, Homo sapiens
gccacagccuccugaguag

SEQ ID NO: 1317640 - RNA, 19 nt, Homo sapiens
gauugcagcaccugggauu

SEQ ID NO: 1317641 - RNA, 19 nt, Homo sapiens
cuucuuaaauucuguacca

SEQ ID NO: 1317642 - RNA, 19 nt, Homo sapiens
caguuuggguaacauagga

SEQ ID NO: 1317643 - RNA, 19 nt, Homo sapiens
gaccaguuuggguaacaua

SEQ ID NO: 1317644 - RNA, 19 nt, Homo sapiens
caucacugguggcaucauc

SEQ ID NO: 1317645 - RNA, 19 nt, Homo sapiens
gguaacauaggaagagcuu

SEQ ID NO: 1317646 - RNA, 19 nt, Homo sapiens
gcaggauguaguuuaacaa

SEQ ID NO: 1317647 - RNA, 19 nt, Homo sapiens
caaggaugcagugugcuuu

SEQ ID NO: 1317648 - RNA, 19 nt, Homo sapiens
caucuccagggcagaauuu

SEQ ID NO: 1317649 - RNA, 19 nt, Homo sapiens
uugagaccauccuggcuaa

SEQ ID NO: 1317650 - RNA, 19 nt, Homo sapiens
uaaccaccaccaucucuuc

SEQ ID NO: 1317651 - RNA, 19 nt, Homo sapiens
caccugggauuggaguuug

SEQ ID NO: 1317652 - RNA, 19 nt, Homo sapiens
caacacccugguuccacua

SEQ ID NO: 1317653 - RNA, 19 nt, Homo sapiens
gagcccaggaguucaagga

SEQ ID NO: 1317654 - RNA, 19 nt, Homo sapiens
ucgaacuccugacucaaau

SEQ ID NO: 1317655 - RNA, 19 nt, Homo sapiens
caaggagaucauuauugaa

SEQ ID NO: 1317656 - RNA, 19 nt, Homo sapiens
cggcaaggagaucauuauu

SEQ ID NO: 1317657 - RNA, 19 nt, Homo sapiens
gagcauugggaagagcaua

SEQ ID NO: 1317658 - RNA, 19 nt, Homo sapiens
uacuaguaccucccucuua

SEQ ID NO: 1317659 - RNA, 19 nt, Homo sapiens
ccuaaccuagucugaguuu

SEQ ID NO: 1317660 - RNA, 19 nt, Homo sapiens
ugcaggauguaguuuaaca

SEQ ID NO: 1317661 - RNA, 19 nt, Homo sapiens
caggagcugaccgauguua

SEQ ID NO: 1317662 - RNA, 19 nt, Homo sapiens
aaggagaucauuauugaag

SEQ ID NO: 1317663 - RNA, 19 nt, Homo sapiens
gacgugaaacggagcuaug

SEQ ID NO: 1317664 - RNA, 19 nt, Homo sapiens
caggauguaguuuaacaau

SEQ ID NO: 1317665 - RNA, 19 nt, Homo sapiens
ugccucagccucccgagua

SEQ ID NO: 1317666 - RNA, 19 nt, Homo sapiens
gagaccauccuggcuaaca

SEQ ID NO: 1317667 - RNA, 19 nt, Homo sapiens
cuugguuuccucauuuaua

SEQ ID NO: 1317668 - RNA, 19 nt, Homo sapiens
ugaaccuucuuaaauucug

SEQ ID NO: 1317669 - RNA, 19 nt, Homo sapiens
aggagaucauuauugaaga

SEQ ID NO: 1317670 - RNA, 19 nt, Homo sapiens
ucaaggaugcagugugcuu

SEQ ID NO: 1317671 - RNA, 19 nt, Homo sapiens
ugacaucuccagggcagaa

SEQ ID NO: 1317672 - RNA, 19 nt, Homo sapiens
ucccuagccugccucucua

SEQ ID NO: 1317673 - RNA, 19 nt, Homo sapiens
ccacugugccugaccuuac

SEQ ID NO: 1317674 - RNA, 19 nt, Homo sapiens
acuccugacucaaaugauc

SEQ ID NO: 1317675 - RNA, 19 nt, Homo sapiens
ggagaguggcgugaaacug

SEQ ID NO: 1317676 - RNA, 19 nt, Homo sapiens
ucacaagaucgggagauug

SEQ ID NO: 1317677 - RNA, 19 nt, Homo sapiens
uaagcucucaauaaacguu

SEQ ID NO: 1317678 - RNA, 19 nt, Homo sapiens
gccacacccuaaccuaguc

SEQ ID NO: 1317679 - RNA, 19 nt, Homo sapiens
gucucgaacuccugacuca

SEQ ID NO: 1317680 - RNA, 19 nt, Homo sapiens
ccaccaugcccagcugauu

SEQ ID NO: 1317681 - RNA, 19 nt, Homo sapiens
agaccauccuggcuaacau

SEQ ID NO: 1317682 - RNA, 19 nt, Homo sapiens
gugaagagcuccuuugaua

SEQ ID NO: 1317683 - RNA, 19 nt, Homo sapiens
ggacaugaguguucuguuc

SEQ ID NO: 1317684 - RNA, 19 nt, Homo sapiens
gaaugcuggucaagauuua

SEQ ID NO: 1317685 - RNA, 19 nt, Homo sapiens
gggaaguacuuaaguggua

SEQ ID NO: 1317686 - RNA, 19 nt, Homo sapiens
cggaagacauggcuaagua

SEQ ID NO: 1317687 - RNA, 19 nt, Homo sapiens
gaagagcuccuuugauaau

SEQ ID NO: 1317688 - RNA, 19 nt, Homo sapiens
gcucuuccauguucucuuu

SEQ ID NO: 1317689 - RNA, 19 nt, Homo sapiens
ucacagggcuuccagaauc

SEQ ID NO: 1317690 - RNA, 19 nt, Homo sapiens
gaagugguguuuugucaua

SEQ ID NO: 1317691 - RNA, 19 nt, Homo sapiens
gauuucaccuccucaaaga

SEQ ID NO: 1317692 - RNA, 19 nt, Homo sapiens
ugauaaagcugagugagaa

SEQ ID NO: 1317693 - RNA, 19 nt, Homo sapiens
guaaacagcacaccucaga

SEQ ID NO: 1317694 - RNA, 19 nt, Homo sapiens
caaguauagugcauaaaga

SEQ ID NO: 1317695 - RNA, 19 nt, Homo sapiens
caauuagacaugccuauaa

SEQ ID NO: 1317696 - RNA, 19 nt, Homo sapiens
gagcuccuuugauaaugua

SEQ ID NO: 1317697 - RNA, 19 nt, Homo sapiens
uaaagcugagugagaauua

SEQ ID NO: 1317698 - RNA, 19 nt, Homo sapiens
ugagaaugcuggucaagau

SEQ ID NO: 1317699 - RNA, 19 nt, Homo sapiens
aaacgucucucuccaugug

SEQ ID NO: 1317700 - RNA, 19 nt, Homo sapiens
ggccauguguuuaaacuuc

SEQ ID NO: 1317701 - RNA, 19 nt, Homo sapiens
ggucaagauuuaccuuuua

SEQ ID NO: 1317702 - RNA, 19 nt, Homo sapiens
ggaauacauccaacccuuu

SEQ ID NO: 1317703 - RNA, 19 nt, Homo sapiens
ccagugcacuccuuaucaa

SEQ ID NO: 1317704 - RNA, 19 nt, Homo sapiens
ggaaguacuuaagugguau

SEQ ID NO: 1317705 - RNA, 19 nt, Homo sapiens
cuaaagcuuuccuugagaa

SEQ ID NO: 1317706 - RNA, 19 nt, Homo sapiens
agacaugccuauaauaaac

SEQ ID NO: 1317707 - RNA, 19 nt, Homo sapiens
aaggagaccugccuaguca

SEQ ID NO: 1317708 - RNA, 19 nt, Homo sapiens
gaaggagaccugccuaguc

SEQ ID NO: 1317709 - RNA, 19 nt, Homo sapiens
gaaaauagucuuggaaaug

SEQ ID NO: 1317710 - RNA, 19 nt, Homo sapiens
cuaaauaacgacuaggaaa

SEQ ID NO: 1317711 - RNA, 19 nt, Homo sapiens
gaauacauccaacccuuuc

SEQ ID NO: 1317712 - RNA, 19 nt, Homo sapiens
gugcacuccuuaucaauag

SEQ ID NO: 1317713 - RNA, 19 nt, Homo sapiens
ucacagaggacaugagugu

SEQ ID NO: 1317714 - RNA, 19 nt, Homo sapiens
ucaauuagacaugccuaua

SEQ ID NO: 1317715 - RNA, 19 nt, Homo sapiens
ggugucauuuccucucuga

SEQ ID NO: 1317716 - RNA, 19 nt, Homo sapiens
gaaagcuaaauaacgacua

SEQ ID NO: 1317717 - RNA, 19 nt, Homo sapiens
ggaaaauagucuuggaaau

SEQ ID NO: 1317718 - RNA, 19 nt, Homo sapiens
gagaaugcuggucaagauu

SEQ ID NO: 1317719 - RNA, 19 nt, Homo sapiens
uccgaaagcuaaauaacga

SEQ ID NO: 1317720 - RNA, 19 nt, Homo sapiens
gaagacauggcuaaguauc

SEQ ID NO: 1317721 - RNA, 19 nt, Homo sapiens
ggaagacauggcuaaguau

SEQ ID NO: 1317722 - RNA, 19 nt, Homo sapiens
ugaagagcuccuuugauaa

SEQ ID NO: 1317723 - RNA, 19 nt, Homo sapiens
gaucacagaggacaugagu

SEQ ID NO: 1317724 - RNA, 19 nt, Homo sapiens
gacucuauccuuccaguuu

SEQ ID NO: 1317725 - RNA, 19 nt, Homo sapiens
agaauuauauuggccaaca

SEQ ID NO: 1317726 - RNA, 19 nt, Homo sapiens
cauuugggauugaggaguu

SEQ ID NO: 1317727 - RNA, 19 nt, Homo sapiens
guauagugcauaaagaaug

SEQ ID NO: 1317728 - RNA, 19 nt, Homo sapiens
aaagcuaaauaacgacuag

SEQ ID NO: 1317729 - RNA, 19 nt, Homo sapiens
gcagaugaggcgcaggaaa

SEQ ID NO: 1317730 - RNA, 19 nt, Homo sapiens
gaggaucacccgccuucuu

SEQ ID NO: 1317731 - RNA, 19 nt, Homo sapiens
cuaaaguauuuccggaaga

SEQ ID NO: 1317732 - RNA, 19 nt, Homo sapiens
aggaucacccgccuucuua

SEQ ID NO: 1317733 - RNA, 19 nt, Homo sapiens
ggucacagggcuuccagaa

SEQ ID NO: 1317734 - RNA, 19 nt, Homo sapiens
ggacuuaacggccacucau

SEQ ID NO: 1317735 - RNA, 19 nt, Homo sapiens
ucaaguauagugcauaaag

SEQ ID NO: 1317736 - RNA, 19 nt, Homo sapiens
gcuaaauaacgacuaggaa

SEQ ID NO: 1317737 - RNA, 19 nt, Homo sapiens
ccucuguccucauuguuug

SEQ ID NO: 1317738 - RNA, 19 nt, Homo sapiens
agacauggcuaaguaucga

SEQ ID NO: 1317739 - RNA, 19 nt, Homo sapiens
ucuaaagcuuuccuugaga

SEQ ID NO: 1317740 - RNA, 19 nt, Homo sapiens
gaugugaagagcuccuuug

SEQ ID NO: 1317741 - RNA, 19 nt, Homo sapiens
agaaugcuggucaagauuu

SEQ ID NO: 1317742 - RNA, 19 nt, Homo sapiens
uaugguguccgaaagcuaa

SEQ ID NO: 1317743 - RNA, 19 nt, Homo sapiens
gguuuucgguucuggaaua

SEQ ID NO: 1317744 - RNA, 19 nt, Homo sapiens
cagcuugucuggcgucaac

SEQ ID NO: 1317745 - RNA, 19 nt, Homo sapiens
uuaaaagccuguugauuca

SEQ ID NO: 1317746 - RNA, 19 nt, Homo sapiens
uugcauauguugcuauugg

SEQ ID NO: 1317747 - RNA, 19 nt, Homo sapiens
uaaaguauuuccggaagac

SEQ ID NO: 1317748 - RNA, 19 nt, Homo sapiens
gaaguacuuaagugguauu

SEQ ID NO: 1317749 - RNA, 19 nt, Homo sapiens
gguguccgaaagcuaaaua

SEQ ID NO: 1317750 - RNA, 19 nt, Homo sapiens
guauuaugguguccgaaag

SEQ ID NO: 1317751 - RNA, 19 nt, Homo sapiens
ccagggacguggcuuacag

SEQ ID NO: 1317752 - RNA, 19 nt, Homo sapiens
ucaccagggacguggcuua

SEQ ID NO: 1317753 - RNA, 19 nt, Homo sapiens
ccucagaagugguguuuug

SEQ ID NO: 1317754 - RNA, 19 nt, Homo sapiens
aaacagcacaccucagaag

SEQ ID NO: 1317755 - RNA, 19 nt, Homo sapiens
ggaucacccgccuucuuaa

SEQ ID NO: 1317756 - RNA, 19 nt, Homo sapiens
ugagugagaauuauauugg

SEQ ID NO: 1317757 - RNA, 19 nt, Homo sapiens
aagcugagugagaauuaua

SEQ ID NO: 1317758 - RNA, 19 nt, Homo sapiens
gcaggaaaauagucuugga

SEQ ID NO: 1317759 - RNA, 19 nt, Homo sapiens
cuuagugggccauguguuu

SEQ ID NO: 1317760 - RNA, 19 nt, Homo sapiens
ggcccuguauugcuuagug

SEQ ID NO: 1317761 - RNA, 19 nt, Homo sapiens
aaagcugagugagaauuau

SEQ ID NO: 1317762 - RNA, 19 nt, Homo sapiens
gcagggauggucacacagu

SEQ ID NO: 1317763 - RNA, 19 nt, Homo sapiens
gaauuauauuggccaacag

SEQ ID NO: 1317764 - RNA, 19 nt, Homo sapiens
ugcuugagcuccaggauca

SEQ ID NO: 1317765 - RNA, 19 nt, Homo sapiens
cauguucucuuugcacaag

SEQ ID NO: 1317766 - RNA, 19 nt, Homo sapiens
ggagaccugccuagucaca

SEQ ID NO: 1317767 - RNA, 19 nt, Homo sapiens
aggcagggauggucacaca

SEQ ID NO: 1317768 - RNA, 19 nt, Homo sapiens
guuauuggaguguugaugu

SEQ ID NO: 1317769 - RNA, 19 nt, Homo sapiens
uuagugggccauguguuua

SEQ ID NO: 1317770 - RNA, 19 nt, Homo sapiens
gcugagugagaauuauauu

SEQ ID NO: 1317771 - RNA, 19 nt, Homo sapiens
ggauugaggaguuguugag

SEQ ID NO: 1317772 - RNA, 19 nt, Homo sapiens
cacaagcgacucuauccuu

SEQ ID NO: 1317773 - RNA, 19 nt, Homo sapiens
ugugggaaguacuuaagug

SEQ ID NO: 1317774 - RNA, 19 nt, Homo sapiens
uaaugugggaaguacuuaa

SEQ ID NO: 1317775 - RNA, 19 nt, Homo sapiens
cagcucacccucccugugu

SEQ ID NO: 1317776 - RNA, 19 nt, Homo sapiens
ucagucccguggcccugua

SEQ ID NO: 1317777 - RNA, 19 nt, Homo sapiens
guggaagucucaggucagu

SEQ ID NO: 1317778 - RNA, 19 nt, Homo sapiens
gaaacgucucucuccaugu

SEQ ID NO: 1317779 - RNA, 19 nt, Homo sapiens
gccagugcacuccuuauca

SEQ ID NO: 1317780 - RNA, 19 nt, Homo sapiens
acagaggacaugaguguuc

SEQ ID NO: 1317781 - RNA, 19 nt, Homo sapiens
ccucccagcucacaauagg

SEQ ID NO: 1317782 - RNA, 19 nt, Homo sapiens
gcaaagaccuauuucauug

SEQ ID NO: 1317783 - RNA, 19 nt, Homo sapiens
gaacggguauugauugaua

SEQ ID NO: 1317784 - RNA, 19 nt, Homo sapiens
gaagggagaugcuuuguac

SEQ ID NO: 1317785 - RNA, 19 nt, Homo sapiens
ggaauuaucaucuggcuaa

SEQ ID NO: 1317786 - RNA, 19 nt, Homo sapiens
gggaagagauccuaaugga

SEQ ID NO: 1317787 - RNA, 19 nt, Homo sapiens
ggaagaagcccacauugga

SEQ ID NO: 1317788 - RNA, 19 nt, Homo sapiens
ggagaugcuuuguacauau

SEQ ID NO: 1317789 - RNA, 19 nt, Homo sapiens
ggaccauggugcucuuuaa

SEQ ID NO: 1317790 - RNA, 19 nt, Homo sapiens
guaaguaugugaugagcaa

SEQ ID NO: 1317791 - RNA, 19 nt, Homo sapiens
uguaugagcucgguauaua

SEQ ID NO: 1317792 - RNA, 19 nt, Homo sapiens
ggauaaacauguccaucuu

SEQ ID NO: 1317793 - RNA, 19 nt, Homo sapiens
gagaacggguauugauuga

SEQ ID NO: 1317794 - RNA, 19 nt, Homo sapiens
gaggaaagaaggaaauaaa

SEQ ID NO: 1317795 - RNA, 19 nt, Homo sapiens
guaaaccacauguuagaua

SEQ ID NO: 1317796 - RNA, 19 nt, Homo sapiens
gggagaugcuuuguacaua

SEQ ID NO: 1317797 - RNA, 19 nt, Homo sapiens
gagaugcuuuguacauauu

SEQ ID NO: 1317798 - RNA, 19 nt, Homo sapiens
cugaacaacugccugaaua

SEQ ID NO: 1317799 - RNA, 19 nt, Homo sapiens
gcauuucacugacuucuag

SEQ ID NO: 1317800 - RNA, 19 nt, Homo sapiens
ucacuaaugcuguuacuaa

SEQ ID NO: 1317801 - RNA, 19 nt, Homo sapiens
gcacuuaggaccuucuuga

SEQ ID NO: 1317802 - RNA, 19 nt, Homo sapiens
gcacugguuuagggacuua

SEQ ID NO: 1317803 - RNA, 19 nt, Homo sapiens
ucaaggacauucagugguu

SEQ ID NO: 1317804 - RNA, 19 nt, Homo sapiens
gcaaugaggaggaguggaa

SEQ ID NO: 1317805 - RNA, 19 nt, Homo sapiens
ggagaacggguauugauug

SEQ ID NO: 1317806 - RNA, 19 nt, Homo sapiens
acagaucacuuucucuuug

SEQ ID NO: 1317807 - RNA, 19 nt, Homo sapiens
ggaacaagcccugggauug

SEQ ID NO: 1317808 - RNA, 19 nt, Homo sapiens
aaacccagcuccucacuuc

SEQ ID NO: 1317809 - RNA, 19 nt, Homo sapiens
gcugucuucuguaaugaua

SEQ ID NO: 1317810 - RNA, 19 nt, Homo sapiens
caauugcccugcugaacaa

SEQ ID NO: 1317811 - RNA, 19 nt, Homo sapiens
cuacuaggucuucucauua

SEQ ID NO: 1317812 - RNA, 19 nt, Homo sapiens
caugguggcucuaguggaa

SEQ ID NO: 1317813 - RNA, 19 nt, Homo sapiens
uaaguaggcuucagugcau

SEQ ID NO: 1317814 - RNA, 19 nt, Homo sapiens
gugacucccuggccuagua

SEQ ID NO: 1317815 - RNA, 19 nt, Homo sapiens
caacagugcaugugaagga

SEQ ID NO: 1317816 - RNA, 19 nt, Homo sapiens
ggaagggagaugcuuugua

SEQ ID NO: 1317817 - RNA, 19 nt, Homo sapiens
guacagaucacuuucucuu

SEQ ID NO: 1317818 - RNA, 19 nt, Homo sapiens
ugagcucgguauauauuaa

SEQ ID NO: 1317819 - RNA, 19 nt, Homo sapiens
gacauucuuuggacuguau

SEQ ID NO: 1317820 - RNA, 19 nt, Homo sapiens
gauuguauuuccuccuuug

SEQ ID NO: 1317821 - RNA, 19 nt, Homo sapiens
gaagagggaagagauccua

SEQ ID NO: 1317822 - RNA, 19 nt, Homo sapiens
gcgauuguauuuccuccuu

SEQ ID NO: 1317823 - RNA, 19 nt, Homo sapiens
gaacaagcccugggauugg

SEQ ID NO: 1317824 - RNA, 19 nt, Homo sapiens
gccaaucacuaaugcuguu

SEQ ID NO: 1317825 - RNA, 19 nt, Homo sapiens
gcuguguacucucccauug

SEQ ID NO: 1317826 - RNA, 19 nt, Homo sapiens
cuuaggaccuucuugauag

SEQ ID NO: 1317827 - RNA, 19 nt, Homo sapiens
gcucaguucucuucugucu

SEQ ID NO: 1317828 - RNA, 19 nt, Homo sapiens
gaacaacugccugaauaca

SEQ ID NO: 1317829 - RNA, 19 nt, Homo sapiens
gugcagcuguuuucacuua

SEQ ID NO: 1317830 - RNA, 19 nt, Homo sapiens
ucaucuggcuaaauauuug

SEQ ID NO: 1317831 - RNA, 19 nt, Homo sapiens
gauaaacauguccaucuug

SEQ ID NO: 1317832 - RNA, 19 nt, Homo sapiens
ggagaugggaguuagugaa

SEQ ID NO: 1317833 - RNA, 19 nt, Homo sapiens
ccagguaaguaugugauga

SEQ ID NO: 1317834 - RNA, 19 nt, Homo sapiens
uccagcagcuauauuggua

SEQ ID NO: 1317835 - RNA, 19 nt, Homo sapiens
gaauuaucaucuggcuaaa

SEQ ID NO: 1317836 - RNA, 19 nt, Homo sapiens
ggugggauucuucaacuaa

SEQ ID NO: 1317837 - RNA, 19 nt, Homo sapiens
guugcugucuucuguaaug

SEQ ID NO: 1317838 - RNA, 19 nt, Homo sapiens
gaggugggauucuucaacu

SEQ ID NO: 1317839 - RNA, 19 nt, Homo sapiens
acacggagcagaugagaga

SEQ ID NO: 1317840 - RNA, 19 nt, Homo sapiens
gaacacggagcagaugaga

SEQ ID NO: 1317841 - RNA, 19 nt, Homo sapiens
gguaugcacuuaggaccuu

SEQ ID NO: 1317842 - RNA, 19 nt, Homo sapiens
ggugggaacucugcugugu

SEQ ID NO: 1317843 - RNA, 19 nt, Homo sapiens
aagaaccgcugccuugcaa

SEQ ID NO: 1317844 - RNA, 19 nt, Homo sapiens
cagcaaggauaaacauguc

SEQ ID NO: 1317845 - RNA, 19 nt, Homo sapiens
gagguugacuuagggaaca

SEQ ID NO: 1317846 - RNA, 19 nt, Homo sapiens
ugagagcccugccaugucu

SEQ ID NO: 1317847 - RNA, 19 nt, Homo sapiens
caacuaugguuucuuugcu

SEQ ID NO: 1317848 - RNA, 19 nt, Homo sapiens
gagggaagagauccuaaug

SEQ ID NO: 1317849 - RNA, 19 nt, Homo sapiens
gugcugagguugacuuagg

SEQ ID NO: 1317850 - RNA, 19 nt, Homo sapiens
gugaaggaaaguucuguuu

SEQ ID NO: 1317851 - RNA, 19 nt, Homo sapiens
caacucuguuagcccaauu

SEQ ID NO: 1317852 - RNA, 19 nt, Homo sapiens
gcucauggcaccucugcuu

SEQ ID NO: 1317853 - RNA, 19 nt, Homo sapiens
gagguguacagaucacuuu

SEQ ID NO: 1317854 - RNA, 19 nt, Homo sapiens
gugggauucuucaacuaaa

SEQ ID NO: 1317855 - RNA, 19 nt, Homo sapiens
gaagaaccgcugccuugca

SEQ ID NO: 1317856 - RNA, 19 nt, Homo sapiens
gugcucaguucucuucugu

SEQ ID NO: 1317857 - RNA, 19 nt, Homo sapiens
cagaucacuuucucuuugu

SEQ ID NO: 1317858 - RNA, 19 nt, Homo sapiens
auauuaaccuggugugugu

SEQ ID NO: 1317859 - RNA, 19 nt, Homo sapiens
gagcucgguauauauuaaa

SEQ ID NO: 1317860 - RNA, 19 nt, Homo sapiens
uggcaccucugcuuggaaa

SEQ ID NO: 1317861 - RNA, 19 nt, Homo sapiens
uagcaaagaccuauuucau

SEQ ID NO: 1317862 - RNA, 19 nt, Homo sapiens
ucuuuggacuguauuguga

SEQ ID NO: 1317863 - RNA, 19 nt, Homo sapiens
gaagcagggugggaacucu

SEQ ID NO: 1317864 - RNA, 19 nt, Homo sapiens
uaugagcucgguauauauu

SEQ ID NO: 1317865 - RNA, 19 nt, Homo sapiens
ccaauugcccugcugaaca

SEQ ID NO: 1317866 - RNA, 19 nt, Homo sapiens
ggaagcaagagcagacugu

SEQ ID NO: 1317867 - RNA, 19 nt, Homo sapiens
gggcaugugcugagguuga

SEQ ID NO: 1317868 - RNA, 19 nt, Homo sapiens
aaugggagguguacagauc

SEQ ID NO: 1317869 - RNA, 19 nt, Homo sapiens
gccaguugccaaucacuaa

SEQ ID NO: 1317870 - RNA, 19 nt, Homo sapiens
gggaacaagcccugggauu

SEQ ID NO: 1317871 - RNA, 19 nt, Homo sapiens
aaagaccuauuucauuguc

SEQ ID NO: 1317872 - RNA, 19 nt, Homo sapiens
ggaucaggcuacgaaagug

SEQ ID NO: 1317873 - RNA, 19 nt, Homo sapiens
gggaucaggcuacgaaagu

SEQ ID NO: 1317874 - RNA, 19 nt, Homo sapiens
ucuaguggaagauacguua

SEQ ID NO: 1317875 - RNA, 19 nt, Homo sapiens
ggucagauaaauuuguaug

SEQ ID NO: 1317876 - RNA, 19 nt, Homo sapiens
uuagggacuuagagaggua

SEQ ID NO: 1317877 - RNA, 19 nt, Homo sapiens
gcagcuauauugguaagac

SEQ ID NO: 1317878 - RNA, 19 nt, Homo sapiens
guuucccaaugucaaguua

SEQ ID NO: 1317879 - RNA, 19 nt, Homo sapiens
guagaggaaagaaggaaau

SEQ ID NO: 1317880 - RNA, 19 nt, Homo sapiens
gacaggcaguaguguucaa

SEQ ID NO: 1317881 - RNA, 19 nt, Homo sapiens
gagaugggaguuagugaag

SEQ ID NO: 1317882 - RNA, 19 nt, Homo sapiens
ggaaagagacguccuaaug

SEQ ID NO: 1317883 - RNA, 19 nt, Homo sapiens
gguuauagauguacuguuu

SEQ ID NO: 1317884 - RNA, 19 nt, Homo sapiens
gaaggaagacagaaagaua

SEQ ID NO: 1317885 - RNA, 19 nt, Homo sapiens
ggaaguaaguagcaaguug

SEQ ID NO: 1317886 - RNA, 19 nt, Homo sapiens
ggaagucagucacagaauu

SEQ ID NO: 1317887 - RNA, 19 nt, Homo sapiens
gccaagaacucauugcaaa

SEQ ID NO: 1317888 - RNA, 19 nt, Homo sapiens
gcagugcaaugcccaguaa

SEQ ID NO: 1317889 - RNA, 19 nt, Homo sapiens
uagaauuacugguagcuua

SEQ ID NO: 1317890 - RNA, 19 nt, Homo sapiens
aaagagaacucgucaaugg

SEQ ID NO: 1317891 - RNA, 19 nt, Homo sapiens
gaagaguaaugccuggaaa

SEQ ID NO: 1317892 - RNA, 19 nt, Homo sapiens
caaguuugcugucuuuaga

SEQ ID NO: 1317893 - RNA, 19 nt, Homo sapiens
caagaaaguuccuaaaggu

SEQ ID NO: 1317894 - RNA, 19 nt, Homo sapiens
auaaugcccugaaagaaua

SEQ ID NO: 1317895 - RNA, 19 nt, Homo sapiens
gcaaagagaacucgucaau

SEQ ID NO: 1317896 - RNA, 19 nt, Homo sapiens
gcucaaguuugcugucuuu

SEQ ID NO: 1317897 - RNA, 19 nt, Homo sapiens
gaacgugcuuccucuuuca

SEQ ID NO: 1317898 - RNA, 19 nt, Homo sapiens
gaagucagucacagaauuu

SEQ ID NO: 1317899 - RNA, 19 nt, Homo sapiens
gaaguugaauugcuugaag

SEQ ID NO: 1317900 - RNA, 19 nt, Homo sapiens
gaaaguuccuaaagguguu

SEQ ID NO: 1317901 - RNA, 19 nt, Homo sapiens
gcaaagugacgucaagaaa

SEQ ID NO: 1317902 - RNA, 19 nt, Homo sapiens
gaagacagaaagauagaaa

SEQ ID NO: 1317903 - RNA, 19 nt, Homo sapiens
gcaaaguggugcccagcaa

SEQ ID NO: 1317904 - RNA, 19 nt, Homo sapiens
gaauggagucccuuggaua

SEQ ID NO: 1317905 - RNA, 19 nt, Homo sapiens
caaguugaaucgaaaggaa

SEQ ID NO: 1317906 - RNA, 19 nt, Homo sapiens
gacauugagugcauuaaau

SEQ ID NO: 1317907 - RNA, 19 nt, Homo sapiens
gagccacucucacauacaa

SEQ ID NO: 1317908 - RNA, 19 nt, Homo sapiens
ggaauuaguccuaugaauc

SEQ ID NO: 1317909 - RNA, 19 nt, Homo sapiens
gaaugugguuguaauccuu

SEQ ID NO: 1317910 - RNA, 19 nt, Homo sapiens
aguaacaguuucaugcuua

SEQ ID NO: 1317911 - RNA, 19 nt, Homo sapiens
gaaguaaguagcaaguuga

SEQ ID NO: 1317912 - RNA, 19 nt, Homo sapiens
ggaaauguggcccuaggua

SEQ ID NO: 1317913 - RNA, 19 nt, Homo sapiens
ggauaggucccaugucaaa

SEQ ID NO: 1317914 - RNA, 19 nt, Homo sapiens
agacagggaugacguugaa

SEQ ID NO: 1317915 - RNA, 19 nt, Homo sapiens
gaauacagaacaacugcua

SEQ ID NO: 1317916 - RNA, 19 nt, Homo sapiens
gaaagagacguccuaaugg

SEQ ID NO: 1317917 - RNA, 19 nt, Homo sapiens
gaucuauucugaagcuguu

SEQ ID NO: 1317918 - RNA, 19 nt, Homo sapiens
ucucaggaguagauuguua

SEQ ID NO: 1317919 - RNA, 19 nt, Homo sapiens
gauuauaccugucuguucu

SEQ ID NO: 1317920 - RNA, 19 nt, Homo sapiens
ucacaaggcuaaauaacuc

SEQ ID NO: 1317921 - RNA, 19 nt, Homo sapiens
uaacaaagcgggagcaaag

SEQ ID NO: 1317922 - RNA, 19 nt, Homo sapiens
aaagagacguccuaaugga

SEQ ID NO: 1317923 - RNA, 19 nt, Homo sapiens
ucacugauuucuuauaugg

SEQ ID NO: 1317924 - RNA, 19 nt, Homo sapiens
acaaucaucuguuugacuu

SEQ ID NO: 1317925 - RNA, 19 nt, Homo sapiens
aaucauagaggaagaguaa

SEQ ID NO: 1317926 - RNA, 19 nt, Homo sapiens
gcccagcaauucaggauga

SEQ ID NO: 1317927 - RNA, 19 nt, Homo sapiens
ugaguugcuucaugguuua

SEQ ID NO: 1317928 - RNA, 19 nt, Homo sapiens
guccuagacuucuuauuug

SEQ ID NO: 1317929 - RNA, 19 nt, Homo sapiens
gauguacuguuuggaugua

SEQ ID NO: 1317930 - RNA, 19 nt, Homo sapiens
guaaauccuggucuucaua

SEQ ID NO: 1317931 - RNA, 19 nt, Homo sapiens
ucaagaaaguuccuaaagg

SEQ ID NO: 1317932 - RNA, 19 nt, Homo sapiens
aaagugacgucaagaaagu

SEQ ID NO: 1317933 - RNA, 19 nt, Homo sapiens
gaagacuccuccagcaaag

SEQ ID NO: 1317934 - RNA, 19 nt, Homo sapiens
gaaauguggcccuagguau

SEQ ID NO: 1317935 - RNA, 19 nt, Homo sapiens
gaagaguucaucacggaaa

SEQ ID NO: 1317936 - RNA, 19 nt, Homo sapiens
gaggaaaccaguagcaguu

SEQ ID NO: 1317937 - RNA, 19 nt, Homo sapiens
gaaaggaagggaagaagca

SEQ ID NO: 1317938 - RNA, 19 nt, Homo sapiens
gccaugaaccgguuuggua

SEQ ID NO: 1317939 - RNA, 19 nt, Homo sapiens
gauuguuaguguugacuuu

SEQ ID NO: 1317940 - RNA, 19 nt, Homo sapiens
ggaguagauuguuaguguu

SEQ ID NO: 1317941 - RNA, 19 nt, Homo sapiens
uuacagguuucacaugauu

SEQ ID NO: 1317942 - RNA, 19 nt, Homo sapiens
gauaugucuuuggaugaua

SEQ ID NO: 1317943 - RNA, 19 nt, Homo sapiens
gaagggaagaagcagaauu

SEQ ID NO: 1317944 - RNA, 19 nt, Homo sapiens
ggaaagcuaucaguaacag

SEQ ID NO: 1317945 - RNA, 19 nt, Homo sapiens
ggccugcccugcauuguau

SEQ ID NO: 1317946 - RNA, 19 nt, Homo sapiens
gcaaguugaaggacaggua

SEQ ID NO: 1317947 - RNA, 19 nt, Homo sapiens
gacacagaacaauguauua

SEQ ID NO: 1317948 - RNA, 19 nt, Homo sapiens
gcaaaccuucugagacaaa

SEQ ID NO: 1317949 - RNA, 19 nt, Homo sapiens
gguuucacaugauuuauuc

SEQ ID NO: 1317950 - RNA, 19 nt, Homo sapiens
guuacaaguuuggucauuu

SEQ ID NO: 1317951 - RNA, 19 nt, Homo sapiens
uaauagccauaaaguccua

SEQ ID NO: 1317952 - RNA, 19 nt, Homo sapiens
uggagucccuuggauauuu

SEQ ID NO: 1317953 - RNA, 19 nt, Homo sapiens
gacuguaaaugcauauuca

SEQ ID NO: 1317954 - RNA, 19 nt, Homo sapiens
gaauuacacagcuuuagug

SEQ ID NO: 1317955 - RNA, 19 nt, Homo sapiens
ggagcaaagugacgucaag

SEQ ID NO: 1317956 - RNA, 19 nt, Homo sapiens
ggaugcaacuuaaacuuuu

SEQ ID NO: 1317957 - RNA, 19 nt, Homo sapiens
cuucaugcaucuguaauuu

SEQ ID NO: 1317958 - RNA, 19 nt, Homo sapiens
ucuagucucuccuuagcua

SEQ ID NO: 1317959 - RNA, 19 nt, Homo sapiens
cauggaaagcuaucaguaa

SEQ ID NO: 1317960 - RNA, 19 nt, Homo sapiens
uagagacuguaaaugcaua

SEQ ID NO: 1317961 - RNA, 19 nt, Homo sapiens
gcugucacuugcccuuuaa

SEQ ID NO: 1317962 - RNA, 19 nt, Homo sapiens
uaccaggaguggaaauaaa

SEQ ID NO: 1317963 - RNA, 19 nt, Homo sapiens
uuccuguucuuaccuauua

SEQ ID NO: 1317964 - RNA, 19 nt, Homo sapiens
auaccugucuguucuuaaa

SEQ ID NO: 1317965 - RNA, 19 nt, Homo sapiens
ucacggaaauucaagaaac

SEQ ID NO: 1317966 - RNA, 19 nt, Homo sapiens
gaaaacgacuggaauucga

SEQ ID NO: 1317967 - RNA, 19 nt, Homo sapiens
aguaaugccuggaaagaga

SEQ ID NO: 1317968 - RNA, 19 nt, Homo sapiens
aggaguagauuguuagugu

SEQ ID NO: 1317969 - RNA, 19 nt, Homo sapiens
cagauguuguauacuguaa

SEQ ID NO: 1317970 - RNA, 19 nt, Homo sapiens
ggaauuacacagcuuuagu

SEQ ID NO: 1317971 - RNA, 19 nt, Homo sapiens
gaauuaguccuaugaaucg

SEQ ID NO: 1317972 - RNA, 19 nt, Homo sapiens
guaacaguuucaugcuuau

SEQ ID NO: 1317973 - RNA, 19 nt, Homo sapiens
uagcguccacaaagaauua

SEQ ID NO: 1317974 - RNA, 19 nt, Homo sapiens
ggacagguaguugagauga

SEQ ID NO: 1317975 - RNA, 19 nt, Homo sapiens
gaaggcaugagaggaagua

SEQ ID NO: 1317976 - RNA, 19 nt, Homo sapiens
ggaggagaagguccaguuu

SEQ ID NO: 1317977 - RNA, 19 nt, Homo sapiens
ugaauugcuugaagaguuc

SEQ ID NO: 1317978 - RNA, 19 nt, Homo sapiens
ggacuuccaccacaaaugg

SEQ ID NO: 1317979 - RNA, 19 nt, Homo sapiens
gugcaggcccaguugaaua

SEQ ID NO: 1317980 - RNA, 19 nt, Homo sapiens
aggcaaaccuucugagaca

SEQ ID NO: 1317981 - RNA, 19 nt, Homo sapiens
ggauguagcauagucuuga

SEQ ID NO: 1317982 - RNA, 19 nt, Homo sapiens
ggacagaucuacugcuaua

SEQ ID NO: 1317983 - RNA, 19 nt, Homo sapiens
ggagagauguagugauuua

SEQ ID NO: 1317984 - RNA, 19 nt, Homo sapiens
gcaaauggcugcuugucaa

SEQ ID NO: 1317985 - RNA, 19 nt, Homo sapiens
ggaaugggauggccaguga

SEQ ID NO: 1317986 - RNA, 19 nt, Homo sapiens
ccacugggccugauacuua

SEQ ID NO: 1317987 - RNA, 19 nt, Homo sapiens
cgaauccucucuauuguuu

SEQ ID NO: 1317988 - RNA, 19 nt, Homo sapiens
gagcgaauccucucuauug

SEQ ID NO: 1317989 - RNA, 19 nt, Homo sapiens
ggagaaauuugccacuuga

SEQ ID NO: 1317990 - RNA, 19 nt, Homo sapiens
ggaccaagcuccagucagu

SEQ ID NO: 1317991 - RNA, 19 nt, Homo sapiens
ccacggcccuguuuauauu

SEQ ID NO: 1317992 - RNA, 19 nt, Homo sapiens
ggaaucaguuagaggauga

SEQ ID NO: 1317993 - RNA, 19 nt, Homo sapiens
guggagagauguagugauu

SEQ ID NO: 1317994 - RNA, 19 nt, Homo sapiens
ugucugagcugguggauga

SEQ ID NO: 1317995 - RNA, 19 nt, Homo sapiens
gaauuuggcgucaguggua

SEQ ID NO: 1317996 - RNA, 19 nt, Homo sapiens
cggauuagcuagcaccuuu

SEQ ID NO: 1317997 - RNA, 19 nt, Homo sapiens
ccaaagaccugcugaagac

SEQ ID NO: 1317998 - RNA, 19 nt, Homo sapiens
gaugaaaucagauaaagga

SEQ ID NO: 1317999 - RNA, 19 nt, Homo sapiens
gggcaggucuugacucuag

SEQ ID NO: 1318000 - RNA, 19 nt, Homo sapiens
cgaagaaggugacgcgaau

SEQ ID NO: 1318001 - RNA, 19 nt, Homo sapiens
ccaacgugcugaagcuuaa

SEQ ID NO: 1318002 - RNA, 19 nt, Homo sapiens
uggaagcccuuaauucuug

SEQ ID NO: 1318003 - RNA, 19 nt, Homo sapiens
ggacggagcacucagaaca

SEQ ID NO: 1318004 - RNA, 19 nt, Homo sapiens
guuagaggaugaaaucaga

SEQ ID NO: 1318005 - RNA, 19 nt, Homo sapiens
auacuuagcugacauggau

SEQ ID NO: 1318006 - RNA, 19 nt, Homo sapiens
ccaaggaggccgaggagua

SEQ ID NO: 1318007 - RNA, 19 nt, Homo sapiens
guacaggccugacaaagcu

SEQ ID NO: 1318008 - RNA, 19 nt, Homo sapiens
aagguggaaugacaaguua

SEQ ID NO: 1318009 - RNA, 19 nt, Homo sapiens
gaaugauggccaagacuuu

SEQ ID NO: 1318010 - RNA, 19 nt, Homo sapiens
gcaaggggcuauugaguau

SEQ ID NO: 1318011 - RNA, 19 nt, Homo sapiens
auacugcucuuaccgauga

SEQ ID NO: 1318012 - RNA, 19 nt, Homo sapiens
gagaaaagccguuaugaga

SEQ ID NO: 1318013 - RNA, 19 nt, Homo sapiens
acaacuccaucaagaauga

SEQ ID NO: 1318014 - RNA, 19 nt, Homo sapiens
gggaagaguggagaaauuu

SEQ ID NO: 1318015 - RNA, 19 nt, Homo sapiens
gggaguaccucaguuucuu

SEQ ID NO: 1318016 - RNA, 19 nt, Homo sapiens
gcaagaacaacgaguuuag

SEQ ID NO: 1318017 - RNA, 19 nt, Homo sapiens
gggaugaggaugaugauga

SEQ ID NO: 1318018 - RNA, 19 nt, Homo sapiens
ggaaugacaaguuauugau

SEQ ID NO: 1318019 - RNA, 19 nt, Homo sapiens
ccagcugaccugugacuua

SEQ ID NO: 1318020 - RNA, 19 nt, Homo sapiens
ucaaagggaccauccugua

SEQ ID NO: 1318021 - RNA, 19 nt, Homo sapiens
gcugguggaugacaaguuc

SEQ ID NO: 1318022 - RNA, 19 nt, Homo sapiens
gggccagacuugaacauuc

SEQ ID NO: 1318023 - RNA, 19 nt, Homo sapiens
ggaggaggacaagcucuua

SEQ ID NO: 1318024 - RNA, 19 nt, Homo sapiens
gaccacggcccuguuuaua

SEQ ID NO: 1318025 - RNA, 19 nt, Homo sapiens
cagcugaccugugacuuau

SEQ ID NO: 1318026 - RNA, 19 nt, Homo sapiens
ugaagacccuuuacaacuc

SEQ ID NO: 1318027 - RNA, 19 nt, Homo sapiens
gcucagaggaaguaaaugu

SEQ ID NO: 1318028 - RNA, 19 nt, Homo sapiens
uggaucagcugaagugugu

SEQ ID NO: 1318029 - RNA, 19 nt, Homo sapiens
gaggaugaaaucagauaaa

SEQ ID NO: 1318030 - RNA, 19 nt, Homo sapiens
ggaggacacggacaaguug

SEQ ID NO: 1318031 - RNA, 19 nt, Homo sapiens
gaucagcugaaguguguuu

SEQ ID NO: 1318032 - RNA, 19 nt, Homo sapiens
ggaccacggcccuguuuau

SEQ ID NO: 1318033 - RNA, 19 nt, Homo sapiens
ccaugugacuggcagcaaa

SEQ ID NO: 1318034 - RNA, 19 nt, Homo sapiens
gaucacggauuagcuagca

SEQ ID NO: 1318035 - RNA, 19 nt, Homo sapiens
ugggaagaguggagaaauu

SEQ ID NO: 1318036 - RNA, 19 nt, Homo sapiens
ucauuugucuagugaauca

SEQ ID NO: 1318037 - RNA, 19 nt, Homo sapiens
gggcaagaacaacgaguuu

SEQ ID NO: 1318038 - RNA, 19 nt, Homo sapiens
ggaugaggaugaugaugag

SEQ ID NO: 1318039 - RNA, 19 nt, Homo sapiens
cagaggaaguaaauguuca

SEQ ID NO: 1318040 - RNA, 19 nt, Homo sapiens
gagggcaggucuugacucu

SEQ ID NO: 1318041 - RNA, 19 nt, Homo sapiens
gagcaacugcggucucaug

SEQ ID NO: 1318042 - RNA, 19 nt, Homo sapiens
ggacaggcacgaagaaggu

SEQ ID NO: 1318043 - RNA, 19 nt, Homo sapiens
ugaacauucuggaagauuc

SEQ ID NO: 1318044 - RNA, 19 nt, Homo sapiens
gauuagcuagcaccuuuaa

SEQ ID NO: 1318045 - RNA, 19 nt, Homo sapiens
acuugacgaucacggauua

SEQ ID NO: 1318046 - RNA, 19 nt, Homo sapiens
ggaagaguggagaaauuug

SEQ ID NO: 1318047 - RNA, 19 nt, Homo sapiens
caaagugggcucagaugau

SEQ ID NO: 1318048 - RNA, 19 nt, Homo sapiens
gcaccgagcaaggaagaaa

SEQ ID NO: 1318049 - RNA, 19 nt, Homo sapiens
gaacauucuggaagauuca

SEQ ID NO: 1318050 - RNA, 19 nt, Homo sapiens
uggagaaauuugccacuug

SEQ ID NO: 1318051 - RNA, 19 nt, Homo sapiens
gggaaaagguggaaugaca

SEQ ID NO: 1318052 - RNA, 19 nt, Homo sapiens
aaagugggcucagaugauc

SEQ ID NO: 1318053 - RNA, 19 nt, Homo sapiens
aagaaaugcuguccuggau

SEQ ID NO: 1318054 - RNA, 19 nt, Homo sapiens
gcucaccugugcccugaug

SEQ ID NO: 1318055 - RNA, 19 nt, Homo sapiens
gccaaagaccugcugaaga

SEQ ID NO: 1318056 - RNA, 19 nt, Homo sapiens
ucagcuccaugaagaaguu

SEQ ID NO: 1318057 - RNA, 19 nt, Homo sapiens
aggaugagcugaggaaauc

SEQ ID NO: 1318058 - RNA, 19 nt, Homo sapiens
aaagauguccugucagcaa

SEQ ID NO: 1318059 - RNA, 19 nt, Homo sapiens
ggcaagaacaacgaguuua

SEQ ID NO: 1318060 - RNA, 19 nt, Homo sapiens
ccugaaggauggccuguca

SEQ ID NO: 1318061 - RNA, 19 nt, Homo sapiens
guucacuuccuuaauugua

SEQ ID NO: 1318062 - RNA, 19 nt, Homo sapiens
gacgaucacggauuagcua

SEQ ID NO: 1318063 - RNA, 19 nt, Homo sapiens
cagaucuacugcuauagga

SEQ ID NO: 1318064 - RNA, 19 nt, Homo sapiens
gcugaccugugacuuauac

SEQ ID NO: 1318065 - RNA, 19 nt, Homo sapiens
ggccagacuugaacauucu

SEQ ID NO: 1318066 - RNA, 19 nt, Homo sapiens
guaguuuggccaggaauuu

SEQ ID NO: 1318067 - RNA, 19 nt, Homo sapiens
gguggaaugacaaguuauu

SEQ ID NO: 1318068 - RNA, 19 nt, Homo sapiens
gaucuacugcuauaggaau

SEQ ID NO: 1318069 - RNA, 19 nt, Homo sapiens
ucaguuagaggaugaaauc

SEQ ID NO: 1318070 - RNA, 19 nt, Homo sapiens
ccaccucgcuggagaagcu

SEQ ID NO: 1318071 - RNA, 19 nt, Homo sapiens
aggcguggcuggaagaaau

SEQ ID NO: 1318072 - RNA, 19 nt, Homo sapiens
gaggaugagcugaggaaau

SEQ ID NO: 1318073 - RNA, 19 nt, Homo sapiens
ccacgaaggacccagaugu

SEQ ID NO: 1318074 - RNA, 19 nt, Homo sapiens
uaaguuggaucagcugaag

SEQ ID NO: 1318075 - RNA, 19 nt, Homo sapiens
gucgcuauuucuuucauuu

SEQ ID NO: 1318076 - RNA, 19 nt, Homo sapiens
gcccuuaauucuugguugu

SEQ ID NO: 1318077 - RNA, 19 nt, Homo sapiens
uagaggaugaaaucagaua

SEQ ID NO: 1318078 - RNA, 19 nt, Homo sapiens
ccaggaauuuggcgucagu

SEQ ID NO: 1318079 - RNA, 19 nt, Homo sapiens
ggauuagcuagcaccuuua

SEQ ID NO: 1318080 - RNA, 19 nt, Homo sapiens
aaagguggaaugacaaguu

SEQ ID NO: 1318081 - RNA, 19 nt, Homo sapiens
cuacugcuauaggaauaaa

SEQ ID NO: 1318082 - RNA, 19 nt, Homo sapiens
gaagaacuguuugcuauua

SEQ ID NO: 1318083 - RNA, 19 nt, Homo sapiens
gcauagagcuugcauaaau

SEQ ID NO: 1318084 - RNA, 19 nt, Homo sapiens
acacaugucugaugacuua

SEQ ID NO: 1318085 - RNA, 19 nt, Homo sapiens
gagaauugcccuuggauua

SEQ ID NO: 1318086 - RNA, 19 nt, Homo sapiens
gaaguuauguuucucuuuc

SEQ ID NO: 1318087 - RNA, 19 nt, Homo sapiens
aaacggacauguagaaauu

SEQ ID NO: 1318088 - RNA, 19 nt, Homo sapiens
gaaggagaauugucauguu

SEQ ID NO: 1318089 - RNA, 19 nt, Homo sapiens
gcaugaagccuguaacuau

SEQ ID NO: 1318090 - RNA, 19 nt, Homo sapiens
cauagagcuugcauaaaua

SEQ ID NO: 1318091 - RNA, 19 nt, Homo sapiens
guaggauguugcuaaauuu

SEQ ID NO: 1318092 - RNA, 19 nt, Homo sapiens
aagaagaacuguuugcuau

SEQ ID NO: 1318093 - RNA, 19 nt, Homo sapiens
gaagucagaaggagaauug

SEQ ID NO: 1318094 - RNA, 19 nt, Homo sapiens
ucacaggaauuagagauuu

SEQ ID NO: 1318095 - RNA, 19 nt, Homo sapiens
ggaacugccugagaauuug

SEQ ID NO: 1318096 - RNA, 19 nt, Homo sapiens
uuaaggaacugccugagaa

SEQ ID NO: 1318097 - RNA, 19 nt, Homo sapiens
ucagagaaccuuacuaaug

SEQ ID NO: 1318098 - RNA, 19 nt, Homo sapiens
gaaagauucaggugucaaa

SEQ ID NO: 1318099 - RNA, 19 nt, Homo sapiens
gaacuuucaugcacaagca

SEQ ID NO: 1318100 - RNA, 19 nt, Homo sapiens
ggagaaacagcccugcaua

SEQ ID NO: 1318101 - RNA, 19 nt, Homo sapiens
aguaugggcuucugacuuu

SEQ ID NO: 1318102 - RNA, 19 nt, Homo sapiens
ugauuuaucuucagaguuc

SEQ ID NO: 1318103 - RNA, 19 nt, Homo sapiens
gaauugcccuuggauuaug

SEQ ID NO: 1318104 - RNA, 19 nt, Homo sapiens
cagagaaccuuacuaaugc

SEQ ID NO: 1318105 - RNA, 19 nt, Homo sapiens
gagccacucucucuucaga

SEQ ID NO: 1318106 - RNA, 19 nt, Homo sapiens
gcagaaacucccacacauu

SEQ ID NO: 1318107 - RNA, 19 nt, Homo sapiens
ggagaacuuucaugcacaa

SEQ ID NO: 1318108 - RNA, 19 nt, Homo sapiens
gguuucaccucaaaucaaa

SEQ ID NO: 1318109 - RNA, 19 nt, Homo sapiens
gaaaccaccaguguucaua

SEQ ID NO: 1318110 - RNA, 19 nt, Homo sapiens
gaaauugauucuucuucuc

SEQ ID NO: 1318111 - RNA, 19 nt, Homo sapiens
gaaccuuacuaaugcugaa

SEQ ID NO: 1318112 - RNA, 19 nt, Homo sapiens
gcaacguuguccagaggua

SEQ ID NO: 1318113 - RNA, 19 nt, Homo sapiens
aguaggauguugcuaaauu

SEQ ID NO: 1318114 - RNA, 19 nt, Homo sapiens
uaagauggguagaaaugug

SEQ ID NO: 1318115 - RNA, 19 nt, Homo sapiens
acugaggccuugaugauaa

SEQ ID NO: 1318116 - RNA, 19 nt, Homo sapiens
caugaagccuguaacuaug

SEQ ID NO: 1318117 - RNA, 19 nt, Homo sapiens
ucgaagggcugccagaguu

SEQ ID NO: 1318118 - RNA, 19 nt, Homo sapiens
gcuagaaaguauggauuga

SEQ ID NO: 1318119 - RNA, 19 nt, Homo sapiens
gcccuuggauuaugugguu

SEQ ID NO: 1318120 - RNA, 19 nt, Homo sapiens
gcuugggucuggaaagauu

SEQ ID NO: 1318121 - RNA, 19 nt, Homo sapiens
gcacaagcagagaaacauu

SEQ ID NO: 1318122 - RNA, 19 nt, Homo sapiens
gccacucucucuucagaaa

SEQ ID NO: 1318123 - RNA, 19 nt, Homo sapiens
uaaauaaccaaguggagaa

SEQ ID NO: 1318124 - RNA, 19 nt, Homo sapiens
aggguuaacucaucuaaau

SEQ ID NO: 1318125 - RNA, 19 nt, Homo sapiens
uuacuaaugcugaauggua

SEQ ID NO: 1318126 - RNA, 19 nt, Homo sapiens
uaaagaaaccaccaguguu

SEQ ID NO: 1318127 - RNA, 19 nt, Homo sapiens
gcuggacgccuuugcauga

SEQ ID NO: 1318128 - RNA, 19 nt, Homo sapiens
gaaacagcccugcauagag

SEQ ID NO: 1318129 - RNA, 19 nt, Homo sapiens
cuacaaaacucuaguaugg

SEQ ID NO: 1318130 - RNA, 19 nt, Homo sapiens
gaaacucccacacauucuu

SEQ ID NO: 1318131 - RNA, 19 nt, Homo sapiens
aaagaaaccaccaguguuc

SEQ ID NO: 1318132 - RNA, 19 nt, Homo sapiens
agauucaggugucaaagaa

SEQ ID NO: 1318133 - RNA, 19 nt, Homo sapiens
ccuccuggcuucaaauguu

SEQ ID NO: 1318134 - RNA, 19 nt, Homo sapiens
cagaaacucccacacauuc

SEQ ID NO: 1318135 - RNA, 19 nt, Homo sapiens
gaggaaugcuaagggagaa

SEQ ID NO: 1318136 - RNA, 19 nt, Homo sapiens
gcugaaugguacuaaacaa

SEQ ID NO: 1318137 - RNA, 19 nt, Homo sapiens
ggacuucauagcuuacuga

SEQ ID NO: 1318138 - RNA, 19 nt, Homo sapiens
ccaaaggguuaacucaucu

SEQ ID NO: 1318139 - RNA, 19 nt, Homo sapiens
aaagaagaacuguuugcua

SEQ ID NO: 1318140 - RNA, 19 nt, Homo sapiens
ggaaguuauguuucucuuu

SEQ ID NO: 1318141 - RNA, 19 nt, Homo sapiens
uuuccaggguguagaauuu

SEQ ID NO: 1318142 - RNA, 19 nt, Homo sapiens
uugcagccuugcuaaauuu

SEQ ID NO: 1318143 - RNA, 19 nt, Homo sapiens
caguuugcauugguacuua

SEQ ID NO: 1318144 - RNA, 19 nt, Homo sapiens
uaaagacauugcagaaacu

SEQ ID NO: 1318145 - RNA, 19 nt, Homo sapiens
gagaaacagcccugcauag

SEQ ID NO: 1318146 - RNA, 19 nt, Homo sapiens
gaccugaaccuugcuaaau

SEQ ID NO: 1318147 - RNA, 19 nt, Homo sapiens
gaacugccugagaauuuga

SEQ ID NO: 1318148 - RNA, 19 nt, Homo sapiens
ggaaauauaaagacauugc

SEQ ID NO: 1318149 - RNA, 19 nt, Homo sapiens
caccucaaaucaaagaaga

SEQ ID NO: 1318150 - RNA, 19 nt, Homo sapiens
auaaccaaguggagaaauu

SEQ ID NO: 1318151 - RNA, 19 nt, Homo sapiens
cuaaaucuguucaguuugc

SEQ ID NO: 1318152 - RNA, 19 nt, Homo sapiens
ccugagaauuugaaagugu

SEQ ID NO: 1318153 - RNA, 19 nt, Homo sapiens
aaacucccacacauucuua

SEQ ID NO: 1318154 - RNA, 19 nt, Homo sapiens
auaaagacauugcagaaac

SEQ ID NO: 1318155 - RNA, 19 nt, Homo sapiens
ugauucuucuucucucuuu

SEQ ID NO: 1318156 - RNA, 19 nt, Homo sapiens
gagcuugcauaaauaacca

SEQ ID NO: 1318157 - RNA, 19 nt, Homo sapiens
uaggacagcggccuuguuu

SEQ ID NO: 1318158 - RNA, 19 nt, Homo sapiens
ugaugaugcuagaaaguau

SEQ ID NO: 1318159 - RNA, 19 nt, Homo sapiens
gaacugcuuauggcuugua

SEQ ID NO: 1318160 - RNA, 19 nt, Homo sapiens
aaagaagucagaaggagaa

SEQ ID NO: 1318161 - RNA, 19 nt, Homo sapiens
gugcuugggucuggaaaga

SEQ ID NO: 1318162 - RNA, 19 nt, Homo sapiens
gaacuguuugcuauuacaa

SEQ ID NO: 1318163 - RNA, 19 nt, Homo sapiens
ggagaauugcccuuggauu

SEQ ID NO: 1318164 - RNA, 19 nt, Homo sapiens
ccaaguggagaaauugauu

SEQ ID NO: 1318165 - RNA, 19 nt, Homo sapiens
ggagaauugucauguucca

SEQ ID NO: 1318166 - RNA, 19 nt, Homo sapiens
aaggagaauugucauguuc

SEQ ID NO: 1318167 - RNA, 19 nt, Homo sapiens
acugacagauaguaauuug

SEQ ID NO: 1318168 - RNA, 19 nt, Homo sapiens
acugguuacuggaucuuua

SEQ ID NO: 1318169 - RNA, 19 nt, Homo sapiens
caaacggacauguagaaau

SEQ ID NO: 1318170 - RNA, 19 nt, Homo sapiens
ggacagcggccuuguuuug

SEQ ID NO: 1318171 - RNA, 19 nt, Homo sapiens
aagauacaguggagaacuu

SEQ ID NO: 1318172 - RNA, 19 nt, Homo sapiens
ggaaugcuaagggagaauu

SEQ ID NO: 1318173 - RNA, 19 nt, Homo sapiens
agaaacagcccugcauaga

SEQ ID NO: 1318174 - RNA, 19 nt, Homo sapiens
cgaagggcugccagaguua

SEQ ID NO: 1318175 - RNA, 19 nt, Homo sapiens
uagaaaguauggauugacu

SEQ ID NO: 1318176 - RNA, 19 nt, Homo sapiens
cuaaaugaacugcuuaugg

SEQ ID NO: 1318177 - RNA, 19 nt, Homo sapiens
caucuaaaugaacugcuua

SEQ ID NO: 1318178 - RNA, 19 nt, Homo sapiens
uugcauaaauaaccaagug

SEQ ID NO: 1318179 - RNA, 19 nt, Homo sapiens
gcuaaauguuccucaucau

SEQ ID NO: 1318180 - RNA, 19 nt, Homo sapiens
gcuuauggcuuguaaaagu

SEQ ID NO: 1318181 - RNA, 19 nt, Homo sapiens
cacaagcagagaaacauuu

SEQ ID NO: 1318182 - RNA, 19 nt, Homo sapiens
gaaacaaucucaucuccua

SEQ ID NO: 1318183 - RNA, 19 nt, Homo sapiens
gcgcauagauuacaaauau

SEQ ID NO: 1318184 - RNA, 19 nt, Homo sapiens
caacuucucugcugugaua

SEQ ID NO: 1318185 - RNA, 19 nt, Homo sapiens
gaagaagaaucacauaaga

SEQ ID NO: 1318186 - RNA, 19 nt, Homo sapiens
gcagauaacuaaugaaauc

SEQ ID NO: 1318187 - RNA, 19 nt, Homo sapiens
gagcagaccuucauuaaag

SEQ ID NO: 1318188 - RNA, 19 nt, Homo sapiens
gaaagcacuucuucaauau

SEQ ID NO: 1318189 - RNA, 19 nt, Homo sapiens
gaagaaggcuacagcauca

SEQ ID NO: 1318190 - RNA, 19 nt, Homo sapiens
guaaagguauccaauuuga

SEQ ID NO: 1318191 - RNA, 19 nt, Homo sapiens
gcaaauguaucguuaagau

SEQ ID NO: 1318192 - RNA, 19 nt, Homo sapiens
gaacuuauccagugaagaa

SEQ ID NO: 1318193 - RNA, 19 nt, Homo sapiens
gaacagccuucccucguuu

SEQ ID NO: 1318194 - RNA, 19 nt, Homo sapiens
gaaaauacuuggcagauaa

SEQ ID NO: 1318195 - RNA, 19 nt, Homo sapiens
ccaagcaaauguaucguua

SEQ ID NO: 1318196 - RNA, 19 nt, Homo sapiens
uaaagaagauguugaaguc

SEQ ID NO: 1318197 - RNA, 19 nt, Homo sapiens
ggguaaacaugccaaauuu

SEQ ID NO: 1318198 - RNA, 19 nt, Homo sapiens
ggaaauugauugggaaaga

SEQ ID NO: 1318199 - RNA, 19 nt, Homo sapiens
ggaagaagaagaagaauca

SEQ ID NO: 1318200 - RNA, 19 nt, Homo sapiens
gcaaggauuuggaggauuc

SEQ ID NO: 1318201 - RNA, 19 nt, Homo sapiens
aagcaaaccuucuccauug

SEQ ID NO: 1318202 - RNA, 19 nt, Homo sapiens
gcacugaccugcgcauaga

SEQ ID NO: 1318203 - RNA, 19 nt, Homo sapiens
gcugggaccuggaaucgua

SEQ ID NO: 1318204 - RNA, 19 nt, Homo sapiens
gaccaguccuacaguauuu

SEQ ID NO: 1318205 - RNA, 19 nt, Homo sapiens
uagaagaaguccagaagaa

SEQ ID NO: 1318206 - RNA, 19 nt, Homo sapiens
gcagcaaacugagaauuau

SEQ ID NO: 1318207 - RNA, 19 nt, Homo sapiens
uaaagaaagugucugaaca

SEQ ID NO: 1318208 - RNA, 19 nt, Homo sapiens
gaagaagaagaaucacaua

SEQ ID NO: 1318209 - RNA, 19 nt, Homo sapiens
ccaagucuguugcuguuaa

SEQ ID NO: 1318210 - RNA, 19 nt, Homo sapiens
caaaaucaauggagaguaa

SEQ ID NO: 1318211 - RNA, 19 nt, Homo sapiens
ucaaauguuuaguggguua

SEQ ID NO: 1318212 - RNA, 19 nt, Homo sapiens
guaaacaugccaaauuuga

SEQ ID NO: 1318213 - RNA, 19 nt, Homo sapiens
ccucacgucuuccucuuua

SEQ ID NO: 1318214 - RNA, 19 nt, Homo sapiens
caccugagcuggaugaaga

SEQ ID NO: 1318215 - RNA, 19 nt, Homo sapiens
gagaacugauguaugagaa

SEQ ID NO: 1318216 - RNA, 19 nt, Homo sapiens
cagagaauauuguggaaga

SEQ ID NO: 1318217 - RNA, 19 nt, Homo sapiens
gcagcagcauuuacagaaa

SEQ ID NO: 1318218 - RNA, 19 nt, Homo sapiens
gaacccggcucuaccaaag

SEQ ID NO: 1318219 - RNA, 19 nt, Homo sapiens
uaaacagggccucuuauuu

SEQ ID NO: 1318220 - RNA, 19 nt, Homo sapiens
gaugaccaguccuacagua

SEQ ID NO: 1318221 - RNA, 19 nt, Homo sapiens
gaaccacccuacaauagca

SEQ ID NO: 1318222 - RNA, 19 nt, Homo sapiens
gggaaagcaauucauauuu

SEQ ID NO: 1318223 - RNA, 19 nt, Homo sapiens
gguguaauauuguuaaugg

SEQ ID NO: 1318224 - RNA, 19 nt, Homo sapiens
ggagauguguccagaccuu

SEQ ID NO: 1318225 - RNA, 19 nt, Homo sapiens
gaaauugauugggaaagau

SEQ ID NO: 1318226 - RNA, 19 nt, Homo sapiens
guaagcagcagcaaacuga

SEQ ID NO: 1318227 - RNA, 19 nt, Homo sapiens
guaaaucuuugccauucuu

SEQ ID NO: 1318228 - RNA, 19 nt, Homo sapiens
ucagacuccuuggaaauua

SEQ ID NO: 1318229 - RNA, 19 nt, Homo sapiens
guaaaaccuucccucauua

SEQ ID NO: 1318230 - RNA, 19 nt, Homo sapiens
agaauuauccagcauauga

SEQ ID NO: 1318231 - RNA, 19 nt, Homo sapiens
guaaacagggccucuuauu

SEQ ID NO: 1318232 - RNA, 19 nt, Homo sapiens
aaugauaccucacgucuuc

SEQ ID NO: 1318233 - RNA, 19 nt, Homo sapiens
ggaaaauacuuggcagaua

SEQ ID NO: 1318234 - RNA, 19 nt, Homo sapiens
aaacuaccauccaucaaug

SEQ ID NO: 1318235 - RNA, 19 nt, Homo sapiens
gcagucugguguugaaguu

SEQ ID NO: 1318236 - RNA, 19 nt, Homo sapiens
gcaguuagacacuugaguu

SEQ ID NO: 1318237 - RNA, 19 nt, Homo sapiens
guauuuacuucuaggugua

SEQ ID NO: 1318238 - RNA, 19 nt, Homo sapiens
ccacucaaauuuaacaaag

SEQ ID NO: 1318239 - RNA, 19 nt, Homo sapiens
guuagacacuugaguuuua

SEQ ID NO: 1318240 - RNA, 19 nt, Homo sapiens
ggaauacggaagaaagaaa

SEQ ID NO: 1318241 - RNA, 19 nt, Homo sapiens
auggagaacugauguauga

SEQ ID NO: 1318242 - RNA, 19 nt, Homo sapiens
gaacugauguaugagaaac

SEQ ID NO: 1318243 - RNA, 19 nt, Homo sapiens
gcagugaauuggcgaugug

SEQ ID NO: 1318244 - RNA, 19 nt, Homo sapiens
gaagaaguccagaagaaag

SEQ ID NO: 1318245 - RNA, 19 nt, Homo sapiens
uaggaaugcugcaacugua

SEQ ID NO: 1318246 - RNA, 19 nt, Homo sapiens
aaaccuucccucauuaaua

SEQ ID NO: 1318247 - RNA, 19 nt, Homo sapiens
auucuaagguuacagcaua

SEQ ID NO: 1318248 - RNA, 19 nt, Homo sapiens
uauaucagguggaaaguca

SEQ ID NO: 1318249 - RNA, 19 nt, Homo sapiens
ggauucauauaauggagaa

SEQ ID NO: 1318250 - RNA, 19 nt, Homo sapiens
uaucagugcuugcuaccaa

SEQ ID NO: 1318251 - RNA, 19 nt, Homo sapiens
aaccuucccucauuaauau

SEQ ID NO: 1318252 - RNA, 19 nt, Homo sapiens
aaagggaaagcaauucaua

SEQ ID NO: 1318253 - RNA, 19 nt, Homo sapiens
ugacucaccuaaagaaagu

SEQ ID NO: 1318254 - RNA, 19 nt, Homo sapiens
ucaauaucgucaaccaauu

SEQ ID NO: 1318255 - RNA, 19 nt, Homo sapiens
uaucgccgcucaauuuaga

SEQ ID NO: 1318256 - RNA, 19 nt, Homo sapiens
gaguaaagaagauguugaa

SEQ ID NO: 1318257 - RNA, 19 nt, Homo sapiens
aagcauuaguuaccacuuu

SEQ ID NO: 1318258 - RNA, 19 nt, Homo sapiens
caagcaaaccuucuccauu

SEQ ID NO: 1318259 - RNA, 19 nt, Homo sapiens
aaaccaauaucugcacuug

SEQ ID NO: 1318260 - RNA, 19 nt, Homo sapiens
gagcagacccaagcaaaug

SEQ ID NO: 1318261 - RNA, 19 nt, Homo sapiens
ugagaauuauccagcauau

SEQ ID NO: 1318262 - RNA, 19 nt, Homo sapiens
uuacacccacucaaauuua

SEQ ID NO: 1318263 - RNA, 19 nt, Homo sapiens
ccugccauaugaacauuua

SEQ ID NO: 1318264 - RNA, 19 nt, Homo sapiens
guaaagaagauguugaagu

SEQ ID NO: 1318265 - RNA, 19 nt, Homo sapiens
auugauagcugucauaaag

SEQ ID NO: 1318266 - RNA, 19 nt, Homo sapiens
uaaggcaguuagacacuug

SEQ ID NO: 1318267 - RNA, 19 nt, Homo sapiens
ugauuucccucacacacua

SEQ ID NO: 1318268 - RNA, 19 nt, Homo sapiens
uaagauuaccggagaaaug

SEQ ID NO: 1318269 - RNA, 19 nt, Homo sapiens
gcugagcagaccuucauua

SEQ ID NO: 1318270 - RNA, 19 nt, Homo sapiens
aaacagggccucuuauuuu

SEQ ID NO: 1318271 - RNA, 19 nt, Homo sapiens
gcugugacauugaacuugu

SEQ ID NO: 1318272 - RNA, 19 nt, Homo sapiens
gcucaaauaucaggugucu

SEQ ID NO: 1318273 - RNA, 19 nt, Homo sapiens
uagaacacguccugccaaa

SEQ ID NO: 1318274 - RNA, 19 nt, Homo sapiens
gaagaaaaguggguccauu

SEQ ID NO: 1318275 - RNA, 19 nt, Homo sapiens
ggcccuugcuccucucuuu

SEQ ID NO: 1318276 - RNA, 19 nt, Homo sapiens
aaaggaacuuauccaguga

SEQ ID NO: 1318277 - RNA, 19 nt, Homo sapiens
acgcugagacugagaauuu

SEQ ID NO: 1318278 - RNA, 19 nt, Homo sapiens
ggauauaucagguggaaag

SEQ ID NO: 1318279 - RNA, 19 nt, Homo sapiens
ggagaacugauguaugaga

SEQ ID NO: 1318280 - RNA, 19 nt, Homo sapiens
auacuuggcagauaacuaa

SEQ ID NO: 1318281 - RNA, 19 nt, Homo sapiens
ggaauucuggguaaacaug

SEQ ID NO: 1318282 - RNA, 19 nt, Homo sapiens
gaacagacgugcacuuaga

SEQ ID NO: 1318283 - RNA, 19 nt, Homo sapiens
ggaauaaacugcuucugau

SEQ ID NO: 1318284 - RNA, 19 nt, Homo sapiens
ccaaagggcuggaagauuc

SEQ ID NO: 1318285 - RNA, 19 nt, Homo sapiens
gcagagagcugaggauugu

SEQ ID NO: 1318286 - RNA, 19 nt, Homo sapiens
gaaaauggcucuucagaug

SEQ ID NO: 1318287 - RNA, 19 nt, Homo sapiens
aaacugaaauccauuguga

SEQ ID NO: 1318288 - RNA, 19 nt, Homo sapiens
gaaaggaaacgccacauug

SEQ ID NO: 1318289 - RNA, 19 nt, Homo sapiens
ccaugaaucuggacaaauu

SEQ ID NO: 1318290 - RNA, 19 nt, Homo sapiens
gcaguaauuucccucauga

SEQ ID NO: 1318291 - RNA, 19 nt, Homo sapiens
gcauggagaucaaagaaau

SEQ ID NO: 1318292 - RNA, 19 nt, Homo sapiens
gaugagauguucagcaaug

SEQ ID NO: 1318293 - RNA, 19 nt, Homo sapiens
gcagugaggucaucuagca

SEQ ID NO: 1318294 - RNA, 19 nt, Homo sapiens
gaaccaggcucccuaugca

SEQ ID NO: 1318295 - RNA, 19 nt, Homo sapiens
ggaaucuucuccugccuuu

SEQ ID NO: 1318296 - RNA, 19 nt, Homo sapiens
gaacuacauuggaaacgau

SEQ ID NO: 1318297 - RNA, 19 nt, Homo sapiens
guacaagauuccacuuaga

SEQ ID NO: 1318298 - RNA, 19 nt, Homo sapiens
ggagguuuauacucuuuaa

SEQ ID NO: 1318299 - RNA, 19 nt, Homo sapiens
gauauauacuucacagcaa

SEQ ID NO: 1318300 - RNA, 19 nt, Homo sapiens
ugagucaccuguugaagaa

SEQ ID NO: 1318301 - RNA, 19 nt, Homo sapiens
gaauagggcaggcacuaaa

SEQ ID NO: 1318302 - RNA, 19 nt, Homo sapiens
cgucagaacuacauuggaa

SEQ ID NO: 1318303 - RNA, 19 nt, Homo sapiens
uaacagaguugaaucucau

SEQ ID NO: 1318304 - RNA, 19 nt, Homo sapiens
guacgaagauggagaagcu

SEQ ID NO: 1318305 - RNA, 19 nt, Homo sapiens
caccagcaccucauuguua

SEQ ID NO: 1318306 - RNA, 19 nt, Homo sapiens
ccaguucccucuccaaugu

SEQ ID NO: 1318307 - RNA, 19 nt, Homo sapiens
caacugcagcugugaauga

SEQ ID NO: 1318308 - RNA, 19 nt, Homo sapiens
gaaaacaaguuggagaaaa

SEQ ID NO: 1318309 - RNA, 19 nt, Homo sapiens
caucuuaagugccaugaau

SEQ ID NO: 1318310 - RNA, 19 nt, Homo sapiens
ggaaaggaaacgccacauu

SEQ ID NO: 1318311 - RNA, 19 nt, Homo sapiens
gaacaaacagcagguggaa

SEQ ID NO: 1318312 - RNA, 19 nt, Homo sapiens
guaacagaguugaaucuca

SEQ ID NO: 1318313 - RNA, 19 nt, Homo sapiens
gcuaguggaugaugaccuu

SEQ ID NO: 1318314 - RNA, 19 nt, Homo sapiens
gggauacauucaguuuaua

SEQ ID NO: 1318315 - RNA, 19 nt, Homo sapiens
ggccagaucgcuauguaua

SEQ ID NO: 1318316 - RNA, 19 nt, Homo sapiens
gcaacugcccugccuggua

SEQ ID NO: 1318317 - RNA, 19 nt, Homo sapiens
cugguuugcuguuguguua

SEQ ID NO: 1318318 - RNA, 19 nt, Homo sapiens
gaagaauuccaguacauca

SEQ ID NO: 1318319 - RNA, 19 nt, Homo sapiens
gcacuuagagaacccagaa

SEQ ID NO: 1318320 - RNA, 19 nt, Homo sapiens
ccagaucgcuauguauaau

SEQ ID NO: 1318321 - RNA, 19 nt, Homo sapiens
gugacaaucucaucugugu

SEQ ID NO: 1318322 - RNA, 19 nt, Homo sapiens
ggaaacgccacauuggaaa

SEQ ID NO: 1318323 - RNA, 19 nt, Homo sapiens
ccacagggauacauucagu

SEQ ID NO: 1318324 - RNA, 19 nt, Homo sapiens
gaagcugguuugcuguugu

SEQ ID NO: 1318325 - RNA, 19 nt, Homo sapiens
gaucuuuacaccaggauuu

SEQ ID NO: 1318326 - RNA, 19 nt, Homo sapiens
ggugguagauuucauugag

SEQ ID NO: 1318327 - RNA, 19 nt, Homo sapiens
guucugauguaauuucuca

SEQ ID NO: 1318328 - RNA, 19 nt, Homo sapiens
cauuugccaucuuuaguuu

SEQ ID NO: 1318329 - RNA, 19 nt, Homo sapiens
cgaacgaccucugaaguca

SEQ ID NO: 1318330 - RNA, 19 nt, Homo sapiens
gaagguuuguggccagauc

SEQ ID NO: 1318331 - RNA, 19 nt, Homo sapiens
cggaagcgguuagaagaaa

SEQ ID NO: 1318332 - RNA, 19 nt, Homo sapiens
aauuugauguggugaauga

SEQ ID NO: 1318333 - RNA, 19 nt, Homo sapiens
cggaauaaacugcuucuga

SEQ ID NO: 1318334 - RNA, 19 nt, Homo sapiens
gcaaaugcaugugcuugag

SEQ ID NO: 1318335 - RNA, 19 nt, Homo sapiens
uuacagaccaccaggaauu

SEQ ID NO: 1318336 - RNA, 19 nt, Homo sapiens
caucagugcccguguuuga

SEQ ID NO: 1318337 - RNA, 19 nt, Homo sapiens
ucaauaccgugcaauucuu

SEQ ID NO: 1318338 - RNA, 19 nt, Homo sapiens
gaaacgaugccgagaagag

SEQ ID NO: 1318339 - RNA, 19 nt, Homo sapiens
cagaauaccacaccagaug

SEQ ID NO: 1318340 - RNA, 19 nt, Homo sapiens
aaucucauuugccaucuuu

SEQ ID NO: 1318341 - RNA, 19 nt, Homo sapiens
ugaagacauuauagacuug

SEQ ID NO: 1318342 - RNA, 19 nt, Homo sapiens
ccaucaggcuccuuggaaa

SEQ ID NO: 1318343 - RNA, 19 nt, Homo sapiens
ggcggaguuuguuagaaua

SEQ ID NO: 1318344 - RNA, 19 nt, Homo sapiens
agggauacauucaguuuau

SEQ ID NO: 1318345 - RNA, 19 nt, Homo sapiens
ucugugaaguccaucuuaa

SEQ ID NO: 1318346 - RNA, 19 nt, Homo sapiens
uaggaaacauuauggaucu

SEQ ID NO: 1318347 - RNA, 19 nt, Homo sapiens
ucacggcuuucuccgauga

SEQ ID NO: 1318348 - RNA, 19 nt, Homo sapiens
caguguuucugcaguaauu

SEQ ID NO: 1318349 - RNA, 19 nt, Homo sapiens
guaauaaaggugguagauu

SEQ ID NO: 1318350 - RNA, 19 nt, Homo sapiens
caucuuuccugaccuuugu

SEQ ID NO: 1318351 - RNA, 19 nt, Homo sapiens
cuauugauguguacgaaga

SEQ ID NO: 1318352 - RNA, 19 nt, Homo sapiens
aaucuucuccugccuuuaa

SEQ ID NO: 1318353 - RNA, 19 nt, Homo sapiens
aagaacagacgugcacuua

SEQ ID NO: 1318354 - RNA, 19 nt, Homo sapiens
gaagaacagacgugcacuu

SEQ ID NO: 1318355 - RNA, 19 nt, Homo sapiens
gaaguaacagaguugaauc

SEQ ID NO: 1318356 - RNA, 19 nt, Homo sapiens
cgccaaaggccaaaucaaa

SEQ ID NO: 1318357 - RNA, 19 nt, Homo sapiens
gagugacaaucucaucugu

SEQ ID NO: 1318358 - RNA, 19 nt, Homo sapiens
ugccagauuugcauaagaa

SEQ ID NO: 1318359 - RNA, 19 nt, Homo sapiens
gaccuuuguuucuuucugu

SEQ ID NO: 1318360 - RNA, 19 nt, Homo sapiens
gcccgaaauucuccucaga

SEQ ID NO: 1318361 - RNA, 19 nt, Homo sapiens
gcaauugucugugcuuucc

SEQ ID NO: 1318362 - RNA, 19 nt, Homo sapiens
gaauaaacugcuucugauc

SEQ ID NO: 1318363 - RNA, 19 nt, Homo sapiens
ucucagagcagacaaagga

SEQ ID NO: 1318364 - RNA, 19 nt, Homo sapiens
cuggauauguugauuagau

SEQ ID NO: 1318365 - RNA, 19 nt, Homo sapiens
ggcguacccuggauauguu

SEQ ID NO: 1318366 - RNA, 19 nt, Homo sapiens
ggaagcgguuagaagaaag

SEQ ID NO: 1318367 - RNA, 19 nt, Homo sapiens
ggagaucaaagaaauagca

SEQ ID NO: 1318368 - RNA, 19 nt, Homo sapiens
ccaauuugauguggugaau

SEQ ID NO: 1318369 - RNA, 19 nt, Homo sapiens
aggauuugaugccagauuu

SEQ ID NO: 1318370 - RNA, 19 nt, Homo sapiens
augauccgcucccacuuua

SEQ ID NO: 1318371 - RNA, 19 nt, Homo sapiens
gacaaguccgucagaacua

SEQ ID NO: 1318372 - RNA, 19 nt, Homo sapiens
gaaucucauuugccaucuu

SEQ ID NO: 1318373 - RNA, 19 nt, Homo sapiens
gcugccaccuguaugcuau

SEQ ID NO: 1318374 - RNA, 19 nt, Homo sapiens
guggccagaucgcuaugua

SEQ ID NO: 1318375 - RNA, 19 nt, Homo sapiens
gcucccacuuuacacauau

SEQ ID NO: 1318376 - RNA, 19 nt, Homo sapiens
ccaccauguugccauauuc

SEQ ID NO: 1318377 - RNA, 19 nt, Homo sapiens
uguaugcuauuaacacuca

SEQ ID NO: 1318378 - RNA, 19 nt, Homo sapiens
caagucagcgcggaagaaa

SEQ ID NO: 1318379 - RNA, 19 nt, Homo sapiens
gccugucagugaucuauug

SEQ ID NO: 1318380 - RNA, 19 nt, Homo sapiens
gaagacauuauagacuuga

SEQ ID NO: 1318381 - RNA, 19 nt, Homo sapiens
cuguggagcugcuuauuuc

SEQ ID NO: 1318382 - RNA, 19 nt, Homo sapiens
gcacacagcucacucguau

SEQ ID NO: 1318383 - RNA, 19 nt, Homo sapiens
caacgaaagugaagacaga

SEQ ID NO: 1318384 - RNA, 19 nt, Homo sapiens
caccagagcucuugucuau

SEQ ID NO: 1318385 - RNA, 19 nt, Homo sapiens
gcacagcccaagauuauuu

SEQ ID NO: 1318386 - RNA, 19 nt, Homo sapiens
acaggaagaucaagaauga

SEQ ID NO: 1318387 - RNA, 19 nt, Homo sapiens
ccagagcucuugucuauuc

SEQ ID NO: 1318388 - RNA, 19 nt, Homo sapiens
gaaagaaggguuuggugaa

SEQ ID NO: 1318389 - RNA, 19 nt, Homo sapiens
gaaaccuacuggugaaaga

SEQ ID NO: 1318390 - RNA, 19 nt, Homo sapiens
gcccagagccuacuagaaa

SEQ ID NO: 1318391 - RNA, 19 nt, Homo sapiens
gaacaucucacgagcuuuc

SEQ ID NO: 1318392 - RNA, 19 nt, Homo sapiens
guuaagagccaaucacuga

SEQ ID NO: 1318393 - RNA, 19 nt, Homo sapiens
gggaacaucucacgagcuu

SEQ ID NO: 1318394 - RNA, 19 nt, Homo sapiens
ccacuggcgucacguugua

SEQ ID NO: 1318395 - RNA, 19 nt, Homo sapiens
gcgugcagcugaaccagua

SEQ ID NO: 1318396 - RNA, 19 nt, Homo sapiens
caaccucuauuugguguuu

SEQ ID NO: 1318397 - RNA, 19 nt, Homo sapiens
gcgaugagcaaacucuaua

SEQ ID NO: 1318398 - RNA, 19 nt, Homo sapiens
gggaaggccuuggauguau

SEQ ID NO: 1318399 - RNA, 19 nt, Homo sapiens
cagcacagcccaagauuau

SEQ ID NO: 1318400 - RNA, 19 nt, Homo sapiens
gggacagacuggaauguau

SEQ ID NO: 1318401 - RNA, 19 nt, Homo sapiens
uaacuuuccuggacugugu

SEQ ID NO: 1318402 - RNA, 19 nt, Homo sapiens
gaagacagacacuaugcaa

SEQ ID NO: 1318403 - RNA, 19 nt, Homo sapiens
caacaaggcuacgcagaag

SEQ ID NO: 1318404 - RNA, 19 nt, Homo sapiens
ggacagggccaguguugga

SEQ ID NO: 1318405 - RNA, 19 nt, Homo sapiens
ugacagaggaggagguuaa

SEQ ID NO: 1318406 - RNA, 19 nt, Homo sapiens
gacagacacuaugcaauga

SEQ ID NO: 1318407 - RNA, 19 nt, Homo sapiens
gaaaccgggugcccaugga

SEQ ID NO: 1318408 - RNA, 19 nt, Homo sapiens
aguacaagcugcagaguga

SEQ ID NO: 1318409 - RNA, 19 nt, Homo sapiens
cccaagagcugcacucaca

SEQ ID NO: 1318410 - RNA, 19 nt, Homo sapiens
ccauggagccucagaaaug

SEQ ID NO: 1318411 - RNA, 19 nt, Homo sapiens
ggaaggccuuggauguaug

SEQ ID NO: 1318412 - RNA, 19 nt, Homo sapiens
acacugcccuggaaacaug

SEQ ID NO: 1318413 - RNA, 19 nt, Homo sapiens
caggaaaccuacuggugaa

SEQ ID NO: 1318414 - RNA, 19 nt, Homo sapiens
guuaguggaaggcaaguua

SEQ ID NO: 1318415 - RNA, 19 nt, Homo sapiens
ugaaguccaugcugaggaa

SEQ ID NO: 1318416 - RNA, 19 nt, Homo sapiens
gaccugauccugaagaugu

SEQ ID NO: 1318417 - RNA, 19 nt, Homo sapiens
gaaugagcccgugguguuu

SEQ ID NO: 1318418 - RNA, 19 nt, Homo sapiens
cagacacuaugcaaugaaa

SEQ ID NO: 1318419 - RNA, 19 nt, Homo sapiens
aaaguggacugaacggaau

SEQ ID NO: 1318420 - RNA, 19 nt, Homo sapiens
gaagauguuagacaagaau

SEQ ID NO: 1318421 - RNA, 19 nt, Homo sapiens
ggaagugcccugugacaag

SEQ ID NO: 1318422 - RNA, 19 nt, Homo sapiens
ggacagacuggaauguaug

SEQ ID NO: 1318423 - RNA, 19 nt, Homo sapiens
ucauggaagugcccuguga

SEQ ID NO: 1318424 - RNA, 19 nt, Homo sapiens
cguauguccugcacuggua

SEQ ID NO: 1318425 - RNA, 19 nt, Homo sapiens
gaacggaaucaagcucuga

SEQ ID NO: 1318426 - RNA, 19 nt, Homo sapiens
ugaucgagguccuggauga

SEQ ID NO: 1318427 - RNA, 19 nt, Homo sapiens
gagauugccauccugaaga

SEQ ID NO: 1318428 - RNA, 19 nt, Homo sapiens
agacagacacuaugcaaug

SEQ ID NO: 1318429 - RNA, 19 nt, Homo sapiens
ccaacaaggcuacgcagaa

SEQ ID NO: 1318430 - RNA, 19 nt, Homo sapiens
cagaggaggagguuaagaa

SEQ ID NO: 1318431 - RNA, 19 nt, Homo sapiens
agaaugagcccgugguguu

SEQ ID NO: 1318432 - RNA, 19 nt, Homo sapiens
uguuugaccuccugagaaa

SEQ ID NO: 1318433 - RNA, 19 nt, Homo sapiens
gaagcuggaccacgugaau

SEQ ID NO: 1318434 - RNA, 19 nt, Homo sapiens
gcgcccagguucccaacaa

SEQ ID NO: 1318435 - RNA, 19 nt, Homo sapiens
gagcucuugucuauucaga

SEQ ID NO: 1318436 - RNA, 19 nt, Homo sapiens
ugaagauguuagacaagaa

SEQ ID NO: 1318437 - RNA, 19 nt, Homo sapiens
gagcugaggcuggagaaga

SEQ ID NO: 1318438 - RNA, 19 nt, Homo sapiens
ggccaguguuggagaauuc

SEQ ID NO: 1318439 - RNA, 19 nt, Homo sapiens
caguguggcccgaagcuua

SEQ ID NO: 1318440 - RNA, 19 nt, Homo sapiens
caguuucuacgucuauuua

SEQ ID NO: 1318441 - RNA, 19 nt, Homo sapiens
ccaaguggauggaacuaac

SEQ ID NO: 1318442 - RNA, 19 nt, Homo sapiens
ccacggugauccuggugaa

SEQ ID NO: 1318443 - RNA, 19 nt, Homo sapiens
ccagcacagcccaagauua

SEQ ID NO: 1318444 - RNA, 19 nt, Homo sapiens
ggagcagccuucaccuucu

SEQ ID NO: 1318445 - RNA, 19 nt, Homo sapiens
aaagaaggguuuggugaag

SEQ ID NO: 1318446 - RNA, 19 nt, Homo sapiens
gaucggacccacccuugga

SEQ ID NO: 1318447 - RNA, 19 nt, Homo sapiens
ggaggagguuaagaacuca

SEQ ID NO: 1318448 - RNA, 19 nt, Homo sapiens
cugaagauguuagacaaga

SEQ ID NO: 1318449 - RNA, 19 nt, Homo sapiens
acacagcucacucguaugu

SEQ ID NO: 1318450 - RNA, 19 nt, Homo sapiens
ggaagugcccauucaucga

SEQ ID NO: 1318451 - RNA, 19 nt, Homo sapiens
ggagauugccauccugaag

SEQ ID NO: 1318452 - RNA, 19 nt, Homo sapiens
ggacacugcccuggaaaca

SEQ ID NO: 1318453 - RNA, 19 nt, Homo sapiens
gcaccagagcucuugucua

SEQ ID NO: 1318454 - RNA, 19 nt, Homo sapiens
ccgaggccauuucugauuc

SEQ ID NO: 1318455 - RNA, 19 nt, Homo sapiens
ugaauguggucaaacugau

SEQ ID NO: 1318456 - RNA, 19 nt, Homo sapiens
agauugccauccugaagaa

SEQ ID NO: 1318457 - RNA, 19 nt, Homo sapiens
caccagggcugacuuugac

SEQ ID NO: 1318458 - RNA, 19 nt, Homo sapiens
gcccauggagccucagaaa

SEQ ID NO: 1318459 - RNA, 19 nt, Homo sapiens
gggaagagcgauccauguc

SEQ ID NO: 1318460 - RNA, 19 nt, Homo sapiens
gugaauguggucaaacuga

SEQ ID NO: 1318461 - RNA, 19 nt, Homo sapiens
gaaugcucauagagguuga

SEQ ID NO: 1318462 - RNA, 19 nt, Homo sapiens
gagcagccuucaccuucuc

SEQ ID NO: 1318463 - RNA, 19 nt, Homo sapiens
ucacgagcuuuccuacauc

SEQ ID NO: 1318464 - RNA, 19 nt, Homo sapiens
gcacucacacuccuacaac

SEQ ID NO: 1318465 - RNA, 19 nt, Homo sapiens
gggccaguguuggagaauu

SEQ ID NO: 1318466 - RNA, 19 nt, Homo sapiens
gcacaagcgaugagcaaac

SEQ ID NO: 1318467 - RNA, 19 nt, Homo sapiens
acaaggcuacgcagaagaa

SEQ ID NO: 1318468 - RNA, 19 nt, Homo sapiens
gcaaguuaagagccaauca

SEQ ID NO: 1318469 - RNA, 19 nt, Homo sapiens
aggaggagguuaagaacuc

SEQ ID NO: 1318470 - RNA, 19 nt, Homo sapiens
caccuucucucugggauca

SEQ ID NO: 1318471 - RNA, 19 nt, Homo sapiens
gguggccucugcggcaauu

SEQ ID NO: 1318472 - RNA, 19 nt, Homo sapiens
gaugagcaaacucuauaag

SEQ ID NO: 1318473 - RNA, 19 nt, Homo sapiens
gcaugucgcgugcucaucu

SEQ ID NO: 1318474 - RNA, 19 nt, Homo sapiens
ggaagagcgauccaugucu

SEQ ID NO: 1318475 - RNA, 19 nt, Homo sapiens
guacuugcacugccagaag

SEQ ID NO: 1318476 - RNA, 19 nt, Homo sapiens
gaauguggucaaacugauc

SEQ ID NO: 1318477 - RNA, 19 nt, Homo sapiens
acaccagggcugacuuuga

SEQ ID NO: 1318478 - RNA, 19 nt, Homo sapiens
caucgucccugcccaucuc

SEQ ID NO: 1318479 - RNA, 19 nt, Homo sapiens
gagguuaagaacucaguca

SEQ ID NO: 1318480 - RNA, 19 nt, Homo sapiens
gugaagaucgccgacuuug

SEQ ID NO: 1318481 - RNA, 19 nt, Homo sapiens
cgaugagcaaacucuauaa

SEQ ID NO: 1318482 - RNA, 19 nt, Homo sapiens
gcacacagcucacucguau

SEQ ID NO: 1318483 - RNA, 19 nt, Homo sapiens
gaacagaguaugcaauuug

SEQ ID NO: 1318484 - RNA, 19 nt, Homo sapiens
caacgaaagugaagacaga

SEQ ID NO: 1318485 - RNA, 19 nt, Homo sapiens
caccagagcucuugucuau

SEQ ID NO: 1318486 - RNA, 19 nt, Homo sapiens
gcacagcccaagauuauuu

SEQ ID NO: 1318487 - RNA, 19 nt, Homo sapiens
acaggaagaucaagaauga

SEQ ID NO: 1318488 - RNA, 19 nt, Homo sapiens
ccagagcucuugucuauuc

SEQ ID NO: 1318489 - RNA, 19 nt, Homo sapiens
gaaagaaggguuuggugaa

SEQ ID NO: 1318490 - RNA, 19 nt, Homo sapiens
gaaaccuacuggugaaaga

SEQ ID NO: 1318491 - RNA, 19 nt, Homo sapiens
gcccagagccuacuagaaa

SEQ ID NO: 1318492 - RNA, 19 nt, Homo sapiens
gaacaucucacgagcuuuc

SEQ ID NO: 1318493 - RNA, 19 nt, Homo sapiens
guuaagagccaaucacuga

SEQ ID NO: 1318494 - RNA, 19 nt, Homo sapiens
gggaacaucucacgagcuu

SEQ ID NO: 1318495 - RNA, 19 nt, Homo sapiens
ccacuggcgucacguugua

SEQ ID NO: 1318496 - RNA, 19 nt, Homo sapiens
gcgugcagcugaaccagua

SEQ ID NO: 1318497 - RNA, 19 nt, Homo sapiens
caaccucuauuugguguuu

SEQ ID NO: 1318498 - RNA, 19 nt, Homo sapiens
gcgaugagcaaacucuaua

SEQ ID NO: 1318499 - RNA, 19 nt, Homo sapiens
gggaaggccuuggauguau

SEQ ID NO: 1318500 - RNA, 19 nt, Homo sapiens
cagcacagcccaagauuau

SEQ ID NO: 1318501 - RNA, 19 nt, Homo sapiens
gggacagacuggaauguau

SEQ ID NO: 1318502 - RNA, 19 nt, Homo sapiens
uaacuuuccuggacugugu

SEQ ID NO: 1318503 - RNA, 19 nt, Homo sapiens
gaagacagacacuaugcaa

SEQ ID NO: 1318504 - RNA, 19 nt, Homo sapiens
caacaaggcuacgcagaag

SEQ ID NO: 1318505 - RNA, 19 nt, Homo sapiens
ggacagggccaguguugga

SEQ ID NO: 1318506 - RNA, 19 nt, Homo sapiens
ugacagaggaggagguuaa

SEQ ID NO: 1318507 - RNA, 19 nt, Homo sapiens
gacagacacuaugcaauga

SEQ ID NO: 1318508 - RNA, 19 nt, Homo sapiens
gaaaccgggugcccaugga

SEQ ID NO: 1318509 - RNA, 19 nt, Homo sapiens
aguacaagcugcagaguga

SEQ ID NO: 1318510 - RNA, 19 nt, Homo sapiens
cccaagagcugcacucaca

SEQ ID NO: 1318511 - RNA, 19 nt, Homo sapiens
ccauggagccucagaaaug

SEQ ID NO: 1318512 - RNA, 19 nt, Homo sapiens
ggaaggccuuggauguaug

SEQ ID NO: 1318513 - RNA, 19 nt, Homo sapiens
acacugcccuggaaacaug

SEQ ID NO: 1318514 - RNA, 19 nt, Homo sapiens
caggaaaccuacuggugaa

SEQ ID NO: 1318515 - RNA, 19 nt, Homo sapiens
guuaguggaaggcaaguua

SEQ ID NO: 1318516 - RNA, 19 nt, Homo sapiens
ugaaguccaugcugaggaa

SEQ ID NO: 1318517 - RNA, 19 nt, Homo sapiens
gaccugauccugaagaugu

SEQ ID NO: 1318518 - RNA, 19 nt, Homo sapiens
gaaugagcccgugguguuu

SEQ ID NO: 1318519 - RNA, 19 nt, Homo sapiens
cagacacuaugcaaugaaa

SEQ ID NO: 1318520 - RNA, 19 nt, Homo sapiens
cagaacagaguaugcaauu

SEQ ID NO: 1318521 - RNA, 19 nt, Homo sapiens
aaaguggacugaacggaau

SEQ ID NO: 1318522 - RNA, 19 nt, Homo sapiens
gaagauguuagacaagaau

SEQ ID NO: 1318523 - RNA, 19 nt, Homo sapiens
ggaagugcccugugacaag

SEQ ID NO: 1318524 - RNA, 19 nt, Homo sapiens
ggacagacuggaauguaug

SEQ ID NO: 1318525 - RNA, 19 nt, Homo sapiens
ucauggaagugcccuguga

SEQ ID NO: 1318526 - RNA, 19 nt, Homo sapiens
cguauguccugcacuggua

SEQ ID NO: 1318527 - RNA, 19 nt, Homo sapiens
gaacggaaucaagcucuga

SEQ ID NO: 1318528 - RNA, 19 nt, Homo sapiens
ugaucgagguccuggauga

SEQ ID NO: 1318529 - RNA, 19 nt, Homo sapiens
gagauugccauccugaaga

SEQ ID NO: 1318530 - RNA, 19 nt, Homo sapiens
agacagacacuaugcaaug

SEQ ID NO: 1318531 - RNA, 19 nt, Homo sapiens
ccaacaaggcuacgcagaa

SEQ ID NO: 1318532 - RNA, 19 nt, Homo sapiens
cagaggaggagguuaagaa

SEQ ID NO: 1318533 - RNA, 19 nt, Homo sapiens
agaaugagcccgugguguu

SEQ ID NO: 1318534 - RNA, 19 nt, Homo sapiens
uguuugaccuccugagaaa

SEQ ID NO: 1318535 - RNA, 19 nt, Homo sapiens
gaagcuggaccacgugaau

SEQ ID NO: 1318536 - RNA, 19 nt, Homo sapiens
gagcucuugucuauucaga

SEQ ID NO: 1318537 - RNA, 19 nt, Homo sapiens
ugaagauguuagacaagaa

SEQ ID NO: 1318538 - RNA, 19 nt, Homo sapiens
gagcugaggcuggagaaga

SEQ ID NO: 1318539 - RNA, 19 nt, Homo sapiens
ggccaguguuggagaauuc

SEQ ID NO: 1318540 - RNA, 19 nt, Homo sapiens
caguguggcccgaagcuua

SEQ ID NO: 1318541 - RNA, 19 nt, Homo sapiens
caguuucuacgucuauuua

SEQ ID NO: 1318542 - RNA, 19 nt, Homo sapiens
ccaaguggauggaacuaac

SEQ ID NO: 1318543 - RNA, 19 nt, Homo sapiens
ccacggugauccuggugaa

SEQ ID NO: 1318544 - RNA, 19 nt, Homo sapiens
ccagcacagcccaagauua

SEQ ID NO: 1318545 - RNA, 19 nt, Homo sapiens
ggagcagccuucaccuucu

SEQ ID NO: 1318546 - RNA, 19 nt, Homo sapiens
guggagaguucccaacaag

SEQ ID NO: 1318547 - RNA, 19 nt, Homo sapiens
aaagaaggguuuggugaag

SEQ ID NO: 1318548 - RNA, 19 nt, Homo sapiens
gaucggacccacccuugga

SEQ ID NO: 1318549 - RNA, 19 nt, Homo sapiens
ggaggagguuaagaacuca

SEQ ID NO: 1318550 - RNA, 19 nt, Homo sapiens
cugaagauguuagacaaga

SEQ ID NO: 1318551 - RNA, 19 nt, Homo sapiens
acacagcucacucguaugu

SEQ ID NO: 1318552 - RNA, 19 nt, Homo sapiens
ggaagugcccauucaucga

SEQ ID NO: 1318553 - RNA, 19 nt, Homo sapiens
ggagauugccauccugaag

SEQ ID NO: 1318554 - RNA, 19 nt, Homo sapiens
agaacagaguaugcaauuu

SEQ ID NO: 1318555 - RNA, 19 nt, Homo sapiens
ggacacugcccuggaaaca

SEQ ID NO: 1318556 - RNA, 19 nt, Homo sapiens
gcaccagagcucuugucua

SEQ ID NO: 1318557 - RNA, 19 nt, Homo sapiens
ccgaggccauuucugauuc

SEQ ID NO: 1318558 - RNA, 19 nt, Homo sapiens
ugaauguggucaaacugau

SEQ ID NO: 1318559 - RNA, 19 nt, Homo sapiens
agauugccauccugaagaa

SEQ ID NO: 1318560 - RNA, 19 nt, Homo sapiens
caccagggcugacuuugac

SEQ ID NO: 1318561 - RNA, 19 nt, Homo sapiens
gcccauggagccucagaaa

SEQ ID NO: 1318562 - RNA, 19 nt, Homo sapiens
gggaagagcgauccauguc

SEQ ID NO: 1318563 - RNA, 19 nt, Homo sapiens
gugaauguggucaaacuga

SEQ ID NO: 1318564 - RNA, 19 nt, Homo sapiens
gaaugcucauagagguuga

SEQ ID NO: 1318565 - RNA, 19 nt, Homo sapiens
gagcagccuucaccuucuc

SEQ ID NO: 1318566 - RNA, 19 nt, Homo sapiens
ucacgagcuuuccuacauc

SEQ ID NO: 1318567 - RNA, 19 nt, Homo sapiens
gcacucacacuccuacaac

SEQ ID NO: 1318568 - RNA, 19 nt, Homo sapiens
gggccaguguuggagaauu

SEQ ID NO: 1318569 - RNA, 19 nt, Homo sapiens
gcacaagcgaugagcaaac

SEQ ID NO: 1318570 - RNA, 19 nt, Homo sapiens
acaaggcuacgcagaagaa

SEQ ID NO: 1318571 - RNA, 19 nt, Homo sapiens
gcaaguuaagagccaauca

SEQ ID NO: 1318572 - RNA, 19 nt, Homo sapiens
aggaggagguuaagaacuc

SEQ ID NO: 1318573 - RNA, 19 nt, Homo sapiens
caccuucucucugggauca

SEQ ID NO: 1318574 - RNA, 19 nt, Homo sapiens
gguggccucugcggcaauu

SEQ ID NO: 1318575 - RNA, 19 nt, Homo sapiens
gaugagcaaacucuauaag

SEQ ID NO: 1318576 - RNA, 19 nt, Homo sapiens
gcaugucgcgugcucaucu

SEQ ID NO: 1318577 - RNA, 19 nt, Homo sapiens
ggaagagcgauccaugucu

SEQ ID NO: 1318578 - RNA, 19 nt, Homo sapiens
guacuugcacugccagaag

SEQ ID NO: 1318579 - RNA, 19 nt, Homo sapiens
gaauguggucaaacugauc

SEQ ID NO: 1318580 - RNA, 19 nt, Homo sapiens
acaccagggcugacuuuga

SEQ ID NO: 1318581 - RNA, 19 nt, Homo sapiens
caucgucccugcccaucuc

SEQ ID NO: 1318582 - RNA, 19 nt, Homo sapiens
caacgaaagugaagacaga

SEQ ID NO: 1318583 - RNA, 19 nt, Homo sapiens
acaggaagaucaagaauga

SEQ ID NO: 1318584 - RNA, 19 nt, Homo sapiens
ccaguuagauucaacaaau

SEQ ID NO: 1318585 - RNA, 19 nt, Homo sapiens
gcccagagccuacuagaaa

SEQ ID NO: 1318586 - RNA, 19 nt, Homo sapiens
gcccagcucuugcuucauu

SEQ ID NO: 1318587 - RNA, 19 nt, Homo sapiens
caggaaaccuacuggugua

SEQ ID NO: 1318588 - RNA, 19 nt, Homo sapiens
cagaauauccaguuagauu

SEQ ID NO: 1318589 - RNA, 19 nt, Homo sapiens
ccacuggcgucacguugua

SEQ ID NO: 1318590 - RNA, 19 nt, Homo sapiens
gcgugcagcugaaccagua

SEQ ID NO: 1318591 - RNA, 19 nt, Homo sapiens
gggaaggccuuggauguau

SEQ ID NO: 1318592 - RNA, 19 nt, Homo sapiens
gaaaccuacugguguaagu

SEQ ID NO: 1318593 - RNA, 19 nt, Homo sapiens
gaagacagacacuaugcaa

SEQ ID NO: 1318594 - RNA, 19 nt, Homo sapiens
ugacagaggaggagguuaa

SEQ ID NO: 1318595 - RNA, 19 nt, Homo sapiens
gacagacacuaugcaauga

SEQ ID NO: 1318596 - RNA, 19 nt, Homo sapiens
caacaaggcuacgcagaag

SEQ ID NO: 1318597 - RNA, 19 nt, Homo sapiens
aguacaagcugcagaguga

SEQ ID NO: 1318598 - RNA, 19 nt, Homo sapiens
ggaaggccuuggauguaug

SEQ ID NO: 1318599 - RNA, 19 nt, Homo sapiens
ugaaguccaugcugaggaa

SEQ ID NO: 1318600 - RNA, 19 nt, Homo sapiens
gaccugauccugaagaugu

SEQ ID NO: 1318601 - RNA, 19 nt, Homo sapiens
gaaugagcccgugguguuu

SEQ ID NO: 1318602 - RNA, 19 nt, Homo sapiens
cagacacuaugcaaugaaa

SEQ ID NO: 1318603 - RNA, 19 nt, Homo sapiens
gauccaccuucuucacuau

SEQ ID NO: 1318604 - RNA, 19 nt, Homo sapiens
gaagauguuagacaagaau

SEQ ID NO: 1318605 - RNA, 19 nt, Homo sapiens
ggaagugcccugugacaag

SEQ ID NO: 1318606 - RNA, 19 nt, Homo sapiens
ggcccagaauauccaguua

SEQ ID NO: 1318607 - RNA, 19 nt, Homo sapiens
gggcccagcucuugcuuca

SEQ ID NO: 1318608 - RNA, 19 nt, Homo sapiens
ucauggaagugcccuguga

SEQ ID NO: 1318609 - RNA, 19 nt, Homo sapiens
gaaccaggcccagaauauc

SEQ ID NO: 1318610 - RNA, 19 nt, Homo sapiens
ugaucgagguccuggauga

SEQ ID NO: 1318611 - RNA, 19 nt, Homo sapiens
gagauugccauccugaaga

SEQ ID NO: 1318612 - RNA, 19 nt, Homo sapiens
agacagacacuaugcaaug

SEQ ID NO: 1318613 - RNA, 19 nt, Homo sapiens
cagaggaggagguuaagaa

SEQ ID NO: 1318614 - RNA, 19 nt, Homo sapiens
agaaugagcccgugguguu

SEQ ID NO: 1318615 - RNA, 19 nt, Homo sapiens
uguuugaccuccugagaaa

SEQ ID NO: 1318616 - RNA, 19 nt, Homo sapiens
ccaacaaggcuacgcagaa

SEQ ID NO: 1318617 - RNA, 19 nt, Homo sapiens
gaagcuggaccacgugaau

SEQ ID NO: 1318618 - RNA, 19 nt, Homo sapiens
cagcagauccaccuucuuc

SEQ ID NO: 1318619 - RNA, 19 nt, Homo sapiens
ugaagauguuagacaagaa

SEQ ID NO: 1318620 - RNA, 19 nt, Homo sapiens
gcgcccagguucccaacaa

SEQ ID NO: 1318621 - RNA, 19 nt, Homo sapiens
gugagugcuuguucaguga

SEQ ID NO: 1318622 - RNA, 19 nt, Homo sapiens
ccacggugauccuggugaa

SEQ ID NO: 1318623 - RNA, 19 nt, Homo sapiens
cccagaauauccaguuaga

SEQ ID NO: 1318624 - RNA, 19 nt, Homo sapiens
ggaggagguuaagaacuca

SEQ ID NO: 1318625 - RNA, 19 nt, Homo sapiens
cugaagauguuagacaaga

SEQ ID NO: 1318626 - RNA, 19 nt, Homo sapiens
ggaagugcccauucaucga

SEQ ID NO: 1318627 - RNA, 19 nt, Homo sapiens
ggagauugccauccugaag

SEQ ID NO: 1318628 - RNA, 19 nt, Homo sapiens
ccgaggccauuucugauuc

SEQ ID NO: 1318629 - RNA, 19 nt, Homo sapiens
ugaauguggucaaacugau

SEQ ID NO: 1318630 - RNA, 19 nt, Homo sapiens
agauugccauccugaagaa

SEQ ID NO: 1318631 - RNA, 19 nt, Homo sapiens
gggaagagcgauccauguc

SEQ ID NO: 1318632 - RNA, 19 nt, Homo sapiens
gcagaaccaggcccagaau

SEQ ID NO: 1318633 - RNA, 19 nt, Homo sapiens
gugaauguggucaaacuga

SEQ ID NO: 1318634 - RNA, 19 nt, Homo sapiens
agauccaccuucuucacua

SEQ ID NO: 1318635 - RNA, 19 nt, Homo sapiens
uggcagagguuugcagaca

SEQ ID NO: 1318636 - RNA, 19 nt, Homo sapiens
gggagaggaacccgcauug

SEQ ID NO: 1318637 - RNA, 19 nt, Homo sapiens
gcugcgcgcucaguguuug

SEQ ID NO: 1318638 - RNA, 19 nt, Homo sapiens
agaaccaggcccagaauau

SEQ ID NO: 1318639 - RNA, 19 nt, Homo sapiens
acaaggcuacgcagaagaa

SEQ ID NO: 1318640 - RNA, 19 nt, Homo sapiens
cagaaccaggcccagaaua

SEQ ID NO: 1318641 - RNA, 19 nt, Homo sapiens
caccuucuucacuauaaua

SEQ ID NO: 1318642 - RNA, 19 nt, Homo sapiens
aggaggagguuaagaacuc

SEQ ID NO: 1318643 - RNA, 19 nt, Homo sapiens
cuucuuccaugcagcuuga

SEQ ID NO: 1318644 - RNA, 19 nt, Homo sapiens
ggaagagcgauccaugucu

SEQ ID NO: 1318645 - RNA, 19 nt, Homo sapiens
guacuugcacugccagaag

SEQ ID NO: 1318646 - RNA, 19 nt, Homo sapiens
gaauguggucaaacugauc

SEQ ID NO: 1318647 - RNA, 19 nt, Homo sapiens
gagguuaagaacucaguca

SEQ ID NO: 1318648 - RNA, 19 nt, Homo sapiens
gugaagaucgccgacuuug

SEQ ID NO: 1318649 - RNA, 19 nt, Homo sapiens
ccaccuucuucacuauaau

SEQ ID NO: 1318650 - RNA, 19 nt, Homo sapiens
uccaccuucuucacuauaa

SEQ ID NO: 1318651 - RNA, 19 nt, Homo sapiens
gaacucagucaggcucauc

SEQ ID NO: 1318652 - RNA, 19 nt, Homo sapiens
ccacaggaagaucaagaau

SEQ ID NO: 1318653 - RNA, 19 nt, Homo sapiens
ugggaaggccuuggaugua

SEQ ID NO: 1318654 - RNA, 19 nt, Homo sapiens
gugggaaggccuuggaugu

SEQ ID NO: 1318655 - RNA, 19 nt, Homo sapiens
gaugaugggcacgugaaga

SEQ ID NO: 1318656 - RNA, 19 nt, Homo sapiens
ugccagacaucaaguugca

SEQ ID NO: 1318657 - RNA, 19 nt, Homo sapiens
guuguacugcuuugucuau

SEQ ID NO: 1318658 - RNA, 19 nt, Homo sapiens
gggaugaugggcacgugaa

SEQ ID NO: 1318659 - RNA, 19 nt, Homo sapiens
gacacuaugcaaugaaagu

SEQ ID NO: 1318660 - RNA, 19 nt, Homo sapiens
uacuugcacugccagaaga

SEQ ID NO: 1318661 - RNA, 19 nt, Homo sapiens
uccugaagauguuagacaa

SEQ ID NO: 1318662 - RNA, 19 nt, Homo sapiens
ugacccagcugaggacaac

SEQ ID NO: 1318663 - RNA, 19 nt, Homo sapiens
aaaagaaguuacugaagca

SEQ ID NO: 1318664 - RNA, 19 nt, Homo sapiens
gugcuuguucagugaguaa

SEQ ID NO: 1318665 - RNA, 19 nt, Homo sapiens
cacaggaagaucaagaaug

SEQ ID NO: 1318666 - RNA, 19 nt, Homo sapiens
gaauuggggugccagacau

SEQ ID NO: 1318667 - RNA, 19 nt, Homo sapiens
cgugaagaucgccgacuuu

SEQ ID NO: 1318668 - RNA, 19 nt, Homo sapiens
gagacaggcucacauauug

SEQ ID NO: 1318669 - RNA, 19 nt, Homo sapiens
ucacacaggccauuaauua

SEQ ID NO: 1318670 - RNA, 19 nt, Homo sapiens
gaaggaaggucaggaagaa

SEQ ID NO: 1318671 - RNA, 19 nt, Homo sapiens
gcagaagacuagaauuaga

SEQ ID NO: 1318672 - RNA, 19 nt, Homo sapiens
guacaucaguuaucuugaa

SEQ ID NO: 1318673 - RNA, 19 nt, Homo sapiens
ucacaugaauggauuacua

SEQ ID NO: 1318674 - RNA, 19 nt, Homo sapiens
caugugcucuucugcauua

SEQ ID NO: 1318675 - RNA, 19 nt, Homo sapiens
ggaaagaucacacuacaug

SEQ ID NO: 1318676 - RNA, 19 nt, Homo sapiens
gcuugaaguuagugaauua

SEQ ID NO: 1318677 - RNA, 19 nt, Homo sapiens
cagcagaagacuagaauua

SEQ ID NO: 1318678 - RNA, 19 nt, Homo sapiens
ggaggagaaugugcaauuu

SEQ ID NO: 1318679 - RNA, 19 nt, Homo sapiens
ucaguuaucuugaacauuc

SEQ ID NO: 1318680 - RNA, 19 nt, Homo sapiens
ggagggaucauaguauuua

SEQ ID NO: 1318681 - RNA, 19 nt, Homo sapiens
guaaaucacucauccaaac

SEQ ID NO: 1318682 - RNA, 19 nt, Homo sapiens
ggacaaagaaucccucugu

SEQ ID NO: 1318683 - RNA, 19 nt, Homo sapiens
ggucaaaggugagaaggaa

SEQ ID NO: 1318684 - RNA, 19 nt, Homo sapiens
ggagacaggcucacauauu

SEQ ID NO: 1318685 - RNA, 19 nt, Homo sapiens
uggaagagaucauugcauu

SEQ ID NO: 1318686 - RNA, 19 nt, Homo sapiens
guguuuaucucgccauuaa

SEQ ID NO: 1318687 - RNA, 19 nt, Homo sapiens
caaagaaucccucuguuca

SEQ ID NO: 1318688 - RNA, 19 nt, Homo sapiens
gaaggaagaaaugauguaa

SEQ ID NO: 1318689 - RNA, 19 nt, Homo sapiens
gcagaaucaucuaacacaa

SEQ ID NO: 1318690 - RNA, 19 nt, Homo sapiens
ggaaggaagaaaugaugua

SEQ ID NO: 1318691 - RNA, 19 nt, Homo sapiens
cuauugagguuuagcguuu

SEQ ID NO: 1318692 - RNA, 19 nt, Homo sapiens
gaauuacuccuucuucuuc

SEQ ID NO: 1318693 - RNA, 19 nt, Homo sapiens
ugaacauucugacguguaa

SEQ ID NO: 1318694 - RNA, 19 nt, Homo sapiens
ggaguuaccucagcagaag

SEQ ID NO: 1318695 - RNA, 19 nt, Homo sapiens
gacauugaaucacaugaau

SEQ ID NO: 1318696 - RNA, 19 nt, Homo sapiens
gagcgugccuagcuucuuc

SEQ ID NO: 1318697 - RNA, 19 nt, Homo sapiens
gcaaccauuucacaccauu

SEQ ID NO: 1318698 - RNA, 19 nt, Homo sapiens
gacaaagaaucccucuguu

SEQ ID NO: 1318699 - RNA, 19 nt, Homo sapiens
gaagaaaacuuugaagaag

SEQ ID NO: 1318700 - RNA, 19 nt, Homo sapiens
gugccuagcuucuucuguu

SEQ ID NO: 1318701 - RNA, 19 nt, Homo sapiens
gugaauuccauacuaguua

SEQ ID NO: 1318702 - RNA, 19 nt, Homo sapiens
guacucagaacacuuagaa

SEQ ID NO: 1318703 - RNA, 19 nt, Homo sapiens
gaugcucuuugacuuauga

SEQ ID NO: 1318704 - RNA, 19 nt, Homo sapiens
ggauugaucucuggcacaa

SEQ ID NO: 1318705 - RNA, 19 nt, Homo sapiens
gaccauaagguacaucauu

SEQ ID NO: 1318706 - RNA, 19 nt, Homo sapiens
cuacaugccuguugauugg

SEQ ID NO: 1318707 - RNA, 19 nt, Homo sapiens
ggagugaacaggaggcaaa

SEQ ID NO: 1318708 - RNA, 19 nt, Homo sapiens
aauauucucucucgugcua

SEQ ID NO: 1318709 - RNA, 19 nt, Homo sapiens
ucacucauccaaacuuuaa

SEQ ID NO: 1318710 - RNA, 19 nt, Homo sapiens
cagcaucuuugaccucuga

SEQ ID NO: 1318711 - RNA, 19 nt, Homo sapiens
ucaguguauugcucauuua

SEQ ID NO: 1318712 - RNA, 19 nt, Homo sapiens
ggaagagaucauugcauuu

SEQ ID NO: 1318713 - RNA, 19 nt, Homo sapiens
ggacuugaacuuucucuag

SEQ ID NO: 1318714 - RNA, 19 nt, Homo sapiens
guucagccaucaucauguu

SEQ ID NO: 1318715 - RNA, 19 nt, Homo sapiens
caaacuaggaggagaaugu

SEQ ID NO: 1318716 - RNA, 19 nt, Homo sapiens
acgaauaugagccgaauua

SEQ ID NO: 1318717 - RNA, 19 nt, Homo sapiens
ccauaagguacaucauuua

SEQ ID NO: 1318718 - RNA, 19 nt, Homo sapiens
cuucgagucugcccuaauu

SEQ ID NO: 1318719 - RNA, 19 nt, Homo sapiens
ucaguaugguuaugaguau

SEQ ID NO: 1318720 - RNA, 19 nt, Homo sapiens
gagcagcaaccauuuguuc

SEQ ID NO: 1318721 - RNA, 19 nt, Homo sapiens
gaaucccucuguucacugu

SEQ ID NO: 1318722 - RNA, 19 nt, Homo sapiens
gaagagaucauugcauuuu

SEQ ID NO: 1318723 - RNA, 19 nt, Homo sapiens
ucaugaaugugccgaguga

SEQ ID NO: 1318724 - RNA, 19 nt, Homo sapiens
uaagguacaucaguuaucu

SEQ ID NO: 1318725 - RNA, 19 nt, Homo sapiens
ccauaagguacaucaguua

SEQ ID NO: 1318726 - RNA, 19 nt, Homo sapiens
guuuaucucgccauuaaua

SEQ ID NO: 1318727 - RNA, 19 nt, Homo sapiens
uuugagggauaccuaauuu

SEQ ID NO: 1318728 - RNA, 19 nt, Homo sapiens
gcugugaauuccauacuag

SEQ ID NO: 1318729 - RNA, 19 nt, Homo sapiens
gcugaggacugucuguaca

SEQ ID NO: 1318730 - RNA, 19 nt, Homo sapiens
guaaacccauuggaaguca

SEQ ID NO: 1318731 - RNA, 19 nt, Homo sapiens
accauaagguacaucauuu

SEQ ID NO: 1318732 - RNA, 19 nt, Homo sapiens
uguaaaggaccauaaggua

SEQ ID NO: 1318733 - RNA, 19 nt, Homo sapiens
ggaauuacuguugaugauu

SEQ ID NO: 1318734 - RNA, 19 nt, Homo sapiens
cagaugcucuuugacuuau

SEQ ID NO: 1318735 - RNA, 19 nt, Homo sapiens
acagaugcucuuugacuua

SEQ ID NO: 1318736 - RNA, 19 nt, Homo sapiens
aaguacagaugcucuuuga

SEQ ID NO: 1318737 - RNA, 19 nt, Homo sapiens
gcuguuguuucaugaaugu

SEQ ID NO: 1318738 - RNA, 19 nt, Homo sapiens
ggucucugcugucccaguu

SEQ ID NO: 1318739 - RNA, 19 nt, Homo sapiens
uucaaccucuugcuuuaua

SEQ ID NO: 1318740 - RNA, 19 nt, Homo sapiens
guacaauuguguuuaucuc

SEQ ID NO: 1318741 - RNA, 19 nt, Homo sapiens
aaauuggucucucggguau

SEQ ID NO: 1318742 - RNA, 19 nt, Homo sapiens
cuucuucuguucuucagua

SEQ ID NO: 1318743 - RNA, 19 nt, Homo sapiens
gaaagccggacgaggaguu

SEQ ID NO: 1318744 - RNA, 19 nt, Homo sapiens
guacagaugcucuuugacu

SEQ ID NO: 1318745 - RNA, 19 nt, Homo sapiens
ugcgauggguucugucuuu

SEQ ID NO: 1318746 - RNA, 19 nt, Homo sapiens
cagaaucaucuaacacaaa

SEQ ID NO: 1318747 - RNA, 19 nt, Homo sapiens
caacuuguucucuuccauu

SEQ ID NO: 1318748 - RNA, 19 nt, Homo sapiens
gauguggguuuucuacuuu

SEQ ID NO: 1318749 - RNA, 19 nt, Homo sapiens
ccaagaugauaguucuguu

SEQ ID NO: 1318750 - RNA, 19 nt, Homo sapiens
gcugugggccuauucauca

SEQ ID NO: 1318751 - RNA, 19 nt, Homo sapiens
ccauuucacaccauuguaa

SEQ ID NO: 1318752 - RNA, 19 nt, Homo sapiens
acucagaacacuuagaauu

SEQ ID NO: 1318753 - RNA, 19 nt, Homo sapiens
aauguacucagaacacuua

SEQ ID NO: 1318754 - RNA, 19 nt, Homo sapiens
gguacaucauuuaucuuga

SEQ ID NO: 1318755 - RNA, 19 nt, Homo sapiens
uaaaggaccauaagguaca

SEQ ID NO: 1318756 - RNA, 19 nt, Homo sapiens
aaucacucauccaaacuuu

SEQ ID NO: 1318757 - RNA, 19 nt, Homo sapiens
uacaugacauugaaucaca

SEQ ID NO: 1318758 - RNA, 19 nt, Homo sapiens
cacccuaaauguacucaga

SEQ ID NO: 1318759 - RNA, 19 nt, Homo sapiens
caucaguuaucuugaacau

SEQ ID NO: 1318760 - RNA, 19 nt, Homo sapiens
ucaaggcgauaagcuucua

SEQ ID NO: 1318761 - RNA, 19 nt, Homo sapiens
caagaugauaguucuguug

SEQ ID NO: 1318762 - RNA, 19 nt, Homo sapiens
ugggaucguuaucuucuuu

SEQ ID NO: 1318763 - RNA, 19 nt, Homo sapiens
gaaaauacgaaacacagaa

SEQ ID NO: 1318764 - RNA, 19 nt, Homo sapiens
guguauugcucauuuacug

SEQ ID NO: 1318765 - RNA, 19 nt, Homo sapiens
caucuaacacaaacucuau

SEQ ID NO: 1318766 - RNA, 19 nt, Homo sapiens
gacuggacaccacagcuua

SEQ ID NO: 1318767 - RNA, 19 nt, Homo sapiens
ggcugugaauuccauacua

SEQ ID NO: 1318768 - RNA, 19 nt, Homo sapiens
gcuccgcacuccacacuuu

SEQ ID NO: 1318769 - RNA, 19 nt, Homo sapiens
ucagacagcuucacagagu

SEQ ID NO: 1318770 - RNA, 19 nt, Homo sapiens
gggagaagguguacuggau

SEQ ID NO: 1318771 - RNA, 19 nt, Homo sapiens
cugcagagccuccuccuua

SEQ ID NO: 1318772 - RNA, 19 nt, Homo sapiens
gagaagguguacuggaugu

SEQ ID NO: 1318773 - RNA, 19 nt, Homo sapiens
ggacaucaaagacgucaga

SEQ ID NO: 1318774 - RNA, 19 nt, Homo sapiens
ccugaaagccagcagauuu

SEQ ID NO: 1318775 - RNA, 19 nt, Homo sapiens
gcacuccacacuuuccuuu

SEQ ID NO: 1318776 - RNA, 19 nt, Homo sapiens
caagguggcuucacaucca

SEQ ID NO: 1318777 - RNA, 19 nt, Homo sapiens
guucagcugugcuucaaga

SEQ ID NO: 1318778 - RNA, 19 nt, Homo sapiens
caagacguguucuccugaa

SEQ ID NO: 1318779 - RNA, 19 nt, Homo sapiens
gcacgaguccuuccucuac

SEQ ID NO: 1318780 - RNA, 19 nt, Homo sapiens
cugaaagccagcagauuua

SEQ ID NO: 1318781 - RNA, 19 nt, Homo sapiens
cagaaaagauucaaguuca

SEQ ID NO: 1318782 - RNA, 19 nt, Homo sapiens
gaaagccagcagauuuaug

SEQ ID NO: 1318783 - RNA, 19 nt, Homo sapiens
agugaaugcugcugucuug

SEQ ID NO: 1318784 - RNA, 19 nt, Homo sapiens
gcagcuuccugguguacga

SEQ ID NO: 1318785 - RNA, 19 nt, Homo sapiens
gcagcuuccugguguacga

SEQ ID NO: 1318786 - RNA, 19 nt, Homo sapiens
guacgaguccuuccucuac

SEQ ID NO: 1318787 - RNA, 19 nt, Homo sapiens
guacgaguccuuccucuac

SEQ ID NO: 1318788 - RNA, 19 nt, Homo sapiens
ccaccuagguuuggcuuag

SEQ ID NO: 1318789 - RNA, 19 nt, Homo sapiens
ccagaaagcgagcaaaggu

SEQ ID NO: 1318790 - RNA, 19 nt, Homo sapiens
cagagccuccuccuuacua

SEQ ID NO: 1318791 - RNA, 19 nt, Homo sapiens
ggucaacccacaccaaucu

SEQ ID NO: 1318792 - RNA, 19 nt, Homo sapiens
ccacggaacccaccaugca

SEQ ID NO: 1318793 - RNA, 19 nt, Homo sapiens
ggauggcgagucccaguga

SEQ ID NO: 1318794 - RNA, 19 nt, Homo sapiens
cuccaucccucuugaagga

SEQ ID NO: 1318795 - RNA, 19 nt, Homo sapiens
uggaagacaugacaaagcu

SEQ ID NO: 1318796 - RNA, 19 nt, Homo sapiens
gcgcuggccucucuuucca

SEQ ID NO: 1318797 - RNA, 19 nt, Homo sapiens
ucacucccacccuguaauu

SEQ ID NO: 1318798 - RNA, 19 nt, Homo sapiens
uccgaggcguggauaguuu

SEQ ID NO: 1318799 - RNA, 19 nt, Homo sapiens
gcacugcaaggcugugaca

SEQ ID NO: 1318800 - RNA, 19 nt, Homo sapiens
gcccugaguuccugaagac

SEQ ID NO: 1318801 - RNA, 19 nt, Homo sapiens
caaguucagcugugcuuca

SEQ ID NO: 1318802 - RNA, 19 nt, Homo sapiens
agagccuccuccuuacuaa

SEQ ID NO: 1318803 - RNA, 19 nt, Homo sapiens
cuccuuccaaguuaaauua

SEQ ID NO: 1318804 - RNA, 19 nt, Homo sapiens
ggcccugaguuccugaaga

SEQ ID NO: 1318805 - RNA, 19 nt, Homo sapiens
gcggagaacagugcucaga

SEQ ID NO: 1318806 - RNA, 19 nt, Homo sapiens
guccggagaggcaagauga

SEQ ID NO: 1318807 - RNA, 19 nt, Homo sapiens
caaagacgucagacuggau

SEQ ID NO: 1318808 - RNA, 19 nt, Homo sapiens
aaagccagcagauuuaugg

SEQ ID NO: 1318809 - RNA, 19 nt, Homo sapiens
ugaaugcugcugucuugga

SEQ ID NO: 1318810 - RNA, 19 nt, Homo sapiens
caaagcaucgauggucuuc

SEQ ID NO: 1318811 - RNA, 19 nt, Homo sapiens
ugaaagccagcagauuuau

SEQ ID NO: 1318812 - RNA, 19 nt, Homo sapiens
gcgccuuccugaccuuugg

SEQ ID NO: 1318813 - RNA, 19 nt, Homo sapiens
agguuuggcuuagcagaaa

SEQ ID NO: 1318814 - RNA, 19 nt, Homo sapiens
cgauauggagggccuggaa

SEQ ID NO: 1318815 - RNA, 19 nt, Homo sapiens
gcuccuuccaaguuaaauu

SEQ ID NO: 1318816 - RNA, 19 nt, Homo sapiens
cugugcuccuuccaaguua

SEQ ID NO: 1318817 - RNA, 19 nt, Homo sapiens
ccaaagcaucgauggucuu

SEQ ID NO: 1318818 - RNA, 19 nt, Homo sapiens
gacguguucuccugaaagc

SEQ ID NO: 1318819 - RNA, 19 nt, Homo sapiens
ggaggacccagaaaagauu

SEQ ID NO: 1318820 - RNA, 19 nt, Homo sapiens
ucugugcuccuuccaaguu

SEQ ID NO: 1318821 - RNA, 19 nt, Homo sapiens
aagacguguucuccugaaa

SEQ ID NO: 1318822 - RNA, 19 nt, Homo sapiens
gcacagacauuuaucauuc

SEQ ID NO: 1318823 - RNA, 19 nt, Homo sapiens
gaaguugucucuuggguaa

SEQ ID NO: 1318824 - RNA, 19 nt, Homo sapiens
cauauaagcuaucugguaa

SEQ ID NO: 1318825 - RNA, 19 nt, Homo sapiens
ggaaaguagucacaguaua

SEQ ID NO: 1318826 - RNA, 19 nt, Homo sapiens
gagaaacgccaggaaauua

SEQ ID NO: 1318827 - RNA, 19 nt, Homo sapiens
gugcuaaaguguauuauga

SEQ ID NO: 1318828 - RNA, 19 nt, Homo sapiens
cuagauagauuaaggagaa

SEQ ID NO: 1318829 - RNA, 19 nt, Homo sapiens
acacaaaugucacaagcua

SEQ ID NO: 1318830 - RNA, 19 nt, Homo sapiens
guacuuauguuuacaaugc

SEQ ID NO: 1318831 - RNA, 19 nt, Homo sapiens
gauuuaaguuucugcauug

SEQ ID NO: 1318832 - RNA, 19 nt, Homo sapiens
gaaaguagucacaguauag

SEQ ID NO: 1318833 - RNA, 19 nt, Homo sapiens
ccacaaaguacuuauguuu

SEQ ID NO: 1318834 - RNA, 19 nt, Homo sapiens
ggaguuuacuaguucaauu

SEQ ID NO: 1318835 - RNA, 19 nt, Homo sapiens
gaaauuugcuuuuggagaa

SEQ ID NO: 1318836 - RNA, 19 nt, Homo sapiens
uaggauagcuaaggaaauu

SEQ ID NO: 1318837 - RNA, 19 nt, Homo sapiens
caucauggguacauaaaug

SEQ ID NO: 1318838 - RNA, 19 nt, Homo sapiens
aaagugaaaugcugaguau

SEQ ID NO: 1318839 - RNA, 19 nt, Homo sapiens
caaagacagucccagcaaa

SEQ ID NO: 1318840 - RNA, 19 nt, Homo sapiens
gauaauauguagucuucug

SEQ ID NO: 1318841 - RNA, 19 nt, Homo sapiens
aaacuugccugcuucauca

SEQ ID NO: 1318842 - RNA, 19 nt, Homo sapiens
aaagggaaguugucucuug

SEQ ID NO: 1318843 - RNA, 19 nt, Homo sapiens
gcugugcagugauuuguuu

SEQ ID NO: 1318844 - RNA, 19 nt, Homo sapiens
guuaagggcugugcaguga

SEQ ID NO: 1318845 - RNA, 19 nt, Homo sapiens
ccucauagcacauuguuaa

SEQ ID NO: 1318846 - RNA, 19 nt, Homo sapiens
cagcaaaguugacauacau

SEQ ID NO: 1318847 - RNA, 19 nt, Homo sapiens
acaggauucuauacacuua

SEQ ID NO: 1318848 - RNA, 19 nt, Homo sapiens
gccauuaucuugugguugu

SEQ ID NO: 1318849 - RNA, 19 nt, Homo sapiens
gcauuucuuucuauuccua

SEQ ID NO: 1318850 - RNA, 19 nt, Homo sapiens
cauaguugguugaugcuuu

SEQ ID NO: 1318851 - RNA, 19 nt, Homo sapiens
gaauugagcagcauuguac

SEQ ID NO: 1318852 - RNA, 19 nt, Homo sapiens
uaagggcugugcagugauu

SEQ ID NO: 1318853 - RNA, 19 nt, Homo sapiens
ugacaauacuucaccuuuc

SEQ ID NO: 1318854 - RNA, 19 nt, Homo sapiens
uaacaugacugaacuuuuc

SEQ ID NO: 1318855 - RNA, 19 nt, Homo sapiens
ucauugcuauagaccauua

SEQ ID NO: 1318856 - RNA, 19 nt, Homo sapiens
ucauuacacucaacacuau

SEQ ID NO: 1318857 - RNA, 19 nt, Homo sapiens
gaaacgccaggaaauuaaa

SEQ ID NO: 1318858 - RNA, 19 nt, Homo sapiens
ccauauaagcuaucuggua

SEQ ID NO: 1318859 - RNA, 19 nt, Homo sapiens
gauagcuucuacugacaaa

SEQ ID NO: 1318860 - RNA, 19 nt, Homo sapiens
gacaauacuucaccuuucu

SEQ ID NO: 1318861 - RNA, 19 nt, Homo sapiens
ugacauccauauaagcuau

SEQ ID NO: 1318862 - RNA, 19 nt, Homo sapiens
gcaaagacagucccagcaa

SEQ ID NO: 1318863 - RNA, 19 nt, Homo sapiens
aaauggaguuuacuaguuc

SEQ ID NO: 1318864 - RNA, 19 nt, Homo sapiens
uaaagugguugacuagucu

SEQ ID NO: 1318865 - RNA, 19 nt, Homo sapiens
uaaauggugcuaaagugua

SEQ ID NO: 1318866 - RNA, 19 nt, Homo sapiens
gagagaaacgccaggaaau

SEQ ID NO: 1318867 - RNA, 19 nt, Homo sapiens
gaaacuugccugcuucauc

SEQ ID NO: 1318868 - RNA, 19 nt, Homo sapiens
uuuagagacucgaccauaa

SEQ ID NO: 1318869 - RNA, 19 nt, Homo sapiens
cuauuucucuguaagugua

SEQ ID NO: 1318870 - RNA, 19 nt, Homo sapiens
gauaggauagcuaaggaaa

SEQ ID NO: 1318871 - RNA, 19 nt, Homo sapiens
ucaccaagcuacuaucucu

SEQ ID NO: 1318872 - RNA, 19 nt, Homo sapiens
aaacuuccaugcaaagaca

SEQ ID NO: 1318873 - RNA, 19 nt, Homo sapiens
gcuauuaaucucauugcua

SEQ ID NO: 1318874 - RNA, 19 nt, Homo sapiens
gcaaagggaaguugucucu

SEQ ID NO: 1318875 - RNA, 19 nt, Homo sapiens
gcagauuuaugacauccau

SEQ ID NO: 1318876 - RNA, 19 nt, Homo sapiens
aauaaauggugcuaaagug

SEQ ID NO: 1318877 - RNA, 19 nt, Homo sapiens
cccaugauguuuucaauua

SEQ ID NO: 1318878 - RNA, 19 nt, Homo sapiens
ggguaaacaauacacauuu

SEQ ID NO: 1318879 - RNA, 19 nt, Homo sapiens
ggguaugugugccugguuu

SEQ ID NO: 1318880 - RNA, 19 nt, Homo sapiens
agaaagagagauagaauca

SEQ ID NO: 1318881 - RNA, 19 nt, Homo sapiens
gguauugccuguugauagg

SEQ ID NO: 1318882 - RNA, 19 nt, Homo sapiens
gcagugauuuguuuuguau

SEQ ID NO: 1318883 - RNA, 19 nt, Homo sapiens
uuaaguuucugcauuguuc

SEQ ID NO: 1318884 - RNA, 19 nt, Homo sapiens
ucuaaaaccuucauccuuu

SEQ ID NO: 1318885 - RNA, 19 nt, Homo sapiens
cuauagaccauuaacauga

SEQ ID NO: 1318886 - RNA, 19 nt, Homo sapiens
gugcaaauauaaggcuaaa

SEQ ID NO: 1318887 - RNA, 19 nt, Homo sapiens
uguaucagcauuucuauug

SEQ ID NO: 1318888 - RNA, 19 nt, Homo sapiens
caguauaguguucuguuua

SEQ ID NO: 1318889 - RNA, 19 nt, Homo sapiens
acaaacaauuuccaagcaa

SEQ ID NO: 1318890 - RNA, 19 nt, Homo sapiens
ggauagcuaaggaaauuug

SEQ ID NO: 1318891 - RNA, 19 nt, Homo sapiens
aaauggugcuaaaguguau

SEQ ID NO: 1318892 - RNA, 19 nt, Homo sapiens
agaaacgccaggaaauuaa

SEQ ID NO: 1318893 - RNA, 19 nt, Homo sapiens
ugcagucucugucuauauu

SEQ ID NO: 1318894 - RNA, 19 nt, Homo sapiens
caggaaaguagucacagua

SEQ ID NO: 1318895 - RNA, 19 nt, Homo sapiens
ccagcaaaguugacauaca

SEQ ID NO: 1318896 - RNA, 19 nt, Homo sapiens
ccauggcaaucaaagaguu

SEQ ID NO: 1318897 - RNA, 19 nt, Homo sapiens
gcuauagaccauuaacaug

SEQ ID NO: 1318898 - RNA, 19 nt, Homo sapiens
gugguugacuagucuaugu

SEQ ID NO: 1318899 - RNA, 19 nt, Homo sapiens
guaaaucaaggccucauag

SEQ ID NO: 1318900 - RNA, 19 nt, Homo sapiens
gcuaaaguguauuaugacu

SEQ ID NO: 1318901 - RNA, 19 nt, Homo sapiens
ugacugaacuuuuccacaa

SEQ ID NO: 1318902 - RNA, 19 nt, Homo sapiens
cccaggaaaugucuuuguu

SEQ ID NO: 1318903 - RNA, 19 nt, Homo sapiens
acaaugcuauaacccuuug

SEQ ID NO: 1318904 - RNA, 19 nt, Homo sapiens
ccacacaggauucuauaca

SEQ ID NO: 1318905 - RNA, 19 nt, Homo sapiens
gcauuguucucauuacacu

SEQ ID NO: 1318906 - RNA, 19 nt, Homo sapiens
gaaagagagauagaaucaa

SEQ ID NO: 1318907 - RNA, 19 nt, Homo sapiens
gugaaaugcugaguaugau

SEQ ID NO: 1318908 - RNA, 19 nt, Homo sapiens
gucacaagcuagaaucauc

SEQ ID NO: 1318909 - RNA, 19 nt, Homo sapiens
ccaaacaaacaauuuccaa

SEQ ID NO: 1318910 - RNA, 19 nt, Homo sapiens
ugauggguauugccuguug

SEQ ID NO: 1318911 - RNA, 19 nt, Homo sapiens
gacagucccagcaaaguug

SEQ ID NO: 1318912 - RNA, 19 nt, Homo sapiens
gagaugguacccaggaaau

SEQ ID NO: 1318913 - RNA, 19 nt, Homo sapiens
acuauugcaucuucuguau

SEQ ID NO: 1318914 - RNA, 19 nt, Homo sapiens
caauacuucaccuuucuuu

SEQ ID NO: 1318915 - RNA, 19 nt, Homo sapiens
gagauucaaguaauugcaa

SEQ ID NO: 1318916 - RNA, 19 nt, Homo sapiens
uugagaaacuugccugcuu

SEQ ID NO: 1318917 - RNA, 19 nt, Homo sapiens
uuauugaccuugagaaacu

SEQ ID NO: 1318918 - RNA, 19 nt, Homo sapiens
guacccaggaaaugucuuu

SEQ ID NO: 1318919 - RNA, 19 nt, Homo sapiens
auaaagugguugacuaguc

SEQ ID NO: 1318920 - RNA, 19 nt, Homo sapiens
gcaaguuguagugauguuu

SEQ ID NO: 1318921 - RNA, 19 nt, Homo sapiens
gugcaaggaaagaaauaaa

SEQ ID NO: 1318922 - RNA, 19 nt, Homo sapiens
gcaaaggacuaucagagaa

SEQ ID NO: 1318923 - RNA, 19 nt, Homo sapiens
ggaccucacuggcuucuca

SEQ ID NO: 1318924 - RNA, 19 nt, Homo sapiens
caaagccucuaaccucaaa

SEQ ID NO: 1318925 - RNA, 19 nt, Homo sapiens
ucaaugagacguuucaauu

SEQ ID NO: 1318926 - RNA, 19 nt, Homo sapiens
gcuaucaacgccagaauaa

SEQ ID NO: 1318927 - RNA, 19 nt, Homo sapiens
gagcucaacuucucacucu

SEQ ID NO: 1318928 - RNA, 19 nt, Homo sapiens
ggaguucaaugaccgaauc

SEQ ID NO: 1318929 - RNA, 19 nt, Homo sapiens
aaaccuccaucaagaagaa

SEQ ID NO: 1318930 - RNA, 19 nt, Homo sapiens
gugaaggccucccugauca

SEQ ID NO: 1318931 - RNA, 19 nt, Homo sapiens
ccuaauuucugcccucuug

SEQ ID NO: 1318932 - RNA, 19 nt, Homo sapiens
ggauggauguuuguugaau

SEQ ID NO: 1318933 - RNA, 19 nt, Homo sapiens
ccaauccucucuguccuuu

SEQ ID NO: 1318934 - RNA, 19 nt, Homo sapiens
caaaggacuaucagagaaa

SEQ ID NO: 1318935 - RNA, 19 nt, Homo sapiens
agaccaaggugcacaggaa

SEQ ID NO: 1318936 - RNA, 19 nt, Homo sapiens
gauguuuguugaaugaaug

SEQ ID NO: 1318937 - RNA, 19 nt, Homo sapiens
guccaucccuuuauuugug

SEQ ID NO: 1318938 - RNA, 19 nt, Homo sapiens
gugcagcccuaaucuuugu

SEQ ID NO: 1318939 - RNA, 19 nt, Homo sapiens
gauggauguuuguugaaug

SEQ ID NO: 1318940 - RNA, 19 nt, Homo sapiens
ggauguuuguugaaugaau

SEQ ID NO: 1318941 - RNA, 19 nt, Homo sapiens
aaacucauugggcagauua

SEQ ID NO: 1318942 - RNA, 19 nt, Homo sapiens
ucacugcccuucuccaucu

SEQ ID NO: 1318943 - RNA, 19 nt, Homo sapiens
gcaaccagcacagcacgua

SEQ ID NO: 1318944 - RNA, 19 nt, Homo sapiens
uaacuccuguuccuucauc

SEQ ID NO: 1318945 - RNA, 19 nt, Homo sapiens
caaugagacguuucaauuc

SEQ ID NO: 1318946 - RNA, 19 nt, Homo sapiens
cuaucuccaucccuaauuu

SEQ ID NO: 1318947 - RNA, 19 nt, Homo sapiens
ggugcuggauggauguuug

SEQ ID NO: 1318948 - RNA, 19 nt, Homo sapiens
gaaugucaaugggccaauc

SEQ ID NO: 1318949 - RNA, 19 nt, Homo sapiens
caaacucauugggcagauu

SEQ ID NO: 1318950 - RNA, 19 nt, Homo sapiens
ggucaaaccgagccaaaca

SEQ ID NO: 1318951 - RNA, 19 nt, Homo sapiens
cuggauggauguuuguuga

SEQ ID NO: 1318952 - RNA, 19 nt, Homo sapiens
aaugagacguuucaauucu

SEQ ID NO: 1318953 - RNA, 19 nt, Homo sapiens
gcaucgccgugguggacua

SEQ ID NO: 1318954 - RNA, 19 nt, Homo sapiens
cggaaaaccuccaucaaga

SEQ ID NO: 1318955 - RNA, 19 nt, Homo sapiens
ucaagaagaacacgcugaa

SEQ ID NO: 1318956 - RNA, 19 nt, Homo sapiens
caacgcaaacugcacuuca

SEQ ID NO: 1318957 - RNA, 19 nt, Homo sapiens
aauccucucuguccuuuca

SEQ ID NO: 1318958 - RNA, 19 nt, Homo sapiens
gcagagaugcuggccaauc

SEQ ID NO: 1318959 - RNA, 19 nt, Homo sapiens
ggacuccaacggcuucuca

SEQ ID NO: 1318960 - RNA, 19 nt, Homo sapiens
ccuaaucucuguccccuuu

SEQ ID NO: 1318961 - RNA, 19 nt, Homo sapiens
uaucaacgccagaauaaac

SEQ ID NO: 1318962 - RNA, 19 nt, Homo sapiens
agauuaagccagagcugua

SEQ ID NO: 1318963 - RNA, 19 nt, Homo sapiens
cggcccagcuccuucuuuc

SEQ ID NO: 1318964 - RNA, 19 nt, Homo sapiens
ugucuccucucguuggauu

SEQ ID NO: 1318965 - RNA, 19 nt, Homo sapiens
cuucagcgucuaugacuuu

SEQ ID NO: 1318966 - RNA, 19 nt, Homo sapiens
gcacucccauucuguuucc

SEQ ID NO: 1318967 - RNA, 19 nt, Homo sapiens
gaaucuccaucccuaaucc

SEQ ID NO: 1318968 - RNA, 19 nt, Homo sapiens
ggaaaaccuccaucaagaa

SEQ ID NO: 1318969 - RNA, 19 nt, Homo sapiens
cgagcuggcccaacgcaaa

SEQ ID NO: 1318970 - RNA, 19 nt, Homo sapiens
gcagcccuaaucuuuguuu

SEQ ID NO: 1318971 - RNA, 19 nt, Homo sapiens
ggaacuccaggaccuuguu

SEQ ID NO: 1318972 - RNA, 19 nt, Homo sapiens
cuuguucucugcuggauuc

SEQ ID NO: 1318973 - RNA, 19 nt, Homo sapiens
gaccagacggccaccaugu

SEQ ID NO: 1318974 - RNA, 19 nt, Homo sapiens
cagagaugcuggccaaucc

SEQ ID NO: 1318975 - RNA, 19 nt, Homo sapiens
augaaugaaugaugaaugg

SEQ ID NO: 1318976 - RNA, 19 nt, Homo sapiens
acuuggacauggacucgua

SEQ ID NO: 1318977 - RNA, 19 nt, Homo sapiens
auggauguuuguugaauga

SEQ ID NO: 1318978 - RNA, 19 nt, Homo sapiens
uuucugcccucuugucugu

SEQ ID NO: 1318979 - RNA, 19 nt, Homo sapiens
ccuguucucuguccucuac

SEQ ID NO: 1318980 - RNA, 19 nt, Homo sapiens
ccacugcugcugcuaucaa

SEQ ID NO: 1318981 - RNA, 19 nt, Homo sapiens
ccuaacuccuguuccuuca

SEQ ID NO: 1318982 - RNA, 19 nt, Homo sapiens
gcagcaaaggacuaucaga

SEQ ID NO: 1318983 - RNA, 19 nt, Homo sapiens
ggugccaggaguucaauga

SEQ ID NO: 1318984 - RNA, 19 nt, Homo sapiens
ccagacggccaccauguca

SEQ ID NO: 1318985 - RNA, 19 nt, Homo sapiens
ucaucuccuugaagccaua

SEQ ID NO: 1318986 - RNA, 19 nt, Homo sapiens
ggacuaucagagaaagaga

SEQ ID NO: 1318987 - RNA, 19 nt, Homo sapiens
gcccugcgguaccucuaug

SEQ ID NO: 1318988 - RNA, 19 nt, Homo sapiens
uaauaccugucaccuuguc

SEQ ID NO: 1318989 - RNA, 19 nt, Homo sapiens
gucugucucugucucuuug

SEQ ID NO: 1318990 - RNA, 19 nt, Homo sapiens
ccuggaagcgagaggauga

SEQ ID NO: 1318991 - RNA, 19 nt, Homo sapiens
aaaggacuaucagagaaag

SEQ ID NO: 1318992 - RNA, 19 nt, Homo sapiens
auaaugaggcgcugguguu

SEQ ID NO: 1318993 - RNA, 19 nt, Homo sapiens
caccgugaccaucaucaaa

SEQ ID NO: 1318994 - RNA, 19 nt, Homo sapiens
gcacuucagcgucuaugac

SEQ ID NO: 1318995 - RNA, 19 nt, Homo sapiens
cuugucugcucaucccuaa

SEQ ID NO: 1318996 - RNA, 19 nt, Homo sapiens
ggagcacuggcaucagcua

SEQ ID NO: 1318997 - RNA, 19 nt, Homo sapiens
ccagugcccagucacauca

SEQ ID NO: 1318998 - RNA, 19 nt, Homo sapiens
gugacauucuguggcauug

SEQ ID NO: 1318999 - RNA, 19 nt, Homo sapiens
gagaugcugacaccaacga

SEQ ID NO: 1319000 - RNA, 19 nt, Homo sapiens
uugugcauccucauucuua

SEQ ID NO: 1319001 - RNA, 19 nt, Homo sapiens
cauucagccuccacugugu

SEQ ID NO: 1319002 - RNA, 19 nt, Homo sapiens
cugugcagcccuaaucuuu

SEQ ID NO: 1319003 - RNA, 19 nt, Homo sapiens
cgugaaggccucccugauc

SEQ ID NO: 1319004 - RNA, 19 nt, Homo sapiens
gugucucuuuccacccuua

SEQ ID NO: 1319005 - RNA, 19 nt, Homo sapiens
ucaucuguccaucccuuua

SEQ ID NO: 1319006 - RNA, 19 nt, Homo sapiens
gaaaaccuccaucaagaag

SEQ ID NO: 1319007 - RNA, 19 nt, Homo sapiens
cagcgucuaugacuuugac

SEQ ID NO: 1319008 - RNA, 19 nt, Homo sapiens
caucuguccaucccuuuau

SEQ ID NO: 1319009 - RNA, 19 nt, Homo sapiens
ucaaaccgagccaaacauc

SEQ ID NO: 1319010 - RNA, 19 nt, Homo sapiens
cgacaggugccaggaguuc

SEQ ID NO: 1319011 - RNA, 19 nt, Homo sapiens
caucugugcagcccuaauc

SEQ ID NO: 1319012 - RNA, 19 nt, Homo sapiens
ugucuacuccuaauuccuu

SEQ ID NO: 1319013 - RNA, 19 nt, Homo sapiens
guucauuugucccuguucu

SEQ ID NO: 1319014 - RNA, 19 nt, Homo sapiens
gcuggauggauguuuguug

SEQ ID NO: 1319015 - RNA, 19 nt, Homo sapiens
uaucagagaaagagaacuc

SEQ ID NO: 1319016 - RNA, 19 nt, Homo sapiens
gacuaucagagaaagagaa

SEQ ID NO: 1319017 - RNA, 19 nt, Homo sapiens
guugaaugaaugaaugaug

SEQ ID NO: 1319018 - RNA, 19 nt, Homo sapiens
ccuccuacuuggacaugga

SEQ ID NO: 1319019 - RNA, 19 nt, Homo sapiens
gcccuaaucuuuguuuccu

SEQ ID NO: 1319020 - RNA, 19 nt, Homo sapiens
ucuugucugucuacuccua

SEQ ID NO: 1319021 - RNA, 19 nt, Homo sapiens
ugaaagacuucucauagua

SEQ ID NO: 1319022 - RNA, 19 nt, Homo sapiens
gcucacaguugaaugauau

SEQ ID NO: 1319023 - RNA, 19 nt, Homo sapiens
caaucaaaguaucguguua

SEQ ID NO: 1319024 - RNA, 19 nt, Homo sapiens
caaaguaucguguuaugaa

SEQ ID NO: 1319025 - RNA, 19 nt, Homo sapiens
agagaagccuugauauuga

SEQ ID NO: 1319026 - RNA, 19 nt, Homo sapiens
caagaacuaugugaagaaa

SEQ ID NO: 1319027 - RNA, 19 nt, Homo sapiens
ggaagaugccggugaagaa

SEQ ID NO: 1319028 - RNA, 19 nt, Homo sapiens
aaagaucaaugguacaaug

SEQ ID NO: 1319029 - RNA, 19 nt, Homo sapiens
uauguuagcucuucugcuu

SEQ ID NO: 1319030 - RNA, 19 nt, Homo sapiens
cagagaagccuugauauug

SEQ ID NO: 1319031 - RNA, 19 nt, Homo sapiens
uauacaagcuaaugugaug

SEQ ID NO: 1319032 - RNA, 19 nt, Homo sapiens
cuacagauaugccuuugau

SEQ ID NO: 1319033 - RNA, 19 nt, Homo sapiens
ccacguguauacaagcuaa

SEQ ID NO: 1319034 - RNA, 19 nt, Homo sapiens
gcaagaacuaugugaagaa

SEQ ID NO: 1319035 - RNA, 19 nt, Homo sapiens
acagauaugccuuugauuu

SEQ ID NO: 1319036 - RNA, 19 nt, Homo sapiens
gagaagccuugauauugau

SEQ ID NO: 1319037 - RNA, 19 nt, Homo sapiens
ggaagacggaggccucaaa

SEQ ID NO: 1319038 - RNA, 19 nt, Homo sapiens
guauuagaauucagcagaa

SEQ ID NO: 1319039 - RNA, 19 nt, Homo sapiens
gggaggacauggccacugu

SEQ ID NO: 1319040 - RNA, 19 nt, Homo sapiens
ucagagaagccuugauauu

SEQ ID NO: 1319041 - RNA, 19 nt, Homo sapiens
agaagugccuggcuugguu

SEQ ID NO: 1319042 - RNA, 19 nt, Homo sapiens
ggccuguucuucuugauga

SEQ ID NO: 1319043 - RNA, 19 nt, Homo sapiens
gugaagacauugguguuga

SEQ ID NO: 1319044 - RNA, 19 nt, Homo sapiens
acuaauaaguggagaggaa

SEQ ID NO: 1319045 - RNA, 19 nt, Homo sapiens
cuucuuagacugaauauug

SEQ ID NO: 1319046 - RNA, 19 nt, Homo sapiens
gaaagacuucucauaguac

SEQ ID NO: 1319047 - RNA, 19 nt, Homo sapiens
gcacagaaaaguuacaaaa

SEQ ID NO: 1319048 - RNA, 19 nt, Homo sapiens
ccacaccucuucuuagacu

SEQ ID NO: 1319049 - RNA, 19 nt, Homo sapiens
uaacuaugaugaagauggu

SEQ ID NO: 1319050 - RNA, 19 nt, Homo sapiens
gaacaguccaugcugaucu

SEQ ID NO: 1319051 - RNA, 19 nt, Homo sapiens
ugaagacauugguguugaa

SEQ ID NO: 1319052 - RNA, 19 nt, Homo sapiens
gaggacauggccacuguuu

SEQ ID NO: 1319053 - RNA, 19 nt, Homo sapiens
ugacuucauuacaguguga

SEQ ID NO: 1319054 - RNA, 19 nt, Homo sapiens
gaaauuggaggcugaaagc

SEQ ID NO: 1319055 - RNA, 19 nt, Homo sapiens
gcaaucaaaguaucguguu

SEQ ID NO: 1319056 - RNA, 19 nt, Homo sapiens
ugaacaaagaucaauggua

SEQ ID NO: 1319057 - RNA, 19 nt, Homo sapiens
gagaaagacgacgaggaua

SEQ ID NO: 1319058 - RNA, 19 nt, Homo sapiens
gacaucauagcaagaacua

SEQ ID NO: 1319059 - RNA, 19 nt, Homo sapiens
uaaguggagaggaacauuu

SEQ ID NO: 1319060 - RNA, 19 nt, Homo sapiens
gaagaaaaugcaaaccuuu

SEQ ID NO: 1319061 - RNA, 19 nt, Homo sapiens
cagcagcaguagcggaaga

SEQ ID NO: 1319062 - RNA, 19 nt, Homo sapiens
ggcggaagaugccggugaa

SEQ ID NO: 1319063 - RNA, 19 nt, Homo sapiens
gaagugccuggcuugguuu

SEQ ID NO: 1319064 - RNA, 19 nt, Homo sapiens
gauggugcuuggccuguuc

SEQ ID NO: 1319065 - RNA, 19 nt, Homo sapiens
ggaaauuggaggcugaaag

SEQ ID NO: 1319066 - RNA, 19 nt, Homo sapiens
uguaaaaucuccagcuauu

SEQ ID NO: 1319067 - RNA, 19 nt, Homo sapiens
gcauugagccacaccucuu

SEQ ID NO: 1319068 - RNA, 19 nt, Homo sapiens
ugagccacaccucuucuua

SEQ ID NO: 1319069 - RNA, 19 nt, Homo sapiens
ggacauggccacuguuuuc

SEQ ID NO: 1319070 - RNA, 19 nt, Homo sapiens
gaagaugccggugaagaag

SEQ ID NO: 1319071 - RNA, 19 nt, Homo sapiens
caaggaagaaugguuaaag

SEQ ID NO: 1319072 - RNA, 19 nt, Homo sapiens
agccacaccucuucuuaga

SEQ ID NO: 1319073 - RNA, 19 nt, Homo sapiens
agacuucucauaguacuuu

SEQ ID NO: 1319074 - RNA, 19 nt, Homo sapiens
agagaaagacgacgaggau

SEQ ID NO: 1319075 - RNA, 19 nt, Homo sapiens
aaugcaaaccuuucaauuc

SEQ ID NO: 1319076 - RNA, 19 nt, Homo sapiens
ugacugcacagaaaaguua

SEQ ID NO: 1319077 - RNA, 19 nt, Homo sapiens
agaugccggugaagaagaa

SEQ ID NO: 1319078 - RNA, 19 nt, Homo sapiens
ucaauucccacguguauac

SEQ ID NO: 1319079 - RNA, 19 nt, Homo sapiens
ugaagaaaaugcaaaccuu

SEQ ID NO: 1319080 - RNA, 19 nt, Homo sapiens
ucagacaucauagcaagaa

SEQ ID NO: 1319081 - RNA, 19 nt, Homo sapiens
gaaguuguagggccagaag

SEQ ID NO: 1319082 - RNA, 19 nt, Homo sapiens
gagccacaccucuucuuag

SEQ ID NO: 1319083 - RNA, 19 nt, Homo sapiens
aagaaugguuaaagggaau

SEQ ID NO: 1319084 - RNA, 19 nt, Homo sapiens
acaaagaucaaugguacaa

SEQ ID NO: 1319085 - RNA, 19 nt, Homo sapiens
ugauacugcuaaaucuaug

SEQ ID NO: 1319086 - RNA, 19 nt, Homo sapiens
aaggaagaaugguuaaagg

SEQ ID NO: 1319087 - RNA, 19 nt, Homo sapiens
aaaucuauguuagcucuuc

SEQ ID NO: 1319088 - RNA, 19 nt, Homo sapiens
gggauaaagaucagagaag

SEQ ID NO: 1319089 - RNA, 19 nt, Homo sapiens
gguuaaagggaaugacuuc

SEQ ID NO: 1319090 - RNA, 19 nt, Homo sapiens
agcaagaacuaugugaaga

SEQ ID NO: 1319091 - RNA, 19 nt, Homo sapiens
uggcuugguuuuaugaaua

SEQ ID NO: 1319092 - RNA, 19 nt, Homo sapiens
ucaaaguaucguguuauga

SEQ ID NO: 1319093 - RNA, 19 nt, Homo sapiens
cagauaugccuuugauuuu

SEQ ID NO: 1319094 - RNA, 19 nt, Homo sapiens
ccaaggaagaaugguuaaa

SEQ ID NO: 1319095 - RNA, 19 nt, Homo sapiens
gcugaaagcaugggauuuu

SEQ ID NO: 1319096 - RNA, 19 nt, Homo sapiens
gaagacggaggccucaaaa

SEQ ID NO: 1319097 - RNA, 19 nt, Homo sapiens
acaguugaaugauauuucg

SEQ ID NO: 1319098 - RNA, 19 nt, Homo sapiens
agacauugguguugaaccu

SEQ ID NO: 1319099 - RNA, 19 nt, Homo sapiens
ccucuucuuagacugaaua

SEQ ID NO: 1319100 - RNA, 19 nt, Homo sapiens
uagcaagaacuaugugaag

SEQ ID NO: 1319101 - RNA, 19 nt, Homo sapiens
ccugcuagacuaauaagug

SEQ ID NO: 1319102 - RNA, 19 nt, Homo sapiens
aaagacuucucauaguacu

SEQ ID NO: 1319103 - RNA, 19 nt, Homo sapiens
guauacaagcuaaugugau

SEQ ID NO: 1319104 - RNA, 19 nt, Homo sapiens
augcaaaccuuucaauucc

SEQ ID NO: 1319105 - RNA, 19 nt, Homo sapiens
aaaguaucguguuaugaac

SEQ ID NO: 1319106 - RNA, 19 nt, Homo sapiens
agaaagacgacgaggauac

SEQ ID NO: 1319107 - RNA, 19 nt, Homo sapiens
uacaugugaugggcauuga

SEQ ID NO: 1319108 - RNA, 19 nt, Homo sapiens
guaccuggagcaaucaaag

SEQ ID NO: 1319109 - RNA, 19 nt, Homo sapiens
uguauacaagcuaauguga

SEQ ID NO: 1319110 - RNA, 19 nt, Homo sapiens
gugcuuggccuguucuucu

SEQ ID NO: 1319111 - RNA, 19 nt, Homo sapiens
cggugaagaagaagagaaa

SEQ ID NO: 1319112 - RNA, 19 nt, Homo sapiens
aucaaaguaucguguuaug

SEQ ID NO: 1319113 - RNA, 19 nt, Homo sapiens
cgcucacaguugaaugaua

SEQ ID NO: 1319114 - RNA, 19 nt, Homo sapiens
gcacacagcagauccaaga

SEQ ID NO: 1319115 - RNA, 19 nt, Homo sapiens
gggagcaacuuauucgaaa

SEQ ID NO: 1319116 - RNA, 19 nt, Homo sapiens
ggaggcagcuggaggacaa

SEQ ID NO: 1319117 - RNA, 19 nt, Homo sapiens
gaaacugauugcugaacaa

SEQ ID NO: 1319118 - RNA, 19 nt, Homo sapiens
gaaauaugaggaaagcuuu

SEQ ID NO: 1319119 - RNA, 19 nt, Homo sapiens
caacugaaggucaauacua

SEQ ID NO: 1319120 - RNA, 19 nt, Homo sapiens
gagaacaaacgguaugaaa

SEQ ID NO: 1319121 - RNA, 19 nt, Homo sapiens
gaaaucagccaaagaagag

SEQ ID NO: 1319122 - RNA, 19 nt, Homo sapiens
gagcugaggcugagcauga

SEQ ID NO: 1319123 - RNA, 19 nt, Homo sapiens
caacuuauucgaaaucuug

SEQ ID NO: 1319124 - RNA, 19 nt, Homo sapiens
gcaaauacaagagaagauu

SEQ ID NO: 1319125 - RNA, 19 nt, Homo sapiens
cgaccaaacuaaagaagga

SEQ ID NO: 1319126 - RNA, 19 nt, Homo sapiens
ggaaacugauugcugaaca

SEQ ID NO: 1319127 - RNA, 19 nt, Homo sapiens
aguguugacucuagaaaua

SEQ ID NO: 1319128 - RNA, 19 nt, Homo sapiens
aagagaagauugagcagaa

SEQ ID NO: 1319129 - RNA, 19 nt, Homo sapiens
ggaugaagcaggccauuga

SEQ ID NO: 1319130 - RNA, 19 nt, Homo sapiens
gaagagcagaggaaacuga

SEQ ID NO: 1319131 - RNA, 19 nt, Homo sapiens
aaacacagggagcaacuua

SEQ ID NO: 1319132 - RNA, 19 nt, Homo sapiens
ccuguugucucaccuuuaa

SEQ ID NO: 1319133 - RNA, 19 nt, Homo sapiens
uagagaggcuggaggaaga

SEQ ID NO: 1319134 - RNA, 19 nt, Homo sapiens
gagcagaggaaacugauug

SEQ ID NO: 1319135 - RNA, 19 nt, Homo sapiens
gcuuggaacugacuucaug

SEQ ID NO: 1319136 - RNA, 19 nt, Homo sapiens
gcacgggacagacugauga

SEQ ID NO: 1319137 - RNA, 19 nt, Homo sapiens
gaacuugcaggaaagaaga

SEQ ID NO: 1319138 - RNA, 19 nt, Homo sapiens
gaagggaggcgcuagaaag

SEQ ID NO: 1319139 - RNA, 19 nt, Homo sapiens
ggaaaugcagaaagaagaa

SEQ ID NO: 1319140 - RNA, 19 nt, Homo sapiens
gcugcauagucuuguaaua

SEQ ID NO: 1319141 - RNA, 19 nt, Homo sapiens
uaaagaaggagcaggagaa

SEQ ID NO: 1319142 - RNA, 19 nt, Homo sapiens
cguaaacucuugggaaaug

SEQ ID NO: 1319143 - RNA, 19 nt, Homo sapiens
caacagcaaauacaagaga

SEQ ID NO: 1319144 - RNA, 19 nt, Homo sapiens
gaacaaacgguaugaaaau

SEQ ID NO: 1319145 - RNA, 19 nt, Homo sapiens
gcagaacagccguuacuuc

SEQ ID NO: 1319146 - RNA, 19 nt, Homo sapiens
gucguaaacucuugggaaa

SEQ ID NO: 1319147 - RNA, 19 nt, Homo sapiens
acauuaaggugucgugaga

SEQ ID NO: 1319148 - RNA, 19 nt, Homo sapiens
gacaacagcaaauacaaga

SEQ ID NO: 1319149 - RNA, 19 nt, Homo sapiens
ggagacaacagcaaauaca

SEQ ID NO: 1319150 - RNA, 19 nt, Homo sapiens
aacugaaggucaauacuaa

SEQ ID NO: 1319151 - RNA, 19 nt, Homo sapiens
caagaggaaucccugaaac

SEQ ID NO: 1319152 - RNA, 19 nt, Homo sapiens
gggaggcgcuagaaaggau

SEQ ID NO: 1319153 - RNA, 19 nt, Homo sapiens
cagaacagccguuacuuca

SEQ ID NO: 1319154 - RNA, 19 nt, Homo sapiens
ccaaagaagagcagaggaa

SEQ ID NO: 1319155 - RNA, 19 nt, Homo sapiens
ggagcaacuuauucgaaau

SEQ ID NO: 1319156 - RNA, 19 nt, Homo sapiens
caaagaagagcagaggaaa

SEQ ID NO: 1319157 - RNA, 19 nt, Homo sapiens
gggaaaugcagaaagaaga

SEQ ID NO: 1319158 - RNA, 19 nt, Homo sapiens
ccagaagcaugucguaaac

SEQ ID NO: 1319159 - RNA, 19 nt, Homo sapiens
ugaaaucagccaaagaaga

SEQ ID NO: 1319160 - RNA, 19 nt, Homo sapiens
agauggagcuggaccuuca

SEQ ID NO: 1319161 - RNA, 19 nt, Homo sapiens
gcaugaacuugcaggaaag

SEQ ID NO: 1319162 - RNA, 19 nt, Homo sapiens
cugcucagguucaucauug

SEQ ID NO: 1319163 - RNA, 19 nt, Homo sapiens
caaauacaagagaagauug

SEQ ID NO: 1319164 - RNA, 19 nt, Homo sapiens
caagagaacaaacgguaug

SEQ ID NO: 1319165 - RNA, 19 nt, Homo sapiens
gaaaugcagaaagaagaaa

SEQ ID NO: 1319166 - RNA, 19 nt, Homo sapiens
gagaaagaggagagugaaa

SEQ ID NO: 1319167 - RNA, 19 nt, Homo sapiens
gggcguuucuugagacauc

SEQ ID NO: 1319168 - RNA, 19 nt, Homo sapiens
gcaagagaacaaacgguau

SEQ ID NO: 1319169 - RNA, 19 nt, Homo sapiens
gcaacuuauucgaaaucuu

SEQ ID NO: 1319170 - RNA, 19 nt, Homo sapiens
acacagggagcaacuuauu

SEQ ID NO: 1319171 - RNA, 19 nt, Homo sapiens
aggagaaucuguugaagca

SEQ ID NO: 1319172 - RNA, 19 nt, Homo sapiens
gcgagaaagaggagaguga

SEQ ID NO: 1319173 - RNA, 19 nt, Homo sapiens
gagacaacagcaaauacaa

SEQ ID NO: 1319174 - RNA, 19 nt, Homo sapiens
agcaugaacuugcaggaaa

SEQ ID NO: 1319175 - RNA, 19 nt, Homo sapiens
gcaggagaaucuguugaag

SEQ ID NO: 1319176 - RNA, 19 nt, Homo sapiens
agaaggagcaggagaaucu

SEQ ID NO: 1319177 - RNA, 19 nt, Homo sapiens
gagcagaacagccguuacu

SEQ ID NO: 1319178 - RNA, 19 nt, Homo sapiens
cuugggaaaugcagaaaga

SEQ ID NO: 1319179 - RNA, 19 nt, Homo sapiens
caagcaagggucuuugaug

SEQ ID NO: 1319180 - RNA, 19 nt, Homo sapiens
ccaaggagaugugggaaaa

SEQ ID NO: 1319181 - RNA, 19 nt, Homo sapiens
gaauggagcucuaaaaccu

SEQ ID NO: 1319182 - RNA, 19 nt, Homo sapiens
acugauugcugaacaacuu

SEQ ID NO: 1319183 - RNA, 19 nt, Homo sapiens
cacaucaacugaaggucaa

SEQ ID NO: 1319184 - RNA, 19 nt, Homo sapiens
gagcaacuuauucgaaauc

SEQ ID NO: 1319185 - RNA, 19 nt, Homo sapiens
gagcaugaacuugcaggaa

SEQ ID NO: 1319186 - RNA, 19 nt, Homo sapiens
aagaacaacccgaaacuuc

SEQ ID NO: 1319187 - RNA, 19 nt, Homo sapiens
guagcgcgucugggaauua

SEQ ID NO: 1319188 - RNA, 19 nt, Homo sapiens
agaaauaugaggaaagcuu

SEQ ID NO: 1319189 - RNA, 19 nt, Homo sapiens
gcugcugcauagucuugua

SEQ ID NO: 1319190 - RNA, 19 nt, Homo sapiens
ccgcagagcaagagaacaa

SEQ ID NO: 1319191 - RNA, 19 nt, Homo sapiens
ugucucaccuuuaauuguc

SEQ ID NO: 1319192 - RNA, 19 nt, Homo sapiens
acaagaggaaucccugaaa

SEQ ID NO: 1319193 - RNA, 19 nt, Homo sapiens
gggaggaggccaaggagau

SEQ ID NO: 1319194 - RNA, 19 nt, Homo sapiens
ggcgugugguuuccuguug

SEQ ID NO: 1319195 - RNA, 19 nt, Homo sapiens
gaggaaucccugaaacaca

SEQ ID NO: 1319196 - RNA, 19 nt, Homo sapiens
gaaccgacgggcacaagag

SEQ ID NO: 1319197 - RNA, 19 nt, Homo sapiens
gaggcgaccaaacuaaaga

SEQ ID NO: 1319198 - RNA, 19 nt, Homo sapiens
caaacgguaugaaaaugaa

SEQ ID NO: 1319199 - RNA, 19 nt, Homo sapiens
gcuccaaacaggcagaaug

SEQ ID NO: 1319200 - RNA, 19 nt, Homo sapiens
gugguuuccuguugucuca

SEQ ID NO: 1319201 - RNA, 19 nt, Homo sapiens
gaugagcgagguucugaca

SEQ ID NO: 1319202 - RNA, 19 nt, Homo sapiens
caguauaacgcucaacuca

SEQ ID NO: 1319203 - RNA, 19 nt, Homo sapiens
gagcaggagaaucuguuga

SEQ ID NO: 1319204 - RNA, 19 nt, Homo sapiens
gguggaggcgaccaaacua

SEQ ID NO: 1319205 - RNA, 19 nt, Homo sapiens
ccgaggcacugcugcaaca

SEQ ID NO: 1319206 - RNA, 19 nt, Homo sapiens
gggagcagaacagccguua

SEQ ID NO: 1319207 - RNA, 19 nt, Homo sapiens
agaagcaugucguaaacuc

SEQ ID NO: 1319208 - RNA, 19 nt, Homo sapiens
gccagcagcgccugaauca

SEQ ID NO: 1319209 - RNA, 19 nt, Homo sapiens
gcacgggaagcugaaauca

SEQ ID NO: 1319210 - RNA, 19 nt, Homo sapiens
guguuuggccagacauuaa

SEQ ID NO: 1319211 - RNA, 19 nt, Homo sapiens
ggaggaggccaaggagaug

SEQ ID NO: 1319212 - RNA, 19 nt, Homo sapiens
cuagaaauaugaggaaagc

SEQ ID NO: 1319213 - RNA, 19 nt, Homo sapiens
cugcauagucuuguaauau

SEQ ID NO: 1319214 - RNA, 19 nt, Homo sapiens
gaaauaaaccugacauguu

SEQ ID NO: 1319215 - RNA, 19 nt, Homo sapiens
aaauaaaccugacauguug

SEQ ID NO: 1319216 - RNA, 19 nt, Homo sapiens
acaagaaggugaccaucua

SEQ ID NO: 1319217 - RNA, 19 nt, Homo sapiens
ggccacagcuuucccauca

SEQ ID NO: 1319218 - RNA, 19 nt, Homo sapiens
ugagagcgaaggagaaaua

SEQ ID NO: 1319219 - RNA, 19 nt, Homo sapiens
gcucugggcuggugacaac

SEQ ID NO: 1319220 - RNA, 19 nt, Homo sapiens
cagcuuauccgguccuuug

SEQ ID NO: 1319221 - RNA, 19 nt, Homo sapiens
gcccagcccuguugaagca

SEQ ID NO: 1319222 - RNA, 19 nt, Homo sapiens
gagcgaaggagaaauaaac

SEQ ID NO: 1319223 - RNA, 19 nt, Homo sapiens
ccacguggcuuccguugac

SEQ ID NO: 1319224 - RNA, 19 nt, Homo sapiens
uggaagagaagaacuuuga

SEQ ID NO: 1319225 - RNA, 19 nt, Homo sapiens
gaugggcgcugggucgaau

SEQ ID NO: 1319226 - RNA, 19 nt, Homo sapiens
gaagagaagaacuuugacu

SEQ ID NO: 1319227 - RNA, 19 nt, Homo sapiens
cuggagaccugucgcuaga

SEQ ID NO: 1319228 - RNA, 19 nt, Homo sapiens
ugacccugcuggcggauga

SEQ ID NO: 1319229 - RNA, 19 nt, Homo sapiens
gcagcaguucggcgagaua

SEQ ID NO: 1319230 - RNA, 19 nt, Homo sapiens
gagaaauaaaccugacaug

SEQ ID NO: 1319231 - RNA, 19 nt, Homo sapiens
gcaugacaaugggcucaau

SEQ ID NO: 1319232 - RNA, 19 nt, Homo sapiens
gaucgcaacgucaacuugu

SEQ ID NO: 1319233 - RNA, 19 nt, Homo sapiens
agaaauaaaccugacaugu

SEQ ID NO: 1319234 - RNA, 19 nt, Homo sapiens
gagagcgaaggagaaauaa

SEQ ID NO: 1319235 - RNA, 19 nt, Homo sapiens
ccacagcuuucccaucacu

SEQ ID NO: 1319236 - RNA, 19 nt, Homo sapiens
ggagaaauaaaccugacau

SEQ ID NO: 1319237 - RNA, 19 nt, Homo sapiens
gucugcagcuggacuccua

SEQ ID NO: 1319238 - RNA, 19 nt, Homo sapiens
cuagggcggugcgaugauu

SEQ ID NO: 1319239 - RNA, 19 nt, Homo sapiens
gcaguucggcgagauaaag

SEQ ID NO: 1319240 - RNA, 19 nt, Homo sapiens
caugacaaugggcucaaua

SEQ ID NO: 1319241 - RNA, 19 nt, Homo sapiens
gacaagaaggugaccaucu

SEQ ID NO: 1319242 - RNA, 19 nt, Homo sapiens
ggacccagagucagagaca

SEQ ID NO: 1319243 - RNA, 19 nt, Homo sapiens
ccucgugucugaccauguc

SEQ ID NO: 1319244 - RNA, 19 nt, Homo sapiens
gguggaagagaagaacuuu

SEQ ID NO: 1319245 - RNA, 19 nt, Homo sapiens
guugagagcgaaggagaaa

SEQ ID NO: 1319246 - RNA, 19 nt, Homo sapiens
gcgcugggucgaauacuuc

SEQ ID NO: 1319247 - RNA, 19 nt, Homo sapiens
ggguuucggccguaaguga

SEQ ID NO: 1319248 - RNA, 19 nt, Homo sapiens
ggcgcugggucgaauacuu

SEQ ID NO: 1319249 - RNA, 19 nt, Homo sapiens
acauguuggugcuuggaaa

SEQ ID NO: 1319250 - RNA, 19 nt, Homo sapiens
cuuauccgguccuuugaug

SEQ ID NO: 1319251 - RNA, 19 nt, Homo sapiens
aucaagaccuuaggcacua

SEQ ID NO: 1319252 - RNA, 19 nt, Homo sapiens
ccacauccacugacaagac

SEQ ID NO: 1319253 - RNA, 19 nt, Homo sapiens
ugacuggcaccuaugacaa

SEQ ID NO: 1319254 - RNA, 19 nt, Homo sapiens
cagugaagcucugggacau

SEQ ID NO: 1319255 - RNA, 19 nt, Homo sapiens
gacccaccaaggaccauuu

SEQ ID NO: 1319256 - RNA, 19 nt, Homo sapiens
uccgcgaccucgugucuga

SEQ ID NO: 1319257 - RNA, 19 nt, Homo sapiens
cagcaguucggcgagauaa

SEQ ID NO: 1319258 - RNA, 19 nt, Homo sapiens
gggcguggauguggauacu

SEQ ID NO: 1319259 - RNA, 19 nt, Homo sapiens
ucuccuaccugccugacau

SEQ ID NO: 1319260 - RNA, 19 nt, Homo sapiens
gcgaaauaguacccaugag

SEQ ID NO: 1319261 - RNA, 19 nt, Homo sapiens
gagaucgcaacgucaacuu

SEQ ID NO: 1319262 - RNA, 19 nt, Homo sapiens
cagcggaugggcagcaguu

SEQ ID NO: 1319263 - RNA, 19 nt, Homo sapiens
ucaagaagcuggaaacaga

SEQ ID NO: 1319264 - RNA, 19 nt, Homo sapiens
gggaggaacuuuggcacua

SEQ ID NO: 1319265 - RNA, 19 nt, Homo sapiens
aaucguugcuuguguuuga

SEQ ID NO: 1319266 - RNA, 19 nt, Homo sapiens
ccaaggcuguacuguuuga

SEQ ID NO: 1319267 - RNA, 19 nt, Homo sapiens
ggaggagucgugaaugguu

SEQ ID NO: 1319268 - RNA, 19 nt, Homo sapiens
ggaggaacuuuggcacuag

SEQ ID NO: 1319269 - RNA, 19 nt, Homo sapiens
gaucaauuguaggaggaaa

SEQ ID NO: 1319270 - RNA, 19 nt, Homo sapiens
ccccaaggcuguacuguuu

SEQ ID NO: 1319271 - RNA, 19 nt, Homo sapiens
uguaggaggaaauuucuuu

SEQ ID NO: 1319272 - RNA, 19 nt, Homo sapiens
aggcuguacuguuugauug

SEQ ID NO: 1319273 - RNA, 19 nt, Homo sapiens
gcgaauguguaucccaaaa

SEQ ID NO: 1319274 - RNA, 19 nt, Homo sapiens
gagaauuggaggaaugagu

SEQ ID NO: 1319275 - RNA, 19 nt, Homo sapiens
cugaaucguugcuuguguu

SEQ ID NO: 1319276 - RNA, 19 nt, Homo sapiens
uagcguuugugucucaaga

SEQ ID NO: 1319277 - RNA, 19 nt, Homo sapiens
uuacucugguuacuaagau

SEQ ID NO: 1319278 - RNA, 19 nt, Homo sapiens
cucuuacucugguuacuaa

SEQ ID NO: 1319279 - RNA, 19 nt, Homo sapiens
guacggccuucagcaguca

SEQ ID NO: 1319280 - RNA, 19 nt, Homo sapiens
ucauccaugucuuugcaaa

SEQ ID NO: 1319281 - RNA, 19 nt, Homo sapiens
uuugagaauuggaggaaug

SEQ ID NO: 1319282 - RNA, 19 nt, Homo sapiens
ucucauccaugucuuugca

SEQ ID NO: 1319283 - RNA, 19 nt, Homo sapiens
gacacgccguuggugauau

SEQ ID NO: 1319284 - RNA, 19 nt, Homo sapiens
gaauuggaggaaugaguca

SEQ ID NO: 1319285 - RNA, 19 nt, Homo sapiens
ccggaggagucgugaaugg

SEQ ID NO: 1319286 - RNA, 19 nt, Homo sapiens
ccaaagugccgggaugaca

SEQ ID NO: 1319287 - RNA, 19 nt, Homo sapiens
gcguuugugucucaagaag

SEQ ID NO: 1319288 - RNA, 19 nt, Homo sapiens
aaagaaccugguagcguuu

SEQ ID NO: 1319289 - RNA, 19 nt, Homo sapiens
agacacgccguuggugaua

SEQ ID NO: 1319290 - RNA, 19 nt, Homo sapiens
ccugaaucguugcuugugu

SEQ ID NO: 1319291 - RNA, 19 nt, Homo sapiens
gaccugaaucguugcuugu

SEQ ID NO: 1319292 - RNA, 19 nt, Homo sapiens
cgccguuggugauaucgaa

SEQ ID NO: 1319293 - RNA, 19 nt, Homo sapiens
ugugcaggaucaauuguag

SEQ ID NO: 1319294 - RNA, 19 nt, Homo sapiens
ugaaucguugcuuguguuu

SEQ ID NO: 1319295 - RNA, 19 nt, Homo sapiens
acacgccguuggugauauc

SEQ ID NO: 1319296 - RNA, 19 nt, Homo sapiens
uugcuuguguuugagaauu

SEQ ID NO: 1319297 - RNA, 19 nt, Homo sapiens
gguggagggaggaacuuug

SEQ ID NO: 1319298 - RNA, 19 nt, Homo sapiens
ugguagcguuugugucuca

SEQ ID NO: 1319299 - RNA, 19 nt, Homo sapiens
gcaaccagauuucuucuua

SEQ ID NO: 1319300 - RNA, 19 nt, Homo sapiens
ggaaaggccuugccaugua

SEQ ID NO: 1319301 - RNA, 19 nt, Homo sapiens
ucagggaaauugaagauua

SEQ ID NO: 1319302 - RNA, 19 nt, Homo sapiens
ggagaaagccaucaagaaa

SEQ ID NO: 1319303 - RNA, 19 nt, Homo sapiens
gcucuuaucuuucauuuca

SEQ ID NO: 1319304 - RNA, 19 nt, Homo sapiens
guucaugaaucgcuaauaa

SEQ ID NO: 1319305 - RNA, 19 nt, Homo sapiens
gcauuuggcuacaguguuu

SEQ ID NO: 1319306 - RNA, 19 nt, Homo sapiens
gaucagagaugggaaagga

SEQ ID NO: 1319307 - RNA, 19 nt, Homo sapiens
aaaugaagcuagucuguuu

SEQ ID NO: 1319308 - RNA, 19 nt, Homo sapiens
ggaaucaacuggugcuguu

SEQ ID NO: 1319309 - RNA, 19 nt, Homo sapiens
gaaaggccuugccauguau

SEQ ID NO: 1319310 - RNA, 19 nt, Homo sapiens
uagaauaggucauugguau

SEQ ID NO: 1319311 - RNA, 19 nt, Homo sapiens
caaaucuucuugucaugua

SEQ ID NO: 1319312 - RNA, 19 nt, Homo sapiens
gcaagcuaaucaaacauaa

SEQ ID NO: 1319313 - RNA, 19 nt, Homo sapiens
agaaagccaucaagaaauu

SEQ ID NO: 1319314 - RNA, 19 nt, Homo sapiens
gagaugaggccuuuaaaga

SEQ ID NO: 1319315 - RNA, 19 nt, Homo sapiens
uaacaagcccucuaacaaa

SEQ ID NO: 1319316 - RNA, 19 nt, Homo sapiens
caagaaauuuggagcuuau

SEQ ID NO: 1319317 - RNA, 19 nt, Homo sapiens
gggaggaccugguaucgaa

SEQ ID NO: 1319318 - RNA, 19 nt, Homo sapiens
gguaugggcugaacugugu

SEQ ID NO: 1319319 - RNA, 19 nt, Homo sapiens
acaaauugcugcauguauu

SEQ ID NO: 1319320 - RNA, 19 nt, Homo sapiens
gcaagaaaguggaaucaac

SEQ ID NO: 1319321 - RNA, 19 nt, Homo sapiens
gagcuuauaccauugcuaa

SEQ ID NO: 1319322 - RNA, 19 nt, Homo sapiens
aaaggaggcuguuagucua

SEQ ID NO: 1319323 - RNA, 19 nt, Homo sapiens
caagcaaucuaucuguuug

SEQ ID NO: 1319324 - RNA, 19 nt, Homo sapiens
ucaagaaauuuggagcuua

SEQ ID NO: 1319325 - RNA, 19 nt, Homo sapiens
uggagaagcuaaugaauca

SEQ ID NO: 1319326 - RNA, 19 nt, Homo sapiens
gagcaagcgugauuaugau

SEQ ID NO: 1319327 - RNA, 19 nt, Homo sapiens
cagggaaauugaagauuaa

SEQ ID NO: 1319328 - RNA, 19 nt, Homo sapiens
ccagauuucuucuuagaug

SEQ ID NO: 1319329 - RNA, 19 nt, Homo sapiens
gaacguaaccugaaguaac

SEQ ID NO: 1319330 - RNA, 19 nt, Homo sapiens
uaaccaaucugcugugucu

SEQ ID NO: 1319331 - RNA, 19 nt, Homo sapiens
ccagaauagugagaaauaa

SEQ ID NO: 1319332 - RNA, 19 nt, Homo sapiens
cauaagagauaccagcaau

SEQ ID NO: 1319333 - RNA, 19 nt, Homo sapiens
uaacauggcccuagcaauc

SEQ ID NO: 1319334 - RNA, 19 nt, Homo sapiens
gcacgugguuucuugaucu

SEQ ID NO: 1319335 - RNA, 19 nt, Homo sapiens
uaaaccaggucauccuuug

SEQ ID NO: 1319336 - RNA, 19 nt, Homo sapiens
ugaagaaauugaagcaguu

SEQ ID NO: 1319337 - RNA, 19 nt, Homo sapiens
acagucagaucaagcagua

SEQ ID NO: 1319338 - RNA, 19 nt, Homo sapiens
cugcauguauuccauuuaa

SEQ ID NO: 1319339 - RNA, 19 nt, Homo sapiens
caacaagucaggagauuca

SEQ ID NO: 1319340 - RNA, 19 nt, Homo sapiens
uaagugggauucuaagaca

SEQ ID NO: 1319341 - RNA, 19 nt, Homo sapiens
uggaauggcagaagaauuu

SEQ ID NO: 1319342 - RNA, 19 nt, Homo sapiens
gcagauguggugaugagua

SEQ ID NO: 1319343 - RNA, 19 nt, Homo sapiens
gcaaaggauggagcaaaua

SEQ ID NO: 1319344 - RNA, 19 nt, Homo sapiens
gcaccuugaucuuugacuu

SEQ ID NO: 1319345 - RNA, 19 nt, Homo sapiens
uaaagccacucaagcaauc

SEQ ID NO: 1319346 - RNA, 19 nt, Homo sapiens
gagaaagccaucaagaaau

SEQ ID NO: 1319347 - RNA, 19 nt, Homo sapiens
cuaauacagugguuugaga

SEQ ID NO: 1319348 - RNA, 19 nt, Homo sapiens
caaaggaggcuguuagucu

SEQ ID NO: 1319349 - RNA, 19 nt, Homo sapiens
caaaggauggagcaaauau

SEQ ID NO: 1319350 - RNA, 19 nt, Homo sapiens
ggacuuagccauaggaaaa

SEQ ID NO: 1319351 - RNA, 19 nt, Homo sapiens
gcuaaugaaucagaugaau

SEQ ID NO: 1319352 - RNA, 19 nt, Homo sapiens
ugagcaagcgugauuauga

SEQ ID NO: 1319353 - RNA, 19 nt, Homo sapiens
ggaagcagaggaucagaga

SEQ ID NO: 1319354 - RNA, 19 nt, Homo sapiens
guucggagaugaggccuuu

SEQ ID NO: 1319355 - RNA, 19 nt, Homo sapiens
gguccuaacucccauuucu

SEQ ID NO: 1319356 - RNA, 19 nt, Homo sapiens
gcaguaaaauuagcucuuu

SEQ ID NO: 1319357 - RNA, 19 nt, Homo sapiens
ggauggagcaaauauuguu

SEQ ID NO: 1319358 - RNA, 19 nt, Homo sapiens
uaugacuacugaugacuuu

SEQ ID NO: 1319359 - RNA, 19 nt, Homo sapiens
cagaagcaguuagcaagaa

SEQ ID NO: 1319360 - RNA, 19 nt, Homo sapiens
cagauguggugaugaguau

SEQ ID NO: 1319361 - RNA, 19 nt, Homo sapiens
caaagcuauugcauugaaa

SEQ ID NO: 1319362 - RNA, 19 nt, Homo sapiens
ggaauggcagaagaauuua

SEQ ID NO: 1319363 - RNA, 19 nt, Homo sapiens
gauggagcaaauauuguua

SEQ ID NO: 1319364 - RNA, 19 nt, Homo sapiens
auaaggauaugcacguuug

SEQ ID NO: 1319365 - RNA, 19 nt, Homo sapiens
gaugaaugccagacuguga

SEQ ID NO: 1319366 - RNA, 19 nt, Homo sapiens
gagaagcuaaugaaucaga

SEQ ID NO: 1319367 - RNA, 19 nt, Homo sapiens
gaagauuaaagguaacaug

SEQ ID NO: 1319368 - RNA, 19 nt, Homo sapiens
gaucucaccucuccaucca

SEQ ID NO: 1319369 - RNA, 19 nt, Homo sapiens
aaagagagaggcuucagaa

SEQ ID NO: 1319370 - RNA, 19 nt, Homo sapiens
ggaaauugaagauuaaagg

SEQ ID NO: 1319371 - RNA, 19 nt, Homo sapiens
caaucuaucuguuugaacu

SEQ ID NO: 1319372 - RNA, 19 nt, Homo sapiens
caaggaacguaaccugaag

SEQ ID NO: 1319373 - RNA, 19 nt, Homo sapiens
uagcuaauccugacauuuc

SEQ ID NO: 1319374 - RNA, 19 nt, Homo sapiens
guugugccauuaagcaauu

SEQ ID NO: 1319375 - RNA, 19 nt, Homo sapiens
gaaacagaaaccuuagaau

SEQ ID NO: 1319376 - RNA, 19 nt, Homo sapiens
ccagguggacuuagccaua

SEQ ID NO: 1319377 - RNA, 19 nt, Homo sapiens
ggcaagcuaaucaaacaua

SEQ ID NO: 1319378 - RNA, 19 nt, Homo sapiens
gguggcacgugguuucuug

SEQ ID NO: 1319379 - RNA, 19 nt, Homo sapiens
uaaggacucucucagugau

SEQ ID NO: 1319380 - RNA, 19 nt, Homo sapiens
agaagcaguuagcaagaaa

SEQ ID NO: 1319381 - RNA, 19 nt, Homo sapiens
gcagaccauucuaucauac

SEQ ID NO: 1319382 - RNA, 19 nt, Homo sapiens
gucaggagauucacagcaa

SEQ ID NO: 1319383 - RNA, 19 nt, Homo sapiens
uuaacaagcccucuaacaa

SEQ ID NO: 1319384 - RNA, 19 nt, Homo sapiens
agaggugacuuaaguucaa

SEQ ID NO: 1319385 - RNA, 19 nt, Homo sapiens
gaauggcagaagaauuuaa

SEQ ID NO: 1319386 - RNA, 19 nt, Homo sapiens
gaaagccaucaagaaauuu

SEQ ID NO: 1319387 - RNA, 19 nt, Homo sapiens
ugcagaccauucuaucaua

SEQ ID NO: 1319388 - RNA, 19 nt, Homo sapiens
gcaagcgugauuaugauga

SEQ ID NO: 1319389 - RNA, 19 nt, Homo sapiens
caaagggaguccagucaac

SEQ ID NO: 1319390 - RNA, 19 nt, Homo sapiens
cuucucagcuuccacucua

SEQ ID NO: 1319391 - RNA, 19 nt, Homo sapiens
ugaaacagaaaccuuagaa

SEQ ID NO: 1319392 - RNA, 19 nt, Homo sapiens
uaacaaauugcugcaugua

SEQ ID NO: 1319393 - RNA, 19 nt, Homo sapiens
gacuacugaugacuuugua

SEQ ID NO: 1319394 - RNA, 19 nt, Homo sapiens
gcaauuaaaccaggucauc

SEQ ID NO: 1319395 - RNA, 19 nt, Homo sapiens
aguaugguaugucuaugua

SEQ ID NO: 1319396 - RNA, 19 nt, Homo sapiens
gaugcuacccaguucauga

SEQ ID NO: 1319397 - RNA, 19 nt, Homo sapiens
uaggagcauuuaaucugua

SEQ ID NO: 1319398 - RNA, 19 nt, Homo sapiens
ccauuaagcaauuuagcua

SEQ ID NO: 1319399 - RNA, 19 nt, Homo sapiens
ccaagaggcugcuggagau

SEQ ID NO: 1319400 - RNA, 19 nt, Homo sapiens
gaagagggaugaggaugac

SEQ ID NO: 1319401 - RNA, 19 nt, Homo sapiens
ggacacacaggaccacuca

SEQ ID NO: 1319402 - RNA, 19 nt, Homo sapiens
gcagcgcccagcagaugua

SEQ ID NO: 1319403 - RNA, 19 nt, Homo sapiens
gggcuaagaagagggauga

SEQ ID NO: 1319404 - RNA, 19 nt, Homo sapiens
ggaguuugcccagaaagug

SEQ ID NO: 1319405 - RNA, 19 nt, Homo sapiens
acauguaccuggucaucga

SEQ ID NO: 1319406 - RNA, 19 nt, Homo sapiens
agaagagggaugaggauga

SEQ ID NO: 1319407 - RNA, 19 nt, Homo sapiens
cgagcuccgugaccaugaa

SEQ ID NO: 1319408 - RNA, 19 nt, Homo sapiens
gcucgaggacaacuacaug

SEQ ID NO: 1319409 - RNA, 19 nt, Homo sapiens
aggaugacgugcccacugu

SEQ ID NO: 1319410 - RNA, 19 nt, Homo sapiens
ucgaggacaacuacaugua

SEQ ID NO: 1319411 - RNA, 19 nt, Homo sapiens
ccacugugccgucgacucu

SEQ ID NO: 1319412 - RNA, 19 nt, Homo sapiens
uaagaagagggaugaggau

SEQ ID NO: 1319413 - RNA, 19 nt, Homo sapiens
gcuuagcaaccuggaguuu

SEQ ID NO: 1319414 - RNA, 19 nt, Homo sapiens
uggaggcgcuaugcaagga

SEQ ID NO: 1319415 - RNA, 19 nt, Homo sapiens
aagcuguccugggcuaaga

SEQ ID NO: 1319416 - RNA, 19 nt, Homo sapiens
ggccacgagcacacgcuua

SEQ ID NO: 1319417 - RNA, 19 nt, Homo sapiens
cugcaacgaccacgugaga

SEQ ID NO: 1319418 - RNA, 19 nt, Homo sapiens
ggacgaggcuauauacuga

SEQ ID NO: 1319419 - RNA, 19 nt, Homo sapiens
gagaguaacuguaccuauu

SEQ ID NO: 1319420 - RNA, 19 nt, Homo sapiens
ugagaugacuguacacaua

SEQ ID NO: 1319421 - RNA, 19 nt, Homo sapiens
gaagaaggaagaagaagua

SEQ ID NO: 1319422 - RNA, 19 nt, Homo sapiens
ggucagaguucauauaauc

SEQ ID NO: 1319423 - RNA, 19 nt, Homo sapiens
ggagaaaggagaauugaaa

SEQ ID NO: 1319424 - RNA, 19 nt, Homo sapiens
ggagaaagaagaagaagaa

SEQ ID NO: 1319425 - RNA, 19 nt, Homo sapiens
gaaaggagaauugaaagaa

SEQ ID NO: 1319426 - RNA, 19 nt, Homo sapiens
agagagauguggagcguua

SEQ ID NO: 1319427 - RNA, 19 nt, Homo sapiens
gaaagaagaagaagaagag

SEQ ID NO: 1319428 - RNA, 19 nt, Homo sapiens
gagcugagaugacuguaca

SEQ ID NO: 1319429 - RNA, 19 nt, Homo sapiens
agaagaacaugaagaggaa

SEQ ID NO: 1319430 - RNA, 19 nt, Homo sapiens
ggaggaagaagaagaguau

SEQ ID NO: 1319431 - RNA, 19 nt, Homo sapiens
ggaagaggaggaagaagaa

SEQ ID NO: 1319432 - RNA, 19 nt, Homo sapiens
gcuauauacugaagaagga

SEQ ID NO: 1319433 - RNA, 19 nt, Homo sapiens
ugacagugaugacaauaug

SEQ ID NO: 1319434 - RNA, 19 nt, Homo sapiens
agaagaguaugaugaagaa

SEQ ID NO: 1319435 - RNA, 19 nt, Homo sapiens
ggaggaaacaauacagaaa

SEQ ID NO: 1319436 - RNA, 19 nt, Homo sapiens
uagagacccuggagaagaa

SEQ ID NO: 1319437 - RNA, 19 nt, Homo sapiens
gaggaagcccaguacauuu

SEQ ID NO: 1319438 - RNA, 19 nt, Homo sapiens
gaggcuauauacugaagaa

SEQ ID NO: 1319439 - RNA, 19 nt, Homo sapiens
gaaggaagaggaggaagaa

SEQ ID NO: 1319440 - RNA, 19 nt, Homo sapiens
gaaacaauacagaaacuag

SEQ ID NO: 1319441 - RNA, 19 nt, Homo sapiens
ggagcaguuugaaggagua

SEQ ID NO: 1319442 - RNA, 19 nt, Homo sapiens
ccacauuuguaucaccuuu

SEQ ID NO: 1319443 - RNA, 19 nt, Homo sapiens
agaggaugaugacaguuua

SEQ ID NO: 1319444 - RNA, 19 nt, Homo sapiens
ggacuuugguggugacagu

SEQ ID NO: 1319445 - RNA, 19 nt, Homo sapiens
agaggaaacugauuacauc

SEQ ID NO: 1319446 - RNA, 19 nt, Homo sapiens
gaaggaagaagaaguaacu

SEQ ID NO: 1319447 - RNA, 19 nt, Homo sapiens
gaauauguccuggcacuga

SEQ ID NO: 1319448 - RNA, 19 nt, Homo sapiens
gaguaagccugguuuuaua

SEQ ID NO: 1319449 - RNA, 19 nt, Homo sapiens
gcaaaggacaaacaucuca

SEQ ID NO: 1319450 - RNA, 19 nt, Homo sapiens
ggagaagaaggaagaagaa

SEQ ID NO: 1319451 - RNA, 19 nt, Homo sapiens
gaguaacuguaccuauuau

SEQ ID NO: 1319452 - RNA, 19 nt, Homo sapiens
gaagaagaguaugaugaag

SEQ ID NO: 1319453 - RNA, 19 nt, Homo sapiens
ggagcguuauucagacaaa

SEQ ID NO: 1319454 - RNA, 19 nt, Homo sapiens
gaaggaguaagccugguuu

SEQ ID NO: 1319455 - RNA, 19 nt, Homo sapiens
ggaugaugacaguuuauuu

SEQ ID NO: 1319456 - RNA, 19 nt, Homo sapiens
agaguaacuguaccuauua

SEQ ID NO: 1319457 - RNA, 19 nt, Homo sapiens
agaguaugaugaagaagaa

SEQ ID NO: 1319458 - RNA, 19 nt, Homo sapiens
gaagaagaagaguaugaug

SEQ ID NO: 1319459 - RNA, 19 nt, Homo sapiens
cccaguacauuucaaguug

SEQ ID NO: 1319460 - RNA, 19 nt, Homo sapiens
gaagggagaaaggagaauu

SEQ ID NO: 1319461 - RNA, 19 nt, Homo sapiens
ggaaacaauacagaaacua

SEQ ID NO: 1319462 - RNA, 19 nt, Homo sapiens
ggaaagugcaaaggacaaa

SEQ ID NO: 1319463 - RNA, 19 nt, Homo sapiens
ccuaagaccacagaagaua

SEQ ID NO: 1319464 - RNA, 19 nt, Homo sapiens
ucagacaaauaucagaugu

SEQ ID NO: 1319465 - RNA, 19 nt, Homo sapiens
aaggagaauugaaagaaga

SEQ ID NO: 1319466 - RNA, 19 nt, Homo sapiens
ucuggacccucgugucuuu

SEQ ID NO: 1319467 - RNA, 19 nt, Homo sapiens
ugaggaagcccaguacauu

SEQ ID NO: 1319468 - RNA, 19 nt, Homo sapiens
agaagaagaguaugaugaa

SEQ ID NO: 1319469 - RNA, 19 nt, Homo sapiens
gcagguuuauucacuggau

SEQ ID NO: 1319470 - RNA, 19 nt, Homo sapiens
gaagauaaggaggaaacaa

SEQ ID NO: 1319471 - RNA, 19 nt, Homo sapiens
caauauggacgaggcuaua

SEQ ID NO: 1319472 - RNA, 19 nt, Homo sapiens
ggaagaagaagaguaugau

SEQ ID NO: 1319473 - RNA, 19 nt, Homo sapiens
aaaggagaauugaaagaag

SEQ ID NO: 1319474 - RNA, 19 nt, Homo sapiens
uaucaccuuugcuaucuug

SEQ ID NO: 1319475 - RNA, 19 nt, Homo sapiens
agauaaggaggaaacaaua

SEQ ID NO: 1319476 - RNA, 19 nt, Homo sapiens
uagaggaugaugacaguuu

SEQ ID NO: 1319477 - RNA, 19 nt, Homo sapiens
aagaagaagaguaugauga

SEQ ID NO: 1319478 - RNA, 19 nt, Homo sapiens
uaacuucagaggaggauga

SEQ ID NO: 1319479 - RNA, 19 nt, Homo sapiens
aauagaggaugaugacagu

SEQ ID NO: 1319480 - RNA, 19 nt, Homo sapiens
guucauauaaucugucugu

SEQ ID NO: 1319481 - RNA, 19 nt, Homo sapiens
gagaaaggagaauugaaag

SEQ ID NO: 1319482 - RNA, 19 nt, Homo sapiens
gaagcccaguacauuucaa

SEQ ID NO: 1319483 - RNA, 19 nt, Homo sapiens
agaggaggaugaggagaaa

SEQ ID NO: 1319484 - RNA, 19 nt, Homo sapiens
augaagaggaaacugauua

SEQ ID NO: 1319485 - RNA, 19 nt, Homo sapiens
ugaagaagaacaugaagag

SEQ ID NO: 1319486 - RNA, 19 nt, Homo sapiens
gcagccuucuccacucuuc

SEQ ID NO: 1319487 - RNA, 19 nt, Homo sapiens
cuaagaccacagaagauaa

SEQ ID NO: 1319488 - RNA, 19 nt, Homo sapiens
ggaguaagccugguuuuau

SEQ ID NO: 1319489 - RNA, 19 nt, Homo sapiens
ggaugaggagaaagaagaa

SEQ ID NO: 1319490 - RNA, 19 nt, Homo sapiens
cagaggaggaugaggagaa

SEQ ID NO: 1319491 - RNA, 19 nt, Homo sapiens
cacagaagauaaggaggaa

SEQ ID NO: 1319492 - RNA, 19 nt, Homo sapiens
gaagaggaaacugauuaca

SEQ ID NO: 1319493 - RNA, 19 nt, Homo sapiens
gauaaggaggaaacaauac

SEQ ID NO: 1319494 - RNA, 19 nt, Homo sapiens
ggcagcagguuuauucacu

SEQ ID NO: 1319495 - RNA, 19 nt, Homo sapiens
aagaagaguaugaugaaga

SEQ ID NO: 1319496 - RNA, 19 nt, Homo sapiens
agaaagaagaagaagaaga

SEQ ID NO: 1319497 - RNA, 19 nt, Homo sapiens
gugcaaaggacaaacaucu

SEQ ID NO: 1319498 - RNA, 19 nt, Homo sapiens
ggagaugggaauagaggau

SEQ ID NO: 1319499 - RNA, 19 nt, Homo sapiens
ccucgugucuuucuuuagg

SEQ ID NO: 1319500 - RNA, 19 nt, Homo sapiens
gaacaugaagaggaaacug

SEQ ID NO: 1319501 - RNA, 19 nt, Homo sapiens
ggaagcccaguacauuuca

SEQ ID NO: 1319502 - RNA, 19 nt, Homo sapiens
ucagaugucagguccgauu

SEQ ID NO: 1319503 - RNA, 19 nt, Homo sapiens
gaggaaacaauacagaaac

SEQ ID NO: 1319504 - RNA, 19 nt, Homo sapiens
gcccaguacauuucaaguu

SEQ ID NO: 1319505 - RNA, 19 nt, Homo sapiens
gagcuacgaggagccauga

SEQ ID NO: 1319506 - RNA, 19 nt, Homo sapiens
ugaugaagaagaacaugaa

SEQ ID NO: 1319507 - RNA, 19 nt, Homo sapiens
cuagagacccuggagaaga

SEQ ID NO: 1319508 - RNA, 19 nt, Homo sapiens
ucauauaaucugucuguuc

SEQ ID NO: 1319509 - RNA, 19 nt, Homo sapiens
gaguucauauaaucugucu

SEQ ID NO: 1319510 - RNA, 19 nt, Homo sapiens
aagaagaagagaaggaaga

SEQ ID NO: 1319511 - RNA, 19 nt, Homo sapiens
agaagaagaagaagagaag

SEQ ID NO: 1319512 - RNA, 19 nt, Homo sapiens
agaaaggagaauugaaaga

SEQ ID NO: 1319513 - RNA, 19 nt, Homo sapiens
gggagaaaggagaauugaa

SEQ ID NO: 1319514 - RNA, 19 nt, Homo sapiens
caaaggacaaacaucucaa

SEQ ID NO: 1319515 - RNA, 19 nt, Homo sapiens
gggaauagaggaugaugac

SEQ ID NO: 1319516 - RNA, 19 nt, Homo sapiens
aauauguccuggcacugaa

SEQ ID NO: 1319517 - RNA, 19 nt, Homo sapiens
aagauaaggaggaaacaau

SEQ ID NO: 1319518 - RNA, 19 nt, Homo sapiens
gacaccagauuugugaaua

SEQ ID NO: 1319519 - RNA, 19 nt, Homo sapiens
guuaugacuucucccauga

SEQ ID NO: 1319520 - RNA, 19 nt, Homo sapiens
acaccagauuugugaauaa

SEQ ID NO: 1319521 - RNA, 19 nt, Homo sapiens
ccagauuugugaauaaagu

SEQ ID NO: 1319522 - RNA, 19 nt, Homo sapiens
caccagauuugugaauaaa

SEQ ID NO: 1319523 - RNA, 19 nt, Homo sapiens
acagacaccagauuuguga

SEQ ID NO: 1319524 - RNA, 19 nt, Homo sapiens
gaauaaaguuggggaaugg

SEQ ID NO: 1319525 - RNA, 19 nt, Homo sapiens
gcucagcccguuaugacuu

SEQ ID NO: 1319526 - RNA, 19 nt, Homo sapiens
cuacagacaccagauuugu

SEQ ID NO: 1319527 - RNA, 19 nt, Homo sapiens
acccugcccucucucauga

SEQ ID NO: 1319528 - RNA, 19 nt, Homo sapiens
gcacgugcuggaccuggaa

SEQ ID NO: 1319529 - RNA, 19 nt, Homo sapiens
gggaauggacagccuaaaa

SEQ ID NO: 1319530 - RNA, 19 nt, Homo sapiens
gaagucgcgcuggucagaa

SEQ ID NO: 1319531 - RNA, 19 nt, Homo sapiens
ugaauaaaguuggggaaug

SEQ ID NO: 1319532 - RNA, 19 nt, Homo sapiens
ggcucccucuacauccuua

SEQ ID NO: 1319533 - RNA, 19 nt, Homo sapiens
ccacguggacagcaucaag

SEQ ID NO: 1319534 - RNA, 19 nt, Homo sapiens
gaaauacucugaugaccua

SEQ ID NO: 1319535 - RNA, 19 nt, Homo sapiens
ugacuaaucuucagugaua

SEQ ID NO: 1319536 - RNA, 19 nt, Homo sapiens
ggaaauugauugcccauuc

SEQ ID NO: 1319537 - RNA, 19 nt, Homo sapiens
cauaucaucuguacaguuu

SEQ ID NO: 1319538 - RNA, 19 nt, Homo sapiens
caacaagagugaaacuuug

SEQ ID NO: 1319539 - RNA, 19 nt, Homo sapiens
gaagggauaccaauaacua

SEQ ID NO: 1319540 - RNA, 19 nt, Homo sapiens
caacagagcccucgacgaa

SEQ ID NO: 1319541 - RNA, 19 nt, Homo sapiens
gcaacaagagugaaacuuu

SEQ ID NO: 1319542 - RNA, 19 nt, Homo sapiens
guaaacugauccaaagaaa

SEQ ID NO: 1319543 - RNA, 19 nt, Homo sapiens
ggaauauacuucguucuga

SEQ ID NO: 1319544 - RNA, 19 nt, Homo sapiens
cagaguaacuauauuggaa

SEQ ID NO: 1319545 - RNA, 19 nt, Homo sapiens
gaacaugaucgagguuaua

SEQ ID NO: 1319546 - RNA, 19 nt, Homo sapiens
gggaagauaugaaaggaau

SEQ ID NO: 1319547 - RNA, 19 nt, Homo sapiens
ggauaucugucuaauuugu

SEQ ID NO: 1319548 - RNA, 19 nt, Homo sapiens
uaugaaugcuguucuugua

SEQ ID NO: 1319549 - RNA, 19 nt, Homo sapiens
ccauucuucuggauuauua

SEQ ID NO: 1319550 - RNA, 19 nt, Homo sapiens
gaagagaggcaucggauuc

SEQ ID NO: 1319551 - RNA, 19 nt, Homo sapiens
ucauuugucugccuguuua

SEQ ID NO: 1319552 - RNA, 19 nt, Homo sapiens
ucaaggacaucuccaguau

SEQ ID NO: 1319553 - RNA, 19 nt, Homo sapiens
ucgcauacguugcauauau

SEQ ID NO: 1319554 - RNA, 19 nt, Homo sapiens
gaaauugauugcccauucu

SEQ ID NO: 1319555 - RNA, 19 nt, Homo sapiens
ggacuaugcccaugacuau

SEQ ID NO: 1319556 - RNA, 19 nt, Homo sapiens
gaauagugcgcagaaguua

SEQ ID NO: 1319557 - RNA, 19 nt, Homo sapiens
gaccucaaguguaaacuga

SEQ ID NO: 1319558 - RNA, 19 nt, Homo sapiens
ugacggaaaucgugaagga

SEQ ID NO: 1319559 - RNA, 19 nt, Homo sapiens
caacaacaacaacaacaaa

SEQ ID NO: 1319560 - RNA, 19 nt, Homo sapiens
ugaaugcuguucuuguaaa

SEQ ID NO: 1319561 - RNA, 19 nt, Homo sapiens
gagaucaauuccauucuuc

SEQ ID NO: 1319562 - RNA, 19 nt, Homo sapiens
caaacgagcccaaauccuu

SEQ ID NO: 1319563 - RNA, 19 nt, Homo sapiens
ggagagaucaauuccauuc

SEQ ID NO: 1319564 - RNA, 19 nt, Homo sapiens
ucaccauguuugcugauua

SEQ ID NO: 1319565 - RNA, 19 nt, Homo sapiens
ggcaucggauucucaauga

SEQ ID NO: 1319566 - RNA, 19 nt, Homo sapiens
gacgaagggauaccaauaa

SEQ ID NO: 1319567 - RNA, 19 nt, Homo sapiens
cgacgaagggauaccaaua

SEQ ID NO: 1319568 - RNA, 19 nt, Homo sapiens
cauguuugcugauuauaga

SEQ ID NO: 1319569 - RNA, 19 nt, Homo sapiens
acaaguguguggugaggua

SEQ ID NO: 1319570 - RNA, 19 nt, Homo sapiens
gcauacguugcauauauua

SEQ ID NO: 1319571 - RNA, 19 nt, Homo sapiens
ucacgccacugcauucuau

SEQ ID NO: 1319572 - RNA, 19 nt, Homo sapiens
gaucgagguuauaggaaau

SEQ ID NO: 1319573 - RNA, 19 nt, Homo sapiens
aaacuaaucaugccuuaug

SEQ ID NO: 1319574 - RNA, 19 nt, Homo sapiens
gaagauaugaaaggaauuc

SEQ ID NO: 1319575 - RNA, 19 nt, Homo sapiens
aaggacaucuccaguauca

SEQ ID NO: 1319576 - RNA, 19 nt, Homo sapiens
gcuauguauucccaacuuu

SEQ ID NO: 1319577 - RNA, 19 nt, Homo sapiens
ggcaacagauggagaccuu

SEQ ID NO: 1319578 - RNA, 19 nt, Homo sapiens
ugugguggcucauauguau

SEQ ID NO: 1319579 - RNA, 19 nt, Homo sapiens
gcggguggaucaucugaga

SEQ ID NO: 1319580 - RNA, 19 nt, Homo sapiens
gagaugugacucuguuuga

SEQ ID NO: 1319581 - RNA, 19 nt, Homo sapiens
ggaucagguucggaauaua

SEQ ID NO: 1319582 - RNA, 19 nt, Homo sapiens
gagaacaugaucgagguua

SEQ ID NO: 1319583 - RNA, 19 nt, Homo sapiens
cugaugaccuacugaagaa

SEQ ID NO: 1319584 - RNA, 19 nt, Homo sapiens
ccaaauccuuguagcagau

SEQ ID NO: 1319585 - RNA, 19 nt, Homo sapiens
caaaacuaaucaugccuua

SEQ ID NO: 1319586 - RNA, 19 nt, Homo sapiens
ugaucgagguuauaggaaa

SEQ ID NO: 1319587 - RNA, 19 nt, Homo sapiens
cagaugugguggcucauau

SEQ ID NO: 1319588 - RNA, 19 nt, Homo sapiens
gaaaccccaucucuacuaa

SEQ ID NO: 1319589 - RNA, 19 nt, Homo sapiens
ggaguguauuggaaggaaa

SEQ ID NO: 1319590 - RNA, 19 nt, Homo sapiens
gaggcgagauuaggccauu

SEQ ID NO: 1319591 - RNA, 19 nt, Homo sapiens
gagaccaccuggccaacau

SEQ ID NO: 1319592 - RNA, 19 nt, Homo sapiens
gcaagagguggaaaucaga

SEQ ID NO: 1319593 - RNA, 19 nt, Homo sapiens
agagaucaauuccauucuu

SEQ ID NO: 1319594 - RNA, 19 nt, Homo sapiens
gacauguaguugacggaaa

SEQ ID NO: 1319595 - RNA, 19 nt, Homo sapiens
gagugaaacuuugucucaa

SEQ ID NO: 1319596 - RNA, 19 nt, Homo sapiens
guacaguuuugcuuugaua

SEQ ID NO: 1319597 - RNA, 19 nt, Homo sapiens
ggcaagagguggaaaucag

SEQ ID NO: 1319598 - RNA, 19 nt, Homo sapiens
gcccugaaauacucugaug

SEQ ID NO: 1319599 - RNA, 19 nt, Homo sapiens
caccauguuugcugauuau

SEQ ID NO: 1319600 - RNA, 19 nt, Homo sapiens
ugaggaggguggauuucuu

SEQ ID NO: 1319601 - RNA, 19 nt, Homo sapiens
uuccaugccuuuaguagaa

SEQ ID NO: 1319602 - RNA, 19 nt, Homo sapiens
gagaauagugcgcagaagu

SEQ ID NO: 1319603 - RNA, 19 nt, Homo sapiens
ggccaaggcaggaggauug

SEQ ID NO: 1319604 - RNA, 19 nt, Homo sapiens
caauaacuagugccucgua

SEQ ID NO: 1319605 - RNA, 19 nt, Homo sapiens
caucggauucucaaugaaa

SEQ ID NO: 1319606 - RNA, 19 nt, Homo sapiens
cuaaucaugccuuauguga

SEQ ID NO: 1319607 - RNA, 19 nt, Homo sapiens
gaucagguucggaauauac

SEQ ID NO: 1319608 - RNA, 19 nt, Homo sapiens
gcucuguaaucccaaauac

SEQ ID NO: 1319609 - RNA, 19 nt, Homo sapiens
gauugcccauucucacuug

SEQ ID NO: 1319610 - RNA, 19 nt, Homo sapiens
gguuauaggaaauugauug

SEQ ID NO: 1319611 - RNA, 19 nt, Homo sapiens
aaucaugccuuaugugacu

SEQ ID NO: 1319612 - RNA, 19 nt, Homo sapiens
cgcauacguugcauauauu

SEQ ID NO: 1319613 - RNA, 19 nt, Homo sapiens
uggaucagguucggaauau

SEQ ID NO: 1319614 - RNA, 19 nt, Homo sapiens
gaggaggguggauuucuug

SEQ ID NO: 1319615 - RNA, 19 nt, Homo sapiens
caacugcguccgagaaagu

SEQ ID NO: 1319616 - RNA, 19 nt, Homo sapiens
cgugaaggaacuuuaauau

SEQ ID NO: 1319617 - RNA, 19 nt, Homo sapiens
acauguaguugacggaaau

SEQ ID NO: 1319618 - RNA, 19 nt, Homo sapiens
gcaucggauucucaaugaa

SEQ ID NO: 1319619 - RNA, 19 nt, Homo sapiens
gcuuugauauuuagagaac

SEQ ID NO: 1319620 - RNA, 19 nt, Homo sapiens
gaaaucgugaaggaacuuu

SEQ ID NO: 1319621 - RNA, 19 nt, Homo sapiens
gaccagccuaggcaacaua

SEQ ID NO: 1319622 - RNA, 19 nt, Homo sapiens
uaugaaaggaauuccguuu

SEQ ID NO: 1319623 - RNA, 19 nt, Homo sapiens
cuauguauucccaacuuua

SEQ ID NO: 1319624 - RNA, 19 nt, Homo sapiens
caacagauggagaccuugu

SEQ ID NO: 1319625 - RNA, 19 nt, Homo sapiens
gggacuaugcccaugacua

SEQ ID NO: 1319626 - RNA, 19 nt, Homo sapiens
cgacagugacccuggauca

SEQ ID NO: 1319627 - RNA, 19 nt, Homo sapiens
caauuuaggauaucugucu

SEQ ID NO: 1319628 - RNA, 19 nt, Homo sapiens
uggcucauauguauaaucu

SEQ ID NO: 1319629 - RNA, 19 nt, Homo sapiens
gagguuauaggaaauugau

SEQ ID NO: 1319630 - RNA, 19 nt, Homo sapiens
aguguaaacugauccaaag

SEQ ID NO: 1319631 - RNA, 19 nt, Homo sapiens
caucgcauacguugcauau

SEQ ID NO: 1319632 - RNA, 19 nt, Homo sapiens
uagggaagauaugaaagga

SEQ ID NO: 1319633 - RNA, 19 nt, Homo sapiens
agaauagugcgcagaaguu

SEQ ID NO: 1319634 - RNA, 19 nt, Homo sapiens
guacaaaucuucugaguug

SEQ ID NO: 1319635 - RNA, 19 nt, Homo sapiens
gagaagagcuugcaguuug

SEQ ID NO: 1319636 - RNA, 19 nt, Homo sapiens
gaagaagaguggaaugcuu

SEQ ID NO: 1319637 - RNA, 19 nt, Homo sapiens
ccacucaucuguccuguau

SEQ ID NO: 1319638 - RNA, 19 nt, Homo sapiens
ggacucacaucauucuaug

SEQ ID NO: 1319639 - RNA, 19 nt, Homo sapiens
gaagcuucgugccuguuua

SEQ ID NO: 1319640 - RNA, 19 nt, Homo sapiens
caagagcaguccaucauca

SEQ ID NO: 1319641 - RNA, 19 nt, Homo sapiens
uggaggagauaaaccaauu

SEQ ID NO: 1319642 - RNA, 19 nt, Homo sapiens
ggaaugcuuugcagucagu

SEQ ID NO: 1319643 - RNA, 19 nt, Homo sapiens
agagaugccuggagagaau

SEQ ID NO: 1319644 - RNA, 19 nt, Homo sapiens
gacaacucauucccucuga

SEQ ID NO: 1319645 - RNA, 19 nt, Homo sapiens
ugagcugucuggccuguga

SEQ ID NO: 1319646 - RNA, 19 nt, Homo sapiens
agaagagcuugcaguuuga

SEQ ID NO: 1319647 - RNA, 19 nt, Homo sapiens
uggaggagcugauagacau

SEQ ID NO: 1319648 - RNA, 19 nt, Homo sapiens
gcagagaugccuggagaga

SEQ ID NO: 1319649 - RNA, 19 nt, Homo sapiens
uaaaugagaacacaaacca

SEQ ID NO: 1319650 - RNA, 19 nt, Homo sapiens
ugaggagccuuguacauac

SEQ ID NO: 1319651 - RNA, 19 nt, Homo sapiens
gaauuguccagaagacuug

SEQ ID NO: 1319652 - RNA, 19 nt, Homo sapiens
ggagaauuguccagaagac

SEQ ID NO: 1319653 - RNA, 19 nt, Homo sapiens
ggaggagauaaaccaauuu

SEQ ID NO: 1319654 - RNA, 19 nt, Homo sapiens
cugaggagccuuguacaua

SEQ ID NO: 1319655 - RNA, 19 nt, Homo sapiens
uucaagaggugauggaaga

SEQ ID NO: 1319656 - RNA, 19 nt, Homo sapiens
gggacaggcuccuaaacag

SEQ ID NO: 1319657 - RNA, 19 nt, Homo sapiens
acucaucuguccuguaugu

SEQ ID NO: 1319658 - RNA, 19 nt, Homo sapiens
aacaggagcugaucaacca

SEQ ID NO: 1319659 - RNA, 19 nt, Homo sapiens
caaaucuucugaguugaca

SEQ ID NO: 1319660 - RNA, 19 nt, Homo sapiens
gagcuugcaguuugaugaa

SEQ ID NO: 1319661 - RNA, 19 nt, Homo sapiens
aagaagaguggaaugcuuu

SEQ ID NO: 1319662 - RNA, 19 nt, Homo sapiens
gcagugggccagggaauuc

SEQ ID NO: 1319663 - RNA, 19 nt, Homo sapiens
aaugagaacacaaaccaaa

SEQ ID NO: 1319664 - RNA, 19 nt, Homo sapiens
uagaggguaguauaaauga

SEQ ID NO: 1319665 - RNA, 19 nt, Homo sapiens
guggaaugcuuugcaguca

SEQ ID NO: 1319666 - RNA, 19 nt, Homo sapiens
gggcugugauccucuagag

SEQ ID NO: 1319667 - RNA, 19 nt, Homo sapiens
ugcagucaguggagaauug

SEQ ID NO: 1319668 - RNA, 19 nt, Homo sapiens
aagaggugauggaagaaga

SEQ ID NO: 1319669 - RNA, 19 nt, Homo sapiens
gcaguuugaugaaaagugu

SEQ ID NO: 1319670 - RNA, 19 nt, Homo sapiens
aaacugccuuggaggagau

SEQ ID NO: 1319671 - RNA, 19 nt, Homo sapiens
ugagaagagcuugcaguuu

SEQ ID NO: 1319672 - RNA, 19 nt, Homo sapiens
uggcugugcuggaggaaau

SEQ ID NO: 1319673 - RNA, 19 nt, Homo sapiens
guacauacaagccuuuuau

SEQ ID NO: 1319674 - RNA, 19 nt, Homo sapiens
guauguacaaaucuucuga

SEQ ID NO: 1319675 - RNA, 19 nt, Homo sapiens
ggaggcaaacccacucauc

SEQ ID NO: 1319676 - RNA, 19 nt, Homo sapiens
gaggcaaacccacucaucu

SEQ ID NO: 1319677 - RNA, 19 nt, Homo sapiens
aaagacaaacugccuugga

SEQ ID NO: 1319678 - RNA, 19 nt, Homo sapiens
gagccagcuuggacucaca

SEQ ID NO: 1319679 - RNA, 19 nt, Homo sapiens
ggcaaacccacucaucugu

SEQ ID NO: 1319680 - RNA, 19 nt, Homo sapiens
gaaaagugucucagcauca

SEQ ID NO: 1319681 - RNA, 19 nt, Homo sapiens
gcgaguaugagaagagcuu

SEQ ID NO: 1319682 - RNA, 19 nt, Homo sapiens
ugucuggccugugauacuu

SEQ ID NO: 1319683 - RNA, 19 nt, Homo sapiens
ugugauacuugggcuguga

SEQ ID NO: 1319684 - RNA, 19 nt, Homo sapiens
caucagcgaguaugagaag

SEQ ID NO: 1319685 - RNA, 19 nt, Homo sapiens
uuagaggguaguauaaaug

SEQ ID NO: 1319686 - RNA, 19 nt, Homo sapiens
acaggcuccuaaacaggua

SEQ ID NO: 1319687 - RNA, 19 nt, Homo sapiens
gaggagauaaaccaauuuu

SEQ ID NO: 1319688 - RNA, 19 nt, Homo sapiens
uaguauaaaugagcacagu

SEQ ID NO: 1319689 - RNA, 19 nt, Homo sapiens
agaauuguccagaagacuu

SEQ ID NO: 1319690 - RNA, 19 nt, Homo sapiens
gauggaagaagaguggaau

SEQ ID NO: 1319691 - RNA, 19 nt, Homo sapiens
ggaagaagaguggaaugcu

SEQ ID NO: 1319692 - RNA, 19 nt, Homo sapiens
acagcuuucuaguucaaga

SEQ ID NO: 1319693 - RNA, 19 nt, Homo sapiens
gaagagcuugcaguuugau

SEQ ID NO: 1319694 - RNA, 19 nt, Homo sapiens
cgggacaggcuccuaaaca

SEQ ID NO: 1319695 - RNA, 19 nt, Homo sapiens
uaucaggacuuccaauaaa

SEQ ID NO: 1319696 - RNA, 19 nt, Homo sapiens
gcaaaggucucgagaugca

SEQ ID NO: 1319697 - RNA, 19 nt, Homo sapiens
gauaucaggacuuccaaua

SEQ ID NO: 1319698 - RNA, 19 nt, Homo sapiens
ggucaccgcucgcuacugu

SEQ ID NO: 1319699 - RNA, 19 nt, Homo sapiens
cggcaaaggucucgagaug

SEQ ID NO: 1319700 - RNA, 19 nt, Homo sapiens
ggacuuccaauaaauaaag

SEQ ID NO: 1319701 - RNA, 19 nt, Homo sapiens
ucaggacuuccaauaaaua

SEQ ID NO: 1319702 - RNA, 19 nt, Homo sapiens
gacugucacuaccuuaaga

SEQ ID NO: 1319703 - RNA, 19 nt, Homo sapiens
ggagcaguauggccagugu

SEQ ID NO: 1319704 - RNA, 19 nt, Homo sapiens
caggaaaacuggacaugaa

SEQ ID NO: 1319705 - RNA, 19 nt, Homo sapiens
ucaauuggcuaccggaaaa

SEQ ID NO: 1319706 - RNA, 19 nt, Homo sapiens
gggcaacugugcagagcau

SEQ ID NO: 1319707 - RNA, 19 nt, Homo sapiens
gaaaacuggacaugaauga

SEQ ID NO: 1319708 - RNA, 19 nt, Homo sapiens
caggacuuccaauaaauaa

SEQ ID NO: 1319709 - RNA, 19 nt, Homo sapiens
gcaacugugcagagcauau

SEQ ID NO: 1319710 - RNA, 19 nt, Homo sapiens
gcacauccucccacccaau

SEQ ID NO: 1319711 - RNA, 19 nt, Homo sapiens
gggacugucacuaccuuaa

SEQ ID NO: 1319712 - RNA, 19 nt, Homo sapiens
gcgggacugucacuaccuu

SEQ ID NO: 1319713 - RNA, 19 nt, Homo sapiens
ugacaaccgauaccggaaa

SEQ ID NO: 1319714 - RNA, 19 nt, Homo sapiens
caacugugcagagcauaug

SEQ ID NO: 1319715 - RNA, 19 nt, Homo sapiens
gucacuaccuuaagaugag

SEQ ID NO: 1319716 - RNA, 19 nt, Homo sapiens
ggacugucacuaccuuaag

SEQ ID NO: 1319717 - RNA, 19 nt, Homo sapiens
gacaaccgauaccggaaaa

SEQ ID NO: 1319718 - RNA, 19 nt, Homo sapiens
auaaagacucuguauacug

SEQ ID NO: 1319719 - RNA, 19 nt, Homo sapiens
uaccuuaagaugagcauug

SEQ ID NO: 1319720 - RNA, 19 nt, Homo sapiens
gcagcgggacugucacuac

SEQ ID NO: 1319721 - RNA, 19 nt, Homo sapiens
auaucaggacuuccaauaa

SEQ ID NO: 1319722 - RNA, 19 nt, Homo sapiens
ugucacuaccuuaagauga

SEQ ID NO: 1319723 - RNA, 19 nt, Homo sapiens
aaacuggacaugaaugacu

SEQ ID NO: 1319724 - RNA, 19 nt, Homo sapiens
ggacacgccuuuccugaca

SEQ ID NO: 1319725 - RNA, 19 nt, Homo sapiens
ugacagaucagaccuauug

SEQ ID NO: 1319726 - RNA, 19 nt, Homo sapiens
uaacuaugcucugugguuu

SEQ ID NO: 1319727 - RNA, 19 nt, Homo sapiens
acaaggugcugaccauauu

SEQ ID NO: 1319728 - RNA, 19 nt, Homo sapiens
gauggcaacucugaucuga

SEQ ID NO: 1319729 - RNA, 19 nt, Homo sapiens
ccacagauccuuaccaaca

SEQ ID NO: 1319730 - RNA, 19 nt, Homo sapiens
aaacacaccuucaccuuac

SEQ ID NO: 1319731 - RNA, 19 nt, Homo sapiens
gaagauggcaacucugauc

SEQ ID NO: 1319732 - RNA, 19 nt, Homo sapiens
gcacgugcauuucaguuuu

SEQ ID NO: 1319733 - RNA, 19 nt, Homo sapiens
ccagagaacucagauugca

SEQ ID NO: 1319734 - RNA, 19 nt, Homo sapiens
gugcugaccauauuaaaug

SEQ ID NO: 1319735 - RNA, 19 nt, Homo sapiens
cagaucagaccuauuguga

SEQ ID NO: 1319736 - RNA, 19 nt, Homo sapiens
gcugggcuguggucucuga

SEQ ID NO: 1319737 - RNA, 19 nt, Homo sapiens
guccgaagcacgugcauuu

SEQ ID NO: 1319738 - RNA, 19 nt, Homo sapiens
caaggugcugaccauauua

SEQ ID NO: 1319739 - RNA, 19 nt, Homo sapiens
caugacagaucagaccuau

SEQ ID NO: 1319740 - RNA, 19 nt, Homo sapiens
ucuuauacguccacucuug

SEQ ID NO: 1319741 - RNA, 19 nt, Homo sapiens
gacuggcccugcuccugua

SEQ ID NO: 1319742 - RNA, 19 nt, Homo sapiens
cacagauccuuaccaacaa

SEQ ID NO: 1319743 - RNA, 19 nt, Homo sapiens
gacggacccuuucauugca

SEQ ID NO: 1319744 - RNA, 19 nt, Homo sapiens
cugcguaaguuccacauca

SEQ ID NO: 1319745 - RNA, 19 nt, Homo sapiens
gccaugggcgcuugaguga

SEQ ID NO: 1319746 - RNA, 19 nt, Homo sapiens
ggccucaccugccacucaa

SEQ ID NO: 1319747 - RNA, 19 nt, Homo sapiens
cacaggcagugcagauguu

SEQ ID NO: 1319748 - RNA, 19 nt, Homo sapiens
ugacggacccuuucauugc

SEQ ID NO: 1319749 - RNA, 19 nt, Homo sapiens
ggcccugcccguugacuaa

SEQ ID NO: 1319750 - RNA, 19 nt, Homo sapiens
cuaacuaugcucugugguu

SEQ ID NO: 1319751 - RNA, 19 nt, Homo sapiens
cgaagcacgugcauuucag

SEQ ID NO: 1319752 - RNA, 19 nt, Homo sapiens
uccuccagcugaaccguua

SEQ ID NO: 1319753 - RNA, 19 nt, Homo sapiens
gggaucccuucaugucugu

SEQ ID NO: 1319754 - RNA, 19 nt, Homo sapiens
caucuuauacguccacucu

SEQ ID NO: 1319755 - RNA, 19 nt, Homo sapiens
ccacaucaccaaccaugca

SEQ ID NO: 1319756 - RNA, 19 nt, Homo sapiens
guaaguuccacaucaccaa

SEQ ID NO: 1319757 - RNA, 19 nt, Homo sapiens
aaaacacaccuucaccuua

SEQ ID NO: 1319758 - RNA, 19 nt, Homo sapiens
acguguggguguuuccaua

SEQ ID NO: 1319759 - RNA, 19 nt, Homo sapiens
cugaccauauuaaauguuc

SEQ ID NO: 1319760 - RNA, 19 nt, Homo sapiens
ccacggggaucccuucaug

SEQ ID NO: 1319761 - RNA, 19 nt, Homo sapiens
acccacagauccuuaccaa

SEQ ID NO: 1319762 - RNA, 19 nt, Homo sapiens
ggugcugaccauauuaaau

SEQ ID NO: 1319763 - RNA, 19 nt, Homo sapiens
gcggcgagcugaguaacag

SEQ ID NO: 1319764 - RNA, 19 nt, Homo sapiens
cccagacugugcauaguuc

SEQ ID NO: 1319765 - RNA, 19 nt, Homo sapiens
uuagacaacaggacagaga

SEQ ID NO: 1319766 - RNA, 19 nt, Homo sapiens
ccgaagcacgugcauuuca

SEQ ID NO: 1319767 - RNA, 19 nt, Homo sapiens
ucaccaaccaugcaugcuu

SEQ ID NO: 1319768 - RNA, 19 nt, Homo sapiens
uacaaggugcugaccauau

SEQ ID NO: 1319769 - RNA, 19 nt, Homo sapiens
ggggacugcugcuucuuuu

SEQ ID NO: 1319770 - RNA, 19 nt, Homo sapiens
gacccagacugugcauagu

SEQ ID NO: 1319771 - RNA, 19 nt, Homo sapiens
gaagcacgugcauuucagu

SEQ ID NO: 1319772 - RNA, 19 nt, Homo sapiens
ggucccagcuggaauuacc

SEQ ID NO: 1319773 - RNA, 19 nt, Homo sapiens
uacugucccuuggcccuua

SEQ ID NO: 1319774 - RNA, 19 nt, Homo sapiens
gggacugccaggaguucua

SEQ ID NO: 1319775 - RNA, 19 nt, Homo sapiens
uggccuuccuggcagauga

SEQ ID NO: 1319776 - RNA, 19 nt, Homo sapiens
uugaagauggcaacucuga

SEQ ID NO: 1319777 - RNA, 19 nt, Homo sapiens
cagcauggggcaucuuaua

SEQ ID NO: 1319778 - RNA, 19 nt, Homo sapiens
ggucucugucucccacuuu

SEQ ID NO: 1319779 - RNA, 19 nt, Homo sapiens
cagagcggcgagcugagua

SEQ ID NO: 1319780 - RNA, 19 nt, Homo sapiens
guggacagcaaccuuguuc

SEQ ID NO: 1319781 - RNA, 19 nt, Homo sapiens
cuaccgagcccuguauauc

SEQ ID NO: 1319782 - RNA, 19 nt, Homo sapiens
gaagggugauuauguauua

SEQ ID NO: 1319783 - RNA, 19 nt, Homo sapiens
gcagaaagaugcccgauuu

SEQ ID NO: 1319784 - RNA, 19 nt, Homo sapiens
gaugaagggugauuaugua

SEQ ID NO: 1319785 - RNA, 19 nt, Homo sapiens
ccaaagugguucagaauga

SEQ ID NO: 1319786 - RNA, 19 nt, Homo sapiens
ggaaugagaaucaauguug

SEQ ID NO: 1319787 - RNA, 19 nt, Homo sapiens
gcagguaucuucugguugu

SEQ ID NO: 1319788 - RNA, 19 nt, Homo sapiens
gcucuucucucuacguuaa

SEQ ID NO: 1319789 - RNA, 19 nt, Homo sapiens
gcaccaagaugacugugaa

SEQ ID NO: 1319790 - RNA, 19 nt, Homo sapiens
gagaaucaauguugucaau

SEQ ID NO: 1319791 - RNA, 19 nt, Homo sapiens
gaauuuauaugaccuggau

SEQ ID NO: 1319792 - RNA, 19 nt, Homo sapiens
uauaugaccuggaugaaga

SEQ ID NO: 1319793 - RNA, 19 nt, Homo sapiens
gagaagaucagcuugaaga

SEQ ID NO: 1319794 - RNA, 19 nt, Homo sapiens
caagaugacugugaauaau

SEQ ID NO: 1319795 - RNA, 19 nt, Homo sapiens
ugaagaugaugaugguaua

SEQ ID NO: 1319796 - RNA, 19 nt, Homo sapiens
ggguagggaugguaaauau

SEQ ID NO: 1319797 - RNA, 19 nt, Homo sapiens
ggacacuggugaacaagga

SEQ ID NO: 1319798 - RNA, 19 nt, Homo sapiens
ucacagaguuucauugagu

SEQ ID NO: 1319799 - RNA, 19 nt, Homo sapiens
ggaaaugguacacugaauu

SEQ ID NO: 1319800 - RNA, 19 nt, Homo sapiens
ggaauguuaucaccucaga

SEQ ID NO: 1319801 - RNA, 19 nt, Homo sapiens
caagagcucccaagauuug

SEQ ID NO: 1319802 - RNA, 19 nt, Homo sapiens
gaaaugguacacugaauuc

SEQ ID NO: 1319803 - RNA, 19 nt, Homo sapiens
cucaagagcucccaagauu

SEQ ID NO: 1319804 - RNA, 19 nt, Homo sapiens
ccagagagauguugaacuc

SEQ ID NO: 1319805 - RNA, 19 nt, Homo sapiens
aggcaaagcuuaugaccaa

SEQ ID NO: 1319806 - RNA, 19 nt, Homo sapiens
ccaagaugacugugaauaa

SEQ ID NO: 1319807 - RNA, 19 nt, Homo sapiens
gaaugagaaucaauguugu

SEQ ID NO: 1319808 - RNA, 19 nt, Homo sapiens
gaauggaagaggucaguuu

SEQ ID NO: 1319809 - RNA, 19 nt, Homo sapiens
guuuggagcuuauuugaau

SEQ ID NO: 1319810 - RNA, 19 nt, Homo sapiens
gcugauuucuuaucuggaa

SEQ ID NO: 1319811 - RNA, 19 nt, Homo sapiens
ggaugaagaugaugauggu

SEQ ID NO: 1319812 - RNA, 19 nt, Homo sapiens
gggagaagaucagcuugaa

SEQ ID NO: 1319813 - RNA, 19 nt, Homo sapiens
gcagaagauuggccucuca

SEQ ID NO: 1319814 - RNA, 19 nt, Homo sapiens
gccccaagcugauuucuua

SEQ ID NO: 1319815 - RNA, 19 nt, Homo sapiens
ccacgcagcccacagaauu

SEQ ID NO: 1319816 - RNA, 19 nt, Homo sapiens
guaaauauccucccugcau

SEQ ID NO: 1319817 - RNA, 19 nt, Homo sapiens
ggaagagucuaucuaagcu

SEQ ID NO: 1319818 - RNA, 19 nt, Homo sapiens
uagcuuccguuccuacuaa

SEQ ID NO: 1319819 - RNA, 19 nt, Homo sapiens
gcagacaguugggacgaaa

SEQ ID NO: 1319820 - RNA, 19 nt, Homo sapiens
gaaggacccaggauuugaa

SEQ ID NO: 1319821 - RNA, 19 nt, Homo sapiens
gcgaaaggacggcuuaaug

SEQ ID NO: 1319822 - RNA, 19 nt, Homo sapiens
guuaacguuuccuguagua

SEQ ID NO: 1319823 - RNA, 19 nt, Homo sapiens
gggagaagcuuuugcagaa

SEQ ID NO: 1319824 - RNA, 19 nt, Homo sapiens
ggaaggacccaggauuuga

SEQ ID NO: 1319825 - RNA, 19 nt, Homo sapiens
cuacuaaacagaugaaguu

SEQ ID NO: 1319826 - RNA, 19 nt, Homo sapiens
ggacaucucccuggacgaa

SEQ ID NO: 1319827 - RNA, 19 nt, Homo sapiens
uagcggaggugguguuugu

SEQ ID NO: 1319828 - RNA, 19 nt, Homo sapiens
ugacagcccaucaaugaaa

SEQ ID NO: 1319829 - RNA, 19 nt, Homo sapiens
ggacccgccuuucuguguu

SEQ ID NO: 1319830 - RNA, 19 nt, Homo sapiens
ggagcaagauggcggacau

SEQ ID NO: 1319831 - RNA, 19 nt, Homo sapiens
gcaggaaggacccaggauu

SEQ ID NO: 1319832 - RNA, 19 nt, Homo sapiens
guuccuggcucuccauuuc

SEQ ID NO: 1319833 - RNA, 19 nt, Homo sapiens
guuccaagcuuuccauguc

SEQ ID NO: 1319834 - RNA, 19 nt, Homo sapiens
gaagauuggccucucagau

SEQ ID NO: 1319835 - RNA, 19 nt, Homo sapiens
ggaggacauuguugagcuu

SEQ ID NO: 1319836 - RNA, 19 nt, Homo sapiens
aaagaugcccgauuucgaa

SEQ ID NO: 1319837 - RNA, 19 nt, Homo sapiens
ucuauaagcagucaucuug

SEQ ID NO: 1319838 - RNA, 19 nt, Homo sapiens
caggaaggacccaggauuu

SEQ ID NO: 1319839 - RNA, 19 nt, Homo sapiens
uggaagaggucaguuuguu

SEQ ID NO: 1319840 - RNA, 19 nt, Homo sapiens
guuagcagcuggaagacau

SEQ ID NO: 1319841 - RNA, 19 nt, Homo sapiens
gguguccgaucucgaguug

SEQ ID NO: 1319842 - RNA, 19 nt, Homo sapiens
gcaaagcuuaugaccaaug

SEQ ID NO: 1319843 - RNA, 19 nt, Homo sapiens
gaacaaaagccuugaccaa

SEQ ID NO: 1319844 - RNA, 19 nt, Homo sapiens
caaagugguucagaaugau

SEQ ID NO: 1319845 - RNA, 19 nt, Homo sapiens
aagcagguaucuucugguu

SEQ ID NO: 1319846 - RNA, 19 nt, Homo sapiens
ucaccucgccuggcacuua

SEQ ID NO: 1319847 - RNA, 19 nt, Homo sapiens
gcaggucucaggccucuug

SEQ ID NO: 1319848 - RNA, 19 nt, Homo sapiens
ucagaaugaugcauacaca

SEQ ID NO: 1319849 - RNA, 19 nt, Homo sapiens
ccacauggcugggcuaagc

SEQ ID NO: 1319850 - RNA, 19 nt, Homo sapiens
uggacgaacucaucaggaa

SEQ ID NO: 1319851 - RNA, 19 nt, Homo sapiens
agacauuccucccacacuu

SEQ ID NO: 1319852 - RNA, 19 nt, Homo sapiens
ccaagcugauuucuuaucu

SEQ ID NO: 1319853 - RNA, 19 nt, Homo sapiens
uguaguauguuucuucauc

SEQ ID NO: 1319854 - RNA, 19 nt, Homo sapiens
ggaggugguguuugugaaa

SEQ ID NO: 1319855 - RNA, 19 nt, Homo sapiens
ggaagaggucaguuuguuc

SEQ ID NO: 1319856 - RNA, 19 nt, Homo sapiens
caaagcuuaugaccaaugg

SEQ ID NO: 1319857 - RNA, 19 nt, Homo sapiens
ggccaaacagaauuuauau

SEQ ID NO: 1319858 - RNA, 19 nt, Homo sapiens
gaaggggcauuaagagaug

SEQ ID NO: 1319859 - RNA, 19 nt, Homo sapiens
ccacuugcaguucuuuaaa

SEQ ID NO: 1319860 - RNA, 19 nt, Homo sapiens
gaggaggguggcucuguuu

SEQ ID NO: 1319861 - RNA, 19 nt, Homo sapiens
gggugcagacuucucguua

SEQ ID NO: 1319862 - RNA, 19 nt, Homo sapiens
gagucuaucuaagcucuug

SEQ ID NO: 1319863 - RNA, 19 nt, Homo sapiens
ggaaggguugccagggaua

SEQ ID NO: 1319864 - RNA, 19 nt, Homo sapiens
agugacagcccaucaauga

SEQ ID NO: 1319865 - RNA, 19 nt, Homo sapiens
ugaccuggaugaagaugau

SEQ ID NO: 1319866 - RNA, 19 nt, Homo sapiens
ccacuucccaugccucuau

SEQ ID NO: 1319867 - RNA, 19 nt, Homo sapiens
ggagcuuauuugaauggaa

SEQ ID NO: 1319868 - RNA, 19 nt, Homo sapiens
cagcauaggcgcagacagu

SEQ ID NO: 1319869 - RNA, 19 nt, Homo sapiens
caccucgccuggcacuuaa

SEQ ID NO: 1319870 - RNA, 19 nt, Homo sapiens
ucaagagcucccaagauuu

SEQ ID NO: 1319871 - RNA, 19 nt, Homo sapiens
agaguucaccuuucccuuu

SEQ ID NO: 1319872 - RNA, 19 nt, Homo sapiens
guaguauguuucuucaucu

SEQ ID NO: 1319873 - RNA, 19 nt, Homo sapiens
gaaggguugccagggauaa

SEQ ID NO: 1319874 - RNA, 19 nt, Homo sapiens
ccacagaauucaaaaucaa

SEQ ID NO: 1319875 - RNA, 19 nt, Homo sapiens
gcucucccuuccucuauuc

SEQ ID NO: 1319876 - RNA, 19 nt, Homo sapiens
gacauuccucccacacuuu

SEQ ID NO: 1319877 - RNA, 19 nt, Homo sapiens
ugaaugaccaggccagugu

SEQ ID NO: 1319878 - RNA, 19 nt, Homo sapiens
gcaggaugccagagagaug

SEQ ID NO: 1319879 - RNA, 19 nt, Homo sapiens
uaacguuuccuguaguaug

SEQ ID NO: 1319880 - RNA, 19 nt, Homo sapiens
ucacugaggaggacauugu

SEQ ID NO: 1319881 - RNA, 19 nt, Homo sapiens
ggcccucccucucaccaaa

SEQ ID NO: 1319882 - RNA, 19 nt, Homo sapiens
gcaccuggauugguaauua

SEQ ID NO: 1319883 - RNA, 19 nt, Homo sapiens
ccaaacaucugauuuaaag

SEQ ID NO: 1319884 - RNA, 19 nt, Homo sapiens
gagagacaauccugacuuu

SEQ ID NO: 1319885 - RNA, 19 nt, Homo sapiens
ggacauugaucuaaaggau

SEQ ID NO: 1319886 - RNA, 19 nt, Homo sapiens
caaaggagcaagagguaua

SEQ ID NO: 1319887 - RNA, 19 nt, Homo sapiens
ggauauggcauucauuaaa

SEQ ID NO: 1319888 - RNA, 19 nt, Homo sapiens
cuacagugcugcuucauug

SEQ ID NO: 1319889 - RNA, 19 nt, Homo sapiens
caagagguauaauggauau

SEQ ID NO: 1319890 - RNA, 19 nt, Homo sapiens
gauacuuccuuguuaagaa

SEQ ID NO: 1319891 - RNA, 19 nt, Homo sapiens
ucacagauccugcagauau

SEQ ID NO: 1319892 - RNA, 19 nt, Homo sapiens
gauauuugguucacuaaca

SEQ ID NO: 1319893 - RNA, 19 nt, Homo sapiens
gcaagagguauaauggaua

SEQ ID NO: 1319894 - RNA, 19 nt, Homo sapiens
gauccaaguuauacaugaa

SEQ ID NO: 1319895 - RNA, 19 nt, Homo sapiens
guuagugggugaagaauuc

SEQ ID NO: 1319896 - RNA, 19 nt, Homo sapiens
guccaaacaucugauuuaa

SEQ ID NO: 1319897 - RNA, 19 nt, Homo sapiens
cuucgauacuuccuuguua

SEQ ID NO: 1319898 - RNA, 19 nt, Homo sapiens
guuauauacugguguguga

SEQ ID NO: 1319899 - RNA, 19 nt, Homo sapiens
caaagaaucuacagcuacu

SEQ ID NO: 1319900 - RNA, 19 nt, Homo sapiens
cacagauccugcagauaua

SEQ ID NO: 1319901 - RNA, 19 nt, Homo sapiens
gguguuaaauuugugugua

SEQ ID NO: 1319902 - RNA, 19 nt, Homo sapiens
aaaagccucuucugauuua

SEQ ID NO: 1319903 - RNA, 19 nt, Homo sapiens
ucucacacaugcuucgaua

SEQ ID NO: 1319904 - RNA, 19 nt, Homo sapiens
caucacagauccugcagau

SEQ ID NO: 1319905 - RNA, 19 nt, Homo sapiens
gauggaaagggaagucuaa

SEQ ID NO: 1319906 - RNA, 19 nt, Homo sapiens
cagugcugcuucauuguua

SEQ ID NO: 1319907 - RNA, 19 nt, Homo sapiens
gaauuggacauugaucuaa

SEQ ID NO: 1319908 - RNA, 19 nt, Homo sapiens
uggaagaauuggacauuga

SEQ ID NO: 1319909 - RNA, 19 nt, Homo sapiens
gaagauaacaagccacucu

SEQ ID NO: 1319910 - RNA, 19 nt, Homo sapiens
aggguggucucauggauua

SEQ ID NO: 1319911 - RNA, 19 nt, Homo sapiens
guggagaaguugcauaugg

SEQ ID NO: 1319912 - RNA, 19 nt, Homo sapiens
uguccaaacaucugauuua

SEQ ID NO: 1319913 - RNA, 19 nt, Homo sapiens
aaaagcaccuggauuggua

SEQ ID NO: 1319914 - RNA, 19 nt, Homo sapiens
ugaagaugaugauccugaa

SEQ ID NO: 1319915 - RNA, 19 nt, Homo sapiens
acacaugcuucgauacuuc

SEQ ID NO: 1319916 - RNA, 19 nt, Homo sapiens
ggguaaauuugacaauauc

SEQ ID NO: 1319917 - RNA, 19 nt, Homo sapiens
gaagaucucagugguucaa

SEQ ID NO: 1319918 - RNA, 19 nt, Homo sapiens
gacauugaucuaaaggaua

SEQ ID NO: 1319919 - RNA, 19 nt, Homo sapiens
ggagcaagagguauaaugg

SEQ ID NO: 1319920 - RNA, 19 nt, Homo sapiens
gaugaugauccugaagaua

SEQ ID NO: 1319921 - RNA, 19 nt, Homo sapiens
gggaauucuugcugaagga

SEQ ID NO: 1319922 - RNA, 19 nt, Homo sapiens
ggugugugauccaaguuau

SEQ ID NO: 1319923 - RNA, 19 nt, Homo sapiens
uaaaucugaugcacaaacu

SEQ ID NO: 1319924 - RNA, 19 nt, Homo sapiens
aagauugugucgauauuca

SEQ ID NO: 1319925 - RNA, 19 nt, Homo sapiens
gcugggaauucuugcugaa

SEQ ID NO: 1319926 - RNA, 19 nt, Homo sapiens
ggaagaauuggacauugau

SEQ ID NO: 1319927 - RNA, 19 nt, Homo sapiens
gaucucagugguucaauag

SEQ ID NO: 1319928 - RNA, 19 nt, Homo sapiens
gagcaagagguauaaugga

SEQ ID NO: 1319929 - RNA, 19 nt, Homo sapiens
augaugauccugaagauaa

SEQ ID NO: 1319930 - RNA, 19 nt, Homo sapiens
ugauccaaguuauacauga

SEQ ID NO: 1319931 - RNA, 19 nt, Homo sapiens
guggucucauggauuauaa

SEQ ID NO: 1319932 - RNA, 19 nt, Homo sapiens
agaucucagugguucaaua

SEQ ID NO: 1319933 - RNA, 19 nt, Homo sapiens
ccagaugucaaauuaaauc

SEQ ID NO: 1319934 - RNA, 19 nt, Homo sapiens
ggaguuauaggauauucau

SEQ ID NO: 1319935 - RNA, 19 nt, Homo sapiens
aaucugaugcacaaacuuu

SEQ ID NO: 1319936 - RNA, 19 nt, Homo sapiens
gugguuggaucauuugaag

SEQ ID NO: 1319937 - RNA, 19 nt, Homo sapiens
gacaaguggugagagacaa

SEQ ID NO: 1319938 - RNA, 19 nt, Homo sapiens
auagacaaguggugagaga

SEQ ID NO: 1319939 - RNA, 19 nt, Homo sapiens
uaaaauacuucccaguugu

SEQ ID NO: 1319940 - RNA, 19 nt, Homo sapiens
caccuggauugguaauuau

SEQ ID NO: 1319941 - RNA, 19 nt, Homo sapiens
agaauuggacauugaucua

SEQ ID NO: 1319942 - RNA, 19 nt, Homo sapiens
ggaaguugaagaugaugau

SEQ ID NO: 1319943 - RNA, 19 nt, Homo sapiens
cuacauuucugagacaaag

SEQ ID NO: 1319944 - RNA, 19 nt, Homo sapiens
uuggauauuugguucacua

SEQ ID NO: 1319945 - RNA, 19 nt, Homo sapiens
cuacuacauuucugagaca

SEQ ID NO: 1319946 - RNA, 19 nt, Homo sapiens
cauaaaaguuggggaaaga

SEQ ID NO: 1319947 - RNA, 19 nt, Homo sapiens
gguggucucauggauuaua

SEQ ID NO: 1319948 - RNA, 19 nt, Homo sapiens
gugguacuucuaaaucaua

SEQ ID NO: 1319949 - RNA, 19 nt, Homo sapiens
ucuguuugauucuccauau

SEQ ID NO: 1319950 - RNA, 19 nt, Homo sapiens
gagacaauccugacuuuug

SEQ ID NO: 1319951 - RNA, 19 nt, Homo sapiens
guguuaaauuuguguguag

SEQ ID NO: 1319952 - RNA, 19 nt, Homo sapiens
cauuugaaguggugucuac

SEQ ID NO: 1319953 - RNA, 19 nt, Homo sapiens
gguuggaucauuugaagug

SEQ ID NO: 1319954 - RNA, 19 nt, Homo sapiens
uuuggugguuggaucauuu

SEQ ID NO: 1319955 - RNA, 19 nt, Homo sapiens
ucucagugguucaauagca

SEQ ID NO: 1319956 - RNA, 19 nt, Homo sapiens
uacaaaauccgauguguuu

SEQ ID NO: 1319957 - RNA, 19 nt, Homo sapiens
auggauauggcauucauua

SEQ ID NO: 1319958 - RNA, 19 nt, Homo sapiens
gugucgauauucaccuaaa

SEQ ID NO: 1319959 - RNA, 19 nt, Homo sapiens
uuaagcaauugcaguuauc

SEQ ID NO: 1319960 - RNA, 19 nt, Homo sapiens
gcugaaggaauuggagaaa

SEQ ID NO: 1319961 - RNA, 19 nt, Homo sapiens
guggagauuuuaucaaaga

SEQ ID NO: 1319962 - RNA, 19 nt, Homo sapiens
cagauccugcagauauaua

SEQ ID NO: 1319963 - RNA, 19 nt, Homo sapiens
aaucuacagcuacuacauu

SEQ ID NO: 1319964 - RNA, 19 nt, Homo sapiens
gaaucuacagcuacuacau

SEQ ID NO: 1319965 - RNA, 19 nt, Homo sapiens
ccuuggaguuauaggauau

SEQ ID NO: 1319966 - RNA, 19 nt, Homo sapiens
gaagaauuggacauugauc

SEQ ID NO: 1319967 - RNA, 19 nt, Homo sapiens
auacuucccaguugugaaa

SEQ ID NO: 1319968 - RNA, 19 nt, Homo sapiens
agcaagagguauaauggau

SEQ ID NO: 1319969 - RNA, 19 nt, Homo sapiens
ccccagaugucaaauuaaa

SEQ ID NO: 1319970 - RNA, 19 nt, Homo sapiens
gauccugcagauauauauu

SEQ ID NO: 1319971 - RNA, 19 nt, Homo sapiens
ucuggaaguugaagaugau

SEQ ID NO: 1319972 - RNA, 19 nt, Homo sapiens
guucuuuucuuuuccauga

SEQ ID NO: 1319973 - RNA, 19 nt, Homo sapiens
aaaggagcaagagguauaa

SEQ ID NO: 1319974 - RNA, 19 nt, Homo sapiens
uucgauacuuccuuguuaa

SEQ ID NO: 1319975 - RNA, 19 nt, Homo sapiens
gccaaaagcaccuggauug

SEQ ID NO: 1319976 - RNA, 19 nt, Homo sapiens
cuacagcuacuacauuucu

SEQ ID NO: 1319977 - RNA, 19 nt, Homo sapiens
cagcagacgcggaagaucu

SEQ ID NO: 1319978 - RNA, 19 nt, Homo sapiens
ugagagacaauccugacuu

SEQ ID NO: 1319979 - RNA, 19 nt, Homo sapiens
gaagaugaugauccugaag

SEQ ID NO: 1319980 - RNA, 19 nt, Homo sapiens
gaagaauucaagaccaaaa

SEQ ID NO: 1319981 - RNA, 19 nt, Homo sapiens
uucauuacuuccucucauu

SEQ ID NO: 1319982 - RNA, 19 nt, Homo sapiens
ggaaggacauucuuguauu

SEQ ID NO: 1319983 - RNA, 19 nt, Homo sapiens
gcaugcaggucauacguua

SEQ ID NO: 1319984 - RNA, 19 nt, Homo sapiens
gcaaauccacucucuuuaa

SEQ ID NO: 1319985 - RNA, 19 nt, Homo sapiens
gaagaagaaaggaaagaua

SEQ ID NO: 1319986 - RNA, 19 nt, Homo sapiens
gaaagaugcccacugguuu

SEQ ID NO: 1319987 - RNA, 19 nt, Homo sapiens
gaaggacauucuuguauuc

SEQ ID NO: 1319988 - RNA, 19 nt, Homo sapiens
gacgcgagcuuccuuauga

SEQ ID NO: 1319989 - RNA, 19 nt, Homo sapiens
aaauaaagcucccauucuu

SEQ ID NO: 1319990 - RNA, 19 nt, Homo sapiens
uaacauucccuuugaguuu

SEQ ID NO: 1319991 - RNA, 19 nt, Homo sapiens
cagaagaacagaaggauaa

SEQ ID NO: 1319992 - RNA, 19 nt, Homo sapiens
gaacagaaggauaacauuc

SEQ ID NO: 1319993 - RNA, 19 nt, Homo sapiens
caacccaacuccuuacaga

SEQ ID NO: 1319994 - RNA, 19 nt, Homo sapiens
ggacauucuuguauucaga

SEQ ID NO: 1319995 - RNA, 19 nt, Homo sapiens
caaauccaccaaacaagua

SEQ ID NO: 1319996 - RNA, 19 nt, Homo sapiens
agaauugacugcacaagau

SEQ ID NO: 1319997 - RNA, 19 nt, Homo sapiens
gaaaucagucagcuugguu

SEQ ID NO: 1319998 - RNA, 19 nt, Homo sapiens
caaauccacucucuuuaac

SEQ ID NO: 1319999 - RNA, 19 nt, Homo sapiens
gcuauggaguggaagaguu

SEQ ID NO: 1320000 - RNA, 19 nt, Homo sapiens
cggcaaauccacucucuuu

SEQ ID NO: 1320001 - RNA, 19 nt, Homo sapiens
acacaaauccaccaaacaa

SEQ ID NO: 1320002 - RNA, 19 nt, Homo sapiens
caacucaagcugaagaaga

SEQ ID NO: 1320003 - RNA, 19 nt, Homo sapiens
auaaagcucccauucuuaa

SEQ ID NO: 1320004 - RNA, 19 nt, Homo sapiens
ggacagcgcaucaagaaaa

SEQ ID NO: 1320005 - RNA, 19 nt, Homo sapiens
ggaaaucagucagcuuggu

SEQ ID NO: 1320006 - RNA, 19 nt, Homo sapiens
ugaaagaugcccacugguu

SEQ ID NO: 1320007 - RNA, 19 nt, Homo sapiens
cugauucacuugccuuuga

SEQ ID NO: 1320008 - RNA, 19 nt, Homo sapiens
aggauaacauucccuuuga

SEQ ID NO: 1320009 - RNA, 19 nt, Homo sapiens
cuccagauauuaacuguau

SEQ ID NO: 1320010 - RNA, 19 nt, Homo sapiens
agaaaaguguggccuauaa

SEQ ID NO: 1320011 - RNA, 19 nt, Homo sapiens
gcagguuggguuucaguaa

SEQ ID NO: 1320012 - RNA, 19 nt, Homo sapiens
uggagaagguggugacaug

SEQ ID NO: 1320013 - RNA, 19 nt, Homo sapiens
gaacgaauggcaggauuuc

SEQ ID NO: 1320014 - RNA, 19 nt, Homo sapiens
aaagcaugguuaugucgua

SEQ ID NO: 1320015 - RNA, 19 nt, Homo sapiens
aauaaagcucccauucuua

SEQ ID NO: 1320016 - RNA, 19 nt, Homo sapiens
gaccggcuauggaguggaa

SEQ ID NO: 1320017 - RNA, 19 nt, Homo sapiens
caccaaacaaguagaauug

SEQ ID NO: 1320018 - RNA, 19 nt, Homo sapiens
uaaauaaagcucccauucu

SEQ ID NO: 1320019 - RNA, 19 nt, Homo sapiens
gaacaaaaucagcuuaaug

SEQ ID NO: 1320020 - RNA, 19 nt, Homo sapiens
gaggagcggcgacagcaaa

SEQ ID NO: 1320021 - RNA, 19 nt, Homo sapiens
ugaguuugaugcugauuca

SEQ ID NO: 1320022 - RNA, 19 nt, Homo sapiens
gcaugguuaugucguagga

SEQ ID NO: 1320023 - RNA, 19 nt, Homo sapiens
ggcaaauccacucucuuua

SEQ ID NO: 1320024 - RNA, 19 nt, Homo sapiens
ccagauauuaacuguauug

SEQ ID NO: 1320025 - RNA, 19 nt, Homo sapiens
cuuguucacuccagauauu

SEQ ID NO: 1320026 - RNA, 19 nt, Homo sapiens
cuauacaccugaaggaaca

SEQ ID NO: 1320027 - RNA, 19 nt, Homo sapiens
ucagucagcuugguuuaca

SEQ ID NO: 1320028 - RNA, 19 nt, Homo sapiens
caagaacuuuugugcuuaa

SEQ ID NO: 1320029 - RNA, 19 nt, Homo sapiens
ccaccaaacaaguagaauu

SEQ ID NO: 1320030 - RNA, 19 nt, Homo sapiens
ggccagguacuacauuaaa

SEQ ID NO: 1320031 - RNA, 19 nt, Homo sapiens
ggaagaagaaaggaaagau

SEQ ID NO: 1320032 - RNA, 19 nt, Homo sapiens
ugaggaagaagaaaggaaa

SEQ ID NO: 1320033 - RNA, 19 nt, Homo sapiens
gaauugacugcacaagaug

SEQ ID NO: 1320034 - RNA, 19 nt, Homo sapiens
ggauaacauucccuuugag

SEQ ID NO: 1320035 - RNA, 19 nt, Homo sapiens
ggagggcuuuggagaaggu

SEQ ID NO: 1320036 - RNA, 19 nt, Homo sapiens
ugcaggagcuccagcaaca

SEQ ID NO: 1320037 - RNA, 19 nt, Homo sapiens
ccaagaacuuuugugcuua

SEQ ID NO: 1320038 - RNA, 19 nt, Homo sapiens
acacacaaauccaccaaac

SEQ ID NO: 1320039 - RNA, 19 nt, Homo sapiens
gauaacauucccuuugagu

SEQ ID NO: 1320040 - RNA, 19 nt, Homo sapiens
ucagaagaacagaaggaua

SEQ ID NO: 1320041 - RNA, 19 nt, Homo sapiens
uaaaaggcaucaaagacuu

SEQ ID NO: 1320042 - RNA, 19 nt, Homo sapiens
ggguuucaguaacaccuaa

SEQ ID NO: 1320043 - RNA, 19 nt, Homo sapiens
ggacacggagggcuuugga

SEQ ID NO: 1320044 - RNA, 19 nt, Homo sapiens
ccaaacaaguagaauugac

SEQ ID NO: 1320045 - RNA, 19 nt, Homo sapiens
agucguggcuuccaacauc

SEQ ID NO: 1320046 - RNA, 19 nt, Homo sapiens
gaaaaugacccuguuaugg

SEQ ID NO: 1320047 - RNA, 19 nt, Homo sapiens
ggacgcgagcuuccuuaug

SEQ ID NO: 1320048 - RNA, 19 nt, Homo sapiens
caaaggacagcgcaucaag

SEQ ID NO: 1320049 - RNA, 19 nt, Homo sapiens
aagaacgaauggcaggauu

SEQ ID NO: 1320050 - RNA, 19 nt, Homo sapiens
guaugagaccgaccuuguu

SEQ ID NO: 1320051 - RNA, 19 nt, Homo sapiens
aaggacagcgcaucaagaa

SEQ ID NO: 1320052 - RNA, 19 nt, Homo sapiens
uguuauggguacacacaaa

SEQ ID NO: 1320053 - RNA, 19 nt, Homo sapiens
ccaacuccuuacagaaugu

SEQ ID NO: 1320054 - RNA, 19 nt, Homo sapiens
uaaagcucccauucuuaaa

SEQ ID NO: 1320055 - RNA, 19 nt, Homo sapiens
auaaauaaagcucccauuc

SEQ ID NO: 1320056 - RNA, 19 nt, Homo sapiens
ggauuuccuccucuuguug

SEQ ID NO: 1320057 - RNA, 19 nt, Homo sapiens
uagaauugacugcacaaga

SEQ ID NO: 1320058 - RNA, 19 nt, Homo sapiens
gaucgugcugggaaacaaa

SEQ ID NO: 1320059 - RNA, 19 nt, Homo sapiens
ucagcuuaauguccucaaa

SEQ ID NO: 1320060 - RNA, 19 nt, Homo sapiens
ugaaguuuccuauuugcaa

SEQ ID NO: 1320061 - RNA, 19 nt, Homo sapiens
cuccuucccuuauguacaa

SEQ ID NO: 1320062 - RNA, 19 nt, Homo sapiens
guuugaugcugauucacuu

SEQ ID NO: 1320063 - RNA, 19 nt, Homo sapiens
gaagaacagaaggauaaca

SEQ ID NO: 1320064 - RNA, 19 nt, Homo sapiens
uggaaggacauucuuguau

SEQ ID NO: 1320065 - RNA, 19 nt, Homo sapiens
guaggaagaguuggaagga

SEQ ID NO: 1320066 - RNA, 19 nt, Homo sapiens
guacuacauuaaaccuucu

SEQ ID NO: 1320067 - RNA, 19 nt, Homo sapiens
gaaaaguguggccuauaaa

SEQ ID NO: 1320068 - RNA, 19 nt, Homo sapiens
caagaaaaguguggccuau

SEQ ID NO: 1320069 - RNA, 19 nt, Homo sapiens
gcaggagcguuuucuguuc

SEQ ID NO: 1320070 - RNA, 19 nt, Homo sapiens
ggaaagauaaauguaugag

SEQ ID NO: 1320071 - RNA, 19 nt, Homo sapiens
ggaaaaugacccuguuaug

SEQ ID NO: 1320072 - RNA, 19 nt, Homo sapiens
uaacuguauugaacacaac

SEQ ID NO: 1320073 - RNA, 19 nt, Homo sapiens
uuacagucguggcuuccaa

SEQ ID NO: 1320074 - RNA, 19 nt, Homo sapiens
acaaauccaccaaacaagu

SEQ ID NO: 1320075 - RNA, 19 nt, Homo sapiens
uuggccagguacuacauua

SEQ ID NO: 1320076 - RNA, 19 nt, Homo sapiens
uguacaacgugaggaagaa

SEQ ID NO: 1320077 - RNA, 19 nt, Homo sapiens
guacacacaaauccaccaa

SEQ ID NO: 1320078 - RNA, 19 nt, Homo sapiens
aacucaagcugaagaagau

SEQ ID NO: 1320079 - RNA, 19 nt, Homo sapiens
caaacaaguagaauugacu

SEQ ID NO: 1320080 - RNA, 19 nt, Homo sapiens
aacauucccuuugaguuug

SEQ ID NO: 1320081 - RNA, 19 nt, Homo sapiens
guugaucucugcccuucag

SEQ ID NO: 1320082 - RNA, 19 nt, Homo sapiens
gauagaagaugcaggcuuu

SEQ ID NO: 1320083 - RNA, 19 nt, Homo sapiens
gggaagaaauuaccaaaga

SEQ ID NO: 1320084 - RNA, 19 nt, Homo sapiens
gaacugcccuuugaugaug

SEQ ID NO: 1320085 - RNA, 19 nt, Homo sapiens
ggacccagcugcuugaugu

SEQ ID NO: 1320086 - RNA, 19 nt, Homo sapiens
caaagucuaucagguguuu

SEQ ID NO: 1320087 - RNA, 19 nt, Homo sapiens
gcauuccgguuccuuaauu

SEQ ID NO: 1320088 - RNA, 19 nt, Homo sapiens
gaagugaguguauuuauag

SEQ ID NO: 1320089 - RNA, 19 nt, Homo sapiens
caaaguggaagaacaaauu

SEQ ID NO: 1320090 - RNA, 19 nt, Homo sapiens
aggauaaucuggcaaauga

SEQ ID NO: 1320091 - RNA, 19 nt, Homo sapiens
ucaaggacaugauagaaga

SEQ ID NO: 1320092 - RNA, 19 nt, Homo sapiens
uaagaaguaugaugugaug

SEQ ID NO: 1320093 - RNA, 19 nt, Homo sapiens
cugaagaacugcccuuuga

SEQ ID NO: 1320094 - RNA, 19 nt, Homo sapiens
ccaaagaguaccagaauga

SEQ ID NO: 1320095 - RNA, 19 nt, Homo sapiens
caagucagaguauuaauga

SEQ ID NO: 1320096 - RNA, 19 nt, Homo sapiens
gcuaagaaguaugauguga

SEQ ID NO: 1320097 - RNA, 19 nt, Homo sapiens
gccuggaacugaaggauaa

SEQ ID NO: 1320098 - RNA, 19 nt, Homo sapiens
gaugaugacaaguuugaua

SEQ ID NO: 1320099 - RNA, 19 nt, Homo sapiens
gaagaacugcccuuugaug

SEQ ID NO: 1320100 - RNA, 19 nt, Homo sapiens
gauaugaugagucuuggua

SEQ ID NO: 1320101 - RNA, 19 nt, Homo sapiens
gaaguaugaugugaugaau

SEQ ID NO: 1320102 - RNA, 19 nt, Homo sapiens
ggaagaaauuaccaaagag

SEQ ID NO: 1320103 - RNA, 19 nt, Homo sapiens
aguaugaugugaugaauga

SEQ ID NO: 1320104 - RNA, 19 nt, Homo sapiens
uaucuuugcucaacugcua

SEQ ID NO: 1320105 - RNA, 19 nt, Homo sapiens
cauucuggcuucaaacuuu

SEQ ID NO: 1320106 - RNA, 19 nt, Homo sapiens
uuacgaaagucuaacauca

SEQ ID NO: 1320107 - RNA, 19 nt, Homo sapiens
ugaaugauaugaugagucu

SEQ ID NO: 1320108 - RNA, 19 nt, Homo sapiens
gcuguagggugugugguua

SEQ ID NO: 1320109 - RNA, 19 nt, Homo sapiens
auacagagcuggacuugca

SEQ ID NO: 1320110 - RNA, 19 nt, Homo sapiens
acaaggagaugcuaaaggu

SEQ ID NO: 1320111 - RNA, 19 nt, Homo sapiens
aaacagaagaggcaguuaa

SEQ ID NO: 1320112 - RNA, 19 nt, Homo sapiens
gcauuuggucuguaucuuu

SEQ ID NO: 1320113 - RNA, 19 nt, Homo sapiens
ggacuugcauggguauuag

SEQ ID NO: 1320114 - RNA, 19 nt, Homo sapiens
guaccagaaugaagaagau

SEQ ID NO: 1320115 - RNA, 19 nt, Homo sapiens
ccagucauauccuguugaa

SEQ ID NO: 1320116 - RNA, 19 nt, Homo sapiens
gaagaaauuaccaaagagu

SEQ ID NO: 1320117 - RNA, 19 nt, Homo sapiens
gcacaggugacauugcauu

SEQ ID NO: 1320118 - RNA, 19 nt, Homo sapiens
caacugcuaauuucucuug

SEQ ID NO: 1320119 - RNA, 19 nt, Homo sapiens
gauaaucuggcaaaugaga

SEQ ID NO: 1320120 - RNA, 19 nt, Homo sapiens
gaaccagucauauccuguu

SEQ ID NO: 1320121 - RNA, 19 nt, Homo sapiens
ggacucauguuugaaucga

SEQ ID NO: 1320122 - RNA, 19 nt, Homo sapiens
gaaggauaaucuggcaaau

SEQ ID NO: 1320123 - RNA, 19 nt, Homo sapiens
guugaaagccuggaacuga

SEQ ID NO: 1320124 - RNA, 19 nt, Homo sapiens
guaccugaaucaaccuuuc

SEQ ID NO: 1320125 - RNA, 19 nt, Homo sapiens
gaauuuagccaagugaaca

SEQ ID NO: 1320126 - RNA, 19 nt, Homo sapiens
auuaggagaugcugaagaa

SEQ ID NO: 1320127 - RNA, 19 nt, Homo sapiens
cauuuggucuguaucuuug

SEQ ID NO: 1320128 - RNA, 19 nt, Homo sapiens
gaaaguguggcuaagaagu

SEQ ID NO: 1320129 - RNA, 19 nt, Homo sapiens
ggcccaagucagaguauua

SEQ ID NO: 1320130 - RNA, 19 nt, Homo sapiens
gugaguguauuuauagcuu

SEQ ID NO: 1320131 - RNA, 19 nt, Homo sapiens
aaaguguggcuaagaagua

SEQ ID NO: 1320132 - RNA, 19 nt, Homo sapiens
gaagaugcaggcuuucaca

SEQ ID NO: 1320133 - RNA, 19 nt, Homo sapiens
cauuccgguuccuuaauua

SEQ ID NO: 1320134 - RNA, 19 nt, Homo sapiens
gccuuggacucauguuuga

SEQ ID NO: 1320135 - RNA, 19 nt, Homo sapiens
gaaguccuaucaguaccuu

SEQ ID NO: 1320136 - RNA, 19 nt, Homo sapiens
uauccaggcuuuaugaucu

SEQ ID NO: 1320137 - RNA, 19 nt, Homo sapiens
gcaguuaagggcccaacaa

SEQ ID NO: 1320138 - RNA, 19 nt, Homo sapiens
uugaaaguguggcuaagaa

SEQ ID NO: 1320139 - RNA, 19 nt, Homo sapiens
gaacagucucaaaguggaa

SEQ ID NO: 1320140 - RNA, 19 nt, Homo sapiens
gguauuaggagaugcugaa

SEQ ID NO: 1320141 - RNA, 19 nt, Homo sapiens
gucagaguauuaaugauca

SEQ ID NO: 1320142 - RNA, 19 nt, Homo sapiens
ccaagucagaguauuaaug

SEQ ID NO: 1320143 - RNA, 19 nt, Homo sapiens
ugugaugaaugauaugaug

SEQ ID NO: 1320144 - RNA, 19 nt, Homo sapiens
caucguguuuggaaggauu

SEQ ID NO: 1320145 - RNA, 19 nt, Homo sapiens
uaauuucucuuggcuguag

SEQ ID NO: 1320146 - RNA, 19 nt, Homo sapiens
gcauggguauuaggagaug

SEQ ID NO: 1320147 - RNA, 19 nt, Homo sapiens
uaucagguguuugaaagug

SEQ ID NO: 1320148 - RNA, 19 nt, Homo sapiens
ugaaggauaaucuggcaaa

SEQ ID NO: 1320149 - RNA, 19 nt, Homo sapiens
gaaucgaacagucucaaag

SEQ ID NO: 1320150 - RNA, 19 nt, Homo sapiens
gaagaguucaaggacauga

SEQ ID NO: 1320151 - RNA, 19 nt, Homo sapiens
ugugugacaucaacaagga

SEQ ID NO: 1320152 - RNA, 19 nt, Homo sapiens
caaagaguaccagaaugaa

SEQ ID NO: 1320153 - RNA, 19 nt, Homo sapiens
aaauuuauccugggaagaa

SEQ ID NO: 1320154 - RNA, 19 nt, Homo sapiens
gcccaagucagaguauuaa

SEQ ID NO: 1320155 - RNA, 19 nt, Homo sapiens
uugcucaacugcuaauuuc

SEQ ID NO: 1320156 - RNA, 19 nt, Homo sapiens
uugaaagccuggaacugaa

SEQ ID NO: 1320157 - RNA, 19 nt, Homo sapiens
gaggacgguuucucugucu

SEQ ID NO: 1320158 - RNA, 19 nt, Homo sapiens
ucaacaaggagaugcuaaa

SEQ ID NO: 1320159 - RNA, 19 nt, Homo sapiens
ucuaucagguguuugaaag

SEQ ID NO: 1320160 - RNA, 19 nt, Homo sapiens
gaugugaugaaugauauga

SEQ ID NO: 1320161 - RNA, 19 nt, Homo sapiens
caggcuuuaugaucuauau

SEQ ID NO: 1320162 - RNA, 19 nt, Homo sapiens
agaaguaugaugugaugaa

SEQ ID NO: 1320163 - RNA, 19 nt, Homo sapiens
aggauuugcugcucuggaa

SEQ ID NO: 1320164 - RNA, 19 nt, Homo sapiens
gaugaaugauaugaugagu

SEQ ID NO: 1320165 - RNA, 19 nt, Homo sapiens
ggauacagagcuggacuug

SEQ ID NO: 1320166 - RNA, 19 nt, Homo sapiens
aagaguaccagaaugaaga

SEQ ID NO: 1320167 - RNA, 19 nt, Homo sapiens
agaggcauuuggucuguau

SEQ ID NO: 1320168 - RNA, 19 nt, Homo sapiens
guagagaguauccgaaggu

SEQ ID NO: 1320169 - RNA, 19 nt, Homo sapiens
agaauugugugcugaacca

SEQ ID NO: 1320170 - RNA, 19 nt, Homo sapiens
gaguauuaaugaucaugag

SEQ ID NO: 1320171 - RNA, 19 nt, Homo sapiens
agucauauccuguugaaag

SEQ ID NO: 1320172 - RNA, 19 nt, Homo sapiens
auucuggcuucaaacuuua

SEQ ID NO: 1320173 - RNA, 19 nt, Homo sapiens
gcauuguggccauucauuc

SEQ ID NO: 1320174 - RNA, 19 nt, Homo sapiens
agucuaacaucaggcauug

SEQ ID NO: 1320175 - RNA, 19 nt, Homo sapiens
agaguucaaggacaugaua

SEQ ID NO: 1320176 - RNA, 19 nt, Homo sapiens
uaugaugagucuugguauc

SEQ ID NO: 1320177 - RNA, 19 nt, Homo sapiens
aagaacugcccuuugauga

SEQ ID NO: 1320178 - RNA, 19 nt, Homo sapiens
gcugaagaacugcccuuug

SEQ ID NO: 1320179 - RNA, 19 nt, Homo sapiens
aaugauaugaugagucuug

SEQ ID NO: 1320180 - RNA, 19 nt, Homo sapiens
uaccaaagaguaccagaau

SEQ ID NO: 1320181 - RNA, 19 nt, Homo sapiens
acuaagugcucggcucuug

SEQ ID NO: 1320182 - RNA, 19 nt, Homo sapiens
gaaugcagcuagaacagaa

SEQ ID NO: 1320183 - RNA, 19 nt, Homo sapiens
uuaagaggauucaggguua

SEQ ID NO: 1320184 - RNA, 19 nt, Homo sapiens
uuagaaaguuugagacuga

SEQ ID NO: 1320185 - RNA, 19 nt, Homo sapiens
gggaagagggcaccaagua

SEQ ID NO: 1320186 - RNA, 19 nt, Homo sapiens
ugaagucgaucuuggagaa

SEQ ID NO: 1320187 - RNA, 19 nt, Homo sapiens
gaaacuauaaucugcuuug

SEQ ID NO: 1320188 - RNA, 19 nt, Homo sapiens
gcaccaaguacaagucuuu

SEQ ID NO: 1320189 - RNA, 19 nt, Homo sapiens
acuauaaucugcuuugcua

SEQ ID NO: 1320190 - RNA, 19 nt, Homo sapiens
ccaaagagcaauuuaaugg

SEQ ID NO: 1320191 - RNA, 19 nt, Homo sapiens
gaaagagggaccaaaguca

SEQ ID NO: 1320192 - RNA, 19 nt, Homo sapiens
cgugacaccuggacucuuu

SEQ ID NO: 1320193 - RNA, 19 nt, Homo sapiens
aaauugugcucuagaagaa

SEQ ID NO: 1320194 - RNA, 19 nt, Homo sapiens
guugucuacuuaugaguua

SEQ ID NO: 1320195 - RNA, 19 nt, Homo sapiens
ccauuguguugucuacuua

SEQ ID NO: 1320196 - RNA, 19 nt, Homo sapiens
gcucuaagcagaugaauac

SEQ ID NO: 1320197 - RNA, 19 nt, Homo sapiens
guuaagcaccaacuaaauu

SEQ ID NO: 1320198 - RNA, 19 nt, Homo sapiens
ccauugauguuuagaaagu

SEQ ID NO: 1320199 - RNA, 19 nt, Homo sapiens
gaagagggcaccaaguaca

SEQ ID NO: 1320200 - RNA, 19 nt, Homo sapiens
ccagugugcucguuacguu

SEQ ID NO: 1320201 - RNA, 19 nt, Homo sapiens
ucugaaagaagcuccauua

SEQ ID NO: 1320202 - RNA, 19 nt, Homo sapiens
uggcuucuauagaggauua

SEQ ID NO: 1320203 - RNA, 19 nt, Homo sapiens
cuguauacuuugcauguua

SEQ ID NO: 1320204 - RNA, 19 nt, Homo sapiens
aucaagggcuguauacuuu

SEQ ID NO: 1320205 - RNA, 19 nt, Homo sapiens
ggaaaauugugcucuagaa

SEQ ID NO: 1320206 - RNA, 19 nt, Homo sapiens
ggagaaagagggaccaaag

SEQ ID NO: 1320207 - RNA, 19 nt, Homo sapiens
ucuggaagguuuaaauuca

SEQ ID NO: 1320208 - RNA, 19 nt, Homo sapiens
uaagaggauucaggguuaa

SEQ ID NO: 1320209 - RNA, 19 nt, Homo sapiens
uaacagcaauauugugcau

SEQ ID NO: 1320210 - RNA, 19 nt, Homo sapiens
aggauuaacugccucguau

SEQ ID NO: 1320211 - RNA, 19 nt, Homo sapiens
caucaagggcuguauacuu

SEQ ID NO: 1320212 - RNA, 19 nt, Homo sapiens
caggaaaggccauaaaaua

SEQ ID NO: 1320213 - RNA, 19 nt, Homo sapiens
gccauuguguugucuacuu

SEQ ID NO: 1320214 - RNA, 19 nt, Homo sapiens
guuaauuguguaccuguua

SEQ ID NO: 1320215 - RNA, 19 nt, Homo sapiens
caaauacugccauuguguu

SEQ ID NO: 1320216 - RNA, 19 nt, Homo sapiens
gaucccaaauacugccauu

SEQ ID NO: 1320217 - RNA, 19 nt, Homo sapiens
cauaucaccuguuggacau

SEQ ID NO: 1320218 - RNA, 19 nt, Homo sapiens
aaacaggaaaggccauaaa

SEQ ID NO: 1320219 - RNA, 19 nt, Homo sapiens
gaaacaggaaaggccauaa

SEQ ID NO: 1320220 - RNA, 19 nt, Homo sapiens
ccauuagccucuucugcaa

SEQ ID NO: 1320221 - RNA, 19 nt, Homo sapiens
uaucaccuguuggacauuu

SEQ ID NO: 1320222 - RNA, 19 nt, Homo sapiens
gaaaggccauaaaauaucu

SEQ ID NO: 1320223 - RNA, 19 nt, Homo sapiens
ccacuagaagucauuaaga

SEQ ID NO: 1320224 - RNA, 19 nt, Homo sapiens
cuaagcagaugaauacacu

SEQ ID NO: 1320225 - RNA, 19 nt, Homo sapiens
cuuaaugaauccuauaugg

SEQ ID NO: 1320226 - RNA, 19 nt, Homo sapiens
gugccuaacagcaauauug

SEQ ID NO: 1320227 - RNA, 19 nt, Homo sapiens
gguuggaguugcaccauca

SEQ ID NO: 1320228 - RNA, 19 nt, Homo sapiens
ggguuaagcaccaacuaaa

SEQ ID NO: 1320229 - RNA, 19 nt, Homo sapiens
guucauaucaccuguugga

SEQ ID NO: 1320230 - RNA, 19 nt, Homo sapiens
ggauucaugcuuucuggaa

SEQ ID NO: 1320231 - RNA, 19 nt, Homo sapiens
ccaaauacugccauugugu

SEQ ID NO: 1320232 - RNA, 19 nt, Homo sapiens
cggcagaucccaaauacug

SEQ ID NO: 1320233 - RNA, 19 nt, Homo sapiens
ggacuguuugcccagcuua

SEQ ID NO: 1320234 - RNA, 19 nt, Homo sapiens
gagaaagagggaccaaagu

SEQ ID NO: 1320235 - RNA, 19 nt, Homo sapiens
caugcuuucuggaagguuu

SEQ ID NO: 1320236 - RNA, 19 nt, Homo sapiens
caaagccaaagagcaauuu

SEQ ID NO: 1320237 - RNA, 19 nt, Homo sapiens
ggacauuuccuuuuggauu

SEQ ID NO: 1320238 - RNA, 19 nt, Homo sapiens
gauuagcucuccggacagu

SEQ ID NO: 1320239 - RNA, 19 nt, Homo sapiens
ggaagagggcaccaaguac

SEQ ID NO: 1320240 - RNA, 19 nt, Homo sapiens
ccgaaacuauaaucugcuu

SEQ ID NO: 1320241 - RNA, 19 nt, Homo sapiens
ccaaagccaaagagcaauu

SEQ ID NO: 1320242 - RNA, 19 nt, Homo sapiens
gcuguauacuuugcauguu

SEQ ID NO: 1320243 - RNA, 19 nt, Homo sapiens
guaacaggccggaaaauug

SEQ ID NO: 1320244 - RNA, 19 nt, Homo sapiens
ggcugugccuccugcauug

SEQ ID NO: 1320245 - RNA, 19 nt, Homo sapiens
cugcuuugcuauuuaugaa

SEQ ID NO: 1320246 - RNA, 19 nt, Homo sapiens
gccaaagagcaauuuaaug

SEQ ID NO: 1320247 - RNA, 19 nt, Homo sapiens
auugugcucuagaagaaua

SEQ ID NO: 1320248 - RNA, 19 nt, Homo sapiens
gggcugugccuccugcauu

SEQ ID NO: 1320249 - RNA, 19 nt, Homo sapiens
gaagcuccauuagccucuu

SEQ ID NO: 1320250 - RNA, 19 nt, Homo sapiens
gcaccaacuaaauuaaauc

SEQ ID NO: 1320251 - RNA, 19 nt, Homo sapiens
gguuaagcaccaacuaaau

SEQ ID NO: 1320252 - RNA, 19 nt, Homo sapiens
ggaaaggccauaaaauauc

SEQ ID NO: 1320253 - RNA, 19 nt, Homo sapiens
uuguguaccuguuagaaga

SEQ ID NO: 1320254 - RNA, 19 nt, Homo sapiens
gcagcuagaacagaaagug

SEQ ID NO: 1320255 - RNA, 19 nt, Homo sapiens
caagggcuguauacuuugc

SEQ ID NO: 1320256 - RNA, 19 nt, Homo sapiens
gaagucgaucuuggagaaa

SEQ ID NO: 1320257 - RNA, 19 nt, Homo sapiens
ugaaacaggaaaggccaua

SEQ ID NO: 1320258 - RNA, 19 nt, Homo sapiens
cccaaauacugccauugug

SEQ ID NO: 1320259 - RNA, 19 nt, Homo sapiens
ccacacgaagucauaagga

SEQ ID NO: 1320260 - RNA, 19 nt, Homo sapiens
cagcuagaacagaaaguga

SEQ ID NO: 1320261 - RNA, 19 nt, Homo sapiens
agucuacuauccucagguu

SEQ ID NO: 1320262 - RNA, 19 nt, Homo sapiens
aaagccaaagagcaauuua

SEQ ID NO: 1320263 - RNA, 19 nt, Homo sapiens
uagaaaguuugagacugaa

SEQ ID NO: 1320264 - RNA, 19 nt, Homo sapiens
uuaauuguguaccuguuag

SEQ ID NO: 1320265 - RNA, 19 nt, Homo sapiens
ugaaagaagcuccauuagc

SEQ ID NO: 1320266 - RNA, 19 nt, Homo sapiens
auucguggcuucuauagag

SEQ ID NO: 1320267 - RNA, 19 nt, Homo sapiens
aagccaaagagcaauuuaa

SEQ ID NO: 1320268 - RNA, 19 nt, Homo sapiens
caccaucaagggcuguaua

SEQ ID NO: 1320269 - RNA, 19 nt, Homo sapiens
gacauuuccuuuuggauuc

SEQ ID NO: 1320270 - RNA, 19 nt, Homo sapiens
gcaaaugggacugagaaaa

SEQ ID NO: 1320271 - RNA, 19 nt, Homo sapiens
ggcauucguggcuucuaua

SEQ ID NO: 1320272 - RNA, 19 nt, Homo sapiens
agaaagagggaccaaaguc

SEQ ID NO: 1320273 - RNA, 19 nt, Homo sapiens
cacuagaagucauuaagac

SEQ ID NO: 1320274 - RNA, 19 nt, Homo sapiens
aaacccgaaugcagcuaga

SEQ ID NO: 1320275 - RNA, 19 nt, Homo sapiens
aaauuugguuggaguugca

SEQ ID NO: 1320276 - RNA, 19 nt, Homo sapiens
acacgcugcuucaccucuu

SEQ ID NO: 1320277 - RNA, 19 nt, Homo sapiens
aggcauucguggcuucuau

SEQ ID NO: 1320278 - RNA, 19 nt, Homo sapiens
cgaaugcagcuagaacaga

SEQ ID NO: 1320279 - RNA, 19 nt, Homo sapiens
ugguucauaucaccuguug

SEQ ID NO: 1320280 - RNA, 19 nt, Homo sapiens
gagaccaacauccgugaca

SEQ ID NO: 1320281 - RNA, 19 nt, Homo sapiens
uuagaagaccguacucagu

SEQ ID NO: 1320282 - RNA, 19 nt, Homo sapiens
gaaggaaaccugaagauuu

SEQ ID NO: 1320283 - RNA, 19 nt, Homo sapiens
ggaagaaacagaaaccuua

SEQ ID NO: 1320284 - RNA, 19 nt, Homo sapiens
gggcugggcugaccuacua

SEQ ID NO: 1320285 - RNA, 19 nt, Homo sapiens
uaacucaguccaaccauua

SEQ ID NO: 1320286 - RNA, 19 nt, Homo sapiens
ggaaaucacguuuaagaau

SEQ ID NO: 1320287 - RNA, 19 nt, Homo sapiens
aaggaaaccugaagauuug

SEQ ID NO: 1320288 - RNA, 19 nt, Homo sapiens
gaaauuuccugucugaacu

SEQ ID NO: 1320289 - RNA, 19 nt, Homo sapiens
uggaggagcugcagaucua

SEQ ID NO: 1320290 - RNA, 19 nt, Homo sapiens
gcagggaccaugcuucauu

SEQ ID NO: 1320291 - RNA, 19 nt, Homo sapiens
gcacgugucucuagcaaaa

SEQ ID NO: 1320292 - RNA, 19 nt, Homo sapiens
caaguaaggguucucauug

SEQ ID NO: 1320293 - RNA, 19 nt, Homo sapiens
agagaaauuuccugucuga

SEQ ID NO: 1320294 - RNA, 19 nt, Homo sapiens
ugacauggcuagaauaucg

SEQ ID NO: 1320295 - RNA, 19 nt, Homo sapiens
guguguggcucaacaguuu

SEQ ID NO: 1320296 - RNA, 19 nt, Homo sapiens
ggaaggaaaccugaagauu

SEQ ID NO: 1320297 - RNA, 19 nt, Homo sapiens
gaagaaacagaaaccuuau

SEQ ID NO: 1320298 - RNA, 19 nt, Homo sapiens
ggagggagcccaggaguau

SEQ ID NO: 1320299 - RNA, 19 nt, Homo sapiens
cagcagaugugggcacuga

SEQ ID NO: 1320300 - RNA, 19 nt, Homo sapiens
caggaaaucacguuuaaga

SEQ ID NO: 1320301 - RNA, 19 nt, Homo sapiens
ggccugguaugcaauaaga

SEQ ID NO: 1320302 - RNA, 19 nt, Homo sapiens
ugaagaggaccuuguggua

SEQ ID NO: 1320303 - RNA, 19 nt, Homo sapiens
ugcaggaaaucacguuuaa

SEQ ID NO: 1320304 - RNA, 19 nt, Homo sapiens
gcaguaguccucagugugu

SEQ ID NO: 1320305 - RNA, 19 nt, Homo sapiens
ggacauguguguggcucaa

SEQ ID NO: 1320306 - RNA, 19 nt, Homo sapiens
aggccuaaguccugcauua

SEQ ID NO: 1320307 - RNA, 19 nt, Homo sapiens
cauaagaacugggauugca

SEQ ID NO: 1320308 - RNA, 19 nt, Homo sapiens
gaaaguuggacaugugugu

SEQ ID NO: 1320309 - RNA, 19 nt, Homo sapiens
ccaaguaaggguucucauu

SEQ ID NO: 1320310 - RNA, 19 nt, Homo sapiens
agagagaaauuuccugucu

SEQ ID NO: 1320311 - RNA, 19 nt, Homo sapiens
gaguauguaucgcuguuca

SEQ ID NO: 1320312 - RNA, 19 nt, Homo sapiens
caccagaggcugaagugua

SEQ ID NO: 1320313 - RNA, 19 nt, Homo sapiens
gagcauaagaacugggauu

SEQ ID NO: 1320314 - RNA, 19 nt, Homo sapiens
gggcuuaccguguuacuuc

SEQ ID NO: 1320315 - RNA, 19 nt, Homo sapiens
guccaaccauuaagugaug

SEQ ID NO: 1320316 - RNA, 19 nt, Homo sapiens
guaaggguucucauuguug

SEQ ID NO: 1320317 - RNA, 19 nt, Homo sapiens
caacucaauucuuccuucu

SEQ ID NO: 1320318 - RNA, 19 nt, Homo sapiens
ucuuggaccuggaaaguug

SEQ ID NO: 1320319 - RNA, 19 nt, Homo sapiens
guuaugaccugaacuugcu

SEQ ID NO: 1320320 - RNA, 19 nt, Homo sapiens
ggaguucagugaccuuuug

SEQ ID NO: 1320321 - RNA, 19 nt, Homo sapiens
gggaguggguccaaguaag

SEQ ID NO: 1320322 - RNA, 19 nt, Homo sapiens
gggcacgugucucuagcaa

SEQ ID NO: 1320323 - RNA, 19 nt, Homo sapiens
ugauguggauggcuguuau

SEQ ID NO: 1320324 - RNA, 19 nt, Homo sapiens
aguaaggguucucauuguu

SEQ ID NO: 1320325 - RNA, 19 nt, Homo sapiens
accagaggcugaaguguau

SEQ ID NO: 1320326 - RNA, 19 nt, Homo sapiens
auucacagauucaggauuc

SEQ ID NO: 1320327 - RNA, 19 nt, Homo sapiens
ggcugcaacucaauucuuc

SEQ ID NO: 1320328 - RNA, 19 nt, Homo sapiens
cagggaccaugcuucauuc

SEQ ID NO: 1320329 - RNA, 19 nt, Homo sapiens
ccuaaguccugcauuaacu

SEQ ID NO: 1320330 - RNA, 19 nt, Homo sapiens
ggccugagcauaagaacug

SEQ ID NO: 1320331 - RNA, 19 nt, Homo sapiens
gguaugcaauaagaucaau

SEQ ID NO: 1320332 - RNA, 19 nt, Homo sapiens
uuaacucaguccaaccauu

SEQ ID NO: 1320333 - RNA, 19 nt, Homo sapiens
aaguaaggguucucauugu

SEQ ID NO: 1320334 - RNA, 19 nt, Homo sapiens
gcuccuagccaagauguug

SEQ ID NO: 1320335 - RNA, 19 nt, Homo sapiens
cggcagccaucaccacugu

SEQ ID NO: 1320336 - RNA, 19 nt, Homo sapiens
ggccuaaguccugcauuaa

SEQ ID NO: 1320337 - RNA, 19 nt, Homo sapiens
gcuggcuccugaauauaug

SEQ ID NO: 1320338 - RNA, 19 nt, Homo sapiens
cagccugagucucuugguu

SEQ ID NO: 1320339 - RNA, 19 nt, Homo sapiens
cggaaagcgugacgaagca

SEQ ID NO: 1320340 - RNA, 19 nt, Homo sapiens
agaauuacuacacagcuuu

SEQ ID NO: 1320341 - RNA, 19 nt, Homo sapiens
gaacuugcucuccuacacu

SEQ ID NO: 1320342 - RNA, 19 nt, Homo sapiens
aagaauuacuacacagcuu

SEQ ID NO: 1320343 - RNA, 19 nt, Homo sapiens
ugugugacauggcuagaau

SEQ ID NO: 1320344 - RNA, 19 nt, Homo sapiens
ccagucaguuguacuuacu

SEQ ID NO: 1320345 - RNA, 19 nt, Homo sapiens
gggccacauucacagauuc

SEQ ID NO: 1320346 - RNA, 19 nt, Homo sapiens
cugcaugccuguucugucu

SEQ ID NO: 1320347 - RNA, 19 nt, Homo sapiens
ugaccugccugcgggacua

SEQ ID NO: 1320348 - RNA, 19 nt, Homo sapiens
cuccuacacuugaaugguu

SEQ ID NO: 1320349 - RNA, 19 nt, Homo sapiens
guacaccucagcacacaca

SEQ ID NO: 1320350 - RNA, 19 nt, Homo sapiens
gagggccugguaugcaaua

SEQ ID NO: 1320351 - RNA, 19 nt, Homo sapiens
cuggaaaguuggacaugug

SEQ ID NO: 1320352 - RNA, 19 nt, Homo sapiens
ccugguggcuauuacaaag

SEQ ID NO: 1320353 - RNA, 19 nt, Homo sapiens
aggcugcucuucccucaug

SEQ ID NO: 1320354 - RNA, 19 nt, Homo sapiens
gcacacacaccugccaagu

SEQ ID NO: 1320355 - RNA, 19 nt, Homo sapiens
cugcgggacuacugccuaa

SEQ ID NO: 1320356 - RNA, 19 nt, Homo sapiens
cagaggcugaaguguauuu

SEQ ID NO: 1320357 - RNA, 19 nt, Homo sapiens
gcagaugugggcacugaca

SEQ ID NO: 1320358 - RNA, 19 nt, Homo sapiens
gcuguuaugaccugaacuu

SEQ ID NO: 1320359 - RNA, 19 nt, Homo sapiens
gcagguggcgacuucaucu

SEQ ID NO: 1320360 - RNA, 19 nt, Homo sapiens
ggaguggguccaaguaagg

SEQ ID NO: 1320361 - RNA, 19 nt, Homo sapiens
acucaauucuuccuucuac

SEQ ID NO: 1320362 - RNA, 19 nt, Homo sapiens
ccguguuacuucagcauga

SEQ ID NO: 1320363 - RNA, 19 nt, Homo sapiens
uaucagcagggaccaaaga

SEQ ID NO: 1320364 - RNA, 19 nt, Homo sapiens
auaaauacuuguggaaugc

SEQ ID NO: 1320365 - RNA, 19 nt, Homo sapiens
cugagggccugguaugcaa

SEQ ID NO: 1320366 - RNA, 19 nt, Homo sapiens
aagcaguaguccucagugu

SEQ ID NO: 1320367 - RNA, 19 nt, Homo sapiens
cugcaaggucacuuacaua

SEQ ID NO: 1320368 - RNA, 19 nt, Homo sapiens
gguucucauuguugccuuu

SEQ ID NO: 1320369 - RNA, 19 nt, Homo sapiens
gccugagucucuugguuuc

SEQ ID NO: 1320370 - RNA, 19 nt, Homo sapiens
gcgggacuacugccuaaug

SEQ ID NO: 1320371 - RNA, 19 nt, Homo sapiens
caucugagggccugguaug

SEQ ID NO: 1320372 - RNA, 19 nt, Homo sapiens
caguguguguguaagugaa

SEQ ID NO: 1320373 - RNA, 19 nt, Homo sapiens
uaucggagcuacgccugau

SEQ ID NO: 1320374 - RNA, 19 nt, Homo sapiens
agucacaccuccgcaagga

SEQ ID NO: 1320375 - RNA, 19 nt, Homo sapiens
uaagugaagaggaccuugu

SEQ ID NO: 1320376 - RNA, 19 nt, Homo sapiens
ucugcaaggucacuuacau

SEQ ID NO: 1320377 - RNA, 19 nt, Homo sapiens
uuuccugucugaacucuuc

SEQ ID NO: 1320378 - RNA, 19 nt, Homo sapiens
uugggacacuugaggaaga

SEQ ID NO: 1320379 - RNA, 19 nt, Homo sapiens
acuaaaaccugcuccaugu

SEQ ID NO: 1320380 - RNA, 19 nt, Homo sapiens
gcauccguguccgucagua

SEQ ID NO: 1320381 - RNA, 19 nt, Homo sapiens
ccuggaaaguuggacaugu

SEQ ID NO: 1320382 - RNA, 19 nt, Homo sapiens
ggagugguuugguauauua

SEQ ID NO: 1320383 - RNA, 19 nt, Homo sapiens
ccacagggauuacagcaua

SEQ ID NO: 1320384 - RNA, 19 nt, Homo sapiens
gaagcucucuuaacuguga

SEQ ID NO: 1320385 - RNA, 19 nt, Homo sapiens
ggucugucaugcuuuauua

SEQ ID NO: 1320386 - RNA, 19 nt, Homo sapiens
ggaguuggcugugagauug

SEQ ID NO: 1320387 - RNA, 19 nt, Homo sapiens
gcacggcgcuguaugaucu

SEQ ID NO: 1320388 - RNA, 19 nt, Homo sapiens
gugacaaacucugcacuua

SEQ ID NO: 1320389 - RNA, 19 nt, Homo sapiens
gcacuuaaguccccuguuu

SEQ ID NO: 1320390 - RNA, 19 nt, Homo sapiens
gaaaaggucugggguugua

SEQ ID NO: 1320391 - RNA, 19 nt, Homo sapiens
guggagacuugguucuuua

SEQ ID NO: 1320392 - RNA, 19 nt, Homo sapiens
gauuguaggugcucaagug

SEQ ID NO: 1320393 - RNA, 19 nt, Homo sapiens
gacaaacucugcacuuaag

SEQ ID NO: 1320394 - RNA, 19 nt, Homo sapiens
gcuguagcuuuauuguuua

SEQ ID NO: 1320395 - RNA, 19 nt, Homo sapiens
ugaggucugucaugcuuua

SEQ ID NO: 1320396 - RNA, 19 nt, Homo sapiens
ggucaucacuuuggucaga

SEQ ID NO: 1320397 - RNA, 19 nt, Homo sapiens
cacaggcccuuccuuaauu

SEQ ID NO: 1320398 - RNA, 19 nt, Homo sapiens
cgcuguagcuuuauuguuu

SEQ ID NO: 1320399 - RNA, 19 nt, Homo sapiens
gcccauauuuaauguguga

SEQ ID NO: 1320400 - RNA, 19 nt, Homo sapiens
uguaggugcucaaguguuu

SEQ ID NO: 1320401 - RNA, 19 nt, Homo sapiens
gguggagacuugguucuuu

SEQ ID NO: 1320402 - RNA, 19 nt, Homo sapiens
uaucacaggcccuuccuua

SEQ ID NO: 1320403 - RNA, 19 nt, Homo sapiens
gugcaguggugcgaucuua

SEQ ID NO: 1320404 - RNA, 19 nt, Homo sapiens
gcacuccuccuuauguuga

SEQ ID NO: 1320405 - RNA, 19 nt, Homo sapiens
gaugagggcccaagucuag

SEQ ID NO: 1320406 - RNA, 19 nt, Homo sapiens
cgcaagaggucuacgagaa

SEQ ID NO: 1320407 - RNA, 19 nt, Homo sapiens
aacacucgcuguagcuuua

SEQ ID NO: 1320408 - RNA, 19 nt, Homo sapiens
gaacacucgcuguagcuuu

SEQ ID NO: 1320409 - RNA, 19 nt, Homo sapiens
ugacaaacucugcacuuaa

SEQ ID NO: 1320410 - RNA, 19 nt, Homo sapiens
gaaaaccauuccaucauug

SEQ ID NO: 1320411 - RNA, 19 nt, Homo sapiens
ggacugagugugaaucugu

SEQ ID NO: 1320412 - RNA, 19 nt, Homo sapiens
cuugaaaugugcaauguga

SEQ ID NO: 1320413 - RNA, 19 nt, Homo sapiens
gugccaaucuagccugaaa

SEQ ID NO: 1320414 - RNA, 19 nt, Homo sapiens
gaguaucgguccaugaaag

SEQ ID NO: 1320415 - RNA, 19 nt, Homo sapiens
gcccaagucuagggucuaa

SEQ ID NO: 1320416 - RNA, 19 nt, Homo sapiens
agucuagggucuaaacaaa

SEQ ID NO: 1320417 - RNA, 19 nt, Homo sapiens
cugaagcucucuuaacugu

SEQ ID NO: 1320418 - RNA, 19 nt, Homo sapiens
gggcacuccuccuuauguu

SEQ ID NO: 1320419 - RNA, 19 nt, Homo sapiens
gguccuacuuggccucuug

SEQ ID NO: 1320420 - RNA, 19 nt, Homo sapiens
gcauaaggaaugaguguuc

SEQ ID NO: 1320421 - RNA, 19 nt, Homo sapiens
ucacaggcccuuccuuaau

SEQ ID NO: 1320422 - RNA, 19 nt, Homo sapiens
ucuguaaccuugaaaugug

SEQ ID NO: 1320423 - RNA, 19 nt, Homo sapiens
gcaaacggcaggaguaucg

SEQ ID NO: 1320424 - RNA, 19 nt, Homo sapiens
ugaaaaccauuccaucauu

SEQ ID NO: 1320425 - RNA, 19 nt, Homo sapiens
ccagaaauagagugacaaa

SEQ ID NO: 1320426 - RNA, 19 nt, Homo sapiens
gagcauaaggaaugagugu

SEQ ID NO: 1320427 - RNA, 19 nt, Homo sapiens
caggagugguuugguauau

SEQ ID NO: 1320428 - RNA, 19 nt, Homo sapiens
aguaguuggucaucacuuu

SEQ ID NO: 1320429 - RNA, 19 nt, Homo sapiens
uaacuugcagugcuuauca

SEQ ID NO: 1320430 - RNA, 19 nt, Homo sapiens
gacugagugugaaucugua

SEQ ID NO: 1320431 - RNA, 19 nt, Homo sapiens
ccaaagugcugggauugca

SEQ ID NO: 1320432 - RNA, 19 nt, Homo sapiens
uuggagaaguuacucugua

SEQ ID NO: 1320433 - RNA, 19 nt, Homo sapiens
gcaagaggucuacgagaag

SEQ ID NO: 1320434 - RNA, 19 nt, Homo sapiens
agaaauagagugacaaacu

SEQ ID NO: 1320435 - RNA, 19 nt, Homo sapiens
guuccugugcccauauuua

SEQ ID NO: 1320436 - RNA, 19 nt, Homo sapiens
ccacagcugguccuacuug

SEQ ID NO: 1320437 - RNA, 19 nt, Homo sapiens
gugcucaaguguuucuguu

SEQ ID NO: 1320438 - RNA, 19 nt, Homo sapiens
acaggcccuuccuuaauuu

SEQ ID NO: 1320439 - RNA, 19 nt, Homo sapiens
gggccagguucauccuuga

SEQ ID NO: 1320440 - RNA, 19 nt, Homo sapiens
guggucaacuucuggaaca

SEQ ID NO: 1320441 - RNA, 19 nt, Homo sapiens
gaguguuccugugcccaua

SEQ ID NO: 1320442 - RNA, 19 nt, Homo sapiens
aaaucaaggcggcuuacua

SEQ ID NO: 1320443 - RNA, 19 nt, Homo sapiens
gugcccauauuuaaugugu

SEQ ID NO: 1320444 - RNA, 19 nt, Homo sapiens
gaccaauuguugacuacca

SEQ ID NO: 1320445 - RNA, 19 nt, Homo sapiens
gccuuucgaugucugagaa

SEQ ID NO: 1320446 - RNA, 19 nt, Homo sapiens
guauauuacugagugcaau

SEQ ID NO: 1320447 - RNA, 19 nt, Homo sapiens
ggaugagggcccaagucua

SEQ ID NO: 1320448 - RNA, 19 nt, Homo sapiens
gggaguuggcugugagauu

SEQ ID NO: 1320449 - RNA, 19 nt, Homo sapiens
ucaccugguccucccuuua

SEQ ID NO: 1320450 - RNA, 19 nt, Homo sapiens
cacagggauuacagcauaa

SEQ ID NO: 1320451 - RNA, 19 nt, Homo sapiens
gccucagccuccuguguaa

SEQ ID NO: 1320452 - RNA, 19 nt, Homo sapiens
uuacuaccgucagugcuuu

SEQ ID NO: 1320453 - RNA, 19 nt, Homo sapiens
ccacgcaggcccaaaucaa

SEQ ID NO: 1320454 - RNA, 19 nt, Homo sapiens
cagggcgacugcucguauu

SEQ ID NO: 1320455 - RNA, 19 nt, Homo sapiens
caacuuugacgccuucuac

SEQ ID NO: 1320456 - RNA, 19 nt, Homo sapiens
ccaggagugguuugguaua

SEQ ID NO: 1320457 - RNA, 19 nt, Homo sapiens
agccaggagugguuuggua

SEQ ID NO: 1320458 - RNA, 19 nt, Homo sapiens
cuugaggucugucaugcuu

SEQ ID NO: 1320459 - RNA, 19 nt, Homo sapiens
caugacagcagaggagaaa

SEQ ID NO: 1320460 - RNA, 19 nt, Homo sapiens
uggagaaguuacucuguag

SEQ ID NO: 1320461 - RNA, 19 nt, Homo sapiens
ggaguaucgguccaugaaa

SEQ ID NO: 1320462 - RNA, 19 nt, Homo sapiens
ugugaccaauuguugacua

SEQ ID NO: 1320463 - RNA, 19 nt, Homo sapiens
cgaaagcccaggagugaag

SEQ ID NO: 1320464 - RNA, 19 nt, Homo sapiens
guucgggacugagugugaa

SEQ ID NO: 1320465 - RNA, 19 nt, Homo sapiens
cguccagccucccaaagug

SEQ ID NO: 1320466 - RNA, 19 nt, Homo sapiens
ggucugggguuguacgaaa

SEQ ID NO: 1320467 - RNA, 19 nt, Homo sapiens
gggccucuguaaccuugaa

SEQ ID NO: 1320468 - RNA, 19 nt, Homo sapiens
uuccagauguggucaacuu

SEQ ID NO: 1320469 - RNA, 19 nt, Homo sapiens
guuaaguaguuggucauca

SEQ ID NO: 1320470 - RNA, 19 nt, Homo sapiens
uuucugcucuguuucuaau

SEQ ID NO: 1320471 - RNA, 19 nt, Homo sapiens
guugguggcuugguguuca

SEQ ID NO: 1320472 - RNA, 19 nt, Homo sapiens
uggcuaguguuuuguauuu

SEQ ID NO: 1320473 - RNA, 19 nt, Homo sapiens
cgcacgauguucaacuuug

SEQ ID NO: 1320474 - RNA, 19 nt, Homo sapiens
ggcagggaguuggcuguga

SEQ ID NO: 1320475 - RNA, 19 nt, Homo sapiens
uuuaaugugugaccuugga

SEQ ID NO: 1320476 - RNA, 19 nt, Homo sapiens
caucaucggcuuuuauauu

SEQ ID NO: 1320477 - RNA, 19 nt, Homo sapiens
gcgccaaccgcacgauguu

SEQ ID NO: 1320478 - RNA, 19 nt, Homo sapiens
agacacggcugccauuuuc

SEQ ID NO: 1320479 - RNA, 19 nt, Homo sapiens
cuacuuggccucuugaaaa

SEQ ID NO: 1320480 - RNA, 19 nt, Homo sapiens
uuccugcacucaauguauu

SEQ ID NO: 1320481 - RNA, 19 nt, Homo sapiens
guaguuggucaucacuuug

SEQ ID NO: 1320482 - RNA, 19 nt, Homo sapiens
caacacacauuccucauga

SEQ ID NO: 1320483 - RNA, 19 nt, Homo sapiens
gagccaagaucacaccauu

SEQ ID NO: 1320484 - RNA, 19 nt, Homo sapiens
gagcugcggucuucugcua

SEQ ID NO: 1320485 - RNA, 19 nt, Homo sapiens
ccucggcacuguauucuuu

SEQ ID NO: 1320486 - RNA, 19 nt, Homo sapiens
caucuuccuugaauucuuu

SEQ ID NO: 1320487 - RNA, 19 nt, Homo sapiens
guaaagggccugcucucuu

SEQ ID NO: 1320488 - RNA, 19 nt, Homo sapiens
gggagcaccuggcuacaag

SEQ ID NO: 1320489 - RNA, 19 nt, Homo sapiens
guaccaugcugcuauuguc

SEQ ID NO: 1320490 - RNA, 19 nt, Homo sapiens
gcaggagaauggcuugaac

SEQ ID NO: 1320491 - RNA, 19 nt, Homo sapiens
gcaccuguagucccagcua

SEQ ID NO: 1320492 - RNA, 19 nt, Homo sapiens
acuccaauguugacuguuc

SEQ ID NO: 1320493 - RNA, 19 nt, Homo sapiens
ugacuguucuacaugaaac

SEQ ID NO: 1320494 - RNA, 19 nt, Homo sapiens
uguugacuguucuacauga

SEQ ID NO: 1320495 - RNA, 19 nt, Homo sapiens
guugacuguucuacaugaa

SEQ ID NO: 1320496 - RNA, 19 nt, Homo sapiens
ucaacacacauuccucaug

SEQ ID NO: 1320497 - RNA, 19 nt, Homo sapiens
uguguaccaugcugcuauu

SEQ ID NO: 1320498 - RNA, 19 nt, Homo sapiens
gccaagaucacaccauugc

SEQ ID NO: 1320499 - RNA, 19 nt, Homo sapiens
ugucaucuuccuugaauuc

SEQ ID NO: 1320500 - RNA, 19 nt, Homo sapiens
gaagcggagguugcaguga

SEQ ID NO: 1320501 - RNA, 19 nt, Homo sapiens
auugucaucuuccuugaau

SEQ ID NO: 1320502 - RNA, 19 nt, Homo sapiens
cuauugucaucuuccuuga

SEQ ID NO: 1320503 - RNA, 19 nt, Homo sapiens
ucaucuuccuugaauucuu

SEQ ID NO: 1320504 - RNA, 19 nt, Homo sapiens
ggacuuuggugguaucuuu

SEQ ID NO: 1320505 - RNA, 19 nt, Homo sapiens
uuaaagagcugguguuugg

SEQ ID NO: 1320506 - RNA, 19 nt, Homo sapiens
gcaauaaagcuucucauca

SEQ ID NO: 1320507 - RNA, 19 nt, Homo sapiens
caauaaagcuucucaucag

SEQ ID NO: 1320508 - RNA, 19 nt, Homo sapiens
ggugguaucuuucacacaa

SEQ ID NO: 1320509 - RNA, 19 nt, Homo sapiens
ccaagggugucucaugcua

SEQ ID NO: 1320510 - RNA, 19 nt, Homo sapiens
cagcaacgguuucuucauc

SEQ ID NO: 1320511 - RNA, 19 nt, Homo sapiens
gggcggugaucaucucuga

SEQ ID NO: 1320512 - RNA, 19 nt, Homo sapiens
aauaaacccucacugacuu

SEQ ID NO: 1320513 - RNA, 19 nt, Homo sapiens
cagggucucugcacaguga

SEQ ID NO: 1320514 - RNA, 19 nt, Homo sapiens
gagaugauccaggacagua

SEQ ID NO: 1320515 - RNA, 19 nt, Homo sapiens
gacauucgauacaucuuca

SEQ ID NO: 1320516 - RNA, 19 nt, Homo sapiens
ggacaaguggagccaggua

SEQ ID NO: 1320517 - RNA, 19 nt, Homo sapiens
gcuuccguauccaugauua

SEQ ID NO: 1320518 - RNA, 19 nt, Homo sapiens
ggcuagaacccgaaacaaa

SEQ ID NO: 1320519 - RNA, 19 nt, Homo sapiens
ggacauucgauacaucuuc

SEQ ID NO: 1320520 - RNA, 19 nt, Homo sapiens
caauaaacccucacugacu

SEQ ID NO: 1320521 - RNA, 19 nt, Homo sapiens
gaagaguuugucccacauu

SEQ ID NO: 1320522 - RNA, 19 nt, Homo sapiens
ccguauccaugauuauuug

SEQ ID NO: 1320523 - RNA, 19 nt, Homo sapiens
caagguaugagcagauuca

SEQ ID NO: 1320524 - RNA, 19 nt, Homo sapiens
cacaagguaugagcagauu

SEQ ID NO: 1320525 - RNA, 19 nt, Homo sapiens
gggcguugcuaggcugaaa

SEQ ID NO: 1320526 - RNA, 19 nt, Homo sapiens
caaccgcccuggaccuucu

SEQ ID NO: 1320527 - RNA, 19 nt, Homo sapiens
gcuagaacccgaaacaaaa

SEQ ID NO: 1320528 - RNA, 19 nt, Homo sapiens
gaacucagcaacgguuucu

SEQ ID NO: 1320529 - RNA, 19 nt, Homo sapiens
gaccuucacagcaguuguu

SEQ ID NO: 1320530 - RNA, 19 nt, Homo sapiens
caaggacuuuggugguauc

SEQ ID NO: 1320531 - RNA, 19 nt, Homo sapiens
ccacauuccagccauaagu

SEQ ID NO: 1320532 - RNA, 19 nt, Homo sapiens
gcaacgguuucuucaucca

SEQ ID NO: 1320533 - RNA, 19 nt, Homo sapiens
guuuaaagagcugguguuu

SEQ ID NO: 1320534 - RNA, 19 nt, Homo sapiens
caagaagaggcaagagaca

SEQ ID NO: 1320535 - RNA, 19 nt, Homo sapiens
ccaggaauuuugcuacuug

SEQ ID NO: 1320536 - RNA, 19 nt, Homo sapiens
gaauuuugcuacuuggaau

SEQ ID NO: 1320537 - RNA, 19 nt, Homo sapiens
cucaauaaacccucacuga

SEQ ID NO: 1320538 - RNA, 19 nt, Homo sapiens
gcggugaucaucucugaca

SEQ ID NO: 1320539 - RNA, 19 nt, Homo sapiens
ggagccagguagaggaaaa

SEQ ID NO: 1320540 - RNA, 19 nt, Homo sapiens
ggugucucaugcuacaaga

SEQ ID NO: 1320541 - RNA, 19 nt, Homo sapiens
aagaguuugucccacauuc

SEQ ID NO: 1320542 - RNA, 19 nt, Homo sapiens
gcuucuacguggagaugau

SEQ ID NO: 1320543 - RNA, 19 nt, Homo sapiens
uacaagaagaggcaagaga

SEQ ID NO: 1320544 - RNA, 19 nt, Homo sapiens
uacuuggaauuuggagaua

SEQ ID NO: 1320545 - RNA, 19 nt, Homo sapiens
cuacuuggaauuuggagau

SEQ ID NO: 1320546 - RNA, 19 nt, Homo sapiens
ggaacucagcaacgguuuc

SEQ ID NO: 1320547 - RNA, 19 nt, Homo sapiens
ccacaccugccaaggacuu

SEQ ID NO: 1320548 - RNA, 19 nt, Homo sapiens
cuucacagcaguuguugga

SEQ ID NO: 1320549 - RNA, 19 nt, Homo sapiens
gcuacaagaagaggcaaga

SEQ ID NO: 1320550 - RNA, 19 nt, Homo sapiens
aagggugucucaugcuaca

SEQ ID NO: 1320551 - RNA, 19 nt, Homo sapiens
gucccacauuccagccaua

SEQ ID NO: 1320552 - RNA, 19 nt, Homo sapiens
ucauuuccaucccagucaa

SEQ ID NO: 1320553 - RNA, 19 nt, Homo sapiens
gcaguuguuggagugguuu

SEQ ID NO: 1320554 - RNA, 19 nt, Homo sapiens
gggaaacccaggaauuuug

SEQ ID NO: 1320555 - RNA, 19 nt, Homo sapiens
agaagaguuugucccacau

SEQ ID NO: 1320556 - RNA, 19 nt, Homo sapiens
guaucuuucacacaaggua

SEQ ID NO: 1320557 - RNA, 19 nt, Homo sapiens
cagccacaccugccaagga

SEQ ID NO: 1320558 - RNA, 19 nt, Homo sapiens
ugucagaggugguuuauua

SEQ ID NO: 1320559 - RNA, 19 nt, Homo sapiens
gaucggaaauugcauagua

SEQ ID NO: 1320560 - RNA, 19 nt, Homo sapiens
caugagagaucaagagaua

SEQ ID NO: 1320561 - RNA, 19 nt, Homo sapiens
aaagguagcugaaugguuu

SEQ ID NO: 1320562 - RNA, 19 nt, Homo sapiens
gaacgggaaugucauauag

SEQ ID NO: 1320563 - RNA, 19 nt, Homo sapiens
gaaauugguucuuuguaug

SEQ ID NO: 1320564 - RNA, 19 nt, Homo sapiens
gaagugaucuacaacuaug

SEQ ID NO: 1320565 - RNA, 19 nt, Homo sapiens
gaaaugauccucccucuca

SEQ ID NO: 1320566 - RNA, 19 nt, Homo sapiens
agaaggagcucggaauaua

SEQ ID NO: 1320567 - RNA, 19 nt, Homo sapiens
ggagaagaauauucacaaa

SEQ ID NO: 1320568 - RNA, 19 nt, Homo sapiens
gggcuuaucugaaugauca

SEQ ID NO: 1320569 - RNA, 19 nt, Homo sapiens
gagcgauucuggauuacua

SEQ ID NO: 1320570 - RNA, 19 nt, Homo sapiens
gcccauaucuuaccaguuc

SEQ ID NO: 1320571 - RNA, 19 nt, Homo sapiens
guaaaucuaucaccaaucu

SEQ ID NO: 1320572 - RNA, 19 nt, Homo sapiens
gauccucccucucauggua

SEQ ID NO: 1320573 - RNA, 19 nt, Homo sapiens
gcaugugacuaucuuugua

SEQ ID NO: 1320574 - RNA, 19 nt, Homo sapiens
gaucuuccuugaaaccaua

SEQ ID NO: 1320575 - RNA, 19 nt, Homo sapiens
gagagaagcaugugacuau

SEQ ID NO: 1320576 - RNA, 19 nt, Homo sapiens
gaccaaagguagcugaaug

SEQ ID NO: 1320577 - RNA, 19 nt, Homo sapiens
cagaagugaucuacaacua

SEQ ID NO: 1320578 - RNA, 19 nt, Homo sapiens
gaugguaacuccagugauc

SEQ ID NO: 1320579 - RNA, 19 nt, Homo sapiens
ccaguagguuugugaaauu

SEQ ID NO: 1320580 - RNA, 19 nt, Homo sapiens
cuacaacuauguccaaaga

SEQ ID NO: 1320581 - RNA, 19 nt, Homo sapiens
gaaggagcucggaauauaa

SEQ ID NO: 1320582 - RNA, 19 nt, Homo sapiens
uaucuuaccaguucaguua

SEQ ID NO: 1320583 - RNA, 19 nt, Homo sapiens
gcagaguaauauauaguug

SEQ ID NO: 1320584 - RNA, 19 nt, Homo sapiens
ggaaagagucggcauguag

SEQ ID NO: 1320585 - RNA, 19 nt, Homo sapiens
gggagaugguguuuguaua

SEQ ID NO: 1320586 - RNA, 19 nt, Homo sapiens
gaguaaaucuaucaccaau

SEQ ID NO: 1320587 - RNA, 19 nt, Homo sapiens
gcccagaagugaucuacaa

SEQ ID NO: 1320588 - RNA, 19 nt, Homo sapiens
ggaacgggaaugucauaua

SEQ ID NO: 1320589 - RNA, 19 nt, Homo sapiens
ggagaugguguuuguauau

SEQ ID NO: 1320590 - RNA, 19 nt, Homo sapiens
ugauugggaugaagaauau

SEQ ID NO: 1320591 - RNA, 19 nt, Homo sapiens
aguguuugcucuucauuua

SEQ ID NO: 1320592 - RNA, 19 nt, Homo sapiens
gaaagagucggcauguaga

SEQ ID NO: 1320593 - RNA, 19 nt, Homo sapiens
gauugggaauagaagguua

SEQ ID NO: 1320594 - RNA, 19 nt, Homo sapiens
cuacaugugugcuuucaga

SEQ ID NO: 1320595 - RNA, 19 nt, Homo sapiens
ccacucuucuucauuguga

SEQ ID NO: 1320596 - RNA, 19 nt, Homo sapiens
uauccuaccuacaaagaaa

SEQ ID NO: 1320597 - RNA, 19 nt, Homo sapiens
gaaggaagaaggaaagagu

SEQ ID NO: 1320598 - RNA, 19 nt, Homo sapiens
uaguagaccucguaaacuu

SEQ ID NO: 1320599 - RNA, 19 nt, Homo sapiens
guauuuaucuugggcuuau

SEQ ID NO: 1320600 - RNA, 19 nt, Homo sapiens
ggaauagaagguuauccua

SEQ ID NO: 1320601 - RNA, 19 nt, Homo sapiens
gaaugucagaggugguuua

SEQ ID NO: 1320602 - RNA, 19 nt, Homo sapiens
ucaaaguauuccuccagua

SEQ ID NO: 1320603 - RNA, 19 nt, Homo sapiens
gcauguagacuuucagugu

SEQ ID NO: 1320604 - RNA, 19 nt, Homo sapiens
aaagaaggagcucggaaua

SEQ ID NO: 1320605 - RNA, 19 nt, Homo sapiens
gaugguguuuguauaugaa

SEQ ID NO: 1320606 - RNA, 19 nt, Homo sapiens
ccagugauccagagaauug

SEQ ID NO: 1320607 - RNA, 19 nt, Homo sapiens
gcucacuccuuguauuaga

SEQ ID NO: 1320608 - RNA, 19 nt, Homo sapiens
uuuaagugcuucugucaaa

SEQ ID NO: 1320609 - RNA, 19 nt, Homo sapiens
gugguuaaauggaaauguu

SEQ ID NO: 1320610 - RNA, 19 nt, Homo sapiens
gagaugguguuuguauaug

SEQ ID NO: 1320611 - RNA, 19 nt, Homo sapiens
guacaacucuagcauuuug

SEQ ID NO: 1320612 - RNA, 19 nt, Homo sapiens
uggaugagcuggauauucu

SEQ ID NO: 1320613 - RNA, 19 nt, Homo sapiens
gcauccaacuccacaagug

SEQ ID NO: 1320614 - RNA, 19 nt, Homo sapiens
gaagauuagauugggaaua

SEQ ID NO: 1320615 - RNA, 19 nt, Homo sapiens
cagcucacuccuuguauua

SEQ ID NO: 1320616 - RNA, 19 nt, Homo sapiens
ugacagaucacgagauuca

SEQ ID NO: 1320617 - RNA, 19 nt, Homo sapiens
aagauuagauugggaauag

SEQ ID NO: 1320618 - RNA, 19 nt, Homo sapiens
ucagugcccuaaugcauga

SEQ ID NO: 1320619 - RNA, 19 nt, Homo sapiens
uggcauaucuauuccugaa

SEQ ID NO: 1320620 - RNA, 19 nt, Homo sapiens
gcaccauguugaacgagaa

SEQ ID NO: 1320621 - RNA, 19 nt, Homo sapiens
cagauaaaaugcagaguaa

SEQ ID NO: 1320622 - RNA, 19 nt, Homo sapiens
gaucuggccgagaacauaa

SEQ ID NO: 1320623 - RNA, 19 nt, Homo sapiens
augcugaucuuccuugaaa

SEQ ID NO: 1320624 - RNA, 19 nt, Homo sapiens
gaugggagaagaauauuca

SEQ ID NO: 1320625 - RNA, 19 nt, Homo sapiens
gcuuacagaugaugaugug

SEQ ID NO: 1320626 - RNA, 19 nt, Homo sapiens
gcauaucuauuccugaacu

SEQ ID NO: 1320627 - RNA, 19 nt, Homo sapiens
gaacagcagcagaaacagu

SEQ ID NO: 1320628 - RNA, 19 nt, Homo sapiens
gggaacagcagcagaaaca

SEQ ID NO: 1320629 - RNA, 19 nt, Homo sapiens
ccagcucacuccuuguauu

SEQ ID NO: 1320630 - RNA, 19 nt, Homo sapiens
gagauuuaaugcccauauc

SEQ ID NO: 1320631 - RNA, 19 nt, Homo sapiens
gugcuucugucaaaguauu

SEQ ID NO: 1320632 - RNA, 19 nt, Homo sapiens
gcacagccaaauacaaugu

SEQ ID NO: 1320633 - RNA, 19 nt, Homo sapiens
guggauaacacuagauuug

SEQ ID NO: 1320634 - RNA, 19 nt, Homo sapiens
uucgagcgauucuggauua

SEQ ID NO: 1320635 - RNA, 19 nt, Homo sapiens
cagaaacaguagucaguca

SEQ ID NO: 1320636 - RNA, 19 nt, Homo sapiens
gcucguagacaauuugaau

SEQ ID NO: 1320637 - RNA, 19 nt, Homo sapiens
gggagaagaauauucacaa

SEQ ID NO: 1320638 - RNA, 19 nt, Homo sapiens
ugcaugaguuaucaaauga

SEQ ID NO: 1320639 - RNA, 19 nt, Homo sapiens
ggaucuggccgagaacaua

SEQ ID NO: 1320640 - RNA, 19 nt, Homo sapiens
uuuaggauauugcagugua

SEQ ID NO: 1320641 - RNA, 19 nt, Homo sapiens
acagagauguggccaaguc

SEQ ID NO: 1320642 - RNA, 19 nt, Homo sapiens
gaagaauauccaccacaga

SEQ ID NO: 1320643 - RNA, 19 nt, Homo sapiens
ccuaaugcaugaguuauca

SEQ ID NO: 1320644 - RNA, 19 nt, Homo sapiens
guuuggaucuggccgagaa

SEQ ID NO: 1320645 - RNA, 19 nt, Homo sapiens
ccagucugccuuacccuua

SEQ ID NO: 1320646 - RNA, 19 nt, Homo sapiens
gcagggagugugaauguca

SEQ ID NO: 1320647 - RNA, 19 nt, Homo sapiens
gaaguuccaguuguaaaug

SEQ ID NO: 1320648 - RNA, 19 nt, Homo sapiens
ggagaaggaagaaggaaag

SEQ ID NO: 1320649 - RNA, 19 nt, Homo sapiens
gaucuacaacuauguccaa

SEQ ID NO: 1320650 - RNA, 19 nt, Homo sapiens
acuacagguucgagaguua

SEQ ID NO: 1320651 - RNA, 19 nt, Homo sapiens
guuguagacccauccauuu

SEQ ID NO: 1320652 - RNA, 19 nt, Homo sapiens
aaaugugacuucuccaaca

SEQ ID NO: 1320653 - RNA, 19 nt, Homo sapiens
gauagacgaaggucaagug

SEQ ID NO: 1320654 - RNA, 19 nt, Homo sapiens
ucuuaagaguuaugggaua

SEQ ID NO: 1320655 - RNA, 19 nt, Homo sapiens
cagaagugguggaaauugg

SEQ ID NO: 1320656 - RNA, 19 nt, Homo sapiens
gcaaggccacucuucuuca

SEQ ID NO: 1320657 - RNA, 19 nt, Homo sapiens
uuucagagcaguaguguga

SEQ ID NO: 1320658 - RNA, 19 nt, Homo sapiens
gaagagagaugucuaccua

SEQ ID NO: 1320659 - RNA, 19 nt, Homo sapiens
gaacauugauuacugaagu

SEQ ID NO: 1320660 - RNA, 19 nt, Homo sapiens
ggaaagcacuggucaacau

SEQ ID NO: 1320661 - RNA, 19 nt, Homo sapiens
gcaauaacaucaaguacca

SEQ ID NO: 1320662 - RNA, 19 nt, Homo sapiens
ugaaagggaacauugauua

SEQ ID NO: 1320663 - RNA, 19 nt, Homo sapiens
caggauaucuugugugaug

SEQ ID NO: 1320664 - RNA, 19 nt, Homo sapiens
ggaccaauauugugaucuu

SEQ ID NO: 1320665 - RNA, 19 nt, Homo sapiens
aaacagcucuucauaacau

SEQ ID NO: 1320666 - RNA, 19 nt, Homo sapiens
ccacaaacagcucuucaua

SEQ ID NO: 1320667 - RNA, 19 nt, Homo sapiens
uaggauggcuucuccaguu

SEQ ID NO: 1320668 - RNA, 19 nt, Homo sapiens
acaaacagcucuucauaac

SEQ ID NO: 1320669 - RNA, 19 nt, Homo sapiens
gguaaacacuacacgugaa

SEQ ID NO: 1320670 - RNA, 19 nt, Homo sapiens
ggugcuaguuugaauaaau

SEQ ID NO: 1320671 - RNA, 19 nt, Homo sapiens
gaaccuccagggaccaaua

SEQ ID NO: 1320672 - RNA, 19 nt, Homo sapiens
gugaacaucugggagguaa

SEQ ID NO: 1320673 - RNA, 19 nt, Homo sapiens
gaggugcuaguuugaauaa

SEQ ID NO: 1320674 - RNA, 19 nt, Homo sapiens
gugcuaguuugaauaaaug

SEQ ID NO: 1320675 - RNA, 19 nt, Homo sapiens
gacauuccauacauugaga

SEQ ID NO: 1320676 - RNA, 19 nt, Homo sapiens
caucaaguaccaugacauu

SEQ ID NO: 1320677 - RNA, 19 nt, Homo sapiens
caaugggcaugcaauaaca

SEQ ID NO: 1320678 - RNA, 19 nt, Homo sapiens
aagcaaacuuucccauuuc

SEQ ID NO: 1320679 - RNA, 19 nt, Homo sapiens
ggaggugcuaguuugaaua

SEQ ID NO: 1320680 - RNA, 19 nt, Homo sapiens
ccuugaggcuguaggauga

SEQ ID NO: 1320681 - RNA, 19 nt, Homo sapiens
gcaaugggcaugcaauaac

SEQ ID NO: 1320682 - RNA, 19 nt, Homo sapiens
cacaaacagcucuucauaa

SEQ ID NO: 1320683 - RNA, 19 nt, Homo sapiens
gaaagggaacauugauuac

SEQ ID NO: 1320684 - RNA, 19 nt, Homo sapiens
gagagugaagaacccuuua

SEQ ID NO: 1320685 - RNA, 19 nt, Homo sapiens
caaacuuucccauuuccua

SEQ ID NO: 1320686 - RNA, 19 nt, Homo sapiens
aacaucacauggacaaauu

SEQ ID NO: 1320687 - RNA, 19 nt, Homo sapiens
agaagcagcaugagaguga

SEQ ID NO: 1320688 - RNA, 19 nt, Homo sapiens
caacaucacauggacaaau

SEQ ID NO: 1320689 - RNA, 19 nt, Homo sapiens
uuccauacauugagaguga

SEQ ID NO: 1320690 - RNA, 19 nt, Homo sapiens
ucaaagaggaagugaagga

SEQ ID NO: 1320691 - RNA, 19 nt, Homo sapiens
gaauaaaugugacaaaagc

SEQ ID NO: 1320692 - RNA, 19 nt, Homo sapiens
ccaugacauuccauacauu

SEQ ID NO: 1320693 - RNA, 19 nt, Homo sapiens
cagcaaugggcaugcaaua

SEQ ID NO: 1320694 - RNA, 19 nt, Homo sapiens
gaagcagcaugagagugaa

SEQ ID NO: 1320695 - RNA, 19 nt, Homo sapiens
ugcaugaaaucaaagcaaa

SEQ ID NO: 1320696 - RNA, 19 nt, Homo sapiens
uaaagauggccuggaagua

SEQ ID NO: 1320697 - RNA, 19 nt, Homo sapiens
gauggcuucuccaguuaau

SEQ ID NO: 1320698 - RNA, 19 nt, Homo sapiens
aggauggcuucuccaguua

SEQ ID NO: 1320699 - RNA, 19 nt, Homo sapiens
ccagggaccaauauuguga

SEQ ID NO: 1320700 - RNA, 19 nt, Homo sapiens
cucaggauaucuuguguga

SEQ ID NO: 1320701 - RNA, 19 nt, Homo sapiens
caaguaccaugacauucca

SEQ ID NO: 1320702 - RNA, 19 nt, Homo sapiens
gaccaauauugugaucuug

SEQ ID NO: 1320703 - RNA, 19 nt, Homo sapiens
agagaugucuaccuaggau

SEQ ID NO: 1320704 - RNA, 19 nt, Homo sapiens
caugcaauaacaucaagua

SEQ ID NO: 1320705 - RNA, 19 nt, Homo sapiens
gaaagcacuggucaacauc

SEQ ID NO: 1320706 - RNA, 19 nt, Homo sapiens
gagugaagaacccuuuaug

SEQ ID NO: 1320707 - RNA, 19 nt, Homo sapiens
gcuguaggaugacaacacu

SEQ ID NO: 1320708 - RNA, 19 nt, Homo sapiens
caaagaggaagugaaggaa

SEQ ID NO: 1320709 - RNA, 19 nt, Homo sapiens
gaacaucugggagguaaac

SEQ ID NO: 1320710 - RNA, 19 nt, Homo sapiens
aaagauggccuggaaguag

SEQ ID NO: 1320711 - RNA, 19 nt, Homo sapiens
aagggaacauugauuacug

SEQ ID NO: 1320712 - RNA, 19 nt, Homo sapiens
gugaaagggaacauugauu

SEQ ID NO: 1320713 - RNA, 19 nt, Homo sapiens
uguaggaugacaacacuuu

SEQ ID NO: 1320714 - RNA, 19 nt, Homo sapiens
ggauggcuucuccaguuaa

SEQ ID NO: 1320715 - RNA, 19 nt, Homo sapiens
ggugagaagcagcaugaga

SEQ ID NO: 1320716 - RNA, 19 nt, Homo sapiens
cccauuuccuaccauauau

SEQ ID NO: 1320717 - RNA, 19 nt, Homo sapiens
ccacugcuuccuccacaaa

SEQ ID NO: 1320718 - RNA, 19 nt, Homo sapiens
caugacauuccauacauug

SEQ ID NO: 1320719 - RNA, 19 nt, Homo sapiens
gagagaugucuaccuagga

SEQ ID NO: 1320720 - RNA, 19 nt, Homo sapiens
ucccauuuccuaccauaua

SEQ ID NO: 1320721 - RNA, 19 nt, Homo sapiens
agggaacauugauuacuga

SEQ ID NO: 1320722 - RNA, 19 nt, Homo sapiens
caaacagcucuucauaaca

SEQ ID NO: 1320723 - RNA, 19 nt, Homo sapiens
gggcaugcaauaacaucaa

SEQ ID NO: 1320724 - RNA, 19 nt, Homo sapiens
uggaggugcuaguuugaau

SEQ ID NO: 1320725 - RNA, 19 nt, Homo sapiens
ugagagugaagaacccuuu

SEQ ID NO: 1320726 - RNA, 19 nt, Homo sapiens
ucacauggacaaauuucau

SEQ ID NO: 1320727 - RNA, 19 nt, Homo sapiens
aagauggccuggaaguagu

SEQ ID NO: 1320728 - RNA, 19 nt, Homo sapiens
gcacuggucaacaucacau

SEQ ID NO: 1320729 - RNA, 19 nt, Homo sapiens
ggugaaagggaacauugau

SEQ ID NO: 1320730 - RNA, 19 nt, Homo sapiens
ggcaugcaauaacaucaag

SEQ ID NO: 1320731 - RNA, 19 nt, Homo sapiens
cuaaagauggccuggaagu

SEQ ID NO: 1320732 - RNA, 19 nt, Homo sapiens
cuguggaggugcuaguuug

SEQ ID NO: 1320733 - RNA, 19 nt, Homo sapiens
uaggaugacaacacuuuga

SEQ ID NO: 1320734 - RNA, 19 nt, Homo sapiens
cgugaagaguggugaaagg

SEQ ID NO: 1320735 - RNA, 19 nt, Homo sapiens
guaaacacuacacgugaag

SEQ ID NO: 1320736 - RNA, 19 nt, Homo sapiens
cacauggacaaauuucauu

SEQ ID NO: 1320737 - RNA, 19 nt, Homo sapiens
ugucaaagaggaagugaag

SEQ ID NO: 1320738 - RNA, 19 nt, Homo sapiens
aaggugagaagcagcauga

SEQ ID NO: 1320739 - RNA, 19 nt, Homo sapiens
guggugaaagggaacauug

SEQ ID NO: 1320740 - RNA, 19 nt, Homo sapiens
guaggaugacaacacuuug

SEQ ID NO: 1320741 - RNA, 19 nt, Homo sapiens
gcagcaaugggcaugcaau

SEQ ID NO: 1320742 - RNA, 19 nt, Homo sapiens
uucuaaagauggccuggaa

SEQ ID NO: 1320743 - RNA, 19 nt, Homo sapiens
ugggcugcaugaaaucaaa

SEQ ID NO: 1320744 - RNA, 19 nt, Homo sapiens
ucugggagguaaacacuac

SEQ ID NO: 1320745 - RNA, 19 nt, Homo sapiens
caucacauggacaaauuuc

SEQ ID NO: 1320746 - RNA, 19 nt, Homo sapiens
gccagaagagagaugucua

SEQ ID NO: 1320747 - RNA, 19 nt, Homo sapiens
cauuuccuaccauauauga

SEQ ID NO: 1320748 - RNA, 19 nt, Homo sapiens
auugugaucuuggaauaug

SEQ ID NO: 1320749 - RNA, 19 nt, Homo sapiens
accaugacauuccauacau

SEQ ID NO: 1320750 - RNA, 19 nt, Homo sapiens
uaacaucaaguaccaugac

SEQ ID NO: 1320751 - RNA, 19 nt, Homo sapiens
gucaacaucacauggacaa

SEQ ID NO: 1320752 - RNA, 19 nt, Homo sapiens
gcagcaugagagugaagaa

SEQ ID NO: 1320753 - RNA, 19 nt, Homo sapiens
uauaugaaggugagaagca

SEQ ID NO: 1320754 - RNA, 19 nt, Homo sapiens
gaaguucucuuggaccuua

SEQ ID NO: 1320755 - RNA, 19 nt, Homo sapiens
gaaagaggcuccugaagca

SEQ ID NO: 1320756 - RNA, 19 nt, Homo sapiens
gagcuacucugguugguaa

SEQ ID NO: 1320757 - RNA, 19 nt, Homo sapiens
cgacacagcugcagggaaa

SEQ ID NO: 1320758 - RNA, 19 nt, Homo sapiens
gaaggacuauggacucuug

SEQ ID NO: 1320759 - RNA, 19 nt, Homo sapiens
gauaaccucuaagccauua

SEQ ID NO: 1320760 - RNA, 19 nt, Homo sapiens
ugacagagcugguggaaca

SEQ ID NO: 1320761 - RNA, 19 nt, Homo sapiens
gaugggaucucacuagguu

SEQ ID NO: 1320762 - RNA, 19 nt, Homo sapiens
guaguaacuugacuuaaga

SEQ ID NO: 1320763 - RNA, 19 nt, Homo sapiens
gguaguaacuugacuuaag

SEQ ID NO: 1320764 - RNA, 19 nt, Homo sapiens
ucagaagccugcagaauca

SEQ ID NO: 1320765 - RNA, 19 nt, Homo sapiens
cauccaaccuuuaacuuga

SEQ ID NO: 1320766 - RNA, 19 nt, Homo sapiens
gcaucuggcugaaccuuga

SEQ ID NO: 1320767 - RNA, 19 nt, Homo sapiens
gagaagagcaucacagaag

SEQ ID NO: 1320768 - RNA, 19 nt, Homo sapiens
uaaagcaaguaaaggugua

SEQ ID NO: 1320769 - RNA, 19 nt, Homo sapiens
aaguaaagguguaagguuu

SEQ ID NO: 1320770 - RNA, 19 nt, Homo sapiens
agggaaagcuugccuucua

SEQ ID NO: 1320771 - RNA, 19 nt, Homo sapiens
caucauugcugggagaauu

SEQ ID NO: 1320772 - RNA, 19 nt, Homo sapiens
gcuuacauccuggaaauua

SEQ ID NO: 1320773 - RNA, 19 nt, Homo sapiens
ggacauuccaaauaaagaa

SEQ ID NO: 1320774 - RNA, 19 nt, Homo sapiens
ggaugaacuugggauguuu

SEQ ID NO: 1320775 - RNA, 19 nt, Homo sapiens
caccacaccuggccaagaa

SEQ ID NO: 1320776 - RNA, 19 nt, Homo sapiens
gggaaagcuugccuucuau

SEQ ID NO: 1320777 - RNA, 19 nt, Homo sapiens
ggccauccauccaaccuuu

SEQ ID NO: 1320778 - RNA, 19 nt, Homo sapiens
gguguaagguuuccuaagg

SEQ ID NO: 1320779 - RNA, 19 nt, Homo sapiens
ccugggagauaaccucuaa

SEQ ID NO: 1320780 - RNA, 19 nt, Homo sapiens
cuccaaagcuggugacuuc

SEQ ID NO: 1320781 - RNA, 19 nt, Homo sapiens
ggaacaucuuguagacauu

SEQ ID NO: 1320782 - RNA, 19 nt, Homo sapiens
ugugaucaaucccuaguaa

SEQ ID NO: 1320783 - RNA, 19 nt, Homo sapiens
uaaaagcccuggacaccua

SEQ ID NO: 1320784 - RNA, 19 nt, Homo sapiens
ccuaagggauuacaacaca

SEQ ID NO: 1320785 - RNA, 19 nt, Homo sapiens
gaagagcaucacagaaguu

SEQ ID NO: 1320786 - RNA, 19 nt, Homo sapiens
ggacucuuguuguguggaa

SEQ ID NO: 1320787 - RNA, 19 nt, Homo sapiens
gaacaucuuguagacauug

SEQ ID NO: 1320788 - RNA, 19 nt, Homo sapiens
gaggauaauuggaaguucu

SEQ ID NO: 1320789 - RNA, 19 nt, Homo sapiens
cugggagaauuaagcauua

SEQ ID NO: 1320790 - RNA, 19 nt, Homo sapiens
gaaagcuugccuucuauuc

SEQ ID NO: 1320791 - RNA, 19 nt, Homo sapiens
ggacuauggacucuuguug

SEQ ID NO: 1320792 - RNA, 19 nt, Homo sapiens
uuaugugccuuucuucauu

SEQ ID NO: 1320793 - RNA, 19 nt, Homo sapiens
gaacuugggauguuugaac

SEQ ID NO: 1320794 - RNA, 19 nt, Homo sapiens
gacuuaagaauaccacuuu

SEQ ID NO: 1320795 - RNA, 19 nt, Homo sapiens
caaucaggguaguaacuug

SEQ ID NO: 1320796 - RNA, 19 nt, Homo sapiens
caaguaaagguguaagguu

SEQ ID NO: 1320797 - RNA, 19 nt, Homo sapiens
ggaaagcuugccuucuauu

SEQ ID NO: 1320798 - RNA, 19 nt, Homo sapiens
ccagccaggucuuauguuc

SEQ ID NO: 1320799 - RNA, 19 nt, Homo sapiens
gcauuauccugaagacucu

SEQ ID NO: 1320800 - RNA, 19 nt, Homo sapiens
ggaccuggccgacaaguac

SEQ ID NO: 1320801 - RNA, 19 nt, Homo sapiens
gaccucggcugcaucaucu

SEQ ID NO: 1320802 - RNA, 19 nt, Homo sapiens
ucucuuggaccuuaccuua

SEQ ID NO: 1320803 - RNA, 19 nt, Homo sapiens
ucuauucaguggacaauca

SEQ ID NO: 1320804 - RNA, 19 nt, Homo sapiens
aagaaagcgucaccuggaa

SEQ ID NO: 1320805 - RNA, 19 nt, Homo sapiens
gcuggugacuuccgacaca

SEQ ID NO: 1320806 - RNA, 19 nt, Homo sapiens
gagaggauaauuggaaguu

SEQ ID NO: 1320807 - RNA, 19 nt, Homo sapiens
caggagaggauaauuggaa

SEQ ID NO: 1320808 - RNA, 19 nt, Homo sapiens
ccacaccuggccaagaaua

SEQ ID NO: 1320809 - RNA, 19 nt, Homo sapiens
ccuggaaauuaccugauaa

SEQ ID NO: 1320810 - RNA, 19 nt, Homo sapiens
ugggugagcuacucugguu

SEQ ID NO: 1320811 - RNA, 19 nt, Homo sapiens
uggcuuacauccuggaaau

SEQ ID NO: 1320812 - RNA, 19 nt, Homo sapiens
gcugggagaauuaagcauu

SEQ ID NO: 1320813 - RNA, 19 nt, Homo sapiens
uggaacaucuuguagacau

SEQ ID NO: 1320814 - RNA, 19 nt, Homo sapiens
gaaagcgucaccuggaaag

SEQ ID NO: 1320815 - RNA, 19 nt, Homo sapiens
ccaaggugcugggauuaca

SEQ ID NO: 1320816 - RNA, 19 nt, Homo sapiens
gguggaacaucuuguagac

SEQ ID NO: 1320817 - RNA, 19 nt, Homo sapiens
uaccuuaugugccuuucuu

SEQ ID NO: 1320818 - RNA, 19 nt, Homo sapiens
aaacuguccuuggcucaga

SEQ ID NO: 1320819 - RNA, 19 nt, Homo sapiens
cuggaacugugaaagguuu

SEQ ID NO: 1320820 - RNA, 19 nt, Homo sapiens
ucuuggaccuuaccuuaug

SEQ ID NO: 1320821 - RNA, 19 nt, Homo sapiens
gcugguggaacaucuugua

SEQ ID NO: 1320822 - RNA, 19 nt, Homo sapiens
uccuggaaauuaccugaua

SEQ ID NO: 1320823 - RNA, 19 nt, Homo sapiens
agaagagcaucacagaagu

SEQ ID NO: 1320824 - RNA, 19 nt, Homo sapiens
uaugugccuuucuucauug

SEQ ID NO: 1320825 - RNA, 19 nt, Homo sapiens
uagagaagagcaucacaga

SEQ ID NO: 1320826 - RNA, 19 nt, Homo sapiens
uaagguuuccuaagggauu

SEQ ID NO: 1320827 - RNA, 19 nt, Homo sapiens
gcagggaaaaucagagaua

SEQ ID NO: 1320828 - RNA, 19 nt, Homo sapiens
aggaugaacuugggauguu

SEQ ID NO: 1320829 - RNA, 19 nt, Homo sapiens
uccaugaccuagaagaaau

SEQ ID NO: 1320830 - RNA, 19 nt, Homo sapiens
gucagaagccugcagaauc

SEQ ID NO: 1320831 - RNA, 19 nt, Homo sapiens
gaagcaugccaaugugauc

SEQ ID NO: 1320832 - RNA, 19 nt, Homo sapiens
cagugaagcaugccaaugu

SEQ ID NO: 1320833 - RNA, 19 nt, Homo sapiens
aagcugaggagacuaaguu

SEQ ID NO: 1320834 - RNA, 19 nt, Homo sapiens
gauuacaacacagugguuu

SEQ ID NO: 1320835 - RNA, 19 nt, Homo sapiens
gcaaguaaagguguaaggu

SEQ ID NO: 1320836 - RNA, 19 nt, Homo sapiens
gggaaggacuauggacucu

SEQ ID NO: 1320837 - RNA, 19 nt, Homo sapiens
ucuguauccuuucacugua

SEQ ID NO: 1320838 - RNA, 19 nt, Homo sapiens
acuauggacucuuguugug

SEQ ID NO: 1320839 - RNA, 19 nt, Homo sapiens
guccaaggauucccguaca

SEQ ID NO: 1320840 - RNA, 19 nt, Homo sapiens
ccaagaauaccacuuuuga

SEQ ID NO: 1320841 - RNA, 19 nt, Homo sapiens
aagguuuccuaagggauua

SEQ ID NO: 1320842 - RNA, 19 nt, Homo sapiens
ccauccaaccuuuaacuug

SEQ ID NO: 1320843 - RNA, 19 nt, Homo sapiens
auaauuggaaguucucuug

SEQ ID NO: 1320844 - RNA, 19 nt, Homo sapiens
gaaguuaauccuuuugugu

SEQ ID NO: 1320845 - RNA, 19 nt, Homo sapiens
cuguauccuuucacuguaa

SEQ ID NO: 1320846 - RNA, 19 nt, Homo sapiens
gcuacucugguugguaaua

SEQ ID NO: 1320847 - RNA, 19 nt, Homo sapiens
gcaugccaaugugaucaau

SEQ ID NO: 1320848 - RNA, 19 nt, Homo sapiens
gaugaacuugggauguuug

SEQ ID NO: 1320849 - RNA, 19 nt, Homo sapiens
uggccaagaauaccacuuu

SEQ ID NO: 1320850 - RNA, 19 nt, Homo sapiens
ucgaauuccuggucucaag

SEQ ID NO: 1320851 - RNA, 19 nt, Homo sapiens
uuccauggcuucuccaaag

SEQ ID NO: 1320852 - RNA, 19 nt, Homo sapiens
gagcugguggaacaucuug

SEQ ID NO: 1320853 - RNA, 19 nt, Homo sapiens
ggcccugucuucuggaaag

SEQ ID NO: 1320854 - RNA, 19 nt, Homo sapiens
ggaaaugccuuaaggauag

SEQ ID NO: 1320855 - RNA, 19 nt, Homo sapiens
ggacagccguguuucuuaa

SEQ ID NO: 1320856 - RNA, 19 nt, Homo sapiens
ggccaaagcuuaacuggau

SEQ ID NO: 1320857 - RNA, 19 nt, Homo sapiens
ccacaaggcucccuaaugc

SEQ ID NO: 1320858 - RNA, 19 nt, Homo sapiens
gagcugcccuucaccuuug

SEQ ID NO: 1320859 - RNA, 19 nt, Homo sapiens
gacaugaccuugugguaga

SEQ ID NO: 1320860 - RNA, 19 nt, Homo sapiens
uagaggagcugcccgaaga

SEQ ID NO: 1320861 - RNA, 19 nt, Homo sapiens
uggcaaagcuaucagagaa

SEQ ID NO: 1320862 - RNA, 19 nt, Homo sapiens
gaagugaagaggucugauu

SEQ ID NO: 1320863 - RNA, 19 nt, Homo sapiens
ggaaaucugccuaccaaga

SEQ ID NO: 1320864 - RNA, 19 nt, Homo sapiens
ccaaggcccugaccacuuc

SEQ ID NO: 1320865 - RNA, 19 nt, Homo sapiens
cuccaugacuggccuauuu

SEQ ID NO: 1320866 - RNA, 19 nt, Homo sapiens
caacagggacuccaaucaa

SEQ ID NO: 1320867 - RNA, 19 nt, Homo sapiens
ugacacaucuuugaaccuu

SEQ ID NO: 1320868 - RNA, 19 nt, Homo sapiens
gaaaugccuuaaggauaga

SEQ ID NO: 1320869 - RNA, 19 nt, Homo sapiens
ucucuucccuugccuacua

SEQ ID NO: 1320870 - RNA, 19 nt, Homo sapiens
ugacuggccuauuuacugu

SEQ ID NO: 1320871 - RNA, 19 nt, Homo sapiens
uggccgugcuuuccacuua

SEQ ID NO: 1320872 - RNA, 19 nt, Homo sapiens
ggucuagacagcacaguaa

SEQ ID NO: 1320873 - RNA, 19 nt, Homo sapiens
gaaaucugccuaccaagag

SEQ ID NO: 1320874 - RNA, 19 nt, Homo sapiens
gguagcggcuugggucuga

SEQ ID NO: 1320875 - RNA, 19 nt, Homo sapiens
guguguguguguaacaaua

SEQ ID NO: 1320876 - RNA, 19 nt, Homo sapiens
ucagagaacggacagugua

SEQ ID NO: 1320877 - RNA, 19 nt, Homo sapiens
caaaugggacugugguguu

SEQ ID NO: 1320878 - RNA, 19 nt, Homo sapiens
gugcggugguugauguuaa

SEQ ID NO: 1320879 - RNA, 19 nt, Homo sapiens
aaaugggacugugguguuu

SEQ ID NO: 1320880 - RNA, 19 nt, Homo sapiens
ggagcugcccuucaccuuu

SEQ ID NO: 1320881 - RNA, 19 nt, Homo sapiens
uggaaaugccuuaaggaua

SEQ ID NO: 1320882 - RNA, 19 nt, Homo sapiens
gagccgcacucauucucuu

SEQ ID NO: 1320883 - RNA, 19 nt, Homo sapiens
ccacuucugugccaguugu

SEQ ID NO: 1320884 - RNA, 19 nt, Homo sapiens
guccagcucuuuauucucu

SEQ ID NO: 1320885 - RNA, 19 nt, Homo sapiens
gaucagggcaggaugacau

SEQ ID NO: 1320886 - RNA, 19 nt, Homo sapiens
agggaaaucugccuaccaa

SEQ ID NO: 1320887 - RNA, 19 nt, Homo sapiens
ggauagaggcugggcauca

SEQ ID NO: 1320888 - RNA, 19 nt, Homo sapiens
ugucgaugcugauguggaa

SEQ ID NO: 1320889 - RNA, 19 nt, Homo sapiens
ccaaccugcugccugagaa

SEQ ID NO: 1320890 - RNA, 19 nt, Homo sapiens
uaagugaggcugccaccuu

SEQ ID NO: 1320891 - RNA, 19 nt, Homo sapiens
ccuguaacuucccaccuuu

SEQ ID NO: 1320892 - RNA, 19 nt, Homo sapiens
acacaucuuugaaccuugu

SEQ ID NO: 1320893 - RNA, 19 nt, Homo sapiens
gcucuuuauucucuacuuc

SEQ ID NO: 1320894 - RNA, 19 nt, Homo sapiens
cgugggagccgcacucauu

SEQ ID NO: 1320895 - RNA, 19 nt, Homo sapiens
ggucugacacaucuuugaa

SEQ ID NO: 1320896 - RNA, 19 nt, Homo sapiens
ucugcucacuggucucuuu

SEQ ID NO: 1320897 - RNA, 19 nt, Homo sapiens
uguggaaccucuacuacau

SEQ ID NO: 1320898 - RNA, 19 nt, Homo sapiens
gagauccaccggcgauaug

SEQ ID NO: 1320899 - RNA, 19 nt, Homo sapiens
cagaaccacuuaccaagcu

SEQ ID NO: 1320900 - RNA, 19 nt, Homo sapiens
uaacuucccaccuuuaaac

SEQ ID NO: 1320901 - RNA, 19 nt, Homo sapiens
ggacgcuggaaaugccuua

SEQ ID NO: 1320902 - RNA, 19 nt, Homo sapiens
gcuacggccugacguuucu

SEQ ID NO: 1320903 - RNA, 19 nt, Homo sapiens
ggagauccaccggcgauau

SEQ ID NO: 1320904 - RNA, 19 nt, Homo sapiens
gacccuggcccuacuggaa

SEQ ID NO: 1320905 - RNA, 19 nt, Homo sapiens
gccacaaggcucccuaaug

SEQ ID NO: 1320906 - RNA, 19 nt, Homo sapiens
aacagggacuccaaucaau

SEQ ID NO: 1320907 - RNA, 19 nt, Homo sapiens
guaacuucccaccuuuaaa

SEQ ID NO: 1320908 - RNA, 19 nt, Homo sapiens
cuucgugccuauugaccua

SEQ ID NO: 1320909 - RNA, 19 nt, Homo sapiens
ccuuuaaacugcccagaag

SEQ ID NO: 1320910 - RNA, 19 nt, Homo sapiens
gaccacuucugugccaguu

SEQ ID NO: 1320911 - RNA, 19 nt, Homo sapiens
gcuugggucugacacaucu

SEQ ID NO: 1320912 - RNA, 19 nt, Homo sapiens
uaaccuagugugugugugu

SEQ ID NO: 1320913 - RNA, 19 nt, Homo sapiens
gauagaggcugggcaucac

SEQ ID NO: 1320914 - RNA, 19 nt, Homo sapiens
uggaaccucuacuacaugu

SEQ ID NO: 1320915 - RNA, 19 nt, Homo sapiens
guguguguguaacaauaaa

SEQ ID NO: 1320916 - RNA, 19 nt, Homo sapiens
ggcugggcaucacaucaaa

SEQ ID NO: 1320917 - RNA, 19 nt, Homo sapiens
uggacagccguguuucuua

SEQ ID NO: 1320918 - RNA, 19 nt, Homo sapiens
ccaacagggacuccaauca

SEQ ID NO: 1320919 - RNA, 19 nt, Homo sapiens
uguaacuucccaccuuuaa

SEQ ID NO: 1320920 - RNA, 19 nt, Homo sapiens
gauucaggacccuccauga

SEQ ID NO: 1320921 - RNA, 19 nt, Homo sapiens
aggaugacaugaccuugug

SEQ ID NO: 1320922 - RNA, 19 nt, Homo sapiens
gccaaggcccugaccacuu

SEQ ID NO: 1320923 - RNA, 19 nt, Homo sapiens
gaucuacuggcugaccuuu

SEQ ID NO: 1320924 - RNA, 19 nt, Homo sapiens
acuggccuauuuacuguuu

SEQ ID NO: 1320925 - RNA, 19 nt, Homo sapiens
ccucagggacgcuggaaau

SEQ ID NO: 1320926 - RNA, 19 nt, Homo sapiens
ggagaccgugaguggcuaa

SEQ ID NO: 1320927 - RNA, 19 nt, Homo sapiens
ggagcugcccgaagacgau

SEQ ID NO: 1320928 - RNA, 19 nt, Homo sapiens
gggugugugugucuuugug

SEQ ID NO: 1320929 - RNA, 19 nt, Homo sapiens
cagccguguuucuuaagga

SEQ ID NO: 1320930 - RNA, 19 nt, Homo sapiens
ugauguggaaccucuacua

SEQ ID NO: 1320931 - RNA, 19 nt, Homo sapiens
ugaguucccgccugaucua

SEQ ID NO: 1320932 - RNA, 19 nt, Homo sapiens
gauguggaaccucuacuac

SEQ ID NO: 1320933 - RNA, 19 nt, Homo sapiens
gcugagccuguuaugcuuu

SEQ ID NO: 1320934 - RNA, 19 nt, Homo sapiens
cuauugaccuacagugcau

SEQ ID NO: 1320935 - RNA, 19 nt, Homo sapiens
gugccuucgugccuauuga

SEQ ID NO: 1320936 - RNA, 19 nt, Homo sapiens
ucuccaaacccuugcgaaa

SEQ ID NO: 1320937 - RNA, 19 nt, Homo sapiens
ugugguagaucccagaacu

SEQ ID NO: 1320938 - RNA, 19 nt, Homo sapiens
cuagacagcacaguaagug

SEQ ID NO: 1320939 - RNA, 19 nt, Homo sapiens
caaccugcugccugagaaa

SEQ ID NO: 1320940 - RNA, 19 nt, Homo sapiens
agucagaaccacuuaccaa

SEQ ID NO: 1320941 - RNA, 19 nt, Homo sapiens
cccuguaacuucccaccuu

SEQ ID NO: 1320942 - RNA, 19 nt, Homo sapiens
uccaugacuggccuauuua

SEQ ID NO: 1320943 - RNA, 19 nt, Homo sapiens
ucuacuggcugaccuuugc

SEQ ID NO: 1320944 - RNA, 19 nt, Homo sapiens
agaaccacuuaccaagcua

SEQ ID NO: 1320945 - RNA, 19 nt, Homo sapiens
gcuggaaaugccuuaagga

SEQ ID NO: 1320946 - RNA, 19 nt, Homo sapiens
gaaaggaugugaagguguu

SEQ ID NO: 1320947 - RNA, 19 nt, Homo sapiens
gaagaaaucagaaacagaa

SEQ ID NO: 1320948 - RNA, 19 nt, Homo sapiens
gcuuaucuaugcuuaaaga

SEQ ID NO: 1320949 - RNA, 19 nt, Homo sapiens
aaacgugaaugccgaguug

SEQ ID NO: 1320950 - RNA, 19 nt, Homo sapiens
caacauugauccauaaagc

SEQ ID NO: 1320951 - RNA, 19 nt, Homo sapiens
gcacaaucccaguuccuaa

SEQ ID NO: 1320952 - RNA, 19 nt, Homo sapiens
gugaagguguuuaauguca

SEQ ID NO: 1320953 - RNA, 19 nt, Homo sapiens
agauggagcucuucaguca

SEQ ID NO: 1320954 - RNA, 19 nt, Homo sapiens
gcaaagagugugcgucauc

SEQ ID NO: 1320955 - RNA, 19 nt, Homo sapiens
caagauuaacuauccauug

SEQ ID NO: 1320956 - RNA, 19 nt, Homo sapiens
gaugugaagguguuuaaug

SEQ ID NO: 1320957 - RNA, 19 nt, Homo sapiens
ccauaaagccagugagguu

SEQ ID NO: 1320958 - RNA, 19 nt, Homo sapiens
gaaaucagaaacagaaagg

SEQ ID NO: 1320959 - RNA, 19 nt, Homo sapiens
gugaaggagugcccaguuc

SEQ ID NO: 1320960 - RNA, 19 nt, Homo sapiens
ggagggagaagaauaggau

SEQ ID NO: 1320961 - RNA, 19 nt, Homo sapiens
uggcuuaucuaugcuuaaa

SEQ ID NO: 1320962 - RNA, 19 nt, Homo sapiens
guccggaccugaccugaau

SEQ ID NO: 1320963 - RNA, 19 nt, Homo sapiens
gauucgaugucgucacguu

SEQ ID NO: 1320964 - RNA, 19 nt, Homo sapiens
gaaggagugcccaguucaa

SEQ ID NO: 1320965 - RNA, 19 nt, Homo sapiens
ccagugagguuuuaaaauc

SEQ ID NO: 1320966 - RNA, 19 nt, Homo sapiens
cauuguggcuuaucuaugc

SEQ ID NO: 1320967 - RNA, 19 nt, Homo sapiens
gaaacagaaaggaugugaa

SEQ ID NO: 1320968 - RNA, 19 nt, Homo sapiens
guagaagaaaucagaaaca

SEQ ID NO: 1320969 - RNA, 19 nt, Homo sapiens
aaacagaaaggaugugaag

SEQ ID NO: 1320970 - RNA, 19 nt, Homo sapiens
aacuauccauuguggcuua

SEQ ID NO: 1320971 - RNA, 19 nt, Homo sapiens
uauaauccuuggcacaauc

SEQ ID NO: 1320972 - RNA, 19 nt, Homo sapiens
uggucgaccugacuucuuu

SEQ ID NO: 1320973 - RNA, 19 nt, Homo sapiens
agacagggagggagaagaa

SEQ ID NO: 1320974 - RNA, 19 nt, Homo sapiens
guacaagauuaacuaucca

SEQ ID NO: 1320975 - RNA, 19 nt, Homo sapiens
gaagugaagacacgugcau

SEQ ID NO: 1320976 - RNA, 19 nt, Homo sapiens
gugcagagcagcaggaagu

SEQ ID NO: 1320977 - RNA, 19 nt, Homo sapiens
uagaagaaaucagaaacag

SEQ ID NO: 1320978 - RNA, 19 nt, Homo sapiens
ucagucagcuuuucauuca

SEQ ID NO: 1320979 - RNA, 19 nt, Homo sapiens
ucgaugagauugggaagau

SEQ ID NO: 1320980 - RNA, 19 nt, Homo sapiens
gggccuuuaucgagaguug

SEQ ID NO: 1320981 - RNA, 19 nt, Homo sapiens
acagggagggagaagaaua

SEQ ID NO: 1320982 - RNA, 19 nt, Homo sapiens
cauaaagccagugagguuu

SEQ ID NO: 1320983 - RNA, 19 nt, Homo sapiens
ccucuggugugccuguuga

SEQ ID NO: 1320984 - RNA, 19 nt, Homo sapiens
cuacccgucuugaggaaug

SEQ ID NO: 1320985 - RNA, 19 nt, Homo sapiens
uguacaagauuaacuaucc

SEQ ID NO: 1320986 - RNA, 19 nt, Homo sapiens
ggagugcccaguucaagag

SEQ ID NO: 1320987 - RNA, 19 nt, Homo sapiens
gcagagcagcaggaaguga

SEQ ID NO: 1320988 - RNA, 19 nt, Homo sapiens
uguuuaaugucaccaagga

SEQ ID NO: 1320989 - RNA, 19 nt, Homo sapiens
cacaaucccaguuccuaaa

SEQ ID NO: 1320990 - RNA, 19 nt, Homo sapiens
cagagcagcaggaagugaa

SEQ ID NO: 1320991 - RNA, 19 nt, Homo sapiens
uaucgagaguuggguuaga

SEQ ID NO: 1320992 - RNA, 19 nt, Homo sapiens
ccuuaaugcuggauugucu

SEQ ID NO: 1320993 - RNA, 19 nt, Homo sapiens
uagccuuaaugcuggauug

SEQ ID NO: 1320994 - RNA, 19 nt, Homo sapiens
augugaagguguuuaaugu

SEQ ID NO: 1320995 - RNA, 19 nt, Homo sapiens
acagaaaggaugugaaggu

SEQ ID NO: 1320996 - RNA, 19 nt, Homo sapiens
uguggcuuaucuaugcuua

SEQ ID NO: 1320997 - RNA, 19 nt, Homo sapiens
ucagaaacagaaaggaugu

SEQ ID NO: 1320998 - RNA, 19 nt, Homo sapiens
agaagaaaucagaaacaga

SEQ ID NO: 1320999 - RNA, 19 nt, Homo sapiens
ucaagaggagccugaugga

SEQ ID NO: 1321000 - RNA, 19 nt, Homo sapiens
agaaacagaaaggauguga

SEQ ID NO: 1321001 - RNA, 19 nt, Homo sapiens
ggcacaaucccaguuccua

SEQ ID NO: 1321002 - RNA, 19 nt, Homo sapiens
cuauaauccuuggcacaau

SEQ ID NO: 1321003 - RNA, 19 nt, Homo sapiens
cccagggacuauaauccuu

SEQ ID NO: 1321004 - RNA, 19 nt, Homo sapiens
uuuaaugucaccaaggaaa

SEQ ID NO: 1321005 - RNA, 19 nt, Homo sapiens
aaucagaaacagaaaggau

SEQ ID NO: 1321006 - RNA, 19 nt, Homo sapiens
gcaaaucucucuauccuua

SEQ ID NO: 1321007 - RNA, 19 nt, Homo sapiens
ggaaauggcuggagucuuu

SEQ ID NO: 1321008 - RNA, 19 nt, Homo sapiens
uagcguggcuuuaaacaua

SEQ ID NO: 1321009 - RNA, 19 nt, Homo sapiens
gaagguggcuggcaaaucu

SEQ ID NO: 1321010 - RNA, 19 nt, Homo sapiens
ggagggagauugugaugaa

SEQ ID NO: 1321011 - RNA, 19 nt, Homo sapiens
caaugggacuuaaaccuua

SEQ ID NO: 1321012 - RNA, 19 nt, Homo sapiens
gaacugaucuuuugauuca

SEQ ID NO: 1321013 - RNA, 19 nt, Homo sapiens
acacaugccucauuaagaa

SEQ ID NO: 1321014 - RNA, 19 nt, Homo sapiens
caccaugccuggcuaauuu

SEQ ID NO: 1321015 - RNA, 19 nt, Homo sapiens
cacaacacaugccucauua

SEQ ID NO: 1321016 - RNA, 19 nt, Homo sapiens
gcaaguuccuuuacugugu

SEQ ID NO: 1321017 - RNA, 19 nt, Homo sapiens
ggaagcauguggugaagga

SEQ ID NO: 1321018 - RNA, 19 nt, Homo sapiens
ccacuucauuugucuguuu

SEQ ID NO: 1321019 - RNA, 19 nt, Homo sapiens
cuggagaccugauuucuaa

SEQ ID NO: 1321020 - RNA, 19 nt, Homo sapiens
uuauggaugugauguguua

SEQ ID NO: 1321021 - RNA, 19 nt, Homo sapiens
aaccuuaccucuuguguuu

SEQ ID NO: 1321022 - RNA, 19 nt, Homo sapiens
ggugguuuguucuuucuua

SEQ ID NO: 1321023 - RNA, 19 nt, Homo sapiens
gcaagaacaucuggaucaa

SEQ ID NO: 1321024 - RNA, 19 nt, Homo sapiens
gaugugauauguuauggau

SEQ ID NO: 1321025 - RNA, 19 nt, Homo sapiens
guauuuguguuguugagua

SEQ ID NO: 1321026 - RNA, 19 nt, Homo sapiens
gcaccucucugaacugauc

SEQ ID NO: 1321027 - RNA, 19 nt, Homo sapiens
cagacaaacucaaccagaa

SEQ ID NO: 1321028 - RNA, 19 nt, Homo sapiens
aagaacaucuggaucaaga

SEQ ID NO: 1321029 - RNA, 19 nt, Homo sapiens
ucacuucccucuuguguag

SEQ ID NO: 1321030 - RNA, 19 nt, Homo sapiens
aaacugcucccuauuuauu

SEQ ID NO: 1321031 - RNA, 19 nt, Homo sapiens
ggccaccaguuguaccuua

SEQ ID NO: 1321032 - RNA, 19 nt, Homo sapiens
gguuuguucuuucuuauug

SEQ ID NO: 1321033 - RNA, 19 nt, Homo sapiens
ggacccaauucuccacuug

SEQ ID NO: 1321034 - RNA, 19 nt, Homo sapiens
gacaguaucaugagaguga

SEQ ID NO: 1321035 - RNA, 19 nt, Homo sapiens
gauucugaccuguuuguua

SEQ ID NO: 1321036 - RNA, 19 nt, Homo sapiens
uaaacgagauggguuaaag

SEQ ID NO: 1321037 - RNA, 19 nt, Homo sapiens
gaacaucuggaucaagaga

SEQ ID NO: 1321038 - RNA, 19 nt, Homo sapiens
gagcaugcccuccaaauac

SEQ ID NO: 1321039 - RNA, 19 nt, Homo sapiens
gugaaaaccuguacugauu

SEQ ID NO: 1321040 - RNA, 19 nt, Homo sapiens
ccacaacacaugccucauu

SEQ ID NO: 1321041 - RNA, 19 nt, Homo sapiens
ccauccaucuccugacuuu

SEQ ID NO: 1321042 - RNA, 19 nt, Homo sapiens
gaacacuggagaccugauu

SEQ ID NO: 1321043 - RNA, 19 nt, Homo sapiens
gacagucucuucguuccua

SEQ ID NO: 1321044 - RNA, 19 nt, Homo sapiens
caccacaccuggcuaacuu

SEQ ID NO: 1321045 - RNA, 19 nt, Homo sapiens
auucugaccuguuuguuaa

SEQ ID NO: 1321046 - RNA, 19 nt, Homo sapiens
aaauaaacgagauggguua

SEQ ID NO: 1321047 - RNA, 19 nt, Homo sapiens
uagaaucucccaucucuga

SEQ ID NO: 1321048 - RNA, 19 nt, Homo sapiens
gaacuccugaccuuaaaug

SEQ ID NO: 1321049 - RNA, 19 nt, Homo sapiens
ggagugcaguggugugauc

SEQ ID NO: 1321050 - RNA, 19 nt, Homo sapiens
gggcaccucucugaacuga

SEQ ID NO: 1321051 - RNA, 19 nt, Homo sapiens
ccaaauaccgcaagaacau

SEQ ID NO: 1321052 - RNA, 19 nt, Homo sapiens
acuuaaaccuuaccucuug

SEQ ID NO: 1321053 - RNA, 19 nt, Homo sapiens
aaccucagauggacacuaa

SEQ ID NO: 1321054 - RNA, 19 nt, Homo sapiens
agacuuuggucggguauuu

SEQ ID NO: 1321055 - RNA, 19 nt, Homo sapiens
guaguuaccacaacacaug

SEQ ID NO: 1321056 - RNA, 19 nt, Homo sapiens
gcaguucauaccaauuuaa

SEQ ID NO: 1321057 - RNA, 19 nt, Homo sapiens
ugugauauguuauggaugu

SEQ ID NO: 1321058 - RNA, 19 nt, Homo sapiens
gaacagacaaacucaacca

SEQ ID NO: 1321059 - RNA, 19 nt, Homo sapiens
caaguuccuuuacuguguu

SEQ ID NO: 1321060 - RNA, 19 nt, Homo sapiens
gaucuacucugggaugucu

SEQ ID NO: 1321061 - RNA, 19 nt, Homo sapiens
gggacuuucucauuguuga

SEQ ID NO: 1321062 - RNA, 19 nt, Homo sapiens
gaggaggaguugacagucu

SEQ ID NO: 1321063 - RNA, 19 nt, Homo sapiens
uaagaaacagcaaccauca

SEQ ID NO: 1321064 - RNA, 19 nt, Homo sapiens
caacacaugccucauuaag

SEQ ID NO: 1321065 - RNA, 19 nt, Homo sapiens
gaaucucccaucucugaaa

SEQ ID NO: 1321066 - RNA, 19 nt, Homo sapiens
gaucucggcucacuguaac

SEQ ID NO: 1321067 - RNA, 19 nt, Homo sapiens
uguagaaucucccaucucu

SEQ ID NO: 1321068 - RNA, 19 nt, Homo sapiens
uagcaucaauuccguaguc

SEQ ID NO: 1321069 - RNA, 19 nt, Homo sapiens
gggaggaaaugggaaaugg

SEQ ID NO: 1321070 - RNA, 19 nt, Homo sapiens
agaugauucugaccuguuu

SEQ ID NO: 1321071 - RNA, 19 nt, Homo sapiens
ugagcaugcccuccaaaua

SEQ ID NO: 1321072 - RNA, 19 nt, Homo sapiens
ccaaugggacuuaaaccuu

SEQ ID NO: 1321073 - RNA, 19 nt, Homo sapiens
acacaaaccgcagacagua

SEQ ID NO: 1321074 - RNA, 19 nt, Homo sapiens
ucucauuuacuuccucuua

SEQ ID NO: 1321075 - RNA, 19 nt, Homo sapiens
gauauguuauggaugugau

SEQ ID NO: 1321076 - RNA, 19 nt, Homo sapiens
ucuccugacuuuauuugaa

SEQ ID NO: 1321077 - RNA, 19 nt, Homo sapiens
ccaggugguuuguucuuuc

SEQ ID NO: 1321078 - RNA, 19 nt, Homo sapiens
gggagauugugaugaagug

SEQ ID NO: 1321079 - RNA, 19 nt, Homo sapiens
gacuuguucuggugucuga

SEQ ID NO: 1321080 - RNA, 19 nt, Homo sapiens
cuuauagcguggcuuuaaa

SEQ ID NO: 1321081 - RNA, 19 nt, Homo sapiens
ccaaacugcugggauuaca

SEQ ID NO: 1321082 - RNA, 19 nt, Homo sapiens
gccgagggccagagacuaa

SEQ ID NO: 1321083 - RNA, 19 nt, Homo sapiens
aguuguaccuuacguuuau

SEQ ID NO: 1321084 - RNA, 19 nt, Homo sapiens
ccaguuguaccuuacguuu

SEQ ID NO: 1321085 - RNA, 19 nt, Homo sapiens
gcguggcuuuaaacauaua

SEQ ID NO: 1321086 - RNA, 19 nt, Homo sapiens
ucuauuggaugugauaugu

SEQ ID NO: 1321087 - RNA, 19 nt, Homo sapiens
gaacuccugaccucaagug

SEQ ID NO: 1321088 - RNA, 19 nt, Homo sapiens
cuaaguuccuggguucuga

SEQ ID NO: 1321089 - RNA, 19 nt, Homo sapiens
uaccagcucugcagaugug

SEQ ID NO: 1321090 - RNA, 19 nt, Homo sapiens
agaccugauuucuaacuga

SEQ ID NO: 1321091 - RNA, 19 nt, Homo sapiens
agauugugaugaagugaaa

SEQ ID NO: 1321092 - RNA, 19 nt, Homo sapiens
ccagcuaccacuucauuug

SEQ ID NO: 1321093 - RNA, 19 nt, Homo sapiens
cgagcgugcuguagaaucu

SEQ ID NO: 1321094 - RNA, 19 nt, Homo sapiens
ucgaacuccugaccuuaaa

SEQ ID NO: 1321095 - RNA, 19 nt, Homo sapiens
agaaacagcaaccaucaga

SEQ ID NO: 1321096 - RNA, 19 nt, Homo sapiens
guaccuuacguuuaucauu

SEQ ID NO: 1321097 - RNA, 19 nt, Homo sapiens
ugccuucacuucccucuug

SEQ ID NO: 1321098 - RNA, 19 nt, Homo sapiens
cugacauucucaugaguaa

SEQ ID NO: 1321099 - RNA, 19 nt, Homo sapiens
cauaccaauuuaagcauuc

SEQ ID NO: 1321100 - RNA, 19 nt, Homo sapiens
gaguccagcucagaagaug

SEQ ID NO: 1321101 - RNA, 19 nt, Homo sapiens
cagcugagccacaguuauc

SEQ ID NO: 1321102 - RNA, 19 nt, Homo sapiens
ugucgagcgugcuguagaa

SEQ ID NO: 1321103 - RNA, 19 nt, Homo sapiens
guuaccagcucugcagaug

SEQ ID NO: 1321104 - RNA, 19 nt, Homo sapiens
ucucuauccuuaacuuugu

SEQ ID NO: 1321105 - RNA, 19 nt, Homo sapiens
aagcagggcaccucucuga

SEQ ID NO: 1321106 - RNA, 19 nt, Homo sapiens
caucuucucucucuucuuu

SEQ ID NO: 1321107 - RNA, 19 nt, Homo sapiens
caaccuggccugcaugaug

SEQ ID NO: 1321108 - RNA, 19 nt, Homo sapiens
gcaguucgacagaagugua

SEQ ID NO: 1321109 - RNA, 19 nt, Homo sapiens
cgugucagcugcaccauca

SEQ ID NO: 1321110 - RNA, 19 nt, Homo sapiens
gaaaacagacgacacacuu

SEQ ID NO: 1321111 - RNA, 19 nt, Homo sapiens
ggacaucugcgaagacaac

SEQ ID NO: 1321112 - RNA, 19 nt, Homo sapiens
aaccuggccugcaugauga

SEQ ID NO: 1321113 - RNA, 19 nt, Homo sapiens
gucaugauccugccuguga

SEQ ID NO: 1321114 - RNA, 19 nt, Homo sapiens
caucaucgccaccgucaug

SEQ ID NO: 1321115 - RNA, 19 nt, Homo sapiens
gggcagcacacacaagguu

SEQ ID NO: 1321116 - RNA, 19 nt, Homo sapiens
caagguuguuccaaguugu

SEQ ID NO: 1321117 - RNA, 19 nt, Homo sapiens
ugugaaauaucaugcucuu

SEQ ID NO: 1321118 - RNA, 19 nt, Homo sapiens
guucuugcguggccugguu

SEQ ID NO: 1321119 - RNA, 19 nt, Homo sapiens
ugucuuaccugcugauggu

SEQ ID NO: 1321120 - RNA, 19 nt, Homo sapiens
cuuccugccuuacacguuu

SEQ ID NO: 1321121 - RNA, 19 nt, Homo sapiens
caacgcaugcucagcuuca

SEQ ID NO: 1321122 - RNA, 19 nt, Homo sapiens
ccaucaccuuccugccuua

SEQ ID NO: 1321123 - RNA, 19 nt, Homo sapiens
ggauugccgucuaccugau

SEQ ID NO: 1321124 - RNA, 19 nt, Homo sapiens
cagcaaggagcgcguggaa

SEQ ID NO: 1321125 - RNA, 19 nt, Homo sapiens
gcggccaucuucucucucu

SEQ ID NO: 1321126 - RNA, 19 nt, Homo sapiens
cagcggccaucuucucucu

SEQ ID NO: 1321127 - RNA, 19 nt, Homo sapiens
cagccguccucaccagaga

SEQ ID NO: 1321128 - RNA, 19 nt, Homo sapiens
gggcaucuuccaccucaug

SEQ ID NO: 1321129 - RNA, 19 nt, Homo sapiens
cagcugcaccaucaucuuc

SEQ ID NO: 1321130 - RNA, 19 nt, Homo sapiens
auggugaccuucccugaug

SEQ ID NO: 1321131 - RNA, 19 nt, Homo sapiens
ggaccagggaggacaggau

SEQ ID NO: 1321132 - RNA, 19 nt, Homo sapiens
gcaucuucuuguucugugu

SEQ ID NO: 1321133 - RNA, 19 nt, Homo sapiens
ccgucuaccugaugaccuu

SEQ ID NO: 1321134 - RNA, 19 nt, Homo sapiens
ggccaucuucucucucuuc

SEQ ID NO: 1321135 - RNA, 19 nt, Homo sapiens
ggagaaaucuuaggacuga

SEQ ID NO: 1321136 - RNA, 19 nt, Homo sapiens
gagaaaggaugacucacaa

SEQ ID NO: 1321137 - RNA, 19 nt, Homo sapiens
ggagugggcaggaaugaua

SEQ ID NO: 1321138 - RNA, 19 nt, Homo sapiens
gaaaggcacaucaacaaga

SEQ ID NO: 1321139 - RNA, 19 nt, Homo sapiens
gaaaggaugacucacaaga

SEQ ID NO: 1321140 - RNA, 19 nt, Homo sapiens
gaucuuggcuucucaacag

SEQ ID NO: 1321141 - RNA, 19 nt, Homo sapiens
gcagcuagcuaccuaccuu

SEQ ID NO: 1321142 - RNA, 19 nt, Homo sapiens
ggaaggcacuggcuuacuc

SEQ ID NO: 1321143 - RNA, 19 nt, Homo sapiens
ggacugacaucccuuuacu

SEQ ID NO: 1321144 - RNA, 19 nt, Homo sapiens
aaaggcacaucaacaagaa

SEQ ID NO: 1321145 - RNA, 19 nt, Homo sapiens
uaagggagcacaaauaaag

SEQ ID NO: 1321146 - RNA, 19 nt, Homo sapiens
ucaggcagcuagcuaccua

SEQ ID NO: 1321147 - RNA, 19 nt, Homo sapiens
gccaagggcagaguauuua

SEQ ID NO: 1321148 - RNA, 19 nt, Homo sapiens
cuucuucucuuucugcuuu

SEQ ID NO: 1321149 - RNA, 19 nt, Homo sapiens
gcuuaagggagcacaaaua

SEQ ID NO: 1321150 - RNA, 19 nt, Homo sapiens
gcagugacaccgcuguuga

SEQ ID NO: 1321151 - RNA, 19 nt, Homo sapiens
ggccaagggcagaguauuu

SEQ ID NO: 1321152 - RNA, 19 nt, Homo sapiens
gcagaagaaagacacaaug

SEQ ID NO: 1321153 - RNA, 19 nt, Homo sapiens
uaguacagcugagaucuug

SEQ ID NO: 1321154 - RNA, 19 nt, Homo sapiens
acaauguggagaaaucuua

SEQ ID NO: 1321155 - RNA, 19 nt, Homo sapiens
caacaggugugugcugaag

SEQ ID NO: 1321156 - RNA, 19 nt, Homo sapiens
ccacccaccuucuccuuuc

SEQ ID NO: 1321157 - RNA, 19 nt, Homo sapiens
ggugugugcugaagaugga

SEQ ID NO: 1321158 - RNA, 19 nt, Homo sapiens
cuuaagggagcacaaauaa

SEQ ID NO: 1321159 - RNA, 19 nt, Homo sapiens
ggauacagcacuggaguug

SEQ ID NO: 1321160 - RNA, 19 nt, Homo sapiens
agugugagcuggacugugu

SEQ ID NO: 1321161 - RNA, 19 nt, Homo sapiens
cgggugcucuuaccuucua

SEQ ID NO: 1321162 - RNA, 19 nt, Homo sapiens
ggagagacgucggcuacag

SEQ ID NO: 1321163 - RNA, 19 nt, Homo sapiens
augcugccauugagacuua

SEQ ID NO: 1321164 - RNA, 19 nt, Homo sapiens
gccaccaccucuucuacuu

SEQ ID NO: 1321165 - RNA, 19 nt, Homo sapiens
acaggaaggcacuggcuua

SEQ ID NO: 1321166 - RNA, 19 nt, Homo sapiens
caacgugauccgcugguuu

SEQ ID NO: 1321167 - RNA, 19 nt, Homo sapiens
ggcagaguauuuaggaauc

SEQ ID NO: 1321168 - RNA, 19 nt, Homo sapiens
cgagaaaggaugacucaca

SEQ ID NO: 1321169 - RNA, 19 nt, Homo sapiens
ugacaccgcuguugaugcu

SEQ ID NO: 1321170 - RNA, 19 nt, Homo sapiens
ggaggcuuaugcugccauu

SEQ ID NO: 1321171 - RNA, 19 nt, Homo sapiens
cuucucacaugcugcuuaa

SEQ ID NO: 1321172 - RNA, 19 nt, Homo sapiens
uauggaaguugggaccuuu

SEQ ID NO: 1321173 - RNA, 19 nt, Homo sapiens
acacaccacugcagcaucu

SEQ ID NO: 1321174 - RNA, 19 nt, Homo sapiens
cagaagaaagacacaaugu

SEQ ID NO: 1321175 - RNA, 19 nt, Homo sapiens
guaccaugcaggacaauuc

SEQ ID NO: 1321176 - RNA, 19 nt, Homo sapiens
gggcagaguauuuaggaau

SEQ ID NO: 1321177 - RNA, 19 nt, Homo sapiens
gaacacaccacugcagcau

SEQ ID NO: 1321178 - RNA, 19 nt, Homo sapiens
ucagaauccuugaucaaaa

SEQ ID NO: 1321179 - RNA, 19 nt, Homo sapiens
ggacaacuggaagguauuc

SEQ ID NO: 1321180 - RNA, 19 nt, Homo sapiens
ucgaaaggcacaucaacaa

SEQ ID NO: 1321181 - RNA, 19 nt, Homo sapiens
caucgguacuucuucucuu

SEQ ID NO: 1321182 - RNA, 19 nt, Homo sapiens
ucucaacagggcaaagaua

SEQ ID NO: 1321183 - RNA, 19 nt, Homo sapiens
ucuguaagaagugcauuua

SEQ ID NO: 1321184 - RNA, 19 nt, Homo sapiens
gccaccgucuccaucugua

SEQ ID NO: 1321185 - RNA, 19 nt, Homo sapiens
ucauucugcucccuauguu

SEQ ID NO: 1321186 - RNA, 19 nt, Homo sapiens
uuggacaacuggaagguau

SEQ ID NO: 1321187 - RNA, 19 nt, Homo sapiens
acaggugugugcugaagau

SEQ ID NO: 1321188 - RNA, 19 nt, Homo sapiens
ugaggucacugccacuucu

SEQ ID NO: 1321189 - RNA, 19 nt, Homo sapiens
gggagcacaaauaaaggua

SEQ ID NO: 1321190 - RNA, 19 nt, Homo sapiens
ggagcacaaauaaagguau

SEQ ID NO: 1321191 - RNA, 19 nt, Homo sapiens
ccauggugguuuggauuga

SEQ ID NO: 1321192 - RNA, 19 nt, Homo sapiens
ggugagacuagcaucgaaa

SEQ ID NO: 1321193 - RNA, 19 nt, Homo sapiens
caacagggcaaagauacca

SEQ ID NO: 1321194 - RNA, 19 nt, Homo sapiens
ucugcucccuauguuauuu

SEQ ID NO: 1321195 - RNA, 19 nt, Homo sapiens
cgaaaggcacaucaacaag

SEQ ID NO: 1321196 - RNA, 19 nt, Homo sapiens
gcugguagacaacgugauc

SEQ ID NO: 1321197 - RNA, 19 nt, Homo sapiens
gcaacaggugugugcugaa

SEQ ID NO: 1321198 - RNA, 19 nt, Homo sapiens
uuaagggagcacaaauaaa

SEQ ID NO: 1321199 - RNA, 19 nt, Homo sapiens
gggccauggugguuuggau

SEQ ID NO: 1321200 - RNA, 19 nt, Homo sapiens
cuauaaccaucgguacuuc

SEQ ID NO: 1321201 - RNA, 19 nt, Homo sapiens
gaggugagacuagcaucga

SEQ ID NO: 1321202 - RNA, 19 nt, Homo sapiens
aggcuuaugcugccauuga

SEQ ID NO: 1321203 - RNA, 19 nt, Homo sapiens
gccccuggcuaaacaauug

SEQ ID NO: 1321204 - RNA, 19 nt, Homo sapiens
ccaccaccucuucuacuug

SEQ ID NO: 1321205 - RNA, 19 nt, Homo sapiens
ucaugacucugggcugugu

SEQ ID NO: 1321206 - RNA, 19 nt, Homo sapiens
gcucccugcucuacaacuc

SEQ ID NO: 1321207 - RNA, 19 nt, Homo sapiens
ggccauggugguuuggauu

SEQ ID NO: 1321208 - RNA, 19 nt, Homo sapiens
gcaugcuguucucaucagu

SEQ ID NO: 1321209 - RNA, 19 nt, Homo sapiens
ccuuugagccugucuacug

SEQ ID NO: 1321210 - RNA, 19 nt, Homo sapiens
ucucagaauccuugaucaa

SEQ ID NO: 1321211 - RNA, 19 nt, Homo sapiens
gcagaguauuuaggaaucc

SEQ ID NO: 1321212 - RNA, 19 nt, Homo sapiens
gccauggugguuuggauug

SEQ ID NO: 1321213 - RNA, 19 nt, Homo sapiens
gaccaugagucgaauaaua

SEQ ID NO: 1321214 - RNA, 19 nt, Homo sapiens
gaaauugcuuguucuuguu

SEQ ID NO: 1321215 - RNA, 19 nt, Homo sapiens
gaacaauuaucaggucauu

SEQ ID NO: 1321216 - RNA, 19 nt, Homo sapiens
ggaaauggaagaaauguug

SEQ ID NO: 1321217 - RNA, 19 nt, Homo sapiens
ggacagggaagagauaaua

SEQ ID NO: 1321218 - RNA, 19 nt, Homo sapiens
uaacaaugauggugauaga

SEQ ID NO: 1321219 - RNA, 19 nt, Homo sapiens
ucaaguauaugacugaaga

SEQ ID NO: 1321220 - RNA, 19 nt, Homo sapiens
gagcugaucaaguauauga

SEQ ID NO: 1321221 - RNA, 19 nt, Homo sapiens
aggacgagcugaucaagua

SEQ ID NO: 1321222 - RNA, 19 nt, Homo sapiens
gaaggacagggaagagaua

SEQ ID NO: 1321223 - RNA, 19 nt, Homo sapiens
ugacagaaauacuacuaga

SEQ ID NO: 1321224 - RNA, 19 nt, Homo sapiens
aagaagaaccuacuggaua

SEQ ID NO: 1321225 - RNA, 19 nt, Homo sapiens
uuuaguaugucuagccuua

SEQ ID NO: 1321226 - RNA, 19 nt, Homo sapiens
caaugauggugauagauga

SEQ ID NO: 1321227 - RNA, 19 nt, Homo sapiens
guauaugacugaagaaggu

SEQ ID NO: 1321228 - RNA, 19 nt, Homo sapiens
caaggacuauauaacaaug

SEQ ID NO: 1321229 - RNA, 19 nt, Homo sapiens
gaagaagaaccuacuggau

SEQ ID NO: 1321230 - RNA, 19 nt, Homo sapiens
gaaagaaaauacagaccaa

SEQ ID NO: 1321231 - RNA, 19 nt, Homo sapiens
ggugaugacagaaauacua

SEQ ID NO: 1321232 - RNA, 19 nt, Homo sapiens
gaugacagaaauacuacua

SEQ ID NO: 1321233 - RNA, 19 nt, Homo sapiens
aaggagagcugcaugaucu

SEQ ID NO: 1321234 - RNA, 19 nt, Homo sapiens
gaguguggaaggugauuua

SEQ ID NO: 1321235 - RNA, 19 nt, Homo sapiens
gcagaacgaaccacucgaa

SEQ ID NO: 1321236 - RNA, 19 nt, Homo sapiens
gaaauguugucugcugcaa

SEQ ID NO: 1321237 - RNA, 19 nt, Homo sapiens
aagaugaucguaacacuuu

SEQ ID NO: 1321238 - RNA, 19 nt, Homo sapiens
aauguugucugcugcaauu

SEQ ID NO: 1321239 - RNA, 19 nt, Homo sapiens
aagaggaaauggaagaaau

SEQ ID NO: 1321240 - RNA, 19 nt, Homo sapiens
gaucaaguauaugacugaa

SEQ ID NO: 1321241 - RNA, 19 nt, Homo sapiens
cguaacacuuuaaaccaaa

SEQ ID NO: 1321242 - RNA, 19 nt, Homo sapiens
agaagaaccuacuggauac

SEQ ID NO: 1321243 - RNA, 19 nt, Homo sapiens
gaaccuacuggauacauuc

SEQ ID NO: 1321244 - RNA, 19 nt, Homo sapiens
acaaaugcuucaucaaucu

SEQ ID NO: 1321245 - RNA, 19 nt, Homo sapiens
ugucuagccuuacagaaug

SEQ ID NO: 1321246 - RNA, 19 nt, Homo sapiens
gaugaucguaacacuuuaa

SEQ ID NO: 1321247 - RNA, 19 nt, Homo sapiens
agaggcauuugaagucuuu

SEQ ID NO: 1321248 - RNA, 19 nt, Homo sapiens
gaguagcaguguaaugaag

SEQ ID NO: 1321249 - RNA, 19 nt, Homo sapiens
gaaaacgaguagcagugua

SEQ ID NO: 1321250 - RNA, 19 nt, Homo sapiens
uaaagaugaucguaacacu

SEQ ID NO: 1321251 - RNA, 19 nt, Homo sapiens
gcaagauggcggacgagaa

SEQ ID NO: 1321252 - RNA, 19 nt, Homo sapiens
cagggaagagauaauagua

SEQ ID NO: 1321253 - RNA, 19 nt, Homo sapiens
gcauguaaagaucuuaaga

SEQ ID NO: 1321254 - RNA, 19 nt, Homo sapiens
cagaaauacuacuagaaag

SEQ ID NO: 1321255 - RNA, 19 nt, Homo sapiens
gaaggagagcugcaugauc

SEQ ID NO: 1321256 - RNA, 19 nt, Homo sapiens
aacaaaugcuucaucaauc

SEQ ID NO: 1321257 - RNA, 19 nt, Homo sapiens
ggucaccuucgaauuaauu

SEQ ID NO: 1321258 - RNA, 19 nt, Homo sapiens
gaaauggaagaaauguugu

SEQ ID NO: 1321259 - RNA, 19 nt, Homo sapiens
acaauuaucaggucauuag

SEQ ID NO: 1321260 - RNA, 19 nt, Homo sapiens
caagauggcggacgagaag

SEQ ID NO: 1321261 - RNA, 19 nt, Homo sapiens
cgaauaauacaguggaugu

SEQ ID NO: 1321262 - RNA, 19 nt, Homo sapiens
gacagaaauacuacuagaa

SEQ ID NO: 1321263 - RNA, 19 nt, Homo sapiens
gaugugagagagauuggaa

SEQ ID NO: 1321264 - RNA, 19 nt, Homo sapiens
uugcagagguagaggaaga

SEQ ID NO: 1321265 - RNA, 19 nt, Homo sapiens
acagaccaauuccagaaga

SEQ ID NO: 1321266 - RNA, 19 nt, Homo sapiens
agagguagaggaagaagaa

SEQ ID NO: 1321267 - RNA, 19 nt, Homo sapiens
ugacuuaauuacccaaggu

SEQ ID NO: 1321268 - RNA, 19 nt, Homo sapiens
gagaaggacagggaagaga

SEQ ID NO: 1321269 - RNA, 19 nt, Homo sapiens
gacgagcugaucaaguaua

SEQ ID NO: 1321270 - RNA, 19 nt, Homo sapiens
ucguaacacuuuaaaccaa

SEQ ID NO: 1321271 - RNA, 19 nt, Homo sapiens
caagaggaaauggaagaaa

SEQ ID NO: 1321272 - RNA, 19 nt, Homo sapiens
aacguggguuucuuacuaa

SEQ ID NO: 1321273 - RNA, 19 nt, Homo sapiens
gagauaauaguagcagaau

SEQ ID NO: 1321274 - RNA, 19 nt, Homo sapiens
ggaaggagagcugcaugau

SEQ ID NO: 1321275 - RNA, 19 nt, Homo sapiens
cgaauuaauuaagcugaca

SEQ ID NO: 1321276 - RNA, 19 nt, Homo sapiens
gaucguaacacuuuaaacc

SEQ ID NO: 1321277 - RNA, 19 nt, Homo sapiens
agaaccuacuggauacauu

SEQ ID NO: 1321278 - RNA, 19 nt, Homo sapiens
agagcugcaugaucugauu

SEQ ID NO: 1321279 - RNA, 19 nt, Homo sapiens
caucuuaucuuaggauucc

SEQ ID NO: 1321280 - RNA, 19 nt, Homo sapiens
ggagagcugcaugaucuga

SEQ ID NO: 1321281 - RNA, 19 nt, Homo sapiens
acaaugauggugauagaug

SEQ ID NO: 1321282 - RNA, 19 nt, Homo sapiens
gaacgaaccacucgaaaac

SEQ ID NO: 1321283 - RNA, 19 nt, Homo sapiens
gguuuggcauguaaagauc

SEQ ID NO: 1321284 - RNA, 19 nt, Homo sapiens
ccaaauuuaguaugucuag

SEQ ID NO: 1321285 - RNA, 19 nt, Homo sapiens
aaagaggcauuugaagucu

SEQ ID NO: 1321286 - RNA, 19 nt, Homo sapiens
ccuugugacauaacuauuu

SEQ ID NO: 1321287 - RNA, 19 nt, Homo sapiens
uuucacaucuuaucuuagg

SEQ ID NO: 1321288 - RNA, 19 nt, Homo sapiens
acgaguagcaguguaauga

SEQ ID NO: 1321289 - RNA, 19 nt, Homo sapiens
auacagaccaauuccagaa

SEQ ID NO: 1321290 - RNA, 19 nt, Homo sapiens
agaugaucguaacacuuua

SEQ ID NO: 1321291 - RNA, 19 nt, Homo sapiens
gaggaaauggaagaaaugu

SEQ ID NO: 1321292 - RNA, 19 nt, Homo sapiens
gaccaauuccagaagaugu

SEQ ID NO: 1321293 - RNA, 19 nt, Homo sapiens
caauaacaaaugcuucauc

SEQ ID NO: 1321294 - RNA, 19 nt, Homo sapiens
guagcagaauuucacaaaa

SEQ ID NO: 1321295 - RNA, 19 nt, Homo sapiens
ggacgagcugaucaaguau

SEQ ID NO: 1321296 - RNA, 19 nt, Homo sapiens
uaguaugucuagccuuaca

SEQ ID NO: 1321297 - RNA, 19 nt, Homo sapiens
acgagcugaucaaguauau

SEQ ID NO: 1321298 - RNA, 19 nt, Homo sapiens
uaauacaguggaugugaga

SEQ ID NO: 1321299 - RNA, 19 nt, Homo sapiens
aauaauacaguggauguga

SEQ ID NO: 1321300 - RNA, 19 nt, Homo sapiens
ugaagucuuugaccaugag

SEQ ID NO: 1321301 - RNA, 19 nt, Homo sapiens
cagaacgaaccacucgaaa

SEQ ID NO: 1321302 - RNA, 19 nt, Homo sapiens
cagaccaauuccagaagau

SEQ ID NO: 1321303 - RNA, 19 nt, Homo sapiens
gauugcagagguagaggaa

SEQ ID NO: 1321304 - RNA, 19 nt, Homo sapiens
agagauaauaguagcagaa

SEQ ID NO: 1321305 - RNA, 19 nt, Homo sapiens
aaagaugaucguaacacuu

SEQ ID NO: 1321306 - RNA, 19 nt, Homo sapiens
gaauaauacaguggaugug

SEQ ID NO: 1321307 - RNA, 19 nt, Homo sapiens
cgaguagcaguguaaugaa

SEQ ID NO: 1321308 - RNA, 19 nt, Homo sapiens
guugucugcugcaauugau

SEQ ID NO: 1321309 - RNA, 19 nt, Homo sapiens
uagccuuacagaaugauaa

SEQ ID NO: 1321310 - RNA, 19 nt, Homo sapiens
cacaucuuaucuuaggauu

SEQ ID NO: 1321311 - RNA, 19 nt, Homo sapiens
ggaagagauaauaguagca

SEQ ID NO: 1321312 - RNA, 19 nt, Homo sapiens
aguagcagaauuucacaaa

SEQ ID NO: 1321313 - RNA, 19 nt, Homo sapiens
ggaauacagugacgacaaa

SEQ ID NO: 1321314 - RNA, 19 nt, Homo sapiens
guaaacggcucuucauuag

SEQ ID NO: 1321315 - RNA, 19 nt, Homo sapiens
gaagaugaaauuacccuaa

SEQ ID NO: 1321316 - RNA, 19 nt, Homo sapiens
ggaagacacaccaaagaaa

SEQ ID NO: 1321317 - RNA, 19 nt, Homo sapiens
gaugguggauaaacacauu

SEQ ID NO: 1321318 - RNA, 19 nt, Homo sapiens
ggacuccgaugugaauuug

SEQ ID NO: 1321319 - RNA, 19 nt, Homo sapiens
guuaaucugucccuucauu

SEQ ID NO: 1321320 - RNA, 19 nt, Homo sapiens
ccuacgagaugguggauaa

SEQ ID NO: 1321321 - RNA, 19 nt, Homo sapiens
ccacgaaacccaaaggaaa

SEQ ID NO: 1321322 - RNA, 19 nt, Homo sapiens
aagcagaucugaaggacaa

SEQ ID NO: 1321323 - RNA, 19 nt, Homo sapiens
cuuguucgguugauacuua

SEQ ID NO: 1321324 - RNA, 19 nt, Homo sapiens
caauagcaguucuggaaug

SEQ ID NO: 1321325 - RNA, 19 nt, Homo sapiens
gaugugaauuuguugugaa

SEQ ID NO: 1321326 - RNA, 19 nt, Homo sapiens
gaaugaagcuaggaaacuc

SEQ ID NO: 1321327 - RNA, 19 nt, Homo sapiens
aguaaacggcucuucauua

SEQ ID NO: 1321328 - RNA, 19 nt, Homo sapiens
caaaggagggucugaguuc

SEQ ID NO: 1321329 - RNA, 19 nt, Homo sapiens
gaacaagaaccaccaaagc

SEQ ID NO: 1321330 - RNA, 19 nt, Homo sapiens
gaggaagacacaccaaaga

SEQ ID NO: 1321331 - RNA, 19 nt, Homo sapiens
cacaauagcaguucuggaa

SEQ ID NO: 1321332 - RNA, 19 nt, Homo sapiens
aauccagacuguccaauug

SEQ ID NO: 1321333 - RNA, 19 nt, Homo sapiens
gaccagaggacggaagaua

SEQ ID NO: 1321334 - RNA, 19 nt, Homo sapiens
gccaggagcugacgaacca

SEQ ID NO: 1321335 - RNA, 19 nt, Homo sapiens
gauccgaggagcaaguuaa

SEQ ID NO: 1321336 - RNA, 19 nt, Homo sapiens
gaagcuaggaaacucgaaa

SEQ ID NO: 1321337 - RNA, 19 nt, Homo sapiens
gaagaucgugggucugugu

SEQ ID NO: 1321338 - RNA, 19 nt, Homo sapiens
aaacggcucuucauuagcu

SEQ ID NO: 1321339 - RNA, 19 nt, Homo sapiens
caaacgaacccacguacug

SEQ ID NO: 1321340 - RNA, 19 nt, Homo sapiens
gaaccuucccugcgaacuu

SEQ ID NO: 1321341 - RNA, 19 nt, Homo sapiens
gcaauauuucccuuccuuu

SEQ ID NO: 1321342 - RNA, 19 nt, Homo sapiens
gaaagcagagaucgacauc

SEQ ID NO: 1321343 - RNA, 19 nt, Homo sapiens
gaagauaagaaagcagaga

SEQ ID NO: 1321344 - RNA, 19 nt, Homo sapiens
ccauguacuuggagcacua

SEQ ID NO: 1321345 - RNA, 19 nt, Homo sapiens
gaguaaacggcucuucauu

SEQ ID NO: 1321346 - RNA, 19 nt, Homo sapiens
cuucauucgugucgcaaua

SEQ ID NO: 1321347 - RNA, 19 nt, Homo sapiens
gaagacacaccaaagaaaa

SEQ ID NO: 1321348 - RNA, 19 nt, Homo sapiens
gaggacggaagauaagaaa

SEQ ID NO: 1321349 - RNA, 19 nt, Homo sapiens
uugaagcgcuggauguuuc

SEQ ID NO: 1321350 - RNA, 19 nt, Homo sapiens
gggagaugauuggcuguga

SEQ ID NO: 1321351 - RNA, 19 nt, Homo sapiens
cauccuggcugcagaguac

SEQ ID NO: 1321352 - RNA, 19 nt, Homo sapiens
uagcaguucuggaaugaag

SEQ ID NO: 1321353 - RNA, 19 nt, Homo sapiens
aauagcaguucuggaauga

SEQ ID NO: 1321354 - RNA, 19 nt, Homo sapiens
ggaguaaacggcucuucau

SEQ ID NO: 1321355 - RNA, 19 nt, Homo sapiens
ccugcgaacuucagaggaa

SEQ ID NO: 1321356 - RNA, 19 nt, Homo sapiens
ggaaugaagcuaggaaacu

SEQ ID NO: 1321357 - RNA, 19 nt, Homo sapiens
cgaugugaauuuguuguga

SEQ ID NO: 1321358 - RNA, 19 nt, Homo sapiens
ggacggaagauaagaaagc

SEQ ID NO: 1321359 - RNA, 19 nt, Homo sapiens
ugacgaaccacgaaugcuu

SEQ ID NO: 1321360 - RNA, 19 nt, Homo sapiens
caauccagacuguccaauu

SEQ ID NO: 1321361 - RNA, 19 nt, Homo sapiens
guggagcgccugcagaaga

SEQ ID NO: 1321362 - RNA, 19 nt, Homo sapiens
gggacuccgaugugaauuu

SEQ ID NO: 1321363 - RNA, 19 nt, Homo sapiens
aaguuaaucugucccuuca

SEQ ID NO: 1321364 - RNA, 19 nt, Homo sapiens
gaggagcaaguuaaucugu

SEQ ID NO: 1321365 - RNA, 19 nt, Homo sapiens
gaaaagaggaagaagaagu

SEQ ID NO: 1321366 - RNA, 19 nt, Homo sapiens
cgaccgccauguacuugga

SEQ ID NO: 1321367 - RNA, 19 nt, Homo sapiens
gacggaagauaagaaagca

SEQ ID NO: 1321368 - RNA, 19 nt, Homo sapiens
cgcaauauuucccuuccuu

SEQ ID NO: 1321369 - RNA, 19 nt, Homo sapiens
gaaguaggaggagcugugu

SEQ ID NO: 1321370 - RNA, 19 nt, Homo sapiens
ggagggcagugauuuugaa

SEQ ID NO: 1321371 - RNA, 19 nt, Homo sapiens
ucauucgugucgcaauauu

SEQ ID NO: 1321372 - RNA, 19 nt, Homo sapiens
agcacuaucuggacaguau

SEQ ID NO: 1321373 - RNA, 19 nt, Homo sapiens
cagaacgccuacagcaagu

SEQ ID NO: 1321374 - RNA, 19 nt, Homo sapiens
gcguagcuuuccugugguu

SEQ ID NO: 1321375 - RNA, 19 nt, Homo sapiens
acuccgaugugaauuuguu

SEQ ID NO: 1321376 - RNA, 19 nt, Homo sapiens
agaggaagaagaaguagga

SEQ ID NO: 1321377 - RNA, 19 nt, Homo sapiens
gccaccaggucuccuaugg

SEQ ID NO: 1321378 - RNA, 19 nt, Homo sapiens
gagggucugaguucacuga

SEQ ID NO: 1321379 - RNA, 19 nt, Homo sapiens
aaaggagggucugaguuca

SEQ ID NO: 1321380 - RNA, 19 nt, Homo sapiens
guggauaaacacauucgaa

SEQ ID NO: 1321381 - RNA, 19 nt, Homo sapiens
cuaccuuguucgguugaua

SEQ ID NO: 1321382 - RNA, 19 nt, Homo sapiens
cagaggaagacacaccaaa

SEQ ID NO: 1321383 - RNA, 19 nt, Homo sapiens
guacuuggagcacuaucug

SEQ ID NO: 1321384 - RNA, 19 nt, Homo sapiens
aaaagaggaagaagaagua

SEQ ID NO: 1321385 - RNA, 19 nt, Homo sapiens
acagcaagugcaaggaaua

SEQ ID NO: 1321386 - RNA, 19 nt, Homo sapiens
aagcagagaucgacauccu

SEQ ID NO: 1321387 - RNA, 19 nt, Homo sapiens
cuaauagcaugaagaucgu

SEQ ID NO: 1321388 - RNA, 19 nt, Homo sapiens
cgcuggauguuuccuagaa

SEQ ID NO: 1321389 - RNA, 19 nt, Homo sapiens
gagaugauuggcugugaca

SEQ ID NO: 1321390 - RNA, 19 nt, Homo sapiens
cuacagcaagugcaaggaa

SEQ ID NO: 1321391 - RNA, 19 nt, Homo sapiens
caggaggacaucagaggaa

SEQ ID NO: 1321392 - RNA, 19 nt, Homo sapiens
gcaagugcaaggaauacag

SEQ ID NO: 1321393 - RNA, 19 nt, Homo sapiens
ggagcacuaucuggacagu

SEQ ID NO: 1321394 - RNA, 19 nt, Homo sapiens
ccagaggacggaagauaag

SEQ ID NO: 1321395 - RNA, 19 nt, Homo sapiens
caagauggagggcagugau

SEQ ID NO: 1321396 - RNA, 19 nt, Homo sapiens
gggcugaugcuccguuucu

SEQ ID NO: 1321397 - RNA, 19 nt, Homo sapiens
gcccguggacccaaacgaa

SEQ ID NO: 1321398 - RNA, 19 nt, Homo sapiens
gacaucagaggaagacaca

SEQ ID NO: 1321399 - RNA, 19 nt, Homo sapiens
ccgaggagcaaguuaaucu

SEQ ID NO: 1321400 - RNA, 19 nt, Homo sapiens
acaaaggagggucugaguu

SEQ ID NO: 1321401 - RNA, 19 nt, Homo sapiens
aggaagacacaccaaagaa

SEQ ID NO: 1321402 - RNA, 19 nt, Homo sapiens
ggaggacaucagaggaaga

SEQ ID NO: 1321403 - RNA, 19 nt, Homo sapiens
guacaucuccacggugaag

SEQ ID NO: 1321404 - RNA, 19 nt, Homo sapiens
acgagaugguggauaaaca

SEQ ID NO: 1321405 - RNA, 19 nt, Homo sapiens
uacagcaagugcaaggaau

SEQ ID NO: 1321406 - RNA, 19 nt, Homo sapiens
ggagcugacgaaccacgaa

SEQ ID NO: 1321407 - RNA, 19 nt, Homo sapiens
caagugcaaggaauacagu

SEQ ID NO: 1321408 - RNA, 19 nt, Homo sapiens
guugaagcgcuggauguuu

SEQ ID NO: 1321409 - RNA, 19 nt, Homo sapiens
uggagcgccugcagaagau

SEQ ID NO: 1321410 - RNA, 19 nt, Homo sapiens
auacagugacgacaaagug

SEQ ID NO: 1321411 - RNA, 19 nt, Homo sapiens
gagcugacgaaccacgaau

SEQ ID NO: 1321412 - RNA, 19 nt, Homo sapiens
gaggcaggaggacaucaga

SEQ ID NO: 1321413 - RNA, 19 nt, Homo sapiens
ccacugaucugaugaauau

SEQ ID NO: 1321414 - RNA, 19 nt, Homo sapiens
gaacaacuuuaccaaauga

SEQ ID NO: 1321415 - RNA, 19 nt, Homo sapiens
acaaagaucuuaagacuga

SEQ ID NO: 1321416 - RNA, 19 nt, Homo sapiens
gcacaaagaucuuaagacu

SEQ ID NO: 1321417 - RNA, 19 nt, Homo sapiens
ggaacaacaucaagaaaug

SEQ ID NO: 1321418 - RNA, 19 nt, Homo sapiens
uaagauugcugccgcauuu

SEQ ID NO: 1321419 - RNA, 19 nt, Homo sapiens
gaaggaggaggaagaaaua

SEQ ID NO: 1321420 - RNA, 19 nt, Homo sapiens
gaacugagaagucaagauc

SEQ ID NO: 1321421 - RNA, 19 nt, Homo sapiens
uaaugaagauggagauaug

SEQ ID NO: 1321422 - RNA, 19 nt, Homo sapiens
ucacaacccuacauauuuc

SEQ ID NO: 1321423 - RNA, 19 nt, Homo sapiens
gagauggccugauucaagu

SEQ ID NO: 1321424 - RNA, 19 nt, Homo sapiens
agauagagauggccugauu

SEQ ID NO: 1321425 - RNA, 19 nt, Homo sapiens
gaaauggcaguguguuuau

SEQ ID NO: 1321426 - RNA, 19 nt, Homo sapiens
ggaggaggaagaaauauug

SEQ ID NO: 1321427 - RNA, 19 nt, Homo sapiens
gcugggcuuugaagaauuu

SEQ ID NO: 1321428 - RNA, 19 nt, Homo sapiens
gaagauggagauauggauu

SEQ ID NO: 1321429 - RNA, 19 nt, Homo sapiens
ugaacaacuuuaccaaaug

SEQ ID NO: 1321430 - RNA, 19 nt, Homo sapiens
uuaaguaucuguggaacaa

SEQ ID NO: 1321431 - RNA, 19 nt, Homo sapiens
ggacaggacugaaaaccuu

SEQ ID NO: 1321432 - RNA, 19 nt, Homo sapiens
ccagcuaaaugaacaacuu

SEQ ID NO: 1321433 - RNA, 19 nt, Homo sapiens
ugcaaaggcucuauuggaa

SEQ ID NO: 1321434 - RNA, 19 nt, Homo sapiens
gaccauguauuccugaagu

SEQ ID NO: 1321435 - RNA, 19 nt, Homo sapiens
agaaauggcaguguguuua

SEQ ID NO: 1321436 - RNA, 19 nt, Homo sapiens
caacuuuaccaaaugauug

SEQ ID NO: 1321437 - RNA, 19 nt, Homo sapiens
cuacauauuucugaucaug

SEQ ID NO: 1321438 - RNA, 19 nt, Homo sapiens
cgauuucggcaacaauuua

SEQ ID NO: 1321439 - RNA, 19 nt, Homo sapiens
gaucaugugcugccuuuua

SEQ ID NO: 1321440 - RNA, 19 nt, Homo sapiens
gaacuccauuucaucuuuu

SEQ ID NO: 1321441 - RNA, 19 nt, Homo sapiens
uggaggagguggucagaga

SEQ ID NO: 1321442 - RNA, 19 nt, Homo sapiens
gcugauacccugugcaaca

SEQ ID NO: 1321443 - RNA, 19 nt, Homo sapiens
ccgccuggaugccauguuu

SEQ ID NO: 1321444 - RNA, 19 nt, Homo sapiens
gccgcaggcuuccagcuaa

SEQ ID NO: 1321445 - RNA, 19 nt, Homo sapiens
aaauggcaguguguuuaua

SEQ ID NO: 1321446 - RNA, 19 nt, Homo sapiens
agggauaguuggaggaauu

SEQ ID NO: 1321447 - RNA, 19 nt, Homo sapiens
gcauuugcuuguuaaacug

SEQ ID NO: 1321448 - RNA, 19 nt, Homo sapiens
ugaggaaguuaggcgauuu

SEQ ID NO: 1321449 - RNA, 19 nt, Homo sapiens
gaucugaugaauauucuca

SEQ ID NO: 1321450 - RNA, 19 nt, Homo sapiens
uaaacuacuugaacuccau

SEQ ID NO: 1321451 - RNA, 19 nt, Homo sapiens
aagaaauauuggagggaua

SEQ ID NO: 1321452 - RNA, 19 nt, Homo sapiens
cauguaaacuacuugaacu

SEQ ID NO: 1321453 - RNA, 19 nt, Homo sapiens
ggcaguguguuuauaagca

SEQ ID NO: 1321454 - RNA, 19 nt, Homo sapiens
gaacaacaucaagaaaugg

SEQ ID NO: 1321455 - RNA, 19 nt, Homo sapiens
gugaggaaguuaggcgauu

SEQ ID NO: 1321456 - RNA, 19 nt, Homo sapiens
ucagaaagugaggaaguua

SEQ ID NO: 1321457 - RNA, 19 nt, Homo sapiens
uuucauaccaucucuaaga

SEQ ID NO: 1321458 - RNA, 19 nt, Homo sapiens
gccuucaagucucuggaua

SEQ ID NO: 1321459 - RNA, 19 nt, Homo sapiens
gcgauuucggcaacaauuu

SEQ ID NO: 1321460 - RNA, 19 nt, Homo sapiens
guacacaguugcugauacc

SEQ ID NO: 1321461 - RNA, 19 nt, Homo sapiens
cuucaagucucuggauaga

SEQ ID NO: 1321462 - RNA, 19 nt, Homo sapiens
agaucgaggucuuggagaa

SEQ ID NO: 1321463 - RNA, 19 nt, Homo sapiens
cagaaccgccucccacuca

SEQ ID NO: 1321464 - RNA, 19 nt, Homo sapiens
cugaucaugugcugccuuu

SEQ ID NO: 1321465 - RNA, 19 nt, Homo sapiens
uuucacaacccuacauauu

SEQ ID NO: 1321466 - RNA, 19 nt, Homo sapiens
agagauggccugauucaag

SEQ ID NO: 1321467 - RNA, 19 nt, Homo sapiens
cuggcaagcucuuucacaa

SEQ ID NO: 1321468 - RNA, 19 nt, Homo sapiens
gcuaaugaagauggagaua

SEQ ID NO: 1321469 - RNA, 19 nt, Homo sapiens
guggaggccucagaaagug

SEQ ID NO: 1321470 - RNA, 19 nt, Homo sapiens
agaaggaggaggaagaaau

SEQ ID NO: 1321471 - RNA, 19 nt, Homo sapiens
ggcugcaguugaccaugua

SEQ ID NO: 1321472 - RNA, 19 nt, Homo sapiens
gauucaagugucuaucaaa

SEQ ID NO: 1321473 - RNA, 19 nt, Homo sapiens
cagcuaaaugaacaacuuu

SEQ ID NO: 1321474 - RNA, 19 nt, Homo sapiens
cugccgcauuugcuuguua

SEQ ID NO: 1321475 - RNA, 19 nt, Homo sapiens
ggaggagguggucagagaa

SEQ ID NO: 1321476 - RNA, 19 nt, Homo sapiens
ccgcaggcuuccagcuaaa

SEQ ID NO: 1321477 - RNA, 19 nt, Homo sapiens
aaagcauguuucuugcaaa

SEQ ID NO: 1321478 - RNA, 19 nt, Homo sapiens
gccuuuuacugcugaauua

SEQ ID NO: 1321479 - RNA, 19 nt, Homo sapiens
uucacaacccuacauauuu

SEQ ID NO: 1321480 - RNA, 19 nt, Homo sapiens
gugcaacagcucucauuuc

SEQ ID NO: 1321481 - RNA, 19 nt, Homo sapiens
gcuuccagcuaaaugaaca

SEQ ID NO: 1321482 - RNA, 19 nt, Homo sapiens
gagcauugugucugucaug

SEQ ID NO: 1321483 - RNA, 19 nt, Homo sapiens
gggugccacugaucugaug

SEQ ID NO: 1321484 - RNA, 19 nt, Homo sapiens
ggagggauaguuggaggaa

SEQ ID NO: 1321485 - RNA, 19 nt, Homo sapiens
caacccuacauauuucuga

SEQ ID NO: 1321486 - RNA, 19 nt, Homo sapiens
cgcauuugcuuguuaaacu

SEQ ID NO: 1321487 - RNA, 19 nt, Homo sapiens
gcucuuggaggccucuuug

SEQ ID NO: 1321488 - RNA, 19 nt, Homo sapiens
guguuuauaagcaguauga

SEQ ID NO: 1321489 - RNA, 19 nt, Homo sapiens
caagaaauggcaguguguu

SEQ ID NO: 1321490 - RNA, 19 nt, Homo sapiens
aagcauguuucuugcaaag

SEQ ID NO: 1321491 - RNA, 19 nt, Homo sapiens
gaagugggaacugagaagu

SEQ ID NO: 1321492 - RNA, 19 nt, Homo sapiens
aagaaauggcaguguguuu

SEQ ID NO: 1321493 - RNA, 19 nt, Homo sapiens
aauauuggagggauaguug

SEQ ID NO: 1321494 - RNA, 19 nt, Homo sapiens
aagauggagauauggauuu

SEQ ID NO: 1321495 - RNA, 19 nt, Homo sapiens
ccgguaugcuaaugaagau

SEQ ID NO: 1321496 - RNA, 19 nt, Homo sapiens
gccgguaugcuaaugaaga

SEQ ID NO: 1321497 - RNA, 19 nt, Homo sapiens
aauggcaguguguuuauaa

SEQ ID NO: 1321498 - RNA, 19 nt, Homo sapiens
uggaacaacaucaagaaau

SEQ ID NO: 1321499 - RNA, 19 nt, Homo sapiens
gcaggcuuccagcuaaaug

SEQ ID NO: 1321500 - RNA, 19 nt, Homo sapiens
guggaacaacaucaagaaa

SEQ ID NO: 1321501 - RNA, 19 nt, Homo sapiens
gccggagcauugugucugu

SEQ ID NO: 1321502 - RNA, 19 nt, Homo sapiens
gauaguuggaggaauugug

SEQ ID NO: 1321503 - RNA, 19 nt, Homo sapiens
aagagaaggaggaggaaga

SEQ ID NO: 1321504 - RNA, 19 nt, Homo sapiens
uggcugcaguugaccaugu

SEQ ID NO: 1321505 - RNA, 19 nt, Homo sapiens
gauagagauggccugauuc

SEQ ID NO: 1321506 - RNA, 19 nt, Homo sapiens
cuaaugaagauggagauau

SEQ ID NO: 1321507 - RNA, 19 nt, Homo sapiens
gagaaggaggaggaagaaa

SEQ ID NO: 1321508 - RNA, 19 nt, Homo sapiens
uugcaaaggcucuauugga

SEQ ID NO: 1321509 - RNA, 19 nt, Homo sapiens
gccacugaucugaugaaua

SEQ ID NO: 1321510 - RNA, 19 nt, Homo sapiens
cccuacauauuucugauca

SEQ ID NO: 1321511 - RNA, 19 nt, Homo sapiens
ugcaacagcucucauuucc

SEQ ID NO: 1321512 - RNA, 19 nt, Homo sapiens
agugggaacugagaaguca

SEQ ID NO: 1321513 - RNA, 19 nt, Homo sapiens
gaacccacaugaaccaaua

SEQ ID NO: 1321514 - RNA, 19 nt, Homo sapiens
gguccaaggugcuuacauc

SEQ ID NO: 1321515 - RNA, 19 nt, Homo sapiens
ggacuuccuuagugccauu

SEQ ID NO: 1321516 - RNA, 19 nt, Homo sapiens
ggaggccgguuuaucucaa

SEQ ID NO: 1321517 - RNA, 19 nt, Homo sapiens
cagcccagcuccaacuaga

SEQ ID NO: 1321518 - RNA, 19 nt, Homo sapiens
uggcagcgguuuccacuuc

SEQ ID NO: 1321519 - RNA, 19 nt, Homo sapiens
cgguuuaucucaaugacuu

SEQ ID NO: 1321520 - RNA, 19 nt, Homo sapiens
ggaacagugcccugagcua

SEQ ID NO: 1321521 - RNA, 19 nt, Homo sapiens
aguuggaauuccugacuua

SEQ ID NO: 1321522 - RNA, 19 nt, Homo sapiens
ggaggcuucccuaauguga

SEQ ID NO: 1321523 - RNA, 19 nt, Homo sapiens
caccucaccuugcuuccuu

SEQ ID NO: 1321524 - RNA, 19 nt, Homo sapiens
gcugggagaccauggaugu

SEQ ID NO: 1321525 - RNA, 19 nt, Homo sapiens
uggaccagguguugaguga

SEQ ID NO: 1321526 - RNA, 19 nt, Homo sapiens
caauacagcccagcuccaa

SEQ ID NO: 1321527 - RNA, 19 nt, Homo sapiens
ggagcgaacccacaugaac

SEQ ID NO: 1321528 - RNA, 19 nt, Homo sapiens
cuucaggacucagaucaug

SEQ ID NO: 1321529 - RNA, 19 nt, Homo sapiens
ccugaggcaugcuaccuau

SEQ ID NO: 1321530 - RNA, 19 nt, Homo sapiens
acuaugcccaagccuauua

SEQ ID NO: 1321531 - RNA, 19 nt, Homo sapiens
acacuaugcccaagccuau

SEQ ID NO: 1321532 - RNA, 19 nt, Homo sapiens
gaggccgguuuaucucaau

SEQ ID NO: 1321533 - RNA, 19 nt, Homo sapiens
cucggaggcuucccuaaug

SEQ ID NO: 1321534 - RNA, 19 nt, Homo sapiens
ccaggggccucaugccuaa

SEQ ID NO: 1321535 - RNA, 19 nt, Homo sapiens
ucccuaaugugaccagugu

SEQ ID NO: 1321536 - RNA, 19 nt, Homo sapiens
gaccguguccucugaaggu

SEQ ID NO: 1321537 - RNA, 19 nt, Homo sapiens
ccaaggcgcagccgauucu

SEQ ID NO: 1321538 - RNA, 19 nt, Homo sapiens
gguuuccacuuccaucucu

SEQ ID NO: 1321539 - RNA, 19 nt, Homo sapiens
ggaccguauccuugugcua

SEQ ID NO: 1321540 - RNA, 19 nt, Homo sapiens
ugaccaguguggacuacuc

SEQ ID NO: 1321541 - RNA, 19 nt, Homo sapiens
ucggaggcuucccuaaugu

SEQ ID NO: 1321542 - RNA, 19 nt, Homo sapiens
ucagguaguuggaauuccu

SEQ ID NO: 1321543 - RNA, 19 nt, Homo sapiens
gcccagcuccaacuagauc

SEQ ID NO: 1321544 - RNA, 19 nt, Homo sapiens
uaguuggaauuccugacuu

SEQ ID NO: 1321545 - RNA, 19 nt, Homo sapiens
acagugcccugagcuacga

SEQ ID NO: 1321546 - RNA, 19 nt, Homo sapiens
gauaccaucuuauucuaga

SEQ ID NO: 1321547 - RNA, 19 nt, Homo sapiens
ugaacacggugcaguuuaa

SEQ ID NO: 1321548 - RNA, 19 nt, Homo sapiens
gggcugggucugcaaauua

SEQ ID NO: 1321549 - RNA, 19 nt, Homo sapiens
gccauaagaaccaggaaua

SEQ ID NO: 1321550 - RNA, 19 nt, Homo sapiens
gagauggcguguccagugu

SEQ ID NO: 1321551 - RNA, 19 nt, Homo sapiens
ggcugggucugcaaauuaa

SEQ ID NO: 1321552 - RNA, 19 nt, Homo sapiens
gggcagcucuucucagacu

SEQ ID NO: 1321553 - RNA, 19 nt, Homo sapiens
gugagacgcuaugaccuaa

SEQ ID NO: 1321554 - RNA, 19 nt, Homo sapiens
gugcgagccguacgauuua

SEQ ID NO: 1321555 - RNA, 19 nt, Homo sapiens
ggaccgagacacagacaug

SEQ ID NO: 1321556 - RNA, 19 nt, Homo sapiens
gauggcguguccaguguga

SEQ ID NO: 1321557 - RNA, 19 nt, Homo sapiens
guacaagggccauaagaac

SEQ ID NO: 1321558 - RNA, 19 nt, Homo sapiens
acacggugcaguuuaauga

SEQ ID NO: 1321559 - RNA, 19 nt, Homo sapiens
gugaacacggugcaguuua

SEQ ID NO: 1321560 - RNA, 19 nt, Homo sapiens
ggcgagaggaggccuauga

SEQ ID NO: 1321561 - RNA, 19 nt, Homo sapiens
gagcgagcgugacacacau

SEQ ID NO: 1321562 - RNA, 19 nt, Homo sapiens
gagacgcuaugaccuaagg

SEQ ID NO: 1321563 - RNA, 19 nt, Homo sapiens
gcaggucgugcgcaaauuc

SEQ ID NO: 1321564 - RNA, 19 nt, Homo sapiens
gcagugacaagacgcugaa

SEQ ID NO: 1321565 - RNA, 19 nt, Homo sapiens
ccgcagaaacgguugaaga

SEQ ID NO: 1321566 - RNA, 19 nt, Homo sapiens
ccaaggaccgagacacaga

SEQ ID NO: 1321567 - RNA, 19 nt, Homo sapiens
gaccaaggaccgagacaca

SEQ ID NO: 1321568 - RNA, 19 nt, Homo sapiens
ggacaaggcggugguucug

SEQ ID NO: 1321569 - RNA, 19 nt, Homo sapiens
auaagaaccaggaauacaa

SEQ ID NO: 1321570 - RNA, 19 nt, Homo sapiens
uaaugaagaggccacaguu

SEQ ID NO: 1321571 - RNA, 19 nt, Homo sapiens
gaacacggugcaguuuaau

SEQ ID NO: 1321572 - RNA, 19 nt, Homo sapiens
aaugaagaggccacaguua

SEQ ID NO: 1321573 - RNA, 19 nt, Homo sapiens
ggugaacacggugcaguuu

SEQ ID NO: 1321574 - RNA, 19 nt, Homo sapiens
gcgaguacaagggccauaa

SEQ ID NO: 1321575 - RNA, 19 nt, Homo sapiens
ugaagaggccacaguuauc

SEQ ID NO: 1321576 - RNA, 19 nt, Homo sapiens
gggcaggucgugcgcaaau

SEQ ID NO: 1321577 - RNA, 19 nt, Homo sapiens
gaguacaagggccauaaga

SEQ ID NO: 1321578 - RNA, 19 nt, Homo sapiens
cgugagacgcuaugaccua

SEQ ID NO: 1321579 - RNA, 19 nt, Homo sapiens
cauaagaaccaggaauaca

SEQ ID NO: 1321580 - RNA, 19 nt, Homo sapiens
agugcgagccguacgauuu

SEQ ID NO: 1321581 - RNA, 19 nt, Homo sapiens
uaagaaccaggaauacaag

SEQ ID NO: 1321582 - RNA, 19 nt, Homo sapiens
cauugcggcuccuggacaa

SEQ ID NO: 1321583 - RNA, 19 nt, Homo sapiens
gaagaggccacaguuaucc

SEQ ID NO: 1321584 - RNA, 19 nt, Homo sapiens
ccaccaacaggaccaagga

SEQ ID NO: 1321585 - RNA, 19 nt, Homo sapiens
cggugcaguuuaaugaaga

SEQ ID NO: 1321586 - RNA, 19 nt, Homo sapiens
ggcaggucgugcgcaaauu

SEQ ID NO: 1321587 - RNA, 19 nt, Homo sapiens
ggugucagaccacgagauc

SEQ ID NO: 1321588 - RNA, 19 nt, Homo sapiens
gcucuauugauuccaguau

SEQ ID NO: 1321589 - RNA, 19 nt, Homo sapiens
augaagaggccacaguuau

SEQ ID NO: 1321590 - RNA, 19 nt, Homo sapiens
ugagcgagcgugacacaca

SEQ ID NO: 1321591 - RNA, 19 nt, Homo sapiens
cagugcagacgcuggauga

SEQ ID NO: 1321592 - RNA, 19 nt, Homo sapiens
uauccuguccggcucuauu

SEQ ID NO: 1321593 - RNA, 19 nt, Homo sapiens
ggacugaagugaaggauuu

SEQ ID NO: 1321594 - RNA, 19 nt, Homo sapiens
aaagugagaucucuuguuu

SEQ ID NO: 1321595 - RNA, 19 nt, Homo sapiens
ugagaucucuuguuucauu

SEQ ID NO: 1321596 - RNA, 19 nt, Homo sapiens
ggagugagaaacccauuua

SEQ ID NO: 1321597 - RNA, 19 nt, Homo sapiens
ugacugagacucuaacuaa

SEQ ID NO: 1321598 - RNA, 19 nt, Homo sapiens
ccacaaaggcggaagauga

SEQ ID NO: 1321599 - RNA, 19 nt, Homo sapiens
gggaggcacuugagaaaug

SEQ ID NO: 1321600 - RNA, 19 nt, Homo sapiens
gagaucucuuguuucauua

SEQ ID NO: 1321601 - RNA, 19 nt, Homo sapiens
gcauguguguuuucuauua

SEQ ID NO: 1321602 - RNA, 19 nt, Homo sapiens
gcaaaggagcuaugggaaa

SEQ ID NO: 1321603 - RNA, 19 nt, Homo sapiens
caagaaaaguugaugauug

SEQ ID NO: 1321604 - RNA, 19 nt, Homo sapiens
ggaaauaggaggcuuaaaa

SEQ ID NO: 1321605 - RNA, 19 nt, Homo sapiens
caaaauagccccaaaacaa

SEQ ID NO: 1321606 - RNA, 19 nt, Homo sapiens
ggcggaagaugauguuuau

SEQ ID NO: 1321607 - RNA, 19 nt, Homo sapiens
gaagggaggcacuugagaa

SEQ ID NO: 1321608 - RNA, 19 nt, Homo sapiens
gagaaaucuuccuggauga

SEQ ID NO: 1321609 - RNA, 19 nt, Homo sapiens
ugauugcugugccucauua

SEQ ID NO: 1321610 - RNA, 19 nt, Homo sapiens
gaaacccauuuauacucua

SEQ ID NO: 1321611 - RNA, 19 nt, Homo sapiens
gugcuguuguuugaaauua

SEQ ID NO: 1321612 - RNA, 19 nt, Homo sapiens
uggaguaccuggaggauau

SEQ ID NO: 1321613 - RNA, 19 nt, Homo sapiens
gacaugcucugggauaguu

SEQ ID NO: 1321614 - RNA, 19 nt, Homo sapiens
ugagugcuguuguuugaaa

SEQ ID NO: 1321615 - RNA, 19 nt, Homo sapiens
aaauggagcugugauuaug

SEQ ID NO: 1321616 - RNA, 19 nt, Homo sapiens
ucuggaagcugcuaagaug

SEQ ID NO: 1321617 - RNA, 19 nt, Homo sapiens
gcacuugagaaaugucuuu

SEQ ID NO: 1321618 - RNA, 19 nt, Homo sapiens
agugagaucucuuguuuca

SEQ ID NO: 1321619 - RNA, 19 nt, Homo sapiens
gacugagacucuaacuaaa

SEQ ID NO: 1321620 - RNA, 19 nt, Homo sapiens
gaugauguuuaugggauuu

SEQ ID NO: 1321621 - RNA, 19 nt, Homo sapiens
caaaggagcuaugggaaaa

SEQ ID NO: 1321622 - RNA, 19 nt, Homo sapiens
guccaucucuggcuuuaau

SEQ ID NO: 1321623 - RNA, 19 nt, Homo sapiens
ggaaagcagggcauucuuc

SEQ ID NO: 1321624 - RNA, 19 nt, Homo sapiens
gaaaucuuccuggaugaaa

SEQ ID NO: 1321625 - RNA, 19 nt, Homo sapiens
gcagaagggaggcacuuga

SEQ ID NO: 1321626 - RNA, 19 nt, Homo sapiens
gcaggagaaucacuugaac

SEQ ID NO: 1321627 - RNA, 19 nt, Homo sapiens
gugagaaacccauuuauac

SEQ ID NO: 1321628 - RNA, 19 nt, Homo sapiens
guaaaccuacuuucuguuc

SEQ ID NO: 1321629 - RNA, 19 nt, Homo sapiens
gcucugggauaguuugaca

SEQ ID NO: 1321630 - RNA, 19 nt, Homo sapiens
gagaucacaccacuguauu

SEQ ID NO: 1321631 - RNA, 19 nt, Homo sapiens
gcuaaaaccugggaaauag

SEQ ID NO: 1321632 - RNA, 19 nt, Homo sapiens
gagaaacccauuuauacuc

SEQ ID NO: 1321633 - RNA, 19 nt, Homo sapiens
gaaaccccgucucuacuaa

SEQ ID NO: 1321634 - RNA, 19 nt, Homo sapiens
aaaguucuaugguccacaa

SEQ ID NO: 1321635 - RNA, 19 nt, Homo sapiens
ggaggcacuugagaaaugu

SEQ ID NO: 1321636 - RNA, 19 nt, Homo sapiens
gagaaggaaccaaggacuu

SEQ ID NO: 1321637 - RNA, 19 nt, Homo sapiens
gaaauaggaggcuuaaaau

SEQ ID NO: 1321638 - RNA, 19 nt, Homo sapiens
gaaagcagggcauucuucu

SEQ ID NO: 1321639 - RNA, 19 nt, Homo sapiens
ugaaaacacuggagaagga

SEQ ID NO: 1321640 - RNA, 19 nt, Homo sapiens
uuugagugcuguuguuuga

SEQ ID NO: 1321641 - RNA, 19 nt, Homo sapiens
agugagaaacccauuuaua

SEQ ID NO: 1321642 - RNA, 19 nt, Homo sapiens
ccacucgugucccuaagga

SEQ ID NO: 1321643 - RNA, 19 nt, Homo sapiens
uucaugggauguauuguuu

SEQ ID NO: 1321644 - RNA, 19 nt, Homo sapiens
gacuuuggccucagagaaa

SEQ ID NO: 1321645 - RNA, 19 nt, Homo sapiens
gaucucuuguuucauuauc

SEQ ID NO: 1321646 - RNA, 19 nt, Homo sapiens
gaugauugacuugaagauu

SEQ ID NO: 1321647 - RNA, 19 nt, Homo sapiens
gcugagaucacaccacugu

SEQ ID NO: 1321648 - RNA, 19 nt, Homo sapiens
aagcagggcauucuucuug

SEQ ID NO: 1321649 - RNA, 19 nt, Homo sapiens
ggaucuguccucccugaaa

SEQ ID NO: 1321650 - RNA, 19 nt, Homo sapiens
ugagaucacaccacuguau

SEQ ID NO: 1321651 - RNA, 19 nt, Homo sapiens
gagaccagccugagcaaca

SEQ ID NO: 1321652 - RNA, 19 nt, Homo sapiens
agaaacccauuuauacucu

SEQ ID NO: 1321653 - RNA, 19 nt, Homo sapiens
ggaagcugcuaagaugauc

SEQ ID NO: 1321654 - RNA, 19 nt, Homo sapiens
uaaagugagaucucuuguu

SEQ ID NO: 1321655 - RNA, 19 nt, Homo sapiens
agaaggaaccaaggacuuu

SEQ ID NO: 1321656 - RNA, 19 nt, Homo sapiens
uuuccagccuuauuucaaa

SEQ ID NO: 1321657 - RNA, 19 nt, Homo sapiens
gaucuguccucccugaaaa

SEQ ID NO: 1321658 - RNA, 19 nt, Homo sapiens
guucaugggauguauuguu

SEQ ID NO: 1321659 - RNA, 19 nt, Homo sapiens
uauaaagugagaucucuug

SEQ ID NO: 1321660 - RNA, 19 nt, Homo sapiens
cauuuauacucuacucuca

SEQ ID NO: 1321661 - RNA, 19 nt, Homo sapiens
ucuaugcagugguaaagga

SEQ ID NO: 1321662 - RNA, 19 nt, Homo sapiens
ggaaccaaggacuuucaaa

SEQ ID NO: 1321663 - RNA, 19 nt, Homo sapiens
gccaggcuguuuccucugu

SEQ ID NO: 1321664 - RNA, 19 nt, Homo sapiens
gagaggaagcugcggaucu

SEQ ID NO: 1321665 - RNA, 19 nt, Homo sapiens
ggcaggagaaucacuugaa

SEQ ID NO: 1321666 - RNA, 19 nt, Homo sapiens
aaaccuacuuucuguucug

SEQ ID NO: 1321667 - RNA, 19 nt, Homo sapiens
gcagggcauucuucuugag

SEQ ID NO: 1321668 - RNA, 19 nt, Homo sapiens
gaaggaaccaaggacuuuc

SEQ ID NO: 1321669 - RNA, 19 nt, Homo sapiens
aacggaggcuucucuggaa

SEQ ID NO: 1321670 - RNA, 19 nt, Homo sapiens
gcaccuguagucccagcua

SEQ ID NO: 1321671 - RNA, 19 nt, Homo sapiens
ggauaaccagggacauuca

SEQ ID NO: 1321672 - RNA, 19 nt, Homo sapiens
ugaucaaaccacagacuuu

SEQ ID NO: 1321673 - RNA, 19 nt, Homo sapiens
caaaggcggaagaugaugu

SEQ ID NO: 1321674 - RNA, 19 nt, Homo sapiens
agaggaagcugcggaucug

SEQ ID NO: 1321675 - RNA, 19 nt, Homo sapiens
ccuguaaucccagcacuuu

SEQ ID NO: 1321676 - RNA, 19 nt, Homo sapiens
cugcccagcucagggauaa

SEQ ID NO: 1321677 - RNA, 19 nt, Homo sapiens
ccuacuuucuguucuggaa

SEQ ID NO: 1321678 - RNA, 19 nt, Homo sapiens
ggagugugguacaacuucu

SEQ ID NO: 1321679 - RNA, 19 nt, Homo sapiens
gguuauaugaugucaaagu

SEQ ID NO: 1321680 - RNA, 19 nt, Homo sapiens
ugauugacuugaagauuac

SEQ ID NO: 1321681 - RNA, 19 nt, Homo sapiens
auaggaggcuuaaaauuga

SEQ ID NO: 1321682 - RNA, 19 nt, Homo sapiens
ugagaaacccauuuauacu

SEQ ID NO: 1321683 - RNA, 19 nt, Homo sapiens
guugaugauugacuugaag

SEQ ID NO: 1321684 - RNA, 19 nt, Homo sapiens
ggaguaccuggaggauaua

SEQ ID NO: 1321685 - RNA, 19 nt, Homo sapiens
gggauaaccagggacauuc

SEQ ID NO: 1321686 - RNA, 19 nt, Homo sapiens
guucuaugguccacaaagg

SEQ ID NO: 1321687 - RNA, 19 nt, Homo sapiens
uggaggauauagaccugaa

SEQ ID NO: 1321688 - RNA, 19 nt, Homo sapiens
cucucaguauggauuauua

SEQ ID NO: 1321689 - RNA, 19 nt, Homo sapiens
gacauucaccuguguucau

SEQ ID NO: 1321690 - RNA, 19 nt, Homo sapiens
cggaagaugauguuuaugg

SEQ ID NO: 1321691 - RNA, 19 nt, Homo sapiens
ggauuuccagccuuauuuc

SEQ ID NO: 1321692 - RNA, 19 nt, Homo sapiens
ccaucucuggcuuuaauaa

SEQ ID NO: 1321693 - RNA, 19 nt, Homo sapiens
ggacaaaccuucucccaaa

SEQ ID NO: 1321694 - RNA, 19 nt, Homo sapiens
gaauuugucugugaaagua

SEQ ID NO: 1321695 - RNA, 19 nt, Homo sapiens
gaacagaucuaacccaaaa

SEQ ID NO: 1321696 - RNA, 19 nt, Homo sapiens
ggaacaggguuuagugaaa

SEQ ID NO: 1321697 - RNA, 19 nt, Homo sapiens
caacacaggaucagaauuu

SEQ ID NO: 1321698 - RNA, 19 nt, Homo sapiens
gcagaaacaugccaagaag

SEQ ID NO: 1321699 - RNA, 19 nt, Homo sapiens
gaaaguaucaaacaucuca

SEQ ID NO: 1321700 - RNA, 19 nt, Homo sapiens
gggaaauccucaucauuau

SEQ ID NO: 1321701 - RNA, 19 nt, Homo sapiens
gaaaauaaguggucccaau

SEQ ID NO: 1321702 - RNA, 19 nt, Homo sapiens
gaagcagaaugcagaagga

SEQ ID NO: 1321703 - RNA, 19 nt, Homo sapiens
ccaauccucuuaguuguuu

SEQ ID NO: 1321704 - RNA, 19 nt, Homo sapiens
uaaaugaacccauaugcuu

SEQ ID NO: 1321705 - RNA, 19 nt, Homo sapiens
gaaugcagaaggagaauga

SEQ ID NO: 1321706 - RNA, 19 nt, Homo sapiens
agggaaauccucaucauua

SEQ ID NO: 1321707 - RNA, 19 nt, Homo sapiens
gaacaggguuuagugaaaa

SEQ ID NO: 1321708 - RNA, 19 nt, Homo sapiens
uaucaaacaucucaaagag

SEQ ID NO: 1321709 - RNA, 19 nt, Homo sapiens
ggaguuccucucauguuua

SEQ ID NO: 1321710 - RNA, 19 nt, Homo sapiens
ggaaauccucaucauuauu

SEQ ID NO: 1321711 - RNA, 19 nt, Homo sapiens
guucgaaauuguccucauu

SEQ ID NO: 1321712 - RNA, 19 nt, Homo sapiens
acaaucaucugcuucugaa

SEQ ID NO: 1321713 - RNA, 19 nt, Homo sapiens
guuccucucauguuuauua

SEQ ID NO: 1321714 - RNA, 19 nt, Homo sapiens
gaacccauaugcuuuagcu

SEQ ID NO: 1321715 - RNA, 19 nt, Homo sapiens
ccucucauguuuauuauuc

SEQ ID NO: 1321716 - RNA, 19 nt, Homo sapiens
gcagaaugcagaaggagaa

SEQ ID NO: 1321717 - RNA, 19 nt, Homo sapiens
gaguuccucucauguuuau

SEQ ID NO: 1321718 - RNA, 19 nt, Homo sapiens
caaagaggaacaggguuua

SEQ ID NO: 1321719 - RNA, 19 nt, Homo sapiens
caagauguguguuaaaaga

SEQ ID NO: 1321720 - RNA, 19 nt, Homo sapiens
ucaaagaggaacaggguuu

SEQ ID NO: 1321721 - RNA, 19 nt, Homo sapiens
gaagaucacaaggcagaaa

SEQ ID NO: 1321722 - RNA, 19 nt, Homo sapiens
ggacuuauauggggcaaaa

SEQ ID NO: 1321723 - RNA, 19 nt, Homo sapiens
uggaguuccucucauguuu

SEQ ID NO: 1321724 - RNA, 19 nt, Homo sapiens
caggucagcuugucucagu

SEQ ID NO: 1321725 - RNA, 19 nt, Homo sapiens
caaaacugauugcacaaaa

SEQ ID NO: 1321726 - RNA, 19 nt, Homo sapiens
aaugaacccauaugcuuua

SEQ ID NO: 1321727 - RNA, 19 nt, Homo sapiens
gaggaacaggguuuaguga

SEQ ID NO: 1321728 - RNA, 19 nt, Homo sapiens
gcagugaguggaucagaau

SEQ ID NO: 1321729 - RNA, 19 nt, Homo sapiens
aaaugaacccauaugcuuu

SEQ ID NO: 1321730 - RNA, 19 nt, Homo sapiens
guaucaaacaucucaaaga

SEQ ID NO: 1321731 - RNA, 19 nt, Homo sapiens
gaauucggaacagaucuaa

SEQ ID NO: 1321732 - RNA, 19 nt, Homo sapiens
ggagucaggucagcuuguc

SEQ ID NO: 1321733 - RNA, 19 nt, Homo sapiens
ggagaaugaauccuuugga

SEQ ID NO: 1321734 - RNA, 19 nt, Homo sapiens
ggaacagaucuaacccaaa

SEQ ID NO: 1321735 - RNA, 19 nt, Homo sapiens
gacacacaaucaucugcuu

SEQ ID NO: 1321736 - RNA, 19 nt, Homo sapiens
gggugaaacuggcauugag

SEQ ID NO: 1321737 - RNA, 19 nt, Homo sapiens
cgugaggcguuuacugaug

SEQ ID NO: 1321738 - RNA, 19 nt, Homo sapiens
cuagaaacauugggaaagg

SEQ ID NO: 1321739 - RNA, 19 nt, Homo sapiens
gagaaagaaaguaucaaac

SEQ ID NO: 1321740 - RNA, 19 nt, Homo sapiens
caugagaaagaaaguauca

SEQ ID NO: 1321741 - RNA, 19 nt, Homo sapiens
gcaacacaggaucagaauu

SEQ ID NO: 1321742 - RNA, 19 nt, Homo sapiens
gguaagccaggcaugaaga

SEQ ID NO: 1321743 - RNA, 19 nt, Homo sapiens
gucccaauccucuuaguug

SEQ ID NO: 1321744 - RNA, 19 nt, Homo sapiens
auucagaacacuaugguuu

SEQ ID NO: 1321745 - RNA, 19 nt, Homo sapiens
uagaaacauugggaaagga

SEQ ID NO: 1321746 - RNA, 19 nt, Homo sapiens
gacaaaccuucucccaaaa

SEQ ID NO: 1321747 - RNA, 19 nt, Homo sapiens
guaaaugaacccauaugcu

SEQ ID NO: 1321748 - RNA, 19 nt, Homo sapiens
gccuggaguuccucucaug

SEQ ID NO: 1321749 - RNA, 19 nt, Homo sapiens
aaagaagccuggaguuccu

SEQ ID NO: 1321750 - RNA, 19 nt, Homo sapiens
acccauaugcuuuagcuaa

SEQ ID NO: 1321751 - RNA, 19 nt, Homo sapiens
cacaaucaucugcuucuga

SEQ ID NO: 1321752 - RNA, 19 nt, Homo sapiens
agaaacaugccaagaagca

SEQ ID NO: 1321753 - RNA, 19 nt, Homo sapiens
gcuagaaacauugggaaag

SEQ ID NO: 1321754 - RNA, 19 nt, Homo sapiens
gcagaaggagaaugaaucc

SEQ ID NO: 1321755 - RNA, 19 nt, Homo sapiens
uuucaagaaugcagugagu

SEQ ID NO: 1321756 - RNA, 19 nt, Homo sapiens
agaauucggaacagaucua

SEQ ID NO: 1321757 - RNA, 19 nt, Homo sapiens
gcaccggacacacaaucau

SEQ ID NO: 1321758 - RNA, 19 nt, Homo sapiens
uggcaacacaggaucagaa

SEQ ID NO: 1321759 - RNA, 19 nt, Homo sapiens
gugaguggaucagaauguc

SEQ ID NO: 1321760 - RNA, 19 nt, Homo sapiens
gaaugcagugaguggauca

SEQ ID NO: 1321761 - RNA, 19 nt, Homo sapiens
aaagaauucggaacagauc

SEQ ID NO: 1321762 - RNA, 19 nt, Homo sapiens
cauugggaaaggacuuaua

SEQ ID NO: 1321763 - RNA, 19 nt, Homo sapiens
ugggaaaggacuuauaugg

SEQ ID NO: 1321764 - RNA, 19 nt, Homo sapiens
ugcagugaguggaucagaa

SEQ ID NO: 1321765 - RNA, 19 nt, Homo sapiens
ucccaauccucuuaguugu

SEQ ID NO: 1321766 - RNA, 19 nt, Homo sapiens
ggucccaauccucuuaguu

SEQ ID NO: 1321767 - RNA, 19 nt, Homo sapiens
gugcaugagaaagaaagua

SEQ ID NO: 1321768 - RNA, 19 nt, Homo sapiens
gaucacaaggcagaaacau

SEQ ID NO: 1321769 - RNA, 19 nt, Homo sapiens
aacacaggaucagaauuug

SEQ ID NO: 1321770 - RNA, 19 nt, Homo sapiens
ggcaacacaggaucagaau

SEQ ID NO: 1321771 - RNA, 19 nt, Homo sapiens
aaugccaaguucgaaauug

SEQ ID NO: 1321772 - RNA, 19 nt, Homo sapiens
gcacgaagcugauguguuc

SEQ ID NO: 1321773 - RNA, 19 nt, Homo sapiens
caaggaauguggacaguua

SEQ ID NO: 1321774 - RNA, 19 nt, Homo sapiens
gaauuuacauggccuauug

SEQ ID NO: 1321775 - RNA, 19 nt, Homo sapiens
cgaagcagcugauuuagaa

SEQ ID NO: 1321776 - RNA, 19 nt, Homo sapiens
gaaaguaguuccuauagag

SEQ ID NO: 1321777 - RNA, 19 nt, Homo sapiens
uagaguacaucccaaauuu

SEQ ID NO: 1321778 - RNA, 19 nt, Homo sapiens
ugauaaagcucaaauacga

SEQ ID NO: 1321779 - RNA, 19 nt, Homo sapiens
ccgcauuucuugagacuua

SEQ ID NO: 1321780 - RNA, 19 nt, Homo sapiens
uuaaagggcugucagaaga

SEQ ID NO: 1321781 - RNA, 19 nt, Homo sapiens
gaggaaaacugcauauauu

SEQ ID NO: 1321782 - RNA, 19 nt, Homo sapiens
guucguauguuaaagcaaa

SEQ ID NO: 1321783 - RNA, 19 nt, Homo sapiens
gaauguggacaguuacuaa

SEQ ID NO: 1321784 - RNA, 19 nt, Homo sapiens
gaauuuggagacuuugaua

SEQ ID NO: 1321785 - RNA, 19 nt, Homo sapiens
cagaugaaauggaaaguag

SEQ ID NO: 1321786 - RNA, 19 nt, Homo sapiens
gcaaaggaaggccaagaaa

SEQ ID NO: 1321787 - RNA, 19 nt, Homo sapiens
aauaaaggaugcugauguu

SEQ ID NO: 1321788 - RNA, 19 nt, Homo sapiens
caacauuacacuugauuug

SEQ ID NO: 1321789 - RNA, 19 nt, Homo sapiens
gaaccgagaccgacuucuu

SEQ ID NO: 1321790 - RNA, 19 nt, Homo sapiens
gacaguuacuaauaucuga

SEQ ID NO: 1321791 - RNA, 19 nt, Homo sapiens
aaagaauggucuguaguuu

SEQ ID NO: 1321792 - RNA, 19 nt, Homo sapiens
gaacagaugaaauggaaag

SEQ ID NO: 1321793 - RNA, 19 nt, Homo sapiens
uggaacagaugaaauggaa

SEQ ID NO: 1321794 - RNA, 19 nt, Homo sapiens
gaagauaccagguccacau

SEQ ID NO: 1321795 - RNA, 19 nt, Homo sapiens
ugaaagucuugguggauuu

SEQ ID NO: 1321796 - RNA, 19 nt, Homo sapiens
gaguacaucccaaauuuau

SEQ ID NO: 1321797 - RNA, 19 nt, Homo sapiens
gagcagaauuuggagacuu

SEQ ID NO: 1321798 - RNA, 19 nt, Homo sapiens
ccaaauuuauccagucauc

SEQ ID NO: 1321799 - RNA, 19 nt, Homo sapiens
caagcucaguugaacagaa

SEQ ID NO: 1321800 - RNA, 19 nt, Homo sapiens
gaugaaauggaaaguaguu

SEQ ID NO: 1321801 - RNA, 19 nt, Homo sapiens
aaagggcugucagaagaua

SEQ ID NO: 1321802 - RNA, 19 nt, Homo sapiens
acacuugauuugcugcuuu

SEQ ID NO: 1321803 - RNA, 19 nt, Homo sapiens
caacaucaagagcagaauu

SEQ ID NO: 1321804 - RNA, 19 nt, Homo sapiens
aaacuguacuucaggagau

SEQ ID NO: 1321805 - RNA, 19 nt, Homo sapiens
aagcucaguugaacagaaa

SEQ ID NO: 1321806 - RNA, 19 nt, Homo sapiens
cauuauaagugcauguugu

SEQ ID NO: 1321807 - RNA, 19 nt, Homo sapiens
agauaggucuccacacaga

SEQ ID NO: 1321808 - RNA, 19 nt, Homo sapiens
uaaaguggcauucuaaagg

SEQ ID NO: 1321809 - RNA, 19 nt, Homo sapiens
gcaugauaaagcucaaaua

SEQ ID NO: 1321810 - RNA, 19 nt, Homo sapiens
aagcugauguguucuuugu

SEQ ID NO: 1321811 - RNA, 19 nt, Homo sapiens
cgaagcugauguguucuuu

SEQ ID NO: 1321812 - RNA, 19 nt, Homo sapiens
uaauaaaggaugcugaugu

SEQ ID NO: 1321813 - RNA, 19 nt, Homo sapiens
gcagcugauuuagaagaaa

SEQ ID NO: 1321814 - RNA, 19 nt, Homo sapiens
caagaaaacugcacauaac

SEQ ID NO: 1321815 - RNA, 19 nt, Homo sapiens
cacuugauuugcugcuuua

SEQ ID NO: 1321816 - RNA, 19 nt, Homo sapiens
gcaacauuacacuugauuu

SEQ ID NO: 1321817 - RNA, 19 nt, Homo sapiens
cuccgaagcagcugauuua

SEQ ID NO: 1321818 - RNA, 19 nt, Homo sapiens
caaauagagacaaggaaug

SEQ ID NO: 1321819 - RNA, 19 nt, Homo sapiens
uaugcaacauuacacuuga

SEQ ID NO: 1321820 - RNA, 19 nt, Homo sapiens
ccacuaccacugugcauug

SEQ ID NO: 1321821 - RNA, 19 nt, Homo sapiens
uguggacaguuacuaauau

SEQ ID NO: 1321822 - RNA, 19 nt, Homo sapiens
aguaguuccuauagagaua

SEQ ID NO: 1321823 - RNA, 19 nt, Homo sapiens
ccauggaacagaugaaaug

SEQ ID NO: 1321824 - RNA, 19 nt, Homo sapiens
ggacaguuacuaauaucug

SEQ ID NO: 1321825 - RNA, 19 nt, Homo sapiens
agaguacaucccaaauuua

SEQ ID NO: 1321826 - RNA, 19 nt, Homo sapiens
gaccgacuucuuucucuuu

SEQ ID NO: 1321827 - RNA, 19 nt, Homo sapiens
ggaauguggacaguuacua

SEQ ID NO: 1321828 - RNA, 19 nt, Homo sapiens
gcucacaacaacaucaaga

SEQ ID NO: 1321829 - RNA, 19 nt, Homo sapiens
ucugggcccugccgcauuu

SEQ ID NO: 1321830 - RNA, 19 nt, Homo sapiens
aaagaaaagucgcaaagga

SEQ ID NO: 1321831 - RNA, 19 nt, Homo sapiens
uaagucaaauagagacaag

SEQ ID NO: 1321832 - RNA, 19 nt, Homo sapiens
gaagauguccaaaaggaaa

SEQ ID NO: 1321833 - RNA, 19 nt, Homo sapiens
ucaaauagagacaaggaau

SEQ ID NO: 1321834 - RNA, 19 nt, Homo sapiens
uaaaggaugcugauguuac

SEQ ID NO: 1321835 - RNA, 19 nt, Homo sapiens
cgagagaaaccuucacaag

SEQ ID NO: 1321836 - RNA, 19 nt, Homo sapiens
cuggagcccucaucaccua

SEQ ID NO: 1321837 - RNA, 19 nt, Homo sapiens
agcagaauuuggagacuuu

SEQ ID NO: 1321838 - RNA, 19 nt, Homo sapiens
gacaaggaauguggacagu

SEQ ID NO: 1321839 - RNA, 19 nt, Homo sapiens
caaauacgagagaaaccuu

SEQ ID NO: 1321840 - RNA, 19 nt, Homo sapiens
gaaaaugaagcacgaggaa

SEQ ID NO: 1321841 - RNA, 19 nt, Homo sapiens
caugauaaagcucaaauac

SEQ ID NO: 1321842 - RNA, 19 nt, Homo sapiens
ccagucaucagaaaauuua

SEQ ID NO: 1321843 - RNA, 19 nt, Homo sapiens
agaagcagcccuagugaca

SEQ ID NO: 1321844 - RNA, 19 nt, Homo sapiens
cagcugauuuagaagaaag

SEQ ID NO: 1321845 - RNA, 19 nt, Homo sapiens
ggaauuuacauggccuauu

SEQ ID NO: 1321846 - RNA, 19 nt, Homo sapiens
caucugcuuugguaucauc

SEQ ID NO: 1321847 - RNA, 19 nt, Homo sapiens
cacagaagcagcccuagug

SEQ ID NO: 1321848 - RNA, 19 nt, Homo sapiens
gcagcugcccauuauaagu

SEQ ID NO: 1321849 - RNA, 19 nt, Homo sapiens
uuagaguacaucccaaauu

SEQ ID NO: 1321850 - RNA, 19 nt, Homo sapiens
guggacaguuacuaauauc

SEQ ID NO: 1321851 - RNA, 19 nt, Homo sapiens
ggagaaccgagaccgacuu

SEQ ID NO: 1321852 - RNA, 19 nt, Homo sapiens
ucacaggacauaccacuac

SEQ ID NO: 1321853 - RNA, 19 nt, Homo sapiens
cagcugcccauuauaagug

SEQ ID NO: 1321854 - RNA, 19 nt, Homo sapiens
aaauagagacaaggaaugu

SEQ ID NO: 1321855 - RNA, 19 nt, Homo sapiens
gacauaccacuaccacugu

SEQ ID NO: 1321856 - RNA, 19 nt, Homo sapiens
aaaggaugcugauguuacg

SEQ ID NO: 1321857 - RNA, 19 nt, Homo sapiens
guacaucccaaauuuaucc

SEQ ID NO: 1321858 - RNA, 19 nt, Homo sapiens
aaccgagaccgacuucuuu

SEQ ID NO: 1321859 - RNA, 19 nt, Homo sapiens
aaauguggcuuuuguaagu

SEQ ID NO: 1321860 - RNA, 19 nt, Homo sapiens
cuacaagacagcgcaaaug

SEQ ID NO: 1321861 - RNA, 19 nt, Homo sapiens
ccucaucaccuaaaaguaa

SEQ ID NO: 1321862 - RNA, 19 nt, Homo sapiens
gaagcugauguguucuuug

SEQ ID NO: 1321863 - RNA, 19 nt, Homo sapiens
accgacuucuuucucuuua

SEQ ID NO: 1321864 - RNA, 19 nt, Homo sapiens
gcacaguccagcucacaac

SEQ ID NO: 1321865 - RNA, 19 nt, Homo sapiens
acagaugaaauggaaagua

SEQ ID NO: 1321866 - RNA, 19 nt, Homo sapiens
caaaggaaggccaagaaaa

SEQ ID NO: 1321867 - RNA, 19 nt, Homo sapiens
ccgaagcagcugauuuaga

SEQ ID NO: 1321868 - RNA, 19 nt, Homo sapiens
acaagaaaacugcacauaa

SEQ ID NO: 1321869 - RNA, 19 nt, Homo sapiens
uuuauccagucaucagaaa

SEQ ID NO: 1321870 - RNA, 19 nt, Homo sapiens
uacaagacagcgcaaaugu

SEQ ID NO: 1321871 - RNA, 19 nt, Homo sapiens
ccauuguccuggagcaaca

SEQ ID NO: 1321872 - RNA, 19 nt, Homo sapiens
caacagagcuccuucauuu

SEQ ID NO: 1321873 - RNA, 19 nt, Homo sapiens
gcacgaagcugauguguuc

SEQ ID NO: 1321874 - RNA, 19 nt, Homo sapiens
ggacagaucuagauguuug

SEQ ID NO: 1321875 - RNA, 19 nt, Homo sapiens
gaauuuacauggucuauug

SEQ ID NO: 1321876 - RNA, 19 nt, Homo sapiens
caaggaauguggacaguua

SEQ ID NO: 1321877 - RNA, 19 nt, Homo sapiens
gcuaaacaaucucgcauua

SEQ ID NO: 1321878 - RNA, 19 nt, Homo sapiens
gaaguuagaccaagguaua

SEQ ID NO: 1321879 - RNA, 19 nt, Homo sapiens
gaaguaagcuauauuucug

SEQ ID NO: 1321880 - RNA, 19 nt, Homo sapiens
gaaaguaguuccuauagag

SEQ ID NO: 1321881 - RNA, 19 nt, Homo sapiens
gaaauguucuuuagaguag

SEQ ID NO: 1321882 - RNA, 19 nt, Homo sapiens
uaacuugacuguacauuga

SEQ ID NO: 1321883 - RNA, 19 nt, Homo sapiens
guacaucucuuaaguccuu

SEQ ID NO: 1321884 - RNA, 19 nt, Homo sapiens
gcuaucugcuuuaucaaua

SEQ ID NO: 1321885 - RNA, 19 nt, Homo sapiens
cagcacaccuccucucuuu

SEQ ID NO: 1321886 - RNA, 19 nt, Homo sapiens
guuaagagcauguuacuaa

SEQ ID NO: 1321887 - RNA, 19 nt, Homo sapiens
gaagcacauuuaugcauuu

SEQ ID NO: 1321888 - RNA, 19 nt, Homo sapiens
gaaaauaugucacgaggaa

SEQ ID NO: 1321889 - RNA, 19 nt, Homo sapiens
gcuaugagcuccagugcuu

SEQ ID NO: 1321890 - RNA, 19 nt, Homo sapiens
gaaacgaaguaagcuauau

SEQ ID NO: 1321891 - RNA, 19 nt, Homo sapiens
guaaugguaugcaguaaga

SEQ ID NO: 1321892 - RNA, 19 nt, Homo sapiens
ggaagcaauugaaacacua

SEQ ID NO: 1321893 - RNA, 19 nt, Homo sapiens
ugauaaagcucaaauacga

SEQ ID NO: 1321894 - RNA, 19 nt, Homo sapiens
ccgcauuucuugagacuua

SEQ ID NO: 1321895 - RNA, 19 nt, Homo sapiens
ggaaauguucuuuagagua

SEQ ID NO: 1321896 - RNA, 19 nt, Homo sapiens
gaaguaaugguaugcagua

SEQ ID NO: 1321897 - RNA, 19 nt, Homo sapiens
gcugucaguugaugaauuu

SEQ ID NO: 1321898 - RNA, 19 nt, Homo sapiens
ugagagagaugaagaagau

SEQ ID NO: 1321899 - RNA, 19 nt, Homo sapiens
uuaaagggcugucagaaga

SEQ ID NO: 1321900 - RNA, 19 nt, Homo sapiens
gaacaaaugugugaaucuc

SEQ ID NO: 1321901 - RNA, 19 nt, Homo sapiens
gcacauuuaugcauuucuu

SEQ ID NO: 1321902 - RNA, 19 nt, Homo sapiens
caaccagaauagcacuuua

SEQ ID NO: 1321903 - RNA, 19 nt, Homo sapiens
acaaaggacuucuggcaaa

SEQ ID NO: 1321904 - RNA, 19 nt, Homo sapiens
gaggaaaacugcauauauu

SEQ ID NO: 1321905 - RNA, 19 nt, Homo sapiens
gaauagcacuuuaccuuuu

SEQ ID NO: 1321906 - RNA, 19 nt, Homo sapiens
gaaauaaaagccuguguua

SEQ ID NO: 1321907 - RNA, 19 nt, Homo sapiens
cauggccagucaauaauua

SEQ ID NO: 1321908 - RNA, 19 nt, Homo sapiens
guggaacacuucacauauu

SEQ ID NO: 1321909 - RNA, 19 nt, Homo sapiens
uguauagugucaacaguua

SEQ ID NO: 1321910 - RNA, 19 nt, Homo sapiens
gacaacuacuguaaucauu

SEQ ID NO: 1321911 - RNA, 19 nt, Homo sapiens
cuagauaaguggcugacua

SEQ ID NO: 1321912 - RNA, 19 nt, Homo sapiens
uaacucagcagcaacuuaa

SEQ ID NO: 1321913 - RNA, 19 nt, Homo sapiens
agaccaagguauacaguuu

SEQ ID NO: 1321914 - RNA, 19 nt, Homo sapiens
gaaagauagacuugaguuu

SEQ ID NO: 1321915 - RNA, 19 nt, Homo sapiens
caugguaauuuguggauuu

SEQ ID NO: 1321916 - RNA, 19 nt, Homo sapiens
acaaagcucugcuguuuag

SEQ ID NO: 1321917 - RNA, 19 nt, Homo sapiens
gaaaugaugagagagauga

SEQ ID NO: 1321918 - RNA, 19 nt, Homo sapiens
gaauguggacaguuacuaa

SEQ ID NO: 1321919 - RNA, 19 nt, Homo sapiens
ggaaagcauaagcaaauuu

SEQ ID NO: 1321920 - RNA, 19 nt, Homo sapiens
ccagaaauguuaguaggaa

SEQ ID NO: 1321921 - RNA, 19 nt, Homo sapiens
gauauuacguagcuauagu

SEQ ID NO: 1321922 - RNA, 19 nt, Homo sapiens
gaauuuggagacuuugaua

SEQ ID NO: 1321923 - RNA, 19 nt, Homo sapiens
cagaugaaauggaaaguag

SEQ ID NO: 1321924 - RNA, 19 nt, Homo sapiens
gcaaaggaaggccaagaaa

SEQ ID NO: 1321925 - RNA, 19 nt, Homo sapiens
guagaaagauagacuugag

SEQ ID NO: 1321926 - RNA, 19 nt, Homo sapiens
aaucauggccagucaauaa

SEQ ID NO: 1321927 - RNA, 19 nt, Homo sapiens
ugaagcacauuuaugcauu

SEQ ID NO: 1321928 - RNA, 19 nt, Homo sapiens
gaaccgagaccgacuucuu

SEQ ID NO: 1321929 - RNA, 19 nt, Homo sapiens
gauacaauacacacugaua

SEQ ID NO: 1321930 - RNA, 19 nt, Homo sapiens
uguaacagguggaaaauua

SEQ ID NO: 1321931 - RNA, 19 nt, Homo sapiens
gacuguacauugagauauu

SEQ ID NO: 1321932 - RNA, 19 nt, Homo sapiens
acacuggcauuucuaggua

SEQ ID NO: 1321933 - RNA, 19 nt, Homo sapiens
gauccauacucaaaggaaa

SEQ ID NO: 1321934 - RNA, 19 nt, Homo sapiens
acucuuagauccuucauug

SEQ ID NO: 1321935 - RNA, 19 nt, Homo sapiens
cuccgaagcugauuuagaa

SEQ ID NO: 1321936 - RNA, 19 nt, Homo sapiens
uaacuccgaagcugauuua

SEQ ID NO: 1321937 - RNA, 19 nt, Homo sapiens
gacaguuacuaauaucuga

SEQ ID NO: 1321938 - RNA, 19 nt, Homo sapiens
ccucucauguuauguauau

SEQ ID NO: 1321939 - RNA, 19 nt, Homo sapiens
uacuauagcugucaguuga

SEQ ID NO: 1321940 - RNA, 19 nt, Homo sapiens
ggacucaggcaacugguaa

SEQ ID NO: 1321941 - RNA, 19 nt, Homo sapiens
cgaagcugauuuagaagaa

SEQ ID NO: 1321942 - RNA, 19 nt, Homo sapiens
gauaguacuugcucagaag

SEQ ID NO: 1321943 - RNA, 19 nt, Homo sapiens
gaccucagcaguguauuua

SEQ ID NO: 1321944 - RNA, 19 nt, Homo sapiens
cagaauagcacuuuaccuu

SEQ ID NO: 1321945 - RNA, 19 nt, Homo sapiens
uuuguaggcuugcauagua

SEQ ID NO: 1321946 - RNA, 19 nt, Homo sapiens
gaacagaugaaauggaaag

SEQ ID NO: 1321947 - RNA, 19 nt, Homo sapiens
uggaacagaugaaauggaa

SEQ ID NO: 1321948 - RNA, 19 nt, Homo sapiens
gaagauaccagguccacau

SEQ ID NO: 1321949 - RNA, 19 nt, Homo sapiens
ugaaagucuugguggauuu

SEQ ID NO: 1321950 - RNA, 19 nt, Homo sapiens
guacaugcuacucaagaua

SEQ ID NO: 1321951 - RNA, 19 nt, Homo sapiens
ccacaacugaaguaaauuu

SEQ ID NO: 1321952 - RNA, 19 nt, Homo sapiens
caaguagcaucaucaucuu

SEQ ID NO: 1321953 - RNA, 19 nt, Homo sapiens
gaaguaugcuaaagcuuuu

SEQ ID NO: 1321954 - RNA, 19 nt, Homo sapiens
gaagcugauuuagaagaaa

SEQ ID NO: 1321955 - RNA, 19 nt, Homo sapiens
gcaagcguauauugaagau

SEQ ID NO: 1321956 - RNA, 19 nt, Homo sapiens
caacagcaaauuaaacguu

SEQ ID NO: 1321957 - RNA, 19 nt, Homo sapiens
agacauccauaacuacuau

SEQ ID NO: 1321958 - RNA, 19 nt, Homo sapiens
guaguggguugcccuguau

SEQ ID NO: 1321959 - RNA, 19 nt, Homo sapiens
gcaacuuaauggaaacuag

SEQ ID NO: 1321960 - RNA, 19 nt, Homo sapiens
gagcagaauuuggagacuu

SEQ ID NO: 1321961 - RNA, 19 nt, Homo sapiens
gacuugaguuucuauacuu

SEQ ID NO: 1321962 - RNA, 19 nt, Homo sapiens
ggaccucagcaguguauuu

SEQ ID NO: 1321963 - RNA, 19 nt, Homo sapiens
ggucucaugugcuguagga

SEQ ID NO: 1321964 - RNA, 19 nt, Homo sapiens
gguuaccgcuugcuaagga

SEQ ID NO: 1321965 - RNA, 19 nt, Homo sapiens
uuaaaguuguucucacuga

SEQ ID NO: 1321966 - RNA, 19 nt, Homo sapiens
caagaaguaugcuaaagcu

SEQ ID NO: 1321967 - RNA, 19 nt, Homo sapiens
ugaagaagaugaggaacga

SEQ ID NO: 1321968 - RNA, 19 nt, Homo sapiens
cgaggaauuuacaaacuau

SEQ ID NO: 1321969 - RNA, 19 nt, Homo sapiens
ucucaaauaucucaaagca

SEQ ID NO: 1321970 - RNA, 19 nt, Homo sapiens
gggacucaaugcuugcuuu

SEQ ID NO: 1321971 - RNA, 19 nt, Homo sapiens
gaucacguuugucaagugu

SEQ ID NO: 1321972 - RNA, 19 nt, Homo sapiens
gagcaagccugagauugua

SEQ ID NO: 1321973 - RNA, 19 nt, Homo sapiens
aaccagaucuagauucuua

SEQ ID NO: 1321974 - RNA, 19 nt, Homo sapiens
gagcaggccuggaugaaug

SEQ ID NO: 1321975 - RNA, 19 nt, Homo sapiens
gaagaugaccgaagaagug

SEQ ID NO: 1321976 - RNA, 19 nt, Homo sapiens
cagagaagaugaccgaaga

SEQ ID NO: 1321977 - RNA, 19 nt, Homo sapiens
gcagagggacuacgugauu

SEQ ID NO: 1321978 - RNA, 19 nt, Homo sapiens
gagccgaggucgugccauu

SEQ ID NO: 1321979 - RNA, 19 nt, Homo sapiens
caaaccagaucuagauucu

SEQ ID NO: 1321980 - RNA, 19 nt, Homo sapiens
ucaugaagauagagaaguu

SEQ ID NO: 1321981 - RNA, 19 nt, Homo sapiens
cugcagagcucauugaaag

SEQ ID NO: 1321982 - RNA, 19 nt, Homo sapiens
gcacuugauccgauacaaa

SEQ ID NO: 1321983 - RNA, 19 nt, Homo sapiens
ucuagauucuuacguguuu

SEQ ID NO: 1321984 - RNA, 19 nt, Homo sapiens
uguagaaugugucauggaa

SEQ ID NO: 1321985 - RNA, 19 nt, Homo sapiens
ggagagcaagccugagauu

SEQ ID NO: 1321986 - RNA, 19 nt, Homo sapiens
aaauggagauggagaggau

SEQ ID NO: 1321987 - RNA, 19 nt, Homo sapiens
uagaaugugucauggaaca

SEQ ID NO: 1321988 - RNA, 19 nt, Homo sapiens
gaaguugcaggguugaguu

SEQ ID NO: 1321989 - RNA, 19 nt, Homo sapiens
gcaggagaaucgcuugaac

SEQ ID NO: 1321990 - RNA, 19 nt, Homo sapiens
gaucaugaggucaggaguu

SEQ ID NO: 1321991 - RNA, 19 nt, Homo sapiens
gaagggcucacagcacuug

SEQ ID NO: 1321992 - RNA, 19 nt, Homo sapiens
gaaaccccaucuuuacuga

SEQ ID NO: 1321993 - RNA, 19 nt, Homo sapiens
gauuguagaaugugucaug

SEQ ID NO: 1321994 - RNA, 19 nt, Homo sapiens
gcaguuuguuccucugucu

SEQ ID NO: 1321995 - RNA, 19 nt, Homo sapiens
ggugucgccucaugaagau

SEQ ID NO: 1321996 - RNA, 19 nt, Homo sapiens
uggaacagcuggagcacau

SEQ ID NO: 1321997 - RNA, 19 nt, Homo sapiens
gcagagcucauugaaagau

SEQ ID NO: 1321998 - RNA, 19 nt, Homo sapiens
cacagcacuugauccgaua

SEQ ID NO: 1321999 - RNA, 19 nt, Homo sapiens
cagagggacuacgugauug

SEQ ID NO: 1322000 - RNA, 19 nt, Homo sapiens
agccugagauuguagaaug

SEQ ID NO: 1322001 - RNA, 19 nt, Homo sapiens
gguagaaccagacacagau

SEQ ID NO: 1322002 - RNA, 19 nt, Homo sapiens
ggucagcauccaccaaaug

SEQ ID NO: 1322003 - RNA, 19 nt, Homo sapiens
cagagcucauugaaagauu

SEQ ID NO: 1322004 - RNA, 19 nt, Homo sapiens
ccgaguuccugguuucaga

SEQ ID NO: 1322005 - RNA, 19 nt, Homo sapiens
cagaugagcagagggacua

SEQ ID NO: 1322006 - RNA, 19 nt, Homo sapiens
cgcgggagcugagaaguug

SEQ ID NO: 1322007 - RNA, 19 nt, Homo sapiens
gucaggaguucgagaccaa

SEQ ID NO: 1322008 - RNA, 19 nt, Homo sapiens
gugagagaacgacaagaaa

SEQ ID NO: 1322009 - RNA, 19 nt, Homo sapiens
cggaagaguuggccuuugc

SEQ ID NO: 1322010 - RNA, 19 nt, Homo sapiens
gaaggucagcauccaccaa

SEQ ID NO: 1322011 - RNA, 19 nt, Homo sapiens
ggaccucuuucgggcaguu

SEQ ID NO: 1322012 - RNA, 19 nt, Homo sapiens
agagcaagccugagauugu

SEQ ID NO: 1322013 - RNA, 19 nt, Homo sapiens
gagagcaagccugagauug

SEQ ID NO: 1322014 - RNA, 19 nt, Homo sapiens
ccuguaaucccagcacuuu

SEQ ID NO: 1322015 - RNA, 19 nt, Homo sapiens
gagcaggagguugcaguga

SEQ ID NO: 1322016 - RNA, 19 nt, Homo sapiens
ggagcaggccuggaugaau

SEQ ID NO: 1322017 - RNA, 19 nt, Homo sapiens
gagaccaaccgaccaacau

SEQ ID NO: 1322018 - RNA, 19 nt, Homo sapiens
ccaaaccagaucuagauuc

SEQ ID NO: 1322019 - RNA, 19 nt, Homo sapiens
gagauuguagaauguguca

SEQ ID NO: 1322020 - RNA, 19 nt, Homo sapiens
gauuggagcaggccuggau

SEQ ID NO: 1322021 - RNA, 19 nt, Homo sapiens
agagcucauugaaagauug

SEQ ID NO: 1322022 - RNA, 19 nt, Homo sapiens
ugaccgaagaaguggauuu

SEQ ID NO: 1322023 - RNA, 19 nt, Homo sapiens
gagagugagagaacgacaa

SEQ ID NO: 1322024 - RNA, 19 nt, Homo sapiens
gagaagaugaccgaagaag

SEQ ID NO: 1322025 - RNA, 19 nt, Homo sapiens
gcaagccugagauuguaga

SEQ ID NO: 1322026 - RNA, 19 nt, Homo sapiens
gaccgaagaaguggauuuc

SEQ ID NO: 1322027 - RNA, 19 nt, Homo sapiens
agugagagaacgacaagaa

SEQ ID NO: 1322028 - RNA, 19 nt, Homo sapiens
gcaguucccaaaccagauc

SEQ ID NO: 1322029 - RNA, 19 nt, Homo sapiens
gcuacguccucagcagcua

SEQ ID NO: 1322030 - RNA, 19 nt, Homo sapiens
guagaaccagacacagaug

SEQ ID NO: 1322031 - RNA, 19 nt, Homo sapiens
ccgaagaaguggauuuccu

SEQ ID NO: 1322032 - RNA, 19 nt, Homo sapiens
guuccugguuucagagaag

SEQ ID NO: 1322033 - RNA, 19 nt, Homo sapiens
gccugagauuguagaaugu

SEQ ID NO: 1322034 - RNA, 19 nt, Homo sapiens
gaugaccgaagaaguggau

SEQ ID NO: 1322035 - RNA, 19 nt, Homo sapiens
ucccaaaccagaucuagau

SEQ ID NO: 1322036 - RNA, 19 nt, Homo sapiens
uagaaccagacacagauga

SEQ ID NO: 1322037 - RNA, 19 nt, Homo sapiens
gaaagauguucaagagaua

SEQ ID NO: 1322038 - RNA, 19 nt, Homo sapiens
cauccaagcucuacugaua

SEQ ID NO: 1322039 - RNA, 19 nt, Homo sapiens
ugggauagaugacggauua

SEQ ID NO: 1322040 - RNA, 19 nt, Homo sapiens
gcuaaaagcuuacggagua

SEQ ID NO: 1322041 - RNA, 19 nt, Homo sapiens
gauagcaacugugguggua

SEQ ID NO: 1322042 - RNA, 19 nt, Homo sapiens
aaacauggcuaaaagcuua

SEQ ID NO: 1322043 - RNA, 19 nt, Homo sapiens
gaugauguacugacaaauu

SEQ ID NO: 1322044 - RNA, 19 nt, Homo sapiens
gagcuuugauuccacagaa

SEQ ID NO: 1322045 - RNA, 19 nt, Homo sapiens
gaugacggauuagaaugua

SEQ ID NO: 1322046 - RNA, 19 nt, Homo sapiens
guacuuguguggagcuuug

SEQ ID NO: 1322047 - RNA, 19 nt, Homo sapiens
cagaugauguacugacaaa

SEQ ID NO: 1322048 - RNA, 19 nt, Homo sapiens
caauauggaugaaccaaag

SEQ ID NO: 1322049 - RNA, 19 nt, Homo sapiens
gauuucaacugccaccaaa

SEQ ID NO: 1322050 - RNA, 19 nt, Homo sapiens
gguguucguuucucaggua

SEQ ID NO: 1322051 - RNA, 19 nt, Homo sapiens
caaacuagacggugauguu

SEQ ID NO: 1322052 - RNA, 19 nt, Homo sapiens
caacugccaccaaaugaaa

SEQ ID NO: 1322053 - RNA, 19 nt, Homo sapiens
ggagacugauauuaagaga

SEQ ID NO: 1322054 - RNA, 19 nt, Homo sapiens
uacccaauauccaguuaua

SEQ ID NO: 1322055 - RNA, 19 nt, Homo sapiens
ggauuagaauguauacaca

SEQ ID NO: 1322056 - RNA, 19 nt, Homo sapiens
gaaaaugccacaugggaua

SEQ ID NO: 1322057 - RNA, 19 nt, Homo sapiens
ggacaguacccaauaugga

SEQ ID NO: 1322058 - RNA, 19 nt, Homo sapiens
gcauggacaguacccaaua

SEQ ID NO: 1322059 - RNA, 19 nt, Homo sapiens
gauagaugacggauuagaa

SEQ ID NO: 1322060 - RNA, 19 nt, Homo sapiens
gaaggcaaagcgagagaaa

SEQ ID NO: 1322061 - RNA, 19 nt, Homo sapiens
gcuacccaauauccaguua

SEQ ID NO: 1322062 - RNA, 19 nt, Homo sapiens
aagcucuacugauacuuua

SEQ ID NO: 1322063 - RNA, 19 nt, Homo sapiens
gaggucaguucgagacuag

SEQ ID NO: 1322064 - RNA, 19 nt, Homo sapiens
caauucaaacccagcauaa

SEQ ID NO: 1322065 - RNA, 19 nt, Homo sapiens
gaaaccccaucucuacuaa

SEQ ID NO: 1322066 - RNA, 19 nt, Homo sapiens
uaaaacagaugauguacug

SEQ ID NO: 1322067 - RNA, 19 nt, Homo sapiens
caagcucuacugauacuuu

SEQ ID NO: 1322068 - RNA, 19 nt, Homo sapiens
gaaaaugcaaugugaggua

SEQ ID NO: 1322069 - RNA, 19 nt, Homo sapiens
caacugguaauuauaguca

SEQ ID NO: 1322070 - RNA, 19 nt, Homo sapiens
guaggacucugucucaaaa

SEQ ID NO: 1322071 - RNA, 19 nt, Homo sapiens
gguaaaacauggcuaaaag

SEQ ID NO: 1322072 - RNA, 19 nt, Homo sapiens
gaaaauggagacugauauu

SEQ ID NO: 1322073 - RNA, 19 nt, Homo sapiens
ugacggauuagaauguaua

SEQ ID NO: 1322074 - RNA, 19 nt, Homo sapiens
cauggacaguacccaauau

SEQ ID NO: 1322075 - RNA, 19 nt, Homo sapiens
gaaagaugcgugcugaaaa

SEQ ID NO: 1322076 - RNA, 19 nt, Homo sapiens
guacccaaacccaaacauu

SEQ ID NO: 1322077 - RNA, 19 nt, Homo sapiens
agaaagaugcgugcugaaa

SEQ ID NO: 1322078 - RNA, 19 nt, Homo sapiens
ucaacguucugucagguau

SEQ ID NO: 1322079 - RNA, 19 nt, Homo sapiens
ucaauucaaacccagcaua

SEQ ID NO: 1322080 - RNA, 19 nt, Homo sapiens
gcaggauaauugcuugaac

SEQ ID NO: 1322081 - RNA, 19 nt, Homo sapiens
aacguucugucagguauua

SEQ ID NO: 1322082 - RNA, 19 nt, Homo sapiens
gacaguacccaauauggau

SEQ ID NO: 1322083 - RNA, 19 nt, Homo sapiens
caaacauugccaagagaaa

SEQ ID NO: 1322084 - RNA, 19 nt, Homo sapiens
gcaccuguaguuccagcua

SEQ ID NO: 1322085 - RNA, 19 nt, Homo sapiens
cgaggucaguucgagacua

SEQ ID NO: 1322086 - RNA, 19 nt, Homo sapiens
guucugucagguauuaaua

SEQ ID NO: 1322087 - RNA, 19 nt, Homo sapiens
ccaauauccaguuauaauc

SEQ ID NO: 1322088 - RNA, 19 nt, Homo sapiens
ugaaaguggcaaaggguuu

SEQ ID NO: 1322089 - RNA, 19 nt, Homo sapiens
gaaccaaaggcaaagaaaa

SEQ ID NO: 1322090 - RNA, 19 nt, Homo sapiens
ggugguacccaaacccaaa

SEQ ID NO: 1322091 - RNA, 19 nt, Homo sapiens
ccagcaggcuuaaaaguau

SEQ ID NO: 1322092 - RNA, 19 nt, Homo sapiens
aauggagacugauauuaag

SEQ ID NO: 1322093 - RNA, 19 nt, Homo sapiens
gcgcgcaccuguaguucca

SEQ ID NO: 1322094 - RNA, 19 nt, Homo sapiens
aaucaggccucaacguucu

SEQ ID NO: 1322095 - RNA, 19 nt, Homo sapiens
gguagacucuuaaaaccuu

SEQ ID NO: 1322096 - RNA, 19 nt, Homo sapiens
acuagacggugauguuuua

SEQ ID NO: 1322097 - RNA, 19 nt, Homo sapiens
cccaauauccaguuauaau

SEQ ID NO: 1322098 - RNA, 19 nt, Homo sapiens
ggauagaugacggauuaga

SEQ ID NO: 1322099 - RNA, 19 nt, Homo sapiens
ccaauauggaugaaccaaa

SEQ ID NO: 1322100 - RNA, 19 nt, Homo sapiens
ccaaacauugccaagagaa

SEQ ID NO: 1322101 - RNA, 19 nt, Homo sapiens
ggaggcugaggcaggauaa

SEQ ID NO: 1322102 - RNA, 19 nt, Homo sapiens
ccuguaaucccagcacuuu

SEQ ID NO: 1322103 - RNA, 19 nt, Homo sapiens
ugucagguauuaauauggu

SEQ ID NO: 1322104 - RNA, 19 nt, Homo sapiens
gcaaagcgagagaaaagaa

SEQ ID NO: 1322105 - RNA, 19 nt, Homo sapiens
uacccaaacccaaacauug

SEQ ID NO: 1322106 - RNA, 19 nt, Homo sapiens
ucugucagguauuaauaug

SEQ ID NO: 1322107 - RNA, 19 nt, Homo sapiens
aagagaaaaugcaauguga

SEQ ID NO: 1322108 - RNA, 19 nt, Homo sapiens
uucaagagauagcaacugu

SEQ ID NO: 1322109 - RNA, 19 nt, Homo sapiens
ggaguaaguggaaaagaaa

SEQ ID NO: 1322110 - RNA, 19 nt, Homo sapiens
aaggaggccagcaggcuua

SEQ ID NO: 1322111 - RNA, 19 nt, Homo sapiens
cggaguaaguggaaaagaa

SEQ ID NO: 1322112 - RNA, 19 nt, Homo sapiens
cccaaacauugccaagaga

SEQ ID NO: 1322113 - RNA, 19 nt, Homo sapiens
ggcugaggcaggauaauug

SEQ ID NO: 1322114 - RNA, 19 nt, Homo sapiens
gggaggcugaggcaggaua

SEQ ID NO: 1322115 - RNA, 19 nt, Homo sapiens
acuggaugcuacccaauau

SEQ ID NO: 1322116 - RNA, 19 nt, Homo sapiens
cuuaaaaccuuggaaaaug

SEQ ID NO: 1322117 - RNA, 19 nt, Homo sapiens
gagguguggguguucguuu

SEQ ID NO: 1322118 - RNA, 19 nt, Homo sapiens
gaaaagcaaagcaaaagca

SEQ ID NO: 1322119 - RNA, 19 nt, Homo sapiens
uggaugaaccaaaggcaaa

SEQ ID NO: 1322120 - RNA, 19 nt, Homo sapiens
ccugggcaauggaguagga

SEQ ID NO: 1322121 - RNA, 19 nt, Homo sapiens
gagauggagguugcaguga

SEQ ID NO: 1322122 - RNA, 19 nt, Homo sapiens
auaaucaggccucaacguu

SEQ ID NO: 1322123 - RNA, 19 nt, Homo sapiens
acugauacuuuaacuggau

SEQ ID NO: 1322124 - RNA, 19 nt, Homo sapiens
ucaacugccaccaaaugaa

SEQ ID NO: 1322125 - RNA, 19 nt, Homo sapiens
ugaaccaaaggcaaagaaa

SEQ ID NO: 1322126 - RNA, 19 nt, Homo sapiens
gagacugauauuaagagaa

SEQ ID NO: 1322127 - RNA, 19 nt, Homo sapiens
aaaaugcaaugugagguaa

SEQ ID NO: 1322128 - RNA, 19 nt, Homo sapiens
acccaaacauugccaagag

SEQ ID NO: 1322129 - RNA, 19 nt, Homo sapiens
agacggugauguuuuaaug

SEQ ID NO: 1322130 - RNA, 19 nt, Homo sapiens
gaugcgugcugaaaagaga

SEQ ID NO: 1322131 - RNA, 19 nt, Homo sapiens
guuauaaucaggccucaac

SEQ ID NO: 1322132 - RNA, 19 nt, Homo sapiens
auagaugacggauuagaau

SEQ ID NO: 1322133 - RNA, 19 nt, Homo sapiens
aaugugagguaaaagauga

SEQ ID NO: 1322134 - RNA, 19 nt, Homo sapiens
gcacuccacccugggcaau

SEQ ID NO: 1322135 - RNA, 19 nt, Homo sapiens
gccagcaggcuuaaaagua

SEQ ID NO: 1322136 - RNA, 19 nt, Homo sapiens
agaccagcauggacaguac

SEQ ID NO: 1322137 - RNA, 19 nt, Homo sapiens
guacaaagaaggaauagaa

SEQ ID NO: 1322138 - RNA, 19 nt, Homo sapiens
cuacuuagcuccuuagcaa

SEQ ID NO: 1322139 - RNA, 19 nt, Homo sapiens
gcaguaaaguggcgcuaca

SEQ ID NO: 1322140 - RNA, 19 nt, Homo sapiens
uaaaguggcgcuacaaaca

SEQ ID NO: 1322141 - RNA, 19 nt, Homo sapiens
caaagaaggaauagaagau

SEQ ID NO: 1322142 - RNA, 19 nt, Homo sapiens
ccuuugagauagagauaaa

SEQ ID NO: 1322143 - RNA, 19 nt, Homo sapiens
caggguaagugcccacgaa

SEQ ID NO: 1322144 - RNA, 19 nt, Homo sapiens
ugucagcuauuggcaguaa

SEQ ID NO: 1322145 - RNA, 19 nt, Homo sapiens
ccagggcaaugucagcuau

SEQ ID NO: 1322146 - RNA, 19 nt, Homo sapiens
gagaaacccuagaaaagau

SEQ ID NO: 1322147 - RNA, 19 nt, Homo sapiens
cacaggugccuuugagaua

SEQ ID NO: 1322148 - RNA, 19 nt, Homo sapiens
ggagaaacccuagaaaaga

SEQ ID NO: 1322149 - RNA, 19 nt, Homo sapiens
aaaccuuggucucccuuug

SEQ ID NO: 1322150 - RNA, 19 nt, Homo sapiens
ccgaagagccaguaaugga

SEQ ID NO: 1322151 - RNA, 19 nt, Homo sapiens
uaaauggacagcugguguu

SEQ ID NO: 1322152 - RNA, 19 nt, Homo sapiens
acucuucgccucgguaaua

SEQ ID NO: 1322153 - RNA, 19 nt, Homo sapiens
acaaagaaggaauagaaga

SEQ ID NO: 1322154 - RNA, 19 nt, Homo sapiens
ugagauagagauaaaugga

SEQ ID NO: 1322155 - RNA, 19 nt, Homo sapiens
gacccuggccuccacuuug

SEQ ID NO: 1322156 - RNA, 19 nt, Homo sapiens
uaauggagaaacccuagaa

SEQ ID NO: 1322157 - RNA, 19 nt, Homo sapiens
ggccuccacuuugcccuuu

SEQ ID NO: 1322158 - RNA, 19 nt, Homo sapiens
guaaaguggcgcuacaaac

SEQ ID NO: 1322159 - RNA, 19 nt, Homo sapiens
caggugccuuugagauaga

SEQ ID NO: 1322160 - RNA, 19 nt, Homo sapiens
cgaaagcccaguccacucu

SEQ ID NO: 1322161 - RNA, 19 nt, Homo sapiens
acaggugccuuugagauag

SEQ ID NO: 1322162 - RNA, 19 nt, Homo sapiens
gagcuggccagugcuguga

SEQ ID NO: 1322163 - RNA, 19 nt, Homo sapiens
gacagcugguguucuccaa

SEQ ID NO: 1322164 - RNA, 19 nt, Homo sapiens
gcaucgugguggaguacug

SEQ ID NO: 1322165 - RNA, 19 nt, Homo sapiens
gguaagugcccacgaaagc

SEQ ID NO: 1322166 - RNA, 19 nt, Homo sapiens
gaaagcccaguccacucuu

SEQ ID NO: 1322167 - RNA, 19 nt, Homo sapiens
uagaaaagaucaccaacag

SEQ ID NO: 1322168 - RNA, 19 nt, Homo sapiens
ccacucuucgccucgguaa

SEQ ID NO: 1322169 - RNA, 19 nt, Homo sapiens
aaagcccaguccacucuuc

SEQ ID NO: 1322170 - RNA, 19 nt, Homo sapiens
ggaagaaacugcaggagaa

SEQ ID NO: 1322171 - RNA, 19 nt, Homo sapiens
uggaagagcuuaaggaaau

SEQ ID NO: 1322172 - RNA, 19 nt, Homo sapiens
ggaagagcuuaaggaaaua

SEQ ID NO: 1322173 - RNA, 19 nt, Homo sapiens
gauaaaggcauguggaaga

SEQ ID NO: 1322174 - RNA, 19 nt, Homo sapiens
gagcuuaaggaaauagaua

SEQ ID NO: 1322175 - RNA, 19 nt, Homo sapiens
ccacagacaccuuggaaga

SEQ ID NO: 1322176 - RNA, 19 nt, Homo sapiens
uagcgcgacuccauucaaa

SEQ ID NO: 1322177 - RNA, 19 nt, Homo sapiens
uguggagucuuguacauug

SEQ ID NO: 1322178 - RNA, 19 nt, Homo sapiens
ggccuuaccucgugcacau

SEQ ID NO: 1322179 - RNA, 19 nt, Homo sapiens
gagcuuagcgcgacuccau

SEQ ID NO: 1322180 - RNA, 19 nt, Homo sapiens
ucaguggccugucguugga

SEQ ID NO: 1322181 - RNA, 19 nt, Homo sapiens
gggagagaauacccagguu

SEQ ID NO: 1322182 - RNA, 19 nt, Homo sapiens
auaaaggcauguggaagaa

SEQ ID NO: 1322183 - RNA, 19 nt, Homo sapiens
ucaaacuacuacaaacaca

SEQ ID NO: 1322184 - RNA, 19 nt, Homo sapiens
ucagauguacgagagcuua

SEQ ID NO: 1322185 - RNA, 19 nt, Homo sapiens
ccauucaaacuacuacaaa

SEQ ID NO: 1322186 - RNA, 19 nt, Homo sapiens
gguguggagucuuguacau

SEQ ID NO: 1322187 - RNA, 19 nt, Homo sapiens
gccugucguuggaagagua

SEQ ID NO: 1322188 - RNA, 19 nt, Homo sapiens
gcgacuccauucaaacuac

SEQ ID NO: 1322189 - RNA, 19 nt, Homo sapiens
gcggguagcacaggccuuu

SEQ ID NO: 1322190 - RNA, 19 nt, Homo sapiens
caaacuacuacaaacacaa

SEQ ID NO: 1322191 - RNA, 19 nt, Homo sapiens
gaagaaacugcaggagaag

SEQ ID NO: 1322192 - RNA, 19 nt, Homo sapiens
aaaggcauguggaagaaac

SEQ ID NO: 1322193 - RNA, 19 nt, Homo sapiens
uagauaaaggcauguggaa

SEQ ID NO: 1322194 - RNA, 19 nt, Homo sapiens
ugaggccugugaucagaug

SEQ ID NO: 1322195 - RNA, 19 nt, Homo sapiens
gaagagcuuaaggaaauag

SEQ ID NO: 1322196 - RNA, 19 nt, Homo sapiens
cuuaagcucugugaggaau

SEQ ID NO: 1322197 - RNA, 19 nt, Homo sapiens
gaaauagauaaaggcaugu

SEQ ID NO: 1322198 - RNA, 19 nt, Homo sapiens
uaagcucugugaggaaugg

SEQ ID NO: 1322199 - RNA, 19 nt, Homo sapiens
ggaagaguacaagcugauc

SEQ ID NO: 1322200 - RNA, 19 nt, Homo sapiens
aaacuacuacaaacacaag

SEQ ID NO: 1322201 - RNA, 19 nt, Homo sapiens
cauucaaacuacuacaaac

SEQ ID NO: 1322202 - RNA, 19 nt, Homo sapiens
uaaaggcauguggaagaaa

SEQ ID NO: 1322203 - RNA, 19 nt, Homo sapiens
gcuuagcgcgacuccauuc

SEQ ID NO: 1322204 - RNA, 19 nt, Homo sapiens
ggagguagcuucucuguuu

SEQ ID NO: 1322205 - RNA, 19 nt, Homo sapiens
guaaagaccuguucaucua

SEQ ID NO: 1322206 - RNA, 19 nt, Homo sapiens
ccacaaggcugguugcaua

SEQ ID NO: 1322207 - RNA, 19 nt, Homo sapiens
gauaguaaccucagucuuu

SEQ ID NO: 1322208 - RNA, 19 nt, Homo sapiens
guggagaccuugagaaauu

SEQ ID NO: 1322209 - RNA, 19 nt, Homo sapiens
caaggcugguugcauauua

SEQ ID NO: 1322210 - RNA, 19 nt, Homo sapiens
agauauaggugcuuaguuu

SEQ ID NO: 1322211 - RNA, 19 nt, Homo sapiens
cgaauagauuucaguagua

SEQ ID NO: 1322212 - RNA, 19 nt, Homo sapiens
gcaagauucuguucaguca

SEQ ID NO: 1322213 - RNA, 19 nt, Homo sapiens
acaaagauauaggugcuua

SEQ ID NO: 1322214 - RNA, 19 nt, Homo sapiens
gcaaagauagaagaagaua

SEQ ID NO: 1322215 - RNA, 19 nt, Homo sapiens
acagaucauuggcuucuua

SEQ ID NO: 1322216 - RNA, 19 nt, Homo sapiens
gcucucaguuucuguaaug

SEQ ID NO: 1322217 - RNA, 19 nt, Homo sapiens
gcuuaaacaugauuggauu

SEQ ID NO: 1322218 - RNA, 19 nt, Homo sapiens
gcauuucgauuugacauga

SEQ ID NO: 1322219 - RNA, 19 nt, Homo sapiens
agaaaggauucgucuguuu

SEQ ID NO: 1322220 - RNA, 19 nt, Homo sapiens
gauauaggugcuuaguuua

SEQ ID NO: 1322221 - RNA, 19 nt, Homo sapiens
gcagaugcuuggacucuuc

SEQ ID NO: 1322222 - RNA, 19 nt, Homo sapiens
caagaaaggauucgucugu

SEQ ID NO: 1322223 - RNA, 19 nt, Homo sapiens
ggacucuucucccaaaucu

SEQ ID NO: 1322224 - RNA, 19 nt, Homo sapiens
gaucgucuaugcggaaaga

SEQ ID NO: 1322225 - RNA, 19 nt, Homo sapiens
cauauuacaugggcugauu

SEQ ID NO: 1322226 - RNA, 19 nt, Homo sapiens
gugcuuaguuuaaugacuu

SEQ ID NO: 1322227 - RNA, 19 nt, Homo sapiens
guuagucucuccucuuuca

SEQ ID NO: 1322228 - RNA, 19 nt, Homo sapiens
ccgaauagauuucaguagu

SEQ ID NO: 1322229 - RNA, 19 nt, Homo sapiens
cauaacacagcuuuagaua

SEQ ID NO: 1322230 - RNA, 19 nt, Homo sapiens
gaagauauaagguaaagac

SEQ ID NO: 1322231 - RNA, 19 nt, Homo sapiens
ggagagagcaagaaaggau

SEQ ID NO: 1322232 - RNA, 19 nt, Homo sapiens
gauagaagaagauauaagg

SEQ ID NO: 1322233 - RNA, 19 nt, Homo sapiens
aaagaccuguucaucuaaa

SEQ ID NO: 1322234 - RNA, 19 nt, Homo sapiens
gaacguugguaguccuaag

SEQ ID NO: 1322235 - RNA, 19 nt, Homo sapiens
aaacaugauuggauuagag

SEQ ID NO: 1322236 - RNA, 19 nt, Homo sapiens
aggcaaagauagaagaaga

SEQ ID NO: 1322237 - RNA, 19 nt, Homo sapiens
aaagaccucucacagacaa

SEQ ID NO: 1322238 - RNA, 19 nt, Homo sapiens
aagauucuguucagucauu

SEQ ID NO: 1322239 - RNA, 19 nt, Homo sapiens
gauuugacucucuuucuuu

SEQ ID NO: 1322240 - RNA, 19 nt, Homo sapiens
gaucauuggcuucuuaugg

SEQ ID NO: 1322241 - RNA, 19 nt, Homo sapiens
gauagucacaagcaagauu

SEQ ID NO: 1322242 - RNA, 19 nt, Homo sapiens
gacagagcaucauaacaca

SEQ ID NO: 1322243 - RNA, 19 nt, Homo sapiens
cagguuaucugacauuggu

SEQ ID NO: 1322244 - RNA, 19 nt, Homo sapiens
caagcaagauucuguucag

SEQ ID NO: 1322245 - RNA, 19 nt, Homo sapiens
uaaagaccuguucaucuaa

SEQ ID NO: 1322246 - RNA, 19 nt, Homo sapiens
gguaaagaccuguucaucu

SEQ ID NO: 1322247 - RNA, 19 nt, Homo sapiens
auccagggcuuaaacauga

SEQ ID NO: 1322248 - RNA, 19 nt, Homo sapiens
ugauuugacucucuuucuu

SEQ ID NO: 1322249 - RNA, 19 nt, Homo sapiens
gaaagaccucucacagaca

SEQ ID NO: 1322250 - RNA, 19 nt, Homo sapiens
gaaaggauucgucuguuuu

SEQ ID NO: 1322251 - RNA, 19 nt, Homo sapiens
gggcugauuugacucucuu

SEQ ID NO: 1322252 - RNA, 19 nt, Homo sapiens
uagcagacagagcaucaua

SEQ ID NO: 1322253 - RNA, 19 nt, Homo sapiens
cuuagagacuccagauuuc

SEQ ID NO: 1322254 - RNA, 19 nt, Homo sapiens
ccucagggcuuggacaauc

SEQ ID NO: 1322255 - RNA, 19 nt, Homo sapiens
gcucaagcaaggacaguga

SEQ ID NO: 1322256 - RNA, 19 nt, Homo sapiens
uaaacugaaugcuggacau

SEQ ID NO: 1322257 - RNA, 19 nt, Homo sapiens
cggaaagaccucucacaga

SEQ ID NO: 1322258 - RNA, 19 nt, Homo sapiens
gagagagcaagaaaggauu

SEQ ID NO: 1322259 - RNA, 19 nt, Homo sapiens
acugaaugcuggacauguu

SEQ ID NO: 1322260 - RNA, 19 nt, Homo sapiens
caucauaacacagcuuuag

SEQ ID NO: 1322261 - RNA, 19 nt, Homo sapiens
gcagacagagcaucauaac

SEQ ID NO: 1322262 - RNA, 19 nt, Homo sapiens
gaccuguucaucuaaagaa

SEQ ID NO: 1322263 - RNA, 19 nt, Homo sapiens
aagaaaggauucgucuguu

SEQ ID NO: 1322264 - RNA, 19 nt, Homo sapiens
caguggagaccuugagaaa

SEQ ID NO: 1322265 - RNA, 19 nt, Homo sapiens
agguuagucucuccucuuu

SEQ ID NO: 1322266 - RNA, 19 nt, Homo sapiens
ccaugcugcucaccgugua

SEQ ID NO: 1322267 - RNA, 19 nt, Homo sapiens
gacugcagguuaucugaca

SEQ ID NO: 1322268 - RNA, 19 nt, Homo sapiens
acuuagagacuccagauuu

SEQ ID NO: 1322269 - RNA, 19 nt, Homo sapiens
uacaugggcugauuugacu

SEQ ID NO: 1322270 - RNA, 19 nt, Homo sapiens
agucucuccucuuucauuu

SEQ ID NO: 1322271 - RNA, 19 nt, Homo sapiens
gggcaucugcuuggaggua

SEQ ID NO: 1322272 - RNA, 19 nt, Homo sapiens
uggagaccuugagaaauuu

SEQ ID NO: 1322273 - RNA, 19 nt, Homo sapiens
agacagagcaucauaacac

SEQ ID NO: 1322274 - RNA, 19 nt, Homo sapiens
ucacagacaaccacagauc

SEQ ID NO: 1322275 - RNA, 19 nt, Homo sapiens
agacaaccacagaucauug

SEQ ID NO: 1322276 - RNA, 19 nt, Homo sapiens
gggcauggagcucaagcaa

SEQ ID NO: 1322277 - RNA, 19 nt, Homo sapiens
gaagcucaggcaaagauag

SEQ ID NO: 1322278 - RNA, 19 nt, Homo sapiens
uugacucucuuucuuuaga

SEQ ID NO: 1322279 - RNA, 19 nt, Homo sapiens
cagccuugcuccgagauau

SEQ ID NO: 1322280 - RNA, 19 nt, Homo sapiens
gcuuggagguagcuucucu

SEQ ID NO: 1322281 - RNA, 19 nt, Homo sapiens
aaacuuagagacuccagau

SEQ ID NO: 1322282 - RNA, 19 nt, Homo sapiens
ucacaagcaagauucuguu

SEQ ID NO: 1322283 - RNA, 19 nt, Homo sapiens
acucuucucccaaaucuga

SEQ ID NO: 1322284 - RNA, 19 nt, Homo sapiens
gcugguugcauauuacaug

SEQ ID NO: 1322285 - RNA, 19 nt, Homo sapiens
ugacaugacaaagauauag

SEQ ID NO: 1322286 - RNA, 19 nt, Homo sapiens
ugacauugguugggcaucu

SEQ ID NO: 1322287 - RNA, 19 nt, Homo sapiens
ucacacugauagucacaag

SEQ ID NO: 1322288 - RNA, 19 nt, Homo sapiens
guuuccagcucucaguuuc

SEQ ID NO: 1322289 - RNA, 19 nt, Homo sapiens
ucauaacacagcuuuagau

SEQ ID NO: 1322290 - RNA, 19 nt, Homo sapiens
acuucgagcugcacaacuu

SEQ ID NO: 1322291 - RNA, 19 nt, Homo sapiens
cgcaugagcuguccuugcu

SEQ ID NO: 1322292 - RNA, 19 nt, Homo sapiens
cuggagaaauaacuucauc

SEQ ID NO: 1322293 - RNA, 19 nt, Homo sapiens
ccagcucucaguuucugua

SEQ ID NO: 1322294 - RNA, 19 nt, Homo sapiens
aaacuuaccccgaauagau

SEQ ID NO: 1322295 - RNA, 19 nt, Homo sapiens
gcaucauaacacagcuuua

SEQ ID NO: 1322296 - RNA, 19 nt, Homo sapiens
cagaucgucuaugcggaaa

SEQ ID NO: 1322297 - RNA, 19 nt, Homo sapiens
acacagcagucccacucau

SEQ ID NO: 1322298 - RNA, 19 nt, Homo sapiens
uaaauccagggcuuaaaca

SEQ ID NO: 1322299 - RNA, 19 nt, Homo sapiens
ccacagaucauuggcuucu

SEQ ID NO: 1322300 - RNA, 19 nt, Homo sapiens
ucuaugcauuucgauuuga

SEQ ID NO: 1322301 - RNA, 19 nt, Homo sapiens
gagauaguaaccucagucu

SEQ ID NO: 1322302 - RNA, 19 nt, Homo sapiens
cagacaaccacagaucauu

SEQ ID NO: 1322303 - RNA, 19 nt, Homo sapiens
gagguagcuucucuguuuu

SEQ ID NO: 1322304 - RNA, 19 nt, Homo sapiens
gcagguauuucacuguuua

SEQ ID NO: 1322305 - RNA, 19 nt, Homo sapiens
gcaaggacauggcacugua

SEQ ID NO: 1322306 - RNA, 19 nt, Homo sapiens
ccaaguugcucuccaagua

SEQ ID NO: 1322307 - RNA, 19 nt, Homo sapiens
ggguuuagcuggccuguaa

SEQ ID NO: 1322308 - RNA, 19 nt, Homo sapiens
gagcagaucuucccagucu

SEQ ID NO: 1322309 - RNA, 19 nt, Homo sapiens
gaucuuaaggguagaauuu

SEQ ID NO: 1322310 - RNA, 19 nt, Homo sapiens
gcacuguacucgcuguuga

SEQ ID NO: 1322311 - RNA, 19 nt, Homo sapiens
ggauagauuccauuuguuu

SEQ ID NO: 1322312 - RNA, 19 nt, Homo sapiens
ggugagauccuuuggaauu

SEQ ID NO: 1322313 - RNA, 19 nt, Homo sapiens
gaacacugauuauauucuc

SEQ ID NO: 1322314 - RNA, 19 nt, Homo sapiens
gaaccucaauauguuaaga

SEQ ID NO: 1322315 - RNA, 19 nt, Homo sapiens
gagaugccuuucugaaguu

SEQ ID NO: 1322316 - RNA, 19 nt, Homo sapiens
guauuucacuguuuacugu

SEQ ID NO: 1322317 - RNA, 19 nt, Homo sapiens
uuacuaaccuggauauaca

SEQ ID NO: 1322318 - RNA, 19 nt, Homo sapiens
gcacugaggaugauuaugg

SEQ ID NO: 1322319 - RNA, 19 nt, Homo sapiens
guccagcucuucauccuaa

SEQ ID NO: 1322320 - RNA, 19 nt, Homo sapiens
uagaauauaugcccaacga

SEQ ID NO: 1322321 - RNA, 19 nt, Homo sapiens
gguagaagacgaugcugua

SEQ ID NO: 1322322 - RNA, 19 nt, Homo sapiens
gaagcaggacuaugucuau

SEQ ID NO: 1322323 - RNA, 19 nt, Homo sapiens
ccaacucguuugagaaaga

SEQ ID NO: 1322324 - RNA, 19 nt, Homo sapiens
ggagagagggccuauguag

SEQ ID NO: 1322325 - RNA, 19 nt, Homo sapiens
uccuugaccugauguaaua

SEQ ID NO: 1322326 - RNA, 19 nt, Homo sapiens
gccaagagaugccuuucug

SEQ ID NO: 1322327 - RNA, 19 nt, Homo sapiens
ccgagaggcuccagcacua

SEQ ID NO: 1322328 - RNA, 19 nt, Homo sapiens
gaccaacucguuugagaaa

SEQ ID NO: 1322329 - RNA, 19 nt, Homo sapiens
caagagaugccuuucugaa

SEQ ID NO: 1322330 - RNA, 19 nt, Homo sapiens
agacgaugcuguaccagaa

SEQ ID NO: 1322331 - RNA, 19 nt, Homo sapiens
gagcuucccucugccaaug

SEQ ID NO: 1322332 - RNA, 19 nt, Homo sapiens
aggcugcccuccacuauuu

SEQ ID NO: 1322333 - RNA, 19 nt, Homo sapiens
uaacaguggugacguuugg

SEQ ID NO: 1322334 - RNA, 19 nt, Homo sapiens
agaaagagaagcaggacua

SEQ ID NO: 1322335 - RNA, 19 nt, Homo sapiens
gaacaaaaguugaccucau

SEQ ID NO: 1322336 - RNA, 19 nt, Homo sapiens
caacgaggcaggaccaugu

SEQ ID NO: 1322337 - RNA, 19 nt, Homo sapiens
agagaugccuuucugaagu

SEQ ID NO: 1322338 - RNA, 19 nt, Homo sapiens
ucaccuaccugucccaagu

SEQ ID NO: 1322339 - RNA, 19 nt, Homo sapiens
gcagaucuucccagucuug

SEQ ID NO: 1322340 - RNA, 19 nt, Homo sapiens
gcaggaccauguggauaga

SEQ ID NO: 1322341 - RNA, 19 nt, Homo sapiens
gcaggacuaugucuauugc

SEQ ID NO: 1322342 - RNA, 19 nt, Homo sapiens
agucaucccugcagaccua

SEQ ID NO: 1322343 - RNA, 19 nt, Homo sapiens
caagaguuccugcagcaaa

SEQ ID NO: 1322344 - RNA, 19 nt, Homo sapiens
ccaaaugagccaagaguuc

SEQ ID NO: 1322345 - RNA, 19 nt, Homo sapiens
ccagugagggugcauuuga

SEQ ID NO: 1322346 - RNA, 19 nt, Homo sapiens
gaaagagaagcaggacuau

SEQ ID NO: 1322347 - RNA, 19 nt, Homo sapiens
ucuacacucuuacuucuau

SEQ ID NO: 1322348 - RNA, 19 nt, Homo sapiens
gugagauccuuuggaauug

SEQ ID NO: 1322349 - RNA, 19 nt, Homo sapiens
ggauauacaugagguuugc

SEQ ID NO: 1322350 - RNA, 19 nt, Homo sapiens
agagagggccuauguagug

SEQ ID NO: 1322351 - RNA, 19 nt, Homo sapiens
aagagaagcaggacuaugu

SEQ ID NO: 1322352 - RNA, 19 nt, Homo sapiens
gagcguagugugagccauu

SEQ ID NO: 1322353 - RNA, 19 nt, Homo sapiens
ugagauccuuuggaauuga

SEQ ID NO: 1322354 - RNA, 19 nt, Homo sapiens
cggguuugauuucugauga

SEQ ID NO: 1322355 - RNA, 19 nt, Homo sapiens
cccuuuaucucaagcugua

SEQ ID NO: 1322356 - RNA, 19 nt, Homo sapiens
gaccagacaugaacaaaag

SEQ ID NO: 1322357 - RNA, 19 nt, Homo sapiens
cagugagggugcauuugaa

SEQ ID NO: 1322358 - RNA, 19 nt, Homo sapiens
guccuucccuguacagugu

SEQ ID NO: 1322359 - RNA, 19 nt, Homo sapiens
agaagacgaugcuguacca

SEQ ID NO: 1322360 - RNA, 19 nt, Homo sapiens
ggaccucucccuccacaca

SEQ ID NO: 1322361 - RNA, 19 nt, Homo sapiens
gcugaguccuucccuguac

SEQ ID NO: 1322362 - RNA, 19 nt, Homo sapiens
gcauuugaacacugauuau

SEQ ID NO: 1322363 - RNA, 19 nt, Homo sapiens
uaaccuggauauacaugag

SEQ ID NO: 1322364 - RNA, 19 nt, Homo sapiens
ucuauugccuggagucauc

SEQ ID NO: 1322365 - RNA, 19 nt, Homo sapiens
gugaugacccuucgaccaa

SEQ ID NO: 1322366 - RNA, 19 nt, Homo sapiens
gggugcauuugaacacuga

SEQ ID NO: 1322367 - RNA, 19 nt, Homo sapiens
gcuggugggucggcacuau

SEQ ID NO: 1322368 - RNA, 19 nt, Homo sapiens
caaguugcucuccaaguau

SEQ ID NO: 1322369 - RNA, 19 nt, Homo sapiens
gauagauuccauuuguuuc

SEQ ID NO: 1322370 - RNA, 19 nt, Homo sapiens
guuccugccucucaguguu

SEQ ID NO: 1322371 - RNA, 19 nt, Homo sapiens
aagcaggacuaugucuauu

SEQ ID NO: 1322372 - RNA, 19 nt, Homo sapiens
ucgaccaacucguuugaga

SEQ ID NO: 1322373 - RNA, 19 nt, Homo sapiens
cugcagguauuucacuguu

SEQ ID NO: 1322374 - RNA, 19 nt, Homo sapiens
agccgaaccucgugaaaca

SEQ ID NO: 1322375 - RNA, 19 nt, Homo sapiens
gagagagggccuauguagu

SEQ ID NO: 1322376 - RNA, 19 nt, Homo sapiens
ccaugcggauccuggaaug

SEQ ID NO: 1322377 - RNA, 19 nt, Homo sapiens
gaggaugauuauggugaug

SEQ ID NO: 1322378 - RNA, 19 nt, Homo sapiens
ugauaugacuguuuuagga

SEQ ID NO: 1322379 - RNA, 19 nt, Homo sapiens
gggagagagggccuaugua

SEQ ID NO: 1322380 - RNA, 19 nt, Homo sapiens
ugaaacacaucgggcucuu

SEQ ID NO: 1322381 - RNA, 19 nt, Homo sapiens
ugaaccaaaugagccaaga

SEQ ID NO: 1322382 - RNA, 19 nt, Homo sapiens
cgaccaacucguuugagaa

SEQ ID NO: 1322383 - RNA, 19 nt, Homo sapiens
gagauccuuuggaauugag

SEQ ID NO: 1322384 - RNA, 19 nt, Homo sapiens
ccaagagaugccuuucuga

SEQ ID NO: 1322385 - RNA, 19 nt, Homo sapiens
ucaccgacuucuacacucu

SEQ ID NO: 1322386 - RNA, 19 nt, Homo sapiens
gcucuucuucucccuguau

SEQ ID NO: 1322387 - RNA, 19 nt, Homo sapiens
ggcaggaccauguggauag

SEQ ID NO: 1322388 - RNA, 19 nt, Homo sapiens
ugaggaugauuauggugau

SEQ ID NO: 1322389 - RNA, 19 nt, Homo sapiens
aaaauuuugugcacaguga

SEQ ID NO: 1322390 - RNA, 19 nt, Homo sapiens
cagacuacguccugauggu

SEQ ID NO: 1322391 - RNA, 19 nt, Homo sapiens
guaugucccuguggccaau

SEQ ID NO: 1322392 - RNA, 19 nt, Homo sapiens
acuguuuacuguuguuaga

SEQ ID NO: 1322393 - RNA, 19 nt, Homo sapiens
gaaccucgugaaacacauc

SEQ ID NO: 1322394 - RNA, 19 nt, Homo sapiens
ggagccgaaccucgugaaa

SEQ ID NO: 1322395 - RNA, 19 nt, Homo sapiens
cuucuacacucuuacuucu

SEQ ID NO: 1322396 - RNA, 19 nt, Homo sapiens
ccaccggcuucuucagcaa

SEQ ID NO: 1322397 - RNA, 19 nt, Homo sapiens
aggaccauguggauagauu

SEQ ID NO: 1322398 - RNA, 19 nt, Homo sapiens
guaugaaaauggauguaug

SEQ ID NO: 1322399 - RNA, 19 nt, Homo sapiens
aaacacaucgggcucuucu

SEQ ID NO: 1322400 - RNA, 19 nt, Homo sapiens
gaaacacaucgggcucuuc

SEQ ID NO: 1322401 - RNA, 19 nt, Homo sapiens
ccaaguguacugccacaag

SEQ ID NO: 1322402 - RNA, 19 nt, Homo sapiens
ggaccagacaugaacaaaa

SEQ ID NO: 1322403 - RNA, 19 nt, Homo sapiens
agaagcaggacuaugucua

SEQ ID NO: 1322404 - RNA, 19 nt, Homo sapiens
gaagaaugcugagauguau

SEQ ID NO: 1322405 - RNA, 19 nt, Homo sapiens
ggaagaaugcugagaugua

SEQ ID NO: 1322406 - RNA, 19 nt, Homo sapiens
uguauaaacugucuucaga

SEQ ID NO: 1322407 - RNA, 19 nt, Homo sapiens
gaggaagaaugcugagaug

SEQ ID NO: 1322408 - RNA, 19 nt, Homo sapiens
gaagaagggaccaaucaug

SEQ ID NO: 1322409 - RNA, 19 nt, Homo sapiens
gagcagagaggcagagcua

SEQ ID NO: 1322410 - RNA, 19 nt, Homo sapiens
uaaacugucuucagagcaa

SEQ ID NO: 1322411 - RNA, 19 nt, Homo sapiens
gcugagauguauaaacugu

SEQ ID NO: 1322412 - RNA, 19 nt, Homo sapiens
ucccacaucuucuaccuuu

SEQ ID NO: 1322413 - RNA, 19 nt, Homo sapiens
gagcuaagacgccgugaca

SEQ ID NO: 1322414 - RNA, 19 nt, Homo sapiens
aaagauggagagcacaaua

SEQ ID NO: 1322415 - RNA, 19 nt, Homo sapiens
agaaugcugagauguauaa

SEQ ID NO: 1322416 - RNA, 19 nt, Homo sapiens
aaagagaggcugccaccaa

SEQ ID NO: 1322417 - RNA, 19 nt, Homo sapiens
gcagaugccuuuguuuuca

SEQ ID NO: 1322418 - RNA, 19 nt, Homo sapiens
gagcagcuggagcguauug

SEQ ID NO: 1322419 - RNA, 19 nt, Homo sapiens
cuucagagcaauuccauga

SEQ ID NO: 1322420 - RNA, 19 nt, Homo sapiens
gcagagaggcagagcuaag

SEQ ID NO: 1322421 - RNA, 19 nt, Homo sapiens
gcuacugucugaaaacaaa

SEQ ID NO: 1322422 - RNA, 19 nt, Homo sapiens
ugagauguauaaacugucu

SEQ ID NO: 1322423 - RNA, 19 nt, Homo sapiens
aggagcagcuggagcguau

SEQ ID NO: 1322424 - RNA, 19 nt, Homo sapiens
gagagccccucacaaagaa

SEQ ID NO: 1322425 - RNA, 19 nt, Homo sapiens
cugaggagcagacaucauu

SEQ ID NO: 1322426 - RNA, 19 nt, Homo sapiens
gcugccacguguuuaggaa

SEQ ID NO: 1322427 - RNA, 19 nt, Homo sapiens
aggagggugucaagaggua

SEQ ID NO: 1322428 - RNA, 19 nt, Homo sapiens
uggcaaagagggaaagaga

SEQ ID NO: 1322429 - RNA, 19 nt, Homo sapiens
aagauggagagcacaauaa

SEQ ID NO: 1322430 - RNA, 19 nt, Homo sapiens
gaugaaggagggugucaag

SEQ ID NO: 1322431 - RNA, 19 nt, Homo sapiens
ccacugugcccugccguuu

SEQ ID NO: 1322432 - RNA, 19 nt, Homo sapiens
ugacuuggagcccugaaga

SEQ ID NO: 1322433 - RNA, 19 nt, Homo sapiens
agauggagagcacaauaaa

SEQ ID NO: 1322434 - RNA, 19 nt, Homo sapiens
augcugagauguauaaacu

SEQ ID NO: 1322435 - RNA, 19 nt, Homo sapiens
gggcugaggagcagacauc

SEQ ID NO: 1322436 - RNA, 19 nt, Homo sapiens
cccagauucuccacugcua

SEQ ID NO: 1322437 - RNA, 19 nt, Homo sapiens
cagagaggcagagcuaaga

SEQ ID NO: 1322438 - RNA, 19 nt, Homo sapiens
ugaaggagggugucaagag

SEQ ID NO: 1322439 - RNA, 19 nt, Homo sapiens
ucaaagauggagagcacaa

SEQ ID NO: 1322440 - RNA, 19 nt, Homo sapiens
guauugagaggaagaaugc

SEQ ID NO: 1322441 - RNA, 19 nt, Homo sapiens
ccacaucuucuaccuuugg

SEQ ID NO: 1322442 - RNA, 19 nt, Homo sapiens
gguguccggcugucugaaa

SEQ ID NO: 1322443 - RNA, 19 nt, Homo sapiens
gagcguauugagaggaaga

SEQ ID NO: 1322444 - RNA, 19 nt, Homo sapiens
cagcuggagcguauugaga

SEQ ID NO: 1322445 - RNA, 19 nt, Homo sapiens
gagaggcugccaccaagca

SEQ ID NO: 1322446 - RNA, 19 nt, Homo sapiens
cugaagaagggaccaauca

SEQ ID NO: 1322447 - RNA, 19 nt, Homo sapiens
gauggagagcacaauaaag

SEQ ID NO: 1322448 - RNA, 19 nt, Homo sapiens
gccgugacaccuucuacaa

SEQ ID NO: 1322449 - RNA, 19 nt, Homo sapiens
uggagcguauugagaggaa

SEQ ID NO: 1322450 - RNA, 19 nt, Homo sapiens
uaagacgccgugacaccuu

SEQ ID NO: 1322451 - RNA, 19 nt, Homo sapiens
gccaugaggagcagaaguc

SEQ ID NO: 1322452 - RNA, 19 nt, Homo sapiens
gagaggaagaaugcugaga

SEQ ID NO: 1322453 - RNA, 19 nt, Homo sapiens
ggugguacaugaacucuuu

SEQ ID NO: 1322454 - RNA, 19 nt, Homo sapiens
cuacaggaaucuucuuugu

SEQ ID NO: 1322455 - RNA, 19 nt, Homo sapiens
ccacgagucuacaggaauc

SEQ ID NO: 1322456 - RNA, 19 nt, Homo sapiens
gccgaugacuuccuugucu

SEQ ID NO: 1322457 - RNA, 19 nt, Homo sapiens
gcccacgagucuacaggaa

SEQ ID NO: 1322458 - RNA, 19 nt, Homo sapiens
aaacgacuuuauucuugga

SEQ ID NO: 1322459 - RNA, 19 nt, Homo sapiens
ggccaaaggcgccaucauc

SEQ ID NO: 1322460 - RNA, 19 nt, Homo sapiens
cacagaacgugcggagauu

SEQ ID NO: 1322461 - RNA, 19 nt, Homo sapiens
gccugggccuuacuuccua

SEQ ID NO: 1322462 - RNA, 19 nt, Homo sapiens
acacagaacgugcggagau

SEQ ID NO: 1322463 - RNA, 19 nt, Homo sapiens
ggcagcuggugguacauga

SEQ ID NO: 1322464 - RNA, 19 nt, Homo sapiens
gaggaagcacuaccugagu

SEQ ID NO: 1322465 - RNA, 19 nt, Homo sapiens
gagccagugccgaguucua

SEQ ID NO: 1322466 - RNA, 19 nt, Homo sapiens
gcgccaucauccucuacaa

SEQ ID NO: 1322467 - RNA, 19 nt, Homo sapiens
gaacccaagaccucuggau

SEQ ID NO: 1322468 - RNA, 19 nt, Homo sapiens
cuucugagcaggugaggaa

SEQ ID NO: 1322469 - RNA, 19 nt, Homo sapiens
gaucugugaugaggugaac

SEQ ID NO: 1322470 - RNA, 19 nt, Homo sapiens
uucaggagaucugugauga

SEQ ID NO: 1322471 - RNA, 19 nt, Homo sapiens
ccgaugacuuccuugucuu

SEQ ID NO: 1322472 - RNA, 19 nt, Homo sapiens
cacagccgaugacuuccuu

SEQ ID NO: 1322473 - RNA, 19 nt, Homo sapiens
ggagaugugggcugaacuc

SEQ ID NO: 1322474 - RNA, 19 nt, Homo sapiens
gagacuuccugggcaccaa

SEQ ID NO: 1322475 - RNA, 19 nt, Homo sapiens
agugcagccugacuucuga

SEQ ID NO: 1322476 - RNA, 19 nt, Homo sapiens
gcagcuggugguacaugaa

SEQ ID NO: 1322477 - RNA, 19 nt, Homo sapiens
cgacuuuauucuuggaaaa

SEQ ID NO: 1322478 - RNA, 19 nt, Homo sapiens
acccaagaccucuggauga

SEQ ID NO: 1322479 - RNA, 19 nt, Homo sapiens
cccaagaccucuggaugag

SEQ ID NO: 1322480 - RNA, 19 nt, Homo sapiens
ccagugccgaguucuaugu

SEQ ID NO: 1322481 - RNA, 19 nt, Homo sapiens
ggcaucgcccgaaaugaga

SEQ ID NO: 1322482 - RNA, 19 nt, Homo sapiens
ggaauggacugcagaacaa

SEQ ID NO: 1322483 - RNA, 19 nt, Homo sapiens
gaaccaggccucuccaaga

SEQ ID NO: 1322484 - RNA, 19 nt, Homo sapiens
gcaaguauaucgcgucaac

SEQ ID NO: 1322485 - RNA, 19 nt, Homo sapiens
gagaaagccaagaagauaa

SEQ ID NO: 1322486 - RNA, 19 nt, Homo sapiens
gcaaagagcagcuagaaaa

SEQ ID NO: 1322487 - RNA, 19 nt, Homo sapiens
ugauuugggugucuuguuu

SEQ ID NO: 1322488 - RNA, 19 nt, Homo sapiens
ugagaaagccaagaagaua

SEQ ID NO: 1322489 - RNA, 19 nt, Homo sapiens
gaagauaaagaaccuaaag

SEQ ID NO: 1322490 - RNA, 19 nt, Homo sapiens
gaggaggcacucaggguua

SEQ ID NO: 1322491 - RNA, 19 nt, Homo sapiens
gagaauaaacacaaguaga

SEQ ID NO: 1322492 - RNA, 19 nt, Homo sapiens
aggaggaggucccaguaua

SEQ ID NO: 1322493 - RNA, 19 nt, Homo sapiens
ggaggaggucccaguauau

SEQ ID NO: 1322494 - RNA, 19 nt, Homo sapiens
gauaaagaaccuaaagaag

SEQ ID NO: 1322495 - RNA, 19 nt, Homo sapiens
uaccuuugcugcugauuug

SEQ ID NO: 1322496 - RNA, 19 nt, Homo sapiens
gcaacuagggcccucauca

SEQ ID NO: 1322497 - RNA, 19 nt, Homo sapiens
ggaggucccaguauaugaa

SEQ ID NO: 1322498 - RNA, 19 nt, Homo sapiens
guuagaggacuuggaguua

SEQ ID NO: 1322499 - RNA, 19 nt, Homo sapiens
ggaggagggcgcuagaaga

SEQ ID NO: 1322500 - RNA, 19 nt, Homo sapiens
ccaagaagauaaagaaccu

SEQ ID NO: 1322501 - RNA, 19 nt, Homo sapiens
ccaagacagccaaacguaa

SEQ ID NO: 1322502 - RNA, 19 nt, Homo sapiens
ccacugagaaagccaagaa

SEQ ID NO: 1322503 - RNA, 19 nt, Homo sapiens
cuagggcccucaucacuuc

SEQ ID NO: 1322504 - RNA, 19 nt, Homo sapiens
aaacacaaguagacauguc

SEQ ID NO: 1322505 - RNA, 19 nt, Homo sapiens
gagggaguaugcccaaguc

SEQ ID NO: 1322506 - RNA, 19 nt, Homo sapiens
gggaauggacugcagaaca

SEQ ID NO: 1322507 - RNA, 19 nt, Homo sapiens
aacguaaccugaagcgaaa

SEQ ID NO: 1322508 - RNA, 19 nt, Homo sapiens
ggugaaagaaggauaugug

SEQ ID NO: 1322509 - RNA, 19 nt, Homo sapiens
gauuugggugucuuguuua

SEQ ID NO: 1322510 - RNA, 19 nt, Homo sapiens
cagcaaagagcagcuagaa

SEQ ID NO: 1322511 - RNA, 19 nt, Homo sapiens
agaaagccaagaagauaaa

SEQ ID NO: 1322512 - RNA, 19 nt, Homo sapiens
ugagcaggacucuugauaa

SEQ ID NO: 1322513 - RNA, 19 nt, Homo sapiens
gaauaaacacaaguagaca

SEQ ID NO: 1322514 - RNA, 19 nt, Homo sapiens
ucgcgguguuuauggguua

SEQ ID NO: 1322515 - RNA, 19 nt, Homo sapiens
cuacggagacaggcaagua

SEQ ID NO: 1322516 - RNA, 19 nt, Homo sapiens
gcaagcagcggagggugaa

SEQ ID NO: 1322517 - RNA, 19 nt, Homo sapiens
guaccuuugcugcugauuu

SEQ ID NO: 1322518 - RNA, 19 nt, Homo sapiens
gaggagggcgcuagaagag

SEQ ID NO: 1322519 - RNA, 19 nt, Homo sapiens
gaggaggucccaguauaug

SEQ ID NO: 1322520 - RNA, 19 nt, Homo sapiens
ggaagagacagcccaacuc

SEQ ID NO: 1322521 - RNA, 19 nt, Homo sapiens
caagaguaaaccagaguug

SEQ ID NO: 1322522 - RNA, 19 nt, Homo sapiens
ggagggugaaagaaggaua

SEQ ID NO: 1322523 - RNA, 19 nt, Homo sapiens
gaaaacaaguaugugaagu

SEQ ID NO: 1322524 - RNA, 19 nt, Homo sapiens
ccaggaggaggucccagua

SEQ ID NO: 1322525 - RNA, 19 nt, Homo sapiens
gaauggacugcagaacaaa

SEQ ID NO: 1322526 - RNA, 19 nt, Homo sapiens
uaggaggucugggcgagaa

SEQ ID NO: 1322527 - RNA, 19 nt, Homo sapiens
caagacagccaaacguaac

SEQ ID NO: 1322528 - RNA, 19 nt, Homo sapiens
gagggugaaagaaggauau

SEQ ID NO: 1322529 - RNA, 19 nt, Homo sapiens
aagccaagaagauaaagaa

SEQ ID NO: 1322530 - RNA, 19 nt, Homo sapiens
gaggguagagggaguaugc

SEQ ID NO: 1322531 - RNA, 19 nt, Homo sapiens
aagaggaguuagaggacuu

SEQ ID NO: 1322532 - RNA, 19 nt, Homo sapiens
ggagacaggcaaguauauc

SEQ ID NO: 1322533 - RNA, 19 nt, Homo sapiens
agaauaaacacaaguagac

SEQ ID NO: 1322534 - RNA, 19 nt, Homo sapiens
uuagaggacuuggaguuag

SEQ ID NO: 1322535 - RNA, 19 nt, Homo sapiens
gccuugagcaggacucuug

SEQ ID NO: 1322536 - RNA, 19 nt, Homo sapiens
gggaguaugcccaagucuu

SEQ ID NO: 1322537 - RNA, 19 nt, Homo sapiens
ccuagcgucucccucaauc

SEQ ID NO: 1322538 - RNA, 19 nt, Homo sapiens
gaggucccaguauaugaaa

SEQ ID NO: 1322539 - RNA, 19 nt, Homo sapiens
cagccaaacguaaccugaa

SEQ ID NO: 1322540 - RNA, 19 nt, Homo sapiens
uagaggacuuggaguuagg

SEQ ID NO: 1322541 - RNA, 19 nt, Homo sapiens
ggcgcuagaagaggaguua

SEQ ID NO: 1322542 - RNA, 19 nt, Homo sapiens
caaggaggagggcgcuaga

SEQ ID NO: 1322543 - RNA, 19 nt, Homo sapiens
gaaacuccggcagguggaa

SEQ ID NO: 1322544 - RNA, 19 nt, Homo sapiens
gaagaggcggcagcagcaa

SEQ ID NO: 1322545 - RNA, 19 nt, Homo sapiens
uccaagacagccaaacgua

SEQ ID NO: 1322546 - RNA, 19 nt, Homo sapiens
cagcugccaccacugagaa

SEQ ID NO: 1322547 - RNA, 19 nt, Homo sapiens
cagcggagggugaaagaag

SEQ ID NO: 1322548 - RNA, 19 nt, Homo sapiens
auaaacacaaguagacaug

SEQ ID NO: 1322549 - RNA, 19 nt, Homo sapiens
gagacaggcaaguauaucg

SEQ ID NO: 1322550 - RNA, 19 nt, Homo sapiens
gcuagaagaggaguuagag

SEQ ID NO: 1322551 - RNA, 19 nt, Homo sapiens
uugagcaggacucuugaua

SEQ ID NO: 1322552 - RNA, 19 nt, Homo sapiens
gaaccuaaagaagaaacuc

SEQ ID NO: 1322553 - RNA, 19 nt, Homo sapiens
gaaagccaagaagauaaag

SEQ ID NO: 1322554 - RNA, 19 nt, Homo sapiens
cggagacaggcaaguauau

SEQ ID NO: 1322555 - RNA, 19 nt, Homo sapiens
gcucaagagugcuaauuua

SEQ ID NO: 1322556 - RNA, 19 nt, Homo sapiens
agaagacccagaugaauua

SEQ ID NO: 1322557 - RNA, 19 nt, Homo sapiens
agacccagaugaauuauug

SEQ ID NO: 1322558 - RNA, 19 nt, Homo sapiens
gaacaauucuaguuuacac

SEQ ID NO: 1322559 - RNA, 19 nt, Homo sapiens
cccaaagccuuccuaauga

SEQ ID NO: 1322560 - RNA, 19 nt, Homo sapiens
gaucagacguuuuacaaau

SEQ ID NO: 1322561 - RNA, 19 nt, Homo sapiens
gcauugccauggaucaguu

SEQ ID NO: 1322562 - RNA, 19 nt, Homo sapiens
gaccugcccuacaucagaa

SEQ ID NO: 1322563 - RNA, 19 nt, Homo sapiens
gcugaggacuggugugaag

SEQ ID NO: 1322564 - RNA, 19 nt, Homo sapiens
ccaaagccuuccuaaugau

SEQ ID NO: 1322565 - RNA, 19 nt, Homo sapiens
ggacugcucggcuccaaga

SEQ ID NO: 1322566 - RNA, 19 nt, Homo sapiens
acaagaagacccagaugaa

SEQ ID NO: 1322567 - RNA, 19 nt, Homo sapiens
ucccaaagccuuccuaaug

SEQ ID NO: 1322568 - RNA, 19 nt, Homo sapiens
gcaggacgcucagaaacag

SEQ ID NO: 1322569 - RNA, 19 nt, Homo sapiens
aagaagacccagaugaauu

SEQ ID NO: 1322570 - RNA, 19 nt, Homo sapiens
gagcagauuuugagguauu

SEQ ID NO: 1322571 - RNA, 19 nt, Homo sapiens
agacucccauggaagaauu

SEQ ID NO: 1322572 - RNA, 19 nt, Homo sapiens
gaucaguugcuuucccaaa

SEQ ID NO: 1322573 - RNA, 19 nt, Homo sapiens
caagaagacccagaugaau

SEQ ID NO: 1322574 - RNA, 19 nt, Homo sapiens
cagcagugccaaagacgua

SEQ ID NO: 1322575 - RNA, 19 nt, Homo sapiens
uugcagaugaggaugauua

SEQ ID NO: 1322576 - RNA, 19 nt, Homo sapiens
caccacaguuuaccuugga

SEQ ID NO: 1322577 - RNA, 19 nt, Homo sapiens
gagggacuaucagcagaga

SEQ ID NO: 1322578 - RNA, 19 nt, Homo sapiens
uaaguagagcauuuccuuu

SEQ ID NO: 1322579 - RNA, 19 nt, Homo sapiens
gggacuaucagcagagaga

SEQ ID NO: 1322580 - RNA, 19 nt, Homo sapiens
ucaucagacucccauggaa

SEQ ID NO: 1322581 - RNA, 19 nt, Homo sapiens
acacaugugagaagaguug

SEQ ID NO: 1322582 - RNA, 19 nt, Homo sapiens
caauucuaguuuacacaug

SEQ ID NO: 1322583 - RNA, 19 nt, Homo sapiens
gauauuugaguuucagcuu

SEQ ID NO: 1322584 - RNA, 19 nt, Homo sapiens
ggugugaaggugcugauga

SEQ ID NO: 1322585 - RNA, 19 nt, Homo sapiens
guagagcauuuccuuuuau

SEQ ID NO: 1322586 - RNA, 19 nt, Homo sapiens
uuaaguagagcauuuccuu

SEQ ID NO: 1322587 - RNA, 19 nt, Homo sapiens
guguggaggccaaaggaua

SEQ ID NO: 1322588 - RNA, 19 nt, Homo sapiens
guggagaucagacguuuua

SEQ ID NO: 1322589 - RNA, 19 nt, Homo sapiens
uacaagaagacccagauga

SEQ ID NO: 1322590 - RNA, 19 nt, Homo sapiens
aaguggagaucagacguuu

SEQ ID NO: 1322591 - RNA, 19 nt, Homo sapiens
ggaacaauucuaguuuaca

SEQ ID NO: 1322592 - RNA, 19 nt, Homo sapiens
ugaccugcccuacaucaga

SEQ ID NO: 1322593 - RNA, 19 nt, Homo sapiens
caaagccuuccuaaugaug

SEQ ID NO: 1322594 - RNA, 19 nt, Homo sapiens
uuacacaugugagaagagu

SEQ ID NO: 1322595 - RNA, 19 nt, Homo sapiens
uggaacaauucuaguuuac

SEQ ID NO: 1322596 - RNA, 19 nt, Homo sapiens
aguagagcauuuccuuuua

SEQ ID NO: 1322597 - RNA, 19 nt, Homo sapiens
gagaucagacguuuuacaa

SEQ ID NO: 1322598 - RNA, 19 nt, Homo sapiens
gaagacccagaugaauuau

SEQ ID NO: 1322599 - RNA, 19 nt, Homo sapiens
gcucagaaacagggaaaca

SEQ ID NO: 1322600 - RNA, 19 nt, Homo sapiens
cagcagagagaaggcauug

SEQ ID NO: 1322601 - RNA, 19 nt, Homo sapiens
gggccuucaccacaguuua

SEQ ID NO: 1322602 - RNA, 19 nt, Homo sapiens
guuuacacaugugagaaga

SEQ ID NO: 1322603 - RNA, 19 nt, Homo sapiens
cagcugaggacugguguga

SEQ ID NO: 1322604 - RNA, 19 nt, Homo sapiens
gauuacagggacuuuguca

SEQ ID NO: 1322605 - RNA, 19 nt, Homo sapiens
ccauggaucaguugcuuuc

SEQ ID NO: 1322606 - RNA, 19 nt, Homo sapiens
cacaguuuaccuuggauuu

SEQ ID NO: 1322607 - RNA, 19 nt, Homo sapiens
cagaugaggaugauuacag

SEQ ID NO: 1322608 - RNA, 19 nt, Homo sapiens
uuacagggacuuugucaac

SEQ ID NO: 1322609 - RNA, 19 nt, Homo sapiens
gaugauuacagggacuuug

SEQ ID NO: 1322610 - RNA, 19 nt, Homo sapiens
ggacuuugucaaccuggau

SEQ ID NO: 1322611 - RNA, 19 nt, Homo sapiens
gaaaggauccacauuaauu

SEQ ID NO: 1322612 - RNA, 19 nt, Homo sapiens
gaacacaucgucaauaaau

SEQ ID NO: 1322613 - RNA, 19 nt, Homo sapiens
gugaaaggauccacauuaa

SEQ ID NO: 1322614 - RNA, 19 nt, Homo sapiens
gaacaagaacuaauacuag

SEQ ID NO: 1322615 - RNA, 19 nt, Homo sapiens
uaaaucaccugcacccaaa

SEQ ID NO: 1322616 - RNA, 19 nt, Homo sapiens
gaagaacacaucgucaaua

SEQ ID NO: 1322617 - RNA, 19 nt, Homo sapiens
ggaacaagaacuaauacua

SEQ ID NO: 1322618 - RNA, 19 nt, Homo sapiens
ggugaaagcugugaaagga

SEQ ID NO: 1322619 - RNA, 19 nt, Homo sapiens
aagaacacaucgucaauaa

SEQ ID NO: 1322620 - RNA, 19 nt, Homo sapiens
caaaggagcagaucuuaga

SEQ ID NO: 1322621 - RNA, 19 nt, Homo sapiens
caaggacauuggagagaua

SEQ ID NO: 1322622 - RNA, 19 nt, Homo sapiens
ggaaagaagagauuacuca

SEQ ID NO: 1322623 - RNA, 19 nt, Homo sapiens
uuacugauauggugacuga

SEQ ID NO: 1322624 - RNA, 19 nt, Homo sapiens
gcuacacauucaacaauuu

SEQ ID NO: 1322625 - RNA, 19 nt, Homo sapiens
gaaccuucauuucgaggaa

SEQ ID NO: 1322626 - RNA, 19 nt, Homo sapiens
gcagugccauggaaggauu

SEQ ID NO: 1322627 - RNA, 19 nt, Homo sapiens
gagggcaucucagaagaaa

SEQ ID NO: 1322628 - RNA, 19 nt, Homo sapiens
ccaccauccugccaucuaa

SEQ ID NO: 1322629 - RNA, 19 nt, Homo sapiens
gaauguguuucuccaggaa

SEQ ID NO: 1322630 - RNA, 19 nt, Homo sapiens
ggaaggauuuaacaugucu

SEQ ID NO: 1322631 - RNA, 19 nt, Homo sapiens
gaccagcagugccauggaa

SEQ ID NO: 1322632 - RNA, 19 nt, Homo sapiens
ggauuuaacaugucucaga

SEQ ID NO: 1322633 - RNA, 19 nt, Homo sapiens
gugaagcaccuacaagaaa

SEQ ID NO: 1322634 - RNA, 19 nt, Homo sapiens
ucaggaaccuucauuucga

SEQ ID NO: 1322635 - RNA, 19 nt, Homo sapiens
gaucuuagaacugcuggua

SEQ ID NO: 1322636 - RNA, 19 nt, Homo sapiens
gcuuugccaucaacacuuu

SEQ ID NO: 1322637 - RNA, 19 nt, Homo sapiens
cuaagacuuucaagacuga

SEQ ID NO: 1322638 - RNA, 19 nt, Homo sapiens
ggauccacauuaauucuuc

SEQ ID NO: 1322639 - RNA, 19 nt, Homo sapiens
ucaacaauuucuugcuuug

SEQ ID NO: 1322640 - RNA, 19 nt, Homo sapiens
gggccucuccaacaauuua

SEQ ID NO: 1322641 - RNA, 19 nt, Homo sapiens
cugccacuaugaaguaaua

SEQ ID NO: 1322642 - RNA, 19 nt, Homo sapiens
gagcaguuccugagcauuc

SEQ ID NO: 1322643 - RNA, 19 nt, Homo sapiens
ugccagaguugcacacaaa

SEQ ID NO: 1322644 - RNA, 19 nt, Homo sapiens
gagucacuauuacugauau

SEQ ID NO: 1322645 - RNA, 19 nt, Homo sapiens
cauggugacucuuacaauc

SEQ ID NO: 1322646 - RNA, 19 nt, Homo sapiens
gcaccuacaagaaacuuau

SEQ ID NO: 1322647 - RNA, 19 nt, Homo sapiens
gcacagaaccaguuguacu

SEQ ID NO: 1322648 - RNA, 19 nt, Homo sapiens
ggcuacacauucaacaauu

SEQ ID NO: 1322649 - RNA, 19 nt, Homo sapiens
uaaagacacagcugaaauc

SEQ ID NO: 1322650 - RNA, 19 nt, Homo sapiens
aagaauggcuguggaaucu

SEQ ID NO: 1322651 - RNA, 19 nt, Homo sapiens
gaggcagggcuaagacuuu

SEQ ID NO: 1322652 - RNA, 19 nt, Homo sapiens
ccacuaugaaguaauaaga

SEQ ID NO: 1322653 - RNA, 19 nt, Homo sapiens
gccaugggaccacgcauaa

SEQ ID NO: 1322654 - RNA, 19 nt, Homo sapiens
gaacagugaaacagcaaca

SEQ ID NO: 1322655 - RNA, 19 nt, Homo sapiens
cauaaauggagaacgagua

SEQ ID NO: 1322656 - RNA, 19 nt, Homo sapiens
acgcauaaauggagaacga

SEQ ID NO: 1322657 - RNA, 19 nt, Homo sapiens
cagcugaaauccuggaaac

SEQ ID NO: 1322658 - RNA, 19 nt, Homo sapiens
cacaaaggagcagaucuua

SEQ ID NO: 1322659 - RNA, 19 nt, Homo sapiens
gaaaagagacuagcauaag

SEQ ID NO: 1322660 - RNA, 19 nt, Homo sapiens
auuuaaaccucaugaccua

SEQ ID NO: 1322661 - RNA, 19 nt, Homo sapiens
gugggccucuccaacaauu

SEQ ID NO: 1322662 - RNA, 19 nt, Homo sapiens
ucagcaacauaauccagaa

SEQ ID NO: 1322663 - RNA, 19 nt, Homo sapiens
gcaagcacagaaccaguug

SEQ ID NO: 1322664 - RNA, 19 nt, Homo sapiens
gcacccaaaucuccaucuc

SEQ ID NO: 1322665 - RNA, 19 nt, Homo sapiens
ggauuuagagagggaguuu

SEQ ID NO: 1322666 - RNA, 19 nt, Homo sapiens
cugaggagcugcagaucug

SEQ ID NO: 1322667 - RNA, 19 nt, Homo sapiens
acacaaaggagcagaucuu

SEQ ID NO: 1322668 - RNA, 19 nt, Homo sapiens
uaacaggaacccagucaag

SEQ ID NO: 1322669 - RNA, 19 nt, Homo sapiens
gggcuaagacuuucaagac

SEQ ID NO: 1322670 - RNA, 19 nt, Homo sapiens
gcuguggaaucuggaguga

SEQ ID NO: 1322671 - RNA, 19 nt, Homo sapiens
ugaagcaccuacaagaaac

SEQ ID NO: 1322672 - RNA, 19 nt, Homo sapiens
acacaucgucaauaaauca

SEQ ID NO: 1322673 - RNA, 19 nt, Homo sapiens
guccagaccucccaaagcu

SEQ ID NO: 1322674 - RNA, 19 nt, Homo sapiens
gaucuggguucagcaacau

SEQ ID NO: 1322675 - RNA, 19 nt, Homo sapiens
uccaggaacuuugcuauca

SEQ ID NO: 1322676 - RNA, 19 nt, Homo sapiens
ggagaacgaguaaauuuug

SEQ ID NO: 1322677 - RNA, 19 nt, Homo sapiens
aaauggagaacgaguaaau

SEQ ID NO: 1322678 - RNA, 19 nt, Homo sapiens
auaaauggagaacgaguaa

SEQ ID NO: 1322679 - RNA, 19 nt, Homo sapiens
aagcacagaaccaguugua

SEQ ID NO: 1322680 - RNA, 19 nt, Homo sapiens
ggugacucuuacaaucaua

SEQ ID NO: 1322681 - RNA, 19 nt, Homo sapiens
acuuauaacucaagguugu

SEQ ID NO: 1322682 - RNA, 19 nt, Homo sapiens
caaaagagggcaucucaga

SEQ ID NO: 1322683 - RNA, 19 nt, Homo sapiens
gcaacauaauccagaaagc

SEQ ID NO: 1322684 - RNA, 19 nt, Homo sapiens
gcagaucuggguucagcaa

SEQ ID NO: 1322685 - RNA, 19 nt, Homo sapiens
caagaauggcuguggaauc

SEQ ID NO: 1322686 - RNA, 19 nt, Homo sapiens
ggccaugggaccacgcaua

SEQ ID NO: 1322687 - RNA, 19 nt, Homo sapiens
aagagggcaucucagaaga

SEQ ID NO: 1322688 - RNA, 19 nt, Homo sapiens
cagagcaucccaagaguca

SEQ ID NO: 1322689 - RNA, 19 nt, Homo sapiens
agaauuguuucgucagcaa

SEQ ID NO: 1322690 - RNA, 19 nt, Homo sapiens
cagaaugggaguacucaau

SEQ ID NO: 1322691 - RNA, 19 nt, Homo sapiens
caugggaccacgcauaaau

SEQ ID NO: 1322692 - RNA, 19 nt, Homo sapiens
gauccacauuaauucuuca

SEQ ID NO: 1322693 - RNA, 19 nt, Homo sapiens
ugaaaggauccacauuaau

SEQ ID NO: 1322694 - RNA, 19 nt, Homo sapiens
cagugggccucuccaacaa

SEQ ID NO: 1322695 - RNA, 19 nt, Homo sapiens
ucaugaggcuagugaagca

SEQ ID NO: 1322696 - RNA, 19 nt, Homo sapiens
aaagagggcaucucagaag

SEQ ID NO: 1322697 - RNA, 19 nt, Homo sapiens
uagagucacuauuacugau

SEQ ID NO: 1322698 - RNA, 19 nt, Homo sapiens
cuagugaaaguagaagaua

SEQ ID NO: 1322699 - RNA, 19 nt, Homo sapiens
gaaugggaguacucaaucc

SEQ ID NO: 1322700 - RNA, 19 nt, Homo sapiens
ugaagaacacaucgucaau

SEQ ID NO: 1322701 - RNA, 19 nt, Homo sapiens
uuaaagacacagcugaaau

SEQ ID NO: 1322702 - RNA, 19 nt, Homo sapiens
gggaugagaaauuuaagca

SEQ ID NO: 1322703 - RNA, 19 nt, Homo sapiens
aaagagacuagcauaagga

SEQ ID NO: 1322704 - RNA, 19 nt, Homo sapiens
acucaauccugccaagaau

SEQ ID NO: 1322705 - RNA, 19 nt, Homo sapiens
ccucaugaccuaggugaaa

SEQ ID NO: 1322706 - RNA, 19 nt, Homo sapiens
ccugggaugagaaauuuaa

SEQ ID NO: 1322707 - RNA, 19 nt, Homo sapiens
uagagagggaguuugauga

SEQ ID NO: 1322708 - RNA, 19 nt, Homo sapiens
uuccugggaugagaaauuu

SEQ ID NO: 1322709 - RNA, 19 nt, Homo sapiens
gcauggugacucuuacaau

SEQ ID NO: 1322710 - RNA, 19 nt, Homo sapiens
ugacccuguuggaggauuu

SEQ ID NO: 1322711 - RNA, 19 nt, Homo sapiens
ggaaggagaacugcaaaua

SEQ ID NO: 1322712 - RNA, 19 nt, Homo sapiens
guacaucgaccuagacaaa

SEQ ID NO: 1322713 - RNA, 19 nt, Homo sapiens
ccaaguacaucgaccuaga

SEQ ID NO: 1322714 - RNA, 19 nt, Homo sapiens
gcucucagccaccuugaua

SEQ ID NO: 1322715 - RNA, 19 nt, Homo sapiens
gaacuuggcagccuugaag

SEQ ID NO: 1322716 - RNA, 19 nt, Homo sapiens
gaaggagaacugcaaauag

SEQ ID NO: 1322717 - RNA, 19 nt, Homo sapiens
gagccgagcccacuucuuc

SEQ ID NO: 1322718 - RNA, 19 nt, Homo sapiens
gaggacauccagcuagauu

SEQ ID NO: 1322719 - RNA, 19 nt, Homo sapiens
gaccagaagucgggaaagu

SEQ ID NO: 1322720 - RNA, 19 nt, Homo sapiens
gccacaacgucaucaaugu

SEQ ID NO: 1322721 - RNA, 19 nt, Homo sapiens
gugaggacauccagcuaga

SEQ ID NO: 1322722 - RNA, 19 nt, Homo sapiens
gaauuuggccugggcguau

SEQ ID NO: 1322723 - RNA, 19 nt, Homo sapiens
acauuuggcuucuguacug

SEQ ID NO: 1322724 - RNA, 19 nt, Homo sapiens
ucagccaccuugauaguca

SEQ ID NO: 1322725 - RNA, 19 nt, Homo sapiens
ggacauccagcuagauuac

SEQ ID NO: 1322726 - RNA, 19 nt, Homo sapiens
gcuccucuguguugcuuug

SEQ ID NO: 1322727 - RNA, 19 nt, Homo sapiens
aaggagaacugcaaauagg

SEQ ID NO: 1322728 - RNA, 19 nt, Homo sapiens
ggggaaggauguuaacuug

SEQ ID NO: 1322729 - RNA, 19 nt, Homo sapiens
ccagaagucgggaaaguca

SEQ ID NO: 1322730 - RNA, 19 nt, Homo sapiens
acaaaggguuccggaagga

SEQ ID NO: 1322731 - RNA, 19 nt, Homo sapiens
gggaccugcugacuugaau

SEQ ID NO: 1322732 - RNA, 19 nt, Homo sapiens
ggaccugccaccaucacaa

SEQ ID NO: 1322733 - RNA, 19 nt, Homo sapiens
gaaccuggcagccccaaaa

SEQ ID NO: 1322734 - RNA, 19 nt, Homo sapiens
gggaccagaugcuuuacag

SEQ ID NO: 1322735 - RNA, 19 nt, Homo sapiens
ggccacaacgucaucaaug

SEQ ID NO: 1322736 - RNA, 19 nt, Homo sapiens
gcaaccugcaccaucacua

SEQ ID NO: 1322737 - RNA, 19 nt, Homo sapiens
gaggacacucccaucagaa

SEQ ID NO: 1322738 - RNA, 19 nt, Homo sapiens
gaggacacucccaucagaa

SEQ ID NO: 1322739 - RNA, 19 nt, Homo sapiens
acauccagcuagauuacaa

SEQ ID NO: 1322740 - RNA, 19 nt, Homo sapiens
gggagggagugaaguuggu

SEQ ID NO: 1322741 - RNA, 19 nt, Homo sapiens
ccacgcugcugcucuucau

SEQ ID NO: 1322742 - RNA, 19 nt, Homo sapiens
ugccugggcuggagucuag

SEQ ID NO: 1322743 - RNA, 19 nt, Homo sapiens
uaaaguccccaucugauuu

SEQ ID NO: 1322744 - RNA, 19 nt, Homo sapiens
cugcaccucuccugucugu

SEQ ID NO: 1322745 - RNA, 19 nt, Homo sapiens
cgaauacucggaccagaag

SEQ ID NO: 1322746 - RNA, 19 nt, Homo sapiens
caauaaaguccccaucuga

SEQ ID NO: 1322747 - RNA, 19 nt, Homo sapiens
cugccaccaucacaauaaa

SEQ ID NO: 1322748 - RNA, 19 nt, Homo sapiens
acacucccaucagaacuug

SEQ ID NO: 1322749 - RNA, 19 nt, Homo sapiens
gaccugccaccaucacaau

SEQ ID NO: 1322750 - RNA, 19 nt, Homo sapiens
cccgaauccugcuuuggaa

SEQ ID NO: 1322751 - RNA, 19 nt, Homo sapiens
gaauccugcuuuggaaacu

SEQ ID NO: 1322752 - RNA, 19 nt, Homo sapiens
uuacaggagugaggacauc

SEQ ID NO: 1322753 - RNA, 19 nt, Homo sapiens
caaaggggaaggauguuaa

SEQ ID NO: 1322754 - RNA, 19 nt, Homo sapiens
agaagucgggaaagucaaa

SEQ ID NO: 1322755 - RNA, 19 nt, Homo sapiens
ccgcggaggcuacgaauac

SEQ ID NO: 1322756 - RNA, 19 nt, Homo sapiens
caacuucucgcugcucauc

SEQ ID NO: 1322757 - RNA, 19 nt, Homo sapiens
ggcgccugcuggacuugua

SEQ ID NO: 1322758 - RNA, 19 nt, Homo sapiens
gagugaggacauccagcua

SEQ ID NO: 1322759 - RNA, 19 nt, Homo sapiens
ccugccaccaucacaauaa

SEQ ID NO: 1322760 - RNA, 19 nt, Homo sapiens
caucccgaauccugcuuug

SEQ ID NO: 1322761 - RNA, 19 nt, Homo sapiens
gacacucccaucagaacuu

SEQ ID NO: 1322762 - RNA, 19 nt, Homo sapiens
gagggagugaaguugguuu

SEQ ID NO: 1322763 - RNA, 19 nt, Homo sapiens
caaccugcaccaucacuac

SEQ ID NO: 1322764 - RNA, 19 nt, Homo sapiens
caacgucaucaaugucauc

SEQ ID NO: 1322765 - RNA, 19 nt, Homo sapiens
ggcuacauuuggcuucugu

SEQ ID NO: 1322766 - RNA, 19 nt, Homo sapiens
ccacaacgucaucaauguc

SEQ ID NO: 1322767 - RNA, 19 nt, Homo sapiens
gccaccugcaccaccauua

SEQ ID NO: 1322768 - RNA, 19 nt, Homo sapiens
caaccaaaaucccacugau

SEQ ID NO: 1322769 - RNA, 19 nt, Homo sapiens
uuuggaaacuugugcuucu

SEQ ID NO: 1322770 - RNA, 19 nt, Homo sapiens
caacgaagcugucgaagga

SEQ ID NO: 1322771 - RNA, 19 nt, Homo sapiens
ggauuuacuuugcuagauu

SEQ ID NO: 1322772 - RNA, 19 nt, Homo sapiens
gguaggaaguuaauaauac

SEQ ID NO: 1322773 - RNA, 19 nt, Homo sapiens
ugggugagguuucaaagua

SEQ ID NO: 1322774 - RNA, 19 nt, Homo sapiens
cgaaggagaagacaauaaa

SEQ ID NO: 1322775 - RNA, 19 nt, Homo sapiens
ucaggaugcucuuguuuau

SEQ ID NO: 1322776 - RNA, 19 nt, Homo sapiens
gggaauuccugcuaagugu

SEQ ID NO: 1322777 - RNA, 19 nt, Homo sapiens
agaaggcccuggagaaguu

SEQ ID NO: 1322778 - RNA, 19 nt, Homo sapiens
guacaacgaagcugucgaa

SEQ ID NO: 1322779 - RNA, 19 nt, Homo sapiens
gaagaaggcccuggagaag

SEQ ID NO: 1322780 - RNA, 19 nt, Homo sapiens
ucaaggugcucaacaugau

SEQ ID NO: 1322781 - RNA, 19 nt, Homo sapiens
ggguaggaaguuaauaaua

SEQ ID NO: 1322782 - RNA, 19 nt, Homo sapiens
aggaugcucuuguuuauuc

SEQ ID NO: 1322783 - RNA, 19 nt, Homo sapiens
gagggucagugccaagaug

SEQ ID NO: 1322784 - RNA, 19 nt, Homo sapiens
gcucagacccuccucuugu

SEQ ID NO: 1322785 - RNA, 19 nt, Homo sapiens
gcccagcuauguacaacga

SEQ ID NO: 1322786 - RNA, 19 nt, Homo sapiens
gacugggaauuccugcuaa

SEQ ID NO: 1322787 - RNA, 19 nt, Homo sapiens
agaagaaggcccuggagaa

SEQ ID NO: 1322788 - RNA, 19 nt, Homo sapiens
ccaccgagaagcagaagaa

SEQ ID NO: 1322789 - RNA, 19 nt, Homo sapiens
gaacugugggugagguuuc

SEQ ID NO: 1322790 - RNA, 19 nt, Homo sapiens
gaaggagaagacaauaaag

SEQ ID NO: 1322791 - RNA, 19 nt, Homo sapiens
gguggaggaugccuugucu

SEQ ID NO: 1322792 - RNA, 19 nt, Homo sapiens
cucagacccuccucuugua

SEQ ID NO: 1322793 - RNA, 19 nt, Homo sapiens
uaagugccagcuccucuuu

SEQ ID NO: 1322794 - RNA, 19 nt, Homo sapiens
gggugagguuucaaaguag

SEQ ID NO: 1322795 - RNA, 19 nt, Homo sapiens
guuguuggauuuacuuugc

SEQ ID NO: 1322796 - RNA, 19 nt, Homo sapiens
gagugggcauccugucauc

SEQ ID NO: 1322797 - RNA, 19 nt, Homo sapiens
cucaggaugcucuuguuua

SEQ ID NO: 1322798 - RNA, 19 nt, Homo sapiens
agacugggaauuccugcua

SEQ ID NO: 1322799 - RNA, 19 nt, Homo sapiens
ucgaaggagaagacaauaa

SEQ ID NO: 1322800 - RNA, 19 nt, Homo sapiens
ucuagaguguuugugugua

SEQ ID NO: 1322801 - RNA, 19 nt, Homo sapiens
uuccggagcugaagcagau

SEQ ID NO: 1322802 - RNA, 19 nt, Homo sapiens
ucucggugcugaugcagau

SEQ ID NO: 1322803 - RNA, 19 nt, Homo sapiens
cuagaguguuuguguguac

SEQ ID NO: 1322804 - RNA, 19 nt, Homo sapiens
ccgaggagaagcugguuga

SEQ ID NO: 1322805 - RNA, 19 nt, Homo sapiens
ccucaggaugcucuuguuu

SEQ ID NO: 1322806 - RNA, 19 nt, Homo sapiens
gcgagugggcauccuguca

SEQ ID NO: 1322807 - RNA, 19 nt, Homo sapiens
uggauuuacuuugcuagau

SEQ ID NO: 1322808 - RNA, 19 nt, Homo sapiens
gccggaagacugggaauuc

SEQ ID NO: 1322809 - RNA, 19 nt, Homo sapiens
aaggagaagacaauaaagu

SEQ ID NO: 1322810 - RNA, 19 nt, Homo sapiens
gggcucagacccuccucuu

SEQ ID NO: 1322811 - RNA, 19 nt, Homo sapiens
gccucaggaugcucuuguu

SEQ ID NO: 1322812 - RNA, 19 nt, Homo sapiens
uaaguguggcuucuagagu

SEQ ID NO: 1322813 - RNA, 19 nt, Homo sapiens
ucacguaccugugcagaaa

SEQ ID NO: 1322814 - RNA, 19 nt, Homo sapiens
cacaagaacuggagguuuc

SEQ ID NO: 1322815 - RNA, 19 nt, Homo sapiens
gugacaagguucccgauga

SEQ ID NO: 1322816 - RNA, 19 nt, Homo sapiens
gagcagaggguccuggaaa

SEQ ID NO: 1322817 - RNA, 19 nt, Homo sapiens
gcacaagaacuggagguuu

SEQ ID NO: 1322818 - RNA, 19 nt, Homo sapiens
gagaaaaguuccugaagug

SEQ ID NO: 1322819 - RNA, 19 nt, Homo sapiens
acgcagcuguucacgcuua

SEQ ID NO: 1322820 - RNA, 19 nt, Homo sapiens
guaugacagugacaagguu

SEQ ID NO: 1322821 - RNA, 19 nt, Homo sapiens
gaacuggagguuucagaag

SEQ ID NO: 1322822 - RNA, 19 nt, Homo sapiens
ugacaagguucccgaugag

SEQ ID NO: 1322823 - RNA, 19 nt, Homo sapiens
gggaauauuuuagagauug

SEQ ID NO: 1322824 - RNA, 19 nt, Homo sapiens
gaaggcggaagcccugaug

SEQ ID NO: 1322825 - RNA, 19 nt, Homo sapiens
gaagagaaaaguuccugaa

SEQ ID NO: 1322826 - RNA, 19 nt, Homo sapiens
ggagucggaucacguaccu

SEQ ID NO: 1322827 - RNA, 19 nt, Homo sapiens
gccuggcuguggccuguuu

SEQ ID NO: 1322828 - RNA, 19 nt, Homo sapiens
aaucugcuuuggagggaaa

SEQ ID NO: 1322829 - RNA, 19 nt, Homo sapiens
aacuggagguuucagaaga

SEQ ID NO: 1322830 - RNA, 19 nt, Homo sapiens
aaaaggaacggaagaaaga

SEQ ID NO: 1322831 - RNA, 19 nt, Homo sapiens
cguggaugcucuggaauca

SEQ ID NO: 1322832 - RNA, 19 nt, Homo sapiens
uggacuaccucugcagaug

SEQ ID NO: 1322833 - RNA, 19 nt, Homo sapiens
gagagcugacggugcagaa

SEQ ID NO: 1322834 - RNA, 19 nt, Homo sapiens
uuccugaagugacagagaa

SEQ ID NO: 1322835 - RNA, 19 nt, Homo sapiens
ugcugcagcugcucuccua

SEQ ID NO: 1322836 - RNA, 19 nt, Homo sapiens
gaugaggagggcucugauc

SEQ ID NO: 1322837 - RNA, 19 nt, Homo sapiens
ccucuguggcugcauuuga

SEQ ID NO: 1322838 - RNA, 19 nt, Homo sapiens
aaacagaagagaaaaguuc

SEQ ID NO: 1322839 - RNA, 19 nt, Homo sapiens
caaguucgcuguucaagua

SEQ ID NO: 1322840 - RNA, 19 nt, Homo sapiens
gaucagaguuugaaaugaa

SEQ ID NO: 1322841 - RNA, 19 nt, Homo sapiens
gcacgcauaucaucucuuu

SEQ ID NO: 1322842 - RNA, 19 nt, Homo sapiens
gaacauuggauaucaguuu

SEQ ID NO: 1322843 - RNA, 19 nt, Homo sapiens
gaacugaacgaaugaagaa

SEQ ID NO: 1322844 - RNA, 19 nt, Homo sapiens
gaugaaagacaguauguuu

SEQ ID NO: 1322845 - RNA, 19 nt, Homo sapiens
gcucaccuuugucuaaaua

SEQ ID NO: 1322846 - RNA, 19 nt, Homo sapiens
caagauggcagcccucaua

SEQ ID NO: 1322847 - RNA, 19 nt, Homo sapiens
gaagcucaccuuugucuaa

SEQ ID NO: 1322848 - RNA, 19 nt, Homo sapiens
gacaguauguuucagagaa

SEQ ID NO: 1322849 - RNA, 19 nt, Homo sapiens
gaaaccagaagaagaauau

SEQ ID NO: 1322850 - RNA, 19 nt, Homo sapiens
gaagaagacuauggcauca

SEQ ID NO: 1322851 - RNA, 19 nt, Homo sapiens
agagagaacugaacgaaug

SEQ ID NO: 1322852 - RNA, 19 nt, Homo sapiens
cagcuagccugaugacaaa

SEQ ID NO: 1322853 - RNA, 19 nt, Homo sapiens
auaaaggacuucccugaaa

SEQ ID NO: 1322854 - RNA, 19 nt, Homo sapiens
ugaaucagcauuugcauuu

SEQ ID NO: 1322855 - RNA, 19 nt, Homo sapiens
ucacaucuccuauuuauca

SEQ ID NO: 1322856 - RNA, 19 nt, Homo sapiens
cagcaaccaugacugauga

SEQ ID NO: 1322857 - RNA, 19 nt, Homo sapiens
cuguacagcugguauauuu

SEQ ID NO: 1322858 - RNA, 19 nt, Homo sapiens
gaacgaaugaagaagacua

SEQ ID NO: 1322859 - RNA, 19 nt, Homo sapiens
gaugugacuuuaaggaaau

SEQ ID NO: 1322860 - RNA, 19 nt, Homo sapiens
ugacuugggacaucaaaua

SEQ ID NO: 1322861 - RNA, 19 nt, Homo sapiens
agacuaugaugccaacuuu

SEQ ID NO: 1322862 - RNA, 19 nt, Homo sapiens
ggaguauguuguauucgaa

SEQ ID NO: 1322863 - RNA, 19 nt, Homo sapiens
cuugggacaucaaauauaa

SEQ ID NO: 1322864 - RNA, 19 nt, Homo sapiens
uggcagaaguggaagauga

SEQ ID NO: 1322865 - RNA, 19 nt, Homo sapiens
ggagcuuuguggaaucuuu

SEQ ID NO: 1322866 - RNA, 19 nt, Homo sapiens
gaaagcaggauugguuauu

SEQ ID NO: 1322867 - RNA, 19 nt, Homo sapiens
cgaugugacuuuaaggaaa

SEQ ID NO: 1322868 - RNA, 19 nt, Homo sapiens
gcugaaaccagaagaagaa

SEQ ID NO: 1322869 - RNA, 19 nt, Homo sapiens
aagaugagccuacuuguga

SEQ ID NO: 1322870 - RNA, 19 nt, Homo sapiens
gagaaugcauaccaagauc

SEQ ID NO: 1322871 - RNA, 19 nt, Homo sapiens
ggccaucuaugaccgguuu

SEQ ID NO: 1322872 - RNA, 19 nt, Homo sapiens
uauacugacucacugauga

SEQ ID NO: 1322873 - RNA, 19 nt, Homo sapiens
guacagcugguauauuuga

SEQ ID NO: 1322874 - RNA, 19 nt, Homo sapiens
gcagcuauaguuccaguaa

SEQ ID NO: 1322875 - RNA, 19 nt, Homo sapiens
gaagaugagccuacuugug

SEQ ID NO: 1322876 - RNA, 19 nt, Homo sapiens
cagagaacauuggauauca

SEQ ID NO: 1322877 - RNA, 19 nt, Homo sapiens
uauugaagcucaccuuugu

SEQ ID NO: 1322878 - RNA, 19 nt, Homo sapiens
ggugaagccugggugauga

SEQ ID NO: 1322879 - RNA, 19 nt, Homo sapiens
ggugaguucugcacauuuc

SEQ ID NO: 1322880 - RNA, 19 nt, Homo sapiens
uauggaagcuggagaaugc

SEQ ID NO: 1322881 - RNA, 19 nt, Homo sapiens
gggcagggaucagaguuug

SEQ ID NO: 1322882 - RNA, 19 nt, Homo sapiens
gcagguggcagguauaaca

SEQ ID NO: 1322883 - RNA, 19 nt, Homo sapiens
ggagaaugcauaccaagau

SEQ ID NO: 1322884 - RNA, 19 nt, Homo sapiens
gaaauguugucaggguguu

SEQ ID NO: 1322885 - RNA, 19 nt, Homo sapiens
ggaucagaguuugaaauga

SEQ ID NO: 1322886 - RNA, 19 nt, Homo sapiens
gcuggaagcuuugaagucu

SEQ ID NO: 1322887 - RNA, 19 nt, Homo sapiens
gcauaucaucucuuucaaa

SEQ ID NO: 1322888 - RNA, 19 nt, Homo sapiens
ugugagcgaugugacuuua

SEQ ID NO: 1322889 - RNA, 19 nt, Homo sapiens
guugauguauggacaggaa

SEQ ID NO: 1322890 - RNA, 19 nt, Homo sapiens
uaaauaacucagaccauga

SEQ ID NO: 1322891 - RNA, 19 nt, Homo sapiens
gcuaaggauaucuuuauug

SEQ ID NO: 1322892 - RNA, 19 nt, Homo sapiens
caaaggagggacugauaga

SEQ ID NO: 1322893 - RNA, 19 nt, Homo sapiens
cguuucacaucuccuauuu

SEQ ID NO: 1322894 - RNA, 19 nt, Homo sapiens
gcuuugaagucucccauuc

SEQ ID NO: 1322895 - RNA, 19 nt, Homo sapiens
gagcuuuguggaaucuuua

SEQ ID NO: 1322896 - RNA, 19 nt, Homo sapiens
gggaucagaguuugaaaug

SEQ ID NO: 1322897 - RNA, 19 nt, Homo sapiens
gcagcauccucuuuguaau

SEQ ID NO: 1322898 - RNA, 19 nt, Homo sapiens
ugaggcugcuggaagcuuu

SEQ ID NO: 1322899 - RNA, 19 nt, Homo sapiens
ucagauggcagaaguggaa

SEQ ID NO: 1322900 - RNA, 19 nt, Homo sapiens
gcagggaucagaguuugaa

SEQ ID NO: 1322901 - RNA, 19 nt, Homo sapiens
gagagaacugaacgaauga

SEQ ID NO: 1322902 - RNA, 19 nt, Homo sapiens
gcauggaccagccuucaga

SEQ ID NO: 1322903 - RNA, 19 nt, Homo sapiens
ggaagcuggagaaugcaua

SEQ ID NO: 1322904 - RNA, 19 nt, Homo sapiens
agacaugacuugggacauc

SEQ ID NO: 1322905 - RNA, 19 nt, Homo sapiens
uaaaggacuucccugaaaa

SEQ ID NO: 1322906 - RNA, 19 nt, Homo sapiens
ggaaagcaggauugguuau

SEQ ID NO: 1322907 - RNA, 19 nt, Homo sapiens
aaagcaggauugguuauuc

SEQ ID NO: 1322908 - RNA, 19 nt, Homo sapiens
cuugguaacugaacacugu

SEQ ID NO: 1322909 - RNA, 19 nt, Homo sapiens
cagcagggacugugagaga

SEQ ID NO: 1322910 - RNA, 19 nt, Homo sapiens
uuucagagaacauuggaua

SEQ ID NO: 1322911 - RNA, 19 nt, Homo sapiens
gccauggacacucuucuuu

SEQ ID NO: 1322912 - RNA, 19 nt, Homo sapiens
gcuggagaaugcauaccaa

SEQ ID NO: 1322913 - RNA, 19 nt, Homo sapiens
ccuggaguauguuguauuc

SEQ ID NO: 1322914 - RNA, 19 nt, Homo sapiens
ccuagcagguggcagguau

SEQ ID NO: 1322915 - RNA, 19 nt, Homo sapiens
guauggacaggaagaugua

SEQ ID NO: 1322916 - RNA, 19 nt, Homo sapiens
acuaugaugccaacuuuaa

SEQ ID NO: 1322917 - RNA, 19 nt, Homo sapiens
agaagacuauggcaucaca

SEQ ID NO: 1322918 - RNA, 19 nt, Homo sapiens
ccggaaagcaggauugguu

SEQ ID NO: 1322919 - RNA, 19 nt, Homo sapiens
cggaaagcaggauugguua

SEQ ID NO: 1322920 - RNA, 19 nt, Homo sapiens
guucgcuguucaaguauga

SEQ ID NO: 1322921 - RNA, 19 nt, Homo sapiens
gacaugacuugggacauca

SEQ ID NO: 1322922 - RNA, 19 nt, Homo sapiens
ggacugauagagagaacug

SEQ ID NO: 1322923 - RNA, 19 nt, Homo sapiens
cagcagcauccucuuugua

SEQ ID NO: 1322924 - RNA, 19 nt, Homo sapiens
cagaagaagaauaugaaga

SEQ ID NO: 1322925 - RNA, 19 nt, Homo sapiens
aagcucaccuuugucuaaa

SEQ ID NO: 1322926 - RNA, 19 nt, Homo sapiens
gcgaugugacuuuaaggaa

SEQ ID NO: 1322927 - RNA, 19 nt, Homo sapiens
gcagucucaucaucagcaa

SEQ ID NO: 1322928 - RNA, 19 nt, Homo sapiens
ugaaaccagaagaagaaua

SEQ ID NO: 1322929 - RNA, 19 nt, Homo sapiens
gaaaagcaguugacaaacc

SEQ ID NO: 1322930 - RNA, 19 nt, Homo sapiens
uggaguauguuguauucga

SEQ ID NO: 1322931 - RNA, 19 nt, Homo sapiens
aggaagauguacccaagga

SEQ ID NO: 1322932 - RNA, 19 nt, Homo sapiens
gcauuugcauuuuauggaa

SEQ ID NO: 1322933 - RNA, 19 nt, Homo sapiens
ugagcgaugugacuuuaag

SEQ ID NO: 1322934 - RNA, 19 nt, Homo sapiens
aaagacaguauguuucaga

SEQ ID NO: 1322935 - RNA, 19 nt, Homo sapiens
agaagaagaauaugaagag

SEQ ID NO: 1322936 - RNA, 19 nt, Homo sapiens
gaaccagggcaacguguac

SEQ ID NO: 1322937 - RNA, 19 nt, Homo sapiens
gacuauggcaucacaagug

SEQ ID NO: 1322938 - RNA, 19 nt, Homo sapiens
gaagacuggggaagaauaa

SEQ ID NO: 1322939 - RNA, 19 nt, Homo sapiens
gaagaagaauggaauguuu

SEQ ID NO: 1322940 - RNA, 19 nt, Homo sapiens
gagagaauguguauuugua

SEQ ID NO: 1322941 - RNA, 19 nt, Homo sapiens
gaugaaauguccaaucuug

SEQ ID NO: 1322942 - RNA, 19 nt, Homo sapiens
ggagauagcucagaaaugg

SEQ ID NO: 1322943 - RNA, 19 nt, Homo sapiens
gcucagaaauggaugauga

SEQ ID NO: 1322944 - RNA, 19 nt, Homo sapiens
gaagacuggacaacaauua

SEQ ID NO: 1322945 - RNA, 19 nt, Homo sapiens
gcgaaaagcuguugcuaua

SEQ ID NO: 1322946 - RNA, 19 nt, Homo sapiens
gcaaauucguacaaaggua

SEQ ID NO: 1322947 - RNA, 19 nt, Homo sapiens
ccucagagcuguggaauga

SEQ ID NO: 1322948 - RNA, 19 nt, Homo sapiens
gaagagggaagacuauauu

SEQ ID NO: 1322949 - RNA, 19 nt, Homo sapiens
gaugaagacugugaaagaa

SEQ ID NO: 1322950 - RNA, 19 nt, Homo sapiens
ggaagacuauauuaugaug

SEQ ID NO: 1322951 - RNA, 19 nt, Homo sapiens
gcauugauauuaccucaga

SEQ ID NO: 1322952 - RNA, 19 nt, Homo sapiens
guacaaagguagcaggaau

SEQ ID NO: 1322953 - RNA, 19 nt, Homo sapiens
gaaagaagaagaauggaau

SEQ ID NO: 1322954 - RNA, 19 nt, Homo sapiens
gaugaaguuugguuuaaga

SEQ ID NO: 1322955 - RNA, 19 nt, Homo sapiens
gaauguguauuuguaggua

SEQ ID NO: 1322956 - RNA, 19 nt, Homo sapiens
guagguaguacucuaaaua

SEQ ID NO: 1322957 - RNA, 19 nt, Homo sapiens
caugagagaauguguauuu

SEQ ID NO: 1322958 - RNA, 19 nt, Homo sapiens
guauauacguggacaaaca

SEQ ID NO: 1322959 - RNA, 19 nt, Homo sapiens
gauaggcacagcauugaua

SEQ ID NO: 1322960 - RNA, 19 nt, Homo sapiens
ggauggagauagcucagaa

SEQ ID NO: 1322961 - RNA, 19 nt, Homo sapiens
gaagccaguuguuguuuca

SEQ ID NO: 1322962 - RNA, 19 nt, Homo sapiens
gaacuagaggagaagauaa

SEQ ID NO: 1322963 - RNA, 19 nt, Homo sapiens
gaaaagcuguugcuauaug

SEQ ID NO: 1322964 - RNA, 19 nt, Homo sapiens
uaagucagguggaugcaaa

SEQ ID NO: 1322965 - RNA, 19 nt, Homo sapiens
guaagugccaugagaguaa

SEQ ID NO: 1322966 - RNA, 19 nt, Homo sapiens
aaagaugaauguccuacaa

SEQ ID NO: 1322967 - RNA, 19 nt, Homo sapiens
uggaaccgcuggcaacuuu

SEQ ID NO: 1322968 - RNA, 19 nt, Homo sapiens
gagggaagacuauauuaug

SEQ ID NO: 1322969 - RNA, 19 nt, Homo sapiens
gcuggcaacuuuacaggaa

SEQ ID NO: 1322970 - RNA, 19 nt, Homo sapiens
gaaauguccaaucuugaaa

SEQ ID NO: 1322971 - RNA, 19 nt, Homo sapiens
ugaagacugugaaagaaga

SEQ ID NO: 1322972 - RNA, 19 nt, Homo sapiens
gauggugaaugguauauac

SEQ ID NO: 1322973 - RNA, 19 nt, Homo sapiens
gaggauaggcacagcauug

SEQ ID NO: 1322974 - RNA, 19 nt, Homo sapiens
uagcaggaaucuauagaga

SEQ ID NO: 1322975 - RNA, 19 nt, Homo sapiens
aaagguagcaggaaucuau

SEQ ID NO: 1322976 - RNA, 19 nt, Homo sapiens
ucagguccauauauaguuu

SEQ ID NO: 1322977 - RNA, 19 nt, Homo sapiens
aaauguaagugccaugaga

SEQ ID NO: 1322978 - RNA, 19 nt, Homo sapiens
agagugaacuagaggagaa

SEQ ID NO: 1322979 - RNA, 19 nt, Homo sapiens
gcaaaucuaagcuuuacau

SEQ ID NO: 1322980 - RNA, 19 nt, Homo sapiens
caacaauuaaccaugauga

SEQ ID NO: 1322981 - RNA, 19 nt, Homo sapiens
agggaagacuauauuauga

SEQ ID NO: 1322982 - RNA, 19 nt, Homo sapiens
ucagagcuguggaaugaug

SEQ ID NO: 1322983 - RNA, 19 nt, Homo sapiens
agaaauggaugaugaagac

SEQ ID NO: 1322984 - RNA, 19 nt, Homo sapiens
gaauggaauguuuggauga

SEQ ID NO: 1322985 - RNA, 19 nt, Homo sapiens
ggaaccaccugugaaacug

SEQ ID NO: 1322986 - RNA, 19 nt, Homo sapiens
ugaaauguccaaucuugaa

SEQ ID NO: 1322987 - RNA, 19 nt, Homo sapiens
uguuucagguccauauaua

SEQ ID NO: 1322988 - RNA, 19 nt, Homo sapiens
aggcacagcauugauauua

SEQ ID NO: 1322989 - RNA, 19 nt, Homo sapiens
caugaugaaguuugguuua

SEQ ID NO: 1322990 - RNA, 19 nt, Homo sapiens
gauaagaaggcuugaagag

SEQ ID NO: 1322991 - RNA, 19 nt, Homo sapiens
ugaugaagacugugaaaga

SEQ ID NO: 1322992 - RNA, 19 nt, Homo sapiens
gaaaagcaccagaauacuu

SEQ ID NO: 1322993 - RNA, 19 nt, Homo sapiens
gaagauaagaaggcuugaa

SEQ ID NO: 1322994 - RNA, 19 nt, Homo sapiens
agaaggagaccaaccauca

SEQ ID NO: 1322995 - RNA, 19 nt, Homo sapiens
uaagugccaugagaguaaa

SEQ ID NO: 1322996 - RNA, 19 nt, Homo sapiens
cuugaagacuggacaacaa

SEQ ID NO: 1322997 - RNA, 19 nt, Homo sapiens
gcuuagaaucuguaaagaa

SEQ ID NO: 1322998 - RNA, 19 nt, Homo sapiens
uaaccaugaugaaguuugg

SEQ ID NO: 1322999 - RNA, 19 nt, Homo sapiens
gcacagcauugauauuacc

SEQ ID NO: 1323000 - RNA, 19 nt, Homo sapiens
ugaacuagaggagaagaua

SEQ ID NO: 1323001 - RNA, 19 nt, Homo sapiens
cuuagaaucuguaaagaac

SEQ ID NO: 1323002 - RNA, 19 nt, Homo sapiens
aaagaagccaguuguuguu

SEQ ID NO: 1323003 - RNA, 19 nt, Homo sapiens
ugaaagaagaagaauggaa

SEQ ID NO: 1323004 - RNA, 19 nt, Homo sapiens
gggauaagaaggagaccaa

SEQ ID NO: 1323005 - RNA, 19 nt, Homo sapiens
caauuaaccaugaugaagu

SEQ ID NO: 1323006 - RNA, 19 nt, Homo sapiens
gcuguggaaugaugagcuu

SEQ ID NO: 1323007 - RNA, 19 nt, Homo sapiens
aaacggaaccaccugugaa

SEQ ID NO: 1323008 - RNA, 19 nt, Homo sapiens
augaugagcuucagucaag

SEQ ID NO: 1323009 - RNA, 19 nt, Homo sapiens
gaugaugaagacugugaaa

SEQ ID NO: 1323010 - RNA, 19 nt, Homo sapiens
caagaagucauagcuggaa

SEQ ID NO: 1323011 - RNA, 19 nt, Homo sapiens
gcuuuacauuucacagcua

SEQ ID NO: 1323012 - RNA, 19 nt, Homo sapiens
uggaauguuuggaugaaau

SEQ ID NO: 1323013 - RNA, 19 nt, Homo sapiens
aagagggaagacuauauua

SEQ ID NO: 1323014 - RNA, 19 nt, Homo sapiens
gagguggacuacgccgaaa

SEQ ID NO: 1323015 - RNA, 19 nt, Homo sapiens
ugaagagggaagacuauau

SEQ ID NO: 1323016 - RNA, 19 nt, Homo sapiens
ggaauguuuggaugaaaug

SEQ ID NO: 1323017 - RNA, 19 nt, Homo sapiens
ccaaauguaagugccauga

SEQ ID NO: 1323018 - RNA, 19 nt, Homo sapiens
gaugaauguccuacaagug

SEQ ID NO: 1323019 - RNA, 19 nt, Homo sapiens
gaagacugugaaagaagaa

SEQ ID NO: 1323020 - RNA, 19 nt, Homo sapiens
gaugagcuucagucaagaa

SEQ ID NO: 1323021 - RNA, 19 nt, Homo sapiens
gaaugaugagcuucaguca

SEQ ID NO: 1323022 - RNA, 19 nt, Homo sapiens
ucagguggaugcaaaacua

SEQ ID NO: 1323023 - RNA, 19 nt, Homo sapiens
ucacagcuacagaaaggaa

SEQ ID NO: 1323024 - RNA, 19 nt, Homo sapiens
gggaagacuauauuaugau

SEQ ID NO: 1323025 - RNA, 19 nt, Homo sapiens
gauggaagcaaaucuaagc

SEQ ID NO: 1323026 - RNA, 19 nt, Homo sapiens
agaugaauguccuacaagu

SEQ ID NO: 1323027 - RNA, 19 nt, Homo sapiens
gagcucugcuuagaaucug

SEQ ID NO: 1323028 - RNA, 19 nt, Homo sapiens
auacguggacaaacaauau

SEQ ID NO: 1323029 - RNA, 19 nt, Homo sapiens
cagaaauggaugaugaaga

SEQ ID NO: 1323030 - RNA, 19 nt, Homo sapiens
aauggaauguuuggaugaa

SEQ ID NO: 1323031 - RNA, 19 nt, Homo sapiens
caacaauuaggaaggcaau

SEQ ID NO: 1323032 - RNA, 19 nt, Homo sapiens
agaagccaguuguuguuuc

SEQ ID NO: 1323033 - RNA, 19 nt, Homo sapiens
ggagaccaaccaucacgau

SEQ ID NO: 1323034 - RNA, 19 nt, Homo sapiens
ggaaccgcuggcaacuuua

SEQ ID NO: 1323035 - RNA, 19 nt, Homo sapiens
ugagagaauguguauuugu

SEQ ID NO: 1323036 - RNA, 19 nt, Homo sapiens
gaggccugauggaagcaaa

SEQ ID NO: 1323037 - RNA, 19 nt, Homo sapiens
agagggaagacuauauuau

SEQ ID NO: 1323038 - RNA, 19 nt, Homo sapiens
acaguuuaccgaucucaaa

SEQ ID NO: 1323039 - RNA, 19 nt, Homo sapiens
cagaacaacuccgucuuua

SEQ ID NO: 1323040 - RNA, 19 nt, Homo sapiens
guaaguacauacacacaug

SEQ ID NO: 1323041 - RNA, 19 nt, Homo sapiens
gaaaauaugugcuucuucu

SEQ ID NO: 1323042 - RNA, 19 nt, Homo sapiens
uagaggaacugaggaagaa

SEQ ID NO: 1323043 - RNA, 19 nt, Homo sapiens
cuucuuaccucccaccuuu

SEQ ID NO: 1323044 - RNA, 19 nt, Homo sapiens
uguaugaacugacuaaugg

SEQ ID NO: 1323045 - RNA, 19 nt, Homo sapiens
gcacaaggccgagaucauc

SEQ ID NO: 1323046 - RNA, 19 nt, Homo sapiens
cacaaacaguccagcauga

SEQ ID NO: 1323047 - RNA, 19 nt, Homo sapiens
ccagaacaacuccgucuuu

SEQ ID NO: 1323048 - RNA, 19 nt, Homo sapiens
gcuguugccucccuucuca

SEQ ID NO: 1323049 - RNA, 19 nt, Homo sapiens
ggaccugucucccuuuacu

SEQ ID NO: 1323050 - RNA, 19 nt, Homo sapiens
gggaagacacagaggauga

SEQ ID NO: 1323051 - RNA, 19 nt, Homo sapiens
ccaaagacuggaucuguga

SEQ ID NO: 1323052 - RNA, 19 nt, Homo sapiens
gaacaacuccgucuuuacc

SEQ ID NO: 1323053 - RNA, 19 nt, Homo sapiens
ucuguaaaccugacacuuu

SEQ ID NO: 1323054 - RNA, 19 nt, Homo sapiens
ggaugaagccacucuacug

SEQ ID NO: 1323055 - RNA, 19 nt, Homo sapiens
cgauccagauuguauuaga

SEQ ID NO: 1323056 - RNA, 19 nt, Homo sapiens
ugucucccuuuacuucuua

SEQ ID NO: 1323057 - RNA, 19 nt, Homo sapiens
acacagaggaugaggaguu

SEQ ID NO: 1323058 - RNA, 19 nt, Homo sapiens
gauccagauuguauuagag

SEQ ID NO: 1323059 - RNA, 19 nt, Homo sapiens
cauccuagacuguccuuga

SEQ ID NO: 1323060 - RNA, 19 nt, Homo sapiens
gggaaacucaucuaucagu

SEQ ID NO: 1323061 - RNA, 19 nt, Homo sapiens
ucaacaacgucaagcuaca

SEQ ID NO: 1323062 - RNA, 19 nt, Homo sapiens
cuacgauggcgaugaguuu

SEQ ID NO: 1323063 - RNA, 19 nt, Homo sapiens
cuacuacgauggcgaugag

SEQ ID NO: 1323064 - RNA, 19 nt, Homo sapiens
aaaccugacacuuuauaug

SEQ ID NO: 1323065 - RNA, 19 nt, Homo sapiens
gccgagaucaucacuguca

SEQ ID NO: 1323066 - RNA, 19 nt, Homo sapiens
gucgauccagauuguauua

SEQ ID NO: 1323067 - RNA, 19 nt, Homo sapiens
gagucgauccagauuguau

SEQ ID NO: 1323068 - RNA, 19 nt, Homo sapiens
gccgaggcgucaaguucuu

SEQ ID NO: 1323069 - RNA, 19 nt, Homo sapiens
ugacuccaccagacucaaa

SEQ ID NO: 1323070 - RNA, 19 nt, Homo sapiens
aggccgagaucaucacugu

SEQ ID NO: 1323071 - RNA, 19 nt, Homo sapiens
cacagaggaugaggaguuc

SEQ ID NO: 1323072 - RNA, 19 nt, Homo sapiens
gcgucaaguucuucuagca

SEQ ID NO: 1323073 - RNA, 19 nt, Homo sapiens
ccagcuuccugaucaugug

SEQ ID NO: 1323074 - RNA, 19 nt, Homo sapiens
aaccugacacuuuauaugu

SEQ ID NO: 1323075 - RNA, 19 nt, Homo sapiens
caggcaauaugaagauagg

SEQ ID NO: 1323076 - RNA, 19 nt, Homo sapiens
ucgcuucccacccuucuuu

SEQ ID NO: 1323077 - RNA, 19 nt, Homo sapiens
gcggaggccagaagaaugg

SEQ ID NO: 1323078 - RNA, 19 nt, Homo sapiens
aaguccagcuuccugauca

SEQ ID NO: 1323079 - RNA, 19 nt, Homo sapiens
gcaaguccagcuuccugau

SEQ ID NO: 1323080 - RNA, 19 nt, Homo sapiens
gcucgcugguccuguccuu

SEQ ID NO: 1323081 - RNA, 19 nt, Homo sapiens
gaggaacugaggaagaaag

SEQ ID NO: 1323082 - RNA, 19 nt, Homo sapiens
uuagaggaacugaggaaga

SEQ ID NO: 1323083 - RNA, 19 nt, Homo sapiens
ccagauuguauuagaggaa

SEQ ID NO: 1323084 - RNA, 19 nt, Homo sapiens
cuucaacaacgucaagcua

SEQ ID NO: 1323085 - RNA, 19 nt, Homo sapiens
cagcaugacggugauggaa

SEQ ID NO: 1323086 - RNA, 19 nt, Homo sapiens
gagcacaaggccgagauca

SEQ ID NO: 1323087 - RNA, 19 nt, Homo sapiens
ucgagugguuggauaagag

SEQ ID NO: 1323088 - RNA, 19 nt, Homo sapiens
ggagucgauccagauugua

SEQ ID NO: 1323089 - RNA, 19 nt, Homo sapiens
uccaggcaauaugaagaua

SEQ ID NO: 1323090 - RNA, 19 nt, Homo sapiens
ucgaguggccguggcagua

SEQ ID NO: 1323091 - RNA, 19 nt, Homo sapiens
ggaagacacagaggaugag

SEQ ID NO: 1323092 - RNA, 19 nt, Homo sapiens
gaguggccguggcaguauc

SEQ ID NO: 1323093 - RNA, 19 nt, Homo sapiens
gaggauauguguuggaaua

SEQ ID NO: 1323094 - RNA, 19 nt, Homo sapiens
ggaaggacgcuaaauaaua

SEQ ID NO: 1323095 - RNA, 19 nt, Homo sapiens
gaaggacgcuaaauaauag

SEQ ID NO: 1323096 - RNA, 19 nt, Homo sapiens
gcagauauccacaaacaua

SEQ ID NO: 1323097 - RNA, 19 nt, Homo sapiens
gggaagaaguaauuuauuc

SEQ ID NO: 1323098 - RNA, 19 nt, Homo sapiens
gggauaaccuugcuguuug

SEQ ID NO: 1323099 - RNA, 19 nt, Homo sapiens
gggcggagauauguaaaua

SEQ ID NO: 1323100 - RNA, 19 nt, Homo sapiens
ucacugaaauggcuuuauu

SEQ ID NO: 1323101 - RNA, 19 nt, Homo sapiens
gaaagugcguacaguuaga

SEQ ID NO: 1323102 - RNA, 19 nt, Homo sapiens
gcggagauauguaaauaga

SEQ ID NO: 1323103 - RNA, 19 nt, Homo sapiens
uggcugaacuacugaauaa

SEQ ID NO: 1323104 - RNA, 19 nt, Homo sapiens
gaacucacccuagcuugua

SEQ ID NO: 1323105 - RNA, 19 nt, Homo sapiens
gacgaucacuuacauuugu

SEQ ID NO: 1323106 - RNA, 19 nt, Homo sapiens
uaacgucucugcguaauca

SEQ ID NO: 1323107 - RNA, 19 nt, Homo sapiens
ugagauggcugaacuacug

SEQ ID NO: 1323108 - RNA, 19 nt, Homo sapiens
uagcagauauccacaaaca

SEQ ID NO: 1323109 - RNA, 19 nt, Homo sapiens
gauuagaacaugaugauug

SEQ ID NO: 1323110 - RNA, 19 nt, Homo sapiens
uaaccuugcuguuugucua

SEQ ID NO: 1323111 - RNA, 19 nt, Homo sapiens
uagaaagugcguacaguua

SEQ ID NO: 1323112 - RNA, 19 nt, Homo sapiens
ggauaaccuugcuguuugu

SEQ ID NO: 1323113 - RNA, 19 nt, Homo sapiens
ccugauugcuccugucuga

SEQ ID NO: 1323114 - RNA, 19 nt, Homo sapiens
ggauauguguuggaauaau

SEQ ID NO: 1323115 - RNA, 19 nt, Homo sapiens
gaacuuccagccucagaga

SEQ ID NO: 1323116 - RNA, 19 nt, Homo sapiens
gauuauccgcauuguauuu

SEQ ID NO: 1323117 - RNA, 19 nt, Homo sapiens
caauugagauggcugaacu

SEQ ID NO: 1323118 - RNA, 19 nt, Homo sapiens
gauuggagaugcaugaaac

SEQ ID NO: 1323119 - RNA, 19 nt, Homo sapiens
gagggcagauuagaacaug

SEQ ID NO: 1323120 - RNA, 19 nt, Homo sapiens
cgucuugagucugggauua

SEQ ID NO: 1323121 - RNA, 19 nt, Homo sapiens
gcuccugucugauucuuuc

SEQ ID NO: 1323122 - RNA, 19 nt, Homo sapiens
gaccguaagauacuuggua

SEQ ID NO: 1323123 - RNA, 19 nt, Homo sapiens
gaaguucugacugggauaa

SEQ ID NO: 1323124 - RNA, 19 nt, Homo sapiens
gagcuaauauggcaaaaca

SEQ ID NO: 1323125 - RNA, 19 nt, Homo sapiens
gauuaacgucucugcguaa

SEQ ID NO: 1323126 - RNA, 19 nt, Homo sapiens
gacgcuaaauaauaggauu

SEQ ID NO: 1323127 - RNA, 19 nt, Homo sapiens
gaugauuggagaugcauga

SEQ ID NO: 1323128 - RNA, 19 nt, Homo sapiens
auaauaggauugcucauac

SEQ ID NO: 1323129 - RNA, 19 nt, Homo sapiens
cuggaaggacgcuaaauaa

SEQ ID NO: 1323130 - RNA, 19 nt, Homo sapiens
gaaugucggcuguuugucu

SEQ ID NO: 1323131 - RNA, 19 nt, Homo sapiens
ggagugggcggagauaugu

SEQ ID NO: 1323132 - RNA, 19 nt, Homo sapiens
auaauuacgucuugagucu

SEQ ID NO: 1323133 - RNA, 19 nt, Homo sapiens
cuugguaucgcuucuauuu

SEQ ID NO: 1323134 - RNA, 19 nt, Homo sapiens
gaacaugaugauuggagau

SEQ ID NO: 1323135 - RNA, 19 nt, Homo sapiens
gcagaaugucggcuguuug

SEQ ID NO: 1323136 - RNA, 19 nt, Homo sapiens
caacuggaaggacgcuaaa

SEQ ID NO: 1323137 - RNA, 19 nt, Homo sapiens
gaauaauuacgucuugagu

SEQ ID NO: 1323138 - RNA, 19 nt, Homo sapiens
aggagucgcugucucugaa

SEQ ID NO: 1323139 - RNA, 19 nt, Homo sapiens
guaaucaggacuugcaaca

SEQ ID NO: 1323140 - RNA, 19 nt, Homo sapiens
uugcagucuugcuaaauuu

SEQ ID NO: 1323141 - RNA, 19 nt, Homo sapiens
ugggauaaccuugcuguuu

SEQ ID NO: 1323142 - RNA, 19 nt, Homo sapiens
cagauuagaacaugaugau

SEQ ID NO: 1323143 - RNA, 19 nt, Homo sapiens
gcagauuagaacaugauga

SEQ ID NO: 1323144 - RNA, 19 nt, Homo sapiens
gaagggagugggcggagau

SEQ ID NO: 1323145 - RNA, 19 nt, Homo sapiens
uuugcagucuugcuaaauu

SEQ ID NO: 1323146 - RNA, 19 nt, Homo sapiens
cagaaugucggcuguuugu

SEQ ID NO: 1323147 - RNA, 19 nt, Homo sapiens
acuggaaggacgcuaaaua

SEQ ID NO: 1323148 - RNA, 19 nt, Homo sapiens
gcauuguauuuagugcuuu

SEQ ID NO: 1323149 - RNA, 19 nt, Homo sapiens
gcucauaccagcgcguuau

SEQ ID NO: 1323150 - RNA, 19 nt, Homo sapiens
gggagugggcggagauaug

SEQ ID NO: 1323151 - RNA, 19 nt, Homo sapiens
ggaauaauuacgucuugag

SEQ ID NO: 1323152 - RNA, 19 nt, Homo sapiens
gauugcuccugucugauuc

SEQ ID NO: 1323153 - RNA, 19 nt, Homo sapiens
ugauugcuccugucugauu

SEQ ID NO: 1323154 - RNA, 19 nt, Homo sapiens
gcaugaaacgugauuaacg

SEQ ID NO: 1323155 - RNA, 19 nt, Homo sapiens
uggaggauauguguuggaa

SEQ ID NO: 1323156 - RNA, 19 nt, Homo sapiens
ugacgaucacuuacauuug

SEQ ID NO: 1323157 - RNA, 19 nt, Homo sapiens
ugcagaaugucggcuguuu

SEQ ID NO: 1323158 - RNA, 19 nt, Homo sapiens
gcagaccguaagauacuug

SEQ ID NO: 1323159 - RNA, 19 nt, Homo sapiens
auuagcagauauccacaaa

SEQ ID NO: 1323160 - RNA, 19 nt, Homo sapiens
cugacgaucacuuacauuu

SEQ ID NO: 1323161 - RNA, 19 nt, Homo sapiens
aaacccuucugauuaccuu

SEQ ID NO: 1323162 - RNA, 19 nt, Homo sapiens
ccugucugauucuuucuga

SEQ ID NO: 1323163 - RNA, 19 nt, Homo sapiens
cauuguauuuagugcuuug

SEQ ID NO: 1323164 - RNA, 19 nt, Homo sapiens
cuucaugacgggaaccuaa

SEQ ID NO: 1323165 - RNA, 19 nt, Homo sapiens
ucugggaagaaguaauuua

SEQ ID NO: 1323166 - RNA, 19 nt, Homo sapiens
uaacugaucggagcauucu

SEQ ID NO: 1323167 - RNA, 19 nt, Homo sapiens
cgcauuguauuuagugcuu

SEQ ID NO: 1323168 - RNA, 19 nt, Homo sapiens
gggcagauuagaacaugau

SEQ ID NO: 1323169 - RNA, 19 nt, Homo sapiens
gcugaacuacugaauaaaa

SEQ ID NO: 1323170 - RNA, 19 nt, Homo sapiens
uggaauaauuacgucuuga

SEQ ID NO: 1323171 - RNA, 19 nt, Homo sapiens
guugcuuucuggaauuuag

SEQ ID NO: 1323172 - RNA, 19 nt, Homo sapiens
caugaugauuggagaugca

SEQ ID NO: 1323173 - RNA, 19 nt, Homo sapiens
agaaagugcguacaguuag

SEQ ID NO: 1323174 - RNA, 19 nt, Homo sapiens
aauagaaagugcguacagu

SEQ ID NO: 1323175 - RNA, 19 nt, Homo sapiens
cagucuugcuaaauuuguu

SEQ ID NO: 1323176 - RNA, 19 nt, Homo sapiens
gcagucuugcuaaauuugu

SEQ ID NO: 1323177 - RNA, 19 nt, Homo sapiens
ggagggcagauuagaacau

SEQ ID NO: 1323178 - RNA, 19 nt, Homo sapiens
uggaaggacgcuaaauaau

SEQ ID NO: 1323179 - RNA, 19 nt, Homo sapiens
uuggaauaauuacgucuug

SEQ ID NO: 1323180 - RNA, 19 nt, Homo sapiens
ccuugcuguuugucuauuu

SEQ ID NO: 1323181 - RNA, 19 nt, Homo sapiens
gauuagcagauauccacaa

SEQ ID NO: 1323182 - RNA, 19 nt, Homo sapiens
ggacuugcaacacccugau

SEQ ID NO: 1323183 - RNA, 19 nt, Homo sapiens
auuagaacaugaugauugg

SEQ ID NO: 1323184 - RNA, 19 nt, Homo sapiens
ugguaucgcuucuauuuug

SEQ ID NO: 1323185 - RNA, 19 nt, Homo sapiens
gagauggcugaacuacuga

SEQ ID NO: 1323186 - RNA, 19 nt, Homo sapiens
ugacugggauaaccuugcu

SEQ ID NO: 1323187 - RNA, 19 nt, Homo sapiens
acaacuggaaggacgcuaa

SEQ ID NO: 1323188 - RNA, 19 nt, Homo sapiens
guaacugaucggagcauuc

SEQ ID NO: 1323189 - RNA, 19 nt, Homo sapiens
ugucggcuguuugucugua

SEQ ID NO: 1323190 - RNA, 19 nt, Homo sapiens
ugaacucacccuagcuugu

SEQ ID NO: 1323191 - RNA, 19 nt, Homo sapiens
cugggaagaaguaauuuau

SEQ ID NO: 1323192 - RNA, 19 nt, Homo sapiens
ggucgucaucaccuuauuc

SEQ ID NO: 1323193 - RNA, 19 nt, Homo sapiens
gcacauugacuccuucuga

SEQ ID NO: 1323194 - RNA, 19 nt, Homo sapiens
ccaggaagcucugaggauu

SEQ ID NO: 1323195 - RNA, 19 nt, Homo sapiens
caacgcagccggcuucuuc

SEQ ID NO: 1323196 - RNA, 19 nt, Homo sapiens
cuacugacaugcagaggaa

SEQ ID NO: 1323197 - RNA, 19 nt, Homo sapiens
gaagcagaacuaugauuug

SEQ ID NO: 1323198 - RNA, 19 nt, Homo sapiens
ccagaagcaugucuuugug

SEQ ID NO: 1323199 - RNA, 19 nt, Homo sapiens
cugcgucacuuccucuaua

SEQ ID NO: 1323200 - RNA, 19 nt, Homo sapiens
ccaggagggugccauguuc

SEQ ID NO: 1323201 - RNA, 19 nt, Homo sapiens
cuacagcguugcccaagug

SEQ ID NO: 1323202 - RNA, 19 nt, Homo sapiens
gcaccagaagcaugucuuu

SEQ ID NO: 1323203 - RNA, 19 nt, Homo sapiens
gaggagaugcugccaggaa

SEQ ID NO: 1323204 - RNA, 19 nt, Homo sapiens
gaagagaagcagcgaaugc

SEQ ID NO: 1323205 - RNA, 19 nt, Homo sapiens
agaagcagaacuaugauuu

SEQ ID NO: 1323206 - RNA, 19 nt, Homo sapiens
gauggcacauugacuccuu

SEQ ID NO: 1323207 - RNA, 19 nt, Homo sapiens
ccuuugagcucuacaugug

SEQ ID NO: 1323208 - RNA, 19 nt, Homo sapiens
aaggauggcuacugacaug

SEQ ID NO: 1323209 - RNA, 19 nt, Homo sapiens
gcgccgaaaggaccaauuu

SEQ ID NO: 1323210 - RNA, 19 nt, Homo sapiens
cucaaaggauggcuacuga

SEQ ID NO: 1323211 - RNA, 19 nt, Homo sapiens
cagaucagccaggacuuua

SEQ ID NO: 1323212 - RNA, 19 nt, Homo sapiens
caaaggauggcuacugaca

SEQ ID NO: 1323213 - RNA, 19 nt, Homo sapiens
ggacuccucugagaaacag

SEQ ID NO: 1323214 - RNA, 19 nt, Homo sapiens
ccacugaccgugaggacuu

SEQ ID NO: 1323215 - RNA, 19 nt, Homo sapiens
ccgugugccugcccaaauu

SEQ ID NO: 1323216 - RNA, 19 nt, Homo sapiens
guuggugaaugcauuaaag

SEQ ID NO: 1323217 - RNA, 19 nt, Homo sapiens
gcacuuuccagcacuaugg

SEQ ID NO: 1323218 - RNA, 19 nt, Homo sapiens
cuacagacaugcgccagau

SEQ ID NO: 1323219 - RNA, 19 nt, Homo sapiens
ucaccagcccugagauuga

SEQ ID NO: 1323220 - RNA, 19 nt, Homo sapiens
gaggcacuuuccagcacua

SEQ ID NO: 1323221 - RNA, 19 nt, Homo sapiens
agcagaagcagaacuauga

SEQ ID NO: 1323222 - RNA, 19 nt, Homo sapiens
ccagaucagccaggacuuu

SEQ ID NO: 1323223 - RNA, 19 nt, Homo sapiens
cacauugacuccuucugau

SEQ ID NO: 1323224 - RNA, 19 nt, Homo sapiens
ugaaugcauuaaagugcuu

SEQ ID NO: 1323225 - RNA, 19 nt, Homo sapiens
gaaacaggagagcucaaag

SEQ ID NO: 1323226 - RNA, 19 nt, Homo sapiens
guggguuggugaaugcauu

SEQ ID NO: 1323227 - RNA, 19 nt, Homo sapiens
ucaagaccauuuacuacac

SEQ ID NO: 1323228 - RNA, 19 nt, Homo sapiens
ggucugaggaggcacuuuc

SEQ ID NO: 1323229 - RNA, 19 nt, Homo sapiens
cauggcgccugcaccagaa

SEQ ID NO: 1323230 - RNA, 19 nt, Homo sapiens
ucuucaaccucauuaguuc

SEQ ID NO: 1323231 - RNA, 19 nt, Homo sapiens
gaccugcaccugcucuuca

SEQ ID NO: 1323232 - RNA, 19 nt, Homo sapiens
gcagugaccggcaccuucu

SEQ ID NO: 1323233 - RNA, 19 nt, Homo sapiens
gcacugcgcacacccuacu

SEQ ID NO: 1323234 - RNA, 19 nt, Homo sapiens
gcucaaaggauggcuacug

SEQ ID NO: 1323235 - RNA, 19 nt, Homo sapiens
agaaacaggagagcucaaa

SEQ ID NO: 1323236 - RNA, 19 nt, Homo sapiens
cagaagcagaacuaugauu

SEQ ID NO: 1323237 - RNA, 19 nt, Homo sapiens
cagcagaagcagaacuaug

SEQ ID NO: 1323238 - RNA, 19 nt, Homo sapiens
gcagcugagccacaucuuc

SEQ ID NO: 1323239 - RNA, 19 nt, Homo sapiens
ucacgccccucaccuauug

SEQ ID NO: 1323240 - RNA, 19 nt, Homo sapiens
ugcgucacuuccucuauaa

SEQ ID NO: 1323241 - RNA, 19 nt, Homo sapiens
aagcagaacuaugauuugc

SEQ ID NO: 1323242 - RNA, 19 nt, Homo sapiens
ggaagagaagcagcgaaug

SEQ ID NO: 1323243 - RNA, 19 nt, Homo sapiens
ggaauggcccagggaaugg

SEQ ID NO: 1323244 - RNA, 19 nt, Homo sapiens
ccuggacuccucugagaaa

SEQ ID NO: 1323245 - RNA, 19 nt, Homo sapiens
gcucuucaaccucauuagu

SEQ ID NO: 1323246 - RNA, 19 nt, Homo sapiens
gcagaagcagaacuaugau

SEQ ID NO: 1323247 - RNA, 19 nt, Homo sapiens
gacuguggguuggugaaug

SEQ ID NO: 1323248 - RNA, 19 nt, Homo sapiens
gccaggagggugccauguu

SEQ ID NO: 1323249 - RNA, 19 nt, Homo sapiens
gacaugcagaggaagagaa

SEQ ID NO: 1323250 - RNA, 19 nt, Homo sapiens
cacucaagaccauuuacua

SEQ ID NO: 1323251 - RNA, 19 nt, Homo sapiens
gcccacucaagaccauuua

SEQ ID NO: 1323252 - RNA, 19 nt, Homo sapiens
cagagcgcaucaccgacaa

SEQ ID NO: 1323253 - RNA, 19 nt, Homo sapiens
gcacuauggguguuauggu

SEQ ID NO: 1323254 - RNA, 19 nt, Homo sapiens
ucagugccauccauaagcu

SEQ ID NO: 1323255 - RNA, 19 nt, Homo sapiens
ugaccgugaggacuucuuu

SEQ ID NO: 1323256 - RNA, 19 nt, Homo sapiens
gugcgcagcugagccacau

SEQ ID NO: 1323257 - RNA, 19 nt, Homo sapiens
caggaagcucugaggauug

SEQ ID NO: 1323258 - RNA, 19 nt, Homo sapiens
ggugugggaagccauagga

SEQ ID NO: 1323259 - RNA, 19 nt, Homo sapiens
accuagagccugacacuga

SEQ ID NO: 1323260 - RNA, 19 nt, Homo sapiens
aaacaggagagcucaaagg

SEQ ID NO: 1323261 - RNA, 19 nt, Homo sapiens
ccuacgaggaccugacuga

SEQ ID NO: 1323262 - RNA, 19 nt, Homo sapiens
ggacuguggguuggugaau

SEQ ID NO: 1323263 - RNA, 19 nt, Homo sapiens
uuugagcucuacauguguu

SEQ ID NO: 1323264 - RNA, 19 nt, Homo sapiens
ccagcacuauggguguuau

SEQ ID NO: 1323265 - RNA, 19 nt, Homo sapiens
gcaugucuuugugcugagu

SEQ ID NO: 1323266 - RNA, 19 nt, Homo sapiens
acagacaugcgccagauca

SEQ ID NO: 1323267 - RNA, 19 nt, Homo sapiens
gaaaggugcuuaggaaguu

SEQ ID NO: 1323268 - RNA, 19 nt, Homo sapiens
gcgcuuaccuuucagacuu

SEQ ID NO: 1323269 - RNA, 19 nt, Homo sapiens
caacaagacuaugcgcauu

SEQ ID NO: 1323270 - RNA, 19 nt, Homo sapiens
ccugaaaggugcuuaggaa

SEQ ID NO: 1323271 - RNA, 19 nt, Homo sapiens
uagaggcgcugcucaacaa

SEQ ID NO: 1323272 - RNA, 19 nt, Homo sapiens
cgauggcgcuuaccuuuca

SEQ ID NO: 1323273 - RNA, 19 nt, Homo sapiens
gcacugaccgugacugcaa

SEQ ID NO: 1323274 - RNA, 19 nt, Homo sapiens
gagaagagaauggcuguug

SEQ ID NO: 1323275 - RNA, 19 nt, Homo sapiens
ccacaucguuuccauugag

SEQ ID NO: 1323276 - RNA, 19 nt, Homo sapiens
gaagagaauggcuguugca

SEQ ID NO: 1323277 - RNA, 19 nt, Homo sapiens
ggacacuggucggcugcuu

SEQ ID NO: 1323278 - RNA, 19 nt, Homo sapiens
caccacaucguuuccauug

SEQ ID NO: 1323279 - RNA, 19 nt, Homo sapiens
cacgauggcgcuuaccuuu

SEQ ID NO: 1323280 - RNA, 19 nt, Homo sapiens
ugaaaggugcuuaggaagu

SEQ ID NO: 1323281 - RNA, 19 nt, Homo sapiens
gcgcugcucaacaagacua

SEQ ID NO: 1323282 - RNA, 19 nt, Homo sapiens
ccguaucucugaccacgau

SEQ ID NO: 1323283 - RNA, 19 nt, Homo sapiens
ccuuucagacuucauuaaa

SEQ ID NO: 1323284 - RNA, 19 nt, Homo sapiens
ugaccacgauggcgcuuac

SEQ ID NO: 1323285 - RNA, 19 nt, Homo sapiens
gacaccacaucguuuccau

SEQ ID NO: 1323286 - RNA, 19 nt, Homo sapiens
ccacgauggcgcuuaccuu

SEQ ID NO: 1323287 - RNA, 19 nt, Homo sapiens
gaccaugcugcuacgagaa

SEQ ID NO: 1323288 - RNA, 19 nt, Homo sapiens
aaaggugcuuaggaaguug

SEQ ID NO: 1323289 - RNA, 19 nt, Homo sapiens
gaacugguuuggaauccua

SEQ ID NO: 1323290 - RNA, 19 nt, Homo sapiens
gcacguuagucaacaauug

SEQ ID NO: 1323291 - RNA, 19 nt, Homo sapiens
uaagggaacucuaggaaga

SEQ ID NO: 1323292 - RNA, 19 nt, Homo sapiens
gaagguggcuccagaucug

SEQ ID NO: 1323293 - RNA, 19 nt, Homo sapiens
ggaacugccucuuggauca

SEQ ID NO: 1323294 - RNA, 19 nt, Homo sapiens
gcaguaugcuucccacaug

SEQ ID NO: 1323295 - RNA, 19 nt, Homo sapiens
ucuaggagcuguuuauguu

SEQ ID NO: 1323296 - RNA, 19 nt, Homo sapiens
ggagguaauugguccuuug

SEQ ID NO: 1323297 - RNA, 19 nt, Homo sapiens
aaguagcgcuucaugcuua

SEQ ID NO: 1323298 - RNA, 19 nt, Homo sapiens
gcagcuggccgcagacaua

SEQ ID NO: 1323299 - RNA, 19 nt, Homo sapiens
ggacacaaacaccugagua

SEQ ID NO: 1323300 - RNA, 19 nt, Homo sapiens
gaagaggcaaacaguaauu

SEQ ID NO: 1323301 - RNA, 19 nt, Homo sapiens
ucugggaacuucauucauu

SEQ ID NO: 1323302 - RNA, 19 nt, Homo sapiens
guugaucuuugcaguaauu

SEQ ID NO: 1323303 - RNA, 19 nt, Homo sapiens
ggucuaagccaggaaguaa

SEQ ID NO: 1323304 - RNA, 19 nt, Homo sapiens
ggagaaaccaguugauugg

SEQ ID NO: 1323305 - RNA, 19 nt, Homo sapiens
gaacaguugaauagcuuaa

SEQ ID NO: 1323306 - RNA, 19 nt, Homo sapiens
cagaacaguugaauagcuu

SEQ ID NO: 1323307 - RNA, 19 nt, Homo sapiens
gguccuuuguccauauaua

SEQ ID NO: 1323308 - RNA, 19 nt, Homo sapiens
caaaagaucaggacaauau

SEQ ID NO: 1323309 - RNA, 19 nt, Homo sapiens
ucacucagcugugcuuuca

SEQ ID NO: 1323310 - RNA, 19 nt, Homo sapiens
ccacuacuuugaaaccauu

SEQ ID NO: 1323311 - RNA, 19 nt, Homo sapiens
ggaaacgaacgguguugaa

SEQ ID NO: 1323312 - RNA, 19 nt, Homo sapiens
ggccugaguucccauagga

SEQ ID NO: 1323313 - RNA, 19 nt, Homo sapiens
cauaggacacacucacaua

SEQ ID NO: 1323314 - RNA, 19 nt, Homo sapiens
uaggagcuguuuauguuug

SEQ ID NO: 1323315 - RNA, 19 nt, Homo sapiens
ugaagggccacuuguguuu

SEQ ID NO: 1323316 - RNA, 19 nt, Homo sapiens
ggaacacugugcgaagaga

SEQ ID NO: 1323317 - RNA, 19 nt, Homo sapiens
ccuucuuccuucacaauua

SEQ ID NO: 1323318 - RNA, 19 nt, Homo sapiens
cgacauggcuacgugaucu

SEQ ID NO: 1323319 - RNA, 19 nt, Homo sapiens
gaucaggacaauaugacuu

SEQ ID NO: 1323320 - RNA, 19 nt, Homo sapiens
acaguugaauagcuuaaug

SEQ ID NO: 1323321 - RNA, 19 nt, Homo sapiens
cuacuggguuguugaucuu

SEQ ID NO: 1323322 - RNA, 19 nt, Homo sapiens
ugucuuugcuggaggagaa

SEQ ID NO: 1323323 - RNA, 19 nt, Homo sapiens
uaguacauccuccaaauug

SEQ ID NO: 1323324 - RNA, 19 nt, Homo sapiens
cugggaacuucauucauuu

SEQ ID NO: 1323325 - RNA, 19 nt, Homo sapiens
cuuaguacauccuccaaau

SEQ ID NO: 1323326 - RNA, 19 nt, Homo sapiens
gaggaucucgugugccuau

SEQ ID NO: 1323327 - RNA, 19 nt, Homo sapiens
gaagaagguggcuccagau

SEQ ID NO: 1323328 - RNA, 19 nt, Homo sapiens
gaucucgugugccuauugg

SEQ ID NO: 1323329 - RNA, 19 nt, Homo sapiens
uugaagaggcaaacaguaa

SEQ ID NO: 1323330 - RNA, 19 nt, Homo sapiens
ccuuaggugugaaguuuga

SEQ ID NO: 1323331 - RNA, 19 nt, Homo sapiens
gaucuuugcaguaauuucu

SEQ ID NO: 1323332 - RNA, 19 nt, Homo sapiens
aaagaucaggacaauauga

SEQ ID NO: 1323333 - RNA, 19 nt, Homo sapiens
ggcugggccucucuucauu

SEQ ID NO: 1323334 - RNA, 19 nt, Homo sapiens
caauuggaacugccucuug

SEQ ID NO: 1323335 - RNA, 19 nt, Homo sapiens
cauaggcaggugcacguua

SEQ ID NO: 1323336 - RNA, 19 nt, Homo sapiens
uuccuuaggugugaaguuu

SEQ ID NO: 1323337 - RNA, 19 nt, Homo sapiens
ccuaguuccucacagucua

SEQ ID NO: 1323338 - RNA, 19 nt, Homo sapiens
uggagaaaccaguugauug

SEQ ID NO: 1323339 - RNA, 19 nt, Homo sapiens
acucagcugugcuuucaug

SEQ ID NO: 1323340 - RNA, 19 nt, Homo sapiens
gcucugcauguuuccauuu

SEQ ID NO: 1323341 - RNA, 19 nt, Homo sapiens
gcgcuugcccuuaaagaag

SEQ ID NO: 1323342 - RNA, 19 nt, Homo sapiens
uuguugaucuuugcaguaa

SEQ ID NO: 1323343 - RNA, 19 nt, Homo sapiens
gaaacgaacgguguugaac

SEQ ID NO: 1323344 - RNA, 19 nt, Homo sapiens
gacacaaacaccugaguag

SEQ ID NO: 1323345 - RNA, 19 nt, Homo sapiens
gaaguucaagguggugaga

SEQ ID NO: 1323346 - RNA, 19 nt, Homo sapiens
ccacuuguguuuucuguuc

SEQ ID NO: 1323347 - RNA, 19 nt, Homo sapiens
guacauccuccaaauuguc

SEQ ID NO: 1323348 - RNA, 19 nt, Homo sapiens
gauauuuaagggaacucua

SEQ ID NO: 1323349 - RNA, 19 nt, Homo sapiens
gcaggugcacguuagucaa

SEQ ID NO: 1323350 - RNA, 19 nt, Homo sapiens
gcugggccucucuucauuu

SEQ ID NO: 1323351 - RNA, 19 nt, Homo sapiens
gagguaauugguccuuugu

SEQ ID NO: 1323352 - RNA, 19 nt, Homo sapiens
gggaaacgaacgguguuga

SEQ ID NO: 1323353 - RNA, 19 nt, Homo sapiens
aauccugucucuuugucuu

SEQ ID NO: 1323354 - RNA, 19 nt, Homo sapiens
ugaagaggcaaacaguaau

SEQ ID NO: 1323355 - RNA, 19 nt, Homo sapiens
ggaucucgugugccuauug

SEQ ID NO: 1323356 - RNA, 19 nt, Homo sapiens
aauccuaguuccucacagu

SEQ ID NO: 1323357 - RNA, 19 nt, Homo sapiens
gccaaaagaucaggacaau

SEQ ID NO: 1323358 - RNA, 19 nt, Homo sapiens
ggugcacguuagucaacaa

SEQ ID NO: 1323359 - RNA, 19 nt, Homo sapiens
caguugaauagcuuaauga

SEQ ID NO: 1323360 - RNA, 19 nt, Homo sapiens
uuaaaauccugucucuuug

SEQ ID NO: 1323361 - RNA, 19 nt, Homo sapiens
gagggacuccagaaguuca

SEQ ID NO: 1323362 - RNA, 19 nt, Homo sapiens
ucaggacaauaugacuuga

SEQ ID NO: 1323363 - RNA, 19 nt, Homo sapiens
guuguugaucuuugcagua

SEQ ID NO: 1323364 - RNA, 19 nt, Homo sapiens
ucucuuugucuuaccauaa

SEQ ID NO: 1323365 - RNA, 19 nt, Homo sapiens
cuaauuggagaaaccaguu

SEQ ID NO: 1323366 - RNA, 19 nt, Homo sapiens
guacucagccaaaagauca

SEQ ID NO: 1323367 - RNA, 19 nt, Homo sapiens
uuaguacauccuccaaauu

SEQ ID NO: 1323368 - RNA, 19 nt, Homo sapiens
ggacuccaagagaaacuca

SEQ ID NO: 1323369 - RNA, 19 nt, Homo sapiens
cuguuuauguuuggaggua

SEQ ID NO: 1323370 - RNA, 19 nt, Homo sapiens
uaaggccugaguucccaua

SEQ ID NO: 1323371 - RNA, 19 nt, Homo sapiens
ucccugcucugcauguuuc

SEQ ID NO: 1323372 - RNA, 19 nt, Homo sapiens
guuuauguuuggagguaau

SEQ ID NO: 1323373 - RNA, 19 nt, Homo sapiens
ucuacuggguuguugaucu

SEQ ID NO: 1323374 - RNA, 19 nt, Homo sapiens
aggacaauaugacuugagu

SEQ ID NO: 1323375 - RNA, 19 nt, Homo sapiens
ggagggugacaaggaagaa

SEQ ID NO: 1323376 - RNA, 19 nt, Homo sapiens
uaauugguccuuuguccau

SEQ ID NO: 1323377 - RNA, 19 nt, Homo sapiens
cuaggagcuguuuauguuu

SEQ ID NO: 1323378 - RNA, 19 nt, Homo sapiens
uaauuucuaggagcuguuu

SEQ ID NO: 1323379 - RNA, 19 nt, Homo sapiens
uagcgcuucaugcuuagua

SEQ ID NO: 1323380 - RNA, 19 nt, Homo sapiens
auaggcaggugcacguuag

SEQ ID NO: 1323381 - RNA, 19 nt, Homo sapiens
gccacuacuuugaaaccau

SEQ ID NO: 1323382 - RNA, 19 nt, Homo sapiens
cuucuuccuucacaauuag

SEQ ID NO: 1323383 - RNA, 19 nt, Homo sapiens
caaagaagcuugugaagga

SEQ ID NO: 1323384 - RNA, 19 nt, Homo sapiens
ggagagagaucuucaagga

SEQ ID NO: 1323385 - RNA, 19 nt, Homo sapiens
gcagaaagcucuaagugau

SEQ ID NO: 1323386 - RNA, 19 nt, Homo sapiens
gaacuuagacucuguuaau

SEQ ID NO: 1323387 - RNA, 19 nt, Homo sapiens
gggaagcguuuacagauaa

SEQ ID NO: 1323388 - RNA, 19 nt, Homo sapiens
ggaagagauugcugaauug

SEQ ID NO: 1323389 - RNA, 19 nt, Homo sapiens
gcaauaagcuuggcugagu

SEQ ID NO: 1323390 - RNA, 19 nt, Homo sapiens
gagcaaauguuguauaagg

SEQ ID NO: 1323391 - RNA, 19 nt, Homo sapiens
caaagcagauccuaaaaua

SEQ ID NO: 1323392 - RNA, 19 nt, Homo sapiens
ugaagaaacuggaacucua

SEQ ID NO: 1323393 - RNA, 19 nt, Homo sapiens
gacagaaacugaaagacuu

SEQ ID NO: 1323394 - RNA, 19 nt, Homo sapiens
cccaagaacugcucuauga

SEQ ID NO: 1323395 - RNA, 19 nt, Homo sapiens
aaagacagcuugaagaauc

SEQ ID NO: 1323396 - RNA, 19 nt, Homo sapiens
ggaugaagcugagaugaug

SEQ ID NO: 1323397 - RNA, 19 nt, Homo sapiens
gcaauagacgggcacauaa

SEQ ID NO: 1323398 - RNA, 19 nt, Homo sapiens
gcuagagacucaaacgaaa

SEQ ID NO: 1323399 - RNA, 19 nt, Homo sapiens
gggaacagaugcuggagaa

SEQ ID NO: 1323400 - RNA, 19 nt, Homo sapiens
ggaaaaguguugcccguua

SEQ ID NO: 1323401 - RNA, 19 nt, Homo sapiens
ccagagaaaucagaacaaa

SEQ ID NO: 1323402 - RNA, 19 nt, Homo sapiens
guaaagacagcuugaagaa

SEQ ID NO: 1323403 - RNA, 19 nt, Homo sapiens
gcagugcauuuccuuagaa

SEQ ID NO: 1323404 - RNA, 19 nt, Homo sapiens
aggaagagauugcugaauu

SEQ ID NO: 1323405 - RNA, 19 nt, Homo sapiens
gcaauuucaugguguuuca

SEQ ID NO: 1323406 - RNA, 19 nt, Homo sapiens
ggauucaccuugaggaaau

SEQ ID NO: 1323407 - RNA, 19 nt, Homo sapiens
gaaacuggaacucuacaaa

SEQ ID NO: 1323408 - RNA, 19 nt, Homo sapiens
aauauagggugcaguguaa

SEQ ID NO: 1323409 - RNA, 19 nt, Homo sapiens
gcgaacaguugucuccaaa

SEQ ID NO: 1323410 - RNA, 19 nt, Homo sapiens
ucagcuugcuuuaucauuu

SEQ ID NO: 1323411 - RNA, 19 nt, Homo sapiens
ugaaugacuuggaggcuuu

SEQ ID NO: 1323412 - RNA, 19 nt, Homo sapiens
uggagcaaauguuguauaa

SEQ ID NO: 1323413 - RNA, 19 nt, Homo sapiens
ugaaagacuuggagcaaau

SEQ ID NO: 1323414 - RNA, 19 nt, Homo sapiens
gaugaugcuuguauggaaa

SEQ ID NO: 1323415 - RNA, 19 nt, Homo sapiens
cuggagaagugaccuauuu

SEQ ID NO: 1323416 - RNA, 19 nt, Homo sapiens
cagaaucucuuggcucuug

SEQ ID NO: 1323417 - RNA, 19 nt, Homo sapiens
gaaguagaaggcuuuaaga

SEQ ID NO: 1323418 - RNA, 19 nt, Homo sapiens
ggagagcagaccaaacuuu

SEQ ID NO: 1323419 - RNA, 19 nt, Homo sapiens
gcagagggaggaagagauu

SEQ ID NO: 1323420 - RNA, 19 nt, Homo sapiens
gaacaguugucuccaaacg

SEQ ID NO: 1323421 - RNA, 19 nt, Homo sapiens
caucacaaccugucacauu

SEQ ID NO: 1323422 - RNA, 19 nt, Homo sapiens
gaaugaacuuagacucugu

SEQ ID NO: 1323423 - RNA, 19 nt, Homo sapiens
aagaagaacuugcccgaau

SEQ ID NO: 1323424 - RNA, 19 nt, Homo sapiens
ucagggagcuagaagacaa

SEQ ID NO: 1323425 - RNA, 19 nt, Homo sapiens
gaugaaaacuuaggaagaa

SEQ ID NO: 1323426 - RNA, 19 nt, Homo sapiens
uggaggcuuucauuauuua

SEQ ID NO: 1323427 - RNA, 19 nt, Homo sapiens
aaggagaacugaagaaucu

SEQ ID NO: 1323428 - RNA, 19 nt, Homo sapiens
ggaaguagaaggcuuuaag

SEQ ID NO: 1323429 - RNA, 19 nt, Homo sapiens
gcagaaagcgaacaguugu

SEQ ID NO: 1323430 - RNA, 19 nt, Homo sapiens
gaacagaugcuggagaagu

SEQ ID NO: 1323431 - RNA, 19 nt, Homo sapiens
ggagcuagaagacaagaaa

SEQ ID NO: 1323432 - RNA, 19 nt, Homo sapiens
gcauaaacuugaaugugau

SEQ ID NO: 1323433 - RNA, 19 nt, Homo sapiens
caaacgaaauguccaucug

SEQ ID NO: 1323434 - RNA, 19 nt, Homo sapiens
guggugguauucauuauug

SEQ ID NO: 1323435 - RNA, 19 nt, Homo sapiens
agaagaacuugcccgaauu

SEQ ID NO: 1323436 - RNA, 19 nt, Homo sapiens
caauauagggugcagugua

SEQ ID NO: 1323437 - RNA, 19 nt, Homo sapiens
uaugagagcaccaaagauu

SEQ ID NO: 1323438 - RNA, 19 nt, Homo sapiens
gaaaaugaccgacugagaa

SEQ ID NO: 1323439 - RNA, 19 nt, Homo sapiens
agcauaaacuugaauguga

SEQ ID NO: 1323440 - RNA, 19 nt, Homo sapiens
gaaggacagcauaaacuug

SEQ ID NO: 1323441 - RNA, 19 nt, Homo sapiens
gagcagagccugaauuacg

SEQ ID NO: 1323442 - RNA, 19 nt, Homo sapiens
ugacuagaguggugguauu

SEQ ID NO: 1323443 - RNA, 19 nt, Homo sapiens
ggaagaagguauuuugcaa

SEQ ID NO: 1323444 - RNA, 19 nt, Homo sapiens
cuuggaggcuuucauuauu

SEQ ID NO: 1323445 - RNA, 19 nt, Homo sapiens
auacucagcuugcuuuauc

SEQ ID NO: 1323446 - RNA, 19 nt, Homo sapiens
agaaagcucuaagugauau

SEQ ID NO: 1323447 - RNA, 19 nt, Homo sapiens
aaucuuaagucgaaagugu

SEQ ID NO: 1323448 - RNA, 19 nt, Homo sapiens
gaagaacuugcccgaauuc

SEQ ID NO: 1323449 - RNA, 19 nt, Homo sapiens
caagaacugcucuaugaga

SEQ ID NO: 1323450 - RNA, 19 nt, Homo sapiens
ccaaagagacauacagaca

SEQ ID NO: 1323451 - RNA, 19 nt, Homo sapiens
cagaaagcucuaagugaua

SEQ ID NO: 1323452 - RNA, 19 nt, Homo sapiens
aaugaggacuugcugaaga

SEQ ID NO: 1323453 - RNA, 19 nt, Homo sapiens
agaaggcagugaugaugaa

SEQ ID NO: 1323454 - RNA, 19 nt, Homo sapiens
ucaaggaucgcacuaacaa

SEQ ID NO: 1323455 - RNA, 19 nt, Homo sapiens
gaagaaacuggaacucuac

SEQ ID NO: 1323456 - RNA, 19 nt, Homo sapiens
uagaaggcuuuaagacaga

SEQ ID NO: 1323457 - RNA, 19 nt, Homo sapiens
gaggugugcuucuugaaac

SEQ ID NO: 1323458 - RNA, 19 nt, Homo sapiens
gagaaugaacuuagacucu

SEQ ID NO: 1323459 - RNA, 19 nt, Homo sapiens
ggaucgcacuaacaagaug

SEQ ID NO: 1323460 - RNA, 19 nt, Homo sapiens
gaaaaguguugcccguuau

SEQ ID NO: 1323461 - RNA, 19 nt, Homo sapiens
gagagcagaccaaacuuuc

SEQ ID NO: 1323462 - RNA, 19 nt, Homo sapiens
agaagaccaucgagagaga

SEQ ID NO: 1323463 - RNA, 19 nt, Homo sapiens
gaaggcagcacaucacaac

SEQ ID NO: 1323464 - RNA, 19 nt, Homo sapiens
ggaagcguuuacagauaau

SEQ ID NO: 1323465 - RNA, 19 nt, Homo sapiens
gugcauuuccuuagaagaa

SEQ ID NO: 1323466 - RNA, 19 nt, Homo sapiens
aaucaaagagcuaaccaaa

SEQ ID NO: 1323467 - RNA, 19 nt, Homo sapiens
acagacggauucaccuuga

SEQ ID NO: 1323468 - RNA, 19 nt, Homo sapiens
uauccaggcuguaggugaa

SEQ ID NO: 1323469 - RNA, 19 nt, Homo sapiens
caaagucaccauucuccaa

SEQ ID NO: 1323470 - RNA, 19 nt, Homo sapiens
gaacaaaaucaaagagcua

SEQ ID NO: 1323471 - RNA, 19 nt, Homo sapiens
ggacagacggauucaccuu

SEQ ID NO: 1323472 - RNA, 19 nt, Homo sapiens
ccaaacuccauccuucuaa

SEQ ID NO: 1323473 - RNA, 19 nt, Homo sapiens
gcugagaugaugcuuguau

SEQ ID NO: 1323474 - RNA, 19 nt, Homo sapiens
ggaccacuaggaaagcuuu

SEQ ID NO: 1323475 - RNA, 19 nt, Homo sapiens
uguuuggucuggagaauga

SEQ ID NO: 1323476 - RNA, 19 nt, Homo sapiens
uagacgggcacauaagaua

SEQ ID NO: 1323477 - RNA, 19 nt, Homo sapiens
gcauuuccuuagaagaaga

SEQ ID NO: 1323478 - RNA, 19 nt, Homo sapiens
agaugaugcuuguauggaa

SEQ ID NO: 1323479 - RNA, 19 nt, Homo sapiens
cagauucacuggagucaac

SEQ ID NO: 1323480 - RNA, 19 nt, Homo sapiens
ugacuuggaggcuuucauu

SEQ ID NO: 1323481 - RNA, 19 nt, Homo sapiens
caaacuccauccuucuaag

SEQ ID NO: 1323482 - RNA, 19 nt, Homo sapiens
ggggaagcguuuacagaua

SEQ ID NO: 1323483 - RNA, 19 nt, Homo sapiens
gaucagaaguugaggagaa

SEQ ID NO: 1323484 - RNA, 19 nt, Homo sapiens
caguagaaguugcaucuua

SEQ ID NO: 1323485 - RNA, 19 nt, Homo sapiens
gaagaaaucgguccugaug

SEQ ID NO: 1323486 - RNA, 19 nt, Homo sapiens
gaaaggagguauucgaacu

SEQ ID NO: 1323487 - RNA, 19 nt, Homo sapiens
ccaaacagccuaaagaaug

SEQ ID NO: 1323488 - RNA, 19 nt, Homo sapiens
gaaccacagugagaagaaa

SEQ ID NO: 1323489 - RNA, 19 nt, Homo sapiens
caaacagccuaaagaaugu

SEQ ID NO: 1323490 - RNA, 19 nt, Homo sapiens
uacagaagcugaugaagga

SEQ ID NO: 1323491 - RNA, 19 nt, Homo sapiens
gauggacauucccgagaua

SEQ ID NO: 1323492 - RNA, 19 nt, Homo sapiens
gaacugaaccugccagacu

SEQ ID NO: 1323493 - RNA, 19 nt, Homo sapiens
uuacugauguucuugcaaa

SEQ ID NO: 1323494 - RNA, 19 nt, Homo sapiens
gcagacgcuuggugauuga

SEQ ID NO: 1323495 - RNA, 19 nt, Homo sapiens
gaaaugaaacuguccuuuu

SEQ ID NO: 1323496 - RNA, 19 nt, Homo sapiens
ugcaagcacucaguaaaua

SEQ ID NO: 1323497 - RNA, 19 nt, Homo sapiens
cuaagucuguguccuaaug

SEQ ID NO: 1323498 - RNA, 19 nt, Homo sapiens
ggacauucccgagauaaga

SEQ ID NO: 1323499 - RNA, 19 nt, Homo sapiens
ggagacggcaaaguuauaa

SEQ ID NO: 1323500 - RNA, 19 nt, Homo sapiens
ggaagaaccacagugagaa

SEQ ID NO: 1323501 - RNA, 19 nt, Homo sapiens
gauaagaaaggagguauuc

SEQ ID NO: 1323502 - RNA, 19 nt, Homo sapiens
cuaaugaagauuccaguuu

SEQ ID NO: 1323503 - RNA, 19 nt, Homo sapiens
cagaggagacggcaaaguu

SEQ ID NO: 1323504 - RNA, 19 nt, Homo sapiens
gcaagcacucaguaaauau

SEQ ID NO: 1323505 - RNA, 19 nt, Homo sapiens
gaaaagagaauaccaccaa

SEQ ID NO: 1323506 - RNA, 19 nt, Homo sapiens
gaaggagacacagaaguga

SEQ ID NO: 1323507 - RNA, 19 nt, Homo sapiens
uuaauugugucaacagaug

SEQ ID NO: 1323508 - RNA, 19 nt, Homo sapiens
ggagagaucagaaguugag

SEQ ID NO: 1323509 - RNA, 19 nt, Homo sapiens
aaaccaaacagccuaaaga

SEQ ID NO: 1323510 - RNA, 19 nt, Homo sapiens
acagauggaucacuggaau

SEQ ID NO: 1323511 - RNA, 19 nt, Homo sapiens
gacuggaacuggagagauc

SEQ ID NO: 1323512 - RNA, 19 nt, Homo sapiens
gucgagaccugagcugaaa

SEQ ID NO: 1323513 - RNA, 19 nt, Homo sapiens
agaggagacggcaaaguua

SEQ ID NO: 1323514 - RNA, 19 nt, Homo sapiens
ccucaaggccaaugauuug

SEQ ID NO: 1323515 - RNA, 19 nt, Homo sapiens
gcaggagacaguuccaguu

SEQ ID NO: 1323516 - RNA, 19 nt, Homo sapiens
uuaggucgaugacagcauu

SEQ ID NO: 1323517 - RNA, 19 nt, Homo sapiens
aggguuaccugaagaccua

SEQ ID NO: 1323518 - RNA, 19 nt, Homo sapiens
uaagaaaggagguauucga

SEQ ID NO: 1323519 - RNA, 19 nt, Homo sapiens
gaacuggagagaucagaag

SEQ ID NO: 1323520 - RNA, 19 nt, Homo sapiens
aguagaaguugcaucuuau

SEQ ID NO: 1323521 - RNA, 19 nt, Homo sapiens
gaggagacggcaaaguuau

SEQ ID NO: 1323522 - RNA, 19 nt, Homo sapiens
gaagaaccacagugagaag

SEQ ID NO: 1323523 - RNA, 19 nt, Homo sapiens
aaaugaaacuguccuuuug

SEQ ID NO: 1323524 - RNA, 19 nt, Homo sapiens
cuggagagaucagaaguug

SEQ ID NO: 1323525 - RNA, 19 nt, Homo sapiens
gacgcuuggugauugaauu

SEQ ID NO: 1323526 - RNA, 19 nt, Homo sapiens
guagaaguugcaucuuauu

SEQ ID NO: 1323527 - RNA, 19 nt, Homo sapiens
gguauucgaacuucuggaa

SEQ ID NO: 1323528 - RNA, 19 nt, Homo sapiens
agucuuuccucauaccuaa

SEQ ID NO: 1323529 - RNA, 19 nt, Homo sapiens
cucacagucuuuccucaua

SEQ ID NO: 1323530 - RNA, 19 nt, Homo sapiens
ggugauugaauuagaagaa

SEQ ID NO: 1323531 - RNA, 19 nt, Homo sapiens
gcuuggugauugaauuaga

SEQ ID NO: 1323532 - RNA, 19 nt, Homo sapiens
uauucgaacuucuggaaau

SEQ ID NO: 1323533 - RNA, 19 nt, Homo sapiens
gaaguugaggagaaugaug

SEQ ID NO: 1323534 - RNA, 19 nt, Homo sapiens
gccaaugauuugacucaca

SEQ ID NO: 1323535 - RNA, 19 nt, Homo sapiens
agaagcugaugaaggacua

SEQ ID NO: 1323536 - RNA, 19 nt, Homo sapiens
gacauucccgagauaagaa

SEQ ID NO: 1323537 - RNA, 19 nt, Homo sapiens
ggagacaguuccaguuccu

SEQ ID NO: 1323538 - RNA, 19 nt, Homo sapiens
ggaacuggagagaucagaa

SEQ ID NO: 1323539 - RNA, 19 nt, Homo sapiens
agaaaucgguccugaugcu

SEQ ID NO: 1323540 - RNA, 19 nt, Homo sapiens
gcuuugagacaacgugauu

SEQ ID NO: 1323541 - RNA, 19 nt, Homo sapiens
cagcagacgcuuggugauu

SEQ ID NO: 1323542 - RNA, 19 nt, Homo sapiens
gcugaugaaggacuauuau

SEQ ID NO: 1323543 - RNA, 19 nt, Homo sapiens
uccuguaccuucagagaaa

SEQ ID NO: 1323544 - RNA, 19 nt, Homo sapiens
ggaaaugggagugcucagu

SEQ ID NO: 1323545 - RNA, 19 nt, Homo sapiens
agaaggagacacagaagug

SEQ ID NO: 1323546 - RNA, 19 nt, Homo sapiens
ggguaaaacuuaggaagaa

SEQ ID NO: 1323547 - RNA, 19 nt, Homo sapiens
gauacaaccaaaggaaaga

SEQ ID NO: 1323548 - RNA, 19 nt, Homo sapiens
ugaaggagaaggagacaca

SEQ ID NO: 1323549 - RNA, 19 nt, Homo sapiens
uuaggaagaaccacaguga

SEQ ID NO: 1323550 - RNA, 19 nt, Homo sapiens
ugaauuagaagaacugaac

SEQ ID NO: 1323551 - RNA, 19 nt, Homo sapiens
gagaaggagacacagaagu

SEQ ID NO: 1323552 - RNA, 19 nt, Homo sapiens
ggagguauucgaacuucug

SEQ ID NO: 1323553 - RNA, 19 nt, Homo sapiens
gagauaagaaaggagguau

SEQ ID NO: 1323554 - RNA, 19 nt, Homo sapiens
ugauggacauucccgagau

SEQ ID NO: 1323555 - RNA, 19 nt, Homo sapiens
cagaaguugaggagaauga

SEQ ID NO: 1323556 - RNA, 19 nt, Homo sapiens
aaagagaauaccaccaaga

SEQ ID NO: 1323557 - RNA, 19 nt, Homo sapiens
aagaaaggagguauucgaa

SEQ ID NO: 1323558 - RNA, 19 nt, Homo sapiens
cagcagcccagaagcauca

SEQ ID NO: 1323559 - RNA, 19 nt, Homo sapiens
ggagaaggagacacagaag

SEQ ID NO: 1323560 - RNA, 19 nt, Homo sapiens
caaggccaaugauuugacu

SEQ ID NO: 1323561 - RNA, 19 nt, Homo sapiens
uaaaguaucaccggcuugu

SEQ ID NO: 1323562 - RNA, 19 nt, Homo sapiens
agguaaaguugcuggagaa

SEQ ID NO: 1323563 - RNA, 19 nt, Homo sapiens
ucacagucuuuccucauac

SEQ ID NO: 1323564 - RNA, 19 nt, Homo sapiens
cgagauaagaaaggaggua

SEQ ID NO: 1323565 - RNA, 19 nt, Homo sapiens
ggaaaagaagaaagaagaa

SEQ ID NO: 1323566 - RNA, 19 nt, Homo sapiens
ugaaauggcagacgaucuc

SEQ ID NO: 1323567 - RNA, 19 nt, Homo sapiens
cucaguaaauaucagcaaa

SEQ ID NO: 1323568 - RNA, 19 nt, Homo sapiens
caagcacucaguaaauauc

SEQ ID NO: 1323569 - RNA, 19 nt, Homo sapiens
ugaggagaaugauggacau

SEQ ID NO: 1323570 - RNA, 19 nt, Homo sapiens
aaccaaacagccuaaagaa

SEQ ID NO: 1323571 - RNA, 19 nt, Homo sapiens
cugaagaccuacagaagcu

SEQ ID NO: 1323572 - RNA, 19 nt, Homo sapiens
ugacucugauacauugcaa

SEQ ID NO: 1323573 - RNA, 19 nt, Homo sapiens
uugcaaagcacauaaaggu

SEQ ID NO: 1323574 - RNA, 19 nt, Homo sapiens
aggaagaaccacagugaga

SEQ ID NO: 1323575 - RNA, 19 nt, Homo sapiens
cuuggugauugaauuagaa

SEQ ID NO: 1323576 - RNA, 19 nt, Homo sapiens
caggagacaguuccaguuc

SEQ ID NO: 1323577 - RNA, 19 nt, Homo sapiens
agaaaugaaacuguccuuu

SEQ ID NO: 1323578 - RNA, 19 nt, Homo sapiens
gagacggcaaaguuauaaa

SEQ ID NO: 1323579 - RNA, 19 nt, Homo sapiens
agcagacgcuuggugauug

SEQ ID NO: 1323580 - RNA, 19 nt, Homo sapiens
cugaugaaggacuauuaua

SEQ ID NO: 1323581 - RNA, 19 nt, Homo sapiens
aggagacggcaaaguuaua

SEQ ID NO: 1323582 - RNA, 19 nt, Homo sapiens
acgcuuggugauugaauua

SEQ ID NO: 1323583 - RNA, 19 nt, Homo sapiens
ccaaacagcucuacauuau

SEQ ID NO: 1323584 - RNA, 19 nt, Homo sapiens
aaaccaagcuucuuugauu

SEQ ID NO: 1323585 - RNA, 19 nt, Homo sapiens
gaauauaucgcaguaguua

SEQ ID NO: 1323586 - RNA, 19 nt, Homo sapiens
caacauagagcugacauua

SEQ ID NO: 1323587 - RNA, 19 nt, Homo sapiens
gcaggaauauaucgcagua

SEQ ID NO: 1323588 - RNA, 19 nt, Homo sapiens
ggaaagcacuuggugauuc

SEQ ID NO: 1323589 - RNA, 19 nt, Homo sapiens
agacauggcuucaucauuc

SEQ ID NO: 1323590 - RNA, 19 nt, Homo sapiens
ggucaaaguuggaaauugu

SEQ ID NO: 1323591 - RNA, 19 nt, Homo sapiens
gaaagcacuuggugauuca

SEQ ID NO: 1323592 - RNA, 19 nt, Homo sapiens
ccaaagccaucaaaucgaa

SEQ ID NO: 1323593 - RNA, 19 nt, Homo sapiens
gccaagcaaugcaggaaua

SEQ ID NO: 1323594 - RNA, 19 nt, Homo sapiens
guacaaacaggucaaaguu

SEQ ID NO: 1323595 - RNA, 19 nt, Homo sapiens
uagcauaaggcuuccauua

SEQ ID NO: 1323596 - RNA, 19 nt, Homo sapiens
gccaaacagcucuacauua

SEQ ID NO: 1323597 - RNA, 19 nt, Homo sapiens
aaacagcucuacauuaugc

SEQ ID NO: 1323598 - RNA, 19 nt, Homo sapiens
ggacauaaggaacuaguca

SEQ ID NO: 1323599 - RNA, 19 nt, Homo sapiens
acauagagcugacauuaac

SEQ ID NO: 1323600 - RNA, 19 nt, Homo sapiens
ggaacuagucacaguguug

SEQ ID NO: 1323601 - RNA, 19 nt, Homo sapiens
uggccgagcuguuugagaa

SEQ ID NO: 1323602 - RNA, 19 nt, Homo sapiens
aaacugcagucuguaauag

SEQ ID NO: 1323603 - RNA, 19 nt, Homo sapiens
ccugugaguuucuggauau

SEQ ID NO: 1323604 - RNA, 19 nt, Homo sapiens
ggacaaugaaggccaaaca

SEQ ID NO: 1323605 - RNA, 19 nt, Homo sapiens
gaaaacaacauugaccaua

SEQ ID NO: 1323606 - RNA, 19 nt, Homo sapiens
uaaaaucaguucuguggaa

SEQ ID NO: 1323607 - RNA, 19 nt, Homo sapiens
caucagggaagaagacaaa

SEQ ID NO: 1323608 - RNA, 19 nt, Homo sapiens
aaccaagcuucuuugauuu

SEQ ID NO: 1323609 - RNA, 19 nt, Homo sapiens
gugaguuucuggauauugu

SEQ ID NO: 1323610 - RNA, 19 nt, Homo sapiens
uaaccaaagccaucaaauc

SEQ ID NO: 1323611 - RNA, 19 nt, Homo sapiens
ggaauauaucgcaguaguu

SEQ ID NO: 1323612 - RNA, 19 nt, Homo sapiens
uggcaaggcuuaaucaaaa

SEQ ID NO: 1323613 - RNA, 19 nt, Homo sapiens
acacaacuggcaaggcuua

SEQ ID NO: 1323614 - RNA, 19 nt, Homo sapiens
ggaaauuguaauacuccua

SEQ ID NO: 1323615 - RNA, 19 nt, Homo sapiens
ggaggugacaggcugcaaa

SEQ ID NO: 1323616 - RNA, 19 nt, Homo sapiens
ggaugugaaugugaaagau

SEQ ID NO: 1323617 - RNA, 19 nt, Homo sapiens
ucagauaccagagaagaaa

SEQ ID NO: 1323618 - RNA, 19 nt, Homo sapiens
ggccaaacagcucuacauu

SEQ ID NO: 1323619 - RNA, 19 nt, Homo sapiens
auaaggaacuagucacagu

SEQ ID NO: 1323620 - RNA, 19 nt, Homo sapiens
aagcaaugcaggaauauau

SEQ ID NO: 1323621 - RNA, 19 nt, Homo sapiens
aggcuuccauuaugaaaga

SEQ ID NO: 1323622 - RNA, 19 nt, Homo sapiens
gagacauggcuucaucauu

SEQ ID NO: 1323623 - RNA, 19 nt, Homo sapiens
ggaaaacugcagucuguaa

SEQ ID NO: 1323624 - RNA, 19 nt, Homo sapiens
ucaaaagacuggaaaacug

SEQ ID NO: 1323625 - RNA, 19 nt, Homo sapiens
gccugugaguuucuggaua

SEQ ID NO: 1323626 - RNA, 19 nt, Homo sapiens
aaggagacauggcuucauc

SEQ ID NO: 1323627 - RNA, 19 nt, Homo sapiens
gaaaggaaaagaagcaaau

SEQ ID NO: 1323628 - RNA, 19 nt, Homo sapiens
gcaaggagacauggcuuca

SEQ ID NO: 1323629 - RNA, 19 nt, Homo sapiens
caacuggcaaggcuuaauc

SEQ ID NO: 1323630 - RNA, 19 nt, Homo sapiens
gguacaaacaggucaaagu

SEQ ID NO: 1323631 - RNA, 19 nt, Homo sapiens
uaccagagaagaaaggaaa

SEQ ID NO: 1323632 - RNA, 19 nt, Homo sapiens
caagcaaugcaggaauaua

SEQ ID NO: 1323633 - RNA, 19 nt, Homo sapiens
ccacccgucuuugguaugu

SEQ ID NO: 1323634 - RNA, 19 nt, Homo sapiens
gcaccugcaaggccugauu

SEQ ID NO: 1323635 - RNA, 19 nt, Homo sapiens
gaugugaaugugaaagaug

SEQ ID NO: 1323636 - RNA, 19 nt, Homo sapiens
ccaguuauuaguucucuau

SEQ ID NO: 1323637 - RNA, 19 nt, Homo sapiens
aggaauauaucgcaguagu

SEQ ID NO: 1323638 - RNA, 19 nt, Homo sapiens
caaacagcucuacauuaug

SEQ ID NO: 1323639 - RNA, 19 nt, Homo sapiens
aagaaaccaucagggaaga

SEQ ID NO: 1323640 - RNA, 19 nt, Homo sapiens
gcaacauagagcugacauu

SEQ ID NO: 1323641 - RNA, 19 nt, Homo sapiens
ucgaggacauaaggaacua

SEQ ID NO: 1323642 - RNA, 19 nt, Homo sapiens
caacauugaccauauaacc

SEQ ID NO: 1323643 - RNA, 19 nt, Homo sapiens
guuggaaauuguaauacuc

SEQ ID NO: 1323644 - RNA, 19 nt, Homo sapiens
uuugguauguauuggcuaa

SEQ ID NO: 1323645 - RNA, 19 nt, Homo sapiens
gaaugugaaagaugaagag

SEQ ID NO: 1323646 - RNA, 19 nt, Homo sapiens
aagaagcaaauacagguuu

SEQ ID NO: 1323647 - RNA, 19 nt, Homo sapiens
cuaaaccaagcuucuuuga

SEQ ID NO: 1323648 - RNA, 19 nt, Homo sapiens
ugcagucuguaauagcaua

SEQ ID NO: 1323649 - RNA, 19 nt, Homo sapiens
cauugaccauauaaccaaa

SEQ ID NO: 1323650 - RNA, 19 nt, Homo sapiens
gaaaccaucagggaagaag

SEQ ID NO: 1323651 - RNA, 19 nt, Homo sapiens
gaagaaaggaaaagaagca

SEQ ID NO: 1323652 - RNA, 19 nt, Homo sapiens
aaauguggaugugaaugug

SEQ ID NO: 1323653 - RNA, 19 nt, Homo sapiens
agguuggaauccucagaua

SEQ ID NO: 1323654 - RNA, 19 nt, Homo sapiens
gagcgagcaaggagacaug

SEQ ID NO: 1323655 - RNA, 19 nt, Homo sapiens
aacauagagcugacauuaa

SEQ ID NO: 1323656 - RNA, 19 nt, Homo sapiens
ggagacauggcuucaucau

SEQ ID NO: 1323657 - RNA, 19 nt, Homo sapiens
uaaaccaagcuucuuugau

SEQ ID NO: 1323658 - RNA, 19 nt, Homo sapiens
uuugauuacugcagggaaa

SEQ ID NO: 1323659 - RNA, 19 nt, Homo sapiens
uaaggcuuccauuaugaaa

SEQ ID NO: 1323660 - RNA, 19 nt, Homo sapiens
aaacaggucaaaguuggaa

SEQ ID NO: 1323661 - RNA, 19 nt, Homo sapiens
uauaaccaaagccaucaaa

SEQ ID NO: 1323662 - RNA, 19 nt, Homo sapiens
gcagggaaaacaacauuga

SEQ ID NO: 1323663 - RNA, 19 nt, Homo sapiens
ggccuuacacccaauccaa

SEQ ID NO: 1323664 - RNA, 19 nt, Homo sapiens
gcaaugcaggaauauaucg

SEQ ID NO: 1323665 - RNA, 19 nt, Homo sapiens
uguaauacuccuaaaccaa

SEQ ID NO: 1323666 - RNA, 19 nt, Homo sapiens
gugggccaguuauuaguuc

SEQ ID NO: 1323667 - RNA, 19 nt, Homo sapiens
ggugggccaguuauuaguu

SEQ ID NO: 1323668 - RNA, 19 nt, Homo sapiens
ccucagauaccagagaaga

SEQ ID NO: 1323669 - RNA, 19 nt, Homo sapiens
gcagucuguaauagcauaa

SEQ ID NO: 1323670 - RNA, 19 nt, Homo sapiens
augugaaugugaaagauga

SEQ ID NO: 1323671 - RNA, 19 nt, Homo sapiens
caaagccaucaaaucgaaa

SEQ ID NO: 1323672 - RNA, 19 nt, Homo sapiens
aaccaaagccaucaaaucg

SEQ ID NO: 1323673 - RNA, 19 nt, Homo sapiens
gucaaaguuggaaauugua

SEQ ID NO: 1323674 - RNA, 19 nt, Homo sapiens
uacaaacaggucaaaguug

SEQ ID NO: 1323675 - RNA, 19 nt, Homo sapiens
gaaaacugcagucuguaau

SEQ ID NO: 1323676 - RNA, 19 nt, Homo sapiens
caaacaggucaaaguugga

SEQ ID NO: 1323677 - RNA, 19 nt, Homo sapiens
aaagaagcaaauacagguu

SEQ ID NO: 1323678 - RNA, 19 nt, Homo sapiens
ccuaaaccaagcuucuuug

SEQ ID NO: 1323679 - RNA, 19 nt, Homo sapiens
acauugaccauauaaccaa

SEQ ID NO: 1323680 - RNA, 19 nt, Homo sapiens
uuuggugggccaguuauua

SEQ ID NO: 1323681 - RNA, 19 nt, Homo sapiens
gcagcucuuguaccuguau

SEQ ID NO: 1323682 - RNA, 19 nt, Homo sapiens
cauauaaccaaagccauca

SEQ ID NO: 1323683 - RNA, 19 nt, Homo sapiens
gcagaggucuuccuucaug

SEQ ID NO: 1323684 - RNA, 19 nt, Homo sapiens
ugacaaagacggcaaauau

SEQ ID NO: 1323685 - RNA, 19 nt, Homo sapiens
uguauuagcucuuuccauu

SEQ ID NO: 1323686 - RNA, 19 nt, Homo sapiens
cagaagagcaguucaaguu

SEQ ID NO: 1323687 - RNA, 19 nt, Homo sapiens
guaagaacccucaguuuca

SEQ ID NO: 1323688 - RNA, 19 nt, Homo sapiens
caaguaauccugaccuauu

SEQ ID NO: 1323689 - RNA, 19 nt, Homo sapiens
ugauacaacuuggacaaua

SEQ ID NO: 1323690 - RNA, 19 nt, Homo sapiens
guggugaccuuuauugaug

SEQ ID NO: 1323691 - RNA, 19 nt, Homo sapiens
gggagaacauuaauaucug

SEQ ID NO: 1323692 - RNA, 19 nt, Homo sapiens
gauacaacuuggacaauac

SEQ ID NO: 1323693 - RNA, 19 nt, Homo sapiens
acaaagacggcaaauauga

SEQ ID NO: 1323694 - RNA, 19 nt, Homo sapiens
gaugauguggugaccuuua

SEQ ID NO: 1323695 - RNA, 19 nt, Homo sapiens
ucaacgaaaucuccuggaa

SEQ ID NO: 1323696 - RNA, 19 nt, Homo sapiens
cggcagaggucuuccuuca

SEQ ID NO: 1323697 - RNA, 19 nt, Homo sapiens
uguuugggcuuccuaauga

SEQ ID NO: 1323698 - RNA, 19 nt, Homo sapiens
aaguaauccugaccuauuu

SEQ ID NO: 1323699 - RNA, 19 nt, Homo sapiens
ggucuguucucucggaguu

SEQ ID NO: 1323700 - RNA, 19 nt, Homo sapiens
ggacaaacuaugggaggua

SEQ ID NO: 1323701 - RNA, 19 nt, Homo sapiens
guaucaacauccucagcua

SEQ ID NO: 1323702 - RNA, 19 nt, Homo sapiens
gugggcacccuaaauauuu

SEQ ID NO: 1323703 - RNA, 19 nt, Homo sapiens
uaugggagguacaguguga

SEQ ID NO: 1323704 - RNA, 19 nt, Homo sapiens
ggauguggaugaguuagug

SEQ ID NO: 1323705 - RNA, 19 nt, Homo sapiens
aauccugaccuauuuguua

SEQ ID NO: 1323706 - RNA, 19 nt, Homo sapiens
ggaagggcauggaaguuuu

SEQ ID NO: 1323707 - RNA, 19 nt, Homo sapiens
gguagacuuuguggcauuu

SEQ ID NO: 1323708 - RNA, 19 nt, Homo sapiens
caagacacaccguuccaaa

SEQ ID NO: 1323709 - RNA, 19 nt, Homo sapiens
gacaaagacggcaaauaug

SEQ ID NO: 1323710 - RNA, 19 nt, Homo sapiens
ggucuuccuucaugugguu

SEQ ID NO: 1323711 - RNA, 19 nt, Homo sapiens
cugcaucuguaucaaguuu

SEQ ID NO: 1323712 - RNA, 19 nt, Homo sapiens
ggaauggaagggcauggaa

SEQ ID NO: 1323713 - RNA, 19 nt, Homo sapiens
ggacaauaccuaguuugga

SEQ ID NO: 1323714 - RNA, 19 nt, Homo sapiens
gcauuugccugugaugaca

SEQ ID NO: 1323715 - RNA, 19 nt, Homo sapiens
caaaaugcauugccacugu

SEQ ID NO: 1323716 - RNA, 19 nt, Homo sapiens
aaaggccucugcuggcauu

SEQ ID NO: 1323717 - RNA, 19 nt, Homo sapiens
cagcaucggaagaucauuu

SEQ ID NO: 1323718 - RNA, 19 nt, Homo sapiens
cgaaaucuccuggaacaau

SEQ ID NO: 1323719 - RNA, 19 nt, Homo sapiens
gauguggugaccuuuauug

SEQ ID NO: 1323720 - RNA, 19 nt, Homo sapiens
gcugcaguguugugaguug

SEQ ID NO: 1323721 - RNA, 19 nt, Homo sapiens
aacgaaaucuccuggaaca

SEQ ID NO: 1323722 - RNA, 19 nt, Homo sapiens
gaacugugaagcuguuugg

SEQ ID NO: 1323723 - RNA, 19 nt, Homo sapiens
gcaguguugugaguuggaa

SEQ ID NO: 1323724 - RNA, 19 nt, Homo sapiens
uguaagaacccucaguuuc

SEQ ID NO: 1323725 - RNA, 19 nt, Homo sapiens
uauuagcucuuuccauucu

SEQ ID NO: 1323726 - RNA, 19 nt, Homo sapiens
aauauguucuuccugacaa

SEQ ID NO: 1323727 - RNA, 19 nt, Homo sapiens
gcacccuaaauauuuguaa

SEQ ID NO: 1323728 - RNA, 19 nt, Homo sapiens
uuagcucuuuccauucuuu

SEQ ID NO: 1323729 - RNA, 19 nt, Homo sapiens
uaagaacccucaguuucag

SEQ ID NO: 1323730 - RNA, 19 nt, Homo sapiens
ucugggauguggaugaguu

SEQ ID NO: 1323731 - RNA, 19 nt, Homo sapiens
guuacggcgucuggagaua

SEQ ID NO: 1323732 - RNA, 19 nt, Homo sapiens
gcagaagagcaguucaagu

SEQ ID NO: 1323733 - RNA, 19 nt, Homo sapiens
gauaguguggaccagcuuu

SEQ ID NO: 1323734 - RNA, 19 nt, Homo sapiens
ggagguacagugugagucu

SEQ ID NO: 1323735 - RNA, 19 nt, Homo sapiens
uggaugaguuagugugugu

SEQ ID NO: 1323736 - RNA, 19 nt, Homo sapiens
caaauggcaaugguuguau

SEQ ID NO: 1323737 - RNA, 19 nt, Homo sapiens
caaagcagaagagcaguuc

SEQ ID NO: 1323738 - RNA, 19 nt, Homo sapiens
gggcagaccauugcuguag

SEQ ID NO: 1323739 - RNA, 19 nt, Homo sapiens
uggaagggcauggaaguuu

SEQ ID NO: 1323740 - RNA, 19 nt, Homo sapiens
uagacuuuguggcauuuga

SEQ ID NO: 1323741 - RNA, 19 nt, Homo sapiens
ggagacaggggacaaacua

SEQ ID NO: 1323742 - RNA, 19 nt, Homo sapiens
gacacaccguuccaaagca

SEQ ID NO: 1323743 - RNA, 19 nt, Homo sapiens
gggaugugaggacuacaaa

SEQ ID NO: 1323744 - RNA, 19 nt, Homo sapiens
cagcaagacgcgcgaguuc

SEQ ID NO: 1323745 - RNA, 19 nt, Homo sapiens
gacuuuguggcauuugaua

SEQ ID NO: 1323746 - RNA, 19 nt, Homo sapiens
ccuccugucuucucugcuu

SEQ ID NO: 1323747 - RNA, 19 nt, Homo sapiens
uuauugacauugcugaagu

SEQ ID NO: 1323748 - RNA, 19 nt, Homo sapiens
caacugcaucuguaucaag

SEQ ID NO: 1323749 - RNA, 19 nt, Homo sapiens
cuuggacaauaccuaguuu

SEQ ID NO: 1323750 - RNA, 19 nt, Homo sapiens
uugcuuugucuguguauua

SEQ ID NO: 1323751 - RNA, 19 nt, Homo sapiens
ccggaacugugaagcuguu

SEQ ID NO: 1323752 - RNA, 19 nt, Homo sapiens
ccaacugcaucuguaucaa

SEQ ID NO: 1323753 - RNA, 19 nt, Homo sapiens
uacggcgucuggagauaaa

SEQ ID NO: 1323754 - RNA, 19 nt, Homo sapiens
aggaugauguggugaccuu

SEQ ID NO: 1323755 - RNA, 19 nt, Homo sapiens
uugccacugugaacacuaa

SEQ ID NO: 1323756 - RNA, 19 nt, Homo sapiens
gugguuaguuuggucuguu

SEQ ID NO: 1323757 - RNA, 19 nt, Homo sapiens
gauaaaaccauucgcaucu

SEQ ID NO: 1323758 - RNA, 19 nt, Homo sapiens
gaagugcagaugcuuuggu

SEQ ID NO: 1323759 - RNA, 19 nt, Homo sapiens
ccaaagcagaagagcaguu

SEQ ID NO: 1323760 - RNA, 19 nt, Homo sapiens
ugguagacuuuguggcauu

SEQ ID NO: 1323761 - RNA, 19 nt, Homo sapiens
gcugcgcauuucguucuuu

SEQ ID NO: 1323762 - RNA, 19 nt, Homo sapiens
cggaagaucauuuuauuga

SEQ ID NO: 1323763 - RNA, 19 nt, Homo sapiens
gaugaguuaguguguguuc

SEQ ID NO: 1323764 - RNA, 19 nt, Homo sapiens
ccuuccaacugcaucugua

SEQ ID NO: 1323765 - RNA, 19 nt, Homo sapiens
aaauggcaaugguuguauc

SEQ ID NO: 1323766 - RNA, 19 nt, Homo sapiens
ccaaguaauccugaccuau

SEQ ID NO: 1323767 - RNA, 19 nt, Homo sapiens
guaauccugaccuauuugu

SEQ ID NO: 1323768 - RNA, 19 nt, Homo sapiens
caggaagugcagaugcuuu

SEQ ID NO: 1323769 - RNA, 19 nt, Homo sapiens
uccaaguaauccugaccua

SEQ ID NO: 1323770 - RNA, 19 nt, Homo sapiens
ugggcacccuaaauauuug

SEQ ID NO: 1323771 - RNA, 19 nt, Homo sapiens
ggaacugugaagcuguuug

SEQ ID NO: 1323772 - RNA, 19 nt, Homo sapiens
caaagacggcaaauaugac

SEQ ID NO: 1323773 - RNA, 19 nt, Homo sapiens
aagagcaguucaaguucga

SEQ ID NO: 1323774 - RNA, 19 nt, Homo sapiens
cuaaaggggagaacauuaa

SEQ ID NO: 1323775 - RNA, 19 nt, Homo sapiens
gaugugaggacuacaaaau

SEQ ID NO: 1323776 - RNA, 19 nt, Homo sapiens
gcauuucguucuuuugcuu

SEQ ID NO: 1323777 - RNA, 19 nt, Homo sapiens
uccuucaugugguuaguuu

SEQ ID NO: 1323778 - RNA, 19 nt, Homo sapiens
cagaggucuuccuucaugu

SEQ ID NO: 1323779 - RNA, 19 nt, Homo sapiens
gcaagacgcgcgaguuccu

SEQ ID NO: 1323780 - RNA, 19 nt, Homo sapiens
cgggaagccggaacuguga

SEQ ID NO: 1323781 - RNA, 19 nt, Homo sapiens
aaagacggcaaauaugaca

SEQ ID NO: 1323782 - RNA, 19 nt, Homo sapiens
guguggaccagcuuuguug

SEQ ID NO: 1323783 - RNA, 19 nt, Homo sapiens
aaauagagcaccaagguua

SEQ ID NO: 1323784 - RNA, 19 nt, Homo sapiens
ggaaauagagcaccaaggu

SEQ ID NO: 1323785 - RNA, 19 nt, Homo sapiens
guacagagaauauaacaca

SEQ ID NO: 1323786 - RNA, 19 nt, Homo sapiens
gugaagguauugugaguug

SEQ ID NO: 1323787 - RNA, 19 nt, Homo sapiens
gcucaauccugcaaugugu

SEQ ID NO: 1323788 - RNA, 19 nt, Homo sapiens
cagagaauauaacacaaug

SEQ ID NO: 1323789 - RNA, 19 nt, Homo sapiens
gaaauagagcaccaagguu

SEQ ID NO: 1323790 - RNA, 19 nt, Homo sapiens
ucaguuuccucguucuuaa

SEQ ID NO: 1323791 - RNA, 19 nt, Homo sapiens
caacuuguacagagaauau

SEQ ID NO: 1323792 - RNA, 19 nt, Homo sapiens
gagaauagugcauugugaa

SEQ ID NO: 1323793 - RNA, 19 nt, Homo sapiens
gaaagugggagggaaauag

SEQ ID NO: 1323794 - RNA, 19 nt, Homo sapiens
agagaauagugcauuguga

SEQ ID NO: 1323795 - RNA, 19 nt, Homo sapiens
caaguacauuugggccuaa

SEQ ID NO: 1323796 - RNA, 19 nt, Homo sapiens
uaucuuaguucucccucuu

SEQ ID NO: 1323797 - RNA, 19 nt, Homo sapiens
gagagaauagugcauugug

SEQ ID NO: 1323798 - RNA, 19 nt, Homo sapiens
guacauuugggccuaaaga

SEQ ID NO: 1323799 - RNA, 19 nt, Homo sapiens
cauuugggccuaaagauau

SEQ ID NO: 1323800 - RNA, 19 nt, Homo sapiens
acauuugggccuaaagaua

SEQ ID NO: 1323801 - RNA, 19 nt, Homo sapiens
guguggagcugucauucug

SEQ ID NO: 1323802 - RNA, 19 nt, Homo sapiens
gggccucaguuuccucguu

SEQ ID NO: 1323803 - RNA, 19 nt, Homo sapiens
ccaacugcaucgcucaauc

SEQ ID NO: 1323804 - RNA, 19 nt, Homo sapiens
gcugaaagugggagggaaa

SEQ ID NO: 1323805 - RNA, 19 nt, Homo sapiens
acacgggucucccucucuu

SEQ ID NO: 1323806 - RNA, 19 nt, Homo sapiens
uauaacacaauggcaagua

SEQ ID NO: 1323807 - RNA, 19 nt, Homo sapiens
ggucccugcuuugcauuug

SEQ ID NO: 1323808 - RNA, 19 nt, Homo sapiens
ggagagaauagugcauugu

SEQ ID NO: 1323809 - RNA, 19 nt, Homo sapiens
ugaaagugggagggaaaua

SEQ ID NO: 1323810 - RNA, 19 nt, Homo sapiens
aauagugcauugugaaggu

SEQ ID NO: 1323811 - RNA, 19 nt, Homo sapiens
aaagugggagggaaauaga

SEQ ID NO: 1323812 - RNA, 19 nt, Homo sapiens
aauagagcaccaagguuaa

SEQ ID NO: 1323813 - RNA, 19 nt, Homo sapiens
guuuccucguucuuaaaua

SEQ ID NO: 1323814 - RNA, 19 nt, Homo sapiens
cauggaauaagccagaaug

SEQ ID NO: 1323815 - RNA, 19 nt, Homo sapiens
ggugugugcucagguguac

SEQ ID NO: 1323816 - RNA, 19 nt, Homo sapiens
aagccagaaugcugaaagu

SEQ ID NO: 1323817 - RNA, 19 nt, Homo sapiens
uaacacaauggcaaguaca

SEQ ID NO: 1323818 - RNA, 19 nt, Homo sapiens
guuuguggcucaauuauua

SEQ ID NO: 1323819 - RNA, 19 nt, Homo sapiens
ccagugaccuuccauguuu

SEQ ID NO: 1323820 - RNA, 19 nt, Homo sapiens
caaauuguccuguaucuuu

SEQ ID NO: 1323821 - RNA, 19 nt, Homo sapiens
gcacauguuugaugaccua

SEQ ID NO: 1323822 - RNA, 19 nt, Homo sapiens
gaccauucccucuuucuua

SEQ ID NO: 1323823 - RNA, 19 nt, Homo sapiens
ugaccuaccucauaauuca

SEQ ID NO: 1323824 - RNA, 19 nt, Homo sapiens
uagaagcacuccaucaaga

SEQ ID NO: 1323825 - RNA, 19 nt, Homo sapiens
gaaagagucccuguaccua

SEQ ID NO: 1323826 - RNA, 19 nt, Homo sapiens
gagcagagccccuugaaaa

SEQ ID NO: 1323827 - RNA, 19 nt, Homo sapiens
gaaccacucucgaccucau

SEQ ID NO: 1323828 - RNA, 19 nt, Homo sapiens
agagcaaucuguccacuug

SEQ ID NO: 1323829 - RNA, 19 nt, Homo sapiens
ucuagugucucuucucuug

SEQ ID NO: 1323830 - RNA, 19 nt, Homo sapiens
gauauugguucucaugacu

SEQ ID NO: 1323831 - RNA, 19 nt, Homo sapiens
uaaccucucagcagcauuu

SEQ ID NO: 1323832 - RNA, 19 nt, Homo sapiens
ucuauuagucacugucuua

SEQ ID NO: 1323833 - RNA, 19 nt, Homo sapiens
ucagugauuuagcuccuuu

SEQ ID NO: 1323834 - RNA, 19 nt, Homo sapiens
gaacuccagugaccuucca

SEQ ID NO: 1323835 - RNA, 19 nt, Homo sapiens
ucuaucaaauuguccugua

SEQ ID NO: 1323836 - RNA, 19 nt, Homo sapiens
gcccacucuuucucaauuu

SEQ ID NO: 1323837 - RNA, 19 nt, Homo sapiens
gcucuagugucucuucucu

SEQ ID NO: 1323838 - RNA, 19 nt, Homo sapiens
accauucccucuuucuuaa

SEQ ID NO: 1323839 - RNA, 19 nt, Homo sapiens
gauauuauuuccuguuacc

SEQ ID NO: 1323840 - RNA, 19 nt, Homo sapiens
aagagucccuguaccuaug

SEQ ID NO: 1323841 - RNA, 19 nt, Homo sapiens
uguccuguaucuuuauuga

SEQ ID NO: 1323842 - RNA, 19 nt, Homo sapiens
cuccaugccauauuuauuu

SEQ ID NO: 1323843 - RNA, 19 nt, Homo sapiens
cauguuuguggcucaauua

SEQ ID NO: 1323844 - RNA, 19 nt, Homo sapiens
ccauguuuguggcucaauu

SEQ ID NO: 1323845 - RNA, 19 nt, Homo sapiens
uaagaacuccagugaccuu

SEQ ID NO: 1323846 - RNA, 19 nt, Homo sapiens
ucauagcucacuccaacua

SEQ ID NO: 1323847 - RNA, 19 nt, Homo sapiens
guucaucauuccacagagu

SEQ ID NO: 1323848 - RNA, 19 nt, Homo sapiens
cuaacaugcucuagugucu

SEQ ID NO: 1323849 - RNA, 19 nt, Homo sapiens
ucaauuugcuuuguucacu

SEQ ID NO: 1323850 - RNA, 19 nt, Homo sapiens
caagagccccuucauauuc

SEQ ID NO: 1323851 - RNA, 19 nt, Homo sapiens
cucagucccuuccgauuga

SEQ ID NO: 1323852 - RNA, 19 nt, Homo sapiens
cauauucccuugcaaaauc

SEQ ID NO: 1323853 - RNA, 19 nt, Homo sapiens
uucauacucuccuggguuu

SEQ ID NO: 1323854 - RNA, 19 nt, Homo sapiens
aaagagucccuguaccuau

SEQ ID NO: 1323855 - RNA, 19 nt, Homo sapiens
cuaucaaauuguccuguau

SEQ ID NO: 1323856 - RNA, 19 nt, Homo sapiens
ucccauuccucagugauuu

SEQ ID NO: 1323857 - RNA, 19 nt, Homo sapiens
acuaugauauugguucuca

SEQ ID NO: 1323858 - RNA, 19 nt, Homo sapiens
ucuagaagcacuccaucaa

SEQ ID NO: 1323859 - RNA, 19 nt, Homo sapiens
uagugucucuucucuugau

SEQ ID NO: 1323860 - RNA, 19 nt, Homo sapiens
uauugguucucaugacuuc

SEQ ID NO: 1323861 - RNA, 19 nt, Homo sapiens
ugucuuacauugucaucuc

SEQ ID NO: 1323862 - RNA, 19 nt, Homo sapiens
ugucucuucucuugauaga

SEQ ID NO: 1323863 - RNA, 19 nt, Homo sapiens
agcccacucuuucucaauu

SEQ ID NO: 1323864 - RNA, 19 nt, Homo sapiens
aggaaacuaugauauuggu

SEQ ID NO: 1323865 - RNA, 19 nt, Homo sapiens
cuucauauucccuugcaaa

SEQ ID NO: 1323866 - RNA, 19 nt, Homo sapiens
uagucacugucuuacauug

SEQ ID NO: 1323867 - RNA, 19 nt, Homo sapiens
ucagcagcauacuaacaug

SEQ ID NO: 1323868 - RNA, 19 nt, Homo sapiens
cuuucuccaugccauauuu

SEQ ID NO: 1323869 - RNA, 19 nt, Homo sapiens
uggguuuccucccucacua

SEQ ID NO: 1323870 - RNA, 19 nt, Homo sapiens
ucucagucccuuccgauug

SEQ ID NO: 1323871 - RNA, 19 nt, Homo sapiens
ucacugucuuacauuguca

SEQ ID NO: 1323872 - RNA, 19 nt, Homo sapiens
auuagucacugucuuacau

SEQ ID NO: 1323873 - RNA, 19 nt, Homo sapiens
caucaagagccccuucaua

SEQ ID NO: 1323874 - RNA, 19 nt, Homo sapiens
gucacugucuuacauuguc

SEQ ID NO: 1323875 - RNA, 19 nt, Homo sapiens
cuccaacuauucccuaucu

SEQ ID NO: 1323876 - RNA, 19 nt, Homo sapiens
uugcuuuguucacugcuuu

SEQ ID NO: 1323877 - RNA, 19 nt, Homo sapiens
ggaaacuaugauauugguu

SEQ ID NO: 1323878 - RNA, 19 nt, Homo sapiens
uagcucacuccaacuauuc

SEQ ID NO: 1323879 - RNA, 19 nt, Homo sapiens
ggaaguggcucgacucuug

SEQ ID NO: 1323880 - RNA, 19 nt, Homo sapiens
gcuaaacccuuuccaugua

SEQ ID NO: 1323881 - RNA, 19 nt, Homo sapiens
gcauguagcccuaaugaua

SEQ ID NO: 1323882 - RNA, 19 nt, Homo sapiens
cuacaagucuaucuucuuu

SEQ ID NO: 1323883 - RNA, 19 nt, Homo sapiens
gggacuaggugaccgguua

SEQ ID NO: 1323884 - RNA, 19 nt, Homo sapiens
gagaguacguagaaacuug

SEQ ID NO: 1323885 - RNA, 19 nt, Homo sapiens
uaaaugaguuucuguccaa

SEQ ID NO: 1323886 - RNA, 19 nt, Homo sapiens
gauccaaggguuuguauuu

SEQ ID NO: 1323887 - RNA, 19 nt, Homo sapiens
uaucacaucucauuugguu

SEQ ID NO: 1323888 - RNA, 19 nt, Homo sapiens
gaaaggaguaugagaugaa

SEQ ID NO: 1323889 - RNA, 19 nt, Homo sapiens
guacaugacuauuuaaagc

SEQ ID NO: 1323890 - RNA, 19 nt, Homo sapiens
gagauuaucgcauagaguu

SEQ ID NO: 1323891 - RNA, 19 nt, Homo sapiens
gaaagcauguagcccuaau

SEQ ID NO: 1323892 - RNA, 19 nt, Homo sapiens
ggauggaguuugauuuauc

SEQ ID NO: 1323893 - RNA, 19 nt, Homo sapiens
gaccugggcuggacagugu

SEQ ID NO: 1323894 - RNA, 19 nt, Homo sapiens
uguccaagcugcaagauga

SEQ ID NO: 1323895 - RNA, 19 nt, Homo sapiens
gcgagcagcuugggacauu

SEQ ID NO: 1323896 - RNA, 19 nt, Homo sapiens
cuaccuggcucuucucuug

SEQ ID NO: 1323897 - RNA, 19 nt, Homo sapiens
gaaauggaccgggaaccua

SEQ ID NO: 1323898 - RNA, 19 nt, Homo sapiens
gcaaggauggccaaaauua

SEQ ID NO: 1323899 - RNA, 19 nt, Homo sapiens
ugauugaacugcugguauu

SEQ ID NO: 1323900 - RNA, 19 nt, Homo sapiens
gauggagucuugcucuguu

SEQ ID NO: 1323901 - RNA, 19 nt, Homo sapiens
caggauggaguuugauuua

SEQ ID NO: 1323902 - RNA, 19 nt, Homo sapiens
ggaaagguguaugacauca

SEQ ID NO: 1323903 - RNA, 19 nt, Homo sapiens
ccaaagugcuggauuacag

SEQ ID NO: 1323904 - RNA, 19 nt, Homo sapiens
ugaauacuaugauguguag

SEQ ID NO: 1323905 - RNA, 19 nt, Homo sapiens
aggaugagcuaaacccuuu

SEQ ID NO: 1323906 - RNA, 19 nt, Homo sapiens
gaaugcaccuguagcuagu

SEQ ID NO: 1323907 - RNA, 19 nt, Homo sapiens
guaggacuguuuacucguu

SEQ ID NO: 1323908 - RNA, 19 nt, Homo sapiens
cauaggagguuugaaaugg

SEQ ID NO: 1323909 - RNA, 19 nt, Homo sapiens
ugaaacgaauggcagagaa

SEQ ID NO: 1323910 - RNA, 19 nt, Homo sapiens
cgaaaggaguaugagauga

SEQ ID NO: 1323911 - RNA, 19 nt, Homo sapiens
ggagugcaguggugugauc

SEQ ID NO: 1323912 - RNA, 19 nt, Homo sapiens
gcaaugaauacuaugaugu

SEQ ID NO: 1323913 - RNA, 19 nt, Homo sapiens
gaacugaagaaggccuaua

SEQ ID NO: 1323914 - RNA, 19 nt, Homo sapiens
guggugugaucucagcuua

SEQ ID NO: 1323915 - RNA, 19 nt, Homo sapiens
gauacugugcugaguguaa

SEQ ID NO: 1323916 - RNA, 19 nt, Homo sapiens
gaaagcauaggagguuuga

SEQ ID NO: 1323917 - RNA, 19 nt, Homo sapiens
gagacuggaaacugaauuu

SEQ ID NO: 1323918 - RNA, 19 nt, Homo sapiens
ggcaaugaauacuaugaug

SEQ ID NO: 1323919 - RNA, 19 nt, Homo sapiens
ggucauguuucaguuucua

SEQ ID NO: 1323920 - RNA, 19 nt, Homo sapiens
gggucaagcagaauauuaa

SEQ ID NO: 1323921 - RNA, 19 nt, Homo sapiens
gccuuugucuugucauuug

SEQ ID NO: 1323922 - RNA, 19 nt, Homo sapiens
aagcauaggagguuugaaa

SEQ ID NO: 1323923 - RNA, 19 nt, Homo sapiens
aaaggaguaugagaugaaa

SEQ ID NO: 1323924 - RNA, 19 nt, Homo sapiens
cgguuaggcuggagggaua

SEQ ID NO: 1323925 - RNA, 19 nt, Homo sapiens
caagaucaccuacuuugca

SEQ ID NO: 1323926 - RNA, 19 nt, Homo sapiens
gggcccaggucauguuuca

SEQ ID NO: 1323927 - RNA, 19 nt, Homo sapiens
ugaagaaggccuauagaca

SEQ ID NO: 1323928 - RNA, 19 nt, Homo sapiens
cagauacugugcugagugu

SEQ ID NO: 1323929 - RNA, 19 nt, Homo sapiens
gcauaggagguuugaaaug

SEQ ID NO: 1323930 - RNA, 19 nt, Homo sapiens
gcagugauuuggaccuuuu

SEQ ID NO: 1323931 - RNA, 19 nt, Homo sapiens
aguaugagaugaaacgaau

SEQ ID NO: 1323932 - RNA, 19 nt, Homo sapiens
gcgaaaggaguaugagaug

SEQ ID NO: 1323933 - RNA, 19 nt, Homo sapiens
aagucuaucuucuuucuug

SEQ ID NO: 1323934 - RNA, 19 nt, Homo sapiens
aagcaauucucccaucuca

SEQ ID NO: 1323935 - RNA, 19 nt, Homo sapiens
ggaaagcauaggagguuug

SEQ ID NO: 1323936 - RNA, 19 nt, Homo sapiens
gaaacgaauggcagagaau

SEQ ID NO: 1323937 - RNA, 19 nt, Homo sapiens
ggugggagaguacguagaa

SEQ ID NO: 1323938 - RNA, 19 nt, Homo sapiens
cggccugaaucuugucuuu

SEQ ID NO: 1323939 - RNA, 19 nt, Homo sapiens
cucccaaagugcuggauua

SEQ ID NO: 1323940 - RNA, 19 nt, Homo sapiens
ccuaggaacugaaucuuuu

SEQ ID NO: 1323941 - RNA, 19 nt, Homo sapiens
aaagguguaugacaucaca

SEQ ID NO: 1323942 - RNA, 19 nt, Homo sapiens
gcugcaagaugaccucaag

SEQ ID NO: 1323943 - RNA, 19 nt, Homo sapiens
gaaguggcucgacucuuga

SEQ ID NO: 1323944 - RNA, 19 nt, Homo sapiens
gacaauaccaaagaaauag

SEQ ID NO: 1323945 - RNA, 19 nt, Homo sapiens
acaagucuaucuucuuucu

SEQ ID NO: 1323946 - RNA, 19 nt, Homo sapiens
agucggaucuuucaaguac

SEQ ID NO: 1323947 - RNA, 19 nt, Homo sapiens
caaugaauacuaugaugug

SEQ ID NO: 1323948 - RNA, 19 nt, Homo sapiens
ucaaggaggcaaugaauac

SEQ ID NO: 1323949 - RNA, 19 nt, Homo sapiens
gcucuucucuuggcuggau

SEQ ID NO: 1323950 - RNA, 19 nt, Homo sapiens
uaagagugccagauacugu

SEQ ID NO: 1323951 - RNA, 19 nt, Homo sapiens
ggacaguguaucccuuuag

SEQ ID NO: 1323952 - RNA, 19 nt, Homo sapiens
ucucuuuccucaaaucaau

SEQ ID NO: 1323953 - RNA, 19 nt, Homo sapiens
aaccuaagagugccagaua

SEQ ID NO: 1323954 - RNA, 19 nt, Homo sapiens
aaauggaccgggaaccuaa

SEQ ID NO: 1323955 - RNA, 19 nt, Homo sapiens
gaggcaaugaauacuauga

SEQ ID NO: 1323956 - RNA, 19 nt, Homo sapiens
auagacagcuggcagugau

SEQ ID NO: 1323957 - RNA, 19 nt, Homo sapiens
gacaguguaucccuuuagg

SEQ ID NO: 1323958 - RNA, 19 nt, Homo sapiens
gugcuggauuacaggcaua

SEQ ID NO: 1323959 - RNA, 19 nt, Homo sapiens
cugaguagcugggauuaca

SEQ ID NO: 1323960 - RNA, 19 nt, Homo sapiens
caacaccuaggaacugaau

SEQ ID NO: 1323961 - RNA, 19 nt, Homo sapiens
gggagaagccaaaccuaag

SEQ ID NO: 1323962 - RNA, 19 nt, Homo sapiens
ucauuugguucucggauuc

SEQ ID NO: 1323963 - RNA, 19 nt, Homo sapiens
aggaggcaaugaauacuau

SEQ ID NO: 1323964 - RNA, 19 nt, Homo sapiens
caggucauguuucaguuuc

SEQ ID NO: 1323965 - RNA, 19 nt, Homo sapiens
ugagucggaucuuucaagu

SEQ ID NO: 1323966 - RNA, 19 nt, Homo sapiens
gccucaagaucaccuacuu

SEQ ID NO: 1323967 - RNA, 19 nt, Homo sapiens
gcuacaagucuaucuucuu

SEQ ID NO: 1323968 - RNA, 19 nt, Homo sapiens
ggugugaucucagcuuacu

SEQ ID NO: 1323969 - RNA, 19 nt, Homo sapiens
aagcauguagcccuaauga

SEQ ID NO: 1323970 - RNA, 19 nt, Homo sapiens
uggacaguguaucccuuua

SEQ ID NO: 1323971 - RNA, 19 nt, Homo sapiens
ucaagcaauucucccaucu

SEQ ID NO: 1323972 - RNA, 19 nt, Homo sapiens
gauggaguuugauuuaucc

SEQ ID NO: 1323973 - RNA, 19 nt, Homo sapiens
gaucuucaggauuucuuga

SEQ ID NO: 1323974 - RNA, 19 nt, Homo sapiens
ccuaucacaucucauuugg

SEQ ID NO: 1323975 - RNA, 19 nt, Homo sapiens
gauggaaagguguaugaca

SEQ ID NO: 1323976 - RNA, 19 nt, Homo sapiens
ggagaguacguagaaacuu

SEQ ID NO: 1323977 - RNA, 19 nt, Homo sapiens
cauguagcccuaaugauag

SEQ ID NO: 1323978 - RNA, 19 nt, Homo sapiens
uaggacuguuuacucguuu

SEQ ID NO: 1323979 - RNA, 19 nt, Homo sapiens
caacaaaugccugaucuuc

SEQ ID NO: 1323980 - RNA, 19 nt, Homo sapiens
ccacagcccuaugccauca

SEQ ID NO: 1323981 - RNA, 19 nt, Homo sapiens
ggaacaaggaucccaucuu

SEQ ID NO: 1323982 - RNA, 19 nt, Homo sapiens
agagcaacguggacuuuga

SEQ ID NO: 1323983 - RNA, 19 nt, Homo sapiens
caacaacaaaugccugauc

SEQ ID NO: 1323984 - RNA, 19 nt, Homo sapiens
ggacaugccagccaacaac

SEQ ID NO: 1323985 - RNA, 19 nt, Homo sapiens
ggucuccgcuccucaacgu

SEQ ID NO: 1323986 - RNA, 19 nt, Homo sapiens
gggcccugcucaucaccua

SEQ ID NO: 1323987 - RNA, 19 nt, Homo sapiens
ccagagcaacguggacuuu

SEQ ID NO: 1323988 - RNA, 19 nt, Homo sapiens
ggcccagccugcucagaau

SEQ ID NO: 1323989 - RNA, 19 nt, Homo sapiens
ccagccugcucagaauaaa

SEQ ID NO: 1323990 - RNA, 19 nt, Homo sapiens
gcccagccugcucagaaua

SEQ ID NO: 1323991 - RNA, 19 nt, Homo sapiens
caugccagccaacaacaaa

SEQ ID NO: 1323992 - RNA, 19 nt, Homo sapiens
aacaacaaaugccugaucu

SEQ ID NO: 1323993 - RNA, 19 nt, Homo sapiens
aaacuaagccccuccuuca

SEQ ID NO: 1323994 - RNA, 19 nt, Homo sapiens
gaugcaggaacccagaaug

SEQ ID NO: 1323995 - RNA, 19 nt, Homo sapiens
gaaauaccccgaccuuggu

SEQ ID NO: 1323996 - RNA, 19 nt, Homo sapiens
uggagaggaugguggacau

SEQ ID NO: 1323997 - RNA, 19 nt, Homo sapiens
gaaauuacccacugucuaa

SEQ ID NO: 1323998 - RNA, 19 nt, Homo sapiens
ucacaaagguccuccugua

SEQ ID NO: 1323999 - RNA, 19 nt, Homo sapiens
ggauagagcuucauuccau

SEQ ID NO: 1324000 - RNA, 19 nt, Homo sapiens
gauagagcuucauuccaua

SEQ ID NO: 1324001 - RNA, 19 nt, Homo sapiens
cagaauccuugggaaauua

SEQ ID NO: 1324002 - RNA, 19 nt, Homo sapiens
gaaaggauagagcuucauu

SEQ ID NO: 1324003 - RNA, 19 nt, Homo sapiens
ggaaauuacccacugucua

SEQ ID NO: 1324004 - RNA, 19 nt, Homo sapiens
gaacucaggaaucguguug

SEQ ID NO: 1324005 - RNA, 19 nt, Homo sapiens
ccagaauccuugggaaauu

SEQ ID NO: 1324006 - RNA, 19 nt, Homo sapiens
caccugagaugguuggaaa

SEQ ID NO: 1324007 - RNA, 19 nt, Homo sapiens
gagcuucauuccauaccaa

SEQ ID NO: 1324008 - RNA, 19 nt, Homo sapiens
ccagcuaacuguaggaucu

SEQ ID NO: 1324009 - RNA, 19 nt, Homo sapiens
acccgaaccuggugacuuu

SEQ ID NO: 1324010 - RNA, 19 nt, Homo sapiens
cguguugcaugcauuguuu

SEQ ID NO: 1324011 - RNA, 19 nt, Homo sapiens
ggaaucguguugcaugcau

SEQ ID NO: 1324012 - RNA, 19 nt, Homo sapiens
guaaagggcacugcugaug

SEQ ID NO: 1324013 - RNA, 19 nt, Homo sapiens
gaaccuggugacuuugaaa

SEQ ID NO: 1324014 - RNA, 19 nt, Homo sapiens
gaaucguguugcaugcauu

SEQ ID NO: 1324015 - RNA, 19 nt, Homo sapiens
uacccacugucuaauuuaa

SEQ ID NO: 1324016 - RNA, 19 nt, Homo sapiens
ggagggugcguggaaauga

SEQ ID NO: 1324017 - RNA, 19 nt, Homo sapiens
guggaaaugagaaagcuuu

SEQ ID NO: 1324018 - RNA, 19 nt, Homo sapiens
caaugccaaugccuucaga

SEQ ID NO: 1324019 - RNA, 19 nt, Homo sapiens
aaagggcacugcugauggu

SEQ ID NO: 1324020 - RNA, 19 nt, Homo sapiens
gggcacugcugaugguucu

SEQ ID NO: 1324021 - RNA, 19 nt, Homo sapiens
cgaaccuggugacuuugaa

SEQ ID NO: 1324022 - RNA, 19 nt, Homo sapiens
uggaaacccugaggcaaug

SEQ ID NO: 1324023 - RNA, 19 nt, Homo sapiens
gguggagggugcguggaaa

SEQ ID NO: 1324024 - RNA, 19 nt, Homo sapiens
gagggugcguggaaaugag

SEQ ID NO: 1324025 - RNA, 19 nt, Homo sapiens
cuucagaacucaggaaucg

SEQ ID NO: 1324026 - RNA, 19 nt, Homo sapiens
ggcaugcacgcaaggaauu

SEQ ID NO: 1324027 - RNA, 19 nt, Homo sapiens
cuacccaccugagaugguu

SEQ ID NO: 1324028 - RNA, 19 nt, Homo sapiens
gggcaugcacgcaaggaau

SEQ ID NO: 1324029 - RNA, 19 nt, Homo sapiens
cuucgaagccagagcagaa

SEQ ID NO: 1324030 - RNA, 19 nt, Homo sapiens
gcgcuucuccguccaaugc

SEQ ID NO: 1324031 - RNA, 19 nt, Homo sapiens
gcacugcugaugguucuuc

SEQ ID NO: 1324032 - RNA, 19 nt, Homo sapiens
uugcaugcauuguuucuac

SEQ ID NO: 1324033 - RNA, 19 nt, Homo sapiens
uuacccacugucuaauuua

SEQ ID NO: 1324034 - RNA, 19 nt, Homo sapiens
gguaaagggcacugcugau

SEQ ID NO: 1324035 - RNA, 19 nt, Homo sapiens
cccacugucuaauuuaaag

SEQ ID NO: 1324036 - RNA, 19 nt, Homo sapiens
gcaugcacgcaaggaauug

SEQ ID NO: 1324037 - RNA, 19 nt, Homo sapiens
gaagccagagcagaaccaa

SEQ ID NO: 1324038 - RNA, 19 nt, Homo sapiens
ggaaacccugaggcaauga

SEQ ID NO: 1324039 - RNA, 19 nt, Homo sapiens
gcaaagaaaugaagagauu

SEQ ID NO: 1324040 - RNA, 19 nt, Homo sapiens
gagaggaacuugauacaga

SEQ ID NO: 1324041 - RNA, 19 nt, Homo sapiens
gaaaagaugugaaguaaug

SEQ ID NO: 1324042 - RNA, 19 nt, Homo sapiens
ggauagagaucugauggua

SEQ ID NO: 1324043 - RNA, 19 nt, Homo sapiens
aaagagaccuguacacuca

SEQ ID NO: 1324044 - RNA, 19 nt, Homo sapiens
uaggaaagcuggaaagaga

SEQ ID NO: 1324045 - RNA, 19 nt, Homo sapiens
gcagaagcuuguaacauug

SEQ ID NO: 1324046 - RNA, 19 nt, Homo sapiens
uagcagagauggauagaga

SEQ ID NO: 1324047 - RNA, 19 nt, Homo sapiens
gaauuuagaagaacaguug

SEQ ID NO: 1324048 - RNA, 19 nt, Homo sapiens
gcagagaucagaguacuaa

SEQ ID NO: 1324049 - RNA, 19 nt, Homo sapiens
ugcagaagcuuguaacauu

SEQ ID NO: 1324050 - RNA, 19 nt, Homo sapiens
gaagcugacugcagaugau

SEQ ID NO: 1324051 - RNA, 19 nt, Homo sapiens
uacaagaucuggaggaaug

SEQ ID NO: 1324052 - RNA, 19 nt, Homo sapiens
ggagguuugugcaauuuga

SEQ ID NO: 1324053 - RNA, 19 nt, Homo sapiens
gucaagaacuggagguuug

SEQ ID NO: 1324054 - RNA, 19 nt, Homo sapiens
gaaauaugacuuugguaga

SEQ ID NO: 1324055 - RNA, 19 nt, Homo sapiens
gacagagacaagcaaauua

SEQ ID NO: 1324056 - RNA, 19 nt, Homo sapiens
ggaaaugcaucaauaaccu

SEQ ID NO: 1324057 - RNA, 19 nt, Homo sapiens
ggacaagguuagcagagau

SEQ ID NO: 1324058 - RNA, 19 nt, Homo sapiens
gagcaacuaagugaauuua

SEQ ID NO: 1324059 - RNA, 19 nt, Homo sapiens
uaacagcucuuaggaaacu

SEQ ID NO: 1324060 - RNA, 19 nt, Homo sapiens
gaaaguggagauacuaaca

SEQ ID NO: 1324061 - RNA, 19 nt, Homo sapiens
gaaacaaccaggucagcuu

SEQ ID NO: 1324062 - RNA, 19 nt, Homo sapiens
gaaaugcaucaauaaccua

SEQ ID NO: 1324063 - RNA, 19 nt, Homo sapiens
cuaaggagguugucucagu

SEQ ID NO: 1324064 - RNA, 19 nt, Homo sapiens
ggaacuugauacagaugaa

SEQ ID NO: 1324065 - RNA, 19 nt, Homo sapiens
guacuaagagacagagauu

SEQ ID NO: 1324066 - RNA, 19 nt, Homo sapiens
gaggugguuugaacuuuga

SEQ ID NO: 1324067 - RNA, 19 nt, Homo sapiens
cagauuguuugcaaagaaa

SEQ ID NO: 1324068 - RNA, 19 nt, Homo sapiens
ucagauuguuugcaaagaa

SEQ ID NO: 1324069 - RNA, 19 nt, Homo sapiens
gagaucugaugguaggaaa

SEQ ID NO: 1324070 - RNA, 19 nt, Homo sapiens
uaaggagguugucucaguu

SEQ ID NO: 1324071 - RNA, 19 nt, Homo sapiens
gaagaacaguuggauagac

SEQ ID NO: 1324072 - RNA, 19 nt, Homo sapiens
gagauacuaacagcucuua

SEQ ID NO: 1324073 - RNA, 19 nt, Homo sapiens
gaaacucuggagcaacuaa

SEQ ID NO: 1324074 - RNA, 19 nt, Homo sapiens
guagaugaacuaaguggaa

SEQ ID NO: 1324075 - RNA, 19 nt, Homo sapiens
cgaggugguuugaacuuug

SEQ ID NO: 1324076 - RNA, 19 nt, Homo sapiens
gaaagacagagacaagcaa

SEQ ID NO: 1324077 - RNA, 19 nt, Homo sapiens
uuuaugcucuucaucauug

SEQ ID NO: 1324078 - RNA, 19 nt, Homo sapiens
uaaauggugucuuucuucu

SEQ ID NO: 1324079 - RNA, 19 nt, Homo sapiens
guaaauggugucuuucuuc

SEQ ID NO: 1324080 - RNA, 19 nt, Homo sapiens
aaaggaaacucuggagcaa

SEQ ID NO: 1324081 - RNA, 19 nt, Homo sapiens
caagcaaauuaaagcagaa

SEQ ID NO: 1324082 - RNA, 19 nt, Homo sapiens
acagagacaagcaaauuaa

SEQ ID NO: 1324083 - RNA, 19 nt, Homo sapiens
ucacuggacucuguucguu

SEQ ID NO: 1324084 - RNA, 19 nt, Homo sapiens
gaacuggagguuugugcaa

SEQ ID NO: 1324085 - RNA, 19 nt, Homo sapiens
acuuauggcuuguguuuau

SEQ ID NO: 1324086 - RNA, 19 nt, Homo sapiens
augaagagauucuggaaau

SEQ ID NO: 1324087 - RNA, 19 nt, Homo sapiens
ggaaagagaccuguacacu

SEQ ID NO: 1324088 - RNA, 19 nt, Homo sapiens
gauagacucaugcaacaau

SEQ ID NO: 1324089 - RNA, 19 nt, Homo sapiens
caacuuauccccacucauu

SEQ ID NO: 1324090 - RNA, 19 nt, Homo sapiens
gggacucacuggacucugu

SEQ ID NO: 1324091 - RNA, 19 nt, Homo sapiens
agacagagacaagcaaauu

SEQ ID NO: 1324092 - RNA, 19 nt, Homo sapiens
acuaagagacagagauuaa

SEQ ID NO: 1324093 - RNA, 19 nt, Homo sapiens
gagugauccugaacuuguu

SEQ ID NO: 1324094 - RNA, 19 nt, Homo sapiens
uuaggaaacuuggagagaa

SEQ ID NO: 1324095 - RNA, 19 nt, Homo sapiens
gcuaucagccaggccuuua

SEQ ID NO: 1324096 - RNA, 19 nt, Homo sapiens
ggaaagacagagacaagca

SEQ ID NO: 1324097 - RNA, 19 nt, Homo sapiens
gaccuuggcucuggagaca

SEQ ID NO: 1324098 - RNA, 19 nt, Homo sapiens
uagaagaacaguuggauag

SEQ ID NO: 1324099 - RNA, 19 nt, Homo sapiens
ucauuggagugaacaguga

SEQ ID NO: 1324100 - RNA, 19 nt, Homo sapiens
gcagagaggaacuugauac

SEQ ID NO: 1324101 - RNA, 19 nt, Homo sapiens
ggaggaaugcagagaggaa

SEQ ID NO: 1324102 - RNA, 19 nt, Homo sapiens
ugauuugucuguuuaagag

SEQ ID NO: 1324103 - RNA, 19 nt, Homo sapiens
cguuaugauuugucuguuu

SEQ ID NO: 1324104 - RNA, 19 nt, Homo sapiens
ggacucuguucguuaugau

SEQ ID NO: 1324105 - RNA, 19 nt, Homo sapiens
gcaucaauaaccuaagaaa

SEQ ID NO: 1324106 - RNA, 19 nt, Homo sapiens
gucaucagauuguuugcaa

SEQ ID NO: 1324107 - RNA, 19 nt, Homo sapiens
ggagcaacuaagugaauuu

SEQ ID NO: 1324108 - RNA, 19 nt, Homo sapiens
gaggaaagacagagacaag

SEQ ID NO: 1324109 - RNA, 19 nt, Homo sapiens
gaagagauucuggaaaugc

SEQ ID NO: 1324110 - RNA, 19 nt, Homo sapiens
gaacaguuggauagacuca

SEQ ID NO: 1324111 - RNA, 19 nt, Homo sapiens
gaggucaucagauuguuug

SEQ ID NO: 1324112 - RNA, 19 nt, Homo sapiens
ugaagagauucuggaaaug

SEQ ID NO: 1324113 - RNA, 19 nt, Homo sapiens
aaaaugacauggugcagaa

SEQ ID NO: 1324114 - RNA, 19 nt, Homo sapiens
guuugaacuuugagccuuu

SEQ ID NO: 1324115 - RNA, 19 nt, Homo sapiens
uuguaguccugaugaauaa

SEQ ID NO: 1324116 - RNA, 19 nt, Homo sapiens
auacuuauggcuuguguuu

SEQ ID NO: 1324117 - RNA, 19 nt, Homo sapiens
uguaaauggugucuuucuu

SEQ ID NO: 1324118 - RNA, 19 nt, Homo sapiens
cagaaaguggagauacuaa

SEQ ID NO: 1324119 - RNA, 19 nt, Homo sapiens
gcagagauggauagagauc

SEQ ID NO: 1324120 - RNA, 19 nt, Homo sapiens
uggauagacucaugcaaca

SEQ ID NO: 1324121 - RNA, 19 nt, Homo sapiens
acaguuggauagacucaug

SEQ ID NO: 1324122 - RNA, 19 nt, Homo sapiens
ugagugauccugaacuugu

SEQ ID NO: 1324123 - RNA, 19 nt, Homo sapiens
gcuauacucagccaguuug

SEQ ID NO: 1324124 - RNA, 19 nt, Homo sapiens
uuugguagaugaacuaagu

SEQ ID NO: 1324125 - RNA, 19 nt, Homo sapiens
gagaucagaguacuaagag

SEQ ID NO: 1324126 - RNA, 19 nt, Homo sapiens
ccuuggcucuggagacaaa

SEQ ID NO: 1324127 - RNA, 19 nt, Homo sapiens
guaguccugaugaauaauu

SEQ ID NO: 1324128 - RNA, 19 nt, Homo sapiens
ccagaggucaucagauugu

SEQ ID NO: 1324129 - RNA, 19 nt, Homo sapiens
uagaugaacuaaguggaau

SEQ ID NO: 1324130 - RNA, 19 nt, Homo sapiens
gaacuuugagccuuuugua

SEQ ID NO: 1324131 - RNA, 19 nt, Homo sapiens
gcaaaugcaggugcuauac

SEQ ID NO: 1324132 - RNA, 19 nt, Homo sapiens
caacagaaaguggagauac

SEQ ID NO: 1324133 - RNA, 19 nt, Homo sapiens
ccgaggugguuugaacuuu

SEQ ID NO: 1324134 - RNA, 19 nt, Homo sapiens
cagagacaagcaaauuaaa

SEQ ID NO: 1324135 - RNA, 19 nt, Homo sapiens
cuucugggguuuucaguua

SEQ ID NO: 1324136 - RNA, 19 nt, Homo sapiens
uaggaaacuuggagagaag

SEQ ID NO: 1324137 - RNA, 19 nt, Homo sapiens
gaacuugauacagaugaau

SEQ ID NO: 1324138 - RNA, 19 nt, Homo sapiens
gagacaagcaaauuaaagc

SEQ ID NO: 1324139 - RNA, 19 nt, Homo sapiens
caacaaagcuggacaauug

SEQ ID NO: 1324140 - RNA, 19 nt, Homo sapiens
ucacaucgauugcaaauaa

SEQ ID NO: 1324141 - RNA, 19 nt, Homo sapiens
gaacaucaacuacaagaaa

SEQ ID NO: 1324142 - RNA, 19 nt, Homo sapiens
uaacuaugcugccauggua

SEQ ID NO: 1324143 - RNA, 19 nt, Homo sapiens
gcaauaggaauguaaagua

SEQ ID NO: 1324144 - RNA, 19 nt, Homo sapiens
guugaacacuuuagccuua

SEQ ID NO: 1324145 - RNA, 19 nt, Homo sapiens
gggauuaucaucucaguua

SEQ ID NO: 1324146 - RNA, 19 nt, Homo sapiens
gcucaucagugaaauguug

SEQ ID NO: 1324147 - RNA, 19 nt, Homo sapiens
cuagguggcuccauuguuu

SEQ ID NO: 1324148 - RNA, 19 nt, Homo sapiens
ggugagagguuugguuuga

SEQ ID NO: 1324149 - RNA, 19 nt, Homo sapiens
acagaugaauguacaauug

SEQ ID NO: 1324150 - RNA, 19 nt, Homo sapiens
aaugggagcucacuaagaa

SEQ ID NO: 1324151 - RNA, 19 nt, Homo sapiens
ugagagguuugguuugaua

SEQ ID NO: 1324152 - RNA, 19 nt, Homo sapiens
ucagugaaauguugaauag

SEQ ID NO: 1324153 - RNA, 19 nt, Homo sapiens
gaaggaacaagaaauugaa

SEQ ID NO: 1324154 - RNA, 19 nt, Homo sapiens
gagcagaggugaagaaacc

SEQ ID NO: 1324155 - RNA, 19 nt, Homo sapiens
ggaacaagaaauugaaaga

SEQ ID NO: 1324156 - RNA, 19 nt, Homo sapiens
cugagaauaucaccaaauu

SEQ ID NO: 1324157 - RNA, 19 nt, Homo sapiens
gcuguuccuucaucuuaua

SEQ ID NO: 1324158 - RNA, 19 nt, Homo sapiens
ggauuaucaucucaguuaa

SEQ ID NO: 1324159 - RNA, 19 nt, Homo sapiens
uuaaggaacugaugcaucu

SEQ ID NO: 1324160 - RNA, 19 nt, Homo sapiens
gaucaucaaugggauuauc

SEQ ID NO: 1324161 - RNA, 19 nt, Homo sapiens
cgacaaugcugagaauauc

SEQ ID NO: 1324162 - RNA, 19 nt, Homo sapiens
caauaggaauguaaaguac

SEQ ID NO: 1324163 - RNA, 19 nt, Homo sapiens
gcuggacaauugcuaguug

SEQ ID NO: 1324164 - RNA, 19 nt, Homo sapiens
ugagaaggaacaagaaauu

SEQ ID NO: 1324165 - RNA, 19 nt, Homo sapiens
guagcaguauuucaguaaa

SEQ ID NO: 1324166 - RNA, 19 nt, Homo sapiens
ugaaaugccugagcaguag

SEQ ID NO: 1324167 - RNA, 19 nt, Homo sapiens
gaacggcaacucuuaaggu

SEQ ID NO: 1324168 - RNA, 19 nt, Homo sapiens
ggagcucacuaagaacaaa

SEQ ID NO: 1324169 - RNA, 19 nt, Homo sapiens
ucacguguauauuaaggaa

SEQ ID NO: 1324170 - RNA, 19 nt, Homo sapiens
gaacacuuuagccuuaauu

SEQ ID NO: 1324171 - RNA, 19 nt, Homo sapiens
gcauggacuucuuggugaa

SEQ ID NO: 1324172 - RNA, 19 nt, Homo sapiens
gcaacaaagcuggacaauu

SEQ ID NO: 1324173 - RNA, 19 nt, Homo sapiens
uaccaugccuggaacauca

SEQ ID NO: 1324174 - RNA, 19 nt, Homo sapiens
guuagucuguuaggucuuu

SEQ ID NO: 1324175 - RNA, 19 nt, Homo sapiens
ugaaagggccuaccacaca

SEQ ID NO: 1324176 - RNA, 19 nt, Homo sapiens
gguagacaaucacaucgau

SEQ ID NO: 1324177 - RNA, 19 nt, Homo sapiens
aguagguggucacguguua

SEQ ID NO: 1324178 - RNA, 19 nt, Homo sapiens
aauuuaaucucaccgaaug

SEQ ID NO: 1324179 - RNA, 19 nt, Homo sapiens
gagaaggaacaagaaauug

SEQ ID NO: 1324180 - RNA, 19 nt, Homo sapiens
gcucugagaaggaacaaga

SEQ ID NO: 1324181 - RNA, 19 nt, Homo sapiens
gcucugggccugcugauuc

SEQ ID NO: 1324182 - RNA, 19 nt, Homo sapiens
gaggaugagcaaguucuua

SEQ ID NO: 1324183 - RNA, 19 nt, Homo sapiens
uaaauagcuucgucucagu

SEQ ID NO: 1324184 - RNA, 19 nt, Homo sapiens
ggaguucuuucaccacaag

SEQ ID NO: 1324185 - RNA, 19 nt, Homo sapiens
gaaaugggagaaugaagag

SEQ ID NO: 1324186 - RNA, 19 nt, Homo sapiens
gugaaauguugaauaguag

SEQ ID NO: 1324187 - RNA, 19 nt, Homo sapiens
cucaauuacuguacaacua

SEQ ID NO: 1324188 - RNA, 19 nt, Homo sapiens
ucaaugggauuaucaucuc

SEQ ID NO: 1324189 - RNA, 19 nt, Homo sapiens
ccuggaacaucaacuacaa

SEQ ID NO: 1324190 - RNA, 19 nt, Homo sapiens
caguagcaguauuucagua

SEQ ID NO: 1324191 - RNA, 19 nt, Homo sapiens
ggagggcaccccaaucuua

SEQ ID NO: 1324192 - RNA, 19 nt, Homo sapiens
agaaggaacaagaaauuga

SEQ ID NO: 1324193 - RNA, 19 nt, Homo sapiens
acacgacaaugcugagaau

SEQ ID NO: 1324194 - RNA, 19 nt, Homo sapiens
guaacacauuugagaucuu

SEQ ID NO: 1324195 - RNA, 19 nt, Homo sapiens
gcuucuagguggcuccauu

SEQ ID NO: 1324196 - RNA, 19 nt, Homo sapiens
caucugagcauucugaaag

SEQ ID NO: 1324197 - RNA, 19 nt, Homo sapiens
cagcugcucugagaaggaa

SEQ ID NO: 1324198 - RNA, 19 nt, Homo sapiens
ggccuucuccuuuaaguau

SEQ ID NO: 1324199 - RNA, 19 nt, Homo sapiens
ggccucacuuucccaacua

SEQ ID NO: 1324200 - RNA, 19 nt, Homo sapiens
gcaaauaauagucuuucuc

SEQ ID NO: 1324201 - RNA, 19 nt, Homo sapiens
ucagaacggcaacucuuaa

SEQ ID NO: 1324202 - RNA, 19 nt, Homo sapiens
agaaaugggagaaugaaga

SEQ ID NO: 1324203 - RNA, 19 nt, Homo sapiens
caagaaaugggagaaugaa

SEQ ID NO: 1324204 - RNA, 19 nt, Homo sapiens
uacaagaaaugggagaaug

SEQ ID NO: 1324205 - RNA, 19 nt, Homo sapiens
cacuuuagccuuaauugaa

SEQ ID NO: 1324206 - RNA, 19 nt, Homo sapiens
cacacuguaucaaauguau

SEQ ID NO: 1324207 - RNA, 19 nt, Homo sapiens
gaacaagaaauugaaagac

SEQ ID NO: 1324208 - RNA, 19 nt, Homo sapiens
acaagaaaugggagaauga

SEQ ID NO: 1324209 - RNA, 19 nt, Homo sapiens
uaaaaugggagcucacuaa

SEQ ID NO: 1324210 - RNA, 19 nt, Homo sapiens
gagcucaucagugaaaugu

SEQ ID NO: 1324211 - RNA, 19 nt, Homo sapiens
gagcaacaaagcuggacaa

SEQ ID NO: 1324212 - RNA, 19 nt, Homo sapiens
gaagguccaguaccaccaa

SEQ ID NO: 1324213 - RNA, 19 nt, Homo sapiens
cugaaaugccugagcagua

SEQ ID NO: 1324214 - RNA, 19 nt, Homo sapiens
cgacaagaauaacuaugcu

SEQ ID NO: 1324215 - RNA, 19 nt, Homo sapiens
ggaacaucaacuacaagaa

SEQ ID NO: 1324216 - RNA, 19 nt, Homo sapiens
uugcugaaguguuccuuug

SEQ ID NO: 1324217 - RNA, 19 nt, Homo sapiens
aggcuguuccuucaucuua

SEQ ID NO: 1324218 - RNA, 19 nt, Homo sapiens
cgacagcauggacuucuug

SEQ ID NO: 1324219 - RNA, 19 nt, Homo sapiens
gcgacagcauggacuucuu

SEQ ID NO: 1324220 - RNA, 19 nt, Homo sapiens
caaugggauuaucaucuca

SEQ ID NO: 1324221 - RNA, 19 nt, Homo sapiens
accaaauucuccagacuug

SEQ ID NO: 1324222 - RNA, 19 nt, Homo sapiens
uaucaucucaguuaagaca

SEQ ID NO: 1324223 - RNA, 19 nt, Homo sapiens
gcugagaggaugagcaagu

SEQ ID NO: 1324224 - RNA, 19 nt, Homo sapiens
ugccugagcaguagcagua

SEQ ID NO: 1324225 - RNA, 19 nt, Homo sapiens
ucugccaccugacaacauu

SEQ ID NO: 1324226 - RNA, 19 nt, Homo sapiens
uucaagcuguucuaaauag

SEQ ID NO: 1324227 - RNA, 19 nt, Homo sapiens
caaagcuggacaauugcua

SEQ ID NO: 1324228 - RNA, 19 nt, Homo sapiens
ccacacuguaucaaaugua

SEQ ID NO: 1324229 - RNA, 19 nt, Homo sapiens
guucuuucaccacaaguuu

SEQ ID NO: 1324230 - RNA, 19 nt, Homo sapiens
ggucacguguuagucuguu

SEQ ID NO: 1324231 - RNA, 19 nt, Homo sapiens
aggaugagcaaguucuuaa

SEQ ID NO: 1324232 - RNA, 19 nt, Homo sapiens
ccaaucuuauuaugcucaa

SEQ ID NO: 1324233 - RNA, 19 nt, Homo sapiens
gaaauguugaauaguagca

SEQ ID NO: 1324234 - RNA, 19 nt, Homo sapiens
aacggcaacucuuaagguu

SEQ ID NO: 1324235 - RNA, 19 nt, Homo sapiens
gaacucacaaccagaucca

SEQ ID NO: 1324236 - RNA, 19 nt, Homo sapiens
ccagaacucacaaccagau

SEQ ID NO: 1324237 - RNA, 19 nt, Homo sapiens
gcaguagcaguauuucagu

SEQ ID NO: 1324238 - RNA, 19 nt, Homo sapiens
gagcaguagcaguauuuca

SEQ ID NO: 1324239 - RNA, 19 nt, Homo sapiens
ucaagcaccugcauguuug

SEQ ID NO: 1324240 - RNA, 19 nt, Homo sapiens
ugucgaagauggaggagaa

SEQ ID NO: 1324241 - RNA, 19 nt, Homo sapiens
acagcaaacugcacuacaa

SEQ ID NO: 1324242 - RNA, 19 nt, Homo sapiens
caaacccaaucgcuacuuc

SEQ ID NO: 1324243 - RNA, 19 nt, Homo sapiens
gaccguuccugcccuacuu

SEQ ID NO: 1324244 - RNA, 19 nt, Homo sapiens
ccagugagaccgacaagga

SEQ ID NO: 1324245 - RNA, 19 nt, Homo sapiens
cagcaaacugcacuacaaa

SEQ ID NO: 1324246 - RNA, 19 nt, Homo sapiens
gccgagccgugucgaagau

SEQ ID NO: 1324247 - RNA, 19 nt, Homo sapiens
uucaagcaccugcauguuu

SEQ ID NO: 1324248 - RNA, 19 nt, Homo sapiens
gcaccgcucgcucuucaag

SEQ ID NO: 1324249 - RNA, 19 nt, Homo sapiens
acgcaccgcucgcucuuca

SEQ ID NO: 1324250 - RNA, 19 nt, Homo sapiens
cuugaacccugcgcccuuu

SEQ ID NO: 1324251 - RNA, 19 nt, Homo sapiens
augccaccgucccgaaaua

SEQ ID NO: 1324252 - RNA, 19 nt, Homo sapiens
gcaaacugcacuacaaacc

SEQ ID NO: 1324253 - RNA, 19 nt, Homo sapiens
gcuccaggcuaauaaagug

SEQ ID NO: 1324254 - RNA, 19 nt, Homo sapiens
cuaauaaaguggagaaacu

SEQ ID NO: 1324255 - RNA, 19 nt, Homo sapiens
gaggagcuccaggcuaaua

SEQ ID NO: 1324256 - RNA, 19 nt, Homo sapiens
gcagaacuuugugcccauu

SEQ ID NO: 1324257 - RNA, 19 nt, Homo sapiens
ccucagcccugcucacugu

SEQ ID NO: 1324258 - RNA, 19 nt, Homo sapiens
ucggcgagcuccugaaaug

SEQ ID NO: 1324259 - RNA, 19 nt, Homo sapiens
caccugaagugccagcauu

SEQ ID NO: 1324260 - RNA, 19 nt, Homo sapiens
gcgagaaucaccagcuguu

SEQ ID NO: 1324261 - RNA, 19 nt, Homo sapiens
uaaaguggagaaacuguca

SEQ ID NO: 1324262 - RNA, 19 nt, Homo sapiens
ggagcuccaggcuaauaaa

SEQ ID NO: 1324263 - RNA, 19 nt, Homo sapiens
gugccagcauuuggacuuu

SEQ ID NO: 1324264 - RNA, 19 nt, Homo sapiens
agaacuuugugcccauuga

SEQ ID NO: 1324265 - RNA, 19 nt, Homo sapiens
gccaaggccugugcaguac

SEQ ID NO: 1324266 - RNA, 19 nt, Homo sapiens
ugaagugccagcauuugga

SEQ ID NO: 1324267 - RNA, 19 nt, Homo sapiens
caaggccugugcaguacgu

SEQ ID NO: 1324268 - RNA, 19 nt, Homo sapiens
gagcuccaggcuaauaaag

SEQ ID NO: 1324269 - RNA, 19 nt, Homo sapiens
gcgagaauguggccuagaa

SEQ ID NO: 1324270 - RNA, 19 nt, Homo sapiens
gagaauguccgcuuugugu

SEQ ID NO: 1324271 - RNA, 19 nt, Homo sapiens
gcuccaggcuaauaaagug

SEQ ID NO: 1324272 - RNA, 19 nt, Homo sapiens
cgaggagaauguccgcuuu

SEQ ID NO: 1324273 - RNA, 19 nt, Homo sapiens
cuaauaaaguggagaaacu

SEQ ID NO: 1324274 - RNA, 19 nt, Homo sapiens
ggucguggcucaggucaga

SEQ ID NO: 1324275 - RNA, 19 nt, Homo sapiens
gaggagcuccaggcuaaua

SEQ ID NO: 1324276 - RNA, 19 nt, Homo sapiens
ccucagcccugcucacugu

SEQ ID NO: 1324277 - RNA, 19 nt, Homo sapiens
caccugaagugccagcauu

SEQ ID NO: 1324278 - RNA, 19 nt, Homo sapiens
ggagugggcgaggguuaua

SEQ ID NO: 1324279 - RNA, 19 nt, Homo sapiens
ggugagcggcuugugguua

SEQ ID NO: 1324280 - RNA, 19 nt, Homo sapiens
gaauguggccuagaacuac

SEQ ID NO: 1324281 - RNA, 19 nt, Homo sapiens
gcgagaaucaccagcuguu

SEQ ID NO: 1324282 - RNA, 19 nt, Homo sapiens
gugagcggcuugugguuag

SEQ ID NO: 1324283 - RNA, 19 nt, Homo sapiens
ucacuucccucaggacaca

SEQ ID NO: 1324284 - RNA, 19 nt, Homo sapiens
uaaaguggagaaacuguca

SEQ ID NO: 1324285 - RNA, 19 nt, Homo sapiens
agaauguggccuagaacua

SEQ ID NO: 1324286 - RNA, 19 nt, Homo sapiens
guggguggcugcucucucu

SEQ ID NO: 1324287 - RNA, 19 nt, Homo sapiens
ggagcuccaggcuaauaaa

SEQ ID NO: 1324288 - RNA, 19 nt, Homo sapiens
gaggagaauguccgcuuug

SEQ ID NO: 1324289 - RNA, 19 nt, Homo sapiens
gugccagcauuuggacuuu

SEQ ID NO: 1324290 - RNA, 19 nt, Homo sapiens
cagacuuugugcccauuga

SEQ ID NO: 1324291 - RNA, 19 nt, Homo sapiens
ggagaauguccgcuuugug

SEQ ID NO: 1324292 - RNA, 19 nt, Homo sapiens
gccaaggccugugcaguac

SEQ ID NO: 1324293 - RNA, 19 nt, Homo sapiens
gagauggaggugcuucugu

SEQ ID NO: 1324294 - RNA, 19 nt, Homo sapiens
ugaagugccagcauuugga

SEQ ID NO: 1324295 - RNA, 19 nt, Homo sapiens
agggaaacaucguggagau

SEQ ID NO: 1324296 - RNA, 19 nt, Homo sapiens
ugccuaggcuggccaaguc

SEQ ID NO: 1324297 - RNA, 19 nt, Homo sapiens
caaggccugugcaguacgu

SEQ ID NO: 1324298 - RNA, 19 nt, Homo sapiens
gagaauguggccuagaacu

SEQ ID NO: 1324299 - RNA, 19 nt, Homo sapiens
gggcugcuccugaguucug

SEQ ID NO: 1324300 - RNA, 19 nt, Homo sapiens
gguuugggacacucuaaga

SEQ ID NO: 1324301 - RNA, 19 nt, Homo sapiens
gagcuccaggcuaauaaag

SEQ ID NO: 1324302 - RNA, 19 nt, Homo sapiens
ggacucuugugcagaaacc

SEQ ID NO: 1324303 - RNA, 19 nt, Homo sapiens
gguagaugcuucugauuua

SEQ ID NO: 1324304 - RNA, 19 nt, Homo sapiens
gaaacuaacuaccugaaga

SEQ ID NO: 1324305 - RNA, 19 nt, Homo sapiens
gaggacagcuggccgcuuu

SEQ ID NO: 1324306 - RNA, 19 nt, Homo sapiens
acaaggaacugacuucuga

SEQ ID NO: 1324307 - RNA, 19 nt, Homo sapiens
ugacagaaaugcugaaaca

SEQ ID NO: 1324308 - RNA, 19 nt, Homo sapiens
ugaaguugcucaugaaaug

SEQ ID NO: 1324309 - RNA, 19 nt, Homo sapiens
gaagaagaccauauucaug

SEQ ID NO: 1324310 - RNA, 19 nt, Homo sapiens
gaaauggaaaugacagaaa

SEQ ID NO: 1324311 - RNA, 19 nt, Homo sapiens
gacaguagccucaaggaaa

SEQ ID NO: 1324312 - RNA, 19 nt, Homo sapiens
gaacugacuucugaaacug

SEQ ID NO: 1324313 - RNA, 19 nt, Homo sapiens
ggaacugacuucugaaacu

SEQ ID NO: 1324314 - RNA, 19 nt, Homo sapiens
ccagugacccaauagaaua

SEQ ID NO: 1324315 - RNA, 19 nt, Homo sapiens
gaagaggugcuuuggaaau

SEQ ID NO: 1324316 - RNA, 19 nt, Homo sapiens
caaaaugccacaagaaaua

SEQ ID NO: 1324317 - RNA, 19 nt, Homo sapiens
cucacuggcuuuaucauua

SEQ ID NO: 1324318 - RNA, 19 nt, Homo sapiens
gugaacauuugaacuaguu

SEQ ID NO: 1324319 - RNA, 19 nt, Homo sapiens
cagcuagaaccaagauuua

SEQ ID NO: 1324320 - RNA, 19 nt, Homo sapiens
ggaagaguaucagauucaa

SEQ ID NO: 1324321 - RNA, 19 nt, Homo sapiens
uaaauuacaaggaggcuuu

SEQ ID NO: 1324322 - RNA, 19 nt, Homo sapiens
ccacgaagaagaccauauu

SEQ ID NO: 1324323 - RNA, 19 nt, Homo sapiens
gaaaacagcaaaagcaaaa

SEQ ID NO: 1324324 - RNA, 19 nt, Homo sapiens
cugaagaggugcuuuggaa

SEQ ID NO: 1324325 - RNA, 19 nt, Homo sapiens
ccagguacuuccagucuga

SEQ ID NO: 1324326 - RNA, 19 nt, Homo sapiens
ccagcaauguggaacuaaa

SEQ ID NO: 1324327 - RNA, 19 nt, Homo sapiens
gaagaaggugccacagaga

SEQ ID NO: 1324328 - RNA, 19 nt, Homo sapiens
ccagcuagaaccaagauuu

SEQ ID NO: 1324329 - RNA, 19 nt, Homo sapiens
acaguagccucaaggaaau

SEQ ID NO: 1324330 - RNA, 19 nt, Homo sapiens
aagaggugcuuuggaaauu

SEQ ID NO: 1324331 - RNA, 19 nt, Homo sapiens
aggaaugccucaacagguu

SEQ ID NO: 1324332 - RNA, 19 nt, Homo sapiens
cgaagaagaccauauucau

SEQ ID NO: 1324333 - RNA, 19 nt, Homo sapiens
aguaucagauucaacagaa

SEQ ID NO: 1324334 - RNA, 19 nt, Homo sapiens
gaccagaacuucaaaaugc

SEQ ID NO: 1324335 - RNA, 19 nt, Homo sapiens
ggaaauggaaaugacagaa

SEQ ID NO: 1324336 - RNA, 19 nt, Homo sapiens
cugauuuacuucucucaaa

SEQ ID NO: 1324337 - RNA, 19 nt, Homo sapiens
gcugaaacaggaagaguau

SEQ ID NO: 1324338 - RNA, 19 nt, Homo sapiens
ucaaggaaauggaaaugac

SEQ ID NO: 1324339 - RNA, 19 nt, Homo sapiens
ccaagaaaauggccagcua

SEQ ID NO: 1324340 - RNA, 19 nt, Homo sapiens
cugccaggauggaaacuaa

SEQ ID NO: 1324341 - RNA, 19 nt, Homo sapiens
caggaagaguaucagauuc

SEQ ID NO: 1324342 - RNA, 19 nt, Homo sapiens
acaggaagaguaucagauu

SEQ ID NO: 1324343 - RNA, 19 nt, Homo sapiens
ugaaacaggaagaguauca

SEQ ID NO: 1324344 - RNA, 19 nt, Homo sapiens
uggcagagguggcgaaggu

SEQ ID NO: 1324345 - RNA, 19 nt, Homo sapiens
gcucacuggcuuuaucauu

SEQ ID NO: 1324346 - RNA, 19 nt, Homo sapiens
aaagcuagaagccaagaaa

SEQ ID NO: 1324347 - RNA, 19 nt, Homo sapiens
caggaggaauaugacagua

SEQ ID NO: 1324348 - RNA, 19 nt, Homo sapiens
ucacuggcuuuaucauuac

SEQ ID NO: 1324349 - RNA, 19 nt, Homo sapiens
ugaaaagugucacaaggaa

SEQ ID NO: 1324350 - RNA, 19 nt, Homo sapiens
gcaggaggaauaugacagu

SEQ ID NO: 1324351 - RNA, 19 nt, Homo sapiens
uuuggagacuacacaauga

SEQ ID NO: 1324352 - RNA, 19 nt, Homo sapiens
gcuuuaucauuacaggaaa

SEQ ID NO: 1324353 - RNA, 19 nt, Homo sapiens
gcccagugacccaauagaa

SEQ ID NO: 1324354 - RNA, 19 nt, Homo sapiens
guagaugcuucugauuuac

SEQ ID NO: 1324355 - RNA, 19 nt, Homo sapiens
cauuugaacuaguuauagg

SEQ ID NO: 1324356 - RNA, 19 nt, Homo sapiens
gcuagaaccaagauuuaag

SEQ ID NO: 1324357 - RNA, 19 nt, Homo sapiens
gaaaauggccagcuagaac

SEQ ID NO: 1324358 - RNA, 19 nt, Homo sapiens
ugauuuacuucucucaaag

SEQ ID NO: 1324359 - RNA, 19 nt, Homo sapiens
ucaacagguuccuccuuca

SEQ ID NO: 1324360 - RNA, 19 nt, Homo sapiens
gugaagaaggugccacaga

SEQ ID NO: 1324361 - RNA, 19 nt, Homo sapiens
ggaaacuaacuaccugaag

SEQ ID NO: 1324362 - RNA, 19 nt, Homo sapiens
gaguaucagauucaacaga

SEQ ID NO: 1324363 - RNA, 19 nt, Homo sapiens
caaggaggcuuuucagcau

SEQ ID NO: 1324364 - RNA, 19 nt, Homo sapiens
aaacaggaagaguaucaga

SEQ ID NO: 1324365 - RNA, 19 nt, Homo sapiens
caaggaaauggaaaugaca

SEQ ID NO: 1324366 - RNA, 19 nt, Homo sapiens
gagaauagggaaaagaaga

SEQ ID NO: 1324367 - RNA, 19 nt, Homo sapiens
agaggugcuuuggaaauug

SEQ ID NO: 1324368 - RNA, 19 nt, Homo sapiens
aagaguaucagauucaaca

SEQ ID NO: 1324369 - RNA, 19 nt, Homo sapiens
ugacaguagccucaaggaa

SEQ ID NO: 1324370 - RNA, 19 nt, Homo sapiens
ggaaaacagcaaaagcaaa

SEQ ID NO: 1324371 - RNA, 19 nt, Homo sapiens
gaggugcuuuggaaauugc

SEQ ID NO: 1324372 - RNA, 19 nt, Homo sapiens
ugaagaggugcuuuggaaa

SEQ ID NO: 1324373 - RNA, 19 nt, Homo sapiens
agguagaugcuucugauuu

SEQ ID NO: 1324374 - RNA, 19 nt, Homo sapiens
ggcuuuaucauuacaggaa

SEQ ID NO: 1324375 - RNA, 19 nt, Homo sapiens
agaagaccauauucaugca

SEQ ID NO: 1324376 - RNA, 19 nt, Homo sapiens
cagauugaccagaacuuca

SEQ ID NO: 1324377 - RNA, 19 nt, Homo sapiens
aaagaagagaauagggaaa

SEQ ID NO: 1324378 - RNA, 19 nt, Homo sapiens
agaugcuucugauuuacuu

SEQ ID NO: 1324379 - RNA, 19 nt, Homo sapiens
aaaguccagccgagucaaa

SEQ ID NO: 1324380 - RNA, 19 nt, Homo sapiens
ccuccuggcuccaaaucuc

SEQ ID NO: 1324381 - RNA, 19 nt, Homo sapiens
ggauggaaacuaacuaccu

SEQ ID NO: 1324382 - RNA, 19 nt, Homo sapiens
gaagagaauagggaaaaga

SEQ ID NO: 1324383 - RNA, 19 nt, Homo sapiens
ccagauugaccagaacuuc

SEQ ID NO: 1324384 - RNA, 19 nt, Homo sapiens
ccaggauggaaacuaacua

SEQ ID NO: 1324385 - RNA, 19 nt, Homo sapiens
aaacuaacuaccugaagag

SEQ ID NO: 1324386 - RNA, 19 nt, Homo sapiens
ucucaaaucugucccuuua

SEQ ID NO: 1324387 - RNA, 19 nt, Homo sapiens
ggaaacacuuggugaaaga

SEQ ID NO: 1324388 - RNA, 19 nt, Homo sapiens
ucaacgaucucaugauaaa

SEQ ID NO: 1324389 - RNA, 19 nt, Homo sapiens
caacaacagugacggaaug

SEQ ID NO: 1324390 - RNA, 19 nt, Homo sapiens
gcaguuacccauccuuuaa

SEQ ID NO: 1324391 - RNA, 19 nt, Homo sapiens
augcauggcuaauaaguua

SEQ ID NO: 1324392 - RNA, 19 nt, Homo sapiens
gcuccaugcuugacucuuu

SEQ ID NO: 1324393 - RNA, 19 nt, Homo sapiens
gguuaagugucucaauaaa

SEQ ID NO: 1324394 - RNA, 19 nt, Homo sapiens
uggguuaagugucucaaua

SEQ ID NO: 1324395 - RNA, 19 nt, Homo sapiens
cugcuggucucucucuuua

SEQ ID NO: 1324396 - RNA, 19 nt, Homo sapiens
auacuugguucaacuguuu

SEQ ID NO: 1324397 - RNA, 19 nt, Homo sapiens
gcuggucucucucuuuaau

SEQ ID NO: 1324398 - RNA, 19 nt, Homo sapiens
gcacucaguuauccaagca

SEQ ID NO: 1324399 - RNA, 19 nt, Homo sapiens
uacauuaccugcuauaucu

SEQ ID NO: 1324400 - RNA, 19 nt, Homo sapiens
ucaaaucugucccuuuagu

SEQ ID NO: 1324401 - RNA, 19 nt, Homo sapiens
ccacuuggauguccugaag

SEQ ID NO: 1324402 - RNA, 19 nt, Homo sapiens
ccacugcagcacauucuua

SEQ ID NO: 1324403 - RNA, 19 nt, Homo sapiens
gaucagacuuucaucuacu

SEQ ID NO: 1324404 - RNA, 19 nt, Homo sapiens
gggaucagacuuucaucua

SEQ ID NO: 1324405 - RNA, 19 nt, Homo sapiens
ggaaagcggaaccaccaaa

SEQ ID NO: 1324406 - RNA, 19 nt, Homo sapiens
caccuaacacucacacaua

SEQ ID NO: 1324407 - RNA, 19 nt, Homo sapiens
cuuauuacaucucaccaaa

SEQ ID NO: 1324408 - RNA, 19 nt, Homo sapiens
gcauaucuacgaaugauca

SEQ ID NO: 1324409 - RNA, 19 nt, Homo sapiens
cggaaugccuccauacauc

SEQ ID NO: 1324410 - RNA, 19 nt, Homo sapiens
uaaagccagucuucacuag

SEQ ID NO: 1324411 - RNA, 19 nt, Homo sapiens
ggaucagacuuucaucuac

SEQ ID NO: 1324412 - RNA, 19 nt, Homo sapiens
acacucacacauacaaaua

SEQ ID NO: 1324413 - RNA, 19 nt, Homo sapiens
cagcauaucuacgaaugau

SEQ ID NO: 1324414 - RNA, 19 nt, Homo sapiens
caaagccacugcagcacau

SEQ ID NO: 1324415 - RNA, 19 nt, Homo sapiens
ggguuaagugucucaauaa

SEQ ID NO: 1324416 - RNA, 19 nt, Homo sapiens
ucacacauacaaauacuug

SEQ ID NO: 1324417 - RNA, 19 nt, Homo sapiens
gaccucaggauacauuaaa

SEQ ID NO: 1324418 - RNA, 19 nt, Homo sapiens
gcagcacauucuuaacugu

SEQ ID NO: 1324419 - RNA, 19 nt, Homo sapiens
uaacaaaacugggcaaagu

SEQ ID NO: 1324420 - RNA, 19 nt, Homo sapiens
aaacucagcauaucuacga

SEQ ID NO: 1324421 - RNA, 19 nt, Homo sapiens
uguaaaggguaucugauca

SEQ ID NO: 1324422 - RNA, 19 nt, Homo sapiens
gaauggcuacccaaaggaa

SEQ ID NO: 1324423 - RNA, 19 nt, Homo sapiens
ccuaccaccugcagauuug

SEQ ID NO: 1324424 - RNA, 19 nt, Homo sapiens
acaaauacuugguucaacu

SEQ ID NO: 1324425 - RNA, 19 nt, Homo sapiens
agaaauaugcuccaugcuu

SEQ ID NO: 1324426 - RNA, 19 nt, Homo sapiens
gcauggcuaauaaguuaaa

SEQ ID NO: 1324427 - RNA, 19 nt, Homo sapiens
ugaauaaaugcauggcuaa

SEQ ID NO: 1324428 - RNA, 19 nt, Homo sapiens
uaacuguguccaaguggua

SEQ ID NO: 1324429 - RNA, 19 nt, Homo sapiens
gugacggaaugccuccaua

SEQ ID NO: 1324430 - RNA, 19 nt, Homo sapiens
uaaaggguaucugaucaag

SEQ ID NO: 1324431 - RNA, 19 nt, Homo sapiens
guaaaggguaucugaucaa

SEQ ID NO: 1324432 - RNA, 19 nt, Homo sapiens
ccauacaucugcagaaucc

SEQ ID NO: 1324433 - RNA, 19 nt, Homo sapiens
guucucauucagauucuua

SEQ ID NO: 1324434 - RNA, 19 nt, Homo sapiens
aaaucugucccuuuaguuu

SEQ ID NO: 1324435 - RNA, 19 nt, Homo sapiens
guuauccaagcaagaaaua

SEQ ID NO: 1324436 - RNA, 19 nt, Homo sapiens
ccacgaauggcuacccaaa

SEQ ID NO: 1324437 - RNA, 19 nt, Homo sapiens
uuacuguucucauucagau

SEQ ID NO: 1324438 - RNA, 19 nt, Homo sapiens
cuccaugcuugacucuuua

SEQ ID NO: 1324439 - RNA, 19 nt, Homo sapiens
aaaggaaacacuuggugaa

SEQ ID NO: 1324440 - RNA, 19 nt, Homo sapiens
caaaucugucccuuuaguu

SEQ ID NO: 1324441 - RNA, 19 nt, Homo sapiens
ggaugccagcacucaguua

SEQ ID NO: 1324442 - RNA, 19 nt, Homo sapiens
gaauaaaugcauggcuaau

SEQ ID NO: 1324443 - RNA, 19 nt, Homo sapiens
ucuaagaugugcccuacca

SEQ ID NO: 1324444 - RNA, 19 nt, Homo sapiens
gcuccugggaucagacuuu

SEQ ID NO: 1324445 - RNA, 19 nt, Homo sapiens
gagagcaagacaugggaaa

SEQ ID NO: 1324446 - RNA, 19 nt, Homo sapiens
uaaaacucauccccucuaa

SEQ ID NO: 1324447 - RNA, 19 nt, Homo sapiens
cuaaagccagucuucacua

SEQ ID NO: 1324448 - RNA, 19 nt, Homo sapiens
gcagauuuggguuaagugu

SEQ ID NO: 1324449 - RNA, 19 nt, Homo sapiens
ucaguuauccaagcaagaa

SEQ ID NO: 1324450 - RNA, 19 nt, Homo sapiens
aacacuuggugaaagauuu

SEQ ID NO: 1324451 - RNA, 19 nt, Homo sapiens
cagcuuacugucuuuauca

SEQ ID NO: 1324452 - RNA, 19 nt, Homo sapiens
gaugccagcacucaguuau

SEQ ID NO: 1324453 - RNA, 19 nt, Homo sapiens
ggaaugccuccauacaucu

SEQ ID NO: 1324454 - RNA, 19 nt, Homo sapiens
cuauaucuguaaaggguau

SEQ ID NO: 1324455 - RNA, 19 nt, Homo sapiens
uaacacucacacauacaaa

SEQ ID NO: 1324456 - RNA, 19 nt, Homo sapiens
acucuuaacccacccuaaa

SEQ ID NO: 1324457 - RNA, 19 nt, Homo sapiens
ucuuuacccucacuaacaa

SEQ ID NO: 1324458 - RNA, 19 nt, Homo sapiens
ugaagccaccugaaacuca

SEQ ID NO: 1324459 - RNA, 19 nt, Homo sapiens
acgaauggcuacccaaagg

SEQ ID NO: 1324460 - RNA, 19 nt, Homo sapiens
cuaaagguaucccguugac

SEQ ID NO: 1324461 - RNA, 19 nt, Homo sapiens
uauuacaucucaccaaagc

SEQ ID NO: 1324462 - RNA, 19 nt, Homo sapiens
uauccaagcaagaaauaug

SEQ ID NO: 1324463 - RNA, 19 nt, Homo sapiens
agauuuggguuaagugucu

SEQ ID NO: 1324464 - RNA, 19 nt, Homo sapiens
acuguuugcucuccuugaa

SEQ ID NO: 1324465 - RNA, 19 nt, Homo sapiens
uaucugaucaagccaacaa

SEQ ID NO: 1324466 - RNA, 19 nt, Homo sapiens
uaccugcuauaucuguaaa

SEQ ID NO: 1324467 - RNA, 19 nt, Homo sapiens
caaauacuugguucaacug

SEQ ID NO: 1324468 - RNA, 19 nt, Homo sapiens
agucuucacuagccacgaa

SEQ ID NO: 1324469 - RNA, 19 nt, Homo sapiens
gaaagcggaaccaccaaaa

SEQ ID NO: 1324470 - RNA, 19 nt, Homo sapiens
guccugaagccaccugaaa

SEQ ID NO: 1324471 - RNA, 19 nt, Homo sapiens
uuacauuaccugcuauauc

SEQ ID NO: 1324472 - RNA, 19 nt, Homo sapiens
caccugcagauuuggguua

SEQ ID NO: 1324473 - RNA, 19 nt, Homo sapiens
uagcaguuacccauccuuu

SEQ ID NO: 1324474 - RNA, 19 nt, Homo sapiens
uguuugcucuccuugaaau

SEQ ID NO: 1324475 - RNA, 19 nt, Homo sapiens
ucaacuguuugcucuccuu

SEQ ID NO: 1324476 - RNA, 19 nt, Homo sapiens
ucucaugccucaggacauc

SEQ ID NO: 1324477 - RNA, 19 nt, Homo sapiens
acauuaaagcuacuuagug

SEQ ID NO: 1324478 - RNA, 19 nt, Homo sapiens
ucaggauacauuaaagcua

SEQ ID NO: 1324479 - RNA, 19 nt, Homo sapiens
aaacacuuggugaaagauu

SEQ ID NO: 1324480 - RNA, 19 nt, Homo sapiens
uguccaagugguaauaauu

SEQ ID NO: 1324481 - RNA, 19 nt, Homo sapiens
aaaugaaugccuccucugu

SEQ ID NO: 1324482 - RNA, 19 nt, Homo sapiens
cuaacacucacacauacaa

SEQ ID NO: 1324483 - RNA, 19 nt, Homo sapiens
auccuuacauuaccugcua

SEQ ID NO: 1324484 - RNA, 19 nt, Homo sapiens
guugaccucaggauacauu

SEQ ID NO: 1324485 - RNA, 19 nt, Homo sapiens
ucuuaacuguguccaagug

SEQ ID NO: 1324486 - RNA, 19 nt, Homo sapiens
ggaacaagcuuaaacagaa

SEQ ID NO: 1324487 - RNA, 19 nt, Homo sapiens
gcacauguauuauaacaga

SEQ ID NO: 1324488 - RNA, 19 nt, Homo sapiens
gaacaagcuuaaacagaaa

SEQ ID NO: 1324489 - RNA, 19 nt, Homo sapiens
gugaaacccugucuacaaa

SEQ ID NO: 1324490 - RNA, 19 nt, Homo sapiens
gcaauacucccgucucaaa

SEQ ID NO: 1324491 - RNA, 19 nt, Homo sapiens
guuaguagauucuucaaug

SEQ ID NO: 1324492 - RNA, 19 nt, Homo sapiens
agaaacagcagcacuauuu

SEQ ID NO: 1324493 - RNA, 19 nt, Homo sapiens
uaacagagauugguacaag

SEQ ID NO: 1324494 - RNA, 19 nt, Homo sapiens
gagcaauacucccgucuca

SEQ ID NO: 1324495 - RNA, 19 nt, Homo sapiens
gcacuaagccaagauccua

SEQ ID NO: 1324496 - RNA, 19 nt, Homo sapiens
caaacgagacucuguauca

SEQ ID NO: 1324497 - RNA, 19 nt, Homo sapiens
cagaagcacauguauuaua

SEQ ID NO: 1324498 - RNA, 19 nt, Homo sapiens
gcucacgccuguaaucuca

SEQ ID NO: 1324499 - RNA, 19 nt, Homo sapiens
ccuguaaucccaacaauuu

SEQ ID NO: 1324500 - RNA, 19 nt, Homo sapiens
cagaagaaauggcggacuu

SEQ ID NO: 1324501 - RNA, 19 nt, Homo sapiens
gugaggacaugaaagcaaa

SEQ ID NO: 1324502 - RNA, 19 nt, Homo sapiens
gaagucugcugacgggaau

SEQ ID NO: 1324503 - RNA, 19 nt, Homo sapiens
ggugaaacccugucuacaa

SEQ ID NO: 1324504 - RNA, 19 nt, Homo sapiens
gcacgagaaucacuugaac

SEQ ID NO: 1324505 - RNA, 19 nt, Homo sapiens
ggucagaaagcaacauuga

SEQ ID NO: 1324506 - RNA, 19 nt, Homo sapiens
ccuguaaucucagcacuuu

SEQ ID NO: 1324507 - RNA, 19 nt, Homo sapiens
caugaaagcaaaugcaauu

SEQ ID NO: 1324508 - RNA, 19 nt, Homo sapiens
ggacuucuacaaggaauuu

SEQ ID NO: 1324509 - RNA, 19 nt, Homo sapiens
gaaagucuugccaugauug

SEQ ID NO: 1324510 - RNA, 19 nt, Homo sapiens
gcgaaacccugccucuaca

SEQ ID NO: 1324511 - RNA, 19 nt, Homo sapiens
uucagaagcacauguauua

SEQ ID NO: 1324512 - RNA, 19 nt, Homo sapiens
gagcuucgaggauugauug

SEQ ID NO: 1324513 - RNA, 19 nt, Homo sapiens
uaacuugauucuugguguu

SEQ ID NO: 1324514 - RNA, 19 nt, Homo sapiens
ugacgggaaugauguggaa

SEQ ID NO: 1324515 - RNA, 19 nt, Homo sapiens
gcggguggaucacuugaga

SEQ ID NO: 1324516 - RNA, 19 nt, Homo sapiens
uuuccuguguuucgaauua

SEQ ID NO: 1324517 - RNA, 19 nt, Homo sapiens
ggaaaggauuuggaacaag

SEQ ID NO: 1324518 - RNA, 19 nt, Homo sapiens
agaauggaaucaacaguuc

SEQ ID NO: 1324519 - RNA, 19 nt, Homo sapiens
gauggagggugccuuuagu

SEQ ID NO: 1324520 - RNA, 19 nt, Homo sapiens
gcagauggagcuccuuuca

SEQ ID NO: 1324521 - RNA, 19 nt, Homo sapiens
gccaagauccuaccacuag

SEQ ID NO: 1324522 - RNA, 19 nt, Homo sapiens
gaaacccugccucuacaaa

SEQ ID NO: 1324523 - RNA, 19 nt, Homo sapiens
aaacgagacucuguaucaa

SEQ ID NO: 1324524 - RNA, 19 nt, Homo sapiens
agauggagcuccuuucaca

SEQ ID NO: 1324525 - RNA, 19 nt, Homo sapiens
ggauuuggaacaagcuuaa

SEQ ID NO: 1324526 - RNA, 19 nt, Homo sapiens
ucagaaagcaacauugaau

SEQ ID NO: 1324527 - RNA, 19 nt, Homo sapiens
gacaagaaacacaagaaug

SEQ ID NO: 1324528 - RNA, 19 nt, Homo sapiens
guagauucuucaaugcuau

SEQ ID NO: 1324529 - RNA, 19 nt, Homo sapiens
gaccaaacgagacucugua

SEQ ID NO: 1324530 - RNA, 19 nt, Homo sapiens
gcaaaacccugucucuaca

SEQ ID NO: 1324531 - RNA, 19 nt, Homo sapiens
guacguggugugaaauaaa

SEQ ID NO: 1324532 - RNA, 19 nt, Homo sapiens
gcucuaggccagcuuguug

SEQ ID NO: 1324533 - RNA, 19 nt, Homo sapiens
ccuucgaccuguucacuuu

SEQ ID NO: 1324534 - RNA, 19 nt, Homo sapiens
uaaacacgaagguuaaaug

SEQ ID NO: 1324535 - RNA, 19 nt, Homo sapiens
acaagaaacagcagcacua

SEQ ID NO: 1324536 - RNA, 19 nt, Homo sapiens
ccuauaaucccagcacuuu

SEQ ID NO: 1324537 - RNA, 19 nt, Homo sapiens
ucaagauucugcccuccaa

SEQ ID NO: 1324538 - RNA, 19 nt, Homo sapiens
agaaagucuugccaugauu

SEQ ID NO: 1324539 - RNA, 19 nt, Homo sapiens
gauucuugguguuaacuau

SEQ ID NO: 1324540 - RNA, 19 nt, Homo sapiens
gacccugucucaaauaaaa

SEQ ID NO: 1324541 - RNA, 19 nt, Homo sapiens
ggccaggcauggugacuca

SEQ ID NO: 1324542 - RNA, 19 nt, Homo sapiens
gagaucaggaguucaagau

SEQ ID NO: 1324543 - RNA, 19 nt, Homo sapiens
ugaaugcagugcgguguga

SEQ ID NO: 1324544 - RNA, 19 nt, Homo sapiens
uggaaaggauuuggaacaa

SEQ ID NO: 1324545 - RNA, 19 nt, Homo sapiens
acacaagaauggaaucaac

SEQ ID NO: 1324546 - RNA, 19 nt, Homo sapiens
ccagauaaauauucaaacc

SEQ ID NO: 1324547 - RNA, 19 nt, Homo sapiens
caagaaacagcagcacuau

SEQ ID NO: 1324548 - RNA, 19 nt, Homo sapiens
ggacaugaaagcaaaugca

SEQ ID NO: 1324549 - RNA, 19 nt, Homo sapiens
acaagaaacacaagaaugg

SEQ ID NO: 1324550 - RNA, 19 nt, Homo sapiens
ugaaucaggucagaaagca

SEQ ID NO: 1324551 - RNA, 19 nt, Homo sapiens
aggcugagcuucgaggauu

SEQ ID NO: 1324552 - RNA, 19 nt, Homo sapiens
gguggagggugccuguaau

SEQ ID NO: 1324553 - RNA, 19 nt, Homo sapiens
gguccaggcugcacuaagc

SEQ ID NO: 1324554 - RNA, 19 nt, Homo sapiens
aguagauucuucaaugcua

SEQ ID NO: 1324555 - RNA, 19 nt, Homo sapiens
gcaggagaauagcaugaac

SEQ ID NO: 1324556 - RNA, 19 nt, Homo sapiens
gaaccaguuugggcaacau

SEQ ID NO: 1324557 - RNA, 19 nt, Homo sapiens
ggccaaggcaagcaaauca

SEQ ID NO: 1324558 - RNA, 19 nt, Homo sapiens
ccaggcauggugacucaua

SEQ ID NO: 1324559 - RNA, 19 nt, Homo sapiens
gacaugaaagcaaaugcaa

SEQ ID NO: 1324560 - RNA, 19 nt, Homo sapiens
cguacguggugugaaauaa

SEQ ID NO: 1324561 - RNA, 19 nt, Homo sapiens
aagcugaggcgggagaaua

SEQ ID NO: 1324562 - RNA, 19 nt, Homo sapiens
caagaucagucuggacaac

SEQ ID NO: 1324563 - RNA, 19 nt, Homo sapiens
gaucaugaggucaggagau

SEQ ID NO: 1324564 - RNA, 19 nt, Homo sapiens
caugauggagggugccuuu

SEQ ID NO: 1324565 - RNA, 19 nt, Homo sapiens
ggccaaacauggugaaacc

SEQ ID NO: 1324566 - RNA, 19 nt, Homo sapiens
gucaggagaucgagaccau

SEQ ID NO: 1324567 - RNA, 19 nt, Homo sapiens
aagaauggaaucaacaguu

SEQ ID NO: 1324568 - RNA, 19 nt, Homo sapiens
caagaaacacaagaaugga

SEQ ID NO: 1324569 - RNA, 19 nt, Homo sapiens
ggaguucgaaccaguuugg

SEQ ID NO: 1324570 - RNA, 19 nt, Homo sapiens
cacuugagcucaggaguuc

SEQ ID NO: 1324571 - RNA, 19 nt, Homo sapiens
gaaacacaagaauggaauc

SEQ ID NO: 1324572 - RNA, 19 nt, Homo sapiens
cgaggcggguggaucacuu

SEQ ID NO: 1324573 - RNA, 19 nt, Homo sapiens
ccuguaaucccagcacuuu

SEQ ID NO: 1324574 - RNA, 19 nt, Homo sapiens
acuccagccugacgacaaa

SEQ ID NO: 1324575 - RNA, 19 nt, Homo sapiens
cgaggugggcagaucauga

SEQ ID NO: 1324576 - RNA, 19 nt, Homo sapiens
ucacuugagcucaggaguu

SEQ ID NO: 1324577 - RNA, 19 nt, Homo sapiens
ggaacaaaagcuuagaaaa

SEQ ID NO: 1324578 - RNA, 19 nt, Homo sapiens
gaaacagcagcacuauuuu

SEQ ID NO: 1324579 - RNA, 19 nt, Homo sapiens
uggcggacuucuacaagga

SEQ ID NO: 1324580 - RNA, 19 nt, Homo sapiens
gagaccauccugcccaaca

SEQ ID NO: 1324581 - RNA, 19 nt, Homo sapiens
uaagacaagaaacacaaga

SEQ ID NO: 1324582 - RNA, 19 nt, Homo sapiens
gaagaccaaacgagacucu

SEQ ID NO: 1324583 - RNA, 19 nt, Homo sapiens
gccagcuuguugucacgua

SEQ ID NO: 1324584 - RNA, 19 nt, Homo sapiens
gucuugccaugauuggaua

SEQ ID NO: 1324585 - RNA, 19 nt, Homo sapiens
caacaguucugggcaaacc

SEQ ID NO: 1324586 - RNA, 19 nt, Homo sapiens
cgacagauuccuucuauua

SEQ ID NO: 1324587 - RNA, 19 nt, Homo sapiens
gggauuggcucgcugaguu

SEQ ID NO: 1324588 - RNA, 19 nt, Homo sapiens
gcaccgauuuccucuacuu

SEQ ID NO: 1324589 - RNA, 19 nt, Homo sapiens
cuaaaugggucaacuccuu

SEQ ID NO: 1324590 - RNA, 19 nt, Homo sapiens
uggaagagccgaacggaua

SEQ ID NO: 1324591 - RNA, 19 nt, Homo sapiens
ggaagagccgaacggauaa

SEQ ID NO: 1324592 - RNA, 19 nt, Homo sapiens
aagaaaugcugccguguug

SEQ ID NO: 1324593 - RNA, 19 nt, Homo sapiens
cagcugggcauuagugaua

SEQ ID NO: 1324594 - RNA, 19 nt, Homo sapiens
gagcaccgauuuccucuac

SEQ ID NO: 1324595 - RNA, 19 nt, Homo sapiens
gacagauuccuucuauuaa

SEQ ID NO: 1324596 - RNA, 19 nt, Homo sapiens
gauaauggagggcucuuug

SEQ ID NO: 1324597 - RNA, 19 nt, Homo sapiens
gagccaauauacacuaugg

SEQ ID NO: 1324598 - RNA, 19 nt, Homo sapiens
gaaaugcugccguguugga

SEQ ID NO: 1324599 - RNA, 19 nt, Homo sapiens
ugggucaacuccuuuguuu

SEQ ID NO: 1324600 - RNA, 19 nt, Homo sapiens
gagagccaauauacacuau

SEQ ID NO: 1324601 - RNA, 19 nt, Homo sapiens
ggagagccaauauacacua

SEQ ID NO: 1324602 - RNA, 19 nt, Homo sapiens
gcaaaccgaagcaagaaau

SEQ ID NO: 1324603 - RNA, 19 nt, Homo sapiens
uuacuguggucaugauuga

SEQ ID NO: 1324604 - RNA, 19 nt, Homo sapiens
ggagggagagccaauauac

SEQ ID NO: 1324605 - RNA, 19 nt, Homo sapiens
caagaaaugcugccguguu

SEQ ID NO: 1324606 - RNA, 19 nt, Homo sapiens
cauaugaggacggccauua

SEQ ID NO: 1324607 - RNA, 19 nt, Homo sapiens
gggagcagcugggcauuag

SEQ ID NO: 1324608 - RNA, 19 nt, Homo sapiens
gcugaguucuaagcucuaa

SEQ ID NO: 1324609 - RNA, 19 nt, Homo sapiens
gagccgaacggauaagaga

SEQ ID NO: 1324610 - RNA, 19 nt, Homo sapiens
cauagucaccguccgcuuu

SEQ ID NO: 1324611 - RNA, 19 nt, Homo sapiens
gaggagcuguacaccacaa

SEQ ID NO: 1324612 - RNA, 19 nt, Homo sapiens
caauuuacguucuuuacac

SEQ ID NO: 1324613 - RNA, 19 nt, Homo sapiens
uaaaugggucaacuccuuu

SEQ ID NO: 1324614 - RNA, 19 nt, Homo sapiens
gaggacggccauuauuguu

SEQ ID NO: 1324615 - RNA, 19 nt, Homo sapiens
acagauuccuucuauuaag

SEQ ID NO: 1324616 - RNA, 19 nt, Homo sapiens
ggucaugauugagcauaug

SEQ ID NO: 1324617 - RNA, 19 nt, Homo sapiens
ugaguucucccucccaauu

SEQ ID NO: 1324618 - RNA, 19 nt, Homo sapiens
gauugggucugucgucucu

SEQ ID NO: 1324619 - RNA, 19 nt, Homo sapiens
gggagggagagccaauaua

SEQ ID NO: 1324620 - RNA, 19 nt, Homo sapiens
gaggaugagcccacagaga

SEQ ID NO: 1324621 - RNA, 19 nt, Homo sapiens
gcgacagauuccuucuauu

SEQ ID NO: 1324622 - RNA, 19 nt, Homo sapiens
gagcagcugggcauuagug

SEQ ID NO: 1324623 - RNA, 19 nt, Homo sapiens
gcaaauggaaaugcucuag

SEQ ID NO: 1324624 - RNA, 19 nt, Homo sapiens
aagcugaagcggaaauauu

SEQ ID NO: 1324625 - RNA, 19 nt, Homo sapiens
caacagccugccaaucgaa

SEQ ID NO: 1324626 - RNA, 19 nt, Homo sapiens
gcccuccucuucccagaau

SEQ ID NO: 1324627 - RNA, 19 nt, Homo sapiens
gagucaccgucgcgagaaa

SEQ ID NO: 1324628 - RNA, 19 nt, Homo sapiens
ggaggugagaggagcugua

SEQ ID NO: 1324629 - RNA, 19 nt, Homo sapiens
aagcggaaauauugaaguc

SEQ ID NO: 1324630 - RNA, 19 nt, Homo sapiens
gaagcugaagcggaaauau

SEQ ID NO: 1324631 - RNA, 19 nt, Homo sapiens
uaugaggacggccauuauu

SEQ ID NO: 1324632 - RNA, 19 nt, Homo sapiens
ucaggucgcuugccuucgu

SEQ ID NO: 1324633 - RNA, 19 nt, Homo sapiens
gagggagggagagccaaua

SEQ ID NO: 1324634 - RNA, 19 nt, Homo sapiens
uggcucaaauccuguaaag

SEQ ID NO: 1324635 - RNA, 19 nt, Homo sapiens
agcgacagauuccuucuau

SEQ ID NO: 1324636 - RNA, 19 nt, Homo sapiens
ccucagcccuacccacaca

SEQ ID NO: 1324637 - RNA, 19 nt, Homo sapiens
caacgaggaggacgaggau

SEQ ID NO: 1324638 - RNA, 19 nt, Homo sapiens
gaagcggaaauauugaagu

SEQ ID NO: 1324639 - RNA, 19 nt, Homo sapiens
gcugccauguuguuaacga

SEQ ID NO: 1324640 - RNA, 19 nt, Homo sapiens
acaacagccugccaaucga

SEQ ID NO: 1324641 - RNA, 19 nt, Homo sapiens
cggacgaauuucugaguca

SEQ ID NO: 1324642 - RNA, 19 nt, Homo sapiens
gauaagggaggcggagugu

SEQ ID NO: 1324643 - RNA, 19 nt, Homo sapiens
cuccacaggugccuuaaag

SEQ ID NO: 1324644 - RNA, 19 nt, Homo sapiens
cacaacagccugccaaucg

SEQ ID NO: 1324645 - RNA, 19 nt, Homo sapiens
ggccuucaauuuacguucu

SEQ ID NO: 1324646 - RNA, 19 nt, Homo sapiens
ucaaggagaagaggacaga

SEQ ID NO: 1324647 - RNA, 19 nt, Homo sapiens
ugaggacggccauuauugu

SEQ ID NO: 1324648 - RNA, 19 nt, Homo sapiens
ugucgaagaaguuuauugu

SEQ ID NO: 1324649 - RNA, 19 nt, Homo sapiens
uauacacuaugggcugauu

SEQ ID NO: 1324650 - RNA, 19 nt, Homo sapiens
caaaccgaagcaagaaaug

SEQ ID NO: 1324651 - RNA, 19 nt, Homo sapiens
gcugaagcggaaauauuga

SEQ ID NO: 1324652 - RNA, 19 nt, Homo sapiens
ggucgcuugccuucguuua

SEQ ID NO: 1324653 - RNA, 19 nt, Homo sapiens
ggagggagggagagccaau

SEQ ID NO: 1324654 - RNA, 19 nt, Homo sapiens
gagggagagccaauauaca

SEQ ID NO: 1324655 - RNA, 19 nt, Homo sapiens
ggucaacuccuuuguuuuc

SEQ ID NO: 1324656 - RNA, 19 nt, Homo sapiens
ggacuggggucgucuuugc

SEQ ID NO: 1324657 - RNA, 19 nt, Homo sapiens
gauuugcucgcacggcauu

SEQ ID NO: 1324658 - RNA, 19 nt, Homo sapiens
ugaguucuaagcucuaaau

SEQ ID NO: 1324659 - RNA, 19 nt, Homo sapiens
uaauggagggcucuuugug

SEQ ID NO: 1324660 - RNA, 19 nt, Homo sapiens
gcccacgucccgacaacuu

SEQ ID NO: 1324661 - RNA, 19 nt, Homo sapiens
uggccaagcccuccucuuc

SEQ ID NO: 1324662 - RNA, 19 nt, Homo sapiens
gaguucucccucccaauug

SEQ ID NO: 1324663 - RNA, 19 nt, Homo sapiens
aauggagggcucuuuguga

SEQ ID NO: 1324664 - RNA, 19 nt, Homo sapiens
uuggcucgcugaguucuaa

SEQ ID NO: 1324665 - RNA, 19 nt, Homo sapiens
gcuuaacaccagcgacuuc

SEQ ID NO: 1324666 - RNA, 19 nt, Homo sapiens
ccgaacggauaagagaaga

SEQ ID NO: 1324667 - RNA, 19 nt, Homo sapiens
ggagcuguacaccacaaga

SEQ ID NO: 1324668 - RNA, 19 nt, Homo sapiens
gcugccguguuggaucuuu

SEQ ID NO: 1324669 - RNA, 19 nt, Homo sapiens
uacacuaugggcugauuaa

SEQ ID NO: 1324670 - RNA, 19 nt, Homo sapiens
cgucucccauucccaagau

SEQ ID NO: 1324671 - RNA, 19 nt, Homo sapiens
ggaugagcccacagagaca

SEQ ID NO: 1324672 - RNA, 19 nt, Homo sapiens
gccguugccuccacgacau

SEQ ID NO: 1324673 - RNA, 19 nt, Homo sapiens
ugucaacugguucggauga

SEQ ID NO: 1324674 - RNA, 19 nt, Homo sapiens
ggcaaaccgaagcaagaaa

SEQ ID NO: 1324675 - RNA, 19 nt, Homo sapiens
gaaggaagauggagauugg

SEQ ID NO: 1324676 - RNA, 19 nt, Homo sapiens
ggacugcccuuucccaaga

SEQ ID NO: 1324677 - RNA, 19 nt, Homo sapiens
gaagugagcaaaugugaaa

SEQ ID NO: 1324678 - RNA, 19 nt, Homo sapiens
gcacuccaauuggccauua

SEQ ID NO: 1324679 - RNA, 19 nt, Homo sapiens
caagauggcgucgaagaua

SEQ ID NO: 1324680 - RNA, 19 nt, Homo sapiens
gaagucacauggguucuca

SEQ ID NO: 1324681 - RNA, 19 nt, Homo sapiens
guuaagaggcagcucauuu

SEQ ID NO: 1324682 - RNA, 19 nt, Homo sapiens
guaucuaccucaucugugu

SEQ ID NO: 1324683 - RNA, 19 nt, Homo sapiens
gcugugcgcuaguuucaug

SEQ ID NO: 1324684 - RNA, 19 nt, Homo sapiens
ggagacagaggaaggaaga

SEQ ID NO: 1324685 - RNA, 19 nt, Homo sapiens
gauuggaagugagcaaaug

SEQ ID NO: 1324686 - RNA, 19 nt, Homo sapiens
gcgcacaguugccaucauc

SEQ ID NO: 1324687 - RNA, 19 nt, Homo sapiens
ggaaggaagauggagauug

SEQ ID NO: 1324688 - RNA, 19 nt, Homo sapiens
gcugagcacuacagaaguc

SEQ ID NO: 1324689 - RNA, 19 nt, Homo sapiens
gaagauggagauuggaagu

SEQ ID NO: 1324690 - RNA, 19 nt, Homo sapiens
gaguagagcagacccuguu

SEQ ID NO: 1324691 - RNA, 19 nt, Homo sapiens
guucugcucugggcuguga

SEQ ID NO: 1324692 - RNA, 19 nt, Homo sapiens
agauggagauuggaaguga

SEQ ID NO: 1324693 - RNA, 19 nt, Homo sapiens
uggcguaucugaaccaucu

SEQ ID NO: 1324694 - RNA, 19 nt, Homo sapiens
gggcugagcacuacagaag

SEQ ID NO: 1324695 - RNA, 19 nt, Homo sapiens
ggaagugagcaaaugugaa

SEQ ID NO: 1324696 - RNA, 19 nt, Homo sapiens
uuaagaggcagcucauuug

SEQ ID NO: 1324697 - RNA, 19 nt, Homo sapiens
cccagugccuuaccuguau

SEQ ID NO: 1324698 - RNA, 19 nt, Homo sapiens
cuucggaacugcugucauc

SEQ ID NO: 1324699 - RNA, 19 nt, Homo sapiens
gagggaguguguguguuga

SEQ ID NO: 1324700 - RNA, 19 nt, Homo sapiens
gagagggaguguguguguu

SEQ ID NO: 1324701 - RNA, 19 nt, Homo sapiens
gcucugcagugcuguuugg

SEQ ID NO: 1324702 - RNA, 19 nt, Homo sapiens
ggaugcggcuacugagagu

SEQ ID NO: 1324703 - RNA, 19 nt, Homo sapiens
cacuaaugcuguacagguu

SEQ ID NO: 1324704 - RNA, 19 nt, Homo sapiens
ggcugaagguccguaugua

SEQ ID NO: 1324705 - RNA, 19 nt, Homo sapiens
gcgcuaguuucauguccuu

SEQ ID NO: 1324706 - RNA, 19 nt, Homo sapiens
ccaaacaccagaccacaca

SEQ ID NO: 1324707 - RNA, 19 nt, Homo sapiens
gagagagugugggcaucuu

SEQ ID NO: 1324708 - RNA, 19 nt, Homo sapiens
gcugggaugcggcuacuga

SEQ ID NO: 1324709 - RNA, 19 nt, Homo sapiens
gcaggcaguggccagcuuu

SEQ ID NO: 1324710 - RNA, 19 nt, Homo sapiens
gcacaggggcugagcacua

SEQ ID NO: 1324711 - RNA, 19 nt, Homo sapiens
uuaccuguauuucgacaug

SEQ ID NO: 1324712 - RNA, 19 nt, Homo sapiens
gcacuacagaagucacaug

SEQ ID NO: 1324713 - RNA, 19 nt, Homo sapiens
gagauuggaagugagcaaa

SEQ ID NO: 1324714 - RNA, 19 nt, Homo sapiens
gaggaaggaagauggagau

SEQ ID NO: 1324715 - RNA, 19 nt, Homo sapiens
ugccuuaccuguauuucga

SEQ ID NO: 1324716 - RNA, 19 nt, Homo sapiens
gaccacacaguccuccaaa

SEQ ID NO: 1324717 - RNA, 19 nt, Homo sapiens
aagauggcgucgaagauag

SEQ ID NO: 1324718 - RNA, 19 nt, Homo sapiens
uaagaggcagcucauuugu

SEQ ID NO: 1324719 - RNA, 19 nt, Homo sapiens
ccagugccuuaccuguauu

SEQ ID NO: 1324720 - RNA, 19 nt, Homo sapiens
gggaguguguguguugaca

SEQ ID NO: 1324721 - RNA, 19 nt, Homo sapiens
ccaagauggcgucgaagau

SEQ ID NO: 1324722 - RNA, 19 nt, Homo sapiens
gcagugcuguuuggagacu

SEQ ID NO: 1324723 - RNA, 19 nt, Homo sapiens
gcuaguuucauguccuuug

SEQ ID NO: 1324724 - RNA, 19 nt, Homo sapiens
ugagagggagugugugugu

SEQ ID NO: 1324725 - RNA, 19 nt, Homo sapiens
gaggggagcugaugaucca

SEQ ID NO: 1324726 - RNA, 19 nt, Homo sapiens
ggagauuggaagugagcaa

SEQ ID NO: 1324727 - RNA, 19 nt, Homo sapiens
gaccggcuggcguaucuga

SEQ ID NO: 1324728 - RNA, 19 nt, Homo sapiens
gagcacuacagaagucaca

SEQ ID NO: 1324729 - RNA, 19 nt, Homo sapiens
agagggaguguguguguug

SEQ ID NO: 1324730 - RNA, 19 nt, Homo sapiens
ggagagagugugggcaucu

SEQ ID NO: 1324731 - RNA, 19 nt, Homo sapiens
gaaacaguaccggcucucu

SEQ ID NO: 1324732 - RNA, 19 nt, Homo sapiens
gcugaagguccguauguac

SEQ ID NO: 1324733 - RNA, 19 nt, Homo sapiens
ccugcugucucuguuucua

SEQ ID NO: 1324734 - RNA, 19 nt, Homo sapiens
uggaagugagcaaauguga

SEQ ID NO: 1324735 - RNA, 19 nt, Homo sapiens
ccagaugaagcuccuugga

SEQ ID NO: 1324736 - RNA, 19 nt, Homo sapiens
gaugauccagcuguucuuc

SEQ ID NO: 1324737 - RNA, 19 nt, Homo sapiens
gaaauccugugaugugaaa

SEQ ID NO: 1324738 - RNA, 19 nt, Homo sapiens
gaaagccgccucccaagaa

SEQ ID NO: 1324739 - RNA, 19 nt, Homo sapiens
gagaaauccugugauguga

SEQ ID NO: 1324740 - RNA, 19 nt, Homo sapiens
ucacaagcccuuaaauaaa

SEQ ID NO: 1324741 - RNA, 19 nt, Homo sapiens
ggaagcccguuucauguuc

SEQ ID NO: 1324742 - RNA, 19 nt, Homo sapiens
cacaagcccuuaaauaaag

SEQ ID NO: 1324743 - RNA, 19 nt, Homo sapiens
aaucacaagcccuuaaaua

SEQ ID NO: 1324744 - RNA, 19 nt, Homo sapiens
ccaggaagcccguuucaug

SEQ ID NO: 1324745 - RNA, 19 nt, Homo sapiens
cgagaaauccugugaugug

SEQ ID NO: 1324746 - RNA, 19 nt, Homo sapiens
ggacaagggaagcccacua

SEQ ID NO: 1324747 - RNA, 19 nt, Homo sapiens
cacgagaaauccugugaug

SEQ ID NO: 1324748 - RNA, 19 nt, Homo sapiens
cagaacccguggaugugua

SEQ ID NO: 1324749 - RNA, 19 nt, Homo sapiens
gcccauaacguaucuguca

SEQ ID NO: 1324750 - RNA, 19 nt, Homo sapiens
gaagcccguuucauguuca

SEQ ID NO: 1324751 - RNA, 19 nt, Homo sapiens
ggccugaacugaucucacu

SEQ ID NO: 1324752 - RNA, 19 nt, Homo sapiens
guggauguguacagugauu

SEQ ID NO: 1324753 - RNA, 19 nt, Homo sapiens
uguguacagugauuggaua

SEQ ID NO: 1324754 - RNA, 19 nt, Homo sapiens
guacagugauuggauagac

SEQ ID NO: 1324755 - RNA, 19 nt, Homo sapiens
gaauuccagacgcccauaa

SEQ ID NO: 1324756 - RNA, 19 nt, Homo sapiens
acaccggagucaucucuug

SEQ ID NO: 1324757 - RNA, 19 nt, Homo sapiens
cgaaagccgccucccaaga

SEQ ID NO: 1324758 - RNA, 19 nt, Homo sapiens
ccguggauguguacaguga

SEQ ID NO: 1324759 - RNA, 19 nt, Homo sapiens
ugucagaacccguggaugu

SEQ ID NO: 1324760 - RNA, 19 nt, Homo sapiens
aucacaagcccuuaaauaa

SEQ ID NO: 1324761 - RNA, 19 nt, Homo sapiens
ucaaucacaagcccuuaaa

SEQ ID NO: 1324762 - RNA, 19 nt, Homo sapiens
caggaagcccguuucaugu

SEQ ID NO: 1324763 - RNA, 19 nt, Homo sapiens
caagggaagcccacuagag

SEQ ID NO: 1324764 - RNA, 19 nt, Homo sapiens
gacaagggaagcccacuag

SEQ ID NO: 1324765 - RNA, 19 nt, Homo sapiens
gccaaucaguagcgacaca

SEQ ID NO: 1324766 - RNA, 19 nt, Homo sapiens
uccagacgcccauaacgua

SEQ ID NO: 1324767 - RNA, 19 nt, Homo sapiens
gcagaaagucaaaacgaaa

SEQ ID NO: 1324768 - RNA, 19 nt, Homo sapiens
ucauccaccugcagacaug

SEQ ID NO: 1324769 - RNA, 19 nt, Homo sapiens
ggaauuccagacgcccaua

SEQ ID NO: 1324770 - RNA, 19 nt, Homo sapiens
caacaccggagucaucucu

SEQ ID NO: 1324771 - RNA, 19 nt, Homo sapiens
guaaccaggaagcccguuu

SEQ ID NO: 1324772 - RNA, 19 nt, Homo sapiens
gggacuguuuccugacauc

SEQ ID NO: 1324773 - RNA, 19 nt, Homo sapiens
ccgugugccuagaggaauu

SEQ ID NO: 1324774 - RNA, 19 nt, Homo sapiens
gucaaucacaagcccuuaa

SEQ ID NO: 1324775 - RNA, 19 nt, Homo sapiens
ccagacgcccauaacguau

SEQ ID NO: 1324776 - RNA, 19 nt, Homo sapiens
ccgcaacaccggagucauc

SEQ ID NO: 1324777 - RNA, 19 nt, Homo sapiens
gaagaaagcugauaagcaa

SEQ ID NO: 1324778 - RNA, 19 nt, Homo sapiens
gcaccuagcuacuucauuu

SEQ ID NO: 1324779 - RNA, 19 nt, Homo sapiens
gaaaugugcuuugauguuu

SEQ ID NO: 1324780 - RNA, 19 nt, Homo sapiens
uagcagaaauuauggguua

SEQ ID NO: 1324781 - RNA, 19 nt, Homo sapiens
gaaagaggcauuacuauuc

SEQ ID NO: 1324782 - RNA, 19 nt, Homo sapiens
ggucaaagguucaaucaau

SEQ ID NO: 1324783 - RNA, 19 nt, Homo sapiens
ggaaaugaaugauccugaa

SEQ ID NO: 1324784 - RNA, 19 nt, Homo sapiens
ggagcaagcuuuaaguaug

SEQ ID NO: 1324785 - RNA, 19 nt, Homo sapiens
ggaguuacauauagagauu

SEQ ID NO: 1324786 - RNA, 19 nt, Homo sapiens
caauauaccucgaaucugu

SEQ ID NO: 1324787 - RNA, 19 nt, Homo sapiens
gauaucaaaucccuucauu

SEQ ID NO: 1324788 - RNA, 19 nt, Homo sapiens
guagaaaucccuucauuga

SEQ ID NO: 1324789 - RNA, 19 nt, Homo sapiens
gagaauaagucgucugcuu

SEQ ID NO: 1324790 - RNA, 19 nt, Homo sapiens
gaggaaacauucaggaaau

SEQ ID NO: 1324791 - RNA, 19 nt, Homo sapiens
ggauguagcaauuacuuua

SEQ ID NO: 1324792 - RNA, 19 nt, Homo sapiens
gaagcaaggccaauugaaa

SEQ ID NO: 1324793 - RNA, 19 nt, Homo sapiens
gaagugguuugaccuaaau

SEQ ID NO: 1324794 - RNA, 19 nt, Homo sapiens
gaaucaugcuguucaucua

SEQ ID NO: 1324795 - RNA, 19 nt, Homo sapiens
gagagaaguuaaaggcaaa

SEQ ID NO: 1324796 - RNA, 19 nt, Homo sapiens
caucaucaauccucccaua

SEQ ID NO: 1324797 - RNA, 19 nt, Homo sapiens
gagacacagugacagauuu

SEQ ID NO: 1324798 - RNA, 19 nt, Homo sapiens
gucaaagguucaaucaaua

SEQ ID NO: 1324799 - RNA, 19 nt, Homo sapiens
acagauaccuuagauagaa

SEQ ID NO: 1324800 - RNA, 19 nt, Homo sapiens
ugagaaaugugcuuugaug

SEQ ID NO: 1324801 - RNA, 19 nt, Homo sapiens
gcaaaaggcucugaagaaa

SEQ ID NO: 1324802 - RNA, 19 nt, Homo sapiens
cgaauaaaguacuguuuca

SEQ ID NO: 1324803 - RNA, 19 nt, Homo sapiens
gagaagugguuugaccuaa

SEQ ID NO: 1324804 - RNA, 19 nt, Homo sapiens
gagcguaacuaugaauuuc

SEQ ID NO: 1324805 - RNA, 19 nt, Homo sapiens
ugaauuugcugacuugguu

SEQ ID NO: 1324806 - RNA, 19 nt, Homo sapiens
caaagaagaggaaacauuc

SEQ ID NO: 1324807 - RNA, 19 nt, Homo sapiens
gaucccaguuugaaaguga

SEQ ID NO: 1324808 - RNA, 19 nt, Homo sapiens
ggauacagcccuuguuaga

SEQ ID NO: 1324809 - RNA, 19 nt, Homo sapiens
gaaagguuauagagucaau

SEQ ID NO: 1324810 - RNA, 19 nt, Homo sapiens
gagcggagaaagccuauuu

SEQ ID NO: 1324811 - RNA, 19 nt, Homo sapiens
ugaacaaguugcagauuug

SEQ ID NO: 1324812 - RNA, 19 nt, Homo sapiens
cgagaaagaggcauuacua

SEQ ID NO: 1324813 - RNA, 19 nt, Homo sapiens
uacaguagcuagagauuau

SEQ ID NO: 1324814 - RNA, 19 nt, Homo sapiens
gaagagugguaucacaaag

SEQ ID NO: 1324815 - RNA, 19 nt, Homo sapiens
gcauuggcauuuaaaguuc

SEQ ID NO: 1324816 - RNA, 19 nt, Homo sapiens
cuaccaggcuuaauaggaa

SEQ ID NO: 1324817 - RNA, 19 nt, Homo sapiens
uagaugcuguuacuaugua

SEQ ID NO: 1324818 - RNA, 19 nt, Homo sapiens
aaagaggcauuacuauuca

SEQ ID NO: 1324819 - RNA, 19 nt, Homo sapiens
caagaucacugggagaugu

SEQ ID NO: 1324820 - RNA, 19 nt, Homo sapiens
gaggauauuugcaaugagu

SEQ ID NO: 1324821 - RNA, 19 nt, Homo sapiens
gcacaaagaagaggaaaca

SEQ ID NO: 1324822 - RNA, 19 nt, Homo sapiens
ucaaaucccuucauuccau

SEQ ID NO: 1324823 - RNA, 19 nt, Homo sapiens
ccacagaaagaauauugua

SEQ ID NO: 1324824 - RNA, 19 nt, Homo sapiens
uaaagccacuguaccugaa

SEQ ID NO: 1324825 - RNA, 19 nt, Homo sapiens
ccacagauaccuuagauag

SEQ ID NO: 1324826 - RNA, 19 nt, Homo sapiens
gauccugacucuggacaaa

SEQ ID NO: 1324827 - RNA, 19 nt, Homo sapiens
gaagaucccaguuugaaag

SEQ ID NO: 1324828 - RNA, 19 nt, Homo sapiens
cauuuaaaguucuccauga

SEQ ID NO: 1324829 - RNA, 19 nt, Homo sapiens
cugaagagcguaacuauga

SEQ ID NO: 1324830 - RNA, 19 nt, Homo sapiens
gcuaaaauccguaauauug

SEQ ID NO: 1324831 - RNA, 19 nt, Homo sapiens
gaaagcugauaagcaaguu

SEQ ID NO: 1324832 - RNA, 19 nt, Homo sapiens
aaaggcaucuugugacugu

SEQ ID NO: 1324833 - RNA, 19 nt, Homo sapiens
ugaccaacauguagaaauc

SEQ ID NO: 1324834 - RNA, 19 nt, Homo sapiens
auacagcccuuguuagaug

SEQ ID NO: 1324835 - RNA, 19 nt, Homo sapiens
ucaaaggagugguggaugu

SEQ ID NO: 1324836 - RNA, 19 nt, Homo sapiens
gcaauucaaaugauggaaa

SEQ ID NO: 1324837 - RNA, 19 nt, Homo sapiens
gagcaagcuuuaaguaugc

SEQ ID NO: 1324838 - RNA, 19 nt, Homo sapiens
aaugaaugauccugaauug

SEQ ID NO: 1324839 - RNA, 19 nt, Homo sapiens
gcagaucuggcacaaagaa

SEQ ID NO: 1324840 - RNA, 19 nt, Homo sapiens
aauauggacuggagaccua

SEQ ID NO: 1324841 - RNA, 19 nt, Homo sapiens
gcgugaagaucccaguuug

SEQ ID NO: 1324842 - RNA, 19 nt, Homo sapiens
gaaaagaagcacagacaaa

SEQ ID NO: 1324843 - RNA, 19 nt, Homo sapiens
gagaaagaggcauuacuau

SEQ ID NO: 1324844 - RNA, 19 nt, Homo sapiens
ugccaggccucuaaaugua

SEQ ID NO: 1324845 - RNA, 19 nt, Homo sapiens
gcacuggagccacccguuu

SEQ ID NO: 1324846 - RNA, 19 nt, Homo sapiens
cuacagacugcaauacaua

SEQ ID NO: 1324847 - RNA, 19 nt, Homo sapiens
uugaacaaguugcagauuu

SEQ ID NO: 1324848 - RNA, 19 nt, Homo sapiens
ggaaugccuuaauugaaca

SEQ ID NO: 1324849 - RNA, 19 nt, Homo sapiens
gcaagcugauaaacacaau

SEQ ID NO: 1324850 - RNA, 19 nt, Homo sapiens
ggagacacagugacagauu

SEQ ID NO: 1324851 - RNA, 19 nt, Homo sapiens
cccaguguguauauuaaua

SEQ ID NO: 1324852 - RNA, 19 nt, Homo sapiens
agaagugguuugaccuaaa

SEQ ID NO: 1324853 - RNA, 19 nt, Homo sapiens
uauuggauuuguucccuua

SEQ ID NO: 1324854 - RNA, 19 nt, Homo sapiens
ugucuaagcagccagauuu

SEQ ID NO: 1324855 - RNA, 19 nt, Homo sapiens
agaaaucccuucauugacu

SEQ ID NO: 1324856 - RNA, 19 nt, Homo sapiens
guuagaugcuguuacuaug

SEQ ID NO: 1324857 - RNA, 19 nt, Homo sapiens
gaaggaaacaacugaagca

SEQ ID NO: 1324858 - RNA, 19 nt, Homo sapiens
gaggcaagcugauaaacac

SEQ ID NO: 1324859 - RNA, 19 nt, Homo sapiens
ggcccagacucucacagua

SEQ ID NO: 1324860 - RNA, 19 nt, Homo sapiens
agaaagaggcauuacuauu

SEQ ID NO: 1324861 - RNA, 19 nt, Homo sapiens
aaagaugccaggccucuaa

SEQ ID NO: 1324862 - RNA, 19 nt, Homo sapiens
ggagaagugguuugaccua

SEQ ID NO: 1324863 - RNA, 19 nt, Homo sapiens
acaaagaagaggaaacauu

SEQ ID NO: 1324864 - RNA, 19 nt, Homo sapiens
uuaaaguucuccaugacaa

SEQ ID NO: 1324865 - RNA, 19 nt, Homo sapiens
gaauuucugcagugguaua

SEQ ID NO: 1324866 - RNA, 19 nt, Homo sapiens
gaaaugaaugauccugaau

SEQ ID NO: 1324867 - RNA, 19 nt, Homo sapiens
guugaaagcaucagagaga

SEQ ID NO: 1324868 - RNA, 19 nt, Homo sapiens
agagugguaucacaaaguu

SEQ ID NO: 1324869 - RNA, 19 nt, Homo sapiens
gaaacauucaggaaauuca

SEQ ID NO: 1324870 - RNA, 19 nt, Homo sapiens
uggcagaucuggcacaaag

SEQ ID NO: 1324871 - RNA, 19 nt, Homo sapiens
gagagaccauccuaaacuc

SEQ ID NO: 1324872 - RNA, 19 nt, Homo sapiens
gaggcuagauccugacucu

SEQ ID NO: 1324873 - RNA, 19 nt, Homo sapiens
agaauaagucgucugcuuu

SEQ ID NO: 1324874 - RNA, 19 nt, Homo sapiens
guaccugaaucaugcuguu

SEQ ID NO: 1324875 - RNA, 19 nt, Homo sapiens
gauagaacuuuaggagaca

SEQ ID NO: 1324876 - RNA, 19 nt, Homo sapiens
gaaacugcacggagagaau

SEQ ID NO: 1324877 - RNA, 19 nt, Homo sapiens
gaaagaggcauuacuauuc

SEQ ID NO: 1324878 - RNA, 19 nt, Homo sapiens
uuagugcgcugauaauuua

SEQ ID NO: 1324879 - RNA, 19 nt, Homo sapiens
ggaaaugaaugauccugaa

SEQ ID NO: 1324880 - RNA, 19 nt, Homo sapiens
ggagcaagcuuuaaguaug

SEQ ID NO: 1324881 - RNA, 19 nt, Homo sapiens
caauauaccucgaaucugu

SEQ ID NO: 1324882 - RNA, 19 nt, Homo sapiens
gauaucaaaucccuucauu

SEQ ID NO: 1324883 - RNA, 19 nt, Homo sapiens
guagaaaucccuucauuga

SEQ ID NO: 1324884 - RNA, 19 nt, Homo sapiens
gagaauaagucgucugcuu

SEQ ID NO: 1324885 - RNA, 19 nt, Homo sapiens
gagagaaguuaaaggcaaa

SEQ ID NO: 1324886 - RNA, 19 nt, Homo sapiens
caucaucaauccucccaua

SEQ ID NO: 1324887 - RNA, 19 nt, Homo sapiens
gagacacagugacagauuu

SEQ ID NO: 1324888 - RNA, 19 nt, Homo sapiens
gagcguaacuaugaauuuc

SEQ ID NO: 1324889 - RNA, 19 nt, Homo sapiens
ugaauuugcugacuugguu

SEQ ID NO: 1324890 - RNA, 19 nt, Homo sapiens
ggauacagcccuuguuaga

SEQ ID NO: 1324891 - RNA, 19 nt, Homo sapiens
gaaagguuauagagucaau

SEQ ID NO: 1324892 - RNA, 19 nt, Homo sapiens
ugaacaaguugcagauuug

SEQ ID NO: 1324893 - RNA, 19 nt, Homo sapiens
cgagaaagaggcauuacua

SEQ ID NO: 1324894 - RNA, 19 nt, Homo sapiens
gagcggagaaagccuauuu

SEQ ID NO: 1324895 - RNA, 19 nt, Homo sapiens
aauauacccucaagagauu

SEQ ID NO: 1324896 - RNA, 19 nt, Homo sapiens
gcauuggcauuuaaaguuc

SEQ ID NO: 1324897 - RNA, 19 nt, Homo sapiens
cuaccaggcuuaauaggaa

SEQ ID NO: 1324898 - RNA, 19 nt, Homo sapiens
uagaugcuguuacuaugua

SEQ ID NO: 1324899 - RNA, 19 nt, Homo sapiens
aaagaggcauuacuauuca

SEQ ID NO: 1324900 - RNA, 19 nt, Homo sapiens
caagaucacugggagaugu

SEQ ID NO: 1324901 - RNA, 19 nt, Homo sapiens
gaggauauuugcaaugagu

SEQ ID NO: 1324902 - RNA, 19 nt, Homo sapiens
ucaaaucccuucauuccau

SEQ ID NO: 1324903 - RNA, 19 nt, Homo sapiens
ccacagaaagaauauugua

SEQ ID NO: 1324904 - RNA, 19 nt, Homo sapiens
gcaauauacccucaagaga

SEQ ID NO: 1324905 - RNA, 19 nt, Homo sapiens
cauuuaaaguucuccauga

SEQ ID NO: 1324906 - RNA, 19 nt, Homo sapiens
cugaagagcguaacuauga

SEQ ID NO: 1324907 - RNA, 19 nt, Homo sapiens
gcuaaaauccguaauauug

SEQ ID NO: 1324908 - RNA, 19 nt, Homo sapiens
ugaccaacauguagaaauc

SEQ ID NO: 1324909 - RNA, 19 nt, Homo sapiens
auacagcccuuguuagaug

SEQ ID NO: 1324910 - RNA, 19 nt, Homo sapiens
ucaaaggagugguggaugu

SEQ ID NO: 1324911 - RNA, 19 nt, Homo sapiens
gcaauucaaaugauggaaa

SEQ ID NO: 1324912 - RNA, 19 nt, Homo sapiens
gagcaagcuuuaaguaugc

SEQ ID NO: 1324913 - RNA, 19 nt, Homo sapiens
caauauacccucaagagau

SEQ ID NO: 1324914 - RNA, 19 nt, Homo sapiens
aaugaaugauccugaauug

SEQ ID NO: 1324915 - RNA, 19 nt, Homo sapiens
gaaaagaagcacagacaaa

SEQ ID NO: 1324916 - RNA, 19 nt, Homo sapiens
gagaaagaggcauuacuau

SEQ ID NO: 1324917 - RNA, 19 nt, Homo sapiens
cuacagacugcaauacaua

SEQ ID NO: 1324918 - RNA, 19 nt, Homo sapiens
uugaacaaguugcagauuu

SEQ ID NO: 1324919 - RNA, 19 nt, Homo sapiens
ggaaugccuuaauugaaca

SEQ ID NO: 1324920 - RNA, 19 nt, Homo sapiens
gcaagcugauaaacacaau

SEQ ID NO: 1324921 - RNA, 19 nt, Homo sapiens
ggagacacagugacagauu

SEQ ID NO: 1324922 - RNA, 19 nt, Homo sapiens
cccaguguguauauuaaua

SEQ ID NO: 1324923 - RNA, 19 nt, Homo sapiens
agaaaucccuucauugacu

SEQ ID NO: 1324924 - RNA, 19 nt, Homo sapiens
guuagaugcuguuacuaug

SEQ ID NO: 1324925 - RNA, 19 nt, Homo sapiens
gaaggaaacaacugaagca

SEQ ID NO: 1324926 - RNA, 19 nt, Homo sapiens
gaggcaagcugauaaacac

SEQ ID NO: 1324927 - RNA, 19 nt, Homo sapiens
ggcccagacucucacagua

SEQ ID NO: 1324928 - RNA, 19 nt, Homo sapiens
agaaagaggcauuacuauu

SEQ ID NO: 1324929 - RNA, 19 nt, Homo sapiens
cuaauuagugcgcugauaa

SEQ ID NO: 1324930 - RNA, 19 nt, Homo sapiens
uuaaaguucuccaugacaa

SEQ ID NO: 1324931 - RNA, 19 nt, Homo sapiens
gaauuucugcagugguaua

SEQ ID NO: 1324932 - RNA, 19 nt, Homo sapiens
gaaaugaaugauccugaau

SEQ ID NO: 1324933 - RNA, 19 nt, Homo sapiens
guugaaagcaucagagaga

SEQ ID NO: 1324934 - RNA, 19 nt, Homo sapiens
agaauaagucgucugcuuu

SEQ ID NO: 1324935 - RNA, 19 nt, Homo sapiens
gaaacugcacggagagaau

SEQ ID NO: 1324936 - RNA, 19 nt, Homo sapiens
gcuacagacugcaauacau

SEQ ID NO: 1324937 - RNA, 19 nt, Homo sapiens
gaaagccccucuuggaaau

SEQ ID NO: 1324938 - RNA, 19 nt, Homo sapiens
ugaagagcguaacuaugaa

SEQ ID NO: 1324939 - RNA, 19 nt, Homo sapiens
ugaugaauuugcugacuug

SEQ ID NO: 1324940 - RNA, 19 nt, Homo sapiens
uaugugcauuggcauuuaa

SEQ ID NO: 1324941 - RNA, 19 nt, Homo sapiens
gaagagcguaacuaugaau

SEQ ID NO: 1324942 - RNA, 19 nt, Homo sapiens
uugcagauuuggaugauga

SEQ ID NO: 1324943 - RNA, 19 nt, Homo sapiens
guaacaguuuggaggauca

SEQ ID NO: 1324944 - RNA, 19 nt, Homo sapiens
caaaggagugguggaugua

SEQ ID NO: 1324945 - RNA, 19 nt, Homo sapiens
gagcgagaaagaggcauua

SEQ ID NO: 1324946 - RNA, 19 nt, Homo sapiens
ucauauugaugcaggcaaa

SEQ ID NO: 1324947 - RNA, 19 nt, Homo sapiens
ggaggcaagcugauaaaca

SEQ ID NO: 1324948 - RNA, 19 nt, Homo sapiens
ucaauccucccauagcuaa

SEQ ID NO: 1324949 - RNA, 19 nt, Homo sapiens
aaacugcacggagagaaua

SEQ ID NO: 1324950 - RNA, 19 nt, Homo sapiens
gaaagcaucagagagaagu

SEQ ID NO: 1324951 - RNA, 19 nt, Homo sapiens
gagcggugccuaagagugu

SEQ ID NO: 1324952 - RNA, 19 nt, Homo sapiens
gcuguuacauuugauugga

SEQ ID NO: 1324953 - RNA, 19 nt, Homo sapiens
ugaggccguugcagacuuu

SEQ ID NO: 1324954 - RNA, 19 nt, Homo sapiens
gaugauggagacacaguga

SEQ ID NO: 1324955 - RNA, 19 nt, Homo sapiens
uacccaguguguauauuaa

SEQ ID NO: 1324956 - RNA, 19 nt, Homo sapiens
gaaccuguuuucuucugua

SEQ ID NO: 1324957 - RNA, 19 nt, Homo sapiens
gagauuccagaaccuguuu

SEQ ID NO: 1324958 - RNA, 19 nt, Homo sapiens
caguuggccauucauaaua

SEQ ID NO: 1324959 - RNA, 19 nt, Homo sapiens
ccacaugugccgcuuggaa

SEQ ID NO: 1324960 - RNA, 19 nt, Homo sapiens
guauaaauggucuuagugu

SEQ ID NO: 1324961 - RNA, 19 nt, Homo sapiens
uugaggauauuugcaauga

SEQ ID NO: 1324962 - RNA, 19 nt, Homo sapiens
gcugauaaacacaauauac

SEQ ID NO: 1324963 - RNA, 19 nt, Homo sapiens
uuaugugcauuggcauuua

SEQ ID NO: 1324964 - RNA, 19 nt, Homo sapiens
augaauuucugcaguggua

SEQ ID NO: 1324965 - RNA, 19 nt, Homo sapiens
ccaguuggccauucauaau

SEQ ID NO: 1324966 - RNA, 19 nt, Homo sapiens
ugccuuaauugaacaaguu

SEQ ID NO: 1324967 - RNA, 19 nt, Homo sapiens
ugaccaacuugaggauauu

SEQ ID NO: 1324968 - RNA, 19 nt, Homo sapiens
guacuauuccggauauaca

SEQ ID NO: 1324969 - RNA, 19 nt, Homo sapiens
ccagguauaaauggucuua

SEQ ID NO: 1324970 - RNA, 19 nt, Homo sapiens
aaacuucuuuggaauugca

SEQ ID NO: 1324971 - RNA, 19 nt, Homo sapiens
gagguugagcggugccuaa

SEQ ID NO: 1324972 - RNA, 19 nt, Homo sapiens
aggcauuacuauucaauca

SEQ ID NO: 1324973 - RNA, 19 nt, Homo sapiens
gcagccagguauaaauggu

SEQ ID NO: 1324974 - RNA, 19 nt, Homo sapiens
ggagauuccagaaccuguu

SEQ ID NO: 1324975 - RNA, 19 nt, Homo sapiens
aaacaaugaagcagagaga

SEQ ID NO: 1324976 - RNA, 19 nt, Homo sapiens
gaauaagucgucugcuuuu

SEQ ID NO: 1324977 - RNA, 19 nt, Homo sapiens
gaagaaagcugauaagcaa

SEQ ID NO: 1324978 - RNA, 19 nt, Homo sapiens
gcaccuagcuacuucauuu

SEQ ID NO: 1324979 - RNA, 19 nt, Homo sapiens
gaaaugugcuuugauguuu

SEQ ID NO: 1324980 - RNA, 19 nt, Homo sapiens
uagcagaaauuauggguua

SEQ ID NO: 1324981 - RNA, 19 nt, Homo sapiens
gaaagaggcauuacuauuc

SEQ ID NO: 1324982 - RNA, 19 nt, Homo sapiens
ggucaaagguucaaucaau

SEQ ID NO: 1324983 - RNA, 19 nt, Homo sapiens
ggaaaugaaugauccugaa

SEQ ID NO: 1324984 - RNA, 19 nt, Homo sapiens
ggagcaagcuuuaaguaug

SEQ ID NO: 1324985 - RNA, 19 nt, Homo sapiens
ggaguuacauauagagauu

SEQ ID NO: 1324986 - RNA, 19 nt, Homo sapiens
caauauaccucgaaucugu

SEQ ID NO: 1324987 - RNA, 19 nt, Homo sapiens
gauaucaaaucccuucauu

SEQ ID NO: 1324988 - RNA, 19 nt, Homo sapiens
guagaaaucccuucauuga

SEQ ID NO: 1324989 - RNA, 19 nt, Homo sapiens
gagaauaagucgucugcuu

SEQ ID NO: 1324990 - RNA, 19 nt, Homo sapiens
gaggaaacauucaggaaau

SEQ ID NO: 1324991 - RNA, 19 nt, Homo sapiens
ggauguagcaauuacuuua

SEQ ID NO: 1324992 - RNA, 19 nt, Homo sapiens
gaagcaaggccaauugaaa

SEQ ID NO: 1324993 - RNA, 19 nt, Homo sapiens
gaagugguuugaccuaaau

SEQ ID NO: 1324994 - RNA, 19 nt, Homo sapiens
gaaucaugcuguucaucua

SEQ ID NO: 1324995 - RNA, 19 nt, Homo sapiens
gagagaaguuaaaggcaaa

SEQ ID NO: 1324996 - RNA, 19 nt, Homo sapiens
caucaucaauccucccaua

SEQ ID NO: 1324997 - RNA, 19 nt, Homo sapiens
gagacacagugacagauuu

SEQ ID NO: 1324998 - RNA, 19 nt, Homo sapiens
gucaaagguucaaucaaua

SEQ ID NO: 1324999 - RNA, 19 nt, Homo sapiens
acagauaccuuagauagaa

SEQ ID NO: 1325000 - RNA, 19 nt, Homo sapiens
ugagaaaugugcuuugaug

SEQ ID NO: 1325001 - RNA, 19 nt, Homo sapiens
gcaaaaggcucugaagaaa

SEQ ID NO: 1325002 - RNA, 19 nt, Homo sapiens
cgaauaaaguacuguuuca

SEQ ID NO: 1325003 - RNA, 19 nt, Homo sapiens
gagaagugguuugaccuaa

SEQ ID NO: 1325004 - RNA, 19 nt, Homo sapiens
gagcguaacuaugaauuuc

SEQ ID NO: 1325005 - RNA, 19 nt, Homo sapiens
ugaauuugcugacuugguu

SEQ ID NO: 1325006 - RNA, 19 nt, Homo sapiens
caaagaagaggaaacauuc

SEQ ID NO: 1325007 - RNA, 19 nt, Homo sapiens
gaucccaguuugaaaguga

SEQ ID NO: 1325008 - RNA, 19 nt, Homo sapiens
ggauacagcccuuguuaga

SEQ ID NO: 1325009 - RNA, 19 nt, Homo sapiens
gaaagguuauagagucaau

SEQ ID NO: 1325010 - RNA, 19 nt, Homo sapiens
gagcggagaaagccuauuu

SEQ ID NO: 1325011 - RNA, 19 nt, Homo sapiens
ugaacaaguugcagauuug

SEQ ID NO: 1325012 - RNA, 19 nt, Homo sapiens
cgagaaagaggcauuacua

SEQ ID NO: 1325013 - RNA, 19 nt, Homo sapiens
uacaguagcuagagauuau

SEQ ID NO: 1325014 - RNA, 19 nt, Homo sapiens
gaagagugguaucacaaag

SEQ ID NO: 1325015 - RNA, 19 nt, Homo sapiens
cuaccaggcuuaauaggaa

SEQ ID NO: 1325016 - RNA, 19 nt, Homo sapiens
uagaugcuguuacuaugua

SEQ ID NO: 1325017 - RNA, 19 nt, Homo sapiens
aaagaggcauuacuauuca

SEQ ID NO: 1325018 - RNA, 19 nt, Homo sapiens
caagaucacugggagaugu

SEQ ID NO: 1325019 - RNA, 19 nt, Homo sapiens
gaggauauuugcaaugagu

SEQ ID NO: 1325020 - RNA, 19 nt, Homo sapiens
gcacaaagaagaggaaaca

SEQ ID NO: 1325021 - RNA, 19 nt, Homo sapiens
ucaaaucccuucauuccau

SEQ ID NO: 1325022 - RNA, 19 nt, Homo sapiens
ccacagaaagaauauugua

SEQ ID NO: 1325023 - RNA, 19 nt, Homo sapiens
uaaagccacuguaccugaa

SEQ ID NO: 1325024 - RNA, 19 nt, Homo sapiens
ccacagauaccuuagauag

SEQ ID NO: 1325025 - RNA, 19 nt, Homo sapiens
gauccugacucuggacaaa

SEQ ID NO: 1325026 - RNA, 19 nt, Homo sapiens
gaagaucccaguuugaaag

SEQ ID NO: 1325027 - RNA, 19 nt, Homo sapiens
cugaagagcguaacuauga

SEQ ID NO: 1325028 - RNA, 19 nt, Homo sapiens
gcuaaaauccguaauauug

SEQ ID NO: 1325029 - RNA, 19 nt, Homo sapiens
gaaagcugauaagcaaguu

SEQ ID NO: 1325030 - RNA, 19 nt, Homo sapiens
aaaggcaucuugugacugu

SEQ ID NO: 1325031 - RNA, 19 nt, Homo sapiens
ugaccaacauguagaaauc

SEQ ID NO: 1325032 - RNA, 19 nt, Homo sapiens
auacagcccuuguuagaug

SEQ ID NO: 1325033 - RNA, 19 nt, Homo sapiens
ucaaaggagugguggaugu

SEQ ID NO: 1325034 - RNA, 19 nt, Homo sapiens
gcaauucaaaugauggaaa

SEQ ID NO: 1325035 - RNA, 19 nt, Homo sapiens
gagcaagcuuuaaguaugc

SEQ ID NO: 1325036 - RNA, 19 nt, Homo sapiens
aaugaaugauccugaauug

SEQ ID NO: 1325037 - RNA, 19 nt, Homo sapiens
gcagaucuggcacaaagaa

SEQ ID NO: 1325038 - RNA, 19 nt, Homo sapiens
aauauggacuggagaccua

SEQ ID NO: 1325039 - RNA, 19 nt, Homo sapiens
gcgugaagaucccaguuug

SEQ ID NO: 1325040 - RNA, 19 nt, Homo sapiens
gaaaagaagcacagacaaa

SEQ ID NO: 1325041 - RNA, 19 nt, Homo sapiens
gagaaagaggcauuacuau

SEQ ID NO: 1325042 - RNA, 19 nt, Homo sapiens
ugccaggccucuaaaugua

SEQ ID NO: 1325043 - RNA, 19 nt, Homo sapiens
gcacuggagccacccguuu

SEQ ID NO: 1325044 - RNA, 19 nt, Homo sapiens
cuacagacugcaauacaua

SEQ ID NO: 1325045 - RNA, 19 nt, Homo sapiens
uugaacaaguugcagauuu

SEQ ID NO: 1325046 - RNA, 19 nt, Homo sapiens
ggaaugccuuaauugaaca

SEQ ID NO: 1325047 - RNA, 19 nt, Homo sapiens
gcaagcugauaaacacaau

SEQ ID NO: 1325048 - RNA, 19 nt, Homo sapiens
ggagacacagugacagauu

SEQ ID NO: 1325049 - RNA, 19 nt, Homo sapiens
cccaguguguauauuaaua

SEQ ID NO: 1325050 - RNA, 19 nt, Homo sapiens
agaagugguuugaccuaaa

SEQ ID NO: 1325051 - RNA, 19 nt, Homo sapiens
uauuggauuuguucccuua

SEQ ID NO: 1325052 - RNA, 19 nt, Homo sapiens
ugucuaagcagccagauuu

SEQ ID NO: 1325053 - RNA, 19 nt, Homo sapiens
agaaaucccuucauugacu

SEQ ID NO: 1325054 - RNA, 19 nt, Homo sapiens
guuagaugcuguuacuaug

SEQ ID NO: 1325055 - RNA, 19 nt, Homo sapiens
gaaggaaacaacugaagca

SEQ ID NO: 1325056 - RNA, 19 nt, Homo sapiens
gaggcaagcugauaaacac

SEQ ID NO: 1325057 - RNA, 19 nt, Homo sapiens
ggcccagacucucacagua

SEQ ID NO: 1325058 - RNA, 19 nt, Homo sapiens
agaaagaggcauuacuauu

SEQ ID NO: 1325059 - RNA, 19 nt, Homo sapiens
aaagaugccaggccucuaa

SEQ ID NO: 1325060 - RNA, 19 nt, Homo sapiens
ggagaagugguuugaccua

SEQ ID NO: 1325061 - RNA, 19 nt, Homo sapiens
acaaagaagaggaaacauu

SEQ ID NO: 1325062 - RNA, 19 nt, Homo sapiens
gaaaugaaugauccugaau

SEQ ID NO: 1325063 - RNA, 19 nt, Homo sapiens
guugaaagcaucagagaga

SEQ ID NO: 1325064 - RNA, 19 nt, Homo sapiens
agagugguaucacaaaguu

SEQ ID NO: 1325065 - RNA, 19 nt, Homo sapiens
gaaacauucaggaaauuca

SEQ ID NO: 1325066 - RNA, 19 nt, Homo sapiens
uggcagaucuggcacaaag

SEQ ID NO: 1325067 - RNA, 19 nt, Homo sapiens
gagagaccauccuaaacuc

SEQ ID NO: 1325068 - RNA, 19 nt, Homo sapiens
gaggcuagauccugacucu

SEQ ID NO: 1325069 - RNA, 19 nt, Homo sapiens
agaauaagucgucugcuuu

SEQ ID NO: 1325070 - RNA, 19 nt, Homo sapiens
guaccugaaucaugcuguu

SEQ ID NO: 1325071 - RNA, 19 nt, Homo sapiens
gauagaacuuuaggagaca

SEQ ID NO: 1325072 - RNA, 19 nt, Homo sapiens
gcuacagacugcaauacau

SEQ ID NO: 1325073 - RNA, 19 nt, Homo sapiens
gaaagccccucuuggaaau

SEQ ID NO: 1325074 - RNA, 19 nt, Homo sapiens
aaugagaaaugugcuuuga

SEQ ID NO: 1325075 - RNA, 19 nt, Homo sapiens
ccuggcaccuccacaacua

SEQ ID NO: 1325076 - RNA, 19 nt, Homo sapiens
ugaagagcguaacuaugaa

SEQ ID NO: 1325077 - RNA, 19 nt, Homo sapiens
ccacucagcucuccaagua

SEQ ID NO: 1325078 - RNA, 19 nt, Homo sapiens
gaagggaagugacguuguu

SEQ ID NO: 1325079 - RNA, 19 nt, Homo sapiens
ggaugaaggugaaugacua

SEQ ID NO: 1325080 - RNA, 19 nt, Homo sapiens
gaugaucccuauuuccaua

SEQ ID NO: 1325081 - RNA, 19 nt, Homo sapiens
gaacaguuauuaugaagag

SEQ ID NO: 1325082 - RNA, 19 nt, Homo sapiens
ggacauuuccuaacaauuc

SEQ ID NO: 1325083 - RNA, 19 nt, Homo sapiens
gaaaucaguuacggacaaa

SEQ ID NO: 1325084 - RNA, 19 nt, Homo sapiens
gcauggacgucuucacuga

SEQ ID NO: 1325085 - RNA, 19 nt, Homo sapiens
gcacagacuuuaggcauuc

SEQ ID NO: 1325086 - RNA, 19 nt, Homo sapiens
gcaggaacuuugugaagga

SEQ ID NO: 1325087 - RNA, 19 nt, Homo sapiens
ccaaaggaguggacauuuc

SEQ ID NO: 1325088 - RNA, 19 nt, Homo sapiens
ucacaaacgucuauuggau

SEQ ID NO: 1325089 - RNA, 19 nt, Homo sapiens
ugaauagccugacccuaaa

SEQ ID NO: 1325090 - RNA, 19 nt, Homo sapiens
gaaugagagugccaucuuc

SEQ ID NO: 1325091 - RNA, 19 nt, Homo sapiens
ucagauagcacagacuuua

SEQ ID NO: 1325092 - RNA, 19 nt, Homo sapiens
gaaagcaauucaggaaaca

SEQ ID NO: 1325093 - RNA, 19 nt, Homo sapiens
uacagaaggucucacaauu

SEQ ID NO: 1325094 - RNA, 19 nt, Homo sapiens
ccauggugcuccuagauuu

SEQ ID NO: 1325095 - RNA, 19 nt, Homo sapiens
gaucccuauuuccauauua

SEQ ID NO: 1325096 - RNA, 19 nt, Homo sapiens
ugaaaucaguuacggacaa

SEQ ID NO: 1325097 - RNA, 19 nt, Homo sapiens
gugaaugacuaaagcuuug

SEQ ID NO: 1325098 - RNA, 19 nt, Homo sapiens
gaaggugaaugacuaaagc

SEQ ID NO: 1325099 - RNA, 19 nt, Homo sapiens
acaaacgucuauuggauga

SEQ ID NO: 1325100 - RNA, 19 nt, Homo sapiens
agaaauguuugcccugaaa

SEQ ID NO: 1325101 - RNA, 19 nt, Homo sapiens
cuaaugaugaucccuauuu

SEQ ID NO: 1325102 - RNA, 19 nt, Homo sapiens
gaaggaagccgaggagauc

SEQ ID NO: 1325103 - RNA, 19 nt, Homo sapiens
gaguggacauuuccuaaca

SEQ ID NO: 1325104 - RNA, 19 nt, Homo sapiens
gcucgcauaugacaggaaa

SEQ ID NO: 1325105 - RNA, 19 nt, Homo sapiens
uuggauggcucgcauauga

SEQ ID NO: 1325106 - RNA, 19 nt, Homo sapiens
ccucggaccuguauaaucu

SEQ ID NO: 1325107 - RNA, 19 nt, Homo sapiens
gacuaaagcuuugcuacug

SEQ ID NO: 1325108 - RNA, 19 nt, Homo sapiens
ggagauuccucagcucaug

SEQ ID NO: 1325109 - RNA, 19 nt, Homo sapiens
ccagaaagcaauucaggaa

SEQ ID NO: 1325110 - RNA, 19 nt, Homo sapiens
aggaaacaguggagaaauu

SEQ ID NO: 1325111 - RNA, 19 nt, Homo sapiens
gggcugaggauuccggaua

SEQ ID NO: 1325112 - RNA, 19 nt, Homo sapiens
guccaucucuuugauauca

SEQ ID NO: 1325113 - RNA, 19 nt, Homo sapiens
ggaggaaggugggguaauu

SEQ ID NO: 1325114 - RNA, 19 nt, Homo sapiens
ggaaacaguggagaaauuc

SEQ ID NO: 1325115 - RNA, 19 nt, Homo sapiens
gcgcauccaccgccuguuu

SEQ ID NO: 1325116 - RNA, 19 nt, Homo sapiens
ggcuacaacuugaggagaa

SEQ ID NO: 1325117 - RNA, 19 nt, Homo sapiens
ggugaaugacuaaagcuuu

SEQ ID NO: 1325118 - RNA, 19 nt, Homo sapiens
gaugaaggugaaugacuaa

SEQ ID NO: 1325119 - RNA, 19 nt, Homo sapiens
uaaugaugaucccuauuuc

SEQ ID NO: 1325120 - RNA, 19 nt, Homo sapiens
ccggaacaguuauuaugaa

SEQ ID NO: 1325121 - RNA, 19 nt, Homo sapiens
augaauagccugacccuaa

SEQ ID NO: 1325122 - RNA, 19 nt, Homo sapiens
acgcaaacacuuucacuuu

SEQ ID NO: 1325123 - RNA, 19 nt, Homo sapiens
gaccuuguuccguauuuaa

SEQ ID NO: 1325124 - RNA, 19 nt, Homo sapiens
gaagaaaugaacuccuaca

SEQ ID NO: 1325125 - RNA, 19 nt, Homo sapiens
ccaguaccgugccaucuuc

SEQ ID NO: 1325126 - RNA, 19 nt, Homo sapiens
gcuacaacuugaggagaaa

SEQ ID NO: 1325127 - RNA, 19 nt, Homo sapiens
ggccuucgcuaacuacaag

SEQ ID NO: 1325128 - RNA, 19 nt, Homo sapiens
ucuauuggaugaaggugaa

SEQ ID NO: 1325129 - RNA, 19 nt, Homo sapiens
agaaagcaauucaggaaac

SEQ ID NO: 1325130 - RNA, 19 nt, Homo sapiens
cagaaauguuugcccugaa

SEQ ID NO: 1325131 - RNA, 19 nt, Homo sapiens
cagaaggucucacaauucc

SEQ ID NO: 1325132 - RNA, 19 nt, Homo sapiens
ucucaacaauauucugguu

SEQ ID NO: 1325133 - RNA, 19 nt, Homo sapiens
agaaaugaacuccuacaug

SEQ ID NO: 1325134 - RNA, 19 nt, Homo sapiens
ggagcuugcagccuacgua

SEQ ID NO: 1325135 - RNA, 19 nt, Homo sapiens
gcucagauagcacagacuu

SEQ ID NO: 1325136 - RNA, 19 nt, Homo sapiens
gacauuuccuaacaauucu

SEQ ID NO: 1325137 - RNA, 19 nt, Homo sapiens
agaccuuguuccguauuua

SEQ ID NO: 1325138 - RNA, 19 nt, Homo sapiens
ugaaugagagugccaucuu

SEQ ID NO: 1325139 - RNA, 19 nt, Homo sapiens
guggacauuuccuaacaau

SEQ ID NO: 1325140 - RNA, 19 nt, Homo sapiens
gaagaccuuguuccguauu

SEQ ID NO: 1325141 - RNA, 19 nt, Homo sapiens
cuacagaaggucucacaau

SEQ ID NO: 1325142 - RNA, 19 nt, Homo sapiens
ccugcuuucucaacaauau

SEQ ID NO: 1325143 - RNA, 19 nt, Homo sapiens
guguccaucucuuugauau

SEQ ID NO: 1325144 - RNA, 19 nt, Homo sapiens
ggaacaguuauuaugaaga

SEQ ID NO: 1325145 - RNA, 19 nt, Homo sapiens
guuccucggaccuguauaa

SEQ ID NO: 1325146 - RNA, 19 nt, Homo sapiens
gaaauguuugcccugaaau

SEQ ID NO: 1325147 - RNA, 19 nt, Homo sapiens
aaacgucuauuggaugaag

SEQ ID NO: 1325148 - RNA, 19 nt, Homo sapiens
cagaaagcaauucaggaaa

SEQ ID NO: 1325149 - RNA, 19 nt, Homo sapiens
acagaaggucucacaauuc

SEQ ID NO: 1325150 - RNA, 19 nt, Homo sapiens
ggucaguuggcuccuguuu

SEQ ID NO: 1325151 - RNA, 19 nt, Homo sapiens
cggaacaguuauuaugaag

SEQ ID NO: 1325152 - RNA, 19 nt, Homo sapiens
gacaaaauguuggcuacaa

SEQ ID NO: 1325153 - RNA, 19 nt, Homo sapiens
ccaagacgcaaacacuuuc

SEQ ID NO: 1325154 - RNA, 19 nt, Homo sapiens
ucggcgagguggaggauga

SEQ ID NO: 1325155 - RNA, 19 nt, Homo sapiens
ggaagggaagugacguugu

SEQ ID NO: 1325156 - RNA, 19 nt, Homo sapiens
ucaggaaacaguggagaaa

SEQ ID NO: 1325157 - RNA, 19 nt, Homo sapiens
ucaguuggcuccuguuuuc

SEQ ID NO: 1325158 - RNA, 19 nt, Homo sapiens
cuaaaccggcacacagaaa

SEQ ID NO: 1325159 - RNA, 19 nt, Homo sapiens
caagguuugguaauaaugu

SEQ ID NO: 1325160 - RNA, 19 nt, Homo sapiens
gguaaccuagggcauguga

SEQ ID NO: 1325161 - RNA, 19 nt, Homo sapiens
ucacugaggcugaguugag

SEQ ID NO: 1325162 - RNA, 19 nt, Homo sapiens
ggccuuccaucgcgcugaa

SEQ ID NO: 1325163 - RNA, 19 nt, Homo sapiens
uaaaccggcacacagaaau

SEQ ID NO: 1325164 - RNA, 19 nt, Homo sapiens
ggguggccaucagcacuuu

SEQ ID NO: 1325165 - RNA, 19 nt, Homo sapiens
gaguugagggugaaguuuc

SEQ ID NO: 1325166 - RNA, 19 nt, Homo sapiens
gcacacagaaauuuuggaa

SEQ ID NO: 1325167 - RNA, 19 nt, Homo sapiens
ugaaggaagccgaggagau

SEQ ID NO: 1325168 - RNA, 19 nt, Homo sapiens
aaaccggcacacagaaauu

SEQ ID NO: 1325169 - RNA, 19 nt, Homo sapiens
cgacuuggccuucgcuaac

SEQ ID NO: 1325170 - RNA, 19 nt, Homo sapiens
guccggaacaguuauuaug

SEQ ID NO: 1325171 - RNA, 19 nt, Homo sapiens
gcugggugcuacagaaggu

SEQ ID NO: 1325172 - RNA, 19 nt, Homo sapiens
caggaacuuugugaaggaa

SEQ ID NO: 1325173 - RNA, 19 nt, Homo sapiens
acaauucuguauggaggaa

SEQ ID NO: 1325174 - RNA, 19 nt, Homo sapiens
ggauggcucgcauaugaca

SEQ ID NO: 1325175 - RNA, 19 nt, Homo sapiens
aagaccuuguuccguauuu

SEQ ID NO: 1325176 - RNA, 19 nt, Homo sapiens
gcgcauggacgucuucacu

SEQ ID NO: 1325177 - RNA, 19 nt, Homo sapiens
gcacagaaaugaaaugaaa

SEQ ID NO: 1325178 - RNA, 19 nt, Homo sapiens
gaaagaaaccauugacuua

SEQ ID NO: 1325179 - RNA, 19 nt, Homo sapiens
ugacauagcuuccauuauu

SEQ ID NO: 1325180 - RNA, 19 nt, Homo sapiens
gagaauaucuggucauaga

SEQ ID NO: 1325181 - RNA, 19 nt, Homo sapiens
aaaccuggaugaagaauua

SEQ ID NO: 1325182 - RNA, 19 nt, Homo sapiens
gaaagaaugucacuaacug

SEQ ID NO: 1325183 - RNA, 19 nt, Homo sapiens
uaacagcggugauaucauu

SEQ ID NO: 1325184 - RNA, 19 nt, Homo sapiens
caagaacacuuuaaggaaa

SEQ ID NO: 1325185 - RNA, 19 nt, Homo sapiens
uaugugaacuggagaaaua

SEQ ID NO: 1325186 - RNA, 19 nt, Homo sapiens
gaaauacgagagaggauua

SEQ ID NO: 1325187 - RNA, 19 nt, Homo sapiens
acaaagagaugguagacua

SEQ ID NO: 1325188 - RNA, 19 nt, Homo sapiens
gaagaaggcaucaguaaug

SEQ ID NO: 1325189 - RNA, 19 nt, Homo sapiens
gaccagauguacauuauug

SEQ ID NO: 1325190 - RNA, 19 nt, Homo sapiens
ccaugugucuucauuuaua

SEQ ID NO: 1325191 - RNA, 19 nt, Homo sapiens
caaugaaccuuaauagugu

SEQ ID NO: 1325192 - RNA, 19 nt, Homo sapiens
caaccgagcuugcacuuca

SEQ ID NO: 1325193 - RNA, 19 nt, Homo sapiens
gaggauggauuacagaaau

SEQ ID NO: 1325194 - RNA, 19 nt, Homo sapiens
gaccaacaaucgaauaaga

SEQ ID NO: 1325195 - RNA, 19 nt, Homo sapiens
cauaagaauuccucaaaga

SEQ ID NO: 1325196 - RNA, 19 nt, Homo sapiens
ucaaagaagccauacauuu

SEQ ID NO: 1325197 - RNA, 19 nt, Homo sapiens
gugcauagacauacuguua

SEQ ID NO: 1325198 - RNA, 19 nt, Homo sapiens
gacaguagaggauggauua

SEQ ID NO: 1325199 - RNA, 19 nt, Homo sapiens
ugccauaucuucucuauug

SEQ ID NO: 1325200 - RNA, 19 nt, Homo sapiens
gagaccagauguacauuau

SEQ ID NO: 1325201 - RNA, 19 nt, Homo sapiens
gaacuuugucagagaauaa

SEQ ID NO: 1325202 - RNA, 19 nt, Homo sapiens
gcauagacauacuguuaga

SEQ ID NO: 1325203 - RNA, 19 nt, Homo sapiens
gaaggcaucaguaaugaaa

SEQ ID NO: 1325204 - RNA, 19 nt, Homo sapiens
gaacuagaacugaaggauu

SEQ ID NO: 1325205 - RNA, 19 nt, Homo sapiens
cgagagaggauuaaucuuu

SEQ ID NO: 1325206 - RNA, 19 nt, Homo sapiens
ugucugugcuuuaagaaua

SEQ ID NO: 1325207 - RNA, 19 nt, Homo sapiens
ccucauaccuugcccauuc

SEQ ID NO: 1325208 - RNA, 19 nt, Homo sapiens
ugaagaagcagauuccuuu

SEQ ID NO: 1325209 - RNA, 19 nt, Homo sapiens
gccaugagcuaucuaagga

SEQ ID NO: 1325210 - RNA, 19 nt, Homo sapiens
ugaaguaccagaucauuaa

SEQ ID NO: 1325211 - RNA, 19 nt, Homo sapiens
aaccaugugucuucauuua

SEQ ID NO: 1325212 - RNA, 19 nt, Homo sapiens
gguaacuauucacuucuua

SEQ ID NO: 1325213 - RNA, 19 nt, Homo sapiens
guacacgcuugaaagagua

SEQ ID NO: 1325214 - RNA, 19 nt, Homo sapiens
ggaugucugugcuuuaaga

SEQ ID NO: 1325215 - RNA, 19 nt, Homo sapiens
ggacuuugaacguucuuua

SEQ ID NO: 1325216 - RNA, 19 nt, Homo sapiens
uaagaugucugguuugucu

SEQ ID NO: 1325217 - RNA, 19 nt, Homo sapiens
gagauuauuugguagcaau

SEQ ID NO: 1325218 - RNA, 19 nt, Homo sapiens
ucaaugaaccuuaauagug

SEQ ID NO: 1325219 - RNA, 19 nt, Homo sapiens
ccagauaacguccuuaaga

SEQ ID NO: 1325220 - RNA, 19 nt, Homo sapiens
gaaaagccauucagagaug

SEQ ID NO: 1325221 - RNA, 19 nt, Homo sapiens
acuauaagaugucugguuu

SEQ ID NO: 1325222 - RNA, 19 nt, Homo sapiens
ccaaagccuuguuuccauu

SEQ ID NO: 1325223 - RNA, 19 nt, Homo sapiens
ggcuggagauuauuuggua

SEQ ID NO: 1325224 - RNA, 19 nt, Homo sapiens
gacauaagaauuccucaaa

SEQ ID NO: 1325225 - RNA, 19 nt, Homo sapiens
uauaugugguccuucauuu

SEQ ID NO: 1325226 - RNA, 19 nt, Homo sapiens
gguagcaauugaagagaaa

SEQ ID NO: 1325227 - RNA, 19 nt, Homo sapiens
cagucuggauuaucuguua

SEQ ID NO: 1325228 - RNA, 19 nt, Homo sapiens
gaauaagacggacagaaga

SEQ ID NO: 1325229 - RNA, 19 nt, Homo sapiens
caaagaagccauacauuuu

SEQ ID NO: 1325230 - RNA, 19 nt, Homo sapiens
aacuagaacugaaggauuu

SEQ ID NO: 1325231 - RNA, 19 nt, Homo sapiens
gaaccucggcuguugauuc

SEQ ID NO: 1325232 - RNA, 19 nt, Homo sapiens
cauauucucuguaguccuu

SEQ ID NO: 1325233 - RNA, 19 nt, Homo sapiens
gagagaggauuaaucuuuu

SEQ ID NO: 1325234 - RNA, 19 nt, Homo sapiens
cagugcagcuguacaaaga

SEQ ID NO: 1325235 - RNA, 19 nt, Homo sapiens
ggguggaauuuguauauug

SEQ ID NO: 1325236 - RNA, 19 nt, Homo sapiens
uaccagaccgguucucuua

SEQ ID NO: 1325237 - RNA, 19 nt, Homo sapiens
guacaagugucagucaugu

SEQ ID NO: 1325238 - RNA, 19 nt, Homo sapiens
guagaaguuuacaaagcua

SEQ ID NO: 1325239 - RNA, 19 nt, Homo sapiens
ccaagaacacuuuaaggaa

SEQ ID NO: 1325240 - RNA, 19 nt, Homo sapiens
cgaaagaaaccauugacuu

SEQ ID NO: 1325241 - RNA, 19 nt, Homo sapiens
gacauagcuuccauuauuc

SEQ ID NO: 1325242 - RNA, 19 nt, Homo sapiens
cagaagaaggcaucaguaa

SEQ ID NO: 1325243 - RNA, 19 nt, Homo sapiens
ggagggaccauucagcaaa

SEQ ID NO: 1325244 - RNA, 19 nt, Homo sapiens
guugguauguggcuucauu

SEQ ID NO: 1325245 - RNA, 19 nt, Homo sapiens
gagaugaaguugguaugug

SEQ ID NO: 1325246 - RNA, 19 nt, Homo sapiens
cuacaugguugucaaaucu

SEQ ID NO: 1325247 - RNA, 19 nt, Homo sapiens
gaggaauucucacuauugg

SEQ ID NO: 1325248 - RNA, 19 nt, Homo sapiens
cuacauuucuacgugcuua

SEQ ID NO: 1325249 - RNA, 19 nt, Homo sapiens
cugcuuaccuuaccgugua

SEQ ID NO: 1325250 - RNA, 19 nt, Homo sapiens
ggaaagcugugggcaccuu

SEQ ID NO: 1325251 - RNA, 19 nt, Homo sapiens
uuucacagcuugagucaga

SEQ ID NO: 1325252 - RNA, 19 nt, Homo sapiens
cucguuggcugcacaaaua

SEQ ID NO: 1325253 - RNA, 19 nt, Homo sapiens
gaacaucggaggaucugau

SEQ ID NO: 1325254 - RNA, 19 nt, Homo sapiens
gcuggauacuucuggguuu

SEQ ID NO: 1325255 - RNA, 19 nt, Homo sapiens
gguggaauuuguauauugu

SEQ ID NO: 1325256 - RNA, 19 nt, Homo sapiens
caaaucuguugaauugaug

SEQ ID NO: 1325257 - RNA, 19 nt, Homo sapiens
cuucuugucuagcuauuaa

SEQ ID NO: 1325258 - RNA, 19 nt, Homo sapiens
gcuggaaccuggagagaag

SEQ ID NO: 1325259 - RNA, 19 nt, Homo sapiens
gaaaagauaccaguguuaa

SEQ ID NO: 1325260 - RNA, 19 nt, Homo sapiens
ugaacagucuggauuaucu

SEQ ID NO: 1325261 - RNA, 19 nt, Homo sapiens
ggugauaucauuagacugu

SEQ ID NO: 1325262 - RNA, 19 nt, Homo sapiens
cggaggaucugauaaaugc

SEQ ID NO: 1325263 - RNA, 19 nt, Homo sapiens
gaugguagacuauagcaau

SEQ ID NO: 1325264 - RNA, 19 nt, Homo sapiens
ccgguucucuuacaucuga

SEQ ID NO: 1325265 - RNA, 19 nt, Homo sapiens
agaauugucucucaacucu

SEQ ID NO: 1325266 - RNA, 19 nt, Homo sapiens
gaucuugacaugcacagaa

SEQ ID NO: 1325267 - RNA, 19 nt, Homo sapiens
uauaagaugucugguuugu

SEQ ID NO: 1325268 - RNA, 19 nt, Homo sapiens
gaauacagcuuuucauagg

SEQ ID NO: 1325269 - RNA, 19 nt, Homo sapiens
guauggaugucugugcuuu

SEQ ID NO: 1325270 - RNA, 19 nt, Homo sapiens
guucaaguuuaguucauug

SEQ ID NO: 1325271 - RNA, 19 nt, Homo sapiens
gacaugcacagaaaugaaa

SEQ ID NO: 1325272 - RNA, 19 nt, Homo sapiens
aaugggagaucuugacaug

SEQ ID NO: 1325273 - RNA, 19 nt, Homo sapiens
caaaauaccuccuguagcu

SEQ ID NO: 1325274 - RNA, 19 nt, Homo sapiens
gagaaaagauaccaguguu

SEQ ID NO: 1325275 - RNA, 19 nt, Homo sapiens
aagaaggcaucaguaauga

SEQ ID NO: 1325276 - RNA, 19 nt, Homo sapiens
uaauaucacuccuguugag

SEQ ID NO: 1325277 - RNA, 19 nt, Homo sapiens
gaaacaaaguggugucaaa

SEQ ID NO: 1325278 - RNA, 19 nt, Homo sapiens
gaaagaggcugcggacuug

SEQ ID NO: 1325279 - RNA, 19 nt, Homo sapiens
gcacugaucuuuggauaga

SEQ ID NO: 1325280 - RNA, 19 nt, Homo sapiens
ggaaggaguucacuguaga

SEQ ID NO: 1325281 - RNA, 19 nt, Homo sapiens
ccaaagccaucucaucuga

SEQ ID NO: 1325282 - RNA, 19 nt, Homo sapiens
gaaauucgcaggagccaaa

SEQ ID NO: 1325283 - RNA, 19 nt, Homo sapiens
ggacuugacuuucuuucug

SEQ ID NO: 1325284 - RNA, 19 nt, Homo sapiens
gaagaaggacucugauuuc

SEQ ID NO: 1325285 - RNA, 19 nt, Homo sapiens
ggucuugucugcugugauu

SEQ ID NO: 1325286 - RNA, 19 nt, Homo sapiens
ggaaagaggcugcggacuu

SEQ ID NO: 1325287 - RNA, 19 nt, Homo sapiens
gaggauuuguuacuucgua

SEQ ID NO: 1325288 - RNA, 19 nt, Homo sapiens
gcucgcagcuggacuuguu

SEQ ID NO: 1325289 - RNA, 19 nt, Homo sapiens
ccagauugaucguaagaaa

SEQ ID NO: 1325290 - RNA, 19 nt, Homo sapiens
ccaauggugugaugaauuc

SEQ ID NO: 1325291 - RNA, 19 nt, Homo sapiens
ggacuuguuugacgauguu

SEQ ID NO: 1325292 - RNA, 19 nt, Homo sapiens
guaagcacuuggaagauug

SEQ ID NO: 1325293 - RNA, 19 nt, Homo sapiens
caucucaucugacauguuc

SEQ ID NO: 1325294 - RNA, 19 nt, Homo sapiens
gcucaggccucgagucuag

SEQ ID NO: 1325295 - RNA, 19 nt, Homo sapiens
ucaagcauccggccuauuu

SEQ ID NO: 1325296 - RNA, 19 nt, Homo sapiens
guagugccguuccuaauca

SEQ ID NO: 1325297 - RNA, 19 nt, Homo sapiens
accaagggcuggaaacuuu

SEQ ID NO: 1325298 - RNA, 19 nt, Homo sapiens
gaagugaccaucucaagca

SEQ ID NO: 1325299 - RNA, 19 nt, Homo sapiens
gccaacaccaaauauaaua

SEQ ID NO: 1325300 - RNA, 19 nt, Homo sapiens
ggagguggaugcggaguau

SEQ ID NO: 1325301 - RNA, 19 nt, Homo sapiens
gccaagcacugucauucuu

SEQ ID NO: 1325302 - RNA, 19 nt, Homo sapiens
ggacugagcccuuuauucc

SEQ ID NO: 1325303 - RNA, 19 nt, Homo sapiens
ggacucugauuucuucaca

SEQ ID NO: 1325304 - RNA, 19 nt, Homo sapiens
agaagaaggacucugauuu

SEQ ID NO: 1325305 - RNA, 19 nt, Homo sapiens
ucacggagcaggaagugua

SEQ ID NO: 1325306 - RNA, 19 nt, Homo sapiens
ggaagcagaggaugugaga

SEQ ID NO: 1325307 - RNA, 19 nt, Homo sapiens
agccagagcuucagugaga

SEQ ID NO: 1325308 - RNA, 19 nt, Homo sapiens
gagaagaaggacucugauu

SEQ ID NO: 1325309 - RNA, 19 nt, Homo sapiens
gcauggcacugaucuuugg

SEQ ID NO: 1325310 - RNA, 19 nt, Homo sapiens
acaaaguggugucaaaaua

SEQ ID NO: 1325311 - RNA, 19 nt, Homo sapiens
gcucacuuauccugccaua

SEQ ID NO: 1325312 - RNA, 19 nt, Homo sapiens
cagcggacauugcccaguu

SEQ ID NO: 1325313 - RNA, 19 nt, Homo sapiens
ggacaaucccuuuuccuua

SEQ ID NO: 1325314 - RNA, 19 nt, Homo sapiens
uagccgagcugcccagaug

SEQ ID NO: 1325315 - RNA, 19 nt, Homo sapiens
caucugacauguucuuugg

SEQ ID NO: 1325316 - RNA, 19 nt, Homo sapiens
accaggagcuccagauuga

SEQ ID NO: 1325317 - RNA, 19 nt, Homo sapiens
gcacuuggaagauuguuuc

SEQ ID NO: 1325318 - RNA, 19 nt, Homo sapiens
gaugccaacaccaaauaua

SEQ ID NO: 1325319 - RNA, 19 nt, Homo sapiens
ggagaaggagccagaagug

SEQ ID NO: 1325320 - RNA, 19 nt, Homo sapiens
gaaaagaagcuacagaauc

SEQ ID NO: 1325321 - RNA, 19 nt, Homo sapiens
gcucugugacucaggcuua

SEQ ID NO: 1325322 - RNA, 19 nt, Homo sapiens
ucgcuacgguuccuacuga

SEQ ID NO: 1325323 - RNA, 19 nt, Homo sapiens
uaagaggcuucgcgcaguu

SEQ ID NO: 1325324 - RNA, 19 nt, Homo sapiens
cugaaaagcuccaucauug

SEQ ID NO: 1325325 - RNA, 19 nt, Homo sapiens
cagagggacuugacuuucu

SEQ ID NO: 1325326 - RNA, 19 nt, Homo sapiens
gugaggcgcgucagaaauu

SEQ ID NO: 1325327 - RNA, 19 nt, Homo sapiens
aaaagaagcuacagaaucu

SEQ ID NO: 1325328 - RNA, 19 nt, Homo sapiens
ggacauugcccaguuuaag

SEQ ID NO: 1325329 - RNA, 19 nt, Homo sapiens
gcagugccaucagcucuuc

SEQ ID NO: 1325330 - RNA, 19 nt, Homo sapiens
ggauagacaacaugaguag

SEQ ID NO: 1325331 - RNA, 19 nt, Homo sapiens
aguaagcacuuggaagauu

SEQ ID NO: 1325332 - RNA, 19 nt, Homo sapiens
gcaacaagaacuccacagu

SEQ ID NO: 1325333 - RNA, 19 nt, Homo sapiens
acaguaagcacuuggaaga

SEQ ID NO: 1325334 - RNA, 19 nt, Homo sapiens
gagaaggagccagaaguga

SEQ ID NO: 1325335 - RNA, 19 nt, Homo sapiens
ccaaugaugccaacaccaa

SEQ ID NO: 1325336 - RNA, 19 nt, Homo sapiens
uggcacugaucuuuggaua

SEQ ID NO: 1325337 - RNA, 19 nt, Homo sapiens
caucagguccacagaguug

SEQ ID NO: 1325338 - RNA, 19 nt, Homo sapiens
uuucuggacuguuuguauu

SEQ ID NO: 1325339 - RNA, 19 nt, Homo sapiens
aaagccaucucaucugaca

SEQ ID NO: 1325340 - RNA, 19 nt, Homo sapiens
gccagcagcagcuaagaaa

SEQ ID NO: 1325341 - RNA, 19 nt, Homo sapiens
cauccggccuauuucagaa

SEQ ID NO: 1325342 - RNA, 19 nt, Homo sapiens
gcaggugauugagcaggaa

SEQ ID NO: 1325343 - RNA, 19 nt, Homo sapiens
gagagcaggcagaaagguu

SEQ ID NO: 1325344 - RNA, 19 nt, Homo sapiens
gaggugggaaggagagaaa

SEQ ID NO: 1325345 - RNA, 19 nt, Homo sapiens
gcaggacccucugugacau

SEQ ID NO: 1325346 - RNA, 19 nt, Homo sapiens
ccaagggcuggaaacuuua

SEQ ID NO: 1325347 - RNA, 19 nt, Homo sapiens
guuagacucuuguccuucu

SEQ ID NO: 1325348 - RNA, 19 nt, Homo sapiens
gcagccagagcuucaguga

SEQ ID NO: 1325349 - RNA, 19 nt, Homo sapiens
caaaguggugucaaaauaa

SEQ ID NO: 1325350 - RNA, 19 nt, Homo sapiens
gagccaagcacugucauuc

SEQ ID NO: 1325351 - RNA, 19 nt, Homo sapiens
uggaaggaguucacuguag

SEQ ID NO: 1325352 - RNA, 19 nt, Homo sapiens
uaagcagggugucaagucu

SEQ ID NO: 1325353 - RNA, 19 nt, Homo sapiens
gauggugacggcaacaaga

SEQ ID NO: 1325354 - RNA, 19 nt, Homo sapiens
agauugaucguaagaaaga

SEQ ID NO: 1325355 - RNA, 19 nt, Homo sapiens
gcgccaagaauccgaguug

SEQ ID NO: 1325356 - RNA, 19 nt, Homo sapiens
ucacuuauccugccauacu

SEQ ID NO: 1325357 - RNA, 19 nt, Homo sapiens
gaagcgagagcaggcagaa

SEQ ID NO: 1325358 - RNA, 19 nt, Homo sapiens
gacccucugugacauucuu

SEQ ID NO: 1325359 - RNA, 19 nt, Homo sapiens
uguaccaucugcuguggaa

SEQ ID NO: 1325360 - RNA, 19 nt, Homo sapiens
gccaauggugugaugaauu

SEQ ID NO: 1325361 - RNA, 19 nt, Homo sapiens
gacaaucccuuuuccuuag

SEQ ID NO: 1325362 - RNA, 19 nt, Homo sapiens
ugacgauguugguacuuuc

SEQ ID NO: 1325363 - RNA, 19 nt, Homo sapiens
ugucugagaugcaggugau

SEQ ID NO: 1325364 - RNA, 19 nt, Homo sapiens
gaacugaaaagcuccauca

SEQ ID NO: 1325365 - RNA, 19 nt, Homo sapiens
gagccaaagccaucucauc

SEQ ID NO: 1325366 - RNA, 19 nt, Homo sapiens
gcauccggccuauuucaga

SEQ ID NO: 1325367 - RNA, 19 nt, Homo sapiens
acccaaagccucacuggaa

SEQ ID NO: 1325368 - RNA, 19 nt, Homo sapiens
gagccgaacaagaccgaaa

SEQ ID NO: 1325369 - RNA, 19 nt, Homo sapiens
gguuccagcugagguguau

SEQ ID NO: 1325370 - RNA, 19 nt, Homo sapiens
agagggacuugacuuucuu

SEQ ID NO: 1325371 - RNA, 19 nt, Homo sapiens
guguuagacucuuguccuu

SEQ ID NO: 1325372 - RNA, 19 nt, Homo sapiens
agaccgaaauccagacucu

SEQ ID NO: 1325373 - RNA, 19 nt, Homo sapiens
gcggacauugcccaguuua

SEQ ID NO: 1325374 - RNA, 19 nt, Homo sapiens
gcaacacagaccacucuuc

SEQ ID NO: 1325375 - RNA, 19 nt, Homo sapiens
ggccaauggugugaugaau

SEQ ID NO: 1325376 - RNA, 19 nt, Homo sapiens
gagcaggaaguguaucucu

SEQ ID NO: 1325377 - RNA, 19 nt, Homo sapiens
gcaggaagaugucgaguuu

SEQ ID NO: 1325378 - RNA, 19 nt, Homo sapiens
ggaaagcaguguguaauuu

SEQ ID NO: 1325379 - RNA, 19 nt, Homo sapiens
gguugaagcuggaaguuua

SEQ ID NO: 1325380 - RNA, 19 nt, Homo sapiens
gaagcuggaaguuuaauua

SEQ ID NO: 1325381 - RNA, 19 nt, Homo sapiens
gauagaaaguugaccacua

SEQ ID NO: 1325382 - RNA, 19 nt, Homo sapiens
gagaguggacuuuguauuu

SEQ ID NO: 1325383 - RNA, 19 nt, Homo sapiens
gugcuagcaugaauuaaua

SEQ ID NO: 1325384 - RNA, 19 nt, Homo sapiens
uaucaucagugaagaauug

SEQ ID NO: 1325385 - RNA, 19 nt, Homo sapiens
ucauagcucuccuuaguuu

SEQ ID NO: 1325386 - RNA, 19 nt, Homo sapiens
ucaaguggcugaacugaau

SEQ ID NO: 1325387 - RNA, 19 nt, Homo sapiens
gaaggcaguuccaguuuua

SEQ ID NO: 1325388 - RNA, 19 nt, Homo sapiens
gaagaugucgaguuucaaa

SEQ ID NO: 1325389 - RNA, 19 nt, Homo sapiens
auagaaaguugaccacuaa

SEQ ID NO: 1325390 - RNA, 19 nt, Homo sapiens
uggcugaacugaaugauga

SEQ ID NO: 1325391 - RNA, 19 nt, Homo sapiens
ucaaacaccuacacauuca

SEQ ID NO: 1325392 - RNA, 19 nt, Homo sapiens
caaaauaguugcugaaaca

SEQ ID NO: 1325393 - RNA, 19 nt, Homo sapiens
gaaauacaagagacucaaa

SEQ ID NO: 1325394 - RNA, 19 nt, Homo sapiens
gggccaauccugucgcuua

SEQ ID NO: 1325395 - RNA, 19 nt, Homo sapiens
gaauacaaccuuugacaag

SEQ ID NO: 1325396 - RNA, 19 nt, Homo sapiens
ccaccuaccuaaccuacuu

SEQ ID NO: 1325397 - RNA, 19 nt, Homo sapiens
gagaaggcaguuccaguuu

SEQ ID NO: 1325398 - RNA, 19 nt, Homo sapiens
gaacugaaugaugaugaua

SEQ ID NO: 1325399 - RNA, 19 nt, Homo sapiens
gaaagauuacucaggaaga

SEQ ID NO: 1325400 - RNA, 19 nt, Homo sapiens
gaaacgguauaaucggaau

SEQ ID NO: 1325401 - RNA, 19 nt, Homo sapiens
ggccaauccugucgcuuaa

SEQ ID NO: 1325402 - RNA, 19 nt, Homo sapiens
uggcugacauugccucuuu

SEQ ID NO: 1325403 - RNA, 19 nt, Homo sapiens
cugaaacaaugaacaacua

SEQ ID NO: 1325404 - RNA, 19 nt, Homo sapiens
uuucauagcucuccuuagu

SEQ ID NO: 1325405 - RNA, 19 nt, Homo sapiens
cauuuaagcagccaucaua

SEQ ID NO: 1325406 - RNA, 19 nt, Homo sapiens
ugacgaaacccagaucuuu

SEQ ID NO: 1325407 - RNA, 19 nt, Homo sapiens
ggaauacaaccuuugacaa

SEQ ID NO: 1325408 - RNA, 19 nt, Homo sapiens
aaagauuacucaggaagaa

SEQ ID NO: 1325409 - RNA, 19 nt, Homo sapiens
caaacaauaaccagcaauu

SEQ ID NO: 1325410 - RNA, 19 nt, Homo sapiens
uagcacagauuuguuuaug

SEQ ID NO: 1325411 - RNA, 19 nt, Homo sapiens
uaaggaaagcaguguguaa

SEQ ID NO: 1325412 - RNA, 19 nt, Homo sapiens
cagcccauauccuguguaa

SEQ ID NO: 1325413 - RNA, 19 nt, Homo sapiens
aauaguugcugaaacaaug

SEQ ID NO: 1325414 - RNA, 19 nt, Homo sapiens
ucauggaggugcuuuagau

SEQ ID NO: 1325415 - RNA, 19 nt, Homo sapiens
acaauggaauacaaccuuu

SEQ ID NO: 1325416 - RNA, 19 nt, Homo sapiens
gaccaccaaucuuguuugu

SEQ ID NO: 1325417 - RNA, 19 nt, Homo sapiens
gaguggacuuuguauuuca

SEQ ID NO: 1325418 - RNA, 19 nt, Homo sapiens
cgaagaagcagcaaucagu

SEQ ID NO: 1325419 - RNA, 19 nt, Homo sapiens
gcuaugcauuuguggaguu

SEQ ID NO: 1325420 - RNA, 19 nt, Homo sapiens
accacuaacugcagguuua

SEQ ID NO: 1325421 - RNA, 19 nt, Homo sapiens
aaacccagaucuuuucaua

SEQ ID NO: 1325422 - RNA, 19 nt, Homo sapiens
ccaauccugucgcuuaauc

SEQ ID NO: 1325423 - RNA, 19 nt, Homo sapiens
aggaagaugucgaguuuca

SEQ ID NO: 1325424 - RNA, 19 nt, Homo sapiens
gauggaggagcgauuuaaa

SEQ ID NO: 1325425 - RNA, 19 nt, Homo sapiens
gcagccaucauaucaauca

SEQ ID NO: 1325426 - RNA, 19 nt, Homo sapiens
ucauauuucucccaguuug

SEQ ID NO: 1325427 - RNA, 19 nt, Homo sapiens
guugugcuagcaugaauua

SEQ ID NO: 1325428 - RNA, 19 nt, Homo sapiens
cagauuuguuuauguguuc

SEQ ID NO: 1325429 - RNA, 19 nt, Homo sapiens
gaaagcaguguguaauuuu

SEQ ID NO: 1325430 - RNA, 19 nt, Homo sapiens
caagagacucaaacaccua

SEQ ID NO: 1325431 - RNA, 19 nt, Homo sapiens
ggauggaggagcgauuuaa

SEQ ID NO: 1325432 - RNA, 19 nt, Homo sapiens
aagcagccaucauaucaau

SEQ ID NO: 1325433 - RNA, 19 nt, Homo sapiens
ugagaaggcaguuccaguu

SEQ ID NO: 1325434 - RNA, 19 nt, Homo sapiens
ggaggugcuuuagauuuca

SEQ ID NO: 1325435 - RNA, 19 nt, Homo sapiens
uggaggugcuuuagauuuc

SEQ ID NO: 1325436 - RNA, 19 nt, Homo sapiens
gcaauuaaagaccaccaau

SEQ ID NO: 1325437 - RNA, 19 nt, Homo sapiens
aauacaaccuuugacaaga

SEQ ID NO: 1325438 - RNA, 19 nt, Homo sapiens
uagguacaauggaauacaa

SEQ ID NO: 1325439 - RNA, 19 nt, Homo sapiens
caucauaucaaucagugaa

SEQ ID NO: 1325440 - RNA, 19 nt, Homo sapiens
uuaagcagccaucauauca

SEQ ID NO: 1325441 - RNA, 19 nt, Homo sapiens
gcccauauccuguguaaaa

SEQ ID NO: 1325442 - RNA, 19 nt, Homo sapiens
ucaggaagaaauuagcuaa

SEQ ID NO: 1325443 - RNA, 19 nt, Homo sapiens
uuucauauuucucccaguu

SEQ ID NO: 1325444 - RNA, 19 nt, Homo sapiens
uaugagaguggacuuugua

SEQ ID NO: 1325445 - RNA, 19 nt, Homo sapiens
gacaagauuuucagaggaa

SEQ ID NO: 1325446 - RNA, 19 nt, Homo sapiens
agaguggacuuuguauuuc

SEQ ID NO: 1325447 - RNA, 19 nt, Homo sapiens
ugaacugaaugaugaugau

SEQ ID NO: 1325448 - RNA, 19 nt, Homo sapiens
aaucggacacuaacacaaa

SEQ ID NO: 1325449 - RNA, 19 nt, Homo sapiens
ucagugaaacgguauaauc

SEQ ID NO: 1325450 - RNA, 19 nt, Homo sapiens
aaucuuguuuguccaucua

SEQ ID NO: 1325451 - RNA, 19 nt, Homo sapiens
auacaaccuuugacaagau

SEQ ID NO: 1325452 - RNA, 19 nt, Homo sapiens
acucaaacaccuacacauu

SEQ ID NO: 1325453 - RNA, 19 nt, Homo sapiens
ggaauugacuaugauuuuc

SEQ ID NO: 1325454 - RNA, 19 nt, Homo sapiens
cuaccuguuuggugaaaga

SEQ ID NO: 1325455 - RNA, 19 nt, Homo sapiens
caucagugaagaauuguau

SEQ ID NO: 1325456 - RNA, 19 nt, Homo sapiens
gcuuuagauuucaacauca

SEQ ID NO: 1325457 - RNA, 19 nt, Homo sapiens
guauuucacuagguacaau

SEQ ID NO: 1325458 - RNA, 19 nt, Homo sapiens
ggacuuuguauuucacuag

SEQ ID NO: 1325459 - RNA, 19 nt, Homo sapiens
gaggugcuuuagauuucaa

SEQ ID NO: 1325460 - RNA, 19 nt, Homo sapiens
uacaaccuuugacaagauu

SEQ ID NO: 1325461 - RNA, 19 nt, Homo sapiens
ggaaucggacacuaacaca

SEQ ID NO: 1325462 - RNA, 19 nt, Homo sapiens
ccacuaacugcagguuuaa

SEQ ID NO: 1325463 - RNA, 19 nt, Homo sapiens
aguuuacucugccuggaua

SEQ ID NO: 1325464 - RNA, 19 nt, Homo sapiens
aagaaagauuacucaggaa

SEQ ID NO: 1325465 - RNA, 19 nt, Homo sapiens
aaucggaaucggacacuaa

SEQ ID NO: 1325466 - RNA, 19 nt, Homo sapiens
cuaacugcagguuuaagua

SEQ ID NO: 1325467 - RNA, 19 nt, Homo sapiens
gcaguggcuuggcugacau

SEQ ID NO: 1325468 - RNA, 19 nt, Homo sapiens
gaaucggacacuaacacaa

SEQ ID NO: 1325469 - RNA, 19 nt, Homo sapiens
gaaguaaaaggacuggaaa

SEQ ID NO: 1325470 - RNA, 19 nt, Homo sapiens
cagguucgcaagcgcauaa

SEQ ID NO: 1325471 - RNA, 19 nt, Homo sapiens
cuuuguauuucacuaggua

SEQ ID NO: 1325472 - RNA, 19 nt, Homo sapiens
gguucaggcuguccagaag

SEQ ID NO: 1325473 - RNA, 19 nt, Homo sapiens
acccagaucuuuucauauu

SEQ ID NO: 1325474 - RNA, 19 nt, Homo sapiens
uaaaaggacuggaaauagc

SEQ ID NO: 1325475 - RNA, 19 nt, Homo sapiens
ugaggauguugccaaaaua

SEQ ID NO: 1325476 - RNA, 19 nt, Homo sapiens
caauuaaagaccaccaauc

SEQ ID NO: 1325477 - RNA, 19 nt, Homo sapiens
gacgcugucucuauuuaua

SEQ ID NO: 1325478 - RNA, 19 nt, Homo sapiens
ccuaaggcgugcaaacaga

SEQ ID NO: 1325479 - RNA, 19 nt, Homo sapiens
cugggaggcugaaaccuuu

SEQ ID NO: 1325480 - RNA, 19 nt, Homo sapiens
gcagagagaacagcgaugu

SEQ ID NO: 1325481 - RNA, 19 nt, Homo sapiens
gugcuuuucucucuaauaa

SEQ ID NO: 1325482 - RNA, 19 nt, Homo sapiens
caucuacuuugaaacaucu

SEQ ID NO: 1325483 - RNA, 19 nt, Homo sapiens
guugugcgcccauuucuca

SEQ ID NO: 1325484 - RNA, 19 nt, Homo sapiens
gcgcccauuucucagauca

SEQ ID NO: 1325485 - RNA, 19 nt, Homo sapiens
gauguugugcgcccauuuc

SEQ ID NO: 1325486 - RNA, 19 nt, Homo sapiens
ccugggcaauguagcaaga

SEQ ID NO: 1325487 - RNA, 19 nt, Homo sapiens
ggcgagaccaggagugaug

SEQ ID NO: 1325488 - RNA, 19 nt, Homo sapiens
ggucaggcaagcuggauuc

SEQ ID NO: 1325489 - RNA, 19 nt, Homo sapiens
ggccgaggcaggaagauuc

SEQ ID NO: 1325490 - RNA, 19 nt, Homo sapiens
gcccauuucucagaucaag

SEQ ID NO: 1325491 - RNA, 19 nt, Homo sapiens
ccauuucucagaucaagga

SEQ ID NO: 1325492 - RNA, 19 nt, Homo sapiens
gcgauguugugcgcccauu

SEQ ID NO: 1325493 - RNA, 19 nt, Homo sapiens
gaagaaacauucagacuag

SEQ ID NO: 1325494 - RNA, 19 nt, Homo sapiens
gaagagagccauuauugaa

SEQ ID NO: 1325495 - RNA, 19 nt, Homo sapiens
ggaagaaauugcucaaaga

SEQ ID NO: 1325496 - RNA, 19 nt, Homo sapiens
gaaagcagauaaacuagau

SEQ ID NO: 1325497 - RNA, 19 nt, Homo sapiens
ggagauaauuggaggcuaa

SEQ ID NO: 1325498 - RNA, 19 nt, Homo sapiens
aaagauagauccugcauau

SEQ ID NO: 1325499 - RNA, 19 nt, Homo sapiens
gaaguacagucacaaguug

SEQ ID NO: 1325500 - RNA, 19 nt, Homo sapiens
gaaaucagggagaaacuua

SEQ ID NO: 1325501 - RNA, 19 nt, Homo sapiens
gguauaggcuuuguaauga

SEQ ID NO: 1325502 - RNA, 19 nt, Homo sapiens
ggaacuaaaugaagcuuug

SEQ ID NO: 1325503 - RNA, 19 nt, Homo sapiens
gaaaugaugccuauguuga

SEQ ID NO: 1325504 - RNA, 19 nt, Homo sapiens
guuagugccugguacaaua

SEQ ID NO: 1325505 - RNA, 19 nt, Homo sapiens
uagaagaccuuggugauuu

SEQ ID NO: 1325506 - RNA, 19 nt, Homo sapiens
uaaagaaucuccugucucu

SEQ ID NO: 1325507 - RNA, 19 nt, Homo sapiens
gucacaaguugaagaauua

SEQ ID NO: 1325508 - RNA, 19 nt, Homo sapiens
agaauaggcuggugaauca

SEQ ID NO: 1325509 - RNA, 19 nt, Homo sapiens
uagaacagcuccaagaaga

SEQ ID NO: 1325510 - RNA, 19 nt, Homo sapiens
gagccaagauuuaacaaca

SEQ ID NO: 1325511 - RNA, 19 nt, Homo sapiens
agaaugaacuggagacaga

SEQ ID NO: 1325512 - RNA, 19 nt, Homo sapiens
uucaagagcugaugaguaa

SEQ ID NO: 1325513 - RNA, 19 nt, Homo sapiens
aaacucagccagcuuauuu

SEQ ID NO: 1325514 - RNA, 19 nt, Homo sapiens
gaagaaaacuacagaggaa

SEQ ID NO: 1325515 - RNA, 19 nt, Homo sapiens
ucacuuggauccagacauu

SEQ ID NO: 1325516 - RNA, 19 nt, Homo sapiens
aaaggcagcugaagauaga

SEQ ID NO: 1325517 - RNA, 19 nt, Homo sapiens
agagagagauggaagagaa

SEQ ID NO: 1325518 - RNA, 19 nt, Homo sapiens
gaaagaaagaggaagaaau

SEQ ID NO: 1325519 - RNA, 19 nt, Homo sapiens
gagacauucuucugauaaa

SEQ ID NO: 1325520 - RNA, 19 nt, Homo sapiens
gaacagcuccaagaagaaa

SEQ ID NO: 1325521 - RNA, 19 nt, Homo sapiens
uaaacuagaaggucaagua

SEQ ID NO: 1325522 - RNA, 19 nt, Homo sapiens
gcuccagacucaauuagaa

SEQ ID NO: 1325523 - RNA, 19 nt, Homo sapiens
ggaaguacagucacaaguu

SEQ ID NO: 1325524 - RNA, 19 nt, Homo sapiens
gcaaaucuacgcaagaaug

SEQ ID NO: 1325525 - RNA, 19 nt, Homo sapiens
agaagaccuuggugauuua

SEQ ID NO: 1325526 - RNA, 19 nt, Homo sapiens
gcucaaagaugccaugaac

SEQ ID NO: 1325527 - RNA, 19 nt, Homo sapiens
agauagauccugcauauuu

SEQ ID NO: 1325528 - RNA, 19 nt, Homo sapiens
gaagaagagagccauuauu

SEQ ID NO: 1325529 - RNA, 19 nt, Homo sapiens
gcaugagaauaagauguua

SEQ ID NO: 1325530 - RNA, 19 nt, Homo sapiens
gcucacaacacaaggguua

SEQ ID NO: 1325531 - RNA, 19 nt, Homo sapiens
ggcagagaaucagguauua

SEQ ID NO: 1325532 - RNA, 19 nt, Homo sapiens
gcgagagccuccucacuug

SEQ ID NO: 1325533 - RNA, 19 nt, Homo sapiens
gauuuaaggcggcagguua

SEQ ID NO: 1325534 - RNA, 19 nt, Homo sapiens
aaacugaaguaggagauaa

SEQ ID NO: 1325535 - RNA, 19 nt, Homo sapiens
ggaaugacccugcauaaaa

SEQ ID NO: 1325536 - RNA, 19 nt, Homo sapiens
gaacuucggcaacagaaug

SEQ ID NO: 1325537 - RNA, 19 nt, Homo sapiens
aaacaaagagucagagaga

SEQ ID NO: 1325538 - RNA, 19 nt, Homo sapiens
aaagaaagaggaagaaaug

SEQ ID NO: 1325539 - RNA, 19 nt, Homo sapiens
gaagaaauugcucaaagau

SEQ ID NO: 1325540 - RNA, 19 nt, Homo sapiens
gcagguaugugagcuuguu

SEQ ID NO: 1325541 - RNA, 19 nt, Homo sapiens
gaagauagacuggcaagca

SEQ ID NO: 1325542 - RNA, 19 nt, Homo sapiens
gaacuggagacagagaaua

SEQ ID NO: 1325543 - RNA, 19 nt, Homo sapiens
ccaagaagguucggacaau

SEQ ID NO: 1325544 - RNA, 19 nt, Homo sapiens
caagagacagguaguagaa

SEQ ID NO: 1325545 - RNA, 19 nt, Homo sapiens
acuagaaggucaaguagaa

SEQ ID NO: 1325546 - RNA, 19 nt, Homo sapiens
gcaacagaaugaugaacug

SEQ ID NO: 1325547 - RNA, 19 nt, Homo sapiens
cagcagagcuuggaaggau

SEQ ID NO: 1325548 - RNA, 19 nt, Homo sapiens
gaaagaggaagaaaugaag

SEQ ID NO: 1325549 - RNA, 19 nt, Homo sapiens
ggaaaccauugaagagcuu

SEQ ID NO: 1325550 - RNA, 19 nt, Homo sapiens
gaaggaaaccauugaagag

SEQ ID NO: 1325551 - RNA, 19 nt, Homo sapiens
ggcuaaagauaagcaauuu

SEQ ID NO: 1325552 - RNA, 19 nt, Homo sapiens
ugaagaacaucuagagaag

SEQ ID NO: 1325553 - RNA, 19 nt, Homo sapiens
gaagaaaugaagcaaaugg

SEQ ID NO: 1325554 - RNA, 19 nt, Homo sapiens
ggagaaacuuauucgucuu

SEQ ID NO: 1325555 - RNA, 19 nt, Homo sapiens
cagucuagcugcagagauu

SEQ ID NO: 1325556 - RNA, 19 nt, Homo sapiens
guuaaugccucuuggaagu

SEQ ID NO: 1325557 - RNA, 19 nt, Homo sapiens
gaggaagaguuaagaaagg

SEQ ID NO: 1325558 - RNA, 19 nt, Homo sapiens
gaagagaagaauaccaugu

SEQ ID NO: 1325559 - RNA, 19 nt, Homo sapiens
augaugaacugaccacuuu

SEQ ID NO: 1325560 - RNA, 19 nt, Homo sapiens
cuacagaggaacuaaauga

SEQ ID NO: 1325561 - RNA, 19 nt, Homo sapiens
ccagaaauacaagcucuua

SEQ ID NO: 1325562 - RNA, 19 nt, Homo sapiens
gcaaauggaagaacgauac

SEQ ID NO: 1325563 - RNA, 19 nt, Homo sapiens
ggaaaugaugccuauguug

SEQ ID NO: 1325564 - RNA, 19 nt, Homo sapiens
gccagaccguggaagauuu

SEQ ID NO: 1325565 - RNA, 19 nt, Homo sapiens
gacagcaaauuaaugacuu

SEQ ID NO: 1325566 - RNA, 19 nt, Homo sapiens
aagaagagagccauuauug

SEQ ID NO: 1325567 - RNA, 19 nt, Homo sapiens
aaaagaagcuugaagaaca

SEQ ID NO: 1325568 - RNA, 19 nt, Homo sapiens
gcagagccuucuagaugau

SEQ ID NO: 1325569 - RNA, 19 nt, Homo sapiens
ggaaagacucaaucaaucu

SEQ ID NO: 1325570 - RNA, 19 nt, Homo sapiens
gauaauuggaggcuaaaga

SEQ ID NO: 1325571 - RNA, 19 nt, Homo sapiens
gauagauccugcauauuuu

SEQ ID NO: 1325572 - RNA, 19 nt, Homo sapiens
guauaggcuuuguaaugaa

SEQ ID NO: 1325573 - RNA, 19 nt, Homo sapiens
agagagccauuauugaaga

SEQ ID NO: 1325574 - RNA, 19 nt, Homo sapiens
caagaagguucggacaaug

SEQ ID NO: 1325575 - RNA, 19 nt, Homo sapiens
gaagcaagaguacauccaa

SEQ ID NO: 1325576 - RNA, 19 nt, Homo sapiens
gcugugcugugaacuguga

SEQ ID NO: 1325577 - RNA, 19 nt, Homo sapiens
gagauggaagagaaauaua

SEQ ID NO: 1325578 - RNA, 19 nt, Homo sapiens
gagagauggaagagaaaua

SEQ ID NO: 1325579 - RNA, 19 nt, Homo sapiens
ucaaggagcagcaccagaa

SEQ ID NO: 1325580 - RNA, 19 nt, Homo sapiens
cagaagaagagagccauua

SEQ ID NO: 1325581 - RNA, 19 nt, Homo sapiens
gcggcagguuaaacucuua

SEQ ID NO: 1325582 - RNA, 19 nt, Homo sapiens
ggucaaguagaaucuuaua

SEQ ID NO: 1325583 - RNA, 19 nt, Homo sapiens
gcugagacauucuucugau

SEQ ID NO: 1325584 - RNA, 19 nt, Homo sapiens
agaagaaacauucagacua

SEQ ID NO: 1325585 - RNA, 19 nt, Homo sapiens
uggaaagacucaaucaauc

SEQ ID NO: 1325586 - RNA, 19 nt, Homo sapiens
gccaugaacuggauaugca

SEQ ID NO: 1325587 - RNA, 19 nt, Homo sapiens
aggaagaaaugaagcaaau

SEQ ID NO: 1325588 - RNA, 19 nt, Homo sapiens
agucacaaguugaagaauu

SEQ ID NO: 1325589 - RNA, 19 nt, Homo sapiens
gagaauaggcuggugaauc

SEQ ID NO: 1325590 - RNA, 19 nt, Homo sapiens
aaacagauuauccgaagaa

SEQ ID NO: 1325591 - RNA, 19 nt, Homo sapiens
aaggucaaguagaaucuua

SEQ ID NO: 1325592 - RNA, 19 nt, Homo sapiens
gcagagaaucagguauuaa

SEQ ID NO: 1325593 - RNA, 19 nt, Homo sapiens
caacuacgaugacuacuaa

SEQ ID NO: 1325594 - RNA, 19 nt, Homo sapiens
gaaauaaacucaagcugau

SEQ ID NO: 1325595 - RNA, 19 nt, Homo sapiens
uaacagagaucgaaaugga

SEQ ID NO: 1325596 - RNA, 19 nt, Homo sapiens
cagcagaucuuucuaccua

SEQ ID NO: 1325597 - RNA, 19 nt, Homo sapiens
gaaauggacaugaauacua

SEQ ID NO: 1325598 - RNA, 19 nt, Homo sapiens
gcaaauagcgauucucuuc

SEQ ID NO: 1325599 - RNA, 19 nt, Homo sapiens
gaugaagacucugcaauug

SEQ ID NO: 1325600 - RNA, 19 nt, Homo sapiens
gacaucaccuauuggcuua

SEQ ID NO: 1325601 - RNA, 19 nt, Homo sapiens
uggcauaaguggaaauaaa

SEQ ID NO: 1325602 - RNA, 19 nt, Homo sapiens
gaagcgaaauuugaagaug

SEQ ID NO: 1325603 - RNA, 19 nt, Homo sapiens
ccuauuggcuuaacagaga

SEQ ID NO: 1325604 - RNA, 19 nt, Homo sapiens
cuacuugguuucugauuug

SEQ ID NO: 1325605 - RNA, 19 nt, Homo sapiens
gccacacgcuguacaagaa

SEQ ID NO: 1325606 - RNA, 19 nt, Homo sapiens
gagaauaaagccaaagaau

SEQ ID NO: 1325607 - RNA, 19 nt, Homo sapiens
uagcgauucucuucaugua

SEQ ID NO: 1325608 - RNA, 19 nt, Homo sapiens
agacuaaaguggccguuga

SEQ ID NO: 1325609 - RNA, 19 nt, Homo sapiens
gcgauucucuucauguauc

SEQ ID NO: 1325610 - RNA, 19 nt, Homo sapiens
aagcgaaauuugaagauga

SEQ ID NO: 1325611 - RNA, 19 nt, Homo sapiens
ugacgaagcgaaauuugaa

SEQ ID NO: 1325612 - RNA, 19 nt, Homo sapiens
aagcaccuguuccaacuaa

SEQ ID NO: 1325613 - RNA, 19 nt, Homo sapiens
cuucauguaucuccuaaug

SEQ ID NO: 1325614 - RNA, 19 nt, Homo sapiens
ugaagacucugcaauuggu

SEQ ID NO: 1325615 - RNA, 19 nt, Homo sapiens
caacgucacuaugaugaag

SEQ ID NO: 1325616 - RNA, 19 nt, Homo sapiens
ugaauacuauggcgauuac

SEQ ID NO: 1325617 - RNA, 19 nt, Homo sapiens
cuacaugggcuuugacgaa

SEQ ID NO: 1325618 - RNA, 19 nt, Homo sapiens
gauauuucaugggaauguu

SEQ ID NO: 1325619 - RNA, 19 nt, Homo sapiens
ugaugaagacucugcaauu

SEQ ID NO: 1325620 - RNA, 19 nt, Homo sapiens
aaacaacacauguaaaugc

SEQ ID NO: 1325621 - RNA, 19 nt, Homo sapiens
aaauagcgauucucuucau

SEQ ID NO: 1325622 - RNA, 19 nt, Homo sapiens
uaaaguggccguugaugag

SEQ ID NO: 1325623 - RNA, 19 nt, Homo sapiens
gcaccuguuccaacuaaga

SEQ ID NO: 1325624 - RNA, 19 nt, Homo sapiens
ucacuaugaugaagacucu

SEQ ID NO: 1325625 - RNA, 19 nt, Homo sapiens
gcagugguaccagcaguuu

SEQ ID NO: 1325626 - RNA, 19 nt, Homo sapiens
gcagaucuuucuaccuacu

SEQ ID NO: 1325627 - RNA, 19 nt, Homo sapiens
gggcccagguggcauaagu

SEQ ID NO: 1325628 - RNA, 19 nt, Homo sapiens
gagccagcgucaacuacga

SEQ ID NO: 1325629 - RNA, 19 nt, Homo sapiens
cuaaaguggccguugauga

SEQ ID NO: 1325630 - RNA, 19 nt, Homo sapiens
ccagguggcauaaguggaa

SEQ ID NO: 1325631 - RNA, 19 nt, Homo sapiens
ucaacuacgaugacuacua

SEQ ID NO: 1325632 - RNA, 19 nt, Homo sapiens
cuaccaacgucacuaugau

SEQ ID NO: 1325633 - RNA, 19 nt, Homo sapiens
gaucgaaauggacaugaau

SEQ ID NO: 1325634 - RNA, 19 nt, Homo sapiens
gccuuacacuacuugguuu

SEQ ID NO: 1325635 - RNA, 19 nt, Homo sapiens
agaagcaccuguuccaacu

SEQ ID NO: 1325636 - RNA, 19 nt, Homo sapiens
gaagcaccuguuccaacua

SEQ ID NO: 1325637 - RNA, 19 nt, Homo sapiens
ggccguugaugagaauaaa

SEQ ID NO: 1325638 - RNA, 19 nt, Homo sapiens
acuacuugguuucugauuu

SEQ ID NO: 1325639 - RNA, 19 nt, Homo sapiens
uacacuacuugguuucuga

SEQ ID NO: 1325640 - RNA, 19 nt, Homo sapiens
ccuaaugccuuacacuacu

SEQ ID NO: 1325641 - RNA, 19 nt, Homo sapiens
uguaucuccuaaugccuua

SEQ ID NO: 1325642 - RNA, 19 nt, Homo sapiens
caaauagcgauucucuuca

SEQ ID NO: 1325643 - RNA, 19 nt, Homo sapiens
ugacuugccacacgcugua

SEQ ID NO: 1325644 - RNA, 19 nt, Homo sapiens
cuauggcgauuacuaccaa

SEQ ID NO: 1325645 - RNA, 19 nt, Homo sapiens
caagaagcaaauagcgauu

SEQ ID NO: 1325646 - RNA, 19 nt, Homo sapiens
gguaccagcaguuucucua

SEQ ID NO: 1325647 - RNA, 19 nt, Homo sapiens
cuaaugccuuacacuacuu

SEQ ID NO: 1325648 - RNA, 19 nt, Homo sapiens
ugaugagaauaaagccaaa

SEQ ID NO: 1325649 - RNA, 19 nt, Homo sapiens
agaucgaaauggacaugaa

SEQ ID NO: 1325650 - RNA, 19 nt, Homo sapiens
cgaugacuacuaaccauga

SEQ ID NO: 1325651 - RNA, 19 nt, Homo sapiens
gguggcauaaguggaaaua

SEQ ID NO: 1325652 - RNA, 19 nt, Homo sapiens
ccagcaguuucucuacaug

SEQ ID NO: 1325653 - RNA, 19 nt, Homo sapiens
gcauggagccagcgucaac

SEQ ID NO: 1325654 - RNA, 19 nt, Homo sapiens
caugaauacuauggcgauu

SEQ ID NO: 1325655 - RNA, 19 nt, Homo sapiens
agaucuuucuaccuacuuu

SEQ ID NO: 1325656 - RNA, 19 nt, Homo sapiens
ugagaauaaagccaaagaa

SEQ ID NO: 1325657 - RNA, 19 nt, Homo sapiens
aauacuauggcgauuacua

SEQ ID NO: 1325658 - RNA, 19 nt, Homo sapiens
uaccagcaguuucucuaca

SEQ ID NO: 1325659 - RNA, 19 nt, Homo sapiens
cuaccuacuuuggugauca

SEQ ID NO: 1325660 - RNA, 19 nt, Homo sapiens
aaacgagaagcaccuguuc

SEQ ID NO: 1325661 - RNA, 19 nt, Homo sapiens
gcuguacaagaagcaaaua

SEQ ID NO: 1325662 - RNA, 19 nt, Homo sapiens
acauguaaaugccuuuuga

SEQ ID NO: 1325663 - RNA, 19 nt, Homo sapiens
ggcauaaguggaaauaaac

SEQ ID NO: 1325664 - RNA, 19 nt, Homo sapiens
uaaagccaaagaauuccuu

SEQ ID NO: 1325665 - RNA, 19 nt, Homo sapiens
aauagcgauucucuucaug

SEQ ID NO: 1325666 - RNA, 19 nt, Homo sapiens
gcauaaguggaaauaaacu

SEQ ID NO: 1325667 - RNA, 19 nt, Homo sapiens
ugacuacuaaccaugacuu

SEQ ID NO: 1325668 - RNA, 19 nt, Homo sapiens
ccgaggugcagcaguggua

SEQ ID NO: 1325669 - RNA, 19 nt, Homo sapiens
gagaucgaaauggacauga

SEQ ID NO: 1325670 - RNA, 19 nt, Homo sapiens
cgaagcgaaauuugaagau

SEQ ID NO: 1325671 - RNA, 19 nt, Homo sapiens
ggaaugauuucucugcuaa

SEQ ID NO: 1325672 - RNA, 19 nt, Homo sapiens
acuaugggauucuagauua

SEQ ID NO: 1325673 - RNA, 19 nt, Homo sapiens
gaggagaggugcacuuuac

SEQ ID NO: 1325674 - RNA, 19 nt, Homo sapiens
gccaaaggcuuaguuguga

SEQ ID NO: 1325675 - RNA, 19 nt, Homo sapiens
gcacagacaccucuaccuu

SEQ ID NO: 1325676 - RNA, 19 nt, Homo sapiens
acacaucaaucauggaaug

SEQ ID NO: 1325677 - RNA, 19 nt, Homo sapiens
gguagaagaccaaagaaga

SEQ ID NO: 1325678 - RNA, 19 nt, Homo sapiens
agagaacccuccaccauau

SEQ ID NO: 1325679 - RNA, 19 nt, Homo sapiens
ucugauugcuguuaacaaa

SEQ ID NO: 1325680 - RNA, 19 nt, Homo sapiens
ccaaagaagagaugagcua

SEQ ID NO: 1325681 - RNA, 19 nt, Homo sapiens
guuaacaaaugacuagcuu

SEQ ID NO: 1325682 - RNA, 19 nt, Homo sapiens
gccuguauguuucaauaaa

SEQ ID NO: 1325683 - RNA, 19 nt, Homo sapiens
aagaagagaugagcuagga

SEQ ID NO: 1325684 - RNA, 19 nt, Homo sapiens
gagaggagaggugcacuuu

SEQ ID NO: 1325685 - RNA, 19 nt, Homo sapiens
ccgccuguauguuucaaua

SEQ ID NO: 1325686 - RNA, 19 nt, Homo sapiens
uaacacaucaaucauggaa

SEQ ID NO: 1325687 - RNA, 19 nt, Homo sapiens
acagacaccucuaccuuca

SEQ ID NO: 1325688 - RNA, 19 nt, Homo sapiens
ugauugcuguuaacaaaug

SEQ ID NO: 1325689 - RNA, 19 nt, Homo sapiens
aagagaacccuccaccaua

SEQ ID NO: 1325690 - RNA, 19 nt, Homo sapiens
caagagaacccuccaccau

SEQ ID NO: 1325691 - RNA, 19 nt, Homo sapiens
guucagacccgaccguuau

SEQ ID NO: 1325692 - RNA, 19 nt, Homo sapiens
gaagaccaaagaagagaug

SEQ ID NO: 1325693 - RNA, 19 nt, Homo sapiens
ucaagguaguggccaaaug

SEQ ID NO: 1325694 - RNA, 19 nt, Homo sapiens
caagguaguggccaaaugu

SEQ ID NO: 1325695 - RNA, 19 nt, Homo sapiens
ccaaaggcuuaguugugaa

SEQ ID NO: 1325696 - RNA, 19 nt, Homo sapiens
caguguaugugguagaaga

SEQ ID NO: 1325697 - RNA, 19 nt, Homo sapiens
ggccaaaggcuuaguugug

SEQ ID NO: 1325698 - RNA, 19 nt, Homo sapiens
uggaaugauuucucugcua

SEQ ID NO: 1325699 - RNA, 19 nt, Homo sapiens
caaaggcuuaguugugaaa

SEQ ID NO: 1325700 - RNA, 19 nt, Homo sapiens
uuaauucagugacuugauc

SEQ ID NO: 1325701 - RNA, 19 nt, Homo sapiens
cuaugggauucuagauuaa

SEQ ID NO: 1325702 - RNA, 19 nt, Homo sapiens
gguugcuacuguuuaauuc

SEQ ID NO: 1325703 - RNA, 19 nt, Homo sapiens
guagaagaccaaagaagag

SEQ ID NO: 1325704 - RNA, 19 nt, Homo sapiens
ggguugcuacuguuuaauu

SEQ ID NO: 1325705 - RNA, 19 nt, Homo sapiens
gauugcuguuaacaaauga

SEQ ID NO: 1325706 - RNA, 19 nt, Homo sapiens
ccaaggauacccacaguac

SEQ ID NO: 1325707 - RNA, 19 nt, Homo sapiens
aagaugugcuaaaugacuu

SEQ ID NO: 1325708 - RNA, 19 nt, Homo sapiens
gcucugcugccaccucuga

SEQ ID NO: 1325709 - RNA, 19 nt, Homo sapiens
gcuggacggcucucuguug

SEQ ID NO: 1325710 - RNA, 19 nt, Homo sapiens
gcuguuaacaaaugacuag

SEQ ID NO: 1325711 - RNA, 19 nt, Homo sapiens
gcacuaugggauucuagau

SEQ ID NO: 1325712 - RNA, 19 nt, Homo sapiens
ggagaggagaggugcacuu

SEQ ID NO: 1325713 - RNA, 19 nt, Homo sapiens
gguucagacccgaccguua

SEQ ID NO: 1325714 - RNA, 19 nt, Homo sapiens
ugagacaggugcggcaagu

SEQ ID NO: 1325715 - RNA, 19 nt, Homo sapiens
guaguggccaaauguaaca

SEQ ID NO: 1325716 - RNA, 19 nt, Homo sapiens
uaccaaggauacccacagu

SEQ ID NO: 1325717 - RNA, 19 nt, Homo sapiens
aaugauuucucugcuaaca

SEQ ID NO: 1325718 - RNA, 19 nt, Homo sapiens
agaggagaggugcacuuua

SEQ ID NO: 1325719 - RNA, 19 nt, Homo sapiens
gacuagcuuugcacagaca

SEQ ID NO: 1325720 - RNA, 19 nt, Homo sapiens
augacuagcuuugcacaga

SEQ ID NO: 1325721 - RNA, 19 nt, Homo sapiens
ucagcacuaugggauucua

SEQ ID NO: 1325722 - RNA, 19 nt, Homo sapiens
gacaggugcggcaagucua

SEQ ID NO: 1325723 - RNA, 19 nt, Homo sapiens
uagaagaccaaagaagaga

SEQ ID NO: 1325724 - RNA, 19 nt, Homo sapiens
aaagaugugcuaaaugacu

SEQ ID NO: 1325725 - RNA, 19 nt, Homo sapiens
cuucagcacuaugggauuc

SEQ ID NO: 1325726 - RNA, 19 nt, Homo sapiens
ggagaggugcacuuuacag

SEQ ID NO: 1325727 - RNA, 19 nt, Homo sapiens
gguaguggccaaauguaac

SEQ ID NO: 1325728 - RNA, 19 nt, Homo sapiens
gagaacccuccaccauauc

SEQ ID NO: 1325729 - RNA, 19 nt, Homo sapiens
ggaaacccauugaagaguu

SEQ ID NO: 1325730 - RNA, 19 nt, Homo sapiens
uuaaaggagugcagcaaua

SEQ ID NO: 1325731 - RNA, 19 nt, Homo sapiens
gaaacccauugaagaguug

SEQ ID NO: 1325732 - RNA, 19 nt, Homo sapiens
uaaauaacauccaguacag

SEQ ID NO: 1325733 - RNA, 19 nt, Homo sapiens
aaaccgaugugauccuuga

SEQ ID NO: 1325734 - RNA, 19 nt, Homo sapiens
gugcaagauuucucaaaga

SEQ ID NO: 1325735 - RNA, 19 nt, Homo sapiens
aaacauuucugcacaaacu

SEQ ID NO: 1325736 - RNA, 19 nt, Homo sapiens
uaaaggagugcagcaauaa

SEQ ID NO: 1325737 - RNA, 19 nt, Homo sapiens
uaacauccaguacagauau

SEQ ID NO: 1325738 - RNA, 19 nt, Homo sapiens
ggaaaugcuucugcuacau

SEQ ID NO: 1325739 - RNA, 19 nt, Homo sapiens
gcaagauuucucaaagauu

SEQ ID NO: 1325740 - RNA, 19 nt, Homo sapiens
caauaacugcacugucuaa

SEQ ID NO: 1325741 - RNA, 19 nt, Homo sapiens
gcaauaacugcacugucua

SEQ ID NO: 1325742 - RNA, 19 nt, Homo sapiens
ccucgccucuuucuucuga

SEQ ID NO: 1325743 - RNA, 19 nt, Homo sapiens
uccaaagggugaccaaaug

SEQ ID NO: 1325744 - RNA, 19 nt, Homo sapiens
gaaaaggaaggaacucauu

SEQ ID NO: 1325745 - RNA, 19 nt, Homo sapiens
cgaucaauacuuuggauuu

SEQ ID NO: 1325746 - RNA, 19 nt, Homo sapiens
ccaaagggugaccaaauga

SEQ ID NO: 1325747 - RNA, 19 nt, Homo sapiens
ccucaucuuucgcugugua

SEQ ID NO: 1325748 - RNA, 19 nt, Homo sapiens
uaacugcacugucuaaaag

SEQ ID NO: 1325749 - RNA, 19 nt, Homo sapiens
accaggcgaucaauacuuu

SEQ ID NO: 1325750 - RNA, 19 nt, Homo sapiens
cggaaaugcuucugcuaca

SEQ ID NO: 1325751 - RNA, 19 nt, Homo sapiens
cuauaaaucuaguggaaac

SEQ ID NO: 1325752 - RNA, 19 nt, Homo sapiens
gaaaaccgaugugauccuu

SEQ ID NO: 1325753 - RNA, 19 nt, Homo sapiens
ugccauuugugcaagauuu

SEQ ID NO: 1325754 - RNA, 19 nt, Homo sapiens
ugcaagauuucucaaagau

SEQ ID NO: 1325755 - RNA, 19 nt, Homo sapiens
agcaauaacugcacugucu

SEQ ID NO: 1325756 - RNA, 19 nt, Homo sapiens
uaacaaucaaccaacaaug

SEQ ID NO: 1325757 - RNA, 19 nt, Homo sapiens
ggacccuacuguaccucaa

SEQ ID NO: 1325758 - RNA, 19 nt, Homo sapiens
ggcucuggauaaggaauua

SEQ ID NO: 1325759 - RNA, 19 nt, Homo sapiens
ggguggagccucaucuuuc

SEQ ID NO: 1325760 - RNA, 19 nt, Homo sapiens
uguguauucucuuuggaaa

SEQ ID NO: 1325761 - RNA, 19 nt, Homo sapiens
gguggagccucaucuuucg

SEQ ID NO: 1325762 - RNA, 19 nt, Homo sapiens
ccaggugagucucccaucu

SEQ ID NO: 1325763 - RNA, 19 nt, Homo sapiens
gcuuauaacaaucaaccaa

SEQ ID NO: 1325764 - RNA, 19 nt, Homo sapiens
ugugcaagauuucucaaag

SEQ ID NO: 1325765 - RNA, 19 nt, Homo sapiens
guccaaagggugaccaaau

SEQ ID NO: 1325766 - RNA, 19 nt, Homo sapiens
cucuauaaaucuaguggaa

SEQ ID NO: 1325767 - RNA, 19 nt, Homo sapiens
ggcgaucaauacuuuggau

SEQ ID NO: 1325768 - RNA, 19 nt, Homo sapiens
uuuaggguuugucuacauu

SEQ ID NO: 1325769 - RNA, 19 nt, Homo sapiens
caaucaaccaacaauggaa

SEQ ID NO: 1325770 - RNA, 19 nt, Homo sapiens
gcccaccaggcgaucaaua

SEQ ID NO: 1325771 - RNA, 19 nt, Homo sapiens
acaaucaaccaacaaugga

SEQ ID NO: 1325772 - RNA, 19 nt, Homo sapiens
uuugggcucuggauaagga

SEQ ID NO: 1325773 - RNA, 19 nt, Homo sapiens
caucuuucgcuguguauuc

SEQ ID NO: 1325774 - RNA, 19 nt, Homo sapiens
aaucaaccaacaauggaaa

SEQ ID NO: 1325775 - RNA, 19 nt, Homo sapiens
ccagaaccuugggaaacug

SEQ ID NO: 1325776 - RNA, 19 nt, Homo sapiens
aauaacauccaguacagau

SEQ ID NO: 1325777 - RNA, 19 nt, Homo sapiens
gcgaucaauacuuuggauu

SEQ ID NO: 1325778 - RNA, 19 nt, Homo sapiens
uggauaaggaauuaaagga

SEQ ID NO: 1325779 - RNA, 19 nt, Homo sapiens
gacccuacuguaccucaaa

SEQ ID NO: 1325780 - RNA, 19 nt, Homo sapiens
gaaacuguggacccuacug

SEQ ID NO: 1325781 - RNA, 19 nt, Homo sapiens
gcuguguauucucuuugga

SEQ ID NO: 1325782 - RNA, 19 nt, Homo sapiens
uugaagaguugcaaaaugu

SEQ ID NO: 1325783 - RNA, 19 nt, Homo sapiens
caauuaggguguuuccuua

SEQ ID NO: 1325784 - RNA, 19 nt, Homo sapiens
agacauaccucccaucaug

SEQ ID NO: 1325785 - RNA, 19 nt, Homo sapiens
ccagagaggugguaaaugg

SEQ ID NO: 1325786 - RNA, 19 nt, Homo sapiens
ccugcuggcuuuagaauaa

SEQ ID NO: 1325787 - RNA, 19 nt, Homo sapiens
gguucaaucuaaucugaua

SEQ ID NO: 1325788 - RNA, 19 nt, Homo sapiens
uuaaacaacuccuuuccaa

SEQ ID NO: 1325789 - RNA, 19 nt, Homo sapiens
gcaauuaggguguuuccuu

SEQ ID NO: 1325790 - RNA, 19 nt, Homo sapiens
acaccaaccugcuggcuuu

SEQ ID NO: 1325791 - RNA, 19 nt, Homo sapiens
uaccacacuuuaccaguua

SEQ ID NO: 1325792 - RNA, 19 nt, Homo sapiens
caucuucccucgauugguu

SEQ ID NO: 1325793 - RNA, 19 nt, Homo sapiens
gaccacagacucaagauug

SEQ ID NO: 1325794 - RNA, 19 nt, Homo sapiens
ggaggcaacuacacaccaa

SEQ ID NO: 1325795 - RNA, 19 nt, Homo sapiens
ugaucucucuugucuagua

SEQ ID NO: 1325796 - RNA, 19 nt, Homo sapiens
gaaggcaauuaggguguuu

SEQ ID NO: 1325797 - RNA, 19 nt, Homo sapiens
gugguucaaucuaaucuga

SEQ ID NO: 1325798 - RNA, 19 nt, Homo sapiens
gcagacauaccucccauca

SEQ ID NO: 1325799 - RNA, 19 nt, Homo sapiens
ugacuacccugaucucucu

SEQ ID NO: 1325800 - RNA, 19 nt, Homo sapiens
gagagcagguuggugacuu

SEQ ID NO: 1325801 - RNA, 19 nt, Homo sapiens
ucccacagcuuuuccauua

SEQ ID NO: 1325802 - RNA, 19 nt, Homo sapiens
ccugaucucucuugucuag

SEQ ID NO: 1325803 - RNA, 19 nt, Homo sapiens
uuaccacacuuuaccaguu

SEQ ID NO: 1325804 - RNA, 19 nt, Homo sapiens
ucgauugguuaacuccuua

SEQ ID NO: 1325805 - RNA, 19 nt, Homo sapiens
ggugguaaauggcagaaag

SEQ ID NO: 1325806 - RNA, 19 nt, Homo sapiens
ggaagcgagaggcaucuaa

SEQ ID NO: 1325807 - RNA, 19 nt, Homo sapiens
gcuugaggcugugguguga

SEQ ID NO: 1325808 - RNA, 19 nt, Homo sapiens
cauauuagaaggcaauuag

SEQ ID NO: 1325809 - RNA, 19 nt, Homo sapiens
ccaaccugcuggcuuuaga

SEQ ID NO: 1325810 - RNA, 19 nt, Homo sapiens
caucuaagcaggcaguguu

SEQ ID NO: 1325811 - RNA, 19 nt, Homo sapiens
gcagguuggugacuuugag

SEQ ID NO: 1325812 - RNA, 19 nt, Homo sapiens
aaacccagcucccaugacu

SEQ ID NO: 1325813 - RNA, 19 nt, Homo sapiens
agagcagguuggugacuuu

SEQ ID NO: 1325814 - RNA, 19 nt, Homo sapiens
gguggugguucaaucuaau

SEQ ID NO: 1325815 - RNA, 19 nt, Homo sapiens
ccacagcuuuuccauuaaa

SEQ ID NO: 1325816 - RNA, 19 nt, Homo sapiens
agaauugucaugccucuga

SEQ ID NO: 1325817 - RNA, 19 nt, Homo sapiens
gaauaaaagcaccaacuga

SEQ ID NO: 1325818 - RNA, 19 nt, Homo sapiens
aaucaugcuccuccuagua

SEQ ID NO: 1325819 - RNA, 19 nt, Homo sapiens
gaagcgagaggcaucuaag

SEQ ID NO: 1325820 - RNA, 19 nt, Homo sapiens
gcugcuccauggacuugaa

SEQ ID NO: 1325821 - RNA, 19 nt, Homo sapiens
gcaaaugguggugguucaa

SEQ ID NO: 1325822 - RNA, 19 nt, Homo sapiens
ggaccaauuuguggguagu

SEQ ID NO: 1325823 - RNA, 19 nt, Homo sapiens
gacauaccucccaucauga

SEQ ID NO: 1325824 - RNA, 19 nt, Homo sapiens
ccauggacuugaagaacau

SEQ ID NO: 1325825 - RNA, 19 nt, Homo sapiens
ugagcgggauguccagugu

SEQ ID NO: 1325826 - RNA, 19 nt, Homo sapiens
auuaggguguuuccuuaaa

SEQ ID NO: 1325827 - RNA, 19 nt, Homo sapiens
ugacauauuagaaggcaau

SEQ ID NO: 1325828 - RNA, 19 nt, Homo sapiens
ccagagggcagcagacagu

SEQ ID NO: 1325829 - RNA, 19 nt, Homo sapiens
guucaucuucccucgauug

SEQ ID NO: 1325830 - RNA, 19 nt, Homo sapiens
guacgcacauaugcacaca

SEQ ID NO: 1325831 - RNA, 19 nt, Homo sapiens
ugguggugguucaaucuaa

SEQ ID NO: 1325832 - RNA, 19 nt, Homo sapiens
uugaggcuguggugugaaa

SEQ ID NO: 1325833 - RNA, 19 nt, Homo sapiens
caaucaugcuccuccuagu

SEQ ID NO: 1325834 - RNA, 19 nt, Homo sapiens
uccauggacuugaagaaca

SEQ ID NO: 1325835 - RNA, 19 nt, Homo sapiens
aaaugguggugguucaauc

SEQ ID NO: 1325836 - RNA, 19 nt, Homo sapiens
caaccugcuggcuuuagaa

SEQ ID NO: 1325837 - RNA, 19 nt, Homo sapiens
agaaggcaauuaggguguu

SEQ ID NO: 1325838 - RNA, 19 nt, Homo sapiens
ccacgcgagucucaaucau

SEQ ID NO: 1325839 - RNA, 19 nt, Homo sapiens
uaguucaucuucccucgau

SEQ ID NO: 1325840 - RNA, 19 nt, Homo sapiens
ugaaacccagcucccauga

SEQ ID NO: 1325841 - RNA, 19 nt, Homo sapiens
ccagggaggcaacuacaca

SEQ ID NO: 1325842 - RNA, 19 nt, Homo sapiens
acccugaucucucuugucu

SEQ ID NO: 1325843 - RNA, 19 nt, Homo sapiens
ucagaccacagacucaaga

SEQ ID NO: 1325844 - RNA, 19 nt, Homo sapiens
caccacaccuguccuugcu

SEQ ID NO: 1325845 - RNA, 19 nt, Homo sapiens
gaucucucuugucuaguac

SEQ ID NO: 1325846 - RNA, 19 nt, Homo sapiens
caaaugguggugguucaau

SEQ ID NO: 1325847 - RNA, 19 nt, Homo sapiens
gaccagggaggcaacuaca

SEQ ID NO: 1325848 - RNA, 19 nt, Homo sapiens
gcacacaggcagacauacc

SEQ ID NO: 1325849 - RNA, 19 nt, Homo sapiens
gagcagcaguugaauguaa

SEQ ID NO: 1325850 - RNA, 19 nt, Homo sapiens
ggaaaggacugugaaaugu

SEQ ID NO: 1325851 - RNA, 19 nt, Homo sapiens
ggacgacaacuacaacuua

SEQ ID NO: 1325852 - RNA, 19 nt, Homo sapiens
gaaguucucucuggaaaga

SEQ ID NO: 1325853 - RNA, 19 nt, Homo sapiens
gggagaauguggaguguaa

SEQ ID NO: 1325854 - RNA, 19 nt, Homo sapiens
ggccagagauggaugacua

SEQ ID NO: 1325855 - RNA, 19 nt, Homo sapiens
gaaaggacugugaaaugua

SEQ ID NO: 1325856 - RNA, 19 nt, Homo sapiens
aauguaagcuggagagaaa

SEQ ID NO: 1325857 - RNA, 19 nt, Homo sapiens
ggaugaagaugaagugcuu

SEQ ID NO: 1325858 - RNA, 19 nt, Homo sapiens
caucaucucucaggacuuu

SEQ ID NO: 1325859 - RNA, 19 nt, Homo sapiens
uaaagcaccgguugaauaa

SEQ ID NO: 1325860 - RNA, 19 nt, Homo sapiens
ggaagaagcgcuuucaaca

SEQ ID NO: 1325861 - RNA, 19 nt, Homo sapiens
acaaguaccuggaggagaa

SEQ ID NO: 1325862 - RNA, 19 nt, Homo sapiens
cuaaagcaccgguugaaua

SEQ ID NO: 1325863 - RNA, 19 nt, Homo sapiens
gaagaugaagugcuuaaug

SEQ ID NO: 1325864 - RNA, 19 nt, Homo sapiens
gaagaagcgcuuucaacaa

SEQ ID NO: 1325865 - RNA, 19 nt, Homo sapiens
gggacacacucaccauaaa

SEQ ID NO: 1325866 - RNA, 19 nt, Homo sapiens
ccuuagaucuggaugauga

SEQ ID NO: 1325867 - RNA, 19 nt, Homo sapiens
agaagaacaucaagagguu

SEQ ID NO: 1325868 - RNA, 19 nt, Homo sapiens
gagcgguacuacaagauga

SEQ ID NO: 1325869 - RNA, 19 nt, Homo sapiens
gguccgagaacaaguauaa

SEQ ID NO: 1325870 - RNA, 19 nt, Homo sapiens
gggaaaggacugugaaaug

SEQ ID NO: 1325871 - RNA, 19 nt, Homo sapiens
uggagacgcugaaggauga

SEQ ID NO: 1325872 - RNA, 19 nt, Homo sapiens
agagauggaugacuacaug

SEQ ID NO: 1325873 - RNA, 19 nt, Homo sapiens
aagaagcgcuuucaacaag

SEQ ID NO: 1325874 - RNA, 19 nt, Homo sapiens
ccaugucccugaaguguga

SEQ ID NO: 1325875 - RNA, 19 nt, Homo sapiens
gcguggagcugcuaaccuu

SEQ ID NO: 1325876 - RNA, 19 nt, Homo sapiens
gcaagaaccucagccucau

SEQ ID NO: 1325877 - RNA, 19 nt, Homo sapiens
gcagcacagucgaagaaga

SEQ ID NO: 1325878 - RNA, 19 nt, Homo sapiens
ucgcagugcuuaaucgaaa

SEQ ID NO: 1325879 - RNA, 19 nt, Homo sapiens
caagucagauaucgucaca

SEQ ID NO: 1325880 - RNA, 19 nt, Homo sapiens
cagaggagcugcgagacaa

SEQ ID NO: 1325881 - RNA, 19 nt, Homo sapiens
aagcaccgguugaauaaga

SEQ ID NO: 1325882 - RNA, 19 nt, Homo sapiens
gcagguccgagaacaagua

SEQ ID NO: 1325883 - RNA, 19 nt, Homo sapiens
gacaagauccagccggaaa

SEQ ID NO: 1325884 - RNA, 19 nt, Homo sapiens
gcagcagcaucaugucaau

SEQ ID NO: 1325885 - RNA, 19 nt, Homo sapiens
ggagaagaacgacgagaug

SEQ ID NO: 1325886 - RNA, 19 nt, Homo sapiens
gagaaugaaaugcugaaga

SEQ ID NO: 1325887 - RNA, 19 nt, Homo sapiens
gagaagaacgacgagauga

SEQ ID NO: 1325888 - RNA, 19 nt, Homo sapiens
ggcaggagcuggucaacag

SEQ ID NO: 1325889 - RNA, 19 nt, Homo sapiens
cgagaucgaucagcuaaag

SEQ ID NO: 1325890 - RNA, 19 nt, Homo sapiens
gaccuggccuagcaguuug

SEQ ID NO: 1325891 - RNA, 19 nt, Homo sapiens
ggacgaggaccagcuguga

SEQ ID NO: 1325892 - RNA, 19 nt, Homo sapiens
agacggagaccaucaucua

SEQ ID NO: 1325893 - RNA, 19 nt, Homo sapiens
gacgacaacuacaacuuag

SEQ ID NO: 1325894 - RNA, 19 nt, Homo sapiens
gaucaaguccaacaucuac

SEQ ID NO: 1325895 - RNA, 19 nt, Homo sapiens
gggaucggcugcacaagag

SEQ ID NO: 1325896 - RNA, 19 nt, Homo sapiens
gagaugaagcucagacaca

SEQ ID NO: 1325897 - RNA, 19 nt, Homo sapiens
gaugagaagaagcagauga

SEQ ID NO: 1325898 - RNA, 19 nt, Homo sapiens
gcuauguggucuucuugga

SEQ ID NO: 1325899 - RNA, 19 nt, Homo sapiens
gcuaugauuucucuugcau

SEQ ID NO: 1325900 - RNA, 19 nt, Homo sapiens
caggagcgguacuacaaga

SEQ ID NO: 1325901 - RNA, 19 nt, Homo sapiens
ugagcaggaugaagaugaa

SEQ ID NO: 1325902 - RNA, 19 nt, Homo sapiens
agagcgagcugggcaagaa

SEQ ID NO: 1325903 - RNA, 19 nt, Homo sapiens
gaagugugacgauguugug

SEQ ID NO: 1325904 - RNA, 19 nt, Homo sapiens
gaagcgaacaucagauuuu

SEQ ID NO: 1325905 - RNA, 19 nt, Homo sapiens
gcucgacccugggaaagga

SEQ ID NO: 1325906 - RNA, 19 nt, Homo sapiens
agaaugaaaugcugaagac

SEQ ID NO: 1325907 - RNA, 19 nt, Homo sapiens
gaaggagcagguucuggaa

SEQ ID NO: 1325908 - RNA, 19 nt, Homo sapiens
gaauguaagcuggagagaa

SEQ ID NO: 1325909 - RNA, 19 nt, Homo sapiens
cagagcagcaguugaaugu

SEQ ID NO: 1325910 - RNA, 19 nt, Homo sapiens
ugacugagaagcaggaaga

SEQ ID NO: 1325911 - RNA, 19 nt, Homo sapiens
acuacaagaugaaggaaga

SEQ ID NO: 1325912 - RNA, 19 nt, Homo sapiens
ggccuucggucaccucugu

SEQ ID NO: 1325913 - RNA, 19 nt, Homo sapiens
gaacuggagcgggagaaug

SEQ ID NO: 1325914 - RNA, 19 nt, Homo sapiens
ucacgcacuuccugaugaa

SEQ ID NO: 1325915 - RNA, 19 nt, Homo sapiens
aaaggacugugaaauguac

SEQ ID NO: 1325916 - RNA, 19 nt, Homo sapiens
ugaacgaggucaucaagcu

SEQ ID NO: 1325917 - RNA, 19 nt, Homo sapiens
aagaugaagugcuuaaugc

SEQ ID NO: 1325918 - RNA, 19 nt, Homo sapiens
cagauaucgucacaagaga

SEQ ID NO: 1325919 - RNA, 19 nt, Homo sapiens
ggaagcuggugaaggacau

SEQ ID NO: 1325920 - RNA, 19 nt, Homo sapiens
caguaaccaucaucucuca

SEQ ID NO: 1325921 - RNA, 19 nt, Homo sapiens
gagcgggacagcuacaaug

SEQ ID NO: 1325922 - RNA, 19 nt, Homo sapiens
gauaucgucacaagagaug

SEQ ID NO: 1325923 - RNA, 19 nt, Homo sapiens
gaagagcuggacccugaga

SEQ ID NO: 1325924 - RNA, 19 nt, Homo sapiens
ccugaagugugacgauguu

SEQ ID NO: 1325925 - RNA, 19 nt, Homo sapiens
ggacacaugcaccaaagag

SEQ ID NO: 1325926 - RNA, 19 nt, Homo sapiens
gaggagggccagagaugga

SEQ ID NO: 1325927 - RNA, 19 nt, Homo sapiens
guaccaggcuaugauuucu

SEQ ID NO: 1325928 - RNA, 19 nt, Homo sapiens
gauccagccggaaagugua

SEQ ID NO: 1325929 - RNA, 19 nt, Homo sapiens
ugaccuggccuagcaguuu

SEQ ID NO: 1325930 - RNA, 19 nt, Homo sapiens
ucagauaucgucacaagag

SEQ ID NO: 1325931 - RNA, 19 nt, Homo sapiens
agucagauaucgucacaag

SEQ ID NO: 1325932 - RNA, 19 nt, Homo sapiens
gaaacugcagcgccugaug

SEQ ID NO: 1325933 - RNA, 19 nt, Homo sapiens
aggaaguucucucuggaaa

SEQ ID NO: 1325934 - RNA, 19 nt, Homo sapiens
uggcugaccuggccuagca

SEQ ID NO: 1325935 - RNA, 19 nt, Homo sapiens
gccggaaaguguagaaguc

SEQ ID NO: 1325936 - RNA, 19 nt, Homo sapiens
gcucaagggacgacaagau

SEQ ID NO: 1325937 - RNA, 19 nt, Homo sapiens
ggaaaguguagaagucaca

SEQ ID NO: 1325938 - RNA, 19 nt, Homo sapiens
gaaggacgacaacuacaac

SEQ ID NO: 1325939 - RNA, 19 nt, Homo sapiens
ugaaggacgacaacuacaa

SEQ ID NO: 1325940 - RNA, 19 nt, Homo sapiens
aggaagagcgggacagcua

SEQ ID NO: 1325941 - RNA, 19 nt, Homo sapiens
acccagaacuguacaaacu

SEQ ID NO: 1325942 - RNA, 19 nt, Homo sapiens
gagcagcgcaagaccaucu

SEQ ID NO: 1325943 - RNA, 19 nt, Homo sapiens
ccaacuccuucaccaagau

SEQ ID NO: 1325944 - RNA, 19 nt, Homo sapiens
agauggaggaggaauguaa

SEQ ID NO: 1325945 - RNA, 19 nt, Homo sapiens
gcacaugcucagccgcuau

SEQ ID NO: 1325946 - RNA, 19 nt, Homo sapiens
accggaagcuggugaagga

SEQ ID NO: 1325947 - RNA, 19 nt, Homo sapiens
ugcggcagcuggaggauga

SEQ ID NO: 1325948 - RNA, 19 nt, Homo sapiens
gcaggaugaagaugaagug

SEQ ID NO: 1325949 - RNA, 19 nt, Homo sapiens
ugacagagcuggagaauga

SEQ ID NO: 1325950 - RNA, 19 nt, Homo sapiens
caagacagauccugacaua

SEQ ID NO: 1325951 - RNA, 19 nt, Homo sapiens
gaacagaggacucagguuu

SEQ ID NO: 1325952 - RNA, 19 nt, Homo sapiens
gguaggagcuugaucuuug

SEQ ID NO: 1325953 - RNA, 19 nt, Homo sapiens
gaucauagcucaccacaac

SEQ ID NO: 1325954 - RNA, 19 nt, Homo sapiens
gcgaauugcuagauguuua

SEQ ID NO: 1325955 - RNA, 19 nt, Homo sapiens
gauaggaucuugcucuguu

SEQ ID NO: 1325956 - RNA, 19 nt, Homo sapiens
gcgaggagcugcugaagga

SEQ ID NO: 1325957 - RNA, 19 nt, Homo sapiens
gaaacacaccuguauuuga

SEQ ID NO: 1325958 - RNA, 19 nt, Homo sapiens
ccaaucagccuuugcauuu

SEQ ID NO: 1325959 - RNA, 19 nt, Homo sapiens
ggacucagguuucauagca

SEQ ID NO: 1325960 - RNA, 19 nt, Homo sapiens
ggaauagacaugguacuua

SEQ ID NO: 1325961 - RNA, 19 nt, Homo sapiens
gcaaugaggagcaguuuga

SEQ ID NO: 1325962 - RNA, 19 nt, Homo sapiens
gaauagacaugguacuuac

SEQ ID NO: 1325963 - RNA, 19 nt, Homo sapiens
gaaauucacaccauggauu

SEQ ID NO: 1325964 - RNA, 19 nt, Homo sapiens
aaacacaccuguauuugau

SEQ ID NO: 1325965 - RNA, 19 nt, Homo sapiens
cagaguuuauccuagauua

SEQ ID NO: 1325966 - RNA, 19 nt, Homo sapiens
gaacuggaagcucguguuu

SEQ ID NO: 1325967 - RNA, 19 nt, Homo sapiens
cagcacaucuuauaguaug

SEQ ID NO: 1325968 - RNA, 19 nt, Homo sapiens
aaaucaaccugcucaauga

SEQ ID NO: 1325969 - RNA, 19 nt, Homo sapiens
gcucacgccuguaauccua

SEQ ID NO: 1325970 - RNA, 19 nt, Homo sapiens
gaguagggauuagcaguaa

SEQ ID NO: 1325971 - RNA, 19 nt, Homo sapiens
uaaagaugguguauguuug

SEQ ID NO: 1325972 - RNA, 19 nt, Homo sapiens
ggucugcuaucaggaguua

SEQ ID NO: 1325973 - RNA, 19 nt, Homo sapiens
gagcuuagaacaacaguga

SEQ ID NO: 1325974 - RNA, 19 nt, Homo sapiens
uagacaggaugcccaguua

SEQ ID NO: 1325975 - RNA, 19 nt, Homo sapiens
gaugguguauguuuguaaa

SEQ ID NO: 1325976 - RNA, 19 nt, Homo sapiens
aaacguguguggucuuauu

SEQ ID NO: 1325977 - RNA, 19 nt, Homo sapiens
ggagugagcuucguguaca

SEQ ID NO: 1325978 - RNA, 19 nt, Homo sapiens
gagcaggccuggcuuuuaa

SEQ ID NO: 1325979 - RNA, 19 nt, Homo sapiens
gcauuggaauuucagagaa

SEQ ID NO: 1325980 - RNA, 19 nt, Homo sapiens
ggaccaaccuucaauucca

SEQ ID NO: 1325981 - RNA, 19 nt, Homo sapiens
acaaugacaucacagagaa

SEQ ID NO: 1325982 - RNA, 19 nt, Homo sapiens
gcaguaacuuaucugaaau

SEQ ID NO: 1325983 - RNA, 19 nt, Homo sapiens
ucaagcaggagaauuauaa

SEQ ID NO: 1325984 - RNA, 19 nt, Homo sapiens
aagaugagauggaccugua

SEQ ID NO: 1325985 - RNA, 19 nt, Homo sapiens
ccucagaccuuucuacaca

SEQ ID NO: 1325986 - RNA, 19 nt, Homo sapiens
gaaaggaacaagacagauc

SEQ ID NO: 1325987 - RNA, 19 nt, Homo sapiens
uagaaacacaccuguauuu

SEQ ID NO: 1325988 - RNA, 19 nt, Homo sapiens
ggcgaggguuucuguagua

SEQ ID NO: 1325989 - RNA, 19 nt, Homo sapiens
gggauuagcaguaacuuau

SEQ ID NO: 1325990 - RNA, 19 nt, Homo sapiens
cgccuuaacugccugagua

SEQ ID NO: 1325991 - RNA, 19 nt, Homo sapiens
acacacaccucaaguccaa

SEQ ID NO: 1325992 - RNA, 19 nt, Homo sapiens
ucccauggcugcaucuuaa

SEQ ID NO: 1325993 - RNA, 19 nt, Homo sapiens
agagcaagcugaagcaaga

SEQ ID NO: 1325994 - RNA, 19 nt, Homo sapiens
guacaacagcgaauugcua

SEQ ID NO: 1325995 - RNA, 19 nt, Homo sapiens
ggccagaguuuauccuaga

SEQ ID NO: 1325996 - RNA, 19 nt, Homo sapiens
guugagaggcuuuaagaaa

SEQ ID NO: 1325997 - RNA, 19 nt, Homo sapiens
uuauauggcuugugauuca

SEQ ID NO: 1325998 - RNA, 19 nt, Homo sapiens
caccucaaguccaaccuua

SEQ ID NO: 1325999 - RNA, 19 nt, Homo sapiens
ggauaaggauucacauucg

SEQ ID NO: 1326000 - RNA, 19 nt, Homo sapiens
aaacagagaaacuggauga

SEQ ID NO: 1326001 - RNA, 19 nt, Homo sapiens
gauguuuacugcucucaau

SEQ ID NO: 1326002 - RNA, 19 nt, Homo sapiens
ccaccucgcucaucagcaa

SEQ ID NO: 1326003 - RNA, 19 nt, Homo sapiens
agcaguaacuuaucugaaa

SEQ ID NO: 1326004 - RNA, 19 nt, Homo sapiens
ccaaagcacugggauuaca

SEQ ID NO: 1326005 - RNA, 19 nt, Homo sapiens
ccaguuaaguuugaauuuc

SEQ ID NO: 1326006 - RNA, 19 nt, Homo sapiens
guacuuaccuuagaguuuu

SEQ ID NO: 1326007 - RNA, 19 nt, Homo sapiens
uaauggaucuuuguucuag

SEQ ID NO: 1326008 - RNA, 19 nt, Homo sapiens
guaguagacucagauuuua

SEQ ID NO: 1326009 - RNA, 19 nt, Homo sapiens
gaaucaacuucaaggacuu

SEQ ID NO: 1326010 - RNA, 19 nt, Homo sapiens
cacauucgcucuaguacga

SEQ ID NO: 1326011 - RNA, 19 nt, Homo sapiens
cgacagaaccgccuugagu

SEQ ID NO: 1326012 - RNA, 19 nt, Homo sapiens
ggagcaguuugaagacuau

SEQ ID NO: 1326013 - RNA, 19 nt, Homo sapiens
ggcaguacauggacaagau

SEQ ID NO: 1326014 - RNA, 19 nt, Homo sapiens
uggagcaccugcagaugua

SEQ ID NO: 1326015 - RNA, 19 nt, Homo sapiens
ugaauuggccagaguuuau

SEQ ID NO: 1326016 - RNA, 19 nt, Homo sapiens
caaccaaagaaaugaguuu

SEQ ID NO: 1326017 - RNA, 19 nt, Homo sapiens
gagcaaaauugugaucuuu

SEQ ID NO: 1326018 - RNA, 19 nt, Homo sapiens
cgacuugaaugggcagauu

SEQ ID NO: 1326019 - RNA, 19 nt, Homo sapiens
uggaggagauggugaagga

SEQ ID NO: 1326020 - RNA, 19 nt, Homo sapiens
ggcagucggucuucuagga

SEQ ID NO: 1326021 - RNA, 19 nt, Homo sapiens
ugaaggagaaggaggguuu

SEQ ID NO: 1326022 - RNA, 19 nt, Homo sapiens
gggauaaggauucacauuc

SEQ ID NO: 1326023 - RNA, 19 nt, Homo sapiens
ggcucaagcaggagaauua

SEQ ID NO: 1326024 - RNA, 19 nt, Homo sapiens
gggacagcauugacucuug

SEQ ID NO: 1326025 - RNA, 19 nt, Homo sapiens
ggagcuugaucuuuguuuc

SEQ ID NO: 1326026 - RNA, 19 nt, Homo sapiens
auaaacguguguggucuua

SEQ ID NO: 1326027 - RNA, 19 nt, Homo sapiens
gaaaauacagagcuuagaa

SEQ ID NO: 1326028 - RNA, 19 nt, Homo sapiens
gacaaugacaucacagaga

SEQ ID NO: 1326029 - RNA, 19 nt, Homo sapiens
gcuagucccugugcguuga

SEQ ID NO: 1326030 - RNA, 19 nt, Homo sapiens
gagaauuugccaauaggaa

SEQ ID NO: 1326031 - RNA, 19 nt, Homo sapiens
gcaguuucuugcuuucuuc

SEQ ID NO: 1326032 - RNA, 19 nt, Homo sapiens
cuaguacgaugggcucuuu

SEQ ID NO: 1326033 - RNA, 19 nt, Homo sapiens
auacagagcuuagaacaac

SEQ ID NO: 1326034 - RNA, 19 nt, Homo sapiens
gauuagcaguaacuuaucu

SEQ ID NO: 1326035 - RNA, 19 nt, Homo sapiens
ggccaggacauauuugaaa

SEQ ID NO: 1326036 - RNA, 19 nt, Homo sapiens
aagcgauccucccgccuua

SEQ ID NO: 1326037 - RNA, 19 nt, Homo sapiens
ggaguguagugguaugauc

SEQ ID NO: 1326038 - RNA, 19 nt, Homo sapiens
ucacagagaagguaagcuu

SEQ ID NO: 1326039 - RNA, 19 nt, Homo sapiens
uuaauugcguguccuacuu

SEQ ID NO: 1326040 - RNA, 19 nt, Homo sapiens
gaugcccaguuaaguuuga

SEQ ID NO: 1326041 - RNA, 19 nt, Homo sapiens
guaggagcuugaucuuugu

SEQ ID NO: 1326042 - RNA, 19 nt, Homo sapiens
caaucagccuuugcauuug

SEQ ID NO: 1326043 - RNA, 19 nt, Homo sapiens
cagcagcccucugugaugu

SEQ ID NO: 1326044 - RNA, 19 nt, Homo sapiens
gacagaaccgccuugaguu

SEQ ID NO: 1326045 - RNA, 19 nt, Homo sapiens
caacauagugauaccuugu

SEQ ID NO: 1326046 - RNA, 19 nt, Homo sapiens
ugacuuuauuucugaccua

SEQ ID NO: 1326047 - RNA, 19 nt, Homo sapiens
ugccaaagcacugggauua

SEQ ID NO: 1326048 - RNA, 19 nt, Homo sapiens
gcuaucaggaguuacugua

SEQ ID NO: 1326049 - RNA, 19 nt, Homo sapiens
gcaacaaucuccuuagaaa

SEQ ID NO: 1326050 - RNA, 19 nt, Homo sapiens
ggaaguggaugaaauggua

SEQ ID NO: 1326051 - RNA, 19 nt, Homo sapiens
gaaccaaacugcacuggau

SEQ ID NO: 1326052 - RNA, 19 nt, Homo sapiens
gaaggaagguggcagaauc

SEQ ID NO: 1326053 - RNA, 19 nt, Homo sapiens
agaagaagcuaaacaagaa

SEQ ID NO: 1326054 - RNA, 19 nt, Homo sapiens
ccgagaagcucaacaacua

SEQ ID NO: 1326055 - RNA, 19 nt, Homo sapiens
gacgggagcuccacuguga

SEQ ID NO: 1326056 - RNA, 19 nt, Homo sapiens
uuacacagcuucagugaug

SEQ ID NO: 1326057 - RNA, 19 nt, Homo sapiens
gcaagaagaagcuaaacaa

SEQ ID NO: 1326058 - RNA, 19 nt, Homo sapiens
ggaagccagucuccuacua

SEQ ID NO: 1326059 - RNA, 19 nt, Homo sapiens
ugaaggcgcugaccuacaa

SEQ ID NO: 1326060 - RNA, 19 nt, Homo sapiens
uggagaagcuguugaagga

SEQ ID NO: 1326061 - RNA, 19 nt, Homo sapiens
gagcugagcacaccaagga

SEQ ID NO: 1326062 - RNA, 19 nt, Homo sapiens
gaagccgucucccuccaaa

SEQ ID NO: 1326063 - RNA, 19 nt, Homo sapiens
ucacgaugcugcucaugaa

SEQ ID NO: 1326064 - RNA, 19 nt, Homo sapiens
gcagaaucguguccucgaa

SEQ ID NO: 1326065 - RNA, 19 nt, Homo sapiens
ucaacuccauggucaguaa

SEQ ID NO: 1326066 - RNA, 19 nt, Homo sapiens
gagcuggacugcaccaagu

SEQ ID NO: 1326067 - RNA, 19 nt, Homo sapiens
ggacucuggugcugaggaa

SEQ ID NO: 1326068 - RNA, 19 nt, Homo sapiens
ugaaggagcgguuugcaaa

SEQ ID NO: 1326069 - RNA, 19 nt, Homo sapiens
gcgauuuccucucagaaga

SEQ ID NO: 1326070 - RNA, 19 nt, Homo sapiens
ccaaagcccgcaagaagaa

SEQ ID NO: 1326071 - RNA, 19 nt, Homo sapiens
ccuacuaccugcacacuau

SEQ ID NO: 1326072 - RNA, 19 nt, Homo sapiens
ggagagaagagcagugaga

SEQ ID NO: 1326073 - RNA, 19 nt, Homo sapiens
gagcagccaccgugaagaa

SEQ ID NO: 1326074 - RNA, 19 nt, Homo sapiens
ggagguaacuaggauuucu

SEQ ID NO: 1326075 - RNA, 19 nt, Homo sapiens
gaucagcauuguggagcua

SEQ ID NO: 1326076 - RNA, 19 nt, Homo sapiens
uggaugaaaugguauggaa

SEQ ID NO: 1326077 - RNA, 19 nt, Homo sapiens
gaccgacgacgaccuguuu

SEQ ID NO: 1326078 - RNA, 19 nt, Homo sapiens
gagcggaagcccaagaaga

SEQ ID NO: 1326079 - RNA, 19 nt, Homo sapiens
gcaccauacuugaaaacua

SEQ ID NO: 1326080 - RNA, 19 nt, Homo sapiens
caacugcaaacaucacuau

SEQ ID NO: 1326081 - RNA, 19 nt, Homo sapiens
aguagaaacuugagugaca

SEQ ID NO: 1326082 - RNA, 19 nt, Homo sapiens
gcaugcagaauacacauug

SEQ ID NO: 1326083 - RNA, 19 nt, Homo sapiens
gcaccacgcagcccaugaa

SEQ ID NO: 1326084 - RNA, 19 nt, Homo sapiens
ccagaugauugaugagauc

SEQ ID NO: 1326085 - RNA, 19 nt, Homo sapiens
gcucggacgccaacccuuu

SEQ ID NO: 1326086 - RNA, 19 nt, Homo sapiens
gugcucgaauugagagaaa

SEQ ID NO: 1326087 - RNA, 19 nt, Homo sapiens
aagaagaagcuaaacaaga

SEQ ID NO: 1326088 - RNA, 19 nt, Homo sapiens
cgaugggucugugaagaaa

SEQ ID NO: 1326089 - RNA, 19 nt, Homo sapiens
gaccgcaccauacuugaaa

SEQ ID NO: 1326090 - RNA, 19 nt, Homo sapiens
gagagaagagcagugagaa

SEQ ID NO: 1326091 - RNA, 19 nt, Homo sapiens
gaacuucagaauaaacagu

SEQ ID NO: 1326092 - RNA, 19 nt, Homo sapiens
gaccauggaccgcgaguuc

SEQ ID NO: 1326093 - RNA, 19 nt, Homo sapiens
caaggacgguguggaccaa

SEQ ID NO: 1326094 - RNA, 19 nt, Homo sapiens
gaccuacaacgaccugauu

SEQ ID NO: 1326095 - RNA, 19 nt, Homo sapiens
uggaugagcugggugugaa

SEQ ID NO: 1326096 - RNA, 19 nt, Homo sapiens
gccaggagaaggagaagaa

SEQ ID NO: 1326097 - RNA, 19 nt, Homo sapiens
caagcucgcuauggagaau

SEQ ID NO: 1326098 - RNA, 19 nt, Homo sapiens
uggcccagaugauugauga

SEQ ID NO: 1326099 - RNA, 19 nt, Homo sapiens
ccaccagacugaccaacuc

SEQ ID NO: 1326100 - RNA, 19 nt, Homo sapiens
gaagccaagaggaggauug

SEQ ID NO: 1326101 - RNA, 19 nt, Homo sapiens
gccaagaggaggauugugu

SEQ ID NO: 1326102 - RNA, 19 nt, Homo sapiens
guagaaacuugagugacau

SEQ ID NO: 1326103 - RNA, 19 nt, Homo sapiens
gagguaacuaggauuucua

SEQ ID NO: 1326104 - RNA, 19 nt, Homo sapiens
cgaugcugcucaugaaauc

SEQ ID NO: 1326105 - RNA, 19 nt, Homo sapiens
uuuguacugucgauaguuu

SEQ ID NO: 1326106 - RNA, 19 nt, Homo sapiens
uugcaacaaucuccuuaga

SEQ ID NO: 1326107 - RNA, 19 nt, Homo sapiens
ggaggauuguguucaccau

SEQ ID NO: 1326108 - RNA, 19 nt, Homo sapiens
ugacaucggcaccaucaug

SEQ ID NO: 1326109 - RNA, 19 nt, Homo sapiens
ggaugaaaugguauggaaa

SEQ ID NO: 1326110 - RNA, 19 nt, Homo sapiens
ucacuauggcgucgagaaa

SEQ ID NO: 1326111 - RNA, 19 nt, Homo sapiens
gccaccaacugcaaacauc

SEQ ID NO: 1326112 - RNA, 19 nt, Homo sapiens
gauuccggcuucucagauc

SEQ ID NO: 1326113 - RNA, 19 nt, Homo sapiens
caagaagaagcuaaacaag

SEQ ID NO: 1326114 - RNA, 19 nt, Homo sapiens
ucaggaaguggaugaaaug

SEQ ID NO: 1326115 - RNA, 19 nt, Homo sapiens
ccgaaaaccuuggaaaaug

SEQ ID NO: 1326116 - RNA, 19 nt, Homo sapiens
gagaucaggaggcuguuuc

SEQ ID NO: 1326117 - RNA, 19 nt, Homo sapiens
gcacacuacuccccacuca

SEQ ID NO: 1326118 - RNA, 19 nt, Homo sapiens
ccaagaggaggauuguguu

SEQ ID NO: 1326119 - RNA, 19 nt, Homo sapiens
cuucuagaguccuucaaga

SEQ ID NO: 1326120 - RNA, 19 nt, Homo sapiens
gccacaaccucuucaucuc

SEQ ID NO: 1326121 - RNA, 19 nt, Homo sapiens
ccgcggaccugaguuuaca

SEQ ID NO: 1326122 - RNA, 19 nt, Homo sapiens
ggagaucaggaggcuguuu

SEQ ID NO: 1326123 - RNA, 19 nt, Homo sapiens
gaugaaaugguauggaaaa

SEQ ID NO: 1326124 - RNA, 19 nt, Homo sapiens
gaauggccacaaccucuuc

SEQ ID NO: 1326125 - RNA, 19 nt, Homo sapiens
gugagaagggccugagaga

SEQ ID NO: 1326126 - RNA, 19 nt, Homo sapiens
cagcagcgcgagagcaaga

SEQ ID NO: 1326127 - RNA, 19 nt, Homo sapiens
gaagccagucuccuacuac

SEQ ID NO: 1326128 - RNA, 19 nt, Homo sapiens
ccacgcagcccaugaagcu

SEQ ID NO: 1326129 - RNA, 19 nt, Homo sapiens
cgaguguuauauuugugaa

SEQ ID NO: 1326130 - RNA, 19 nt, Homo sapiens
gugcugcagucgcuguuca

SEQ ID NO: 1326131 - RNA, 19 nt, Homo sapiens
ggccacaaccucuucaucu

SEQ ID NO: 1326132 - RNA, 19 nt, Homo sapiens
caacaaucuccuuagaaag

SEQ ID NO: 1326133 - RNA, 19 nt, Homo sapiens
gcuauggagaauuacguuu

SEQ ID NO: 1326134 - RNA, 19 nt, Homo sapiens
gaagaagcuaaacaagaag

SEQ ID NO: 1326135 - RNA, 19 nt, Homo sapiens
cagaaucguguccucgaaa

SEQ ID NO: 1326136 - RNA, 19 nt, Homo sapiens
gaaguggaugaaaugguau

SEQ ID NO: 1326137 - RNA, 19 nt, Homo sapiens
aggauuguguucaccauca

SEQ ID NO: 1326138 - RNA, 19 nt, Homo sapiens
caagaggaggauuguguuc

SEQ ID NO: 1326139 - RNA, 19 nt, Homo sapiens
caccauacuugaaaacuau

SEQ ID NO: 1326140 - RNA, 19 nt, Homo sapiens
cagaauaaacaguagaaac

SEQ ID NO: 1326141 - RNA, 19 nt, Homo sapiens
ccaaguaugcggagaccau

SEQ ID NO: 1326142 - RNA, 19 nt, Homo sapiens
cgaccuguuuguggacuug

SEQ ID NO: 1326143 - RNA, 19 nt, Homo sapiens
ccucaagaauggccacaac

SEQ ID NO: 1326144 - RNA, 19 nt, Homo sapiens
ucaauagcagcaaguggaa

SEQ ID NO: 1326145 - RNA, 19 nt, Homo sapiens
cgaaaaccuuggaaaaugg

SEQ ID NO: 1326146 - RNA, 19 nt, Homo sapiens
aauugacuaugacaccaaa

SEQ ID NO: 1326147 - RNA, 19 nt, Homo sapiens
agaagcuguugaaggagaa

SEQ ID NO: 1326148 - RNA, 19 nt, Homo sapiens
cuacaacgaccugauucaa

SEQ ID NO: 1326149 - RNA, 19 nt, Homo sapiens
ggacaaagaagaacaaaua

SEQ ID NO: 1326150 - RNA, 19 nt, Homo sapiens
ggacagacagggcugguua

SEQ ID NO: 1326151 - RNA, 19 nt, Homo sapiens
gaggagauguccagcuuga

SEQ ID NO: 1326152 - RNA, 19 nt, Homo sapiens
gaaacauccuugguaccua

SEQ ID NO: 1326153 - RNA, 19 nt, Homo sapiens
agacagggcugguuaaacu

SEQ ID NO: 1326154 - RNA, 19 nt, Homo sapiens
guaaauaaggcccaaggaa

SEQ ID NO: 1326155 - RNA, 19 nt, Homo sapiens
gaaggucgccaucaagauc

SEQ ID NO: 1326156 - RNA, 19 nt, Homo sapiens
caaggaggcccgaaaguuc

SEQ ID NO: 1326157 - RNA, 19 nt, Homo sapiens
aaauauuccucgugcuaaa

SEQ ID NO: 1326158 - RNA, 19 nt, Homo sapiens
ggagaucgccauccugaag

SEQ ID NO: 1326159 - RNA, 19 nt, Homo sapiens
caacugugaaucuguaaau

SEQ ID NO: 1326160 - RNA, 19 nt, Homo sapiens
caaauauuccucgugcuaa

SEQ ID NO: 1326161 - RNA, 19 nt, Homo sapiens
ucuacgagaacaagaaaua

SEQ ID NO: 1326162 - RNA, 19 nt, Homo sapiens
acaaauauuccucgugcua

SEQ ID NO: 1326163 - RNA, 19 nt, Homo sapiens
ggaacuucaucuccuugga

SEQ ID NO: 1326164 - RNA, 19 nt, Homo sapiens
ccaaggaggcccgaaaguu

SEQ ID NO: 1326165 - RNA, 19 nt, Homo sapiens
cggagucggugcugaugaa

SEQ ID NO: 1326166 - RNA, 19 nt, Homo sapiens
gucagaaggucgccaucaa

SEQ ID NO: 1326167 - RNA, 19 nt, Homo sapiens
gagcaaauucagaaacauc

SEQ ID NO: 1326168 - RNA, 19 nt, Homo sapiens
gaaauauuuguaccugguu

SEQ ID NO: 1326169 - RNA, 19 nt, Homo sapiens
ggaaggaauucugguuucg

SEQ ID NO: 1326170 - RNA, 19 nt, Homo sapiens
cggaaggaauucugguuuc

SEQ ID NO: 1326171 - RNA, 19 nt, Homo sapiens
agacaucguccaugccuuu

SEQ ID NO: 1326172 - RNA, 19 nt, Homo sapiens
gaccagagcggaaguccau

SEQ ID NO: 1326173 - RNA, 19 nt, Homo sapiens
gauuugcucuccggaagga

SEQ ID NO: 1326174 - RNA, 19 nt, Homo sapiens
ggggagcuguuucuauuuu

SEQ ID NO: 1326175 - RNA, 19 nt, Homo sapiens
aaauaaggcccaaggaaca

SEQ ID NO: 1326176 - RNA, 19 nt, Homo sapiens
ccacuucauuccuccagau

SEQ ID NO: 1326177 - RNA, 19 nt, Homo sapiens
ggagaagacgcugggcaaa

SEQ ID NO: 1326178 - RNA, 19 nt, Homo sapiens
cugaggagauguccagcuu

SEQ ID NO: 1326179 - RNA, 19 nt, Homo sapiens
ggggugagcuauucgacua

SEQ ID NO: 1326180 - RNA, 19 nt, Homo sapiens
cagaaggucgccaucaaga

SEQ ID NO: 1326181 - RNA, 19 nt, Homo sapiens
ccucuaagcagcccaagga

SEQ ID NO: 1326182 - RNA, 19 nt, Homo sapiens
ggagcaaauucagaaacau

SEQ ID NO: 1326183 - RNA, 19 nt, Homo sapiens
uggagcaaauucagaaaca

SEQ ID NO: 1326184 - RNA, 19 nt, Homo sapiens
gaaaguucuuccgccagau

SEQ ID NO: 1326185 - RNA, 19 nt, Homo sapiens
cgagaacaagaaauauuug

SEQ ID NO: 1326186 - RNA, 19 nt, Homo sapiens
gaccuucuguacggauuug

SEQ ID NO: 1326187 - RNA, 19 nt, Homo sapiens
agaagacgcugggcaaagg

SEQ ID NO: 1326188 - RNA, 19 nt, Homo sapiens
gcagugaggaggagaacca

SEQ ID NO: 1326189 - RNA, 19 nt, Homo sapiens
gaaccaagaaaagaugaua

SEQ ID NO: 1326190 - RNA, 19 nt, Homo sapiens
gugaggaggagaaccaaga

SEQ ID NO: 1326191 - RNA, 19 nt, Homo sapiens
ugucugcgcuggacuucug

SEQ ID NO: 1326192 - RNA, 19 nt, Homo sapiens
ggagacugacgcccaagga

SEQ ID NO: 1326193 - RNA, 19 nt, Homo sapiens
gggagcuguuucuauuuua

SEQ ID NO: 1326194 - RNA, 19 nt, Homo sapiens
gaggaggagaaccaagaaa

SEQ ID NO: 1326195 - RNA, 19 nt, Homo sapiens
ggaccaagggcaccauguc

SEQ ID NO: 1326196 - RNA, 19 nt, Homo sapiens
gagaagacgcugggcaaag

SEQ ID NO: 1326197 - RNA, 19 nt, Homo sapiens
caucguccaugccuuucug

SEQ ID NO: 1326198 - RNA, 19 nt, Homo sapiens
cccaaggaguccggucuuu

SEQ ID NO: 1326199 - RNA, 19 nt, Homo sapiens
ccacaugccccacuucauu

SEQ ID NO: 1326200 - RNA, 19 nt, Homo sapiens
guggagcuguggagucauc

SEQ ID NO: 1326201 - RNA, 19 nt, Homo sapiens
guaaagaaggggagacuga

SEQ ID NO: 1326202 - RNA, 19 nt, Homo sapiens
cugugaaucuguaaauaag

SEQ ID NO: 1326203 - RNA, 19 nt, Homo sapiens
cuaaaggacaaaccucuca

SEQ ID NO: 1326204 - RNA, 19 nt, Homo sapiens
gaagacgcugggcaaagga

SEQ ID NO: 1326205 - RNA, 19 nt, Homo sapiens
ccauggaaguccugagcau

SEQ ID NO: 1326206 - RNA, 19 nt, Homo sapiens
caaauucagaaacauccuu

SEQ ID NO: 1326207 - RNA, 19 nt, Homo sapiens
gcuguggagucauccucuu

SEQ ID NO: 1326208 - RNA, 19 nt, Homo sapiens
gacagacagggcugguuaa

SEQ ID NO: 1326209 - RNA, 19 nt, Homo sapiens
caaagcagacaucguccau

SEQ ID NO: 1326210 - RNA, 19 nt, Homo sapiens
ccggaaggaauucugguuu

SEQ ID NO: 1326211 - RNA, 19 nt, Homo sapiens
ccagcacgcccaauaugug

SEQ ID NO: 1326212 - RNA, 19 nt, Homo sapiens
ggagcuguuucuauuuuau

SEQ ID NO: 1326213 - RNA, 19 nt, Homo sapiens
ccuaucggcuggagaagac

SEQ ID NO: 1326214 - RNA, 19 nt, Homo sapiens
gagaucccguagcgucagu

SEQ ID NO: 1326215 - RNA, 19 nt, Homo sapiens
uccugaagcucaucgaaca

SEQ ID NO: 1326216 - RNA, 19 nt, Homo sapiens
cauccgcauugcagacuuc

SEQ ID NO: 1326217 - RNA, 19 nt, Homo sapiens
ugccacagcuacuccaucu

SEQ ID NO: 1326218 - RNA, 19 nt, Homo sapiens
aaaguucuuccgccagauu

SEQ ID NO: 1326219 - RNA, 19 nt, Homo sapiens
aaaccucucagcagcauca

SEQ ID NO: 1326220 - RNA, 19 nt, Homo sapiens
cuucaucuccuuggacaaa

SEQ ID NO: 1326221 - RNA, 19 nt, Homo sapiens
uggcaucacugggcugcuu

SEQ ID NO: 1326222 - RNA, 19 nt, Homo sapiens
ggucagaaggucgccauca

SEQ ID NO: 1326223 - RNA, 19 nt, Homo sapiens
gaagguggagcgggagauc

SEQ ID NO: 1326224 - RNA, 19 nt, Homo sapiens
gcucaucgaacacccacau

SEQ ID NO: 1326225 - RNA, 19 nt, Homo sapiens
ucaucuccuuggacaaaga

SEQ ID NO: 1326226 - RNA, 19 nt, Homo sapiens
ggaguccggucuuuuccuu

SEQ ID NO: 1326227 - RNA, 19 nt, Homo sapiens
acaaaccucucagcagcau

SEQ ID NO: 1326228 - RNA, 19 nt, Homo sapiens
caucgaacacccacauguc

SEQ ID NO: 1326229 - RNA, 19 nt, Homo sapiens
agaagcuccuggccaccaa

SEQ ID NO: 1326230 - RNA, 19 nt, Homo sapiens
uccgucaccuucacucuca

SEQ ID NO: 1326231 - RNA, 19 nt, Homo sapiens
cuacgagaacaagaaauau

SEQ ID NO: 1326232 - RNA, 19 nt, Homo sapiens
agucggugcugaugaaggu

SEQ ID NO: 1326233 - RNA, 19 nt, Homo sapiens
acacccacauguccucaag

SEQ ID NO: 1326234 - RNA, 19 nt, Homo sapiens
cgucuacgagaacaagaaa

SEQ ID NO: 1326235 - RNA, 19 nt, Homo sapiens
ugaggaggagaaccaagaa

SEQ ID NO: 1326236 - RNA, 19 nt, Homo sapiens
uagagagcauggcaucacu

SEQ ID NO: 1326237 - RNA, 19 nt, Homo sapiens
uucagaaacauccuuggua

SEQ ID NO: 1326238 - RNA, 19 nt, Homo sapiens
gcccuuugaugacgacaac

SEQ ID NO: 1326239 - RNA, 19 nt, Homo sapiens
ccgagaaccugcuuuugga

SEQ ID NO: 1326240 - RNA, 19 nt, Homo sapiens
caacaaggcuguguacaug

SEQ ID NO: 1326241 - RNA, 19 nt, Homo sapiens
gaacauguccugccaccaa

SEQ ID NO: 1326242 - RNA, 19 nt, Homo sapiens
ggagacaguuucagaugau

SEQ ID NO: 1326243 - RNA, 19 nt, Homo sapiens
caacaucuccuggcucuuu

SEQ ID NO: 1326244 - RNA, 19 nt, Homo sapiens
cagaggagcuccaggcaau

SEQ ID NO: 1326245 - RNA, 19 nt, Homo sapiens
gaaguugaaugcuuaaucc

SEQ ID NO: 1326246 - RNA, 19 nt, Homo sapiens
caugaaggcagaagguuua

SEQ ID NO: 1326247 - RNA, 19 nt, Homo sapiens
ggagaugccugaggaugga

SEQ ID NO: 1326248 - RNA, 19 nt, Homo sapiens
gcagugccgaacaguauua

SEQ ID NO: 1326249 - RNA, 19 nt, Homo sapiens
ccaagagacugcccugcaa

SEQ ID NO: 1326250 - RNA, 19 nt, Homo sapiens
gcacaccuucccacucuuu

SEQ ID NO: 1326251 - RNA, 19 nt, Homo sapiens
caacaugaacacccuguau

SEQ ID NO: 1326252 - RNA, 19 nt, Homo sapiens
ccacacaacucagggaaag

SEQ ID NO: 1326253 - RNA, 19 nt, Homo sapiens
ucaucaagguucugcugua

SEQ ID NO: 1326254 - RNA, 19 nt, Homo sapiens
ugucuggccuucaccguuu

SEQ ID NO: 1326255 - RNA, 19 nt, Homo sapiens
cauugucucucuuauguuc

SEQ ID NO: 1326256 - RNA, 19 nt, Homo sapiens
cgcauugucucucuuaugu

SEQ ID NO: 1326257 - RNA, 19 nt, Homo sapiens
ggaggcaagcuaugaacuu

SEQ ID NO: 1326258 - RNA, 19 nt, Homo sapiens
gugcacaccuucccacucu

SEQ ID NO: 1326259 - RNA, 19 nt, Homo sapiens
uggagacaguuucagauga

SEQ ID NO: 1326260 - RNA, 19 nt, Homo sapiens
caugagacaguucaagaaa

SEQ ID NO: 1326261 - RNA, 19 nt, Homo sapiens
ucaccaucuucaucaagua

SEQ ID NO: 1326262 - RNA, 19 nt, Homo sapiens
gagacaguuucagaugauu

SEQ ID NO: 1326263 - RNA, 19 nt, Homo sapiens
ucaagguucugcuguacau

SEQ ID NO: 1326264 - RNA, 19 nt, Homo sapiens
cuucuucucuuccucaaau

SEQ ID NO: 1326265 - RNA, 19 nt, Homo sapiens
ccaggcauguucccacugu

SEQ ID NO: 1326266 - RNA, 19 nt, Homo sapiens
ggacaacaaggcuguguac

SEQ ID NO: 1326267 - RNA, 19 nt, Homo sapiens
gcauggcaguccuguacau

SEQ ID NO: 1326268 - RNA, 19 nt, Homo sapiens
gcaaggugaugggcaaggu

SEQ ID NO: 1326269 - RNA, 19 nt, Homo sapiens
ugaggaccguguggacuuu

SEQ ID NO: 1326270 - RNA, 19 nt, Homo sapiens
caacugagggcagcagaga

SEQ ID NO: 1326271 - RNA, 19 nt, Homo sapiens
caacucagggaaaggaaug

SEQ ID NO: 1326272 - RNA, 19 nt, Homo sapiens
uaagacugguacccauuuc

SEQ ID NO: 1326273 - RNA, 19 nt, Homo sapiens
ccaugaaggcagaagguuu

SEQ ID NO: 1326274 - RNA, 19 nt, Homo sapiens
ggugacuggugccaagaga

SEQ ID NO: 1326275 - RNA, 19 nt, Homo sapiens
ugagacaguucaagaaagc

SEQ ID NO: 1326276 - RNA, 19 nt, Homo sapiens
guugcacucuucacucuuc

SEQ ID NO: 1326277 - RNA, 19 nt, Homo sapiens
agacaguuucagaugauua

SEQ ID NO: 1326278 - RNA, 19 nt, Homo sapiens
cuaagacugguacccauuu

SEQ ID NO: 1326279 - RNA, 19 nt, Homo sapiens
ugaggagacugccacuaca

SEQ ID NO: 1326280 - RNA, 19 nt, Homo sapiens
gcaacaugaacacccugua

SEQ ID NO: 1326281 - RNA, 19 nt, Homo sapiens
gccaugagacaguucaaga

SEQ ID NO: 1326282 - RNA, 19 nt, Homo sapiens
gacaguuucagaugauuau

SEQ ID NO: 1326283 - RNA, 19 nt, Homo sapiens
gaagguuuagccucugaga

SEQ ID NO: 1326284 - RNA, 19 nt, Homo sapiens
cgagccauccgcaacauga

SEQ ID NO: 1326285 - RNA, 19 nt, Homo sapiens
gaacgcagccccaacaucu

SEQ ID NO: 1326286 - RNA, 19 nt, Homo sapiens
gcacucuucacucuucuuc

SEQ ID NO: 1326287 - RNA, 19 nt, Homo sapiens
gauggagcaccuucuggaa

SEQ ID NO: 1326288 - RNA, 19 nt, Homo sapiens
ucaccgugcuggccuccuu

SEQ ID NO: 1326289 - RNA, 19 nt, Homo sapiens
gaacacccuguauccagau

SEQ ID NO: 1326290 - RNA, 19 nt, Homo sapiens
ccaugagacaguucaagaa

SEQ ID NO: 1326291 - RNA, 19 nt, Homo sapiens
acuagugucuuuuggcuua

SEQ ID NO: 1326292 - RNA, 19 nt, Homo sapiens
cagcauggcaguccuguac

SEQ ID NO: 1326293 - RNA, 19 nt, Homo sapiens
caucaagguucugcuguac

SEQ ID NO: 1326294 - RNA, 19 nt, Homo sapiens
uuacaggcuucaucaaggu

SEQ ID NO: 1326295 - RNA, 19 nt, Homo sapiens
gcagcugguguuuggcuuu

SEQ ID NO: 1326296 - RNA, 19 nt, Homo sapiens
gguguuuggcuuugaguau

SEQ ID NO: 1326297 - RNA, 19 nt, Homo sapiens
cagcugguguuuggcuuug

SEQ ID NO: 1326298 - RNA, 19 nt, Homo sapiens
gcauuucugcgucuuacug

SEQ ID NO: 1326299 - RNA, 19 nt, Homo sapiens
cauccaggccuuuguccuu

SEQ ID NO: 1326300 - RNA, 19 nt, Homo sapiens
ucacgccuacuaccucaaa

SEQ ID NO: 1326301 - RNA, 19 nt, Homo sapiens
ugaaguugaaugcuuaauc

SEQ ID NO: 1326302 - RNA, 19 nt, Homo sapiens
gggacaacaaggcugugua

SEQ ID NO: 1326303 - RNA, 19 nt, Homo sapiens
guguuuggcuuugaguaug

SEQ ID NO: 1326304 - RNA, 19 nt, Homo sapiens
cuuccuuacuagugucuuu

SEQ ID NO: 1326305 - RNA, 19 nt, Homo sapiens
gaauuacuuccuuacuagu

SEQ ID NO: 1326306 - RNA, 19 nt, Homo sapiens
gccuccagcuccugaguca

SEQ ID NO: 1326307 - RNA, 19 nt, Homo sapiens
gaugggcaagguguucuuu

SEQ ID NO: 1326308 - RNA, 19 nt, Homo sapiens
acaacaaggcuguguacau

SEQ ID NO: 1326309 - RNA, 19 nt, Homo sapiens
ccaucuucaucaaguaugu

SEQ ID NO: 1326310 - RNA, 19 nt, Homo sapiens
guacauccaggccuuuguc

SEQ ID NO: 1326311 - RNA, 19 nt, Homo sapiens
gcuggaggcaagcuaugaa

SEQ ID NO: 1326312 - RNA, 19 nt, Homo sapiens
cugcagugccgaacaguau

SEQ ID NO: 1326313 - RNA, 19 nt, Homo sapiens
gcaaccacauuuuccauac

SEQ ID NO: 1326314 - RNA, 19 nt, Homo sapiens
gugcucaccaucuucauca

SEQ ID NO: 1326315 - RNA, 19 nt, Homo sapiens
gaggaccguguggacuuua

SEQ ID NO: 1326316 - RNA, 19 nt, Homo sapiens
uagcucccguucccaagug

SEQ ID NO: 1326317 - RNA, 19 nt, Homo sapiens
ccgcuuuguugcacucuuc

SEQ ID NO: 1326318 - RNA, 19 nt, Homo sapiens
ugcugcagaucaaccagua

SEQ ID NO: 1326319 - RNA, 19 nt, Homo sapiens
ccgccaugcugcagaucaa

SEQ ID NO: 1326320 - RNA, 19 nt, Homo sapiens
cauccuggacuuccucuuc

SEQ ID NO: 1326321 - RNA, 19 nt, Homo sapiens
caucaucugccgagaagag

SEQ ID NO: 1326322 - RNA, 19 nt, Homo sapiens
acacaacucagggaaagga

SEQ ID NO: 1326323 - RNA, 19 nt, Homo sapiens
ggauggagagcccgaugca

SEQ ID NO: 1326324 - RNA, 19 nt, Homo sapiens
ccaccugccguauggaugu

SEQ ID NO: 1326325 - RNA, 19 nt, Homo sapiens
ccuaagacugguacccauu

SEQ ID NO: 1326326 - RNA, 19 nt, Homo sapiens
gagccauccgcaacaugaa

SEQ ID NO: 1326327 - RNA, 19 nt, Homo sapiens
ugaccaucaugaucaaggu

SEQ ID NO: 1326328 - RNA, 19 nt, Homo sapiens
caacaaggcuguguacaug

SEQ ID NO: 1326329 - RNA, 19 nt, Homo sapiens
gaacauguccugccaccaa

SEQ ID NO: 1326330 - RNA, 19 nt, Homo sapiens
ggagacaguuucagaugau

SEQ ID NO: 1326331 - RNA, 19 nt, Homo sapiens
caacaucuccuggcucuuu

SEQ ID NO: 1326332 - RNA, 19 nt, Homo sapiens
cagaggagcuccaggcaau

SEQ ID NO: 1326333 - RNA, 19 nt, Homo sapiens
gaaguugaaugcuuaaucc

SEQ ID NO: 1326334 - RNA, 19 nt, Homo sapiens
caugaaggcagaagguuua

SEQ ID NO: 1326335 - RNA, 19 nt, Homo sapiens
ggagaugccugaggaugga

SEQ ID NO: 1326336 - RNA, 19 nt, Homo sapiens
gcagugccgaacaguauua

SEQ ID NO: 1326337 - RNA, 19 nt, Homo sapiens
ccaagagacugcccugcaa

SEQ ID NO: 1326338 - RNA, 19 nt, Homo sapiens
gcacaccuucccacucuuu

SEQ ID NO: 1326339 - RNA, 19 nt, Homo sapiens
caacaugaacacccuguau

SEQ ID NO: 1326340 - RNA, 19 nt, Homo sapiens
ccacacaacucagggaaag

SEQ ID NO: 1326341 - RNA, 19 nt, Homo sapiens
ucaucaagguucugcugua

SEQ ID NO: 1326342 - RNA, 19 nt, Homo sapiens
ugucuggccuucaccguuu

SEQ ID NO: 1326343 - RNA, 19 nt, Homo sapiens
cauugucucucuuauguuc

SEQ ID NO: 1326344 - RNA, 19 nt, Homo sapiens
cgcauugucucucuuaugu

SEQ ID NO: 1326345 - RNA, 19 nt, Homo sapiens
ggaggcaagcuaugaacuu

SEQ ID NO: 1326346 - RNA, 19 nt, Homo sapiens
gugcacaccuucccacucu

SEQ ID NO: 1326347 - RNA, 19 nt, Homo sapiens
uggagacaguuucagauga

SEQ ID NO: 1326348 - RNA, 19 nt, Homo sapiens
caugagacaguucaagaaa

SEQ ID NO: 1326349 - RNA, 19 nt, Homo sapiens
ucaccaucuucaucaagua

SEQ ID NO: 1326350 - RNA, 19 nt, Homo sapiens
gagacaguuucagaugauu

SEQ ID NO: 1326351 - RNA, 19 nt, Homo sapiens
ucaagguucugcuguacau

SEQ ID NO: 1326352 - RNA, 19 nt, Homo sapiens
cuucuucucuuccucaaau

SEQ ID NO: 1326353 - RNA, 19 nt, Homo sapiens
ccaggcauguucccacugu

SEQ ID NO: 1326354 - RNA, 19 nt, Homo sapiens
ggacaacaaggcuguguac

SEQ ID NO: 1326355 - RNA, 19 nt, Homo sapiens
gcauggcaguccuguacau

SEQ ID NO: 1326356 - RNA, 19 nt, Homo sapiens
gcaaggugaugggcaaggu

SEQ ID NO: 1326357 - RNA, 19 nt, Homo sapiens
ugaggaccguguggacuuu

SEQ ID NO: 1326358 - RNA, 19 nt, Homo sapiens
caacugagggcagcagaga

SEQ ID NO: 1326359 - RNA, 19 nt, Homo sapiens
caacucagggaaaggaaug

SEQ ID NO: 1326360 - RNA, 19 nt, Homo sapiens
uaagacugguacccauuuc

SEQ ID NO: 1326361 - RNA, 19 nt, Homo sapiens
ccaugaaggcagaagguuu

SEQ ID NO: 1326362 - RNA, 19 nt, Homo sapiens
ggugacuggugccaagaga

SEQ ID NO: 1326363 - RNA, 19 nt, Homo sapiens
ugagacaguucaagaaagc

SEQ ID NO: 1326364 - RNA, 19 nt, Homo sapiens
guugcacucuucacucuuc

SEQ ID NO: 1326365 - RNA, 19 nt, Homo sapiens
agacaguuucagaugauua

SEQ ID NO: 1326366 - RNA, 19 nt, Homo sapiens
cuaagacugguacccauuu

SEQ ID NO: 1326367 - RNA, 19 nt, Homo sapiens
ugaggagacugccacuaca

SEQ ID NO: 1326368 - RNA, 19 nt, Homo sapiens
gcaacaugaacacccugua

SEQ ID NO: 1326369 - RNA, 19 nt, Homo sapiens
gccaugagacaguucaaga

SEQ ID NO: 1326370 - RNA, 19 nt, Homo sapiens
gacaguuucagaugauuau

SEQ ID NO: 1326371 - RNA, 19 nt, Homo sapiens
gaagguuuagccucugaga

SEQ ID NO: 1326372 - RNA, 19 nt, Homo sapiens
cgagccauccgcaacauga

SEQ ID NO: 1326373 - RNA, 19 nt, Homo sapiens
gaacgcagccccaacaucu

SEQ ID NO: 1326374 - RNA, 19 nt, Homo sapiens
gcacucuucacucuucuuc

SEQ ID NO: 1326375 - RNA, 19 nt, Homo sapiens
gauggagcaccuucuggaa

SEQ ID NO: 1326376 - RNA, 19 nt, Homo sapiens
ucaccgugcuggccuccuu

SEQ ID NO: 1326377 - RNA, 19 nt, Homo sapiens
gaacacccuguauccagau

SEQ ID NO: 1326378 - RNA, 19 nt, Homo sapiens
ccaugagacaguucaagaa

SEQ ID NO: 1326379 - RNA, 19 nt, Homo sapiens
acuagugucuuuuggcuua

SEQ ID NO: 1326380 - RNA, 19 nt, Homo sapiens
cagcauggcaguccuguac

SEQ ID NO: 1326381 - RNA, 19 nt, Homo sapiens
caucaagguucugcuguac

SEQ ID NO: 1326382 - RNA, 19 nt, Homo sapiens
uuacaggcuucaucaaggu

SEQ ID NO: 1326383 - RNA, 19 nt, Homo sapiens
gcagcugguguuuggcuuu

SEQ ID NO: 1326384 - RNA, 19 nt, Homo sapiens
gguguuuggcuuugaguau

SEQ ID NO: 1326385 - RNA, 19 nt, Homo sapiens
cagcugguguuuggcuuug

SEQ ID NO: 1326386 - RNA, 19 nt, Homo sapiens
gcauuucugcgucuuacug

SEQ ID NO: 1326387 - RNA, 19 nt, Homo sapiens
cauccaggccuuuguccuu

SEQ ID NO: 1326388 - RNA, 19 nt, Homo sapiens
ucacgccuacuaccucaaa

SEQ ID NO: 1326389 - RNA, 19 nt, Homo sapiens
ugaaguugaaugcuuaauc

SEQ ID NO: 1326390 - RNA, 19 nt, Homo sapiens
gggacaacaaggcugugua

SEQ ID NO: 1326391 - RNA, 19 nt, Homo sapiens
guguuuggcuuugaguaug

SEQ ID NO: 1326392 - RNA, 19 nt, Homo sapiens
cuuccuuacuagugucuuu

SEQ ID NO: 1326393 - RNA, 19 nt, Homo sapiens
gaauuacuuccuuacuagu

SEQ ID NO: 1326394 - RNA, 19 nt, Homo sapiens
gccuccagcuccugaguca

SEQ ID NO: 1326395 - RNA, 19 nt, Homo sapiens
gaugggcaagguguucuuu

SEQ ID NO: 1326396 - RNA, 19 nt, Homo sapiens
acaacaaggcuguguacau

SEQ ID NO: 1326397 - RNA, 19 nt, Homo sapiens
ccaucuucaucaaguaugu

SEQ ID NO: 1326398 - RNA, 19 nt, Homo sapiens
guacauccaggccuuuguc

SEQ ID NO: 1326399 - RNA, 19 nt, Homo sapiens
gcuggaggcaagcuaugaa

SEQ ID NO: 1326400 - RNA, 19 nt, Homo sapiens
cugcagugccgaacaguau

SEQ ID NO: 1326401 - RNA, 19 nt, Homo sapiens
gcaaccacauuuuccauac

SEQ ID NO: 1326402 - RNA, 19 nt, Homo sapiens
gugcucaccaucuucauca

SEQ ID NO: 1326403 - RNA, 19 nt, Homo sapiens
gaggaccguguggacuuua

SEQ ID NO: 1326404 - RNA, 19 nt, Homo sapiens
uagcucccguucccaagug

SEQ ID NO: 1326405 - RNA, 19 nt, Homo sapiens
ccgcuuuguugcacucuuc

SEQ ID NO: 1326406 - RNA, 19 nt, Homo sapiens
ugcugcagaucaaccagua

SEQ ID NO: 1326407 - RNA, 19 nt, Homo sapiens
ccgccaugcugcagaucaa

SEQ ID NO: 1326408 - RNA, 19 nt, Homo sapiens
cauccuggacuuccucuuc

SEQ ID NO: 1326409 - RNA, 19 nt, Homo sapiens
caucaucugccgagaagag

SEQ ID NO: 1326410 - RNA, 19 nt, Homo sapiens
acacaacucagggaaagga

SEQ ID NO: 1326411 - RNA, 19 nt, Homo sapiens
ggauggagagcccgaugca

SEQ ID NO: 1326412 - RNA, 19 nt, Homo sapiens
ccaccugccguauggaugu

SEQ ID NO: 1326413 - RNA, 19 nt, Homo sapiens
ccuaagacugguacccauu

SEQ ID NO: 1326414 - RNA, 19 nt, Homo sapiens
gagccauccgcaacaugaa

SEQ ID NO: 1326415 - RNA, 19 nt, Homo sapiens
ugaccaucaugaucaaggu

SEQ ID NO: 1326416 - RNA, 19 nt, Homo sapiens
ggaaugaccuuaagaagaa

SEQ ID NO: 1326417 - RNA, 19 nt, Homo sapiens
gcacagaaaucaagaaugg

SEQ ID NO: 1326418 - RNA, 19 nt, Homo sapiens
ccacguacccugccuaaua

SEQ ID NO: 1326419 - RNA, 19 nt, Homo sapiens
gaagaggaaugaccuuaag

SEQ ID NO: 1326420 - RNA, 19 nt, Homo sapiens
cgacguagcucuugaugca

SEQ ID NO: 1326421 - RNA, 19 nt, Homo sapiens
ggacgagacuggagagaca

SEQ ID NO: 1326422 - RNA, 19 nt, Homo sapiens
gacgaugcauuauaacuug

SEQ ID NO: 1326423 - RNA, 19 nt, Homo sapiens
aaucaaggguuuccacgua

SEQ ID NO: 1326424 - RNA, 19 nt, Homo sapiens
gcucggaucugugugguuu

SEQ ID NO: 1326425 - RNA, 19 nt, Homo sapiens
ggacagcuuucacucacaa

SEQ ID NO: 1326426 - RNA, 19 nt, Homo sapiens
gagauaggauggagaugug

SEQ ID NO: 1326427 - RNA, 19 nt, Homo sapiens
aaaguaaggccaucuauga

SEQ ID NO: 1326428 - RNA, 19 nt, Homo sapiens
ccaaagcccuggaaucaag

SEQ ID NO: 1326429 - RNA, 19 nt, Homo sapiens
ggaagaggaaugaccuuaa

SEQ ID NO: 1326430 - RNA, 19 nt, Homo sapiens
cuagaugccuacacaauau

SEQ ID NO: 1326431 - RNA, 19 nt, Homo sapiens
gagaugacauauauagagu

SEQ ID NO: 1326432 - RNA, 19 nt, Homo sapiens
gcgugaaacugcccaaaga

SEQ ID NO: 1326433 - RNA, 19 nt, Homo sapiens
gacaaguacuuccacauca

SEQ ID NO: 1326434 - RNA, 19 nt, Homo sapiens
gaagacagaaacaaggaaa

SEQ ID NO: 1326435 - RNA, 19 nt, Homo sapiens
ucaagugcuucgucuguaa

SEQ ID NO: 1326436 - RNA, 19 nt, Homo sapiens
guggugagauccuggacua

SEQ ID NO: 1326437 - RNA, 19 nt, Homo sapiens
gaacugaagacagaaacaa

SEQ ID NO: 1326438 - RNA, 19 nt, Homo sapiens
ggacaaguacuuccacauc

SEQ ID NO: 1326439 - RNA, 19 nt, Homo sapiens
gcugagagguggaugaaac

SEQ ID NO: 1326440 - RNA, 19 nt, Homo sapiens
aaaccgaauucgcgugaaa

SEQ ID NO: 1326441 - RNA, 19 nt, Homo sapiens
gaaugcaugugccagaagu

SEQ ID NO: 1326442 - RNA, 19 nt, Homo sapiens
gguauagccaccacuguuu

SEQ ID NO: 1326443 - RNA, 19 nt, Homo sapiens
agagcucccugucuaguuu

SEQ ID NO: 1326444 - RNA, 19 nt, Homo sapiens
gcagacacaaggaccaauu

SEQ ID NO: 1326445 - RNA, 19 nt, Homo sapiens
gugggaagcuccugaaugc

SEQ ID NO: 1326446 - RNA, 19 nt, Homo sapiens
cgaaggcguuggugucugu

SEQ ID NO: 1326447 - RNA, 19 nt, Homo sapiens
ggagagaaggauggagaua

SEQ ID NO: 1326448 - RNA, 19 nt, Homo sapiens
ggccaaagcccuggaauca

SEQ ID NO: 1326449 - RNA, 19 nt, Homo sapiens
ccuagaugccuacacaaua

SEQ ID NO: 1326450 - RNA, 19 nt, Homo sapiens
uacaagaucuauccguaug

SEQ ID NO: 1326451 - RNA, 19 nt, Homo sapiens
guaaggccaucuaugacau

SEQ ID NO: 1326452 - RNA, 19 nt, Homo sapiens
gcguuggugucugucauua

SEQ ID NO: 1326453 - RNA, 19 nt, Homo sapiens
ggagauaggauggagaugu

SEQ ID NO: 1326454 - RNA, 19 nt, Homo sapiens
agccagaacugaagacaga

SEQ ID NO: 1326455 - RNA, 19 nt, Homo sapiens
uaauaugcuuccugccauu

SEQ ID NO: 1326456 - RNA, 19 nt, Homo sapiens
gaaugaccuuaagaagaaa

SEQ ID NO: 1326457 - RNA, 19 nt, Homo sapiens
gaagcuuggaccaggauaa

SEQ ID NO: 1326458 - RNA, 19 nt, Homo sapiens
caggauaacaggaagaaga

SEQ ID NO: 1326459 - RNA, 19 nt, Homo sapiens
acaaguacuuccacaucaa

SEQ ID NO: 1326460 - RNA, 19 nt, Homo sapiens
ugacagcugugagaaauac

SEQ ID NO: 1326461 - RNA, 19 nt, Homo sapiens
ggauggagauguggcucuu

SEQ ID NO: 1326462 - RNA, 19 nt, Homo sapiens
caggaaguguuugggauga

SEQ ID NO: 1326463 - RNA, 19 nt, Homo sapiens
aacgcgagaugacauauau

SEQ ID NO: 1326464 - RNA, 19 nt, Homo sapiens
caguggguguugccucuuu

SEQ ID NO: 1326465 - RNA, 19 nt, Homo sapiens
caacacgugugggaaugug

SEQ ID NO: 1326466 - RNA, 19 nt, Homo sapiens
gcgaugugcucccugaaac

SEQ ID NO: 1326467 - RNA, 19 nt, Homo sapiens
ggaugaaacaccaaagucu

SEQ ID NO: 1326468 - RNA, 19 nt, Homo sapiens
cugugaggcuuguugauga

SEQ ID NO: 1326469 - RNA, 19 nt, Homo sapiens
ccucagagagcaucauuuc

SEQ ID NO: 1326470 - RNA, 19 nt, Homo sapiens
gaaacaaggaaaccagaac

SEQ ID NO: 1326471 - RNA, 19 nt, Homo sapiens
ugugacagcugugagaaau

SEQ ID NO: 1326472 - RNA, 19 nt, Homo sapiens
gccuuacuccguuuccuua

SEQ ID NO: 1326473 - RNA, 19 nt, Homo sapiens
agagaaggauggagauagg

SEQ ID NO: 1326474 - RNA, 19 nt, Homo sapiens
gagagaaggauggagauag

SEQ ID NO: 1326475 - RNA, 19 nt, Homo sapiens
gaaaacauccuccucugau

SEQ ID NO: 1326476 - RNA, 19 nt, Homo sapiens
cgagaugacauauauagag

SEQ ID NO: 1326477 - RNA, 19 nt, Homo sapiens
aaacgcgagaugacauaua

SEQ ID NO: 1326478 - RNA, 19 nt, Homo sapiens
ggacaagacagggcaccuu

SEQ ID NO: 1326479 - RNA, 19 nt, Homo sapiens
cgacaugaucuccuacuca

SEQ ID NO: 1326480 - RNA, 19 nt, Homo sapiens
gcagaaggcgaagagaugu

SEQ ID NO: 1326481 - RNA, 19 nt, Homo sapiens
ggccagauguuugcagaag

SEQ ID NO: 1326482 - RNA, 19 nt, Homo sapiens
gaaaauaaaagacgaugca

SEQ ID NO: 1326483 - RNA, 19 nt, Homo sapiens
uuagugcaaugucauaucu

SEQ ID NO: 1326484 - RNA, 19 nt, Homo sapiens
ggaucugugugguuucagu

SEQ ID NO: 1326485 - RNA, 19 nt, Homo sapiens
cuacuuaaacgcgagauga

SEQ ID NO: 1326486 - RNA, 19 nt, Homo sapiens
caagcuugguggugagauc

SEQ ID NO: 1326487 - RNA, 19 nt, Homo sapiens
gcaugugccagaaguguuc

SEQ ID NO: 1326488 - RNA, 19 nt, Homo sapiens
gcugcgaccaguucauuga

SEQ ID NO: 1326489 - RNA, 19 nt, Homo sapiens
cacguacccugccuaauac

SEQ ID NO: 1326490 - RNA, 19 nt, Homo sapiens
aggaaugaccuuaagaaga

SEQ ID NO: 1326491 - RNA, 19 nt, Homo sapiens
gaggaaugaccuuaagaag

SEQ ID NO: 1326492 - RNA, 19 nt, Homo sapiens
caucaagugcuucgucugu

SEQ ID NO: 1326493 - RNA, 19 nt, Homo sapiens
ccgaguacaucagcaagga

SEQ ID NO: 1326494 - RNA, 19 nt, Homo sapiens
agacgaugcauuauaacuu

SEQ ID NO: 1326495 - RNA, 19 nt, Homo sapiens
agugcaaugucauaucuga

SEQ ID NO: 1326496 - RNA, 19 nt, Homo sapiens
caagugcuucgucuguaaa

SEQ ID NO: 1326497 - RNA, 19 nt, Homo sapiens
uuaaacgcgagaugacaua

SEQ ID NO: 1326498 - RNA, 19 nt, Homo sapiens
gacaagcagccagaacuga

SEQ ID NO: 1326499 - RNA, 19 nt, Homo sapiens
gucauuagguguguguuag

SEQ ID NO: 1326500 - RNA, 19 nt, Homo sapiens
ugucauuagguguguguua

SEQ ID NO: 1326501 - RNA, 19 nt, Homo sapiens
uggcucuucucaucuuuga

SEQ ID NO: 1326502 - RNA, 19 nt, Homo sapiens
agacagaccccucuaaaga

SEQ ID NO: 1326503 - RNA, 19 nt, Homo sapiens
agaggaaugaccuuaagaa

SEQ ID NO: 1326504 - RNA, 19 nt, Homo sapiens
gagcugugaggcuuguuga

SEQ ID NO: 1326505 - RNA, 19 nt, Homo sapiens
caagaucuauccguaugac

SEQ ID NO: 1326506 - RNA, 19 nt, Homo sapiens
cuacugcgaagcugacuau

SEQ ID NO: 1326507 - RNA, 19 nt, Homo sapiens
guuggugucugucauuagg

SEQ ID NO: 1326508 - RNA, 19 nt, Homo sapiens
gcugugaggcuuguugaug

SEQ ID NO: 1326509 - RNA, 19 nt, Homo sapiens
caucgucacaaaccgaauu

SEQ ID NO: 1326510 - RNA, 19 nt, Homo sapiens
ucuccgagccgugugauuu

SEQ ID NO: 1326511 - RNA, 19 nt, Homo sapiens
ccagaacugaagacagaaa

SEQ ID NO: 1326512 - RNA, 19 nt, Homo sapiens
acaagcagccagaacugaa

SEQ ID NO: 1326513 - RNA, 19 nt, Homo sapiens
aagaacgcuuuguaaauac

SEQ ID NO: 1326514 - RNA, 19 nt, Homo sapiens
gcuccugaaugccgaguac

SEQ ID NO: 1326515 - RNA, 19 nt, Homo sapiens
ucccagggccuccgaaguu

SEQ ID NO: 1326516 - RNA, 19 nt, Homo sapiens
gaauaaagcugcugugaau

SEQ ID NO: 1326517 - RNA, 19 nt, Homo sapiens
caucaaggcugaauaguau

SEQ ID NO: 1326518 - RNA, 19 nt, Homo sapiens
gaagagagaccauuaggaa

SEQ ID NO: 1326519 - RNA, 19 nt, Homo sapiens
cagcagcccuggacuauuu

SEQ ID NO: 1326520 - RNA, 19 nt, Homo sapiens
ccaaugcguugucuuauuu

SEQ ID NO: 1326521 - RNA, 19 nt, Homo sapiens
gggcaagccuucaaauauu

SEQ ID NO: 1326522 - RNA, 19 nt, Homo sapiens
ggaggagccugugcaaaua

SEQ ID NO: 1326523 - RNA, 19 nt, Homo sapiens
ccucaaagguuaucacuau

SEQ ID NO: 1326524 - RNA, 19 nt, Homo sapiens
uaaccuccauuaucguuua

SEQ ID NO: 1326525 - RNA, 19 nt, Homo sapiens
gagagaagcccuuugaaug

SEQ ID NO: 1326526 - RNA, 19 nt, Homo sapiens
gaucuagcauuuauugaga

SEQ ID NO: 1326527 - RNA, 19 nt, Homo sapiens
guauguggccucuuuguua

SEQ ID NO: 1326528 - RNA, 19 nt, Homo sapiens
gaagguuccugcauguuau

SEQ ID NO: 1326529 - RNA, 19 nt, Homo sapiens
acaaaugucugcuagauca

SEQ ID NO: 1326530 - RNA, 19 nt, Homo sapiens
ccacaucucuccacuucuu

SEQ ID NO: 1326531 - RNA, 19 nt, Homo sapiens
gaaauccccucucuacuaa

SEQ ID NO: 1326532 - RNA, 19 nt, Homo sapiens
ggucagucuucacaucuua

SEQ ID NO: 1326533 - RNA, 19 nt, Homo sapiens
caucugaaguguacaguug

SEQ ID NO: 1326534 - RNA, 19 nt, Homo sapiens
gcaaauacaggaugcuuga

SEQ ID NO: 1326535 - RNA, 19 nt, Homo sapiens
gcuaugacuuucccucgua

SEQ ID NO: 1326536 - RNA, 19 nt, Homo sapiens
ugaauaauccugcagguuu

SEQ ID NO: 1326537 - RNA, 19 nt, Homo sapiens
uugcugagauuugcuauua

SEQ ID NO: 1326538 - RNA, 19 nt, Homo sapiens
gggagacccuaucaaugua

SEQ ID NO: 1326539 - RNA, 19 nt, Homo sapiens
ggagaggcauccugugaau

SEQ ID NO: 1326540 - RNA, 19 nt, Homo sapiens
gauaaauccuaugcaugua

SEQ ID NO: 1326541 - RNA, 19 nt, Homo sapiens
gaacauucaaccauucauu

SEQ ID NO: 1326542 - RNA, 19 nt, Homo sapiens
ccaccaugauuauguauug

SEQ ID NO: 1326543 - RNA, 19 nt, Homo sapiens
gacaugauuucuagaccua

SEQ ID NO: 1326544 - RNA, 19 nt, Homo sapiens
gcagagaagugcuuugacu

SEQ ID NO: 1326545 - RNA, 19 nt, Homo sapiens
ggacaaguagacaugauuu

SEQ ID NO: 1326546 - RNA, 19 nt, Homo sapiens
ggagagaagccauuugaau

SEQ ID NO: 1326547 - RNA, 19 nt, Homo sapiens
ucacuauucugaugucuau

SEQ ID NO: 1326548 - RNA, 19 nt, Homo sapiens
agauacagcucugaccuua

SEQ ID NO: 1326549 - RNA, 19 nt, Homo sapiens
gucaagagauuagaaauuc

SEQ ID NO: 1326550 - RNA, 19 nt, Homo sapiens
gaaggccgcuaugcagauu

SEQ ID NO: 1326551 - RNA, 19 nt, Homo sapiens
guucagggaugguuucaug

SEQ ID NO: 1326552 - RNA, 19 nt, Homo sapiens
gagagaaaccauaugaaug

SEQ ID NO: 1326553 - RNA, 19 nt, Homo sapiens
gagaugugaugcuggagaa

SEQ ID NO: 1326554 - RNA, 19 nt, Homo sapiens
aaacagcccucuugugucu

SEQ ID NO: 1326555 - RNA, 19 nt, Homo sapiens
ggagagaagcccuuugaau

SEQ ID NO: 1326556 - RNA, 19 nt, Homo sapiens
guguaaagauugugggaaa

SEQ ID NO: 1326557 - RNA, 19 nt, Homo sapiens
gagaagcccuacgagugua

SEQ ID NO: 1326558 - RNA, 19 nt, Homo sapiens
guaauaguccauagucuga

SEQ ID NO: 1326559 - RNA, 19 nt, Homo sapiens
ggucugguguggcuuauuc

SEQ ID NO: 1326560 - RNA, 19 nt, Homo sapiens
cauguuauauggcuauuuc

SEQ ID NO: 1326561 - RNA, 19 nt, Homo sapiens
ggagagaagcccuaugugu

SEQ ID NO: 1326562 - RNA, 19 nt, Homo sapiens
uaacagcauugaaccacuu

SEQ ID NO: 1326563 - RNA, 19 nt, Homo sapiens
ggacaaaguggaggaagaa

SEQ ID NO: 1326564 - RNA, 19 nt, Homo sapiens
uaucuuggcuauugugaau

SEQ ID NO: 1326565 - RNA, 19 nt, Homo sapiens
guguagauauaccacauuu

SEQ ID NO: 1326566 - RNA, 19 nt, Homo sapiens
ccagagagaaaccauauga

SEQ ID NO: 1326567 - RNA, 19 nt, Homo sapiens
gaggaacuuuaaccugauu

SEQ ID NO: 1326568 - RNA, 19 nt, Homo sapiens
ccagagugcccaccuaauu

SEQ ID NO: 1326569 - RNA, 19 nt, Homo sapiens
gcaaagagcagagccaaag

SEQ ID NO: 1326570 - RNA, 19 nt, Homo sapiens
gcaauuccuagccaagaua

SEQ ID NO: 1326571 - RNA, 19 nt, Homo sapiens
uuugagguauguacuguua

SEQ ID NO: 1326572 - RNA, 19 nt, Homo sapiens
gaaguguacaguuggauga

SEQ ID NO: 1326573 - RNA, 19 nt, Homo sapiens
cauccuguguuucaaugua

SEQ ID NO: 1326574 - RNA, 19 nt, Homo sapiens
gcauguaacaaaugugaaa

SEQ ID NO: 1326575 - RNA, 19 nt, Homo sapiens
cagagauccuguccauuga

SEQ ID NO: 1326576 - RNA, 19 nt, Homo sapiens
cugggaaucucaacuuaaa

SEQ ID NO: 1326577 - RNA, 19 nt, Homo sapiens
gaauuuccuuccucaucaa

SEQ ID NO: 1326578 - RNA, 19 nt, Homo sapiens
cuacaaaugucugcuagau

SEQ ID NO: 1326579 - RNA, 19 nt, Homo sapiens
ggucuugagucgucuuuca

SEQ ID NO: 1326580 - RNA, 19 nt, Homo sapiens
gagaagcccuuugaaugca

SEQ ID NO: 1326581 - RNA, 19 nt, Homo sapiens
ggcaagccuucaaauauuc

SEQ ID NO: 1326582 - RNA, 19 nt, Homo sapiens
gagauccuguccauugaug

SEQ ID NO: 1326583 - RNA, 19 nt, Homo sapiens
gaauaauccugcagguuuu

SEQ ID NO: 1326584 - RNA, 19 nt, Homo sapiens
uaacugaugcacuuaguau

SEQ ID NO: 1326585 - RNA, 19 nt, Homo sapiens
gguaaaagccgcaagcuaa

SEQ ID NO: 1326586 - RNA, 19 nt, Homo sapiens
gggaagauauuguguucag

SEQ ID NO: 1326587 - RNA, 19 nt, Homo sapiens
ugaaaugcauacaucugaa

SEQ ID NO: 1326588 - RNA, 19 nt, Homo sapiens
gcugugaauguucuuguua

SEQ ID NO: 1326589 - RNA, 19 nt, Homo sapiens
gcacuuaguauaugucagu

SEQ ID NO: 1326590 - RNA, 19 nt, Homo sapiens
gguccuggcuaguaugaau

SEQ ID NO: 1326591 - RNA, 19 nt, Homo sapiens
gcaggagaauucuuugaac

SEQ ID NO: 1326592 - RNA, 19 nt, Homo sapiens
gccugggaaucucaacuua

SEQ ID NO: 1326593 - RNA, 19 nt, Homo sapiens
guucauccauguuaucaca

SEQ ID NO: 1326594 - RNA, 19 nt, Homo sapiens
caaagguuaucacuauucu

SEQ ID NO: 1326595 - RNA, 19 nt, Homo sapiens
acacugacacuuugaggua

SEQ ID NO: 1326596 - RNA, 19 nt, Homo sapiens
gugcagaaccucaguguca

SEQ ID NO: 1326597 - RNA, 19 nt, Homo sapiens
agaauuuccuuccucauca

SEQ ID NO: 1326598 - RNA, 19 nt, Homo sapiens
uuaauuacauggugagaag

SEQ ID NO: 1326599 - RNA, 19 nt, Homo sapiens
cauggaauccgucaccuuu

SEQ ID NO: 1326600 - RNA, 19 nt, Homo sapiens
gaacucacacuggagagaa

SEQ ID NO: 1326601 - RNA, 19 nt, Homo sapiens
gaacgugcacaagaggaua

SEQ ID NO: 1326602 - RNA, 19 nt, Homo sapiens
gaacucacacuggagagaa

SEQ ID NO: 1326603 - RNA, 19 nt, Homo sapiens
cgacacaugagaacccaua

SEQ ID NO: 1326604 - RNA, 19 nt, Homo sapiens
agaggagccuguauagaga

SEQ ID NO: 1326605 - RNA, 19 nt, Homo sapiens
uaaagcugcugugaauguu

SEQ ID NO: 1326606 - RNA, 19 nt, Homo sapiens
uggaauccgucaccuuuga

SEQ ID NO: 1326607 - RNA, 19 nt, Homo sapiens
gcccuggacuauuuauuuc

SEQ ID NO: 1326608 - RNA, 19 nt, Homo sapiens
guaugaauaugagaaguca

SEQ ID NO: 1326609 - RNA, 19 nt, Homo sapiens
gcacagcuccucacucacu

SEQ ID NO: 1326610 - RNA, 19 nt, Homo sapiens
aggcacagcuccucacuca

SEQ ID NO: 1326611 - RNA, 19 nt, Homo sapiens
auacagcucugaccuuauc

SEQ ID NO: 1326612 - RNA, 19 nt, Homo sapiens
caguuagguugauuccaua

SEQ ID NO: 1326613 - RNA, 19 nt, Homo sapiens
ccugaagcuuugcaucuuu

SEQ ID NO: 1326614 - RNA, 19 nt, Homo sapiens
ucugugaucuagcauuuau

SEQ ID NO: 1326615 - RNA, 19 nt, Homo sapiens
ggaaagccuucagggaaca

SEQ ID NO: 1326616 - RNA, 19 nt, Homo sapiens
ggaagaagaugaagacuau

SEQ ID NO: 1326617 - RNA, 19 nt, Homo sapiens
gaagacagauaucaagaaa

SEQ ID NO: 1326618 - RNA, 19 nt, Homo sapiens
gaaaguagaagcagcaaua

SEQ ID NO: 1326619 - RNA, 19 nt, Homo sapiens
gacuuuaccuuacuuguua

SEQ ID NO: 1326620 - RNA, 19 nt, Homo sapiens
cauaauaguuugcccauuu

SEQ ID NO: 1326621 - RNA, 19 nt, Homo sapiens
uaaagugacccaaacauua

SEQ ID NO: 1326622 - RNA, 19 nt, Homo sapiens
gaacuacccuaugcuguuu

SEQ ID NO: 1326623 - RNA, 19 nt, Homo sapiens
ggaaggaaccaccaguuua

SEQ ID NO: 1326624 - RNA, 19 nt, Homo sapiens
gaaauaggcagucagugua

SEQ ID NO: 1326625 - RNA, 19 nt, Homo sapiens
ugaagacuaucgagaauuu

SEQ ID NO: 1326626 - RNA, 19 nt, Homo sapiens
caccagauguagauauuua

SEQ ID NO: 1326627 - RNA, 19 nt, Homo sapiens
uaaaggagaugaaccuaga

SEQ ID NO: 1326628 - RNA, 19 nt, Homo sapiens
gaaagccggagaugaaaua

SEQ ID NO: 1326629 - RNA, 19 nt, Homo sapiens
gauaauaguuuccaguaca

SEQ ID NO: 1326630 - RNA, 19 nt, Homo sapiens
gaugaaaacucuagaacua

SEQ ID NO: 1326631 - RNA, 19 nt, Homo sapiens
cauagaggguuuaaagaaa

SEQ ID NO: 1326632 - RNA, 19 nt, Homo sapiens
gaaaacggauuuaggauga

SEQ ID NO: 1326633 - RNA, 19 nt, Homo sapiens
acaaaugucuucuauguca

SEQ ID NO: 1326634 - RNA, 19 nt, Homo sapiens
gaucagaggaggaauaaug

SEQ ID NO: 1326635 - RNA, 19 nt, Homo sapiens
gagcaaugguacuuagaaa

SEQ ID NO: 1326636 - RNA, 19 nt, Homo sapiens
gaaggaaccaccaguuuau

SEQ ID NO: 1326637 - RNA, 19 nt, Homo sapiens
ggaagaccauagaggguuu

SEQ ID NO: 1326638 - RNA, 19 nt, Homo sapiens
gagacguucugccaagaua

SEQ ID NO: 1326639 - RNA, 19 nt, Homo sapiens
gaaaugcuuuguaccaagu

SEQ ID NO: 1326640 - RNA, 19 nt, Homo sapiens
gugaaaccauuccaaacua

SEQ ID NO: 1326641 - RNA, 19 nt, Homo sapiens
ggaaauaggcagucagugu

SEQ ID NO: 1326642 - RNA, 19 nt, Homo sapiens
gcacaguuccagaaaguaa

SEQ ID NO: 1326643 - RNA, 19 nt, Homo sapiens
guagaagcagcaauaaaua

SEQ ID NO: 1326644 - RNA, 19 nt, Homo sapiens
ggauaucucuaccauguca

SEQ ID NO: 1326645 - RNA, 19 nt, Homo sapiens
gaugaagacuaucgagaau

SEQ ID NO: 1326646 - RNA, 19 nt, Homo sapiens
agaaagaauuugugucaga

SEQ ID NO: 1326647 - RNA, 19 nt, Homo sapiens
gagaauuuccucagaagaa

SEQ ID NO: 1326648 - RNA, 19 nt, Homo sapiens
gacaccagauguagauauu

SEQ ID NO: 1326649 - RNA, 19 nt, Homo sapiens
ugaaaccauuccaaacuaa

SEQ ID NO: 1326650 - RNA, 19 nt, Homo sapiens
gaaacuuuguggcuggaaa

SEQ ID NO: 1326651 - RNA, 19 nt, Homo sapiens
aaagcaaccuuaggaguaa

SEQ ID NO: 1326652 - RNA, 19 nt, Homo sapiens
aaccauaacugauuuguca

SEQ ID NO: 1326653 - RNA, 19 nt, Homo sapiens
gccaggaaguacuacauaa

SEQ ID NO: 1326654 - RNA, 19 nt, Homo sapiens
ggaaacaacuucguucacu

SEQ ID NO: 1326655 - RNA, 19 nt, Homo sapiens
ggaugaagaugagaagaau

SEQ ID NO: 1326656 - RNA, 19 nt, Homo sapiens
caugaugacuccuuaagug

SEQ ID NO: 1326657 - RNA, 19 nt, Homo sapiens
gagcagaaggucucuaaga

SEQ ID NO: 1326658 - RNA, 19 nt, Homo sapiens
guaaagugacccaaacauu

SEQ ID NO: 1326659 - RNA, 19 nt, Homo sapiens
gagagggagugaugucuuc

SEQ ID NO: 1326660 - RNA, 19 nt, Homo sapiens
caguguaucuggccuuaaa

SEQ ID NO: 1326661 - RNA, 19 nt, Homo sapiens
ugaaauagaugagccaagu

SEQ ID NO: 1326662 - RNA, 19 nt, Homo sapiens
aaagugacccaaacauuaa

SEQ ID NO: 1326663 - RNA, 19 nt, Homo sapiens
gcaaugguacuuagaaauc

SEQ ID NO: 1326664 - RNA, 19 nt, Homo sapiens
ggacuuuaccuuacuuguu

SEQ ID NO: 1326665 - RNA, 19 nt, Homo sapiens
ggaguaaagugacccaaac

SEQ ID NO: 1326666 - RNA, 19 nt, Homo sapiens
gaacuguugucauucacau

SEQ ID NO: 1326667 - RNA, 19 nt, Homo sapiens
gaagcuccauugauuuagu

SEQ ID NO: 1326668 - RNA, 19 nt, Homo sapiens
ggaaggaaauaggcaguca

SEQ ID NO: 1326669 - RNA, 19 nt, Homo sapiens
gaauaaugaggaacuggua

SEQ ID NO: 1326670 - RNA, 19 nt, Homo sapiens
ggaagacagauaucaagaa

SEQ ID NO: 1326671 - RNA, 19 nt, Homo sapiens
cgugagaguugcuccagua

SEQ ID NO: 1326672 - RNA, 19 nt, Homo sapiens
ucacugucuucccuucuua

SEQ ID NO: 1326673 - RNA, 19 nt, Homo sapiens
gaggaggaauaaugaggaa

SEQ ID NO: 1326674 - RNA, 19 nt, Homo sapiens
ugucuucccuucuuacauu

SEQ ID NO: 1326675 - RNA, 19 nt, Homo sapiens
gaaccuagagucaaagagu

SEQ ID NO: 1326676 - RNA, 19 nt, Homo sapiens
gcuccuuccuccuguguaa

SEQ ID NO: 1326677 - RNA, 19 nt, Homo sapiens
uggcagggaugaaguauca

SEQ ID NO: 1326678 - RNA, 19 nt, Homo sapiens
gaugacuccuuaagugguu

SEQ ID NO: 1326679 - RNA, 19 nt, Homo sapiens
gggaaaugcuuuguaccaa

SEQ ID NO: 1326680 - RNA, 19 nt, Homo sapiens
uuuaguagcugcuccauca

SEQ ID NO: 1326681 - RNA, 19 nt, Homo sapiens
cccaaagacuaaucauaaa

SEQ ID NO: 1326682 - RNA, 19 nt, Homo sapiens
gaaaagcugaugaagauaa

SEQ ID NO: 1326683 - RNA, 19 nt, Homo sapiens
ugggauaucucuaccaugu

SEQ ID NO: 1326684 - RNA, 19 nt, Homo sapiens
gcccuugggugaaauuguu

SEQ ID NO: 1326685 - RNA, 19 nt, Homo sapiens
ggagaugaaccuagaguca

SEQ ID NO: 1326686 - RNA, 19 nt, Homo sapiens
gggaaaggcuccgaacagu

SEQ ID NO: 1326687 - RNA, 19 nt, Homo sapiens
ccauagaggguuuaaagaa

SEQ ID NO: 1326688 - RNA, 19 nt, Homo sapiens
gaggagcaaugguacuuag

SEQ ID NO: 1326689 - RNA, 19 nt, Homo sapiens
cagcagaggagcacgagua

SEQ ID NO: 1326690 - RNA, 19 nt, Homo sapiens
uaaaagugcuccuaggaaa

SEQ ID NO: 1326691 - RNA, 19 nt, Homo sapiens
cagcacaguuccagaaagu

SEQ ID NO: 1326692 - RNA, 19 nt, Homo sapiens
ucaccagcaucaugggaua

SEQ ID NO: 1326693 - RNA, 19 nt, Homo sapiens
gaccauagaggguuuaaag

SEQ ID NO: 1326694 - RNA, 19 nt, Homo sapiens
gaaagagaaaguagaagca

SEQ ID NO: 1326695 - RNA, 19 nt, Homo sapiens
gagcugagucuuagaguag

SEQ ID NO: 1326696 - RNA, 19 nt, Homo sapiens
agaugaaccuagagucaaa

SEQ ID NO: 1326697 - RNA, 19 nt, Homo sapiens
ggaaggaucagaggaggaa

SEQ ID NO: 1326698 - RNA, 19 nt, Homo sapiens
uaaagcagcggcagcaaga

SEQ ID NO: 1326699 - RNA, 19 nt, Homo sapiens
gaggacugguucguuguaa

SEQ ID NO: 1326700 - RNA, 19 nt, Homo sapiens
ucagaaagaauuuguguca

SEQ ID NO: 1326701 - RNA, 19 nt, Homo sapiens
ggaaaggcuccgaacaguu

SEQ ID NO: 1326702 - RNA, 19 nt, Homo sapiens
caggaaauguuuacuuguc

SEQ ID NO: 1326703 - RNA, 19 nt, Homo sapiens
aaaucuaccuacuggauga

SEQ ID NO: 1326704 - RNA, 19 nt, Homo sapiens
ggaaguacuacauaaaugg

SEQ ID NO: 1326705 - RNA, 19 nt, Homo sapiens
gagaguugcuccaguagcu

SEQ ID NO: 1326706 - RNA, 19 nt, Homo sapiens
gcccgaggccucauccaua

SEQ ID NO: 1326707 - RNA, 19 nt, Homo sapiens
agagaguggugucaaguau

SEQ ID NO: 1326708 - RNA, 19 nt, Homo sapiens
ggacagccagagugcuuaa

SEQ ID NO: 1326709 - RNA, 19 nt, Homo sapiens
gggccuauauccuucuuuc

SEQ ID NO: 1326710 - RNA, 19 nt, Homo sapiens
ggagcaaugguacuuagaa

SEQ ID NO: 1326711 - RNA, 19 nt, Homo sapiens
uaucgagaauuuccucaga

SEQ ID NO: 1326712 - RNA, 19 nt, Homo sapiens
uuagaacuguugucauuca

SEQ ID NO: 1326713 - RNA, 19 nt, Homo sapiens
ggauaauaguuuccaguac

SEQ ID NO: 1326714 - RNA, 19 nt, Homo sapiens
ccugggcucuuguacauug

SEQ ID NO: 1326715 - RNA, 19 nt, Homo sapiens
gaaguacuacauaaaugga

SEQ ID NO: 1326716 - RNA, 19 nt, Homo sapiens
guaaugagcuucacuauuu

SEQ ID NO: 1326717 - RNA, 19 nt, Homo sapiens
ucacagauaucauguauug

SEQ ID NO: 1326718 - RNA, 19 nt, Homo sapiens
ggaaacgacaacuauauua

SEQ ID NO: 1326719 - RNA, 19 nt, Homo sapiens
caaagacacugacaacuca

SEQ ID NO: 1326720 - RNA, 19 nt, Homo sapiens
uauaugaacuggagaaaga

SEQ ID NO: 1326721 - RNA, 19 nt, Homo sapiens
gcccuuggcuucauuguuu

SEQ ID NO: 1326722 - RNA, 19 nt, Homo sapiens
ggaccaaauuccauucaaa

SEQ ID NO: 1326723 - RNA, 19 nt, Homo sapiens
caagaugacuggaaacuag

SEQ ID NO: 1326724 - RNA, 19 nt, Homo sapiens
caacagaaauuguaaugag

SEQ ID NO: 1326725 - RNA, 19 nt, Homo sapiens
cgaauuaccuucagcacaa

SEQ ID NO: 1326726 - RNA, 19 nt, Homo sapiens
caagagaugugcaccaaug

SEQ ID NO: 1326727 - RNA, 19 nt, Homo sapiens
gaaguuaaguauguuguug

SEQ ID NO: 1326728 - RNA, 19 nt, Homo sapiens
caacaagacccucauauuc

SEQ ID NO: 1326729 - RNA, 19 nt, Homo sapiens
ugauacaaauccagaguua

SEQ ID NO: 1326730 - RNA, 19 nt, Homo sapiens
uagaacagauugcaaagaa

SEQ ID NO: 1326731 - RNA, 19 nt, Homo sapiens
uaagagaagucguuuaaag

SEQ ID NO: 1326732 - RNA, 19 nt, Homo sapiens
gaacaaaugaacacaaugu

SEQ ID NO: 1326733 - RNA, 19 nt, Homo sapiens
ggaaagaugcucagagaga

SEQ ID NO: 1326734 - RNA, 19 nt, Homo sapiens
ccaguucucacuuaaauua

SEQ ID NO: 1326735 - RNA, 19 nt, Homo sapiens
gaauuccugucuuaaacua

SEQ ID NO: 1326736 - RNA, 19 nt, Homo sapiens
gcaacaagacccucauauu

SEQ ID NO: 1326737 - RNA, 19 nt, Homo sapiens
gcagaucaggauuuaaaua

SEQ ID NO: 1326738 - RNA, 19 nt, Homo sapiens
gaacacagucuuucgacaa

SEQ ID NO: 1326739 - RNA, 19 nt, Homo sapiens
gaagaggaagggcaaguuu

SEQ ID NO: 1326740 - RNA, 19 nt, Homo sapiens
ugagugaggcuaaucuuua

SEQ ID NO: 1326741 - RNA, 19 nt, Homo sapiens
gaaauggaucuuugaauag

SEQ ID NO: 1326742 - RNA, 19 nt, Homo sapiens
uaaacagucaugugucuua

SEQ ID NO: 1326743 - RNA, 19 nt, Homo sapiens
gagagagaauccugcagaa

SEQ ID NO: 1326744 - RNA, 19 nt, Homo sapiens
gcaggccucucccaacuug

SEQ ID NO: 1326745 - RNA, 19 nt, Homo sapiens
caacugggccgugcagaua

SEQ ID NO: 1326746 - RNA, 19 nt, Homo sapiens
gaaacgagagggaaucuuc

SEQ ID NO: 1326747 - RNA, 19 nt, Homo sapiens
aauagcagaucaggauuua

SEQ ID NO: 1326748 - RNA, 19 nt, Homo sapiens
gaauagcagaucaggauuu

SEQ ID NO: 1326749 - RNA, 19 nt, Homo sapiens
ugagauggcuccuacgaau

SEQ ID NO: 1326750 - RNA, 19 nt, Homo sapiens
gaaagaaugcuggcaacaa

SEQ ID NO: 1326751 - RNA, 19 nt, Homo sapiens
aaacauagaccaucacauc

SEQ ID NO: 1326752 - RNA, 19 nt, Homo sapiens
gaagagauagaacaugaug

SEQ ID NO: 1326753 - RNA, 19 nt, Homo sapiens
uaagauauauccagcuucu

SEQ ID NO: 1326754 - RNA, 19 nt, Homo sapiens
gaacagauugcaaagaaag

SEQ ID NO: 1326755 - RNA, 19 nt, Homo sapiens
cccgagagcuugguaaauu

SEQ ID NO: 1326756 - RNA, 19 nt, Homo sapiens
acagucaugugucuuaauu

SEQ ID NO: 1326757 - RNA, 19 nt, Homo sapiens
auaccuagcucuucacaga

SEQ ID NO: 1326758 - RNA, 19 nt, Homo sapiens
uagcagaucaggauuuaaa

SEQ ID NO: 1326759 - RNA, 19 nt, Homo sapiens
guucaguccuugccauuug

SEQ ID NO: 1326760 - RNA, 19 nt, Homo sapiens
uggcaagaauaaugugaua

SEQ ID NO: 1326761 - RNA, 19 nt, Homo sapiens
gugaacaaaugaacacaau

SEQ ID NO: 1326762 - RNA, 19 nt, Homo sapiens
gaccacaucccacccaauu

SEQ ID NO: 1326763 - RNA, 19 nt, Homo sapiens
caguuuaccuucagauuuc

SEQ ID NO: 1326764 - RNA, 19 nt, Homo sapiens
uugaagagauagaacauga

SEQ ID NO: 1326765 - RNA, 19 nt, Homo sapiens
caaugugucuaccuuugaa

SEQ ID NO: 1326766 - RNA, 19 nt, Homo sapiens
ggagaaagaauuccugucu

SEQ ID NO: 1326767 - RNA, 19 nt, Homo sapiens
gaaauuguaaugagcuuca

SEQ ID NO: 1326768 - RNA, 19 nt, Homo sapiens
ccaacuggugcaacuauua

SEQ ID NO: 1326769 - RNA, 19 nt, Homo sapiens
gaaaggauaagaccucucu

SEQ ID NO: 1326770 - RNA, 19 nt, Homo sapiens
ggacaucgaaucaguuuac

SEQ ID NO: 1326771 - RNA, 19 nt, Homo sapiens
aaagaaugcuggcaacaag

SEQ ID NO: 1326772 - RNA, 19 nt, Homo sapiens
gagcacagcaggcaccuau

SEQ ID NO: 1326773 - RNA, 19 nt, Homo sapiens
ccgagagcuugguaaauuu

SEQ ID NO: 1326774 - RNA, 19 nt, Homo sapiens
uauguccaguucucacuua

SEQ ID NO: 1326775 - RNA, 19 nt, Homo sapiens
gagaugugcaccaaugaaa

SEQ ID NO: 1326776 - RNA, 19 nt, Homo sapiens
gaaacuugccgucuuccuu

SEQ ID NO: 1326777 - RNA, 19 nt, Homo sapiens
ugggaaagaugcucagaga

SEQ ID NO: 1326778 - RNA, 19 nt, Homo sapiens
caugcaagaugacuggaaa

SEQ ID NO: 1326779 - RNA, 19 nt, Homo sapiens
gugccuuacuguuguuuaa

SEQ ID NO: 1326780 - RNA, 19 nt, Homo sapiens
gagauggcuccuacgaaua

SEQ ID NO: 1326781 - RNA, 19 nt, Homo sapiens
ccauacaguugacuucaga

SEQ ID NO: 1326782 - RNA, 19 nt, Homo sapiens
uugccaagcucaugaaaga

SEQ ID NO: 1326783 - RNA, 19 nt, Homo sapiens
uaaacucacuuugcccauu

SEQ ID NO: 1326784 - RNA, 19 nt, Homo sapiens
agacaucuguugaaauaag

SEQ ID NO: 1326785 - RNA, 19 nt, Homo sapiens
aaacagucaugugucuuaa

SEQ ID NO: 1326786 - RNA, 19 nt, Homo sapiens
acagauaccuagcucuuca

SEQ ID NO: 1326787 - RNA, 19 nt, Homo sapiens
cgaauagucugaguagauc

SEQ ID NO: 1326788 - RNA, 19 nt, Homo sapiens
agaagaauuugaggaugua

SEQ ID NO: 1326789 - RNA, 19 nt, Homo sapiens
caucaguagcccuuuauuu

SEQ ID NO: 1326790 - RNA, 19 nt, Homo sapiens
ccaaggaagagaagaagaa

SEQ ID NO: 1326791 - RNA, 19 nt, Homo sapiens
aagaagaauuugaggaugu

SEQ ID NO: 1326792 - RNA, 19 nt, Homo sapiens
gaagggcaaguuuaagaga

SEQ ID NO: 1326793 - RNA, 19 nt, Homo sapiens
gcaagaugacuggaaacua

SEQ ID NO: 1326794 - RNA, 19 nt, Homo sapiens
guccaguucucacuuaaau

SEQ ID NO: 1326795 - RNA, 19 nt, Homo sapiens
uuucuugucuuguuucuug

SEQ ID NO: 1326796 - RNA, 19 nt, Homo sapiens
gcagauggacagugaagau

SEQ ID NO: 1326797 - RNA, 19 nt, Homo sapiens
ccucagagagcuucauaaa

SEQ ID NO: 1326798 - RNA, 19 nt, Homo sapiens
cuucacagauaucauguau

SEQ ID NO: 1326799 - RNA, 19 nt, Homo sapiens
ucaguagcccuuuauuuga

SEQ ID NO: 1326800 - RNA, 19 nt, Homo sapiens
ugaucuaccucuugggaaa

SEQ ID NO: 1326801 - RNA, 19 nt, Homo sapiens
caaauaaaauugccuaguc

SEQ ID NO: 1326802 - RNA, 19 nt, Homo sapiens
ugaaagauagaacagauug

SEQ ID NO: 1326803 - RNA, 19 nt, Homo sapiens
gaccaaauuccauucaaau

SEQ ID NO: 1326804 - RNA, 19 nt, Homo sapiens
ggaacuuaacauucugaua

SEQ ID NO: 1326805 - RNA, 19 nt, Homo sapiens
uaaugcauauguccaguuc

SEQ ID NO: 1326806 - RNA, 19 nt, Homo sapiens
uggccauguuccuaaauua

SEQ ID NO: 1326807 - RNA, 19 nt, Homo sapiens
gggaaggaacacagucuuu

SEQ ID NO: 1326808 - RNA, 19 nt, Homo sapiens
aaacucacuuugcccauuc

SEQ ID NO: 1326809 - RNA, 19 nt, Homo sapiens
ucugaugacuggaauagau

SEQ ID NO: 1326810 - RNA, 19 nt, Homo sapiens
caacuggugcaacuauuau

SEQ ID NO: 1326811 - RNA, 19 nt, Homo sapiens
ggaaggaacacagucuuuc

SEQ ID NO: 1326812 - RNA, 19 nt, Homo sapiens
ucaguuuaccuucagauuu

SEQ ID NO: 1326813 - RNA, 19 nt, Homo sapiens
agaggaagggcaaguuuaa

SEQ ID NO: 1326814 - RNA, 19 nt, Homo sapiens
gguggaaacgacaacuaua

SEQ ID NO: 1326815 - RNA, 19 nt, Homo sapiens
caguagcccuuuauuugau

SEQ ID NO: 1326816 - RNA, 19 nt, Homo sapiens
gaacagcucuucucaucaa

SEQ ID NO: 1326817 - RNA, 19 nt, Homo sapiens
ucagaaaucuucauccaaa

SEQ ID NO: 1326818 - RNA, 19 nt, Homo sapiens
ugaaggagauauuccagua

SEQ ID NO: 1326819 - RNA, 19 nt, Homo sapiens
gaaugaagcagaaauggaa

SEQ ID NO: 1326820 - RNA, 19 nt, Homo sapiens
ggaacgaagucgcacagaa

SEQ ID NO: 1326821 - RNA, 19 nt, Homo sapiens
ucagagccgucccaaauaa

SEQ ID NO: 1326822 - RNA, 19 nt, Homo sapiens
agaaggaacuggauagguu

SEQ ID NO: 1326823 - RNA, 19 nt, Homo sapiens
cuacaugucuguccugaga

SEQ ID NO: 1326824 - RNA, 19 nt, Homo sapiens
gugcuggagugcagaaaua

SEQ ID NO: 1326825 - RNA, 19 nt, Homo sapiens
ugaauguccucgucuguuu

SEQ ID NO: 1326826 - RNA, 19 nt, Homo sapiens
uaacgccgaugccacagua

SEQ ID NO: 1326827 - RNA, 19 nt, Homo sapiens
gcacaagggcccagaacaa

SEQ ID NO: 1326828 - RNA, 19 nt, Homo sapiens
ugaaguccauuucuaguga

SEQ ID NO: 1326829 - RNA, 19 nt, Homo sapiens
gagcagaggccuccagaga

SEQ ID NO: 1326830 - RNA, 19 nt, Homo sapiens
cauccaaacugaacgaaga

SEQ ID NO: 1326831 - RNA, 19 nt, Homo sapiens
gcacguuccugcacuaucu

SEQ ID NO: 1326832 - RNA, 19 nt, Homo sapiens
cagaggaaauugcaagaga

SEQ ID NO: 1326833 - RNA, 19 nt, Homo sapiens
caaaggaagcaucaugaaa

SEQ ID NO: 1326834 - RNA, 19 nt, Homo sapiens
aaacgugaaugaagcagaa

SEQ ID NO: 1326835 - RNA, 19 nt, Homo sapiens
caaauacagugcagucagu

SEQ ID NO: 1326836 - RNA, 19 nt, Homo sapiens
gaacgaagucgcacagaag

SEQ ID NO: 1326837 - RNA, 19 nt, Homo sapiens
agaaagcucuagaaauuag

SEQ ID NO: 1326838 - RNA, 19 nt, Homo sapiens
ccacgaagaagaucaagaa

SEQ ID NO: 1326839 - RNA, 19 nt, Homo sapiens
gaucccagccucucaagaa

SEQ ID NO: 1326840 - RNA, 19 nt, Homo sapiens
ucagaagcccgaaggguua

SEQ ID NO: 1326841 - RNA, 19 nt, Homo sapiens
gaaaagaaagcucuagaaa

SEQ ID NO: 1326842 - RNA, 19 nt, Homo sapiens
aagcagaaauggaagaaau

SEQ ID NO: 1326843 - RNA, 19 nt, Homo sapiens
ggccuauucugccacauuu

SEQ ID NO: 1326844 - RNA, 19 nt, Homo sapiens
gaaggaacuggauagguuu

SEQ ID NO: 1326845 - RNA, 19 nt, Homo sapiens
gcucugcgcugugaugaug

SEQ ID NO: 1326846 - RNA, 19 nt, Homo sapiens
caagugagcccgaggaaca

SEQ ID NO: 1326847 - RNA, 19 nt, Homo sapiens
gcggagacuuuguugaaau

SEQ ID NO: 1326848 - RNA, 19 nt, Homo sapiens
gcacuacccagaggaaauu

SEQ ID NO: 1326849 - RNA, 19 nt, Homo sapiens
ugagugauguccaguuuca

SEQ ID NO: 1326850 - RNA, 19 nt, Homo sapiens
gaacaaaguggcgcuguca

SEQ ID NO: 1326851 - RNA, 19 nt, Homo sapiens
gcacagcugcccuacaugu

SEQ ID NO: 1326852 - RNA, 19 nt, Homo sapiens
aggccgagcuuucugaauu

SEQ ID NO: 1326853 - RNA, 19 nt, Homo sapiens
uccaguaugugaacaauga

SEQ ID NO: 1326854 - RNA, 19 nt, Homo sapiens
gaagaugagggccaggaaa

SEQ ID NO: 1326855 - RNA, 19 nt, Homo sapiens
gcgaaagcuucuccaggaa

SEQ ID NO: 1326856 - RNA, 19 nt, Homo sapiens
gaaagcagggccgagaauu

SEQ ID NO: 1326857 - RNA, 19 nt, Homo sapiens
gcagagaauugcgaaagca

SEQ ID NO: 1326858 - RNA, 19 nt, Homo sapiens
gcagaagccgugacuguuc

SEQ ID NO: 1326859 - RNA, 19 nt, Homo sapiens
guccugauguucccagaaa

SEQ ID NO: 1326860 - RNA, 19 nt, Homo sapiens
ccugagugauguccaguuu

SEQ ID NO: 1326861 - RNA, 19 nt, Homo sapiens
ggagcaguguggaggaaga

SEQ ID NO: 1326862 - RNA, 19 nt, Homo sapiens
ggagcuagaacaaaccaaa

SEQ ID NO: 1326863 - RNA, 19 nt, Homo sapiens
ggagaaggaagcagagaau

SEQ ID NO: 1326864 - RNA, 19 nt, Homo sapiens
ccaaagugcugggaucaca

SEQ ID NO: 1326865 - RNA, 19 nt, Homo sapiens
gaacagcaggccgagcuuu

SEQ ID NO: 1326866 - RNA, 19 nt, Homo sapiens
cgaagucgcacagaaguuu

SEQ ID NO: 1326867 - RNA, 19 nt, Homo sapiens
ccaaggaccacgaagaaga

SEQ ID NO: 1326868 - RNA, 19 nt, Homo sapiens
gcgaacaggugccuauugc

SEQ ID NO: 1326869 - RNA, 19 nt, Homo sapiens
gugcuaaucggaagaagaa

SEQ ID NO: 1326870 - RNA, 19 nt, Homo sapiens
acgaacagcucuucucauc

SEQ ID NO: 1326871 - RNA, 19 nt, Homo sapiens
gggacaagguggaggagau

SEQ ID NO: 1326872 - RNA, 19 nt, Homo sapiens
ggaggaagcggagacuuug

SEQ ID NO: 1326873 - RNA, 19 nt, Homo sapiens
gcugcugguugcugacuuu

SEQ ID NO: 1326874 - RNA, 19 nt, Homo sapiens
cccacaaguucgugcuuua

SEQ ID NO: 1326875 - RNA, 19 nt, Homo sapiens
ggaaauugcaagagaaguc

SEQ ID NO: 1326876 - RNA, 19 nt, Homo sapiens
aggcagagcugaggcagaa

SEQ ID NO: 1326877 - RNA, 19 nt, Homo sapiens
agacgccggugcugaagaa

SEQ ID NO: 1326878 - RNA, 19 nt, Homo sapiens
agaggaaauugcaagagaa

SEQ ID NO: 1326879 - RNA, 19 nt, Homo sapiens
ucucagagccgucccaaau

SEQ ID NO: 1326880 - RNA, 19 nt, Homo sapiens
gaggguggcaguccgguuu

SEQ ID NO: 1326881 - RNA, 19 nt, Homo sapiens
gaaauccaaggaccacgaa

SEQ ID NO: 1326882 - RNA, 19 nt, Homo sapiens
gaugagggccaggaaagaa

SEQ ID NO: 1326883 - RNA, 19 nt, Homo sapiens
gcaugucacccacuggauu

SEQ ID NO: 1326884 - RNA, 19 nt, Homo sapiens
gaccuaacccagucaaauc

SEQ ID NO: 1326885 - RNA, 19 nt, Homo sapiens
aaagcagggccgagaauuu

SEQ ID NO: 1326886 - RNA, 19 nt, Homo sapiens
gaaggaagcagagaauugc

SEQ ID NO: 1326887 - RNA, 19 nt, Homo sapiens
ccacagcccagaugcaguu

SEQ ID NO: 1326888 - RNA, 19 nt, Homo sapiens
gcccacaaguucgugcuuu

SEQ ID NO: 1326889 - RNA, 19 nt, Homo sapiens
gaagguggagcggaacuga

SEQ ID NO: 1326890 - RNA, 19 nt, Homo sapiens
cuccaggccucaaugauga

SEQ ID NO: 1326891 - RNA, 19 nt, Homo sapiens
aaaggaagcaucaugaaag

SEQ ID NO: 1326892 - RNA, 19 nt, Homo sapiens
ucccagagcccaccaagaa

SEQ ID NO: 1326893 - RNA, 19 nt, Homo sapiens
gaaguccauuucuagugau

SEQ ID NO: 1326894 - RNA, 19 nt, Homo sapiens
ggaagcaucaugaaagcau

SEQ ID NO: 1326895 - RNA, 19 nt, Homo sapiens
ggaacuggauagguuugga

SEQ ID NO: 1326896 - RNA, 19 nt, Homo sapiens
cuagugauccucuggaaga

SEQ ID NO: 1326897 - RNA, 19 nt, Homo sapiens
cgaagaagaucaagaaaac

SEQ ID NO: 1326898 - RNA, 19 nt, Homo sapiens
agaaggaagcagagaauug

SEQ ID NO: 1326899 - RNA, 19 nt, Homo sapiens
cauguucacuagcggauuc

SEQ ID NO: 1326900 - RNA, 19 nt, Homo sapiens
ccacagguuuggcgugagu

SEQ ID NO: 1326901 - RNA, 19 nt, Homo sapiens
gaacaaaccaaaaugaagu

SEQ ID NO: 1326902 - RNA, 19 nt, Homo sapiens
gaaaucuucauccaaacug

SEQ ID NO: 1326903 - RNA, 19 nt, Homo sapiens
caucaaaggaagcaucaug

SEQ ID NO: 1326904 - RNA, 19 nt, Homo sapiens
ccucgucuguuucaaauac

SEQ ID NO: 1326905 - RNA, 19 nt, Homo sapiens
gcaguguggaggaagauga

SEQ ID NO: 1326906 - RNA, 19 nt, Homo sapiens
ggccgagcuuucugaauuc

SEQ ID NO: 1326907 - RNA, 19 nt, Homo sapiens
caaacugaacgaagaagau

SEQ ID NO: 1326908 - RNA, 19 nt, Homo sapiens
ggaagcggagacuuuguug

SEQ ID NO: 1326909 - RNA, 19 nt, Homo sapiens
gagaaggaagcagagaauu

SEQ ID NO: 1326910 - RNA, 19 nt, Homo sapiens
ggaagaugagggccaggaa

SEQ ID NO: 1326911 - RNA, 19 nt, Homo sapiens
ucaaaggaagcaucaugaa

SEQ ID NO: 1326912 - RNA, 19 nt, Homo sapiens
cagcagaagccgugacugu

SEQ ID NO: 1326913 - RNA, 19 nt, Homo sapiens
aagcggagacuuuguugaa

SEQ ID NO: 1326914 - RNA, 19 nt, Homo sapiens
accagaaggugcugcugua

SEQ ID NO: 1326915 - RNA, 19 nt, Homo sapiens
gccacaguauuccauuaug

SEQ ID NO: 1326916 - RNA, 19 nt, Homo sapiens
aaacagagcucuaagauga

SEQ ID NO: 1326917 - RNA, 19 nt, Homo sapiens
gcucuaagaugauccuuua

SEQ ID NO: 1326918 - RNA, 19 nt, Homo sapiens
ggaagaggauuacuuuaaa

SEQ ID NO: 1326919 - RNA, 19 nt, Homo sapiens
ggucauaacuccagcuaua

SEQ ID NO: 1326920 - RNA, 19 nt, Homo sapiens
ucaaggacauuacaaguua

SEQ ID NO: 1326921 - RNA, 19 nt, Homo sapiens
gacaaaggcuucaaagauu

SEQ ID NO: 1326922 - RNA, 19 nt, Homo sapiens
caaaugcccuggauuauau

SEQ ID NO: 1326923 - RNA, 19 nt, Homo sapiens
gggauaagcuucucucuug

SEQ ID NO: 1326924 - RNA, 19 nt, Homo sapiens
gaaagcagcuauguagaaa

SEQ ID NO: 1326925 - RNA, 19 nt, Homo sapiens
ccacaucacucaaggcaua

SEQ ID NO: 1326926 - RNA, 19 nt, Homo sapiens
gcaaagguauucagcaaga

SEQ ID NO: 1326927 - RNA, 19 nt, Homo sapiens
gcacagacauccucaacug

SEQ ID NO: 1326928 - RNA, 19 nt, Homo sapiens
uuacugagcuagcccaaua

SEQ ID NO: 1326929 - RNA, 19 nt, Homo sapiens
ggacaaaggcuucaaagau

SEQ ID NO: 1326930 - RNA, 19 nt, Homo sapiens
acaaaggcuucaaagauua

SEQ ID NO: 1326931 - RNA, 19 nt, Homo sapiens
ggagaaacuucaacucaau

SEQ ID NO: 1326932 - RNA, 19 nt, Homo sapiens
gcaugaagaugucagauca

SEQ ID NO: 1326933 - RNA, 19 nt, Homo sapiens
gaagacagcucuacuaacc

SEQ ID NO: 1326934 - RNA, 19 nt, Homo sapiens
ucaagagauuucaguguua

SEQ ID NO: 1326935 - RNA, 19 nt, Homo sapiens
uaaagcaccugaaacguau

SEQ ID NO: 1326936 - RNA, 19 nt, Homo sapiens
gggaagaggauuacuuuaa

SEQ ID NO: 1326937 - RNA, 19 nt, Homo sapiens
caacugaguagcaauagua

SEQ ID NO: 1326938 - RNA, 19 nt, Homo sapiens
guaaacagcaugaggauau

SEQ ID NO: 1326939 - RNA, 19 nt, Homo sapiens
cgucagaacacauacauua

SEQ ID NO: 1326940 - RNA, 19 nt, Homo sapiens
ggagaggucugugccguuu

SEQ ID NO: 1326941 - RNA, 19 nt, Homo sapiens
gcuagacacugaaucaaga

SEQ ID NO: 1326942 - RNA, 19 nt, Homo sapiens
ucagauaaguccaaaugaa

SEQ ID NO: 1326943 - RNA, 19 nt, Homo sapiens
gggcagcuuuaucaaauuu

SEQ ID NO: 1326944 - RNA, 19 nt, Homo sapiens
caagaagguugcggucaua

SEQ ID NO: 1326945 - RNA, 19 nt, Homo sapiens
guacagagguauuaaugag

SEQ ID NO: 1326946 - RNA, 19 nt, Homo sapiens
gcugacaacuucuauuuua

SEQ ID NO: 1326947 - RNA, 19 nt, Homo sapiens
gaagaggauuacuuuaaag

SEQ ID NO: 1326948 - RNA, 19 nt, Homo sapiens
caacaucagcuaaauauag

SEQ ID NO: 1326949 - RNA, 19 nt, Homo sapiens
ggacugggauaauuguuca

SEQ ID NO: 1326950 - RNA, 19 nt, Homo sapiens
caaagcaacuguuagaaac

SEQ ID NO: 1326951 - RNA, 19 nt, Homo sapiens
gggcaaagguauucagcaa

SEQ ID NO: 1326952 - RNA, 19 nt, Homo sapiens
ggaauuguguucucaaagg

SEQ ID NO: 1326953 - RNA, 19 nt, Homo sapiens
ugaccaagcugcccucaug

SEQ ID NO: 1326954 - RNA, 19 nt, Homo sapiens
gcuaacggcuacuccugua

SEQ ID NO: 1326955 - RNA, 19 nt, Homo sapiens
gagcaacugaguagcaaua

SEQ ID NO: 1326956 - RNA, 19 nt, Homo sapiens
gagggaagaggauuacuuu

SEQ ID NO: 1326957 - RNA, 19 nt, Homo sapiens
ccaaaugcccuggauuaua

SEQ ID NO: 1326958 - RNA, 19 nt, Homo sapiens
gaagaugucagaucagcaa

SEQ ID NO: 1326959 - RNA, 19 nt, Homo sapiens
gggcaaaccuaggaagcua

SEQ ID NO: 1326960 - RNA, 19 nt, Homo sapiens
gcagcuauguagaaaugaa

SEQ ID NO: 1326961 - RNA, 19 nt, Homo sapiens
gggaagacagcucuacuaa

SEQ ID NO: 1326962 - RNA, 19 nt, Homo sapiens
uauccugcauguacaauaa

SEQ ID NO: 1326963 - RNA, 19 nt, Homo sapiens
gcaaggaugagcagcauga

SEQ ID NO: 1326964 - RNA, 19 nt, Homo sapiens
gcuuucaaguucuucauaa

SEQ ID NO: 1326965 - RNA, 19 nt, Homo sapiens
ggucaccacugcaaugaau

SEQ ID NO: 1326966 - RNA, 19 nt, Homo sapiens
uggaauggcuagacacuga

SEQ ID NO: 1326967 - RNA, 19 nt, Homo sapiens
gacguaguaugaaaccuaa

SEQ ID NO: 1326968 - RNA, 19 nt, Homo sapiens
guauucagaugugucuaua

SEQ ID NO: 1326969 - RNA, 19 nt, Homo sapiens
cagcuuaccucaguauuuc

SEQ ID NO: 1326970 - RNA, 19 nt, Homo sapiens
gcagcuuaccucaguauuu

SEQ ID NO: 1326971 - RNA, 19 nt, Homo sapiens
cagaagaggaacuaaauga

SEQ ID NO: 1326972 - RNA, 19 nt, Homo sapiens
uuaaagcaccugaaacgua

SEQ ID NO: 1326973 - RNA, 19 nt, Homo sapiens
ccagaaagcagcuauguag

SEQ ID NO: 1326974 - RNA, 19 nt, Homo sapiens
ucuaacaccaucacaaaua

SEQ ID NO: 1326975 - RNA, 19 nt, Homo sapiens
cacaauacuuugggcaaua

SEQ ID NO: 1326976 - RNA, 19 nt, Homo sapiens
ucaaaggaaucagguguga

SEQ ID NO: 1326977 - RNA, 19 nt, Homo sapiens
cagauaaguccaaaugaaa

SEQ ID NO: 1326978 - RNA, 19 nt, Homo sapiens
uagggcagcuuuaucaaau

SEQ ID NO: 1326979 - RNA, 19 nt, Homo sapiens
ccauauuccuggucauuau

SEQ ID NO: 1326980 - RNA, 19 nt, Homo sapiens
aagcagcuauguagaaaug

SEQ ID NO: 1326981 - RNA, 19 nt, Homo sapiens
gcucagauaaguccaaaug

SEQ ID NO: 1326982 - RNA, 19 nt, Homo sapiens
gaagucgccugugcacaug

SEQ ID NO: 1326983 - RNA, 19 nt, Homo sapiens
guaaccaguugcuguaaca

SEQ ID NO: 1326984 - RNA, 19 nt, Homo sapiens
cuaguuggccuccucauuu

SEQ ID NO: 1326985 - RNA, 19 nt, Homo sapiens
ugaauauucugacucugaa

SEQ ID NO: 1326986 - RNA, 19 nt, Homo sapiens
gggcugaacugcagugaac

SEQ ID NO: 1326987 - RNA, 19 nt, Homo sapiens
guagauggcuccuguaccu

SEQ ID NO: 1326988 - RNA, 19 nt, Homo sapiens
caacuauccucugggcaaa

SEQ ID NO: 1326989 - RNA, 19 nt, Homo sapiens
ccauggaacacaauacuuu

SEQ ID NO: 1326990 - RNA, 19 nt, Homo sapiens
ggaaguaugagaguucuga

SEQ ID NO: 1326991 - RNA, 19 nt, Homo sapiens
gaauacugcuacaggaagu

SEQ ID NO: 1326992 - RNA, 19 nt, Homo sapiens
acacacacguuuccaaagu

SEQ ID NO: 1326993 - RNA, 19 nt, Homo sapiens
gcauguuaguuauuacguu

SEQ ID NO: 1326994 - RNA, 19 nt, Homo sapiens
ucaacucaaucccagguuu

SEQ ID NO: 1326995 - RNA, 19 nt, Homo sapiens
gaugucagaucagcaagga

SEQ ID NO: 1326996 - RNA, 19 nt, Homo sapiens
acaauacuuugggcaauaa

SEQ ID NO: 1326997 - RNA, 19 nt, Homo sapiens
ugucugguccaucaaauua

SEQ ID NO: 1326998 - RNA, 19 nt, Homo sapiens
ggauagacgucagaacaca

SEQ ID NO: 1326999 - RNA, 19 nt, Homo sapiens
acaaagcaacuguuagaaa

SEQ ID NO: 1327000 - RNA, 19 nt, Homo sapiens
ucagaugugucuauaccuu

SEQ ID NO: 1327001 - RNA, 19 nt, Homo sapiens
ccuuccaccuucuaucuua

SEQ ID NO: 1327002 - RNA, 19 nt, Homo sapiens
acaggaaauuggacaaaug

SEQ ID NO: 1327003 - RNA, 19 nt, Homo sapiens
caacagccaagauuacaga

SEQ ID NO: 1327004 - RNA, 19 nt, Homo sapiens
caucaacaucagcuaaaua

SEQ ID NO: 1327005 - RNA, 19 nt, Homo sapiens
ggauaauuguucaaggaau

SEQ ID NO: 1327006 - RNA, 19 nt, Homo sapiens
ccaagaagguugcggucau

SEQ ID NO: 1327007 - RNA, 19 nt, Homo sapiens
gaaguugagcccacaguca

SEQ ID NO: 1327008 - RNA, 19 nt, Homo sapiens
uuacaaagcaacuguuaga

SEQ ID NO: 1327009 - RNA, 19 nt, Homo sapiens
cugcgaagcuggaauacug

SEQ ID NO: 1327010 - RNA, 19 nt, Homo sapiens
ugacugcgaagcuggaaua

SEQ ID NO: 1327011 - RNA, 19 nt, Homo sapiens
gaagaggaacuaaaugacu

SEQ ID NO: 1327012 - RNA, 19 nt, Homo sapiens
ugagauugacguaguauga

SEQ ID NO: 1327013 - RNA, 19 nt, Homo sapiens
gugagugccucccaggauu

SEQ ID NO: 1327014 - RNA, 19 nt, Homo sapiens
gccuaaacauguauacugu

SEQ ID NO: 1327015 - RNA, 19 nt, Homo sapiens
gcuuugucauaucuacuua

SEQ ID NO: 1327016 - RNA, 19 nt, Homo sapiens
ggaaacaacuuuauaagag

SEQ ID NO: 1327017 - RNA, 19 nt, Homo sapiens
gaacaggccuuagaaacaa

SEQ ID NO: 1327018 - RNA, 19 nt, Homo sapiens
ggucaggacucuacuguaa

SEQ ID NO: 1327019 - RNA, 19 nt, Homo sapiens
gugauuggcuuauaaauga

SEQ ID NO: 1327020 - RNA, 19 nt, Homo sapiens
gggaaucacugaacaugua

SEQ ID NO: 1327021 - RNA, 19 nt, Homo sapiens
ggagaggucuuguugagaa

SEQ ID NO: 1327022 - RNA, 19 nt, Homo sapiens
ggacagacuuugaauauac

SEQ ID NO: 1327023 - RNA, 19 nt, Homo sapiens
aaacaaggguaccacaaua

SEQ ID NO: 1327024 - RNA, 19 nt, Homo sapiens
ucaaguaacugcucccuaa

SEQ ID NO: 1327025 - RNA, 19 nt, Homo sapiens
gaacuugcccacaugauaa

SEQ ID NO: 1327026 - RNA, 19 nt, Homo sapiens
gaacuuugaacccauguua

SEQ ID NO: 1327027 - RNA, 19 nt, Homo sapiens
ccagauguaucgaauuuaa

SEQ ID NO: 1327028 - RNA, 19 nt, Homo sapiens
ggacacacauagcaauuug

SEQ ID NO: 1327029 - RNA, 19 nt, Homo sapiens
gaacuuaaaucuggacugu

SEQ ID NO: 1327030 - RNA, 19 nt, Homo sapiens
caacaggaaugucuaugaa

SEQ ID NO: 1327031 - RNA, 19 nt, Homo sapiens
guaguccacuuuaugcuua

SEQ ID NO: 1327032 - RNA, 19 nt, Homo sapiens
cauaugaccucccaaagaa

SEQ ID NO: 1327033 - RNA, 19 nt, Homo sapiens
gcacugacauucuaaacug

SEQ ID NO: 1327034 - RNA, 19 nt, Homo sapiens
gaaugaguguguaaugauu

SEQ ID NO: 1327035 - RNA, 19 nt, Homo sapiens
ucacaucccuugucauuau

SEQ ID NO: 1327036 - RNA, 19 nt, Homo sapiens
cuacuggcauuguucauua

SEQ ID NO: 1327037 - RNA, 19 nt, Homo sapiens
gagcugcacugacauucua

SEQ ID NO: 1327038 - RNA, 19 nt, Homo sapiens
caaagucaauucaaggaaa

SEQ ID NO: 1327039 - RNA, 19 nt, Homo sapiens
gugagucaguuaacaaaua

SEQ ID NO: 1327040 - RNA, 19 nt, Homo sapiens
cuucagagcugcaugguaa

SEQ ID NO: 1327041 - RNA, 19 nt, Homo sapiens
guaguaauguuaacagaga

SEQ ID NO: 1327042 - RNA, 19 nt, Homo sapiens
agacuuaucuugcaauaug

SEQ ID NO: 1327043 - RNA, 19 nt, Homo sapiens
uagccuacauugucauuua

SEQ ID NO: 1327044 - RNA, 19 nt, Homo sapiens
gaacagauuuugugucuug

SEQ ID NO: 1327045 - RNA, 19 nt, Homo sapiens
gaaacguuguuacugauga

SEQ ID NO: 1327046 - RNA, 19 nt, Homo sapiens
gaacccauaugccacuauu

SEQ ID NO: 1327047 - RNA, 19 nt, Homo sapiens
gaaugucuaugaaguugaa

SEQ ID NO: 1327048 - RNA, 19 nt, Homo sapiens
ccacugugcugauaaaugu

SEQ ID NO: 1327049 - RNA, 19 nt, Homo sapiens
ggacugcacugggacauug

SEQ ID NO: 1327050 - RNA, 19 nt, Homo sapiens
gagcagagaugcccuuguc

SEQ ID NO: 1327051 - RNA, 19 nt, Homo sapiens
ggacuugacagaagcuaua

SEQ ID NO: 1327052 - RNA, 19 nt, Homo sapiens
gcacugauaugccaauguc

SEQ ID NO: 1327053 - RNA, 19 nt, Homo sapiens
gagauguccucuaggguuu

SEQ ID NO: 1327054 - RNA, 19 nt, Homo sapiens
gagcagggcaccuauggua

SEQ ID NO: 1327055 - RNA, 19 nt, Homo sapiens
uaauugcuguccuaugaua

SEQ ID NO: 1327056 - RNA, 19 nt, Homo sapiens
acaguggucuucaaucuuu

SEQ ID NO: 1327057 - RNA, 19 nt, Homo sapiens
gagaaacaguggucuucaa

SEQ ID NO: 1327058 - RNA, 19 nt, Homo sapiens
cuucagaucuaugacauua

SEQ ID NO: 1327059 - RNA, 19 nt, Homo sapiens
gaagcaagcggauuucaga

SEQ ID NO: 1327060 - RNA, 19 nt, Homo sapiens
gacaugaaauccuauaugg

SEQ ID NO: 1327061 - RNA, 19 nt, Homo sapiens
ggacucuacuguaaugaga

SEQ ID NO: 1327062 - RNA, 19 nt, Homo sapiens
gauaacucauguuugcuuu

SEQ ID NO: 1327063 - RNA, 19 nt, Homo sapiens
acaagugauuggcuuauaa

SEQ ID NO: 1327064 - RNA, 19 nt, Homo sapiens
gaaguugaaccuacaguga

SEQ ID NO: 1327065 - RNA, 19 nt, Homo sapiens
ggucagguguccacuguga

SEQ ID NO: 1327066 - RNA, 19 nt, Homo sapiens
gguaacgacugucaucaga

SEQ ID NO: 1327067 - RNA, 19 nt, Homo sapiens
ucagagagguuguucuuca

SEQ ID NO: 1327068 - RNA, 19 nt, Homo sapiens
ugacugaauugcaaucuau

SEQ ID NO: 1327069 - RNA, 19 nt, Homo sapiens
ggcaacaugucuuuauuau

SEQ ID NO: 1327070 - RNA, 19 nt, Homo sapiens
caaaggcaacagcaacuua

SEQ ID NO: 1327071 - RNA, 19 nt, Homo sapiens
gaagcaugacuuauuguaa

SEQ ID NO: 1327072 - RNA, 19 nt, Homo sapiens
gagaaaugcaaacaacuuu

SEQ ID NO: 1327073 - RNA, 19 nt, Homo sapiens
gaagacaaggaacauauug

SEQ ID NO: 1327074 - RNA, 19 nt, Homo sapiens
uaacgacugucaucagaga

SEQ ID NO: 1327075 - RNA, 19 nt, Homo sapiens
uaaccugacugaaccaaau

SEQ ID NO: 1327076 - RNA, 19 nt, Homo sapiens
agacaugugugagucaaua

SEQ ID NO: 1327077 - RNA, 19 nt, Homo sapiens
ggaacaggccuuagaaaca

SEQ ID NO: 1327078 - RNA, 19 nt, Homo sapiens
ugagaaugcugacacaaug

SEQ ID NO: 1327079 - RNA, 19 nt, Homo sapiens
caacuggacucagaauugu

SEQ ID NO: 1327080 - RNA, 19 nt, Homo sapiens
ggugauaggcaucuaauug

SEQ ID NO: 1327081 - RNA, 19 nt, Homo sapiens
ucaaccaacuucagaucua

SEQ ID NO: 1327082 - RNA, 19 nt, Homo sapiens
gaaccuacagugaguguug

SEQ ID NO: 1327083 - RNA, 19 nt, Homo sapiens
ucaacgagcucggugcuuu

SEQ ID NO: 1327084 - RNA, 19 nt, Homo sapiens
ucaagcugguguuaucaua

SEQ ID NO: 1327085 - RNA, 19 nt, Homo sapiens
ugggaaagcuacucaguga

SEQ ID NO: 1327086 - RNA, 19 nt, Homo sapiens
caucaccucugaaucuuga

SEQ ID NO: 1327087 - RNA, 19 nt, Homo sapiens
cauaugcaagugugaauua

SEQ ID NO: 1327088 - RNA, 19 nt, Homo sapiens
caucagaacuugcccacau

SEQ ID NO: 1327089 - RNA, 19 nt, Homo sapiens
uagcugauguccugaaaug

SEQ ID NO: 1327090 - RNA, 19 nt, Homo sapiens
guaaaucacuccaguuagc

SEQ ID NO: 1327091 - RNA, 19 nt, Homo sapiens
ucaaggaaauaaggaauga

SEQ ID NO: 1327092 - RNA, 19 nt, Homo sapiens
ggucgucaaugcagauuau

SEQ ID NO: 1327093 - RNA, 19 nt, Homo sapiens
ccagacuuaucuugcaaua

SEQ ID NO: 1327094 - RNA, 19 nt, Homo sapiens
aaggaaacguuguuacuga

SEQ ID NO: 1327095 - RNA, 19 nt, Homo sapiens
gggacaagaugaaaauaua

SEQ ID NO: 1327096 - RNA, 19 nt, Homo sapiens
gcagaagucaauacacaaa

SEQ ID NO: 1327097 - RNA, 19 nt, Homo sapiens
ugacugcucucaaccaugu

SEQ ID NO: 1327098 - RNA, 19 nt, Homo sapiens
gaaugccagugccauaaug

SEQ ID NO: 1327099 - RNA, 19 nt, Homo sapiens
gaaaguguggucaucuuga

SEQ ID NO: 1327100 - RNA, 19 nt, Homo sapiens
ccucugaaauuacaaacuu

SEQ ID NO: 1327101 - RNA, 19 nt, Homo sapiens
aaacaguggucuucaaucu

SEQ ID NO: 1327102 - RNA, 19 nt, Homo sapiens
gaaaggaaacguuguuacu

SEQ ID NO: 1327103 - RNA, 19 nt, Homo sapiens
guguuuggauuguuaauga

SEQ ID NO: 1327104 - RNA, 19 nt, Homo sapiens
gagaaacuaugcuuaagcu

SEQ ID NO: 1327105 - RNA, 19 nt, Homo sapiens
ugccugagcuuuauuuguu

SEQ ID NO: 1327106 - RNA, 19 nt, Homo sapiens
ugaauuacgugguauggau

SEQ ID NO: 1327107 - RNA, 19 nt, Homo sapiens
gcgcugcgauucucaagau

SEQ ID NO: 1327108 - RNA, 19 nt, Homo sapiens
uguaguguuuggauuguua

SEQ ID NO: 1327109 - RNA, 19 nt, Homo sapiens
ugauuaaucuuucccuaga

SEQ ID NO: 1327110 - RNA, 19 nt, Homo sapiens
uaaaagaccugggaaagaa

SEQ ID NO: 1327111 - RNA, 19 nt, Homo sapiens
caucaucauucuuguccua

SEQ ID NO: 1327112 - RNA, 19 nt, Homo sapiens
ggcuuuggcuguaacuuaa

SEQ ID NO: 1327113 - RNA, 19 nt, Homo sapiens
gggcuuuggcuguaacuua

SEQ ID NO: 1327114 - RNA, 19 nt, Homo sapiens
gcagaaaggaaacguuguu

SEQ ID NO: 1327115 - RNA, 19 nt, Homo sapiens
ccacuuaucuuuugcuuga

SEQ ID NO: 1327116 - RNA, 19 nt, Homo sapiens
gaacggaacugcacagaua

SEQ ID NO: 1327117 - RNA, 19 nt, Homo sapiens
gcaaagaccuggacgaaug

SEQ ID NO: 1327118 - RNA, 19 nt, Homo sapiens
gcaaagaugucgacgaaug

SEQ ID NO: 1327119 - RNA, 19 nt, Homo sapiens
ggcaacaacugcauggaua

SEQ ID NO: 1327120 - RNA, 19 nt, Homo sapiens
gcuacuaccugccuggaua

SEQ ID NO: 1327121 - RNA, 19 nt, Homo sapiens
gugaagaugugaaugaaug

SEQ ID NO: 1327122 - RNA, 19 nt, Homo sapiens
gcacagaugacaaugaaug

SEQ ID NO: 1327123 - RNA, 19 nt, Homo sapiens
ggagaaugcuuuuauauca

SEQ ID NO: 1327124 - RNA, 19 nt, Homo sapiens
caagggacaugcaccaaug

SEQ ID NO: 1327125 - RNA, 19 nt, Homo sapiens
gcucugauguggaugaaug

SEQ ID NO: 1327126 - RNA, 19 nt, Homo sapiens
ggacuucacuggcaucaac

SEQ ID NO: 1327127 - RNA, 19 nt, Homo sapiens
gaaaugggaccugcaagaa

SEQ ID NO: 1327128 - RNA, 19 nt, Homo sapiens
caacaccacugaguacaga

SEQ ID NO: 1327129 - RNA, 19 nt, Homo sapiens
gggccgagauguagaugaa

SEQ ID NO: 1327130 - RNA, 19 nt, Homo sapiens
ccagggaguuucagcugua

SEQ ID NO: 1327131 - RNA, 19 nt, Homo sapiens
ggaaaugggaccugcaaga

SEQ ID NO: 1327132 - RNA, 19 nt, Homo sapiens
gcgaggacaucgacgaaug

SEQ ID NO: 1327133 - RNA, 19 nt, Homo sapiens
ccuggcaacucuaauauug

SEQ ID NO: 1327134 - RNA, 19 nt, Homo sapiens
gugaggauauugacgaaug

SEQ ID NO: 1327135 - RNA, 19 nt, Homo sapiens
gacgugcacuguauuaaca

SEQ ID NO: 1327136 - RNA, 19 nt, Homo sapiens
ggugugacgugcacuguau

SEQ ID NO: 1327137 - RNA, 19 nt, Homo sapiens
cugcaaagaugucgacgaa

SEQ ID NO: 1327138 - RNA, 19 nt, Homo sapiens
acacggagaucugcaaaga

SEQ ID NO: 1327139 - RNA, 19 nt, Homo sapiens
cagaguaccuccaagucaa

SEQ ID NO: 1327140 - RNA, 19 nt, Homo sapiens
cacagugacuugccacauu

SEQ ID NO: 1327141 - RNA, 19 nt, Homo sapiens
caggaagagugaaaugcua

SEQ ID NO: 1327142 - RNA, 19 nt, Homo sapiens
acagugacuugccacauuu

SEQ ID NO: 1327143 - RNA, 19 nt, Homo sapiens
gcagugggcuuggcauuac

SEQ ID NO: 1327144 - RNA, 19 nt, Homo sapiens
ggaggcagcugcgucaaca

SEQ ID NO: 1327145 - RNA, 19 nt, Homo sapiens
ggccauggcugugaagaug

SEQ ID NO: 1327146 - RNA, 19 nt, Homo sapiens
ccaauggcaucugcauaaa

SEQ ID NO: 1327147 - RNA, 19 nt, Homo sapiens
gggaaccucugugcauuug

SEQ ID NO: 1327148 - RNA, 19 nt, Homo sapiens
ggacgagugugaagagaac

SEQ ID NO: 1327149 - RNA, 19 nt, Homo sapiens
gaaacacggugggcagcuu

SEQ ID NO: 1327150 - RNA, 19 nt, Homo sapiens
caacgagugugcucuggau

SEQ ID NO: 1327151 - RNA, 19 nt, Homo sapiens
gugcauugauguagacgaa

SEQ ID NO: 1327152 - RNA, 19 nt, Homo sapiens
gaacugggaaggacugauc

SEQ ID NO: 1327153 - RNA, 19 nt, Homo sapiens
guagaugaaugccguaugc

SEQ ID NO: 1327154 - RNA, 19 nt, Homo sapiens
gugagaaccugccuggaau

SEQ ID NO: 1327155 - RNA, 19 nt, Homo sapiens
agugugagcuguaugaaug

SEQ ID NO: 1327156 - RNA, 19 nt, Homo sapiens
ggacgagugugcagauggu

SEQ ID NO: 1327157 - RNA, 19 nt, Homo sapiens
ucacaucccuccaguccau

SEQ ID NO: 1327158 - RNA, 19 nt, Homo sapiens
ggagacgauaauaaaguua

SEQ ID NO: 1327159 - RNA, 19 nt, Homo sapiens
cugcacagaugacaaugaa

SEQ ID NO: 1327160 - RNA, 19 nt, Homo sapiens
aaaaugagcuggccuucaa

SEQ ID NO: 1327161 - RNA, 19 nt, Homo sapiens
gcagaguaccuccaaguca

SEQ ID NO: 1327162 - RNA, 19 nt, Homo sapiens
gcgagugcauugauguaga

SEQ ID NO: 1327163 - RNA, 19 nt, Homo sapiens
gccuuccgcugccacaaua

SEQ ID NO: 1327164 - RNA, 19 nt, Homo sapiens
caucggaggcuucgaaugu

SEQ ID NO: 1327165 - RNA, 19 nt, Homo sapiens
ucacuggcaucaacugugu

SEQ ID NO: 1327166 - RNA, 19 nt, Homo sapiens
ggaagccccuugacauuga

SEQ ID NO: 1327167 - RNA, 19 nt, Homo sapiens
caacacguuuggcaguuuc

SEQ ID NO: 1327168 - RNA, 19 nt, Homo sapiens
agaggugacugucucaaug

SEQ ID NO: 1327169 - RNA, 19 nt, Homo sapiens
caacacugcugggucuuuc

SEQ ID NO: 1327170 - RNA, 19 nt, Homo sapiens
uggagacgauaauaaaguu

SEQ ID NO: 1327171 - RNA, 19 nt, Homo sapiens
gugaaaugcuacacgacaa

SEQ ID NO: 1327172 - RNA, 19 nt, Homo sapiens
gcacuaacggcgucugugu

SEQ ID NO: 1327173 - RNA, 19 nt, Homo sapiens
aaaguggagacgauaauaa

SEQ ID NO: 1327174 - RNA, 19 nt, Homo sapiens
gcugugaagaugugaauga

SEQ ID NO: 1327175 - RNA, 19 nt, Homo sapiens
gaaugagugugcagagaac

SEQ ID NO: 1327176 - RNA, 19 nt, Homo sapiens
gccacaggcugcucugaug

SEQ ID NO: 1327177 - RNA, 19 nt, Homo sapiens
cacgguaccugcagaaaca

SEQ ID NO: 1327178 - RNA, 19 nt, Homo sapiens
gaugugagauuggaaccau

SEQ ID NO: 1327179 - RNA, 19 nt, Homo sapiens
gaaccagaccauugacauc

SEQ ID NO: 1327180 - RNA, 19 nt, Homo sapiens
ggcccagacuccacaguga

SEQ ID NO: 1327181 - RNA, 19 nt, Homo sapiens
gggcuuauuccucggagua

SEQ ID NO: 1327182 - RNA, 19 nt, Homo sapiens
gccgagauguagaugaaug

SEQ ID NO: 1327183 - RNA, 19 nt, Homo sapiens
gcucggugcccaaagcuuu

SEQ ID NO: 1327184 - RNA, 19 nt, Homo sapiens
gcauccugcuggcuuguga

SEQ ID NO: 1327185 - RNA, 19 nt, Homo sapiens
ggaugaaugugccgagaac

SEQ ID NO: 1327186 - RNA, 19 nt, Homo sapiens
caaggccacugcaccaaca

SEQ ID NO: 1327187 - RNA, 19 nt, Homo sapiens
uauaacggcacaugucaaa

SEQ ID NO: 1327188 - RNA, 19 nt, Homo sapiens
gguggcaacugcacagaca

SEQ ID NO: 1327189 - RNA, 19 nt, Homo sapiens
gcguggacaucaacgaaug

SEQ ID NO: 1327190 - RNA, 19 nt, Homo sapiens
cuacgagaguggcuucaug

SEQ ID NO: 1327191 - RNA, 19 nt, Homo sapiens
ggacaccggcucagugaca

SEQ ID NO: 1327192 - RNA, 19 nt, Homo sapiens
ggccuuccaugugaacuuu

SEQ ID NO: 1327193 - RNA, 19 nt, Homo sapiens
gcaagggacaugcaccaau

SEQ ID NO: 1327194 - RNA, 19 nt, Homo sapiens
gcaacaacugcauggauau

SEQ ID NO: 1327195 - RNA, 19 nt, Homo sapiens
ucaacacguuuggcaguuu

SEQ ID NO: 1327196 - RNA, 19 nt, Homo sapiens
ucacugucauucuggaaga

SEQ ID NO: 1327197 - RNA, 19 nt, Homo sapiens
gcgaagacagggaugaaug

SEQ ID NO: 1327198 - RNA, 19 nt, Homo sapiens
cgaccauucuauaaagaug

SEQ ID NO: 1327199 - RNA, 19 nt, Homo sapiens
gugcguggaugugagauug

SEQ ID NO: 1327200 - RNA, 19 nt, Homo sapiens
ucugguaccuucugucuag

SEQ ID NO: 1327201 - RNA, 19 nt, Homo sapiens
ccaaugaauuccagcaacu

SEQ ID NO: 1327202 - RNA, 19 nt, Homo sapiens
uaccagauccuguguggaa

SEQ ID NO: 1327203 - RNA, 19 nt, Homo sapiens
ccgcaucacugucauucug

SEQ ID NO: 1327204 - RNA, 19 nt, Homo sapiens
aaugugagaugggcuuuga

SEQ ID NO: 1327205 - RNA, 19 nt, Homo sapiens
gucacgaccuggaugaaug

SEQ ID NO: 1327206 - RNA, 19 nt, Homo sapiens
gggauggcuucgaauguca

SEQ ID NO: 1327207 - RNA, 19 nt, Homo sapiens
ggaggcacuugcaccaaca

SEQ ID NO: 1327208 - RNA, 19 nt, Homo sapiens
ucaccaaccugugucugaa

SEQ ID NO: 1327209 - RNA, 19 nt, Homo sapiens
ggagaucccgaaugucugu

SEQ ID NO: 1327210 - RNA, 19 nt, Homo sapiens
gcauggauaugaggaagag

SEQ ID NO: 1327211 - RNA, 19 nt, Homo sapiens
ggccgaccauucuauaaag

SEQ ID NO: 1327212 - RNA, 19 nt, Homo sapiens
ggacacggagaucugcaaa

SEQ ID NO: 1327213 - RNA, 19 nt, Homo sapiens
cauugccgcuguccaguug

SEQ ID NO: 1327214 - RNA, 19 nt, Homo sapiens
agcgauggcugaccagauu

SEQ ID NO: 1327215 - RNA, 19 nt, Homo sapiens
ggccaugugucgagaugug

SEQ ID NO: 1327216 - RNA, 19 nt, Homo sapiens
ggaaguaccugcccacaua

SEQ ID NO: 1327217 - RNA, 19 nt, Homo sapiens
ggaagcagauuaugaggua

SEQ ID NO: 1327218 - RNA, 19 nt, Homo sapiens
gaaagaguauggagagaaa

SEQ ID NO: 1327219 - RNA, 19 nt, Homo sapiens
guacaaacccugaaauuaa

SEQ ID NO: 1327220 - RNA, 19 nt, Homo sapiens
ggaauggcaucauaucuuu

SEQ ID NO: 1327221 - RNA, 19 nt, Homo sapiens
ggaagacacugauuaccua

SEQ ID NO: 1327222 - RNA, 19 nt, Homo sapiens
gaaccaagagccagaaaua

SEQ ID NO: 1327223 - RNA, 19 nt, Homo sapiens
gcaagaaguucccauguau

SEQ ID NO: 1327224 - RNA, 19 nt, Homo sapiens
gcaagaaguucccauguau

SEQ ID NO: 1327225 - RNA, 19 nt, Homo sapiens
gcaagaaguucccauguau

SEQ ID NO: 1327226 - RNA, 19 nt, Homo sapiens
gcaagaaguucccauguau

SEQ ID NO: 1327227 - RNA, 19 nt, Homo sapiens
gcaagaaguucccauguau

SEQ ID NO: 1327228 - RNA, 19 nt, Homo sapiens
gaucucggcucaccaaauu

SEQ ID NO: 1327229 - RNA, 19 nt, Homo sapiens
caagaagacuccaugugua

SEQ ID NO: 1327230 - RNA, 19 nt, Homo sapiens
gcuagaagcucucaugugu

SEQ ID NO: 1327231 - RNA, 19 nt, Homo sapiens
gcaagaaguucccaugugu

SEQ ID NO: 1327232 - RNA, 19 nt, Homo sapiens
gcaagaaguucccacaugu

SEQ ID NO: 1327233 - RNA, 19 nt, Homo sapiens
gcaagaaguucccaugugu

SEQ ID NO: 1327234 - RNA, 19 nt, Homo sapiens
gcaagaaguucccaugugu

SEQ ID NO: 1327235 - RNA, 19 nt, Homo sapiens
gaaguaaagcaacaaguaa

SEQ ID NO: 1327236 - RNA, 19 nt, Homo sapiens
ggacagacccugaaucuag

SEQ ID NO: 1327237 - RNA, 19 nt, Homo sapiens
gaccauauaucgaaaguuc

SEQ ID NO: 1327238 - RNA, 19 nt, Homo sapiens
gaagacgagugauuucaug

SEQ ID NO: 1327239 - RNA, 19 nt, Homo sapiens
caaguaauauccacgaguu

SEQ ID NO: 1327240 - RNA, 19 nt, Homo sapiens
uagcaacacuagauuauga

SEQ ID NO: 1327241 - RNA, 19 nt, Homo sapiens
ggcaagaaguucccaugua

SEQ ID NO: 1327242 - RNA, 19 nt, Homo sapiens
ggcaagaaguucccaugua

SEQ ID NO: 1327243 - RNA, 19 nt, Homo sapiens
ggcaagaaguucccaugua

SEQ ID NO: 1327244 - RNA, 19 nt, Homo sapiens
ggcaagaaguucccaugua

SEQ ID NO: 1327245 - RNA, 19 nt, Homo sapiens
ggcaagaaguucccaugua

SEQ ID NO: 1327246 - RNA, 19 nt, Homo sapiens
gcaacacccuagaagauga

SEQ ID NO: 1327247 - RNA, 19 nt, Homo sapiens
guacagauccuauauccaa

SEQ ID NO: 1327248 - RNA, 19 nt, Homo sapiens
uaugaugccuagcuaauuu

SEQ ID NO: 1327249 - RNA, 19 nt, Homo sapiens
gcaagaagacuccaugugu

SEQ ID NO: 1327250 - RNA, 19 nt, Homo sapiens
gaaucuaggcaagaaauua

SEQ ID NO: 1327251 - RNA, 19 nt, Homo sapiens
auaaaggaauggcaucaua

SEQ ID NO: 1327252 - RNA, 19 nt, Homo sapiens
gcauaacugucuugggauu

SEQ ID NO: 1327253 - RNA, 19 nt, Homo sapiens
gcgagaaguucccguguau

SEQ ID NO: 1327254 - RNA, 19 nt, Homo sapiens
gggcauguuugaaagcuuu

SEQ ID NO: 1327255 - RNA, 19 nt, Homo sapiens
gagcagccaggcagaaaua

SEQ ID NO: 1327256 - RNA, 19 nt, Homo sapiens
gaagacagggcuccagcua

SEQ ID NO: 1327257 - RNA, 19 nt, Homo sapiens
gggaacgccuaguuugaaa

SEQ ID NO: 1327258 - RNA, 19 nt, Homo sapiens
agaaguacuugcaaucuga

SEQ ID NO: 1327259 - RNA, 19 nt, Homo sapiens
ugaaguaaagcaacaagua

SEQ ID NO: 1327260 - RNA, 19 nt, Homo sapiens
ggcaagaaguucccacaug

SEQ ID NO: 1327261 - RNA, 19 nt, Homo sapiens
gguuaucuccuguuauuaa

SEQ ID NO: 1327262 - RNA, 19 nt, Homo sapiens
uaaaugggaaucuguugua

SEQ ID NO: 1327263 - RNA, 19 nt, Homo sapiens
aaagcuaccugguguacaa

SEQ ID NO: 1327264 - RNA, 19 nt, Homo sapiens
ggcaagaaauuauguguac

SEQ ID NO: 1327265 - RNA, 19 nt, Homo sapiens
gcgagaaguucccaugugu

SEQ ID NO: 1327266 - RNA, 19 nt, Homo sapiens
uauuauggcugaaccaaga

SEQ ID NO: 1327267 - RNA, 19 nt, Homo sapiens
gagauugaaugcagcaaca

SEQ ID NO: 1327268 - RNA, 19 nt, Homo sapiens
ccagagggcauguuugaaa

SEQ ID NO: 1327269 - RNA, 19 nt, Homo sapiens
ccucgcagcuuguaaaucu

SEQ ID NO: 1327270 - RNA, 19 nt, Homo sapiens
caugagcaguggagagauu

SEQ ID NO: 1327271 - RNA, 19 nt, Homo sapiens
acacugaaaucuuaaaggu

SEQ ID NO: 1327272 - RNA, 19 nt, Homo sapiens
caagaaguucccauguaua

SEQ ID NO: 1327273 - RNA, 19 nt, Homo sapiens
caagaaguucccauguaua

SEQ ID NO: 1327274 - RNA, 19 nt, Homo sapiens
caagaaguucccauguaua

SEQ ID NO: 1327275 - RNA, 19 nt, Homo sapiens
caagaaguucccauguaua

SEQ ID NO: 1327276 - RNA, 19 nt, Homo sapiens
caagaaguucccauguaua

SEQ ID NO: 1327277 - RNA, 19 nt, Homo sapiens
gcagacaguaugagcauga

SEQ ID NO: 1327278 - RNA, 19 nt, Homo sapiens
uagaagcucucauguguac

SEQ ID NO: 1327279 - RNA, 19 nt, Homo sapiens
ggcaagaaguucccaugug

SEQ ID NO: 1327280 - RNA, 19 nt, Homo sapiens
ggcaagaaguucccaugug

SEQ ID NO: 1327281 - RNA, 19 nt, Homo sapiens
ggcgagaaguucccgugua

SEQ ID NO: 1327282 - RNA, 19 nt, Homo sapiens
ggcaagaaguucccaugug

SEQ ID NO: 1327283 - RNA, 19 nt, Homo sapiens
caucagaaguacuugcaau

SEQ ID NO: 1327284 - RNA, 19 nt, Homo sapiens
ggauuugcaugcguuuauu

SEQ ID NO: 1327285 - RNA, 19 nt, Homo sapiens
uauauaugaugccuagcua

SEQ ID NO: 1327286 - RNA, 19 nt, Homo sapiens
gagcaugaccaguggagaa

SEQ ID NO: 1327287 - RNA, 19 nt, Homo sapiens
gagaaguucccauguguuc

SEQ ID NO: 1327288 - RNA, 19 nt, Homo sapiens
caagaaguucccacaugua

SEQ ID NO: 1327289 - RNA, 19 nt, Homo sapiens
ugucucagauauugguaua

SEQ ID NO: 1327290 - RNA, 19 nt, Homo sapiens
ccagccaggccuucauuua

SEQ ID NO: 1327291 - RNA, 19 nt, Homo sapiens
uguacaaacccugaaauua

SEQ ID NO: 1327292 - RNA, 19 nt, Homo sapiens
gcaaggauuugugggaagu

SEQ ID NO: 1327293 - RNA, 19 nt, Homo sapiens
ggacaaacaaguaauaucc

SEQ ID NO: 1327294 - RNA, 19 nt, Homo sapiens
gcaggaagcagauuaugag

SEQ ID NO: 1327295 - RNA, 19 nt, Homo sapiens
gcgggucuacucacucuua

SEQ ID NO: 1327296 - RNA, 19 nt, Homo sapiens
gaagcucucauguguacaa

SEQ ID NO: 1327297 - RNA, 19 nt, Homo sapiens
gaagaaguucccauguguu

SEQ ID NO: 1327298 - RNA, 19 nt, Homo sapiens
gaagacacugauuaccuaa

SEQ ID NO: 1327299 - RNA, 19 nt, Homo sapiens
ggaggacugucaagauguc

SEQ ID NO: 1327300 - RNA, 19 nt, Homo sapiens
aacgaaggcucaagaacaa

SEQ ID NO: 1327301 - RNA, 19 nt, Homo sapiens
aaacgaaggcucaagaaca

SEQ ID NO: 1327302 - RNA, 19 nt, Homo sapiens
gguauacuccagaaucuug

SEQ ID NO: 1327303 - RNA, 19 nt, Homo sapiens
guacacacgcugaaaucaa

SEQ ID NO: 1327304 - RNA, 19 nt, Homo sapiens
guacaggccaugaauccaa

SEQ ID NO: 1327305 - RNA, 19 nt, Homo sapiens
gagaaguucccguguauac

SEQ ID NO: 1327306 - RNA, 19 nt, Homo sapiens
gggguuaucuccuguuauu

SEQ ID NO: 1327307 - RNA, 19 nt, Homo sapiens
uagaacacaucacguccaa

SEQ ID NO: 1327308 - RNA, 19 nt, Homo sapiens
uuugaaagcuuuagguaca

SEQ ID NO: 1327309 - RNA, 19 nt, Homo sapiens
acacacuccuagccuguuu

SEQ ID NO: 1327310 - RNA, 19 nt, Homo sapiens
gcaccugccuagcugucaa

SEQ ID NO: 1327311 - RNA, 19 nt, Homo sapiens
aaaauuaccuguagcaaca

SEQ ID NO: 1327312 - RNA, 19 nt, Homo sapiens
ugagagguuugcaaggauu

SEQ ID NO: 1327313 - RNA, 19 nt, Homo sapiens
caagaaguucccaugugua

SEQ ID NO: 1327314 - RNA, 19 nt, Homo sapiens
caagaaguucccaugugua

SEQ ID NO: 1327315 - RNA, 19 nt, Homo sapiens
uaaaggaauggcaucauau

SEQ ID NO: 1327316 - RNA, 19 nt, Homo sapiens
gaaagcaaccugacaauga

SEQ ID NO: 1327317 - RNA, 19 nt, Homo sapiens
gcauuucucucuccacugu

SEQ ID NO: 1327318 - RNA, 19 nt, Homo sapiens
gaaaaugggcagaugaaua

SEQ ID NO: 1327319 - RNA, 19 nt, Homo sapiens
auaaggacguggugaauga

SEQ ID NO: 1327320 - RNA, 19 nt, Homo sapiens
caagaaggcagacacaaga

SEQ ID NO: 1327321 - RNA, 19 nt, Homo sapiens
gcagaugaauagcaauaag

SEQ ID NO: 1327322 - RNA, 19 nt, Homo sapiens
ccaagccgauguuuguuau

SEQ ID NO: 1327323 - RNA, 19 nt, Homo sapiens
gcaauaaguggaccuuugu

SEQ ID NO: 1327324 - RNA, 19 nt, Homo sapiens
gggcagaugaauagcaaua

SEQ ID NO: 1327325 - RNA, 19 nt, Homo sapiens
ccaccaagccgauguuugu

SEQ ID NO: 1327326 - RNA, 19 nt, Homo sapiens
aaagcaaccugacaaugau

SEQ ID NO: 1327327 - RNA, 19 nt, Homo sapiens
caguggacauucuuccuuu

SEQ ID NO: 1327328 - RNA, 19 nt, Homo sapiens
gcuagcccauucugacuug

SEQ ID NO: 1327329 - RNA, 19 nt, Homo sapiens
gaucuuccuggccaaauuu

SEQ ID NO: 1327330 - RNA, 19 nt, Homo sapiens
ugaauggcgucuuuaccaa

SEQ ID NO: 1327331 - RNA, 19 nt, Homo sapiens
caaccugacaaugauaaua

SEQ ID NO: 1327332 - RNA, 19 nt, Homo sapiens
ggacauucuuccuuugcau

SEQ ID NO: 1327333 - RNA, 19 nt, Homo sapiens
uuaguacacucugaacaaa

SEQ ID NO: 1327334 - RNA, 19 nt, Homo sapiens
aauaaguggaccuuuguua

SEQ ID NO: 1327335 - RNA, 19 nt, Homo sapiens
gcacaugugacuacaagca

SEQ ID NO: 1327336 - RNA, 19 nt, Homo sapiens
ggaggccacgcccagauuu

SEQ ID NO: 1327337 - RNA, 19 nt, Homo sapiens
gauaaggacguggugaaug

SEQ ID NO: 1327338 - RNA, 19 nt, Homo sapiens
cauucugacuugaugugua

SEQ ID NO: 1327339 - RNA, 19 nt, Homo sapiens
aagccgauguuuguuauug

SEQ ID NO: 1327340 - RNA, 19 nt, Homo sapiens
agcaauaaguggaccuuug

SEQ ID NO: 1327341 - RNA, 19 nt, Homo sapiens
gagguucugugccuuucug

SEQ ID NO: 1327342 - RNA, 19 nt, Homo sapiens
gcacugucccgcacaugug

SEQ ID NO: 1327343 - RNA, 19 nt, Homo sapiens
gggauaaggacguggugaa

SEQ ID NO: 1327344 - RNA, 19 nt, Homo sapiens
ugaucuuccuggccaaauu

SEQ ID NO: 1327345 - RNA, 19 nt, Homo sapiens
cgauguuuguuauugcauu

SEQ ID NO: 1327346 - RNA, 19 nt, Homo sapiens
cggaggagauguggcucua

SEQ ID NO: 1327347 - RNA, 19 nt, Homo sapiens
uugauuugguguucagaaa

SEQ ID NO: 1327348 - RNA, 19 nt, Homo sapiens
ggaccuuuguuacucuucu

SEQ ID NO: 1327349 - RNA, 19 nt, Homo sapiens
ccgcacaugugacuacaag

SEQ ID NO: 1327350 - RNA, 19 nt, Homo sapiens
ggauaaggacguggugaau

SEQ ID NO: 1327351 - RNA, 19 nt, Homo sapiens
cagggaaguuacacugcuu

SEQ ID NO: 1327352 - RNA, 19 nt, Homo sapiens
cgucuuuaccaacacaaua

SEQ ID NO: 1327353 - RNA, 19 nt, Homo sapiens
guucugugccuuucuguca

SEQ ID NO: 1327354 - RNA, 19 nt, Homo sapiens
gcucugaauggcgucuuua

SEQ ID NO: 1327355 - RNA, 19 nt, Homo sapiens
gauuugguguucagaaagc

SEQ ID NO: 1327356 - RNA, 19 nt, Homo sapiens
gacauucuuccuuugcauu

SEQ ID NO: 1327357 - RNA, 19 nt, Homo sapiens
ucaagaaggcagacacaag

SEQ ID NO: 1327358 - RNA, 19 nt, Homo sapiens
cacaagagacagcagacaa

SEQ ID NO: 1327359 - RNA, 19 nt, Homo sapiens
uaaguggaccuuuguuacu

SEQ ID NO: 1327360 - RNA, 19 nt, Homo sapiens
gugaaugagggccgaaaga

SEQ ID NO: 1327361 - RNA, 19 nt, Homo sapiens
acacucugaacaaagcuua

SEQ ID NO: 1327362 - RNA, 19 nt, Homo sapiens
gucuuuaccaacacaauaa

SEQ ID NO: 1327363 - RNA, 19 nt, Homo sapiens
cagaaagcaaccugacaau

SEQ ID NO: 1327364 - RNA, 19 nt, Homo sapiens
ggcucugaauggcgucuuu

SEQ ID NO: 1327365 - RNA, 19 nt, Homo sapiens
cagaugaauagcaauaagu

SEQ ID NO: 1327366 - RNA, 19 nt, Homo sapiens
ggcagaugaauagcaauaa

SEQ ID NO: 1327367 - RNA, 19 nt, Homo sapiens
ccaguggacauucuuccuu

SEQ ID NO: 1327368 - RNA, 19 nt, Homo sapiens
acguggaggcggaguauuu

SEQ ID NO: 1327369 - RNA, 19 nt, Homo sapiens
caauaaguggaccuuuguu

SEQ ID NO: 1327370 - RNA, 19 nt, Homo sapiens
aaaaugggcagaugaauag

SEQ ID NO: 1327371 - RNA, 19 nt, Homo sapiens
gccgauguuuguuauugca

SEQ ID NO: 1327372 - RNA, 19 nt, Homo sapiens
accaagccgauguuuguua

SEQ ID NO: 1327373 - RNA, 19 nt, Homo sapiens
agaaagcaaccugacaaug

SEQ ID NO: 1327374 - RNA, 19 nt, Homo sapiens
gggaaaucuuggagguucu

SEQ ID NO: 1327375 - RNA, 19 nt, Homo sapiens
uaccgcugcuucccugaug

SEQ ID NO: 1327376 - RNA, 19 nt, Homo sapiens
aauggcgucuuuaccaaca

SEQ ID NO: 1327377 - RNA, 19 nt, Homo sapiens
gccuugcccuggcucugaa

SEQ ID NO: 1327378 - RNA, 19 nt, Homo sapiens
gcaaccugacaaugauaau

SEQ ID NO: 1327379 - RNA, 19 nt, Homo sapiens
uuuaguacacucugaacaa

SEQ ID NO: 1327380 - RNA, 19 nt, Homo sapiens
acaaggccgugggaaaucu

SEQ ID NO: 1327381 - RNA, 19 nt, Homo sapiens
ggacacugcuagagaguua

SEQ ID NO: 1327382 - RNA, 19 nt, Homo sapiens
ggacaauucugaaguguau

SEQ ID NO: 1327383 - RNA, 19 nt, Homo sapiens
gugaagaccuguucucuga

SEQ ID NO: 1327384 - RNA, 19 nt, Homo sapiens
cagcaacccugagucaaua

SEQ ID NO: 1327385 - RNA, 19 nt, Homo sapiens
gcugaccgguucugaagua

SEQ ID NO: 1327386 - RNA, 19 nt, Homo sapiens
gcaggacaauucugaagug

SEQ ID NO: 1327387 - RNA, 19 nt, Homo sapiens
ccaaguagcugcgacuaug

SEQ ID NO: 1327388 - RNA, 19 nt, Homo sapiens
gggaagauauuggugaaga

SEQ ID NO: 1327389 - RNA, 19 nt, Homo sapiens
aaacaaggccuacccagaa

SEQ ID NO: 1327390 - RNA, 19 nt, Homo sapiens
caucucagccucccaagua

SEQ ID NO: 1327391 - RNA, 19 nt, Homo sapiens
gugcugggauuacagauga

SEQ ID NO: 1327392 - RNA, 19 nt, Homo sapiens
gcacagacauaagcaccuu

SEQ ID NO: 1327393 - RNA, 19 nt, Homo sapiens
gcucagggcccuacagcua

SEQ ID NO: 1327394 - RNA, 19 nt, Homo sapiens
gcaguaacccacucauuca

SEQ ID NO: 1327395 - RNA, 19 nt, Homo sapiens
gagagcagcauucuggauu

SEQ ID NO: 1327396 - RNA, 19 nt, Homo sapiens
guaacccacucauucaugu

SEQ ID NO: 1327397 - RNA, 19 nt, Homo sapiens
ccaaagugcugggauuaca

SEQ ID NO: 1327398 - RNA, 19 nt, Homo sapiens
gcagcaacccugagucaau

SEQ ID NO: 1327399 - RNA, 19 nt, Homo sapiens
agaaggagcacagacauaa

SEQ ID NO: 1327400 - RNA, 19 nt, Homo sapiens
gagcaggaccucagcuuca

SEQ ID NO: 1327401 - RNA, 19 nt, Homo sapiens
gaggcauucuuauucuuau

SEQ ID NO: 1327402 - RNA, 19 nt, Homo sapiens
ggacggcugucgaacuucu

SEQ ID NO: 1327403 - RNA, 19 nt, Homo sapiens
ggagacugauggugaagag

SEQ ID NO: 1327404 - RNA, 19 nt, Homo sapiens
gaccgguucugaaguaugg

SEQ ID NO: 1327405 - RNA, 19 nt, Homo sapiens
gagcagcaacccugaguca

SEQ ID NO: 1327406 - RNA, 19 nt, Homo sapiens
gcccugagguggugucuac

SEQ ID NO: 1327407 - RNA, 19 nt, Homo sapiens
ccaguugcccgcagcagua

SEQ ID NO: 1327408 - RNA, 19 nt, Homo sapiens
cagaaggagcacagacaua

SEQ ID NO: 1327409 - RNA, 19 nt, Homo sapiens
ugaaggacacugcuagaga

SEQ ID NO: 1327410 - RNA, 19 nt, Homo sapiens
ggaaggcacccaggaggaa

SEQ ID NO: 1327411 - RNA, 19 nt, Homo sapiens
agaggcauucuuauucuua

SEQ ID NO: 1327412 - RNA, 19 nt, Homo sapiens
cuccugggcucaagugauu

SEQ ID NO: 1327413 - RNA, 19 nt, Homo sapiens
acaccacgcugggcuaguu

SEQ ID NO: 1327414 - RNA, 19 nt, Homo sapiens
gcuagagaguuaccaugca

SEQ ID NO: 1327415 - RNA, 19 nt, Homo sapiens
gcacugggcaagcuagaag

SEQ ID NO: 1327416 - RNA, 19 nt, Homo sapiens
ggaccacugccuucaggaa

SEQ ID NO: 1327417 - RNA, 19 nt, Homo sapiens
cuucuucucuccugcuuau

SEQ ID NO: 1327418 - RNA, 19 nt, Homo sapiens
gaacuccugggcucaagug

SEQ ID NO: 1327419 - RNA, 19 nt, Homo sapiens
caccgaugguuuccuguau

SEQ ID NO: 1327420 - RNA, 19 nt, Homo sapiens
ggaagauauuggugaagac

SEQ ID NO: 1327421 - RNA, 19 nt, Homo sapiens
auaagcaccuuccggaauc

SEQ ID NO: 1327422 - RNA, 19 nt, Homo sapiens
cauaagcaccuuccggaau

SEQ ID NO: 1327423 - RNA, 19 nt, Homo sapiens
ggauggcucccaaauaaac

SEQ ID NO: 1327424 - RNA, 19 nt, Homo sapiens
ccgaugguuuccuguauca

SEQ ID NO: 1327425 - RNA, 19 nt, Homo sapiens
gacugauggugaagagcua

SEQ ID NO: 1327426 - RNA, 19 nt, Homo sapiens
ugggacggcugucgaacuu

SEQ ID NO: 1327427 - RNA, 19 nt, Homo sapiens
gagcaggacaauucugaag

SEQ ID NO: 1327428 - RNA, 19 nt, Homo sapiens
ccuggagacugauggugaa

SEQ ID NO: 1327429 - RNA, 19 nt, Homo sapiens
gaaggagcacagacauaag

SEQ ID NO: 1327430 - RNA, 19 nt, Homo sapiens
cagcaguaacccacucauu

SEQ ID NO: 1327431 - RNA, 19 nt, Homo sapiens
caggauggagucccaguug

SEQ ID NO: 1327432 - RNA, 19 nt, Homo sapiens
ggagagcagcauucuggau

SEQ ID NO: 1327433 - RNA, 19 nt, Homo sapiens
gcaggaccucagcuucauu

SEQ ID NO: 1327434 - RNA, 19 nt, Homo sapiens
gggcaagcuagaaguguug

SEQ ID NO: 1327435 - RNA, 19 nt, Homo sapiens
gaugguuuccuguaucaca

SEQ ID NO: 1327436 - RNA, 19 nt, Homo sapiens
gcaggauggagucccaguu

SEQ ID NO: 1327437 - RNA, 19 nt, Homo sapiens
ugggcaagcuagaaguguu

SEQ ID NO: 1327438 - RNA, 19 nt, Homo sapiens
ucuugggccuggagacuga

SEQ ID NO: 1327439 - RNA, 19 nt, Homo sapiens
uaacccacucauucaugua

SEQ ID NO: 1327440 - RNA, 19 nt, Homo sapiens
ggaccucagcuucauuguc

SEQ ID NO: 1327441 - RNA, 19 nt, Homo sapiens
ugagagccgcugggccuua

SEQ ID NO: 1327442 - RNA, 19 nt, Homo sapiens
agagcagcauucuggauuc

SEQ ID NO: 1327443 - RNA, 19 nt, Homo sapiens
guuggugccuacaaucagu

SEQ ID NO: 1327444 - RNA, 19 nt, Homo sapiens
uugcagaucaggaaacaga

SEQ ID NO: 1327445 - RNA, 19 nt, Homo sapiens
gcugggauuacagaugaua

SEQ ID NO: 1327446 - RNA, 19 nt, Homo sapiens
cagcugaccgguucugaag

SEQ ID NO: 1327447 - RNA, 19 nt, Homo sapiens
auucugaaguguauucuac

SEQ ID NO: 1327448 - RNA, 19 nt, Homo sapiens
caggacaauucugaagugu

SEQ ID NO: 1327449 - RNA, 19 nt, Homo sapiens
ucagcuucauuguccuuga

SEQ ID NO: 1327450 - RNA, 19 nt, Homo sapiens
caggaccucagcuucauug

SEQ ID NO: 1327451 - RNA, 19 nt, Homo sapiens
cccaugggcucuaccuucu

SEQ ID NO: 1327452 - RNA, 19 nt, Homo sapiens
ggugcugggccuaaaccua

SEQ ID NO: 1327453 - RNA, 19 nt, Homo sapiens
cggaaucaucucccucuga

SEQ ID NO: 1327454 - RNA, 19 nt, Homo sapiens
gcucccaaauaaaccucuu

SEQ ID NO: 1327455 - RNA, 19 nt, Homo sapiens
acagcugugugcucaguca

SEQ ID NO: 1327456 - RNA, 19 nt, Homo sapiens
ggugguguccugagucaag

SEQ ID NO: 1327457 - RNA, 19 nt, Homo sapiens
gguggugacucuggaugca

SEQ ID NO: 1327458 - RNA, 19 nt, Homo sapiens
ggcauucuuauucuuauuc

SEQ ID NO: 1327459 - RNA, 19 nt, Homo sapiens
caaggccuacccagaagug

SEQ ID NO: 1327460 - RNA, 19 nt, Homo sapiens
uaagcaccuuccggaauca

SEQ ID NO: 1327461 - RNA, 19 nt, Homo sapiens
acaauucugaaguguauuc

SEQ ID NO: 1327462 - RNA, 19 nt, Homo sapiens
cagcuucauuguccuugag

SEQ ID NO: 1327463 - RNA, 19 nt, Homo sapiens
acaccgaugguuuccugua

SEQ ID NO: 1327464 - RNA, 19 nt, Homo sapiens
caugaaggacacugcuaga

SEQ ID NO: 1327465 - RNA, 19 nt, Homo sapiens
acaagucccugcgguucug

SEQ ID NO: 1327466 - RNA, 19 nt, Homo sapiens
aaagugcugggauuacaga

SEQ ID NO: 1327467 - RNA, 19 nt, Homo sapiens
ugucgaacuucuggauguu

SEQ ID NO: 1327468 - RNA, 19 nt, Homo sapiens
gcaagaacuuccauuauug

SEQ ID NO: 1327469 - RNA, 19 nt, Homo sapiens
uuaaauagcucaccaauca

SEQ ID NO: 1327470 - RNA, 19 nt, Homo sapiens
gaaagaaagggaaguauuu

SEQ ID NO: 1327471 - RNA, 19 nt, Homo sapiens
gaagagaacugcggacuug

SEQ ID NO: 1327472 - RNA, 19 nt, Homo sapiens
gacagaagguggugaagua

SEQ ID NO: 1327473 - RNA, 19 nt, Homo sapiens
gaaauacgcagaugacaaa

SEQ ID NO: 1327474 - RNA, 19 nt, Homo sapiens
ugacacagcucaagaaugu

SEQ ID NO: 1327475 - RNA, 19 nt, Homo sapiens
ccaaagaacuaaacauuca

SEQ ID NO: 1327476 - RNA, 19 nt, Homo sapiens
gagaagccauuaucagaaa

SEQ ID NO: 1327477 - RNA, 19 nt, Homo sapiens
uaaagcagguuuggcauua

SEQ ID NO: 1327478 - RNA, 19 nt, Homo sapiens
ugacaaggaugaaauagaa

SEQ ID NO: 1327479 - RNA, 19 nt, Homo sapiens
gagaaacaaugguaaaugu

SEQ ID NO: 1327480 - RNA, 19 nt, Homo sapiens
caaauacuguucucugaaa

SEQ ID NO: 1327481 - RNA, 19 nt, Homo sapiens
gcacuacuauccagauuug

SEQ ID NO: 1327482 - RNA, 19 nt, Homo sapiens
gaaauaagaaugacaagug

SEQ ID NO: 1327483 - RNA, 19 nt, Homo sapiens
ggaaagcagagaaccauua

SEQ ID NO: 1327484 - RNA, 19 nt, Homo sapiens
ggagacacagugacuauua

SEQ ID NO: 1327485 - RNA, 19 nt, Homo sapiens
gaacuuacucugaugaauu

SEQ ID NO: 1327486 - RNA, 19 nt, Homo sapiens
caaggcauauugauuugua

SEQ ID NO: 1327487 - RNA, 19 nt, Homo sapiens
gaacaugugauugcaauaa

SEQ ID NO: 1327488 - RNA, 19 nt, Homo sapiens
ggcaauacaucagguguua

SEQ ID NO: 1327489 - RNA, 19 nt, Homo sapiens
ucacaaggcauauugauuu

SEQ ID NO: 1327490 - RNA, 19 nt, Homo sapiens
aaacagagccagagguuaa

SEQ ID NO: 1327491 - RNA, 19 nt, Homo sapiens
gaggauauaguggaaauua

SEQ ID NO: 1327492 - RNA, 19 nt, Homo sapiens
aaugugagcuuguucauga

SEQ ID NO: 1327493 - RNA, 19 nt, Homo sapiens
gauaaagucuccagaugca

SEQ ID NO: 1327494 - RNA, 19 nt, Homo sapiens
agaagacgcugaggauaua

SEQ ID NO: 1327495 - RNA, 19 nt, Homo sapiens
gaaaguacauuggcuaugc

SEQ ID NO: 1327496 - RNA, 19 nt, Homo sapiens
uauagcaacugaacuaaga

SEQ ID NO: 1327497 - RNA, 19 nt, Homo sapiens
cgauagcucuccuuugauu

SEQ ID NO: 1327498 - RNA, 19 nt, Homo sapiens
ggacagaucugcgcguauc

SEQ ID NO: 1327499 - RNA, 19 nt, Homo sapiens
cacaguagcucguaugaau

SEQ ID NO: 1327500 - RNA, 19 nt, Homo sapiens
gaaggauugucuaaugaug

SEQ ID NO: 1327501 - RNA, 19 nt, Homo sapiens
ugcaagaacuuccauuauu

SEQ ID NO: 1327502 - RNA, 19 nt, Homo sapiens
caggaaggauugucuaaug

SEQ ID NO: 1327503 - RNA, 19 nt, Homo sapiens
ggugggaacuucucaggaa

SEQ ID NO: 1327504 - RNA, 19 nt, Homo sapiens
gcagauugccaaagaacua

SEQ ID NO: 1327505 - RNA, 19 nt, Homo sapiens
cacagaagcugcucgaguu

SEQ ID NO: 1327506 - RNA, 19 nt, Homo sapiens
ugagaagauucaagcauuu

SEQ ID NO: 1327507 - RNA, 19 nt, Homo sapiens
ggacgaggaagauuucaaa

SEQ ID NO: 1327508 - RNA, 19 nt, Homo sapiens
uacaucagguguuaacuaa

SEQ ID NO: 1327509 - RNA, 19 nt, Homo sapiens
gcuaggaacuuacucugau

SEQ ID NO: 1327510 - RNA, 19 nt, Homo sapiens
ggaagcuggugcccuggua

SEQ ID NO: 1327511 - RNA, 19 nt, Homo sapiens
gagagaagcaggucggauu

SEQ ID NO: 1327512 - RNA, 19 nt, Homo sapiens
gaaaauacauugcucuaag

SEQ ID NO: 1327513 - RNA, 19 nt, Homo sapiens
gcaugcagcugaguuacaa

SEQ ID NO: 1327514 - RNA, 19 nt, Homo sapiens
ggaaacagagccagagguu

SEQ ID NO: 1327515 - RNA, 19 nt, Homo sapiens
aacauuggaucgauucaua

SEQ ID NO: 1327516 - RNA, 19 nt, Homo sapiens
ucaaauacuuccguacuug

SEQ ID NO: 1327517 - RNA, 19 nt, Homo sapiens
guacaacuaugagccuuug

SEQ ID NO: 1327518 - RNA, 19 nt, Homo sapiens
gcuggaagcuuuauuucuc

SEQ ID NO: 1327519 - RNA, 19 nt, Homo sapiens
gaucgauucauaccauaua

SEQ ID NO: 1327520 - RNA, 19 nt, Homo sapiens
caacguugcugaaagaacu

SEQ ID NO: 1327521 - RNA, 19 nt, Homo sapiens
uggaggacauuacaauaaa

SEQ ID NO: 1327522 - RNA, 19 nt, Homo sapiens
gaauugaugucugaugauc

SEQ ID NO: 1327523 - RNA, 19 nt, Homo sapiens
guauagaggcagaggauuu

SEQ ID NO: 1327524 - RNA, 19 nt, Homo sapiens
gugauaaagucuccagaug

SEQ ID NO: 1327525 - RNA, 19 nt, Homo sapiens
ggaaagcugcggcugaaga

SEQ ID NO: 1327526 - RNA, 19 nt, Homo sapiens
gauaguuccucuggagauu

SEQ ID NO: 1327527 - RNA, 19 nt, Homo sapiens
guuagggccuccuggguuu

SEQ ID NO: 1327528 - RNA, 19 nt, Homo sapiens
cagcaugguucuggaauga

SEQ ID NO: 1327529 - RNA, 19 nt, Homo sapiens
caaagaagacgcugaggau

SEQ ID NO: 1327530 - RNA, 19 nt, Homo sapiens
gaaacagagccagagguua

SEQ ID NO: 1327531 - RNA, 19 nt, Homo sapiens
ugauggaguucucacuuaa

SEQ ID NO: 1327532 - RNA, 19 nt, Homo sapiens
guucgugucaguaauauaa

SEQ ID NO: 1327533 - RNA, 19 nt, Homo sapiens
gcaaggguguacaacuaug

SEQ ID NO: 1327534 - RNA, 19 nt, Homo sapiens
aaacguacuucugaacaaa

SEQ ID NO: 1327535 - RNA, 19 nt, Homo sapiens
gucaaauacuguucucuga

SEQ ID NO: 1327536 - RNA, 19 nt, Homo sapiens
ugaccaggguuaccucuug

SEQ ID NO: 1327537 - RNA, 19 nt, Homo sapiens
ggauauaguggaaauuaug

SEQ ID NO: 1327538 - RNA, 19 nt, Homo sapiens
gagcaagguuggaauugag

SEQ ID NO: 1327539 - RNA, 19 nt, Homo sapiens
gagcaaauuacuauggaaa

SEQ ID NO: 1327540 - RNA, 19 nt, Homo sapiens
agcgauagcucuccuuuga

SEQ ID NO: 1327541 - RNA, 19 nt, Homo sapiens
gaagcuuuauuucucugaa

SEQ ID NO: 1327542 - RNA, 19 nt, Homo sapiens
agagaugaauggagaguau

SEQ ID NO: 1327543 - RNA, 19 nt, Homo sapiens
acacacacacagucaaaua

SEQ ID NO: 1327544 - RNA, 19 nt, Homo sapiens
cagauuugauuuggucuuu

SEQ ID NO: 1327545 - RNA, 19 nt, Homo sapiens
ggagaaacaaugguaaaug

SEQ ID NO: 1327546 - RNA, 19 nt, Homo sapiens
uaccagauauagcaacuga

SEQ ID NO: 1327547 - RNA, 19 nt, Homo sapiens
cgaggaagauuucaaagcu

SEQ ID NO: 1327548 - RNA, 19 nt, Homo sapiens
ggaaugagcaacaggucaa

SEQ ID NO: 1327549 - RNA, 19 nt, Homo sapiens
cgagcaagguuggaauuga

SEQ ID NO: 1327550 - RNA, 19 nt, Homo sapiens
gaaagcagagaaccauuag

SEQ ID NO: 1327551 - RNA, 19 nt, Homo sapiens
caaaguauuagucuugcua

SEQ ID NO: 1327552 - RNA, 19 nt, Homo sapiens
uugauggaguucucacuua

SEQ ID NO: 1327553 - RNA, 19 nt, Homo sapiens
gagcuuuccucuuccagau

SEQ ID NO: 1327554 - RNA, 19 nt, Homo sapiens
caggaaagcugcggcugaa

SEQ ID NO: 1327555 - RNA, 19 nt, Homo sapiens
gagaggaagcaaccaaaga

SEQ ID NO: 1327556 - RNA, 19 nt, Homo sapiens
ugagcaucaugaucacuua

SEQ ID NO: 1327557 - RNA, 19 nt, Homo sapiens
cagcaaaguauuagucuug

SEQ ID NO: 1327558 - RNA, 19 nt, Homo sapiens
ggucugacgguaacucuuu

SEQ ID NO: 1327559 - RNA, 19 nt, Homo sapiens
ccacauccuuguuguugga

SEQ ID NO: 1327560 - RNA, 19 nt, Homo sapiens
ggaacuuacucugaugaau

SEQ ID NO: 1327561 - RNA, 19 nt, Homo sapiens
gaaacaauagaucccauuc

SEQ ID NO: 1327562 - RNA, 19 nt, Homo sapiens
cgaugaauuugauaagaug

SEQ ID NO: 1327563 - RNA, 19 nt, Homo sapiens
gaucaagguauuuguggaa

SEQ ID NO: 1327564 - RNA, 19 nt, Homo sapiens
guggagaaauucagagcuu

SEQ ID NO: 1327565 - RNA, 19 nt, Homo sapiens
gaccaggguuaccucuuga

SEQ ID NO: 1327566 - RNA, 19 nt, Homo sapiens
cauuagcagugccacagua

SEQ ID NO: 1327567 - RNA, 19 nt, Homo sapiens
gacgguaacucuuucaaaa

SEQ ID NO: 1327568 - RNA, 19 nt, Homo sapiens
caaaguggguguucaauaa

SEQ ID NO: 1327569 - RNA, 19 nt, Homo sapiens
aaaggaggcuguaaauuua

SEQ ID NO: 1327570 - RNA, 19 nt, Homo sapiens
gcacagagccucaggagua

SEQ ID NO: 1327571 - RNA, 19 nt, Homo sapiens
ugacagaacugcuggauuu

SEQ ID NO: 1327572 - RNA, 19 nt, Homo sapiens
gaaggaagauucagaagug

SEQ ID NO: 1327573 - RNA, 19 nt, Homo sapiens
gcucugaccucuuagcuua

SEQ ID NO: 1327574 - RNA, 19 nt, Homo sapiens
caaaggaggcuguaaauuu

SEQ ID NO: 1327575 - RNA, 19 nt, Homo sapiens
gagcuauccugacuuaaua

SEQ ID NO: 1327576 - RNA, 19 nt, Homo sapiens
gaccuuagcuguccuagga

SEQ ID NO: 1327577 - RNA, 19 nt, Homo sapiens
guucugcucugaccucuua

SEQ ID NO: 1327578 - RNA, 19 nt, Homo sapiens
ccaaaguucucaaugguuu

SEQ ID NO: 1327579 - RNA, 19 nt, Homo sapiens
cuaaugcucugaucuguaa

SEQ ID NO: 1327580 - RNA, 19 nt, Homo sapiens
gggaagaacugugugauug

SEQ ID NO: 1327581 - RNA, 19 nt, Homo sapiens
ugaguuggcuuuauucuug

SEQ ID NO: 1327582 - RNA, 19 nt, Homo sapiens
gcuuacaccuuaucuauga

SEQ ID NO: 1327583 - RNA, 19 nt, Homo sapiens
ggaaggagauucugcuagu

SEQ ID NO: 1327584 - RNA, 19 nt, Homo sapiens
gccauaaacuccacaauuc

SEQ ID NO: 1327585 - RNA, 19 nt, Homo sapiens
guucaggccucuccucuuu

SEQ ID NO: 1327586 - RNA, 19 nt, Homo sapiens
ggacaggccuggcauguac

SEQ ID NO: 1327587 - RNA, 19 nt, Homo sapiens
gcucugaucuguaagugaa

SEQ ID NO: 1327588 - RNA, 19 nt, Homo sapiens
gaagacaccgcauuuguga

SEQ ID NO: 1327589 - RNA, 19 nt, Homo sapiens
ccacagagacugagaguug

SEQ ID NO: 1327590 - RNA, 19 nt, Homo sapiens
gaaggagauucugcuagua

SEQ ID NO: 1327591 - RNA, 19 nt, Homo sapiens
gagcuaauucgcauauaua

SEQ ID NO: 1327592 - RNA, 19 nt, Homo sapiens
uggaggagcugucuucaaa

SEQ ID NO: 1327593 - RNA, 19 nt, Homo sapiens
gaagauggaauacaccaaa

SEQ ID NO: 1327594 - RNA, 19 nt, Homo sapiens
gaggagcugucuucaaaug

SEQ ID NO: 1327595 - RNA, 19 nt, Homo sapiens
caacaaaggaggcuguaaa

SEQ ID NO: 1327596 - RNA, 19 nt, Homo sapiens
ccauaacagugcagugaua

SEQ ID NO: 1327597 - RNA, 19 nt, Homo sapiens
uaacacauuuggccaguug

SEQ ID NO: 1327598 - RNA, 19 nt, Homo sapiens
caacaagucugaguacauc

SEQ ID NO: 1327599 - RNA, 19 nt, Homo sapiens
ucgacaagauggaaguuua

SEQ ID NO: 1327600 - RNA, 19 nt, Homo sapiens
auacauagcuucgacaaga

SEQ ID NO: 1327601 - RNA, 19 nt, Homo sapiens
gaauaguguuucucucuuc

SEQ ID NO: 1327602 - RNA, 19 nt, Homo sapiens
caaaaugucuguacuuaga

SEQ ID NO: 1327603 - RNA, 19 nt, Homo sapiens
gauauugccuagccaaagu

SEQ ID NO: 1327604 - RNA, 19 nt, Homo sapiens
ggaguugccuucugaggau

SEQ ID NO: 1327605 - RNA, 19 nt, Homo sapiens
gcacccagguuccuacugu

SEQ ID NO: 1327606 - RNA, 19 nt, Homo sapiens
ccagauuccuguugucuau

SEQ ID NO: 1327607 - RNA, 19 nt, Homo sapiens
ggaaagguguuugugacuu

SEQ ID NO: 1327608 - RNA, 19 nt, Homo sapiens
gcaaggggcugguccauga

SEQ ID NO: 1327609 - RNA, 19 nt, Homo sapiens
gauggaaguuuauuucucu

SEQ ID NO: 1327610 - RNA, 19 nt, Homo sapiens
caaaacagcuguauguaau

SEQ ID NO: 1327611 - RNA, 19 nt, Homo sapiens
caaagucagucgccaguca

SEQ ID NO: 1327612 - RNA, 19 nt, Homo sapiens
ucucagcucugcuuucauu

SEQ ID NO: 1327613 - RNA, 19 nt, Homo sapiens
gccuugagguuagaauuua

SEQ ID NO: 1327614 - RNA, 19 nt, Homo sapiens
ccucuuagcuuagaaggaa

SEQ ID NO: 1327615 - RNA, 19 nt, Homo sapiens
uaugaacagucacuuugua

SEQ ID NO: 1327616 - RNA, 19 nt, Homo sapiens
gaaaagucguagugucaua

SEQ ID NO: 1327617 - RNA, 19 nt, Homo sapiens
ggucaacgcagcacagauu

SEQ ID NO: 1327618 - RNA, 19 nt, Homo sapiens
ggacgucauuguguuguga

SEQ ID NO: 1327619 - RNA, 19 nt, Homo sapiens
uagcaucucugccucaugu

SEQ ID NO: 1327620 - RNA, 19 nt, Homo sapiens
ccaaaguggguguucaaua

SEQ ID NO: 1327621 - RNA, 19 nt, Homo sapiens
cagcucugcuuucauuuga

SEQ ID NO: 1327622 - RNA, 19 nt, Homo sapiens
gcucucagcucugcuuuca

SEQ ID NO: 1327623 - RNA, 19 nt, Homo sapiens
agauuccuguugucuauua

SEQ ID NO: 1327624 - RNA, 19 nt, Homo sapiens
ccacagcaccaguuauuga

SEQ ID NO: 1327625 - RNA, 19 nt, Homo sapiens
caagauggaaguuuauuuc

SEQ ID NO: 1327626 - RNA, 19 nt, Homo sapiens
ggagcuauccugacuuaau

SEQ ID NO: 1327627 - RNA, 19 nt, Homo sapiens
cagcacagauugguuccua

SEQ ID NO: 1327628 - RNA, 19 nt, Homo sapiens
cagaugauauuaccugaag

SEQ ID NO: 1327629 - RNA, 19 nt, Homo sapiens
cauuugaguuggcuuuauu

SEQ ID NO: 1327630 - RNA, 19 nt, Homo sapiens
gaauuuaauggcucacgua

SEQ ID NO: 1327631 - RNA, 19 nt, Homo sapiens
guccuaggauaguuaguaa

SEQ ID NO: 1327632 - RNA, 19 nt, Homo sapiens
gaugauauuaccugaagaa

SEQ ID NO: 1327633 - RNA, 19 nt, Homo sapiens
gaagguauccagccucaag

SEQ ID NO: 1327634 - RNA, 19 nt, Homo sapiens
gcuuaagaauucacuaaca

SEQ ID NO: 1327635 - RNA, 19 nt, Homo sapiens
gccgauguguguugaaaga

SEQ ID NO: 1327636 - RNA, 19 nt, Homo sapiens
uaaagaaccauuuggagau

SEQ ID NO: 1327637 - RNA, 19 nt, Homo sapiens
gggcagagggaauuuaaug

SEQ ID NO: 1327638 - RNA, 19 nt, Homo sapiens
aaacagcuguauguaauca

SEQ ID NO: 1327639 - RNA, 19 nt, Homo sapiens
cagauugguuccuauguuc

SEQ ID NO: 1327640 - RNA, 19 nt, Homo sapiens
caauaaagaaccauuugga

SEQ ID NO: 1327641 - RNA, 19 nt, Homo sapiens
ggaaagacugaccgacuga

SEQ ID NO: 1327642 - RNA, 19 nt, Homo sapiens
ugaguuccauguccucuug

SEQ ID NO: 1327643 - RNA, 19 nt, Homo sapiens
ggccacaguuagcaacaaa

SEQ ID NO: 1327644 - RNA, 19 nt, Homo sapiens
ggaagggcucuuagaauca

SEQ ID NO: 1327645 - RNA, 19 nt, Homo sapiens
gccuuuggcuuucacuaaa

SEQ ID NO: 1327646 - RNA, 19 nt, Homo sapiens
ggacaaagugagccaguca

SEQ ID NO: 1327647 - RNA, 19 nt, Homo sapiens
gaaagacugcugcaaaauu

SEQ ID NO: 1327648 - RNA, 19 nt, Homo sapiens
gaguguguauccuaggaaa

SEQ ID NO: 1327649 - RNA, 19 nt, Homo sapiens
gagcccagauuccuguugu

SEQ ID NO: 1327650 - RNA, 19 nt, Homo sapiens
ugaaucugcuugagcucua

SEQ ID NO: 1327651 - RNA, 19 nt, Homo sapiens
gugcugauguauucgaaga

SEQ ID NO: 1327652 - RNA, 19 nt, Homo sapiens
gcucuuagaaucaguuugu

SEQ ID NO: 1327653 - RNA, 19 nt, Homo sapiens
aggaagggcucuuagaauc

SEQ ID NO: 1327654 - RNA, 19 nt, Homo sapiens
guugaaagacugcugcaaa

SEQ ID NO: 1327655 - RNA, 19 nt, Homo sapiens
gcacagauugguuccuaug

SEQ ID NO: 1327656 - RNA, 19 nt, Homo sapiens
uuauaacccuggagaugaa

SEQ ID NO: 1327657 - RNA, 19 nt, Homo sapiens
gugaugaaugacuguauua

SEQ ID NO: 1327658 - RNA, 19 nt, Homo sapiens
gaaucugcuugagcucuaa

SEQ ID NO: 1327659 - RNA, 19 nt, Homo sapiens
acagauugguuccuauguu

SEQ ID NO: 1327660 - RNA, 19 nt, Homo sapiens
caauagcuacuacaaacaa

SEQ ID NO: 1327661 - RNA, 19 nt, Homo sapiens
cacagagccucaggaguaa

SEQ ID NO: 1327662 - RNA, 19 nt, Homo sapiens
gaagggcucuuagaaucag

SEQ ID NO: 1327663 - RNA, 19 nt, Homo sapiens
agagcuaauucgcauauau

SEQ ID NO: 1327664 - RNA, 19 nt, Homo sapiens
gacggcaucugggaacaaa

SEQ ID NO: 1327665 - RNA, 19 nt, Homo sapiens
ugaauaguguuucucucuu

SEQ ID NO: 1327666 - RNA, 19 nt, Homo sapiens
gaacagucacuuuguacca

SEQ ID NO: 1327667 - RNA, 19 nt, Homo sapiens
ugcuugagcucuaagauga

SEQ ID NO: 1327668 - RNA, 19 nt, Homo sapiens
caaagaugcuucugaaaua

SEQ ID NO: 1327669 - RNA, 19 nt, Homo sapiens
gaagagagcauuuguggua

SEQ ID NO: 1327670 - RNA, 19 nt, Homo sapiens
gaacagaugucuauugagu

SEQ ID NO: 1327671 - RNA, 19 nt, Homo sapiens
ccaaaugagugauaagauu

SEQ ID NO: 1327672 - RNA, 19 nt, Homo sapiens
gagaucauguggaagcaua

SEQ ID NO: 1327673 - RNA, 19 nt, Homo sapiens
acagaaagauuguugaaga

SEQ ID NO: 1327674 - RNA, 19 nt, Homo sapiens
caacaccgcugugcaaguu

SEQ ID NO: 1327675 - RNA, 19 nt, Homo sapiens
caacauaguacaccaaaga

SEQ ID NO: 1327676 - RNA, 19 nt, Homo sapiens
gaugggagguucuauucuu

SEQ ID NO: 1327677 - RNA, 19 nt, Homo sapiens
gcucagugcuucagacaga

SEQ ID NO: 1327678 - RNA, 19 nt, Homo sapiens
aagaacagaugucuauuga

SEQ ID NO: 1327679 - RNA, 19 nt, Homo sapiens
caagaaacccgauugucua

SEQ ID NO: 1327680 - RNA, 19 nt, Homo sapiens
gacaacggcucgggaauga

SEQ ID NO: 1327681 - RNA, 19 nt, Homo sapiens
caccaaagaugcuucugaa

SEQ ID NO: 1327682 - RNA, 19 nt, Homo sapiens
gaaagauuguugaagacau

SEQ ID NO: 1327683 - RNA, 19 nt, Homo sapiens
gauacaggccugaggaauu

SEQ ID NO: 1327684 - RNA, 19 nt, Homo sapiens
gaacaaguugcuaaagaug

SEQ ID NO: 1327685 - RNA, 19 nt, Homo sapiens
ccaaagaugcuucugaaau

SEQ ID NO: 1327686 - RNA, 19 nt, Homo sapiens
caacagaucacggaaaugu

SEQ ID NO: 1327687 - RNA, 19 nt, Homo sapiens
ggcaacagaucacggaaau

SEQ ID NO: 1327688 - RNA, 19 nt, Homo sapiens
caagaacagaugucuauug

SEQ ID NO: 1327689 - RNA, 19 nt, Homo sapiens
gaacuacgaagaggaaaug

SEQ ID NO: 1327690 - RNA, 19 nt, Homo sapiens
gcucgcuguucaucaguua

SEQ ID NO: 1327691 - RNA, 19 nt, Homo sapiens
ugaacaaguugcuaaagau

SEQ ID NO: 1327692 - RNA, 19 nt, Homo sapiens
ggguuagaguugaaucuuu

SEQ ID NO: 1327693 - RNA, 19 nt, Homo sapiens
gcgguuaguuaaggauaua

SEQ ID NO: 1327694 - RNA, 19 nt, Homo sapiens
aagaggaaauggccaagaa

SEQ ID NO: 1327695 - RNA, 19 nt, Homo sapiens
gccuugaccucaccaacua

SEQ ID NO: 1327696 - RNA, 19 nt, Homo sapiens
gagaaugaacaaagcauau

SEQ ID NO: 1327697 - RNA, 19 nt, Homo sapiens
uaugcuaugugccaaauga

SEQ ID NO: 1327698 - RNA, 19 nt, Homo sapiens
ugacguuggugagcuuaua

SEQ ID NO: 1327699 - RNA, 19 nt, Homo sapiens
ggaacgagacuccauagca

SEQ ID NO: 1327700 - RNA, 19 nt, Homo sapiens
gccaauauuucuguuguau

SEQ ID NO: 1327701 - RNA, 19 nt, Homo sapiens
aguuauagcuccuccagaa

SEQ ID NO: 1327702 - RNA, 19 nt, Homo sapiens
uuagacaagcgguuaguua

SEQ ID NO: 1327703 - RNA, 19 nt, Homo sapiens
guuccugccuucuauaugu

SEQ ID NO: 1327704 - RNA, 19 nt, Homo sapiens
acagaugucuauugaguag

SEQ ID NO: 1327705 - RNA, 19 nt, Homo sapiens
cuacuggccuugugcugaa

SEQ ID NO: 1327706 - RNA, 19 nt, Homo sapiens
uggaggagcucgcuguuca

SEQ ID NO: 1327707 - RNA, 19 nt, Homo sapiens
auucagggcauguuuaaua

SEQ ID NO: 1327708 - RNA, 19 nt, Homo sapiens
ccaagaaacccgauugucu

SEQ ID NO: 1327709 - RNA, 19 nt, Homo sapiens
acagaucacggaaauguuu

SEQ ID NO: 1327710 - RNA, 19 nt, Homo sapiens
uagacaagcgguuaguuaa

SEQ ID NO: 1327711 - RNA, 19 nt, Homo sapiens
gacaagcgguuaguuaagg

SEQ ID NO: 1327712 - RNA, 19 nt, Homo sapiens
gugaaggguuagaguugaa

SEQ ID NO: 1327713 - RNA, 19 nt, Homo sapiens
auacaggccugaggaauuc

SEQ ID NO: 1327714 - RNA, 19 nt, Homo sapiens
ggagcucgcuguucaucag

SEQ ID NO: 1327715 - RNA, 19 nt, Homo sapiens
cauauucagggcauguuua

SEQ ID NO: 1327716 - RNA, 19 nt, Homo sapiens
gagaaaugcacuugugaag

SEQ ID NO: 1327717 - RNA, 19 nt, Homo sapiens
uuauagcucuucuggguau

SEQ ID NO: 1327718 - RNA, 19 nt, Homo sapiens
gcugcuggcuucacuacug

SEQ ID NO: 1327719 - RNA, 19 nt, Homo sapiens
gggaggacauggagaucau

SEQ ID NO: 1327720 - RNA, 19 nt, Homo sapiens
aauaauguuucccauagug

SEQ ID NO: 1327721 - RNA, 19 nt, Homo sapiens
auacugggauuccgggauu

SEQ ID NO: 1327722 - RNA, 19 nt, Homo sapiens
ucaaggagagcuuuuguua

SEQ ID NO: 1327723 - RNA, 19 nt, Homo sapiens
aaagauuguugaagacauc

SEQ ID NO: 1327724 - RNA, 19 nt, Homo sapiens
gagcguggucucauuacuu

SEQ ID NO: 1327725 - RNA, 19 nt, Homo sapiens
uaauaauggugaagcucaa

SEQ ID NO: 1327726 - RNA, 19 nt, Homo sapiens
guucuauucuugcauccuu

SEQ ID NO: 1327727 - RNA, 19 nt, Homo sapiens
gauggcccagucuugauua

SEQ ID NO: 1327728 - RNA, 19 nt, Homo sapiens
acuauaaccuaaagcugaa

SEQ ID NO: 1327729 - RNA, 19 nt, Homo sapiens
gcauauucagggcauguuu

SEQ ID NO: 1327730 - RNA, 19 nt, Homo sapiens
ugagaaugaacaaagcaua

SEQ ID NO: 1327731 - RNA, 19 nt, Homo sapiens
augaacaaguugcuaaaga

SEQ ID NO: 1327732 - RNA, 19 nt, Homo sapiens
gcagauauccaggcaagca

SEQ ID NO: 1327733 - RNA, 19 nt, Homo sapiens
gaagaggaaauggccaaga

SEQ ID NO: 1327734 - RNA, 19 nt, Homo sapiens
aaggagagcuuuuguuaug

SEQ ID NO: 1327735 - RNA, 19 nt, Homo sapiens
gguuagaguugaaucuuuu

SEQ ID NO: 1327736 - RNA, 19 nt, Homo sapiens
ugaguagaaccaaguuaaa

SEQ ID NO: 1327737 - RNA, 19 nt, Homo sapiens
gaaaggaaaauaucagugu

SEQ ID NO: 1327738 - RNA, 19 nt, Homo sapiens
uuaaggauauagcaaaggu

SEQ ID NO: 1327739 - RNA, 19 nt, Homo sapiens
cuaaagaugagaaugaaca

SEQ ID NO: 1327740 - RNA, 19 nt, Homo sapiens
ggauaauaauggugaagcu

SEQ ID NO: 1327741 - RNA, 19 nt, Homo sapiens
gagaaaauacuucaccuau

SEQ ID NO: 1327742 - RNA, 19 nt, Homo sapiens
uaaugaagaaccaugguau

SEQ ID NO: 1327743 - RNA, 19 nt, Homo sapiens
guggagcguggucucauua

SEQ ID NO: 1327744 - RNA, 19 nt, Homo sapiens
cugcagaauuuaaagaagu

SEQ ID NO: 1327745 - RNA, 19 nt, Homo sapiens
caacggcucgggaaugauc

SEQ ID NO: 1327746 - RNA, 19 nt, Homo sapiens
ugaggaacgagacuccaua

SEQ ID NO: 1327747 - RNA, 19 nt, Homo sapiens
cgugucauaugaaccuuga

SEQ ID NO: 1327748 - RNA, 19 nt, Homo sapiens
cagaaagauuguugaagac

SEQ ID NO: 1327749 - RNA, 19 nt, Homo sapiens
cuaaugaagaaccauggua

SEQ ID NO: 1327750 - RNA, 19 nt, Homo sapiens
ggguguuccugccuucuau

SEQ ID NO: 1327751 - RNA, 19 nt, Homo sapiens
caguuuaucuacccgaaca

SEQ ID NO: 1327752 - RNA, 19 nt, Homo sapiens
aaagaugcuucugaaauac

SEQ ID NO: 1327753 - RNA, 19 nt, Homo sapiens
agacagaaagauuguugaa

SEQ ID NO: 1327754 - RNA, 19 nt, Homo sapiens
ucagacagaaagauuguug

SEQ ID NO: 1327755 - RNA, 19 nt, Homo sapiens
gcucaagaacagaugucua

SEQ ID NO: 1327756 - RNA, 19 nt, Homo sapiens
ggaugccaauauuucuguu

SEQ ID NO: 1327757 - RNA, 19 nt, Homo sapiens
gcaagcauacuaaaaugaa

SEQ ID NO: 1327758 - RNA, 19 nt, Homo sapiens
gcugcagaauuuaaagaag

SEQ ID NO: 1327759 - RNA, 19 nt, Homo sapiens
uuuguuauguggcaaugaa

SEQ ID NO: 1327760 - RNA, 19 nt, Homo sapiens
cgacaacggcucgggaaug

SEQ ID NO: 1327761 - RNA, 19 nt, Homo sapiens
agagugugcccaucuuuga

SEQ ID NO: 1327762 - RNA, 19 nt, Homo sapiens
acaaguugcuaaagaugag

SEQ ID NO: 1327763 - RNA, 19 nt, Homo sapiens
ugugaaggguuagaguuga

SEQ ID NO: 1327764 - RNA, 19 nt, Homo sapiens
uuacugagccagcgcugaa

SEQ ID NO: 1327765 - RNA, 19 nt, Homo sapiens
ugagaaaugcacuugugaa

SEQ ID NO: 1327766 - RNA, 19 nt, Homo sapiens
uuugagaaaugcacuugug

SEQ ID NO: 1327767 - RNA, 19 nt, Homo sapiens
acaccgcugugcaaguuau

SEQ ID NO: 1327768 - RNA, 19 nt, Homo sapiens
gaaauacacccacaauaaa

SEQ ID NO: 1327769 - RNA, 19 nt, Homo sapiens
agaaauacacccacaauaa

SEQ ID NO: 1327770 - RNA, 19 nt, Homo sapiens
gaacugaagauccgagagu

SEQ ID NO: 1327771 - RNA, 19 nt, Homo sapiens
cagaaauacacccacaaua

SEQ ID NO: 1327772 - RNA, 19 nt, Homo sapiens
gcuauguccuacccuguga

SEQ ID NO: 1327773 - RNA, 19 nt, Homo sapiens
ccgcaucuccgacgacuuu

SEQ ID NO: 1327774 - RNA, 19 nt, Homo sapiens
gaagauccgagaguaagga

SEQ ID NO: 1327775 - RNA, 19 nt, Homo sapiens
ccagaaauacacccacaau

SEQ ID NO: 1327776 - RNA, 19 nt, Homo sapiens
ggacugcugcaacgacaug

SEQ ID NO: 1327777 - RNA, 19 nt, Homo sapiens
gauccgagaguaaggaagu

SEQ ID NO: 1327778 - RNA, 19 nt, Homo sapiens
aacugaagauccgagagua

SEQ ID NO: 1327779 - RNA, 19 nt, Homo sapiens
gagaauaccugcaucauaa

SEQ ID NO: 1327780 - RNA, 19 nt, Homo sapiens
ugagaugucugcagaauga

SEQ ID NO: 1327781 - RNA, 19 nt, Homo sapiens
ggagaauaccugcaucaua

SEQ ID NO: 1327782 - RNA, 19 nt, Homo sapiens
aaacuacuguuccuucaaa

SEQ ID NO: 1327783 - RNA, 19 nt, Homo sapiens
cggaugagcuggcgucuau

SEQ ID NO: 1327784 - RNA, 19 nt, Homo sapiens
gaaaggcugugaagauguc

SEQ ID NO: 1327785 - RNA, 19 nt, Homo sapiens
gcaagaagaggaacaggaa

SEQ ID NO: 1327786 - RNA, 19 nt, Homo sapiens
ggauuucccuaccaagauu

SEQ ID NO: 1327787 - RNA, 19 nt, Homo sapiens
gcuauucgaucguggagaa

SEQ ID NO: 1327788 - RNA, 19 nt, Homo sapiens
gagcugcgcccuccuuaaa

SEQ ID NO: 1327789 - RNA, 19 nt, Homo sapiens
uggaagagcuccuacaauc

SEQ ID NO: 1327790 - RNA, 19 nt, Homo sapiens
cugaaucucuaucuucuaa

SEQ ID NO: 1327791 - RNA, 19 nt, Homo sapiens
gaaggugucccgcaugaga

SEQ ID NO: 1327792 - RNA, 19 nt, Homo sapiens
ccaagagaguccuguguuc

SEQ ID NO: 1327793 - RNA, 19 nt, Homo sapiens
gaucagcccaggaaauaga

SEQ ID NO: 1327794 - RNA, 19 nt, Homo sapiens
gaacauccaggagcucauu

SEQ ID NO: 1327795 - RNA, 19 nt, Homo sapiens
agacugaguuccuuagcuu

SEQ ID NO: 1327796 - RNA, 19 nt, Homo sapiens
ccaaacuacuguuccuuca

SEQ ID NO: 1327797 - RNA, 19 nt, Homo sapiens
gcagaaacaggaagagcaa

SEQ ID NO: 1327798 - RNA, 19 nt, Homo sapiens
gcuccaaccucccuuaugc

SEQ ID NO: 1327799 - RNA, 19 nt, Homo sapiens
gaaacaggaagagcaagaa

SEQ ID NO: 1327800 - RNA, 19 nt, Homo sapiens
ggcaggagccgacacaaga

SEQ ID NO: 1327801 - RNA, 19 nt, Homo sapiens
ucuauucucucaccuaaca

SEQ ID NO: 1327802 - RNA, 19 nt, Homo sapiens
cggaaggugucccgcauga

SEQ ID NO: 1327803 - RNA, 19 nt, Homo sapiens
cuucuaacccuuccucuuu

SEQ ID NO: 1327804 - RNA, 19 nt, Homo sapiens
ggaagagcaagaagaggaa

SEQ ID NO: 1327805 - RNA, 19 nt, Homo sapiens
ucucuauucucucaccuaa

SEQ ID NO: 1327806 - RNA, 19 nt, Homo sapiens
uuuacgggcuggauuugua

SEQ ID NO: 1327807 - RNA, 19 nt, Homo sapiens
gccagucucuauucucuca

SEQ ID NO: 1327808 - RNA, 19 nt, Homo sapiens
gcuccaaccacgucuacua

SEQ ID NO: 1327809 - RNA, 19 nt, Homo sapiens
acucagagcccaaguuuca

SEQ ID NO: 1327810 - RNA, 19 nt, Homo sapiens
caugagaugucugcagaau

SEQ ID NO: 1327811 - RNA, 19 nt, Homo sapiens
acacagacuauauccagua

SEQ ID NO: 1327812 - RNA, 19 nt, Homo sapiens
gccaaggccuggaaguaca

SEQ ID NO: 1327813 - RNA, 19 nt, Homo sapiens
ucgaucagcccaggaaaua

SEQ ID NO: 1327814 - RNA, 19 nt, Homo sapiens
ugacagaacgccagaccuu

SEQ ID NO: 1327815 - RNA, 19 nt, Homo sapiens
ccuccugguuugagucuuu

SEQ ID NO: 1327816 - RNA, 19 nt, Homo sapiens
acgaaaggcugugaagaug

SEQ ID NO: 1327817 - RNA, 19 nt, Homo sapiens
cgucuacuaugccaagaga

SEQ ID NO: 1327818 - RNA, 19 nt, Homo sapiens
cagcuggaccaauaugaaa

SEQ ID NO: 1327819 - RNA, 19 nt, Homo sapiens
agacucagagcccaaguuu

SEQ ID NO: 1327820 - RNA, 19 nt, Homo sapiens
gcaggagccgacacaagaa

SEQ ID NO: 1327821 - RNA, 19 nt, Homo sapiens
gaagagcuccuacaauccu

SEQ ID NO: 1327822 - RNA, 19 nt, Homo sapiens
gaugagcuggcgucuauuc

SEQ ID NO: 1327823 - RNA, 19 nt, Homo sapiens
cgaauacgaacgcuucuuc

SEQ ID NO: 1327824 - RNA, 19 nt, Homo sapiens
agcagugucugaugagaaa

SEQ ID NO: 1327825 - RNA, 19 nt, Homo sapiens
ggagggaaagcaggaagaa

SEQ ID NO: 1327826 - RNA, 19 nt, Homo sapiens
ccuuaugccuccugguuug

SEQ ID NO: 1327827 - RNA, 19 nt, Homo sapiens
cuacuccuaugauaaugga

SEQ ID NO: 1327828 - RNA, 19 nt, Homo sapiens
cagccagucucuauucucu

SEQ ID NO: 1327829 - RNA, 19 nt, Homo sapiens
uauaugaugagaacuccua

SEQ ID NO: 1327830 - RNA, 19 nt, Homo sapiens
cccacguucucuauuguuu

SEQ ID NO: 1327831 - RNA, 19 nt, Homo sapiens
cagccaaggccuggaagua

SEQ ID NO: 1327832 - RNA, 19 nt, Homo sapiens
ccaggaaauagaugaaaug

SEQ ID NO: 1327833 - RNA, 19 nt, Homo sapiens
gacgggaggcugugucuca

SEQ ID NO: 1327834 - RNA, 19 nt, Homo sapiens
gcacaagcaggagcaagga

SEQ ID NO: 1327835 - RNA, 19 nt, Homo sapiens
gccaagagaguccuguguu

SEQ ID NO: 1327836 - RNA, 19 nt, Homo sapiens
ccaaccacgucuacuaugc

SEQ ID NO: 1327837 - RNA, 19 nt, Homo sapiens
cacgaaaggcugugaagau

SEQ ID NO: 1327838 - RNA, 19 nt, Homo sapiens
gggaaagcaggaagaagga

SEQ ID NO: 1327839 - RNA, 19 nt, Homo sapiens
caacguggaagagcuccua

SEQ ID NO: 1327840 - RNA, 19 nt, Homo sapiens
ggagcaacagucccagaga

SEQ ID NO: 1327841 - RNA, 19 nt, Homo sapiens
gaaucucuaucuucuaacc

SEQ ID NO: 1327842 - RNA, 19 nt, Homo sapiens
gaucuucuccggccaugag

SEQ ID NO: 1327843 - RNA, 19 nt, Homo sapiens
gcuccagacugaguuccuu

SEQ ID NO: 1327844 - RNA, 19 nt, Homo sapiens
cccaggaaauagaugaaau

SEQ ID NO: 1327845 - RNA, 19 nt, Homo sapiens
gcucagcaacaacguggaa

SEQ ID NO: 1327846 - RNA, 19 nt, Homo sapiens
agccagcagugucugauga

SEQ ID NO: 1327847 - RNA, 19 nt, Homo sapiens
ccacagccaaggccuggaa

SEQ ID NO: 1327848 - RNA, 19 nt, Homo sapiens
caggaaauagaugaaauga

SEQ ID NO: 1327849 - RNA, 19 nt, Homo sapiens
caccuaacacucucaagga

SEQ ID NO: 1327850 - RNA, 19 nt, Homo sapiens
ccagcuggaccaauaugaa

SEQ ID NO: 1327851 - RNA, 19 nt, Homo sapiens
cugcccacguucucuauug

SEQ ID NO: 1327852 - RNA, 19 nt, Homo sapiens
caaacuacuguuccuucaa

SEQ ID NO: 1327853 - RNA, 19 nt, Homo sapiens
ugcgacaccucccacaaga

SEQ ID NO: 1327854 - RNA, 19 nt, Homo sapiens
gccaggaguucagcaccuu

SEQ ID NO: 1327855 - RNA, 19 nt, Homo sapiens
guacauggaggaggagauc

SEQ ID NO: 1327856 - RNA, 19 nt, Homo sapiens
aagaagaggaacaggaaga

SEQ ID NO: 1327857 - RNA, 19 nt, Homo sapiens
agaaacaggaagagcaaga

SEQ ID NO: 1327858 - RNA, 19 nt, Homo sapiens
guucagcaccuugacucua

SEQ ID NO: 1327859 - RNA, 19 nt, Homo sapiens
cgaaaggcugugaagaugu

SEQ ID NO: 1327860 - RNA, 19 nt, Homo sapiens
guccaucggcaaccaggua

SEQ ID NO: 1327861 - RNA, 19 nt, Homo sapiens
gagucuuucugccaguuca

SEQ ID NO: 1327862 - RNA, 19 nt, Homo sapiens
gcugagcccuggcaaaagu

SEQ ID NO: 1327863 - RNA, 19 nt, Homo sapiens
gcagaaugagacuuacagu

SEQ ID NO: 1327864 - RNA, 19 nt, Homo sapiens
cagcagugucugaugagaa

SEQ ID NO: 1327865 - RNA, 19 nt, Homo sapiens
ccacgaaaggcugugaaga

SEQ ID NO: 1327866 - RNA, 19 nt, Homo sapiens
guucccagccagucucuau

SEQ ID NO: 1327867 - RNA, 19 nt, Homo sapiens
agcccaaguuucacucuga

SEQ ID NO: 1327868 - RNA, 19 nt, Homo sapiens
ccagcagugucugaugaga

SEQ ID NO: 1327869 - RNA, 19 nt, Homo sapiens
cccagaaucaggccgcuuu

SEQ ID NO: 1327870 - RNA, 19 nt, Homo sapiens
gguacgagaaguagagucu

SEQ ID NO: 1327871 - RNA, 19 nt, Homo sapiens
cgacaccucccacaagacu

SEQ ID NO: 1327872 - RNA, 19 nt, Homo sapiens
ugugacuucugcuccuuga

SEQ ID NO: 1327873 - RNA, 19 nt, Homo sapiens
agucuacuccuaugauaau

SEQ ID NO: 1327874 - RNA, 19 nt, Homo sapiens
ggaagagcuccuacaaucc

SEQ ID NO: 1327875 - RNA, 19 nt, Homo sapiens
gaacugacaugaacaagua

SEQ ID NO: 1327876 - RNA, 19 nt, Homo sapiens
gcaguaacauuucagagaa

SEQ ID NO: 1327877 - RNA, 19 nt, Homo sapiens
gaagacuuaugcucuaauu

SEQ ID NO: 1327878 - RNA, 19 nt, Homo sapiens
uaacagaacuaacuucgau

SEQ ID NO: 1327879 - RNA, 19 nt, Homo sapiens
gcacauauccugagaugau

SEQ ID NO: 1327880 - RNA, 19 nt, Homo sapiens
ggagaguccuugaaagaga

SEQ ID NO: 1327881 - RNA, 19 nt, Homo sapiens
caaagauaguaaaggcuua

SEQ ID NO: 1327882 - RNA, 19 nt, Homo sapiens
aggaaacccugaauucaua

SEQ ID NO: 1327883 - RNA, 19 nt, Homo sapiens
gcugugauaugguauuuau

SEQ ID NO: 1327884 - RNA, 19 nt, Homo sapiens
ggacggugaugaugaagau

SEQ ID NO: 1327885 - RNA, 19 nt, Homo sapiens
ugaaagagacccaaggaaa

SEQ ID NO: 1327886 - RNA, 19 nt, Homo sapiens
gauaguaaaggcuuagaaa

SEQ ID NO: 1327887 - RNA, 19 nt, Homo sapiens
ggacaugguaacggaauua

SEQ ID NO: 1327888 - RNA, 19 nt, Homo sapiens
guacaugucacgguucaua

SEQ ID NO: 1327889 - RNA, 19 nt, Homo sapiens
caauagccuucaugacauu

SEQ ID NO: 1327890 - RNA, 19 nt, Homo sapiens
ugaugaagaugaugcagaa

SEQ ID NO: 1327891 - RNA, 19 nt, Homo sapiens
aaacaccgucuuaacaaua

SEQ ID NO: 1327892 - RNA, 19 nt, Homo sapiens
gaugaugccacuuugauga

SEQ ID NO: 1327893 - RNA, 19 nt, Homo sapiens
aaagauggcuguuguaucc

SEQ ID NO: 1327894 - RNA, 19 nt, Homo sapiens
gaaagagacccaaggaaac

SEQ ID NO: 1327895 - RNA, 19 nt, Homo sapiens
gaaauagaaauaccaacga

SEQ ID NO: 1327896 - RNA, 19 nt, Homo sapiens
ccaaggaaacccugaauuc

SEQ ID NO: 1327897 - RNA, 19 nt, Homo sapiens
gaacaaguagugaaaauug

SEQ ID NO: 1327898 - RNA, 19 nt, Homo sapiens
guucauaggcaguaacauu

SEQ ID NO: 1327899 - RNA, 19 nt, Homo sapiens
gauggcuguuguauccuua

SEQ ID NO: 1327900 - RNA, 19 nt, Homo sapiens
agacuuaugcucuaauuug

SEQ ID NO: 1327901 - RNA, 19 nt, Homo sapiens
ugaagaugaugcagaagau

SEQ ID NO: 1327902 - RNA, 19 nt, Homo sapiens
aaggaagacuuaugcucua

SEQ ID NO: 1327903 - RNA, 19 nt, Homo sapiens
gcuguuguauccuuauugu

SEQ ID NO: 1327904 - RNA, 19 nt, Homo sapiens
ggacuuggacggugaugau

SEQ ID NO: 1327905 - RNA, 19 nt, Homo sapiens
caaggaaacccugaauuca

SEQ ID NO: 1327906 - RNA, 19 nt, Homo sapiens
gagaugaugccacuuugau

SEQ ID NO: 1327907 - RNA, 19 nt, Homo sapiens
gaaauaccaacgagaaagg

SEQ ID NO: 1327908 - RNA, 19 nt, Homo sapiens
ggccuuaaguaaacaaucu

SEQ ID NO: 1327909 - RNA, 19 nt, Homo sapiens
gaguacaugucacgguuca

SEQ ID NO: 1327910 - RNA, 19 nt, Homo sapiens
gaaggaaaauagaacacuu

SEQ ID NO: 1327911 - RNA, 19 nt, Homo sapiens
acaauagccuucaugacau

SEQ ID NO: 1327912 - RNA, 19 nt, Homo sapiens
gucguguucuggaagcuua

SEQ ID NO: 1327913 - RNA, 19 nt, Homo sapiens
gugcugugauaugguauuu

SEQ ID NO: 1327914 - RNA, 19 nt, Homo sapiens
ggcaguaacauuucagaga

SEQ ID NO: 1327915 - RNA, 19 nt, Homo sapiens
cauaggcaguaacauuuca

SEQ ID NO: 1327916 - RNA, 19 nt, Homo sapiens
gcuuagcggucaccaugga

SEQ ID NO: 1327917 - RNA, 19 nt, Homo sapiens
aacaauagccuucaugaca

SEQ ID NO: 1327918 - RNA, 19 nt, Homo sapiens
ccagaugaaggacauggua

SEQ ID NO: 1327919 - RNA, 19 nt, Homo sapiens
uagccuucaugacauuuaa

SEQ ID NO: 1327920 - RNA, 19 nt, Homo sapiens
uaucauguaccuuaagaga

SEQ ID NO: 1327921 - RNA, 19 nt, Homo sapiens
cuuaugcucuaauuuggaa

SEQ ID NO: 1327922 - RNA, 19 nt, Homo sapiens
ggacauuuaaggaagacuu

SEQ ID NO: 1327923 - RNA, 19 nt, Homo sapiens
gaugccacuuugaugaaug

SEQ ID NO: 1327924 - RNA, 19 nt, Homo sapiens
gacuuaugcucuaauuugg

SEQ ID NO: 1327925 - RNA, 19 nt, Homo sapiens
gugcauuagucugauuuau

SEQ ID NO: 1327926 - RNA, 19 nt, Homo sapiens
cuaggacauuuaaggaaga

SEQ ID NO: 1327927 - RNA, 19 nt, Homo sapiens
gacaugaacaaguagugaa

SEQ ID NO: 1327928 - RNA, 19 nt, Homo sapiens
ccugagaugaugccacuuu

SEQ ID NO: 1327929 - RNA, 19 nt, Homo sapiens
uagaaauaccaacgagaaa

SEQ ID NO: 1327930 - RNA, 19 nt, Homo sapiens
auagaaauaccaacgagaa

SEQ ID NO: 1327931 - RNA, 19 nt, Homo sapiens
gaauucauacccacgucaa

SEQ ID NO: 1327932 - RNA, 19 nt, Homo sapiens
gaagaugaugcagaagaug

SEQ ID NO: 1327933 - RNA, 19 nt, Homo sapiens
aggaagacuuaugcucuaa

SEQ ID NO: 1327934 - RNA, 19 nt, Homo sapiens
cagaugaaggacaugguaa

SEQ ID NO: 1327935 - RNA, 19 nt, Homo sapiens
acacuaggacauuuaagga

SEQ ID NO: 1327936 - RNA, 19 nt, Homo sapiens
uauuuccucuccuccugua

SEQ ID NO: 1327937 - RNA, 19 nt, Homo sapiens
uuugugcugugauauggua

SEQ ID NO: 1327938 - RNA, 19 nt, Homo sapiens
ggaagacuuaugcucuaau

SEQ ID NO: 1327939 - RNA, 19 nt, Homo sapiens
ugacaugaacaaguaguga

SEQ ID NO: 1327940 - RNA, 19 nt, Homo sapiens
cuuggacggugaugaugaa

SEQ ID NO: 1327941 - RNA, 19 nt, Homo sapiens
aagaugaugcagaagauga

SEQ ID NO: 1327942 - RNA, 19 nt, Homo sapiens
uuaacaauagccuucauga

SEQ ID NO: 1327943 - RNA, 19 nt, Homo sapiens
ugauuugugugaugucuac

SEQ ID NO: 1327944 - RNA, 19 nt, Homo sapiens
augcacauauccugagaug

SEQ ID NO: 1327945 - RNA, 19 nt, Homo sapiens
ucauacccacgucaaauau

SEQ ID NO: 1327946 - RNA, 19 nt, Homo sapiens
cugagaugaugccacuuug

SEQ ID NO: 1327947 - RNA, 19 nt, Homo sapiens
cacauauccugagaugaug

SEQ ID NO: 1327948 - RNA, 19 nt, Homo sapiens
uucauaggcaguaacauuu

SEQ ID NO: 1327949 - RNA, 19 nt, Homo sapiens
ucauugauuugugugaugu

SEQ ID NO: 1327950 - RNA, 19 nt, Homo sapiens
gaugaugcagaagaugaaa

SEQ ID NO: 1327951 - RNA, 19 nt, Homo sapiens
ugagaugaugccacuuuga

SEQ ID NO: 1327952 - RNA, 19 nt, Homo sapiens
aaggaaacccugaauucau

SEQ ID NO: 1327953 - RNA, 19 nt, Homo sapiens
aacaccgucuuaacaauag

SEQ ID NO: 1327954 - RNA, 19 nt, Homo sapiens
acaugaacaaguagugaaa

SEQ ID NO: 1327955 - RNA, 19 nt, Homo sapiens
uguuguauccuuauuguca

SEQ ID NO: 1327956 - RNA, 19 nt, Homo sapiens
uucauacccacgucaaaua

SEQ ID NO: 1327957 - RNA, 19 nt, Homo sapiens
uucagacccuggaaggaaa

SEQ ID NO: 1327958 - RNA, 19 nt, Homo sapiens
agagaacugacaugaacaa

SEQ ID NO: 1327959 - RNA, 19 nt, Homo sapiens
uauccuuauugucacacua

SEQ ID NO: 1327960 - RNA, 19 nt, Homo sapiens
agauggcuguuguauccuu

SEQ ID NO: 1327961 - RNA, 19 nt, Homo sapiens
ugaugccacuuugaugaau

SEQ ID NO: 1327962 - RNA, 19 nt, Homo sapiens
uagugaaaauugggcauua

SEQ ID NO: 1327963 - RNA, 19 nt, Homo sapiens
uggagcugcugggagagua

SEQ ID NO: 1327964 - RNA, 19 nt, Homo sapiens
uggcuguuguauccuuauu

SEQ ID NO: 1327965 - RNA, 19 nt, Homo sapiens
gaagagaucugugauuaaa

SEQ ID NO: 1327966 - RNA, 19 nt, Homo sapiens
gguagaagcuccuugagaa

SEQ ID NO: 1327967 - RNA, 19 nt, Homo sapiens
caacagcuaugaaacaaau

SEQ ID NO: 1327968 - RNA, 19 nt, Homo sapiens
gaaauaguccauucucauu

SEQ ID NO: 1327969 - RNA, 19 nt, Homo sapiens
gaaccuaagucauaguugu

SEQ ID NO: 1327970 - RNA, 19 nt, Homo sapiens
ggaaauagggaauaaauca

SEQ ID NO: 1327971 - RNA, 19 nt, Homo sapiens
caaauuacuucaucucuag

SEQ ID NO: 1327972 - RNA, 19 nt, Homo sapiens
aggaagagaucugugauua

SEQ ID NO: 1327973 - RNA, 19 nt, Homo sapiens
ucaagaagcugaucuacgu

SEQ ID NO: 1327974 - RNA, 19 nt, Homo sapiens
ggagaagaagcauaaauga

SEQ ID NO: 1327975 - RNA, 19 nt, Homo sapiens
ggaagagaucugugauuaa

SEQ ID NO: 1327976 - RNA, 19 nt, Homo sapiens
ggaaggaagagaucuguga

SEQ ID NO: 1327977 - RNA, 19 nt, Homo sapiens
guuaugggcucuucuuuua

SEQ ID NO: 1327978 - RNA, 19 nt, Homo sapiens
cauuuaaucucuccaucua

SEQ ID NO: 1327979 - RNA, 19 nt, Homo sapiens
ugaaagguguguugcuuga

SEQ ID NO: 1327980 - RNA, 19 nt, Homo sapiens
cuacguacaucuggucaua

SEQ ID NO: 1327981 - RNA, 19 nt, Homo sapiens
gagaagaagcauaaaugaa

SEQ ID NO: 1327982 - RNA, 19 nt, Homo sapiens
gaaugaaaggacacuagua

SEQ ID NO: 1327983 - RNA, 19 nt, Homo sapiens
aaagguguguugcuugaaa

SEQ ID NO: 1327984 - RNA, 19 nt, Homo sapiens
gaacuaugggccagacauu

SEQ ID NO: 1327985 - RNA, 19 nt, Homo sapiens
gugaaacagugaacauaau

SEQ ID NO: 1327986 - RNA, 19 nt, Homo sapiens
uuuagcagcuguaauguug

SEQ ID NO: 1327987 - RNA, 19 nt, Homo sapiens
ggccuaccguuuccucuuu

SEQ ID NO: 1327988 - RNA, 19 nt, Homo sapiens
ggccagacauuuaaucucu

SEQ ID NO: 1327989 - RNA, 19 nt, Homo sapiens
gcauaaaugaagccucuuu

SEQ ID NO: 1327990 - RNA, 19 nt, Homo sapiens
gacaucccaucgaaugaaa

SEQ ID NO: 1327991 - RNA, 19 nt, Homo sapiens
gaaacuuguuauucaugug

SEQ ID NO: 1327992 - RNA, 19 nt, Homo sapiens
acaauucaguagaaacuug

SEQ ID NO: 1327993 - RNA, 19 nt, Homo sapiens
ugagucuacuacuguauaa

SEQ ID NO: 1327994 - RNA, 19 nt, Homo sapiens
gugugacccucaaguauga

SEQ ID NO: 1327995 - RNA, 19 nt, Homo sapiens
gccaugcacuaccagauga

SEQ ID NO: 1327996 - RNA, 19 nt, Homo sapiens
gcacacaggagaagaagca

SEQ ID NO: 1327997 - RNA, 19 nt, Homo sapiens
cuaaugauguggagcaagu

SEQ ID NO: 1327998 - RNA, 19 nt, Homo sapiens
ggacaucccaucgaaugaa

SEQ ID NO: 1327999 - RNA, 19 nt, Homo sapiens
guacagcgguuccaaaauc

SEQ ID NO: 1328000 - RNA, 19 nt, Homo sapiens
gaucagcaugggacucuuu

SEQ ID NO: 1328001 - RNA, 19 nt, Homo sapiens
ccauugagacuaaaggaaa

SEQ ID NO: 1328002 - RNA, 19 nt, Homo sapiens
gcuguggucuccucugcaa

SEQ ID NO: 1328003 - RNA, 19 nt, Homo sapiens
agaagaagcauaaaugaag

SEQ ID NO: 1328004 - RNA, 19 nt, Homo sapiens
cacaggagaagaagcauaa

SEQ ID NO: 1328005 - RNA, 19 nt, Homo sapiens
uuccaucgcuccacucauu

SEQ ID NO: 1328006 - RNA, 19 nt, Homo sapiens
ccucaaguaugaaaucaag

SEQ ID NO: 1328007 - RNA, 19 nt, Homo sapiens
acuaugggccagacauuua

SEQ ID NO: 1328008 - RNA, 19 nt, Homo sapiens
guagaagcuccuugagaaa

SEQ ID NO: 1328009 - RNA, 19 nt, Homo sapiens
ucauuuaucuagcuuaggu

SEQ ID NO: 1328010 - RNA, 19 nt, Homo sapiens
uuuaaucucuccaucuaug

SEQ ID NO: 1328011 - RNA, 19 nt, Homo sapiens
gaccaacagcuaugaaaca

SEQ ID NO: 1328012 - RNA, 19 nt, Homo sapiens
aaaccuagcaguggccaua

SEQ ID NO: 1328013 - RNA, 19 nt, Homo sapiens
agagaucugugauuaaacu

SEQ ID NO: 1328014 - RNA, 19 nt, Homo sapiens
gaaggaagagaucugugau

SEQ ID NO: 1328015 - RNA, 19 nt, Homo sapiens
caaaaucccuucuggugau

SEQ ID NO: 1328016 - RNA, 19 nt, Homo sapiens
ggauuuacaauucaguaga

SEQ ID NO: 1328017 - RNA, 19 nt, Homo sapiens
ucacgggucaggaaacauu

SEQ ID NO: 1328018 - RNA, 19 nt, Homo sapiens
ggucacgggucaggaaaca

SEQ ID NO: 1328019 - RNA, 19 nt, Homo sapiens
gagugugacccucaaguau

SEQ ID NO: 1328020 - RNA, 19 nt, Homo sapiens
ugugaaacagugaacauaa

SEQ ID NO: 1328021 - RNA, 19 nt, Homo sapiens
cuaaaggaaauagggaaua

SEQ ID NO: 1328022 - RNA, 19 nt, Homo sapiens
guuaugagucuacuacugu

SEQ ID NO: 1328023 - RNA, 19 nt, Homo sapiens
accuacagcugauugguaa

SEQ ID NO: 1328024 - RNA, 19 nt, Homo sapiens
gcugauugguaagaacuau

SEQ ID NO: 1328025 - RNA, 19 nt, Homo sapiens
cugaggcucuugucacaug

SEQ ID NO: 1328026 - RNA, 19 nt, Homo sapiens
caguggccauagagaagua

SEQ ID NO: 1328027 - RNA, 19 nt, Homo sapiens
ucauguaccugguguuggu

SEQ ID NO: 1328028 - RNA, 19 nt, Homo sapiens
uuaugagucuacuacugua

SEQ ID NO: 1328029 - RNA, 19 nt, Homo sapiens
ggguaucaguuaugagucu

SEQ ID NO: 1328030 - RNA, 19 nt, Homo sapiens
uuaucuagcuuagguuaug

SEQ ID NO: 1328031 - RNA, 19 nt, Homo sapiens
ggucuccucugcaaagcau

SEQ ID NO: 1328032 - RNA, 19 nt, Homo sapiens
cauugagacuaaaggaaau

SEQ ID NO: 1328033 - RNA, 19 nt, Homo sapiens
gcaacaacauuagcuaccu

SEQ ID NO: 1328034 - RNA, 19 nt, Homo sapiens
ugaaauaguccauucucau

SEQ ID NO: 1328035 - RNA, 19 nt, Homo sapiens
gugcagaccaggccaaagu

SEQ ID NO: 1328036 - RNA, 19 nt, Homo sapiens
ccaucgcuccacucauuua

SEQ ID NO: 1328037 - RNA, 19 nt, Homo sapiens
gcugcugguugcuaagaug

SEQ ID NO: 1328038 - RNA, 19 nt, Homo sapiens
gguaucaguuaugagucua

SEQ ID NO: 1328039 - RNA, 19 nt, Homo sapiens
gggaaccuaagucauaguu

SEQ ID NO: 1328040 - RNA, 19 nt, Homo sapiens
ggguagaagcuccuugaga

SEQ ID NO: 1328041 - RNA, 19 nt, Homo sapiens
ugugaaagguguguugcuu

SEQ ID NO: 1328042 - RNA, 19 nt, Homo sapiens
caagaagcugaucuacgua

SEQ ID NO: 1328043 - RNA, 19 nt, Homo sapiens
gccuggacaucccaucgaa

SEQ ID NO: 1328044 - RNA, 19 nt, Homo sapiens
gaaagguguguugcuugaa

SEQ ID NO: 1328045 - RNA, 19 nt, Homo sapiens
cauaaaugaagccucuuug

SEQ ID NO: 1328046 - RNA, 19 nt, Homo sapiens
agaagcuccuagacucuug

SEQ ID NO: 1328047 - RNA, 19 nt, Homo sapiens
ucgcuccacucauuuaugg

SEQ ID NO: 1328048 - RNA, 19 nt, Homo sapiens
aaacaggaaggaagagauc

SEQ ID NO: 1328049 - RNA, 19 nt, Homo sapiens
caguagaaacuuguuauuc

SEQ ID NO: 1328050 - RNA, 19 nt, Homo sapiens
guucugggcaggcacaaug

SEQ ID NO: 1328051 - RNA, 19 nt, Homo sapiens
ucagcuguuugaaguugaa

SEQ ID NO: 1328052 - RNA, 19 nt, Homo sapiens
gcagaccaggccaaaguuc

SEQ ID NO: 1328053 - RNA, 19 nt, Homo sapiens
aggagaagaagcauaaaug

SEQ ID NO: 1328054 - RNA, 19 nt, Homo sapiens
caucauguaccugguguug

SEQ ID NO: 1328055 - RNA, 19 nt, Homo sapiens
acguacaucuggucauaug

SEQ ID NO: 1328056 - RNA, 19 nt, Homo sapiens
guggagcaaguacauuaaa

SEQ ID NO: 1328057 - RNA, 19 nt, Homo sapiens
ggccaaaguucuggaaagc

SEQ ID NO: 1328058 - RNA, 19 nt, Homo sapiens
gauuuuagcagcuguaaug

SEQ ID NO: 1328059 - RNA, 19 nt, Homo sapiens
acacaggagaagaagcaua

SEQ ID NO: 1328060 - RNA, 19 nt, Homo sapiens
uggcaaggccuaccguuuc

SEQ ID NO: 1328061 - RNA, 19 nt, Homo sapiens
ucucauuuaucuagcuuag

SEQ ID NO: 1328062 - RNA, 19 nt, Homo sapiens
cuaugggccagacauuuaa

SEQ ID NO: 1328063 - RNA, 19 nt, Homo sapiens
agaaguagacuggguaugg

SEQ ID NO: 1328064 - RNA, 19 nt, Homo sapiens
uagcaguggccauagagaa

SEQ ID NO: 1328065 - RNA, 19 nt, Homo sapiens
ccaaagagcuucaacagua

SEQ ID NO: 1328066 - RNA, 19 nt, Homo sapiens
gaaaggaaauguauuaagg

SEQ ID NO: 1328067 - RNA, 19 nt, Homo sapiens
aaaguucgcugcauagaaa

SEQ ID NO: 1328068 - RNA, 19 nt, Homo sapiens
ggugauggcugguggguaa

SEQ ID NO: 1328069 - RNA, 19 nt, Homo sapiens
acagagagcugggaucuaa

SEQ ID NO: 1328070 - RNA, 19 nt, Homo sapiens
gaacagcggcucacaggaa

SEQ ID NO: 1328071 - RNA, 19 nt, Homo sapiens
guucaagacuggugauuug

SEQ ID NO: 1328072 - RNA, 19 nt, Homo sapiens
ggagaccaguguaaauuug

SEQ ID NO: 1328073 - RNA, 19 nt, Homo sapiens
gaacugcucggaagacauu

SEQ ID NO: 1328074 - RNA, 19 nt, Homo sapiens
gaaguaaggacuaugaugu

SEQ ID NO: 1328075 - RNA, 19 nt, Homo sapiens
gaaagaaucgaugaugaaa

SEQ ID NO: 1328076 - RNA, 19 nt, Homo sapiens
gaucuaauguacaagugaa

SEQ ID NO: 1328077 - RNA, 19 nt, Homo sapiens
ggaaacaaaggaucaaaug

SEQ ID NO: 1328078 - RNA, 19 nt, Homo sapiens
ggguaaaugugauaguaaa

SEQ ID NO: 1328079 - RNA, 19 nt, Homo sapiens
agacauuuguuuccaguuu

SEQ ID NO: 1328080 - RNA, 19 nt, Homo sapiens
gagcugggaucuaauguac

SEQ ID NO: 1328081 - RNA, 19 nt, Homo sapiens
gcugggaucuaauguacaa

SEQ ID NO: 1328082 - RNA, 19 nt, Homo sapiens
caaccaacauacaguggaa

SEQ ID NO: 1328083 - RNA, 19 nt, Homo sapiens
guagcaauguacagauaaa

SEQ ID NO: 1328084 - RNA, 19 nt, Homo sapiens
uggaguaguuuacaagauu

SEQ ID NO: 1328085 - RNA, 19 nt, Homo sapiens
ccagagaaauggcaaaugc

SEQ ID NO: 1328086 - RNA, 19 nt, Homo sapiens
caagaaguaaggacuauga

SEQ ID NO: 1328087 - RNA, 19 nt, Homo sapiens
gagggugaguaaagaggua

SEQ ID NO: 1328088 - RNA, 19 nt, Homo sapiens
ggaagaggaugguaaaccu

SEQ ID NO: 1328089 - RNA, 19 nt, Homo sapiens
guacauacaagccagagaa

SEQ ID NO: 1328090 - RNA, 19 nt, Homo sapiens
guggguaaaugugauagua

SEQ ID NO: 1328091 - RNA, 19 nt, Homo sapiens
gaagaaacacaagaagaga

SEQ ID NO: 1328092 - RNA, 19 nt, Homo sapiens
guaaggacuaugauguaua

SEQ ID NO: 1328093 - RNA, 19 nt, Homo sapiens
cgaaagaaucgaugaugaa

SEQ ID NO: 1328094 - RNA, 19 nt, Homo sapiens
aagagaagcagcagcauuu

SEQ ID NO: 1328095 - RNA, 19 nt, Homo sapiens
gaugguaaaccuaaagaga

SEQ ID NO: 1328096 - RNA, 19 nt, Homo sapiens
ccugaagaaucuacaaaga

SEQ ID NO: 1328097 - RNA, 19 nt, Homo sapiens
uagacacucugcaauauca

SEQ ID NO: 1328098 - RNA, 19 nt, Homo sapiens
ggaguaguuuacaagauuc

SEQ ID NO: 1328099 - RNA, 19 nt, Homo sapiens
gaagaggaugguaaaccua

SEQ ID NO: 1328100 - RNA, 19 nt, Homo sapiens
ggugaaaacugucuguauu

SEQ ID NO: 1328101 - RNA, 19 nt, Homo sapiens
gcauucaucaaccaacaua

SEQ ID NO: 1328102 - RNA, 19 nt, Homo sapiens
gggagaccaguguaaauuu

SEQ ID NO: 1328103 - RNA, 19 nt, Homo sapiens
caaagagcuucaacaguac

SEQ ID NO: 1328104 - RNA, 19 nt, Homo sapiens
gaauaggagaggagcauau

SEQ ID NO: 1328105 - RNA, 19 nt, Homo sapiens
guucaagacuguucaagac

SEQ ID NO: 1328106 - RNA, 19 nt, Homo sapiens
gagaagcagcagcauuuga

SEQ ID NO: 1328107 - RNA, 19 nt, Homo sapiens
acgaaagaaucgaugauga

SEQ ID NO: 1328108 - RNA, 19 nt, Homo sapiens
uaaagcuggucacaagaau

SEQ ID NO: 1328109 - RNA, 19 nt, Homo sapiens
cauacaagccagagaaaug

SEQ ID NO: 1328110 - RNA, 19 nt, Homo sapiens
uacagaaguugaagaaaca

SEQ ID NO: 1328111 - RNA, 19 nt, Homo sapiens
gagugagggugaguaaaga

SEQ ID NO: 1328112 - RNA, 19 nt, Homo sapiens
gaaagaaggaguaaaagau

SEQ ID NO: 1328113 - RNA, 19 nt, Homo sapiens
uuacaagauuccucauuca

SEQ ID NO: 1328114 - RNA, 19 nt, Homo sapiens
gaauuguuggcuaaaguuu

SEQ ID NO: 1328115 - RNA, 19 nt, Homo sapiens
ucuuaaagcuggucacaag

SEQ ID NO: 1328116 - RNA, 19 nt, Homo sapiens
gaaauagauacagaaguug

SEQ ID NO: 1328117 - RNA, 19 nt, Homo sapiens
ccaguuuccuauuguuaga

SEQ ID NO: 1328118 - RNA, 19 nt, Homo sapiens
ucacaagaauggcaaacag

SEQ ID NO: 1328119 - RNA, 19 nt, Homo sapiens
cacggacucugacgaaaga

SEQ ID NO: 1328120 - RNA, 19 nt, Homo sapiens
cggaagacauugguagaug

SEQ ID NO: 1328121 - RNA, 19 nt, Homo sapiens
gagaacugcucggaagaca

SEQ ID NO: 1328122 - RNA, 19 nt, Homo sapiens
auacagaaguugaagaaac

SEQ ID NO: 1328123 - RNA, 19 nt, Homo sapiens
gaaucgaugaugaaauaga

SEQ ID NO: 1328124 - RNA, 19 nt, Homo sapiens
gauuuggaguaguuuacaa

SEQ ID NO: 1328125 - RNA, 19 nt, Homo sapiens
aacaaaggaucaaaugcuu

SEQ ID NO: 1328126 - RNA, 19 nt, Homo sapiens
agucaggaaucagaagaua

SEQ ID NO: 1328127 - RNA, 19 nt, Homo sapiens
ggucauggauuuugagaau

SEQ ID NO: 1328128 - RNA, 19 nt, Homo sapiens
caauaucucuuacuauacc

SEQ ID NO: 1328129 - RNA, 19 nt, Homo sapiens
ugaucaugaugcagagaua

SEQ ID NO: 1328130 - RNA, 19 nt, Homo sapiens
gaagacauugguagaugga

SEQ ID NO: 1328131 - RNA, 19 nt, Homo sapiens
ggaauaggagaggagcaua

SEQ ID NO: 1328132 - RNA, 19 nt, Homo sapiens
caagaauuguuggcuaaag

SEQ ID NO: 1328133 - RNA, 19 nt, Homo sapiens
ggacagagagcugggaucu

SEQ ID NO: 1328134 - RNA, 19 nt, Homo sapiens
gcauuugagucaggcauuc

SEQ ID NO: 1328135 - RNA, 19 nt, Homo sapiens
agaaacacaagaagagaaa

SEQ ID NO: 1328136 - RNA, 19 nt, Homo sapiens
gcaaacagaagaaaaugaa

SEQ ID NO: 1328137 - RNA, 19 nt, Homo sapiens
gacauuuguuuccaguuuc

SEQ ID NO: 1328138 - RNA, 19 nt, Homo sapiens
aaacuggagugcgagcaaa

SEQ ID NO: 1328139 - RNA, 19 nt, Homo sapiens
gaguuaguucucuuuauga

SEQ ID NO: 1328140 - RNA, 19 nt, Homo sapiens
ugaagaaacacaagaagag

SEQ ID NO: 1328141 - RNA, 19 nt, Homo sapiens
uuuacaagauuccucauuc

SEQ ID NO: 1328142 - RNA, 19 nt, Homo sapiens
gcaauguacagauaaagag

SEQ ID NO: 1328143 - RNA, 19 nt, Homo sapiens
agguagcaauguacagaua

SEQ ID NO: 1328144 - RNA, 19 nt, Homo sapiens
gucuguauuugcauaauga

SEQ ID NO: 1328145 - RNA, 19 nt, Homo sapiens
uaagggagaccaguguaaa

SEQ ID NO: 1328146 - RNA, 19 nt, Homo sapiens
gaaacaaaggaucaaaugc

SEQ ID NO: 1328147 - RNA, 19 nt, Homo sapiens
ucaggaaucagaagauaau

SEQ ID NO: 1328148 - RNA, 19 nt, Homo sapiens
gcaagguuaggcugaguga

SEQ ID NO: 1328149 - RNA, 19 nt, Homo sapiens
gguagcaauguacagauaa

SEQ ID NO: 1328150 - RNA, 19 nt, Homo sapiens
gagaccaguguaaauuuga

SEQ ID NO: 1328151 - RNA, 19 nt, Homo sapiens
gccuggcccuggaaacaaa

SEQ ID NO: 1328152 - RNA, 19 nt, Homo sapiens
gaggagguuugaggagaga

SEQ ID NO: 1328153 - RNA, 19 nt, Homo sapiens
auaaugauaucugcaguca

SEQ ID NO: 1328154 - RNA, 19 nt, Homo sapiens
aaagagaagcagcagcauu

SEQ ID NO: 1328155 - RNA, 19 nt, Homo sapiens
ccacaggcugcuaaacaaa

SEQ ID NO: 1328156 - RNA, 19 nt, Homo sapiens
cccacaggcugcuaaacaa

SEQ ID NO: 1328157 - RNA, 19 nt, Homo sapiens
uuuagacacucugcaauau

SEQ ID NO: 1328158 - RNA, 19 nt, Homo sapiens
gcagucaggaaucagaaga

SEQ ID NO: 1328159 - RNA, 19 nt, Homo sapiens
gcugagugagggugaguaa

SEQ ID NO: 1328160 - RNA, 19 nt, Homo sapiens
gggaucuaauguacaagug

SEQ ID NO: 1328161 - RNA, 19 nt, Homo sapiens
aagaauuguuggcuaaagu

SEQ ID NO: 1328162 - RNA, 19 nt, Homo sapiens
aaacggccacggacucuga

SEQ ID NO: 1328163 - RNA, 19 nt, Homo sapiens
gagagaacugcucggaaga

SEQ ID NO: 1328164 - RNA, 19 nt, Homo sapiens
aauaggagaggagcauaua

SEQ ID NO: 1328165 - RNA, 19 nt, Homo sapiens
gaauauagcugcauuaacu

SEQ ID NO: 1328166 - RNA, 19 nt, Homo sapiens
gaugacagauggugugaaa

SEQ ID NO: 1328167 - RNA, 19 nt, Homo sapiens
gaacacauuuccuucugaa

SEQ ID NO: 1328168 - RNA, 19 nt, Homo sapiens
gcagauccgucacagacua

SEQ ID NO: 1328169 - RNA, 19 nt, Homo sapiens
ucacuuuccuuauguauca

SEQ ID NO: 1328170 - RNA, 19 nt, Homo sapiens
ccaaaguucuugaauuuac

SEQ ID NO: 1328171 - RNA, 19 nt, Homo sapiens
cagaaggccugcccucaga

SEQ ID NO: 1328172 - RNA, 19 nt, Homo sapiens
caaugaugguugagugaaa

SEQ ID NO: 1328173 - RNA, 19 nt, Homo sapiens
cauaauccauuuagcaauc

SEQ ID NO: 1328174 - RNA, 19 nt, Homo sapiens
cuaauacaaugaugguuga

SEQ ID NO: 1328175 - RNA, 19 nt, Homo sapiens
uagcuguccugcuguuuaa

SEQ ID NO: 1328176 - RNA, 19 nt, Homo sapiens
aaagcaagcaucuaagaaa

SEQ ID NO: 1328177 - RNA, 19 nt, Homo sapiens
gcauuaacuuggaaagaag

SEQ ID NO: 1328178 - RNA, 19 nt, Homo sapiens
ucaacaaggucgacaagca

SEQ ID NO: 1328179 - RNA, 19 nt, Homo sapiens
gggagaagggaacacauuu

SEQ ID NO: 1328180 - RNA, 19 nt, Homo sapiens
ugcauuaacuuggaaagaa

SEQ ID NO: 1328181 - RNA, 19 nt, Homo sapiens
cagaagggguguuugagua

SEQ ID NO: 1328182 - RNA, 19 nt, Homo sapiens
gaccaucaccucccaguag

SEQ ID NO: 1328183 - RNA, 19 nt, Homo sapiens
caucuaaguuugcuuuuga

SEQ ID NO: 1328184 - RNA, 19 nt, Homo sapiens
ugaaggccaucucuguuuc

SEQ ID NO: 1328185 - RNA, 19 nt, Homo sapiens
ggagaagggaacacauuuc

SEQ ID NO: 1328186 - RNA, 19 nt, Homo sapiens
uggaaauccuggaguacaa

SEQ ID NO: 1328187 - RNA, 19 nt, Homo sapiens
cacauuuccuucugaacuu

SEQ ID NO: 1328188 - RNA, 19 nt, Homo sapiens
auguguaucuucuguguaa

SEQ ID NO: 1328189 - RNA, 19 nt, Homo sapiens
aagauaauaugagggagaa

SEQ ID NO: 1328190 - RNA, 19 nt, Homo sapiens
ggaguacaacuucaacaag

SEQ ID NO: 1328191 - RNA, 19 nt, Homo sapiens
cuagcuguccugcuguuua

SEQ ID NO: 1328192 - RNA, 19 nt, Homo sapiens
acauuuccuucugaacuua

SEQ ID NO: 1328193 - RNA, 19 nt, Homo sapiens
gcaauccaggccucuguug

SEQ ID NO: 1328194 - RNA, 19 nt, Homo sapiens
gaagacagaaacuccaacu

SEQ ID NO: 1328195 - RNA, 19 nt, Homo sapiens
guggcuagcauuucccuuu

SEQ ID NO: 1328196 - RNA, 19 nt, Homo sapiens
ggagauggcaggcauugac

SEQ ID NO: 1328197 - RNA, 19 nt, Homo sapiens
gaggagacccagaaauggu

SEQ ID NO: 1328198 - RNA, 19 nt, Homo sapiens
guuugaguauucagauuuc

SEQ ID NO: 1328199 - RNA, 19 nt, Homo sapiens
cagaggaccagguggaaau

SEQ ID NO: 1328200 - RNA, 19 nt, Homo sapiens
guuguauguuccauugcua

SEQ ID NO: 1328201 - RNA, 19 nt, Homo sapiens
ggaggagacccagaaaugg

SEQ ID NO: 1328202 - RNA, 19 nt, Homo sapiens
ccaugaaggccaucucugu

SEQ ID NO: 1328203 - RNA, 19 nt, Homo sapiens
ggcuagcauuucccuuuga

SEQ ID NO: 1328204 - RNA, 19 nt, Homo sapiens
ggagacccagaaaugguuu

SEQ ID NO: 1328205 - RNA, 19 nt, Homo sapiens
uggcuagcauuucccuuug

SEQ ID NO: 1328206 - RNA, 19 nt, Homo sapiens
uggaauauagcugcauuaa

SEQ ID NO: 1328207 - RNA, 19 nt, Homo sapiens
cuauguguaucuucugugu

SEQ ID NO: 1328208 - RNA, 19 nt, Homo sapiens
aguguuguauguuccauug

SEQ ID NO: 1328209 - RNA, 19 nt, Homo sapiens
caugaaggccaucucuguu

SEQ ID NO: 1328210 - RNA, 19 nt, Homo sapiens
guguuugaguauucagauu

SEQ ID NO: 1328211 - RNA, 19 nt, Homo sapiens
gaagggguguuugaguauu

SEQ ID NO: 1328212 - RNA, 19 nt, Homo sapiens
gcauuucccuuugagucau

SEQ ID NO: 1328213 - RNA, 19 nt, Homo sapiens
uuaagcagcgccuggcaaa

SEQ ID NO: 1328214 - RNA, 19 nt, Homo sapiens
uggcaggcauugacagcuu

SEQ ID NO: 1328215 - RNA, 19 nt, Homo sapiens
ggaauauagcugcauuaac

SEQ ID NO: 1328216 - RNA, 19 nt, Homo sapiens
agguggaaauccuggagua

SEQ ID NO: 1328217 - RNA, 19 nt, Homo sapiens
aggaggagacccagaaaug

SEQ ID NO: 1328218 - RNA, 19 nt, Homo sapiens
ucaccucccaguagcaauu

SEQ ID NO: 1328219 - RNA, 19 nt, Homo sapiens
aagcaagcaucuaagaaaa

SEQ ID NO: 1328220 - RNA, 19 nt, Homo sapiens
uagcugcauuaacuuggaa

SEQ ID NO: 1328221 - RNA, 19 nt, Homo sapiens
caauuugcuuucauaaucc

SEQ ID NO: 1328222 - RNA, 19 nt, Homo sapiens
gcuagcauuucccuuugag

SEQ ID NO: 1328223 - RNA, 19 nt, Homo sapiens
ugacagcuucacuccauga

SEQ ID NO: 1328224 - RNA, 19 nt, Homo sapiens
gaggaggagacccagaaau

SEQ ID NO: 1328225 - RNA, 19 nt, Homo sapiens
cgucacagacuaaggagau

SEQ ID NO: 1328226 - RNA, 19 nt, Homo sapiens
cuuggaauauagcugcauu

SEQ ID NO: 1328227 - RNA, 19 nt, Homo sapiens
cagaagacagaaacuccaa

SEQ ID NO: 1328228 - RNA, 19 nt, Homo sapiens
aauccaggccucuguugaa

SEQ ID NO: 1328229 - RNA, 19 nt, Homo sapiens
caauccaggccucuguuga

SEQ ID NO: 1328230 - RNA, 19 nt, Homo sapiens
gagacccagaaaugguuua

SEQ ID NO: 1328231 - RNA, 19 nt, Homo sapiens
gagauggcaggcauugaca

SEQ ID NO: 1328232 - RNA, 19 nt, Homo sapiens
gaaggccugcccucagagu

SEQ ID NO: 1328233 - RNA, 19 nt, Homo sapiens
cagauccgucacagacuaa

SEQ ID NO: 1328234 - RNA, 19 nt, Homo sapiens
ccgaggaggagacccagaa

SEQ ID NO: 1328235 - RNA, 19 nt, Homo sapiens
cgaggaggagacccagaaa

SEQ ID NO: 1328236 - RNA, 19 nt, Homo sapiens
augaaggccaucucuguuu

SEQ ID NO: 1328237 - RNA, 19 nt, Homo sapiens
gaagccuguugggccagaa

SEQ ID NO: 1328238 - RNA, 19 nt, Homo sapiens
auugacagcuucacuccau

SEQ ID NO: 1328239 - RNA, 19 nt, Homo sapiens
gaaggccaucucuguuucu

SEQ ID NO: 1328240 - RNA, 19 nt, Homo sapiens
gaauauagcugcauuaacu

SEQ ID NO: 1328241 - RNA, 19 nt, Homo sapiens
gaugacagauggugugaaa

SEQ ID NO: 1328242 - RNA, 19 nt, Homo sapiens
gaacacauuuccuucugaa

SEQ ID NO: 1328243 - RNA, 19 nt, Homo sapiens
gcagauccgucacagacua

SEQ ID NO: 1328244 - RNA, 19 nt, Homo sapiens
ucacuuuccuuauguauca

SEQ ID NO: 1328245 - RNA, 19 nt, Homo sapiens
ccaaaguucuugaauuuac

SEQ ID NO: 1328246 - RNA, 19 nt, Homo sapiens
cagaaggccugcccucaga

SEQ ID NO: 1328247 - RNA, 19 nt, Homo sapiens
caaugaugguugagugaaa

SEQ ID NO: 1328248 - RNA, 19 nt, Homo sapiens
cauaauccauuuagcaauc

SEQ ID NO: 1328249 - RNA, 19 nt, Homo sapiens
cuaauacaaugaugguuga

SEQ ID NO: 1328250 - RNA, 19 nt, Homo sapiens
uagcuguccugcuguuuaa

SEQ ID NO: 1328251 - RNA, 19 nt, Homo sapiens
aaagcaagcaucuaagaaa

SEQ ID NO: 1328252 - RNA, 19 nt, Homo sapiens
gcauuaacuuggaaagaag

SEQ ID NO: 1328253 - RNA, 19 nt, Homo sapiens
ucaacaaggucgacaagca

SEQ ID NO: 1328254 - RNA, 19 nt, Homo sapiens
gggagaagggaacacauuu

SEQ ID NO: 1328255 - RNA, 19 nt, Homo sapiens
ugcauuaacuuggaaagaa

SEQ ID NO: 1328256 - RNA, 19 nt, Homo sapiens
cagaagggguguuugagua

SEQ ID NO: 1328257 - RNA, 19 nt, Homo sapiens
gaccaucaccucccaguag

SEQ ID NO: 1328258 - RNA, 19 nt, Homo sapiens
caucuaaguuugcuuuuga

SEQ ID NO: 1328259 - RNA, 19 nt, Homo sapiens
ugaaggccaucucuguuuc

SEQ ID NO: 1328260 - RNA, 19 nt, Homo sapiens
uggaaauccuggaguacaa

SEQ ID NO: 1328261 - RNA, 19 nt, Homo sapiens
ggagaagggaacacauuuc

SEQ ID NO: 1328262 - RNA, 19 nt, Homo sapiens
cacauuuccuucugaacuu

SEQ ID NO: 1328263 - RNA, 19 nt, Homo sapiens
auguguaucuucuguguaa

SEQ ID NO: 1328264 - RNA, 19 nt, Homo sapiens
aagauaauaugagggagaa

SEQ ID NO: 1328265 - RNA, 19 nt, Homo sapiens
ggaguacaacuucaacaag

SEQ ID NO: 1328266 - RNA, 19 nt, Homo sapiens
cuagcuguccugcuguuua

SEQ ID NO: 1328267 - RNA, 19 nt, Homo sapiens
acauuuccuucugaacuua

SEQ ID NO: 1328268 - RNA, 19 nt, Homo sapiens
gcaauccaggccucuguug

SEQ ID NO: 1328269 - RNA, 19 nt, Homo sapiens
gaagacagaaacuccaacu

SEQ ID NO: 1328270 - RNA, 19 nt, Homo sapiens
guggcuagcauuucccuuu

SEQ ID NO: 1328271 - RNA, 19 nt, Homo sapiens
ggagauggcaggcauugac

SEQ ID NO: 1328272 - RNA, 19 nt, Homo sapiens
gaggagacccagaaauggu

SEQ ID NO: 1328273 - RNA, 19 nt, Homo sapiens
cagaggaccagguggaaau

SEQ ID NO: 1328274 - RNA, 19 nt, Homo sapiens
guuugaguauucagauuuc

SEQ ID NO: 1328275 - RNA, 19 nt, Homo sapiens
guuguauguuccauugcua

SEQ ID NO: 1328276 - RNA, 19 nt, Homo sapiens
ccaugaaggccaucucugu

SEQ ID NO: 1328277 - RNA, 19 nt, Homo sapiens
ggaggagacccagaaaugg

SEQ ID NO: 1328278 - RNA, 19 nt, Homo sapiens
ggcuagcauuucccuuuga

SEQ ID NO: 1328279 - RNA, 19 nt, Homo sapiens
uggcuagcauuucccuuug

SEQ ID NO: 1328280 - RNA, 19 nt, Homo sapiens
ggagacccagaaaugguuu

SEQ ID NO: 1328281 - RNA, 19 nt, Homo sapiens
uggaauauagcugcauuaa

SEQ ID NO: 1328282 - RNA, 19 nt, Homo sapiens
cuauguguaucuucugugu

SEQ ID NO: 1328283 - RNA, 19 nt, Homo sapiens
aguguuguauguuccauug

SEQ ID NO: 1328284 - RNA, 19 nt, Homo sapiens
caugaaggccaucucuguu

SEQ ID NO: 1328285 - RNA, 19 nt, Homo sapiens
guguuugaguauucagauu

SEQ ID NO: 1328286 - RNA, 19 nt, Homo sapiens
uuaagcagcgccuggcaaa

SEQ ID NO: 1328287 - RNA, 19 nt, Homo sapiens
gaagggguguuugaguauu

SEQ ID NO: 1328288 - RNA, 19 nt, Homo sapiens
gcauuucccuuugagucau

SEQ ID NO: 1328289 - RNA, 19 nt, Homo sapiens
uggcaggcauugacagcuu

SEQ ID NO: 1328290 - RNA, 19 nt, Homo sapiens
ggaauauagcugcauuaac

SEQ ID NO: 1328291 - RNA, 19 nt, Homo sapiens
agguggaaauccuggagua

SEQ ID NO: 1328292 - RNA, 19 nt, Homo sapiens
ucaccucccaguagcaauu

SEQ ID NO: 1328293 - RNA, 19 nt, Homo sapiens
aggaggagacccagaaaug

SEQ ID NO: 1328294 - RNA, 19 nt, Homo sapiens
aagcaagcaucuaagaaaa

SEQ ID NO: 1328295 - RNA, 19 nt, Homo sapiens
uagcugcauuaacuuggaa

SEQ ID NO: 1328296 - RNA, 19 nt, Homo sapiens
caauuugcuuucauaaucc

SEQ ID NO: 1328297 - RNA, 19 nt, Homo sapiens
gcuagcauuucccuuugag

SEQ ID NO: 1328298 - RNA, 19 nt, Homo sapiens
ugacagcuucacuccauga

SEQ ID NO: 1328299 - RNA, 19 nt, Homo sapiens
gaggaggagacccagaaau

SEQ ID NO: 1328300 - RNA, 19 nt, Homo sapiens
cgucacagacuaaggagau

SEQ ID NO: 1328301 - RNA, 19 nt, Homo sapiens
cuuggaauauagcugcauu

SEQ ID NO: 1328302 - RNA, 19 nt, Homo sapiens
cagaagacagaaacuccaa

SEQ ID NO: 1328303 - RNA, 19 nt, Homo sapiens
aauccaggccucuguugaa

SEQ ID NO: 1328304 - RNA, 19 nt, Homo sapiens
caauccaggccucuguuga

SEQ ID NO: 1328305 - RNA, 19 nt, Homo sapiens
gaaggccugcccucagagu

SEQ ID NO: 1328306 - RNA, 19 nt, Homo sapiens
gagacccagaaaugguuua

SEQ ID NO: 1328307 - RNA, 19 nt, Homo sapiens
gagauggcaggcauugaca

SEQ ID NO: 1328308 - RNA, 19 nt, Homo sapiens
cgaggaggagacccagaaa

SEQ ID NO: 1328309 - RNA, 19 nt, Homo sapiens
cagauccgucacagacuaa

SEQ ID NO: 1328310 - RNA, 19 nt, Homo sapiens
augaaggccaucucuguuu

SEQ ID NO: 1328311 - RNA, 19 nt, Homo sapiens
ccgaggaggagacccagaa

SEQ ID NO: 1328312 - RNA, 19 nt, Homo sapiens
gaagccuguugggccagaa

SEQ ID NO: 1328313 - RNA, 19 nt, Homo sapiens
gaaggccaucucuguuucu

SEQ ID NO: 1328314 - RNA, 19 nt, Homo sapiens
auugacagcuucacuccau

SEQ ID NO: 1328315 - RNA, 19 nt, Homo sapiens
gaauauagcugcauuaacu

SEQ ID NO: 1328316 - RNA, 19 nt, Homo sapiens
gaugacagauggugugaaa

SEQ ID NO: 1328317 - RNA, 19 nt, Homo sapiens
gaacacauuuccuucugaa

SEQ ID NO: 1328318 - RNA, 19 nt, Homo sapiens
gcagauccgucacagacua

SEQ ID NO: 1328319 - RNA, 19 nt, Homo sapiens
ucacuuuccuuauguauca

SEQ ID NO: 1328320 - RNA, 19 nt, Homo sapiens
ccaaaguucuugaauuuac

SEQ ID NO: 1328321 - RNA, 19 nt, Homo sapiens
cagaaggccugcccucaga

SEQ ID NO: 1328322 - RNA, 19 nt, Homo sapiens
caaugaugguugagugaaa

SEQ ID NO: 1328323 - RNA, 19 nt, Homo sapiens
cauaauccauuuagcaauc

SEQ ID NO: 1328324 - RNA, 19 nt, Homo sapiens
cuaauacaaugaugguuga

SEQ ID NO: 1328325 - RNA, 19 nt, Homo sapiens
uagcuguccugcuguuuaa

SEQ ID NO: 1328326 - RNA, 19 nt, Homo sapiens
aaagcaagcaucuaagaaa

SEQ ID NO: 1328327 - RNA, 19 nt, Homo sapiens
gcauuaacuuggaaagaag

SEQ ID NO: 1328328 - RNA, 19 nt, Homo sapiens
ucaacaaggucgacaagca

SEQ ID NO: 1328329 - RNA, 19 nt, Homo sapiens
gggagaagggaacacauuu

SEQ ID NO: 1328330 - RNA, 19 nt, Homo sapiens
ugcauuaacuuggaaagaa

SEQ ID NO: 1328331 - RNA, 19 nt, Homo sapiens
cagaagggguguuugagua

SEQ ID NO: 1328332 - RNA, 19 nt, Homo sapiens
gaccaucaccucccaguag

SEQ ID NO: 1328333 - RNA, 19 nt, Homo sapiens
caucuaaguuugcuuuuga

SEQ ID NO: 1328334 - RNA, 19 nt, Homo sapiens
ugaaggccaucucuguuuc

SEQ ID NO: 1328335 - RNA, 19 nt, Homo sapiens
ggagaagggaacacauuuc

SEQ ID NO: 1328336 - RNA, 19 nt, Homo sapiens
uggaaauccuggaguacaa

SEQ ID NO: 1328337 - RNA, 19 nt, Homo sapiens
cacauuuccuucugaacuu

SEQ ID NO: 1328338 - RNA, 19 nt, Homo sapiens
auguguaucuucuguguaa

SEQ ID NO: 1328339 - RNA, 19 nt, Homo sapiens
aagauaauaugagggagaa

SEQ ID NO: 1328340 - RNA, 19 nt, Homo sapiens
ggaguacaacuucaacaag

SEQ ID NO: 1328341 - RNA, 19 nt, Homo sapiens
cuagcuguccugcuguuua

SEQ ID NO: 1328342 - RNA, 19 nt, Homo sapiens
acauuuccuucugaacuua

SEQ ID NO: 1328343 - RNA, 19 nt, Homo sapiens
gcaauccaggccucuguug

SEQ ID NO: 1328344 - RNA, 19 nt, Homo sapiens
gaagacagaaacuccaacu

SEQ ID NO: 1328345 - RNA, 19 nt, Homo sapiens
guggcuagcauuucccuuu

SEQ ID NO: 1328346 - RNA, 19 nt, Homo sapiens
ggagauggcaggcauugac

SEQ ID NO: 1328347 - RNA, 19 nt, Homo sapiens
gaggagacccagaaauggu

SEQ ID NO: 1328348 - RNA, 19 nt, Homo sapiens
guuugaguauucagauuuc

SEQ ID NO: 1328349 - RNA, 19 nt, Homo sapiens
cagaggaccagguggaaau

SEQ ID NO: 1328350 - RNA, 19 nt, Homo sapiens
guuguauguuccauugcua

SEQ ID NO: 1328351 - RNA, 19 nt, Homo sapiens
ccaugaaggccaucucugu

SEQ ID NO: 1328352 - RNA, 19 nt, Homo sapiens
ggaggagacccagaaaugg

SEQ ID NO: 1328353 - RNA, 19 nt, Homo sapiens
ggcuagcauuucccuuuga

SEQ ID NO: 1328354 - RNA, 19 nt, Homo sapiens
uggcuagcauuucccuuug

SEQ ID NO: 1328355 - RNA, 19 nt, Homo sapiens
ggagacccagaaaugguuu

SEQ ID NO: 1328356 - RNA, 19 nt, Homo sapiens
uggaauauagcugcauuaa

SEQ ID NO: 1328357 - RNA, 19 nt, Homo sapiens
cuauguguaucuucugugu

SEQ ID NO: 1328358 - RNA, 19 nt, Homo sapiens
aguguuguauguuccauug

SEQ ID NO: 1328359 - RNA, 19 nt, Homo sapiens
caugaaggccaucucuguu

SEQ ID NO: 1328360 - RNA, 19 nt, Homo sapiens
gcgcuugccuuugccucuu

SEQ ID NO: 1328361 - RNA, 19 nt, Homo sapiens
guguuugaguauucagauu

SEQ ID NO: 1328362 - RNA, 19 nt, Homo sapiens
gaagggguguuugaguauu

SEQ ID NO: 1328363 - RNA, 19 nt, Homo sapiens
gcauuucccuuugagucau

SEQ ID NO: 1328364 - RNA, 19 nt, Homo sapiens
uuaagcagcgccuggcaaa

SEQ ID NO: 1328365 - RNA, 19 nt, Homo sapiens
uggcaggcauugacagcuu

SEQ ID NO: 1328366 - RNA, 19 nt, Homo sapiens
agguggaaauccuggagua

SEQ ID NO: 1328367 - RNA, 19 nt, Homo sapiens
ggaauauagcugcauuaac

SEQ ID NO: 1328368 - RNA, 19 nt, Homo sapiens
ucaccucccaguagcaauu

SEQ ID NO: 1328369 - RNA, 19 nt, Homo sapiens
aggaggagacccagaaaug

SEQ ID NO: 1328370 - RNA, 19 nt, Homo sapiens
aagcaagcaucuaagaaaa

SEQ ID NO: 1328371 - RNA, 19 nt, Homo sapiens
uagcugcauuaacuuggaa

SEQ ID NO: 1328372 - RNA, 19 nt, Homo sapiens
caauuugcuuucauaaucc

SEQ ID NO: 1328373 - RNA, 19 nt, Homo sapiens
gcuagcauuucccuuugag

SEQ ID NO: 1328374 - RNA, 19 nt, Homo sapiens
ugacagcuucacuccauga

SEQ ID NO: 1328375 - RNA, 19 nt, Homo sapiens
gaggaggagacccagaaau

SEQ ID NO: 1328376 - RNA, 19 nt, Homo sapiens
cgucacagacuaaggagau

SEQ ID NO: 1328377 - RNA, 19 nt, Homo sapiens
cuuggaauauagcugcauu

SEQ ID NO: 1328378 - RNA, 19 nt, Homo sapiens
cagaagacagaaacuccaa

SEQ ID NO: 1328379 - RNA, 19 nt, Homo sapiens
aauccaggccucuguugaa

SEQ ID NO: 1328380 - RNA, 19 nt, Homo sapiens
caauccaggccucuguuga

SEQ ID NO: 1328381 - RNA, 19 nt, Homo sapiens
gaaggccugcccucagagu

SEQ ID NO: 1328382 - RNA, 19 nt, Homo sapiens
gagacccagaaaugguuua

SEQ ID NO: 1328383 - RNA, 19 nt, Homo sapiens
gagauggcaggcauugaca

SEQ ID NO: 1328384 - RNA, 19 nt, Homo sapiens
ccgaggaggagacccagaa

SEQ ID NO: 1328385 - RNA, 19 nt, Homo sapiens
augaaggccaucucuguuu

SEQ ID NO: 1328386 - RNA, 19 nt, Homo sapiens
cgaggaggagacccagaaa

SEQ ID NO: 1328387 - RNA, 19 nt, Homo sapiens
cagauccgucacagacuaa

SEQ ID NO: 1328388 - RNA, 19 nt, Homo sapiens
gaagccuguugggccagaa

SEQ ID NO: 1328389 - RNA, 19 nt, Homo sapiens
gaaggccaucucuguuucu

SEQ ID NO: 1328390 - RNA, 19 nt, Homo sapiens
auugacagcuucacuccau

SEQ ID NO: 1328391 - RNA, 19 nt, Homo sapiens
gggcaaaccuuuaguaauu

SEQ ID NO: 1328392 - RNA, 19 nt, Homo sapiens
gaacauguacucauucaua

SEQ ID NO: 1328393 - RNA, 19 nt, Homo sapiens
ggaaaccugucgaugcuua

SEQ ID NO: 1328394 - RNA, 19 nt, Homo sapiens
ggagagaaaugcuaugaau

SEQ ID NO: 1328395 - RNA, 19 nt, Homo sapiens
gggaaagccuucacugauu

SEQ ID NO: 1328396 - RNA, 19 nt, Homo sapiens
gagaggaacuguuugacuu

SEQ ID NO: 1328397 - RNA, 19 nt, Homo sapiens
ucucagaucuuaacaauuc

SEQ ID NO: 1328398 - RNA, 19 nt, Homo sapiens
gaacacucaugccuuaaga

SEQ ID NO: 1328399 - RNA, 19 nt, Homo sapiens
gagagaccauauacucaua

SEQ ID NO: 1328400 - RNA, 19 nt, Homo sapiens
gcugaaagauugacgauca

SEQ ID NO: 1328401 - RNA, 19 nt, Homo sapiens
caggagaacuuacuuuaga

SEQ ID NO: 1328402 - RNA, 19 nt, Homo sapiens
ugaaagagauguuggaaag

SEQ ID NO: 1328403 - RNA, 19 nt, Homo sapiens
ggaauguguugaaaccuuu

SEQ ID NO: 1328404 - RNA, 19 nt, Homo sapiens
ggagaaaccauauaaggaa

SEQ ID NO: 1328405 - RNA, 19 nt, Homo sapiens
cagagaauguguaagaauu

SEQ ID NO: 1328406 - RNA, 19 nt, Homo sapiens
ggaaagccuucacugauuc

SEQ ID NO: 1328407 - RNA, 19 nt, Homo sapiens
gaggaacuguuugacuuua

SEQ ID NO: 1328408 - RNA, 19 nt, Homo sapiens
ugagaagccuuaucaaugu

SEQ ID NO: 1328409 - RNA, 19 nt, Homo sapiens
aaucuuggcuccuuccaua

SEQ ID NO: 1328410 - RNA, 19 nt, Homo sapiens
gaagagaagacauaugaau

SEQ ID NO: 1328411 - RNA, 19 nt, Homo sapiens
gagaagccuuaucaaugua

SEQ ID NO: 1328412 - RNA, 19 nt, Homo sapiens
uaaugaauguggcaaagaa

SEQ ID NO: 1328413 - RNA, 19 nt, Homo sapiens
cgucauaucuuacucaaca

SEQ ID NO: 1328414 - RNA, 19 nt, Homo sapiens
ggaaugccauaucagaaug

SEQ ID NO: 1328415 - RNA, 19 nt, Homo sapiens
gaacuuggucguuaggaaa

SEQ ID NO: 1328416 - RNA, 19 nt, Homo sapiens
gggcaagccuucaguaucu

SEQ ID NO: 1328417 - RNA, 19 nt, Homo sapiens
caauagaagagaagacaua

SEQ ID NO: 1328418 - RNA, 19 nt, Homo sapiens
gcuaaugaauggcgcuuga

SEQ ID NO: 1328419 - RNA, 19 nt, Homo sapiens
uagaagagaagacauauga

SEQ ID NO: 1328420 - RNA, 19 nt, Homo sapiens
gaaugugggcaaaccuuua

SEQ ID NO: 1328421 - RNA, 19 nt, Homo sapiens
gcaccuuagucaacauaaa

SEQ ID NO: 1328422 - RNA, 19 nt, Homo sapiens
gaauguggcaaagaauuua

SEQ ID NO: 1328423 - RNA, 19 nt, Homo sapiens
uaggaaacauccacacuga

SEQ ID NO: 1328424 - RNA, 19 nt, Homo sapiens
ggagaggccauauaaaugu

SEQ ID NO: 1328425 - RNA, 19 nt, Homo sapiens
gcuaacucuucacaucuua

SEQ ID NO: 1328426 - RNA, 19 nt, Homo sapiens
gggcacggccuuuccauuu

SEQ ID NO: 1328427 - RNA, 19 nt, Homo sapiens
cgacaucuaagaagucaua

SEQ ID NO: 1328428 - RNA, 19 nt, Homo sapiens
gaacggcccuuugaauguc

SEQ ID NO: 1328429 - RNA, 19 nt, Homo sapiens
ggcaaagaauuuacuuguu

SEQ ID NO: 1328430 - RNA, 19 nt, Homo sapiens
gggaaacccuucacugagu

SEQ ID NO: 1328431 - RNA, 19 nt, Homo sapiens
ggagaacuauaagaaucua

SEQ ID NO: 1328432 - RNA, 19 nt, Homo sapiens
gagaugugaugcuggagaa

SEQ ID NO: 1328433 - RNA, 19 nt, Homo sapiens
gagaaaccauauaaggaau

SEQ ID NO: 1328434 - RNA, 19 nt, Homo sapiens
agaaaacccucuaucuuua

SEQ ID NO: 1328435 - RNA, 19 nt, Homo sapiens
cccgagagauggcuaauga

SEQ ID NO: 1328436 - RNA, 19 nt, Homo sapiens
ccucaugccuuacugaaug

SEQ ID NO: 1328437 - RNA, 19 nt, Homo sapiens
gaaaccauauaaggaaugu

SEQ ID NO: 1328438 - RNA, 19 nt, Homo sapiens
gaccauauacucauaagga

SEQ ID NO: 1328439 - RNA, 19 nt, Homo sapiens
ggagagagaccauauacuc

SEQ ID NO: 1328440 - RNA, 19 nt, Homo sapiens
gcugauacuuggaaagaau

SEQ ID NO: 1328441 - RNA, 19 nt, Homo sapiens
aguaauuccucaugccuua

SEQ ID NO: 1328442 - RNA, 19 nt, Homo sapiens
gugagaagccuuaucaaug

SEQ ID NO: 1328443 - RNA, 19 nt, Homo sapiens
gagaaaagccuuaugaaug

SEQ ID NO: 1328444 - RNA, 19 nt, Homo sapiens
caagaaaacuagccaaaau

SEQ ID NO: 1328445 - RNA, 19 nt, Homo sapiens
gugagcacauuggauauaa

SEQ ID NO: 1328446 - RNA, 19 nt, Homo sapiens
gcugggugguugacaaauu

SEQ ID NO: 1328447 - RNA, 19 nt, Homo sapiens
cuagaggaaugccauauca

SEQ ID NO: 1328448 - RNA, 19 nt, Homo sapiens
gagaaaccauauaaaugca

SEQ ID NO: 1328449 - RNA, 19 nt, Homo sapiens
ggauguggcuguggacuuc

SEQ ID NO: 1328450 - RNA, 19 nt, Homo sapiens
agagauggcuaaugaaugg

SEQ ID NO: 1328451 - RNA, 19 nt, Homo sapiens
uggagauucuucuuuguuu

SEQ ID NO: 1328452 - RNA, 19 nt, Homo sapiens
gagaaaugcuaugaaugug

SEQ ID NO: 1328453 - RNA, 19 nt, Homo sapiens
cugggugguugacaaauua

SEQ ID NO: 1328454 - RNA, 19 nt, Homo sapiens
ggaaacauccacacugaag

SEQ ID NO: 1328455 - RNA, 19 nt, Homo sapiens
gauugggagagucauauua

SEQ ID NO: 1328456 - RNA, 19 nt, Homo sapiens
gaagaggaaccugacugua

SEQ ID NO: 1328457 - RNA, 19 nt, Homo sapiens
caucaggccuuacaguaca

SEQ ID NO: 1328458 - RNA, 19 nt, Homo sapiens
gggagaggccauauaaaug

SEQ ID NO: 1328459 - RNA, 19 nt, Homo sapiens
gcagacucauccuggugua

SEQ ID NO: 1328460 - RNA, 19 nt, Homo sapiens
ggagaacuuacuuuagaaa

SEQ ID NO: 1328461 - RNA, 19 nt, Homo sapiens
cacaggagaacuuacuuua

SEQ ID NO: 1328462 - RNA, 19 nt, Homo sapiens
ucagagaaacuuauacaga

SEQ ID NO: 1328463 - RNA, 19 nt, Homo sapiens
agaggaaccugacuguaug

SEQ ID NO: 1328464 - RNA, 19 nt, Homo sapiens
ugagaagucccaugaguga

SEQ ID NO: 1328465 - RNA, 19 nt, Homo sapiens
ggauuggguaggaggauua

SEQ ID NO: 1328466 - RNA, 19 nt, Homo sapiens
gaugacagaugaguaaugc

SEQ ID NO: 1328467 - RNA, 19 nt, Homo sapiens
cauccacacugaagaggaa

SEQ ID NO: 1328468 - RNA, 19 nt, Homo sapiens
gcaauguacacagucauaa

SEQ ID NO: 1328469 - RNA, 19 nt, Homo sapiens
ggaaugugggcaaaccuuu

SEQ ID NO: 1328470 - RNA, 19 nt, Homo sapiens
gaagucauaguguggagaa

SEQ ID NO: 1328471 - RNA, 19 nt, Homo sapiens
cauaguagaguguuaccua

SEQ ID NO: 1328472 - RNA, 19 nt, Homo sapiens
caagaaaacucacacucaa

SEQ ID NO: 1328473 - RNA, 19 nt, Homo sapiens
ggucagcaccucagcagaa

SEQ ID NO: 1328474 - RNA, 19 nt, Homo sapiens
auaucuagcuggucugaaa

SEQ ID NO: 1328475 - RNA, 19 nt, Homo sapiens
gaacucaugcuggagagaa

SEQ ID NO: 1328476 - RNA, 19 nt, Homo sapiens
ccucagagaauguguaaga

SEQ ID NO: 1328477 - RNA, 19 nt, Homo sapiens
ggaguggacuuugcuggau

SEQ ID NO: 1328478 - RNA, 19 nt, Homo sapiens
guguggagauucuucuuug

SEQ ID NO: 1328479 - RNA, 19 nt, Homo sapiens
agagaaaugcuaugaaugu

SEQ ID NO: 1328480 - RNA, 19 nt, Homo sapiens
caugcaaacucaagaugga

SEQ ID NO: 1328481 - RNA, 19 nt, Homo sapiens
acucaugccuuaagacuca

SEQ ID NO: 1328482 - RNA, 19 nt, Homo sapiens
cagcaccucagcagaauuu

SEQ ID NO: 1328483 - RNA, 19 nt, Homo sapiens
ugucucagaucuuaacaau

SEQ ID NO: 1328484 - RNA, 19 nt, Homo sapiens
ggaggugcccagugaaaug

SEQ ID NO: 1328485 - RNA, 19 nt, Homo sapiens
ugaauguggcaaagaauuu

SEQ ID NO: 1328486 - RNA, 19 nt, Homo sapiens
gagagagaccauauacuca

SEQ ID NO: 1328487 - RNA, 19 nt, Homo sapiens
gccaacaucuacaucuugu

SEQ ID NO: 1328488 - RNA, 19 nt, Homo sapiens
cagaaaacccucuaucuuu

SEQ ID NO: 1328489 - RNA, 19 nt, Homo sapiens
gauugacgaucaucuuucu

SEQ ID NO: 1328490 - RNA, 19 nt, Homo sapiens
gaggaaugccauaucagaa

SEQ ID NO: 1328491 - RNA, 19 nt, Homo sapiens
gaugagagaugauuacuuc

SEQ ID NO: 1328492 - RNA, 19 nt, Homo sapiens
gcaagaagcaugaauguga

SEQ ID NO: 1328493 - RNA, 19 nt, Homo sapiens
guacaucauugacccauuu

SEQ ID NO: 1328494 - RNA, 19 nt, Homo sapiens
gaaggaggcuggcaagaag

SEQ ID NO: 1328495 - RNA, 19 nt, Homo sapiens
agaaagaacuacaggauau

SEQ ID NO: 1328496 - RNA, 19 nt, Homo sapiens
gucaguaaguucucaauaa

SEQ ID NO: 1328497 - RNA, 19 nt, Homo sapiens
gagaaagaacuacaggaua

SEQ ID NO: 1328498 - RNA, 19 nt, Homo sapiens
ugaaggguauguacauuug

SEQ ID NO: 1328499 - RNA, 19 nt, Homo sapiens
ggaggucucuaaguggaua

SEQ ID NO: 1328500 - RNA, 19 nt, Homo sapiens
gaaacaugcugcccuucau

SEQ ID NO: 1328501 - RNA, 19 nt, Homo sapiens
gggcauuaauggcaagaaa

SEQ ID NO: 1328502 - RNA, 19 nt, Homo sapiens
gggccagccugucauggua

SEQ ID NO: 1328503 - RNA, 19 nt, Homo sapiens
cagauuugguuugagaaua

SEQ ID NO: 1328504 - RNA, 19 nt, Homo sapiens
gugcagauuugguuugaga

SEQ ID NO: 1328505 - RNA, 19 nt, Homo sapiens
gaacucgcagugcagauuu

SEQ ID NO: 1328506 - RNA, 19 nt, Homo sapiens
gaauagaagagccaaaugg

SEQ ID NO: 1328507 - RNA, 19 nt, Homo sapiens
ggaccaguguagccaguau

SEQ ID NO: 1328508 - RNA, 19 nt, Homo sapiens
gcuauggugcugucgcuua

SEQ ID NO: 1328509 - RNA, 19 nt, Homo sapiens
gagaauagaagagccaaau

SEQ ID NO: 1328510 - RNA, 19 nt, Homo sapiens
gaacuacaggauaugaaug

SEQ ID NO: 1328511 - RNA, 19 nt, Homo sapiens
gcaugaaugugacugaacu

SEQ ID NO: 1328512 - RNA, 19 nt, Homo sapiens
cggcagcgauggcaacguu

SEQ ID NO: 1328513 - RNA, 19 nt, Homo sapiens
gccaguauaugaccagcuu

SEQ ID NO: 1328514 - RNA, 19 nt, Homo sapiens
caguguagccaguauauga

SEQ ID NO: 1328515 - RNA, 19 nt, Homo sapiens
ggucaguaaguucucaaua

SEQ ID NO: 1328516 - RNA, 19 nt, Homo sapiens
uaucgugccuucuuucaca

SEQ ID NO: 1328517 - RNA, 19 nt, Homo sapiens
gaaccugggcagcaguauu

SEQ ID NO: 1328518 - RNA, 19 nt, Homo sapiens
uacaggauaugaaugcuau

SEQ ID NO: 1328519 - RNA, 19 nt, Homo sapiens
caucagagggcauuaaugg

SEQ ID NO: 1328520 - RNA, 19 nt, Homo sapiens
cgaaggaggcuggcaagaa

SEQ ID NO: 1328521 - RNA, 19 nt, Homo sapiens
gaaagaacuacaggauaug

SEQ ID NO: 1328522 - RNA, 19 nt, Homo sapiens
gugaaggguauguacauuu

SEQ ID NO: 1328523 - RNA, 19 nt, Homo sapiens
gaagcaugaaugugacuga

SEQ ID NO: 1328524 - RNA, 19 nt, Homo sapiens
gcauuaauggcaagaaaca

SEQ ID NO: 1328525 - RNA, 19 nt, Homo sapiens
cgagaaagaacuacaggau

SEQ ID NO: 1328526 - RNA, 19 nt, Homo sapiens
gauagccucugugccacuu

SEQ ID NO: 1328527 - RNA, 19 nt, Homo sapiens
caaauagcgggaagcagaa

SEQ ID NO: 1328528 - RNA, 19 nt, Homo sapiens
cgacgacgagaaagaacua

SEQ ID NO: 1328529 - RNA, 19 nt, Homo sapiens
ccacaccacucaggguaug

SEQ ID NO: 1328530 - RNA, 19 nt, Homo sapiens
ucuuugagccagauucaua

SEQ ID NO: 1328531 - RNA, 19 nt, Homo sapiens
ggagacaucagagggcauu

SEQ ID NO: 1328532 - RNA, 19 nt, Homo sapiens
agauuugguuugagaauag

SEQ ID NO: 1328533 - RNA, 19 nt, Homo sapiens
caaagaggaggaagaggau

SEQ ID NO: 1328534 - RNA, 19 nt, Homo sapiens
ucuaagggauagccucugu

SEQ ID NO: 1328535 - RNA, 19 nt, Homo sapiens
gcagugcagauuugguuug

SEQ ID NO: 1328536 - RNA, 19 nt, Homo sapiens
aaccgcagcugaggccaua

SEQ ID NO: 1328537 - RNA, 19 nt, Homo sapiens
gcagauuugguuugagaau

SEQ ID NO: 1328538 - RNA, 19 nt, Homo sapiens
aaggguauguacauuuguu

SEQ ID NO: 1328539 - RNA, 19 nt, Homo sapiens
cauaacggcacccuuguuc

SEQ ID NO: 1328540 - RNA, 19 nt, Homo sapiens
cagugcagauuugguuuga

SEQ ID NO: 1328541 - RNA, 19 nt, Homo sapiens
uuacugaagaggucaaaga

SEQ ID NO: 1328542 - RNA, 19 nt, Homo sapiens
guacauuuguuuugugugu

SEQ ID NO: 1328543 - RNA, 19 nt, Homo sapiens
caucaaaaguaguucauca

SEQ ID NO: 1328544 - RNA, 19 nt, Homo sapiens
cggaguuccuggccaccua

SEQ ID NO: 1328545 - RNA, 19 nt, Homo sapiens
ugagccagauucauauuuu

SEQ ID NO: 1328546 - RNA, 19 nt, Homo sapiens
ucagcgggaugagagauga

SEQ ID NO: 1328547 - RNA, 19 nt, Homo sapiens
uaacggcacccuuguucau

SEQ ID NO: 1328548 - RNA, 19 nt, Homo sapiens
gacaucagagggcauuaau

SEQ ID NO: 1328549 - RNA, 19 nt, Homo sapiens
ccaaauggaggagacauca

SEQ ID NO: 1328550 - RNA, 19 nt, Homo sapiens
gcagcgauggcaacguuga

SEQ ID NO: 1328551 - RNA, 19 nt, Homo sapiens
gcccaaggcggagaagaaa

SEQ ID NO: 1328552 - RNA, 19 nt, Homo sapiens
aaagaacuacaggauauga

SEQ ID NO: 1328553 - RNA, 19 nt, Homo sapiens
gcauagcaccccaucaaaa

SEQ ID NO: 1328554 - RNA, 19 nt, Homo sapiens
ggaugagagaugauuacuu

SEQ ID NO: 1328555 - RNA, 19 nt, Homo sapiens
gcgggaugagagaugauua

SEQ ID NO: 1328556 - RNA, 19 nt, Homo sapiens
gauuugguuugagaauaga

SEQ ID NO: 1328557 - RNA, 19 nt, Homo sapiens
gaccaguguagccaguaua

SEQ ID NO: 1328558 - RNA, 19 nt, Homo sapiens
ugugaaggguauguacauu

SEQ ID NO: 1328559 - RNA, 19 nt, Homo sapiens
aaauggaggagacaucaga

SEQ ID NO: 1328560 - RNA, 19 nt, Homo sapiens
aagcaugaaugugacugaa

SEQ ID NO: 1328561 - RNA, 19 nt, Homo sapiens
ggucaaagaggaggaagag

SEQ ID NO: 1328562 - RNA, 19 nt, Homo sapiens
cuacaggauaugaaugcua

SEQ ID NO: 1328563 - RNA, 19 nt, Homo sapiens
gaaggguauguacauuugu

SEQ ID NO: 1328564 - RNA, 19 nt, Homo sapiens
agacaucagagggcauuaa

SEQ ID NO: 1328565 - RNA, 19 nt, Homo sapiens
aauagaagagccaaaugga

SEQ ID NO: 1328566 - RNA, 19 nt, Homo sapiens
gagccagauucauauuuug

SEQ ID NO: 1328567 - RNA, 19 nt, Homo sapiens
gagucuagacaccagaaga

SEQ ID NO: 1328568 - RNA, 19 nt, Homo sapiens
agaaacaugcugcccuuca

SEQ ID NO: 1328569 - RNA, 19 nt, Homo sapiens
ugcugucgcuuacugaaga

SEQ ID NO: 1328570 - RNA, 19 nt, Homo sapiens
ugagagaugauuacuucug

SEQ ID NO: 1328571 - RNA, 19 nt, Homo sapiens
ugaacucgcagugcagauu

SEQ ID NO: 1328572 - RNA, 19 nt, Homo sapiens
ccauaacggcacccuuguu

SEQ ID NO: 1328573 - RNA, 19 nt, Homo sapiens
gcgagcaguuccccaguga

SEQ ID NO: 1328574 - RNA, 19 nt, Homo sapiens
agaacuacaggauaugaau

SEQ ID NO: 1328575 - RNA, 19 nt, Homo sapiens
guaguucaucaaaugucua

SEQ ID NO: 1328576 - RNA, 19 nt, Homo sapiens
cccaaugucuaagggauag

SEQ ID NO: 1328577 - RNA, 19 nt, Homo sapiens
ucaugcuucuuccaccuau

SEQ ID NO: 1328578 - RNA, 19 nt, Homo sapiens
aggcacagcagcaggagaa

SEQ ID NO: 1328579 - RNA, 19 nt, Homo sapiens
gcagacagcuuuaacuuau

SEQ ID NO: 1328580 - RNA, 19 nt, Homo sapiens
gcacauaauucacuggauu

SEQ ID NO: 1328581 - RNA, 19 nt, Homo sapiens
aaauaaaccuggagcaauu

SEQ ID NO: 1328582 - RNA, 19 nt, Homo sapiens
cggaagcaauugaaaguua

SEQ ID NO: 1328583 - RNA, 19 nt, Homo sapiens
ugaugaacgugaacaaaua

SEQ ID NO: 1328584 - RNA, 19 nt, Homo sapiens
gcauuaccaucguggaaua

SEQ ID NO: 1328585 - RNA, 19 nt, Homo sapiens
ggacuaugcgcccucauua

SEQ ID NO: 1328586 - RNA, 19 nt, Homo sapiens
ucgaguaaguucagcauua

SEQ ID NO: 1328587 - RNA, 19 nt, Homo sapiens
gaacacaugccaaacauca

SEQ ID NO: 1328588 - RNA, 19 nt, Homo sapiens
ggcagaagaugaaaugcua

SEQ ID NO: 1328589 - RNA, 19 nt, Homo sapiens
gaacugagugugccagaaa

SEQ ID NO: 1328590 - RNA, 19 nt, Homo sapiens
gaaaguauuaguuccauug

SEQ ID NO: 1328591 - RNA, 19 nt, Homo sapiens
ggaauaaucuagcgcaaac

SEQ ID NO: 1328592 - RNA, 19 nt, Homo sapiens
ugaaaccacuacuguauug

SEQ ID NO: 1328593 - RNA, 19 nt, Homo sapiens
gaagaugaaaugcuaaaga

SEQ ID NO: 1328594 - RNA, 19 nt, Homo sapiens
ggaagcaauugaaaguuau

SEQ ID NO: 1328595 - RNA, 19 nt, Homo sapiens
caacauguguggauuuuaa

SEQ ID NO: 1328596 - RNA, 19 nt, Homo sapiens
gaaaagagacccagcauug

SEQ ID NO: 1328597 - RNA, 19 nt, Homo sapiens
gaugauaugggaaauacua

SEQ ID NO: 1328598 - RNA, 19 nt, Homo sapiens
cgaaacaucaguaaguuaa

SEQ ID NO: 1328599 - RNA, 19 nt, Homo sapiens
gaaauaaaccuggagcaau

SEQ ID NO: 1328600 - RNA, 19 nt, Homo sapiens
ggagagguuucuacaggaa

SEQ ID NO: 1328601 - RNA, 19 nt, Homo sapiens
ccaaugagguggacuaugc

SEQ ID NO: 1328602 - RNA, 19 nt, Homo sapiens
gaauagaugauaugggaaa

SEQ ID NO: 1328603 - RNA, 19 nt, Homo sapiens
uaaaggcacauucuguaua

SEQ ID NO: 1328604 - RNA, 19 nt, Homo sapiens
ccacgaacauugucaccuu

SEQ ID NO: 1328605 - RNA, 19 nt, Homo sapiens
guauguacgugagcuagua

SEQ ID NO: 1328606 - RNA, 19 nt, Homo sapiens
ucgggaaguugaauauuaa

SEQ ID NO: 1328607 - RNA, 19 nt, Homo sapiens
aaaccacacuccuuuagau

SEQ ID NO: 1328608 - RNA, 19 nt, Homo sapiens
gaagagaagcugggaggaa

SEQ ID NO: 1328609 - RNA, 19 nt, Homo sapiens
gaugaacgugaacaaauaa

SEQ ID NO: 1328610 - RNA, 19 nt, Homo sapiens
cacacacacuuuauacaaa

SEQ ID NO: 1328611 - RNA, 19 nt, Homo sapiens
caugcaggcuucugaguga

SEQ ID NO: 1328612 - RNA, 19 nt, Homo sapiens
uaaagaagggucaggcaaa

SEQ ID NO: 1328613 - RNA, 19 nt, Homo sapiens
gagagaggcagaagaugaa

SEQ ID NO: 1328614 - RNA, 19 nt, Homo sapiens
gcgaaacaucaguaaguua

SEQ ID NO: 1328615 - RNA, 19 nt, Homo sapiens
gaaaccacacuccuuuaga

SEQ ID NO: 1328616 - RNA, 19 nt, Homo sapiens
ugaugagaauuuccucuuu

SEQ ID NO: 1328617 - RNA, 19 nt, Homo sapiens
cagacagcuuuaacuuaua

SEQ ID NO: 1328618 - RNA, 19 nt, Homo sapiens
ugaagauccuggaagagaa

SEQ ID NO: 1328619 - RNA, 19 nt, Homo sapiens
uucgggaaguugaauauua

SEQ ID NO: 1328620 - RNA, 19 nt, Homo sapiens
caacauugaggagaguuua

SEQ ID NO: 1328621 - RNA, 19 nt, Homo sapiens
ugcaaaggguuaugacaaa

SEQ ID NO: 1328622 - RNA, 19 nt, Homo sapiens
uagcaaaucaggucuauca

SEQ ID NO: 1328623 - RNA, 19 nt, Homo sapiens
aagagaagcugggaggaaa

SEQ ID NO: 1328624 - RNA, 19 nt, Homo sapiens
cagauggaguucuagcaaa

SEQ ID NO: 1328625 - RNA, 19 nt, Homo sapiens
auuaauggcucggcuuaua

SEQ ID NO: 1328626 - RNA, 19 nt, Homo sapiens
guagaagggcacauaauuc

SEQ ID NO: 1328627 - RNA, 19 nt, Homo sapiens
ggaaaccacacuccuuuag

SEQ ID NO: 1328628 - RNA, 19 nt, Homo sapiens
ggaaagcugaagccacaaa

SEQ ID NO: 1328629 - RNA, 19 nt, Homo sapiens
cacgaacauugucaccuua

SEQ ID NO: 1328630 - RNA, 19 nt, Homo sapiens
gcuuagucaucuauuggua

SEQ ID NO: 1328631 - RNA, 19 nt, Homo sapiens
ugaaagcaaagccucauuu

SEQ ID NO: 1328632 - RNA, 19 nt, Homo sapiens
gaugagaauuuccucuuuu

SEQ ID NO: 1328633 - RNA, 19 nt, Homo sapiens
ucacuggauugaaagcaaa

SEQ ID NO: 1328634 - RNA, 19 nt, Homo sapiens
ugagagacuugcuucuaga

SEQ ID NO: 1328635 - RNA, 19 nt, Homo sapiens
acacaugccaaacaucaua

SEQ ID NO: 1328636 - RNA, 19 nt, Homo sapiens
gcagagguuucccagucaa

SEQ ID NO: 1328637 - RNA, 19 nt, Homo sapiens
aaaggcacauucuguauac

SEQ ID NO: 1328638 - RNA, 19 nt, Homo sapiens
gcaaaucaggucuaucagu

SEQ ID NO: 1328639 - RNA, 19 nt, Homo sapiens
gcuguguguuugcuauauu

SEQ ID NO: 1328640 - RNA, 19 nt, Homo sapiens
gcacagauguugaaaaucc

SEQ ID NO: 1328641 - RNA, 19 nt, Homo sapiens
cgaguaaguucagcauuag

SEQ ID NO: 1328642 - RNA, 19 nt, Homo sapiens
ccacacuccuuuagauugg

SEQ ID NO: 1328643 - RNA, 19 nt, Homo sapiens
gagcuacuggaauagauuu

SEQ ID NO: 1328644 - RNA, 19 nt, Homo sapiens
uagaagggcacauaauuca

SEQ ID NO: 1328645 - RNA, 19 nt, Homo sapiens
acaaguaccaguugcugua

SEQ ID NO: 1328646 - RNA, 19 nt, Homo sapiens
aagaucagcuucgugcaaa

SEQ ID NO: 1328647 - RNA, 19 nt, Homo sapiens
aaagagagaggcagaagau

SEQ ID NO: 1328648 - RNA, 19 nt, Homo sapiens
gggaaauacuaauaacaac

SEQ ID NO: 1328649 - RNA, 19 nt, Homo sapiens
uaaagcgaaacaucaguaa

SEQ ID NO: 1328650 - RNA, 19 nt, Homo sapiens
cugcagagcuccagaagac

SEQ ID NO: 1328651 - RNA, 19 nt, Homo sapiens
gcugagagacuugcuucua

SEQ ID NO: 1328652 - RNA, 19 nt, Homo sapiens
acacacacacuuuauacaa

SEQ ID NO: 1328653 - RNA, 19 nt, Homo sapiens
agagagaggcagaagauga

SEQ ID NO: 1328654 - RNA, 19 nt, Homo sapiens
cuaaagcgaaacaucagua

SEQ ID NO: 1328655 - RNA, 19 nt, Homo sapiens
uguagaagggcacauaauu

SEQ ID NO: 1328656 - RNA, 19 nt, Homo sapiens
uagaugauaugggaaauac

SEQ ID NO: 1328657 - RNA, 19 nt, Homo sapiens
gcagaagaugaaaugcuaa

SEQ ID NO: 1328658 - RNA, 19 nt, Homo sapiens
ggcgacaacccaacauuga

SEQ ID NO: 1328659 - RNA, 19 nt, Homo sapiens
gaacaccacauauuuuaga

SEQ ID NO: 1328660 - RNA, 19 nt, Homo sapiens
gaacauugucaccuuaugc

SEQ ID NO: 1328661 - RNA, 19 nt, Homo sapiens
gugcaaaggguuaugacaa

SEQ ID NO: 1328662 - RNA, 19 nt, Homo sapiens
acacacacacacacacuuu

SEQ ID NO: 1328663 - RNA, 19 nt, Homo sapiens
cuacuguauugccuggaua

SEQ ID NO: 1328664 - RNA, 19 nt, Homo sapiens
caaaccuggucccaacaug

SEQ ID NO: 1328665 - RNA, 19 nt, Homo sapiens
aaagaacacaugccaaaca

SEQ ID NO: 1328666 - RNA, 19 nt, Homo sapiens
uaaaagaacacaugccaaa

SEQ ID NO: 1328667 - RNA, 19 nt, Homo sapiens
gaagggcacauaauucacu

SEQ ID NO: 1328668 - RNA, 19 nt, Homo sapiens
gcaaaggguuaugacaaaa

SEQ ID NO: 1328669 - RNA, 19 nt, Homo sapiens
gauuugaaaccacuacugu

SEQ ID NO: 1328670 - RNA, 19 nt, Homo sapiens
guaaguucagcauuagaaa

SEQ ID NO: 1328671 - RNA, 19 nt, Homo sapiens
guuauuugaacaccacaua

SEQ ID NO: 1328672 - RNA, 19 nt, Homo sapiens
guaccagaaacacauuaaa

SEQ ID NO: 1328673 - RNA, 19 nt, Homo sapiens
caaaacaccagacuucauu

SEQ ID NO: 1328674 - RNA, 19 nt, Homo sapiens
caucaagcaugccauuggu

SEQ ID NO: 1328675 - RNA, 19 nt, Homo sapiens
agauggaguucuagcaaau

SEQ ID NO: 1328676 - RNA, 19 nt, Homo sapiens
gaaacuccacccuccaagu

SEQ ID NO: 1328677 - RNA, 19 nt, Homo sapiens
augcugacauaacaacuuu

SEQ ID NO: 1328678 - RNA, 19 nt, Homo sapiens
gacaguaagccaagugcaa

SEQ ID NO: 1328679 - RNA, 19 nt, Homo sapiens
aaacucaggugacuuguua

SEQ ID NO: 1328680 - RNA, 19 nt, Homo sapiens
ccaccaagaucgccaaaua

SEQ ID NO: 1328681 - RNA, 19 nt, Homo sapiens
guagagagguugaagauca

SEQ ID NO: 1328682 - RNA, 19 nt, Homo sapiens
gaagaucaaucaguucuau

SEQ ID NO: 1328683 - RNA, 19 nt, Homo sapiens
gaucggagcuguccacaca

SEQ ID NO: 1328684 - RNA, 19 nt, Homo sapiens
ggagggaguucaaauaaag

SEQ ID NO: 1328685 - RNA, 19 nt, Homo sapiens
ccacugagguccaaugaug

SEQ ID NO: 1328686 - RNA, 19 nt, Homo sapiens
caacauacuccaaauaguu

SEQ ID NO: 1328687 - RNA, 19 nt, Homo sapiens
acaaaggucagaaaucuua

SEQ ID NO: 1328688 - RNA, 19 nt, Homo sapiens
gauccagucucucuuuguu

SEQ ID NO: 1328689 - RNA, 19 nt, Homo sapiens
uggcuuagcuuuccauguu

SEQ ID NO: 1328690 - RNA, 19 nt, Homo sapiens
ggaacugaccgaccuauug

SEQ ID NO: 1328691 - RNA, 19 nt, Homo sapiens
gggagggaguucaaauaaa

SEQ ID NO: 1328692 - RNA, 19 nt, Homo sapiens
ggauuuacuugaacauguu

SEQ ID NO: 1328693 - RNA, 19 nt, Homo sapiens
ugaggaagaucaucacuag

SEQ ID NO: 1328694 - RNA, 19 nt, Homo sapiens
gaacugaccgaccuauugu

SEQ ID NO: 1328695 - RNA, 19 nt, Homo sapiens
gcagagauccugagugucu

SEQ ID NO: 1328696 - RNA, 19 nt, Homo sapiens
gcugcaggguacacaaaua

SEQ ID NO: 1328697 - RNA, 19 nt, Homo sapiens
cuaaacaguucccuugaga

SEQ ID NO: 1328698 - RNA, 19 nt, Homo sapiens
ccagccaggugacaucuuu

SEQ ID NO: 1328699 - RNA, 19 nt, Homo sapiens
ugaccgaccuauugucuug

SEQ ID NO: 1328700 - RNA, 19 nt, Homo sapiens
gagagcccaucaacuguga

SEQ ID NO: 1328701 - RNA, 19 nt, Homo sapiens
gcaacauacuccaaauagu

SEQ ID NO: 1328702 - RNA, 19 nt, Homo sapiens
gcaccgagaaguuaaggaa

SEQ ID NO: 1328703 - RNA, 19 nt, Homo sapiens
cauguaguguguggauuua

SEQ ID NO: 1328704 - RNA, 19 nt, Homo sapiens
ucgcagagauccugagugu

SEQ ID NO: 1328705 - RNA, 19 nt, Homo sapiens
ucacagggcggauggauga

SEQ ID NO: 1328706 - RNA, 19 nt, Homo sapiens
ggaguucaaauaaagcuuu

SEQ ID NO: 1328707 - RNA, 19 nt, Homo sapiens
ccaguuauguucuguuucu

SEQ ID NO: 1328708 - RNA, 19 nt, Homo sapiens
gaacagcaugcaacacuca

SEQ ID NO: 1328709 - RNA, 19 nt, Homo sapiens
cgacaucgguuggauuaca

SEQ ID NO: 1328710 - RNA, 19 nt, Homo sapiens
uagcuacaguugugcguuu

SEQ ID NO: 1328711 - RNA, 19 nt, Homo sapiens
auacaaaggucagaaaucu

SEQ ID NO: 1328712 - RNA, 19 nt, Homo sapiens
gagaaccacugagguccaa

SEQ ID NO: 1328713 - RNA, 19 nt, Homo sapiens
ccagaugccucuugauagg

SEQ ID NO: 1328714 - RNA, 19 nt, Homo sapiens
gcgaugaggcccuucuuug

SEQ ID NO: 1328715 - RNA, 19 nt, Homo sapiens
ugucaacauuagcaagaua

SEQ ID NO: 1328716 - RNA, 19 nt, Homo sapiens
gcugugauccagaaagauu

SEQ ID NO: 1328717 - RNA, 19 nt, Homo sapiens
ggaagaacagcaugcaaca

SEQ ID NO: 1328718 - RNA, 19 nt, Homo sapiens
cgagagcguugcuuugauc

SEQ ID NO: 1328719 - RNA, 19 nt, Homo sapiens
gcucaaggucacagaguuu

SEQ ID NO: 1328720 - RNA, 19 nt, Homo sapiens
ucagggaagcuauuagaaa

SEQ ID NO: 1328721 - RNA, 19 nt, Homo sapiens
ccaagccuccggcaucuuu

SEQ ID NO: 1328722 - RNA, 19 nt, Homo sapiens
ggugaugccugggugaaga

SEQ ID NO: 1328723 - RNA, 19 nt, Homo sapiens
cgugcaaacugaaaccaaa

SEQ ID NO: 1328724 - RNA, 19 nt, Homo sapiens
cuuaggugcugucaacauu

SEQ ID NO: 1328725 - RNA, 19 nt, Homo sapiens
gaaacucaggugacuuguu

SEQ ID NO: 1328726 - RNA, 19 nt, Homo sapiens
cagggaagcuauuagaaac

SEQ ID NO: 1328727 - RNA, 19 nt, Homo sapiens
aauaugcugugccugauga

SEQ ID NO: 1328728 - RNA, 19 nt, Homo sapiens
caaauaugcugugccugau

SEQ ID NO: 1328729 - RNA, 19 nt, Homo sapiens
caucuuugcuggcuucagu

SEQ ID NO: 1328730 - RNA, 19 nt, Homo sapiens
gcaucugaaugaucuguag

SEQ ID NO: 1328731 - RNA, 19 nt, Homo sapiens
guugugcguuugugaaaug

SEQ ID NO: 1328732 - RNA, 19 nt, Homo sapiens
gauaggagaggcaacauac

SEQ ID NO: 1328733 - RNA, 19 nt, Homo sapiens
ggugaaacgucuuccaaaa

SEQ ID NO: 1328734 - RNA, 19 nt, Homo sapiens
gaggcaacauacuccaaau

SEQ ID NO: 1328735 - RNA, 19 nt, Homo sapiens
guuauguucuguuucuuca

SEQ ID NO: 1328736 - RNA, 19 nt, Homo sapiens
guuacaggcuuagcaacaa

SEQ ID NO: 1328737 - RNA, 19 nt, Homo sapiens
cgacgccagugggugcuua

SEQ ID NO: 1328738 - RNA, 19 nt, Homo sapiens
ccaaggaggacccuguuug

SEQ ID NO: 1328739 - RNA, 19 nt, Homo sapiens
ggaggccaguuaaaugucu

SEQ ID NO: 1328740 - RNA, 19 nt, Homo sapiens
uuacaggcuuagcaacaaa

SEQ ID NO: 1328741 - RNA, 19 nt, Homo sapiens
uagaaacucaggugacuug

SEQ ID NO: 1328742 - RNA, 19 nt, Homo sapiens
aagcugugauccagaaaga

SEQ ID NO: 1328743 - RNA, 19 nt, Homo sapiens
ugaagcuacuccaguuaug

SEQ ID NO: 1328744 - RNA, 19 nt, Homo sapiens
ccauuccucugcccucuug

SEQ ID NO: 1328745 - RNA, 19 nt, Homo sapiens
gggagacaguagagagguu

SEQ ID NO: 1328746 - RNA, 19 nt, Homo sapiens
guaugggccucucugcaau

SEQ ID NO: 1328747 - RNA, 19 nt, Homo sapiens
ccaagggcaucguccauac

SEQ ID NO: 1328748 - RNA, 19 nt, Homo sapiens
guguguggauuuacuugaa

SEQ ID NO: 1328749 - RNA, 19 nt, Homo sapiens
gauacaaaggucagaaauc

SEQ ID NO: 1328750 - RNA, 19 nt, Homo sapiens
gaaccacugagguccaaug

SEQ ID NO: 1328751 - RNA, 19 nt, Homo sapiens
ggcaacauacuccaaauag

SEQ ID NO: 1328752 - RNA, 19 nt, Homo sapiens
guauuuggaagucugaauu

SEQ ID NO: 1328753 - RNA, 19 nt, Homo sapiens
gagugguggucuuuuguua

SEQ ID NO: 1328754 - RNA, 19 nt, Homo sapiens
guuuguaccucugucuaaa

SEQ ID NO: 1328755 - RNA, 19 nt, Homo sapiens
gcagugaggacaugcucuu

SEQ ID NO: 1328756 - RNA, 19 nt, Homo sapiens
ucaaugaugccaagugcaa

SEQ ID NO: 1328757 - RNA, 19 nt, Homo sapiens
agaggaaccuggacauggu

SEQ ID NO: 1328758 - RNA, 19 nt, Homo sapiens
caggagagcgugcaaacug

SEQ ID NO: 1328759 - RNA, 19 nt, Homo sapiens
ugccugaccuucacucugu

SEQ ID NO: 1328760 - RNA, 19 nt, Homo sapiens
gggaagcuauuagaaacuc

SEQ ID NO: 1328761 - RNA, 19 nt, Homo sapiens
ugugcuugguuguguauaa

SEQ ID NO: 1328762 - RNA, 19 nt, Homo sapiens
gaggaucagaggccacauu

SEQ ID NO: 1328763 - RNA, 19 nt, Homo sapiens
ugaggaaacaugaggauca

SEQ ID NO: 1328764 - RNA, 19 nt, Homo sapiens
uggauuuacuugaacaugu

SEQ ID NO: 1328765 - RNA, 19 nt, Homo sapiens
ggaggucccaggaguguca

SEQ ID NO: 1328766 - RNA, 19 nt, Homo sapiens
ugaagaaaauaguggauga

SEQ ID NO: 1328767 - RNA, 19 nt, Homo sapiens
cuucagcacuggcaagauc

SEQ ID NO: 1328768 - RNA, 19 nt, Homo sapiens
ggaagcuauuagaaacuca

SEQ ID NO: 1328769 - RNA, 19 nt, Homo sapiens
ggagagcgugcaaacugaa

SEQ ID NO: 1328770 - RNA, 19 nt, Homo sapiens
gaagcuacuccaguuaugu

SEQ ID NO: 1328771 - RNA, 19 nt, Homo sapiens
gaguguuucuccugugcuu

SEQ ID NO: 1328772 - RNA, 19 nt, Homo sapiens
gcaagauaauggaaaucac

SEQ ID NO: 1328773 - RNA, 19 nt, Homo sapiens
accagaaagugcugucauu

SEQ ID NO: 1328774 - RNA, 19 nt, Homo sapiens
caacggcuguccggcuguu

SEQ ID NO: 1328775 - RNA, 19 nt, Homo sapiens
gugaggacaugcucuucau

SEQ ID NO: 1328776 - RNA, 19 nt, Homo sapiens
cagagagcaugggcaguga

SEQ ID NO: 1328777 - RNA, 19 nt, Homo sapiens
gaggaaacaugaggaucag

SEQ ID NO: 1328778 - RNA, 19 nt, Homo sapiens
augcaacacucacauguag

SEQ ID NO: 1328779 - RNA, 19 nt, Homo sapiens
gagaaucccucaccaauaa

SEQ ID NO: 1328780 - RNA, 19 nt, Homo sapiens
ggaggaagcuucaaaagaa

SEQ ID NO: 1328781 - RNA, 19 nt, Homo sapiens
gccaguagcugcuuuaaag

SEQ ID NO: 1328782 - RNA, 19 nt, Homo sapiens
ccaauaaggaacuguguua

SEQ ID NO: 1328783 - RNA, 19 nt, Homo sapiens
guaagacagugacaaagau

SEQ ID NO: 1328784 - RNA, 19 nt, Homo sapiens
caagagacaacagcgauua

SEQ ID NO: 1328785 - RNA, 19 nt, Homo sapiens
caaagauacucaccuguac

SEQ ID NO: 1328786 - RNA, 19 nt, Homo sapiens
caaaggaggaagcuucaaa

SEQ ID NO: 1328787 - RNA, 19 nt, Homo sapiens
cagcaacucccaacucaaa

SEQ ID NO: 1328788 - RNA, 19 nt, Homo sapiens
gcagaaggaccacaguaga

SEQ ID NO: 1328789 - RNA, 19 nt, Homo sapiens
acaaagauacucaccugua

SEQ ID NO: 1328790 - RNA, 19 nt, Homo sapiens
auaaggaacuguguuaauc

SEQ ID NO: 1328791 - RNA, 19 nt, Homo sapiens
aaagaagccauucauguau

SEQ ID NO: 1328792 - RNA, 19 nt, Homo sapiens
uaagacagugacaaagaua

SEQ ID NO: 1328793 - RNA, 19 nt, Homo sapiens
agacaacagcgauuacaaa

SEQ ID NO: 1328794 - RNA, 19 nt, Homo sapiens
aaacagaguaagacaguga

SEQ ID NO: 1328795 - RNA, 19 nt, Homo sapiens
gcgcggagcacgagaaaca

SEQ ID NO: 1328796 - RNA, 19 nt, Homo sapiens
agagaaucccucaccaaua

SEQ ID NO: 1328797 - RNA, 19 nt, Homo sapiens
gaaggaccacaguagagaa

SEQ ID NO: 1328798 - RNA, 19 nt, Homo sapiens
acaacgaguuucugucuag

SEQ ID NO: 1328799 - RNA, 19 nt, Homo sapiens
gcacgagaaacaacgaguu

SEQ ID NO: 1328800 - RNA, 19 nt, Homo sapiens
aaaagaagccauucaugua

SEQ ID NO: 1328801 - RNA, 19 nt, Homo sapiens
aagaagccauucauguaug

SEQ ID NO: 1328802 - RNA, 19 nt, Homo sapiens
uacagcaacucccaacuca

SEQ ID NO: 1328803 - RNA, 19 nt, Homo sapiens
uaaaggagggagggaguuu

SEQ ID NO: 1328804 - RNA, 19 nt, Homo sapiens
gggugggacugcagaagga

SEQ ID NO: 1328805 - RNA, 19 nt, Homo sapiens
caacgaguuucugucuaga

SEQ ID NO: 1328806 - RNA, 19 nt, Homo sapiens
agaguaagacagugacaaa

SEQ ID NO: 1328807 - RNA, 19 nt, Homo sapiens
gagacaacagcgauuacaa

SEQ ID NO: 1328808 - RNA, 19 nt, Homo sapiens
uaaggaacuguguuaauca

SEQ ID NO: 1328809 - RNA, 19 nt, Homo sapiens
caauaaggaacuguguuaa

SEQ ID NO: 1328810 - RNA, 19 nt, Homo sapiens
gcgcgaaaucggcucauug

SEQ ID NO: 1328811 - RNA, 19 nt, Homo sapiens
guagagaaucccucaccaa

SEQ ID NO: 1328812 - RNA, 19 nt, Homo sapiens
caaaagaagccauucaugu

SEQ ID NO: 1328813 - RNA, 19 nt, Homo sapiens
auacucaccuguacaaagg

SEQ ID NO: 1328814 - RNA, 19 nt, Homo sapiens
gauacucaccuguacaaag

SEQ ID NO: 1328815 - RNA, 19 nt, Homo sapiens
uagagaaucccucaccaau

SEQ ID NO: 1328816 - RNA, 19 nt, Homo sapiens
ccaagagacaacagcgauu

SEQ ID NO: 1328817 - RNA, 19 nt, Homo sapiens
ggaccacaguagagaaucc

SEQ ID NO: 1328818 - RNA, 19 nt, Homo sapiens
aguaagacagugacaaaga

SEQ ID NO: 1328819 - RNA, 19 nt, Homo sapiens
caucagaggaagaucaaag

SEQ ID NO: 1328820 - RNA, 19 nt, Homo sapiens
gacaacagcgauuacaaac

SEQ ID NO: 1328821 - RNA, 19 nt, Homo sapiens
aaucaggaguggccagaag

SEQ ID NO: 1328822 - RNA, 19 nt, Homo sapiens
ccacggacucugccaguag

SEQ ID NO: 1328823 - RNA, 19 nt, Homo sapiens
gagggaaacacuggucuag

SEQ ID NO: 1328824 - RNA, 19 nt, Homo sapiens
aacaacgaguuucugucua

SEQ ID NO: 1328825 - RNA, 19 nt, Homo sapiens
agaaggaccacaguagaga

SEQ ID NO: 1328826 - RNA, 19 nt, Homo sapiens
cagaaggaccacaguagag

SEQ ID NO: 1328827 - RNA, 19 nt, Homo sapiens
aagauacucaccuguacaa

SEQ ID NO: 1328828 - RNA, 19 nt, Homo sapiens
gaguuucugucuagaucgu

SEQ ID NO: 1328829 - RNA, 19 nt, Homo sapiens
gucucuccaucccuuagua

SEQ ID NO: 1328830 - RNA, 19 nt, Homo sapiens
cgccucagccucucgagaa

SEQ ID NO: 1328831 - RNA, 19 nt, Homo sapiens
caguagcugcuuuaaagga

SEQ ID NO: 1328832 - RNA, 19 nt, Homo sapiens
ggcgcgaaaucggcucauu

SEQ ID NO: 1328833 - RNA, 19 nt, Homo sapiens
caaaacagaguaagacagu

SEQ ID NO: 1328834 - RNA, 19 nt, Homo sapiens
acgaguuucugucuagauc

SEQ ID NO: 1328835 - RNA, 19 nt, Homo sapiens
gaugagggcuuuccacuug

SEQ ID NO: 1328836 - RNA, 19 nt, Homo sapiens
ggacaaggaugagggcuuu

SEQ ID NO: 1328837 - RNA, 19 nt, Homo sapiens
ggaggaauguggauaacaa

SEQ ID NO: 1328838 - RNA, 19 nt, Homo sapiens
gcaugaagaccaccgguua

SEQ ID NO: 1328839 - RNA, 19 nt, Homo sapiens
caucaccucuuaaggcauu

SEQ ID NO: 1328840 - RNA, 19 nt, Homo sapiens
ggaggaggaauguggauaa

SEQ ID NO: 1328841 - RNA, 19 nt, Homo sapiens
gaaaggaaaacaacuauga

SEQ ID NO: 1328842 - RNA, 19 nt, Homo sapiens
aggcagucaucaccucuua

SEQ ID NO: 1328843 - RNA, 19 nt, Homo sapiens
gauguaauguccccacaaa

SEQ ID NO: 1328844 - RNA, 19 nt, Homo sapiens
caggagccaugcaaagugu

SEQ ID NO: 1328845 - RNA, 19 nt, Homo sapiens
acccagaccugcugaagga

SEQ ID NO: 1328846 - RNA, 19 nt, Homo sapiens
caacuaugagucugccaaa

SEQ ID NO: 1328847 - RNA, 19 nt, Homo sapiens
ucagccaccugcaguuuca

SEQ ID NO: 1328848 - RNA, 19 nt, Homo sapiens
cuccagggcucaugucugu

SEQ ID NO: 1328849 - RNA, 19 nt, Homo sapiens
gcacaucugccucauucca

SEQ ID NO: 1328850 - RNA, 19 nt, Homo sapiens
gcagucaucaccucuuaag

SEQ ID NO: 1328851 - RNA, 19 nt, Homo sapiens
ccagggcucaugucuguga

SEQ ID NO: 1328852 - RNA, 19 nt, Homo sapiens
ggaugagggcuuuccacuu

SEQ ID NO: 1328853 - RNA, 19 nt, Homo sapiens
ggacuccggcagcacauuc

SEQ ID NO: 1328854 - RNA, 19 nt, Homo sapiens
gaagaacauggaggaggaa

SEQ ID NO: 1328855 - RNA, 19 nt, Homo sapiens
cugaaaaucuugaaaugga

SEQ ID NO: 1328856 - RNA, 19 nt, Homo sapiens
gaggaggaauguggauaac

SEQ ID NO: 1328857 - RNA, 19 nt, Homo sapiens
gccuuugucuccaccugaa

SEQ ID NO: 1328858 - RNA, 19 nt, Homo sapiens
caacgauuccacgcucaaa

SEQ ID NO: 1328859 - RNA, 19 nt, Homo sapiens
gcaacgauuccacgcucaa

SEQ ID NO: 1328860 - RNA, 19 nt, Homo sapiens
aagcuaggaagauguaaug

SEQ ID NO: 1328861 - RNA, 19 nt, Homo sapiens
gccuguguguuccaagcua

SEQ ID NO: 1328862 - RNA, 19 nt, Homo sapiens
ccaccugaaacuccugaaa

SEQ ID NO: 1328863 - RNA, 19 nt, Homo sapiens
ccaggagccaugcaaagug

SEQ ID NO: 1328864 - RNA, 19 nt, Homo sapiens
cagcacauucggcuucaga

SEQ ID NO: 1328865 - RNA, 19 nt, Homo sapiens
ggaaaacaacuaugagucu

SEQ ID NO: 1328866 - RNA, 19 nt, Homo sapiens
gcuaggaagauguaauguc

SEQ ID NO: 1328867 - RNA, 19 nt, Homo sapiens
cucugucacugccacauuu

SEQ ID NO: 1328868 - RNA, 19 nt, Homo sapiens
ucucagaugcguuuuaaaa

SEQ ID NO: 1328869 - RNA, 19 nt, Homo sapiens
uggcuucugcccacacuuu

SEQ ID NO: 1328870 - RNA, 19 nt, Homo sapiens
caagcuaggaagauguaau

SEQ ID NO: 1328871 - RNA, 19 nt, Homo sapiens
cguguccgguguucgauag

SEQ ID NO: 1328872 - RNA, 19 nt, Homo sapiens
ggagccaugcaaaguguca

SEQ ID NO: 1328873 - RNA, 19 nt, Homo sapiens
aaacagaagugaugaaguu

SEQ ID NO: 1328874 - RNA, 19 nt, Homo sapiens
gaacaccucugccgaacuu

SEQ ID NO: 1328875 - RNA, 19 nt, Homo sapiens
ggaauaaagaguuugcuua

SEQ ID NO: 1328876 - RNA, 19 nt, Homo sapiens
gaaacacucugaaaucaca

SEQ ID NO: 1328877 - RNA, 19 nt, Homo sapiens
gcaaauacaaugagcuuaa

SEQ ID NO: 1328878 - RNA, 19 nt, Homo sapiens
gaaaggccacgaacaauga

SEQ ID NO: 1328879 - RNA, 19 nt, Homo sapiens
ggagauguaucaacagaau

SEQ ID NO: 1328880 - RNA, 19 nt, Homo sapiens
gagaaggaaaucaacaaua

SEQ ID NO: 1328881 - RNA, 19 nt, Homo sapiens
gaagagcgacugagaagga

SEQ ID NO: 1328882 - RNA, 19 nt, Homo sapiens
gggaaacacucugaaauca

SEQ ID NO: 1328883 - RNA, 19 nt, Homo sapiens
cgaaggucaucaaauuuaa

SEQ ID NO: 1328884 - RNA, 19 nt, Homo sapiens
gugaugaaguugacaaaga

SEQ ID NO: 1328885 - RNA, 19 nt, Homo sapiens
gcaacauccucauuguauu

SEQ ID NO: 1328886 - RNA, 19 nt, Homo sapiens
acucgaaggucaucaaauu

SEQ ID NO: 1328887 - RNA, 19 nt, Homo sapiens
gcagcagcauuaacccuuu

SEQ ID NO: 1328888 - RNA, 19 nt, Homo sapiens
uaaagacgguguugagagu

SEQ ID NO: 1328889 - RNA, 19 nt, Homo sapiens
ggaaaggccacgaacaaug

SEQ ID NO: 1328890 - RNA, 19 nt, Homo sapiens
caaagaagagcgacugaga

SEQ ID NO: 1328891 - RNA, 19 nt, Homo sapiens
ggauacuuguaaccaauuu

SEQ ID NO: 1328892 - RNA, 19 nt, Homo sapiens
acaaugagcuuaauaugcu

SEQ ID NO: 1328893 - RNA, 19 nt, Homo sapiens
guacucugguauacacuuu

SEQ ID NO: 1328894 - RNA, 19 nt, Homo sapiens
ugauacaacuggugaacuu

SEQ ID NO: 1328895 - RNA, 19 nt, Homo sapiens
gaugaagugcaaagcuuua

SEQ ID NO: 1328896 - RNA, 19 nt, Homo sapiens
ucgaaggucaucaaauuua

SEQ ID NO: 1328897 - RNA, 19 nt, Homo sapiens
uaaugaguguggacaggua

SEQ ID NO: 1328898 - RNA, 19 nt, Homo sapiens
cauccucccuuccaugauu

SEQ ID NO: 1328899 - RNA, 19 nt, Homo sapiens
gcauggaagagaaguguaa

SEQ ID NO: 1328900 - RNA, 19 nt, Homo sapiens
guuauuaccucuccaucug

SEQ ID NO: 1328901 - RNA, 19 nt, Homo sapiens
gaaggaaaucaacaauaug

SEQ ID NO: 1328902 - RNA, 19 nt, Homo sapiens
agaaacgucugccucaaau

SEQ ID NO: 1328903 - RNA, 19 nt, Homo sapiens
gguauacacuuuauuugac

SEQ ID NO: 1328904 - RNA, 19 nt, Homo sapiens
guagugccaucaugacugu

SEQ ID NO: 1328905 - RNA, 19 nt, Homo sapiens
ggcaacauccucauuguau

SEQ ID NO: 1328906 - RNA, 19 nt, Homo sapiens
guccaaccauuucgacuga

SEQ ID NO: 1328907 - RNA, 19 nt, Homo sapiens
gaagugcaaagcuuuaauc

SEQ ID NO: 1328908 - RNA, 19 nt, Homo sapiens
ggaugaagugcaaagcuuu

SEQ ID NO: 1328909 - RNA, 19 nt, Homo sapiens
ugaugaaguugacaaagau

SEQ ID NO: 1328910 - RNA, 19 nt, Homo sapiens
caacauccucauuguauuc

SEQ ID NO: 1328911 - RNA, 19 nt, Homo sapiens
ugauugggauuaucuguuc

SEQ ID NO: 1328912 - RNA, 19 nt, Homo sapiens
gacgauguacucugguaua

SEQ ID NO: 1328913 - RNA, 19 nt, Homo sapiens
gaacaagguacaagaccau

SEQ ID NO: 1328914 - RNA, 19 nt, Homo sapiens
cgacugacacguuggagaa

SEQ ID NO: 1328915 - RNA, 19 nt, Homo sapiens
aaacagucccugacaucua

SEQ ID NO: 1328916 - RNA, 19 nt, Homo sapiens
gggcagguguaccgauaug

SEQ ID NO: 1328917 - RNA, 19 nt, Homo sapiens
gggccucucugcaccauca

SEQ ID NO: 1328918 - RNA, 19 nt, Homo sapiens
gcagguguaccgauauguu

SEQ ID NO: 1328919 - RNA, 19 nt, Homo sapiens
cgacugagaaggaaaucaa

SEQ ID NO: 1328920 - RNA, 19 nt, Homo sapiens
gaagugaugaaguugacaa

SEQ ID NO: 1328921 - RNA, 19 nt, Homo sapiens
gaaguguaaccaugcaaau

SEQ ID NO: 1328922 - RNA, 19 nt, Homo sapiens
aagggcagguguaccgaua

SEQ ID NO: 1328923 - RNA, 19 nt, Homo sapiens
ccuucuauguggguuauua

SEQ ID NO: 1328924 - RNA, 19 nt, Homo sapiens
gaugccagaugcugcaauc

SEQ ID NO: 1328925 - RNA, 19 nt, Homo sapiens
cggauuggaugaagugcaa

SEQ ID NO: 1328926 - RNA, 19 nt, Homo sapiens
gauacaacuggugaacuua

SEQ ID NO: 1328927 - RNA, 19 nt, Homo sapiens
guaaccaauuugccuguag

SEQ ID NO: 1328928 - RNA, 19 nt, Homo sapiens
caaugagcuuaauaugcua

SEQ ID NO: 1328929 - RNA, 19 nt, Homo sapiens
gaaaucacacuuuuaggaa

SEQ ID NO: 1328930 - RNA, 19 nt, Homo sapiens
guacuuugcccucguccaa

SEQ ID NO: 1328931 - RNA, 19 nt, Homo sapiens
aacagucccugacaucuau

SEQ ID NO: 1328932 - RNA, 19 nt, Homo sapiens
agaauaaggaugccagaug

SEQ ID NO: 1328933 - RNA, 19 nt, Homo sapiens
gagauguaucaacagaaua

SEQ ID NO: 1328934 - RNA, 19 nt, Homo sapiens
uggaugaagugcaaagcuu

SEQ ID NO: 1328935 - RNA, 19 nt, Homo sapiens
uaaccaauuugccuguagu

SEQ ID NO: 1328936 - RNA, 19 nt, Homo sapiens
caaccuggcuguggcugau

SEQ ID NO: 1328937 - RNA, 19 nt, Homo sapiens
aaagaagagcgacugagaa

SEQ ID NO: 1328938 - RNA, 19 nt, Homo sapiens
gaauccauuucaugcaucu

SEQ ID NO: 1328939 - RNA, 19 nt, Homo sapiens
aacaaauccuggaauaaag

SEQ ID NO: 1328940 - RNA, 19 nt, Homo sapiens
gcaaucccaguguaccaaa

SEQ ID NO: 1328941 - RNA, 19 nt, Homo sapiens
ugggagauguaucaacaga

SEQ ID NO: 1328942 - RNA, 19 nt, Homo sapiens
gauuugguccacauaguug

SEQ ID NO: 1328943 - RNA, 19 nt, Homo sapiens
cagguguaccgauauguuu

SEQ ID NO: 1328944 - RNA, 19 nt, Homo sapiens
uggaaugccuuuucuuauu

SEQ ID NO: 1328945 - RNA, 19 nt, Homo sapiens
gagcuuaauaugcuaacug

SEQ ID NO: 1328946 - RNA, 19 nt, Homo sapiens
cuugggagauguaucaaca

SEQ ID NO: 1328947 - RNA, 19 nt, Homo sapiens
gaguugugcuuuugauuug

SEQ ID NO: 1328948 - RNA, 19 nt, Homo sapiens
ccauucuucuuguguacuu

SEQ ID NO: 1328949 - RNA, 19 nt, Homo sapiens
ccagugugguggauacagu

SEQ ID NO: 1328950 - RNA, 19 nt, Homo sapiens
ccacacuggccuucuaugu

SEQ ID NO: 1328951 - RNA, 19 nt, Homo sapiens
ccucaaauccaaagaagag

SEQ ID NO: 1328952 - RNA, 19 nt, Homo sapiens
acaaauccuggaauaaaga

SEQ ID NO: 1328953 - RNA, 19 nt, Homo sapiens
ggaagagaaguguaaccau

SEQ ID NO: 1328954 - RNA, 19 nt, Homo sapiens
caacuggugaacuuacaga

SEQ ID NO: 1328955 - RNA, 19 nt, Homo sapiens
cagaagugaugaaguugac

SEQ ID NO: 1328956 - RNA, 19 nt, Homo sapiens
gcuauacuugggagaugua

SEQ ID NO: 1328957 - RNA, 19 nt, Homo sapiens
aagacgguguugagaguug

SEQ ID NO: 1328958 - RNA, 19 nt, Homo sapiens
ggaucaauuugggccuuug

SEQ ID NO: 1328959 - RNA, 19 nt, Homo sapiens
gagcgacugagaaggaaau

SEQ ID NO: 1328960 - RNA, 19 nt, Homo sapiens
uacaagaccauccggauca

SEQ ID NO: 1328961 - RNA, 19 nt, Homo sapiens
ccaaccauuucgacugaca

SEQ ID NO: 1328962 - RNA, 19 nt, Homo sapiens
gcauuaacccuuuucucua

SEQ ID NO: 1328963 - RNA, 19 nt, Homo sapiens
aagcuuuaaucccuggaaa

SEQ ID NO: 1328964 - RNA, 19 nt, Homo sapiens
cugacgauguacucuggua

SEQ ID NO: 1328965 - RNA, 19 nt, Homo sapiens
gaccauccggaucaauuug

SEQ ID NO: 1328966 - RNA, 19 nt, Homo sapiens
uuucaugcaucuuguugga

SEQ ID NO: 1328967 - RNA, 19 nt, Homo sapiens
ccauuucgacugacacguu

SEQ ID NO: 1328968 - RNA, 19 nt, Homo sapiens
guacuugugacucuuagca

SEQ ID NO: 1328969 - RNA, 19 nt, Homo sapiens
gguagucuuuauccugagu

SEQ ID NO: 1328970 - RNA, 19 nt, Homo sapiens
agaccauccggaucaauuu

SEQ ID NO: 1328971 - RNA, 19 nt, Homo sapiens
ggagaacaagguacaagac

SEQ ID NO: 1328972 - RNA, 19 nt, Homo sapiens
uaaccaugcaaauacaaug

SEQ ID NO: 1328973 - RNA, 19 nt, Homo sapiens
gaagauaccuuuauagaga

SEQ ID NO: 1328974 - RNA, 19 nt, Homo sapiens
ggacaacuaugcacucuua

SEQ ID NO: 1328975 - RNA, 19 nt, Homo sapiens
gauaugugguuucuucuua

SEQ ID NO: 1328976 - RNA, 19 nt, Homo sapiens
guaaagacgucuaaacuug

SEQ ID NO: 1328977 - RNA, 19 nt, Homo sapiens
gagaagagcauguuuauga

SEQ ID NO: 1328978 - RNA, 19 nt, Homo sapiens
gauggaagauaccuuuaua

SEQ ID NO: 1328979 - RNA, 19 nt, Homo sapiens
gcaauggaauuucauaaug

SEQ ID NO: 1328980 - RNA, 19 nt, Homo sapiens
uaaauggacucguaagaaa

SEQ ID NO: 1328981 - RNA, 19 nt, Homo sapiens
cuaaauaaauggacucgua

SEQ ID NO: 1328982 - RNA, 19 nt, Homo sapiens
gggcaaauguguagauauu

SEQ ID NO: 1328983 - RNA, 19 nt, Homo sapiens
ggacagcauuucuagaauu

SEQ ID NO: 1328984 - RNA, 19 nt, Homo sapiens
gacagcauuucuagaauua

SEQ ID NO: 1328985 - RNA, 19 nt, Homo sapiens
ucacaagauucucuacuua

SEQ ID NO: 1328986 - RNA, 19 nt, Homo sapiens
guacugagauuuaaaugug

SEQ ID NO: 1328987 - RNA, 19 nt, Homo sapiens
guaacaaucugaggcaaua

SEQ ID NO: 1328988 - RNA, 19 nt, Homo sapiens
ggaaggguguuuaaacuau

SEQ ID NO: 1328989 - RNA, 19 nt, Homo sapiens
cuacaaaguugaugcuuaa

SEQ ID NO: 1328990 - RNA, 19 nt, Homo sapiens
aaccauagcuuucuaggua

SEQ ID NO: 1328991 - RNA, 19 nt, Homo sapiens
ggaaguggaucacgggaaa

SEQ ID NO: 1328992 - RNA, 19 nt, Homo sapiens
uaacugagguaccagauga

SEQ ID NO: 1328993 - RNA, 19 nt, Homo sapiens
caacguauguuuacuguag

SEQ ID NO: 1328994 - RNA, 19 nt, Homo sapiens
gcaguggucuaauuuaaug

SEQ ID NO: 1328995 - RNA, 19 nt, Homo sapiens
gcacuuuccuauauauuug

SEQ ID NO: 1328996 - RNA, 19 nt, Homo sapiens
gaacagaaccauagcuuuc

SEQ ID NO: 1328997 - RNA, 19 nt, Homo sapiens
caacuaugcacucuuauaa

SEQ ID NO: 1328998 - RNA, 19 nt, Homo sapiens
gaacacgucuucagaacca

SEQ ID NO: 1328999 - RNA, 19 nt, Homo sapiens
agaauaggcugcaaacuug

SEQ ID NO: 1329000 - RNA, 19 nt, Homo sapiens
caagagauguucauguaau

SEQ ID NO: 1329001 - RNA, 19 nt, Homo sapiens
uaacuuagauccucauucu

SEQ ID NO: 1329002 - RNA, 19 nt, Homo sapiens
gcugcaaacuugucuauug

SEQ ID NO: 1329003 - RNA, 19 nt, Homo sapiens
ccaaacugcuuuacauaga

SEQ ID NO: 1329004 - RNA, 19 nt, Homo sapiens
caauaucacuaggacuuua

SEQ ID NO: 1329005 - RNA, 19 nt, Homo sapiens
uuaggaaacuugucuuuga

SEQ ID NO: 1329006 - RNA, 19 nt, Homo sapiens
guagaagccuaugauauug

SEQ ID NO: 1329007 - RNA, 19 nt, Homo sapiens
ugacauguguggguuuaua

SEQ ID NO: 1329008 - RNA, 19 nt, Homo sapiens
gcaggcauuuggaucagua

SEQ ID NO: 1329009 - RNA, 19 nt, Homo sapiens
ugcaagagauguucaugua

SEQ ID NO: 1329010 - RNA, 19 nt, Homo sapiens
uaacuggacucaaucuuag

SEQ ID NO: 1329011 - RNA, 19 nt, Homo sapiens
gugcuagucuaacuuaauu

SEQ ID NO: 1329012 - RNA, 19 nt, Homo sapiens
aaagagugcugacaguauu

SEQ ID NO: 1329013 - RNA, 19 nt, Homo sapiens
caaaugaccugagagaagu

SEQ ID NO: 1329014 - RNA, 19 nt, Homo sapiens
gcaaucagcccuuacuuca

SEQ ID NO: 1329015 - RNA, 19 nt, Homo sapiens
guaaugugauacugugaaa

SEQ ID NO: 1329016 - RNA, 19 nt, Homo sapiens
caaguguacugagauuuaa

SEQ ID NO: 1329017 - RNA, 19 nt, Homo sapiens
ugaaugugcuguugcuaaa

SEQ ID NO: 1329018 - RNA, 19 nt, Homo sapiens
gcagugaggucuccaucga

SEQ ID NO: 1329019 - RNA, 19 nt, Homo sapiens
cuaaguauaugaucaguca

SEQ ID NO: 1329020 - RNA, 19 nt, Homo sapiens
gaaggacaguugacagaca

SEQ ID NO: 1329021 - RNA, 19 nt, Homo sapiens
gaggguacgaucuaaguua

SEQ ID NO: 1329022 - RNA, 19 nt, Homo sapiens
cguaaaggguauaagcaua

SEQ ID NO: 1329023 - RNA, 19 nt, Homo sapiens
ucaaguguacugagauuua

SEQ ID NO: 1329024 - RNA, 19 nt, Homo sapiens
cuagauaugugguuucuuc

SEQ ID NO: 1329025 - RNA, 19 nt, Homo sapiens
gaaguugggauucuuguau

SEQ ID NO: 1329026 - RNA, 19 nt, Homo sapiens
gcucagguauguaguaagu

SEQ ID NO: 1329027 - RNA, 19 nt, Homo sapiens
gaauguauguagcacuuuc

SEQ ID NO: 1329028 - RNA, 19 nt, Homo sapiens
gacauacuguggcuaauuc

SEQ ID NO: 1329029 - RNA, 19 nt, Homo sapiens
gauaguaugucuguaaucu

SEQ ID NO: 1329030 - RNA, 19 nt, Homo sapiens
cauaguacuuuaccuguug

SEQ ID NO: 1329031 - RNA, 19 nt, Homo sapiens
uaaggugguuugagcauga

SEQ ID NO: 1329032 - RNA, 19 nt, Homo sapiens
gaagagcauguuuaugaaa

SEQ ID NO: 1329033 - RNA, 19 nt, Homo sapiens
gagaacaaauggaugugau

SEQ ID NO: 1329034 - RNA, 19 nt, Homo sapiens
ucuacaaaguugaugcuua

SEQ ID NO: 1329035 - RNA, 19 nt, Homo sapiens
ggaacauuauacccaguuu

SEQ ID NO: 1329036 - RNA, 19 nt, Homo sapiens
guugaacucuugugauuuc

SEQ ID NO: 1329037 - RNA, 19 nt, Homo sapiens
ggucugagccuaugccuau

SEQ ID NO: 1329038 - RNA, 19 nt, Homo sapiens
cagaaaguacucuaaauga

SEQ ID NO: 1329039 - RNA, 19 nt, Homo sapiens
gaaggguguuuaaacuaug

SEQ ID NO: 1329040 - RNA, 19 nt, Homo sapiens
ugacauagaacauugaguu

SEQ ID NO: 1329041 - RNA, 19 nt, Homo sapiens
aaagcaaacuggcaugguu

SEQ ID NO: 1329042 - RNA, 19 nt, Homo sapiens
gaaaauggguaugcuuaaa

SEQ ID NO: 1329043 - RNA, 19 nt, Homo sapiens
gugcaucacuggcaucuca

SEQ ID NO: 1329044 - RNA, 19 nt, Homo sapiens
ccagaacaaacuccauuua

SEQ ID NO: 1329045 - RNA, 19 nt, Homo sapiens
ccuaugauauugagcuaaa

SEQ ID NO: 1329046 - RNA, 19 nt, Homo sapiens
aaucggaggucguguuuau

SEQ ID NO: 1329047 - RNA, 19 nt, Homo sapiens
aaucagcccuuacuucaga

SEQ ID NO: 1329048 - RNA, 19 nt, Homo sapiens
uguagaagccuaugauauu

SEQ ID NO: 1329049 - RNA, 19 nt, Homo sapiens
cagaauaggcugcaaacuu

SEQ ID NO: 1329050 - RNA, 19 nt, Homo sapiens
uaugaucauuccaccaaua

SEQ ID NO: 1329051 - RNA, 19 nt, Homo sapiens
cagugacgauuuaaaugua

SEQ ID NO: 1329052 - RNA, 19 nt, Homo sapiens
gacauagaacauugaguua

SEQ ID NO: 1329053 - RNA, 19 nt, Homo sapiens
gcaagagauguucauguaa

SEQ ID NO: 1329054 - RNA, 19 nt, Homo sapiens
cuaacuggacucaaucuua

SEQ ID NO: 1329055 - RNA, 19 nt, Homo sapiens
ggaaugacugcuucugaaa

SEQ ID NO: 1329056 - RNA, 19 nt, Homo sapiens
uaaguauacuagacaguga

SEQ ID NO: 1329057 - RNA, 19 nt, Homo sapiens
ucgaauaguugguguugaa

SEQ ID NO: 1329058 - RNA, 19 nt, Homo sapiens
ugaaggauaaaccaacuua

SEQ ID NO: 1329059 - RNA, 19 nt, Homo sapiens
acagagaagcacuaacuua

SEQ ID NO: 1329060 - RNA, 19 nt, Homo sapiens
ccauaaauccauaccuuaa

SEQ ID NO: 1329061 - RNA, 19 nt, Homo sapiens
acaaagagaagaucuaugu

SEQ ID NO: 1329062 - RNA, 19 nt, Homo sapiens
acuagacagugacgauuua

SEQ ID NO: 1329063 - RNA, 19 nt, Homo sapiens
caccaaagaacaagaguuu

SEQ ID NO: 1329064 - RNA, 19 nt, Homo sapiens
aauggguacuacagaauua

SEQ ID NO: 1329065 - RNA, 19 nt, Homo sapiens
cagaagagguccuagaaaa

SEQ ID NO: 1329066 - RNA, 19 nt, Homo sapiens
caaggaaagguaacuuauu

SEQ ID NO: 1329067 - RNA, 19 nt, Homo sapiens
ggaaacuugucuuugauac

SEQ ID NO: 1329068 - RNA, 19 nt, Homo sapiens
gcaaucggaggucguguuu

SEQ ID NO: 1329069 - RNA, 19 nt, Homo sapiens
gagcaugaacagaaugaaa

SEQ ID NO: 1329070 - RNA, 19 nt, Homo sapiens
aaauggaugugaucaugaa

SEQ ID NO: 1329071 - RNA, 19 nt, Homo sapiens
acaaauggaugugaucaug

SEQ ID NO: 1329072 - RNA, 19 nt, Homo sapiens
uaaugccaguuccacuuua

SEQ ID NO: 1329073 - RNA, 19 nt, Homo sapiens
ggagagcucugcugugaug

SEQ ID NO: 1329074 - RNA, 19 nt, Homo sapiens
gcagugaccuugugaacca

SEQ ID NO: 1329075 - RNA, 19 nt, Homo sapiens
gcaagucggucgaggagau

SEQ ID NO: 1329076 - RNA, 19 nt, Homo sapiens
ccagaguaguggccgaaua

SEQ ID NO: 1329077 - RNA, 19 nt, Homo sapiens
caagcacagugaagaguug

SEQ ID NO: 1329078 - RNA, 19 nt, Homo sapiens
ccaacaagccgaccacguu

SEQ ID NO: 1329079 - RNA, 19 nt, Homo sapiens
gcaaguggcaucccuaaaa

SEQ ID NO: 1329080 - RNA, 19 nt, Homo sapiens
ucucgacgcuggugcagaa

SEQ ID NO: 1329081 - RNA, 19 nt, Homo sapiens
augaagagcugccuguuuc

SEQ ID NO: 1329082 - RNA, 19 nt, Homo sapiens
gcaagcacagugaagaguu

SEQ ID NO: 1329083 - RNA, 19 nt, Homo sapiens
guaguggccgaauaccuua

SEQ ID NO: 1329084 - RNA, 19 nt, Homo sapiens
acggagagcucugcuguga

SEQ ID NO: 1329085 - RNA, 19 nt, Homo sapiens
cccaggcuuuggacuguua

SEQ ID NO: 1329086 - RNA, 19 nt, Homo sapiens
cgacuucgcccgacggaau

SEQ ID NO: 1329087 - RNA, 19 nt, Homo sapiens
gagguucugcuugggauaa

SEQ ID NO: 1329088 - RNA, 19 nt, Homo sapiens
ucugaagaaucccugaugu

SEQ ID NO: 1329089 - RNA, 19 nt, Homo sapiens
aaugaagagcugccuguuu

SEQ ID NO: 1329090 - RNA, 19 nt, Homo sapiens
gagagcauccacugcaagu

SEQ ID NO: 1329091 - RNA, 19 nt, Homo sapiens
caacggacugggucgcuau

SEQ ID NO: 1329092 - RNA, 19 nt, Homo sapiens
aaucccugaugucuuauug

SEQ ID NO: 1329093 - RNA, 19 nt, Homo sapiens
agagcugccuguuucuuuc

SEQ ID NO: 1329094 - RNA, 19 nt, Homo sapiens
ucccugaugucuuauugga

SEQ ID NO: 1329095 - RNA, 19 nt, Homo sapiens
ugaagaaucccugaugucu

SEQ ID NO: 1329096 - RNA, 19 nt, Homo sapiens
aaacuuauccaaggucaca

SEQ ID NO: 1329097 - RNA, 19 nt, Homo sapiens
gaauccaggggucguaaua

SEQ ID NO: 1329098 - RNA, 19 nt, Homo sapiens
ggccagcguucuccacaac

SEQ ID NO: 1329099 - RNA, 19 nt, Homo sapiens
gaaucccugaugucuuauu

SEQ ID NO: 1329100 - RNA, 19 nt, Homo sapiens
ggucguaauauauguaaac

SEQ ID NO: 1329101 - RNA, 19 nt, Homo sapiens
guucugcuugggauaauga

SEQ ID NO: 1329102 - RNA, 19 nt, Homo sapiens
cagaguaguggccgaauac

SEQ ID NO: 1329103 - RNA, 19 nt, Homo sapiens
cggacugggucgcuaugug

SEQ ID NO: 1329104 - RNA, 19 nt, Homo sapiens
gcaaguugacagagguucu

SEQ ID NO: 1329105 - RNA, 19 nt, Homo sapiens
gaagaaaucccucagauaa

SEQ ID NO: 1329106 - RNA, 19 nt, Homo sapiens
ggacagauuugaauugauu

SEQ ID NO: 1329107 - RNA, 19 nt, Homo sapiens
caagaagaaucaacuauga

SEQ ID NO: 1329108 - RNA, 19 nt, Homo sapiens
gaaaugagguguguguuug

SEQ ID NO: 1329109 - RNA, 19 nt, Homo sapiens
gagguaagcuguugugaug

SEQ ID NO: 1329110 - RNA, 19 nt, Homo sapiens
ccucuaagcucaacaugua

SEQ ID NO: 1329111 - RNA, 19 nt, Homo sapiens
ggagauuuguugcacauuu

SEQ ID NO: 1329112 - RNA, 19 nt, Homo sapiens
caaggaagguguagcuaaa

SEQ ID NO: 1329113 - RNA, 19 nt, Homo sapiens
caacauguaugaagcuuug

SEQ ID NO: 1329114 - RNA, 19 nt, Homo sapiens
ggacauagugcagacauua

SEQ ID NO: 1329115 - RNA, 19 nt, Homo sapiens
gagaaguggucacaucuga

SEQ ID NO: 1329116 - RNA, 19 nt, Homo sapiens
agacaaagcucgagugagu

SEQ ID NO: 1329117 - RNA, 19 nt, Homo sapiens
gcagagaaguggucacauc

SEQ ID NO: 1329118 - RNA, 19 nt, Homo sapiens
gcauagaaccagucaauga

SEQ ID NO: 1329119 - RNA, 19 nt, Homo sapiens
ggaaaugagguguguguuu

SEQ ID NO: 1329120 - RNA, 19 nt, Homo sapiens
gaacaaugcauggcaacua

SEQ ID NO: 1329121 - RNA, 19 nt, Homo sapiens
gguuagagaugcaaucaga

SEQ ID NO: 1329122 - RNA, 19 nt, Homo sapiens
uaaccacccugaaguguga

SEQ ID NO: 1329123 - RNA, 19 nt, Homo sapiens
ugaagaagcccaucaguau

SEQ ID NO: 1329124 - RNA, 19 nt, Homo sapiens
gaaaucuagugaugaacuu

SEQ ID NO: 1329125 - RNA, 19 nt, Homo sapiens
gaagaagcccaucaguauu

SEQ ID NO: 1329126 - RNA, 19 nt, Homo sapiens
guuguacccucccaaagua

SEQ ID NO: 1329127 - RNA, 19 nt, Homo sapiens
caagaaaugguacucaauu

SEQ ID NO: 1329128 - RNA, 19 nt, Homo sapiens
gcaaggaagguguagcuaa

SEQ ID NO: 1329129 - RNA, 19 nt, Homo sapiens
aaaggacaguugcacauuu

SEQ ID NO: 1329130 - RNA, 19 nt, Homo sapiens
acacaaugcucaucuguca

SEQ ID NO: 1329131 - RNA, 19 nt, Homo sapiens
ggaaagccuauuagaauug

SEQ ID NO: 1329132 - RNA, 19 nt, Homo sapiens
ggaaauguauugggaaguc

SEQ ID NO: 1329133 - RNA, 19 nt, Homo sapiens
gcacuggauucuggacuuu

SEQ ID NO: 1329134 - RNA, 19 nt, Homo sapiens
guacuccuauugcuacuga

SEQ ID NO: 1329135 - RNA, 19 nt, Homo sapiens
gaaguuaaagguaucaugu

SEQ ID NO: 1329136 - RNA, 19 nt, Homo sapiens
gcacaucucaucccuggaa

SEQ ID NO: 1329137 - RNA, 19 nt, Homo sapiens
guggaaaucuagugaugaa

SEQ ID NO: 1329138 - RNA, 19 nt, Homo sapiens
agacauuggugaagacuga

SEQ ID NO: 1329139 - RNA, 19 nt, Homo sapiens
ugacagugcuggagaaucu

SEQ ID NO: 1329140 - RNA, 19 nt, Homo sapiens
gcacaccaaggaacagaua

SEQ ID NO: 1329141 - RNA, 19 nt, Homo sapiens
cgaagaaaucccucagaua

SEQ ID NO: 1329142 - RNA, 19 nt, Homo sapiens
gaagaaauggaacaaagug

SEQ ID NO: 1329143 - RNA, 19 nt, Homo sapiens
gaccggagaugcacaccaa

SEQ ID NO: 1329144 - RNA, 19 nt, Homo sapiens
gaucuuggguuagguggaa

SEQ ID NO: 1329145 - RNA, 19 nt, Homo sapiens
gguaucauguuucccagaa

SEQ ID NO: 1329146 - RNA, 19 nt, Homo sapiens
caggagacauuacccgaaa

SEQ ID NO: 1329147 - RNA, 19 nt, Homo sapiens
gaaaggacaguugcacauu

SEQ ID NO: 1329148 - RNA, 19 nt, Homo sapiens
ggugaagacugaggaagaa

SEQ ID NO: 1329149 - RNA, 19 nt, Homo sapiens
gauagcuucuuuacaagug

SEQ ID NO: 1329150 - RNA, 19 nt, Homo sapiens
gaagggacagauuugaauu

SEQ ID NO: 1329151 - RNA, 19 nt, Homo sapiens
gaagauggccuugugaaag

SEQ ID NO: 1329152 - RNA, 19 nt, Homo sapiens
uggaaagccuauuagaauu

SEQ ID NO: 1329153 - RNA, 19 nt, Homo sapiens
gugaaugcuuugauaguga

SEQ ID NO: 1329154 - RNA, 19 nt, Homo sapiens
ggaagucacaguucaggaa

SEQ ID NO: 1329155 - RNA, 19 nt, Homo sapiens
caggaaagcccaacagaga

SEQ ID NO: 1329156 - RNA, 19 nt, Homo sapiens
gagauuuguugcacauuuc

SEQ ID NO: 1329157 - RNA, 19 nt, Homo sapiens
ucaaugagguaagcuguug

SEQ ID NO: 1329158 - RNA, 19 nt, Homo sapiens
uaacccaggugcuucucua

SEQ ID NO: 1329159 - RNA, 19 nt, Homo sapiens
agucaaccauccauaguaa

SEQ ID NO: 1329160 - RNA, 19 nt, Homo sapiens
gucaaugugugaaugcuuu

SEQ ID NO: 1329161 - RNA, 19 nt, Homo sapiens
gauaauggccaccuagauc

SEQ ID NO: 1329162 - RNA, 19 nt, Homo sapiens
guaguaccuuucucuaugu

SEQ ID NO: 1329163 - RNA, 19 nt, Homo sapiens
gaaauacagggugaggaua

SEQ ID NO: 1329164 - RNA, 19 nt, Homo sapiens
gugaagaagcccaucagua

SEQ ID NO: 1329165 - RNA, 19 nt, Homo sapiens
uguaguaccuuucucuaug

SEQ ID NO: 1329166 - RNA, 19 nt, Homo sapiens
gaacacaaugcucaucugu

SEQ ID NO: 1329167 - RNA, 19 nt, Homo sapiens
acacaggguuaucugguuu

SEQ ID NO: 1329168 - RNA, 19 nt, Homo sapiens
gaaagccuauuagaauugg

SEQ ID NO: 1329169 - RNA, 19 nt, Homo sapiens
gaugcuggguguaaucuca

SEQ ID NO: 1329170 - RNA, 19 nt, Homo sapiens
agaaaucccucagauaagu

SEQ ID NO: 1329171 - RNA, 19 nt, Homo sapiens
agaaucaacuaugaaggua

SEQ ID NO: 1329172 - RNA, 19 nt, Homo sapiens
gaauggaaagccuauuaga

SEQ ID NO: 1329173 - RNA, 19 nt, Homo sapiens
uccgaugacugaagaaauu

SEQ ID NO: 1329174 - RNA, 19 nt, Homo sapiens
gacaggaaguggagacaca

SEQ ID NO: 1329175 - RNA, 19 nt, Homo sapiens
gugcagacauuaauaagac

SEQ ID NO: 1329176 - RNA, 19 nt, Homo sapiens
uaagaagcaagaaauggua

SEQ ID NO: 1329177 - RNA, 19 nt, Homo sapiens
gugaugaacuucgcugaug

SEQ ID NO: 1329178 - RNA, 19 nt, Homo sapiens
aagaagcccaucaguauuu

SEQ ID NO: 1329179 - RNA, 19 nt, Homo sapiens
cgagaacuuugucaucaau

SEQ ID NO: 1329180 - RNA, 19 nt, Homo sapiens
gggcauagaaccagucaau

SEQ ID NO: 1329181 - RNA, 19 nt, Homo sapiens
guccauuaaccaacaauua

SEQ ID NO: 1329182 - RNA, 19 nt, Homo sapiens
uggguuagguggaaaucua

SEQ ID NO: 1329183 - RNA, 19 nt, Homo sapiens
gaagucacaguucaggaaa

SEQ ID NO: 1329184 - RNA, 19 nt, Homo sapiens
gaagugagugggccuguuc

SEQ ID NO: 1329185 - RNA, 19 nt, Homo sapiens
gacaggacaugcacccaau

SEQ ID NO: 1329186 - RNA, 19 nt, Homo sapiens
aaaugaagauggccuugug

SEQ ID NO: 1329187 - RNA, 19 nt, Homo sapiens
ggaacacaaugcucaucug

SEQ ID NO: 1329188 - RNA, 19 nt, Homo sapiens
gcaagaaaugguacucaau

SEQ ID NO: 1329189 - RNA, 19 nt, Homo sapiens
caacuaugaagguagauga

SEQ ID NO: 1329190 - RNA, 19 nt, Homo sapiens
ggauaagaagcaagaaaug

SEQ ID NO: 1329191 - RNA, 19 nt, Homo sapiens
gaggauaagaagcaagaaa

SEQ ID NO: 1329192 - RNA, 19 nt, Homo sapiens
gauaagucaaccauccaua

SEQ ID NO: 1329193 - RNA, 19 nt, Homo sapiens
gaggucagcuacgucuuug

SEQ ID NO: 1329194 - RNA, 19 nt, Homo sapiens
ccaaggaacagauaaugga

SEQ ID NO: 1329195 - RNA, 19 nt, Homo sapiens
guugaacuguaguaccuuu

SEQ ID NO: 1329196 - RNA, 19 nt, Homo sapiens
gaacaauucgugagaacag

SEQ ID NO: 1329197 - RNA, 19 nt, Homo sapiens
ggagaagccucaggaaagc

SEQ ID NO: 1329198 - RNA, 19 nt, Homo sapiens
gcccaucaguauuucuuga

SEQ ID NO: 1329199 - RNA, 19 nt, Homo sapiens
aaucaacuaugaagguaga

SEQ ID NO: 1329200 - RNA, 19 nt, Homo sapiens
gaaguggucacaucugagu

SEQ ID NO: 1329201 - RNA, 19 nt, Homo sapiens
aaauacagggugaggauaa

SEQ ID NO: 1329202 - RNA, 19 nt, Homo sapiens
gaagguagaugaggauccu

SEQ ID NO: 1329203 - RNA, 19 nt, Homo sapiens
aagauggccuugugaaagu

SEQ ID NO: 1329204 - RNA, 19 nt, Homo sapiens
guaccuuucucuaugucaa

SEQ ID NO: 1329205 - RNA, 19 nt, Homo sapiens
gaaggaacaucugucuaua

SEQ ID NO: 1329206 - RNA, 19 nt, Homo sapiens
gcucccaccucccaaauua

SEQ ID NO: 1329207 - RNA, 19 nt, Homo sapiens
ggaaguaguuucucuuugg

SEQ ID NO: 1329208 - RNA, 19 nt, Homo sapiens
ucacgaagauaaugaagaa

SEQ ID NO: 1329209 - RNA, 19 nt, Homo sapiens
gcaaagauuucugucaguu

SEQ ID NO: 1329210 - RNA, 19 nt, Homo sapiens
gaaauccuguguucuguca

SEQ ID NO: 1329211 - RNA, 19 nt, Homo sapiens
gucagaggcugcaaguuua

SEQ ID NO: 1329212 - RNA, 19 nt, Homo sapiens
caauauggcuguggaaguu

SEQ ID NO: 1329213 - RNA, 19 nt, Homo sapiens
gcacccauguuucgaaaga

SEQ ID NO: 1329214 - RNA, 19 nt, Homo sapiens
caagaaggcuuuggaguag

SEQ ID NO: 1329215 - RNA, 19 nt, Homo sapiens
guaaauuccucaucuaugc

SEQ ID NO: 1329216 - RNA, 19 nt, Homo sapiens
uccuuaagcuguucaauaa

SEQ ID NO: 1329217 - RNA, 19 nt, Homo sapiens
auaaaccgguuccucauuu

SEQ ID NO: 1329218 - RNA, 19 nt, Homo sapiens
cgaguaaauuccucaucua

SEQ ID NO: 1329219 - RNA, 19 nt, Homo sapiens
acaagaaggcuuuggagua

SEQ ID NO: 1329220 - RNA, 19 nt, Homo sapiens
aauaguggcuagcuucaaa

SEQ ID NO: 1329221 - RNA, 19 nt, Homo sapiens
ggcacgaaauccucaauau

SEQ ID NO: 1329222 - RNA, 19 nt, Homo sapiens
ugucagaggcugcaaguuu

SEQ ID NO: 1329223 - RNA, 19 nt, Homo sapiens
aaagauuucugucaguuuc

SEQ ID NO: 1329224 - RNA, 19 nt, Homo sapiens
guagcuaaagccacuauuu

SEQ ID NO: 1329225 - RNA, 19 nt, Homo sapiens
ggaacgggaugguuuagac

SEQ ID NO: 1329226 - RNA, 19 nt, Homo sapiens
cgaaaugccagauuagaug

SEQ ID NO: 1329227 - RNA, 19 nt, Homo sapiens
acgagaauauggaaacauu

SEQ ID NO: 1329228 - RNA, 19 nt, Homo sapiens
gaaaacaaauagguccuuu

SEQ ID NO: 1329229 - RNA, 19 nt, Homo sapiens
ccacgcgggucacgacuau

SEQ ID NO: 1329230 - RNA, 19 nt, Homo sapiens
ucaacauucuccaguuuau

SEQ ID NO: 1329231 - RNA, 19 nt, Homo sapiens
ugucaacauucuccaguuu

SEQ ID NO: 1329232 - RNA, 19 nt, Homo sapiens
gugcugaaaucccaaucaa

SEQ ID NO: 1329233 - RNA, 19 nt, Homo sapiens
ccaccucccaaauuaaaua

SEQ ID NO: 1329234 - RNA, 19 nt, Homo sapiens
gcaaccacauuuggacaga

SEQ ID NO: 1329235 - RNA, 19 nt, Homo sapiens
gcugauggcaaccacauuu

SEQ ID NO: 1329236 - RNA, 19 nt, Homo sapiens
gcacgaaauccucaauauc

SEQ ID NO: 1329237 - RNA, 19 nt, Homo sapiens
agcaagcccuguucucuuu

SEQ ID NO: 1329238 - RNA, 19 nt, Homo sapiens
auaucgaaaugccagauua

SEQ ID NO: 1329239 - RNA, 19 nt, Homo sapiens
gcaacaagaaggcuuugga

SEQ ID NO: 1329240 - RNA, 19 nt, Homo sapiens
uaaaaucgcacccauguuu

SEQ ID NO: 1329241 - RNA, 19 nt, Homo sapiens
caaagauuucugucaguuu

SEQ ID NO: 1329242 - RNA, 19 nt, Homo sapiens
caugggacauugccacuuc

SEQ ID NO: 1329243 - RNA, 19 nt, Homo sapiens
gugacuccaugcuuguaua

SEQ ID NO: 1329244 - RNA, 19 nt, Homo sapiens
aguaggaacuguaacuaug

SEQ ID NO: 1329245 - RNA, 19 nt, Homo sapiens
agaaggaacaucugucuau

SEQ ID NO: 1329246 - RNA, 19 nt, Homo sapiens
gaguaaauuccucaucuau

SEQ ID NO: 1329247 - RNA, 19 nt, Homo sapiens
ccgcagaccagaaccagua

SEQ ID NO: 1329248 - RNA, 19 nt, Homo sapiens
gagcagcgcaggacacaca

SEQ ID NO: 1329249 - RNA, 19 nt, Homo sapiens
caaacuggauggccacaac

SEQ ID NO: 1329250 - RNA, 19 nt, Homo sapiens
caacauucuccaguuuaua

SEQ ID NO: 1329251 - RNA, 19 nt, Homo sapiens
ccggaacacuagagaaugu

SEQ ID NO: 1329252 - RNA, 19 nt, Homo sapiens
gaacuguaacuaugucucu

SEQ ID NO: 1329253 - RNA, 19 nt, Homo sapiens
ucuauacggugcugaaauc

SEQ ID NO: 1329254 - RNA, 19 nt, Homo sapiens
gagaaacguguguggaguu

SEQ ID NO: 1329255 - RNA, 19 nt, Homo sapiens
ggagaagagggugguguuu

SEQ ID NO: 1329256 - RNA, 19 nt, Homo sapiens
gugaaguucuccgccauga

SEQ ID NO: 1329257 - RNA, 19 nt, Homo sapiens
agcauauucuguucaagua

SEQ ID NO: 1329258 - RNA, 19 nt, Homo sapiens
ggacugggacgcacucucu

SEQ ID NO: 1329259 - RNA, 19 nt, Homo sapiens
gggcacgaaauccucaaua

SEQ ID NO: 1329260 - RNA, 19 nt, Homo sapiens
agacuuuccugcucagugu

SEQ ID NO: 1329261 - RNA, 19 nt, Homo sapiens
ccgaguaaauuccucaucu

SEQ ID NO: 1329262 - RNA, 19 nt, Homo sapiens
acaggucacuagaguuaga

SEQ ID NO: 1329263 - RNA, 19 nt, Homo sapiens
ugucuuugcuccaauaugg

SEQ ID NO: 1329264 - RNA, 19 nt, Homo sapiens
gcugaaaucccaaucaaaa

SEQ ID NO: 1329265 - RNA, 19 nt, Homo sapiens
ggacuucaacccgaguaaa

SEQ ID NO: 1329266 - RNA, 19 nt, Homo sapiens
cagcgcaggacacacauaa

SEQ ID NO: 1329267 - RNA, 19 nt, Homo sapiens
ccuuaagacuggacaagau

SEQ ID NO: 1329268 - RNA, 19 nt, Homo sapiens
uugaaguucuggucuguga

SEQ ID NO: 1329269 - RNA, 19 nt, Homo sapiens
gugggaaagucucaagcuu

SEQ ID NO: 1329270 - RNA, 19 nt, Homo sapiens
gaaaucccaaucaaaagua

SEQ ID NO: 1329271 - RNA, 19 nt, Homo sapiens
ucaugccgcuguucuuugu

SEQ ID NO: 1329272 - RNA, 19 nt, Homo sapiens
cuaguucuguacagcauau

SEQ ID NO: 1329273 - RNA, 19 nt, Homo sapiens
agacacagcacaguccuuu

SEQ ID NO: 1329274 - RNA, 19 nt, Homo sapiens
gacagaaucgagagaggaa

SEQ ID NO: 1329275 - RNA, 19 nt, Homo sapiens
gaaguucuggucugugaca

SEQ ID NO: 1329276 - RNA, 19 nt, Homo sapiens
caacaccaagcaagagaug

SEQ ID NO: 1329277 - RNA, 19 nt, Homo sapiens
guaggaacuguaacuaugu

SEQ ID NO: 1329278 - RNA, 19 nt, Homo sapiens
caaccacauuuggacagaa

SEQ ID NO: 1329279 - RNA, 19 nt, Homo sapiens
gucaacauucuccaguuua

SEQ ID NO: 1329280 - RNA, 19 nt, Homo sapiens
uuaaagccauguugauugc

SEQ ID NO: 1329281 - RNA, 19 nt, Homo sapiens
ggaguaggcaugauguuuu

SEQ ID NO: 1329282 - RNA, 19 nt, Homo sapiens
gaacucgugcagguacgua

SEQ ID NO: 1329283 - RNA, 19 nt, Homo sapiens
guggaaguaguuucucuuu

SEQ ID NO: 1329284 - RNA, 19 nt, Homo sapiens
guuuaaagccauguugauu

SEQ ID NO: 1329285 - RNA, 19 nt, Homo sapiens
cuuaagcuguucaauaaac

SEQ ID NO: 1329286 - RNA, 19 nt, Homo sapiens
aaauagguccuuugcugaa

SEQ ID NO: 1329287 - RNA, 19 nt, Homo sapiens
ucagaauaguggcuagcuu

SEQ ID NO: 1329288 - RNA, 19 nt, Homo sapiens
uggaaguaguuucucuuug

SEQ ID NO: 1329289 - RNA, 19 nt, Homo sapiens
ggcugucuuugcuccaaua

SEQ ID NO: 1329290 - RNA, 19 nt, Homo sapiens
cgagagaggaagccauuuc

SEQ ID NO: 1329291 - RNA, 19 nt, Homo sapiens
gcauccacuugcucuuguu

SEQ ID NO: 1329292 - RNA, 19 nt, Homo sapiens
gaguuuaaagccauguuga

SEQ ID NO: 1329293 - RNA, 19 nt, Homo sapiens
ggaguuuaaagccauguug

SEQ ID NO: 1329294 - RNA, 19 nt, Homo sapiens
cagcauauucuguucaagu

SEQ ID NO: 1329295 - RNA, 19 nt, Homo sapiens
uuacugggcugucuuugcu

SEQ ID NO: 1329296 - RNA, 19 nt, Homo sapiens
cuucuuacauuugagauuc

SEQ ID NO: 1329297 - RNA, 19 nt, Homo sapiens
gugguccucuacuacauug

SEQ ID NO: 1329298 - RNA, 19 nt, Homo sapiens
cuccuuaagcuguucaaua

SEQ ID NO: 1329299 - RNA, 19 nt, Homo sapiens
aauagguccuuugcugaaa

SEQ ID NO: 1329300 - RNA, 19 nt, Homo sapiens
ccagguacguccaucucau

SEQ ID NO: 1329301 - RNA, 19 nt, Homo sapiens
aguuagaaauccuguguuc

SEQ ID NO: 1329302 - RNA, 19 nt, Homo sapiens
ggcauccacuugcucuugu

SEQ ID NO: 1329303 - RNA, 19 nt, Homo sapiens
gacuucaacccgaguaaau

SEQ ID NO: 1329304 - RNA, 19 nt, Homo sapiens
acgggaugguuuagacuuu

SEQ ID NO: 1329305 - RNA, 19 nt, Homo sapiens
gaagaaagcuaaguuguga

SEQ ID NO: 1329306 - RNA, 19 nt, Homo sapiens
gagcuaagaugaaauaguu

SEQ ID NO: 1329307 - RNA, 19 nt, Homo sapiens
ccacugaacuguacacuuu

SEQ ID NO: 1329308 - RNA, 19 nt, Homo sapiens
gaaaugaggcaguaguuua

SEQ ID NO: 1329309 - RNA, 19 nt, Homo sapiens
gaacagcgguccaggagaa

SEQ ID NO: 1329310 - RNA, 19 nt, Homo sapiens
ggacagugcuacuuguaua

SEQ ID NO: 1329311 - RNA, 19 nt, Homo sapiens
uagcauauguguugaagua

SEQ ID NO: 1329312 - RNA, 19 nt, Homo sapiens
gaacggguccggcuuagua

SEQ ID NO: 1329313 - RNA, 19 nt, Homo sapiens
gaaaugagcuuggcuucug

SEQ ID NO: 1329314 - RNA, 19 nt, Homo sapiens
gaaguacacagcuauuaua

SEQ ID NO: 1329315 - RNA, 19 nt, Homo sapiens
gcagggcgcucuuaacaga

SEQ ID NO: 1329316 - RNA, 19 nt, Homo sapiens
caagaaaucuggagugagu

SEQ ID NO: 1329317 - RNA, 19 nt, Homo sapiens
ucaccaagaucacccaaua

SEQ ID NO: 1329318 - RNA, 19 nt, Homo sapiens
gcuagugacugcacaauau

SEQ ID NO: 1329319 - RNA, 19 nt, Homo sapiens
gcaggaaacucuggaauca

SEQ ID NO: 1329320 - RNA, 19 nt, Homo sapiens
guacacagcuauuauaugc

SEQ ID NO: 1329321 - RNA, 19 nt, Homo sapiens
gaugacggauguaaauauu

SEQ ID NO: 1329322 - RNA, 19 nt, Homo sapiens
aaagacagccucuagauuu

SEQ ID NO: 1329323 - RNA, 19 nt, Homo sapiens
gguaagaaaugaggcagua

SEQ ID NO: 1329324 - RNA, 19 nt, Homo sapiens
ugauauaguucaccacuuu

SEQ ID NO: 1329325 - RNA, 19 nt, Homo sapiens
gaaaccaaaggaagaauuu

SEQ ID NO: 1329326 - RNA, 19 nt, Homo sapiens
gaaaggacagugcuacuug

SEQ ID NO: 1329327 - RNA, 19 nt, Homo sapiens
caaagacugucaaguggaa

SEQ ID NO: 1329328 - RNA, 19 nt, Homo sapiens
ucacuaagcagaauaggua

SEQ ID NO: 1329329 - RNA, 19 nt, Homo sapiens
guacugaacacaauauuug

SEQ ID NO: 1329330 - RNA, 19 nt, Homo sapiens
gaaguuagagugagggaaa

SEQ ID NO: 1329331 - RNA, 19 nt, Homo sapiens
uauugaaggugcuacuuua

SEQ ID NO: 1329332 - RNA, 19 nt, Homo sapiens
gggaugagaugacggaugu

SEQ ID NO: 1329333 - RNA, 19 nt, Homo sapiens
gaggaccacugcagagaaa

SEQ ID NO: 1329334 - RNA, 19 nt, Homo sapiens
gaagcuugguucuacugua

SEQ ID NO: 1329335 - RNA, 19 nt, Homo sapiens
aagcagagauucaccaaga

SEQ ID NO: 1329336 - RNA, 19 nt, Homo sapiens
ccugaauccuuuaacuuua

SEQ ID NO: 1329337 - RNA, 19 nt, Homo sapiens
ucagaaaccugcugcacuu

SEQ ID NO: 1329338 - RNA, 19 nt, Homo sapiens
caagaucacccaauaccua

SEQ ID NO: 1329339 - RNA, 19 nt, Homo sapiens
gaaccaagacucagagcuu

SEQ ID NO: 1329340 - RNA, 19 nt, Homo sapiens
agacucagguguaagguuu

SEQ ID NO: 1329341 - RNA, 19 nt, Homo sapiens
ccgagaaacuuaacagaug

SEQ ID NO: 1329342 - RNA, 19 nt, Homo sapiens
aaagagaauuugucgaaga

SEQ ID NO: 1329343 - RNA, 19 nt, Homo sapiens
agagagcccugaauccuuu

SEQ ID NO: 1329344 - RNA, 19 nt, Homo sapiens
cgagaaacuuaacagauga

SEQ ID NO: 1329345 - RNA, 19 nt, Homo sapiens
ugucgaagauggugaggua

SEQ ID NO: 1329346 - RNA, 19 nt, Homo sapiens
agaaagcacuggagcaaau

SEQ ID NO: 1329347 - RNA, 19 nt, Homo sapiens
ugguaaagcuccagaaaug

SEQ ID NO: 1329348 - RNA, 19 nt, Homo sapiens
ucacaaaucaguuucaaga

SEQ ID NO: 1329349 - RNA, 19 nt, Homo sapiens
ugacuuauggcaugaauuu

SEQ ID NO: 1329350 - RNA, 19 nt, Homo sapiens
gauuaaagagcuaagauga

SEQ ID NO: 1329351 - RNA, 19 nt, Homo sapiens
caagucuccuguuagcaua

SEQ ID NO: 1329352 - RNA, 19 nt, Homo sapiens
gaaaagagaauuugucgaa

SEQ ID NO: 1329353 - RNA, 19 nt, Homo sapiens
cgacaaagcccuggaacaa

SEQ ID NO: 1329354 - RNA, 19 nt, Homo sapiens
gauccuagcucaucaucag

SEQ ID NO: 1329355 - RNA, 19 nt, Homo sapiens
ucagaagacuagaacagaa

SEQ ID NO: 1329356 - RNA, 19 nt, Homo sapiens
aaagaugguugucccuaaa

SEQ ID NO: 1329357 - RNA, 19 nt, Homo sapiens
ugacggauguaaauauuuc

SEQ ID NO: 1329358 - RNA, 19 nt, Homo sapiens
gggcucauauggagaucua

SEQ ID NO: 1329359 - RNA, 19 nt, Homo sapiens
uaacagaugaguucuugaa

SEQ ID NO: 1329360 - RNA, 19 nt, Homo sapiens
ggauauggauaaacuggau

SEQ ID NO: 1329361 - RNA, 19 nt, Homo sapiens
gagagugacauaagugauu

SEQ ID NO: 1329362 - RNA, 19 nt, Homo sapiens
ccacaagucugcaggaaac

SEQ ID NO: 1329363 - RNA, 19 nt, Homo sapiens
gggaauuacauaaggauaa

SEQ ID NO: 1329364 - RNA, 19 nt, Homo sapiens
gagcuuauagcccauuauu

SEQ ID NO: 1329365 - RNA, 19 nt, Homo sapiens
gaaaacugcccaagauuaa

SEQ ID NO: 1329366 - RNA, 19 nt, Homo sapiens
auauagcucucauguauug

SEQ ID NO: 1329367 - RNA, 19 nt, Homo sapiens
ccugaaacaugaaaccaaa

SEQ ID NO: 1329368 - RNA, 19 nt, Homo sapiens
gcacuuuucugauauaguu

SEQ ID NO: 1329369 - RNA, 19 nt, Homo sapiens
ggcaagaaaucuggaguga

SEQ ID NO: 1329370 - RNA, 19 nt, Homo sapiens
gaaagcacuggagcaaaua

SEQ ID NO: 1329371 - RNA, 19 nt, Homo sapiens
uaacugaacuaugcuugga

SEQ ID NO: 1329372 - RNA, 19 nt, Homo sapiens
caaagacagccucuagauu

SEQ ID NO: 1329373 - RNA, 19 nt, Homo sapiens
agucuuaaguuccauugua

SEQ ID NO: 1329374 - RNA, 19 nt, Homo sapiens
acaaagcccuggaacaaca

SEQ ID NO: 1329375 - RNA, 19 nt, Homo sapiens
gcagucggaugauguuauc

SEQ ID NO: 1329376 - RNA, 19 nt, Homo sapiens
ccaagggccuauacuuuua

SEQ ID NO: 1329377 - RNA, 19 nt, Homo sapiens
aagcuugguucuacuguaa

SEQ ID NO: 1329378 - RNA, 19 nt, Homo sapiens
ucaagagggccuucaguaa

SEQ ID NO: 1329379 - RNA, 19 nt, Homo sapiens
caaauucaguuggaucuag

SEQ ID NO: 1329380 - RNA, 19 nt, Homo sapiens
caaggcaaauucaguugga

SEQ ID NO: 1329381 - RNA, 19 nt, Homo sapiens
aaagaauggaugacacuua

SEQ ID NO: 1329382 - RNA, 19 nt, Homo sapiens
gaaacuuguuccuuugagu

SEQ ID NO: 1329383 - RNA, 19 nt, Homo sapiens
ccacacugcucucuuccuu

SEQ ID NO: 1329384 - RNA, 19 nt, Homo sapiens
caugcuaccuucaaucuuc

SEQ ID NO: 1329385 - RNA, 19 nt, Homo sapiens
ggaaaguaauacaagucuu

SEQ ID NO: 1329386 - RNA, 19 nt, Homo sapiens
ucuauuaacugaacuaugc

SEQ ID NO: 1329387 - RNA, 19 nt, Homo sapiens
aagagggccuucaguaaga

SEQ ID NO: 1329388 - RNA, 19 nt, Homo sapiens
ucaggcacauacauaguaa

SEQ ID NO: 1329389 - RNA, 19 nt, Homo sapiens
gaauaugaaaccaaaggaa

SEQ ID NO: 1329390 - RNA, 19 nt, Homo sapiens
uagauuguccagugacuua

SEQ ID NO: 1329391 - RNA, 19 nt, Homo sapiens
uaaugaggcccaacugaaa

SEQ ID NO: 1329392 - RNA, 19 nt, Homo sapiens
gauaaugaggcccaacuga

SEQ ID NO: 1329393 - RNA, 19 nt, Homo sapiens
gacuagaacagaacuuaaa

SEQ ID NO: 1329394 - RNA, 19 nt, Homo sapiens
gagaugacggauguaaaua

SEQ ID NO: 1329395 - RNA, 19 nt, Homo sapiens
guaugccacuauuaaagaa

SEQ ID NO: 1329396 - RNA, 19 nt, Homo sapiens
gaucacccaauaccuaauu

SEQ ID NO: 1329397 - RNA, 19 nt, Homo sapiens
cuacaucacaaaucaguuu

SEQ ID NO: 1329398 - RNA, 19 nt, Homo sapiens
ucuaaaugguucugaauag

SEQ ID NO: 1329399 - RNA, 19 nt, Homo sapiens
uaccuucaaucuucaacua

SEQ ID NO: 1329400 - RNA, 19 nt, Homo sapiens
ugauuucccuuucagcauu

SEQ ID NO: 1329401 - RNA, 19 nt, Homo sapiens
aagaauggaugacacuuag

SEQ ID NO: 1329402 - RNA, 19 nt, Homo sapiens
gaugagaugacggauguaa

SEQ ID NO: 1329403 - RNA, 19 nt, Homo sapiens
gagagacugaaacaagaua

SEQ ID NO: 1329404 - RNA, 19 nt, Homo sapiens
uggagagacugaaacaaga

SEQ ID NO: 1329405 - RNA, 19 nt, Homo sapiens
caacagugauguaacuauu

SEQ ID NO: 1329406 - RNA, 19 nt, Homo sapiens
caacaaugaugacaacuuc

SEQ ID NO: 1329407 - RNA, 19 nt, Homo sapiens
ucauaagccugggaaguuu

SEQ ID NO: 1329408 - RNA, 19 nt, Homo sapiens
ggaagucaagagcaaguuu

SEQ ID NO: 1329409 - RNA, 19 nt, Homo sapiens
ugauguaacuauuggcuau

SEQ ID NO: 1329410 - RNA, 19 nt, Homo sapiens
cugggaaguuugaagauuu

SEQ ID NO: 1329411 - RNA, 19 nt, Homo sapiens
ucucagaccuugcgauucu

SEQ ID NO: 1329412 - RNA, 19 nt, Homo sapiens
gaagucaagagcaaguuug

SEQ ID NO: 1329413 - RNA, 19 nt, Homo sapiens
ggagagcgaugaggacaac

SEQ ID NO: 1329414 - RNA, 19 nt, Homo sapiens
gaaccgaaguuuucacaag

SEQ ID NO: 1329415 - RNA, 19 nt, Homo sapiens
guuugaagauuucuacaag

SEQ ID NO: 1329416 - RNA, 19 nt, Homo sapiens
gaaguuugaagauuucuac

SEQ ID NO: 1329417 - RNA, 19 nt, Homo sapiens
gagaccugcugcccaucaa

SEQ ID NO: 1329418 - RNA, 19 nt, Homo sapiens
ccugggaaguuugaagauu

SEQ ID NO: 1329419 - RNA, 19 nt, Homo sapiens
gucauaagccugggaaguu

SEQ ID NO: 1329420 - RNA, 19 nt, Homo sapiens
gcagcgcaguggaagucaa

SEQ ID NO: 1329421 - RNA, 19 nt, Homo sapiens
caacagccacaaccucauc

SEQ ID NO: 1329422 - RNA, 19 nt, Homo sapiens
ggaaguuugaagauuucua

SEQ ID NO: 1329423 - RNA, 19 nt, Homo sapiens
ggagaccugcugcccauca

SEQ ID NO: 1329424 - RNA, 19 nt, Homo sapiens
caguggaagucaagagcaa

SEQ ID NO: 1329425 - RNA, 19 nt, Homo sapiens
acagugauguaacuauugg

SEQ ID NO: 1329426 - RNA, 19 nt, Homo sapiens
ucaacaaugaugacaacuu

SEQ ID NO: 1329427 - RNA, 19 nt, Homo sapiens
cuucaucucgcgcauggua

SEQ ID NO: 1329428 - RNA, 19 nt, Homo sapiens
ccaacagugauguaacuau

SEQ ID NO: 1329429 - RNA, 19 nt, Homo sapiens
ugggaaguuugaagauuuc

SEQ ID NO: 1329430 - RNA, 19 nt, Homo sapiens
ccaggucacggacaugaug

SEQ ID NO: 1329431 - RNA, 19 nt, Homo sapiens
guugugcacacccaccaua

SEQ ID NO: 1329432 - RNA, 19 nt, Homo sapiens
acuauuggcuaugcagaug

SEQ ID NO: 1329433 - RNA, 19 nt, Homo sapiens
gugcacacccaccauaucu

SEQ ID NO: 1329434 - RNA, 19 nt, Homo sapiens
ggaggugaacggcauugag

SEQ ID NO: 1329435 - RNA, 19 nt, Homo sapiens
ucagggucuucauccagaa

SEQ ID NO: 1329436 - RNA, 19 nt, Homo sapiens
ggcgguuucuagugcaaau

SEQ ID NO: 1329437 - RNA, 19 nt, Homo sapiens
ccacagauauuaaacgaaa

SEQ ID NO: 1329438 - RNA, 19 nt, Homo sapiens
ggacauggaugacuauaca

SEQ ID NO: 1329439 - RNA, 19 nt, Homo sapiens
ggacagagaccuuugaaga

SEQ ID NO: 1329440 - RNA, 19 nt, Homo sapiens
gagauugacucuaaagaug

SEQ ID NO: 1329441 - RNA, 19 nt, Homo sapiens
ugagagauaucaucagaaa

SEQ ID NO: 1329442 - RNA, 19 nt, Homo sapiens
caucaucgcuuucccuuug

SEQ ID NO: 1329443 - RNA, 19 nt, Homo sapiens
ucagaugacuccauugaaa

SEQ ID NO: 1329444 - RNA, 19 nt, Homo sapiens
ggaaacagcaagagauuga

SEQ ID NO: 1329445 - RNA, 19 nt, Homo sapiens
gacuauagcagccuuauuu

SEQ ID NO: 1329446 - RNA, 19 nt, Homo sapiens
gcaccacgaugaugacaau

SEQ ID NO: 1329447 - RNA, 19 nt, Homo sapiens
gaagagaagcuuggaguga

SEQ ID NO: 1329448 - RNA, 19 nt, Homo sapiens
gaagaaaacccuuuacuug

SEQ ID NO: 1329449 - RNA, 19 nt, Homo sapiens
acaaugguguuccaaguuu

SEQ ID NO: 1329450 - RNA, 19 nt, Homo sapiens
gguggcugcuuguacuuua

SEQ ID NO: 1329451 - RNA, 19 nt, Homo sapiens
ccugaggucuuaauuguga

SEQ ID NO: 1329452 - RNA, 19 nt, Homo sapiens
ccacauaacgaaaggaauu

SEQ ID NO: 1329453 - RNA, 19 nt, Homo sapiens
gaaaaugccuuggauugaa

SEQ ID NO: 1329454 - RNA, 19 nt, Homo sapiens
ugccuuggauugaauauaa

SEQ ID NO: 1329455 - RNA, 19 nt, Homo sapiens
ccaccaggauuugaaguaa

SEQ ID NO: 1329456 - RNA, 19 nt, Homo sapiens
caaugguguuccaaguuua

SEQ ID NO: 1329457 - RNA, 19 nt, Homo sapiens
cuucaacccugaggucuua

SEQ ID NO: 1329458 - RNA, 19 nt, Homo sapiens
gcacuucuacuggacguua

SEQ ID NO: 1329459 - RNA, 19 nt, Homo sapiens
caugcuaacuggacuauag

SEQ ID NO: 1329460 - RNA, 19 nt, Homo sapiens
gacacucacucuuugauuc

SEQ ID NO: 1329461 - RNA, 19 nt, Homo sapiens
ugaucaaccuugccaugua

SEQ ID NO: 1329462 - RNA, 19 nt, Homo sapiens
ccagagcggugaccaagau

SEQ ID NO: 1329463 - RNA, 19 nt, Homo sapiens
gaaguaaugagagauauca

SEQ ID NO: 1329464 - RNA, 19 nt, Homo sapiens
gauuugaaguaaugagaga

SEQ ID NO: 1329465 - RNA, 19 nt, Homo sapiens
cagcaugguuccugaaauc

SEQ ID NO: 1329466 - RNA, 19 nt, Homo sapiens
acagagaccuuugaagaug

SEQ ID NO: 1329467 - RNA, 19 nt, Homo sapiens
agaaggacaugcggucuuu

SEQ ID NO: 1329468 - RNA, 19 nt, Homo sapiens
guguguauauuguauguug

SEQ ID NO: 1329469 - RNA, 19 nt, Homo sapiens
ccauucagaugacuccauu

SEQ ID NO: 1329470 - RNA, 19 nt, Homo sapiens
gaucaaccuugccauguac

SEQ ID NO: 1329471 - RNA, 19 nt, Homo sapiens
uaauugacuuucuggaaga

SEQ ID NO: 1329472 - RNA, 19 nt, Homo sapiens
uaccguaucagaacuauuu

SEQ ID NO: 1329473 - RNA, 19 nt, Homo sapiens
cagagaccuuugaagauga

SEQ ID NO: 1329474 - RNA, 19 nt, Homo sapiens
gacaauaccaucuaugagu

SEQ ID NO: 1329475 - RNA, 19 nt, Homo sapiens
cgaaaggaauugugaaacg

SEQ ID NO: 1329476 - RNA, 19 nt, Homo sapiens
aaacacagaaccauucaga

SEQ ID NO: 1329477 - RNA, 19 nt, Homo sapiens
auagcagccuuauuucuuu

SEQ ID NO: 1329478 - RNA, 19 nt, Homo sapiens
ggacacucacucuuugauu

SEQ ID NO: 1329479 - RNA, 19 nt, Homo sapiens
acacagaaccauucagaug

SEQ ID NO: 1329480 - RNA, 19 nt, Homo sapiens
aagagaagcuuggagugaa

SEQ ID NO: 1329481 - RNA, 19 nt, Homo sapiens
guuuaucuccuuucuguuu

SEQ ID NO: 1329482 - RNA, 19 nt, Homo sapiens
gaagaugagggagcagaaa

SEQ ID NO: 1329483 - RNA, 19 nt, Homo sapiens
ggauuacggugggaucaug

SEQ ID NO: 1329484 - RNA, 19 nt, Homo sapiens
gagcagcgaaggcagcaaa

SEQ ID NO: 1329485 - RNA, 19 nt, Homo sapiens
gaggauaaggaggaaauuu

SEQ ID NO: 1329486 - RNA, 19 nt, Homo sapiens
ggcccaagcuuuccacucu

SEQ ID NO: 1329487 - RNA, 19 nt, Homo sapiens
gaagcuuggagugaauuua

SEQ ID NO: 1329488 - RNA, 19 nt, Homo sapiens
ccacgaacagugcaaguga

SEQ ID NO: 1329489 - RNA, 19 nt, Homo sapiens
gacagagaccuuugaagau

SEQ ID NO: 1329490 - RNA, 19 nt, Homo sapiens
gagaggauaaggaggaaau

SEQ ID NO: 1329491 - RNA, 19 nt, Homo sapiens
cauaauugacuuucuggaa

SEQ ID NO: 1329492 - RNA, 19 nt, Homo sapiens
aaguuuaucuccuuucugu

SEQ ID NO: 1329493 - RNA, 19 nt, Homo sapiens
uauagcagccuuauuucuu

SEQ ID NO: 1329494 - RNA, 19 nt, Homo sapiens
ugacgccacugucuuugga

SEQ ID NO: 1329495 - RNA, 19 nt, Homo sapiens
ggacaugcggucuuuagca

SEQ ID NO: 1329496 - RNA, 19 nt, Homo sapiens
guuccaaguuuaucuccuu

SEQ ID NO: 1329497 - RNA, 19 nt, Homo sapiens
cacagaaccauucagauga

SEQ ID NO: 1329498 - RNA, 19 nt, Homo sapiens
ccgaacggcugaucaaagg

SEQ ID NO: 1329499 - RNA, 19 nt, Homo sapiens
gccaguggguggacaaucu

SEQ ID NO: 1329500 - RNA, 19 nt, Homo sapiens
gcuuguacuuuaugugugu

SEQ ID NO: 1329501 - RNA, 19 nt, Homo sapiens
auugugagauggauucuug

SEQ ID NO: 1329502 - RNA, 19 nt, Homo sapiens
ggacuauagcagccuuauu

SEQ ID NO: 1329503 - RNA, 19 nt, Homo sapiens
cauguacugugagaggaua

SEQ ID NO: 1329504 - RNA, 19 nt, Homo sapiens
gaaggacaugcggucuuua

SEQ ID NO: 1329505 - RNA, 19 nt, Homo sapiens
cacgaacuccuggucauua

SEQ ID NO: 1329506 - RNA, 19 nt, Homo sapiens
ggaagaaaacccuuuacuu

SEQ ID NO: 1329507 - RNA, 19 nt, Homo sapiens
aagcuuggagugaauuuaa

SEQ ID NO: 1329508 - RNA, 19 nt, Homo sapiens
ccaaguuuaucuccuuucu

SEQ ID NO: 1329509 - RNA, 19 nt, Homo sapiens
guugucagcugauaguuuu

SEQ ID NO: 1329510 - RNA, 19 nt, Homo sapiens
ggaaaacucucugcucaag

SEQ ID NO: 1329511 - RNA, 19 nt, Homo sapiens
gagaaggacaugcggucuu

SEQ ID NO: 1329512 - RNA, 19 nt, Homo sapiens
agauuuacaugcugaugga

SEQ ID NO: 1329513 - RNA, 19 nt, Homo sapiens
ccuuggcccucaugaaaga

SEQ ID NO: 1329514 - RNA, 19 nt, Homo sapiens
ggaaaaugccuuggauuga

SEQ ID NO: 1329515 - RNA, 19 nt, Homo sapiens
uaggaaacagcaagagauu

SEQ ID NO: 1329516 - RNA, 19 nt, Homo sapiens
ggaaccagagcaucuccuu

SEQ ID NO: 1329517 - RNA, 19 nt, Homo sapiens
acccugaggucuuaauugu

SEQ ID NO: 1329518 - RNA, 19 nt, Homo sapiens
cgaggaagagauuuacaug

SEQ ID NO: 1329519 - RNA, 19 nt, Homo sapiens
uaacgaaaggaauugugaa

SEQ ID NO: 1329520 - RNA, 19 nt, Homo sapiens
agagaagcuuggagugaau

SEQ ID NO: 1329521 - RNA, 19 nt, Homo sapiens
gguugucagcugauaguuu

SEQ ID NO: 1329522 - RNA, 19 nt, Homo sapiens
aggaagagauuuacaugcu

SEQ ID NO: 1329523 - RNA, 19 nt, Homo sapiens
ucuacuggacguuagcuua

SEQ ID NO: 1329524 - RNA, 19 nt, Homo sapiens
ucaaugagacccggaagau

SEQ ID NO: 1329525 - RNA, 19 nt, Homo sapiens
ggguggacaaucucaauga

SEQ ID NO: 1329526 - RNA, 19 nt, Homo sapiens
aaccuuggcccucaugaaa

SEQ ID NO: 1329527 - RNA, 19 nt, Homo sapiens
caccaggauuugaaguaau

SEQ ID NO: 1329528 - RNA, 19 nt, Homo sapiens
ugguagagcagguguaaga

SEQ ID NO: 1329529 - RNA, 19 nt, Homo sapiens
gagauggauucuugaaccu

SEQ ID NO: 1329530 - RNA, 19 nt, Homo sapiens
caacccugaggucuuaauu

SEQ ID NO: 1329531 - RNA, 19 nt, Homo sapiens
gggaaaaugccuuggauug

SEQ ID NO: 1329532 - RNA, 19 nt, Homo sapiens
ugacuuaccguaucagaac

SEQ ID NO: 1329533 - RNA, 19 nt, Homo sapiens
accaggauuugaaguaaug

SEQ ID NO: 1329534 - RNA, 19 nt, Homo sapiens
acuggacacucacucuuug

SEQ ID NO: 1329535 - RNA, 19 nt, Homo sapiens
gugagaggauaaggaggaa

SEQ ID NO: 1329536 - RNA, 19 nt, Homo sapiens
gaccuuaccagggacaaga

SEQ ID NO: 1329537 - RNA, 19 nt, Homo sapiens
gagcauggguguccuagug

SEQ ID NO: 1329538 - RNA, 19 nt, Homo sapiens
gcagguggcuggacugagu

SEQ ID NO: 1329539 - RNA, 19 nt, Homo sapiens
ggacucagcggguauaaag

SEQ ID NO: 1329540 - RNA, 19 nt, Homo sapiens
gagaagucguugagaucuu

SEQ ID NO: 1329541 - RNA, 19 nt, Homo sapiens
ggaaggggcuggcuggauu

SEQ ID NO: 1329542 - RNA, 19 nt, Homo sapiens
gagaugugauccugguguu

SEQ ID NO: 1329543 - RNA, 19 nt, Homo sapiens
gcauggaggccaaggagaa

SEQ ID NO: 1329544 - RNA, 19 nt, Homo sapiens
ggagaagcagcaucuguug

SEQ ID NO: 1329545 - RNA, 19 nt, Homo sapiens
cugcauaucugggcacuga

SEQ ID NO: 1329546 - RNA, 19 nt, Homo sapiens
gagcugccuucauccaugu

SEQ ID NO: 1329547 - RNA, 19 nt, Homo sapiens
caagggcguugacuucaca

SEQ ID NO: 1329548 - RNA, 19 nt, Homo sapiens
gaugugauccugguguuga

SEQ ID NO: 1329549 - RNA, 19 nt, Homo sapiens
cguccgagcugccuucauc

SEQ ID NO: 1329550 - RNA, 19 nt, Homo sapiens
agaagucguugagaucuug

SEQ ID NO: 1329551 - RNA, 19 nt, Homo sapiens
ccauccagaucgaggacua

SEQ ID NO: 1329552 - RNA, 19 nt, Homo sapiens
gcugugaacaucauaaugg

SEQ ID NO: 1329553 - RNA, 19 nt, Homo sapiens
gaccuggccuggacuugca

SEQ ID NO: 1329554 - RNA, 19 nt, Homo sapiens
ggguauaaagcuaguguga

SEQ ID NO: 1329555 - RNA, 19 nt, Homo sapiens
ucacugccaugcucagaag

SEQ ID NO: 1329556 - RNA, 19 nt, Homo sapiens
ggacuacucggaggacaug

SEQ ID NO: 1329557 - RNA, 19 nt, Homo sapiens
caucugcaccuucgucuuc

SEQ ID NO: 1329558 - RNA, 19 nt, Homo sapiens
ccuaguggcagccuauauu

SEQ ID NO: 1329559 - RNA, 19 nt, Homo sapiens
caugugaucggcgacuuua

SEQ ID NO: 1329560 - RNA, 19 nt, Homo sapiens
ggacaaccuugaccauccu

SEQ ID NO: 1329561 - RNA, 19 nt, Homo sapiens
gcagagcauggguguccua

SEQ ID NO: 1329562 - RNA, 19 nt, Homo sapiens
ccaaccagcaggaggagaa

SEQ ID NO: 1329563 - RNA, 19 nt, Homo sapiens
ccaaggagaagcagcaucu

SEQ ID NO: 1329564 - RNA, 19 nt, Homo sapiens
cuaguggcagccuauauuu

SEQ ID NO: 1329565 - RNA, 19 nt, Homo sapiens
gaucggagaagucguugag

SEQ ID NO: 1329566 - RNA, 19 nt, Homo sapiens
gcccuggucucuguacugu

SEQ ID NO: 1329567 - RNA, 19 nt, Homo sapiens
ucggagaagucguugagau

SEQ ID NO: 1329568 - RNA, 19 nt, Homo sapiens
ugggagcccuggucucugu

SEQ ID NO: 1329569 - RNA, 19 nt, Homo sapiens
agaagcagcaucuguugga

SEQ ID NO: 1329570 - RNA, 19 nt, Homo sapiens
gcaccuucgucuucuccau

SEQ ID NO: 1329571 - RNA, 19 nt, Homo sapiens
ggagaagucguugagaucu

SEQ ID NO: 1329572 - RNA, 19 nt, Homo sapiens
caugaucggagaagucguu

SEQ ID NO: 1329573 - RNA, 19 nt, Homo sapiens
ccauugcucagaauacaga

SEQ ID NO: 1329574 - RNA, 19 nt, Homo sapiens
ucaagccagaauacaagua

SEQ ID NO: 1329575 - RNA, 19 nt, Homo sapiens
gcuagugugacccugcaaa

SEQ ID NO: 1329576 - RNA, 19 nt, Homo sapiens
ggucauacacgggaucucu

SEQ ID NO: 1329577 - RNA, 19 nt, Homo sapiens
caucgccauugcucagaau

SEQ ID NO: 1329578 - RNA, 19 nt, Homo sapiens
ggcccagccuguucugucu

SEQ ID NO: 1329579 - RNA, 19 nt, Homo sapiens
cgccauugcucagaauaca

SEQ ID NO: 1329580 - RNA, 19 nt, Homo sapiens
ggacuugcaggccauugag

SEQ ID NO: 1329581 - RNA, 19 nt, Homo sapiens
ccaucugccuguuguucau

SEQ ID NO: 1329582 - RNA, 19 nt, Homo sapiens
aggagaagcagcaucuguu

SEQ ID NO: 1329583 - RNA, 19 nt, Homo sapiens
ugugaucggcgacuuuaug

SEQ ID NO: 1329584 - RNA, 19 nt, Homo sapiens
ccaugugaucggcgacuuu

SEQ ID NO: 1329585 - RNA, 19 nt, Homo sapiens
gcugcgcuguggcugugaa

SEQ ID NO: 1329586 - RNA, 19 nt, Homo sapiens
gcugaucucuggggacuau

SEQ ID NO: 1329587 - RNA, 19 nt, Homo sapiens
guaaggagguacagcagau

SEQ ID NO: 1329588 - RNA, 19 nt, Homo sapiens
guauggaucuguggucauu

SEQ ID NO: 1329589 - RNA, 19 nt, Homo sapiens
ggaaaccuucggcuucuga

SEQ ID NO: 1329590 - RNA, 19 nt, Homo sapiens
ggucuacgccucccaggaa

SEQ ID NO: 1329591 - RNA, 19 nt, Homo sapiens
ggacggcuuccucuauaug

SEQ ID NO: 1329592 - RNA, 19 nt, Homo sapiens
gaucaucgagcgcuacaag

SEQ ID NO: 1329593 - RNA, 19 nt, Homo sapiens
ugagcgaguuggucaagau

SEQ ID NO: 1329594 - RNA, 19 nt, Homo sapiens
gcaccaacccaccuacucu

SEQ ID NO: 1329595 - RNA, 19 nt, Homo sapiens
gcgaguuggucaagaucau

SEQ ID NO: 1329596 - RNA, 19 nt, Homo sapiens
caggaaaccuucggcuucu

SEQ ID NO: 1329597 - RNA, 19 nt, Homo sapiens
ucuacgagcaggagaaaga

SEQ ID NO: 1329598 - RNA, 19 nt, Homo sapiens
ccucagaccggccuuucaa

SEQ ID NO: 1329599 - RNA, 19 nt, Homo sapiens
cgaccgcuguaaggaggua

SEQ ID NO: 1329600 - RNA, 19 nt, Homo sapiens
gcccaucgcggacaucuac

SEQ ID NO: 1329601 - RNA, 19 nt, Homo sapiens
gcuacaagggugagaagca

SEQ ID NO: 1329602 - RNA, 19 nt, Homo sapiens
gaccagcaccccagcaaaa

SEQ ID NO: 1329603 - RNA, 19 nt, Homo sapiens
cauugucccucugcagaau

SEQ ID NO: 1329604 - RNA, 19 nt, Homo sapiens
gcugugugguucaucuuuu

SEQ ID NO: 1329605 - RNA, 19 nt, Homo sapiens
gagggcaccaacccaccua

SEQ ID NO: 1329606 - RNA, 19 nt, Homo sapiens
caucuacgagcaggagaaa

SEQ ID NO: 1329607 - RNA, 19 nt, Homo sapiens
gcacaaccugcaacuguaa

SEQ ID NO: 1329608 - RNA, 19 nt, Homo sapiens
caaaggaggcucagacaag

SEQ ID NO: 1329609 - RNA, 19 nt, Homo sapiens
gcaaaggaggcucagacaa

SEQ ID NO: 1329610 - RNA, 19 nt, Homo sapiens
aaaggaggcucagacaagu

SEQ ID NO: 1329611 - RNA, 19 nt, Homo sapiens
cugcaugucuggaggaauc

SEQ ID NO: 1329612 - RNA, 19 nt, Homo sapiens
gggaaugugucugcauguc

SEQ ID NO: 1329613 - RNA, 19 nt, Homo sapiens
ggaaugugucugcaugucu

SEQ ID NO: 1329614 - RNA, 19 nt, Homo sapiens
uguaaaacaugucggaaga

SEQ ID NO: 1329615 - RNA, 19 nt, Homo sapiens
gaagagcucuauacaggua

SEQ ID NO: 1329616 - RNA, 19 nt, Homo sapiens
gaacaugguuucauuggau

SEQ ID NO: 1329617 - RNA, 19 nt, Homo sapiens
caagaugucuggagaagau

SEQ ID NO: 1329618 - RNA, 19 nt, Homo sapiens
ccaggaagcuugagaguag

SEQ ID NO: 1329619 - RNA, 19 nt, Homo sapiens
gagaggcccuucgcuauga

SEQ ID NO: 1329620 - RNA, 19 nt, Homo sapiens
aagcagacccuacaagaua

SEQ ID NO: 1329621 - RNA, 19 nt, Homo sapiens
ugagggaccugcccaaaga

SEQ ID NO: 1329622 - RNA, 19 nt, Homo sapiens
cugaguagcugggauuaua

SEQ ID NO: 1329623 - RNA, 19 nt, Homo sapiens
ggaggaagaggaagagaaa

SEQ ID NO: 1329624 - RNA, 19 nt, Homo sapiens
gugcagagggccacaauaa

SEQ ID NO: 1329625 - RNA, 19 nt, Homo sapiens
gcugaugccucacuacuag

SEQ ID NO: 1329626 - RNA, 19 nt, Homo sapiens
gcaagaaggccaccaagca

SEQ ID NO: 1329627 - RNA, 19 nt, Homo sapiens
uagagaaagcucccaguua

SEQ ID NO: 1329628 - RNA, 19 nt, Homo sapiens
caccaugccuggccagaaa

SEQ ID NO: 1329629 - RNA, 19 nt, Homo sapiens
agagaaagcucccaguuac

SEQ ID NO: 1329630 - RNA, 19 nt, Homo sapiens
gcagagggccacaauaagu

SEQ ID NO: 1329631 - RNA, 19 nt, Homo sapiens
gaacaagaugucuggagaa

SEQ ID NO: 1329632 - RNA, 19 nt, Homo sapiens
gggaacauauggagagcaa

SEQ ID NO: 1329633 - RNA, 19 nt, Homo sapiens
gcaacacgacacccaguuu

SEQ ID NO: 1329634 - RNA, 19 nt, Homo sapiens
caacuucaugcuugacaua

SEQ ID NO: 1329635 - RNA, 19 nt, Homo sapiens
ccaagacucugcacaacca

SEQ ID NO: 1329636 - RNA, 19 nt, Homo sapiens
guacaucgucuucgucuuc

SEQ ID NO: 1329637 - RNA, 19 nt, Homo sapiens
agacaggguuucaccaugu

SEQ ID NO: 1329638 - RNA, 19 nt, Homo sapiens
ccacaauaaguguauguuu

SEQ ID NO: 1329639 - RNA, 19 nt, Homo sapiens
gaagagaaaagaagaagaa

SEQ ID NO: 1329640 - RNA, 19 nt, Homo sapiens
gcuguugggucccuucuca

SEQ ID NO: 1329641 - RNA, 19 nt, Homo sapiens
ccaggagaaugcagacuuc

SEQ ID NO: 1329642 - RNA, 19 nt, Homo sapiens
gaacugcuacagaacaaca

SEQ ID NO: 1329643 - RNA, 19 nt, Homo sapiens
cacccgaacugcuacagaa

SEQ ID NO: 1329644 - RNA, 19 nt, Homo sapiens
uggcuaagguugacaugga

SEQ ID NO: 1329645 - RNA, 19 nt, Homo sapiens
gaacauauggagagcaacu

SEQ ID NO: 1329646 - RNA, 19 nt, Homo sapiens
ccaagcagacccuacaaga

SEQ ID NO: 1329647 - RNA, 19 nt, Homo sapiens
gcaguggacuacucuuacu

SEQ ID NO: 1329648 - RNA, 19 nt, Homo sapiens
ggccagaaaucuauguuuu

SEQ ID NO: 1329649 - RNA, 19 nt, Homo sapiens
ccaaaguacugggauuaca

SEQ ID NO: 1329650 - RNA, 19 nt, Homo sapiens
ggaucagccuccaacuuca

SEQ ID NO: 1329651 - RNA, 19 nt, Homo sapiens
caacacgacacccaguuug

SEQ ID NO: 1329652 - RNA, 19 nt, Homo sapiens
uugcugccaucguguauuu

SEQ ID NO: 1329653 - RNA, 19 nt, Homo sapiens
gacaggguuucaccauguu

SEQ ID NO: 1329654 - RNA, 19 nt, Homo sapiens
cagaaagucagaagaggaa

SEQ ID NO: 1329655 - RNA, 19 nt, Homo sapiens
gaacauguggaagaaggaa

SEQ ID NO: 1329656 - RNA, 19 nt, Homo sapiens
gaagaaaacccugaacaug

SEQ ID NO: 1329657 - RNA, 19 nt, Homo sapiens
ggaguccaguggcacaauc

SEQ ID NO: 1329658 - RNA, 19 nt, Homo sapiens
gcugggaccuuccucuuuu

SEQ ID NO: 1329659 - RNA, 19 nt, Homo sapiens
ggaauucaccaaggacaug

SEQ ID NO: 1329660 - RNA, 19 nt, Homo sapiens
ggagggcacgcuacuggaa

SEQ ID NO: 1329661 - RNA, 19 nt, Homo sapiens
gaaguccaggcuccaagaa

SEQ ID NO: 1329662 - RNA, 19 nt, Homo sapiens
uguauacccugguuaacau

SEQ ID NO: 1329663 - RNA, 19 nt, Homo sapiens
cuuagaacauguggaagaa

SEQ ID NO: 1329664 - RNA, 19 nt, Homo sapiens
ucaaauccccuccuucuuu

SEQ ID NO: 1329665 - RNA, 19 nt, Homo sapiens
guuggcaucucgugguuuc

SEQ ID NO: 1329666 - RNA, 19 nt, Homo sapiens
ccgaacugcuacagaacaa

SEQ ID NO: 1329667 - RNA, 19 nt, Homo sapiens
aacaugguuucauuggaua

SEQ ID NO: 1329668 - RNA, 19 nt, Homo sapiens
caagcagacccuacaagau

SEQ ID NO: 1329669 - RNA, 19 nt, Homo sapiens
ggagacaggguuucaccau

SEQ ID NO: 1329670 - RNA, 19 nt, Homo sapiens
ggacaauggaaaucuacau

SEQ ID NO: 1329671 - RNA, 19 nt, Homo sapiens
gggaggaagaggaagagaa

SEQ ID NO: 1329672 - RNA, 19 nt, Homo sapiens
ggugcuagccucugcaaca

SEQ ID NO: 1329673 - RNA, 19 nt, Homo sapiens
gcucugaguagcugggauu

SEQ ID NO: 1329674 - RNA, 19 nt, Homo sapiens
cgagaggcccuucgcuaug

SEQ ID NO: 1329675 - RNA, 19 nt, Homo sapiens
ggucccuucucaucauguu

SEQ ID NO: 1329676 - RNA, 19 nt, Homo sapiens
ccucaugggcuuccuguuc

SEQ ID NO: 1329677 - RNA, 19 nt, Homo sapiens
gucucagccucccaaagua

SEQ ID NO: 1329678 - RNA, 19 nt, Homo sapiens
cgucucagccucccaaagu

SEQ ID NO: 1329679 - RNA, 19 nt, Homo sapiens
ucaccaaggacauggauca

SEQ ID NO: 1329680 - RNA, 19 nt, Homo sapiens
gcauugcccaggagaaagu

SEQ ID NO: 1329681 - RNA, 19 nt, Homo sapiens
gugcauugcccaggagaaa

SEQ ID NO: 1329682 - RNA, 19 nt, Homo sapiens
ucgcuaugacuuccugaua

SEQ ID NO: 1329683 - RNA, 19 nt, Homo sapiens
caccaccacccagcuauuu

SEQ ID NO: 1329684 - RNA, 19 nt, Homo sapiens
gaaccgggagcagcugaug

SEQ ID NO: 1329685 - RNA, 19 nt, Homo sapiens
gagaaaagaagaagaaaac

SEQ ID NO: 1329686 - RNA, 19 nt, Homo sapiens
caaauccccuccuucuuuc

SEQ ID NO: 1329687 - RNA, 19 nt, Homo sapiens
caucgucaccaucaacuuc

SEQ ID NO: 1329688 - RNA, 19 nt, Homo sapiens
acaccaagacucugcacaa

SEQ ID NO: 1329689 - RNA, 19 nt, Homo sapiens
ccaccaagcagacccuaca

SEQ ID NO: 1329690 - RNA, 19 nt, Homo sapiens
cagagggccacaauaagug

SEQ ID NO: 1329691 - RNA, 19 nt, Homo sapiens
gcacgcuacuggaauucac

SEQ ID NO: 1329692 - RNA, 19 nt, Homo sapiens
ccaucugccugaccagcuu

SEQ ID NO: 1329693 - RNA, 19 nt, Homo sapiens
gaagaggaagagaaaagaa

SEQ ID NO: 1329694 - RNA, 19 nt, Homo sapiens
ucacuuuggacaauggaaa

SEQ ID NO: 1329695 - RNA, 19 nt, Homo sapiens
gauccacuucuuucuauac

SEQ ID NO: 1329696 - RNA, 19 nt, Homo sapiens
agauccacuucuuucuaua

SEQ ID NO: 1329697 - RNA, 19 nt, Homo sapiens
ccugagcugugcaaccaau

SEQ ID NO: 1329698 - RNA, 19 nt, Homo sapiens
ggaccugcccaaagagucu

SEQ ID NO: 1329699 - RNA, 19 nt, Homo sapiens
gggaaggggccaaacaaaa

SEQ ID NO: 1329700 - RNA, 19 nt, Homo sapiens
auacagguacuaagacuag

SEQ ID NO: 1329701 - RNA, 19 nt, Homo sapiens
caaaguacugggauuacag

SEQ ID NO: 1329702 - RNA, 19 nt, Homo sapiens
uuuggacaauggaaaucua

SEQ ID NO: 1329703 - RNA, 19 nt, Homo sapiens
cuucucaucauguuuguga

SEQ ID NO: 1329704 - RNA, 19 nt, Homo sapiens
aguccaggcuccaagaaca

SEQ ID NO: 1329705 - RNA, 19 nt, Homo sapiens
gcuggaacaagcagacuuc

SEQ ID NO: 1329706 - RNA, 19 nt, Homo sapiens
gaaagucagaagaggaaaa

SEQ ID NO: 1329707 - RNA, 19 nt, Homo sapiens
uuagagaaagcucccaguu

SEQ ID NO: 1329708 - RNA, 19 nt, Homo sapiens
uugcaguggacuacucuua

SEQ ID NO: 1329709 - RNA, 19 nt, Homo sapiens
agucauggccgguucaaca

SEQ ID NO: 1329710 - RNA, 19 nt, Homo sapiens
ucgagaggcccuucgcuau

SEQ ID NO: 1329711 - RNA, 19 nt, Homo sapiens
acaagcagacuuccaagag

SEQ ID NO: 1329712 - RNA, 19 nt, Homo sapiens
ucucgugguuucuguacau

SEQ ID NO: 1329713 - RNA, 19 nt, Homo sapiens
uaacaggaccccagaaagu

SEQ ID NO: 1329714 - RNA, 19 nt, Homo sapiens
caugggaggacuuuaugga

SEQ ID NO: 1329715 - RNA, 19 nt, Homo sapiens
gggcuggccuggacaauua

SEQ ID NO: 1329716 - RNA, 19 nt, Homo sapiens
gcggaaagcugaaggagaa

SEQ ID NO: 1329717 - RNA, 19 nt, Homo sapiens
cacaaggaaugaacuauug

SEQ ID NO: 1329718 - RNA, 19 nt, Homo sapiens
gaugaaggcugcgggcauu

SEQ ID NO: 1329719 - RNA, 19 nt, Homo sapiens
gagggaaaauuaagcuaua

SEQ ID NO: 1329720 - RNA, 19 nt, Homo sapiens
aaucuacacucguugcaaa

SEQ ID NO: 1329721 - RNA, 19 nt, Homo sapiens
caauauuccuucucaaacu

SEQ ID NO: 1329722 - RNA, 19 nt, Homo sapiens
ccaaaugccugugucaucu

SEQ ID NO: 1329723 - RNA, 19 nt, Homo sapiens
uaaagagacacaaggaaug

SEQ ID NO: 1329724 - RNA, 19 nt, Homo sapiens
gcaccaggaaucugccuuu

SEQ ID NO: 1329725 - RNA, 19 nt, Homo sapiens
gaaagcugaaggagaacaa

SEQ ID NO: 1329726 - RNA, 19 nt, Homo sapiens
acacaaggaaugaacuauu

SEQ ID NO: 1329727 - RNA, 19 nt, Homo sapiens
uggcaaggcuggaagaaac

SEQ ID NO: 1329728 - RNA, 19 nt, Homo sapiens
cggcaggcuuugaggauga

SEQ ID NO: 1329729 - RNA, 19 nt, Homo sapiens
aaagagacacaaggaauga

SEQ ID NO: 1329730 - RNA, 19 nt, Homo sapiens
ccaggaaucugccuuuuca

SEQ ID NO: 1329731 - RNA, 19 nt, Homo sapiens
uuaaagagacacaaggaau

SEQ ID NO: 1329732 - RNA, 19 nt, Homo sapiens
gaaucugccuuuucaguuc

SEQ ID NO: 1329733 - RNA, 19 nt, Homo sapiens
uaugagagcggcuacaaca

SEQ ID NO: 1329734 - RNA, 19 nt, Homo sapiens
aaaugccugugucaucuug

SEQ ID NO: 1329735 - RNA, 19 nt, Homo sapiens
ucacugaugaccucacaga

SEQ ID NO: 1329736 - RNA, 19 nt, Homo sapiens
cccaauauuccuucucaaa

SEQ ID NO: 1329737 - RNA, 19 nt, Homo sapiens
ugcagugaauguccaaaug

SEQ ID NO: 1329738 - RNA, 19 nt, Homo sapiens
agacacaaggaaugaacua

SEQ ID NO: 1329739 - RNA, 19 nt, Homo sapiens
guuaaagagacacaaggaa

SEQ ID NO: 1329740 - RNA, 19 nt, Homo sapiens
gcagugaauguccaaaugc

SEQ ID NO: 1329741 - RNA, 19 nt, Homo sapiens
ccaauauuccuucucaaac

SEQ ID NO: 1329742 - RNA, 19 nt, Homo sapiens
cccguuuccucccaauauu

SEQ ID NO: 1329743 - RNA, 19 nt, Homo sapiens
cuacacucguugcaaacug

SEQ ID NO: 1329744 - RNA, 19 nt, Homo sapiens
caaaugccugugucaucuu

SEQ ID NO: 1329745 - RNA, 19 nt, Homo sapiens
ggaaucugccuuuucaguu

SEQ ID NO: 1329746 - RNA, 19 nt, Homo sapiens
ggacccaggaugcuuugca

SEQ ID NO: 1329747 - RNA, 19 nt, Homo sapiens
gcauguaccuuguuugauu

SEQ ID NO: 1329748 - RNA, 19 nt, Homo sapiens
ccacuaagaucauagacua

SEQ ID NO: 1329749 - RNA, 19 nt, Homo sapiens
ggaaucaggucuucagaga

SEQ ID NO: 1329750 - RNA, 19 nt, Homo sapiens
gaauuggacuuccuggauu

SEQ ID NO: 1329751 - RNA, 19 nt, Homo sapiens
gagcagggaucuccaggaa

SEQ ID NO: 1329752 - RNA, 19 nt, Homo sapiens
gcagggaucuccaggaauc

SEQ ID NO: 1329753 - RNA, 19 nt, Homo sapiens
gggagaaccuggagaacaa

SEQ ID NO: 1329754 - RNA, 19 nt, Homo sapiens
gaagggugaucuaggagaa

SEQ ID NO: 1329755 - RNA, 19 nt, Homo sapiens
ccacgaugcugcugaagaa

SEQ ID NO: 1329756 - RNA, 19 nt, Homo sapiens
gaaagacaccgaguaggua

SEQ ID NO: 1329757 - RNA, 19 nt, Homo sapiens
gaaauaaggcaaacucaca

SEQ ID NO: 1329758 - RNA, 19 nt, Homo sapiens
gauuaagggugaccaagga

SEQ ID NO: 1329759 - RNA, 19 nt, Homo sapiens
ugagaagggugaucuagga

SEQ ID NO: 1329760 - RNA, 19 nt, Homo sapiens
gaucaaggagccacuaaga

SEQ ID NO: 1329761 - RNA, 19 nt, Homo sapiens
ucaaggagaaccaggcuua

SEQ ID NO: 1329762 - RNA, 19 nt, Homo sapiens
gaagaagcacgcagggaaa

SEQ ID NO: 1329763 - RNA, 19 nt, Homo sapiens
ugacaccaauuuauggaaa

SEQ ID NO: 1329764 - RNA, 19 nt, Homo sapiens
gcucagaaauccuaugaac

SEQ ID NO: 1329765 - RNA, 19 nt, Homo sapiens
gauauucuagcuacaguuu

SEQ ID NO: 1329766 - RNA, 19 nt, Homo sapiens
gggagagccuggaccaaga

SEQ ID NO: 1329767 - RNA, 19 nt, Homo sapiens
caaggugaaucaggaacua

SEQ ID NO: 1329768 - RNA, 19 nt, Homo sapiens
acaggguccuucuaucaua

SEQ ID NO: 1329769 - RNA, 19 nt, Homo sapiens
gaggaucgccgcucucgaa

SEQ ID NO: 1329770 - RNA, 19 nt, Homo sapiens
ucaagacuauggugcaaga

SEQ ID NO: 1329771 - RNA, 19 nt, Homo sapiens
aaauaagaaucgcaagaga

SEQ ID NO: 1329772 - RNA, 19 nt, Homo sapiens
gggagccaauggaaugaaa

SEQ ID NO: 1329773 - RNA, 19 nt, Homo sapiens
caaccuccacgaagccuua

SEQ ID NO: 1329774 - RNA, 19 nt, Homo sapiens
cagcuugugugauuccauu

SEQ ID NO: 1329775 - RNA, 19 nt, Homo sapiens
ucagaaauccuaugaacau

SEQ ID NO: 1329776 - RNA, 19 nt, Homo sapiens
ggacaaaaggguucuauug

SEQ ID NO: 1329777 - RNA, 19 nt, Homo sapiens
uggaucaccucaagacuau

SEQ ID NO: 1329778 - RNA, 19 nt, Homo sapiens
ccacaggguccuucuauca

SEQ ID NO: 1329779 - RNA, 19 nt, Homo sapiens
gggagacgcuggagagaac

SEQ ID NO: 1329780 - RNA, 19 nt, Homo sapiens
aauuggacuuccuggauua

SEQ ID NO: 1329781 - RNA, 19 nt, Homo sapiens
ugauuccauuugacacuua

SEQ ID NO: 1329782 - RNA, 19 nt, Homo sapiens
cagcauguaccuuguuuga

SEQ ID NO: 1329783 - RNA, 19 nt, Homo sapiens
acagaggauuaccaccuua

SEQ ID NO: 1329784 - RNA, 19 nt, Homo sapiens
guaccuuguuugauucuuc

SEQ ID NO: 1329785 - RNA, 19 nt, Homo sapiens
gcaguaggacagaauggaa

SEQ ID NO: 1329786 - RNA, 19 nt, Homo sapiens
agacuauggugcaagagaa

SEQ ID NO: 1329787 - RNA, 19 nt, Homo sapiens
ucaaggagccacuaagauc

SEQ ID NO: 1329788 - RNA, 19 nt, Homo sapiens
cggguugccuggagcagua

SEQ ID NO: 1329789 - RNA, 19 nt, Homo sapiens
gaucgccgcucucgaaucc

SEQ ID NO: 1329790 - RNA, 19 nt, Homo sapiens
caaaggagaaagaggugaa

SEQ ID NO: 1329791 - RNA, 19 nt, Homo sapiens
ggguacagaugguccuaug

SEQ ID NO: 1329792 - RNA, 19 nt, Homo sapiens
gaucagcagcucauuaaac

SEQ ID NO: 1329793 - RNA, 19 nt, Homo sapiens
cgaaagacaccgaguaggu

SEQ ID NO: 1329794 - RNA, 19 nt, Homo sapiens
ggaccaaaggguacagaug

SEQ ID NO: 1329795 - RNA, 19 nt, Homo sapiens
uaagggagaaccuggagaa

SEQ ID NO: 1329796 - RNA, 19 nt, Homo sapiens
ucaaccaccugacaccaau

SEQ ID NO: 1329797 - RNA, 19 nt, Homo sapiens
gauuccauuugacacuuaa

SEQ ID NO: 1329798 - RNA, 19 nt, Homo sapiens
caacggcaaccuccacgaa

SEQ ID NO: 1329799 - RNA, 19 nt, Homo sapiens
gggauuauuugagguguag

SEQ ID NO: 1329800 - RNA, 19 nt, Homo sapiens
acauacugaugccugauuu

SEQ ID NO: 1329801 - RNA, 19 nt, Homo sapiens
ccgaguagguagaaauaag

SEQ ID NO: 1329802 - RNA, 19 nt, Homo sapiens
cuguucagcuugugugauu

SEQ ID NO: 1329803 - RNA, 19 nt, Homo sapiens
caaggagccacuaagauca

SEQ ID NO: 1329804 - RNA, 19 nt, Homo sapiens
ggagggugcuuuucacuuc

SEQ ID NO: 1329805 - RNA, 19 nt, Homo sapiens
ggaccaagagggcccuaug

SEQ ID NO: 1329806 - RNA, 19 nt, Homo sapiens
gaagccuuacagaggauua

SEQ ID NO: 1329807 - RNA, 19 nt, Homo sapiens
ggaacuagaggcccaaagg

SEQ ID NO: 1329808 - RNA, 19 nt, Homo sapiens
gguaagagaggccgaagag

SEQ ID NO: 1329809 - RNA, 19 nt, Homo sapiens
gaaugcaggugggaaacag

SEQ ID NO: 1329810 - RNA, 19 nt, Homo sapiens
gcuguacugccagauauaa

SEQ ID NO: 1329811 - RNA, 19 nt, Homo sapiens
cauguaccuuguuugauuc

SEQ ID NO: 1329812 - RNA, 19 nt, Homo sapiens
cugaucagcagcucauuaa

SEQ ID NO: 1329813 - RNA, 19 nt, Homo sapiens
caccgaguagguagaaaua

SEQ ID NO: 1329814 - RNA, 19 nt, Homo sapiens
ccaccugacaccaauuuau

SEQ ID NO: 1329815 - RNA, 19 nt, Homo sapiens
guagaaauaaggcaaacuc

SEQ ID NO: 1329816 - RNA, 19 nt, Homo sapiens
gacuucggcuucgcgagua

SEQ ID NO: 1329817 - RNA, 19 nt, Homo sapiens
ggauuaccaccuuaacugu

SEQ ID NO: 1329818 - RNA, 19 nt, Homo sapiens
uacagaggauuaccaccuu

SEQ ID NO: 1329819 - RNA, 19 nt, Homo sapiens
gaagcacgcagggaaagga

SEQ ID NO: 1329820 - RNA, 19 nt, Homo sapiens
aauaagaaucgcaagagaa

SEQ ID NO: 1329821 - RNA, 19 nt, Homo sapiens
gcaaggcaggggauuauuu

SEQ ID NO: 1329822 - RNA, 19 nt, Homo sapiens
cuaagaucauagacuacaa

SEQ ID NO: 1329823 - RNA, 19 nt, Homo sapiens
uuaccagguuuaccaggaa

SEQ ID NO: 1329824 - RNA, 19 nt, Homo sapiens
uauuggagcaccuggaauu

SEQ ID NO: 1329825 - RNA, 19 nt, Homo sapiens
gcauugguuccuuggguuu

SEQ ID NO: 1329826 - RNA, 19 nt, Homo sapiens
cagauauucuagcuacagu

SEQ ID NO: 1329827 - RNA, 19 nt, Homo sapiens
auacugaugccugauuuaa

SEQ ID NO: 1329828 - RNA, 19 nt, Homo sapiens
cccagcauguaccuuguuu

SEQ ID NO: 1329829 - RNA, 19 nt, Homo sapiens
ggacucaaaggcucaaagg

SEQ ID NO: 1329830 - RNA, 19 nt, Homo sapiens
ggaauaccaggaccuaagg

SEQ ID NO: 1329831 - RNA, 19 nt, Homo sapiens
gaccuaggaugguguuucc

SEQ ID NO: 1329832 - RNA, 19 nt, Homo sapiens
gcuguagcgugcucucaca

SEQ ID NO: 1329833 - RNA, 19 nt, Homo sapiens
acaaaaggguucuauugga

SEQ ID NO: 1329834 - RNA, 19 nt, Homo sapiens
caccugacaccaauuuaug

SEQ ID NO: 1329835 - RNA, 19 nt, Homo sapiens
gaaugaagaaggcuguacu

SEQ ID NO: 1329836 - RNA, 19 nt, Homo sapiens
acugaugccugauuuaagg

SEQ ID NO: 1329837 - RNA, 19 nt, Homo sapiens
cauacugaugccugauuua

SEQ ID NO: 1329838 - RNA, 19 nt, Homo sapiens
cuugugugauuccauuuga

SEQ ID NO: 1329839 - RNA, 19 nt, Homo sapiens
ggagagccuggucuugaug

SEQ ID NO: 1329840 - RNA, 19 nt, Homo sapiens
cagaggauuaccaccuuaa

SEQ ID NO: 1329841 - RNA, 19 nt, Homo sapiens
aaacaaggugaaucaggaa

SEQ ID NO: 1329842 - RNA, 19 nt, Homo sapiens
cuggguggguuucgucuug

SEQ ID NO: 1329843 - RNA, 19 nt, Homo sapiens
ccagggaaacgagguaaga

SEQ ID NO: 1329844 - RNA, 19 nt, Homo sapiens
gaucaccucaagacuaugg

SEQ ID NO: 1329845 - RNA, 19 nt, Homo sapiens
uggagagccuggucuugau

SEQ ID NO: 1329846 - RNA, 19 nt, Homo sapiens
ggagagcagggacucaaag

SEQ ID NO: 1329847 - RNA, 19 nt, Homo sapiens
gaaugucacuggaauauua

SEQ ID NO: 1329848 - RNA, 19 nt, Homo sapiens
gggaagaaauuuguaguua

SEQ ID NO: 1329849 - RNA, 19 nt, Homo sapiens
ggauugaagugcagaauuu

SEQ ID NO: 1329850 - RNA, 19 nt, Homo sapiens
ggaaggaggguaauaauga

SEQ ID NO: 1329851 - RNA, 19 nt, Homo sapiens
gaaaguacaaccagaauug

SEQ ID NO: 1329852 - RNA, 19 nt, Homo sapiens
ccagugagauuaagugauu

SEQ ID NO: 1329853 - RNA, 19 nt, Homo sapiens
gaaggaggguaauaaugaa

SEQ ID NO: 1329854 - RNA, 19 nt, Homo sapiens
ccagagacuuggcuuaauu

SEQ ID NO: 1329855 - RNA, 19 nt, Homo sapiens
ggacugugguguucuaugu

SEQ ID NO: 1329856 - RNA, 19 nt, Homo sapiens
uaauuggucuggguaaaua

SEQ ID NO: 1329857 - RNA, 19 nt, Homo sapiens
gagcauaaauaaucaagcu

SEQ ID NO: 1329858 - RNA, 19 nt, Homo sapiens
ucaguagcuuuguuugaua

SEQ ID NO: 1329859 - RNA, 19 nt, Homo sapiens
gcuaugagguuuuaugcua

SEQ ID NO: 1329860 - RNA, 19 nt, Homo sapiens
ggaaaguacaaccagaauu

SEQ ID NO: 1329861 - RNA, 19 nt, Homo sapiens
ccugagaacuugauaaugc

SEQ ID NO: 1329862 - RNA, 19 nt, Homo sapiens
guagcuauuuguugcaaga

SEQ ID NO: 1329863 - RNA, 19 nt, Homo sapiens
agauauggcuuguggacuu

SEQ ID NO: 1329864 - RNA, 19 nt, Homo sapiens
uauaugcccuaggaaagua

SEQ ID NO: 1329865 - RNA, 19 nt, Homo sapiens
gauuuacaguacaguuuga

SEQ ID NO: 1329866 - RNA, 19 nt, Homo sapiens
ucacuggaauauuacaaug

SEQ ID NO: 1329867 - RNA, 19 nt, Homo sapiens
ccaggacugugguguucua

SEQ ID NO: 1329868 - RNA, 19 nt, Homo sapiens
guuccuggcuacuguuuau

SEQ ID NO: 1329869 - RNA, 19 nt, Homo sapiens
ggaggguaauaaugaacaa

SEQ ID NO: 1329870 - RNA, 19 nt, Homo sapiens
agcauuacauucucaauug

SEQ ID NO: 1329871 - RNA, 19 nt, Homo sapiens
gaaaaccaacugaucuaua

SEQ ID NO: 1329872 - RNA, 19 nt, Homo sapiens
acagucacccuuacacaua

SEQ ID NO: 1329873 - RNA, 19 nt, Homo sapiens
gaguaaggccuaccaaucu

SEQ ID NO: 1329874 - RNA, 19 nt, Homo sapiens
gcauagcauuaccugagaa

SEQ ID NO: 1329875 - RNA, 19 nt, Homo sapiens
cccauagacuaauagcaua

SEQ ID NO: 1329876 - RNA, 19 nt, Homo sapiens
gacaugacuuauucucugu

SEQ ID NO: 1329877 - RNA, 19 nt, Homo sapiens
uacaguaguuugugauuag

SEQ ID NO: 1329878 - RNA, 19 nt, Homo sapiens
gacuuauucucuguucaua

SEQ ID NO: 1329879 - RNA, 19 nt, Homo sapiens
gucaguagcuuuguuugau

SEQ ID NO: 1329880 - RNA, 19 nt, Homo sapiens
uuacacauaugcccuaguc

SEQ ID NO: 1329881 - RNA, 19 nt, Homo sapiens
cagauauacugugggauga

SEQ ID NO: 1329882 - RNA, 19 nt, Homo sapiens
ggucauauuaguagcuauu

SEQ ID NO: 1329883 - RNA, 19 nt, Homo sapiens
uuacaggcaugcuacaauc

SEQ ID NO: 1329884 - RNA, 19 nt, Homo sapiens
gaaauuuauguccagaaug

SEQ ID NO: 1329885 - RNA, 19 nt, Homo sapiens
gaguaucucaggguaagua

SEQ ID NO: 1329886 - RNA, 19 nt, Homo sapiens
gauauacugugggaugagu

SEQ ID NO: 1329887 - RNA, 19 nt, Homo sapiens
ugugacccauagacuaaua

SEQ ID NO: 1329888 - RNA, 19 nt, Homo sapiens
ucuaucaugggcaguauua

SEQ ID NO: 1329889 - RNA, 19 nt, Homo sapiens
gggaaggaggguaauaaug

SEQ ID NO: 1329890 - RNA, 19 nt, Homo sapiens
gcauuacauucucaauugg

SEQ ID NO: 1329891 - RNA, 19 nt, Homo sapiens
caguagcuuuguuugauau

SEQ ID NO: 1329892 - RNA, 19 nt, Homo sapiens
gagaacuugauaaugcaua

SEQ ID NO: 1329893 - RNA, 19 nt, Homo sapiens
cagaaugucacuggaauau

SEQ ID NO: 1329894 - RNA, 19 nt, Homo sapiens
guaaauguucagcuaaauc

SEQ ID NO: 1329895 - RNA, 19 nt, Homo sapiens
gauauggcuuguggacuuc

SEQ ID NO: 1329896 - RNA, 19 nt, Homo sapiens
cuuauucucuguucauaca

SEQ ID NO: 1329897 - RNA, 19 nt, Homo sapiens
gcuauuuguugcaagauac

SEQ ID NO: 1329898 - RNA, 19 nt, Homo sapiens
gcacagucacccuuacaca

SEQ ID NO: 1329899 - RNA, 19 nt, Homo sapiens
uaucucaaccuccauuguu

SEQ ID NO: 1329900 - RNA, 19 nt, Homo sapiens
ucucaaagugugacccaua

SEQ ID NO: 1329901 - RNA, 19 nt, Homo sapiens
cagucacccuuacacauau

SEQ ID NO: 1329902 - RNA, 19 nt, Homo sapiens
agacuaauagcauagcauu

SEQ ID NO: 1329903 - RNA, 19 nt, Homo sapiens
ugcaugcaauggaaagaaa

SEQ ID NO: 1329904 - RNA, 19 nt, Homo sapiens
gugauucugauuuacagua

SEQ ID NO: 1329905 - RNA, 19 nt, Homo sapiens
gagaguaaggccuaccaau

SEQ ID NO: 1329906 - RNA, 19 nt, Homo sapiens
uaucaugggcaguauuaga

SEQ ID NO: 1329907 - RNA, 19 nt, Homo sapiens
guccagugguucucaaagu

SEQ ID NO: 1329908 - RNA, 19 nt, Homo sapiens
gugcagaauuuggcauauc

SEQ ID NO: 1329909 - RNA, 19 nt, Homo sapiens
uagcauuaccugagaacuu

SEQ ID NO: 1329910 - RNA, 19 nt, Homo sapiens
agcauuaccugagaacuug

SEQ ID NO: 1329911 - RNA, 19 nt, Homo sapiens
cgcaaaaccugcugaauca

SEQ ID NO: 1329912 - RNA, 19 nt, Homo sapiens
acacgcacagucacccuua

SEQ ID NO: 1329913 - RNA, 19 nt, Homo sapiens
uaauugggaaggaggguaa

SEQ ID NO: 1329914 - RNA, 19 nt, Homo sapiens
cccacuggcuagaacauau

SEQ ID NO: 1329915 - RNA, 19 nt, Homo sapiens
uucacuaucugguuuacaa

SEQ ID NO: 1329916 - RNA, 19 nt, Homo sapiens
caugacuuauucucuguuc

SEQ ID NO: 1329917 - RNA, 19 nt, Homo sapiens
cuauaccaguucuuucaau

SEQ ID NO: 1329918 - RNA, 19 nt, Homo sapiens
gaucuauaccaguucuuuc

SEQ ID NO: 1329919 - RNA, 19 nt, Homo sapiens
ccacucacacgcacaguca

SEQ ID NO: 1329920 - RNA, 19 nt, Homo sapiens
gauacuugaagccaaaugu

SEQ ID NO: 1329921 - RNA, 19 nt, Homo sapiens
gagacccacuggcuagaac

SEQ ID NO: 1329922 - RNA, 19 nt, Homo sapiens
cacagucaguagcuuuguu

SEQ ID NO: 1329923 - RNA, 19 nt, Homo sapiens
uaggaaaguacaaccagaa

SEQ ID NO: 1329924 - RNA, 19 nt, Homo sapiens
agaguaaggccuaccaauc

SEQ ID NO: 1329925 - RNA, 19 nt, Homo sapiens
aucucaaccuccauuguua

SEQ ID NO: 1329926 - RNA, 19 nt, Homo sapiens
aacauugaguccagugaga

SEQ ID NO: 1329927 - RNA, 19 nt, Homo sapiens
aaaaccaacugaucuauac

SEQ ID NO: 1329928 - RNA, 19 nt, Homo sapiens
auaaucaagcuuaggacua

SEQ ID NO: 1329929 - RNA, 19 nt, Homo sapiens
agugugacccauagacuaa

SEQ ID NO: 1329930 - RNA, 19 nt, Homo sapiens
acagucaguagcuuuguuu

SEQ ID NO: 1329931 - RNA, 19 nt, Homo sapiens
gauuucacucugucuauca

SEQ ID NO: 1329932 - RNA, 19 nt, Homo sapiens
aaaguacaaccagaauuga

SEQ ID NO: 1329933 - RNA, 19 nt, Homo sapiens
cagagacuuggcuuaauug

SEQ ID NO: 1329934 - RNA, 19 nt, Homo sapiens
uaucucaggguaaguaaca

SEQ ID NO: 1329935 - RNA, 19 nt, Homo sapiens
cauauccuccagagacuug

SEQ ID NO: 1329936 - RNA, 19 nt, Homo sapiens
ggacuaaaugaaagauacu

SEQ ID NO: 1329937 - RNA, 19 nt, Homo sapiens
aggacuaaaugaaagauac

SEQ ID NO: 1329938 - RNA, 19 nt, Homo sapiens
ccucacagucaguagcuuu

SEQ ID NO: 1329939 - RNA, 19 nt, Homo sapiens
gauugaagugcagaauuug

SEQ ID NO: 1329940 - RNA, 19 nt, Homo sapiens
uacuugaagccaaauguuu

SEQ ID NO: 1329941 - RNA, 19 nt, Homo sapiens
uaccugagaacuugauaau

SEQ ID NO: 1329942 - RNA, 19 nt, Homo sapiens
aguacaaccagaauugaaa

SEQ ID NO: 1329943 - RNA, 19 nt, Homo sapiens
cuuaauuggucuggguaaa

SEQ ID NO: 1329944 - RNA, 19 nt, Homo sapiens
gacuuccaauaucauccua

SEQ ID NO: 1329945 - RNA, 19 nt, Homo sapiens
ugauuuacaguacaguuug

SEQ ID NO: 1329946 - RNA, 19 nt, Homo sapiens
ggaauauuacaaugagcau

SEQ ID NO: 1329947 - RNA, 19 nt, Homo sapiens
caggaaggcucauaaagaa

SEQ ID NO: 1329948 - RNA, 19 nt, Homo sapiens
ugaggaugcuggcuacuua

SEQ ID NO: 1329949 - RNA, 19 nt, Homo sapiens
auaaagaacucucaaagga

SEQ ID NO: 1329950 - RNA, 19 nt, Homo sapiens
gcaggaaggcucauaaaga

SEQ ID NO: 1329951 - RNA, 19 nt, Homo sapiens
cacagaaacuuccaacuug

SEQ ID NO: 1329952 - RNA, 19 nt, Homo sapiens
gaugcuggcuacuuaaaga

SEQ ID NO: 1329953 - RNA, 19 nt, Homo sapiens
ucaaaaggcugaaagguuu

SEQ ID NO: 1329954 - RNA, 19 nt, Homo sapiens
gcucagagaagcagacaaa

SEQ ID NO: 1329955 - RNA, 19 nt, Homo sapiens
ccacagaaacuuccaacuu

SEQ ID NO: 1329956 - RNA, 19 nt, Homo sapiens
ugaauucuguaaaccauug

SEQ ID NO: 1329957 - RNA, 19 nt, Homo sapiens
aaacaguucgcuacaagua

SEQ ID NO: 1329958 - RNA, 19 nt, Homo sapiens
acaguucgcuacaaguaaa

SEQ ID NO: 1329959 - RNA, 19 nt, Homo sapiens
gccgagagcccuacagaga

SEQ ID NO: 1329960 - RNA, 19 nt, Homo sapiens
gugcaucucuuccgacucu

SEQ ID NO: 1329961 - RNA, 19 nt, Homo sapiens
ggaggagcccaacgcguuu

SEQ ID NO: 1329962 - RNA, 19 nt, Homo sapiens
uuaaacaguucgcuacaag

SEQ ID NO: 1329963 - RNA, 19 nt, Homo sapiens
cgcuacaaguaaaugauua

SEQ ID NO: 1329964 - RNA, 19 nt, Homo sapiens
cgagagcccuacagagaag

SEQ ID NO: 1329965 - RNA, 19 nt, Homo sapiens
ccacguacaaguaugaguu

SEQ ID NO: 1329966 - RNA, 19 nt, Homo sapiens
ggaguccacguacaaguau

SEQ ID NO: 1329967 - RNA, 19 nt, Homo sapiens
ucuguaaaccauugcauaa

SEQ ID NO: 1329968 - RNA, 19 nt, Homo sapiens
gcaggugcagcgaagauga

SEQ ID NO: 1329969 - RNA, 19 nt, Homo sapiens
ggaaggcucauaaagaacu

SEQ ID NO: 1329970 - RNA, 19 nt, Homo sapiens
caugaauucuguaaaccau

SEQ ID NO: 1329971 - RNA, 19 nt, Homo sapiens
ccagggccaugagaaguug

SEQ ID NO: 1329972 - RNA, 19 nt, Homo sapiens
ggacugcgugggaguuugu

SEQ ID NO: 1329973 - RNA, 19 nt, Homo sapiens
agugggagaucgccaacaa

SEQ ID NO: 1329974 - RNA, 19 nt, Homo sapiens
gaggaugcuggcuacuuaa

SEQ ID NO: 1329975 - RNA, 19 nt, Homo sapiens
gaccaggcuugugcucaga

SEQ ID NO: 1329976 - RNA, 19 nt, Homo sapiens
gggaguuugugaccuugug

SEQ ID NO: 1329977 - RNA, 19 nt, Homo sapiens
cauaaagaacucucaaagg

SEQ ID NO: 1329978 - RNA, 19 nt, Homo sapiens
cgugggaguuugugaccuu

SEQ ID NO: 1329979 - RNA, 19 nt, Homo sapiens
ucauaaagaacucucaaag

SEQ ID NO: 1329980 - RNA, 19 nt, Homo sapiens
auaacuccaugaauucugu

SEQ ID NO: 1329981 - RNA, 19 nt, Homo sapiens
acagagaagcuggcuggua

SEQ ID NO: 1329982 - RNA, 19 nt, Homo sapiens
gaaggcucauaaagaacuc

SEQ ID NO: 1329983 - RNA, 19 nt, Homo sapiens
gcucauaaagaacucucaa

SEQ ID NO: 1329984 - RNA, 19 nt, Homo sapiens
ccgagagcccuacagagaa

SEQ ID NO: 1329985 - RNA, 19 nt, Homo sapiens
gagaagcagacaaaacaaa

SEQ ID NO: 1329986 - RNA, 19 nt, Homo sapiens
uuuaaacaguucgcuacaa

SEQ ID NO: 1329987 - RNA, 19 nt, Homo sapiens
gagaagcuggcugguagga

SEQ ID NO: 1329988 - RNA, 19 nt, Homo sapiens
uacacgaggcccacagaaa

SEQ ID NO: 1329989 - RNA, 19 nt, Homo sapiens
uaaagaccccagaagaaaa

SEQ ID NO: 1329990 - RNA, 19 nt, Homo sapiens
ucuacgcgcugacguucga

SEQ ID NO: 1329991 - RNA, 19 nt, Homo sapiens
ccaggcuugugcucagaga

SEQ ID NO: 1329992 - RNA, 19 nt, Homo sapiens
acacgaggcccacagaaac

SEQ ID NO: 1329993 - RNA, 19 nt, Homo sapiens
cuccaugaauucuguaaac

SEQ ID NO: 1329994 - RNA, 19 nt, Homo sapiens
gcagugggaccagguagag

SEQ ID NO: 1329995 - RNA, 19 nt, Homo sapiens
ggagaaaggugggaacaua

SEQ ID NO: 1329996 - RNA, 19 nt, Homo sapiens
gcagugaaguugacagauu

SEQ ID NO: 1329997 - RNA, 19 nt, Homo sapiens
aaacacaucugaauucaug

SEQ ID NO: 1329998 - RNA, 19 nt, Homo sapiens
gaagcagaauuaagucaaa

SEQ ID NO: 1329999 - RNA, 19 nt, Homo sapiens
uaacagccauggugauuga

SEQ ID NO: 1330000 - RNA, 19 nt, Homo sapiens
gaucacauguccuugaaug

SEQ ID NO: 1330001 - RNA, 19 nt, Homo sapiens
gaacauacaauuggagauu

SEQ ID NO: 1330002 - RNA, 19 nt, Homo sapiens
gguauggaguuguggauuu

SEQ ID NO: 1330003 - RNA, 19 nt, Homo sapiens
gaacagcuccuuucuuucu

SEQ ID NO: 1330004 - RNA, 19 nt, Homo sapiens
guauggaguuguggauuua

SEQ ID NO: 1330005 - RNA, 19 nt, Homo sapiens
uugaacagcuccuuucuuu

SEQ ID NO: 1330006 - RNA, 19 nt, Homo sapiens
caacccagcucccagguau

SEQ ID NO: 1330007 - RNA, 19 nt, Homo sapiens
ggagggcauucauuucaaa

SEQ ID NO: 1330008 - RNA, 19 nt, Homo sapiens
gacaaagcaucaagagaga

SEQ ID NO: 1330009 - RNA, 19 nt, Homo sapiens
gaauugcuacuguguauga

SEQ ID NO: 1330010 - RNA, 19 nt, Homo sapiens
gauaucaucagcuaccuaa

SEQ ID NO: 1330011 - RNA, 19 nt, Homo sapiens
gguguaggcuccaaaauaa

SEQ ID NO: 1330012 - RNA, 19 nt, Homo sapiens
cagugaaguugacagauuu

SEQ ID NO: 1330013 - RNA, 19 nt, Homo sapiens
uggcagauaucaucagcua

SEQ ID NO: 1330014 - RNA, 19 nt, Homo sapiens
gcacgaccauggagaaagg

SEQ ID NO: 1330015 - RNA, 19 nt, Homo sapiens
gggaucacauguccuugaa

SEQ ID NO: 1330016 - RNA, 19 nt, Homo sapiens
gaauuaagucaaacaagga

SEQ ID NO: 1330017 - RNA, 19 nt, Homo sapiens
caagagagaccuccagagu

SEQ ID NO: 1330018 - RNA, 19 nt, Homo sapiens
ccauuucagucaucaagaa

SEQ ID NO: 1330019 - RNA, 19 nt, Homo sapiens
agacaaauguacacagauc

SEQ ID NO: 1330020 - RNA, 19 nt, Homo sapiens
ugaaugagaugaguacagu

SEQ ID NO: 1330021 - RNA, 19 nt, Homo sapiens
ggccgucucugugauauug

SEQ ID NO: 1330022 - RNA, 19 nt, Homo sapiens
ggagaauggaugagccuaa

SEQ ID NO: 1330023 - RNA, 19 nt, Homo sapiens
uaauguggcugagguugaa

SEQ ID NO: 1330024 - RNA, 19 nt, Homo sapiens
gagaauggaugagccuaag

SEQ ID NO: 1330025 - RNA, 19 nt, Homo sapiens
uugcuacuguguaugaaua

SEQ ID NO: 1330026 - RNA, 19 nt, Homo sapiens
guuguucccuugacagaga

SEQ ID NO: 1330027 - RNA, 19 nt, Homo sapiens
gagugaugaugaaguuaga

SEQ ID NO: 1330028 - RNA, 19 nt, Homo sapiens
ucccuuagcccacgacaua

SEQ ID NO: 1330029 - RNA, 19 nt, Homo sapiens
ucacaggguuacaccaaau

SEQ ID NO: 1330030 - RNA, 19 nt, Homo sapiens
ugagguugaagcagaauua

SEQ ID NO: 1330031 - RNA, 19 nt, Homo sapiens
gcaacuggcagauaucauc

SEQ ID NO: 1330032 - RNA, 19 nt, Homo sapiens
caccagcccucagaucauu

SEQ ID NO: 1330033 - RNA, 19 nt, Homo sapiens
aaacaaggacaaagcauca

SEQ ID NO: 1330034 - RNA, 19 nt, Homo sapiens
aaucucaaccgcucccuua

SEQ ID NO: 1330035 - RNA, 19 nt, Homo sapiens
ugaguacagucuccauuuc

SEQ ID NO: 1330036 - RNA, 19 nt, Homo sapiens
auagacaaauguacacaga

SEQ ID NO: 1330037 - RNA, 19 nt, Homo sapiens
ccuaacagcugccaguuuu

SEQ ID NO: 1330038 - RNA, 19 nt, Homo sapiens
gaaaggugggaacauacaa

SEQ ID NO: 1330039 - RNA, 19 nt, Homo sapiens
aggaauugcuacuguguau

SEQ ID NO: 1330040 - RNA, 19 nt, Homo sapiens
caucaaaacugaaaaucug

SEQ ID NO: 1330041 - RNA, 19 nt, Homo sapiens
gaugaugaaguuagaguuc

SEQ ID NO: 1330042 - RNA, 19 nt, Homo sapiens
gcagaauuaagucaaacaa

SEQ ID NO: 1330043 - RNA, 19 nt, Homo sapiens
gguugaagcagaauuaagu

SEQ ID NO: 1330044 - RNA, 19 nt, Homo sapiens
cacauguccuugaaugaga

SEQ ID NO: 1330045 - RNA, 19 nt, Homo sapiens
ggagugaugaugaaguuag

SEQ ID NO: 1330046 - RNA, 19 nt, Homo sapiens
gagcaggacagugguaugu

SEQ ID NO: 1330047 - RNA, 19 nt, Homo sapiens
aaacaauaacgcuuuggaa

SEQ ID NO: 1330048 - RNA, 19 nt, Homo sapiens
gcagcauauuauagacaaa

SEQ ID NO: 1330049 - RNA, 19 nt, Homo sapiens
gaggaauugcuacugugua

SEQ ID NO: 1330050 - RNA, 19 nt, Homo sapiens
ucggagugaugaugaaguu

SEQ ID NO: 1330051 - RNA, 19 nt, Homo sapiens
gcagggccgucucugugau

SEQ ID NO: 1330052 - RNA, 19 nt, Homo sapiens
ucagaucauugaaccaagu

SEQ ID NO: 1330053 - RNA, 19 nt, Homo sapiens
uuagugcugugcuggauau

SEQ ID NO: 1330054 - RNA, 19 nt, Homo sapiens
gaauggaugagccuaagca

SEQ ID NO: 1330055 - RNA, 19 nt, Homo sapiens
aacaauaacgcuuuggaaa

SEQ ID NO: 1330056 - RNA, 19 nt, Homo sapiens
gaugaguacagucuccauu

SEQ ID NO: 1330057 - RNA, 19 nt, Homo sapiens
ugagccaucuaaaccaguu

SEQ ID NO: 1330058 - RNA, 19 nt, Homo sapiens
ggaggaauugcuacugugu

SEQ ID NO: 1330059 - RNA, 19 nt, Homo sapiens
uagaacugcuuuggugguu

SEQ ID NO: 1330060 - RNA, 19 nt, Homo sapiens
gcaacccagcucccaggua

SEQ ID NO: 1330061 - RNA, 19 nt, Homo sapiens
gaguagugcagaggaagua

SEQ ID NO: 1330062 - RNA, 19 nt, Homo sapiens
aauuggagauuccugacuu

SEQ ID NO: 1330063 - RNA, 19 nt, Homo sapiens
ucaagaacccuacuguuuu

SEQ ID NO: 1330064 - RNA, 19 nt, Homo sapiens
aucaagaacccuacuguuu

SEQ ID NO: 1330065 - RNA, 19 nt, Homo sapiens
gaguacagucuccauuuca

SEQ ID NO: 1330066 - RNA, 19 nt, Homo sapiens
ggagaagaugggaguagug

SEQ ID NO: 1330067 - RNA, 19 nt, Homo sapiens
uagaguucuuggagcagua

SEQ ID NO: 1330068 - RNA, 19 nt, Homo sapiens
ugaugaaguuagaguucuu

SEQ ID NO: 1330069 - RNA, 19 nt, Homo sapiens
gagaaaggugggaacauac

SEQ ID NO: 1330070 - RNA, 19 nt, Homo sapiens
caaggacaaagcaucaaga

SEQ ID NO: 1330071 - RNA, 19 nt, Homo sapiens
uaucaucagcuaccuaaca

SEQ ID NO: 1330072 - RNA, 19 nt, Homo sapiens
gugggaacauacaauugga

SEQ ID NO: 1330073 - RNA, 19 nt, Homo sapiens
gagguugaagcagaauuaa

SEQ ID NO: 1330074 - RNA, 19 nt, Homo sapiens
caucaagaacccuacuguu

SEQ ID NO: 1330075 - RNA, 19 nt, Homo sapiens
agacacagagccagaagug

SEQ ID NO: 1330076 - RNA, 19 nt, Homo sapiens
gauaucagagagcuaaguc

SEQ ID NO: 1330077 - RNA, 19 nt, Homo sapiens
caacuggcagauaucauca

SEQ ID NO: 1330078 - RNA, 19 nt, Homo sapiens
gagagacacagagccagaa

SEQ ID NO: 1330079 - RNA, 19 nt, Homo sapiens
gccaacaagcagugaaguu

SEQ ID NO: 1330080 - RNA, 19 nt, Homo sapiens
ggugggaacauacaauugg

SEQ ID NO: 1330081 - RNA, 19 nt, Homo sapiens
gcuccuuucuuucuguuac

SEQ ID NO: 1330082 - RNA, 19 nt, Homo sapiens
guacacaucaaaacugaaa

SEQ ID NO: 1330083 - RNA, 19 nt, Homo sapiens
uggagggcauucauuucaa

SEQ ID NO: 1330084 - RNA, 19 nt, Homo sapiens
guaacagccauggugauug

SEQ ID NO: 1330085 - RNA, 19 nt, Homo sapiens
ucugugauauuguggucaa

SEQ ID NO: 1330086 - RNA, 19 nt, Homo sapiens
ugaagcagaauuaagucaa

SEQ ID NO: 1330087 - RNA, 19 nt, Homo sapiens
gcuacuguguaugaauaga

SEQ ID NO: 1330088 - RNA, 19 nt, Homo sapiens
ggcuugggccugagaauca

SEQ ID NO: 1330089 - RNA, 19 nt, Homo sapiens
gcaguguuguucccuugac

SEQ ID NO: 1330090 - RNA, 19 nt, Homo sapiens
gguuagugcugugcuggau

SEQ ID NO: 1330091 - RNA, 19 nt, Homo sapiens
cuuagcccacgacauaaua

SEQ ID NO: 1330092 - RNA, 19 nt, Homo sapiens
gccggaaagagcaaacaaa

SEQ ID NO: 1330093 - RNA, 19 nt, Homo sapiens
ugcagcauauuauagacaa

SEQ ID NO: 1330094 - RNA, 19 nt, Homo sapiens
ggauuuagaacugcuuugg

SEQ ID NO: 1330095 - RNA, 19 nt, Homo sapiens
aaucuggccuccaaauaua

SEQ ID NO: 1330096 - RNA, 19 nt, Homo sapiens
ucugaaaucugucaacuau

SEQ ID NO: 1330097 - RNA, 19 nt, Homo sapiens
gaaucuggccuccaaauau

SEQ ID NO: 1330098 - RNA, 19 nt, Homo sapiens
ugaaaucugucaacuaucu

SEQ ID NO: 1330099 - RNA, 19 nt, Homo sapiens
caaccagcauucuugaugu

SEQ ID NO: 1330100 - RNA, 19 nt, Homo sapiens
guuguaauuugcucugaaa

SEQ ID NO: 1330101 - RNA, 19 nt, Homo sapiens
uuaccucucuaccaaauga

SEQ ID NO: 1330102 - RNA, 19 nt, Homo sapiens
ucuaugagcugaguuaugg

SEQ ID NO: 1330103 - RNA, 19 nt, Homo sapiens
ugaaucuggccuccaaaua

SEQ ID NO: 1330104 - RNA, 19 nt, Homo sapiens
uauuugcucucugccauaa

SEQ ID NO: 1330105 - RNA, 19 nt, Homo sapiens
aaccagcauucuugaugua

SEQ ID NO: 1330106 - RNA, 19 nt, Homo sapiens
uagcccaucugcuggcaaa

SEQ ID NO: 1330107 - RNA, 19 nt, Homo sapiens
gaaccuccacccucugaca

SEQ ID NO: 1330108 - RNA, 19 nt, Homo sapiens
ccaaaugaacauaaguugu

SEQ ID NO: 1330109 - RNA, 19 nt, Homo sapiens
uccaaccaauucuuagauu

SEQ ID NO: 1330110 - RNA, 19 nt, Homo sapiens
ccaaccugcucuagugcuu

SEQ ID NO: 1330111 - RNA, 19 nt, Homo sapiens
gcucugaaaucugucaacu

SEQ ID NO: 1330112 - RNA, 19 nt, Homo sapiens
gcuguggccuagagaacug

SEQ ID NO: 1330113 - RNA, 19 nt, Homo sapiens
uuugcucucugccauaauu

SEQ ID NO: 1330114 - RNA, 19 nt, Homo sapiens
gcugaguuaugggaagcua

SEQ ID NO: 1330115 - RNA, 19 nt, Homo sapiens
gccagucucuaugcugcua

SEQ ID NO: 1330116 - RNA, 19 nt, Homo sapiens
augggaagcuaguuggaaa

SEQ ID NO: 1330117 - RNA, 19 nt, Homo sapiens
ggacucaccagauucucau

SEQ ID NO: 1330118 - RNA, 19 nt, Homo sapiens
cgcccaaccugcucuagug

SEQ ID NO: 1330119 - RNA, 19 nt, Homo sapiens
gaaaucugucaacuaucuu

SEQ ID NO: 1330120 - RNA, 19 nt, Homo sapiens
caguuccaaccaauucuua

SEQ ID NO: 1330121 - RNA, 19 nt, Homo sapiens
uuucucauauggagcuauu

SEQ ID NO: 1330122 - RNA, 19 nt, Homo sapiens
ucucugccauaauuucuca

SEQ ID NO: 1330123 - RNA, 19 nt, Homo sapiens
cagccuuccugcaguaucu

SEQ ID NO: 1330124 - RNA, 19 nt, Homo sapiens
ugccagccuuccugcagua

SEQ ID NO: 1330125 - RNA, 19 nt, Homo sapiens
ucaucaaccagcauucuug

SEQ ID NO: 1330126 - RNA, 19 nt, Homo sapiens
gcuggcaaaccaccugcua

SEQ ID NO: 1330127 - RNA, 19 nt, Homo sapiens
cauuguggccagucucuau

SEQ ID NO: 1330128 - RNA, 19 nt, Homo sapiens
guuccaaccaauucuuaga

SEQ ID NO: 1330129 - RNA, 19 nt, Homo sapiens
ccugcugcaucuccaguug

SEQ ID NO: 1330130 - RNA, 19 nt, Homo sapiens
ggagcuauuccauuuuaaa

SEQ ID NO: 1330131 - RNA, 19 nt, Homo sapiens
guaugggacuuugaaauaa

SEQ ID NO: 1330132 - RNA, 19 nt, Homo sapiens
gaugaagccugaaauugug

SEQ ID NO: 1330133 - RNA, 19 nt, Homo sapiens
gcagccaagucauguaauu

SEQ ID NO: 1330134 - RNA, 19 nt, Homo sapiens
caacucagauccuacaaca

SEQ ID NO: 1330135 - RNA, 19 nt, Homo sapiens
gaaucaacgucuacuacaa

SEQ ID NO: 1330136 - RNA, 19 nt, Homo sapiens
aagaggagaucgauggaua

SEQ ID NO: 1330137 - RNA, 19 nt, Homo sapiens
caacaugaacgaccuggua

SEQ ID NO: 1330138 - RNA, 19 nt, Homo sapiens
ggaguuagaaacagucuuu

SEQ ID NO: 1330139 - RNA, 19 nt, Homo sapiens
cuagaggacuugaaagaga

SEQ ID NO: 1330140 - RNA, 19 nt, Homo sapiens
cuaaacgugugucuucaaa

SEQ ID NO: 1330141 - RNA, 19 nt, Homo sapiens
aagcaugucugcaaauuag

SEQ ID NO: 1330142 - RNA, 19 nt, Homo sapiens
guucaagcaugucugcaaa

SEQ ID NO: 1330143 - RNA, 19 nt, Homo sapiens
caagucauguaauuaguca

SEQ ID NO: 1330144 - RNA, 19 nt, Homo sapiens
ggagggaguuagaaacagu

SEQ ID NO: 1330145 - RNA, 19 nt, Homo sapiens
ucaagcaugucugcaaauu

SEQ ID NO: 1330146 - RNA, 19 nt, Homo sapiens
ggaggaagcuuuugaggau

SEQ ID NO: 1330147 - RNA, 19 nt, Homo sapiens
ccugacaacuucaucuuug

SEQ ID NO: 1330148 - RNA, 19 nt, Homo sapiens
caagcaugucugcaaauua

SEQ ID NO: 1330149 - RNA, 19 nt, Homo sapiens
ccauggagacuuucuacua

SEQ ID NO: 1330150 - RNA, 19 nt, Homo sapiens
gcacugguuuaauuguguu

SEQ ID NO: 1330151 - RNA, 19 nt, Homo sapiens
cauggagacuuucuacuag

SEQ ID NO: 1330152 - RNA, 19 nt, Homo sapiens
gggaagugaucagcgauga

SEQ ID NO: 1330153 - RNA, 19 nt, Homo sapiens
gagcaguucucagccaugu

SEQ ID NO: 1330154 - RNA, 19 nt, Homo sapiens
aguaugggacuuugaaaua

SEQ ID NO: 1330155 - RNA, 19 nt, Homo sapiens
uagaggacuugaaagagaa

SEQ ID NO: 1330156 - RNA, 19 nt, Homo sapiens
caagauccgugaggaguuc

SEQ ID NO: 1330157 - RNA, 19 nt, Homo sapiens
ccagaucggcaccaaguuu

SEQ ID NO: 1330158 - RNA, 19 nt, Homo sapiens
caaaugcagccaagucaug

SEQ ID NO: 1330159 - RNA, 19 nt, Homo sapiens
ugaugaagccugaaauugu

SEQ ID NO: 1330160 - RNA, 19 nt, Homo sapiens
ggaaccagaucggcaccaa

SEQ ID NO: 1330161 - RNA, 19 nt, Homo sapiens
acaacgaggcgcucuauga

SEQ ID NO: 1330162 - RNA, 19 nt, Homo sapiens
cguguugccuuauaugaau

SEQ ID NO: 1330163 - RNA, 19 nt, Homo sapiens
gcaaauuaggagggaguua

SEQ ID NO: 1330164 - RNA, 19 nt, Homo sapiens
gaauggugcacugguuuaa

SEQ ID NO: 1330165 - RNA, 19 nt, Homo sapiens
gagaaucaacgucuacuac

SEQ ID NO: 1330166 - RNA, 19 nt, Homo sapiens
gcaguucucagccauguuc

SEQ ID NO: 1330167 - RNA, 19 nt, Homo sapiens
agucaucgucucagaaaua

SEQ ID NO: 1330168 - RNA, 19 nt, Homo sapiens
gggaacaacugggcgaaag

SEQ ID NO: 1330169 - RNA, 19 nt, Homo sapiens
ggacuugaaagagaacuga

SEQ ID NO: 1330170 - RNA, 19 nt, Homo sapiens
ugaauggugcacugguuua

SEQ ID NO: 1330171 - RNA, 19 nt, Homo sapiens
ugagggagaucgugcacau

SEQ ID NO: 1330172 - RNA, 19 nt, Homo sapiens
uggaguggauucccaacaa

SEQ ID NO: 1330173 - RNA, 19 nt, Homo sapiens
gcaagauccgugaggaguu

SEQ ID NO: 1330174 - RNA, 19 nt, Homo sapiens
cagccaagucauguaauua

SEQ ID NO: 1330175 - RNA, 19 nt, Homo sapiens
gugagggcauggaugaaau

SEQ ID NO: 1330176 - RNA, 19 nt, Homo sapiens
caucgucucagaaauaugu

SEQ ID NO: 1330177 - RNA, 19 nt, Homo sapiens
caucuggaacaaagacuaa

SEQ ID NO: 1330178 - RNA, 19 nt, Homo sapiens
uuagucaucuggaacaaag

SEQ ID NO: 1330179 - RNA, 19 nt, Homo sapiens
uguaauuagucaucuggaa

SEQ ID NO: 1330180 - RNA, 19 nt, Homo sapiens
gaacaccuucagcgucaug

SEQ ID NO: 1330181 - RNA, 19 nt, Homo sapiens
gugaugaagccugaaauug

SEQ ID NO: 1330182 - RNA, 19 nt, Homo sapiens
auggugcacugguuuaauu

SEQ ID NO: 1330183 - RNA, 19 nt, Homo sapiens
ggugagggcauggaugaaa

SEQ ID NO: 1330184 - RNA, 19 nt, Homo sapiens
caaauuaggagggaguuag

SEQ ID NO: 1330185 - RNA, 19 nt, Homo sapiens
gccaagucauguaauuagu

SEQ ID NO: 1330186 - RNA, 19 nt, Homo sapiens
ggaagaggagaucgaugga

SEQ ID NO: 1330187 - RNA, 19 nt, Homo sapiens
gucaucgucucagaaauau

SEQ ID NO: 1330188 - RNA, 19 nt, Homo sapiens
ggaguggauucccaacaac

SEQ ID NO: 1330189 - RNA, 19 nt, Homo sapiens
gagcucacccagcagaugu

SEQ ID NO: 1330190 - RNA, 19 nt, Homo sapiens
gcaguaugggacuuugaaa

SEQ ID NO: 1330191 - RNA, 19 nt, Homo sapiens
gugcacugguuuaauugug

SEQ ID NO: 1330192 - RNA, 19 nt, Homo sapiens
ggagagaaucaacgucuac

SEQ ID NO: 1330193 - RNA, 19 nt, Homo sapiens
auacuaaacgugugucuuc

SEQ ID NO: 1330194 - RNA, 19 nt, Homo sapiens
ccugaauggugcacugguu

SEQ ID NO: 1330195 - RNA, 19 nt, Homo sapiens
guguugccuuauaugaaua

SEQ ID NO: 1330196 - RNA, 19 nt, Homo sapiens
uggagagaaucaacgucua

SEQ ID NO: 1330197 - RNA, 19 nt, Homo sapiens
ucacaaaugcagccaaguc

SEQ ID NO: 1330198 - RNA, 19 nt, Homo sapiens
caacgucuacuacaaugag

SEQ ID NO: 1330199 - RNA, 19 nt, Homo sapiens
uaagaacagcagcuacuuc

SEQ ID NO: 1330200 - RNA, 19 nt, Homo sapiens
guaagaacagcagcuacuu

SEQ ID NO: 1330201 - RNA, 19 nt, Homo sapiens
cugaaauugugccguguug

SEQ ID NO: 1330202 - RNA, 19 nt, Homo sapiens
gauggauagucggaauaga

SEQ ID NO: 1330203 - RNA, 19 nt, Homo sapiens
gcgcaucuccgagcaguuc

SEQ ID NO: 1330204 - RNA, 19 nt, Homo sapiens
ggagguggacgagcagaug

SEQ ID NO: 1330205 - RNA, 19 nt, Homo sapiens
gugccguguugccuuauau

SEQ ID NO: 1330206 - RNA, 19 nt, Homo sapiens
uccauuaaguguucaagca

SEQ ID NO: 1330207 - RNA, 19 nt, Homo sapiens
cgacaacgaggcgcucuau

SEQ ID NO: 1330208 - RNA, 19 nt, Homo sapiens
gcaugucugcaaauuagga

SEQ ID NO: 1330209 - RNA, 19 nt, Homo sapiens
gcauggaugaaauggaguu

SEQ ID NO: 1330210 - RNA, 19 nt, Homo sapiens
aaucaacgucuacuacaau

SEQ ID NO: 1330211 - RNA, 19 nt, Homo sapiens
gaagaggagaucgauggau

SEQ ID NO: 1330212 - RNA, 19 nt, Homo sapiens
caacgaggcgcucuaugac

SEQ ID NO: 1330213 - RNA, 19 nt, Homo sapiens
acgaggcgcucuaugacau

SEQ ID NO: 1330214 - RNA, 19 nt, Homo sapiens
auugugccguguugccuua

SEQ ID NO: 1330215 - RNA, 19 nt, Homo sapiens
ucaccgaggcggagagcaa

SEQ ID NO: 1330216 - RNA, 19 nt, Homo sapiens
uacuagaggacuugaaaga

SEQ ID NO: 1330217 - RNA, 19 nt, Homo sapiens
uaauuagucaucuggaaca

SEQ ID NO: 1330218 - RNA, 19 nt, Homo sapiens
cacaaaugcagccaaguca

SEQ ID NO: 1330219 - RNA, 19 nt, Homo sapiens
gauccuacaacacgcaagu

SEQ ID NO: 1330220 - RNA, 19 nt, Homo sapiens
ugugaugaagccugaaauu

SEQ ID NO: 1330221 - RNA, 19 nt, Homo sapiens
uaggagggaguuagaaaca

SEQ ID NO: 1330222 - RNA, 19 nt, Homo sapiens
gccugacaacuucaucuuu

SEQ ID NO: 1330223 - RNA, 19 nt, Homo sapiens
uauccgaguaccagcagua

SEQ ID NO: 1330224 - RNA, 19 nt, Homo sapiens
gcaagcuggcggugaacau

SEQ ID NO: 1330225 - RNA, 19 nt, Homo sapiens
agaauacagacgagaccua

SEQ ID NO: 1330226 - RNA, 19 nt, Homo sapiens
aaauuaggagggaguuaga

SEQ ID NO: 1330227 - RNA, 19 nt, Homo sapiens
cgggugagggcauggauga

SEQ ID NO: 1330228 - RNA, 19 nt, Homo sapiens
cgcugcagcuggagagaau

SEQ ID NO: 1330229 - RNA, 19 nt, Homo sapiens
gagucaucgucucagaaau

SEQ ID NO: 1330230 - RNA, 19 nt, Homo sapiens
gaggagaucgauggauagu

SEQ ID NO: 1330231 - RNA, 19 nt, Homo sapiens
uaacaaccaugcucaagug

SEQ ID NO: 1330232 - RNA, 19 nt, Homo sapiens
gcuaccagcuggaacauga

SEQ ID NO: 1330233 - RNA, 19 nt, Homo sapiens
gcccacacaucuucuuuga

SEQ ID NO: 1330234 - RNA, 19 nt, Homo sapiens
gagaagauccgcccacaca

SEQ ID NO: 1330235 - RNA, 19 nt, Homo sapiens
caaccacuaugaccuguuc

SEQ ID NO: 1330236 - RNA, 19 nt, Homo sapiens
ggaacagcccgaucugcua

SEQ ID NO: 1330237 - RNA, 19 nt, Homo sapiens
ucaacaguaucaaccacua

SEQ ID NO: 1330238 - RNA, 19 nt, Homo sapiens
gaagauccgcccacacauc

SEQ ID NO: 1330239 - RNA, 19 nt, Homo sapiens
gcuggaacaugagaacgaa

SEQ ID NO: 1330240 - RNA, 19 nt, Homo sapiens
guagguugcagaagaaguu

SEQ ID NO: 1330241 - RNA, 19 nt, Homo sapiens
acaccaaccucuacuuguc

SEQ ID NO: 1330242 - RNA, 19 nt, Homo sapiens
cgggagcuguacccugaua

SEQ ID NO: 1330243 - RNA, 19 nt, Homo sapiens
ccaagaagaaacccaaauc

SEQ ID NO: 1330244 - RNA, 19 nt, Homo sapiens
gacaucguccucaugacua

SEQ ID NO: 1330245 - RNA, 19 nt, Homo sapiens
cuggguagguugcagaaga

SEQ ID NO: 1330246 - RNA, 19 nt, Homo sapiens
cagcagggaugugguugug

SEQ ID NO: 1330247 - RNA, 19 nt, Homo sapiens
cggcuggagugcccaauuc

SEQ ID NO: 1330248 - RNA, 19 nt, Homo sapiens
ucacaccaaccucuacuug

SEQ ID NO: 1330249 - RNA, 19 nt, Homo sapiens
gcgagaagccauugaugag

SEQ ID NO: 1330250 - RNA, 19 nt, Homo sapiens
ccucaugacuaacaaccau

SEQ ID NO: 1330251 - RNA, 19 nt, Homo sapiens
gugaggacgucuucgacau

SEQ ID NO: 1330252 - RNA, 19 nt, Homo sapiens
aucgagagguucugcauga

SEQ ID NO: 1330253 - RNA, 19 nt, Homo sapiens
caacaguaucaaccacuau

SEQ ID NO: 1330254 - RNA, 19 nt, Homo sapiens
acaucguccucaugacuaa

SEQ ID NO: 1330255 - RNA, 19 nt, Homo sapiens
uggguagguugcagaagaa

SEQ ID NO: 1330256 - RNA, 19 nt, Homo sapiens
gauccgcccacacaucuuc

SEQ ID NO: 1330257 - RNA, 19 nt, Homo sapiens
cuucuuugaugaccagaug

SEQ ID NO: 1330258 - RNA, 19 nt, Homo sapiens
caagaagaaacccaaaucg

SEQ ID NO: 1330259 - RNA, 19 nt, Homo sapiens
ugagaaggcccacgagaac

SEQ ID NO: 1330260 - RNA, 19 nt, Homo sapiens
gcccaagccucagaaugca

SEQ ID NO: 1330261 - RNA, 19 nt, Homo sapiens
acgaggagcagcagaucua

SEQ ID NO: 1330262 - RNA, 19 nt, Homo sapiens
gggaggaagccaagauuuu

SEQ ID NO: 1330263 - RNA, 19 nt, Homo sapiens
agacagaugaagccuuguu

SEQ ID NO: 1330264 - RNA, 19 nt, Homo sapiens
cuggagugcccaauucgua

SEQ ID NO: 1330265 - RNA, 19 nt, Homo sapiens
gagcuguacccugauagug

SEQ ID NO: 1330266 - RNA, 19 nt, Homo sapiens
gcagucaccaucgcugugu

SEQ ID NO: 1330267 - RNA, 19 nt, Homo sapiens
ggacgaggagcagcagauc

SEQ ID NO: 1330268 - RNA, 19 nt, Homo sapiens
agaaggcccacgagaacaa

SEQ ID NO: 1330269 - RNA, 19 nt, Homo sapiens
gagaaggcccacgagaaca

SEQ ID NO: 1330270 - RNA, 19 nt, Homo sapiens
ggaccgauucuucgagcau

SEQ ID NO: 1330271 - RNA, 19 nt, Homo sapiens
cgacaucguccucaugacu

SEQ ID NO: 1330272 - RNA, 19 nt, Homo sapiens
gcccaauucguaccuacuu

SEQ ID NO: 1330273 - RNA, 19 nt, Homo sapiens
uggaggcacuggguagguu

SEQ ID NO: 1330274 - RNA, 19 nt, Homo sapiens
gcagcugccaccaucuuca

SEQ ID NO: 1330275 - RNA, 19 nt, Homo sapiens
gguguccgccucaucaaca

SEQ ID NO: 1330276 - RNA, 19 nt, Homo sapiens
caugagaacgaacccuuca

SEQ ID NO: 1330277 - RNA, 19 nt, Homo sapiens
cccaauucguaccuacuug

SEQ ID NO: 1330278 - RNA, 19 nt, Homo sapiens
cuaacaaccaugcucaagu

SEQ ID NO: 1330279 - RNA, 19 nt, Homo sapiens
gggccagccuucccuuuug

SEQ ID NO: 1330280 - RNA, 19 nt, Homo sapiens
gacagaugaagccuuguuc

SEQ ID NO: 1330281 - RNA, 19 nt, Homo sapiens
ugcgagaagccauugauga

SEQ ID NO: 1330282 - RNA, 19 nt, Homo sapiens
ggagcuguacccugauagu

SEQ ID NO: 1330283 - RNA, 19 nt, Homo sapiens
ugagaacgaacccuucagu

SEQ ID NO: 1330284 - RNA, 19 nt, Homo sapiens
gaucagagaccguuccuaa

SEQ ID NO: 1330285 - RNA, 19 nt, Homo sapiens
gaagaugacugaguucuag

SEQ ID NO: 1330286 - RNA, 19 nt, Homo sapiens
gcaaggacauuaaagugau

SEQ ID NO: 1330287 - RNA, 19 nt, Homo sapiens
caagaugggcuaugaguuu

SEQ ID NO: 1330288 - RNA, 19 nt, Homo sapiens
acaagaagaugacugaguu

SEQ ID NO: 1330289 - RNA, 19 nt, Homo sapiens
ucaccaagaugggcuauga

SEQ ID NO: 1330290 - RNA, 19 nt, Homo sapiens
ggacaacggcuacuacaca

SEQ ID NO: 1330291 - RNA, 19 nt, Homo sapiens
ccaggaagaugcugaguac

SEQ ID NO: 1330292 - RNA, 19 nt, Homo sapiens
caaggacauuaaagugauu

SEQ ID NO: 1330293 - RNA, 19 nt, Homo sapiens
gcagacacccacaagaaga

SEQ ID NO: 1330294 - RNA, 19 nt, Homo sapiens
gccagugucuugggcauuu

SEQ ID NO: 1330295 - RNA, 19 nt, Homo sapiens
cuacuacacagucaaguuu

SEQ ID NO: 1330296 - RNA, 19 nt, Homo sapiens
ggcaaggacauuaaaguga

SEQ ID NO: 1330297 - RNA, 19 nt, Homo sapiens
ggaggagcaaggacaugua

SEQ ID NO: 1330298 - RNA, 19 nt, Homo sapiens
gcuccagacuccucaccaa

SEQ ID NO: 1330299 - RNA, 19 nt, Homo sapiens
ucagagaccguuccuaaag

SEQ ID NO: 1330300 - RNA, 19 nt, Homo sapiens
gcaaggcuggcaccaacaa

SEQ ID NO: 1330301 - RNA, 19 nt, Homo sapiens
ccagacuccucaccaagau

SEQ ID NO: 1330302 - RNA, 19 nt, Homo sapiens
gaggugcacacgcgaggua

SEQ ID NO: 1330303 - RNA, 19 nt, Homo sapiens
gaaggcagacacccacaag

SEQ ID NO: 1330304 - RNA, 19 nt, Homo sapiens
cauccaugcugugguguug

SEQ ID NO: 1330305 - RNA, 19 nt, Homo sapiens
gccaggaagaugcugagua

SEQ ID NO: 1330306 - RNA, 19 nt, Homo sapiens
gcuacuacacagucaaguu

SEQ ID NO: 1330307 - RNA, 19 nt, Homo sapiens
ggacauuaaagugauuuca

SEQ ID NO: 1330308 - RNA, 19 nt, Homo sapiens
cacaagcacuauggacgaa

SEQ ID NO: 1330309 - RNA, 19 nt, Homo sapiens
aagaugggcuaugaguuug

SEQ ID NO: 1330310 - RNA, 19 nt, Homo sapiens
ggaaggcagacacccacaa

SEQ ID NO: 1330311 - RNA, 19 nt, Homo sapiens
guacgggugacuccagcua

SEQ ID NO: 1330312 - RNA, 19 nt, Homo sapiens
gaacccagcgggacaucag

SEQ ID NO: 1330313 - RNA, 19 nt, Homo sapiens
aggcagacacccacaagaa

SEQ ID NO: 1330314 - RNA, 19 nt, Homo sapiens
uggagacccugcagaagca

SEQ ID NO: 1330315 - RNA, 19 nt, Homo sapiens
gcagguggucucucuggau

SEQ ID NO: 1330316 - RNA, 19 nt, Homo sapiens
gagcugagugggacaaagg

SEQ ID NO: 1330317 - RNA, 19 nt, Homo sapiens
gaagagcugagugggacaa

SEQ ID NO: 1330318 - RNA, 19 nt, Homo sapiens
ggagcaaggacauguacca

SEQ ID NO: 1330319 - RNA, 19 nt, Homo sapiens
ccaagaugggcuaugaguu

SEQ ID NO: 1330320 - RNA, 19 nt, Homo sapiens
cagagaccguuccuaaagc

SEQ ID NO: 1330321 - RNA, 19 nt, Homo sapiens
gaugacugaguucuagaga

SEQ ID NO: 1330322 - RNA, 19 nt, Homo sapiens
agagaccguuccuaaagca

SEQ ID NO: 1330323 - RNA, 19 nt, Homo sapiens
uccgugugcuuuaccugua

SEQ ID NO: 1330324 - RNA, 19 nt, Homo sapiens
gcccagcuccucggaaugu

SEQ ID NO: 1330325 - RNA, 19 nt, Homo sapiens
ggugcacacgcgagguaua

SEQ ID NO: 1330326 - RNA, 19 nt, Homo sapiens
uggcaaggacauuaaagug

SEQ ID NO: 1330327 - RNA, 19 nt, Homo sapiens
gagcagaggaaggcagaca

SEQ ID NO: 1330328 - RNA, 19 nt, Homo sapiens
agagggagaggacgaggaa

SEQ ID NO: 1330329 - RNA, 19 nt, Homo sapiens
ggaggaggagcaaggacau

SEQ ID NO: 1330330 - RNA, 19 nt, Homo sapiens
ggacgaggaagagcugagu

SEQ ID NO: 1330331 - RNA, 19 nt, Homo sapiens
ccacucacaagucucugaa

SEQ ID NO: 1330332 - RNA, 19 nt, Homo sapiens
caagaagaugacugaguuc

SEQ ID NO: 1330333 - RNA, 19 nt, Homo sapiens
agacugaggagaagaucga

SEQ ID NO: 1330334 - RNA, 19 nt, Homo sapiens
gaggagcaaggacauguac

SEQ ID NO: 1330335 - RNA, 19 nt, Homo sapiens
cugcgugucuggccaagca

SEQ ID NO: 1330336 - RNA, 19 nt, Homo sapiens
gcggguguccgugugcuuu

SEQ ID NO: 1330337 - RNA, 19 nt, Homo sapiens
ggaaauagauucucaugau

SEQ ID NO: 1330338 - RNA, 19 nt, Homo sapiens
gcagagaggugcacgugua

SEQ ID NO: 1330339 - RNA, 19 nt, Homo sapiens
caagauggguuugaacaua

SEQ ID NO: 1330340 - RNA, 19 nt, Homo sapiens
gaaauagauucucaugaug

SEQ ID NO: 1330341 - RNA, 19 nt, Homo sapiens
agaaggcgaugaaggauua

SEQ ID NO: 1330342 - RNA, 19 nt, Homo sapiens
agaaagauguugggaauaa

SEQ ID NO: 1330343 - RNA, 19 nt, Homo sapiens
gcacguguaugaauauauc

SEQ ID NO: 1330344 - RNA, 19 nt, Homo sapiens
gaacgucucuuccaaaaug

SEQ ID NO: 1330345 - RNA, 19 nt, Homo sapiens
gaaagauguugggaauaaa

SEQ ID NO: 1330346 - RNA, 19 nt, Homo sapiens
uggcagcucugggauauua

SEQ ID NO: 1330347 - RNA, 19 nt, Homo sapiens
ggagaacacuaaagagaag

SEQ ID NO: 1330348 - RNA, 19 nt, Homo sapiens
ugagaaagauguugggaau

SEQ ID NO: 1330349 - RNA, 19 nt, Homo sapiens
ccacccaucugcauuaaga

SEQ ID NO: 1330350 - RNA, 19 nt, Homo sapiens
gcacugcccugcaccaagu

SEQ ID NO: 1330351 - RNA, 19 nt, Homo sapiens
aagagaagauucaaccaaa

SEQ ID NO: 1330352 - RNA, 19 nt, Homo sapiens
agacggagcugugccacua

SEQ ID NO: 1330353 - RNA, 19 nt, Homo sapiens
gcgcaauccucaacucuuc

SEQ ID NO: 1330354 - RNA, 19 nt, Homo sapiens
aagauggguuugaacauaa

SEQ ID NO: 1330355 - RNA, 19 nt, Homo sapiens
gcgaggaaauagauucuca

SEQ ID NO: 1330356 - RNA, 19 nt, Homo sapiens
ggaggaugacgacuacuuu

SEQ ID NO: 1330357 - RNA, 19 nt, Homo sapiens
gagaggugcacguguauga

SEQ ID NO: 1330358 - RNA, 19 nt, Homo sapiens
ccuguucacuccauauauu

SEQ ID NO: 1330359 - RNA, 19 nt, Homo sapiens
gagaaggagccacguguug

SEQ ID NO: 1330360 - RNA, 19 nt, Homo sapiens
cuggagaccugcagaaaug

SEQ ID NO: 1330361 - RNA, 19 nt, Homo sapiens
caaccaaacccaccaucuu

SEQ ID NO: 1330362 - RNA, 19 nt, Homo sapiens
ccauauuccgcaaaucuua

SEQ ID NO: 1330363 - RNA, 19 nt, Homo sapiens
ccauacgcaucauuaauuc

SEQ ID NO: 1330364 - RNA, 19 nt, Homo sapiens
aaaccacacuugaagcaau

SEQ ID NO: 1330365 - RNA, 19 nt, Homo sapiens
ccacccagccgguuccuuu

SEQ ID NO: 1330366 - RNA, 19 nt, Homo sapiens
caggagaacacuaaagaga

SEQ ID NO: 1330367 - RNA, 19 nt, Homo sapiens
caucauuaauucgcagauu

SEQ ID NO: 1330368 - RNA, 19 nt, Homo sapiens
ggaggcgggugaagaagag

SEQ ID NO: 1330369 - RNA, 19 nt, Homo sapiens
gcaauggagacaacgaaug

SEQ ID NO: 1330370 - RNA, 19 nt, Homo sapiens
gagaaagauguugggaaua

SEQ ID NO: 1330371 - RNA, 19 nt, Homo sapiens
agauuuaacucugcuccua

SEQ ID NO: 1330372 - RNA, 19 nt, Homo sapiens
gaaggagccacguguugga

SEQ ID NO: 1330373 - RNA, 19 nt, Homo sapiens
guacugugcagguucauuc

SEQ ID NO: 1330374 - RNA, 19 nt, Homo sapiens
uauggcagcucugggauau

SEQ ID NO: 1330375 - RNA, 19 nt, Homo sapiens
gaggaaauagauucucaug

SEQ ID NO: 1330376 - RNA, 19 nt, Homo sapiens
gugcacguguaugaauaua

SEQ ID NO: 1330377 - RNA, 19 nt, Homo sapiens
gaacacuaaagagaagauu

SEQ ID NO: 1330378 - RNA, 19 nt, Homo sapiens
ucacuucauugacaguuca

SEQ ID NO: 1330379 - RNA, 19 nt, Homo sapiens
gguuugaacauaaagaguu

SEQ ID NO: 1330380 - RNA, 19 nt, Homo sapiens
guaccacccacuacucuau

SEQ ID NO: 1330381 - RNA, 19 nt, Homo sapiens
aaagagaagauucaaccaa

SEQ ID NO: 1330382 - RNA, 19 nt, Homo sapiens
gcaccaaguccagucauuc

SEQ ID NO: 1330383 - RNA, 19 nt, Homo sapiens
guauaaagacgucauuuug

SEQ ID NO: 1330384 - RNA, 19 nt, Homo sapiens
gccaugaaaccacacuuga

SEQ ID NO: 1330385 - RNA, 19 nt, Homo sapiens
gaaacccaaaucagccauu

SEQ ID NO: 1330386 - RNA, 19 nt, Homo sapiens
ccaccauacgcaucauuaa

SEQ ID NO: 1330387 - RNA, 19 nt, Homo sapiens
gaggugcacguguaugaau

SEQ ID NO: 1330388 - RNA, 19 nt, Homo sapiens
gaaaccacacuugaagcaa

SEQ ID NO: 1330389 - RNA, 19 nt, Homo sapiens
cauauuccgcaaaucuuaa

SEQ ID NO: 1330390 - RNA, 19 nt, Homo sapiens
ccaugaaaccacacuugaa

SEQ ID NO: 1330391 - RNA, 19 nt, Homo sapiens
gaugcgguuuugagauuua

SEQ ID NO: 1330392 - RNA, 19 nt, Homo sapiens
acacuaaagagaagauuca

SEQ ID NO: 1330393 - RNA, 19 nt, Homo sapiens
caugaaaccacacuugaag

SEQ ID NO: 1330394 - RNA, 19 nt, Homo sapiens
caaaucuuaaccuguggua

SEQ ID NO: 1330395 - RNA, 19 nt, Homo sapiens
agauggguuugaacauaaa

SEQ ID NO: 1330396 - RNA, 19 nt, Homo sapiens
agccaucacuucauugaca

SEQ ID NO: 1330397 - RNA, 19 nt, Homo sapiens
uacacgugguuaugagaaa

SEQ ID NO: 1330398 - RNA, 19 nt, Homo sapiens
agaggaggcgggugaagaa

SEQ ID NO: 1330399 - RNA, 19 nt, Homo sapiens
gaagcaauggagacaacga

SEQ ID NO: 1330400 - RNA, 19 nt, Homo sapiens
ccagccaucacuucauuga

SEQ ID NO: 1330401 - RNA, 19 nt, Homo sapiens
accauacgcaucauuaauu

SEQ ID NO: 1330402 - RNA, 19 nt, Homo sapiens
aggugcacguguaugaaua

SEQ ID NO: 1330403 - RNA, 19 nt, Homo sapiens
gcagaaggcgaugaaggau

SEQ ID NO: 1330404 - RNA, 19 nt, Homo sapiens
accacgagcuguacuacga

SEQ ID NO: 1330405 - RNA, 19 nt, Homo sapiens
cgucagagaaacccaaauc

SEQ ID NO: 1330406 - RNA, 19 nt, Homo sapiens
aaucuuaaccugugguaca

SEQ ID NO: 1330407 - RNA, 19 nt, Homo sapiens
caccauacgcaucauuaau

SEQ ID NO: 1330408 - RNA, 19 nt, Homo sapiens
caauggagacaacgaaugc

SEQ ID NO: 1330409 - RNA, 19 nt, Homo sapiens
cagaaggcgaugaaggauu

SEQ ID NO: 1330410 - RNA, 19 nt, Homo sapiens
aaccacacuugaagcaaug

SEQ ID NO: 1330411 - RNA, 19 nt, Homo sapiens
ugaaaccacacuugaagca

SEQ ID NO: 1330412 - RNA, 19 nt, Homo sapiens
acaaccuguucacuccaua

SEQ ID NO: 1330413 - RNA, 19 nt, Homo sapiens
gccacuaccacgagcugua

SEQ ID NO: 1330414 - RNA, 19 nt, Homo sapiens
ggagacaacgaaugcuuuu

SEQ ID NO: 1330415 - RNA, 19 nt, Homo sapiens
cagaggaggcgggugaaga

SEQ ID NO: 1330416 - RNA, 19 nt, Homo sapiens
aaccaaacccaccaucuuc

SEQ ID NO: 1330417 - RNA, 19 nt, Homo sapiens
agagaagauucaaccaaac

SEQ ID NO: 1330418 - RNA, 19 nt, Homo sapiens
aggagaacacuaaagagaa

SEQ ID NO: 1330419 - RNA, 19 nt, Homo sapiens
ccaucugcauuaagacaca

SEQ ID NO: 1330420 - RNA, 19 nt, Homo sapiens
ccagccgguuccuuucaug

SEQ ID NO: 1330421 - RNA, 19 nt, Homo sapiens
uccaggagaacacuaaaga

SEQ ID NO: 1330422 - RNA, 19 nt, Homo sapiens
caaccuguucacuccauau

SEQ ID NO: 1330423 - RNA, 19 nt, Homo sapiens
uggagacaacgaaugcuuu

SEQ ID NO: 1330424 - RNA, 19 nt, Homo sapiens
cugccacccaucugcauua

SEQ ID NO: 1330425 - RNA, 19 nt, Homo sapiens
ggugcacguguaugaauau

SEQ ID NO: 1330426 - RNA, 19 nt, Homo sapiens
aaucagccauuuuacauuc

SEQ ID NO: 1330427 - RNA, 19 nt, Homo sapiens
cuacacgugguuaugagaa

SEQ ID NO: 1330428 - RNA, 19 nt, Homo sapiens
gcagggaccucucaaguua

SEQ ID NO: 1330429 - RNA, 19 nt, Homo sapiens
gagcaagguucggaaauga

SEQ ID NO: 1330430 - RNA, 19 nt, Homo sapiens
gaaugaaggccaagucuau

SEQ ID NO: 1330431 - RNA, 19 nt, Homo sapiens
ucaagcagcugaugaugga

SEQ ID NO: 1330432 - RNA, 19 nt, Homo sapiens
ggagcaagguucggaaaug

SEQ ID NO: 1330433 - RNA, 19 nt, Homo sapiens
ucucaaagguguuguguca

SEQ ID NO: 1330434 - RNA, 19 nt, Homo sapiens
agacgucggucaccauuga

SEQ ID NO: 1330435 - RNA, 19 nt, Homo sapiens
ggacaaguuucggagaaug

SEQ ID NO: 1330436 - RNA, 19 nt, Homo sapiens
ggacuacacguacuucuca

SEQ ID NO: 1330437 - RNA, 19 nt, Homo sapiens
ucaaagaagaggagaaaga

SEQ ID NO: 1330438 - RNA, 19 nt, Homo sapiens
ggacaacgucgucacuuuc

SEQ ID NO: 1330439 - RNA, 19 nt, Homo sapiens
gcaagacgaugcgguguac

SEQ ID NO: 1330440 - RNA, 19 nt, Homo sapiens
ggagugguccugagcaaug

SEQ ID NO: 1330441 - RNA, 19 nt, Homo sapiens
gagaagggccagaucaagu

SEQ ID NO: 1330442 - RNA, 19 nt, Homo sapiens
caagcaggauggcuaugug

SEQ ID NO: 1330443 - RNA, 19 nt, Homo sapiens
gaaagggagaggucaucaa

SEQ ID NO: 1330444 - RNA, 19 nt, Homo sapiens
ggccaagucuauuccuuca

SEQ ID NO: 1330445 - RNA, 19 nt, Homo sapiens
ucaaagagcaccacucaac

SEQ ID NO: 1330446 - RNA, 19 nt, Homo sapiens
gcuauacgguggagaccau

SEQ ID NO: 1330447 - RNA, 19 nt, Homo sapiens
gagugguccugagcaauga

SEQ ID NO: 1330448 - RNA, 19 nt, Homo sapiens
ggagacgucggucaccauu

SEQ ID NO: 1330449 - RNA, 19 nt, Homo sapiens
gcaagcaggauggcuaugu

SEQ ID NO: 1330450 - RNA, 19 nt, Homo sapiens
aagaagaggagaaagaguu

SEQ ID NO: 1330451 - RNA, 19 nt, Homo sapiens
agaagacccugacccucaa

SEQ ID NO: 1330452 - RNA, 19 nt, Homo sapiens
aggacaacgucgucacuuu

SEQ ID NO: 1330453 - RNA, 19 nt, Homo sapiens
agggagaggucaucaaugg

SEQ ID NO: 1330454 - RNA, 19 nt, Homo sapiens
aaggacaaguuucggagaa

SEQ ID NO: 1330455 - RNA, 19 nt, Homo sapiens
ggauggcuaugugcaguuc

SEQ ID NO: 1330456 - RNA, 19 nt, Homo sapiens
gacaaguuucggagaauga

SEQ ID NO: 1330457 - RNA, 19 nt, Homo sapiens
caaagaagaggagaaagag

SEQ ID NO: 1330458 - RNA, 19 nt, Homo sapiens
gauauccgaguggaaauug

SEQ ID NO: 1330459 - RNA, 19 nt, Homo sapiens
cagagcccgucuccuguga

SEQ ID NO: 1330460 - RNA, 19 nt, Homo sapiens
ggcagggaccucucaaguu

SEQ ID NO: 1330461 - RNA, 19 nt, Homo sapiens
agaagaggagaaagaguuu

SEQ ID NO: 1330462 - RNA, 19 nt, Homo sapiens
aaagggagaggucaucaau

SEQ ID NO: 1330463 - RNA, 19 nt, Homo sapiens
gcaagguucggaaaugaag

SEQ ID NO: 1330464 - RNA, 19 nt, Homo sapiens
cagccuccaucaucugguu

SEQ ID NO: 1330465 - RNA, 19 nt, Homo sapiens
gcgagaagggccagaucaa

SEQ ID NO: 1330466 - RNA, 19 nt, Homo sapiens
gggcagggaccucucaagu

SEQ ID NO: 1330467 - RNA, 19 nt, Homo sapiens
ugaaugaaggccaagucua

SEQ ID NO: 1330468 - RNA, 19 nt, Homo sapiens
ggcauguccuucaccaaca

SEQ ID NO: 1330469 - RNA, 19 nt, Homo sapiens
gcucuucgucugcuucuuc

SEQ ID NO: 1330470 - RNA, 19 nt, Homo sapiens
cgucaacaccuucaaagag

SEQ ID NO: 1330471 - RNA, 19 nt, Homo sapiens
aaugauauccgaguggaaa

SEQ ID NO: 1330472 - RNA, 19 nt, Homo sapiens
acccagcugucacccagua

SEQ ID NO: 1330473 - RNA, 19 nt, Homo sapiens
gcuaugugcaguucgacaa

SEQ ID NO: 1330474 - RNA, 19 nt, Homo sapiens
ccacaggcauguccuucac

SEQ ID NO: 1330475 - RNA, 19 nt, Homo sapiens
ccagcucgaucugcucuuc

SEQ ID NO: 1330476 - RNA, 19 nt, Homo sapiens
gaagacccugacccucaaa

SEQ ID NO: 1330477 - RNA, 19 nt, Homo sapiens
gcacgguugacgucuacuu

SEQ ID NO: 1330478 - RNA, 19 nt, Homo sapiens
gguagggaaccaccuguca

SEQ ID NO: 1330479 - RNA, 19 nt, Homo sapiens
cuucaaagagcaccacuca

SEQ ID NO: 1330480 - RNA, 19 nt, Homo sapiens
ccacagaaccccaauccuu

SEQ ID NO: 1330481 - RNA, 19 nt, Homo sapiens
gggagcaccaccugaagau

SEQ ID NO: 1330482 - RNA, 19 nt, Homo sapiens
cgucagcacccucuucauc

SEQ ID NO: 1330483 - RNA, 19 nt, Homo sapiens
cagcgucaacaccuucaaa

SEQ ID NO: 1330484 - RNA, 19 nt, Homo sapiens
ugaauuccagcaagacuca

SEQ ID NO: 1330485 - RNA, 19 nt, Homo sapiens
gcuucuuccucuucaguca

SEQ ID NO: 1330486 - RNA, 19 nt, Homo sapiens
gcgucaacaccuucaaaga

SEQ ID NO: 1330487 - RNA, 19 nt, Homo sapiens
agaaaucucaaagguguug

SEQ ID NO: 1330488 - RNA, 19 nt, Homo sapiens
ggccagaucaagugcuuca

SEQ ID NO: 1330489 - RNA, 19 nt, Homo sapiens
agaagggccagaucaagug

SEQ ID NO: 1330490 - RNA, 19 nt, Homo sapiens
cgacuacgggcagcgguuu

SEQ ID NO: 1330491 - RNA, 19 nt, Homo sapiens
caaccaucguggcguucug

SEQ ID NO: 1330492 - RNA, 19 nt, Homo sapiens
ccagaucaagugcuucauc

SEQ ID NO: 1330493 - RNA, 19 nt, Homo sapiens
ucguggaucugggcucuga

SEQ ID NO: 1330494 - RNA, 19 nt, Homo sapiens
gccgcacgguugacgucua

SEQ ID NO: 1330495 - RNA, 19 nt, Homo sapiens
caaguuacccacaguaccu

SEQ ID NO: 1330496 - RNA, 19 nt, Homo sapiens
gaggacaacgucgucacuu

SEQ ID NO: 1330497 - RNA, 19 nt, Homo sapiens
ccggagugguccugagcaa

SEQ ID NO: 1330498 - RNA, 19 nt, Homo sapiens
cuggugacguggagaaugg

SEQ ID NO: 1330499 - RNA, 19 nt, Homo sapiens
gggagaaccucuacaagua

SEQ ID NO: 1330500 - RNA, 19 nt, Homo sapiens
cggcagagcuggaugauga

SEQ ID NO: 1330501 - RNA, 19 nt, Homo sapiens
gcaagugcaagaagaauuu

SEQ ID NO: 1330502 - RNA, 19 nt, Homo sapiens
gaugagaacgucugcauug

SEQ ID NO: 1330503 - RNA, 19 nt, Homo sapiens
ccaagggccucaaggaguu

SEQ ID NO: 1330504 - RNA, 19 nt, Homo sapiens
gagaacgucugcauugagu

SEQ ID NO: 1330505 - RNA, 19 nt, Homo sapiens
gagaaucccuaccuaugca

SEQ ID NO: 1330506 - RNA, 19 nt, Homo sapiens
gaagccaacaucacccuuu

SEQ ID NO: 1330507 - RNA, 19 nt, Homo sapiens
gaaacuucguucuguagag

SEQ ID NO: 1330508 - RNA, 19 nt, Homo sapiens
gaacgucugcauugagugu

SEQ ID NO: 1330509 - RNA, 19 nt, Homo sapiens
aaacuucguucuguagaga

SEQ ID NO: 1330510 - RNA, 19 nt, Homo sapiens
gcauggaggccuucgguau

SEQ ID NO: 1330511 - RNA, 19 nt, Homo sapiens
ggacuaugacaucugcaaa

SEQ ID NO: 1330512 - RNA, 19 nt, Homo sapiens
caacauggacaaccucuac

SEQ ID NO: 1330513 - RNA, 19 nt, Homo sapiens
ccaugagaaucccuaccua

SEQ ID NO: 1330514 - RNA, 19 nt, Homo sapiens
ggaccgcuucgccaucuuu

SEQ ID NO: 1330515 - RNA, 19 nt, Homo sapiens
ggaaacuucguucuguaga

SEQ ID NO: 1330516 - RNA, 19 nt, Homo sapiens
gaccuccaguugccuacaa

SEQ ID NO: 1330517 - RNA, 19 nt, Homo sapiens
gagaauccgaggaguaaag

SEQ ID NO: 1330518 - RNA, 19 nt, Homo sapiens
gagaaccucuacaaguacu

SEQ ID NO: 1330519 - RNA, 19 nt, Homo sapiens
gccagagggucgggagaaa

SEQ ID NO: 1330520 - RNA, 19 nt, Homo sapiens
cuggaaacuucguucugua

SEQ ID NO: 1330521 - RNA, 19 nt, Homo sapiens
ccuggaaacuucguucugu

SEQ ID NO: 1330522 - RNA, 19 nt, Homo sapiens
uggagaauccgaggaguaa

SEQ ID NO: 1330523 - RNA, 19 nt, Homo sapiens
gcauugaguguaacugcaa

SEQ ID NO: 1330524 - RNA, 19 nt, Homo sapiens
cuacauugacuuccugaau

SEQ ID NO: 1330525 - RNA, 19 nt, Homo sapiens
ggagaaccucuacaaguac

SEQ ID NO: 1330526 - RNA, 19 nt, Homo sapiens
ugaugcgccugaaggacua

SEQ ID NO: 1330527 - RNA, 19 nt, Homo sapiens
guggagaauccgaggagua

SEQ ID NO: 1330528 - RNA, 19 nt, Homo sapiens
ggugaugaccuucgaguac

SEQ ID NO: 1330529 - RNA, 19 nt, Homo sapiens
aauccugggugaccacaga

SEQ ID NO: 1330530 - RNA, 19 nt, Homo sapiens
gcagcuacauugacuuccu

SEQ ID NO: 1330531 - RNA, 19 nt, Homo sapiens
ggcaagugcaagaagaauu

SEQ ID NO: 1330532 - RNA, 19 nt, Homo sapiens
gaaccucuacaaguacuuc

SEQ ID NO: 1330533 - RNA, 19 nt, Homo sapiens
guggagcccucaggcauca

SEQ ID NO: 1330534 - RNA, 19 nt, Homo sapiens
caaccgcugcagcuacauu

SEQ ID NO: 1330535 - RNA, 19 nt, Homo sapiens
caugagaaucccuaccuau

SEQ ID NO: 1330536 - RNA, 19 nt, Homo sapiens
uccgaggaguaaagaguuu

SEQ ID NO: 1330537 - RNA, 19 nt, Homo sapiens
ccaaggugaugcgccugaa

SEQ ID NO: 1330538 - RNA, 19 nt, Homo sapiens
ccaguugccuacaauucca

SEQ ID NO: 1330539 - RNA, 19 nt, Homo sapiens
cgggagaaccucuacaagu

SEQ ID NO: 1330540 - RNA, 19 nt, Homo sapiens
gcaacauggacaaccucua

SEQ ID NO: 1330541 - RNA, 19 nt, Homo sapiens
acaucacccuuucguggaa

SEQ ID NO: 1330542 - RNA, 19 nt, Homo sapiens
acuaugacaucugcaaauc

SEQ ID NO: 1330543 - RNA, 19 nt, Homo sapiens
gaggugcucccaggugcua

SEQ ID NO: 1330544 - RNA, 19 nt, Homo sapiens
gcagguuccuuuggcaacu

SEQ ID NO: 1330545 - RNA, 19 nt, Homo sapiens
gacuaugacaucugcaaau

SEQ ID NO: 1330546 - RNA, 19 nt, Homo sapiens
cauggaggccuucgguaug

SEQ ID NO: 1330547 - RNA, 19 nt, Homo sapiens
aagccaacaucacccuuuc

SEQ ID NO: 1330548 - RNA, 19 nt, Homo sapiens
gggcaggcuccaagaagga

SEQ ID NO: 1330549 - RNA, 19 nt, Homo sapiens
gcaacgagaccggcuucug

SEQ ID NO: 1330550 - RNA, 19 nt, Homo sapiens
uaugacaucugcaaauccu

SEQ ID NO: 1330551 - RNA, 19 nt, Homo sapiens
guguaacugcaaccagaua

SEQ ID NO: 1330552 - RNA, 19 nt, Homo sapiens
ucgcugacuugguccuguu

SEQ ID NO: 1330553 - RNA, 19 nt, Homo sapiens
gcggcaagugcaagaagaa

SEQ ID NO: 1330554 - RNA, 19 nt, Homo sapiens
ccugcgauuugguuucguu

SEQ ID NO: 1330555 - RNA, 19 nt, Homo sapiens
augagaacgucugcauuga

SEQ ID NO: 1330556 - RNA, 19 nt, Homo sapiens
ucaugguccuggagaaguc

SEQ ID NO: 1330557 - RNA, 19 nt, Homo sapiens
gcacagcacuggugaagaa

SEQ ID NO: 1330558 - RNA, 19 nt, Homo sapiens
ggaccaagcugaagcacua

SEQ ID NO: 1330559 - RNA, 19 nt, Homo sapiens
ucaguucucuccaauauua

SEQ ID NO: 1330560 - RNA, 19 nt, Homo sapiens
caucaucucuuauccaaua

SEQ ID NO: 1330561 - RNA, 19 nt, Homo sapiens
uaacacagguugaaacauu

SEQ ID NO: 1330562 - RNA, 19 nt, Homo sapiens
gauagggucuccuguauug

SEQ ID NO: 1330563 - RNA, 19 nt, Homo sapiens
gaaaggagcaaguuagaaa

SEQ ID NO: 1330564 - RNA, 19 nt, Homo sapiens
ccaaagacgucaagaagaa

SEQ ID NO: 1330565 - RNA, 19 nt, Homo sapiens
gcauugacaucaucuguaa

SEQ ID NO: 1330566 - RNA, 19 nt, Homo sapiens
gcacuaaucccacuaaguu

SEQ ID NO: 1330567 - RNA, 19 nt, Homo sapiens
gaugaggaguacauuuaua

SEQ ID NO: 1330568 - RNA, 19 nt, Homo sapiens
ucucagagcccaacacuua

SEQ ID NO: 1330569 - RNA, 19 nt, Homo sapiens
uaaagacucucaugucaau

SEQ ID NO: 1330570 - RNA, 19 nt, Homo sapiens
gaaagggugagucuguuua

SEQ ID NO: 1330571 - RNA, 19 nt, Homo sapiens
gaugagcccugcauaaagu

SEQ ID NO: 1330572 - RNA, 19 nt, Homo sapiens
gaaaugcacagacaaggaa

SEQ ID NO: 1330573 - RNA, 19 nt, Homo sapiens
gcagaugacccaaaugaga

SEQ ID NO: 1330574 - RNA, 19 nt, Homo sapiens
gaagaaaggagcaaguuag

SEQ ID NO: 1330575 - RNA, 19 nt, Homo sapiens
ugacagaguuggaugacuu

SEQ ID NO: 1330576 - RNA, 19 nt, Homo sapiens
aaacugagcaaccuaauga

SEQ ID NO: 1330577 - RNA, 19 nt, Homo sapiens
uauuaucucugccucauuu

SEQ ID NO: 1330578 - RNA, 19 nt, Homo sapiens
guaaaaccaucaucuguaa

SEQ ID NO: 1330579 - RNA, 19 nt, Homo sapiens
gaaaacaagcuucaucuaa

SEQ ID NO: 1330580 - RNA, 19 nt, Homo sapiens
gagcagaagcugaaggaaa

SEQ ID NO: 1330581 - RNA, 19 nt, Homo sapiens
ggacagaagcugaggugaa

SEQ ID NO: 1330582 - RNA, 19 nt, Homo sapiens
caaaugagagagaaucuga

SEQ ID NO: 1330583 - RNA, 19 nt, Homo sapiens
acaaucaccugcacuucua

SEQ ID NO: 1330584 - RNA, 19 nt, Homo sapiens
uuagggauguucuguguuu

SEQ ID NO: 1330585 - RNA, 19 nt, Homo sapiens
gaugaaugccgaugugauu

SEQ ID NO: 1330586 - RNA, 19 nt, Homo sapiens
aaaggaaacccuacugaaa

SEQ ID NO: 1330587 - RNA, 19 nt, Homo sapiens
gagaaucaccaccgucaaa

SEQ ID NO: 1330588 - RNA, 19 nt, Homo sapiens
cagaagaguucaccuacga

SEQ ID NO: 1330589 - RNA, 19 nt, Homo sapiens
gaaggagcaucugaaggaa

SEQ ID NO: 1330590 - RNA, 19 nt, Homo sapiens
cgaaggagcaucugaagga

SEQ ID NO: 1330591 - RNA, 19 nt, Homo sapiens
gugagucuguuuagaagaa

SEQ ID NO: 1330592 - RNA, 19 nt, Homo sapiens
ucuaaagacucucauguca

SEQ ID NO: 1330593 - RNA, 19 nt, Homo sapiens
aaacaagcuucaucuaaag

SEQ ID NO: 1330594 - RNA, 19 nt, Homo sapiens
gaggaguacauuuauauga

SEQ ID NO: 1330595 - RNA, 19 nt, Homo sapiens
ccaacucagucuucaguga

SEQ ID NO: 1330596 - RNA, 19 nt, Homo sapiens
cuaagucuauuggauguaa

SEQ ID NO: 1330597 - RNA, 19 nt, Homo sapiens
gacagaagcugaggugaag

SEQ ID NO: 1330598 - RNA, 19 nt, Homo sapiens
ccagagggcuacuaugaag

SEQ ID NO: 1330599 - RNA, 19 nt, Homo sapiens
guucuguguuucuuucuuu

SEQ ID NO: 1330600 - RNA, 19 nt, Homo sapiens
gauguucuguguuucuuuc

SEQ ID NO: 1330601 - RNA, 19 nt, Homo sapiens
gaaacgggagcuaaaggaa

SEQ ID NO: 1330602 - RNA, 19 nt, Homo sapiens
gcccaacacuuacaucgau

SEQ ID NO: 1330603 - RNA, 19 nt, Homo sapiens
ggaggguuguguaucaguu

SEQ ID NO: 1330604 - RNA, 19 nt, Homo sapiens
gccaucaucucuuauccaa

SEQ ID NO: 1330605 - RNA, 19 nt, Homo sapiens
agacuuugguggaagauga

SEQ ID NO: 1330606 - RNA, 19 nt, Homo sapiens
agacugagguacugugaau

SEQ ID NO: 1330607 - RNA, 19 nt, Homo sapiens
gaagcacuaaucccacuaa

SEQ ID NO: 1330608 - RNA, 19 nt, Homo sapiens
gcacuguacuccagaaagc

SEQ ID NO: 1330609 - RNA, 19 nt, Homo sapiens
cuacugaaaugcacagaca

SEQ ID NO: 1330610 - RNA, 19 nt, Homo sapiens
gaggauccuucccugagaa

SEQ ID NO: 1330611 - RNA, 19 nt, Homo sapiens
uaaugaaucugggcaggaa

SEQ ID NO: 1330612 - RNA, 19 nt, Homo sapiens
aaacagcauugacaucauc

SEQ ID NO: 1330613 - RNA, 19 nt, Homo sapiens
cuucaguucucuccaauau

SEQ ID NO: 1330614 - RNA, 19 nt, Homo sapiens
cagaugagcccugcauaaa

SEQ ID NO: 1330615 - RNA, 19 nt, Homo sapiens
gagcacaagcugaagauca

SEQ ID NO: 1330616 - RNA, 19 nt, Homo sapiens
gcaacagaaugcagagucu

SEQ ID NO: 1330617 - RNA, 19 nt, Homo sapiens
uaucaguucucuaacacuu

SEQ ID NO: 1330618 - RNA, 19 nt, Homo sapiens
ugaacaaagugaccaucaa

SEQ ID NO: 1330619 - RNA, 19 nt, Homo sapiens
caaccacacucaagaacag

SEQ ID NO: 1330620 - RNA, 19 nt, Homo sapiens
uaaaggaaacccuacugaa

SEQ ID NO: 1330621 - RNA, 19 nt, Homo sapiens
gcucagcuccggaaagaga

SEQ ID NO: 1330622 - RNA, 19 nt, Homo sapiens
gagaaggagaggcuugaaa

SEQ ID NO: 1330623 - RNA, 19 nt, Homo sapiens
gcauaaaguguccagagaa

SEQ ID NO: 1330624 - RNA, 19 nt, Homo sapiens
ccagaugagcccugcauaa

SEQ ID NO: 1330625 - RNA, 19 nt, Homo sapiens
gcccucagcuggacgugaa

SEQ ID NO: 1330626 - RNA, 19 nt, Homo sapiens
cugaugaggaguacauuua

SEQ ID NO: 1330627 - RNA, 19 nt, Homo sapiens
gagaagaaaggagcaaguu

SEQ ID NO: 1330628 - RNA, 19 nt, Homo sapiens
ccgauagggucuccuguau

SEQ ID NO: 1330629 - RNA, 19 nt, Homo sapiens
gaagaucacaccgaugaau

SEQ ID NO: 1330630 - RNA, 19 nt, Homo sapiens
gaacaaagugaccaucaac

SEQ ID NO: 1330631 - RNA, 19 nt, Homo sapiens
gcgaaagggugagucuguu

SEQ ID NO: 1330632 - RNA, 19 nt, Homo sapiens
agaagaaaggagcaaguua

SEQ ID NO: 1330633 - RNA, 19 nt, Homo sapiens
ggaguacauuuauaugaac

SEQ ID NO: 1330634 - RNA, 19 nt, Homo sapiens
guacaaagcccuggaacag

SEQ ID NO: 1330635 - RNA, 19 nt, Homo sapiens
agauauagcugagaaguac

SEQ ID NO: 1330636 - RNA, 19 nt, Homo sapiens
ucauggaggugaaggacaa

SEQ ID NO: 1330637 - RNA, 19 nt, Homo sapiens
agcagaagcugaaggaaau

SEQ ID NO: 1330638 - RNA, 19 nt, Homo sapiens
gcagcagcgucauucacaa

SEQ ID NO: 1330639 - RNA, 19 nt, Homo sapiens
ugacaugaguuuugagaaa

SEQ ID NO: 1330640 - RNA, 19 nt, Homo sapiens
aggaaacccuacugaaaug

SEQ ID NO: 1330641 - RNA, 19 nt, Homo sapiens
agacagacccagaagaguu

SEQ ID NO: 1330642 - RNA, 19 nt, Homo sapiens
gucaucaauugcuuuacua

SEQ ID NO: 1330643 - RNA, 19 nt, Homo sapiens
cagagaaccugggagaaca

SEQ ID NO: 1330644 - RNA, 19 nt, Homo sapiens
gccaggaggagcuguauga

SEQ ID NO: 1330645 - RNA, 19 nt, Homo sapiens
ugagcaaccuaaugaaucu

SEQ ID NO: 1330646 - RNA, 19 nt, Homo sapiens
uaugacacaucccucaaug

SEQ ID NO: 1330647 - RNA, 19 nt, Homo sapiens
ccugagaacuaaaugucuu

SEQ ID NO: 1330648 - RNA, 19 nt, Homo sapiens
ugaaggacaaccugaagaa

SEQ ID NO: 1330649 - RNA, 19 nt, Homo sapiens
gaaagagaaacgggagcua

SEQ ID NO: 1330650 - RNA, 19 nt, Homo sapiens
caagacagacccagaagag

SEQ ID NO: 1330651 - RNA, 19 nt, Homo sapiens
cgaaagggugagucuguuu

SEQ ID NO: 1330652 - RNA, 19 nt, Homo sapiens
cauaaaguguccagagaac

SEQ ID NO: 1330653 - RNA, 19 nt, Homo sapiens
ucacaccugucaaguccuu

SEQ ID NO: 1330654 - RNA, 19 nt, Homo sapiens
ccugucggcuucagaguau

SEQ ID NO: 1330655 - RNA, 19 nt, Homo sapiens
ggaagaaggagcacaagcu

SEQ ID NO: 1330656 - RNA, 19 nt, Homo sapiens
gagaagcaagugcggaaga

SEQ ID NO: 1330657 - RNA, 19 nt, Homo sapiens
ggaacucgcuggucaucua

SEQ ID NO: 1330658 - RNA, 19 nt, Homo sapiens
ggacaacgccccucucuga

SEQ ID NO: 1330659 - RNA, 19 nt, Homo sapiens
gcugguacgugacgguguu

SEQ ID NO: 1330660 - RNA, 19 nt, Homo sapiens
ggaccgugaccaacuucua

SEQ ID NO: 1330661 - RNA, 19 nt, Homo sapiens
acaaccugcuggcgcugua

SEQ ID NO: 1330662 - RNA, 19 nt, Homo sapiens
gcucgugccgcucuucuuc

SEQ ID NO: 1330663 - RNA, 19 nt, Homo sapiens
cuuaagaccugggcucacu

SEQ ID NO: 1330664 - RNA, 19 nt, Homo sapiens
gaccgugaccaacuucuac

SEQ ID NO: 1330665 - RNA, 19 nt, Homo sapiens
gaacucgcuggucaucuac

SEQ ID NO: 1330666 - RNA, 19 nt, Homo sapiens
gcaaguacaucagaacaua

SEQ ID NO: 1330667 - RNA, 19 nt, Homo sapiens
gcauuacgauccacgauua

SEQ ID NO: 1330668 - RNA, 19 nt, Homo sapiens
ggaccuauuuggagcauua

SEQ ID NO: 1330669 - RNA, 19 nt, Homo sapiens
gaugauaccucuggcaaua

SEQ ID NO: 1330670 - RNA, 19 nt, Homo sapiens
gaagggugauucuaauauu

SEQ ID NO: 1330671 - RNA, 19 nt, Homo sapiens
gaagacggcuuucaagaca

SEQ ID NO: 1330672 - RNA, 19 nt, Homo sapiens
ggaauucacuucuucaaag

SEQ ID NO: 1330673 - RNA, 19 nt, Homo sapiens
cagaaagccuugaagauga

SEQ ID NO: 1330674 - RNA, 19 nt, Homo sapiens
gaaucaugccugcuaauua

SEQ ID NO: 1330675 - RNA, 19 nt, Homo sapiens
uaacuccgcuucugauugu

SEQ ID NO: 1330676 - RNA, 19 nt, Homo sapiens
caacacagcuuuucaguuc

SEQ ID NO: 1330677 - RNA, 19 nt, Homo sapiens
gcaaagauaguuucucuag

SEQ ID NO: 1330678 - RNA, 19 nt, Homo sapiens
gauccacgauuauugaugu

SEQ ID NO: 1330679 - RNA, 19 nt, Homo sapiens
aaucaugacuggccauuug

SEQ ID NO: 1330680 - RNA, 19 nt, Homo sapiens
gguauucuaugguuauaug

SEQ ID NO: 1330681 - RNA, 19 nt, Homo sapiens
caccaugacaccugaauua

SEQ ID NO: 1330682 - RNA, 19 nt, Homo sapiens
aaagauaguuucucuagag

SEQ ID NO: 1330683 - RNA, 19 nt, Homo sapiens
gaaaugcaaguacaucaga

SEQ ID NO: 1330684 - RNA, 19 nt, Homo sapiens
gagagaaucaugccugcua

SEQ ID NO: 1330685 - RNA, 19 nt, Homo sapiens
uaauuugcuuugcaccuua

SEQ ID NO: 1330686 - RNA, 19 nt, Homo sapiens
gcaauaggaccaaaugcuu

SEQ ID NO: 1330687 - RNA, 19 nt, Homo sapiens
gcagggguauuccuaauuu

SEQ ID NO: 1330688 - RNA, 19 nt, Homo sapiens
aaaacgagcugugauauuu

SEQ ID NO: 1330689 - RNA, 19 nt, Homo sapiens
caaagauaguuucucuaga

SEQ ID NO: 1330690 - RNA, 19 nt, Homo sapiens
gggaagaacuugcaaaaca

SEQ ID NO: 1330691 - RNA, 19 nt, Homo sapiens
ggugaaguccaaugaaauu

SEQ ID NO: 1330692 - RNA, 19 nt, Homo sapiens
ucaguucugcucuaucuua

SEQ ID NO: 1330693 - RNA, 19 nt, Homo sapiens
ccacgauuauugauguuga

SEQ ID NO: 1330694 - RNA, 19 nt, Homo sapiens
caccuuaucauuucaguuu

SEQ ID NO: 1330695 - RNA, 19 nt, Homo sapiens
caugacaccugaauuaugc

SEQ ID NO: 1330696 - RNA, 19 nt, Homo sapiens
caagacaagauuugcauga

SEQ ID NO: 1330697 - RNA, 19 nt, Homo sapiens
gaccugaaaugcaaguaca

SEQ ID NO: 1330698 - RNA, 19 nt, Homo sapiens
aaacagaaagccuugaaga

SEQ ID NO: 1330699 - RNA, 19 nt, Homo sapiens
caauaggaccaaaugcuuu

SEQ ID NO: 1330700 - RNA, 19 nt, Homo sapiens
guucuuuccuugccacuga

SEQ ID NO: 1330701 - RNA, 19 nt, Homo sapiens
ggaagaacuugcaaaacaa

SEQ ID NO: 1330702 - RNA, 19 nt, Homo sapiens
aaucaugccugcuaauuac

SEQ ID NO: 1330703 - RNA, 19 nt, Homo sapiens
gaucuucuacuacuugaau

SEQ ID NO: 1330704 - RNA, 19 nt, Homo sapiens
aaacgagcugugauauuua

SEQ ID NO: 1330705 - RNA, 19 nt, Homo sapiens
aaugugaccugaaaugcaa

SEQ ID NO: 1330706 - RNA, 19 nt, Homo sapiens
gcuuugcaccuuaucauuu

SEQ ID NO: 1330707 - RNA, 19 nt, Homo sapiens
gaugaccauuggcgaguug

SEQ ID NO: 1330708 - RNA, 19 nt, Homo sapiens
gagcugugauauuuaugau

SEQ ID NO: 1330709 - RNA, 19 nt, Homo sapiens
guuucuaccugaaguaugu

SEQ ID NO: 1330710 - RNA, 19 nt, Homo sapiens
agccauugcugacuuacua

SEQ ID NO: 1330711 - RNA, 19 nt, Homo sapiens
gggaauucacuucuucaaa

SEQ ID NO: 1330712 - RNA, 19 nt, Homo sapiens
acagaaagccuugaagaug

SEQ ID NO: 1330713 - RNA, 19 nt, Homo sapiens
gaggaucuucuacuacuug

SEQ ID NO: 1330714 - RNA, 19 nt, Homo sapiens
acaccugaauuaugcuaaa

SEQ ID NO: 1330715 - RNA, 19 nt, Homo sapiens
agagaaucaugccugcuaa

SEQ ID NO: 1330716 - RNA, 19 nt, Homo sapiens
gaaauaugaccuguacauc

SEQ ID NO: 1330717 - RNA, 19 nt, Homo sapiens
gaauucacuucuucaaagc

SEQ ID NO: 1330718 - RNA, 19 nt, Homo sapiens
ggucucauagggaauauau

SEQ ID NO: 1330719 - RNA, 19 nt, Homo sapiens
gaaugugaccugaaaugca

SEQ ID NO: 1330720 - RNA, 19 nt, Homo sapiens
aaauaugaccuguacauca

SEQ ID NO: 1330721 - RNA, 19 nt, Homo sapiens
agacaagauuugcaugaca

SEQ ID NO: 1330722 - RNA, 19 nt, Homo sapiens
cacugaggaucuucuacua

SEQ ID NO: 1330723 - RNA, 19 nt, Homo sapiens
cuucaaagcaggaccuauu

SEQ ID NO: 1330724 - RNA, 19 nt, Homo sapiens
guucugcucuaucuuacug

SEQ ID NO: 1330725 - RNA, 19 nt, Homo sapiens
agucugaauucaugucuug

SEQ ID NO: 1330726 - RNA, 19 nt, Homo sapiens
cuggugaaguccaaugaaa

SEQ ID NO: 1330727 - RNA, 19 nt, Homo sapiens
ucuacuacuugaaucauga

SEQ ID NO: 1330728 - RNA, 19 nt, Homo sapiens
gauggagacaauacagauu

SEQ ID NO: 1330729 - RNA, 19 nt, Homo sapiens
cuaauuugcuuugcaccuu

SEQ ID NO: 1330730 - RNA, 19 nt, Homo sapiens
cugauuguccuauauugua

SEQ ID NO: 1330731 - RNA, 19 nt, Homo sapiens
guaacuccgcuucugauug

SEQ ID NO: 1330732 - RNA, 19 nt, Homo sapiens
cgaguugauuggguuugua

SEQ ID NO: 1330733 - RNA, 19 nt, Homo sapiens
ccaguccguuguuaugaug

SEQ ID NO: 1330734 - RNA, 19 nt, Homo sapiens
caucugccuugccugugua

SEQ ID NO: 1330735 - RNA, 19 nt, Homo sapiens
uugcuagucugaauucaug

SEQ ID NO: 1330736 - RNA, 19 nt, Homo sapiens
agaaagccuugaagaugau

SEQ ID NO: 1330737 - RNA, 19 nt, Homo sapiens
gaucuuggagagaaacaga

SEQ ID NO: 1330738 - RNA, 19 nt, Homo sapiens
gaguugauuggguuuguaa

SEQ ID NO: 1330739 - RNA, 19 nt, Homo sapiens
augauaaacuuagccauug

SEQ ID NO: 1330740 - RNA, 19 nt, Homo sapiens
aggcaaagauaguuucucu

SEQ ID NO: 1330741 - RNA, 19 nt, Homo sapiens
gugaaguccaaugaaauua

SEQ ID NO: 1330742 - RNA, 19 nt, Homo sapiens
aauaugaccuguacaucag

SEQ ID NO: 1330743 - RNA, 19 nt, Homo sapiens
cauacagcuuccaccauga

SEQ ID NO: 1330744 - RNA, 19 nt, Homo sapiens
cuuagccauugcugacuua

SEQ ID NO: 1330745 - RNA, 19 nt, Homo sapiens
ccaggucucauagggaaua

SEQ ID NO: 1330746 - RNA, 19 nt, Homo sapiens
aacgagcugugauauuuau

SEQ ID NO: 1330747 - RNA, 19 nt, Homo sapiens
uagauuuccuggugaaguc

SEQ ID NO: 1330748 - RNA, 19 nt, Homo sapiens
gaaacagaaagccuugaag

SEQ ID NO: 1330749 - RNA, 19 nt, Homo sapiens
ggaagacgguuuuaucacu

SEQ ID NO: 1330750 - RNA, 19 nt, Homo sapiens
aaaugcaaguacaucagaa

SEQ ID NO: 1330751 - RNA, 19 nt, Homo sapiens
uuccaugacugcaaacaga

SEQ ID NO: 1330752 - RNA, 19 nt, Homo sapiens
ggccuggucucugcauguu

SEQ ID NO: 1330753 - RNA, 19 nt, Homo sapiens
ccaugacaccugaauuaug

SEQ ID NO: 1330754 - RNA, 19 nt, Homo sapiens
cauacacugucauucuugu

SEQ ID NO: 1330755 - RNA, 19 nt, Homo sapiens
gcgaguugauuggguuugu

SEQ ID NO: 1330756 - RNA, 19 nt, Homo sapiens
ucgcuuccaugacugcaaa

SEQ ID NO: 1330757 - RNA, 19 nt, Homo sapiens
gauuuugguuucucaugua

SEQ ID NO: 1330758 - RNA, 19 nt, Homo sapiens
caauacagauuuucgauac

SEQ ID NO: 1330759 - RNA, 19 nt, Homo sapiens
gggugauucuaauauuuca

SEQ ID NO: 1330760 - RNA, 19 nt, Homo sapiens
ggguauuccuaauuugcuu

SEQ ID NO: 1330761 - RNA, 19 nt, Homo sapiens
gcuucugauuguccuauau

SEQ ID NO: 1330762 - RNA, 19 nt, Homo sapiens
agaaauaugaccuguacau

SEQ ID NO: 1330763 - RNA, 19 nt, Homo sapiens
gaaucaugacuggccauuu

SEQ ID NO: 1330764 - RNA, 19 nt, Homo sapiens
caaguacaucagaacauau

SEQ ID NO: 1330765 - RNA, 19 nt, Homo sapiens
cgagcugugauauuuauga

SEQ ID NO: 1330766 - RNA, 19 nt, Homo sapiens
gaacacagcucuugacaca

SEQ ID NO: 1330767 - RNA, 19 nt, Homo sapiens
guacaaagguggugaagag

SEQ ID NO: 1330768 - RNA, 19 nt, Homo sapiens
caagaucugugcauauguu

SEQ ID NO: 1330769 - RNA, 19 nt, Homo sapiens
ccagaaggcucuauacaca

SEQ ID NO: 1330770 - RNA, 19 nt, Homo sapiens
ggcaagauacuacauaauu

SEQ ID NO: 1330771 - RNA, 19 nt, Homo sapiens
acacagcucuugacacaug

SEQ ID NO: 1330772 - RNA, 19 nt, Homo sapiens
gaagggagagucagagaga

SEQ ID NO: 1330773 - RNA, 19 nt, Homo sapiens
gauaccaugcuucuaauuu

SEQ ID NO: 1330774 - RNA, 19 nt, Homo sapiens
uaccauacauguccaaaga

SEQ ID NO: 1330775 - RNA, 19 nt, Homo sapiens
gcaccaagguccccauuuu

SEQ ID NO: 1330776 - RNA, 19 nt, Homo sapiens
cuucugaccuccacaacua

SEQ ID NO: 1330777 - RNA, 19 nt, Homo sapiens
gaacggauucuccucuaga

SEQ ID NO: 1330778 - RNA, 19 nt, Homo sapiens
ggaaggaacacagcucuug

SEQ ID NO: 1330779 - RNA, 19 nt, Homo sapiens
gggaacggauucuccucua

SEQ ID NO: 1330780 - RNA, 19 nt, Homo sapiens
gagagagaauggaagauac

SEQ ID NO: 1330781 - RNA, 19 nt, Homo sapiens
caguacagcucaccaagga

SEQ ID NO: 1330782 - RNA, 19 nt, Homo sapiens
gaccagacaccacugauug

SEQ ID NO: 1330783 - RNA, 19 nt, Homo sapiens
gaaggaacacagcucuuga

SEQ ID NO: 1330784 - RNA, 19 nt, Homo sapiens
gcucuugacacauggauuu

SEQ ID NO: 1330785 - RNA, 19 nt, Homo sapiens
uuaaggaucuugaaaugag

SEQ ID NO: 1330786 - RNA, 19 nt, Homo sapiens
gggcucaguuuaaucacaa

SEQ ID NO: 1330787 - RNA, 19 nt, Homo sapiens
gaacauugaggaacuguac

SEQ ID NO: 1330788 - RNA, 19 nt, Homo sapiens
gugauuauguuaaggaucu

SEQ ID NO: 1330789 - RNA, 19 nt, Homo sapiens
gggcuuauccuccaacugu

SEQ ID NO: 1330790 - RNA, 19 nt, Homo sapiens
ggaccagacaccacugauu

SEQ ID NO: 1330791 - RNA, 19 nt, Homo sapiens
ggaacggauucuccucuag

SEQ ID NO: 1330792 - RNA, 19 nt, Homo sapiens
uguuaaggaucuugaaaug

SEQ ID NO: 1330793 - RNA, 19 nt, Homo sapiens
gagauccuguugcagacaa

SEQ ID NO: 1330794 - RNA, 19 nt, Homo sapiens
ugacacccauuucagacuu

SEQ ID NO: 1330795 - RNA, 19 nt, Homo sapiens
agagagagaauggaagaua

SEQ ID NO: 1330796 - RNA, 19 nt, Homo sapiens
ggugggagauccuguugca

SEQ ID NO: 1330797 - RNA, 19 nt, Homo sapiens
cccaagaucugugcauaug

SEQ ID NO: 1330798 - RNA, 19 nt, Homo sapiens
uguuguggcucagcuauuu

SEQ ID NO: 1330799 - RNA, 19 nt, Homo sapiens
gcaggaagggagagucaga

SEQ ID NO: 1330800 - RNA, 19 nt, Homo sapiens
gguuugagcugggcuuauc

SEQ ID NO: 1330801 - RNA, 19 nt, Homo sapiens
cugcauacuuccuaacaga

SEQ ID NO: 1330802 - RNA, 19 nt, Homo sapiens
ucucagggcugggaauugu

SEQ ID NO: 1330803 - RNA, 19 nt, Homo sapiens
uggcauguguggagacaga

SEQ ID NO: 1330804 - RNA, 19 nt, Homo sapiens
agaaggcucuauacacaag

SEQ ID NO: 1330805 - RNA, 19 nt, Homo sapiens
uuaaauaugcagaccagaa

SEQ ID NO: 1330806 - RNA, 19 nt, Homo sapiens
ucagagagagaauggaaga

SEQ ID NO: 1330807 - RNA, 19 nt, Homo sapiens
ccacacgcuucaccuucuu

SEQ ID NO: 1330808 - RNA, 19 nt, Homo sapiens
uugaggaacuguacaaagg

SEQ ID NO: 1330809 - RNA, 19 nt, Homo sapiens
uaugguaggcagaauaaug

SEQ ID NO: 1330810 - RNA, 19 nt, Homo sapiens
gaccagaaggcucuauaca

SEQ ID NO: 1330811 - RNA, 19 nt, Homo sapiens
uaaauaugcagaccagaag

SEQ ID NO: 1330812 - RNA, 19 nt, Homo sapiens
cauggcaagauacuacaua

SEQ ID NO: 1330813 - RNA, 19 nt, Homo sapiens
aagauaccaugcuucuaau

SEQ ID NO: 1330814 - RNA, 19 nt, Homo sapiens
gagacaauccuggguuauc

SEQ ID NO: 1330815 - RNA, 19 nt, Homo sapiens
guuaaggaucuugaaauga

SEQ ID NO: 1330816 - RNA, 19 nt, Homo sapiens
ggauucuccucuagagucu

SEQ ID NO: 1330817 - RNA, 19 nt, Homo sapiens
ucuaugguaggcagaauaa

SEQ ID NO: 1330818 - RNA, 19 nt, Homo sapiens
ccucagcccguaccaaguu

SEQ ID NO: 1330819 - RNA, 19 nt, Homo sapiens
cccuacagcuggaggaugu

SEQ ID NO: 1330820 - RNA, 19 nt, Homo sapiens
ucaguuuaaucacaagaag

SEQ ID NO: 1330821 - RNA, 19 nt, Homo sapiens
auacauguccaaagagguu

SEQ ID NO: 1330822 - RNA, 19 nt, Homo sapiens
gccacacgcuucaccuucu

SEQ ID NO: 1330823 - RNA, 19 nt, Homo sapiens
auggcaagauacuacauaa

SEQ ID NO: 1330824 - RNA, 19 nt, Homo sapiens
ggccuugagccaacaaaug

SEQ ID NO: 1330825 - RNA, 19 nt, Homo sapiens
cagaccagaaggcucuaua

SEQ ID NO: 1330826 - RNA, 19 nt, Homo sapiens
ggauuucagcucagugaca

SEQ ID NO: 1330827 - RNA, 19 nt, Homo sapiens
ucuagagucuccggaagga

SEQ ID NO: 1330828 - RNA, 19 nt, Homo sapiens
gcucagugacacccauuuc

SEQ ID NO: 1330829 - RNA, 19 nt, Homo sapiens
aauccuggguuauccuugu

SEQ ID NO: 1330830 - RNA, 19 nt, Homo sapiens
ggagacaauccuggguuau

SEQ ID NO: 1330831 - RNA, 19 nt, Homo sapiens
gaggaccagacaccacuga

SEQ ID NO: 1330832 - RNA, 19 nt, Homo sapiens
aaagagguuuugcaaaugu

SEQ ID NO: 1330833 - RNA, 19 nt, Homo sapiens
cuugugggcucaguuuaau

SEQ ID NO: 1330834 - RNA, 19 nt, Homo sapiens
ccuugugggcucaguuuaa

SEQ ID NO: 1330835 - RNA, 19 nt, Homo sapiens
gcuuauccuccaacuguga

SEQ ID NO: 1330836 - RNA, 19 nt, Homo sapiens
cagaaggcucuauacacaa

SEQ ID NO: 1330837 - RNA, 19 nt, Homo sapiens
ugaccuccacaacuauaaa

SEQ ID NO: 1330838 - RNA, 19 nt, Homo sapiens
gacacccauuucagacuuc

SEQ ID NO: 1330839 - RNA, 19 nt, Homo sapiens
ggucuaugguaggcagaau

SEQ ID NO: 1330840 - RNA, 19 nt, Homo sapiens
gcugguagggagacaggaa

SEQ ID NO: 1330841 - RNA, 19 nt, Homo sapiens
caccacugauugcaggaau

SEQ ID NO: 1330842 - RNA, 19 nt, Homo sapiens
cagugacacccauuucaga

SEQ ID NO: 1330843 - RNA, 19 nt, Homo sapiens
gggagagucagagagagaa

SEQ ID NO: 1330844 - RNA, 19 nt, Homo sapiens
uggacuugcucccggauag

SEQ ID NO: 1330845 - RNA, 19 nt, Homo sapiens
agagaagaucugcauacuu

SEQ ID NO: 1330846 - RNA, 19 nt, Homo sapiens
gaacacagcucuugacaca

SEQ ID NO: 1330847 - RNA, 19 nt, Homo sapiens
guacaaagguggugaagag

SEQ ID NO: 1330848 - RNA, 19 nt, Homo sapiens
caagaucugugcauauguu

SEQ ID NO: 1330849 - RNA, 19 nt, Homo sapiens
ccagaaggcucuauacaca

SEQ ID NO: 1330850 - RNA, 19 nt, Homo sapiens
ggcaagauacuacauaauu

SEQ ID NO: 1330851 - RNA, 19 nt, Homo sapiens
acacagcucuugacacaug

SEQ ID NO: 1330852 - RNA, 19 nt, Homo sapiens
gaagggagagucagagaga

SEQ ID NO: 1330853 - RNA, 19 nt, Homo sapiens
gauaccaugcuucuaauuu

SEQ ID NO: 1330854 - RNA, 19 nt, Homo sapiens
uaccauacauguccaaaga

SEQ ID NO: 1330855 - RNA, 19 nt, Homo sapiens
gcaccaagguccccauuuu

SEQ ID NO: 1330856 - RNA, 19 nt, Homo sapiens
cuucugaccuccacaacua

SEQ ID NO: 1330857 - RNA, 19 nt, Homo sapiens
gaacggauucuccucuaga

SEQ ID NO: 1330858 - RNA, 19 nt, Homo sapiens
ggaaggaacacagcucuug

SEQ ID NO: 1330859 - RNA, 19 nt, Homo sapiens
gggaacggauucuccucua

SEQ ID NO: 1330860 - RNA, 19 nt, Homo sapiens
gaccagacaccacugauug

SEQ ID NO: 1330861 - RNA, 19 nt, Homo sapiens
gagagagaauggaagauac

SEQ ID NO: 1330862 - RNA, 19 nt, Homo sapiens
caguacagcucaccaagga

SEQ ID NO: 1330863 - RNA, 19 nt, Homo sapiens
gaaggaacacagcucuuga

SEQ ID NO: 1330864 - RNA, 19 nt, Homo sapiens
gcucuugacacauggauuu

SEQ ID NO: 1330865 - RNA, 19 nt, Homo sapiens
uuaaggaucuugaaaugag

SEQ ID NO: 1330866 - RNA, 19 nt, Homo sapiens
gggcucaguuuaaucacaa

SEQ ID NO: 1330867 - RNA, 19 nt, Homo sapiens
gaacauugaggaacuguac

SEQ ID NO: 1330868 - RNA, 19 nt, Homo sapiens
gugauuauguuaaggaucu

SEQ ID NO: 1330869 - RNA, 19 nt, Homo sapiens
ggaccagacaccacugauu

SEQ ID NO: 1330870 - RNA, 19 nt, Homo sapiens
ggaacggauucuccucuag

SEQ ID NO: 1330871 - RNA, 19 nt, Homo sapiens
uguuaaggaucuugaaaug

SEQ ID NO: 1330872 - RNA, 19 nt, Homo sapiens
gagauccuguugcagacaa

SEQ ID NO: 1330873 - RNA, 19 nt, Homo sapiens
ugacacccauuucagacuu

SEQ ID NO: 1330874 - RNA, 19 nt, Homo sapiens
agagagagaauggaagaua

SEQ ID NO: 1330875 - RNA, 19 nt, Homo sapiens
ggugggagauccuguugca

SEQ ID NO: 1330876 - RNA, 19 nt, Homo sapiens
cccaagaucugugcauaug

SEQ ID NO: 1330877 - RNA, 19 nt, Homo sapiens
gcaggaagggagagucaga

SEQ ID NO: 1330878 - RNA, 19 nt, Homo sapiens
cugcauacuuccuaacaga

SEQ ID NO: 1330879 - RNA, 19 nt, Homo sapiens
uuaaauaugcagaccagaa

SEQ ID NO: 1330880 - RNA, 19 nt, Homo sapiens
uggcauguguggagacaga

SEQ ID NO: 1330881 - RNA, 19 nt, Homo sapiens
agaaggcucuauacacaag

SEQ ID NO: 1330882 - RNA, 19 nt, Homo sapiens
ucagagagagaauggaaga

SEQ ID NO: 1330883 - RNA, 19 nt, Homo sapiens
ccacacgcuucaccuucuu

SEQ ID NO: 1330884 - RNA, 19 nt, Homo sapiens
uugaggaacuguacaaagg

SEQ ID NO: 1330885 - RNA, 19 nt, Homo sapiens
cauggcaagauacuacaua

SEQ ID NO: 1330886 - RNA, 19 nt, Homo sapiens
uaugguaggcagaauaaug

SEQ ID NO: 1330887 - RNA, 19 nt, Homo sapiens
gaccagaaggcucuauaca

SEQ ID NO: 1330888 - RNA, 19 nt, Homo sapiens
uaaauaugcagaccagaag

SEQ ID NO: 1330889 - RNA, 19 nt, Homo sapiens
aagauaccaugcuucuaau

SEQ ID NO: 1330890 - RNA, 19 nt, Homo sapiens
gagacaauccuggguuauc

SEQ ID NO: 1330891 - RNA, 19 nt, Homo sapiens
guuaaggaucuugaaauga

SEQ ID NO: 1330892 - RNA, 19 nt, Homo sapiens
ggauucuccucuagagucu

SEQ ID NO: 1330893 - RNA, 19 nt, Homo sapiens
ucuaugguaggcagaauaa

SEQ ID NO: 1330894 - RNA, 19 nt, Homo sapiens
ccucagcccguaccaaguu

SEQ ID NO: 1330895 - RNA, 19 nt, Homo sapiens
cccuacagcuggaggaugu

SEQ ID NO: 1330896 - RNA, 19 nt, Homo sapiens
auggcaagauacuacauaa

SEQ ID NO: 1330897 - RNA, 19 nt, Homo sapiens
ucaguuuaaucacaagaag

SEQ ID NO: 1330898 - RNA, 19 nt, Homo sapiens
auacauguccaaagagguu

SEQ ID NO: 1330899 - RNA, 19 nt, Homo sapiens
gccacacgcuucaccuucu

SEQ ID NO: 1330900 - RNA, 19 nt, Homo sapiens
ggccuugagccaacaaaug

SEQ ID NO: 1330901 - RNA, 19 nt, Homo sapiens
cagaccagaaggcucuaua

SEQ ID NO: 1330902 - RNA, 19 nt, Homo sapiens
ggauuucagcucagugaca

SEQ ID NO: 1330903 - RNA, 19 nt, Homo sapiens
ucuagagucuccggaagga

SEQ ID NO: 1330904 - RNA, 19 nt, Homo sapiens
gcucagugacacccauuuc

SEQ ID NO: 1330905 - RNA, 19 nt, Homo sapiens
aauccuggguuauccuugu

SEQ ID NO: 1330906 - RNA, 19 nt, Homo sapiens
ggagacaauccuggguuau

SEQ ID NO: 1330907 - RNA, 19 nt, Homo sapiens
gaggaccagacaccacuga

SEQ ID NO: 1330908 - RNA, 19 nt, Homo sapiens
aaagagguuuugcaaaugu

SEQ ID NO: 1330909 - RNA, 19 nt, Homo sapiens
cuugugggcucaguuuaau

SEQ ID NO: 1330910 - RNA, 19 nt, Homo sapiens
ccuugugggcucaguuuaa

SEQ ID NO: 1330911 - RNA, 19 nt, Homo sapiens
cagaaggcucuauacacaa

SEQ ID NO: 1330912 - RNA, 19 nt, Homo sapiens
ugaccuccacaacuauaaa

SEQ ID NO: 1330913 - RNA, 19 nt, Homo sapiens
gacacccauuucagacuuc

SEQ ID NO: 1330914 - RNA, 19 nt, Homo sapiens
ggucuaugguaggcagaau

SEQ ID NO: 1330915 - RNA, 19 nt, Homo sapiens
gcugguagggagacaggaa

SEQ ID NO: 1330916 - RNA, 19 nt, Homo sapiens
cagugacacccauuucaga

SEQ ID NO: 1330917 - RNA, 19 nt, Homo sapiens
caccacugauugcaggaau

SEQ ID NO: 1330918 - RNA, 19 nt, Homo sapiens
agagaagaucugcauacuu

SEQ ID NO: 1330919 - RNA, 19 nt, Homo sapiens
gggagagucagagagagaa

SEQ ID NO: 1330920 - RNA, 19 nt, Homo sapiens
gaaaagaucuugaaaguuc

SEQ ID NO: 1330921 - RNA, 19 nt, Homo sapiens
ggaaguagcuaguaaagca

SEQ ID NO: 1330922 - RNA, 19 nt, Homo sapiens
aaagagagcugcgggaaua

SEQ ID NO: 1330923 - RNA, 19 nt, Homo sapiens
gaucagaaguaucauguga

SEQ ID NO: 1330924 - RNA, 19 nt, Homo sapiens
ggagacaaguauuaucuuu

SEQ ID NO: 1330925 - RNA, 19 nt, Homo sapiens
acacaagccuucugaaauu

SEQ ID NO: 1330926 - RNA, 19 nt, Homo sapiens
gaguauaucuucugugguu

SEQ ID NO: 1330927 - RNA, 19 nt, Homo sapiens
guccagaaguuuacuauuu

SEQ ID NO: 1330928 - RNA, 19 nt, Homo sapiens
ggaggaaccugaauaccuu

SEQ ID NO: 1330929 - RNA, 19 nt, Homo sapiens
gcauaguacuaaugguuua

SEQ ID NO: 1330930 - RNA, 19 nt, Homo sapiens
gaacucacauacguuguuu

SEQ ID NO: 1330931 - RNA, 19 nt, Homo sapiens
auacauaugugcugaauug

SEQ ID NO: 1330932 - RNA, 19 nt, Homo sapiens
gacaguagagugacauuua

SEQ ID NO: 1330933 - RNA, 19 nt, Homo sapiens
aaacaugucuguccaagau

SEQ ID NO: 1330934 - RNA, 19 nt, Homo sapiens
gcaagacuguucugaauac

SEQ ID NO: 1330935 - RNA, 19 nt, Homo sapiens
gaaauuaacccagcuaagu

SEQ ID NO: 1330936 - RNA, 19 nt, Homo sapiens
cauaugugcugaauugauu

SEQ ID NO: 1330937 - RNA, 19 nt, Homo sapiens
cagaagaaccaguaguuua

SEQ ID NO: 1330938 - RNA, 19 nt, Homo sapiens
gaaaccacaccuucaguaa

SEQ ID NO: 1330939 - RNA, 19 nt, Homo sapiens
ggaggugaguucuguaugu

SEQ ID NO: 1330940 - RNA, 19 nt, Homo sapiens
gaaaguuggucuguagaug

SEQ ID NO: 1330941 - RNA, 19 nt, Homo sapiens
gaaagugggcauuacuauu

SEQ ID NO: 1330942 - RNA, 19 nt, Homo sapiens
cagcaagacuguucugaau

SEQ ID NO: 1330943 - RNA, 19 nt, Homo sapiens
gaagaaccaguaguuuaua

SEQ ID NO: 1330944 - RNA, 19 nt, Homo sapiens
gcauauuccucuucagaug

SEQ ID NO: 1330945 - RNA, 19 nt, Homo sapiens
cacgaaacgucuaauacua

SEQ ID NO: 1330946 - RNA, 19 nt, Homo sapiens
ccagaaauaucacaaguac

SEQ ID NO: 1330947 - RNA, 19 nt, Homo sapiens
guacagacucuucauauca

SEQ ID NO: 1330948 - RNA, 19 nt, Homo sapiens
gguaauagauuuuccagaa

SEQ ID NO: 1330949 - RNA, 19 nt, Homo sapiens
gauguugacuucacugauc

SEQ ID NO: 1330950 - RNA, 19 nt, Homo sapiens
ccagaggcguuccauuuga

SEQ ID NO: 1330951 - RNA, 19 nt, Homo sapiens
cgacuuugguuuccucuug

SEQ ID NO: 1330952 - RNA, 19 nt, Homo sapiens
caaaaugcaucauggaaaa

SEQ ID NO: 1330953 - RNA, 19 nt, Homo sapiens
ggaggaggauuuaauacag

SEQ ID NO: 1330954 - RNA, 19 nt, Homo sapiens
uaaauggucuaucuucagu

SEQ ID NO: 1330955 - RNA, 19 nt, Homo sapiens
ucagaaguaucaugugaga

SEQ ID NO: 1330956 - RNA, 19 nt, Homo sapiens
ucacauacguuguuugaac

SEQ ID NO: 1330957 - RNA, 19 nt, Homo sapiens
ugaaacuucuuuacaggaa

SEQ ID NO: 1330958 - RNA, 19 nt, Homo sapiens
gugaagagaagauuaaguu

SEQ ID NO: 1330959 - RNA, 19 nt, Homo sapiens
cagcaucacugugucugua

SEQ ID NO: 1330960 - RNA, 19 nt, Homo sapiens
gggcauuacuauucuuaug

SEQ ID NO: 1330961 - RNA, 19 nt, Homo sapiens
ugacuucacugaucuuagu

SEQ ID NO: 1330962 - RNA, 19 nt, Homo sapiens
ggaaugcagugaaacuucu

SEQ ID NO: 1330963 - RNA, 19 nt, Homo sapiens
ccacagaugcaucauuuga

SEQ ID NO: 1330964 - RNA, 19 nt, Homo sapiens
cgaaacgucuaauacuaug

SEQ ID NO: 1330965 - RNA, 19 nt, Homo sapiens
guggauacauggguaauug

SEQ ID NO: 1330966 - RNA, 19 nt, Homo sapiens
aaaguugcaugauccugua

SEQ ID NO: 1330967 - RNA, 19 nt, Homo sapiens
gguggaggaggauuuaaua

SEQ ID NO: 1330968 - RNA, 19 nt, Homo sapiens
acuaaugguuuaaguggua

SEQ ID NO: 1330969 - RNA, 19 nt, Homo sapiens
uaaagcagcaguacuaaca

SEQ ID NO: 1330970 - RNA, 19 nt, Homo sapiens
ggacuucucaauccaauuc

SEQ ID NO: 1330971 - RNA, 19 nt, Homo sapiens
ggaaguaauuuucgugcua

SEQ ID NO: 1330972 - RNA, 19 nt, Homo sapiens
gaauugaugcuagagguaa

SEQ ID NO: 1330973 - RNA, 19 nt, Homo sapiens
ccaggaagcuguggaccaa

SEQ ID NO: 1330974 - RNA, 19 nt, Homo sapiens
gcagcuguccagaaguuua

SEQ ID NO: 1330975 - RNA, 19 nt, Homo sapiens
gcagugcgaggccauguuu

SEQ ID NO: 1330976 - RNA, 19 nt, Homo sapiens
aaauuaacccagcuaagua

SEQ ID NO: 1330977 - RNA, 19 nt, Homo sapiens
ugaaggaggugaguucugu

SEQ ID NO: 1330978 - RNA, 19 nt, Homo sapiens
agacccaccucuacagaaa

SEQ ID NO: 1330979 - RNA, 19 nt, Homo sapiens
caaaggacacagcuuaugu

SEQ ID NO: 1330980 - RNA, 19 nt, Homo sapiens
caaguacagacucuucaua

SEQ ID NO: 1330981 - RNA, 19 nt, Homo sapiens
uauacaagaugguggucua

SEQ ID NO: 1330982 - RNA, 19 nt, Homo sapiens
gugagaagacuuuaauaga

SEQ ID NO: 1330983 - RNA, 19 nt, Homo sapiens
gcagugaaacuucuuuaca

SEQ ID NO: 1330984 - RNA, 19 nt, Homo sapiens
gauggucugccuucaagua

SEQ ID NO: 1330985 - RNA, 19 nt, Homo sapiens
gguaauugcacuccugaaa

SEQ ID NO: 1330986 - RNA, 19 nt, Homo sapiens
ggaaauuguccaucacguu

SEQ ID NO: 1330987 - RNA, 19 nt, Homo sapiens
cgacugagcgaccuucuga

SEQ ID NO: 1330988 - RNA, 19 nt, Homo sapiens
ccgcaggugucgguucuua

SEQ ID NO: 1330989 - RNA, 19 nt, Homo sapiens
uuaagaaaguugcaugauc

SEQ ID NO: 1330990 - RNA, 19 nt, Homo sapiens
auaaagauguaccucagaa

SEQ ID NO: 1330991 - RNA, 19 nt, Homo sapiens
gaaccaguaguuuauaauc

SEQ ID NO: 1330992 - RNA, 19 nt, Homo sapiens
cuaaaugggugcaauucau

SEQ ID NO: 1330993 - RNA, 19 nt, Homo sapiens
ccagaucucuaugaaccua

SEQ ID NO: 1330994 - RNA, 19 nt, Homo sapiens
guaacuugcugcagaacau

SEQ ID NO: 1330995 - RNA, 19 nt, Homo sapiens
ggucacgaaacgucuaaua

SEQ ID NO: 1330996 - RNA, 19 nt, Homo sapiens
gagugacauuuacuucauu

SEQ ID NO: 1330997 - RNA, 19 nt, Homo sapiens
acaagaugguggucuaaug

SEQ ID NO: 1330998 - RNA, 19 nt, Homo sapiens
uacaggaaguagcuaguaa

SEQ ID NO: 1330999 - RNA, 19 nt, Homo sapiens
ccagugaagagaagauuaa

SEQ ID NO: 1331000 - RNA, 19 nt, Homo sapiens
uuagaagaauucagaggaa

SEQ ID NO: 1331001 - RNA, 19 nt, Homo sapiens
gaggaggauuuaauacagu

SEQ ID NO: 1331002 - RNA, 19 nt, Homo sapiens
ggccagaguucgaguccuu

SEQ ID NO: 1331003 - RNA, 19 nt, Homo sapiens
uguuugaacugcaggagua

SEQ ID NO: 1331004 - RNA, 19 nt, Homo sapiens
ucacacaagccuucugaaa

SEQ ID NO: 1331005 - RNA, 19 nt, Homo sapiens
ggccugaagcugauuauga

SEQ ID NO: 1331006 - RNA, 19 nt, Homo sapiens
aauggucuaucuucaguuu

SEQ ID NO: 1331007 - RNA, 19 nt, Homo sapiens
guaccuggucccuaauuaa

SEQ ID NO: 1331008 - RNA, 19 nt, Homo sapiens
ccaauggauuugaugacaa

SEQ ID NO: 1331009 - RNA, 19 nt, Homo sapiens
aaagugggcauuacuauuc

SEQ ID NO: 1331010 - RNA, 19 nt, Homo sapiens
ucacggaggaaccugaaua

SEQ ID NO: 1331011 - RNA, 19 nt, Homo sapiens
agaagaaccaguaguuuau

SEQ ID NO: 1331012 - RNA, 19 nt, Homo sapiens
aaguacagccuucuuagua

SEQ ID NO: 1331013 - RNA, 19 nt, Homo sapiens
gaaagagagcugcgggaau

SEQ ID NO: 1331014 - RNA, 19 nt, Homo sapiens
gaaguaaaaucugaugguu

SEQ ID NO: 1331015 - RNA, 19 nt, Homo sapiens
auauguaccuggucccuaa

SEQ ID NO: 1331016 - RNA, 19 nt, Homo sapiens
ucugguauauccucugaaa

SEQ ID NO: 1331017 - RNA, 19 nt, Homo sapiens
gaugaagcuuccugcacaa

SEQ ID NO: 1331018 - RNA, 19 nt, Homo sapiens
guggaagccuuuacagauc

SEQ ID NO: 1331019 - RNA, 19 nt, Homo sapiens
uuccagaccuccaugguuu

SEQ ID NO: 1331020 - RNA, 19 nt, Homo sapiens
gaucauaacuggaauaaga

SEQ ID NO: 1331021 - RNA, 19 nt, Homo sapiens
gaaugaaacucagcauaua

SEQ ID NO: 1331022 - RNA, 19 nt, Homo sapiens
ggacaucugcuucaucuua

SEQ ID NO: 1331023 - RNA, 19 nt, Homo sapiens
gggccaaguuugauaaaua

SEQ ID NO: 1331024 - RNA, 19 nt, Homo sapiens
ggaauacgcacauuaaguu

SEQ ID NO: 1331025 - RNA, 19 nt, Homo sapiens
gaaagugggauucugcaua

SEQ ID NO: 1331026 - RNA, 19 nt, Homo sapiens
gagcucagauuucuuggaa

SEQ ID NO: 1331027 - RNA, 19 nt, Homo sapiens
guauaguccuuaugucuuu

SEQ ID NO: 1331028 - RNA, 19 nt, Homo sapiens
ucagggaucuacugucuuu

SEQ ID NO: 1331029 - RNA, 19 nt, Homo sapiens
ugaaauacuuccuugcaaa

SEQ ID NO: 1331030 - RNA, 19 nt, Homo sapiens
cuaaguaggaugagaguua

SEQ ID NO: 1331031 - RNA, 19 nt, Homo sapiens
gcucagacggccuuucuua

SEQ ID NO: 1331032 - RNA, 19 nt, Homo sapiens
uaacuagggcccaccuuua

SEQ ID NO: 1331033 - RNA, 19 nt, Homo sapiens
gaagaaaguuggaaaagau

SEQ ID NO: 1331034 - RNA, 19 nt, Homo sapiens
ucacaggccuggaugaugu

SEQ ID NO: 1331035 - RNA, 19 nt, Homo sapiens
gauuguaggcugcuucuaa

SEQ ID NO: 1331036 - RNA, 19 nt, Homo sapiens
ggauacgagugaaguuuau

SEQ ID NO: 1331037 - RNA, 19 nt, Homo sapiens
gaucuacugucuuuguuca

SEQ ID NO: 1331038 - RNA, 19 nt, Homo sapiens
gcuguaaacucggcagaaa

SEQ ID NO: 1331039 - RNA, 19 nt, Homo sapiens
ucugggagcucucuucauu

SEQ ID NO: 1331040 - RNA, 19 nt, Homo sapiens
uauaaaggauuguguacug

SEQ ID NO: 1331041 - RNA, 19 nt, Homo sapiens
uaaugaagguauugacaga

SEQ ID NO: 1331042 - RNA, 19 nt, Homo sapiens
cacauuaaguuccuuucua

SEQ ID NO: 1331043 - RNA, 19 nt, Homo sapiens
gcauucugguggcaacaua

SEQ ID NO: 1331044 - RNA, 19 nt, Homo sapiens
ucaggcaggucauagguuu

SEQ ID NO: 1331045 - RNA, 19 nt, Homo sapiens
ggaaacaagcagacccuuu

SEQ ID NO: 1331046 - RNA, 19 nt, Homo sapiens
gagugaaguuuauauccaa

SEQ ID NO: 1331047 - RNA, 19 nt, Homo sapiens
gaaauacuuccuugcaaau

SEQ ID NO: 1331048 - RNA, 19 nt, Homo sapiens
agacucaaaggcauuauua

SEQ ID NO: 1331049 - RNA, 19 nt, Homo sapiens
uaagaauacuguccuccuu

SEQ ID NO: 1331050 - RNA, 19 nt, Homo sapiens
ccaucacacuccugccuua

SEQ ID NO: 1331051 - RNA, 19 nt, Homo sapiens
cacgauaagugucuugcua

SEQ ID NO: 1331052 - RNA, 19 nt, Homo sapiens
guaggaauucugucuauug

SEQ ID NO: 1331053 - RNA, 19 nt, Homo sapiens
gauaagugucuugcuauuu

SEQ ID NO: 1331054 - RNA, 19 nt, Homo sapiens
gcagugaugaggacauuga

SEQ ID NO: 1331055 - RNA, 19 nt, Homo sapiens
uaagcuuccuaaugcauaa

SEQ ID NO: 1331056 - RNA, 19 nt, Homo sapiens
uuugaaaccuguucugcua

SEQ ID NO: 1331057 - RNA, 19 nt, Homo sapiens
cgauaagugucuugcuauu

SEQ ID NO: 1331058 - RNA, 19 nt, Homo sapiens
caagauuucagguaaagaa

SEQ ID NO: 1331059 - RNA, 19 nt, Homo sapiens
ggaauaagaggacuaugca

SEQ ID NO: 1331060 - RNA, 19 nt, Homo sapiens
gaaaccuguucugcuauga

SEQ ID NO: 1331061 - RNA, 19 nt, Homo sapiens
gcccauagguguugaugag

SEQ ID NO: 1331062 - RNA, 19 nt, Homo sapiens
ggauggcuuuccuguaaug

SEQ ID NO: 1331063 - RNA, 19 nt, Homo sapiens
gggcauguauaguccuuau

SEQ ID NO: 1331064 - RNA, 19 nt, Homo sapiens
ucaccguguuucuuucaua

SEQ ID NO: 1331065 - RNA, 19 nt, Homo sapiens
gaaacaagcagacccuuuu

SEQ ID NO: 1331066 - RNA, 19 nt, Homo sapiens
ugggagcucucuucauuug

SEQ ID NO: 1331067 - RNA, 19 nt, Homo sapiens
cuuaguggcuguuccagaa

SEQ ID NO: 1331068 - RNA, 19 nt, Homo sapiens
uaucagggaucuacugucu

SEQ ID NO: 1331069 - RNA, 19 nt, Homo sapiens
ggagcucucuucauuugag

SEQ ID NO: 1331070 - RNA, 19 nt, Homo sapiens
gggcagugaugaggacauu

SEQ ID NO: 1331071 - RNA, 19 nt, Homo sapiens
guacugacugaauacauuu

SEQ ID NO: 1331072 - RNA, 19 nt, Homo sapiens
cagcauauauacacuucug

SEQ ID NO: 1331073 - RNA, 19 nt, Homo sapiens
agaaugaaacucagcauau

SEQ ID NO: 1331074 - RNA, 19 nt, Homo sapiens
aaagugggauucugcauac

SEQ ID NO: 1331075 - RNA, 19 nt, Homo sapiens
gcauguauaguccuuaugu

SEQ ID NO: 1331076 - RNA, 19 nt, Homo sapiens
gguaggaauucugucuauu

SEQ ID NO: 1331077 - RNA, 19 nt, Homo sapiens
uaacagagcaccccuuuga

SEQ ID NO: 1331078 - RNA, 19 nt, Homo sapiens
gggaucuacugucuuuguu

SEQ ID NO: 1331079 - RNA, 19 nt, Homo sapiens
aggugaaacucaaauagaa

SEQ ID NO: 1331080 - RNA, 19 nt, Homo sapiens
ccaaggugaaacucaaaua

SEQ ID NO: 1331081 - RNA, 19 nt, Homo sapiens
ggccaaguuugauaaauac

SEQ ID NO: 1331082 - RNA, 19 nt, Homo sapiens
uaagaggacuaugcaaugg

SEQ ID NO: 1331083 - RNA, 19 nt, Homo sapiens
gcuggacaguauucaaguu

SEQ ID NO: 1331084 - RNA, 19 nt, Homo sapiens
ugaaaccuguucugcuaug

SEQ ID NO: 1331085 - RNA, 19 nt, Homo sapiens
gcucauccuccuccuguuu

SEQ ID NO: 1331086 - RNA, 19 nt, Homo sapiens
uaaagccaguggaguucaa

SEQ ID NO: 1331087 - RNA, 19 nt, Homo sapiens
uaggaauucugucuauugu

SEQ ID NO: 1331088 - RNA, 19 nt, Homo sapiens
uaacugcucugaguaugca

SEQ ID NO: 1331089 - RNA, 19 nt, Homo sapiens
cgagugaaguuuauaucca

SEQ ID NO: 1331090 - RNA, 19 nt, Homo sapiens
uauauacacuucuggacau

SEQ ID NO: 1331091 - RNA, 19 nt, Homo sapiens
ggaaugcagagucagauca

SEQ ID NO: 1331092 - RNA, 19 nt, Homo sapiens
gacaucugcuucaucuuag

SEQ ID NO: 1331093 - RNA, 19 nt, Homo sapiens
gcauaucuuucugccaguu

SEQ ID NO: 1331094 - RNA, 19 nt, Homo sapiens
gggaauacgcacauuaagu

SEQ ID NO: 1331095 - RNA, 19 nt, Homo sapiens
gaguaagaguggcagcaau

SEQ ID NO: 1331096 - RNA, 19 nt, Homo sapiens
ggugaaacucaaauagaaa

SEQ ID NO: 1331097 - RNA, 19 nt, Homo sapiens
cuauguagcugaugucacu

SEQ ID NO: 1331098 - RNA, 19 nt, Homo sapiens
gccauuggagcauaucuuu

SEQ ID NO: 1331099 - RNA, 19 nt, Homo sapiens
ggucauagguuuuggaucu

SEQ ID NO: 1331100 - RNA, 19 nt, Homo sapiens
cucaaaggcauuauuauga

SEQ ID NO: 1331101 - RNA, 19 nt, Homo sapiens
uaaguaggaugagaguuag

SEQ ID NO: 1331102 - RNA, 19 nt, Homo sapiens
gaaacucagcauauauaca

SEQ ID NO: 1331103 - RNA, 19 nt, Homo sapiens
agucaucucucugguagaa

SEQ ID NO: 1331104 - RNA, 19 nt, Homo sapiens
aaacucaacaacucagauu

SEQ ID NO: 1331105 - RNA, 19 nt, Homo sapiens
uagaaugaaacucagcaua

SEQ ID NO: 1331106 - RNA, 19 nt, Homo sapiens
cuggcaagauuucagguaa

SEQ ID NO: 1331107 - RNA, 19 nt, Homo sapiens
ggacauugagccacuacug

SEQ ID NO: 1331108 - RNA, 19 nt, Homo sapiens
augaagguauugacagaaa

SEQ ID NO: 1331109 - RNA, 19 nt, Homo sapiens
caugggaauacgcacauua

SEQ ID NO: 1331110 - RNA, 19 nt, Homo sapiens
ggcaagauuucagguaaag

SEQ ID NO: 1331111 - RNA, 19 nt, Homo sapiens
caaggugaaacucaaauag

SEQ ID NO: 1331112 - RNA, 19 nt, Homo sapiens
caguaaagccaguggaguu

SEQ ID NO: 1331113 - RNA, 19 nt, Homo sapiens
gggaucauaacuggaauaa

SEQ ID NO: 1331114 - RNA, 19 nt, Homo sapiens
gaagcuggacaguauucaa

SEQ ID NO: 1331115 - RNA, 19 nt, Homo sapiens
gcuaugaacagagauaaca

SEQ ID NO: 1331116 - RNA, 19 nt, Homo sapiens
gaauacgcacauuaaguuc

SEQ ID NO: 1331117 - RNA, 19 nt, Homo sapiens
uggauacgagugaaguuua

SEQ ID NO: 1331118 - RNA, 19 nt, Homo sapiens
uggcaagauuucagguaaa

SEQ ID NO: 1331119 - RNA, 19 nt, Homo sapiens
cagaaggcacagaacagua

SEQ ID NO: 1331120 - RNA, 19 nt, Homo sapiens
ggagagagcugguggagua

SEQ ID NO: 1331121 - RNA, 19 nt, Homo sapiens
gauaaugcauggcaaguuu

SEQ ID NO: 1331122 - RNA, 19 nt, Homo sapiens
ugaagagguugaaacauua

SEQ ID NO: 1331123 - RNA, 19 nt, Homo sapiens
gggaugaccucuugugaaa

SEQ ID NO: 1331124 - RNA, 19 nt, Homo sapiens
gggaauagcugucggacuu

SEQ ID NO: 1331125 - RNA, 19 nt, Homo sapiens
gaagggaucuagccaaugg

SEQ ID NO: 1331126 - RNA, 19 nt, Homo sapiens
gaaagagauugaagagguu

SEQ ID NO: 1331127 - RNA, 19 nt, Homo sapiens
cagcaaaccuugucugaug

SEQ ID NO: 1331128 - RNA, 19 nt, Homo sapiens
ucagagggaugaauuuauu

SEQ ID NO: 1331129 - RNA, 19 nt, Homo sapiens
gggcagagauuaacaagag

SEQ ID NO: 1331130 - RNA, 19 nt, Homo sapiens
caagguguaugauuuguug

SEQ ID NO: 1331131 - RNA, 19 nt, Homo sapiens
caaagucuaugggacauuu

SEQ ID NO: 1331132 - RNA, 19 nt, Homo sapiens
ucacggagaucaacagaga

SEQ ID NO: 1331133 - RNA, 19 nt, Homo sapiens
caucggaaauucagaaaug

SEQ ID NO: 1331134 - RNA, 19 nt, Homo sapiens
ggaaggauaccacaauuuc

SEQ ID NO: 1331135 - RNA, 19 nt, Homo sapiens
ucagaaaugucccuucaga

SEQ ID NO: 1331136 - RNA, 19 nt, Homo sapiens
uugaagagguugaaacauu

SEQ ID NO: 1331137 - RNA, 19 nt, Homo sapiens
cgaaauggguugcgaugau

SEQ ID NO: 1331138 - RNA, 19 nt, Homo sapiens
ggaaaacuguccaaauuau

SEQ ID NO: 1331139 - RNA, 19 nt, Homo sapiens
gaagagcaagguagaguga

SEQ ID NO: 1331140 - RNA, 19 nt, Homo sapiens
cuaaagauccuccugagaa

SEQ ID NO: 1331141 - RNA, 19 nt, Homo sapiens
ggccagaacuccuccacuu

SEQ ID NO: 1331142 - RNA, 19 nt, Homo sapiens
gcuccgagacuccuuuaua

SEQ ID NO: 1331143 - RNA, 19 nt, Homo sapiens
gcaguuuccaccacucuua

SEQ ID NO: 1331144 - RNA, 19 nt, Homo sapiens
gcucagaaacuccacauau

SEQ ID NO: 1331145 - RNA, 19 nt, Homo sapiens
gaaauggguugcgaugauc

SEQ ID NO: 1331146 - RNA, 19 nt, Homo sapiens
gggaagggaucuagccaau

SEQ ID NO: 1331147 - RNA, 19 nt, Homo sapiens
gcacaugaucgaagaguau

SEQ ID NO: 1331148 - RNA, 19 nt, Homo sapiens
agaaagagguguguugugu

SEQ ID NO: 1331149 - RNA, 19 nt, Homo sapiens
caggaaaacuguccaaauu

SEQ ID NO: 1331150 - RNA, 19 nt, Homo sapiens
ugauuuagcugggaaugaa

SEQ ID NO: 1331151 - RNA, 19 nt, Homo sapiens
ggaagaagaagcugcaagu

SEQ ID NO: 1331152 - RNA, 19 nt, Homo sapiens
uagcugaccuccacgugaa

SEQ ID NO: 1331153 - RNA, 19 nt, Homo sapiens
ucagaaacuccacauauga

SEQ ID NO: 1331154 - RNA, 19 nt, Homo sapiens
gugcaugaguccaagcaaa

SEQ ID NO: 1331155 - RNA, 19 nt, Homo sapiens
gaaagaggagcagauacaa

SEQ ID NO: 1331156 - RNA, 19 nt, Homo sapiens
gggcauggccaccugcuuu

SEQ ID NO: 1331157 - RNA, 19 nt, Homo sapiens
uaaagauccuccugagaag

SEQ ID NO: 1331158 - RNA, 19 nt, Homo sapiens
cgagagaucagguccgaaa

SEQ ID NO: 1331159 - RNA, 19 nt, Homo sapiens
gaguacaccaugauauuga

SEQ ID NO: 1331160 - RNA, 19 nt, Homo sapiens
ggaguacaccaugauauug

SEQ ID NO: 1331161 - RNA, 19 nt, Homo sapiens
ggacaugaggcaccaagga

SEQ ID NO: 1331162 - RNA, 19 nt, Homo sapiens
gaaacuccacauaugagaa

SEQ ID NO: 1331163 - RNA, 19 nt, Homo sapiens
gggaaggauaccacaauuu

SEQ ID NO: 1331164 - RNA, 19 nt, Homo sapiens
gcagaaagagauugaagag

SEQ ID NO: 1331165 - RNA, 19 nt, Homo sapiens
gcaaucagcaaauccaagu

SEQ ID NO: 1331166 - RNA, 19 nt, Homo sapiens
gaaggauaccacaauuuca

SEQ ID NO: 1331167 - RNA, 19 nt, Homo sapiens
gaccaugccuucgaugaca

SEQ ID NO: 1331168 - RNA, 19 nt, Homo sapiens
aaaacacucucaacacuuu

SEQ ID NO: 1331169 - RNA, 19 nt, Homo sapiens
gaggauggcaaucagcaaa

SEQ ID NO: 1331170 - RNA, 19 nt, Homo sapiens
gagaucagguccgaaaugc

SEQ ID NO: 1331171 - RNA, 19 nt, Homo sapiens
uaccuuauguacagaguga

SEQ ID NO: 1331172 - RNA, 19 nt, Homo sapiens
aaaauacacugaugggaaa

SEQ ID NO: 1331173 - RNA, 19 nt, Homo sapiens
ugaaagaggagcagauaca

SEQ ID NO: 1331174 - RNA, 19 nt, Homo sapiens
aaagucacaucggaaauuc

SEQ ID NO: 1331175 - RNA, 19 nt, Homo sapiens
gaagcuggaccucaaaguc

SEQ ID NO: 1331176 - RNA, 19 nt, Homo sapiens
caggagccaugcaguguuc

SEQ ID NO: 1331177 - RNA, 19 nt, Homo sapiens
gggcaagguguaugauuug

SEQ ID NO: 1331178 - RNA, 19 nt, Homo sapiens
cucagaaacuccacauaug

SEQ ID NO: 1331179 - RNA, 19 nt, Homo sapiens
gauugaagagguugaaaca

SEQ ID NO: 1331180 - RNA, 19 nt, Homo sapiens
cagagggaugaauuuauua

SEQ ID NO: 1331181 - RNA, 19 nt, Homo sapiens
ggagaaagagguguguugu

SEQ ID NO: 1331182 - RNA, 19 nt, Homo sapiens
ugaccgagauccaaaagaa

SEQ ID NO: 1331183 - RNA, 19 nt, Homo sapiens
gaaacauuacccacucugu

SEQ ID NO: 1331184 - RNA, 19 nt, Homo sapiens
ggauggcaaucagcaaauc

SEQ ID NO: 1331185 - RNA, 19 nt, Homo sapiens
ggaagcggccucucaacca

SEQ ID NO: 1331186 - RNA, 19 nt, Homo sapiens
uaagauaugcaaacagagu

SEQ ID NO: 1331187 - RNA, 19 nt, Homo sapiens
ggggcaagguguaugauuu

SEQ ID NO: 1331188 - RNA, 19 nt, Homo sapiens
caggaacggcccaagauug

SEQ ID NO: 1331189 - RNA, 19 nt, Homo sapiens
cgagaagugggaagacgua

SEQ ID NO: 1331190 - RNA, 19 nt, Homo sapiens
gaugggaaacaugcucuuu

SEQ ID NO: 1331191 - RNA, 19 nt, Homo sapiens
gaaugaaagaggagcagau

SEQ ID NO: 1331192 - RNA, 19 nt, Homo sapiens
ggauaaugcauggcaaguu

SEQ ID NO: 1331193 - RNA, 19 nt, Homo sapiens
gaagaagcugcaaguccuu

SEQ ID NO: 1331194 - RNA, 19 nt, Homo sapiens
gcaagguguaugauuuguu

SEQ ID NO: 1331195 - RNA, 19 nt, Homo sapiens
gcaaaccuugucugaugaa

SEQ ID NO: 1331196 - RNA, 19 nt, Homo sapiens
gcucugaccgagauccaaa

SEQ ID NO: 1331197 - RNA, 19 nt, Homo sapiens
gagcagaaagagauugaag

SEQ ID NO: 1331198 - RNA, 19 nt, Homo sapiens
ucacaucggaaauucagaa

SEQ ID NO: 1331199 - RNA, 19 nt, Homo sapiens
caugauugcuaccaucucu

SEQ ID NO: 1331200 - RNA, 19 nt, Homo sapiens
gagaaagagguguguugug

SEQ ID NO: 1331201 - RNA, 19 nt, Homo sapiens
ggcccaagauuguucuaag

SEQ ID NO: 1331202 - RNA, 19 nt, Homo sapiens
gugaggagcagaaagagau

SEQ ID NO: 1331203 - RNA, 19 nt, Homo sapiens
aaugaaagaggagcagaua

SEQ ID NO: 1331204 - RNA, 19 nt, Homo sapiens
uguaugauuuguugaacug

SEQ ID NO: 1331205 - RNA, 19 nt, Homo sapiens
uggaguacaccaugauauu

SEQ ID NO: 1331206 - RNA, 19 nt, Homo sapiens
agggaaggauaccacaauu

SEQ ID NO: 1331207 - RNA, 19 nt, Homo sapiens
agagugaggagcagaaaga

SEQ ID NO: 1331208 - RNA, 19 nt, Homo sapiens
ggucagaacaagccucaca

SEQ ID NO: 1331209 - RNA, 19 nt, Homo sapiens
gcccggucuuuguccauuu

SEQ ID NO: 1331210 - RNA, 19 nt, Homo sapiens
gcccaagauuguucuaagg

SEQ ID NO: 1331211 - RNA, 19 nt, Homo sapiens
ggacagcagcaagaucuca

SEQ ID NO: 1331212 - RNA, 19 nt, Homo sapiens
ucacaaaggcaggcacaga

SEQ ID NO: 1331213 - RNA, 19 nt, Homo sapiens
cuccgagacuccuuuauag

SEQ ID NO: 1331214 - RNA, 19 nt, Homo sapiens
gaagaagaagcugcaaguc

SEQ ID NO: 1331215 - RNA, 19 nt, Homo sapiens
auucagaaaugucccuuca

SEQ ID NO: 1331216 - RNA, 19 nt, Homo sapiens
gccaugcaguguuccagau

SEQ ID NO: 1331217 - RNA, 19 nt, Homo sapiens
ugucggacuuccaggcaaa

SEQ ID NO: 1331218 - RNA, 19 nt, Homo sapiens
uuguugaacuggaagaaga

SEQ ID NO: 1331219 - RNA, 19 nt, Homo sapiens
agauugaccuggagaccau

SEQ ID NO: 1331220 - RNA, 19 nt, Homo sapiens
caacaugugucaagccaau

SEQ ID NO: 1331221 - RNA, 19 nt, Homo sapiens
augauuaacuggccaauaa

SEQ ID NO: 1331222 - RNA, 19 nt, Homo sapiens
ccuguggccuguucauuua

SEQ ID NO: 1331223 - RNA, 19 nt, Homo sapiens
ggaagacauugaccacaga

SEQ ID NO: 1331224 - RNA, 19 nt, Homo sapiens
gaccauggcuguguuaaca

SEQ ID NO: 1331225 - RNA, 19 nt, Homo sapiens
cuagcuaccuguuugcaua

SEQ ID NO: 1331226 - RNA, 19 nt, Homo sapiens
guucaaggcauuagacuuu

SEQ ID NO: 1331227 - RNA, 19 nt, Homo sapiens
gaauuccacucuguuaaug

SEQ ID NO: 1331228 - RNA, 19 nt, Homo sapiens
caaauagccucgcccaucu

SEQ ID NO: 1331229 - RNA, 19 nt, Homo sapiens
uaacgugggucauuacaag

SEQ ID NO: 1331230 - RNA, 19 nt, Homo sapiens
ggaaucauccuugcugaaa

SEQ ID NO: 1331231 - RNA, 19 nt, Homo sapiens
uugaagagcuggugaagga

SEQ ID NO: 1331232 - RNA, 19 nt, Homo sapiens
ggacauggaggaacggaaa

SEQ ID NO: 1331233 - RNA, 19 nt, Homo sapiens
gcugaaaucucccagaaac

SEQ ID NO: 1331234 - RNA, 19 nt, Homo sapiens
caaccacaaugauuaacug

SEQ ID NO: 1331235 - RNA, 19 nt, Homo sapiens
gaacuuaggaagggucuug

SEQ ID NO: 1331236 - RNA, 19 nt, Homo sapiens
gaagagcuggugaaggaaa

SEQ ID NO: 1331237 - RNA, 19 nt, Homo sapiens
ggagaaggagaaacaaaga

SEQ ID NO: 1331238 - RNA, 19 nt, Homo sapiens
gaaucauccuugcugaaau

SEQ ID NO: 1331239 - RNA, 19 nt, Homo sapiens
gcugaauuccacucuguua

SEQ ID NO: 1331240 - RNA, 19 nt, Homo sapiens
uauuuaacgugggucauua

SEQ ID NO: 1331241 - RNA, 19 nt, Homo sapiens
ucagagugaugaugaagga

SEQ ID NO: 1331242 - RNA, 19 nt, Homo sapiens
gagagggucuuagggugaa

SEQ ID NO: 1331243 - RNA, 19 nt, Homo sapiens
gagaaacaaagacuccaaa

SEQ ID NO: 1331244 - RNA, 19 nt, Homo sapiens
cagcccagaucgcgcagua

SEQ ID NO: 1331245 - RNA, 19 nt, Homo sapiens
ggucuuagggugaaauuuc

SEQ ID NO: 1331246 - RNA, 19 nt, Homo sapiens
ccagggauuuggagaagga

SEQ ID NO: 1331247 - RNA, 19 nt, Homo sapiens
gcuaccuguuugcauauuu

SEQ ID NO: 1331248 - RNA, 19 nt, Homo sapiens
gcaaguauucaaccacaau

SEQ ID NO: 1331249 - RNA, 19 nt, Homo sapiens
ggagugaggaacuuaggaa

SEQ ID NO: 1331250 - RNA, 19 nt, Homo sapiens
gaaacuccgggaaauggaa

SEQ ID NO: 1331251 - RNA, 19 nt, Homo sapiens
gagcuagaccgauuugaag

SEQ ID NO: 1331252 - RNA, 19 nt, Homo sapiens
agucuuaccuuccaagcaa

SEQ ID NO: 1331253 - RNA, 19 nt, Homo sapiens
cacgucaggugguggcaua

SEQ ID NO: 1331254 - RNA, 19 nt, Homo sapiens
gaugaugaaggaauccaaa

SEQ ID NO: 1331255 - RNA, 19 nt, Homo sapiens
gugcugaauuccacucugu

SEQ ID NO: 1331256 - RNA, 19 nt, Homo sapiens
guauucaaccacaaugauu

SEQ ID NO: 1331257 - RNA, 19 nt, Homo sapiens
cagaaggagugaggaacuu

SEQ ID NO: 1331258 - RNA, 19 nt, Homo sapiens
ggcaaacaguaccgaggaa

SEQ ID NO: 1331259 - RNA, 19 nt, Homo sapiens
ggaaauccaggagaggaaa

SEQ ID NO: 1331260 - RNA, 19 nt, Homo sapiens
aauccaaacugacgaacau

SEQ ID NO: 1331261 - RNA, 19 nt, Homo sapiens
gcccagaucgcgcaguauu

SEQ ID NO: 1331262 - RNA, 19 nt, Homo sapiens
gaugaaggaauccaaacug

SEQ ID NO: 1331263 - RNA, 19 nt, Homo sapiens
guuucuagcuaccuguuug

SEQ ID NO: 1331264 - RNA, 19 nt, Homo sapiens
gaagacauugaccacagaa

SEQ ID NO: 1331265 - RNA, 19 nt, Homo sapiens
aaucauccuugcugaaauc

SEQ ID NO: 1331266 - RNA, 19 nt, Homo sapiens
ggcauuagacuuugucaag

SEQ ID NO: 1331267 - RNA, 19 nt, Homo sapiens
augaaggaauccaaacuga

SEQ ID NO: 1331268 - RNA, 19 nt, Homo sapiens
gagugaugaugaaggaauc

SEQ ID NO: 1331269 - RNA, 19 nt, Homo sapiens
ccacagaaggagugaggaa

SEQ ID NO: 1331270 - RNA, 19 nt, Homo sapiens
cagagagucuuaccuucca

SEQ ID NO: 1331271 - RNA, 19 nt, Homo sapiens
agaagcagauggagguagu

SEQ ID NO: 1331272 - RNA, 19 nt, Homo sapiens
ugaauuccacucuguuaau

SEQ ID NO: 1331273 - RNA, 19 nt, Homo sapiens
uuucagagggauaagcuua

SEQ ID NO: 1331274 - RNA, 19 nt, Homo sapiens
ggagguagugaccaaagga

SEQ ID NO: 1331275 - RNA, 19 nt, Homo sapiens
gacauugaccacagaagga

SEQ ID NO: 1331276 - RNA, 19 nt, Homo sapiens
uugcugaaaucucccagaa

SEQ ID NO: 1331277 - RNA, 19 nt, Homo sapiens
ugagcuagaccgauuugaa

SEQ ID NO: 1331278 - RNA, 19 nt, Homo sapiens
ccugcgagcuguucagagu

SEQ ID NO: 1331279 - RNA, 19 nt, Homo sapiens
gucauuacaagcaccauuu

SEQ ID NO: 1331280 - RNA, 19 nt, Homo sapiens
gaaggagugaggaacuuag

SEQ ID NO: 1331281 - RNA, 19 nt, Homo sapiens
aaacaguaccgaggaauca

SEQ ID NO: 1331282 - RNA, 19 nt, Homo sapiens
ucaaggcauuagacuuugu

SEQ ID NO: 1331283 - RNA, 19 nt, Homo sapiens
ccaagaccaucacuuacac

SEQ ID NO: 1331284 - RNA, 19 nt, Homo sapiens
gaaacaaagacuccaaaau

SEQ ID NO: 1331285 - RNA, 19 nt, Homo sapiens
caacauccagccagagagu

SEQ ID NO: 1331286 - RNA, 19 nt, Homo sapiens
cuaccuguuugcauauuuc

SEQ ID NO: 1331287 - RNA, 19 nt, Homo sapiens
ccagaucgcgcaguauuuc

SEQ ID NO: 1331288 - RNA, 19 nt, Homo sapiens
gcccgagcaucccuacuag

SEQ ID NO: 1331289 - RNA, 19 nt, Homo sapiens
ggucuugccaccacuuaau

SEQ ID NO: 1331290 - RNA, 19 nt, Homo sapiens
cccagaugguuucuagcua

SEQ ID NO: 1331291 - RNA, 19 nt, Homo sapiens
aagcccagaugguuucuag

SEQ ID NO: 1331292 - RNA, 19 nt, Homo sapiens
agaaggagugaggaacuua

SEQ ID NO: 1331293 - RNA, 19 nt, Homo sapiens
caacgggaaccaaccucuu

SEQ ID NO: 1331294 - RNA, 19 nt, Homo sapiens
ugucaagcccagaugguuu

SEQ ID NO: 1331295 - RNA, 19 nt, Homo sapiens
cccagaaacuccgggaaau

SEQ ID NO: 1331296 - RNA, 19 nt, Homo sapiens
agauggagguagugaccaa

SEQ ID NO: 1331297 - RNA, 19 nt, Homo sapiens
caaacaguaccgaggaauc

SEQ ID NO: 1331298 - RNA, 19 nt, Homo sapiens
ggcaaguauucaaccacaa

SEQ ID NO: 1331299 - RNA, 19 nt, Homo sapiens
ccagaaacuccgggaaaug

SEQ ID NO: 1331300 - RNA, 19 nt, Homo sapiens
gugcggaugcggcuguaaa

SEQ ID NO: 1331301 - RNA, 19 nt, Homo sapiens
gcaaacaguaccgaggaau

SEQ ID NO: 1331302 - RNA, 19 nt, Homo sapiens
gaauccaaacugacgaaca

SEQ ID NO: 1331303 - RNA, 19 nt, Homo sapiens
ugcgagcuguucagaguga

SEQ ID NO: 1331304 - RNA, 19 nt, Homo sapiens
cagaaacuccgggaaaugg

SEQ ID NO: 1331305 - RNA, 19 nt, Homo sapiens
aagaauuccuggcugacau

SEQ ID NO: 1331306 - RNA, 19 nt, Homo sapiens
caccagggauuuggagaag

SEQ ID NO: 1331307 - RNA, 19 nt, Homo sapiens
gagguagugaccaaaggaa

SEQ ID NO: 1331308 - RNA, 19 nt, Homo sapiens
gagcuguucagagugauga

SEQ ID NO: 1331309 - RNA, 19 nt, Homo sapiens
ggucauuacaagcaccauu

SEQ ID NO: 1331310 - RNA, 19 nt, Homo sapiens
ccaccagggauuuggagaa

SEQ ID NO: 1331311 - RNA, 19 nt, Homo sapiens
cuuauuuguucaaggcauu

SEQ ID NO: 1331312 - RNA, 19 nt, Homo sapiens
gccccaagaccaucacuua

SEQ ID NO: 1331313 - RNA, 19 nt, Homo sapiens
ugaaaucucccagaaacuc

SEQ ID NO: 1331314 - RNA, 19 nt, Homo sapiens
caaguauucaaccacaaug

SEQ ID NO: 1331315 - RNA, 19 nt, Homo sapiens
gggauuuggagaaggagaa

SEQ ID NO: 1331316 - RNA, 19 nt, Homo sapiens
ccucaagccaccagggauu

SEQ ID NO: 1331317 - RNA, 19 nt, Homo sapiens
uguggcgggugcugaauuc

SEQ ID NO: 1331318 - RNA, 19 nt, Homo sapiens
uccaggagaggaaagaauu

SEQ ID NO: 1331319 - RNA, 19 nt, Homo sapiens
gaaauccaggagaggaaag

SEQ ID NO: 1331320 - RNA, 19 nt, Homo sapiens
caacaaauaucgcugugau

SEQ ID NO: 1331321 - RNA, 19 nt, Homo sapiens
gaagaguuaugaggaagaa

SEQ ID NO: 1331322 - RNA, 19 nt, Homo sapiens
gucaauagcuacuucgauu

SEQ ID NO: 1331323 - RNA, 19 nt, Homo sapiens
gaucugcucugaccuuaag

SEQ ID NO: 1331324 - RNA, 19 nt, Homo sapiens
ggaggagaaggaagaguua

SEQ ID NO: 1331325 - RNA, 19 nt, Homo sapiens
ggagaaggaagaguuauga

SEQ ID NO: 1331326 - RNA, 19 nt, Homo sapiens
gcgggcagcuugcaucugu

SEQ ID NO: 1331327 - RNA, 19 nt, Homo sapiens
gauggugucuccacucgau

SEQ ID NO: 1331328 - RNA, 19 nt, Homo sapiens
ggagagaagccaguaccua

SEQ ID NO: 1331329 - RNA, 19 nt, Homo sapiens
aaauaucgcugugaugcaa

SEQ ID NO: 1331330 - RNA, 19 nt, Homo sapiens
caagguaccagaaaguaug

SEQ ID NO: 1331331 - RNA, 19 nt, Homo sapiens
ccagcuggaugucuguuau

SEQ ID NO: 1331332 - RNA, 19 nt, Homo sapiens
agaauggagucugucagua

SEQ ID NO: 1331333 - RNA, 19 nt, Homo sapiens
ggaagaauggagucuguca

SEQ ID NO: 1331334 - RNA, 19 nt, Homo sapiens
gaauggagucugucaguac

SEQ ID NO: 1331335 - RNA, 19 nt, Homo sapiens
caguacaggugccgauaug

SEQ ID NO: 1331336 - RNA, 19 nt, Homo sapiens
aaggaagaguuaugaggaa

SEQ ID NO: 1331337 - RNA, 19 nt, Homo sapiens
guacaggugccgauaugga

SEQ ID NO: 1331338 - RNA, 19 nt, Homo sapiens
ggaagaguuaugaggaaga

SEQ ID NO: 1331339 - RNA, 19 nt, Homo sapiens
auagcuacuucgauucuuu

SEQ ID NO: 1331340 - RNA, 19 nt, Homo sapiens
gugcagaggaggagaagga

SEQ ID NO: 1331341 - RNA, 19 nt, Homo sapiens
cagaggaggagaaggaaga

SEQ ID NO: 1331342 - RNA, 19 nt, Homo sapiens
agugauuccuuccugguuu

SEQ ID NO: 1331343 - RNA, 19 nt, Homo sapiens
ucgaucugcucugaccuua

SEQ ID NO: 1331344 - RNA, 19 nt, Homo sapiens
ggucucaagguaccagaaa

SEQ ID NO: 1331345 - RNA, 19 nt, Homo sapiens
cacuugcggugccaacaaa

SEQ ID NO: 1331346 - RNA, 19 nt, Homo sapiens
uuuccugggucucaaggua

SEQ ID NO: 1331347 - RNA, 19 nt, Homo sapiens
caaaguggaagccugugau

SEQ ID NO: 1331348 - RNA, 19 nt, Homo sapiens
ccaaaguggaagccuguga

SEQ ID NO: 1331349 - RNA, 19 nt, Homo sapiens
caauagcuacuucgauucu

SEQ ID NO: 1331350 - RNA, 19 nt, Homo sapiens
ucaagguaccagaaaguau

SEQ ID NO: 1331351 - RNA, 19 nt, Homo sapiens
gauauggaaaggcaccaau

SEQ ID NO: 1331352 - RNA, 19 nt, Homo sapiens
aaaguggaagccugugauu

SEQ ID NO: 1331353 - RNA, 19 nt, Homo sapiens
aauggagucugucaguaca

SEQ ID NO: 1331354 - RNA, 19 nt, Homo sapiens
aguauggacuugggcauuc

SEQ ID NO: 1331355 - RNA, 19 nt, Homo sapiens
agggaagaauggagucugu

SEQ ID NO: 1331356 - RNA, 19 nt, Homo sapiens
caaauaucgcugugaugca

SEQ ID NO: 1331357 - RNA, 19 nt, Homo sapiens
uuccagcaaugacaaagug

SEQ ID NO: 1331358 - RNA, 19 nt, Homo sapiens
gauacccucuucuggcuuu

SEQ ID NO: 1331359 - RNA, 19 nt, Homo sapiens
ccaaagagcccaguacagu

SEQ ID NO: 1331360 - RNA, 19 nt, Homo sapiens
augcaugaguucccagaua

SEQ ID NO: 1331361 - RNA, 19 nt, Homo sapiens
ugucugauguccaggaugu

SEQ ID NO: 1331362 - RNA, 19 nt, Homo sapiens
aaagcuccuuguccucauu

SEQ ID NO: 1331363 - RNA, 19 nt, Homo sapiens
gcuugugccugaccucauc

SEQ ID NO: 1331364 - RNA, 19 nt, Homo sapiens
aaagagcccaguacagugu

SEQ ID NO: 1331365 - RNA, 19 nt, Homo sapiens
guucccagauacccucuuc

SEQ ID NO: 1331366 - RNA, 19 nt, Homo sapiens
ggcacuuccugucugaugu

SEQ ID NO: 1331367 - RNA, 19 nt, Homo sapiens
uaaagcuccuuguccucau

SEQ ID NO: 1331368 - RNA, 19 nt, Homo sapiens
gcuccuuguccucauuaaa

SEQ ID NO: 1331369 - RNA, 19 nt, Homo sapiens
acucaacuccugccaagau

SEQ ID NO: 1331370 - RNA, 19 nt, Homo sapiens
ugcaugaguucccagauac

SEQ ID NO: 1331371 - RNA, 19 nt, Homo sapiens
gaagaaggauugccauuag

SEQ ID NO: 1331372 - RNA, 19 nt, Homo sapiens
agaagaaguuccagaaaua

SEQ ID NO: 1331373 - RNA, 19 nt, Homo sapiens
ggagguaucugcccuguca

SEQ ID NO: 1331374 - RNA, 19 nt, Homo sapiens
ucacuuggcugguguuuga

SEQ ID NO: 1331375 - RNA, 19 nt, Homo sapiens
ggaagaaggauugccauua

SEQ ID NO: 1331376 - RNA, 19 nt, Homo sapiens
gaaagccacuucucauaca

SEQ ID NO: 1331377 - RNA, 19 nt, Homo sapiens
gcagugccauccucaugua

SEQ ID NO: 1331378 - RNA, 19 nt, Homo sapiens
cagcuaaccucucuucuuc

SEQ ID NO: 1331379 - RNA, 19 nt, Homo sapiens
ccacagaagugagcaagaa

SEQ ID NO: 1331380 - RNA, 19 nt, Homo sapiens
ccaguuagaugauucacuu

SEQ ID NO: 1331381 - RNA, 19 nt, Homo sapiens
cagaagaaguuccagaaau

SEQ ID NO: 1331382 - RNA, 19 nt, Homo sapiens
gcacagaggccacagaagu

SEQ ID NO: 1331383 - RNA, 19 nt, Homo sapiens
gcgaaagccacuucucaua

SEQ ID NO: 1331384 - RNA, 19 nt, Homo sapiens
caaaggaaacucagucuuc

SEQ ID NO: 1331385 - RNA, 19 nt, Homo sapiens
ucauggagcugaccugguu

SEQ ID NO: 1331386 - RNA, 19 nt, Homo sapiens
gcaggcaacuuccgaaugc

SEQ ID NO: 1331387 - RNA, 19 nt, Homo sapiens
gcagauuaguuccaaagca

SEQ ID NO: 1331388 - RNA, 19 nt, Homo sapiens
gccgauggguccagaagaa

SEQ ID NO: 1331389 - RNA, 19 nt, Homo sapiens
gaaggauugccauuaguga

SEQ ID NO: 1331390 - RNA, 19 nt, Homo sapiens
ucugucaccuggcucaaua

SEQ ID NO: 1331391 - RNA, 19 nt, Homo sapiens
agaaugaaguguacaagca

SEQ ID NO: 1331392 - RNA, 19 nt, Homo sapiens
gcucaucgcugugcucuac

SEQ ID NO: 1331393 - RNA, 19 nt, Homo sapiens
gcaaugcuaucaucaucgu

SEQ ID NO: 1331394 - RNA, 19 nt, Homo sapiens
ggaggaaccagcugcaaau

SEQ ID NO: 1331395 - RNA, 19 nt, Homo sapiens
gaaguuccagaaauacauu

SEQ ID NO: 1331396 - RNA, 19 nt, Homo sapiens
gcaagggcuuugugaaacu

SEQ ID NO: 1331397 - RNA, 19 nt, Homo sapiens
ucuccuguguguucuguua

SEQ ID NO: 1331398 - RNA, 19 nt, Homo sapiens
ggaaccagcugcaaaucac

SEQ ID NO: 1331399 - RNA, 19 nt, Homo sapiens
caagaaguucccaggcaua

SEQ ID NO: 1331400 - RNA, 19 nt, Homo sapiens
ggaaugcuccaguuugauc

SEQ ID NO: 1331401 - RNA, 19 nt, Homo sapiens
gaacacacccaagaaaggu

SEQ ID NO: 1331402 - RNA, 19 nt, Homo sapiens
gaggaugccgccaccauga

SEQ ID NO: 1331403 - RNA, 19 nt, Homo sapiens
guaguaggcaucuggaaug

SEQ ID NO: 1331404 - RNA, 19 nt, Homo sapiens
caccaggaacuauaucuuu

SEQ ID NO: 1331405 - RNA, 19 nt, Homo sapiens
caggaccucuucucuguca

SEQ ID NO: 1331406 - RNA, 19 nt, Homo sapiens
uacauauucugcacugauu

SEQ ID NO: 1331407 - RNA, 19 nt, Homo sapiens
gguccuguccuuccuugua

SEQ ID NO: 1331408 - RNA, 19 nt, Homo sapiens
ugagaucauugcaccaugu

SEQ ID NO: 1331409 - RNA, 19 nt, Homo sapiens
gggugucuguggguuauuu

SEQ ID NO: 1331410 - RNA, 19 nt, Homo sapiens
ccgcaagggcuuugugaaa

SEQ ID NO: 1331411 - RNA, 19 nt, Homo sapiens
ggaacacacccaagaaagg

SEQ ID NO: 1331412 - RNA, 19 nt, Homo sapiens
gaagaaguuccagaaauac

SEQ ID NO: 1331413 - RNA, 19 nt, Homo sapiens
ccagaagaaguuccagaaa

SEQ ID NO: 1331414 - RNA, 19 nt, Homo sapiens
acaagcaggugaucuucga

SEQ ID NO: 1331415 - RNA, 19 nt, Homo sapiens
gagagaaugaaguguacaa

SEQ ID NO: 1331416 - RNA, 19 nt, Homo sapiens
ggccuuaccuggcuacacu

SEQ ID NO: 1331417 - RNA, 19 nt, Homo sapiens
gcugugcucuacuucacuu

SEQ ID NO: 1331418 - RNA, 19 nt, Homo sapiens
guacauauucugcacugau

SEQ ID NO: 1331419 - RNA, 19 nt, Homo sapiens
ccaacccucuccugugugu

SEQ ID NO: 1331420 - RNA, 19 nt, Homo sapiens
gcagcagauuaguuccaaa

SEQ ID NO: 1331421 - RNA, 19 nt, Homo sapiens
uuucuuggguggcugauga

SEQ ID NO: 1331422 - RNA, 19 nt, Homo sapiens
ugagcuagguggaguaacu

SEQ ID NO: 1331423 - RNA, 19 nt, Homo sapiens
aaaggaaacucagucuucu

SEQ ID NO: 1331424 - RNA, 19 nt, Homo sapiens
agcaagacaucgaccugua

SEQ ID NO: 1331425 - RNA, 19 nt, Homo sapiens
ccaagcccaucaccacugu

SEQ ID NO: 1331426 - RNA, 19 nt, Homo sapiens
aaacuggcccugcgucaug

SEQ ID NO: 1331427 - RNA, 19 nt, Homo sapiens
guucuguuaucucuugaug

SEQ ID NO: 1331428 - RNA, 19 nt, Homo sapiens
uguguucuguuaucucuug

SEQ ID NO: 1331429 - RNA, 19 nt, Homo sapiens
uccaggaccucuucucugu

SEQ ID NO: 1331430 - RNA, 19 nt, Homo sapiens
gaguggcaaugcuaucauc

SEQ ID NO: 1331431 - RNA, 19 nt, Homo sapiens
caggaacuauaucuuugga

SEQ ID NO: 1331432 - RNA, 19 nt, Homo sapiens
cgaaagccacuucucauac

SEQ ID NO: 1331433 - RNA, 19 nt, Homo sapiens
ggauugccauuagugacuu

SEQ ID NO: 1331434 - RNA, 19 nt, Homo sapiens
uuagugacuuggaccaguu

SEQ ID NO: 1331435 - RNA, 19 nt, Homo sapiens
gggaagaaggauugccauu

SEQ ID NO: 1331436 - RNA, 19 nt, Homo sapiens
gucaguauuucaaguucuu

SEQ ID NO: 1331437 - RNA, 19 nt, Homo sapiens
ucuguuaucucuugaugag

SEQ ID NO: 1331438 - RNA, 19 nt, Homo sapiens
cauacaagccccuuuauug

SEQ ID NO: 1331439 - RNA, 19 nt, Homo sapiens
guucccaucuacuccuuug

SEQ ID NO: 1331440 - RNA, 19 nt, Homo sapiens
uggcaaugcuaucaucauc

SEQ ID NO: 1331441 - RNA, 19 nt, Homo sapiens
cagaagugagcaagaaguu

SEQ ID NO: 1331442 - RNA, 19 nt, Homo sapiens
ggaguuggagagcacaguu

SEQ ID NO: 1331443 - RNA, 19 nt, Homo sapiens
gaaugggaguggcaaugcu

SEQ ID NO: 1331444 - RNA, 19 nt, Homo sapiens
ccugaugucuggagguauc

SEQ ID NO: 1331445 - RNA, 19 nt, Homo sapiens
accaggaacuauaucuuug

SEQ ID NO: 1331446 - RNA, 19 nt, Homo sapiens
gcagcuacaggucaucuca

SEQ ID NO: 1331447 - RNA, 19 nt, Homo sapiens
uagguggaguaacugguuu

SEQ ID NO: 1331448 - RNA, 19 nt, Homo sapiens
cagcacagaggccacagaa

SEQ ID NO: 1331449 - RNA, 19 nt, Homo sapiens
gcgcuacuuucgagacuac

SEQ ID NO: 1331450 - RNA, 19 nt, Homo sapiens
uaaaugaaagugagaaucc

SEQ ID NO: 1331451 - RNA, 19 nt, Homo sapiens
aaagccacuucucauacaa

SEQ ID NO: 1331452 - RNA, 19 nt, Homo sapiens
gcucagcuaaccucucuuc

SEQ ID NO: 1331453 - RNA, 19 nt, Homo sapiens
uguucuaggugguggcuaa

SEQ ID NO: 1331454 - RNA, 19 nt, Homo sapiens
gcaagacaucgaccuguac

SEQ ID NO: 1331455 - RNA, 19 nt, Homo sapiens
gauggguccagaagaaguu

SEQ ID NO: 1331456 - RNA, 19 nt, Homo sapiens
gagacuacuuucccaucca

SEQ ID NO: 1331457 - RNA, 19 nt, Homo sapiens
guccgaaacugggcugugu

SEQ ID NO: 1331458 - RNA, 19 nt, Homo sapiens
uuggguggcugaugacaug

SEQ ID NO: 1331459 - RNA, 19 nt, Homo sapiens
ggcuaaaucugggccuaau

SEQ ID NO: 1331460 - RNA, 19 nt, Homo sapiens
gaaccgcaagggcuuugug

SEQ ID NO: 1331461 - RNA, 19 nt, Homo sapiens
ggucacaguggguccgaaa

SEQ ID NO: 1331462 - RNA, 19 nt, Homo sapiens
ucagcuaaccucucuucuu

SEQ ID NO: 1331463 - RNA, 19 nt, Homo sapiens
aagaaggauugccauuagu

SEQ ID NO: 1331464 - RNA, 19 nt, Homo sapiens
ucuaggugguggcuaaauc

SEQ ID NO: 1331465 - RNA, 19 nt, Homo sapiens
uuccagaaauacauugguu

SEQ ID NO: 1331466 - RNA, 19 nt, Homo sapiens
guacaagcaggugaucuuc

SEQ ID NO: 1331467 - RNA, 19 nt, Homo sapiens
gaacccaagccucacuuuu

SEQ ID NO: 1331468 - RNA, 19 nt, Homo sapiens
ccaguuugaucucccuucu

SEQ ID NO: 1331469 - RNA, 19 nt, Homo sapiens
gagaggcgaaagccacuuc

SEQ ID NO: 1331470 - RNA, 19 nt, Homo sapiens
aggaaacucagucuucuug

SEQ ID NO: 1331471 - RNA, 19 nt, Homo sapiens
gaaagaauauggcaaagcu

SEQ ID NO: 1331472 - RNA, 19 nt, Homo sapiens
gaaccagaaugaaucaaau

SEQ ID NO: 1331473 - RNA, 19 nt, Homo sapiens
uggcaaagcugaugcaaga

SEQ ID NO: 1331474 - RNA, 19 nt, Homo sapiens
uaggaaacguugcaaauuc

SEQ ID NO: 1331475 - RNA, 19 nt, Homo sapiens
gaaaaugcaucagaaagaa

SEQ ID NO: 1331476 - RNA, 19 nt, Homo sapiens
caagauggguuuauuuuga

SEQ ID NO: 1331477 - RNA, 19 nt, Homo sapiens
gaugcaagauggguuuauu

SEQ ID NO: 1331478 - RNA, 19 nt, Homo sapiens
aaagaaaccaguucaguga

SEQ ID NO: 1331479 - RNA, 19 nt, Homo sapiens
uggcauuguuccucauuua

SEQ ID NO: 1331480 - RNA, 19 nt, Homo sapiens
ggaugggucucuggcauug

SEQ ID NO: 1331481 - RNA, 19 nt, Homo sapiens
gcaaagcugaugcaagaug

SEQ ID NO: 1331482 - RNA, 19 nt, Homo sapiens
cagaguggcucaccagaag

SEQ ID NO: 1331483 - RNA, 19 nt, Homo sapiens
guaggaaacguugcaaauu

SEQ ID NO: 1331484 - RNA, 19 nt, Homo sapiens
guaauacauuccagucuac

SEQ ID NO: 1331485 - RNA, 19 nt, Homo sapiens
uggcuugauugcuucuuua

SEQ ID NO: 1331486 - RNA, 19 nt, Homo sapiens
aaauuccgauggcuugauu

SEQ ID NO: 1331487 - RNA, 19 nt, Homo sapiens
cauugugucuguggaaauu

SEQ ID NO: 1331488 - RNA, 19 nt, Homo sapiens
cuguauggcugcuggauga

SEQ ID NO: 1331489 - RNA, 19 nt, Homo sapiens
gauugcuucuuuauggaaa

SEQ ID NO: 1331490 - RNA, 19 nt, Homo sapiens
gggaaaagagaacaaauuu

SEQ ID NO: 1331491 - RNA, 19 nt, Homo sapiens
gaauauggcaaagcugaug

SEQ ID NO: 1331492 - RNA, 19 nt, Homo sapiens
ucaagaaaaugcaucagaa

SEQ ID NO: 1331493 - RNA, 19 nt, Homo sapiens
gcauuguuccucauuuaug

SEQ ID NO: 1331494 - RNA, 19 nt, Homo sapiens
cuugauugcuucuuuaugg

SEQ ID NO: 1331495 - RNA, 19 nt, Homo sapiens
uggcuguacuguuggcuuu

SEQ ID NO: 1331496 - RNA, 19 nt, Homo sapiens
ugaaccagaaugaaucaaa

SEQ ID NO: 1331497 - RNA, 19 nt, Homo sapiens
accauuaucuaacuucaug

SEQ ID NO: 1331498 - RNA, 19 nt, Homo sapiens
caaccuguuucaaauuggu

SEQ ID NO: 1331499 - RNA, 19 nt, Homo sapiens
acauuccagucuacacuuu

SEQ ID NO: 1331500 - RNA, 19 nt, Homo sapiens
uaucuaacuucaugaacca

SEQ ID NO: 1331501 - RNA, 19 nt, Homo sapiens
uccgauggcuugauugcuu

SEQ ID NO: 1331502 - RNA, 19 nt, Homo sapiens
caucagaaagaaaccaguu

SEQ ID NO: 1331503 - RNA, 19 nt, Homo sapiens
agucauggcuagaacucaa

SEQ ID NO: 1331504 - RNA, 19 nt, Homo sapiens
acuguuggcuuuaccuguu

SEQ ID NO: 1331505 - RNA, 19 nt, Homo sapiens
ggcuagaacucaagaaaau

SEQ ID NO: 1331506 - RNA, 19 nt, Homo sapiens
gcugaugcaagauggguuu

SEQ ID NO: 1331507 - RNA, 19 nt, Homo sapiens
aaauggugauauagggaaa

SEQ ID NO: 1331508 - RNA, 19 nt, Homo sapiens
cuaacuucaugaaccagaa

SEQ ID NO: 1331509 - RNA, 19 nt, Homo sapiens
ccagaguggcucaccagaa

SEQ ID NO: 1331510 - RNA, 19 nt, Homo sapiens
gcaaauuccgauggcuuga

SEQ ID NO: 1331511 - RNA, 19 nt, Homo sapiens
ucagaaagaaaccaguuca

SEQ ID NO: 1331512 - RNA, 19 nt, Homo sapiens
ggaaaagagaacaaauuug

SEQ ID NO: 1331513 - RNA, 19 nt, Homo sapiens
ccagaaugaaucaaaucuu

SEQ ID NO: 1331514 - RNA, 19 nt, Homo sapiens
agaaagaaaccaguucagu

SEQ ID NO: 1331515 - RNA, 19 nt, Homo sapiens
caagaaaaugcaucagaaa

SEQ ID NO: 1331516 - RNA, 19 nt, Homo sapiens
ggaaagaauauggcaaagc

SEQ ID NO: 1331517 - RNA, 19 nt, Homo sapiens
gcgaccaguuuucguugua

SEQ ID NO: 1331518 - RNA, 19 nt, Homo sapiens
cauuguuccucauuuaugc

SEQ ID NO: 1331519 - RNA, 19 nt, Homo sapiens
ggcauuguuccucauuuau

SEQ ID NO: 1331520 - RNA, 19 nt, Homo sapiens
gcaagauggguuuauuuug

SEQ ID NO: 1331521 - RNA, 19 nt, Homo sapiens
acaccauuaucuaacuuca

SEQ ID NO: 1331522 - RNA, 19 nt, Homo sapiens
cggcauuuccugcagauca

SEQ ID NO: 1331523 - RNA, 19 nt, Homo sapiens
caugaaccagaaugaauca

SEQ ID NO: 1331524 - RNA, 19 nt, Homo sapiens
gcuguacuguuggcuuuac

SEQ ID NO: 1331525 - RNA, 19 nt, Homo sapiens
ggacagagccagauucaga

SEQ ID NO: 1331526 - RNA, 19 nt, Homo sapiens
gauggaaguugcuaaauuc

SEQ ID NO: 1331527 - RNA, 19 nt, Homo sapiens
gaaugaaugucacuugugu

SEQ ID NO: 1331528 - RNA, 19 nt, Homo sapiens
ucacauaccuaccaguuug

SEQ ID NO: 1331529 - RNA, 19 nt, Homo sapiens
aaaguggacugcagcauuu

SEQ ID NO: 1331530 - RNA, 19 nt, Homo sapiens
gaaaggaacgauauucuca

SEQ ID NO: 1331531 - RNA, 19 nt, Homo sapiens
cgauggaaguugcuaaauu

SEQ ID NO: 1331532 - RNA, 19 nt, Homo sapiens
ggacauagagagaaaggaa

SEQ ID NO: 1331533 - RNA, 19 nt, Homo sapiens
agaguaaucuugacugaau

SEQ ID NO: 1331534 - RNA, 19 nt, Homo sapiens
ggaacgauauucucaucau

SEQ ID NO: 1331535 - RNA, 19 nt, Homo sapiens
gaacgauauucucaucauc

SEQ ID NO: 1331536 - RNA, 19 nt, Homo sapiens
gaaaaguaauggaagaguu

SEQ ID NO: 1331537 - RNA, 19 nt, Homo sapiens
gggaaugaaugucacuugu

SEQ ID NO: 1331538 - RNA, 19 nt, Homo sapiens
guacaguggucuauuucug

SEQ ID NO: 1331539 - RNA, 19 nt, Homo sapiens
gauauucucaucaucauca

SEQ ID NO: 1331540 - RNA, 19 nt, Homo sapiens
agagccagauucagaguaa

SEQ ID NO: 1331541 - RNA, 19 nt, Homo sapiens
uaaauucuccauggacaua

SEQ ID NO: 1331542 - RNA, 19 nt, Homo sapiens
ccauggacauagagagaaa

SEQ ID NO: 1331543 - RNA, 19 nt, Homo sapiens
ucuguacaguggucuauuu

SEQ ID NO: 1331544 - RNA, 19 nt, Homo sapiens
gagagaaaggaacgauauu

SEQ ID NO: 1331545 - RNA, 19 nt, Homo sapiens
ccacagccauuuccagcau

SEQ ID NO: 1331546 - RNA, 19 nt, Homo sapiens
uaauggaagaguucaguuu

SEQ ID NO: 1331547 - RNA, 19 nt, Homo sapiens
ggaaugaaugucacuugug

SEQ ID NO: 1331548 - RNA, 19 nt, Homo sapiens
cugcuagucugucuccaaa

SEQ ID NO: 1331549 - RNA, 19 nt, Homo sapiens
cuacaucaccuaugggaau

SEQ ID NO: 1331550 - RNA, 19 nt, Homo sapiens
caucacauaccuaccaguu

SEQ ID NO: 1331551 - RNA, 19 nt, Homo sapiens
gcucagaagcugcuagucu

SEQ ID NO: 1331552 - RNA, 19 nt, Homo sapiens
gaguaaucuugacugaaug

SEQ ID NO: 1331553 - RNA, 19 nt, Homo sapiens
agagagaaaggaacgauau

SEQ ID NO: 1331554 - RNA, 19 nt, Homo sapiens
accgagagcuugaaaagua

SEQ ID NO: 1331555 - RNA, 19 nt, Homo sapiens
gcucugacugaguuucuuu

SEQ ID NO: 1331556 - RNA, 19 nt, Homo sapiens
cccaggcucugacugaguu

SEQ ID NO: 1331557 - RNA, 19 nt, Homo sapiens
ucucagagcagcuucaaca

SEQ ID NO: 1331558 - RNA, 19 nt, Homo sapiens
caucaccuaugggaaugaa

SEQ ID NO: 1331559 - RNA, 19 nt, Homo sapiens
ggacugcagcauuuacaag

SEQ ID NO: 1331560 - RNA, 19 nt, Homo sapiens
aaggaacgauauucucauc

SEQ ID NO: 1331561 - RNA, 19 nt, Homo sapiens
guaauggaagaguucaguu

SEQ ID NO: 1331562 - RNA, 19 nt, Homo sapiens
gacugcagcauuuacaaga

SEQ ID NO: 1331563 - RNA, 19 nt, Homo sapiens
caucccaggcucugacuga

SEQ ID NO: 1331564 - RNA, 19 nt, Homo sapiens
uagagagaaaggaacgaua

SEQ ID NO: 1331565 - RNA, 19 nt, Homo sapiens
gcagcauuuacaagaagua

SEQ ID NO: 1331566 - RNA, 19 nt, Homo sapiens
gacugaauggagaaaguuu

SEQ ID NO: 1331567 - RNA, 19 nt, Homo sapiens
caucaucaucuucaucauc

SEQ ID NO: 1331568 - RNA, 19 nt, Homo sapiens
ucaccuaugggaaugaaug

SEQ ID NO: 1331569 - RNA, 19 nt, Homo sapiens
acagccauuuccagcauga

SEQ ID NO: 1331570 - RNA, 19 nt, Homo sapiens
cugacuacaucaccuaugg

SEQ ID NO: 1331571 - RNA, 19 nt, Homo sapiens
ucacugacagaccagcauu

SEQ ID NO: 1331572 - RNA, 19 nt, Homo sapiens
agagaaaggaacgauauuc

SEQ ID NO: 1331573 - RNA, 19 nt, Homo sapiens
guucugacuacaucaccua

SEQ ID NO: 1331574 - RNA, 19 nt, Homo sapiens
gcauuuacaagaaguaucc

SEQ ID NO: 1331575 - RNA, 19 nt, Homo sapiens
ugacugaauggagaaaguu

SEQ ID NO: 1331576 - RNA, 19 nt, Homo sapiens
gacaaucucagagcagcuu

SEQ ID NO: 1331577 - RNA, 19 nt, Homo sapiens
uugcuaaauucuccaugga

SEQ ID NO: 1331578 - RNA, 19 nt, Homo sapiens
ccuaugggaaugaauguca

SEQ ID NO: 1331579 - RNA, 19 nt, Homo sapiens
gagccagauucagaguaau

SEQ ID NO: 1331580 - RNA, 19 nt, Homo sapiens
cacgauggaaguugcuaaa

SEQ ID NO: 1331581 - RNA, 19 nt, Homo sapiens
gcagcuguagugacaaucu

SEQ ID NO: 1331582 - RNA, 19 nt, Homo sapiens
acugcagcauuuacaagaa

SEQ ID NO: 1331583 - RNA, 19 nt, Homo sapiens
gcacagaaguuuaacaauc

SEQ ID NO: 1331584 - RNA, 19 nt, Homo sapiens
gaaugaaugccaaaucuua

SEQ ID NO: 1331585 - RNA, 19 nt, Homo sapiens
uaacgaaacucaacaaagu

SEQ ID NO: 1331586 - RNA, 19 nt, Homo sapiens
gugaaacucuuggaaauaa

SEQ ID NO: 1331587 - RNA, 19 nt, Homo sapiens
ucaaggaacuccaucauca

SEQ ID NO: 1331588 - RNA, 19 nt, Homo sapiens
guagaagccuggauguuug

SEQ ID NO: 1331589 - RNA, 19 nt, Homo sapiens
ccacaaggcugucugagau

SEQ ID NO: 1331590 - RNA, 19 nt, Homo sapiens
ggaacuccaucaucagaaa

SEQ ID NO: 1331591 - RNA, 19 nt, Homo sapiens
gcagaacacuggaguaaac

SEQ ID NO: 1331592 - RNA, 19 nt, Homo sapiens
ggaacaacauggagcaguu

SEQ ID NO: 1331593 - RNA, 19 nt, Homo sapiens
ccuggaaucucuaaaguuu

SEQ ID NO: 1331594 - RNA, 19 nt, Homo sapiens
gcaauacccaguucaauau

SEQ ID NO: 1331595 - RNA, 19 nt, Homo sapiens
gagaaugaaugccaaaucu

SEQ ID NO: 1331596 - RNA, 19 nt, Homo sapiens
ugaagaaacugagccauga

SEQ ID NO: 1331597 - RNA, 19 nt, Homo sapiens
gagaacaccgcacaaguuu

SEQ ID NO: 1331598 - RNA, 19 nt, Homo sapiens
gaaauaauggagucgguuu

SEQ ID NO: 1331599 - RNA, 19 nt, Homo sapiens
gaacaacauggagcaguua

SEQ ID NO: 1331600 - RNA, 19 nt, Homo sapiens
ggauuaccauugccuuauu

SEQ ID NO: 1331601 - RNA, 19 nt, Homo sapiens
aacaucaucucccaaauuu

SEQ ID NO: 1331602 - RNA, 19 nt, Homo sapiens
caagaaagagcuauagaau

SEQ ID NO: 1331603 - RNA, 19 nt, Homo sapiens
gagaagccaauucagauaa

SEQ ID NO: 1331604 - RNA, 19 nt, Homo sapiens
cagcuuugcuagagaauga

SEQ ID NO: 1331605 - RNA, 19 nt, Homo sapiens
uaagaaagcuugcaauacc

SEQ ID NO: 1331606 - RNA, 19 nt, Homo sapiens
gcaaagaaaguagaaaugu

SEQ ID NO: 1331607 - RNA, 19 nt, Homo sapiens
gaacaggugaagaaacuga

SEQ ID NO: 1331608 - RNA, 19 nt, Homo sapiens
uaagucuggucuuuaauga

SEQ ID NO: 1331609 - RNA, 19 nt, Homo sapiens
caagagaagccaauucaga

SEQ ID NO: 1331610 - RNA, 19 nt, Homo sapiens
gaauagcagccaucaaguu

SEQ ID NO: 1331611 - RNA, 19 nt, Homo sapiens
gaugccaccuuccaccuaa

SEQ ID NO: 1331612 - RNA, 19 nt, Homo sapiens
gaaaagcucuuaggggaaa

SEQ ID NO: 1331613 - RNA, 19 nt, Homo sapiens
uaucuggacccuaggauua

SEQ ID NO: 1331614 - RNA, 19 nt, Homo sapiens
auaaugaagugucggcuaa

SEQ ID NO: 1331615 - RNA, 19 nt, Homo sapiens
agacauaagugaaacucuu

SEQ ID NO: 1331616 - RNA, 19 nt, Homo sapiens
uaucagaaaucucagaaag

SEQ ID NO: 1331617 - RNA, 19 nt, Homo sapiens
ggccagcucugcuaaguca

SEQ ID NO: 1331618 - RNA, 19 nt, Homo sapiens
gcuagcagccuaagauaga

SEQ ID NO: 1331619 - RNA, 19 nt, Homo sapiens
aauagcagccaucaaguua

SEQ ID NO: 1331620 - RNA, 19 nt, Homo sapiens
ggagauugacacuuauauu

SEQ ID NO: 1331621 - RNA, 19 nt, Homo sapiens
cagaaagacauaagugaaa

SEQ ID NO: 1331622 - RNA, 19 nt, Homo sapiens
caacauggagcaguuacua

SEQ ID NO: 1331623 - RNA, 19 nt, Homo sapiens
gacuuaauguucaagaaga

SEQ ID NO: 1331624 - RNA, 19 nt, Homo sapiens
uaacuuuggucucugacuu

SEQ ID NO: 1331625 - RNA, 19 nt, Homo sapiens
caauauucauguugcaaga

SEQ ID NO: 1331626 - RNA, 19 nt, Homo sapiens
gaacaagcaagcaaugaag

SEQ ID NO: 1331627 - RNA, 19 nt, Homo sapiens
aaacaucaucucccaaauu

SEQ ID NO: 1331628 - RNA, 19 nt, Homo sapiens
aaacccagccaaauaauga

SEQ ID NO: 1331629 - RNA, 19 nt, Homo sapiens
gaaaagaaacagcagauga

SEQ ID NO: 1331630 - RNA, 19 nt, Homo sapiens
ccaagaaagagcuauagaa

SEQ ID NO: 1331631 - RNA, 19 nt, Homo sapiens
caaccaagaaagagcuaua

SEQ ID NO: 1331632 - RNA, 19 nt, Homo sapiens
caucaaaccuugggcagau

SEQ ID NO: 1331633 - RNA, 19 nt, Homo sapiens
uaucagaggacuugacaaa

SEQ ID NO: 1331634 - RNA, 19 nt, Homo sapiens
uaucagaggacuugacaaa

SEQ ID NO: 1331635 - RNA, 19 nt, Homo sapiens
gauagacagccuagaguga

SEQ ID NO: 1331636 - RNA, 19 nt, Homo sapiens
cuacaucuguuaccuccaa

SEQ ID NO: 1331637 - RNA, 19 nt, Homo sapiens
cuggauguuugucuuaaua

SEQ ID NO: 1331638 - RNA, 19 nt, Homo sapiens
uaagugaaacucuuggaaa

SEQ ID NO: 1331639 - RNA, 19 nt, Homo sapiens
gaaaauaucagaggacuug

SEQ ID NO: 1331640 - RNA, 19 nt, Homo sapiens
gaaaauaucagaggacuug

SEQ ID NO: 1331641 - RNA, 19 nt, Homo sapiens
cacagaaguuuaacaaucu

SEQ ID NO: 1331642 - RNA, 19 nt, Homo sapiens
agaagccaauucagauaaa

SEQ ID NO: 1331643 - RNA, 19 nt, Homo sapiens
caucaucucccaaauuuua

SEQ ID NO: 1331644 - RNA, 19 nt, Homo sapiens
gaaacucuuggaaauaaug

SEQ ID NO: 1331645 - RNA, 19 nt, Homo sapiens
gagaaagaagacaaugaaa

SEQ ID NO: 1331646 - RNA, 19 nt, Homo sapiens
gagaugauauuggaaacca

SEQ ID NO: 1331647 - RNA, 19 nt, Homo sapiens
gagaaagaagacaaugaaa

SEQ ID NO: 1331648 - RNA, 19 nt, Homo sapiens
ugagaacaccgcacaaguu

SEQ ID NO: 1331649 - RNA, 19 nt, Homo sapiens
agaaacagcagaugauaau

SEQ ID NO: 1331650 - RNA, 19 nt, Homo sapiens
ccaguucaauauucauguu

SEQ ID NO: 1331651 - RNA, 19 nt, Homo sapiens
gauggcagcuuugcuagag

SEQ ID NO: 1331652 - RNA, 19 nt, Homo sapiens
gaaaucucagaaagacaua

SEQ ID NO: 1331653 - RNA, 19 nt, Homo sapiens
aaagaaacagcagaugaua

SEQ ID NO: 1331654 - RNA, 19 nt, Homo sapiens
gaaacaggagaugauauug

SEQ ID NO: 1331655 - RNA, 19 nt, Homo sapiens
agaaacaggagaugauauu

SEQ ID NO: 1331656 - RNA, 19 nt, Homo sapiens
aaagaaacaggagaugaua

SEQ ID NO: 1331657 - RNA, 19 nt, Homo sapiens
gaacaacagacugcacaga

SEQ ID NO: 1331658 - RNA, 19 nt, Homo sapiens
guaagucuggucuuuaaug

SEQ ID NO: 1331659 - RNA, 19 nt, Homo sapiens
ucagaaaucucagaaagac

SEQ ID NO: 1331660 - RNA, 19 nt, Homo sapiens
agacugcacagaaguuuaa

SEQ ID NO: 1331661 - RNA, 19 nt, Homo sapiens
gcuauagaauaaggagauu

SEQ ID NO: 1331662 - RNA, 19 nt, Homo sapiens
ugcaauacccaguucaaua

SEQ ID NO: 1331663 - RNA, 19 nt, Homo sapiens
uguagaagccuggauguuu

SEQ ID NO: 1331664 - RNA, 19 nt, Homo sapiens
gcagaacaagcaagcaaug

SEQ ID NO: 1331665 - RNA, 19 nt, Homo sapiens
gaaagaagacaaugaaaag

SEQ ID NO: 1331666 - RNA, 19 nt, Homo sapiens
gaaagaagacaaugaaaag

SEQ ID NO: 1331667 - RNA, 19 nt, Homo sapiens
gauuaccauugccuuauuc

SEQ ID NO: 1331668 - RNA, 19 nt, Homo sapiens
guucauaacuuuucaccuu

SEQ ID NO: 1331669 - RNA, 19 nt, Homo sapiens
caacuugucagucaugauc

SEQ ID NO: 1331670 - RNA, 19 nt, Homo sapiens
cuaaacaucaucucccaaa

SEQ ID NO: 1331671 - RNA, 19 nt, Homo sapiens
gaagcagaacacuggagua

SEQ ID NO: 1331672 - RNA, 19 nt, Homo sapiens
cagcagaugauaauggaaa

SEQ ID NO: 1331673 - RNA, 19 nt, Homo sapiens
agagaaagaagacaaugaa

SEQ ID NO: 1331674 - RNA, 19 nt, Homo sapiens
agagaaagaagacaaugaa

SEQ ID NO: 1331675 - RNA, 19 nt, Homo sapiens
gaggaaaccaauauuacug

SEQ ID NO: 1331676 - RNA, 19 nt, Homo sapiens
ucagaaagacauaagugaa

SEQ ID NO: 1331677 - RNA, 19 nt, Homo sapiens
aacaggagaugauauugga

SEQ ID NO: 1331678 - RNA, 19 nt, Homo sapiens
cagcugagaugcccaccau

SEQ ID NO: 1331679 - RNA, 19 nt, Homo sapiens
aagugaaacucuuggaaau

SEQ ID NO: 1331680 - RNA, 19 nt, Homo sapiens
uagcagccaucaaguuaca

SEQ ID NO: 1331681 - RNA, 19 nt, Homo sapiens
aaagagcuauagaauaagg

SEQ ID NO: 1331682 - RNA, 19 nt, Homo sapiens
uaaacaucaucucccaaau

SEQ ID NO: 1331683 - RNA, 19 nt, Homo sapiens
gaagaaaccucgcggaaag

SEQ ID NO: 1331684 - RNA, 19 nt, Homo sapiens
gaaccgcacugcagagaaa

SEQ ID NO: 1331685 - RNA, 19 nt, Homo sapiens
gaugagaagcgcaaacuua

SEQ ID NO: 1331686 - RNA, 19 nt, Homo sapiens
gaaaauaugugaagaggaa

SEQ ID NO: 1331687 - RNA, 19 nt, Homo sapiens
ucagaaggaucuccgcuua

SEQ ID NO: 1331688 - RNA, 19 nt, Homo sapiens
guacagagccuacauacau

SEQ ID NO: 1331689 - RNA, 19 nt, Homo sapiens
uaacaaggguaaacgauuc

SEQ ID NO: 1331690 - RNA, 19 nt, Homo sapiens
uggaacagcugaagccaua

SEQ ID NO: 1331691 - RNA, 19 nt, Homo sapiens
gaaaugcuucuuugugaaa

SEQ ID NO: 1331692 - RNA, 19 nt, Homo sapiens
gaccagaagugccaaaaua

SEQ ID NO: 1331693 - RNA, 19 nt, Homo sapiens
caagcgagccuguuaaaga

SEQ ID NO: 1331694 - RNA, 19 nt, Homo sapiens
gaaaagagcccaagagcaa

SEQ ID NO: 1331695 - RNA, 19 nt, Homo sapiens
ggaaagaccagacgucauc

SEQ ID NO: 1331696 - RNA, 19 nt, Homo sapiens
gaucuccgcuuagccauug

SEQ ID NO: 1331697 - RNA, 19 nt, Homo sapiens
gaagccagcugucuguuac

SEQ ID NO: 1331698 - RNA, 19 nt, Homo sapiens
ccaaaggacuugaagaaac

SEQ ID NO: 1331699 - RNA, 19 nt, Homo sapiens
gacaagaaucgacguaauu

SEQ ID NO: 1331700 - RNA, 19 nt, Homo sapiens
gaacaugggagaaggaaag

SEQ ID NO: 1331701 - RNA, 19 nt, Homo sapiens
caaaugagguguacaaaag

SEQ ID NO: 1331702 - RNA, 19 nt, Homo sapiens
gaaauacauucagaaggau

SEQ ID NO: 1331703 - RNA, 19 nt, Homo sapiens
gaagggaaggugaagaaga

SEQ ID NO: 1331704 - RNA, 19 nt, Homo sapiens
aaacuuagccugucugaag

SEQ ID NO: 1331705 - RNA, 19 nt, Homo sapiens
auacagacuuugagacuug

SEQ ID NO: 1331706 - RNA, 19 nt, Homo sapiens
gauccucauuuccaucauu

SEQ ID NO: 1331707 - RNA, 19 nt, Homo sapiens
aagggaaggugaagaagaa

SEQ ID NO: 1331708 - RNA, 19 nt, Homo sapiens
ugacaagaaucgacguaau

SEQ ID NO: 1331709 - RNA, 19 nt, Homo sapiens
cauggcagcugcagcaaau

SEQ ID NO: 1331710 - RNA, 19 nt, Homo sapiens
gaaacuuuaagccugauuu

SEQ ID NO: 1331711 - RNA, 19 nt, Homo sapiens
gguagaugcugucgaagag

SEQ ID NO: 1331712 - RNA, 19 nt, Homo sapiens
caccaaaggacuugaagaa

SEQ ID NO: 1331713 - RNA, 19 nt, Homo sapiens
caggagagccaaagggaaa

SEQ ID NO: 1331714 - RNA, 19 nt, Homo sapiens
cgaagaaguugaaaauaug

SEQ ID NO: 1331715 - RNA, 19 nt, Homo sapiens
gaagaacaugggagaagga

SEQ ID NO: 1331716 - RNA, 19 nt, Homo sapiens
caucacacccacagacaaa

SEQ ID NO: 1331717 - RNA, 19 nt, Homo sapiens
aagcgagccuguuaaagau

SEQ ID NO: 1331718 - RNA, 19 nt, Homo sapiens
cauaucaugcucauaaaga

SEQ ID NO: 1331719 - RNA, 19 nt, Homo sapiens
gccauaucaugcucauaaa

SEQ ID NO: 1331720 - RNA, 19 nt, Homo sapiens
caaaggacuugaagaaacc

SEQ ID NO: 1331721 - RNA, 19 nt, Homo sapiens
uacagagccuacauacauu

SEQ ID NO: 1331722 - RNA, 19 nt, Homo sapiens
ccacaauucuucugaugac

SEQ ID NO: 1331723 - RNA, 19 nt, Homo sapiens
uagaugcugucgaagaguu

SEQ ID NO: 1331724 - RNA, 19 nt, Homo sapiens
ggagcuucauggccacuau

SEQ ID NO: 1331725 - RNA, 19 nt, Homo sapiens
gcaaugcagccaagaugau

SEQ ID NO: 1331726 - RNA, 19 nt, Homo sapiens
gaacagcugaagccauauc

SEQ ID NO: 1331727 - RNA, 19 nt, Homo sapiens
gaagaagaacaugggagaa

SEQ ID NO: 1331728 - RNA, 19 nt, Homo sapiens
gaagccauaucaugcucau

SEQ ID NO: 1331729 - RNA, 19 nt, Homo sapiens
cagcaaaugagguguacaa

SEQ ID NO: 1331730 - RNA, 19 nt, Homo sapiens
caaccugcgacaucacuuu

SEQ ID NO: 1331731 - RNA, 19 nt, Homo sapiens
agaagccagcugucuguua

SEQ ID NO: 1331732 - RNA, 19 nt, Homo sapiens
ugaagaaaccucgcggaaa

SEQ ID NO: 1331733 - RNA, 19 nt, Homo sapiens
gcaaacuuagccugucuga

SEQ ID NO: 1331734 - RNA, 19 nt, Homo sapiens
cagaagaucaugccuggau

SEQ ID NO: 1331735 - RNA, 19 nt, Homo sapiens
gcccaccuaucuccauuuc

SEQ ID NO: 1331736 - RNA, 19 nt, Homo sapiens
gagccuacauacauuaagc

SEQ ID NO: 1331737 - RNA, 19 nt, Homo sapiens
gcaaucacgaagaaguuga

SEQ ID NO: 1331738 - RNA, 19 nt, Homo sapiens
caaaggaugagaaggaucu

SEQ ID NO: 1331739 - RNA, 19 nt, Homo sapiens
ucagagagaggcuccaaau

SEQ ID NO: 1331740 - RNA, 19 nt, Homo sapiens
cagcugaagccauaucaug

SEQ ID NO: 1331741 - RNA, 19 nt, Homo sapiens
gcgcaaacuuagccugucu

SEQ ID NO: 1331742 - RNA, 19 nt, Homo sapiens
ggagagaaguaggccaaac

SEQ ID NO: 1331743 - RNA, 19 nt, Homo sapiens
gaugacaagaaucgacgua

SEQ ID NO: 1331744 - RNA, 19 nt, Homo sapiens
acagagccuacauacauua

SEQ ID NO: 1331745 - RNA, 19 nt, Homo sapiens
agccauaucaugcucauaa

SEQ ID NO: 1331746 - RNA, 19 nt, Homo sapiens
agaugcagauccucauuuc

SEQ ID NO: 1331747 - RNA, 19 nt, Homo sapiens
gcaaaugagguguacaaaa

SEQ ID NO: 1331748 - RNA, 19 nt, Homo sapiens
gggcaaugcagccaagaug

SEQ ID NO: 1331749 - RNA, 19 nt, Homo sapiens
gaagugcuacguggacaug

SEQ ID NO: 1331750 - RNA, 19 nt, Homo sapiens
gaaaccucgcggaaagaaa

SEQ ID NO: 1331751 - RNA, 19 nt, Homo sapiens
ccaccuaucuccauuuccu

SEQ ID NO: 1331752 - RNA, 19 nt, Homo sapiens
cagcccaccuaucuccauu

SEQ ID NO: 1331753 - RNA, 19 nt, Homo sapiens
aaaccucgcggaaagaaau

SEQ ID NO: 1331754 - RNA, 19 nt, Homo sapiens
ggccaggaaagauuguuaa

SEQ ID NO: 1331755 - RNA, 19 nt, Homo sapiens
ugacagcacagccgugaau

SEQ ID NO: 1331756 - RNA, 19 nt, Homo sapiens
ggaaggugaagaagaacau

SEQ ID NO: 1331757 - RNA, 19 nt, Homo sapiens
ucuuggacauccucaauca

SEQ ID NO: 1331758 - RNA, 19 nt, Homo sapiens
gggaaacucggccgauauc

SEQ ID NO: 1331759 - RNA, 19 nt, Homo sapiens
caaauccccucugaaaaga

SEQ ID NO: 1331760 - RNA, 19 nt, Homo sapiens
caauucuucugaugacaag

SEQ ID NO: 1331761 - RNA, 19 nt, Homo sapiens
acuuuaagccugauuucua

SEQ ID NO: 1331762 - RNA, 19 nt, Homo sapiens
agaugaugcugaucgugaa

SEQ ID NO: 1331763 - RNA, 19 nt, Homo sapiens
gagagaaguaggccaaacu

SEQ ID NO: 1331764 - RNA, 19 nt, Homo sapiens
cagacgucaucccacaauu

SEQ ID NO: 1331765 - RNA, 19 nt, Homo sapiens
gaccaguccgacaacgaua

SEQ ID NO: 1331766 - RNA, 19 nt, Homo sapiens
ccaagaugaugcugaucgu

SEQ ID NO: 1331767 - RNA, 19 nt, Homo sapiens
ggcaaugcagccaagauga

SEQ ID NO: 1331768 - RNA, 19 nt, Homo sapiens
uuaacaaggguaaacgauu

SEQ ID NO: 1331769 - RNA, 19 nt, Homo sapiens
cugcuaagccaaacagaga

SEQ ID NO: 1331770 - RNA, 19 nt, Homo sapiens
gagaaguaggccaaacuca

SEQ ID NO: 1331771 - RNA, 19 nt, Homo sapiens
cgucaucccacaauucuuc

SEQ ID NO: 1331772 - RNA, 19 nt, Homo sapiens
uauacagacuuugagacuu

SEQ ID NO: 1331773 - RNA, 19 nt, Homo sapiens
ggaaccgcacugcagagaa

SEQ ID NO: 1331774 - RNA, 19 nt, Homo sapiens
cagagccuacauacauuaa

SEQ ID NO: 1331775 - RNA, 19 nt, Homo sapiens
ggauguuggugaucuuagc

SEQ ID NO: 1331776 - RNA, 19 nt, Homo sapiens
gcaucacacccacagacaa

SEQ ID NO: 1331777 - RNA, 19 nt, Homo sapiens
aaagaugcagauccucauu

SEQ ID NO: 1331778 - RNA, 19 nt, Homo sapiens
ccgcugaagucgucucaac

SEQ ID NO: 1331779 - RNA, 19 nt, Homo sapiens
cuuuaagccugauuucuac

SEQ ID NO: 1331780 - RNA, 19 nt, Homo sapiens
agcgguagaugcugucgaa

SEQ ID NO: 1331781 - RNA, 19 nt, Homo sapiens
gagcuucauggccacuauu

SEQ ID NO: 1331782 - RNA, 19 nt, Homo sapiens
gacgggauguuggugaucu

SEQ ID NO: 1331783 - RNA, 19 nt, Homo sapiens
gaccauaaaccaagaauua

SEQ ID NO: 1331784 - RNA, 19 nt, Homo sapiens
ugagugagcuggugugauu

SEQ ID NO: 1331785 - RNA, 19 nt, Homo sapiens
gcaccucacuuaacgucua

SEQ ID NO: 1331786 - RNA, 19 nt, Homo sapiens
gauguuggcuucgauaaug

SEQ ID NO: 1331787 - RNA, 19 nt, Homo sapiens
gagcuggugugauuagguu

SEQ ID NO: 1331788 - RNA, 19 nt, Homo sapiens
aggaagcccugauguuuaa

SEQ ID NO: 1331789 - RNA, 19 nt, Homo sapiens
gcccugauguuuaaaggaa

SEQ ID NO: 1331790 - RNA, 19 nt, Homo sapiens
gaaggagaaugcagcucuu

SEQ ID NO: 1331791 - RNA, 19 nt, Homo sapiens
ccaagauucuacauuucua

SEQ ID NO: 1331792 - RNA, 19 nt, Homo sapiens
gaagaccagugucguaacu

SEQ ID NO: 1331793 - RNA, 19 nt, Homo sapiens
caucagccauuuacuaagu

SEQ ID NO: 1331794 - RNA, 19 nt, Homo sapiens
caagucaguccacauguuu

SEQ ID NO: 1331795 - RNA, 19 nt, Homo sapiens
ucaagucaguccacauguu

SEQ ID NO: 1331796 - RNA, 19 nt, Homo sapiens
ugcagauccugauagauua

SEQ ID NO: 1331797 - RNA, 19 nt, Homo sapiens
ucacuuaacgucuaacuuc

SEQ ID NO: 1331798 - RNA, 19 nt, Homo sapiens
ggagaaugcagcucuuuca

SEQ ID NO: 1331799 - RNA, 19 nt, Homo sapiens
gagaagggaggaaggagaa

SEQ ID NO: 1331800 - RNA, 19 nt, Homo sapiens
gaucccaccugguaucagu

SEQ ID NO: 1331801 - RNA, 19 nt, Homo sapiens
ugcccaagauucuacauuu

SEQ ID NO: 1331802 - RNA, 19 nt, Homo sapiens
gauaaugucauccugaagu

SEQ ID NO: 1331803 - RNA, 19 nt, Homo sapiens
aaaugcagauccugauaga

SEQ ID NO: 1331804 - RNA, 19 nt, Homo sapiens
ugauugggcaccucacuua

SEQ ID NO: 1331805 - RNA, 19 nt, Homo sapiens
ugucguaacuggaauuaag

SEQ ID NO: 1331806 - RNA, 19 nt, Homo sapiens
gggaagaccagugucguaa

SEQ ID NO: 1331807 - RNA, 19 nt, Homo sapiens
gaauggauguuggcuucga

SEQ ID NO: 1331808 - RNA, 19 nt, Homo sapiens
uaacgucuaacuucagauu

SEQ ID NO: 1331809 - RNA, 19 nt, Homo sapiens
ugucaggccuucucaguag

SEQ ID NO: 1331810 - RNA, 19 nt, Homo sapiens
gcccaagauucuacauuuc

SEQ ID NO: 1331811 - RNA, 19 nt, Homo sapiens
acauuggccuugcuacuug

SEQ ID NO: 1331812 - RNA, 19 nt, Homo sapiens
gauucuacauuucuaagag

SEQ ID NO: 1331813 - RNA, 19 nt, Homo sapiens
cuuccucucuucccucuuu

SEQ ID NO: 1331814 - RNA, 19 nt, Homo sapiens
ucgauaaugucauccugaa

SEQ ID NO: 1331815 - RNA, 19 nt, Homo sapiens
gcucgugucugcugugaac

SEQ ID NO: 1331816 - RNA, 19 nt, Homo sapiens
ucuaagccauuucccauca

SEQ ID NO: 1331817 - RNA, 19 nt, Homo sapiens
ggagagcaguuggguuucu

SEQ ID NO: 1331818 - RNA, 19 nt, Homo sapiens
ccuggcugguuguuaauaa

SEQ ID NO: 1331819 - RNA, 19 nt, Homo sapiens
ucacagaccacagcuucua

SEQ ID NO: 1331820 - RNA, 19 nt, Homo sapiens
aaggaacugugucuuuguu

SEQ ID NO: 1331821 - RNA, 19 nt, Homo sapiens
caugugaggcauuugcuuu

SEQ ID NO: 1331822 - RNA, 19 nt, Homo sapiens
ucuaagagucccuggauga

SEQ ID NO: 1331823 - RNA, 19 nt, Homo sapiens
gaaacccagucuuaauucc

SEQ ID NO: 1331824 - RNA, 19 nt, Homo sapiens
ggaguugagggaauguuug

SEQ ID NO: 1331825 - RNA, 19 nt, Homo sapiens
cccaucagccauuuacuaa

SEQ ID NO: 1331826 - RNA, 19 nt, Homo sapiens
augcagauccugauagauu

SEQ ID NO: 1331827 - RNA, 19 nt, Homo sapiens
uuuauucccuucccacaga

SEQ ID NO: 1331828 - RNA, 19 nt, Homo sapiens
cacuuuaucucuucuuucu

SEQ ID NO: 1331829 - RNA, 19 nt, Homo sapiens
auaaugucauccugaaguu

SEQ ID NO: 1331830 - RNA, 19 nt, Homo sapiens
gaagggaggaaggagaaug

SEQ ID NO: 1331831 - RNA, 19 nt, Homo sapiens
ccuagcacccucuguggua

SEQ ID NO: 1331832 - RNA, 19 nt, Homo sapiens
caccucacuuaacgucuaa

SEQ ID NO: 1331833 - RNA, 19 nt, Homo sapiens
ugaggcauuugcuuuguca

SEQ ID NO: 1331834 - RNA, 19 nt, Homo sapiens
cuuaacgucuaacuucaga

SEQ ID NO: 1331835 - RNA, 19 nt, Homo sapiens
gguuguuaauaagcuguua

SEQ ID NO: 1331836 - RNA, 19 nt, Homo sapiens
guaguuagugccugcaugu

SEQ ID NO: 1331837 - RNA, 19 nt, Homo sapiens
agucuuaauuccacacaau

SEQ ID NO: 1331838 - RNA, 19 nt, Homo sapiens
ucucuucccucuuucucuu

SEQ ID NO: 1331839 - RNA, 19 nt, Homo sapiens
gauugggcaccucacuuaa

SEQ ID NO: 1331840 - RNA, 19 nt, Homo sapiens
agggagagcaguuggguuu

SEQ ID NO: 1331841 - RNA, 19 nt, Homo sapiens
cacagaccauaaaccaaga

SEQ ID NO: 1331842 - RNA, 19 nt, Homo sapiens
ucucuuagucccacuuuau

SEQ ID NO: 1331843 - RNA, 19 nt, Homo sapiens
gauucacucuugggcauuc

SEQ ID NO: 1331844 - RNA, 19 nt, Homo sapiens
gagagcaguuggguuucug

SEQ ID NO: 1331845 - RNA, 19 nt, Homo sapiens
uuucuaaacaugcacauug

SEQ ID NO: 1331846 - RNA, 19 nt, Homo sapiens
ggauguuggcuucgauaau

SEQ ID NO: 1331847 - RNA, 19 nt, Homo sapiens
ggccugcagugugcuguga

SEQ ID NO: 1331848 - RNA, 19 nt, Homo sapiens
gcacauuggccuugcuacu

SEQ ID NO: 1331849 - RNA, 19 nt, Homo sapiens
aacuucagauucacucuug

SEQ ID NO: 1331850 - RNA, 19 nt, Homo sapiens
agaaacccagucuuaauuc

SEQ ID NO: 1331851 - RNA, 19 nt, Homo sapiens
uggcuucgauaaugucauc

SEQ ID NO: 1331852 - RNA, 19 nt, Homo sapiens
cacuuaacgucuaacuuca

SEQ ID NO: 1331853 - RNA, 19 nt, Homo sapiens
ggaugacgguggcauucac

SEQ ID NO: 1331854 - RNA, 19 nt, Homo sapiens
cuuuaucucuucuuucucu

SEQ ID NO: 1331855 - RNA, 19 nt, Homo sapiens
cccacuuuaucucuucuuu

SEQ ID NO: 1331856 - RNA, 19 nt, Homo sapiens
ccucuccaaucuugaaugg

SEQ ID NO: 1331857 - RNA, 19 nt, Homo sapiens
cgggaagaccagugucgua

SEQ ID NO: 1331858 - RNA, 19 nt, Homo sapiens
gcagauccugauagauuag

SEQ ID NO: 1331859 - RNA, 19 nt, Homo sapiens
uaaaaugcagauccugaua

SEQ ID NO: 1331860 - RNA, 19 nt, Homo sapiens
uaacuucagauucacucuu

SEQ ID NO: 1331861 - RNA, 19 nt, Homo sapiens
ucccaucagccauuuacua

SEQ ID NO: 1331862 - RNA, 19 nt, Homo sapiens
gacggcuuccugcauguuu

SEQ ID NO: 1331863 - RNA, 19 nt, Homo sapiens
ugccgcaccugaucaguag

SEQ ID NO: 1331864 - RNA, 19 nt, Homo sapiens
cacauuggccuugcuacuu

SEQ ID NO: 1331865 - RNA, 19 nt, Homo sapiens
gaagcccugauguuuaaag

SEQ ID NO: 1331866 - RNA, 19 nt, Homo sapiens
gucuuccucuccaaucuug

SEQ ID NO: 1331867 - RNA, 19 nt, Homo sapiens
acgucuaacuucagauuca

SEQ ID NO: 1331868 - RNA, 19 nt, Homo sapiens
ccauuucccaucagccauu

SEQ ID NO: 1331869 - RNA, 19 nt, Homo sapiens
caccugaucaguaguuagu

SEQ ID NO: 1331870 - RNA, 19 nt, Homo sapiens
cauuucccaucagccauuu

SEQ ID NO: 1331871 - RNA, 19 nt, Homo sapiens
uggcugaauuggcaagucu

SEQ ID NO: 1331872 - RNA, 19 nt, Homo sapiens
caacaaaugugugguaaau

SEQ ID NO: 1331873 - RNA, 19 nt, Homo sapiens
ggaaagagcugcaaaagau

SEQ ID NO: 1331874 - RNA, 19 nt, Homo sapiens
acaauaggcucucaacaaa

SEQ ID NO: 1331875 - RNA, 19 nt, Homo sapiens
gaaacugccuugaaagauc

SEQ ID NO: 1331876 - RNA, 19 nt, Homo sapiens
acaaaugugugguaaauug

SEQ ID NO: 1331877 - RNA, 19 nt, Homo sapiens
aaacuuuccucccucaaua

SEQ ID NO: 1331878 - RNA, 19 nt, Homo sapiens
caauugcucugaagaaaga

SEQ ID NO: 1331879 - RNA, 19 nt, Homo sapiens
caagauggguccugacuca

SEQ ID NO: 1331880 - RNA, 19 nt, Homo sapiens
acacaaggaugcuggcuuu

SEQ ID NO: 1331881 - RNA, 19 nt, Homo sapiens
gaagaaagaaagacauuca

SEQ ID NO: 1331882 - RNA, 19 nt, Homo sapiens
ucaauagacucaugaagug

SEQ ID NO: 1331883 - RNA, 19 nt, Homo sapiens
gacaauugcucugaagaaa

SEQ ID NO: 1331884 - RNA, 19 nt, Homo sapiens
cgaaggaaguuucuacugu

SEQ ID NO: 1331885 - RNA, 19 nt, Homo sapiens
ggcagaaacuauucacauu

SEQ ID NO: 1331886 - RNA, 19 nt, Homo sapiens
gaccuaagauacauacuuc

SEQ ID NO: 1331887 - RNA, 19 nt, Homo sapiens
ggaaacaucauaaaugcaa

SEQ ID NO: 1331888 - RNA, 19 nt, Homo sapiens
ucuagaaacugccuugaaa

SEQ ID NO: 1331889 - RNA, 19 nt, Homo sapiens
ggacaaauuugagucacuu

SEQ ID NO: 1331890 - RNA, 19 nt, Homo sapiens
gaauguacaccacccuaua

SEQ ID NO: 1331891 - RNA, 19 nt, Homo sapiens
gaaaucucauccacagcua

SEQ ID NO: 1331892 - RNA, 19 nt, Homo sapiens
gcaguuugcuuuucugaua

SEQ ID NO: 1331893 - RNA, 19 nt, Homo sapiens
uugaagagauggauaagaa

SEQ ID NO: 1331894 - RNA, 19 nt, Homo sapiens
ggaaguuucuacugucaau

SEQ ID NO: 1331895 - RNA, 19 nt, Homo sapiens
gcagucaccuguccagcuu

SEQ ID NO: 1331896 - RNA, 19 nt, Homo sapiens
caaggaugcuggcuuucaa

SEQ ID NO: 1331897 - RNA, 19 nt, Homo sapiens
gaaaagguacagcaaauaa

SEQ ID NO: 1331898 - RNA, 19 nt, Homo sapiens
gaacagaagggagacaaga

SEQ ID NO: 1331899 - RNA, 19 nt, Homo sapiens
aauaggcucucaacaaaug

SEQ ID NO: 1331900 - RNA, 19 nt, Homo sapiens
caggacaagugaagagaaa

SEQ ID NO: 1331901 - RNA, 19 nt, Homo sapiens
ggucauggccuaccucuuc

SEQ ID NO: 1331902 - RNA, 19 nt, Homo sapiens
gauguggaaucgaaaguuc

SEQ ID NO: 1331903 - RNA, 19 nt, Homo sapiens
gacaccaccuccucaaaga

SEQ ID NO: 1331904 - RNA, 19 nt, Homo sapiens
gaagaaugaagcuaaggaa

SEQ ID NO: 1331905 - RNA, 19 nt, Homo sapiens
caacuugaacguccaaaug

SEQ ID NO: 1331906 - RNA, 19 nt, Homo sapiens
ccaaaugcuuccuguguca

SEQ ID NO: 1331907 - RNA, 19 nt, Homo sapiens
ccauugccuuuaucucaua

SEQ ID NO: 1331908 - RNA, 19 nt, Homo sapiens
cuugaaagauccagaacaa

SEQ ID NO: 1331909 - RNA, 19 nt, Homo sapiens
aaucagacuuuauggagaa

SEQ ID NO: 1331910 - RNA, 19 nt, Homo sapiens
gaaagaaagacauucaacu

SEQ ID NO: 1331911 - RNA, 19 nt, Homo sapiens
gucaaugugucccaggaua

SEQ ID NO: 1331912 - RNA, 19 nt, Homo sapiens
ucugagacauacacacuuu

SEQ ID NO: 1331913 - RNA, 19 nt, Homo sapiens
ccagugccauugccuuuau

SEQ ID NO: 1331914 - RNA, 19 nt, Homo sapiens
gaaucgaaaguucuagaaa

SEQ ID NO: 1331915 - RNA, 19 nt, Homo sapiens
ggauauagacugcauucug

SEQ ID NO: 1331916 - RNA, 19 nt, Homo sapiens
gcagaaacuauucacauuc

SEQ ID NO: 1331917 - RNA, 19 nt, Homo sapiens
guacagcaaauaaacgaaa

SEQ ID NO: 1331918 - RNA, 19 nt, Homo sapiens
caucaucgccggugcuuug

SEQ ID NO: 1331919 - RNA, 19 nt, Homo sapiens
ggauggcugcuuccugaua

SEQ ID NO: 1331920 - RNA, 19 nt, Homo sapiens
gauaagaaagaucaagugu

SEQ ID NO: 1331921 - RNA, 19 nt, Homo sapiens
gaagagauggauaagaaag

SEQ ID NO: 1331922 - RNA, 19 nt, Homo sapiens
cacaauaggcucucaacaa

SEQ ID NO: 1331923 - RNA, 19 nt, Homo sapiens
aggaaguaaucaaccuuua

SEQ ID NO: 1331924 - RNA, 19 nt, Homo sapiens
gccuuuaucucauauucuu

SEQ ID NO: 1331925 - RNA, 19 nt, Homo sapiens
gaggaaguaaucaaccuuu

SEQ ID NO: 1331926 - RNA, 19 nt, Homo sapiens
caaaagugguuuagagaga

SEQ ID NO: 1331927 - RNA, 19 nt, Homo sapiens
gaucaaguguaucugaacu

SEQ ID NO: 1331928 - RNA, 19 nt, Homo sapiens
ggaaucgaaaguucuagaa

SEQ ID NO: 1331929 - RNA, 19 nt, Homo sapiens
ccaaugagaacaccuguca

SEQ ID NO: 1331930 - RNA, 19 nt, Homo sapiens
caugggauuucuugagcua

SEQ ID NO: 1331931 - RNA, 19 nt, Homo sapiens
ggacaccaccuccucaaag

SEQ ID NO: 1331932 - RNA, 19 nt, Homo sapiens
cauacacacuuuccagcaa

SEQ ID NO: 1331933 - RNA, 19 nt, Homo sapiens
gccagcagguccagaaaca

SEQ ID NO: 1331934 - RNA, 19 nt, Homo sapiens
guaaagccauccagaacac

SEQ ID NO: 1331935 - RNA, 19 nt, Homo sapiens
gaagggagacaagaaaucu

SEQ ID NO: 1331936 - RNA, 19 nt, Homo sapiens
caaugugucccaggauaua

SEQ ID NO: 1331937 - RNA, 19 nt, Homo sapiens
ggaaaagggaauucauuaa

SEQ ID NO: 1331938 - RNA, 19 nt, Homo sapiens
auggaucucuuuggcauua

SEQ ID NO: 1331939 - RNA, 19 nt, Homo sapiens
aaguguaucugaacucuca

SEQ ID NO: 1331940 - RNA, 19 nt, Homo sapiens
uagaaacugccuugaaaga

SEQ ID NO: 1331941 - RNA, 19 nt, Homo sapiens
gcaccugcaaccauggaua

SEQ ID NO: 1331942 - RNA, 19 nt, Homo sapiens
cuucaauucucaugggauu

SEQ ID NO: 1331943 - RNA, 19 nt, Homo sapiens
ccuccuggccucaccuuua

SEQ ID NO: 1331944 - RNA, 19 nt, Homo sapiens
aagaaagacauucaacuug

SEQ ID NO: 1331945 - RNA, 19 nt, Homo sapiens
ucugauagcaauuucauga

SEQ ID NO: 1331946 - RNA, 19 nt, Homo sapiens
gaaugaagcuaaggaaaag

SEQ ID NO: 1331947 - RNA, 19 nt, Homo sapiens
caacuacucaagcaucaau

SEQ ID NO: 1331948 - RNA, 19 nt, Homo sapiens
ggauaagaaagaucaagug

SEQ ID NO: 1331949 - RNA, 19 nt, Homo sapiens
aaacucaagcgauuacaga

SEQ ID NO: 1331950 - RNA, 19 nt, Homo sapiens
ggauacccguaccacagaa

SEQ ID NO: 1331951 - RNA, 19 nt, Homo sapiens
gagaggaaguaaucaaccu

SEQ ID NO: 1331952 - RNA, 19 nt, Homo sapiens
gcagguccagaaacaauau

SEQ ID NO: 1331953 - RNA, 19 nt, Homo sapiens
ucacuuuucuccuguguaa

SEQ ID NO: 1331954 - RNA, 19 nt, Homo sapiens
gauggcugcuuccugauac

SEQ ID NO: 1331955 - RNA, 19 nt, Homo sapiens
gauacauacuucaauucuc

SEQ ID NO: 1331956 - RNA, 19 nt, Homo sapiens
ugauagcaauuucaugagu

SEQ ID NO: 1331957 - RNA, 19 nt, Homo sapiens
ucucaccaaucagacuuua

SEQ ID NO: 1331958 - RNA, 19 nt, Homo sapiens
gggcagaaacuauucacau

SEQ ID NO: 1331959 - RNA, 19 nt, Homo sapiens
guccagaaacaauaucaaa

SEQ ID NO: 1331960 - RNA, 19 nt, Homo sapiens
ggcccagucugugccauuu

SEQ ID NO: 1331961 - RNA, 19 nt, Homo sapiens
aagcaucaauagacucaug

SEQ ID NO: 1331962 - RNA, 19 nt, Homo sapiens
guguagcuauugaaacuca

SEQ ID NO: 1331963 - RNA, 19 nt, Homo sapiens
uaguguagcuauugaaacu

SEQ ID NO: 1331964 - RNA, 19 nt, Homo sapiens
ucaccaaucagacuuuaug

SEQ ID NO: 1331965 - RNA, 19 nt, Homo sapiens
ggauauacuucuggaucug

SEQ ID NO: 1331966 - RNA, 19 nt, Homo sapiens
ggaucucuuuggcauuaug

SEQ ID NO: 1331967 - RNA, 19 nt, Homo sapiens
ccucaauagugaaguguca

SEQ ID NO: 1331968 - RNA, 19 nt, Homo sapiens
ucacuucucaccaaucaga

SEQ ID NO: 1331969 - RNA, 19 nt, Homo sapiens
uuagagagaucguaaaauc

SEQ ID NO: 1331970 - RNA, 19 nt, Homo sapiens
cagggaccauugcuucuuc

SEQ ID NO: 1331971 - RNA, 19 nt, Homo sapiens
cagaaaagguacagcaaau

SEQ ID NO: 1331972 - RNA, 19 nt, Homo sapiens
caacaaaugugugguaaau

SEQ ID NO: 1331973 - RNA, 19 nt, Homo sapiens
acaauaggcucucaacaaa

SEQ ID NO: 1331974 - RNA, 19 nt, Homo sapiens
gaaacugccuugaaagauc

SEQ ID NO: 1331975 - RNA, 19 nt, Homo sapiens
gagaacaccugucaugcaa

SEQ ID NO: 1331976 - RNA, 19 nt, Homo sapiens
acaaaugugugguaaauug

SEQ ID NO: 1331977 - RNA, 19 nt, Homo sapiens
aaacuuuccucccucaaua

SEQ ID NO: 1331978 - RNA, 19 nt, Homo sapiens
caauugcucugaagaaaga

SEQ ID NO: 1331979 - RNA, 19 nt, Homo sapiens
caagauggguccugacuca

SEQ ID NO: 1331980 - RNA, 19 nt, Homo sapiens
acacaaggaugcuggcuuu

SEQ ID NO: 1331981 - RNA, 19 nt, Homo sapiens
gaagaaagaaagacauuca

SEQ ID NO: 1331982 - RNA, 19 nt, Homo sapiens
ucaauagacucaugaagug

SEQ ID NO: 1331983 - RNA, 19 nt, Homo sapiens
gacaauugcucugaagaaa

SEQ ID NO: 1331984 - RNA, 19 nt, Homo sapiens
cgaaggaaguuucuacugu

SEQ ID NO: 1331985 - RNA, 19 nt, Homo sapiens
ggcagaaacuauucacauu

SEQ ID NO: 1331986 - RNA, 19 nt, Homo sapiens
gaccuaagauacauacuuc

SEQ ID NO: 1331987 - RNA, 19 nt, Homo sapiens
ggaaacaucauaaaugcaa

SEQ ID NO: 1331988 - RNA, 19 nt, Homo sapiens
ucuagaaacugccuugaaa

SEQ ID NO: 1331989 - RNA, 19 nt, Homo sapiens
ggacaaauuugagucacuu

SEQ ID NO: 1331990 - RNA, 19 nt, Homo sapiens
gaauguacaccacccuaua

SEQ ID NO: 1331991 - RNA, 19 nt, Homo sapiens
gaaaucucauccacagcua

SEQ ID NO: 1331992 - RNA, 19 nt, Homo sapiens
gcaguuugcuuuucugaua

SEQ ID NO: 1331993 - RNA, 19 nt, Homo sapiens
uugaagagauggauaagaa

SEQ ID NO: 1331994 - RNA, 19 nt, Homo sapiens
ggaaguuucuacugucaau

SEQ ID NO: 1331995 - RNA, 19 nt, Homo sapiens
gcagucaccuguccagcuu

SEQ ID NO: 1331996 - RNA, 19 nt, Homo sapiens
caaggaugcuggcuuucaa

SEQ ID NO: 1331997 - RNA, 19 nt, Homo sapiens
gaaaagguacagcaaauaa

SEQ ID NO: 1331998 - RNA, 19 nt, Homo sapiens
gaacagaagggagacaaga

SEQ ID NO: 1331999 - RNA, 19 nt, Homo sapiens
gaacaccugucaugcaaaa

SEQ ID NO: 1332000 - RNA, 19 nt, Homo sapiens
aauaggcucucaacaaaug

SEQ ID NO: 1332001 - RNA, 19 nt, Homo sapiens
caggacaagugaagagaaa

SEQ ID NO: 1332002 - RNA, 19 nt, Homo sapiens
ggucauggccuaccucuuc

SEQ ID NO: 1332003 - RNA, 19 nt, Homo sapiens
gauguggaaucgaaaguuc

SEQ ID NO: 1332004 - RNA, 19 nt, Homo sapiens
gaagaaugaagcuaaggaa

SEQ ID NO: 1332005 - RNA, 19 nt, Homo sapiens
caacuugaacguccaaaug

SEQ ID NO: 1332006 - RNA, 19 nt, Homo sapiens
ccaaaugcuuccuguguca

SEQ ID NO: 1332007 - RNA, 19 nt, Homo sapiens
ccauugccuuuaucucaua

SEQ ID NO: 1332008 - RNA, 19 nt, Homo sapiens
cuugaaagauccagaacaa

SEQ ID NO: 1332009 - RNA, 19 nt, Homo sapiens
aaucagacuuuauggagaa

SEQ ID NO: 1332010 - RNA, 19 nt, Homo sapiens
gaaagaaagacauucaacu

SEQ ID NO: 1332011 - RNA, 19 nt, Homo sapiens
gucaaugugucccaggaua

SEQ ID NO: 1332012 - RNA, 19 nt, Homo sapiens
ucugagacauacacacuuu

SEQ ID NO: 1332013 - RNA, 19 nt, Homo sapiens
ccagugccauugccuuuau

SEQ ID NO: 1332014 - RNA, 19 nt, Homo sapiens
gaaucgaaaguucuagaaa

SEQ ID NO: 1332015 - RNA, 19 nt, Homo sapiens
ggauauagacugcauucug

SEQ ID NO: 1332016 - RNA, 19 nt, Homo sapiens
gcagaaacuauucacauuc

SEQ ID NO: 1332017 - RNA, 19 nt, Homo sapiens
guacagcaaauaaacgaaa

SEQ ID NO: 1332018 - RNA, 19 nt, Homo sapiens
caucaucgccggugcuuug

SEQ ID NO: 1332019 - RNA, 19 nt, Homo sapiens
ggauggcugcuuccugaua

SEQ ID NO: 1332020 - RNA, 19 nt, Homo sapiens
gauaagaaagaucaagugu

SEQ ID NO: 1332021 - RNA, 19 nt, Homo sapiens
gaagagauggauaagaaag

SEQ ID NO: 1332022 - RNA, 19 nt, Homo sapiens
cacaauaggcucucaacaa

SEQ ID NO: 1332023 - RNA, 19 nt, Homo sapiens
aggaaguaaucaaccuuua

SEQ ID NO: 1332024 - RNA, 19 nt, Homo sapiens
gccuuuaucucauauucuu

SEQ ID NO: 1332025 - RNA, 19 nt, Homo sapiens
gaggaaguaaucaaccuuu

SEQ ID NO: 1332026 - RNA, 19 nt, Homo sapiens
caaaagugguuuagagaga

SEQ ID NO: 1332027 - RNA, 19 nt, Homo sapiens
gaucaaguguaucugaacu

SEQ ID NO: 1332028 - RNA, 19 nt, Homo sapiens
ggaaucgaaaguucuagaa

SEQ ID NO: 1332029 - RNA, 19 nt, Homo sapiens
ccaaugagaacaccuguca

SEQ ID NO: 1332030 - RNA, 19 nt, Homo sapiens
caugggauuucuugagcua

SEQ ID NO: 1332031 - RNA, 19 nt, Homo sapiens
cauacacacuuuccagcaa

SEQ ID NO: 1332032 - RNA, 19 nt, Homo sapiens
gccagcagguccagaaaca

SEQ ID NO: 1332033 - RNA, 19 nt, Homo sapiens
guaaagccauccagaacac

SEQ ID NO: 1332034 - RNA, 19 nt, Homo sapiens
gaagggagacaagaaaucu

SEQ ID NO: 1332035 - RNA, 19 nt, Homo sapiens
caaugugucccaggauaua

SEQ ID NO: 1332036 - RNA, 19 nt, Homo sapiens
ggaaaagggaauucauuaa

SEQ ID NO: 1332037 - RNA, 19 nt, Homo sapiens
auggaucucuuuggcauua

SEQ ID NO: 1332038 - RNA, 19 nt, Homo sapiens
aaguguaucugaacucuca

SEQ ID NO: 1332039 - RNA, 19 nt, Homo sapiens
uagaaacugccuugaaaga

SEQ ID NO: 1332040 - RNA, 19 nt, Homo sapiens
gcaccugcaaccauggaua

SEQ ID NO: 1332041 - RNA, 19 nt, Homo sapiens
cuucaauucucaugggauu

SEQ ID NO: 1332042 - RNA, 19 nt, Homo sapiens
ccuccuggccucaccuuua

SEQ ID NO: 1332043 - RNA, 19 nt, Homo sapiens
aagaaagacauucaacuug

SEQ ID NO: 1332044 - RNA, 19 nt, Homo sapiens
ucugauagcaauuucauga

SEQ ID NO: 1332045 - RNA, 19 nt, Homo sapiens
gaaugaagcuaaggaaaag

SEQ ID NO: 1332046 - RNA, 19 nt, Homo sapiens
caacuacucaagcaucaau

SEQ ID NO: 1332047 - RNA, 19 nt, Homo sapiens
ggauaagaaagaucaagug

SEQ ID NO: 1332048 - RNA, 19 nt, Homo sapiens
aaacucaagcgauuacaga

SEQ ID NO: 1332049 - RNA, 19 nt, Homo sapiens
ggauacccguaccacagaa

SEQ ID NO: 1332050 - RNA, 19 nt, Homo sapiens
gagaggaaguaaucaaccu

SEQ ID NO: 1332051 - RNA, 19 nt, Homo sapiens
gcagguccagaaacaauau

SEQ ID NO: 1332052 - RNA, 19 nt, Homo sapiens
ucacuuuucuccuguguaa

SEQ ID NO: 1332053 - RNA, 19 nt, Homo sapiens
gauggcugcuuccugauac

SEQ ID NO: 1332054 - RNA, 19 nt, Homo sapiens
gauacauacuucaauucuc

SEQ ID NO: 1332055 - RNA, 19 nt, Homo sapiens
ugauagcaauuucaugagu

SEQ ID NO: 1332056 - RNA, 19 nt, Homo sapiens
ucucaccaaucagacuuua

SEQ ID NO: 1332057 - RNA, 19 nt, Homo sapiens
gggcagaaacuauucacau

SEQ ID NO: 1332058 - RNA, 19 nt, Homo sapiens
guccagaaacaauaucaaa

SEQ ID NO: 1332059 - RNA, 19 nt, Homo sapiens
ggcccagucugugccauuu

SEQ ID NO: 1332060 - RNA, 19 nt, Homo sapiens
aagcaucaauagacucaug

SEQ ID NO: 1332061 - RNA, 19 nt, Homo sapiens
guguagcuauugaaacuca

SEQ ID NO: 1332062 - RNA, 19 nt, Homo sapiens
uaguguagcuauugaaacu

SEQ ID NO: 1332063 - RNA, 19 nt, Homo sapiens
ucaccaaucagacuuuaug

SEQ ID NO: 1332064 - RNA, 19 nt, Homo sapiens
ggauauacuucuggaucug

SEQ ID NO: 1332065 - RNA, 19 nt, Homo sapiens
ggaucucuuuggcauuaug

SEQ ID NO: 1332066 - RNA, 19 nt, Homo sapiens
ccucaauagugaaguguca

SEQ ID NO: 1332067 - RNA, 19 nt, Homo sapiens
ucacuucucaccaaucaga

SEQ ID NO: 1332068 - RNA, 19 nt, Homo sapiens
uuagagagaucguaaaauc

SEQ ID NO: 1332069 - RNA, 19 nt, Homo sapiens
cagggaccauugcuucuuc

SEQ ID NO: 1332070 - RNA, 19 nt, Homo sapiens
cagaaaagguacagcaaau

SEQ ID NO: 1332071 - RNA, 19 nt, Homo sapiens
ugaaagauccagaacaaaa

SEQ ID NO: 1332072 - RNA, 19 nt, Homo sapiens
gaacaagucuuacguagug

SEQ ID NO: 1332073 - RNA, 19 nt, Homo sapiens
gagcuugucuaauuaguua

SEQ ID NO: 1332074 - RNA, 19 nt, Homo sapiens
gcaaagaccucaacaccuu

SEQ ID NO: 1332075 - RNA, 19 nt, Homo sapiens
ucuaaucccuugugacaua

SEQ ID NO: 1332076 - RNA, 19 nt, Homo sapiens
gagaggaaauaaauggaaa

SEQ ID NO: 1332077 - RNA, 19 nt, Homo sapiens
gggauuguaugccuucuuu

SEQ ID NO: 1332078 - RNA, 19 nt, Homo sapiens
gaaccuaggucuccuugcu

SEQ ID NO: 1332079 - RNA, 19 nt, Homo sapiens
ggccagcucuuaaggaguu

SEQ ID NO: 1332080 - RNA, 19 nt, Homo sapiens
gaagaaacgagugcucuga

SEQ ID NO: 1332081 - RNA, 19 nt, Homo sapiens
gaaagaagucacugucaca

SEQ ID NO: 1332082 - RNA, 19 nt, Homo sapiens
caaaauagccugcaagaau

SEQ ID NO: 1332083 - RNA, 19 nt, Homo sapiens
gaaacgagugcucugaaga

SEQ ID NO: 1332084 - RNA, 19 nt, Homo sapiens
cagacuggcuugcucuuug

SEQ ID NO: 1332085 - RNA, 19 nt, Homo sapiens
gacagaguccuuuagguuu

SEQ ID NO: 1332086 - RNA, 19 nt, Homo sapiens
ggagaggaaauaaauggaa

SEQ ID NO: 1332087 - RNA, 19 nt, Homo sapiens
caguguaccuucuacucua

SEQ ID NO: 1332088 - RNA, 19 nt, Homo sapiens
gaaccuggacuugaaccua

SEQ ID NO: 1332089 - RNA, 19 nt, Homo sapiens
gaauuaaagagcuugucua

SEQ ID NO: 1332090 - RNA, 19 nt, Homo sapiens
gaugaggaaauuaagguuu

SEQ ID NO: 1332091 - RNA, 19 nt, Homo sapiens
aaaggacucucagcaauuc

SEQ ID NO: 1332092 - RNA, 19 nt, Homo sapiens
uaaauggaaaggaggcaua

SEQ ID NO: 1332093 - RNA, 19 nt, Homo sapiens
acaaggagaggaaauaaau

SEQ ID NO: 1332094 - RNA, 19 nt, Homo sapiens
uuaaggaguucaggaguga

SEQ ID NO: 1332095 - RNA, 19 nt, Homo sapiens
gauuguaugccuucuuuau

SEQ ID NO: 1332096 - RNA, 19 nt, Homo sapiens
ggaggcauaugggauuugu

SEQ ID NO: 1332097 - RNA, 19 nt, Homo sapiens
ggcaagcggugaacuaggu

SEQ ID NO: 1332098 - RNA, 19 nt, Homo sapiens
cugcaagaauggcgauaaa

SEQ ID NO: 1332099 - RNA, 19 nt, Homo sapiens
gcaagaaagaagucacugu

SEQ ID NO: 1332100 - RNA, 19 nt, Homo sapiens
gacaaggagaggaaauaaa

SEQ ID NO: 1332101 - RNA, 19 nt, Homo sapiens
uguguuggcugcaauaaag

SEQ ID NO: 1332102 - RNA, 19 nt, Homo sapiens
gaacugcagguacaaagag

SEQ ID NO: 1332103 - RNA, 19 nt, Homo sapiens
ugacaaggagaggaaauaa

SEQ ID NO: 1332104 - RNA, 19 nt, Homo sapiens
gagaagcgacagaacaagu

SEQ ID NO: 1332105 - RNA, 19 nt, Homo sapiens
ucacagugguuuaaaauuc

SEQ ID NO: 1332106 - RNA, 19 nt, Homo sapiens
aaaggaggcauaugggauu

SEQ ID NO: 1332107 - RNA, 19 nt, Homo sapiens
acagaguccuuuagguuuc

SEQ ID NO: 1332108 - RNA, 19 nt, Homo sapiens
aaaauagccugcaagaaug

SEQ ID NO: 1332109 - RNA, 19 nt, Homo sapiens
aaagagaagcgacagaaca

SEQ ID NO: 1332110 - RNA, 19 nt, Homo sapiens
agcagaaccuggacuugaa

SEQ ID NO: 1332111 - RNA, 19 nt, Homo sapiens
uagcagaaccuggacuuga

SEQ ID NO: 1332112 - RNA, 19 nt, Homo sapiens
uauccgaacugcagguaca

SEQ ID NO: 1332113 - RNA, 19 nt, Homo sapiens
ggucuccuugcucuaaaua

SEQ ID NO: 1332114 - RNA, 19 nt, Homo sapiens
cuuuauggaugaggaaauu

SEQ ID NO: 1332115 - RNA, 19 nt, Homo sapiens
gcucuagaaggauggcuuu

SEQ ID NO: 1332116 - RNA, 19 nt, Homo sapiens
ccugguuccuguacacuug

SEQ ID NO: 1332117 - RNA, 19 nt, Homo sapiens
acagaacaagucuuacgua

SEQ ID NO: 1332118 - RNA, 19 nt, Homo sapiens
gcaagcggugaacuaggua

SEQ ID NO: 1332119 - RNA, 19 nt, Homo sapiens
ccucuaaucccuugugaca

SEQ ID NO: 1332120 - RNA, 19 nt, Homo sapiens
acaaagagaagcgacagaa

SEQ ID NO: 1332121 - RNA, 19 nt, Homo sapiens
agaaacgagugcucugaag

SEQ ID NO: 1332122 - RNA, 19 nt, Homo sapiens
ccucaucacagugguuuaa

SEQ ID NO: 1332123 - RNA, 19 nt, Homo sapiens
ccacuucauauuuguauag

SEQ ID NO: 1332124 - RNA, 19 nt, Homo sapiens
caaggagaggaaauaaaug

SEQ ID NO: 1332125 - RNA, 19 nt, Homo sapiens
ggaugaggaaauuaagguu

SEQ ID NO: 1332126 - RNA, 19 nt, Homo sapiens
gcggugaacuagguaagag

SEQ ID NO: 1332127 - RNA, 19 nt, Homo sapiens
cuaggucuccuugcucuaa

SEQ ID NO: 1332128 - RNA, 19 nt, Homo sapiens
aagagaagcgacagaacaa

SEQ ID NO: 1332129 - RNA, 19 nt, Homo sapiens
ggauuguaugccuucuuua

SEQ ID NO: 1332130 - RNA, 19 nt, Homo sapiens
ugacugcuccuccuaagag

SEQ ID NO: 1332131 - RNA, 19 nt, Homo sapiens
ccacugaguaggagucaca

SEQ ID NO: 1332132 - RNA, 19 nt, Homo sapiens
gaccucaucacagugguuu

SEQ ID NO: 1332133 - RNA, 19 nt, Homo sapiens
ucuccuugcucuaaauaca

SEQ ID NO: 1332134 - RNA, 19 nt, Homo sapiens
cgaacugcagguacaaaga

SEQ ID NO: 1332135 - RNA, 19 nt, Homo sapiens
agacuugacagggauugua

SEQ ID NO: 1332136 - RNA, 19 nt, Homo sapiens
aaggaggcauaugggauuu

SEQ ID NO: 1332137 - RNA, 19 nt, Homo sapiens
cuagaaggauggcuuuuca

SEQ ID NO: 1332138 - RNA, 19 nt, Homo sapiens
uuguaugccuucuuuaugg

SEQ ID NO: 1332139 - RNA, 19 nt, Homo sapiens
gcugcaauaaaggucauua

SEQ ID NO: 1332140 - RNA, 19 nt, Homo sapiens
gaggcaagcggugaacuag

SEQ ID NO: 1332141 - RNA, 19 nt, Homo sapiens
agaggcaagcggugaacua

SEQ ID NO: 1332142 - RNA, 19 nt, Homo sapiens
acauuaacaagcacacaaa

SEQ ID NO: 1332143 - RNA, 19 nt, Homo sapiens
uaggucuccuugcucuaaa

SEQ ID NO: 1332144 - RNA, 19 nt, Homo sapiens
agcgacagaacaagucuua

SEQ ID NO: 1332145 - RNA, 19 nt, Homo sapiens
ccugauucauuuccugauc

SEQ ID NO: 1332146 - RNA, 19 nt, Homo sapiens
uguaugccuucuuuaugga

SEQ ID NO: 1332147 - RNA, 19 nt, Homo sapiens
gacuugacagggauuguau

SEQ ID NO: 1332148 - RNA, 19 nt, Homo sapiens
cauuagggcagcaugacaa

SEQ ID NO: 1332149 - RNA, 19 nt, Homo sapiens
gcauuagggcagcaugaca

SEQ ID NO: 1332150 - RNA, 19 nt, Homo sapiens
gaagcgacagaacaagucu

SEQ ID NO: 1332151 - RNA, 19 nt, Homo sapiens
ucagggaaguauccgaacu

SEQ ID NO: 1332152 - RNA, 19 nt, Homo sapiens
uagggcagcaugacaagga

SEQ ID NO: 1332153 - RNA, 19 nt, Homo sapiens
agacuggcuugcucuuugg

SEQ ID NO: 1332154 - RNA, 19 nt, Homo sapiens
cgacagaacaagucuuacg

SEQ ID NO: 1332155 - RNA, 19 nt, Homo sapiens
aagaaacgagugcucugaa

SEQ ID NO: 1332156 - RNA, 19 nt, Homo sapiens
aaagagcuugucuaauuag

SEQ ID NO: 1332157 - RNA, 19 nt, Homo sapiens
gacugcuccuccuaagaga

SEQ ID NO: 1332158 - RNA, 19 nt, Homo sapiens
gcucuuuggcugaccuuca

SEQ ID NO: 1332159 - RNA, 19 nt, Homo sapiens
caaagagaagcgacagaac

SEQ ID NO: 1332160 - RNA, 19 nt, Homo sapiens
gcucaccucagggaaguau

SEQ ID NO: 1332161 - RNA, 19 nt, Homo sapiens
gaacguucaucacuuuaaa

SEQ ID NO: 1332162 - RNA, 19 nt, Homo sapiens
gaucugcaguuucuuaauu

SEQ ID NO: 1332163 - RNA, 19 nt, Homo sapiens
ggacaaagauauuauugag

SEQ ID NO: 1332164 - RNA, 19 nt, Homo sapiens
gaggaaagaugaauugcuu

SEQ ID NO: 1332165 - RNA, 19 nt, Homo sapiens
guucaucacuuuaaacuga

SEQ ID NO: 1332166 - RNA, 19 nt, Homo sapiens
ccgaguaacuucauaauug

SEQ ID NO: 1332167 - RNA, 19 nt, Homo sapiens
gaaggaacguucaucacuu

SEQ ID NO: 1332168 - RNA, 19 nt, Homo sapiens
aaucagaagucacuguuua

SEQ ID NO: 1332169 - RNA, 19 nt, Homo sapiens
gaaauaaucaggucacuca

SEQ ID NO: 1332170 - RNA, 19 nt, Homo sapiens
gaaccuggcaaguuaauuu

SEQ ID NO: 1332171 - RNA, 19 nt, Homo sapiens
gaacaucgggucagaaguu

SEQ ID NO: 1332172 - RNA, 19 nt, Homo sapiens
gaaagaggauucuaguucu

SEQ ID NO: 1332173 - RNA, 19 nt, Homo sapiens
caaauuagaaggugaacua

SEQ ID NO: 1332174 - RNA, 19 nt, Homo sapiens
ggaguccucuuccaauaaa

SEQ ID NO: 1332175 - RNA, 19 nt, Homo sapiens
ugaaggcacuuaagauuga

SEQ ID NO: 1332176 - RNA, 19 nt, Homo sapiens
gcuacaagcucgagaacaa

SEQ ID NO: 1332177 - RNA, 19 nt, Homo sapiens
ggucagaaguugagauuuc

SEQ ID NO: 1332178 - RNA, 19 nt, Homo sapiens
ccacaaauauuucucaucu

SEQ ID NO: 1332179 - RNA, 19 nt, Homo sapiens
ggaaagguccgaaaucuca

SEQ ID NO: 1332180 - RNA, 19 nt, Homo sapiens
ggaagaggaucggcagaaa

SEQ ID NO: 1332181 - RNA, 19 nt, Homo sapiens
caccaauacugaaugaaua

SEQ ID NO: 1332182 - RNA, 19 nt, Homo sapiens
ggaaggagcugcaguugcu

SEQ ID NO: 1332183 - RNA, 19 nt, Homo sapiens
gcaaagagaagaaacaaca

SEQ ID NO: 1332184 - RNA, 19 nt, Homo sapiens
ggaacuuucugcccaggua

SEQ ID NO: 1332185 - RNA, 19 nt, Homo sapiens
ggaaagaugaauugcuuaa

SEQ ID NO: 1332186 - RNA, 19 nt, Homo sapiens
gagaagcaguggcaugaug

SEQ ID NO: 1332187 - RNA, 19 nt, Homo sapiens
cgaguaacuucauaauuga

SEQ ID NO: 1332188 - RNA, 19 nt, Homo sapiens
gcagaaagcagacaccaau

SEQ ID NO: 1332189 - RNA, 19 nt, Homo sapiens
gagauaaagagcucaauga

SEQ ID NO: 1332190 - RNA, 19 nt, Homo sapiens
ccaaagacuuaguagagaa

SEQ ID NO: 1332191 - RNA, 19 nt, Homo sapiens
gcagagacauguguuuauc

SEQ ID NO: 1332192 - RNA, 19 nt, Homo sapiens
aaaguugccugcacgauga

SEQ ID NO: 1332193 - RNA, 19 nt, Homo sapiens
gcggagacuuguauuguga

SEQ ID NO: 1332194 - RNA, 19 nt, Homo sapiens
ugauaaagcuaaaggacaa

SEQ ID NO: 1332195 - RNA, 19 nt, Homo sapiens
auaaagagcucaaugacau

SEQ ID NO: 1332196 - RNA, 19 nt, Homo sapiens
cauauucaccaaagacuua

SEQ ID NO: 1332197 - RNA, 19 nt, Homo sapiens
gaaauuugaagccauguug

SEQ ID NO: 1332198 - RNA, 19 nt, Homo sapiens
agaagucacuguuuaagga

SEQ ID NO: 1332199 - RNA, 19 nt, Homo sapiens
cgacaaugauaaagcuaaa

SEQ ID NO: 1332200 - RNA, 19 nt, Homo sapiens
ggcaugaugucaguguuua

SEQ ID NO: 1332201 - RNA, 19 nt, Homo sapiens
agacuuguauugugaaaga

SEQ ID NO: 1332202 - RNA, 19 nt, Homo sapiens
ucaggucacucacgaagaa

SEQ ID NO: 1332203 - RNA, 19 nt, Homo sapiens
gaaaagacgacagaaaaua

SEQ ID NO: 1332204 - RNA, 19 nt, Homo sapiens
gaaacgaaacucucagcaa

SEQ ID NO: 1332205 - RNA, 19 nt, Homo sapiens
gaacaagcucuuacgacaa

SEQ ID NO: 1332206 - RNA, 19 nt, Homo sapiens
gagcaugcccuacgugaug

SEQ ID NO: 1332207 - RNA, 19 nt, Homo sapiens
gcuaaaggacaaagauauu

SEQ ID NO: 1332208 - RNA, 19 nt, Homo sapiens
gcucuuacgacaaugauaa

SEQ ID NO: 1332209 - RNA, 19 nt, Homo sapiens
ggauucuaguucuucauaa

SEQ ID NO: 1332210 - RNA, 19 nt, Homo sapiens
ugaaagaggauucuaguuc

SEQ ID NO: 1332211 - RNA, 19 nt, Homo sapiens
gggcgaaaguggcaugugu

SEQ ID NO: 1332212 - RNA, 19 nt, Homo sapiens
caaaauaggucagacaaga

SEQ ID NO: 1332213 - RNA, 19 nt, Homo sapiens
gaaguugagauuuccacua

SEQ ID NO: 1332214 - RNA, 19 nt, Homo sapiens
gcaagaacgcacaaauuca

SEQ ID NO: 1332215 - RNA, 19 nt, Homo sapiens
gcagauaucaaaguucuau

SEQ ID NO: 1332216 - RNA, 19 nt, Homo sapiens
aaggaacguucaucacuuu

SEQ ID NO: 1332217 - RNA, 19 nt, Homo sapiens
gaaaguggcaugugugacu

SEQ ID NO: 1332218 - RNA, 19 nt, Homo sapiens
gauguagaaugucaagauc

SEQ ID NO: 1332219 - RNA, 19 nt, Homo sapiens
ggagacuuguauugugaaa

SEQ ID NO: 1332220 - RNA, 19 nt, Homo sapiens
gcaacgcauucuucucuuc

SEQ ID NO: 1332221 - RNA, 19 nt, Homo sapiens
ggaacguucaucacuuuaa

SEQ ID NO: 1332222 - RNA, 19 nt, Homo sapiens
gcugggagcagaacuagaa

SEQ ID NO: 1332223 - RNA, 19 nt, Homo sapiens
agacaccaauacugaauga

SEQ ID NO: 1332224 - RNA, 19 nt, Homo sapiens
gaaaaggcuucaauugugu

SEQ ID NO: 1332225 - RNA, 19 nt, Homo sapiens
gacguggaguggaugagua

SEQ ID NO: 1332226 - RNA, 19 nt, Homo sapiens
aaagcuggauguagaaugu

SEQ ID NO: 1332227 - RNA, 19 nt, Homo sapiens
cagaaaagcuggauguaga

SEQ ID NO: 1332228 - RNA, 19 nt, Homo sapiens
guugcucauuggagaauua

SEQ ID NO: 1332229 - RNA, 19 nt, Homo sapiens
gaaaauaaccacccaaaag

SEQ ID NO: 1332230 - RNA, 19 nt, Homo sapiens
gcaagauuauaagcagaaa

SEQ ID NO: 1332231 - RNA, 19 nt, Homo sapiens
gggugcaccuguucagaaa

SEQ ID NO: 1332232 - RNA, 19 nt, Homo sapiens
gcaguggcaugaugucagu

SEQ ID NO: 1332233 - RNA, 19 nt, Homo sapiens
cagcagagacauguguuua

SEQ ID NO: 1332234 - RNA, 19 nt, Homo sapiens
gcagauuguucggguaaau

SEQ ID NO: 1332235 - RNA, 19 nt, Homo sapiens
ccaaacagcucuccaaaag

SEQ ID NO: 1332236 - RNA, 19 nt, Homo sapiens
caaauggaaugccaaacag

SEQ ID NO: 1332237 - RNA, 19 nt, Homo sapiens
ucucaggaauuaauacaga

SEQ ID NO: 1332238 - RNA, 19 nt, Homo sapiens
caacuacagcuucaggaaa

SEQ ID NO: 1332239 - RNA, 19 nt, Homo sapiens
uaaaagcucuugaauccaa

SEQ ID NO: 1332240 - RNA, 19 nt, Homo sapiens
gauaaagagcucaaugaca

SEQ ID NO: 1332241 - RNA, 19 nt, Homo sapiens
cuacgaguuuguuaaucua

SEQ ID NO: 1332242 - RNA, 19 nt, Homo sapiens
ucagaaacacccacuuuau

SEQ ID NO: 1332243 - RNA, 19 nt, Homo sapiens
uaauuacgcugucauccau

SEQ ID NO: 1332244 - RNA, 19 nt, Homo sapiens
acucaaagauggaggaauc

SEQ ID NO: 1332245 - RNA, 19 nt, Homo sapiens
uuaaggaccagaaauuuga

SEQ ID NO: 1332246 - RNA, 19 nt, Homo sapiens
gcaacgagaagagaucauu

SEQ ID NO: 1332247 - RNA, 19 nt, Homo sapiens
gaaauugaaggcacuuaag

SEQ ID NO: 1332248 - RNA, 19 nt, Homo sapiens
aaaguucuauugugcugaa

SEQ ID NO: 1332249 - RNA, 19 nt, Homo sapiens
ggaaggaacguucaucacu

SEQ ID NO: 1332250 - RNA, 19 nt, Homo sapiens
cauaaacggcacuuaauuc

SEQ ID NO: 1332251 - RNA, 19 nt, Homo sapiens
agcaacagcuucuuucaug

SEQ ID NO: 1332252 - RNA, 19 nt, Homo sapiens
ggauguagaaugucaagau

SEQ ID NO: 1332253 - RNA, 19 nt, Homo sapiens
caaagauggaggaaucaaa

SEQ ID NO: 1332254 - RNA, 19 nt, Homo sapiens
agagugaucugcaguuucu

SEQ ID NO: 1332255 - RNA, 19 nt, Homo sapiens
aaguugagauuuccacuau

SEQ ID NO: 1332256 - RNA, 19 nt, Homo sapiens
uaauugccauccaagauuc

SEQ ID NO: 1332257 - RNA, 19 nt, Homo sapiens
gagaauuguccgccucaaa

SEQ ID NO: 1332258 - RNA, 19 nt, Homo sapiens
aaagaggaaagaugaauug

SEQ ID NO: 1332259 - RNA, 19 nt, Homo sapiens
gagaaaagaggaaagauga

SEQ ID NO: 1332260 - RNA, 19 nt, Homo sapiens
gguaaaagcucuugaaucc

SEQ ID NO: 1332261 - RNA, 19 nt, Homo sapiens
gaucgaaacugacuuaaug

SEQ ID NO: 1332262 - RNA, 19 nt, Homo sapiens
gcagaagguuaacauauuu

SEQ ID NO: 1332263 - RNA, 19 nt, Homo sapiens
gaagaucgaaacugacuua

SEQ ID NO: 1332264 - RNA, 19 nt, Homo sapiens
gaagguagaucuccagucu

SEQ ID NO: 1332265 - RNA, 19 nt, Homo sapiens
gaaccuauuucugggauug

SEQ ID NO: 1332266 - RNA, 19 nt, Homo sapiens
ucaagaaccuuccggacaa

SEQ ID NO: 1332267 - RNA, 19 nt, Homo sapiens
uaaucacccuuaaaccaua

SEQ ID NO: 1332268 - RNA, 19 nt, Homo sapiens
agacaacguugagagaaua

SEQ ID NO: 1332269 - RNA, 19 nt, Homo sapiens
caccaaaucccauugaauu

SEQ ID NO: 1332270 - RNA, 19 nt, Homo sapiens
ugcagaagguuaacauauu

SEQ ID NO: 1332271 - RNA, 19 nt, Homo sapiens
caucaaagcagaagguaga

SEQ ID NO: 1332272 - RNA, 19 nt, Homo sapiens
agguagaucuccagucuuu

SEQ ID NO: 1332273 - RNA, 19 nt, Homo sapiens
ccuuaaaccauaccuauuu

SEQ ID NO: 1332274 - RNA, 19 nt, Homo sapiens
uaagaggcagcuuuaauug

SEQ ID NO: 1332275 - RNA, 19 nt, Homo sapiens
aguugugccuaucuuauua

SEQ ID NO: 1332276 - RNA, 19 nt, Homo sapiens
caacguugagagaauagua

SEQ ID NO: 1332277 - RNA, 19 nt, Homo sapiens
ugauuaagaggcagcuuua

SEQ ID NO: 1332278 - RNA, 19 nt, Homo sapiens
gcaaaggaaagaccaccaa

SEQ ID NO: 1332279 - RNA, 19 nt, Homo sapiens
cagacaacguugagagaau

SEQ ID NO: 1332280 - RNA, 19 nt, Homo sapiens
ggacaacagaaccuauuuc

SEQ ID NO: 1332281 - RNA, 19 nt, Homo sapiens
ccaugaucauucccucuuu

SEQ ID NO: 1332282 - RNA, 19 nt, Homo sapiens
gaagauuaaugcagaaaag

SEQ ID NO: 1332283 - RNA, 19 nt, Homo sapiens
caaaggaaagaccaccaaa

SEQ ID NO: 1332284 - RNA, 19 nt, Homo sapiens
ccacucugcugcucuacug

SEQ ID NO: 1332285 - RNA, 19 nt, Homo sapiens
ugagaagauuaaugcagaa

SEQ ID NO: 1332286 - RNA, 19 nt, Homo sapiens
aaacgcagguugcagaaaa

SEQ ID NO: 1332287 - RNA, 19 nt, Homo sapiens
gaaccuuccggacaacaga

SEQ ID NO: 1332288 - RNA, 19 nt, Homo sapiens
gacaguugugccuaucuua

SEQ ID NO: 1332289 - RNA, 19 nt, Homo sapiens
gcagaaaagucaucaaagc

SEQ ID NO: 1332290 - RNA, 19 nt, Homo sapiens
caaagcagaagguagaucu

SEQ ID NO: 1332291 - RNA, 19 nt, Homo sapiens
uuaaugggaagaacagaaa

SEQ ID NO: 1332292 - RNA, 19 nt, Homo sapiens
gaauuucuagcaucuuauc

SEQ ID NO: 1332293 - RNA, 19 nt, Homo sapiens
aaggaaagaccaccaaauc

SEQ ID NO: 1332294 - RNA, 19 nt, Homo sapiens
guugagagaauaguagaaa

SEQ ID NO: 1332295 - RNA, 19 nt, Homo sapiens
agacaguugugccuaucuu

SEQ ID NO: 1332296 - RNA, 19 nt, Homo sapiens
gagaagauuaaugcagaaa

SEQ ID NO: 1332297 - RNA, 19 nt, Homo sapiens
gguuaacauauuucccuua

SEQ ID NO: 1332298 - RNA, 19 nt, Homo sapiens
uuaauugccaugaucauuc

SEQ ID NO: 1332299 - RNA, 19 nt, Homo sapiens
acaaggcacaguuugaaga

SEQ ID NO: 1332300 - RNA, 19 nt, Homo sapiens
cuaccuggaucagacaguu

SEQ ID NO: 1332301 - RNA, 19 nt, Homo sapiens
cagcuuuaauugccaugau

SEQ ID NO: 1332302 - RNA, 19 nt, Homo sapiens
gaguguauucuguggcauu

SEQ ID NO: 1332303 - RNA, 19 nt, Homo sapiens
caaggcacaguuugaagau

SEQ ID NO: 1332304 - RNA, 19 nt, Homo sapiens
gaccaccaaaucccauuga

SEQ ID NO: 1332305 - RNA, 19 nt, Homo sapiens
caguugugccuaucuuauu

SEQ ID NO: 1332306 - RNA, 19 nt, Homo sapiens
cggguaaucagcucccuuu

SEQ ID NO: 1332307 - RNA, 19 nt, Homo sapiens
ccaccaaaucccauugaau

SEQ ID NO: 1332308 - RNA, 19 nt, Homo sapiens
aaaggaaagaccaccaaau

SEQ ID NO: 1332309 - RNA, 19 nt, Homo sapiens
cccacuuucucacuuauuc

SEQ ID NO: 1332310 - RNA, 19 nt, Homo sapiens
cauugaauuucuagcaucu

SEQ ID NO: 1332311 - RNA, 19 nt, Homo sapiens
guagaucuccagucuuugc

SEQ ID NO: 1332312 - RNA, 19 nt, Homo sapiens
ucacuuauucuagguacuu

SEQ ID NO: 1332313 - RNA, 19 nt, Homo sapiens
gucccacucugcugcucua

SEQ ID NO: 1332314 - RNA, 19 nt, Homo sapiens
uugcagaagguuaacauau

SEQ ID NO: 1332315 - RNA, 19 nt, Homo sapiens
cggacaacagaaccuauuu

SEQ ID NO: 1332316 - RNA, 19 nt, Homo sapiens
ccauggagccagagcagau

SEQ ID NO: 1332317 - RNA, 19 nt, Homo sapiens
gccaugaucauucccucuu

SEQ ID NO: 1332318 - RNA, 19 nt, Homo sapiens
aguguauucuguggcauuu

SEQ ID NO: 1332319 - RNA, 19 nt, Homo sapiens
ugggauugcagaagguuaa

SEQ ID NO: 1332320 - RNA, 19 nt, Homo sapiens
caagaaccuuccggacaac

SEQ ID NO: 1332321 - RNA, 19 nt, Homo sapiens
ugacuuaaugggaagaaca

SEQ ID NO: 1332322 - RNA, 19 nt, Homo sapiens
ucagacaguugugccuauc

SEQ ID NO: 1332323 - RNA, 19 nt, Homo sapiens
ccggacaacagaaccuauu

SEQ ID NO: 1332324 - RNA, 19 nt, Homo sapiens
caaacgcagguugcagaaa

SEQ ID NO: 1332325 - RNA, 19 nt, Homo sapiens
ggacugucguagaguuucc

SEQ ID NO: 1332326 - RNA, 19 nt, Homo sapiens
caacccagcugcccucuuu

SEQ ID NO: 1332327 - RNA, 19 nt, Homo sapiens
gaaacucuucugugaaaua

SEQ ID NO: 1332328 - RNA, 19 nt, Homo sapiens
gaccugaaguugaguauca

SEQ ID NO: 1332329 - RNA, 19 nt, Homo sapiens
cggaaacucuucugugaaa

SEQ ID NO: 1332330 - RNA, 19 nt, Homo sapiens
gaugacagcccaacacuug

SEQ ID NO: 1332331 - RNA, 19 nt, Homo sapiens
caacuccagugaccgcuuu

SEQ ID NO: 1332332 - RNA, 19 nt, Homo sapiens
gcaacaagcgcuauuccaa

SEQ ID NO: 1332333 - RNA, 19 nt, Homo sapiens
gcacacacaccaacgagaa

SEQ ID NO: 1332334 - RNA, 19 nt, Homo sapiens
gaagguggagggacgcuuu

SEQ ID NO: 1332335 - RNA, 19 nt, Homo sapiens
ggagcccaauuguuuguug

SEQ ID NO: 1332336 - RNA, 19 nt, Homo sapiens
uggaccaugucaacgauua

SEQ ID NO: 1332337 - RNA, 19 nt, Homo sapiens
aacggaaacucuucuguga

SEQ ID NO: 1332338 - RNA, 19 nt, Homo sapiens
ggaccuggccugucaugca

SEQ ID NO: 1332339 - RNA, 19 nt, Homo sapiens
aaacucuucugugaaauag

SEQ ID NO: 1332340 - RNA, 19 nt, Homo sapiens
uguccgaccugcagcaaga

SEQ ID NO: 1332341 - RNA, 19 nt, Homo sapiens
ugucaacgauuaccauguc

SEQ ID NO: 1332342 - RNA, 19 nt, Homo sapiens
ggaaacucuucugugaaau

SEQ ID NO: 1332343 - RNA, 19 nt, Homo sapiens
aagccucgcuccugucugu

SEQ ID NO: 1332344 - RNA, 19 nt, Homo sapiens
ggauggugcuaggucauuc

SEQ ID NO: 1332345 - RNA, 19 nt, Homo sapiens
uagcaauaauguccuacug

SEQ ID NO: 1332346 - RNA, 19 nt, Homo sapiens
gcacacgcgcacccacuau

SEQ ID NO: 1332347 - RNA, 19 nt, Homo sapiens
ccaauuguuuguugcaacu

SEQ ID NO: 1332348 - RNA, 19 nt, Homo sapiens
gcccauggccacuuugugu

SEQ ID NO: 1332349 - RNA, 19 nt, Homo sapiens
gcuauuccaacuccaguga

SEQ ID NO: 1332350 - RNA, 19 nt, Homo sapiens
gguggaccaugucaacgau

SEQ ID NO: 1332351 - RNA, 19 nt, Homo sapiens
ucaaaccggcuguggugaa

SEQ ID NO: 1332352 - RNA, 19 nt, Homo sapiens
caaaccggcuguggugaac

SEQ ID NO: 1332353 - RNA, 19 nt, Homo sapiens
ucacugcgcaagcacauca

SEQ ID NO: 1332354 - RNA, 19 nt, Homo sapiens
caaguguaaccagcucuuu

SEQ ID NO: 1332355 - RNA, 19 nt, Homo sapiens
cgacgaacggaaacucuuc

SEQ ID NO: 1332356 - RNA, 19 nt, Homo sapiens
gcucggugcugcucaaacc

SEQ ID NO: 1332357 - RNA, 19 nt, Homo sapiens
caacgauuaccaugucaag

SEQ ID NO: 1332358 - RNA, 19 nt, Homo sapiens
acagggagcugggcuuggu

SEQ ID NO: 1332359 - RNA, 19 nt, Homo sapiens
aacaagcgcuauuccaacu

SEQ ID NO: 1332360 - RNA, 19 nt, Homo sapiens
ggaugacagcccaacacuu

SEQ ID NO: 1332361 - RNA, 19 nt, Homo sapiens
caacgccagguacaagaug

SEQ ID NO: 1332362 - RNA, 19 nt, Homo sapiens
uccagccacugcgcuauuu

SEQ ID NO: 1332363 - RNA, 19 nt, Homo sapiens
acucuucugugaaauagca

SEQ ID NO: 1332364 - RNA, 19 nt, Homo sapiens
gcccaauuguuuguugcaa

SEQ ID NO: 1332365 - RNA, 19 nt, Homo sapiens
uggacaagcccuacuacug

SEQ ID NO: 1332366 - RNA, 19 nt, Homo sapiens
gcccuacuacugcaagaug

SEQ ID NO: 1332367 - RNA, 19 nt, Homo sapiens
gagguuucaacgccaggua

SEQ ID NO: 1332368 - RNA, 19 nt, Homo sapiens
ccugccuccuccuuccuua

SEQ ID NO: 1332369 - RNA, 19 nt, Homo sapiens
aguguaaccagcucuuuga

SEQ ID NO: 1332370 - RNA, 19 nt, Homo sapiens
guacaaggcucuucaaaua

SEQ ID NO: 1332371 - RNA, 19 nt, Homo sapiens
gcaaauggcugaagagaaa

SEQ ID NO: 1332372 - RNA, 19 nt, Homo sapiens
gcacaaauaugaagaaaug

SEQ ID NO: 1332373 - RNA, 19 nt, Homo sapiens
gaaagcuucuuaccaauuu

SEQ ID NO: 1332374 - RNA, 19 nt, Homo sapiens
aaacaagcauggcauauuu

SEQ ID NO: 1332375 - RNA, 19 nt, Homo sapiens
gaaaguagcagauguagau

SEQ ID NO: 1332376 - RNA, 19 nt, Homo sapiens
gcagaagauucccuuguaa

SEQ ID NO: 1332377 - RNA, 19 nt, Homo sapiens
gaagaucugcauuguauuu

SEQ ID NO: 1332378 - RNA, 19 nt, Homo sapiens
gaagaagucuaggauguga

SEQ ID NO: 1332379 - RNA, 19 nt, Homo sapiens
gcaggucucugugaaagua

SEQ ID NO: 1332380 - RNA, 19 nt, Homo sapiens
gaaauaugguacuuaggaa

SEQ ID NO: 1332381 - RNA, 19 nt, Homo sapiens
ucauagagcuaaaugguuu

SEQ ID NO: 1332382 - RNA, 19 nt, Homo sapiens
ugacaauuguucugcuuua

SEQ ID NO: 1332383 - RNA, 19 nt, Homo sapiens
gaacagauaagagauagaa

SEQ ID NO: 1332384 - RNA, 19 nt, Homo sapiens
gauaagagauagaaguagu

SEQ ID NO: 1332385 - RNA, 19 nt, Homo sapiens
ucagauuuguggucuaaua

SEQ ID NO: 1332386 - RNA, 19 nt, Homo sapiens
gagaugaagauaccuuaua

SEQ ID NO: 1332387 - RNA, 19 nt, Homo sapiens
gaaacaagcauggcauauu

SEQ ID NO: 1332388 - RNA, 19 nt, Homo sapiens
gcugaacacuuccucuaaa

SEQ ID NO: 1332389 - RNA, 19 nt, Homo sapiens
ccaauaugcugaacacuuc

SEQ ID NO: 1332390 - RNA, 19 nt, Homo sapiens
ggauaaguuugaagaauuc

SEQ ID NO: 1332391 - RNA, 19 nt, Homo sapiens
guuaauaccagcagucaua

SEQ ID NO: 1332392 - RNA, 19 nt, Homo sapiens
aguagcagauguagauuua

SEQ ID NO: 1332393 - RNA, 19 nt, Homo sapiens
ugaugugacuguaaacuuu

SEQ ID NO: 1332394 - RNA, 19 nt, Homo sapiens
acgaagaucugcauuguau

SEQ ID NO: 1332395 - RNA, 19 nt, Homo sapiens
cagaaucgaggcacaaaua

SEQ ID NO: 1332396 - RNA, 19 nt, Homo sapiens
gaaacaacaacaacaacaa

SEQ ID NO: 1332397 - RNA, 19 nt, Homo sapiens
caauuguucugcuuuaguu

SEQ ID NO: 1332398 - RNA, 19 nt, Homo sapiens
ccaaaggaaugaaugaagu

SEQ ID NO: 1332399 - RNA, 19 nt, Homo sapiens
gugcugaccuggauucuuc

SEQ ID NO: 1332400 - RNA, 19 nt, Homo sapiens
acaaggcucuucaaauaga

SEQ ID NO: 1332401 - RNA, 19 nt, Homo sapiens
gaaacaagaagaagcacaa

SEQ ID NO: 1332402 - RNA, 19 nt, Homo sapiens
ggaccaauaggcuuaauau

SEQ ID NO: 1332403 - RNA, 19 nt, Homo sapiens
agaagaagcacaacugaaa

SEQ ID NO: 1332404 - RNA, 19 nt, Homo sapiens
gaauguaucuguuuucuag

SEQ ID NO: 1332405 - RNA, 19 nt, Homo sapiens
gaagauucccuuguaaaug

SEQ ID NO: 1332406 - RNA, 19 nt, Homo sapiens
ccaaauugaugugacugua

SEQ ID NO: 1332407 - RNA, 19 nt, Homo sapiens
gaguugaacauguccauaa

SEQ ID NO: 1332408 - RNA, 19 nt, Homo sapiens
gauuaagugugaucauugu

SEQ ID NO: 1332409 - RNA, 19 nt, Homo sapiens
auacaacacuucugcaaau

SEQ ID NO: 1332410 - RNA, 19 nt, Homo sapiens
cggaaaagcugacaaagaa

SEQ ID NO: 1332411 - RNA, 19 nt, Homo sapiens
cacuguagcugaccaagaa

SEQ ID NO: 1332412 - RNA, 19 nt, Homo sapiens
uaucugcaauguucuagaa

SEQ ID NO: 1332413 - RNA, 19 nt, Homo sapiens
cauauauucucuugucaga

SEQ ID NO: 1332414 - RNA, 19 nt, Homo sapiens
acacagagagaucauuuaa

SEQ ID NO: 1332415 - RNA, 19 nt, Homo sapiens
uguaugacuuuccaaauug

SEQ ID NO: 1332416 - RNA, 19 nt, Homo sapiens
caaaggaaugaaugaagua

SEQ ID NO: 1332417 - RNA, 19 nt, Homo sapiens
cagauaagagauagaagua

SEQ ID NO: 1332418 - RNA, 19 nt, Homo sapiens
ugcagaagauucccuugua

SEQ ID NO: 1332419 - RNA, 19 nt, Homo sapiens
cuacucaacugugugguaa

SEQ ID NO: 1332420 - RNA, 19 nt, Homo sapiens
gaaacugggaauucugaaa

SEQ ID NO: 1332421 - RNA, 19 nt, Homo sapiens
gagcagcuuuuccuuuaua

SEQ ID NO: 1332422 - RNA, 19 nt, Homo sapiens
caaauugaugugacuguaa

SEQ ID NO: 1332423 - RNA, 19 nt, Homo sapiens
ggaaacaacaacaacaaca

SEQ ID NO: 1332424 - RNA, 19 nt, Homo sapiens
gaagagaugaagauaccuu

SEQ ID NO: 1332425 - RNA, 19 nt, Homo sapiens
gaagaaaugaaacaagaag

SEQ ID NO: 1332426 - RNA, 19 nt, Homo sapiens
uauacaaucugacccuguu

SEQ ID NO: 1332427 - RNA, 19 nt, Homo sapiens
ucugcaauguucuagaaua

SEQ ID NO: 1332428 - RNA, 19 nt, Homo sapiens
cccaguaucugcaauguuc

SEQ ID NO: 1332429 - RNA, 19 nt, Homo sapiens
cuuauaugcccuaaaguua

SEQ ID NO: 1332430 - RNA, 19 nt, Homo sapiens
ccugaguacuauaaacuuu

SEQ ID NO: 1332431 - RNA, 19 nt, Homo sapiens
guaugacuuuccaaauuga

SEQ ID NO: 1332432 - RNA, 19 nt, Homo sapiens
uagaauagaaguuggcaaa

SEQ ID NO: 1332433 - RNA, 19 nt, Homo sapiens
aagcauggcauauuugauu

SEQ ID NO: 1332434 - RNA, 19 nt, Homo sapiens
caagaagaagcacaacuga

SEQ ID NO: 1332435 - RNA, 19 nt, Homo sapiens
gauuaagccuaucuguuag

SEQ ID NO: 1332436 - RNA, 19 nt, Homo sapiens
aagauucccuuguaaaugg

SEQ ID NO: 1332437 - RNA, 19 nt, Homo sapiens
gcccauaauaucuacauaa

SEQ ID NO: 1332438 - RNA, 19 nt, Homo sapiens
agaaaggaaugaacucagu

SEQ ID NO: 1332439 - RNA, 19 nt, Homo sapiens
ugucagauuuguggucuaa

SEQ ID NO: 1332440 - RNA, 19 nt, Homo sapiens
aagagcagcuuuuccuuua

SEQ ID NO: 1332441 - RNA, 19 nt, Homo sapiens
uuacgaagaucugcauugu

SEQ ID NO: 1332442 - RNA, 19 nt, Homo sapiens
gaucuccucuaggcauuga

SEQ ID NO: 1332443 - RNA, 19 nt, Homo sapiens
gaaaagcugacaaagaaaa

SEQ ID NO: 1332444 - RNA, 19 nt, Homo sapiens
gaaaugaaacaagaagaag

SEQ ID NO: 1332445 - RNA, 19 nt, Homo sapiens
aaucgaggcacaaauauga

SEQ ID NO: 1332446 - RNA, 19 nt, Homo sapiens
guuuaaauguugcgaucaa

SEQ ID NO: 1332447 - RNA, 19 nt, Homo sapiens
gauguaaaucuggauguaa

SEQ ID NO: 1332448 - RNA, 19 nt, Homo sapiens
agaaauaugguacuuagga

SEQ ID NO: 1332449 - RNA, 19 nt, Homo sapiens
caggauaauuacuggaaga

SEQ ID NO: 1332450 - RNA, 19 nt, Homo sapiens
uugaacauguccauaaaug

SEQ ID NO: 1332451 - RNA, 19 nt, Homo sapiens
ugguuuccuuucagaauua

SEQ ID NO: 1332452 - RNA, 19 nt, Homo sapiens
gaauuugguuuccuuucag

SEQ ID NO: 1332453 - RNA, 19 nt, Homo sapiens
gcagucauauuuuaucaga

SEQ ID NO: 1332454 - RNA, 19 nt, Homo sapiens
cagaagagaugaagauacc

SEQ ID NO: 1332455 - RNA, 19 nt, Homo sapiens
aggaagaagucuaggaugu

SEQ ID NO: 1332456 - RNA, 19 nt, Homo sapiens
agagauagaaguaguuaga

SEQ ID NO: 1332457 - RNA, 19 nt, Homo sapiens
ugaaagggcaggucucugu

SEQ ID NO: 1332458 - RNA, 19 nt, Homo sapiens
gaagaagcacaacugaaag

SEQ ID NO: 1332459 - RNA, 19 nt, Homo sapiens
gaaucgaggcacaaauaug

SEQ ID NO: 1332460 - RNA, 19 nt, Homo sapiens
gaauagaaguuggcaaacc

SEQ ID NO: 1332461 - RNA, 19 nt, Homo sapiens
cagaagauucccuuguaaa

SEQ ID NO: 1332462 - RNA, 19 nt, Homo sapiens
acacacagagagaucauuu

SEQ ID NO: 1332463 - RNA, 19 nt, Homo sapiens
cuaguuauuccucauguaa

SEQ ID NO: 1332464 - RNA, 19 nt, Homo sapiens
ucauuguacugauggauau

SEQ ID NO: 1332465 - RNA, 19 nt, Homo sapiens
gggcaggucucugugaaag

SEQ ID NO: 1332466 - RNA, 19 nt, Homo sapiens
ugccaagccugcagaguug

SEQ ID NO: 1332467 - RNA, 19 nt, Homo sapiens
gaaguuggcaaaccucucu

SEQ ID NO: 1332468 - RNA, 19 nt, Homo sapiens
ugucauuguugccaggaua

SEQ ID NO: 1332469 - RNA, 19 nt, Homo sapiens
uaccuuauaugcccuaaag

SEQ ID NO: 1332470 - RNA, 19 nt, Homo sapiens
caacauggccuucagcaau

SEQ ID NO: 1332471 - RNA, 19 nt, Homo sapiens
gcacagccuucgcccagaa

SEQ ID NO: 1332472 - RNA, 19 nt, Homo sapiens
gggaugagguccacuacca

SEQ ID NO: 1332473 - RNA, 19 nt, Homo sapiens
gaccaggguaccaucaaua

SEQ ID NO: 1332474 - RNA, 19 nt, Homo sapiens
gaagaggcgaguccuguuc

SEQ ID NO: 1332475 - RNA, 19 nt, Homo sapiens
uggccaaucuguacucaug

SEQ ID NO: 1332476 - RNA, 19 nt, Homo sapiens
ccacggaguucaucaucuc

SEQ ID NO: 1332477 - RNA, 19 nt, Homo sapiens
gcaacacccuggccuucuc

SEQ ID NO: 1332478 - RNA, 19 nt, Homo sapiens
ggaagaggcgaguccuguu

SEQ ID NO: 1332479 - RNA, 19 nt, Homo sapiens
gagguccacuaccacauca

SEQ ID NO: 1332480 - RNA, 19 nt, Homo sapiens
aagcuggccuggcacaaga

SEQ ID NO: 1332481 - RNA, 19 nt, Homo sapiens
gcacaagaagaucuacauc

SEQ ID NO: 1332482 - RNA, 19 nt, Homo sapiens
cagcccaucuucugcuuca

SEQ ID NO: 1332483 - RNA, 19 nt, Homo sapiens
gcuggauccugcugcaugu

SEQ ID NO: 1332484 - RNA, 19 nt, Homo sapiens
gccaaucuguacucaugug

SEQ ID NO: 1332485 - RNA, 19 nt, Homo sapiens
aacauggccuucagcaaug

SEQ ID NO: 1332486 - RNA, 19 nt, Homo sapiens
cuuggagccuuaccucuau

SEQ ID NO: 1332487 - RNA, 19 nt, Homo sapiens
gaccuccugucuggcagua

SEQ ID NO: 1332488 - RNA, 19 nt, Homo sapiens
ggaccagaacacacugaug

SEQ ID NO: 1332489 - RNA, 19 nt, Homo sapiens
gggagaggcagcugagauc

SEQ ID NO: 1332490 - RNA, 19 nt, Homo sapiens
gaagcuggccuggcacaag

SEQ ID NO: 1332491 - RNA, 19 nt, Homo sapiens
agaccaggguaccaucaau

SEQ ID NO: 1332492 - RNA, 19 nt, Homo sapiens
ggagaccaggguaccauca

SEQ ID NO: 1332493 - RNA, 19 nt, Homo sapiens
ccuuggagccuuaccucua

SEQ ID NO: 1332494 - RNA, 19 nt, Homo sapiens
gcagcaccaggccaucuug

SEQ ID NO: 1332495 - RNA, 19 nt, Homo sapiens
ggagaggcagcugagauca

SEQ ID NO: 1332496 - RNA, 19 nt, Homo sapiens
gagaccaggguaccaucaa

SEQ ID NO: 1332497 - RNA, 19 nt, Homo sapiens
ccucaaggucccucaagga

SEQ ID NO: 1332498 - RNA, 19 nt, Homo sapiens
gaccacggaguucaucauc

SEQ ID NO: 1332499 - RNA, 19 nt, Homo sapiens
cacccuggccuucucaaug

SEQ ID NO: 1332500 - RNA, 19 nt, Homo sapiens
guaaaggacuugacauauu

SEQ ID NO: 1332501 - RNA, 19 nt, Homo sapiens
guacugagccacauaauaa

SEQ ID NO: 1332502 - RNA, 19 nt, Homo sapiens
ggagagugaugaacuuuaa

SEQ ID NO: 1332503 - RNA, 19 nt, Homo sapiens
gaagagcuauccucccuuu

SEQ ID NO: 1332504 - RNA, 19 nt, Homo sapiens
gaaacacucaccuaauuua

SEQ ID NO: 1332505 - RNA, 19 nt, Homo sapiens
caacagagaugugagaaga

SEQ ID NO: 1332506 - RNA, 19 nt, Homo sapiens
ccaaucagguggaauguuu

SEQ ID NO: 1332507 - RNA, 19 nt, Homo sapiens
caaaucagcuuccacuuag

SEQ ID NO: 1332508 - RNA, 19 nt, Homo sapiens
ccaaagaugucacacaguu

SEQ ID NO: 1332509 - RNA, 19 nt, Homo sapiens
gaacaacaccaauugcaaa

SEQ ID NO: 1332510 - RNA, 19 nt, Homo sapiens
gaugaacuaugguauaaug

SEQ ID NO: 1332511 - RNA, 19 nt, Homo sapiens
ccaagggcgugaagaauuu

SEQ ID NO: 1332512 - RNA, 19 nt, Homo sapiens
gaagaaagcaccugugauc

SEQ ID NO: 1332513 - RNA, 19 nt, Homo sapiens
gaaggagaggucuuuaaua

SEQ ID NO: 1332514 - RNA, 19 nt, Homo sapiens
ggaagcagauuucuaagag

SEQ ID NO: 1332515 - RNA, 19 nt, Homo sapiens
ccaaaucagcuuccacuua

SEQ ID NO: 1332516 - RNA, 19 nt, Homo sapiens
cuagguaccugcuguguaa

SEQ ID NO: 1332517 - RNA, 19 nt, Homo sapiens
gugaugaacuuuaagaaug

SEQ ID NO: 1332518 - RNA, 19 nt, Homo sapiens
caacgggucucuucacuca

SEQ ID NO: 1332519 - RNA, 19 nt, Homo sapiens
ggacggcuacucucuauuu

SEQ ID NO: 1332520 - RNA, 19 nt, Homo sapiens
gaugauaacauucgugaaa

SEQ ID NO: 1332521 - RNA, 19 nt, Homo sapiens
agaagggacuuuaauagaa

SEQ ID NO: 1332522 - RNA, 19 nt, Homo sapiens
gaaggcagaugaaacucaa

SEQ ID NO: 1332523 - RNA, 19 nt, Homo sapiens
gagaagagcuaggcaguag

SEQ ID NO: 1332524 - RNA, 19 nt, Homo sapiens
gagaagauaauacagauga

SEQ ID NO: 1332525 - RNA, 19 nt, Homo sapiens
gcacgaugguguauucaug

SEQ ID NO: 1332526 - RNA, 19 nt, Homo sapiens
ggucauugcugagguguuu

SEQ ID NO: 1332527 - RNA, 19 nt, Homo sapiens
gaagggacuuuaauagaag

SEQ ID NO: 1332528 - RNA, 19 nt, Homo sapiens
gugcaucgcuaccaacaaa

SEQ ID NO: 1332529 - RNA, 19 nt, Homo sapiens
gagcugacauggcuacuca

SEQ ID NO: 1332530 - RNA, 19 nt, Homo sapiens
gaauaugcaucuuuacucu

SEQ ID NO: 1332531 - RNA, 19 nt, Homo sapiens
ggagaggucuuuaauagcu

SEQ ID NO: 1332532 - RNA, 19 nt, Homo sapiens
ccaaagaggugaagaaagc

SEQ ID NO: 1332533 - RNA, 19 nt, Homo sapiens
gagcagaggcugaugaaug

SEQ ID NO: 1332534 - RNA, 19 nt, Homo sapiens
caucaccuuucaucgauua

SEQ ID NO: 1332535 - RNA, 19 nt, Homo sapiens
ggaguuuccuuucaacaug

SEQ ID NO: 1332536 - RNA, 19 nt, Homo sapiens
gagaagggacuuuaauaga

SEQ ID NO: 1332537 - RNA, 19 nt, Homo sapiens
caagacuggccaucaauua

SEQ ID NO: 1332538 - RNA, 19 nt, Homo sapiens
agacgaaagugucaauuug

SEQ ID NO: 1332539 - RNA, 19 nt, Homo sapiens
ugacauggcuacucaaugg

SEQ ID NO: 1332540 - RNA, 19 nt, Homo sapiens
gagcagcacuccucaaacu

SEQ ID NO: 1332541 - RNA, 19 nt, Homo sapiens
guagggcugugccuucuaa

SEQ ID NO: 1332542 - RNA, 19 nt, Homo sapiens
cgacuucugcugagauuua

SEQ ID NO: 1332543 - RNA, 19 nt, Homo sapiens
gguaauaaaccaaucagaa

SEQ ID NO: 1332544 - RNA, 19 nt, Homo sapiens
acagagaugugagaagaua

SEQ ID NO: 1332545 - RNA, 19 nt, Homo sapiens
ccagaugccucccacaaga

SEQ ID NO: 1332546 - RNA, 19 nt, Homo sapiens
gcucuccgguguucacuuu

SEQ ID NO: 1332547 - RNA, 19 nt, Homo sapiens
guacugcaagcaacaaaua

SEQ ID NO: 1332548 - RNA, 19 nt, Homo sapiens
ugagaucauuggucaaauu

SEQ ID NO: 1332549 - RNA, 19 nt, Homo sapiens
aaggagaggucuuuaauag

SEQ ID NO: 1332550 - RNA, 19 nt, Homo sapiens
ggaaggagaggucuuuaau

SEQ ID NO: 1332551 - RNA, 19 nt, Homo sapiens
gauuacauguauagcagua

SEQ ID NO: 1332552 - RNA, 19 nt, Homo sapiens
guagugaccuuaggauaug

SEQ ID NO: 1332553 - RNA, 19 nt, Homo sapiens
cauugcagcuccuguguuu

SEQ ID NO: 1332554 - RNA, 19 nt, Homo sapiens
gagcagagaaguuccagaa

SEQ ID NO: 1332555 - RNA, 19 nt, Homo sapiens
agaguaaacuggaaucuca

SEQ ID NO: 1332556 - RNA, 19 nt, Homo sapiens
aaauaaggcugccgacuuc

SEQ ID NO: 1332557 - RNA, 19 nt, Homo sapiens
gcacaaaguagacauucaa

SEQ ID NO: 1332558 - RNA, 19 nt, Homo sapiens
gaguuucgcuuggaacgua

SEQ ID NO: 1332559 - RNA, 19 nt, Homo sapiens
gaccaaaccagcaggagua

SEQ ID NO: 1332560 - RNA, 19 nt, Homo sapiens
ccaauuacuugcagggauu

SEQ ID NO: 1332561 - RNA, 19 nt, Homo sapiens
caagaagaauuagacgaaa

SEQ ID NO: 1332562 - RNA, 19 nt, Homo sapiens
gugcaagagucaucauuug

SEQ ID NO: 1332563 - RNA, 19 nt, Homo sapiens
uaacaugggccucuagcua

SEQ ID NO: 1332564 - RNA, 19 nt, Homo sapiens
gaagcagauuucuaagaga

SEQ ID NO: 1332565 - RNA, 19 nt, Homo sapiens
acagaaggcucuccaguca

SEQ ID NO: 1332566 - RNA, 19 nt, Homo sapiens
gaacuaugguauaaugcau

SEQ ID NO: 1332567 - RNA, 19 nt, Homo sapiens
ccaccaaccuggcagcuau

SEQ ID NO: 1332568 - RNA, 19 nt, Homo sapiens
ggacuuuaauagaagauuc

SEQ ID NO: 1332569 - RNA, 19 nt, Homo sapiens
ggaaaucugcacucacuga

SEQ ID NO: 1332570 - RNA, 19 nt, Homo sapiens
ccacaagaguaaacuggaa

SEQ ID NO: 1332571 - RNA, 19 nt, Homo sapiens
gcaagacgacagcauagaa

SEQ ID NO: 1332572 - RNA, 19 nt, Homo sapiens
gaucauuggucaaauugca

SEQ ID NO: 1332573 - RNA, 19 nt, Homo sapiens
cagagaaguuccagaagga

SEQ ID NO: 1332574 - RNA, 19 nt, Homo sapiens
gcaguggagugccuggauu

SEQ ID NO: 1332575 - RNA, 19 nt, Homo sapiens
uuacagccaucuucacuga

SEQ ID NO: 1332576 - RNA, 19 nt, Homo sapiens
ggaguguaguggagaguga

SEQ ID NO: 1332577 - RNA, 19 nt, Homo sapiens
uaaauaacaugggccucua

SEQ ID NO: 1332578 - RNA, 19 nt, Homo sapiens
guguauugcucccaucuuu

SEQ ID NO: 1332579 - RNA, 19 nt, Homo sapiens
gggcaauucuauagguaaa

SEQ ID NO: 1332580 - RNA, 19 nt, Homo sapiens
ccacaguauuguucugaaa

SEQ ID NO: 1332581 - RNA, 19 nt, Homo sapiens
ucacugaaacuaagguuaa

SEQ ID NO: 1332582 - RNA, 19 nt, Homo sapiens
gaagaguaccuagcacaaa

SEQ ID NO: 1332583 - RNA, 19 nt, Homo sapiens
ccaaaagucugaaagugua

SEQ ID NO: 1332584 - RNA, 19 nt, Homo sapiens
uaauacagaugaaccaaag

SEQ ID NO: 1332585 - RNA, 19 nt, Homo sapiens
cauaggugcuguccugcua

SEQ ID NO: 1332586 - RNA, 19 nt, Homo sapiens
cugcugagauuuauauaga

SEQ ID NO: 1332587 - RNA, 19 nt, Homo sapiens
aaacaaaguuaugcaggaa

SEQ ID NO: 1332588 - RNA, 19 nt, Homo sapiens
cagcuuccacuuagcauua

SEQ ID NO: 1332589 - RNA, 19 nt, Homo sapiens
gcuauaagggcaauucuau

SEQ ID NO: 1332590 - RNA, 19 nt, Homo sapiens
gacaugcucucugcacauu

SEQ ID NO: 1332591 - RNA, 19 nt, Homo sapiens
augaaacacucaccuaauu

SEQ ID NO: 1332592 - RNA, 19 nt, Homo sapiens
ccaagaagaauuagacgaa

SEQ ID NO: 1332593 - RNA, 19 nt, Homo sapiens
uagagaagggacuuuaaua

SEQ ID NO: 1332594 - RNA, 19 nt, Homo sapiens
gcuccuguguuuacaaaga

SEQ ID NO: 1332595 - RNA, 19 nt, Homo sapiens
uaaauaaggcugccgacuu

SEQ ID NO: 1332596 - RNA, 19 nt, Homo sapiens
ucuaagagagagcuauuua

SEQ ID NO: 1332597 - RNA, 19 nt, Homo sapiens
gcuuugaaaugcuuugaga

SEQ ID NO: 1332598 - RNA, 19 nt, Homo sapiens
gcaauuaggagccauaugc

SEQ ID NO: 1332599 - RNA, 19 nt, Homo sapiens
ccugcucccuguuguguua

SEQ ID NO: 1332600 - RNA, 19 nt, Homo sapiens
gaagugggaugggaaguua

SEQ ID NO: 1332601 - RNA, 19 nt, Homo sapiens
gaaugaugguuuccaauuu

SEQ ID NO: 1332602 - RNA, 19 nt, Homo sapiens
ggaaagauaugggaagaau

SEQ ID NO: 1332603 - RNA, 19 nt, Homo sapiens
caaaggacaugaacugauc

SEQ ID NO: 1332604 - RNA, 19 nt, Homo sapiens
caagaaaucuaacucaaac

SEQ ID NO: 1332605 - RNA, 19 nt, Homo sapiens
gaucaaggauguucucaac

SEQ ID NO: 1332606 - RNA, 19 nt, Homo sapiens
uacagucccucuccuauaa

SEQ ID NO: 1332607 - RNA, 19 nt, Homo sapiens
gcaucuagcauuagguaua

SEQ ID NO: 1332608 - RNA, 19 nt, Homo sapiens
ccaggacacugacucugua

SEQ ID NO: 1332609 - RNA, 19 nt, Homo sapiens
gaugggaaguuaggaaaga

SEQ ID NO: 1332610 - RNA, 19 nt, Homo sapiens
guacagucccucuccuaua

SEQ ID NO: 1332611 - RNA, 19 nt, Homo sapiens
auaagaagaucaaggaugu

SEQ ID NO: 1332612 - RNA, 19 nt, Homo sapiens
gcuuaugucaucucuguua

SEQ ID NO: 1332613 - RNA, 19 nt, Homo sapiens
aagaagcucucgugugcua

SEQ ID NO: 1332614 - RNA, 19 nt, Homo sapiens
aauaugcgguguuugguuu

SEQ ID NO: 1332615 - RNA, 19 nt, Homo sapiens
gaccaugacaguaaugaaa

SEQ ID NO: 1332616 - RNA, 19 nt, Homo sapiens
gugagaauaugcgguguuu

SEQ ID NO: 1332617 - RNA, 19 nt, Homo sapiens
ccaagaaaucuaacucaaa

SEQ ID NO: 1332618 - RNA, 19 nt, Homo sapiens
gauaguuuacugagaauga

SEQ ID NO: 1332619 - RNA, 19 nt, Homo sapiens
ccacuucauuuguuccauu

SEQ ID NO: 1332620 - RNA, 19 nt, Homo sapiens
uaacguggcaucuagcauu

SEQ ID NO: 1332621 - RNA, 19 nt, Homo sapiens
gugcuuaugucaucucugu

SEQ ID NO: 1332622 - RNA, 19 nt, Homo sapiens
gaauagugccgcaauaaac

SEQ ID NO: 1332623 - RNA, 19 nt, Homo sapiens
uaucauuguuggacauuug

SEQ ID NO: 1332624 - RNA, 19 nt, Homo sapiens
gagaauaugcgguguuugg

SEQ ID NO: 1332625 - RNA, 19 nt, Homo sapiens
caucuagcauuagguauau

SEQ ID NO: 1332626 - RNA, 19 nt, Homo sapiens
uaugucaucucuguuauug

SEQ ID NO: 1332627 - RNA, 19 nt, Homo sapiens
ucaaacgucccacuucauu

SEQ ID NO: 1332628 - RNA, 19 nt, Homo sapiens
guucaauucccaccuauga

SEQ ID NO: 1332629 - RNA, 19 nt, Homo sapiens
ugagaaugaugguuuccaa

SEQ ID NO: 1332630 - RNA, 19 nt, Homo sapiens
uuagguauaucucccaaug

SEQ ID NO: 1332631 - RNA, 19 nt, Homo sapiens
guaccucucugugcuuaug

SEQ ID NO: 1332632 - RNA, 19 nt, Homo sapiens
uuacugagaaugaugguuu

SEQ ID NO: 1332633 - RNA, 19 nt, Homo sapiens
gaauaugcgguguuugguu

SEQ ID NO: 1332634 - RNA, 19 nt, Homo sapiens
guauaucucccaaugcuau

SEQ ID NO: 1332635 - RNA, 19 nt, Homo sapiens
uuaauccagucuaucauug

SEQ ID NO: 1332636 - RNA, 19 nt, Homo sapiens
cacgugaucucauuguuca

SEQ ID NO: 1332637 - RNA, 19 nt, Homo sapiens
guggugacaucucaguuug

SEQ ID NO: 1332638 - RNA, 19 nt, Homo sapiens
ccaagucuuugcuauugug

SEQ ID NO: 1332639 - RNA, 19 nt, Homo sapiens
aguauuccaugguguauau

SEQ ID NO: 1332640 - RNA, 19 nt, Homo sapiens
aaacgucccacuucauuug

SEQ ID NO: 1332641 - RNA, 19 nt, Homo sapiens
ugaauagugccgcaauaaa

SEQ ID NO: 1332642 - RNA, 19 nt, Homo sapiens
gugaauagugccgcaauaa

SEQ ID NO: 1332643 - RNA, 19 nt, Homo sapiens
aacguggcaucuagcauua

SEQ ID NO: 1332644 - RNA, 19 nt, Homo sapiens
ugucaucucuguuauuguc

SEQ ID NO: 1332645 - RNA, 19 nt, Homo sapiens
aaugaugguuuccaauuuc

SEQ ID NO: 1332646 - RNA, 19 nt, Homo sapiens
agaaugaugguuuccaauu

SEQ ID NO: 1332647 - RNA, 19 nt, Homo sapiens
guacaugggcaacauugug

SEQ ID NO: 1332648 - RNA, 19 nt, Homo sapiens
uaggaaagauaugggaaga

SEQ ID NO: 1332649 - RNA, 19 nt, Homo sapiens
gaaguuaggaaagauaugg

SEQ ID NO: 1332650 - RNA, 19 nt, Homo sapiens
ggaagugggaugggaaguu

SEQ ID NO: 1332651 - RNA, 19 nt, Homo sapiens
aaaccagggucccaaccaa

SEQ ID NO: 1332652 - RNA, 19 nt, Homo sapiens
cuacaaaggacaugaacug

SEQ ID NO: 1332653 - RNA, 19 nt, Homo sapiens
caaacgucccacuucauuu

SEQ ID NO: 1332654 - RNA, 19 nt, Homo sapiens
ugugaauagugccgcaaua

SEQ ID NO: 1332655 - RNA, 19 nt, Homo sapiens
gcaacauugugcagguuag

SEQ ID NO: 1332656 - RNA, 19 nt, Homo sapiens
cauaguauuccauggugua

SEQ ID NO: 1332657 - RNA, 19 nt, Homo sapiens
ugcgauaguuuacugagaa

SEQ ID NO: 1332658 - RNA, 19 nt, Homo sapiens
aaagauaugggaagaaugg

SEQ ID NO: 1332659 - RNA, 19 nt, Homo sapiens
gaaagauaugggaagaaug

SEQ ID NO: 1332660 - RNA, 19 nt, Homo sapiens
cagaaaauguugucagugu

SEQ ID NO: 1332661 - RNA, 19 nt, Homo sapiens
gcgauaguuuacugagaau

SEQ ID NO: 1332662 - RNA, 19 nt, Homo sapiens
guacucaguguuccuuaga

SEQ ID NO: 1332663 - RNA, 19 nt, Homo sapiens
gggcaacauugugcagguu

SEQ ID NO: 1332664 - RNA, 19 nt, Homo sapiens
gggaugggaaguuaggaaa

SEQ ID NO: 1332665 - RNA, 19 nt, Homo sapiens
ucucugugcuuaugucauc

SEQ ID NO: 1332666 - RNA, 19 nt, Homo sapiens
acucaaacgucccacuuca

SEQ ID NO: 1332667 - RNA, 19 nt, Homo sapiens
uuccaagucuuugcuauug

SEQ ID NO: 1332668 - RNA, 19 nt, Homo sapiens
ccaccuaugagugagaaua

SEQ ID NO: 1332669 - RNA, 19 nt, Homo sapiens
gaagaucaaggauguucuc

SEQ ID NO: 1332670 - RNA, 19 nt, Homo sapiens
uaacucaaacgucccacuu

SEQ ID NO: 1332671 - RNA, 19 nt, Homo sapiens
ggcaacauugugcagguua

SEQ ID NO: 1332672 - RNA, 19 nt, Homo sapiens
gaguacagucccucuccua

SEQ ID NO: 1332673 - RNA, 19 nt, Homo sapiens
uggcugugcuuguggcuau

SEQ ID NO: 1332674 - RNA, 19 nt, Homo sapiens
aauccagucuaucauuguu

SEQ ID NO: 1332675 - RNA, 19 nt, Homo sapiens
caucucaguuugggaagug

SEQ ID NO: 1332676 - RNA, 19 nt, Homo sapiens
ucucaacagucuagaguac

SEQ ID NO: 1332677 - RNA, 19 nt, Homo sapiens
ucauccaugucccuacaaa

SEQ ID NO: 1332678 - RNA, 19 nt, Homo sapiens
gggaaguuaggaaagauau

SEQ ID NO: 1332679 - RNA, 19 nt, Homo sapiens
gaaaccagggucccaacca

SEQ ID NO: 1332680 - RNA, 19 nt, Homo sapiens
gggaggaggcugagaacuc

SEQ ID NO: 1332681 - RNA, 19 nt, Homo sapiens
uggauaagaagaucaagga

SEQ ID NO: 1332682 - RNA, 19 nt, Homo sapiens
gagaaugaugguuuccaau

SEQ ID NO: 1332683 - RNA, 19 nt, Homo sapiens
caggagcucagagaucuaa

SEQ ID NO: 1332684 - RNA, 19 nt, Homo sapiens
accaagaaaucuaacucaa

SEQ ID NO: 1332685 - RNA, 19 nt, Homo sapiens
gcugccaccugaccugaca

SEQ ID NO: 1332686 - RNA, 19 nt, Homo sapiens
agucuuugcuauugugaau

SEQ ID NO: 1332687 - RNA, 19 nt, Homo sapiens
guuccaagucuuugcuauu

SEQ ID NO: 1332688 - RNA, 19 nt, Homo sapiens
ccacgugaucucauuguuc

SEQ ID NO: 1332689 - RNA, 19 nt, Homo sapiens
ggacacugacucuguacag

SEQ ID NO: 1332690 - RNA, 19 nt, Homo sapiens
ggaaguuaggaaagauaug

SEQ ID NO: 1332691 - RNA, 19 nt, Homo sapiens
caaccaagaaaucuaacuc

SEQ ID NO: 1332692 - RNA, 19 nt, Homo sapiens
ucaacagucuagaguacag

SEQ ID NO: 1332693 - RNA, 19 nt, Homo sapiens
uggcaucuagcauuaggua

SEQ ID NO: 1332694 - RNA, 19 nt, Homo sapiens
cccaggagcucagagaucu

SEQ ID NO: 1332695 - RNA, 19 nt, Homo sapiens
gguuccaagucuuugcuau

SEQ ID NO: 1332696 - RNA, 19 nt, Homo sapiens
gaagcucucgugugcuagu

SEQ ID NO: 1332697 - RNA, 19 nt, Homo sapiens
ucaauucccaccuaugagu

SEQ ID NO: 1332698 - RNA, 19 nt, Homo sapiens
acauugugcagguuaguaa

SEQ ID NO: 1332699 - RNA, 19 nt, Homo sapiens
ggaguacucaguguuccuu

SEQ ID NO: 1332700 - RNA, 19 nt, Homo sapiens
ggagaaagcggagauauug

SEQ ID NO: 1332701 - RNA, 19 nt, Homo sapiens
aagcggagauauuggaguu

SEQ ID NO: 1332702 - RNA, 19 nt, Homo sapiens
gcugcuacuuguccgguuu

SEQ ID NO: 1332703 - RNA, 19 nt, Homo sapiens
ggaucgagcugagaauagg

SEQ ID NO: 1332704 - RNA, 19 nt, Homo sapiens
uggagaaagcggagauauu

SEQ ID NO: 1332705 - RNA, 19 nt, Homo sapiens
agaaagcggagauauugga

SEQ ID NO: 1332706 - RNA, 19 nt, Homo sapiens
ggaacccgaagcuggagaa

SEQ ID NO: 1332707 - RNA, 19 nt, Homo sapiens
gggaucgagcugagaauag

SEQ ID NO: 1332708 - RNA, 19 nt, Homo sapiens
gcucgccagcugcuacuug

SEQ ID NO: 1332709 - RNA, 19 nt, Homo sapiens
gagaaagcggagauauugg

SEQ ID NO: 1332710 - RNA, 19 nt, Homo sapiens
acccgaagcuggagaaagc

SEQ ID NO: 1332711 - RNA, 19 nt, Homo sapiens
gaacccgaagcuggagaaa

SEQ ID NO: 1332712 - RNA, 19 nt, Homo sapiens
cgggaucgagcugagaaua

SEQ ID NO: 1332713 - RNA, 19 nt, Homo sapiens
caucaaccgcagccuggaa

SEQ ID NO: 1332714 - RNA, 19 nt, Homo sapiens
caacauagcucucaagaua

SEQ ID NO: 1332715 - RNA, 19 nt, Homo sapiens
gaacugaacuuccaaugaa

SEQ ID NO: 1332716 - RNA, 19 nt, Homo sapiens
gaagaucccuuucaauuau

SEQ ID NO: 1332717 - RNA, 19 nt, Homo sapiens
caacuuugcuucuuuauga

SEQ ID NO: 1332718 - RNA, 19 nt, Homo sapiens
gcagagaccuccuaguauu

SEQ ID NO: 1332719 - RNA, 19 nt, Homo sapiens
ggacaaaggacauuuauau

SEQ ID NO: 1332720 - RNA, 19 nt, Homo sapiens
ggaaaucaguguaaaucuu

SEQ ID NO: 1332721 - RNA, 19 nt, Homo sapiens
gagcccagcuagaauuaua

SEQ ID NO: 1332722 - RNA, 19 nt, Homo sapiens
guguaaaucuugcaacaua

SEQ ID NO: 1332723 - RNA, 19 nt, Homo sapiens
ggaaauaguugacaaacag

SEQ ID NO: 1332724 - RNA, 19 nt, Homo sapiens
gcacagcgguuuccuucuu

SEQ ID NO: 1332725 - RNA, 19 nt, Homo sapiens
guacuuaagucaucauuca

SEQ ID NO: 1332726 - RNA, 19 nt, Homo sapiens
gaagagacuuacuuuaaca

SEQ ID NO: 1332727 - RNA, 19 nt, Homo sapiens
gcaguaaguugaaauaugg

SEQ ID NO: 1332728 - RNA, 19 nt, Homo sapiens
guccacagauuaauuagua

SEQ ID NO: 1332729 - RNA, 19 nt, Homo sapiens
ggaacccuguguacaauuu

SEQ ID NO: 1332730 - RNA, 19 nt, Homo sapiens
cuaaggagcuguccaguuc

SEQ ID NO: 1332731 - RNA, 19 nt, Homo sapiens
gcagagcucagauauauga

SEQ ID NO: 1332732 - RNA, 19 nt, Homo sapiens
ggagauaucugaaguugac

SEQ ID NO: 1332733 - RNA, 19 nt, Homo sapiens
gcccuaagauugucaguga

SEQ ID NO: 1332734 - RNA, 19 nt, Homo sapiens
ggacagaugccaauagguu

SEQ ID NO: 1332735 - RNA, 19 nt, Homo sapiens
gaaaucaguguaaaucuug

SEQ ID NO: 1332736 - RNA, 19 nt, Homo sapiens
cagcagagaccuccuagua

SEQ ID NO: 1332737 - RNA, 19 nt, Homo sapiens
guaaccagcaugucaauaa

SEQ ID NO: 1332738 - RNA, 19 nt, Homo sapiens
ccacaaauuugaaagacaa

SEQ ID NO: 1332739 - RNA, 19 nt, Homo sapiens
gaaaagacauggaaauaca

SEQ ID NO: 1332740 - RNA, 19 nt, Homo sapiens
uaacuuacaugcccagugu

SEQ ID NO: 1332741 - RNA, 19 nt, Homo sapiens
guaacagaauggaauaaga

SEQ ID NO: 1332742 - RNA, 19 nt, Homo sapiens
ccagaaacaucuuuaccaa

SEQ ID NO: 1332743 - RNA, 19 nt, Homo sapiens
caaauguacuuaagucauc

SEQ ID NO: 1332744 - RNA, 19 nt, Homo sapiens
caagagagcaugcuagugu

SEQ ID NO: 1332745 - RNA, 19 nt, Homo sapiens
gcugguagguguguuguuu

SEQ ID NO: 1332746 - RNA, 19 nt, Homo sapiens
uggcagaaguugaaacaaa

SEQ ID NO: 1332747 - RNA, 19 nt, Homo sapiens
cccagugccuagaauauua

SEQ ID NO: 1332748 - RNA, 19 nt, Homo sapiens
gaaaagcaccugaugaaaa

SEQ ID NO: 1332749 - RNA, 19 nt, Homo sapiens
gcccugaugucuuaaauuc

SEQ ID NO: 1332750 - RNA, 19 nt, Homo sapiens
caaagggagucugcaugua

SEQ ID NO: 1332751 - RNA, 19 nt, Homo sapiens
gcagugaaacuugauauug

SEQ ID NO: 1332752 - RNA, 19 nt, Homo sapiens
ccaugaaccuuccagcauu

SEQ ID NO: 1332753 - RNA, 19 nt, Homo sapiens
guaaauccuuugaacaagu

SEQ ID NO: 1332754 - RNA, 19 nt, Homo sapiens
aagaagaacugauggagau

SEQ ID NO: 1332755 - RNA, 19 nt, Homo sapiens
gaaugguugucagaguuua

SEQ ID NO: 1332756 - RNA, 19 nt, Homo sapiens
ggauuuagcaugugaagau

SEQ ID NO: 1332757 - RNA, 19 nt, Homo sapiens
ccaacuuccucucgaauau

SEQ ID NO: 1332758 - RNA, 19 nt, Homo sapiens
gguuugaaguguugacauu

SEQ ID NO: 1332759 - RNA, 19 nt, Homo sapiens
cgacauggcagaaguugaa

SEQ ID NO: 1332760 - RNA, 19 nt, Homo sapiens
agaaagaacugaacuucca

SEQ ID NO: 1332761 - RNA, 19 nt, Homo sapiens
cagcgacuguauuuaguaa

SEQ ID NO: 1332762 - RNA, 19 nt, Homo sapiens
ucucgaauaucaagaaaug

SEQ ID NO: 1332763 - RNA, 19 nt, Homo sapiens
gaacaagucagugguguca

SEQ ID NO: 1332764 - RNA, 19 nt, Homo sapiens
ucaagaaucuguguuugug

SEQ ID NO: 1332765 - RNA, 19 nt, Homo sapiens
acagggacauaccaaagua

SEQ ID NO: 1332766 - RNA, 19 nt, Homo sapiens
cagugaaacuugauauugu

SEQ ID NO: 1332767 - RNA, 19 nt, Homo sapiens
guagugaaauauggacaaa

SEQ ID NO: 1332768 - RNA, 19 nt, Homo sapiens
gaaucuguguuuguggaua

SEQ ID NO: 1332769 - RNA, 19 nt, Homo sapiens
acaaugcugccuuaacuua

SEQ ID NO: 1332770 - RNA, 19 nt, Homo sapiens
caaaccaucuguauaccau

SEQ ID NO: 1332771 - RNA, 19 nt, Homo sapiens
gauuccaucuuuauccaaa

SEQ ID NO: 1332772 - RNA, 19 nt, Homo sapiens
gaaggcugccaaagcauuu

SEQ ID NO: 1332773 - RNA, 19 nt, Homo sapiens
augcagagcucagauauau

SEQ ID NO: 1332774 - RNA, 19 nt, Homo sapiens
gaucuauugccauaaauug

SEQ ID NO: 1332775 - RNA, 19 nt, Homo sapiens
gcuagaggcauuucuguug

SEQ ID NO: 1332776 - RNA, 19 nt, Homo sapiens
gcauguaugggaacuguuu

SEQ ID NO: 1332777 - RNA, 19 nt, Homo sapiens
aaacaguagucacaauugu

SEQ ID NO: 1332778 - RNA, 19 nt, Homo sapiens
agaauuaacaggucaagaa

SEQ ID NO: 1332779 - RNA, 19 nt, Homo sapiens
gaaucgguuugaaguguug

SEQ ID NO: 1332780 - RNA, 19 nt, Homo sapiens
uaaagguagugaaauaugg

SEQ ID NO: 1332781 - RNA, 19 nt, Homo sapiens
ucaaguugguuaugucuca

SEQ ID NO: 1332782 - RNA, 19 nt, Homo sapiens
cagguugucuaaucaaguu

SEQ ID NO: 1332783 - RNA, 19 nt, Homo sapiens
cagagaccuccuaguauua

SEQ ID NO: 1332784 - RNA, 19 nt, Homo sapiens
ugaagagacuuacuuuaac

SEQ ID NO: 1332785 - RNA, 19 nt, Homo sapiens
ggaaugguugucagaguuu

SEQ ID NO: 1332786 - RNA, 19 nt, Homo sapiens
gcacagaaucgguuugaag

SEQ ID NO: 1332787 - RNA, 19 nt, Homo sapiens
gucaccagcucuuugaauu

SEQ ID NO: 1332788 - RNA, 19 nt, Homo sapiens
uggaaauccuaguuaguuu

SEQ ID NO: 1332789 - RNA, 19 nt, Homo sapiens
aggcacaacuccaggaauu

SEQ ID NO: 1332790 - RNA, 19 nt, Homo sapiens
gaaauacaacuuugcuucu

SEQ ID NO: 1332791 - RNA, 19 nt, Homo sapiens
gaccgcagcgacuguauuu

SEQ ID NO: 1332792 - RNA, 19 nt, Homo sapiens
caaagugaguugcuagaac

SEQ ID NO: 1332793 - RNA, 19 nt, Homo sapiens
gaacccuguguacaauuua

SEQ ID NO: 1332794 - RNA, 19 nt, Homo sapiens
cauuagcccuguuuacaau

SEQ ID NO: 1332795 - RNA, 19 nt, Homo sapiens
uaugugaccucuagaugga

SEQ ID NO: 1332796 - RNA, 19 nt, Homo sapiens
ccacauaacccgucaucug

SEQ ID NO: 1332797 - RNA, 19 nt, Homo sapiens
cagaaucgguuugaagugu

SEQ ID NO: 1332798 - RNA, 19 nt, Homo sapiens
ggaaauccuaguuaguuug

SEQ ID NO: 1332799 - RNA, 19 nt, Homo sapiens
gaggaaugguugucagagu

SEQ ID NO: 1332800 - RNA, 19 nt, Homo sapiens
cagaauggaauaagaucua

SEQ ID NO: 1332801 - RNA, 19 nt, Homo sapiens
gcagcgacuguauuuagua

SEQ ID NO: 1332802 - RNA, 19 nt, Homo sapiens
auuaacaggucaagaagaa

SEQ ID NO: 1332803 - RNA, 19 nt, Homo sapiens
uuacaaugcugccuuaacu

SEQ ID NO: 1332804 - RNA, 19 nt, Homo sapiens
gagcucagauauaugaaaa

SEQ ID NO: 1332805 - RNA, 19 nt, Homo sapiens
aaacaggcauguggaaaca

SEQ ID NO: 1332806 - RNA, 19 nt, Homo sapiens
caaacaguagucacaauug

SEQ ID NO: 1332807 - RNA, 19 nt, Homo sapiens
gaagaacugauggagauau

SEQ ID NO: 1332808 - RNA, 19 nt, Homo sapiens
gaacucguuuucauucauu

SEQ ID NO: 1332809 - RNA, 19 nt, Homo sapiens
gccaaagcauuuauacucu

SEQ ID NO: 1332810 - RNA, 19 nt, Homo sapiens
gcaaauguacuuaagucau

SEQ ID NO: 1332811 - RNA, 19 nt, Homo sapiens
gaaccuggaaauacaacuu

SEQ ID NO: 1332812 - RNA, 19 nt, Homo sapiens
ucaaucaggucagcagaga

SEQ ID NO: 1332813 - RNA, 19 nt, Homo sapiens
aagcaaaacuggaggaaaa

SEQ ID NO: 1332814 - RNA, 19 nt, Homo sapiens
ggacacaacugguuuauca

SEQ ID NO: 1332815 - RNA, 19 nt, Homo sapiens
gaagaagaaggacaaauua

SEQ ID NO: 1332816 - RNA, 19 nt, Homo sapiens
ggagauauccuguggguua

SEQ ID NO: 1332817 - RNA, 19 nt, Homo sapiens
gcauauaaguguccgauuu

SEQ ID NO: 1332818 - RNA, 19 nt, Homo sapiens
gaacuuggaugccagcaaa

SEQ ID NO: 1332819 - RNA, 19 nt, Homo sapiens
guacaugguuccaacauaa

SEQ ID NO: 1332820 - RNA, 19 nt, Homo sapiens
cagcuaagaucucaaguaa

SEQ ID NO: 1332821 - RNA, 19 nt, Homo sapiens
ggacaaccaucuaagaaga

SEQ ID NO: 1332822 - RNA, 19 nt, Homo sapiens
ggacaaaucccauugguau

SEQ ID NO: 1332823 - RNA, 19 nt, Homo sapiens
gaacaacaccugguaauug

SEQ ID NO: 1332824 - RNA, 19 nt, Homo sapiens
gagaaacgcuauugguuau

SEQ ID NO: 1332825 - RNA, 19 nt, Homo sapiens
ggaagaagaaggacaaauu

SEQ ID NO: 1332826 - RNA, 19 nt, Homo sapiens
gaucaauuguuguggauuu

SEQ ID NO: 1332827 - RNA, 19 nt, Homo sapiens
uaucagaucuggaguguga

SEQ ID NO: 1332828 - RNA, 19 nt, Homo sapiens
gggcugcacuucaauaauu

SEQ ID NO: 1332829 - RNA, 19 nt, Homo sapiens
agacagagcuuucauugga

SEQ ID NO: 1332830 - RNA, 19 nt, Homo sapiens
gaagaaagaccuauaugau

SEQ ID NO: 1332831 - RNA, 19 nt, Homo sapiens
gaaguucgcaacaaagaua

SEQ ID NO: 1332832 - RNA, 19 nt, Homo sapiens
aguaaaggcuacaucauua

SEQ ID NO: 1332833 - RNA, 19 nt, Homo sapiens
gcagaagccgcacuuguua

SEQ ID NO: 1332834 - RNA, 19 nt, Homo sapiens
ggacuuaauucagaacaaa

SEQ ID NO: 1332835 - RNA, 19 nt, Homo sapiens
gcuaagaucucaaguaaaa

SEQ ID NO: 1332836 - RNA, 19 nt, Homo sapiens
gaaacgcuauugguuauug

SEQ ID NO: 1332837 - RNA, 19 nt, Homo sapiens
ccaaagggcugcacuucaa

SEQ ID NO: 1332838 - RNA, 19 nt, Homo sapiens
ccuguggacucucauauua

SEQ ID NO: 1332839 - RNA, 19 nt, Homo sapiens
ggaagaaagaccuauauga

SEQ ID NO: 1332840 - RNA, 19 nt, Homo sapiens
ggacaguuauaugcacuua

SEQ ID NO: 1332841 - RNA, 19 nt, Homo sapiens
caaccgcacugaugauauu

SEQ ID NO: 1332842 - RNA, 19 nt, Homo sapiens
gggaagaaauggaaagaau

SEQ ID NO: 1332843 - RNA, 19 nt, Homo sapiens
caagggaggugaagaaagu

SEQ ID NO: 1332844 - RNA, 19 nt, Homo sapiens
gaagacagagcuuucauug

SEQ ID NO: 1332845 - RNA, 19 nt, Homo sapiens
ggacuaagacugaauaugg

SEQ ID NO: 1332846 - RNA, 19 nt, Homo sapiens
ggaucucucugauauugua

SEQ ID NO: 1332847 - RNA, 19 nt, Homo sapiens
caagacaugugggcauaua

SEQ ID NO: 1332848 - RNA, 19 nt, Homo sapiens
ggagacaucuuuaugaacu

SEQ ID NO: 1332849 - RNA, 19 nt, Homo sapiens
gcacaugacaccacaaaga

SEQ ID NO: 1332850 - RNA, 19 nt, Homo sapiens
caaauggaaugguuaaugg

SEQ ID NO: 1332851 - RNA, 19 nt, Homo sapiens
guaaauggucgguggauaa

SEQ ID NO: 1332852 - RNA, 19 nt, Homo sapiens
gaaauguucacccuaacua

SEQ ID NO: 1332853 - RNA, 19 nt, Homo sapiens
ggaggaaucagacaucauu

SEQ ID NO: 1332854 - RNA, 19 nt, Homo sapiens
aggcaaagaugaagagaaa

SEQ ID NO: 1332855 - RNA, 19 nt, Homo sapiens
caguauggaugaagacuuu

SEQ ID NO: 1332856 - RNA, 19 nt, Homo sapiens
uaucaaacaucccaggaaa

SEQ ID NO: 1332857 - RNA, 19 nt, Homo sapiens
gaugggaacuccugugcuu

SEQ ID NO: 1332858 - RNA, 19 nt, Homo sapiens
gaacucaacaggacaaauc

SEQ ID NO: 1332859 - RNA, 19 nt, Homo sapiens
ugagaaacgcuauugguua

SEQ ID NO: 1332860 - RNA, 19 nt, Homo sapiens
caacaggacucccaagaac

SEQ ID NO: 1332861 - RNA, 19 nt, Homo sapiens
ucucaaaggcugcgcauua

SEQ ID NO: 1332862 - RNA, 19 nt, Homo sapiens
caacauaacacuucugaca

SEQ ID NO: 1332863 - RNA, 19 nt, Homo sapiens
gaagaagacagcacugaug

SEQ ID NO: 1332864 - RNA, 19 nt, Homo sapiens
ggaaaggguuguagaugag

SEQ ID NO: 1332865 - RNA, 19 nt, Homo sapiens
gaaaguggaugcgcagagu

SEQ ID NO: 1332866 - RNA, 19 nt, Homo sapiens
gaagguuuguuuaaugcuu

SEQ ID NO: 1332867 - RNA, 19 nt, Homo sapiens
ggacuggacgauuugauuu

SEQ ID NO: 1332868 - RNA, 19 nt, Homo sapiens
guacuacuguuccaagugu

SEQ ID NO: 1332869 - RNA, 19 nt, Homo sapiens
ggacacagcagucuaacau

SEQ ID NO: 1332870 - RNA, 19 nt, Homo sapiens
cuuaagcgauuucaauuug

SEQ ID NO: 1332871 - RNA, 19 nt, Homo sapiens
ucuaacaucugggugaaua

SEQ ID NO: 1332872 - RNA, 19 nt, Homo sapiens
ggucgaagauagaauugga

SEQ ID NO: 1332873 - RNA, 19 nt, Homo sapiens
ggcaauggcuacagcaaug

SEQ ID NO: 1332874 - RNA, 19 nt, Homo sapiens
gaacuucacaaauggaaug

SEQ ID NO: 1332875 - RNA, 19 nt, Homo sapiens
gugauuaaguuagauggua

SEQ ID NO: 1332876 - RNA, 19 nt, Homo sapiens
ucaagcauccaguguguua

SEQ ID NO: 1332877 - RNA, 19 nt, Homo sapiens
gacacaagguucccacaga

SEQ ID NO: 1332878 - RNA, 19 nt, Homo sapiens
ggaagagacuaugaaaugg

SEQ ID NO: 1332879 - RNA, 19 nt, Homo sapiens
gcuaaaugcuauggugauu

SEQ ID NO: 1332880 - RNA, 19 nt, Homo sapiens
cauaacacuucugacaaua

SEQ ID NO: 1332881 - RNA, 19 nt, Homo sapiens
agacagcacugaugaccaa

SEQ ID NO: 1332882 - RNA, 19 nt, Homo sapiens
gauaugcgccuguggcuau

SEQ ID NO: 1332883 - RNA, 19 nt, Homo sapiens
gaugguaaagucccagaua

SEQ ID NO: 1332884 - RNA, 19 nt, Homo sapiens
gcaauggucagcuuggaaa

SEQ ID NO: 1332885 - RNA, 19 nt, Homo sapiens
agacagauuucuccucuuc

SEQ ID NO: 1332886 - RNA, 19 nt, Homo sapiens
gcagcuaagaucucaagua

SEQ ID NO: 1332887 - RNA, 19 nt, Homo sapiens
gcaacaggacucccaagaa

SEQ ID NO: 1332888 - RNA, 19 nt, Homo sapiens
aacaacaccugguaauuga

SEQ ID NO: 1332889 - RNA, 19 nt, Homo sapiens
ucacgaauaucuaucucaa

SEQ ID NO: 1332890 - RNA, 19 nt, Homo sapiens
caacauuucuacugcaucu

SEQ ID NO: 1332891 - RNA, 19 nt, Homo sapiens
guagaaggcauacugaaug

SEQ ID NO: 1332892 - RNA, 19 nt, Homo sapiens
gcacugaugaccaaagaga

SEQ ID NO: 1332893 - RNA, 19 nt, Homo sapiens
caacaaagaagcuggaucu

SEQ ID NO: 1332894 - RNA, 19 nt, Homo sapiens
acaguuauaugcacuuaga

SEQ ID NO: 1332895 - RNA, 19 nt, Homo sapiens
gaagauagaauuggaagca

SEQ ID NO: 1332896 - RNA, 19 nt, Homo sapiens
gaacugcagcccauccuau

SEQ ID NO: 1332897 - RNA, 19 nt, Homo sapiens
aggaaaggguuguagauga

SEQ ID NO: 1332898 - RNA, 19 nt, Homo sapiens
guaaaggcuacaucauuaa

SEQ ID NO: 1332899 - RNA, 19 nt, Homo sapiens
gcaggucgaagauagaauu

SEQ ID NO: 1332900 - RNA, 19 nt, Homo sapiens
gcaggacacaacugguuua

SEQ ID NO: 1332901 - RNA, 19 nt, Homo sapiens
ggaagacagagcuuucauu

SEQ ID NO: 1332902 - RNA, 19 nt, Homo sapiens
gacuaagacugaauaugga

SEQ ID NO: 1332903 - RNA, 19 nt, Homo sapiens
acacaagguucccacagaa

SEQ ID NO: 1332904 - RNA, 19 nt, Homo sapiens
gaaugcagaccaucaagga

SEQ ID NO: 1332905 - RNA, 19 nt, Homo sapiens
gugaaaagguaaacuauga

SEQ ID NO: 1332906 - RNA, 19 nt, Homo sapiens
gaaucugggaacuauguua

SEQ ID NO: 1332907 - RNA, 19 nt, Homo sapiens
ggccuuaccuagaccaguu

SEQ ID NO: 1332908 - RNA, 19 nt, Homo sapiens
gagcaaaccuggccuuacc

SEQ ID NO: 1332909 - RNA, 19 nt, Homo sapiens
uggaagagacuaugaaaug

SEQ ID NO: 1332910 - RNA, 19 nt, Homo sapiens
ggacaaauuauuagaggau

SEQ ID NO: 1332911 - RNA, 19 nt, Homo sapiens
ggaagaaauggaaagaaug

SEQ ID NO: 1332912 - RNA, 19 nt, Homo sapiens
caagcaguauggaugaaga

SEQ ID NO: 1332913 - RNA, 19 nt, Homo sapiens
caauauccauucacucuac

SEQ ID NO: 1332914 - RNA, 19 nt, Homo sapiens
gaagaacccuugaagaaga

SEQ ID NO: 1332915 - RNA, 19 nt, Homo sapiens
gcaagaaacaagcuuauua

SEQ ID NO: 1332916 - RNA, 19 nt, Homo sapiens
agagaaaccuuacaaauga

SEQ ID NO: 1332917 - RNA, 19 nt, Homo sapiens
gagagaaaccuuacaagua

SEQ ID NO: 1332918 - RNA, 19 nt, Homo sapiens
ggaaauggcuacuuaccuu

SEQ ID NO: 1332919 - RNA, 19 nt, Homo sapiens
gagagaaaccuuauaaaug

SEQ ID NO: 1332920 - RNA, 19 nt, Homo sapiens
gagagaaaccuuauaaaug

SEQ ID NO: 1332921 - RNA, 19 nt, Homo sapiens
caacaaaugccuuauaaug

SEQ ID NO: 1332922 - RNA, 19 nt, Homo sapiens
agagaaaccuuacaaguau

SEQ ID NO: 1332923 - RNA, 19 nt, Homo sapiens
gguaaggucuuuagucgaa

SEQ ID NO: 1332924 - RNA, 19 nt, Homo sapiens
agagaaaccuuacaaaugu

SEQ ID NO: 1332925 - RNA, 19 nt, Homo sapiens
gagagaaaccuuacaaaug

SEQ ID NO: 1332926 - RNA, 19 nt, Homo sapiens
ggaaaguucuaaagucaga

SEQ ID NO: 1332927 - RNA, 19 nt, Homo sapiens
aaaugaaggugguaacuuu

SEQ ID NO: 1332928 - RNA, 19 nt, Homo sapiens
acaaaucacuggagaauuc

SEQ ID NO: 1332929 - RNA, 19 nt, Homo sapiens
gagaagucuuucaacaaua

SEQ ID NO: 1332930 - RNA, 19 nt, Homo sapiens
gaagagaugaacaugauaa

SEQ ID NO: 1332931 - RNA, 19 nt, Homo sapiens
gagcaaaacuccaucuuaa

SEQ ID NO: 1332932 - RNA, 19 nt, Homo sapiens
ggcaaggucuuuaggcaua

SEQ ID NO: 1332933 - RNA, 19 nt, Homo sapiens
ggagagaaaccuuauaaau

SEQ ID NO: 1332934 - RNA, 19 nt, Homo sapiens
ggagagaaaccuuauaaau

SEQ ID NO: 1332935 - RNA, 19 nt, Homo sapiens
ggauguggcuauagaauuc

SEQ ID NO: 1332936 - RNA, 19 nt, Homo sapiens
agagaaaccuuauaagugu

SEQ ID NO: 1332937 - RNA, 19 nt, Homo sapiens
gcgaagaacccuugaagaa

SEQ ID NO: 1332938 - RNA, 19 nt, Homo sapiens
gggaaacccuuuaguaucu

SEQ ID NO: 1332939 - RNA, 19 nt, Homo sapiens
gagaaaccuuacaaguaua

SEQ ID NO: 1332940 - RNA, 19 nt, Homo sapiens
ggcaaggucuucacucaaa

SEQ ID NO: 1332941 - RNA, 19 nt, Homo sapiens
gagagaaaccuuauaagug

SEQ ID NO: 1332942 - RNA, 19 nt, Homo sapiens
ggcaaggucuucacucaaa

SEQ ID NO: 1332943 - RNA, 19 nt, Homo sapiens
caacaauaauuccucaguu

SEQ ID NO: 1332944 - RNA, 19 nt, Homo sapiens
ugaaggaaauuacaaagga

SEQ ID NO: 1332945 - RNA, 19 nt, Homo sapiens
ggagagccaaguacaaaua

SEQ ID NO: 1332946 - RNA, 19 nt, Homo sapiens
ucagagaagucauacuaaa

SEQ ID NO: 1332947 - RNA, 19 nt, Homo sapiens
ccugagagauuccuugaaa

SEQ ID NO: 1332948 - RNA, 19 nt, Homo sapiens
agagaaaccuuacaagugu

SEQ ID NO: 1332949 - RNA, 19 nt, Homo sapiens
agagaaaccuuacaagugu

SEQ ID NO: 1332950 - RNA, 19 nt, Homo sapiens
agagaaaccuuacaagugu

SEQ ID NO: 1332951 - RNA, 19 nt, Homo sapiens
cucaugaguucaaguauua

SEQ ID NO: 1332952 - RNA, 19 nt, Homo sapiens
gagagaaaccuuacaagug

SEQ ID NO: 1332953 - RNA, 19 nt, Homo sapiens
gagagaaaccuuacaagug

SEQ ID NO: 1332954 - RNA, 19 nt, Homo sapiens
gagagaaaccuuacaagug

SEQ ID NO: 1332955 - RNA, 19 nt, Homo sapiens
gggaagcccuuacaaaucu

SEQ ID NO: 1332956 - RNA, 19 nt, Homo sapiens
ugagaagucuuucaacaau

SEQ ID NO: 1332957 - RNA, 19 nt, Homo sapiens
guaaucagguugagaaguc

SEQ ID NO: 1332958 - RNA, 19 nt, Homo sapiens
ggagagaaaccuuacaaau

SEQ ID NO: 1332959 - RNA, 19 nt, Homo sapiens
ggagagaaaccuuauaagu

SEQ ID NO: 1332960 - RNA, 19 nt, Homo sapiens
ucacaacucucacaacauc

SEQ ID NO: 1332961 - RNA, 19 nt, Homo sapiens
gaagaguaauacaggagaa

SEQ ID NO: 1332962 - RNA, 19 nt, Homo sapiens
gagaaaccuuauaagugua

SEQ ID NO: 1332963 - RNA, 19 nt, Homo sapiens
gcagagaugcugaaggaaa

SEQ ID NO: 1332964 - RNA, 19 nt, Homo sapiens
gagaaaagccuuacaaaug

SEQ ID NO: 1332965 - RNA, 19 nt, Homo sapiens
gagaaaagccuuacaaaug

SEQ ID NO: 1332966 - RNA, 19 nt, Homo sapiens
gaagucauacuaaagagaa

SEQ ID NO: 1332967 - RNA, 19 nt, Homo sapiens
ugggaaaccuuacaaaugu

SEQ ID NO: 1332968 - RNA, 19 nt, Homo sapiens
uguaagacaucgaggaauu

SEQ ID NO: 1332969 - RNA, 19 nt, Homo sapiens
caucagagaagucauacua

SEQ ID NO: 1332970 - RNA, 19 nt, Homo sapiens
ggcauggucuuuccucaaa

SEQ ID NO: 1332971 - RNA, 19 nt, Homo sapiens
ggcaaggucuucacucaga

SEQ ID NO: 1332972 - RNA, 19 nt, Homo sapiens
ggcaaggucuucacucaga

SEQ ID NO: 1332973 - RNA, 19 nt, Homo sapiens
gcaaagccuucagugugua

SEQ ID NO: 1332974 - RNA, 19 nt, Homo sapiens
ggagugaagccuuauaugu

SEQ ID NO: 1332975 - RNA, 19 nt, Homo sapiens
ggcaaggucuucacucaga

SEQ ID NO: 1332976 - RNA, 19 nt, Homo sapiens
gagaaaccuuacaaaugaa

SEQ ID NO: 1332977 - RNA, 19 nt, Homo sapiens
caagaguccauaauaauga

SEQ ID NO: 1332978 - RNA, 19 nt, Homo sapiens
gagaaaccuuacaaauguu

SEQ ID NO: 1332979 - RNA, 19 nt, Homo sapiens
cauccaagaguccauaaua

SEQ ID NO: 1332980 - RNA, 19 nt, Homo sapiens
gagccaagaucgugccaau

SEQ ID NO: 1332981 - RNA, 19 nt, Homo sapiens
guggaaaguucuaaaguca

SEQ ID NO: 1332982 - RNA, 19 nt, Homo sapiens
acaaaugccuuauaauguc

SEQ ID NO: 1332983 - RNA, 19 nt, Homo sapiens
gauuaagccuucagucaca

SEQ ID NO: 1332984 - RNA, 19 nt, Homo sapiens
ggagaaguauuccaaacag

SEQ ID NO: 1332985 - RNA, 19 nt, Homo sapiens
gaacauucaaaccuaacua

SEQ ID NO: 1332986 - RNA, 19 nt, Homo sapiens
ggcaaagccuucagugugu

SEQ ID NO: 1332987 - RNA, 19 nt, Homo sapiens
gcaaaucaucaaagaauuc

SEQ ID NO: 1332988 - RNA, 19 nt, Homo sapiens
agacaucgaggaauucaua

SEQ ID NO: 1332989 - RNA, 19 nt, Homo sapiens
ggagagaaaccauaugagu

SEQ ID NO: 1332990 - RNA, 19 nt, Homo sapiens
ggagagaaaccuuacaagu

SEQ ID NO: 1332991 - RNA, 19 nt, Homo sapiens
gagaaaccauaugagugua

SEQ ID NO: 1332992 - RNA, 19 nt, Homo sapiens
ggagagaaaccauaugagu

SEQ ID NO: 1332993 - RNA, 19 nt, Homo sapiens
ggagagaaaccuuacaagu

SEQ ID NO: 1332994 - RNA, 19 nt, Homo sapiens
uuacaaaugucaugaaugc

SEQ ID NO: 1332995 - RNA, 19 nt, Homo sapiens
ggagagaaaccuuacaagu

SEQ ID NO: 1332996 - RNA, 19 nt, Homo sapiens
ggagagaaaccuuacaagu

SEQ ID NO: 1332997 - RNA, 19 nt, Homo sapiens
gaauucacaccuuguaaga

SEQ ID NO: 1332998 - RNA, 19 nt, Homo sapiens
gaaguauuccaaacaguga

SEQ ID NO: 1332999 - RNA, 19 nt, Homo sapiens
gaaccacacaaauguaaug

SEQ ID NO: 1333000 - RNA, 19 nt, Homo sapiens
cucaacaaaugccuuauaa

SEQ ID NO: 1333001 - RNA, 19 nt, Homo sapiens
gaguaucaaugcagagaug

SEQ ID NO: 1333002 - RNA, 19 nt, Homo sapiens
ggaaagccaagacauugaa

SEQ ID NO: 1333003 - RNA, 19 nt, Homo sapiens
gaaaccauaugaguguaau

SEQ ID NO: 1333004 - RNA, 19 nt, Homo sapiens
gcaaggucuuuaggcauaa

SEQ ID NO: 1333005 - RNA, 19 nt, Homo sapiens
auacuggagugaagccuua

SEQ ID NO: 1333006 - RNA, 19 nt, Homo sapiens
caaaugccuuauaauguca

SEQ ID NO: 1333007 - RNA, 19 nt, Homo sapiens
uggaagagaugaacaugau

SEQ ID NO: 1333008 - RNA, 19 nt, Homo sapiens
cagagaugcugaaggaaau

SEQ ID NO: 1333009 - RNA, 19 nt, Homo sapiens
gauggaaccacacaaaugu

SEQ ID NO: 1333010 - RNA, 19 nt, Homo sapiens
guucaagccuagcuauuca

SEQ ID NO: 1333011 - RNA, 19 nt, Homo sapiens
cacauggccuugaguauca

SEQ ID NO: 1333012 - RNA, 19 nt, Homo sapiens
ccucaugaguucaaguauu

SEQ ID NO: 1333013 - RNA, 19 nt, Homo sapiens
gaagaggaaagaaagacaa

SEQ ID NO: 1333014 - RNA, 19 nt, Homo sapiens
gaacugcucuucugacuuu

SEQ ID NO: 1333015 - RNA, 19 nt, Homo sapiens
gauguacacuggagaauaa

SEQ ID NO: 1333016 - RNA, 19 nt, Homo sapiens
gcuaggaacugaauaugaa

SEQ ID NO: 1333017 - RNA, 19 nt, Homo sapiens
ggagaugucuagacuguga

SEQ ID NO: 1333018 - RNA, 19 nt, Homo sapiens
ggacuggacugcuaguguu

SEQ ID NO: 1333019 - RNA, 19 nt, Homo sapiens
caaaguaucugucccaaaa

SEQ ID NO: 1333020 - RNA, 19 nt, Homo sapiens
gaggagaugucuagacugu

SEQ ID NO: 1333021 - RNA, 19 nt, Homo sapiens
ggaacugaauaugaaguaa

SEQ ID NO: 1333022 - RNA, 19 nt, Homo sapiens
gaaauuccaagacaaugaa

SEQ ID NO: 1333023 - RNA, 19 nt, Homo sapiens
gcuuguauccucaccuuua

SEQ ID NO: 1333024 - RNA, 19 nt, Homo sapiens
ccacagaggucuccuucuc

SEQ ID NO: 1333025 - RNA, 19 nt, Homo sapiens
ugaaagaggcugugugcaa

SEQ ID NO: 1333026 - RNA, 19 nt, Homo sapiens
ggauguacacuggagaaua

SEQ ID NO: 1333027 - RNA, 19 nt, Homo sapiens
ugaagguccugcucagcua

SEQ ID NO: 1333028 - RNA, 19 nt, Homo sapiens
gaggcugugugcaagaauu

SEQ ID NO: 1333029 - RNA, 19 nt, Homo sapiens
ccugaggacuggacugcua

SEQ ID NO: 1333030 - RNA, 19 nt, Homo sapiens
ucaccuuuaucugauguua

SEQ ID NO: 1333031 - RNA, 19 nt, Homo sapiens
aaagaagacaggcaagauu

SEQ ID NO: 1333032 - RNA, 19 nt, Homo sapiens
aauguugucuggugaaugu

SEQ ID NO: 1333033 - RNA, 19 nt, Homo sapiens
ggagaauaaagcagugaaa

SEQ ID NO: 1333034 - RNA, 19 nt, Homo sapiens
ggaauguugucuggugaau

SEQ ID NO: 1333035 - RNA, 19 nt, Homo sapiens
gagaauaaagcagugaaau

SEQ ID NO: 1333036 - RNA, 19 nt, Homo sapiens
ugaaauuccaagacaauga

SEQ ID NO: 1333037 - RNA, 19 nt, Homo sapiens
uguuauggcugcucaaagu

SEQ ID NO: 1333038 - RNA, 19 nt, Homo sapiens
caaagaagacaggcaagau

SEQ ID NO: 1333039 - RNA, 19 nt, Homo sapiens
cagcuuguauccucaccuu

SEQ ID NO: 1333040 - RNA, 19 nt, Homo sapiens
uauccucaccuuuaucuga

SEQ ID NO: 1333041 - RNA, 19 nt, Homo sapiens
gagacuauccuguguaucc

SEQ ID NO: 1333042 - RNA, 19 nt, Homo sapiens
ucaugagacuauccugugu

SEQ ID NO: 1333043 - RNA, 19 nt, Homo sapiens
gauguuauggcugcucaaa

SEQ ID NO: 1333044 - RNA, 19 nt, Homo sapiens
cagccaagccucagggaau

SEQ ID NO: 1333045 - RNA, 19 nt, Homo sapiens
gaaggagugacgugaaggu

SEQ ID NO: 1333046 - RNA, 19 nt, Homo sapiens
gcugaugcaccuccacaga

SEQ ID NO: 1333047 - RNA, 19 nt, Homo sapiens
aagaagacaggcaagauuc

SEQ ID NO: 1333048 - RNA, 19 nt, Homo sapiens
cugcucuucugacuuuauu

SEQ ID NO: 1333049 - RNA, 19 nt, Homo sapiens
caugagacuauccugugua

SEQ ID NO: 1333050 - RNA, 19 nt, Homo sapiens
guuauggcugcucaaagua

SEQ ID NO: 1333051 - RNA, 19 nt, Homo sapiens
accuuuaucugauguuaug

SEQ ID NO: 1333052 - RNA, 19 nt, Homo sapiens
cuuguauccucaccuuuau

SEQ ID NO: 1333053 - RNA, 19 nt, Homo sapiens
aagaggcugugugcaagaa

SEQ ID NO: 1333054 - RNA, 19 nt, Homo sapiens
aggaggagaugucuagacu

SEQ ID NO: 1333055 - RNA, 19 nt, Homo sapiens
ucaaaguaucugucccaaa

SEQ ID NO: 1333056 - RNA, 19 nt, Homo sapiens
agccaagccucagggaauu

SEQ ID NO: 1333057 - RNA, 19 nt, Homo sapiens
acaaagaagacaggcaaga

SEQ ID NO: 1333058 - RNA, 19 nt, Homo sapiens
augagacuauccuguguau

SEQ ID NO: 1333059 - RNA, 19 nt, Homo sapiens
gacuggacugcuaguguuu

SEQ ID NO: 1333060 - RNA, 19 nt, Homo sapiens
caaccaaacucaggagcua

SEQ ID NO: 1333061 - RNA, 19 nt, Homo sapiens
uaacuggagucugcuuaaa

SEQ ID NO: 1333062 - RNA, 19 nt, Homo sapiens
gaagaaccaaccaaacuca

SEQ ID NO: 1333063 - RNA, 19 nt, Homo sapiens
uaaggugggucuuccugaa

SEQ ID NO: 1333064 - RNA, 19 nt, Homo sapiens
uuaaaggacuguggauaau

SEQ ID NO: 1333065 - RNA, 19 nt, Homo sapiens
aaaaggauaugcagaaaga

SEQ ID NO: 1333066 - RNA, 19 nt, Homo sapiens
ggacagugccaugauucua

SEQ ID NO: 1333067 - RNA, 19 nt, Homo sapiens
cuuaaaggacuguggauaa

SEQ ID NO: 1333068 - RNA, 19 nt, Homo sapiens
cuaccaggcugcuuguuuc

SEQ ID NO: 1333069 - RNA, 19 nt, Homo sapiens
ggacuguggauaaugcaaa

SEQ ID NO: 1333070 - RNA, 19 nt, Homo sapiens
gcaugugugugugccauug

SEQ ID NO: 1333071 - RNA, 19 nt, Homo sapiens
gcuaccaggcugcuuguuu

SEQ ID NO: 1333072 - RNA, 19 nt, Homo sapiens
acaggacagugccaugauu

SEQ ID NO: 1333073 - RNA, 19 nt, Homo sapiens
ccaggcugcuuguuucugu

SEQ ID NO: 1333074 - RNA, 19 nt, Homo sapiens
ggaaugaaccgugaaaucc

SEQ ID NO: 1333075 - RNA, 19 nt, Homo sapiens
gagggugugagcagcaaua

SEQ ID NO: 1333076 - RNA, 19 nt, Homo sapiens
ucucaguguuucacgcuaa

SEQ ID NO: 1333077 - RNA, 19 nt, Homo sapiens
aaaggacuguggauaaugc

SEQ ID NO: 1333078 - RNA, 19 nt, Homo sapiens
gcuuaaaggacuguggaua

SEQ ID NO: 1333079 - RNA, 19 nt, Homo sapiens
gaaaauguugugaguguug

SEQ ID NO: 1333080 - RNA, 19 nt, Homo sapiens
ggugugagcagcaauaagg

SEQ ID NO: 1333081 - RNA, 19 nt, Homo sapiens
gcaggaccccuugaauuua

SEQ ID NO: 1333082 - RNA, 19 nt, Homo sapiens
gugaaaauguugugagugu

SEQ ID NO: 1333083 - RNA, 19 nt, Homo sapiens
agaagagcagcacgucaua

SEQ ID NO: 1333084 - RNA, 19 nt, Homo sapiens
ccaaaaggauaugcagaaa

SEQ ID NO: 1333085 - RNA, 19 nt, Homo sapiens
gacagugccaugauucuag

SEQ ID NO: 1333086 - RNA, 19 nt, Homo sapiens
gacacuagcagucuucucu

SEQ ID NO: 1333087 - RNA, 19 nt, Homo sapiens
uguguguguuugccuuuaa

SEQ ID NO: 1333088 - RNA, 19 nt, Homo sapiens
guguguguguuugccuuua

SEQ ID NO: 1333089 - RNA, 19 nt, Homo sapiens
uaaaggacuguggauaaug

SEQ ID NO: 1333090 - RNA, 19 nt, Homo sapiens
gugaguguguguguguuug

SEQ ID NO: 1333091 - RNA, 19 nt, Homo sapiens
gaccaacaucucucagugu

SEQ ID NO: 1333092 - RNA, 19 nt, Homo sapiens
ccaggaaugaaccgugaaa

SEQ ID NO: 1333093 - RNA, 19 nt, Homo sapiens
gcaggugcuuaaagucaac

SEQ ID NO: 1333094 - RNA, 19 nt, Homo sapiens
ccaaggagagacacuagca

SEQ ID NO: 1333095 - RNA, 19 nt, Homo sapiens
ccaagaccaacaucucuca

SEQ ID NO: 1333096 - RNA, 19 nt, Homo sapiens
gagccagcccgaaggaaca

SEQ ID NO: 1333097 - RNA, 19 nt, Homo sapiens
cagcacgucauacccaaga

SEQ ID NO: 1333098 - RNA, 19 nt, Homo sapiens
acacaggacagugccauga

SEQ ID NO: 1333099 - RNA, 19 nt, Homo sapiens
gaagagcagcacgucauac

SEQ ID NO: 1333100 - RNA, 19 nt, Homo sapiens
acagugccaugauucuagu

SEQ ID NO: 1333101 - RNA, 19 nt, Homo sapiens
ugaagaaccaaccaaacuc

SEQ ID NO: 1333102 - RNA, 19 nt, Homo sapiens
gaugucugcaugugugugu

SEQ ID NO: 1333103 - RNA, 19 nt, Homo sapiens
caacaggggacacuccauu

SEQ ID NO: 1333104 - RNA, 19 nt, Homo sapiens
cccuugaauuuacauugaa

SEQ ID NO: 1333105 - RNA, 19 nt, Homo sapiens
gaaaguaucuuaguuguug

SEQ ID NO: 1333106 - RNA, 19 nt, Homo sapiens
ggagcuagaugauucuuua

SEQ ID NO: 1333107 - RNA, 19 nt, Homo sapiens
caaagugacuguacaauag

SEQ ID NO: 1333108 - RNA, 19 nt, Homo sapiens
guuuaaagauguccuguua

SEQ ID NO: 1333109 - RNA, 19 nt, Homo sapiens
gcaaagugacuguacaaua

SEQ ID NO: 1333110 - RNA, 19 nt, Homo sapiens
uuacagaucuccugaagaa

SEQ ID NO: 1333111 - RNA, 19 nt, Homo sapiens
ucagguagaugaagacuuu

SEQ ID NO: 1333112 - RNA, 19 nt, Homo sapiens
gaaugggacuugcuaaugu

SEQ ID NO: 1333113 - RNA, 19 nt, Homo sapiens
gaacaucccauauuggaaa

SEQ ID NO: 1333114 - RNA, 19 nt, Homo sapiens
gauaagaacaucccauauu

SEQ ID NO: 1333115 - RNA, 19 nt, Homo sapiens
ggaagaaugagaaggaaua

SEQ ID NO: 1333116 - RNA, 19 nt, Homo sapiens
ggacgaaaguugccucugu

SEQ ID NO: 1333117 - RNA, 19 nt, Homo sapiens
guggaaaucuagaaaguuu

SEQ ID NO: 1333118 - RNA, 19 nt, Homo sapiens
cagaagaguugccaugaaa

SEQ ID NO: 1333119 - RNA, 19 nt, Homo sapiens
ggaaaacucucucauuuga

SEQ ID NO: 1333120 - RNA, 19 nt, Homo sapiens
aaauccagcucuccaaaua

SEQ ID NO: 1333121 - RNA, 19 nt, Homo sapiens
gcagaagaguugccaugaa

SEQ ID NO: 1333122 - RNA, 19 nt, Homo sapiens
gcaaaucuacucagccuaa

SEQ ID NO: 1333123 - RNA, 19 nt, Homo sapiens
caagagcucucaguucaaa

SEQ ID NO: 1333124 - RNA, 19 nt, Homo sapiens
gagaaaguaucuuaguugu

SEQ ID NO: 1333125 - RNA, 19 nt, Homo sapiens
caaccuaaauccucucaga

SEQ ID NO: 1333126 - RNA, 19 nt, Homo sapiens
gcaguagccuccaagauag

SEQ ID NO: 1333127 - RNA, 19 nt, Homo sapiens
ggcaguagccuccaagaua

SEQ ID NO: 1333128 - RNA, 19 nt, Homo sapiens
gaaauucgagacauacaaa

SEQ ID NO: 1333129 - RNA, 19 nt, Homo sapiens
aagaggagguuuaugauga

SEQ ID NO: 1333130 - RNA, 19 nt, Homo sapiens
gaucauagaaagagaaaga

SEQ ID NO: 1333131 - RNA, 19 nt, Homo sapiens
ggaugucacucgaauggaa

SEQ ID NO: 1333132 - RNA, 19 nt, Homo sapiens
auaagaacaucccauauug

SEQ ID NO: 1333133 - RNA, 19 nt, Homo sapiens
gaugggaacucuugaaagg

SEQ ID NO: 1333134 - RNA, 19 nt, Homo sapiens
gcaaagacacagucagcua

SEQ ID NO: 1333135 - RNA, 19 nt, Homo sapiens
uuaaagauguccuguuaug

SEQ ID NO: 1333136 - RNA, 19 nt, Homo sapiens
cgaauuggauaucuuuguu

SEQ ID NO: 1333137 - RNA, 19 nt, Homo sapiens
gauaugaggagcuagauga

SEQ ID NO: 1333138 - RNA, 19 nt, Homo sapiens
guuaaagcuuagccaaaua

SEQ ID NO: 1333139 - RNA, 19 nt, Homo sapiens
ggauaucuuuguuuguuug

SEQ ID NO: 1333140 - RNA, 19 nt, Homo sapiens
gccagaaucuucagaaucu

SEQ ID NO: 1333141 - RNA, 19 nt, Homo sapiens
agacuagaaucaagcagua

SEQ ID NO: 1333142 - RNA, 19 nt, Homo sapiens
gaagauagcaaggaggauu

SEQ ID NO: 1333143 - RNA, 19 nt, Homo sapiens
aaacaauucuccuuagauc

SEQ ID NO: 1333144 - RNA, 19 nt, Homo sapiens
gaaaguuggaugugaaguu

SEQ ID NO: 1333145 - RNA, 19 nt, Homo sapiens
gaacauggagggccuucaa

SEQ ID NO: 1333146 - RNA, 19 nt, Homo sapiens
ugagaaaguuggaugugaa

SEQ ID NO: 1333147 - RNA, 19 nt, Homo sapiens
agauauacaugaccgaauu

SEQ ID NO: 1333148 - RNA, 19 nt, Homo sapiens
caaagacacagucagcuaa

SEQ ID NO: 1333149 - RNA, 19 nt, Homo sapiens
gaaggaaugggacuugcua

SEQ ID NO: 1333150 - RNA, 19 nt, Homo sapiens
gaggcgaccugucagcauu

SEQ ID NO: 1333151 - RNA, 19 nt, Homo sapiens
ccucagagaucauagaaag

SEQ ID NO: 1333152 - RNA, 19 nt, Homo sapiens
gaaucaagcaguagauaau

SEQ ID NO: 1333153 - RNA, 19 nt, Homo sapiens
gcaccaggguaacagaguu

SEQ ID NO: 1333154 - RNA, 19 nt, Homo sapiens
caaaugaugggaacucuug

SEQ ID NO: 1333155 - RNA, 19 nt, Homo sapiens
uugaaagccuccuggguua

SEQ ID NO: 1333156 - RNA, 19 nt, Homo sapiens
gagguaacuuuaaccaugu

SEQ ID NO: 1333157 - RNA, 19 nt, Homo sapiens
cgagacauacaaaccauua

SEQ ID NO: 1333158 - RNA, 19 nt, Homo sapiens
ggagaaaaguauagaagaa

SEQ ID NO: 1333159 - RNA, 19 nt, Homo sapiens
agaaugagaaggaauauga

SEQ ID NO: 1333160 - RNA, 19 nt, Homo sapiens
gaaggaacacuuggauuug

SEQ ID NO: 1333161 - RNA, 19 nt, Homo sapiens
gaaaguugccucugugucu

SEQ ID NO: 1333162 - RNA, 19 nt, Homo sapiens
ccagagaucuauaaagcau

SEQ ID NO: 1333163 - RNA, 19 nt, Homo sapiens
gaauuggagguaacuuuaa

SEQ ID NO: 1333164 - RNA, 19 nt, Homo sapiens
gauguccuguuauguuuga

SEQ ID NO: 1333165 - RNA, 19 nt, Homo sapiens
ugaaaggucuagggcagua

SEQ ID NO: 1333166 - RNA, 19 nt, Homo sapiens
cuaagugguuccauccuuu

SEQ ID NO: 1333167 - RNA, 19 nt, Homo sapiens
gaagaggagguuuaugaug

SEQ ID NO: 1333168 - RNA, 19 nt, Homo sapiens
gaauaucuaggaucuguug

SEQ ID NO: 1333169 - RNA, 19 nt, Homo sapiens
gcuagaugauucuuuauac

SEQ ID NO: 1333170 - RNA, 19 nt, Homo sapiens
agaaggaacacuuggauuu

SEQ ID NO: 1333171 - RNA, 19 nt, Homo sapiens
guaaaagacuacugucauu

SEQ ID NO: 1333172 - RNA, 19 nt, Homo sapiens
caaccuaagucauccucaa

SEQ ID NO: 1333173 - RNA, 19 nt, Homo sapiens
aagauguccuguuauguuu

SEQ ID NO: 1333174 - RNA, 19 nt, Homo sapiens
aggcaucauugacauguua

SEQ ID NO: 1333175 - RNA, 19 nt, Homo sapiens
cgaauuggauaucuuuaag

SEQ ID NO: 1333176 - RNA, 19 nt, Homo sapiens
ggaaugggacuugcuaaug

SEQ ID NO: 1333177 - RNA, 19 nt, Homo sapiens
ccugagagaccacaaauga

SEQ ID NO: 1333178 - RNA, 19 nt, Homo sapiens
ugcaagagcucucaguuca

SEQ ID NO: 1333179 - RNA, 19 nt, Homo sapiens
ggucagagcagaggccuaa

SEQ ID NO: 1333180 - RNA, 19 nt, Homo sapiens
agaauuggagguaacuuua

SEQ ID NO: 1333181 - RNA, 19 nt, Homo sapiens
caaccagaauuggagguaa

SEQ ID NO: 1333182 - RNA, 19 nt, Homo sapiens
aaagauguccuguuauguu

SEQ ID NO: 1333183 - RNA, 19 nt, Homo sapiens
cauauucaguugagaaagu

SEQ ID NO: 1333184 - RNA, 19 nt, Homo sapiens
gagugaagaggcucaaauu

SEQ ID NO: 1333185 - RNA, 19 nt, Homo sapiens
gaagcagucaacacaguuu

SEQ ID NO: 1333186 - RNA, 19 nt, Homo sapiens
uggcuggaguggagaauuu

SEQ ID NO: 1333187 - RNA, 19 nt, Homo sapiens
gaguugccaugaaaguaaa

SEQ ID NO: 1333188 - RNA, 19 nt, Homo sapiens
gggaagcauuaaagagcua

SEQ ID NO: 1333189 - RNA, 19 nt, Homo sapiens
gagcucagccagaaucuuc

SEQ ID NO: 1333190 - RNA, 19 nt, Homo sapiens
gucacaagguucuggauga

SEQ ID NO: 1333191 - RNA, 19 nt, Homo sapiens
guuaaacaauucuccuuag

SEQ ID NO: 1333192 - RNA, 19 nt, Homo sapiens
aaaccagccuuucauugga

SEQ ID NO: 1333193 - RNA, 19 nt, Homo sapiens
caccagaagucacauuauc

SEQ ID NO: 1333194 - RNA, 19 nt, Homo sapiens
uaacuccagagaucuauaa

SEQ ID NO: 1333195 - RNA, 19 nt, Homo sapiens
gagaacuccuggcucuuuc

SEQ ID NO: 1333196 - RNA, 19 nt, Homo sapiens
ucucagcccugcccaguug

SEQ ID NO: 1333197 - RNA, 19 nt, Homo sapiens
gugaagaaccaaguuauga

SEQ ID NO: 1333198 - RNA, 19 nt, Homo sapiens
cauuugacccuuauaggua

SEQ ID NO: 1333199 - RNA, 19 nt, Homo sapiens
ugagaaaguaucuuaguug

SEQ ID NO: 1333200 - RNA, 19 nt, Homo sapiens
gaagaguugccaugaaagu

SEQ ID NO: 1333201 - RNA, 19 nt, Homo sapiens
ggacuucgagaauucagaa

SEQ ID NO: 1333202 - RNA, 19 nt, Homo sapiens
uggaagaggagguuuauga

SEQ ID NO: 1333203 - RNA, 19 nt, Homo sapiens
uacaguaccuccucaaucu

SEQ ID NO: 1333204 - RNA, 19 nt, Homo sapiens
ccagagguaucuuugucaa

SEQ ID NO: 1333205 - RNA, 19 nt, Homo sapiens
gcagaaagcacuggaaaua

SEQ ID NO: 1333206 - RNA, 19 nt, Homo sapiens
cacaaucccuggaauaaua

SEQ ID NO: 1333207 - RNA, 19 nt, Homo sapiens
gaaguuugauuaccuguau

SEQ ID NO: 1333208 - RNA, 19 nt, Homo sapiens
gcaggaagcccaagugaaa

SEQ ID NO: 1333209 - RNA, 19 nt, Homo sapiens
gaacauggcuaugagaaca

SEQ ID NO: 1333210 - RNA, 19 nt, Homo sapiens
gaauucaguuuauggauga

SEQ ID NO: 1333211 - RNA, 19 nt, Homo sapiens
ugacuuaucuaacaucuug

SEQ ID NO: 1333212 - RNA, 19 nt, Homo sapiens
gaaagcacuggaaauaaua

SEQ ID NO: 1333213 - RNA, 19 nt, Homo sapiens
gcgcaucucugaauuacaa

SEQ ID NO: 1333214 - RNA, 19 nt, Homo sapiens
gaagacaccugcaaaacua

SEQ ID NO: 1333215 - RNA, 19 nt, Homo sapiens
cagagaagaugaagaugaa

SEQ ID NO: 1333216 - RNA, 19 nt, Homo sapiens
gaacauguccgugcucuga

SEQ ID NO: 1333217 - RNA, 19 nt, Homo sapiens
ggaauaauauccaggaaac

SEQ ID NO: 1333218 - RNA, 19 nt, Homo sapiens
gaaaugugccagugauauu

SEQ ID NO: 1333219 - RNA, 19 nt, Homo sapiens
agaaagcacuggaaauaau

SEQ ID NO: 1333220 - RNA, 19 nt, Homo sapiens
gcuuagagauguucacgaa

SEQ ID NO: 1333221 - RNA, 19 nt, Homo sapiens
ccauaugacuuaucuaaca

SEQ ID NO: 1333222 - RNA, 19 nt, Homo sapiens
gauaauacgugaaauugac

SEQ ID NO: 1333223 - RNA, 19 nt, Homo sapiens
caacucaucugucccaucu

SEQ ID NO: 1333224 - RNA, 19 nt, Homo sapiens
gaacaggauuucugcaaaa

SEQ ID NO: 1333225 - RNA, 19 nt, Homo sapiens
gcagcuacuucucagauug

SEQ ID NO: 1333226 - RNA, 19 nt, Homo sapiens
agaugaagaugaagaagaa

SEQ ID NO: 1333227 - RNA, 19 nt, Homo sapiens
caaccucaauagagaagaa

SEQ ID NO: 1333228 - RNA, 19 nt, Homo sapiens
uauauggacuucagaggaa

SEQ ID NO: 1333229 - RNA, 19 nt, Homo sapiens
gaaaauaguugcagaaagc

SEQ ID NO: 1333230 - RNA, 19 nt, Homo sapiens
ugaacaggauuucugcaaa

SEQ ID NO: 1333231 - RNA, 19 nt, Homo sapiens
ggaagcccaagugaaauua

SEQ ID NO: 1333232 - RNA, 19 nt, Homo sapiens
caaaggcauuucagaugga

SEQ ID NO: 1333233 - RNA, 19 nt, Homo sapiens
gaggagaggaagaaugaaa

SEQ ID NO: 1333234 - RNA, 19 nt, Homo sapiens
gcaaaacuaucgaggaaug

SEQ ID NO: 1333235 - RNA, 19 nt, Homo sapiens
guacccaccugcucucugu

SEQ ID NO: 1333236 - RNA, 19 nt, Homo sapiens
ggaaaugugccagugauau

SEQ ID NO: 1333237 - RNA, 19 nt, Homo sapiens
gcagaccauggauaacuua

SEQ ID NO: 1333238 - RNA, 19 nt, Homo sapiens
gaaagggaccucugaacag

SEQ ID NO: 1333239 - RNA, 19 nt, Homo sapiens
caaauagggccuccagguu

SEQ ID NO: 1333240 - RNA, 19 nt, Homo sapiens
gaccauggauaacuuagag

SEQ ID NO: 1333241 - RNA, 19 nt, Homo sapiens
gcaguggagcugauucuga

SEQ ID NO: 1333242 - RNA, 19 nt, Homo sapiens
gggcagcugugagugguaa

SEQ ID NO: 1333243 - RNA, 19 nt, Homo sapiens
agaaugaaaugacccaagu

SEQ ID NO: 1333244 - RNA, 19 nt, Homo sapiens
ucacacaaucccuggaaua

SEQ ID NO: 1333245 - RNA, 19 nt, Homo sapiens
gaagaggagcgcaucaaca

SEQ ID NO: 1333246 - RNA, 19 nt, Homo sapiens
cacgaaaccuguggugauu

SEQ ID NO: 1333247 - RNA, 19 nt, Homo sapiens
gagcagcagaccauggaua

SEQ ID NO: 1333248 - RNA, 19 nt, Homo sapiens
gggaggagaagcaguagaa

SEQ ID NO: 1333249 - RNA, 19 nt, Homo sapiens
gagaagaugaagaugaaga

SEQ ID NO: 1333250 - RNA, 19 nt, Homo sapiens
cagaaagcacuggaaauaa

SEQ ID NO: 1333251 - RNA, 19 nt, Homo sapiens
gagcgcaucucugaauuac

SEQ ID NO: 1333252 - RNA, 19 nt, Homo sapiens
ugaacucccuaaaugaaug

SEQ ID NO: 1333253 - RNA, 19 nt, Homo sapiens
ggaagcaucaaaggcauuu

SEQ ID NO: 1333254 - RNA, 19 nt, Homo sapiens
aggagaaacuggaacaugu

SEQ ID NO: 1333255 - RNA, 19 nt, Homo sapiens
ccaaagagcagcagaccau

SEQ ID NO: 1333256 - RNA, 19 nt, Homo sapiens
ucucauaggcacugacuuu

SEQ ID NO: 1333257 - RNA, 19 nt, Homo sapiens
agucaggaauucaguuuau

SEQ ID NO: 1333258 - RNA, 19 nt, Homo sapiens
gcaucaacaucuacugucu

SEQ ID NO: 1333259 - RNA, 19 nt, Homo sapiens
aaucuucuauuguguggaa

SEQ ID NO: 1333260 - RNA, 19 nt, Homo sapiens
gaagcccaagugaaauuaa

SEQ ID NO: 1333261 - RNA, 19 nt, Homo sapiens
ugguugaacucccuaaaug

SEQ ID NO: 1333262 - RNA, 19 nt, Homo sapiens
cagucaaccucaauagaga

SEQ ID NO: 1333263 - RNA, 19 nt, Homo sapiens
ggagaggaagaaugaaaug

SEQ ID NO: 1333264 - RNA, 19 nt, Homo sapiens
gaucacacaaucccuggaa

SEQ ID NO: 1333265 - RNA, 19 nt, Homo sapiens
gaacucccuaaaugaauga

SEQ ID NO: 1333266 - RNA, 19 nt, Homo sapiens
uuacagagaagaugaagau

SEQ ID NO: 1333267 - RNA, 19 nt, Homo sapiens
aaacagaaacaagagcuuu

SEQ ID NO: 1333268 - RNA, 19 nt, Homo sapiens
uaugguagcuuucauuucc

SEQ ID NO: 1333269 - RNA, 19 nt, Homo sapiens
agaagaaggcggagaagga

SEQ ID NO: 1333270 - RNA, 19 nt, Homo sapiens
gaacgucucaaaguugguu

SEQ ID NO: 1333271 - RNA, 19 nt, Homo sapiens
gcagaaaacagaaacaaga

SEQ ID NO: 1333272 - RNA, 19 nt, Homo sapiens
cgaaaccuguggugauucu

SEQ ID NO: 1333273 - RNA, 19 nt, Homo sapiens
aaacguaaaggacacuuga

SEQ ID NO: 1333274 - RNA, 19 nt, Homo sapiens
guugaacucccuaaaugaa

SEQ ID NO: 1333275 - RNA, 19 nt, Homo sapiens
caucaaaggcauuucagau

SEQ ID NO: 1333276 - RNA, 19 nt, Homo sapiens
cagugcagguggucaguga

SEQ ID NO: 1333277 - RNA, 19 nt, Homo sapiens
guagcuuucauuuccuuua

SEQ ID NO: 1333278 - RNA, 19 nt, Homo sapiens
gcacuggaaauaauaaacu

SEQ ID NO: 1333279 - RNA, 19 nt, Homo sapiens
gaaacguaaaggacacuug

SEQ ID NO: 1333280 - RNA, 19 nt, Homo sapiens
ugaaagggaccucugaaca

SEQ ID NO: 1333281 - RNA, 19 nt, Homo sapiens
guucugaggauucgaaugu

SEQ ID NO: 1333282 - RNA, 19 nt, Homo sapiens
acagagaagaugaagauga

SEQ ID NO: 1333283 - RNA, 19 nt, Homo sapiens
gagaggaagaaugaaauga

SEQ ID NO: 1333284 - RNA, 19 nt, Homo sapiens
caacaucuacugucugaac

SEQ ID NO: 1333285 - RNA, 19 nt, Homo sapiens
ucauugacaucuacaagca

SEQ ID NO: 1333286 - RNA, 19 nt, Homo sapiens
ggauagacaugggguauau

SEQ ID NO: 1333287 - RNA, 19 nt, Homo sapiens
gaggagaaacuggaacaug

SEQ ID NO: 1333288 - RNA, 19 nt, Homo sapiens
cgaggaauguugcagaaaa

SEQ ID NO: 1333289 - RNA, 19 nt, Homo sapiens
gaggagcgcaucaacaucu

SEQ ID NO: 1333290 - RNA, 19 nt, Homo sapiens
gaugaaagggaccucugaa

SEQ ID NO: 1333291 - RNA, 19 nt, Homo sapiens
gagucaggaauucaguuua

SEQ ID NO: 1333292 - RNA, 19 nt, Homo sapiens
uggaggagaggaagaauga

SEQ ID NO: 1333293 - RNA, 19 nt, Homo sapiens
cacacaaucccuggaauaa

SEQ ID NO: 1333294 - RNA, 19 nt, Homo sapiens
uuagagauguucacgaaac

SEQ ID NO: 1333295 - RNA, 19 nt, Homo sapiens
ggaccucugaacaggauuu

SEQ ID NO: 1333296 - RNA, 19 nt, Homo sapiens
cgccauaucuucuccuuuu

SEQ ID NO: 1333297 - RNA, 19 nt, Homo sapiens
ugagcgcaucucugaauua

SEQ ID NO: 1333298 - RNA, 19 nt, Homo sapiens
gauuaccuguauggcauuu

SEQ ID NO: 1333299 - RNA, 19 nt, Homo sapiens
caaccuguguaggaaaugu

SEQ ID NO: 1333300 - RNA, 19 nt, Homo sapiens
cuucucagauuggauuuga

SEQ ID NO: 1333301 - RNA, 19 nt, Homo sapiens
agaagaagaaggcggagaa

SEQ ID NO: 1333302 - RNA, 19 nt, Homo sapiens
uaggaaaugugccagugau

SEQ ID NO: 1333303 - RNA, 19 nt, Homo sapiens
gacacuugaucacacaauc

SEQ ID NO: 1333304 - RNA, 19 nt, Homo sapiens
caucugucccaucugcuua

SEQ ID NO: 1333305 - RNA, 19 nt, Homo sapiens
guaaggagcuggaugaaug

SEQ ID NO: 1333306 - RNA, 19 nt, Homo sapiens
gaaacgugcuugaaacaau

SEQ ID NO: 1333307 - RNA, 19 nt, Homo sapiens
ggagaacagucaccaggua

SEQ ID NO: 1333308 - RNA, 19 nt, Homo sapiens
gcaaggagcacgaagauga

SEQ ID NO: 1333309 - RNA, 19 nt, Homo sapiens
ggaagaaggacaccaguaa

SEQ ID NO: 1333310 - RNA, 19 nt, Homo sapiens
gaaggaagccagguugaua

SEQ ID NO: 1333311 - RNA, 19 nt, Homo sapiens
gggacgaugugcuguauuu

SEQ ID NO: 1333312 - RNA, 19 nt, Homo sapiens
gaccugcgauugucagaaa

SEQ ID NO: 1333313 - RNA, 19 nt, Homo sapiens
ucacucagcuggaggauuc

SEQ ID NO: 1333314 - RNA, 19 nt, Homo sapiens
guauauguaugccaauuug

SEQ ID NO: 1333315 - RNA, 19 nt, Homo sapiens
ggaagaggaagaauucauu

SEQ ID NO: 1333316 - RNA, 19 nt, Homo sapiens
gagcagggcuuugagaaca

SEQ ID NO: 1333317 - RNA, 19 nt, Homo sapiens
gaacauggacuucuuuacu

SEQ ID NO: 1333318 - RNA, 19 nt, Homo sapiens
agacugaacugaauaacug

SEQ ID NO: 1333319 - RNA, 19 nt, Homo sapiens
ggaaucccauggagaacuu

SEQ ID NO: 1333320 - RNA, 19 nt, Homo sapiens
gaguuuguguuauauguug

SEQ ID NO: 1333321 - RNA, 19 nt, Homo sapiens
ggagccaccuuccucuuga

SEQ ID NO: 1333322 - RNA, 19 nt, Homo sapiens
gagcugagccagaaguuug

SEQ ID NO: 1333323 - RNA, 19 nt, Homo sapiens
cagcugaucugcccuaucu

SEQ ID NO: 1333324 - RNA, 19 nt, Homo sapiens
ugauacagcugcccacuuc

SEQ ID NO: 1333325 - RNA, 19 nt, Homo sapiens
gaagaggaagaauucauug

SEQ ID NO: 1333326 - RNA, 19 nt, Homo sapiens
ggaaccugcugguggagaa

SEQ ID NO: 1333327 - RNA, 19 nt, Homo sapiens
gccagaaguuugacacguu

SEQ ID NO: 1333328 - RNA, 19 nt, Homo sapiens
ccugagagccauugacuuu

SEQ ID NO: 1333329 - RNA, 19 nt, Homo sapiens
gaacaucaucgacaucuac

SEQ ID NO: 1333330 - RNA, 19 nt, Homo sapiens
gaggugaugucuucucucu

SEQ ID NO: 1333331 - RNA, 19 nt, Homo sapiens
gaagacagagcagggcuuu

SEQ ID NO: 1333332 - RNA, 19 nt, Homo sapiens
acaaugcucucuuccuguu

SEQ ID NO: 1333333 - RNA, 19 nt, Homo sapiens
gaggaagaguccacagaag

SEQ ID NO: 1333334 - RNA, 19 nt, Homo sapiens
ggacuucuuuacuuuggau

SEQ ID NO: 1333335 - RNA, 19 nt, Homo sapiens
acauggacuucuuuacuuu

SEQ ID NO: 1333336 - RNA, 19 nt, Homo sapiens
gagaacagucaccagguaa

SEQ ID NO: 1333337 - RNA, 19 nt, Homo sapiens
gcacgaagaugagaaaauc

SEQ ID NO: 1333338 - RNA, 19 nt, Homo sapiens
ugaagaagaagaucaggaa

SEQ ID NO: 1333339 - RNA, 19 nt, Homo sapiens
aggaagagcugagccagaa

SEQ ID NO: 1333340 - RNA, 19 nt, Homo sapiens
caucaucgacaucuacaaa

SEQ ID NO: 1333341 - RNA, 19 nt, Homo sapiens
ccacagaagggaaggaaga

SEQ ID NO: 1333342 - RNA, 19 nt, Homo sapiens
gaacugaauaacuguaucu

SEQ ID NO: 1333343 - RNA, 19 nt, Homo sapiens
cccacagaauggauuauaa

SEQ ID NO: 1333344 - RNA, 19 nt, Homo sapiens
agacagagcagggcuuuga

SEQ ID NO: 1333345 - RNA, 19 nt, Homo sapiens
gaggauucccgucgaguga

SEQ ID NO: 1333346 - RNA, 19 nt, Homo sapiens
gaagugugccaaugacauc

SEQ ID NO: 1333347 - RNA, 19 nt, Homo sapiens
gaagaaggacaccaguaag

SEQ ID NO: 1333348 - RNA, 19 nt, Homo sapiens
ugaggaagaggaagaauuc

SEQ ID NO: 1333349 - RNA, 19 nt, Homo sapiens
aacauggacuucuuuacuu

SEQ ID NO: 1333350 - RNA, 19 nt, Homo sapiens
aaacgugcuugaaacaauc

SEQ ID NO: 1333351 - RNA, 19 nt, Homo sapiens
gaaccagaauuggaaacgu

SEQ ID NO: 1333352 - RNA, 19 nt, Homo sapiens
agaagaagaucaggaagag

SEQ ID NO: 1333353 - RNA, 19 nt, Homo sapiens
ggagcacgaagaugagaaa

SEQ ID NO: 1333354 - RNA, 19 nt, Homo sapiens
ggauuuagagcacauagca

SEQ ID NO: 1333355 - RNA, 19 nt, Homo sapiens
gccacgaggugaucaugga

SEQ ID NO: 1333356 - RNA, 19 nt, Homo sapiens
ggaaacgugcuugaaacaa

SEQ ID NO: 1333357 - RNA, 19 nt, Homo sapiens
ugagagccauugacuuugg

SEQ ID NO: 1333358 - RNA, 19 nt, Homo sapiens
ucucauuccuucccacaga

SEQ ID NO: 1333359 - RNA, 19 nt, Homo sapiens
gaagagcugagccagaagu

SEQ ID NO: 1333360 - RNA, 19 nt, Homo sapiens
gaacagucaccagguaaag

SEQ ID NO: 1333361 - RNA, 19 nt, Homo sapiens
gccuggagauguuuaccaa

SEQ ID NO: 1333362 - RNA, 19 nt, Homo sapiens
gaauuggaaacgugcuuga

SEQ ID NO: 1333363 - RNA, 19 nt, Homo sapiens
gcagggcuuugagaacaug

SEQ ID NO: 1333364 - RNA, 19 nt, Homo sapiens
acaaaagacugaacugaau

SEQ ID NO: 1333365 - RNA, 19 nt, Homo sapiens
ccaagcaacucaucaaaag

SEQ ID NO: 1333366 - RNA, 19 nt, Homo sapiens
gcacucacagggacgaugu

SEQ ID NO: 1333367 - RNA, 19 nt, Homo sapiens
caaucacacaggacacuuu

SEQ ID NO: 1333368 - RNA, 19 nt, Homo sapiens
ccaagccaguggucaucuu

SEQ ID NO: 1333369 - RNA, 19 nt, Homo sapiens
gggaggugaugucuucucu

SEQ ID NO: 1333370 - RNA, 19 nt, Homo sapiens
ggaagugugccaaugacau

SEQ ID NO: 1333371 - RNA, 19 nt, Homo sapiens
ucaucgacaucuacaaaca

SEQ ID NO: 1333372 - RNA, 19 nt, Homo sapiens
ggaaggaagccagguugau

SEQ ID NO: 1333373 - RNA, 19 nt, Homo sapiens
gaaguuugacacguuguau

SEQ ID NO: 1333374 - RNA, 19 nt, Homo sapiens
gaaaaucaacaucuacugu

SEQ ID NO: 1333375 - RNA, 19 nt, Homo sapiens
gacgaugugcuguauuuca

SEQ ID NO: 1333376 - RNA, 19 nt, Homo sapiens
cagggacgaugugcuguau

SEQ ID NO: 1333377 - RNA, 19 nt, Homo sapiens
gggagccaccuuccucuug

SEQ ID NO: 1333378 - RNA, 19 nt, Homo sapiens
gcagcucaguguccauguc

SEQ ID NO: 1333379 - RNA, 19 nt, Homo sapiens
acacugaaccagaauugga

SEQ ID NO: 1333380 - RNA, 19 nt, Homo sapiens
aggagcagcuggacaaguc

SEQ ID NO: 1333381 - RNA, 19 nt, Homo sapiens
caaaagacugaacugaaua

SEQ ID NO: 1333382 - RNA, 19 nt, Homo sapiens
cauagcagacgcccugaga

SEQ ID NO: 1333383 - RNA, 19 nt, Homo sapiens
gugcccaccugcuccaugu

SEQ ID NO: 1333384 - RNA, 19 nt, Homo sapiens
uaaggagcuggaugaauga

SEQ ID NO: 1333385 - RNA, 19 nt, Homo sapiens
aagaagaagaucaggaaga

SEQ ID NO: 1333386 - RNA, 19 nt, Homo sapiens
ccauggagaacuuggagaa

SEQ ID NO: 1333387 - RNA, 19 nt, Homo sapiens
aaaucaacaucuacugucu

SEQ ID NO: 1333388 - RNA, 19 nt, Homo sapiens
agaacaucaucgacaucua

SEQ ID NO: 1333389 - RNA, 19 nt, Homo sapiens
gggaaggaagccagguuga

SEQ ID NO: 1333390 - RNA, 19 nt, Homo sapiens
gacaaaagacugaacugaa

SEQ ID NO: 1333391 - RNA, 19 nt, Homo sapiens
gagaacaucaucgacaucu

SEQ ID NO: 1333392 - RNA, 19 nt, Homo sapiens
agaggaagaguccacagaa

SEQ ID NO: 1333393 - RNA, 19 nt, Homo sapiens
cagaugaggaagaggaaga

SEQ ID NO: 1333394 - RNA, 19 nt, Homo sapiens
ggacaaaagacugaacuga

SEQ ID NO: 1333395 - RNA, 19 nt, Homo sapiens
cugaguuuguguuauaugu

SEQ ID NO: 1333396 - RNA, 19 nt, Homo sapiens
agcagacacugaaccagaa

SEQ ID NO: 1333397 - RNA, 19 nt, Homo sapiens
uguacggccugcagaggaa

SEQ ID NO: 1333398 - RNA, 19 nt, Homo sapiens
uggagaacaucaucgacau

SEQ ID NO: 1333399 - RNA, 19 nt, Homo sapiens
agacacugaaccagaauug

SEQ ID NO: 1333400 - RNA, 19 nt, Homo sapiens
ccauugacuuugggacaga

SEQ ID NO: 1333401 - RNA, 19 nt, Homo sapiens
cagagcagggcuuugagaa

SEQ ID NO: 1333402 - RNA, 19 nt, Homo sapiens
gcuaggcguggcucucauu

SEQ ID NO: 1333403 - RNA, 19 nt, Homo sapiens
gccggaagugugccaauga

SEQ ID NO: 1333404 - RNA, 19 nt, Homo sapiens
ggagaacaucaucgacauc

SEQ ID NO: 1333405 - RNA, 19 nt, Homo sapiens
gcaaagcugucauuaauaa

SEQ ID NO: 1333406 - RNA, 19 nt, Homo sapiens
gaaagggucuucauucauu

SEQ ID NO: 1333407 - RNA, 19 nt, Homo sapiens
caaauaggcuucccacuug

SEQ ID NO: 1333408 - RNA, 19 nt, Homo sapiens
gagaaagggucuucauuca

SEQ ID NO: 1333409 - RNA, 19 nt, Homo sapiens
gcaaauaggcuucccacuu

SEQ ID NO: 1333410 - RNA, 19 nt, Homo sapiens
agacaaaccuuggaaauca

SEQ ID NO: 1333411 - RNA, 19 nt, Homo sapiens
uugcaaagcugucauuaau

SEQ ID NO: 1333412 - RNA, 19 nt, Homo sapiens
guucaugccgugacaauuu

SEQ ID NO: 1333413 - RNA, 19 nt, Homo sapiens
ggagugcagugguucaauc

SEQ ID NO: 1333414 - RNA, 19 nt, Homo sapiens
gagcugccauuuagaacau

SEQ ID NO: 1333415 - RNA, 19 nt, Homo sapiens
cagcuaggauuacagacaa

SEQ ID NO: 1333416 - RNA, 19 nt, Homo sapiens
caagauggcauuuguuaag

SEQ ID NO: 1333417 - RNA, 19 nt, Homo sapiens
ggacccaacuuuguuacug

SEQ ID NO: 1333418 - RNA, 19 nt, Homo sapiens
guucucacuuguuuccaua

SEQ ID NO: 1333419 - RNA, 19 nt, Homo sapiens
gacaaaccuuggaaaucaa

SEQ ID NO: 1333420 - RNA, 19 nt, Homo sapiens
caacuuuguuacugugaga

SEQ ID NO: 1333421 - RNA, 19 nt, Homo sapiens
gaaaguucuggaaugauga

SEQ ID NO: 1333422 - RNA, 19 nt, Homo sapiens
ugagaaagggucuucauuc

SEQ ID NO: 1333423 - RNA, 19 nt, Homo sapiens
gagcagcuaggauuacaga

SEQ ID NO: 1333424 - RNA, 19 nt, Homo sapiens
ccucccaguucaagaaauu

SEQ ID NO: 1333425 - RNA, 19 nt, Homo sapiens
uguuaguucucacuuguuu

SEQ ID NO: 1333426 - RNA, 19 nt, Homo sapiens
gacccaacuuuguuacugu

SEQ ID NO: 1333427 - RNA, 19 nt, Homo sapiens
cauucaagauggcauuugu

SEQ ID NO: 1333428 - RNA, 19 nt, Homo sapiens
gcagcuaggauuacagaca

SEQ ID NO: 1333429 - RNA, 19 nt, Homo sapiens
gagccuggacccaacuuug

SEQ ID NO: 1333430 - RNA, 19 nt, Homo sapiens
uucaagauggcauuuguua

SEQ ID NO: 1333431 - RNA, 19 nt, Homo sapiens
gugagaaagggucuucauu

SEQ ID NO: 1333432 - RNA, 19 nt, Homo sapiens
ccaccucccaguucaagaa

SEQ ID NO: 1333433 - RNA, 19 nt, Homo sapiens
gugguucaaucacggauca

SEQ ID NO: 1333434 - RNA, 19 nt, Homo sapiens
ucaagauggcauuuguuaa

SEQ ID NO: 1333435 - RNA, 19 nt, Homo sapiens
gaggucuuguuaugcaaau

SEQ ID NO: 1333436 - RNA, 19 nt, Homo sapiens
cacgaggucuuguuaugca

SEQ ID NO: 1333437 - RNA, 19 nt, Homo sapiens
ucucacuuguuuccauauu

SEQ ID NO: 1333438 - RNA, 19 nt, Homo sapiens
caguaugaguccauucagu

SEQ ID NO: 1333439 - RNA, 19 nt, Homo sapiens
aaagggucuucauucauuc

SEQ ID NO: 1333440 - RNA, 19 nt, Homo sapiens
ggagcugccauuuagaaca

SEQ ID NO: 1333441 - RNA, 19 nt, Homo sapiens
guaugaguccauucaguuc

SEQ ID NO: 1333442 - RNA, 19 nt, Homo sapiens
ccuggacccaacuuuguua

SEQ ID NO: 1333443 - RNA, 19 nt, Homo sapiens
uaauugcaaagcugucauu

SEQ ID NO: 1333444 - RNA, 19 nt, Homo sapiens
guucuggaaugaugaagcu

SEQ ID NO: 1333445 - RNA, 19 nt, Homo sapiens
cagacaaaccuuggaaauc

SEQ ID NO: 1333446 - RNA, 19 nt, Homo sapiens
acagacaaaccuuggaaau

SEQ ID NO: 1333447 - RNA, 19 nt, Homo sapiens
ugcaaagcugucauuaaua

SEQ ID NO: 1333448 - RNA, 19 nt, Homo sapiens
uauuguuaguucucacuug

SEQ ID NO: 1333449 - RNA, 19 nt, Homo sapiens
ggucuuguuaugcaaauag

SEQ ID NO: 1333450 - RNA, 19 nt, Homo sapiens
uuacagacaaaccuuggaa

SEQ ID NO: 1333451 - RNA, 19 nt, Homo sapiens
cucacuuguuuccauauuu

SEQ ID NO: 1333452 - RNA, 19 nt, Homo sapiens
aguaugaguccauucaguu

SEQ ID NO: 1333453 - RNA, 19 nt, Homo sapiens
uguccacucguuucuguaa

SEQ ID NO: 1333454 - RNA, 19 nt, Homo sapiens
gagugcagugguucaauca

SEQ ID NO: 1333455 - RNA, 19 nt, Homo sapiens
guccacucguuucuguaaa

SEQ ID NO: 1333456 - RNA, 19 nt, Homo sapiens
cuggaaugaugaagcuguu

SEQ ID NO: 1333457 - RNA, 19 nt, Homo sapiens
agaaagggucuucauucau

SEQ ID NO: 1333458 - RNA, 19 nt, Homo sapiens
gcaaauggcuccucaaguu

SEQ ID NO: 1333459 - RNA, 19 nt, Homo sapiens
ggauacagcuuaaagaaga

SEQ ID NO: 1333460 - RNA, 19 nt, Homo sapiens
gcggaaaguucuucgaaua

SEQ ID NO: 1333461 - RNA, 19 nt, Homo sapiens
cgacagcuuucaagucuua

SEQ ID NO: 1333462 - RNA, 19 nt, Homo sapiens
cuacacagauugucucuuu

SEQ ID NO: 1333463 - RNA, 19 nt, Homo sapiens
ggacagcucucagauaaau

SEQ ID NO: 1333464 - RNA, 19 nt, Homo sapiens
ggaagacucugauuucauc

SEQ ID NO: 1333465 - RNA, 19 nt, Homo sapiens
gaaccaagcagcucuuuga

SEQ ID NO: 1333466 - RNA, 19 nt, Homo sapiens
ggagagagcguccuaaaug

SEQ ID NO: 1333467 - RNA, 19 nt, Homo sapiens
gaagauaaugcuugacuuu

SEQ ID NO: 1333468 - RNA, 19 nt, Homo sapiens
gagagagcguccuaaauga

SEQ ID NO: 1333469 - RNA, 19 nt, Homo sapiens
guacuguccucgucuauug

SEQ ID NO: 1333470 - RNA, 19 nt, Homo sapiens
ucagaaaucuuggaucuau

SEQ ID NO: 1333471 - RNA, 19 nt, Homo sapiens
ggccuucaguaccuuauua

SEQ ID NO: 1333472 - RNA, 19 nt, Homo sapiens
ugggacagcucucagauaa

SEQ ID NO: 1333473 - RNA, 19 nt, Homo sapiens
ggacugcuguuucaugcuu

SEQ ID NO: 1333474 - RNA, 19 nt, Homo sapiens
uggaggagcucgcuacuga

SEQ ID NO: 1333475 - RNA, 19 nt, Homo sapiens
gugaagcucaugaagauua

SEQ ID NO: 1333476 - RNA, 19 nt, Homo sapiens
gcuguuucaugcuucauua

SEQ ID NO: 1333477 - RNA, 19 nt, Homo sapiens
ugacugugcuggcgauauu

SEQ ID NO: 1333478 - RNA, 19 nt, Homo sapiens
guacagcuuugaucacaau

SEQ ID NO: 1333479 - RNA, 19 nt, Homo sapiens
ggaaaguucuucgaauaca

SEQ ID NO: 1333480 - RNA, 19 nt, Homo sapiens
gaggaagacucugauuuca

SEQ ID NO: 1333481 - RNA, 19 nt, Homo sapiens
ggaagauaaugcuugacuu

SEQ ID NO: 1333482 - RNA, 19 nt, Homo sapiens
gaaggcgaccugacauuga

SEQ ID NO: 1333483 - RNA, 19 nt, Homo sapiens
cgaauacacucugaaagga

SEQ ID NO: 1333484 - RNA, 19 nt, Homo sapiens
ggcgauauuuaaugaauug

SEQ ID NO: 1333485 - RNA, 19 nt, Homo sapiens
aacauucgauccagaagua

SEQ ID NO: 1333486 - RNA, 19 nt, Homo sapiens
ucuuugagguguuacauuu

SEQ ID NO: 1333487 - RNA, 19 nt, Homo sapiens
gcagcucuuugagguguua

SEQ ID NO: 1333488 - RNA, 19 nt, Homo sapiens
gaaucacacaagcucauua

SEQ ID NO: 1333489 - RNA, 19 nt, Homo sapiens
gcagaaggcauaagauugg

SEQ ID NO: 1333490 - RNA, 19 nt, Homo sapiens
gauaugcuacggaagguaa

SEQ ID NO: 1333491 - RNA, 19 nt, Homo sapiens
ggagagcgcauggauauuc

SEQ ID NO: 1333492 - RNA, 19 nt, Homo sapiens
gaucuuuacgcacuucuuu

SEQ ID NO: 1333493 - RNA, 19 nt, Homo sapiens
augcagacguggaucuuua

SEQ ID NO: 1333494 - RNA, 19 nt, Homo sapiens
cagaaaucuuggaucuaua

SEQ ID NO: 1333495 - RNA, 19 nt, Homo sapiens
gcguagagcagaaugauau

SEQ ID NO: 1333496 - RNA, 19 nt, Homo sapiens
cgaccacccuucucauugu

SEQ ID NO: 1333497 - RNA, 19 nt, Homo sapiens
gggcagaaggcauaagauu

SEQ ID NO: 1333498 - RNA, 19 nt, Homo sapiens
cagcgggacugaacacuca

SEQ ID NO: 1333499 - RNA, 19 nt, Homo sapiens
gaucuauacuggccuaugc

SEQ ID NO: 1333500 - RNA, 19 nt, Homo sapiens
gagagcgcauggauauuca

SEQ ID NO: 1333501 - RNA, 19 nt, Homo sapiens
caggagagcgcauggauau

SEQ ID NO: 1333502 - RNA, 19 nt, Homo sapiens
ggcauaagauuggcuggaa

SEQ ID NO: 1333503 - RNA, 19 nt, Homo sapiens
caacaacgacagcuuucaa

SEQ ID NO: 1333504 - RNA, 19 nt, Homo sapiens
ccgaagaggaccagaauga

SEQ ID NO: 1333505 - RNA, 19 nt, Homo sapiens
uucaguaccuuauuaguga

SEQ ID NO: 1333506 - RNA, 19 nt, Homo sapiens
ggagcucgcuacugagaag

SEQ ID NO: 1333507 - RNA, 19 nt, Homo sapiens
gaaaucaguccuggcaaga

SEQ ID NO: 1333508 - RNA, 19 nt, Homo sapiens
gcgcuguucuuccucaugu

SEQ ID NO: 1333509 - RNA, 19 nt, Homo sapiens
uggcaguacuucagaguug

SEQ ID NO: 1333510 - RNA, 19 nt, Homo sapiens
gcauaagauuggcuggaau

SEQ ID NO: 1333511 - RNA, 19 nt, Homo sapiens
uuaccaaacugcacugcuu

SEQ ID NO: 1333512 - RNA, 19 nt, Homo sapiens
gaagguaacauucgaucca

SEQ ID NO: 1333513 - RNA, 19 nt, Homo sapiens
gaagaggaccagaaugaac

SEQ ID NO: 1333514 - RNA, 19 nt, Homo sapiens
uuggaaaucucauguaugg

SEQ ID NO: 1333515 - RNA, 19 nt, Homo sapiens
guuucaugcuucauuauug

SEQ ID NO: 1333516 - RNA, 19 nt, Homo sapiens
ccuggaagauaaugcuuga

SEQ ID NO: 1333517 - RNA, 19 nt, Homo sapiens
acugaacacucacgccuuu

SEQ ID NO: 1333518 - RNA, 19 nt, Homo sapiens
gagagcguccuaaaugaug

SEQ ID NO: 1333519 - RNA, 19 nt, Homo sapiens
uggugaagcucaugaagau

SEQ ID NO: 1333520 - RNA, 19 nt, Homo sapiens
gaaugucagcggaaaguuc

SEQ ID NO: 1333521 - RNA, 19 nt, Homo sapiens
uaaccaagagccacugaga

SEQ ID NO: 1333522 - RNA, 19 nt, Homo sapiens
cauaagauuggcuggaauu

SEQ ID NO: 1333523 - RNA, 19 nt, Homo sapiens
ggcagaaggcauaagauug

SEQ ID NO: 1333524 - RNA, 19 nt, Homo sapiens
gaggagcucgcuacugaga

SEQ ID NO: 1333525 - RNA, 19 nt, Homo sapiens
gaaaguucuucgaauacac

SEQ ID NO: 1333526 - RNA, 19 nt, Homo sapiens
cagcuuugaucacaauuac

SEQ ID NO: 1333527 - RNA, 19 nt, Homo sapiens
caacgacagcuuucaaguc

SEQ ID NO: 1333528 - RNA, 19 nt, Homo sapiens
ugucauggcuuaacaucag

SEQ ID NO: 1333529 - RNA, 19 nt, Homo sapiens
ugaagcucaugaagauuau

SEQ ID NO: 1333530 - RNA, 19 nt, Homo sapiens
ggaaucacacaagcucauu

SEQ ID NO: 1333531 - RNA, 19 nt, Homo sapiens
gguaacauucgauccagaa

SEQ ID NO: 1333532 - RNA, 19 nt, Homo sapiens
ccaucuggcucuucaagca

SEQ ID NO: 1333533 - RNA, 19 nt, Homo sapiens
gggcacccgccuaguguuu

SEQ ID NO: 1333534 - RNA, 19 nt, Homo sapiens
caaauggcuccucaaguuc

SEQ ID NO: 1333535 - RNA, 19 nt, Homo sapiens
cauuacaccuacaacaauc

SEQ ID NO: 1333536 - RNA, 19 nt, Homo sapiens
acagcucucagauaaauuu

SEQ ID NO: 1333537 - RNA, 19 nt, Homo sapiens
gaacacucacgccuuugau

SEQ ID NO: 1333538 - RNA, 19 nt, Homo sapiens
gaccgaaggcgaccugaca

SEQ ID NO: 1333539 - RNA, 19 nt, Homo sapiens
gguguacgauaaccaagag

SEQ ID NO: 1333540 - RNA, 19 nt, Homo sapiens
aacgacagcuuucaagucu

SEQ ID NO: 1333541 - RNA, 19 nt, Homo sapiens
uggcuuaacaucagaguug

SEQ ID NO: 1333542 - RNA, 19 nt, Homo sapiens
cacaagcucauuacaccua

SEQ ID NO: 1333543 - RNA, 19 nt, Homo sapiens
cguccuaaaugaugcuguu

SEQ ID NO: 1333544 - RNA, 19 nt, Homo sapiens
cgaaggcgaccugacauug

SEQ ID NO: 1333545 - RNA, 19 nt, Homo sapiens
agaccgggcuggccaugau

SEQ ID NO: 1333546 - RNA, 19 nt, Homo sapiens
ggauauucaggcuguggua

SEQ ID NO: 1333547 - RNA, 19 nt, Homo sapiens
gccaacgugacuaaguuua

SEQ ID NO: 1333548 - RNA, 19 nt, Homo sapiens
aaucaguccuggcaagauc

SEQ ID NO: 1333549 - RNA, 19 nt, Homo sapiens
cgccugguguggcuuacua

SEQ ID NO: 1333550 - RNA, 19 nt, Homo sapiens
cgaagaggaccagaaugaa

SEQ ID NO: 1333551 - RNA, 19 nt, Homo sapiens
uacauuuccuggcagagaa

SEQ ID NO: 1333552 - RNA, 19 nt, Homo sapiens
gagcugugacugguguuaa

SEQ ID NO: 1333553 - RNA, 19 nt, Homo sapiens
ggagcugugacugguguua

SEQ ID NO: 1333554 - RNA, 19 nt, Homo sapiens
guaccuuauuagugaaugu

SEQ ID NO: 1333555 - RNA, 19 nt, Homo sapiens
gguacagcuuugaucacaa

SEQ ID NO: 1333556 - RNA, 19 nt, Homo sapiens
gaucuaugggcucaucguu

SEQ ID NO: 1333557 - RNA, 19 nt, Homo sapiens
ggagacggcgcuguucuuc

SEQ ID NO: 1333558 - RNA, 19 nt, Homo sapiens
gccaugaucuccucugaua

SEQ ID NO: 1333559 - RNA, 19 nt, Homo sapiens
uaaagagccugguugguuu

SEQ ID NO: 1333560 - RNA, 19 nt, Homo sapiens
gaggaagaaugauuaaaug

SEQ ID NO: 1333561 - RNA, 19 nt, Homo sapiens
gcaaggccuucgaguguaa

SEQ ID NO: 1333562 - RNA, 19 nt, Homo sapiens
cagaagagcuuagggcauu

SEQ ID NO: 1333563 - RNA, 19 nt, Homo sapiens
cugaagagcuacaggagua

SEQ ID NO: 1333564 - RNA, 19 nt, Homo sapiens
guaaagagccugguugguu

SEQ ID NO: 1333565 - RNA, 19 nt, Homo sapiens
cagguaagcuggucauugu

SEQ ID NO: 1333566 - RNA, 19 nt, Homo sapiens
gggaggaaguggccaaguu

SEQ ID NO: 1333567 - RNA, 19 nt, Homo sapiens
ccaaguuccugucuuucua

SEQ ID NO: 1333568 - RNA, 19 nt, Homo sapiens
cgggagagcuggagauguu

SEQ ID NO: 1333569 - RNA, 19 nt, Homo sapiens
gaaugugguuguccugaau

SEQ ID NO: 1333570 - RNA, 19 nt, Homo sapiens
ccaggaagguaucuaacuu

SEQ ID NO: 1333571 - RNA, 19 nt, Homo sapiens
ggaccuaccacauggauga

SEQ ID NO: 1333572 - RNA, 19 nt, Homo sapiens
ccacaccuaugucucagaa

SEQ ID NO: 1333573 - RNA, 19 nt, Homo sapiens
ggagauggcccugagagaa

SEQ ID NO: 1333574 - RNA, 19 nt, Homo sapiens
ccacauggaugaguaugau

SEQ ID NO: 1333575 - RNA, 19 nt, Homo sapiens
ccaguggcaucauuaacuu

SEQ ID NO: 1333576 - RNA, 19 nt, Homo sapiens
caucuggguugacuugaga

SEQ ID NO: 1333577 - RNA, 19 nt, Homo sapiens
acaccuaugucucagaaga

SEQ ID NO: 1333578 - RNA, 19 nt, Homo sapiens
ggcaaggccuucgagugua

SEQ ID NO: 1333579 - RNA, 19 nt, Homo sapiens
ggaagaaugauuaaauggu

SEQ ID NO: 1333580 - RNA, 19 nt, Homo sapiens
ucuagaggaagaaugauua

SEQ ID NO: 1333581 - RNA, 19 nt, Homo sapiens
gaagacugacuguggaugu

SEQ ID NO: 1333582 - RNA, 19 nt, Homo sapiens
gcagguaagcuggucauug

SEQ ID NO: 1333583 - RNA, 19 nt, Homo sapiens
ucaaaggccucauccucau

SEQ ID NO: 1333584 - RNA, 19 nt, Homo sapiens
uggccaaguuccugucuuu

SEQ ID NO: 1333585 - RNA, 19 nt, Homo sapiens
ccagaggacccaugugaug

SEQ ID NO: 1333586 - RNA, 19 nt, Homo sapiens
cuacaggaccuaccacaug

SEQ ID NO: 1333587 - RNA, 19 nt, Homo sapiens
gcagugggaaacuccuuaa

SEQ ID NO: 1333588 - RNA, 19 nt, Homo sapiens
uuucuugucuuucgcugua

SEQ ID NO: 1333589 - RNA, 19 nt, Homo sapiens
guaucuaacuuggcuuugu

SEQ ID NO: 1333590 - RNA, 19 nt, Homo sapiens
gacuguggaugugccauuu

SEQ ID NO: 1333591 - RNA, 19 nt, Homo sapiens
gggcaccagugagaacaaa

SEQ ID NO: 1333592 - RNA, 19 nt, Homo sapiens
ucaguggcuugguccagua

SEQ ID NO: 1333593 - RNA, 19 nt, Homo sapiens
ggaggaaguggccaaguuc

SEQ ID NO: 1333594 - RNA, 19 nt, Homo sapiens
ccuccuaccuguccucuag

SEQ ID NO: 1333595 - RNA, 19 nt, Homo sapiens
uaucuaacuuggcuuugug

SEQ ID NO: 1333596 - RNA, 19 nt, Homo sapiens
ccuaccacauggaugagua

SEQ ID NO: 1333597 - RNA, 19 nt, Homo sapiens
gcaaggacuucgggauguc

SEQ ID NO: 1333598 - RNA, 19 nt, Homo sapiens
uuaaaugguucugggauuc

SEQ ID NO: 1333599 - RNA, 19 nt, Homo sapiens
gagauggcccugagagaag

SEQ ID NO: 1333600 - RNA, 19 nt, Homo sapiens
agaaugugguuguccugaa

SEQ ID NO: 1333601 - RNA, 19 nt, Homo sapiens
aaacuaggagagucagaaa

SEQ ID NO: 1333602 - RNA, 19 nt, Homo sapiens
gugggaaacuccuuaagcu

SEQ ID NO: 1333603 - RNA, 19 nt, Homo sapiens
gaaggccguuucgguucuu

SEQ ID NO: 1333604 - RNA, 19 nt, Homo sapiens
cagcacgugugucucuaug

SEQ ID NO: 1333605 - RNA, 19 nt, Homo sapiens
ugagaacaaacucugcuuu

SEQ ID NO: 1333606 - RNA, 19 nt, Homo sapiens
caagugaccaacgcaggua

SEQ ID NO: 1333607 - RNA, 19 nt, Homo sapiens
gaaggucaaaggccucauc

SEQ ID NO: 1333608 - RNA, 19 nt, Homo sapiens
ggcccucccucucuccuau

SEQ ID NO: 1333609 - RNA, 19 nt, Homo sapiens
gaaccccaguggcaucauu

SEQ ID NO: 1333610 - RNA, 19 nt, Homo sapiens
gauguucacccuuccucaa

SEQ ID NO: 1333611 - RNA, 19 nt, Homo sapiens
uggcaaggccuucgagugu

SEQ ID NO: 1333612 - RNA, 19 nt, Homo sapiens
cuacaugcuguccguguuu

SEQ ID NO: 1333613 - RNA, 19 nt, Homo sapiens
cuagaggaagaaugauuaa

SEQ ID NO: 1333614 - RNA, 19 nt, Homo sapiens
ugcaugugauuguggauga

SEQ ID NO: 1333615 - RNA, 19 nt, Homo sapiens
uggccacggugcuguguga

SEQ ID NO: 1333616 - RNA, 19 nt, Homo sapiens
cccucccucucuccuauua

SEQ ID NO: 1333617 - RNA, 19 nt, Homo sapiens
caggaagguaucuaacuug

SEQ ID NO: 1333618 - RNA, 19 nt, Homo sapiens
ucaaggcugcccacaccua

SEQ ID NO: 1333619 - RNA, 19 nt, Homo sapiens
gauuguggaugaggucuac

SEQ ID NO: 1333620 - RNA, 19 nt, Homo sapiens
gguggugccucgcucuucu

SEQ ID NO: 1333621 - RNA, 19 nt, Homo sapiens
auuaaaugguucugggauu

SEQ ID NO: 1333622 - RNA, 19 nt, Homo sapiens
cucccucucuccuauuaaa

SEQ ID NO: 1333623 - RNA, 19 nt, Homo sapiens
guaccgcaguguccuaagc

SEQ ID NO: 1333624 - RNA, 19 nt, Homo sapiens
gaagaucuggaaggagaau

SEQ ID NO: 1333625 - RNA, 19 nt, Homo sapiens
caaggcugcccacaccuau

SEQ ID NO: 1333626 - RNA, 19 nt, Homo sapiens
gaacuguuucuugucuuuc

SEQ ID NO: 1333627 - RNA, 19 nt, Homo sapiens
aaucccaaguggcagaaga

SEQ ID NO: 1333628 - RNA, 19 nt, Homo sapiens
ccugguugguuucgcuuug

SEQ ID NO: 1333629 - RNA, 19 nt, Homo sapiens
gggcuggcuucuucaucug

SEQ ID NO: 1333630 - RNA, 19 nt, Homo sapiens
ggaagaucuggaaggagaa

SEQ ID NO: 1333631 - RNA, 19 nt, Homo sapiens
uggaugaggucuacaugcu

SEQ ID NO: 1333632 - RNA, 19 nt, Homo sapiens
ccucucuccuauuaaacaa

SEQ ID NO: 1333633 - RNA, 19 nt, Homo sapiens
gggcaccuuugaggaggaa

SEQ ID NO: 1333634 - RNA, 19 nt, Homo sapiens
ggagagcuggagauguuca

SEQ ID NO: 1333635 - RNA, 19 nt, Homo sapiens
gguaagcuggucauugucu

SEQ ID NO: 1333636 - RNA, 19 nt, Homo sapiens
ucuacaugcuguccguguu

SEQ ID NO: 1333637 - RNA, 19 nt, Homo sapiens
caacauccggcuggccuau

SEQ ID NO: 1333638 - RNA, 19 nt, Homo sapiens
ccacugugcugcccuuccu

SEQ ID NO: 1333639 - RNA, 19 nt, Homo sapiens
gggcaaccagcaaggacuu

SEQ ID NO: 1333640 - RNA, 19 nt, Homo sapiens
acauggaugaguaugauga

SEQ ID NO: 1333641 - RNA, 19 nt, Homo sapiens
gcaccagugagaacaaacu

SEQ ID NO: 1333642 - RNA, 19 nt, Homo sapiens
aguaugaugaggacaagaa

SEQ ID NO: 1333643 - RNA, 19 nt, Homo sapiens
ggagauggauaccgacuug

SEQ ID NO: 1333644 - RNA, 19 nt, Homo sapiens
cagcugacauucucuauga

SEQ ID NO: 1333645 - RNA, 19 nt, Homo sapiens
gaagcugggugcacaaucu

SEQ ID NO: 1333646 - RNA, 19 nt, Homo sapiens
gaaccugccaacugauuaa

SEQ ID NO: 1333647 - RNA, 19 nt, Homo sapiens
gaccagcagugucuugugu

SEQ ID NO: 1333648 - RNA, 19 nt, Homo sapiens
ccaguggccuccagguuga

SEQ ID NO: 1333649 - RNA, 19 nt, Homo sapiens
gauaccgacuugugaucaa

SEQ ID NO: 1333650 - RNA, 19 nt, Homo sapiens
uguaucaucugcacauuca

SEQ ID NO: 1333651 - RNA, 19 nt, Homo sapiens
aaacuguucucccuuaaaa

SEQ ID NO: 1333652 - RNA, 19 nt, Homo sapiens
gauggauaccgacuuguga

SEQ ID NO: 1333653 - RNA, 19 nt, Homo sapiens
gaagcccauuccucggauu

SEQ ID NO: 1333654 - RNA, 19 nt, Homo sapiens
auaaaacuguucucccuua

SEQ ID NO: 1333655 - RNA, 19 nt, Homo sapiens
gacccugugaugcuaauaa

SEQ ID NO: 1333656 - RNA, 19 nt, Homo sapiens
gagcugcaggugugacuga

SEQ ID NO: 1333657 - RNA, 19 nt, Homo sapiens
ugaaccugccaacugauua

SEQ ID NO: 1333658 - RNA, 19 nt, Homo sapiens
ccagcagugucuuguguuc

SEQ ID NO: 1333659 - RNA, 19 nt, Homo sapiens
gagccucccagcugacauu

SEQ ID NO: 1333660 - RNA, 19 nt, Homo sapiens
ugucuuguguuccgugaug

SEQ ID NO: 1333661 - RNA, 19 nt, Homo sapiens
uaaaacuguucucccuuaa

SEQ ID NO: 1333662 - RNA, 19 nt, Homo sapiens
aauggacccugugaugcua

SEQ ID NO: 1333663 - RNA, 19 nt, Homo sapiens
gauuaaaggacaccagacu

SEQ ID NO: 1333664 - RNA, 19 nt, Homo sapiens
ggauaccgacuugugauca

SEQ ID NO: 1333665 - RNA, 19 nt, Homo sapiens
ugacugaugggaaugaagu

SEQ ID NO: 1333666 - RNA, 19 nt, Homo sapiens
acccugugaugcuaauaaa

SEQ ID NO: 1333667 - RNA, 19 nt, Homo sapiens
uaucaucugcacauucaug

SEQ ID NO: 1333668 - RNA, 19 nt, Homo sapiens
gaggaccagcagugucuug

SEQ ID NO: 1333669 - RNA, 19 nt, Homo sapiens
agaagaagaccagcagcuu

SEQ ID NO: 1333670 - RNA, 19 nt, Homo sapiens
ccugccaacugauuaaagg

SEQ ID NO: 1333671 - RNA, 19 nt, Homo sapiens
uggccaagcagacagcaaa

SEQ ID NO: 1333672 - RNA, 19 nt, Homo sapiens
ggaccagcagugucuugug

SEQ ID NO: 1333673 - RNA, 19 nt, Homo sapiens
ccucccagcugacauucuc

SEQ ID NO: 1333674 - RNA, 19 nt, Homo sapiens
uuaaaggacaccagacucu

SEQ ID NO: 1333675 - RNA, 19 nt, Homo sapiens
ggaaacagaucaugggaau

SEQ ID NO: 1333676 - RNA, 19 nt, Homo sapiens
cgucucagcuauaaagaua

SEQ ID NO: 1333677 - RNA, 19 nt, Homo sapiens
ggaacugaauggcaauuug

SEQ ID NO: 1333678 - RNA, 19 nt, Homo sapiens
gcagguauguauaugguau

SEQ ID NO: 1333679 - RNA, 19 nt, Homo sapiens
aaacagaucaugggaauuu

SEQ ID NO: 1333680 - RNA, 19 nt, Homo sapiens
gaucaaagacugucagcuu

SEQ ID NO: 1333681 - RNA, 19 nt, Homo sapiens
guaaaugucauacugugua

SEQ ID NO: 1333682 - RNA, 19 nt, Homo sapiens
ugacagaaagcccguauuu

SEQ ID NO: 1333683 - RNA, 19 nt, Homo sapiens
cgagagaccaggaugauuu

SEQ ID NO: 1333684 - RNA, 19 nt, Homo sapiens
gaagucguuuccucaaguu

SEQ ID NO: 1333685 - RNA, 19 nt, Homo sapiens
ccaauuauauguacauguc

SEQ ID NO: 1333686 - RNA, 19 nt, Homo sapiens
cagaaagcccguauuugua

SEQ ID NO: 1333687 - RNA, 19 nt, Homo sapiens
gcacuucccuacagcagau

SEQ ID NO: 1333688 - RNA, 19 nt, Homo sapiens
ccuaacgaauccuauauga

SEQ ID NO: 1333689 - RNA, 19 nt, Homo sapiens
caaaggccaugaggaaguu

SEQ ID NO: 1333690 - RNA, 19 nt, Homo sapiens
agaaagcccguauuuguaa

SEQ ID NO: 1333691 - RNA, 19 nt, Homo sapiens
uaacaccuguaauccacua

SEQ ID NO: 1333692 - RNA, 19 nt, Homo sapiens
gagcagguauguauauggu

SEQ ID NO: 1333693 - RNA, 19 nt, Homo sapiens
ucacccaaauuguuuaaug

SEQ ID NO: 1333694 - RNA, 19 nt, Homo sapiens
ggaggaugcuacuuuacug

SEQ ID NO: 1333695 - RNA, 19 nt, Homo sapiens
gagcggacagugaaaugua

SEQ ID NO: 1333696 - RNA, 19 nt, Homo sapiens
acagaaagcccguauuugu

SEQ ID NO: 1333697 - RNA, 19 nt, Homo sapiens
gagcacugccugacagaaa

SEQ ID NO: 1333698 - RNA, 19 nt, Homo sapiens
gagguuggccuuagaggaa

SEQ ID NO: 1333699 - RNA, 19 nt, Homo sapiens
gauguuaacaccuguaauc

SEQ ID NO: 1333700 - RNA, 19 nt, Homo sapiens
ggaaauacagaagucguuu

SEQ ID NO: 1333701 - RNA, 19 nt, Homo sapiens
gggagugcccagcaaauuu

SEQ ID NO: 1333702 - RNA, 19 nt, Homo sapiens
cagcagauaucagggagaa

SEQ ID NO: 1333703 - RNA, 19 nt, Homo sapiens
aaauguacauagacuguga

SEQ ID NO: 1333704 - RNA, 19 nt, Homo sapiens
guuuaaugcuucugcugua

SEQ ID NO: 1333705 - RNA, 19 nt, Homo sapiens
gaucuccccuguaaacuuu

SEQ ID NO: 1333706 - RNA, 19 nt, Homo sapiens
gguauaaaccuugagauca

SEQ ID NO: 1333707 - RNA, 19 nt, Homo sapiens
gaaaggagaacagccgaau

SEQ ID NO: 1333708 - RNA, 19 nt, Homo sapiens
gaaagcccguauuuguaag

SEQ ID NO: 1333709 - RNA, 19 nt, Homo sapiens
guacauguccauucuuaag

SEQ ID NO: 1333710 - RNA, 19 nt, Homo sapiens
ccaggaugauuucgagguu

SEQ ID NO: 1333711 - RNA, 19 nt, Homo sapiens
ggacgagagaccaggauga

SEQ ID NO: 1333712 - RNA, 19 nt, Homo sapiens
gaagauguuaacaccugua

SEQ ID NO: 1333713 - RNA, 19 nt, Homo sapiens
ggacagugaaauguaauau

SEQ ID NO: 1333714 - RNA, 19 nt, Homo sapiens
ugccuucgcuugcccauug

SEQ ID NO: 1333715 - RNA, 19 nt, Homo sapiens
gaguaccgcugcccugagu

SEQ ID NO: 1333716 - RNA, 19 nt, Homo sapiens
uguaauaucccucucuaga

SEQ ID NO: 1333717 - RNA, 19 nt, Homo sapiens
aauguaauaucccucucua

SEQ ID NO: 1333718 - RNA, 19 nt, Homo sapiens
ugacccggcacaucaauaa

SEQ ID NO: 1333719 - RNA, 19 nt, Homo sapiens
ccauuucaguguacauugu

SEQ ID NO: 1333720 - RNA, 19 nt, Homo sapiens
acauguccauucuuaaguu

SEQ ID NO: 1333721 - RNA, 19 nt, Homo sapiens
gaugcuuaccaccaaauaa

SEQ ID NO: 1333722 - RNA, 19 nt, Homo sapiens
uaaugcuucugcuguaaau

SEQ ID NO: 1333723 - RNA, 19 nt, Homo sapiens
cuacuucaaaccuuucuuu

SEQ ID NO: 1333724 - RNA, 19 nt, Homo sapiens
agagcuacuucaaaccuuu

SEQ ID NO: 1333725 - RNA, 19 nt, Homo sapiens
uuaaauccuucucacuuuc

SEQ ID NO: 1333726 - RNA, 19 nt, Homo sapiens
uuacuuucauuccuuccua

SEQ ID NO: 1333727 - RNA, 19 nt, Homo sapiens
gugcccauauugccacaaa

SEQ ID NO: 1333728 - RNA, 19 nt, Homo sapiens
ggagaacagccgaauagag

SEQ ID NO: 1333729 - RNA, 19 nt, Homo sapiens
gacccuaacgaauccuaua

SEQ ID NO: 1333730 - RNA, 19 nt, Homo sapiens
ggagcgcacuucccuacag

SEQ ID NO: 1333731 - RNA, 19 nt, Homo sapiens
auguacauguccauucuua

SEQ ID NO: 1333732 - RNA, 19 nt, Homo sapiens
ccuguaaacuuuccuuugc

SEQ ID NO: 1333733 - RNA, 19 nt, Homo sapiens
cagaggagcggacagugaa

SEQ ID NO: 1333734 - RNA, 19 nt, Homo sapiens
gguuucacccaaauuguuu

SEQ ID NO: 1333735 - RNA, 19 nt, Homo sapiens
agaagucguuuccucaagu

SEQ ID NO: 1333736 - RNA, 19 nt, Homo sapiens
ccagaggagcggacaguga

SEQ ID NO: 1333737 - RNA, 19 nt, Homo sapiens
cagcuuaaggaagauguua

SEQ ID NO: 1333738 - RNA, 19 nt, Homo sapiens
uauggaaagucgcggugaa

SEQ ID NO: 1333739 - RNA, 19 nt, Homo sapiens
acagugaaauguaauaucc

SEQ ID NO: 1333740 - RNA, 19 nt, Homo sapiens
uuucauuccuuccuauguu

SEQ ID NO: 1333741 - RNA, 19 nt, Homo sapiens
gacagaaagcccguauuug

SEQ ID NO: 1333742 - RNA, 19 nt, Homo sapiens
ccaaaggccaugaggaagu

SEQ ID NO: 1333743 - RNA, 19 nt, Homo sapiens
ccacuaaggaacugaaugg

SEQ ID NO: 1333744 - RNA, 19 nt, Homo sapiens
gauuuguaauuccuaugga

SEQ ID NO: 1333745 - RNA, 19 nt, Homo sapiens
ugacgggagugcccagcaa

SEQ ID NO: 1333746 - RNA, 19 nt, Homo sapiens
aaaggagaacagccgaaua

SEQ ID NO: 1333747 - RNA, 19 nt, Homo sapiens
guaauccacuaaggaacug

SEQ ID NO: 1333748 - RNA, 19 nt, Homo sapiens
ucagauauuuugcacugua

SEQ ID NO: 1333749 - RNA, 19 nt, Homo sapiens
cuagagcagguauguauau

SEQ ID NO: 1333750 - RNA, 19 nt, Homo sapiens
gagagaccaggaugauuuc

SEQ ID NO: 1333751 - RNA, 19 nt, Homo sapiens
cagaagucguuuccucaag

SEQ ID NO: 1333752 - RNA, 19 nt, Homo sapiens
cauguccauucuuaaguug

SEQ ID NO: 1333753 - RNA, 19 nt, Homo sapiens
aaacuuuccuuugcccaau

SEQ ID NO: 1333754 - RNA, 19 nt, Homo sapiens
ucccaucgccgcuggcaua

SEQ ID NO: 1333755 - RNA, 19 nt, Homo sapiens
caucacaggcgccuauaca

SEQ ID NO: 1333756 - RNA, 19 nt, Homo sapiens
ggaaagucgcggugaaugc

SEQ ID NO: 1333757 - RNA, 19 nt, Homo sapiens
auguacagcuuaaggaaga

SEQ ID NO: 1333758 - RNA, 19 nt, Homo sapiens
cuacuuuacuggaguugag

SEQ ID NO: 1333759 - RNA, 19 nt, Homo sapiens
gauucuggcuacccuuugg

SEQ ID NO: 1333760 - RNA, 19 nt, Homo sapiens
caucgccgcuggcauaagc

SEQ ID NO: 1333761 - RNA, 19 nt, Homo sapiens
gcaucgugcgcguagagua

SEQ ID NO: 1333762 - RNA, 19 nt, Homo sapiens
cagcuucugucucaauagg

SEQ ID NO: 1333763 - RNA, 19 nt, Homo sapiens
uagagcagguauguauaug

SEQ ID NO: 1333764 - RNA, 19 nt, Homo sapiens
gaaacagaucaugggaauu

SEQ ID NO: 1333765 - RNA, 19 nt, Homo sapiens
aaggagaacagccgaauag

SEQ ID NO: 1333766 - RNA, 19 nt, Homo sapiens
uuuaaugcuucugcuguaa

SEQ ID NO: 1333767 - RNA, 19 nt, Homo sapiens
ggagugcccagcaaauuuu

SEQ ID NO: 1333768 - RNA, 19 nt, Homo sapiens
gcuuaccaccaaauaaaug

SEQ ID NO: 1333769 - RNA, 19 nt, Homo sapiens
augaggaaguugagcuuug

SEQ ID NO: 1333770 - RNA, 19 nt, Homo sapiens
guguacuaauucccuacua

SEQ ID NO: 1333771 - RNA, 19 nt, Homo sapiens
ccuguaauccacuaaggaa

SEQ ID NO: 1333772 - RNA, 19 nt, Homo sapiens
cccaaauuguuuaaugcuu

SEQ ID NO: 1333773 - RNA, 19 nt, Homo sapiens
guccugggccugaagauca

SEQ ID NO: 1333774 - RNA, 19 nt, Homo sapiens
ucaauguccacaaaggauu

SEQ ID NO: 1333775 - RNA, 19 nt, Homo sapiens
ucaaggagcuccagaucaa

SEQ ID NO: 1333776 - RNA, 19 nt, Homo sapiens
gaaggaaacuugcaaacac

SEQ ID NO: 1333777 - RNA, 19 nt, Homo sapiens
cgagugcggugcagguuua

SEQ ID NO: 1333778 - RNA, 19 nt, Homo sapiens
ucucagaacuggaaggaaa

SEQ ID NO: 1333779 - RNA, 19 nt, Homo sapiens
gaaaggaggagauggacaa

SEQ ID NO: 1333780 - RNA, 19 nt, Homo sapiens
ggagaucgaguuccugaaa

SEQ ID NO: 1333781 - RNA, 19 nt, Homo sapiens
ggagguggauggaacaagu

SEQ ID NO: 1333782 - RNA, 19 nt, Homo sapiens
agucggagcuggccagaaa

SEQ ID NO: 1333783 - RNA, 19 nt, Homo sapiens
ccgagaagcuggugcacaa

SEQ ID NO: 1333784 - RNA, 19 nt, Homo sapiens
gaaguggcccagcuaauuc

SEQ ID NO: 1333785 - RNA, 19 nt, Homo sapiens
ccaagcgccucaucaagga

SEQ ID NO: 1333786 - RNA, 19 nt, Homo sapiens
cgaaguggcccagcuaauu

SEQ ID NO: 1333787 - RNA, 19 nt, Homo sapiens
caagaucucagaacuggaa

SEQ ID NO: 1333788 - RNA, 19 nt, Homo sapiens
ggaaggaaacuugcaaaca

SEQ ID NO: 1333789 - RNA, 19 nt, Homo sapiens
caacguccaccgcaucaaa

SEQ ID NO: 1333790 - RNA, 19 nt, Homo sapiens
gggcccaccacaagaaaua

SEQ ID NO: 1333791 - RNA, 19 nt, Homo sapiens
gcaggauccaggugaauga

SEQ ID NO: 1333792 - RNA, 19 nt, Homo sapiens
ggacaagaucucagaacug

SEQ ID NO: 1333793 - RNA, 19 nt, Homo sapiens
acaaggagcgcauggagaa

SEQ ID NO: 1333794 - RNA, 19 nt, Homo sapiens
gggaggugcgcaagauuaa

SEQ ID NO: 1333795 - RNA, 19 nt, Homo sapiens
ccagcagccugaacgagaa

SEQ ID NO: 1333796 - RNA, 19 nt, Homo sapiens
uggacaagcuccuggacaa

SEQ ID NO: 1333797 - RNA, 19 nt, Homo sapiens
ggacauggagcccgagaag

SEQ ID NO: 1333798 - RNA, 19 nt, Homo sapiens
gcagaaggagaucgaguuc

SEQ ID NO: 1333799 - RNA, 19 nt, Homo sapiens
ggaaacuugcaaacacuga

SEQ ID NO: 1333800 - RNA, 19 nt, Homo sapiens
gagcgaaguggcccagcua

SEQ ID NO: 1333801 - RNA, 19 nt, Homo sapiens
uggagaagcuggguaucuu

SEQ ID NO: 1333802 - RNA, 19 nt, Homo sapiens
ccagaaaggaggagaugga

SEQ ID NO: 1333803 - RNA, 19 nt, Homo sapiens
gggagacucaggcgcagua

SEQ ID NO: 1333804 - RNA, 19 nt, Homo sapiens
cgggaggugcgcaagauua

SEQ ID NO: 1333805 - RNA, 19 nt, Homo sapiens
agaagcuggugcacaaguu

SEQ ID NO: 1333806 - RNA, 19 nt, Homo sapiens
cggugcagguuuaugauug

SEQ ID NO: 1333807 - RNA, 19 nt, Homo sapiens
ugcaaacacugaggaauuc

SEQ ID NO: 1333808 - RNA, 19 nt, Homo sapiens
gacaagcuccuggacaaga

SEQ ID NO: 1333809 - RNA, 19 nt, Homo sapiens
ucaagcaugcggucacuga

SEQ ID NO: 1333810 - RNA, 19 nt, Homo sapiens
uguuugagcuagcggagaa

SEQ ID NO: 1333811 - RNA, 19 nt, Homo sapiens
cuguggagcuggagaagga

SEQ ID NO: 1333812 - RNA, 19 nt, Homo sapiens
gaucaagcaugcggucacu

SEQ ID NO: 1333813 - RNA, 19 nt, Homo sapiens
gugcggugcagguuuauga

SEQ ID NO: 1333814 - RNA, 19 nt, Homo sapiens
ggacgugagcgccuacagu

SEQ ID NO: 1333815 - RNA, 19 nt, Homo sapiens
uugcaaacacugaggaauu

SEQ ID NO: 1333816 - RNA, 19 nt, Homo sapiens
gagaucgaguuccugaaaa

SEQ ID NO: 1333817 - RNA, 19 nt, Homo sapiens
gcgcauggagaaacuggaa

SEQ ID NO: 1333818 - RNA, 19 nt, Homo sapiens
gaagcuggugcacaaguuc

SEQ ID NO: 1333819 - RNA, 19 nt, Homo sapiens
uaauucagcagacuuugga

SEQ ID NO: 1333820 - RNA, 19 nt, Homo sapiens
guaugccacugacgaggau

SEQ ID NO: 1333821 - RNA, 19 nt, Homo sapiens
agaagcguguggagagguu

SEQ ID NO: 1333822 - RNA, 19 nt, Homo sapiens
gaucucagaacuggaagga

SEQ ID NO: 1333823 - RNA, 19 nt, Homo sapiens
gagaagcuggugcacaagu

SEQ ID NO: 1333824 - RNA, 19 nt, Homo sapiens
cgaggagacgggagaguau

SEQ ID NO: 1333825 - RNA, 19 nt, Homo sapiens
gauggcagcgggagaugau

SEQ ID NO: 1333826 - RNA, 19 nt, Homo sapiens
cugaggagguagaugaauc

SEQ ID NO: 1333827 - RNA, 19 nt, Homo sapiens
acaagcuccuggacaagau

SEQ ID NO: 1333828 - RNA, 19 nt, Homo sapiens
uagaugaauccaagaagga

SEQ ID NO: 1333829 - RNA, 19 nt, Homo sapiens
aaaguauguuccugcagau

SEQ ID NO: 1333830 - RNA, 19 nt, Homo sapiens
gccggaagauccauuucag

SEQ ID NO: 1333831 - RNA, 19 nt, Homo sapiens
ggaggaggacgacgaagac

SEQ ID NO: 1333832 - RNA, 19 nt, Homo sapiens
ucagcgccgucuucgagaa

SEQ ID NO: 1333833 - RNA, 19 nt, Homo sapiens
ggugcagguuuaugauugg

SEQ ID NO: 1333834 - RNA, 19 nt, Homo sapiens
ggccugggcaucagcauca

SEQ ID NO: 1333835 - RNA, 19 nt, Homo sapiens
agaacuggaaggaaacuug

SEQ ID NO: 1333836 - RNA, 19 nt, Homo sapiens
uggacaagaucucagaacu

SEQ ID NO: 1333837 - RNA, 19 nt, Homo sapiens
gagaugauggagcagagau

SEQ ID NO: 1333838 - RNA, 19 nt, Homo sapiens
gcggugcagguuuaugauu

SEQ ID NO: 1333839 - RNA, 19 nt, Homo sapiens
ucaaggacuaccagcagaa

SEQ ID NO: 1333840 - RNA, 19 nt, Homo sapiens
caucgagguguuugagcua

SEQ ID NO: 1333841 - RNA, 19 nt, Homo sapiens
aggaggagauggacaagcu

SEQ ID NO: 1333842 - RNA, 19 nt, Homo sapiens
guucaaggagcuccagauc

SEQ ID NO: 1333843 - RNA, 19 nt, Homo sapiens
guucccggguggugagaug

SEQ ID NO: 1333844 - RNA, 19 nt, Homo sapiens
cgggagaguaugccacuga

SEQ ID NO: 1333845 - RNA, 19 nt, Homo sapiens
gcgaaguggcccagcuaau

SEQ ID NO: 1333846 - RNA, 19 nt, Homo sapiens
aaggaaacuugcaaacacu

SEQ ID NO: 1333847 - RNA, 19 nt, Homo sapiens
ggacaagcuccuggacaag

SEQ ID NO: 1333848 - RNA, 19 nt, Homo sapiens
uggagagguuggagcuguu

SEQ ID NO: 1333849 - RNA, 19 nt, Homo sapiens
agaaauauggcuccaacgu

SEQ ID NO: 1333850 - RNA, 19 nt, Homo sapiens
guacaggacuacacuuaua

SEQ ID NO: 1333851 - RNA, 19 nt, Homo sapiens
ggaaugcagugugcuguua

SEQ ID NO: 1333852 - RNA, 19 nt, Homo sapiens
ucaaggaggucuauaagga

SEQ ID NO: 1333853 - RNA, 19 nt, Homo sapiens
caaacuaccugggcaguga

SEQ ID NO: 1333854 - RNA, 19 nt, Homo sapiens
gggcagagcaauaaauaaa

SEQ ID NO: 1333855 - RNA, 19 nt, Homo sapiens
cauggaggauggaaccuua

SEQ ID NO: 1333856 - RNA, 19 nt, Homo sapiens
caggagcccuugacaggua

SEQ ID NO: 1333857 - RNA, 19 nt, Homo sapiens
gaaggguggucacugaugu

SEQ ID NO: 1333858 - RNA, 19 nt, Homo sapiens
gcagagcaauaaauaaacu

SEQ ID NO: 1333859 - RNA, 19 nt, Homo sapiens
gcagugugcuguuacaacu

SEQ ID NO: 1333860 - RNA, 19 nt, Homo sapiens
ggaaggaagcugagagauc

SEQ ID NO: 1333861 - RNA, 19 nt, Homo sapiens
gcaacaaguauaccaccua

SEQ ID NO: 1333862 - RNA, 19 nt, Homo sapiens
gacagcaguucgaggaaug

SEQ ID NO: 1333863 - RNA, 19 nt, Homo sapiens
gcgaagugauggugaacau

SEQ ID NO: 1333864 - RNA, 19 nt, Homo sapiens
gaggaaugcccuuggaaug

SEQ ID NO: 1333865 - RNA, 19 nt, Homo sapiens
ccgaagcccugcagaagau

SEQ ID NO: 1333866 - RNA, 19 nt, Homo sapiens
ugcagaagauggccaaaug

SEQ ID NO: 1333867 - RNA, 19 nt, Homo sapiens
gagcaaccgacuaugugua

SEQ ID NO: 1333868 - RNA, 19 nt, Homo sapiens
ccugagaaguacuggcuuu

SEQ ID NO: 1333869 - RNA, 19 nt, Homo sapiens
gaagccaacaaguuucuga

SEQ ID NO: 1333870 - RNA, 19 nt, Homo sapiens
ugagaccuaucccgacuau

SEQ ID NO: 1333871 - RNA, 19 nt, Homo sapiens
ccaucaaggaggucuauaa

SEQ ID NO: 1333872 - RNA, 19 nt, Homo sapiens
gcccuuccaugguuacgaa

SEQ ID NO: 1333873 - RNA, 19 nt, Homo sapiens
guacuggcuuucucaagag

SEQ ID NO: 1333874 - RNA, 19 nt, Homo sapiens
ggccaaaugugcuguacag

SEQ ID NO: 1333875 - RNA, 19 nt, Homo sapiens
uguuauccauccugaguuu

SEQ ID NO: 1333876 - RNA, 19 nt, Homo sapiens
ucaagaggaagcagacaaa

SEQ ID NO: 1333877 - RNA, 19 nt, Homo sapiens
aguacuggcuuucucaaga

SEQ ID NO: 1333878 - RNA, 19 nt, Homo sapiens
ggauggaaccuuacaacag

SEQ ID NO: 1333879 - RNA, 19 nt, Homo sapiens
gcagaagauggccaaaugu

SEQ ID NO: 1333880 - RNA, 19 nt, Homo sapiens
ggaaggguggucacugaug

SEQ ID NO: 1333881 - RNA, 19 nt, Homo sapiens
acaaaugcagcccaaacua

SEQ ID NO: 1333882 - RNA, 19 nt, Homo sapiens
guaccuacagugacuccua

SEQ ID NO: 1333883 - RNA, 19 nt, Homo sapiens
gacuaucguugcugguaga

SEQ ID NO: 1333884 - RNA, 19 nt, Homo sapiens
caaaugcagcccaaacuac

SEQ ID NO: 1333885 - RNA, 19 nt, Homo sapiens
gaaguacuggcuuucucaa

SEQ ID NO: 1333886 - RNA, 19 nt, Homo sapiens
cugggaagccaacaaguuu

SEQ ID NO: 1333887 - RNA, 19 nt, Homo sapiens
gggagcaaccgacuaugug

SEQ ID NO: 1333888 - RNA, 19 nt, Homo sapiens
ggagcaaccgacuaugugu

SEQ ID NO: 1333889 - RNA, 19 nt, Homo sapiens
ugaacaugcugaacucacu

SEQ ID NO: 1333890 - RNA, 19 nt, Homo sapiens
ggggaaggguggucacuga

SEQ ID NO: 1333891 - RNA, 19 nt, Homo sapiens
cgccugcccuuccaugguu

SEQ ID NO: 1333892 - RNA, 19 nt, Homo sapiens
cagaagauggccaaaugug

SEQ ID NO: 1333893 - RNA, 19 nt, Homo sapiens
caucaaggaggucuauaag

SEQ ID NO: 1333894 - RNA, 19 nt, Homo sapiens
agacagcaguucgaggaau

SEQ ID NO: 1333895 - RNA, 19 nt, Homo sapiens
agaggaagcagacaaaugc

SEQ ID NO: 1333896 - RNA, 19 nt, Homo sapiens
cgaggaaugcccuuggaau

SEQ ID NO: 1333897 - RNA, 19 nt, Homo sapiens
gacaaaugcagcccaaacu

SEQ ID NO: 1333898 - RNA, 19 nt, Homo sapiens
auccugaguuugugucuga

SEQ ID NO: 1333899 - RNA, 19 nt, Homo sapiens
aaccuuagaugggacacaa

SEQ ID NO: 1333900 - RNA, 19 nt, Homo sapiens
gaggauggaaccuuacaac

SEQ ID NO: 1333901 - RNA, 19 nt, Homo sapiens
ggagguguggccugucuag

SEQ ID NO: 1333902 - RNA, 19 nt, Homo sapiens
ccaagaccacaccauguuc

SEQ ID NO: 1333903 - RNA, 19 nt, Homo sapiens
ccugggaagccaacaaguu

SEQ ID NO: 1333904 - RNA, 19 nt, Homo sapiens
aagaggaagcagacaaaug

SEQ ID NO: 1333905 - RNA, 19 nt, Homo sapiens
gagacagcaguucgaggaa

SEQ ID NO: 1333906 - RNA, 19 nt, Homo sapiens
caaguauaccaccuaccuu

SEQ ID NO: 1333907 - RNA, 19 nt, Homo sapiens
ggaggauggaaccuuacaa

SEQ ID NO: 1333908 - RNA, 19 nt, Homo sapiens
caacacauggaggauggaa

SEQ ID NO: 1333909 - RNA, 19 nt, Homo sapiens
caagaggaagcagacaaau

SEQ ID NO: 1333910 - RNA, 19 nt, Homo sapiens
aaugugcuguacaggacua

SEQ ID NO: 1333911 - RNA, 19 nt, Homo sapiens
uuagaugggacacaaguca

SEQ ID NO: 1333912 - RNA, 19 nt, Homo sapiens
caccacggcaucuccaaga

SEQ ID NO: 1333913 - RNA, 19 nt, Homo sapiens
gccgggagcaaccgacuau

SEQ ID NO: 1333914 - RNA, 19 nt, Homo sapiens
uccaagaccacaccauguu

SEQ ID NO: 1333915 - RNA, 19 nt, Homo sapiens
agaccuaucccgacuaucg

SEQ ID NO: 1333916 - RNA, 19 nt, Homo sapiens
cauauccgaaccuuagaug

SEQ ID NO: 1333917 - RNA, 19 nt, Homo sapiens
cuacgagcgcgaagugaug

SEQ ID NO: 1333918 - RNA, 19 nt, Homo sapiens
gauggagacagcaguucga

SEQ ID NO: 1333919 - RNA, 19 nt, Homo sapiens
gggaagccaacaaguuucu

SEQ ID NO: 1333920 - RNA, 19 nt, Homo sapiens
ggaaugcagugugcuguua

SEQ ID NO: 1333921 - RNA, 19 nt, Homo sapiens
gggcagagcaauaaauaaa

SEQ ID NO: 1333922 - RNA, 19 nt, Homo sapiens
gcagagcaauaaauaaacu

SEQ ID NO: 1333923 - RNA, 19 nt, Homo sapiens
gcagugugcuguuacaacu

SEQ ID NO: 1333924 - RNA, 19 nt, Homo sapiens
gacagcaguucgaggaaug

SEQ ID NO: 1333925 - RNA, 19 nt, Homo sapiens
gcgaagugauggugaacau

SEQ ID NO: 1333926 - RNA, 19 nt, Homo sapiens
gaggaaugcccuuggaaug

SEQ ID NO: 1333927 - RNA, 19 nt, Homo sapiens
gagcaaccgacuaugugua

SEQ ID NO: 1333928 - RNA, 19 nt, Homo sapiens
ugagaccuaucccgacuau

SEQ ID NO: 1333929 - RNA, 19 nt, Homo sapiens
gcccuuccaugguuacgaa

SEQ ID NO: 1333930 - RNA, 19 nt, Homo sapiens
uguuauccauccugaguuu

SEQ ID NO: 1333931 - RNA, 19 nt, Homo sapiens
gacuaucguugcugguaga

SEQ ID NO: 1333932 - RNA, 19 nt, Homo sapiens
ggcgauaggucuggguguu

SEQ ID NO: 1333933 - RNA, 19 nt, Homo sapiens
gggagcaaccgacuaugug

SEQ ID NO: 1333934 - RNA, 19 nt, Homo sapiens
ggagcaaccgacuaugugu

SEQ ID NO: 1333935 - RNA, 19 nt, Homo sapiens
ugaacaugcugaacucacu

SEQ ID NO: 1333936 - RNA, 19 nt, Homo sapiens
cgccugcccuuccaugguu

SEQ ID NO: 1333937 - RNA, 19 nt, Homo sapiens
caggucagagcuugaggua

SEQ ID NO: 1333938 - RNA, 19 nt, Homo sapiens
agacagcaguucgaggaau

SEQ ID NO: 1333939 - RNA, 19 nt, Homo sapiens
cgaggaaugcccuuggaau

SEQ ID NO: 1333940 - RNA, 19 nt, Homo sapiens
auccugaguuugugucuga

SEQ ID NO: 1333941 - RNA, 19 nt, Homo sapiens
aaccuuagaugggacacaa

SEQ ID NO: 1333942 - RNA, 19 nt, Homo sapiens
gagacagcaguucgaggaa

SEQ ID NO: 1333943 - RNA, 19 nt, Homo sapiens
uuagaugggacacaaguca

SEQ ID NO: 1333944 - RNA, 19 nt, Homo sapiens
cgauaggucuggguguucu

SEQ ID NO: 1333945 - RNA, 19 nt, Homo sapiens
gccgggagcaaccgacuau

SEQ ID NO: 1333946 - RNA, 19 nt, Homo sapiens
agaccuaucccgacuaucg

SEQ ID NO: 1333947 - RNA, 19 nt, Homo sapiens
cauauccgaaccuuagaug

SEQ ID NO: 1333948 - RNA, 19 nt, Homo sapiens
gauggagacagcaguucga

SEQ ID NO: 1333949 - RNA, 19 nt, Homo sapiens
cuacgagcgcgaagugaug

SEQ ID NO: 1333950 - RNA, 19 nt, Homo sapiens
ggaaugcagugugcuguua

SEQ ID NO: 1333951 - RNA, 19 nt, Homo sapiens
gggcagagcaauaaauaaa

SEQ ID NO: 1333952 - RNA, 19 nt, Homo sapiens
gcagagcaauaaauaaacu

SEQ ID NO: 1333953 - RNA, 19 nt, Homo sapiens
gcagugugcuguuacaacu

SEQ ID NO: 1333954 - RNA, 19 nt, Homo sapiens
gacagcaguucgaggaaug

SEQ ID NO: 1333955 - RNA, 19 nt, Homo sapiens
gcgaagugauggugaacau

SEQ ID NO: 1333956 - RNA, 19 nt, Homo sapiens
gaggaaugcccuuggaaug

SEQ ID NO: 1333957 - RNA, 19 nt, Homo sapiens
ugagaccuaucccgacuau

SEQ ID NO: 1333958 - RNA, 19 nt, Homo sapiens
uguuauccauccugaguuu

SEQ ID NO: 1333959 - RNA, 19 nt, Homo sapiens
gacuaucguugcugguaga

SEQ ID NO: 1333960 - RNA, 19 nt, Homo sapiens
ggcgauaggucuggguguu

SEQ ID NO: 1333961 - RNA, 19 nt, Homo sapiens
ugaacaugcugaacucacu

SEQ ID NO: 1333962 - RNA, 19 nt, Homo sapiens
caggucagagcuugaggua

SEQ ID NO: 1333963 - RNA, 19 nt, Homo sapiens
agacagcaguucgaggaau

SEQ ID NO: 1333964 - RNA, 19 nt, Homo sapiens
cgaggaaugcccuuggaau

SEQ ID NO: 1333965 - RNA, 19 nt, Homo sapiens
auccugaguuugugucuga

SEQ ID NO: 1333966 - RNA, 19 nt, Homo sapiens
aaccuuagaugggacacaa

SEQ ID NO: 1333967 - RNA, 19 nt, Homo sapiens
gauguguaccucccuacga

SEQ ID NO: 1333968 - RNA, 19 nt, Homo sapiens
gagacagcaguucgaggaa

SEQ ID NO: 1333969 - RNA, 19 nt, Homo sapiens
cgauaggucuggguguucu

SEQ ID NO: 1333970 - RNA, 19 nt, Homo sapiens
uuagaugggacacaaguca

SEQ ID NO: 1333971 - RNA, 19 nt, Homo sapiens
agaccuaucccgacuaucg

SEQ ID NO: 1333972 - RNA, 19 nt, Homo sapiens
cauauccgaaccuuagaug

SEQ ID NO: 1333973 - RNA, 19 nt, Homo sapiens
cuacgagcgcgaagugaug

SEQ ID NO: 1333974 - RNA, 19 nt, Homo sapiens
gauggagacagcaguucga

SEQ ID NO: 1333975 - RNA, 19 nt, Homo sapiens
gcagaaagcucuauaccaa

SEQ ID NO: 1333976 - RNA, 19 nt, Homo sapiens
ggaacuauauuugcacuua

SEQ ID NO: 1333977 - RNA, 19 nt, Homo sapiens
gcaaacacaggaucuauua

SEQ ID NO: 1333978 - RNA, 19 nt, Homo sapiens
gaucagaaguuauggaaga

SEQ ID NO: 1333979 - RNA, 19 nt, Homo sapiens
gaacaaaccaugccaucua

SEQ ID NO: 1333980 - RNA, 19 nt, Homo sapiens
gaagauauaucaccugaag

SEQ ID NO: 1333981 - RNA, 19 nt, Homo sapiens
gauaugcaaucccuagaua

SEQ ID NO: 1333982 - RNA, 19 nt, Homo sapiens
gacaugacaucccaagaua

SEQ ID NO: 1333983 - RNA, 19 nt, Homo sapiens
gaccuucaauccagaguua

SEQ ID NO: 1333984 - RNA, 19 nt, Homo sapiens
ggaagaaauugaaccuuug

SEQ ID NO: 1333985 - RNA, 19 nt, Homo sapiens
gcacgagaauggcaauuug

SEQ ID NO: 1333986 - RNA, 19 nt, Homo sapiens
gcaguucccugaaauacaa

SEQ ID NO: 1333987 - RNA, 19 nt, Homo sapiens
ucaagacacucaagauaaa

SEQ ID NO: 1333988 - RNA, 19 nt, Homo sapiens
agacauaccuucccaagau

SEQ ID NO: 1333989 - RNA, 19 nt, Homo sapiens
caacucacgucaucacuau

SEQ ID NO: 1333990 - RNA, 19 nt, Homo sapiens
ggccagaaauccucaaaga

SEQ ID NO: 1333991 - RNA, 19 nt, Homo sapiens
gagaauuugugccagauga

SEQ ID NO: 1333992 - RNA, 19 nt, Homo sapiens
gagaagaagcccucagaaa

SEQ ID NO: 1333993 - RNA, 19 nt, Homo sapiens
agagguagaucaugauuug

SEQ ID NO: 1333994 - RNA, 19 nt, Homo sapiens
ggagauauguacacuagag

SEQ ID NO: 1333995 - RNA, 19 nt, Homo sapiens
gaaaugaagcacuggcaaa

SEQ ID NO: 1333996 - RNA, 19 nt, Homo sapiens
uauaucaccugaagacuug

SEQ ID NO: 1333997 - RNA, 19 nt, Homo sapiens
gacauaccuucccaagaua

SEQ ID NO: 1333998 - RNA, 19 nt, Homo sapiens
cuucuaaucugacagcuaa

SEQ ID NO: 1333999 - RNA, 19 nt, Homo sapiens
aaacgaaacuguauugacu

SEQ ID NO: 1334000 - RNA, 19 nt, Homo sapiens
caagauaugcuguuucaug

SEQ ID NO: 1334001 - RNA, 19 nt, Homo sapiens
ugacuaacaugcagaaucu

SEQ ID NO: 1334002 - RNA, 19 nt, Homo sapiens
agaaagcucuauaccaaga

SEQ ID NO: 1334003 - RNA, 19 nt, Homo sapiens
caaagaggcauuccuuaga

SEQ ID NO: 1334004 - RNA, 19 nt, Homo sapiens
gauaugcuguuucaugaca

SEQ ID NO: 1334005 - RNA, 19 nt, Homo sapiens
aggaagaaauugaaccuuu

SEQ ID NO: 1334006 - RNA, 19 nt, Homo sapiens
aagauaugcuguuucauga

SEQ ID NO: 1334007 - RNA, 19 nt, Homo sapiens
gaaacuguauugacugcau

SEQ ID NO: 1334008 - RNA, 19 nt, Homo sapiens
ccaaagccuugcaauacuu

SEQ ID NO: 1334009 - RNA, 19 nt, Homo sapiens
caagacacaucaucucaag

SEQ ID NO: 1334010 - RNA, 19 nt, Homo sapiens
caaacagucuucuaaucug

SEQ ID NO: 1334011 - RNA, 19 nt, Homo sapiens
gggauuacuuucaccauuc

SEQ ID NO: 1334012 - RNA, 19 nt, Homo sapiens
gaaauacaacaccuacuuc

SEQ ID NO: 1334013 - RNA, 19 nt, Homo sapiens
caugccaccucaagacaua

SEQ ID NO: 1334014 - RNA, 19 nt, Homo sapiens
gcuaugcuuucuucaaguu

SEQ ID NO: 1334015 - RNA, 19 nt, Homo sapiens
caacaaaugcacaaucugu

SEQ ID NO: 1334016 - RNA, 19 nt, Homo sapiens
cuacagacaucaagacaag

SEQ ID NO: 1334017 - RNA, 19 nt, Homo sapiens
ugaagacucugacuaacau

SEQ ID NO: 1334018 - RNA, 19 nt, Homo sapiens
uaacuucuacuucauguga

SEQ ID NO: 1334019 - RNA, 19 nt, Homo sapiens
uuacuagaguucugccaua

SEQ ID NO: 1334020 - RNA, 19 nt, Homo sapiens
aaaccaaagccuugcaaua

SEQ ID NO: 1334021 - RNA, 19 nt, Homo sapiens
caagacggcauuccuuaaa

SEQ ID NO: 1334022 - RNA, 19 nt, Homo sapiens
aaacagucuucuaaucuga

SEQ ID NO: 1334023 - RNA, 19 nt, Homo sapiens
acaaaugcacaaucuguua

SEQ ID NO: 1334024 - RNA, 19 nt, Homo sapiens
ggccaaagcucaguacaag

SEQ ID NO: 1334025 - RNA, 19 nt, Homo sapiens
aaacuguuaugccaagauu

SEQ ID NO: 1334026 - RNA, 19 nt, Homo sapiens
gaaggccugucagaacaaa

SEQ ID NO: 1334027 - RNA, 19 nt, Homo sapiens
uguacaaccuucucaaaug

SEQ ID NO: 1334028 - RNA, 19 nt, Homo sapiens
ugcacaaucuguuaucuuu

SEQ ID NO: 1334029 - RNA, 19 nt, Homo sapiens
guacaagacacauguuuag

SEQ ID NO: 1334030 - RNA, 19 nt, Homo sapiens
ggaacaauacccagaagga

SEQ ID NO: 1334031 - RNA, 19 nt, Homo sapiens
aaagaggcauuccuuagau

SEQ ID NO: 1334032 - RNA, 19 nt, Homo sapiens
gaggaacuccauagaagaa

SEQ ID NO: 1334033 - RNA, 19 nt, Homo sapiens
gccauccuuugaagaaaua

SEQ ID NO: 1334034 - RNA, 19 nt, Homo sapiens
gaaagugccaaaacuguua

SEQ ID NO: 1334035 - RNA, 19 nt, Homo sapiens
ccaaagaauggaaaucuga

SEQ ID NO: 1334036 - RNA, 19 nt, Homo sapiens
guacaaccuucucaaaugc

SEQ ID NO: 1334037 - RNA, 19 nt, Homo sapiens
gucaagacacucaagauaa

SEQ ID NO: 1334038 - RNA, 19 nt, Homo sapiens
aacaaaccaugccaucuaa

SEQ ID NO: 1334039 - RNA, 19 nt, Homo sapiens
cacaguaaccgauaagaaa

SEQ ID NO: 1334040 - RNA, 19 nt, Homo sapiens
uuaaagaccagcagacuga

SEQ ID NO: 1334041 - RNA, 19 nt, Homo sapiens
ggaagagaccaaagaaugg

SEQ ID NO: 1334042 - RNA, 19 nt, Homo sapiens
uagaaggccugucagaaca

SEQ ID NO: 1334043 - RNA, 19 nt, Homo sapiens
gcaacucacgucaucacua

SEQ ID NO: 1334044 - RNA, 19 nt, Homo sapiens
gguaauaaagguagagaau

SEQ ID NO: 1334045 - RNA, 19 nt, Homo sapiens
acucagggcuggagaaaca

SEQ ID NO: 1334046 - RNA, 19 nt, Homo sapiens
caaagccuugcaauacuua

SEQ ID NO: 1334047 - RNA, 19 nt, Homo sapiens
caaaguauccuuccaucuc

SEQ ID NO: 1334048 - RNA, 19 nt, Homo sapiens
ucacgggcaugaauguuau

SEQ ID NO: 1334049 - RNA, 19 nt, Homo sapiens
uaaagcagaaagcucuaua

SEQ ID NO: 1334050 - RNA, 19 nt, Homo sapiens
gcuggagaaacaaagauua

SEQ ID NO: 1334051 - RNA, 19 nt, Homo sapiens
ccaaauacagcaauaccaa

SEQ ID NO: 1334052 - RNA, 19 nt, Homo sapiens
aagaggcacuccguagaua

SEQ ID NO: 1334053 - RNA, 19 nt, Homo sapiens
caaagaggcacuccguaga

SEQ ID NO: 1334054 - RNA, 19 nt, Homo sapiens
ugaaauacaacaccuacuu

SEQ ID NO: 1334055 - RNA, 19 nt, Homo sapiens
uaucagcgcaugccauauu

SEQ ID NO: 1334056 - RNA, 19 nt, Homo sapiens
aaggagauauguacacuag

SEQ ID NO: 1334057 - RNA, 19 nt, Homo sapiens
aagaagcccuaaagcagaa

SEQ ID NO: 1334058 - RNA, 19 nt, Homo sapiens
gaagaagcccucagaaaau

SEQ ID NO: 1334059 - RNA, 19 nt, Homo sapiens
guagaacucuuuucauugu

SEQ ID NO: 1334060 - RNA, 19 nt, Homo sapiens
caacaagaccuucaaucca

SEQ ID NO: 1334061 - RNA, 19 nt, Homo sapiens
gaagagaccaaagaaugga

SEQ ID NO: 1334062 - RNA, 19 nt, Homo sapiens
gucaaacagucuucuaauc

SEQ ID NO: 1334063 - RNA, 19 nt, Homo sapiens
gaaggcagauuuucauucu

SEQ ID NO: 1334064 - RNA, 19 nt, Homo sapiens
ggagagguagaucaugauu

SEQ ID NO: 1334065 - RNA, 19 nt, Homo sapiens
aagagcaacucccagauca

SEQ ID NO: 1334066 - RNA, 19 nt, Homo sapiens
caagcucaacuuaaucaaa

SEQ ID NO: 1334067 - RNA, 19 nt, Homo sapiens
ccuuccaucucccaaauuu

SEQ ID NO: 1334068 - RNA, 19 nt, Homo sapiens
caacaacaaaugcacaauc

SEQ ID NO: 1334069 - RNA, 19 nt, Homo sapiens
caggauaccucacaguaac

SEQ ID NO: 1334070 - RNA, 19 nt, Homo sapiens
caacagcaaucugaagacu

SEQ ID NO: 1334071 - RNA, 19 nt, Homo sapiens
gcaaucagaagacgugaag

SEQ ID NO: 1334072 - RNA, 19 nt, Homo sapiens
uggaagagaccaaagaaug

SEQ ID NO: 1334073 - RNA, 19 nt, Homo sapiens
caacaucccaggacagaag

SEQ ID NO: 1334074 - RNA, 19 nt, Homo sapiens
caaaugcacaaucuguuau

SEQ ID NO: 1334075 - RNA, 19 nt, Homo sapiens
uaacuuaucucgcaacaaa

SEQ ID NO: 1334076 - RNA, 19 nt, Homo sapiens
gaaugaaacuuaaguagug

SEQ ID NO: 1334077 - RNA, 19 nt, Homo sapiens
gaacaaacuuaguggcaaa

SEQ ID NO: 1334078 - RNA, 19 nt, Homo sapiens
cuacagagaugguaacaaa

SEQ ID NO: 1334079 - RNA, 19 nt, Homo sapiens
gaaagacugugcguugaua

SEQ ID NO: 1334080 - RNA, 19 nt, Homo sapiens
gaaggaaaccucauuguau

SEQ ID NO: 1334081 - RNA, 19 nt, Homo sapiens
gaaaugaagcgaagccuaa

SEQ ID NO: 1334082 - RNA, 19 nt, Homo sapiens
gaacuuccgagacugauua

SEQ ID NO: 1334083 - RNA, 19 nt, Homo sapiens
ugaaaucgaucgugaacuu

SEQ ID NO: 1334084 - RNA, 19 nt, Homo sapiens
cuaauccacuuaaagauga

SEQ ID NO: 1334085 - RNA, 19 nt, Homo sapiens
caaacuuaguggcaaauga

SEQ ID NO: 1334086 - RNA, 19 nt, Homo sapiens
agaguuggcuccuguaaug

SEQ ID NO: 1334087 - RNA, 19 nt, Homo sapiens
caacaaagaaaccgagcua

SEQ ID NO: 1334088 - RNA, 19 nt, Homo sapiens
agacagccauuaacuucua

SEQ ID NO: 1334089 - RNA, 19 nt, Homo sapiens
gaacagacagccauuaacu

SEQ ID NO: 1334090 - RNA, 19 nt, Homo sapiens
gacaaacacauucaucaaa

SEQ ID NO: 1334091 - RNA, 19 nt, Homo sapiens
ugaaggaaaccucauugua

SEQ ID NO: 1334092 - RNA, 19 nt, Homo sapiens
gggaaagacugugcguuga

SEQ ID NO: 1334093 - RNA, 19 nt, Homo sapiens
auguugagaugcaguauua

SEQ ID NO: 1334094 - RNA, 19 nt, Homo sapiens
aagcgaagccuaagugaaa

SEQ ID NO: 1334095 - RNA, 19 nt, Homo sapiens
aaaguugugugucguguug

SEQ ID NO: 1334096 - RNA, 19 nt, Homo sapiens
aguauuagcuguucuugau

SEQ ID NO: 1334097 - RNA, 19 nt, Homo sapiens
aaaccgagcuacucagaca

SEQ ID NO: 1334098 - RNA, 19 nt, Homo sapiens
gcgugaacaugcacagaaa

SEQ ID NO: 1334099 - RNA, 19 nt, Homo sapiens
gacaacacccugaaggaaa

SEQ ID NO: 1334100 - RNA, 19 nt, Homo sapiens
gguuggagcuacagagaug

SEQ ID NO: 1334101 - RNA, 19 nt, Homo sapiens
ggaagaagccagggugguu

SEQ ID NO: 1334102 - RNA, 19 nt, Homo sapiens
ggagaggccuuuggaagag

SEQ ID NO: 1334103 - RNA, 19 nt, Homo sapiens
uugaaagcaugaaguauug

SEQ ID NO: 1334104 - RNA, 19 nt, Homo sapiens
gauucugucuuuaacucua

SEQ ID NO: 1334105 - RNA, 19 nt, Homo sapiens
uggcaacuaugaccagaaa

SEQ ID NO: 1334106 - RNA, 19 nt, Homo sapiens
guucuugauucagcuguua

SEQ ID NO: 1334107 - RNA, 19 nt, Homo sapiens
ucaaucaaauacuggaaga

SEQ ID NO: 1334108 - RNA, 19 nt, Homo sapiens
uaaagaugauucagguauc

SEQ ID NO: 1334109 - RNA, 19 nt, Homo sapiens
guugagaugcaguauuaua

SEQ ID NO: 1334110 - RNA, 19 nt, Homo sapiens
ccaccgcggucuagugaga

SEQ ID NO: 1334111 - RNA, 19 nt, Homo sapiens
aaggaaaccucauuguauc

SEQ ID NO: 1334112 - RNA, 19 nt, Homo sapiens
gaagcgaagccuaagugaa

SEQ ID NO: 1334113 - RNA, 19 nt, Homo sapiens
accugaaccuccuaacuua

SEQ ID NO: 1334114 - RNA, 19 nt, Homo sapiens
aaauucagcucgaaguaca

SEQ ID NO: 1334115 - RNA, 19 nt, Homo sapiens
uuggaaugcugaauagaaa

SEQ ID NO: 1334116 - RNA, 19 nt, Homo sapiens
uuuaccaucuccauaguuu

SEQ ID NO: 1334117 - RNA, 19 nt, Homo sapiens
gaaaccucauuguaucagu

SEQ ID NO: 1334118 - RNA, 19 nt, Homo sapiens
gaggaacagacagccauua

SEQ ID NO: 1334119 - RNA, 19 nt, Homo sapiens
ggaaagacugugcguugau

SEQ ID NO: 1334120 - RNA, 19 nt, Homo sapiens
acaccuggcccauauuauu

SEQ ID NO: 1334121 - RNA, 19 nt, Homo sapiens
uuacaccuggcccauauua

SEQ ID NO: 1334122 - RNA, 19 nt, Homo sapiens
gacagccauuaacuucuaa

SEQ ID NO: 1334123 - RNA, 19 nt, Homo sapiens
gcaguuauugaaagcauga

SEQ ID NO: 1334124 - RNA, 19 nt, Homo sapiens
aaaccucauuguaucaguu

SEQ ID NO: 1334125 - RNA, 19 nt, Homo sapiens
auaucuggcugcacaauga

SEQ ID NO: 1334126 - RNA, 19 nt, Homo sapiens
gaaaauucagcucgaagua

SEQ ID NO: 1334127 - RNA, 19 nt, Homo sapiens
uaaacgaacaaacuuagug

SEQ ID NO: 1334128 - RNA, 19 nt, Homo sapiens
uaauuuaccaucuccauag

SEQ ID NO: 1334129 - RNA, 19 nt, Homo sapiens
uauuagcuguucuugauuc

SEQ ID NO: 1334130 - RNA, 19 nt, Homo sapiens
caguuacaguuuaaggaaa

SEQ ID NO: 1334131 - RNA, 19 nt, Homo sapiens
caaagaaaccgagcuacuc

SEQ ID NO: 1334132 - RNA, 19 nt, Homo sapiens
ccucugagaagucaagauu

SEQ ID NO: 1334133 - RNA, 19 nt, Homo sapiens
cuacucagacaaacacauu

SEQ ID NO: 1334134 - RNA, 19 nt, Homo sapiens
aaagaaaccgagcuacuca

SEQ ID NO: 1334135 - RNA, 19 nt, Homo sapiens
acagacagccauuaacuuc

SEQ ID NO: 1334136 - RNA, 19 nt, Homo sapiens
gaaaguugugugucguguu

SEQ ID NO: 1334137 - RNA, 19 nt, Homo sapiens
aaaauacucugccuugugu

SEQ ID NO: 1334138 - RNA, 19 nt, Homo sapiens
uguuacaccuggcccauau

SEQ ID NO: 1334139 - RNA, 19 nt, Homo sapiens
aaugagagggcuagacaaa

SEQ ID NO: 1334140 - RNA, 19 nt, Homo sapiens
cuucuaauccacuuaaaga

SEQ ID NO: 1334141 - RNA, 19 nt, Homo sapiens
ggacuggagccucuucucu

SEQ ID NO: 1334142 - RNA, 19 nt, Homo sapiens
gaccggcgucuguuucuga

SEQ ID NO: 1334143 - RNA, 19 nt, Homo sapiens
ucaguuacaguuuaaggaa

SEQ ID NO: 1334144 - RNA, 19 nt, Homo sapiens
aaacagugcacuacagaca

SEQ ID NO: 1334145 - RNA, 19 nt, Homo sapiens
agacaaacacauucaucaa

SEQ ID NO: 1334146 - RNA, 19 nt, Homo sapiens
cagacaaacacauucauca

SEQ ID NO: 1334147 - RNA, 19 nt, Homo sapiens
ggagcuacagagaugguaa

SEQ ID NO: 1334148 - RNA, 19 nt, Homo sapiens
caaauaccacauucagcuu

SEQ ID NO: 1334149 - RNA, 19 nt, Homo sapiens
gauuagaggccgaguucau

SEQ ID NO: 1334150 - RNA, 19 nt, Homo sapiens
gauauugaaggaaaugaag

SEQ ID NO: 1334151 - RNA, 19 nt, Homo sapiens
uaccugaaccuccuaacuu

SEQ ID NO: 1334152 - RNA, 19 nt, Homo sapiens
caauguaaacgaacaaacu

SEQ ID NO: 1334153 - RNA, 19 nt, Homo sapiens
guuggcuccuguaaugaaa

SEQ ID NO: 1334154 - RNA, 19 nt, Homo sapiens
gaauaccugaaccuccuaa

SEQ ID NO: 1334155 - RNA, 19 nt, Homo sapiens
uucgggagcucaacaacaa

SEQ ID NO: 1334156 - RNA, 19 nt, Homo sapiens
aaacuuaguggcaaaugau

SEQ ID NO: 1334157 - RNA, 19 nt, Homo sapiens
ggaaacugagggcgaaagu

SEQ ID NO: 1334158 - RNA, 19 nt, Homo sapiens
gaaguauuagcuguucuug

SEQ ID NO: 1334159 - RNA, 19 nt, Homo sapiens
gauguugagaugcaguauu

SEQ ID NO: 1334160 - RNA, 19 nt, Homo sapiens
aauugcagauguugagaug

SEQ ID NO: 1334161 - RNA, 19 nt, Homo sapiens
gaggccgaguucauagaug

SEQ ID NO: 1334162 - RNA, 19 nt, Homo sapiens
gaaaucgaucgugaacuuc

SEQ ID NO: 1334163 - RNA, 19 nt, Homo sapiens
agacaacacccugaaggaa

SEQ ID NO: 1334164 - RNA, 19 nt, Homo sapiens
cagaagacaacacccugaa

SEQ ID NO: 1334165 - RNA, 19 nt, Homo sapiens
aagccucaauguaaacgaa

SEQ ID NO: 1334166 - RNA, 19 nt, Homo sapiens
ggacaccgggcaaauacca

SEQ ID NO: 1334167 - RNA, 19 nt, Homo sapiens
aggaacagacagccauuaa

SEQ ID NO: 1334168 - RNA, 19 nt, Homo sapiens
caugaaguauuggcgugaa

SEQ ID NO: 1334169 - RNA, 19 nt, Homo sapiens
caauuaagaauaccugaac

SEQ ID NO: 1334170 - RNA, 19 nt, Homo sapiens
ucuaauccacuuaaagaug

SEQ ID NO: 1334171 - RNA, 19 nt, Homo sapiens
uacucugccuugugucuuu

SEQ ID NO: 1334172 - RNA, 19 nt, Homo sapiens
gggcaaauaccacauucag

SEQ ID NO: 1334173 - RNA, 19 nt, Homo sapiens
ccagaguuggcuccuguaa

SEQ ID NO: 1334174 - RNA, 19 nt, Homo sapiens
ccauauuauucgaagacuu

SEQ ID NO: 1334175 - RNA, 19 nt, Homo sapiens
gcagaaagguggagaccaa

SEQ ID NO: 1334176 - RNA, 19 nt, Homo sapiens
ucaccaagcuucuauuuau

SEQ ID NO: 1334177 - RNA, 19 nt, Homo sapiens
gaagaggauucucccauug

SEQ ID NO: 1334178 - RNA, 19 nt, Homo sapiens
gaauucaaccuguuucuug

SEQ ID NO: 1334179 - RNA, 19 nt, Homo sapiens
aaauggaggugaugagaaa

SEQ ID NO: 1334180 - RNA, 19 nt, Homo sapiens
gaagcccugucucagauuu

SEQ ID NO: 1334181 - RNA, 19 nt, Homo sapiens
gagcauguguagaaauguu

SEQ ID NO: 1334182 - RNA, 19 nt, Homo sapiens
gagaagugguaauaggaaa

SEQ ID NO: 1334183 - RNA, 19 nt, Homo sapiens
ccagguaugugaccacuau

SEQ ID NO: 1334184 - RNA, 19 nt, Homo sapiens
ugaagaggauucucccauu

SEQ ID NO: 1334185 - RNA, 19 nt, Homo sapiens
ggagagacgucuacaaagc

SEQ ID NO: 1334186 - RNA, 19 nt, Homo sapiens
guagaaauguugucaucau

SEQ ID NO: 1334187 - RNA, 19 nt, Homo sapiens
acaaagagaagugguaaua

SEQ ID NO: 1334188 - RNA, 19 nt, Homo sapiens
gagcuggccuagcaagaug

SEQ ID NO: 1334189 - RNA, 19 nt, Homo sapiens
gaugagagacacaaagaga

SEQ ID NO: 1334190 - RNA, 19 nt, Homo sapiens
gaaguuaguacagaagaaa

SEQ ID NO: 1334191 - RNA, 19 nt, Homo sapiens
agaaagacuuggaggaaau

SEQ ID NO: 1334192 - RNA, 19 nt, Homo sapiens
gaagacagcaucccuugca

SEQ ID NO: 1334193 - RNA, 19 nt, Homo sapiens
gaacagcucagggaaagau

SEQ ID NO: 1334194 - RNA, 19 nt, Homo sapiens
uagaaagacuuggaggaaa

SEQ ID NO: 1334195 - RNA, 19 nt, Homo sapiens
aaagagaagugguaauagg

SEQ ID NO: 1334196 - RNA, 19 nt, Homo sapiens
gaaagguggugggagaaag

SEQ ID NO: 1334197 - RNA, 19 nt, Homo sapiens
ggaaguaggaccagagaag

SEQ ID NO: 1334198 - RNA, 19 nt, Homo sapiens
agaauagagucaucucaug

SEQ ID NO: 1334199 - RNA, 19 nt, Homo sapiens
cucaggagauucgaaguua

SEQ ID NO: 1334200 - RNA, 19 nt, Homo sapiens
gaaaguaaagccaugaaaa

SEQ ID NO: 1334201 - RNA, 19 nt, Homo sapiens
gaaagguggagaccaacaa

SEQ ID NO: 1334202 - RNA, 19 nt, Homo sapiens
gugaagcccugucucagau

SEQ ID NO: 1334203 - RNA, 19 nt, Homo sapiens
gaaaucaaagaagacagua

SEQ ID NO: 1334204 - RNA, 19 nt, Homo sapiens
uggaggaaaucaaagaaga

SEQ ID NO: 1334205 - RNA, 19 nt, Homo sapiens
ccaagcuucuauuuaucua

SEQ ID NO: 1334206 - RNA, 19 nt, Homo sapiens
gagagaugcucaccaagcu

SEQ ID NO: 1334207 - RNA, 19 nt, Homo sapiens
aaacggaagagacuuggua

SEQ ID NO: 1334208 - RNA, 19 nt, Homo sapiens
cgaaguuaguacagaagaa

SEQ ID NO: 1334209 - RNA, 19 nt, Homo sapiens
ggaaaucaaagaagacagu

SEQ ID NO: 1334210 - RNA, 19 nt, Homo sapiens
gcucaccaagcuucuauuu

SEQ ID NO: 1334211 - RNA, 19 nt, Homo sapiens
gguaauaggaaacggaaga

SEQ ID NO: 1334212 - RNA, 19 nt, Homo sapiens
caagaacagcucagggaaa

SEQ ID NO: 1334213 - RNA, 19 nt, Homo sapiens
cagcagaaccaguugaguu

SEQ ID NO: 1334214 - RNA, 19 nt, Homo sapiens
cccaagagaugaaggaaag

SEQ ID NO: 1334215 - RNA, 19 nt, Homo sapiens
cagaaccaguugaguuuca

SEQ ID NO: 1334216 - RNA, 19 nt, Homo sapiens
aagaugugcucucagaaug

SEQ ID NO: 1334217 - RNA, 19 nt, Homo sapiens
caagaugugcucucagaau

SEQ ID NO: 1334218 - RNA, 19 nt, Homo sapiens
gaagaauagagucaucuca

SEQ ID NO: 1334219 - RNA, 19 nt, Homo sapiens
caccaaagacccuaggauu

SEQ ID NO: 1334220 - RNA, 19 nt, Homo sapiens
gagauaaggaggacaagag

SEQ ID NO: 1334221 - RNA, 19 nt, Homo sapiens
ccacauagaaagacuugga

SEQ ID NO: 1334222 - RNA, 19 nt, Homo sapiens
caacaccacuuugcagcau

SEQ ID NO: 1334223 - RNA, 19 nt, Homo sapiens
guacggagagugggaaaga

SEQ ID NO: 1334224 - RNA, 19 nt, Homo sapiens
guguagaaauguugucauc

SEQ ID NO: 1334225 - RNA, 19 nt, Homo sapiens
gggcagaaccagacaugga

SEQ ID NO: 1334226 - RNA, 19 nt, Homo sapiens
gauccgacugguucaaauu

SEQ ID NO: 1334227 - RNA, 19 nt, Homo sapiens
ggauccgacugguucaaau

SEQ ID NO: 1334228 - RNA, 19 nt, Homo sapiens
ggaauuggagagacgucua

SEQ ID NO: 1334229 - RNA, 19 nt, Homo sapiens
ccaaagacccuaggauucu

SEQ ID NO: 1334230 - RNA, 19 nt, Homo sapiens
gaaccagacauggaacaga

SEQ ID NO: 1334231 - RNA, 19 nt, Homo sapiens
agacuuggaggaaaucaaa

SEQ ID NO: 1334232 - RNA, 19 nt, Homo sapiens
ggauggagaguaggagaaa

SEQ ID NO: 1334233 - RNA, 19 nt, Homo sapiens
gucacaagauccuauccaa

SEQ ID NO: 1334234 - RNA, 19 nt, Homo sapiens
gacacaaagagaaguggua

SEQ ID NO: 1334235 - RNA, 19 nt, Homo sapiens
gaaguaggaccagagaagu

SEQ ID NO: 1334236 - RNA, 19 nt, Homo sapiens
aagaacagcucagggaaag

SEQ ID NO: 1334237 - RNA, 19 nt, Homo sapiens
gauaaggaggacaagagaa

SEQ ID NO: 1334238 - RNA, 19 nt, Homo sapiens
cugagcauguguagaaaug

SEQ ID NO: 1334239 - RNA, 19 nt, Homo sapiens
aaacugcaaccaaggaaga

SEQ ID NO: 1334240 - RNA, 19 nt, Homo sapiens
gauucgaaguuaguacaga

SEQ ID NO: 1334241 - RNA, 19 nt, Homo sapiens
gcaacuucauccaggucaa

SEQ ID NO: 1334242 - RNA, 19 nt, Homo sapiens
acagagaucccgggacaaa

SEQ ID NO: 1334243 - RNA, 19 nt, Homo sapiens
agacuugguagacgagaua

SEQ ID NO: 1334244 - RNA, 19 nt, Homo sapiens
gaccagagaaguggaagga

SEQ ID NO: 1334245 - RNA, 19 nt, Homo sapiens
gaaggaaaggagugaaagg

SEQ ID NO: 1334246 - RNA, 19 nt, Homo sapiens
ggcagaaccagacauggaa

SEQ ID NO: 1334247 - RNA, 19 nt, Homo sapiens
ugucaucauuuccacauag

SEQ ID NO: 1334248 - RNA, 19 nt, Homo sapiens
ugaaaguaaagccaugaaa

SEQ ID NO: 1334249 - RNA, 19 nt, Homo sapiens
caccaagcuucuauuuauc

SEQ ID NO: 1334250 - RNA, 19 nt, Homo sapiens
acacaaagagaagugguaa

SEQ ID NO: 1334251 - RNA, 19 nt, Homo sapiens
gcaagaugugcucucagaa

SEQ ID NO: 1334252 - RNA, 19 nt, Homo sapiens
ggagggcuucauucacgua

SEQ ID NO: 1334253 - RNA, 19 nt, Homo sapiens
gagauucgaaguuaguaca

SEQ ID NO: 1334254 - RNA, 19 nt, Homo sapiens
caaagagaagugguaauag

SEQ ID NO: 1334255 - RNA, 19 nt, Homo sapiens
caacuucauccaggucaaa

SEQ ID NO: 1334256 - RNA, 19 nt, Homo sapiens
ccacugcaccucggcauau

SEQ ID NO: 1334257 - RNA, 19 nt, Homo sapiens
gaaagacuuggaggaaauc

SEQ ID NO: 1334258 - RNA, 19 nt, Homo sapiens
gacccuaggauucuuguca

SEQ ID NO: 1334259 - RNA, 19 nt, Homo sapiens
acucauggccagugucaaa

SEQ ID NO: 1334260 - RNA, 19 nt, Homo sapiens
ccaaggaagaauagaguca

SEQ ID NO: 1334261 - RNA, 19 nt, Homo sapiens
agagacgucuacaaagcuu

SEQ ID NO: 1334262 - RNA, 19 nt, Homo sapiens
uuggagagacgucuacaaa

SEQ ID NO: 1334263 - RNA, 19 nt, Homo sapiens
aaccuucccuucccugaau

SEQ ID NO: 1334264 - RNA, 19 nt, Homo sapiens
agagaucccgggacaaaug

SEQ ID NO: 1334265 - RNA, 19 nt, Homo sapiens
caaagaagacaguaaaagu

SEQ ID NO: 1334266 - RNA, 19 nt, Homo sapiens
ggagagugggaaagagaga

SEQ ID NO: 1334267 - RNA, 19 nt, Homo sapiens
gucaucauuuccacauaga

SEQ ID NO: 1334268 - RNA, 19 nt, Homo sapiens
cugagaagauuuauuaccu

SEQ ID NO: 1334269 - RNA, 19 nt, Homo sapiens
gagacuugguagacgagau

SEQ ID NO: 1334270 - RNA, 19 nt, Homo sapiens
agaaguggaaggaagcaaa

SEQ ID NO: 1334271 - RNA, 19 nt, Homo sapiens
cagagccuuuccagcugua

SEQ ID NO: 1334272 - RNA, 19 nt, Homo sapiens
gaggaaaucaaagaagaca

SEQ ID NO: 1334273 - RNA, 19 nt, Homo sapiens
caaccaaggaagaauagag

SEQ ID NO: 1334274 - RNA, 19 nt, Homo sapiens
caaaaggggcuguccauca

SEQ ID NO: 1334275 - RNA, 19 nt, Homo sapiens
ggaaaucucuucagcagaa

SEQ ID NO: 1334276 - RNA, 19 nt, Homo sapiens
ucacagaacugcuuuacaa

SEQ ID NO: 1334277 - RNA, 19 nt, Homo sapiens
gaaaccagaaugaauguua

SEQ ID NO: 1334278 - RNA, 19 nt, Homo sapiens
ugacagaacuggaaauuca

SEQ ID NO: 1334279 - RNA, 19 nt, Homo sapiens
cagagaaagugcccaguua

SEQ ID NO: 1334280 - RNA, 19 nt, Homo sapiens
gaaaggcauccaacaaaua

SEQ ID NO: 1334281 - RNA, 19 nt, Homo sapiens
gaagaaacguaaccaucaa

SEQ ID NO: 1334282 - RNA, 19 nt, Homo sapiens
gcacaacgacuaaagauau

SEQ ID NO: 1334283 - RNA, 19 nt, Homo sapiens
ggaaaggcauccaacaaau

SEQ ID NO: 1334284 - RNA, 19 nt, Homo sapiens
aaagauauccucucuauga

SEQ ID NO: 1334285 - RNA, 19 nt, Homo sapiens
cuaaagauauccucucuau

SEQ ID NO: 1334286 - RNA, 19 nt, Homo sapiens
agaaguaacucgacuauag

SEQ ID NO: 1334287 - RNA, 19 nt, Homo sapiens
gaaggaccauuucauuugu

SEQ ID NO: 1334288 - RNA, 19 nt, Homo sapiens
gcaguugacuauuauuuca

SEQ ID NO: 1334289 - RNA, 19 nt, Homo sapiens
gagaaggaccauuucauuu

SEQ ID NO: 1334290 - RNA, 19 nt, Homo sapiens
ggaaaagacugacuuguau

SEQ ID NO: 1334291 - RNA, 19 nt, Homo sapiens
ccucagugcuaccaaguua

SEQ ID NO: 1334292 - RNA, 19 nt, Homo sapiens
guaaagaaaucacagaacu

SEQ ID NO: 1334293 - RNA, 19 nt, Homo sapiens
caacaauauuuacggcuuu

SEQ ID NO: 1334294 - RNA, 19 nt, Homo sapiens
gaacugcuuuacaaacuca

SEQ ID NO: 1334295 - RNA, 19 nt, Homo sapiens
auaagaagcuaaucaccua

SEQ ID NO: 1334296 - RNA, 19 nt, Homo sapiens
guacacacuucacaccaaa

SEQ ID NO: 1334297 - RNA, 19 nt, Homo sapiens
ugaaagauguacacacuuc

SEQ ID NO: 1334298 - RNA, 19 nt, Homo sapiens
gaagaaguaacucgacuau

SEQ ID NO: 1334299 - RNA, 19 nt, Homo sapiens
gaaguaacucgacuauaga

SEQ ID NO: 1334300 - RNA, 19 nt, Homo sapiens
ucuaagauguuaucaggaa

SEQ ID NO: 1334301 - RNA, 19 nt, Homo sapiens
gauauccucucuaugaaag

SEQ ID NO: 1334302 - RNA, 19 nt, Homo sapiens
gaagacaucaaggcauuaa

SEQ ID NO: 1334303 - RNA, 19 nt, Homo sapiens
aagaagacaucaaggcauu

SEQ ID NO: 1334304 - RNA, 19 nt, Homo sapiens
uccaugcaguugacuauua

SEQ ID NO: 1334305 - RNA, 19 nt, Homo sapiens
guacauggaucaagcuaac

SEQ ID NO: 1334306 - RNA, 19 nt, Homo sapiens
gacaaacaaugcacaacga

SEQ ID NO: 1334307 - RNA, 19 nt, Homo sapiens
gaaaucacagaacugcuuu

SEQ ID NO: 1334308 - RNA, 19 nt, Homo sapiens
gaaggugacagaacuggaa

SEQ ID NO: 1334309 - RNA, 19 nt, Homo sapiens
uaaagaagaaggugacaga

SEQ ID NO: 1334310 - RNA, 19 nt, Homo sapiens
gauacauugucuagagauu

SEQ ID NO: 1334311 - RNA, 19 nt, Homo sapiens
caacaaauaguaagagaag

SEQ ID NO: 1334312 - RNA, 19 nt, Homo sapiens
ugguugggcugcucuauaa

SEQ ID NO: 1334313 - RNA, 19 nt, Homo sapiens
gcuaaucaccuaacagugu

SEQ ID NO: 1334314 - RNA, 19 nt, Homo sapiens
caugaaagauguacacacu

SEQ ID NO: 1334315 - RNA, 19 nt, Homo sapiens
agaguuauguucugcuuug

SEQ ID NO: 1334316 - RNA, 19 nt, Homo sapiens
cuaccaaguuagaagaauu

SEQ ID NO: 1334317 - RNA, 19 nt, Homo sapiens
ccacugaccaucuugagaa

SEQ ID NO: 1334318 - RNA, 19 nt, Homo sapiens
gaagacaaacaaugcacaa

SEQ ID NO: 1334319 - RNA, 19 nt, Homo sapiens
aagacugacuuguaucaaa

SEQ ID NO: 1334320 - RNA, 19 nt, Homo sapiens
caaguuagaagaauucauc

SEQ ID NO: 1334321 - RNA, 19 nt, Homo sapiens
aaacaaugcacaacgacua

SEQ ID NO: 1334322 - RNA, 19 nt, Homo sapiens
cuucaaaucucuccaaggu

SEQ ID NO: 1334323 - RNA, 19 nt, Homo sapiens
ugaagaaacguaaccauca

SEQ ID NO: 1334324 - RNA, 19 nt, Homo sapiens
ccagaaugaauguuaauga

SEQ ID NO: 1334325 - RNA, 19 nt, Homo sapiens
agaaggaccauuucauuug

SEQ ID NO: 1334326 - RNA, 19 nt, Homo sapiens
ccagagauacuguccauuc

SEQ ID NO: 1334327 - RNA, 19 nt, Homo sapiens
guagugcuccaagauguua

SEQ ID NO: 1334328 - RNA, 19 nt, Homo sapiens
cagagauacuguccauuca

SEQ ID NO: 1334329 - RNA, 19 nt, Homo sapiens
ccaugcaguugacuauuau

SEQ ID NO: 1334330 - RNA, 19 nt, Homo sapiens
agaagaaggugacagaacu

SEQ ID NO: 1334331 - RNA, 19 nt, Homo sapiens
ucaaggcauuaaagaagaa

SEQ ID NO: 1334332 - RNA, 19 nt, Homo sapiens
aaaugaaucuuccaguagu

SEQ ID NO: 1334333 - RNA, 19 nt, Homo sapiens
uaccacaaauguaagauuc

SEQ ID NO: 1334334 - RNA, 19 nt, Homo sapiens
gauguggacuucaaaucuc

SEQ ID NO: 1334335 - RNA, 19 nt, Homo sapiens
gagauacuguccauucacu

SEQ ID NO: 1334336 - RNA, 19 nt, Homo sapiens
ugaaagauuccaugcaguu

SEQ ID NO: 1334337 - RNA, 19 nt, Homo sapiens
cuacagacauggaaaucuc

SEQ ID NO: 1334338 - RNA, 19 nt, Homo sapiens
cagaacugcuuuacaaacu

SEQ ID NO: 1334339 - RNA, 19 nt, Homo sapiens
caccuugccucuuguuuca

SEQ ID NO: 1334340 - RNA, 19 nt, Homo sapiens
agagaaggaccauuucauu

SEQ ID NO: 1334341 - RNA, 19 nt, Homo sapiens
gaaagauuccaugcaguug

SEQ ID NO: 1334342 - RNA, 19 nt, Homo sapiens
gacuaaagauauccucucu

SEQ ID NO: 1334343 - RNA, 19 nt, Homo sapiens
ccagaguguucuaagaugu

SEQ ID NO: 1334344 - RNA, 19 nt, Homo sapiens
uccaacaccuugccucuug

SEQ ID NO: 1334345 - RNA, 19 nt, Homo sapiens
ggagaaagggguaaagaaa

SEQ ID NO: 1334346 - RNA, 19 nt, Homo sapiens
gaauuccugcuccacgaua

SEQ ID NO: 1334347 - RNA, 19 nt, Homo sapiens
agaguguucuaagauguua

SEQ ID NO: 1334348 - RNA, 19 nt, Homo sapiens
aguaagagaaggaccauuu

SEQ ID NO: 1334349 - RNA, 19 nt, Homo sapiens
ggcuuuauuuguuccuuaa

SEQ ID NO: 1334350 - RNA, 19 nt, Homo sapiens
caaucugucucuccaucuu

SEQ ID NO: 1334351 - RNA, 19 nt, Homo sapiens
gagaaagugcccaguuauc

SEQ ID NO: 1334352 - RNA, 19 nt, Homo sapiens
cagcagaaccagagaaagu

SEQ ID NO: 1334353 - RNA, 19 nt, Homo sapiens
caacucugaagaacacuuu

SEQ ID NO: 1334354 - RNA, 19 nt, Homo sapiens
caucaaggcauuaaagaag

SEQ ID NO: 1334355 - RNA, 19 nt, Homo sapiens
cggcuuuauuuguuccuua

SEQ ID NO: 1334356 - RNA, 19 nt, Homo sapiens
gcaaagccaaauauuuaca

SEQ ID NO: 1334357 - RNA, 19 nt, Homo sapiens
cagcaacucugaagaacac

SEQ ID NO: 1334358 - RNA, 19 nt, Homo sapiens
aagauauccucucuaugaa

SEQ ID NO: 1334359 - RNA, 19 nt, Homo sapiens
caguagugcuccaagaugu

SEQ ID NO: 1334360 - RNA, 19 nt, Homo sapiens
guuauguucugcuuugcuu

SEQ ID NO: 1334361 - RNA, 19 nt, Homo sapiens
gagcuugaccacaaucugu

SEQ ID NO: 1334362 - RNA, 19 nt, Homo sapiens
gaacuuuucagccaaauga

SEQ ID NO: 1334363 - RNA, 19 nt, Homo sapiens
ggacuucaaaucucuccaa

SEQ ID NO: 1334364 - RNA, 19 nt, Homo sapiens
ggucauaacccagagauac

SEQ ID NO: 1334365 - RNA, 19 nt, Homo sapiens
aaaguccacugaccaucuu

SEQ ID NO: 1334366 - RNA, 19 nt, Homo sapiens
gaaagugcccaguuaucca

SEQ ID NO: 1334367 - RNA, 19 nt, Homo sapiens
cacgauacauugucuagag

SEQ ID NO: 1334368 - RNA, 19 nt, Homo sapiens
uccaguggcuucuuucuag

SEQ ID NO: 1334369 - RNA, 19 nt, Homo sapiens
gacaucaaggcauuaaaga

SEQ ID NO: 1334370 - RNA, 19 nt, Homo sapiens
gaaagauguacacacuuca

SEQ ID NO: 1334371 - RNA, 19 nt, Homo sapiens
caggaaaggcauccaacaa

SEQ ID NO: 1334372 - RNA, 19 nt, Homo sapiens
ccagagaaagugcccaguu

SEQ ID NO: 1334373 - RNA, 19 nt, Homo sapiens
aggcagauguggacuucaa

SEQ ID NO: 1334374 - RNA, 19 nt, Homo sapiens
ggaucaagcuaacuuuugu

SEQ ID NO: 1334375 - RNA, 19 nt, Homo sapiens
ggagcaagcuugauuuaua

SEQ ID NO: 1334376 - RNA, 19 nt, Homo sapiens
ggaaaaggcugcagcauuu

SEQ ID NO: 1334377 - RNA, 19 nt, Homo sapiens
aaacaaggcuggaggaaug

SEQ ID NO: 1334378 - RNA, 19 nt, Homo sapiens
gagcaagcuugauuuauau

SEQ ID NO: 1334379 - RNA, 19 nt, Homo sapiens
gcaucgagguggauaauau

SEQ ID NO: 1334380 - RNA, 19 nt, Homo sapiens
aagaagauccgcagucuaa

SEQ ID NO: 1334381 - RNA, 19 nt, Homo sapiens
ggaacugcuucauccauug

SEQ ID NO: 1334382 - RNA, 19 nt, Homo sapiens
ccauagcagugccagauuu

SEQ ID NO: 1334383 - RNA, 19 nt, Homo sapiens
gaaccugggucgacucaac

SEQ ID NO: 1334384 - RNA, 19 nt, Homo sapiens
guuaaagacugaauuacag

SEQ ID NO: 1334385 - RNA, 19 nt, Homo sapiens
cgagguggauaauauuaau

SEQ ID NO: 1334386 - RNA, 19 nt, Homo sapiens
caucacagcccuuggauca

SEQ ID NO: 1334387 - RNA, 19 nt, Homo sapiens
agacugaauuacagaaaga

SEQ ID NO: 1334388 - RNA, 19 nt, Homo sapiens
acucaaccauguagccaua

SEQ ID NO: 1334389 - RNA, 19 nt, Homo sapiens
gaagauccgcagucuaagu

SEQ ID NO: 1334390 - RNA, 19 nt, Homo sapiens
cagcugugauggauuugaa

SEQ ID NO: 1334391 - RNA, 19 nt, Homo sapiens
gauccgcagucuaagugaa

SEQ ID NO: 1334392 - RNA, 19 nt, Homo sapiens
cauggaguaucuguuguuu

SEQ ID NO: 1334393 - RNA, 19 nt, Homo sapiens
ggaacuggagcaagcuuga

SEQ ID NO: 1334394 - RNA, 19 nt, Homo sapiens
augcagcugugauggauuu

SEQ ID NO: 1334395 - RNA, 19 nt, Homo sapiens
uaaugcagcugugauggau

SEQ ID NO: 1334396 - RNA, 19 nt, Homo sapiens
gaaauaccaagauggaacu

SEQ ID NO: 1334397 - RNA, 19 nt, Homo sapiens
ccacaucacagcccuugga

SEQ ID NO: 1334398 - RNA, 19 nt, Homo sapiens
acaguccaauugcagguuu

SEQ ID NO: 1334399 - RNA, 19 nt, Homo sapiens
ucacugcuuccaucaugua

SEQ ID NO: 1334400 - RNA, 19 nt, Homo sapiens
acuaugacauugaguccuu

SEQ ID NO: 1334401 - RNA, 19 nt, Homo sapiens
cuucacugcuuccaucaug

SEQ ID NO: 1334402 - RNA, 19 nt, Homo sapiens
gcgaaugccguagggcuuu

SEQ ID NO: 1334403 - RNA, 19 nt, Homo sapiens
ggaggaaugcaucacaucu

SEQ ID NO: 1334404 - RNA, 19 nt, Homo sapiens
gaacugcuucauccauugg

SEQ ID NO: 1334405 - RNA, 19 nt, Homo sapiens
caaaauaggagcacaugga

SEQ ID NO: 1334406 - RNA, 19 nt, Homo sapiens
caucgagguggauaauauu

SEQ ID NO: 1334407 - RNA, 19 nt, Homo sapiens
ccugggaaauaccaagaug

SEQ ID NO: 1334408 - RNA, 19 nt, Homo sapiens
gcucccauuccaacaguaa

SEQ ID NO: 1334409 - RNA, 19 nt, Homo sapiens
gcacauggaaaaccaguga

SEQ ID NO: 1334410 - RNA, 19 nt, Homo sapiens
cuucauccauugggacuug

SEQ ID NO: 1334411 - RNA, 19 nt, Homo sapiens
gaggaaugcaucacaucug

SEQ ID NO: 1334412 - RNA, 19 nt, Homo sapiens
gcagugccagauuuggaaa

SEQ ID NO: 1334413 - RNA, 19 nt, Homo sapiens
cuggagcaagcuugauuua

SEQ ID NO: 1334414 - RNA, 19 nt, Homo sapiens
gaacuggagcaagcuugau

SEQ ID NO: 1334415 - RNA, 19 nt, Homo sapiens
gagcuucuuccacaucaca

SEQ ID NO: 1334416 - RNA, 19 nt, Homo sapiens
gugaagaggucaaaauagg

SEQ ID NO: 1334417 - RNA, 19 nt, Homo sapiens
cauagcagugccagauuug

SEQ ID NO: 1334418 - RNA, 19 nt, Homo sapiens
aaagaagauccgcagucua

SEQ ID NO: 1334419 - RNA, 19 nt, Homo sapiens
aagacugaauuacagaaag

SEQ ID NO: 1334420 - RNA, 19 nt, Homo sapiens
ucgagguggauaauauuaa

SEQ ID NO: 1334421 - RNA, 19 nt, Homo sapiens
gagguggauaauauuaaug

SEQ ID NO: 1334422 - RNA, 19 nt, Homo sapiens
gggaaauaccaagauggaa

SEQ ID NO: 1334423 - RNA, 19 nt, Homo sapiens
uagcagugccagauuugga

SEQ ID NO: 1334424 - RNA, 19 nt, Homo sapiens
ggucgacucaaccauguag

SEQ ID NO: 1334425 - RNA, 19 nt, Homo sapiens
gaaagaaucucuccacuuc

SEQ ID NO: 1334426 - RNA, 19 nt, Homo sapiens
gcacagaacaucaauggua

SEQ ID NO: 1334427 - RNA, 19 nt, Homo sapiens
gaacaucaaugguaagaca

SEQ ID NO: 1334428 - RNA, 19 nt, Homo sapiens
ggaaguaggauucaugaua

SEQ ID NO: 1334429 - RNA, 19 nt, Homo sapiens
ucacagaucuucauaguca

SEQ ID NO: 1334430 - RNA, 19 nt, Homo sapiens
gaaguaggauucaugauag

SEQ ID NO: 1334431 - RNA, 19 nt, Homo sapiens
cacaagagcuguuccauuc

SEQ ID NO: 1334432 - RNA, 19 nt, Homo sapiens
gaauccagaucuugacuug

SEQ ID NO: 1334433 - RNA, 19 nt, Homo sapiens
gaaguucacucccacucaa

SEQ ID NO: 1334434 - RNA, 19 nt, Homo sapiens
gaggacacuuuauaagaaa

SEQ ID NO: 1334435 - RNA, 19 nt, Homo sapiens
ugaggacacuuuauaagaa

SEQ ID NO: 1334436 - RNA, 19 nt, Homo sapiens
gcacagcauugcagccauu

SEQ ID NO: 1334437 - RNA, 19 nt, Homo sapiens
ggacagcaaucagaccauu

SEQ ID NO: 1334438 - RNA, 19 nt, Homo sapiens
cagcaagucauucgaguua

SEQ ID NO: 1334439 - RNA, 19 nt, Homo sapiens
gcccagcaguguaugauuu

SEQ ID NO: 1334440 - RNA, 19 nt, Homo sapiens
gccaauauauucucuaugg

SEQ ID NO: 1334441 - RNA, 19 nt, Homo sapiens
gagcagcaaagaauagaua

SEQ ID NO: 1334442 - RNA, 19 nt, Homo sapiens
gcaagucauucgaguuaau

SEQ ID NO: 1334443 - RNA, 19 nt, Homo sapiens
gagcagaagaggauccaua

SEQ ID NO: 1334444 - RNA, 19 nt, Homo sapiens
gaaggcagcaugagagaga

SEQ ID NO: 1334445 - RNA, 19 nt, Homo sapiens
caacuacggcuccuagaaa

SEQ ID NO: 1334446 - RNA, 19 nt, Homo sapiens
gcugcguacuuaugucuua

SEQ ID NO: 1334447 - RNA, 19 nt, Homo sapiens
gaugucugcugcguacuua

SEQ ID NO: 1334448 - RNA, 19 nt, Homo sapiens
cacagaacaucaaugguaa

SEQ ID NO: 1334449 - RNA, 19 nt, Homo sapiens
uagaaacuguccauccuuu

SEQ ID NO: 1334450 - RNA, 19 nt, Homo sapiens
caugauaggccaauauauu

SEQ ID NO: 1334451 - RNA, 19 nt, Homo sapiens
gcggacagcuccauguuca

SEQ ID NO: 1334452 - RNA, 19 nt, Homo sapiens
uaaagucccucugaaagga

SEQ ID NO: 1334453 - RNA, 19 nt, Homo sapiens
gaugaugcauucccuaucu

SEQ ID NO: 1334454 - RNA, 19 nt, Homo sapiens
gaugaacagucagcauuug

SEQ ID NO: 1334455 - RNA, 19 nt, Homo sapiens
ggacuggucugagaaggau

SEQ ID NO: 1334456 - RNA, 19 nt, Homo sapiens
gcagccagguugcaacaau

SEQ ID NO: 1334457 - RNA, 19 nt, Homo sapiens
gaggaugucugggaugaug

SEQ ID NO: 1334458 - RNA, 19 nt, Homo sapiens
agaagaggauccauaaagu

SEQ ID NO: 1334459 - RNA, 19 nt, Homo sapiens
ggaggagcagcaaagaaua

SEQ ID NO: 1334460 - RNA, 19 nt, Homo sapiens
cagccagguugcaacaaua

SEQ ID NO: 1334461 - RNA, 19 nt, Homo sapiens
ucauuuggccugcagaaua

SEQ ID NO: 1334462 - RNA, 19 nt, Homo sapiens
gaauagcuccugcuuggau

SEQ ID NO: 1334463 - RNA, 19 nt, Homo sapiens
aagaaucucuccacuucaa

SEQ ID NO: 1334464 - RNA, 19 nt, Homo sapiens
caagagcuguuccauucug

SEQ ID NO: 1334465 - RNA, 19 nt, Homo sapiens
gaucauggaacuaucacaa

SEQ ID NO: 1334466 - RNA, 19 nt, Homo sapiens
ucauggaacuaucacaaga

SEQ ID NO: 1334467 - RNA, 19 nt, Homo sapiens
cauagucacugcagagaca

SEQ ID NO: 1334468 - RNA, 19 nt, Homo sapiens
gaguuaaugugccaaaguc

SEQ ID NO: 1334469 - RNA, 19 nt, Homo sapiens
gagauuauuuauggagaga

SEQ ID NO: 1334470 - RNA, 19 nt, Homo sapiens
guauguauguuuguguuga

SEQ ID NO: 1334471 - RNA, 19 nt, Homo sapiens
gugagggcauugaggauga

SEQ ID NO: 1334472 - RNA, 19 nt, Homo sapiens
ccauaaagucccucugaaa

SEQ ID NO: 1334473 - RNA, 19 nt, Homo sapiens
gaagaggauccauaaaguc

SEQ ID NO: 1334474 - RNA, 19 nt, Homo sapiens
cauucuggaugcuuucuuu

SEQ ID NO: 1334475 - RNA, 19 nt, Homo sapiens
ucucaguccuggcuaggua

SEQ ID NO: 1334476 - RNA, 19 nt, Homo sapiens
aaucagaccauuccucauu

SEQ ID NO: 1334477 - RNA, 19 nt, Homo sapiens
ugaaacaggcccuccauuc

SEQ ID NO: 1334478 - RNA, 19 nt, Homo sapiens
gccauuuccuuguuacuca

SEQ ID NO: 1334479 - RNA, 19 nt, Homo sapiens
cagaagaggauccauaaag

SEQ ID NO: 1334480 - RNA, 19 nt, Homo sapiens
ucucacagaucuucauagu

SEQ ID NO: 1334481 - RNA, 19 nt, Homo sapiens
ucucuccacuucaagcuaa

SEQ ID NO: 1334482 - RNA, 19 nt, Homo sapiens
gcagaagaggauccauaaa

SEQ ID NO: 1334483 - RNA, 19 nt, Homo sapiens
gaagacaauuuucaugcuu

SEQ ID NO: 1334484 - RNA, 19 nt, Homo sapiens
ucacaagagcuguuccauu

SEQ ID NO: 1334485 - RNA, 19 nt, Homo sapiens
ugacagagaggcagaugga

SEQ ID NO: 1334486 - RNA, 19 nt, Homo sapiens
cuuauuggguggcauccua

SEQ ID NO: 1334487 - RNA, 19 nt, Homo sapiens
uuaaugugccaaagucuaa

SEQ ID NO: 1334488 - RNA, 19 nt, Homo sapiens
ucagaccauuccucauuug

SEQ ID NO: 1334489 - RNA, 19 nt, Homo sapiens
gcgguggauugcuuuguau

SEQ ID NO: 1334490 - RNA, 19 nt, Homo sapiens
cauaaagucccucugaaag

SEQ ID NO: 1334491 - RNA, 19 nt, Homo sapiens
gaaagacaggcagaggaaa

SEQ ID NO: 1334492 - RNA, 19 nt, Homo sapiens
uugaucagguucuggguuu

SEQ ID NO: 1334493 - RNA, 19 nt, Homo sapiens
ggguguguauguauguuug

SEQ ID NO: 1334494 - RNA, 19 nt, Homo sapiens
ugaaagaaucucuccacuu

SEQ ID NO: 1334495 - RNA, 19 nt, Homo sapiens
gaaacaggcccuccauucc

SEQ ID NO: 1334496 - RNA, 19 nt, Homo sapiens
guauguuuguguugacaga

SEQ ID NO: 1334497 - RNA, 19 nt, Homo sapiens
ggcccuccauuccauuuga

SEQ ID NO: 1334498 - RNA, 19 nt, Homo sapiens
gggcacagaacaucaaugg

SEQ ID NO: 1334499 - RNA, 19 nt, Homo sapiens
ggacagcuccauguucaca

SEQ ID NO: 1334500 - RNA, 19 nt, Homo sapiens
ggaaguucacucccacuca

SEQ ID NO: 1334501 - RNA, 19 nt, Homo sapiens
cauuuggccugcagaauac

SEQ ID NO: 1334502 - RNA, 19 nt, Homo sapiens
ccacugagaagacaauuuu

SEQ ID NO: 1334503 - RNA, 19 nt, Homo sapiens
aagaauagauagggaacug

SEQ ID NO: 1334504 - RNA, 19 nt, Homo sapiens
gaggagcagcaaagaauag

SEQ ID NO: 1334505 - RNA, 19 nt, Homo sapiens
gagcccagauggagaaucc

SEQ ID NO: 1334506 - RNA, 19 nt, Homo sapiens
agaaagacaggcagaggaa

SEQ ID NO: 1334507 - RNA, 19 nt, Homo sapiens
guguauguauguuuguguu

SEQ ID NO: 1334508 - RNA, 19 nt, Homo sapiens
gaaacuguccauccuuugc

SEQ ID NO: 1334509 - RNA, 19 nt, Homo sapiens
guuaaugugccaaagucua

SEQ ID NO: 1334510 - RNA, 19 nt, Homo sapiens
ucaggaagcucugguucuc

SEQ ID NO: 1334511 - RNA, 19 nt, Homo sapiens
ugaugaacagucagcauuu

SEQ ID NO: 1334512 - RNA, 19 nt, Homo sapiens
ugaccauccucuucaucuu

SEQ ID NO: 1334513 - RNA, 19 nt, Homo sapiens
gaucaucuuugugucuucu

SEQ ID NO: 1334514 - RNA, 19 nt, Homo sapiens
cauucgauacauucaguua

SEQ ID NO: 1334515 - RNA, 19 nt, Homo sapiens
cagaauacaaugucucagu

SEQ ID NO: 1334516 - RNA, 19 nt, Homo sapiens
guuacucaauauacuggaa

SEQ ID NO: 1334517 - RNA, 19 nt, Homo sapiens
ugcgguggauugcuuugua

SEQ ID NO: 1334518 - RNA, 19 nt, Homo sapiens
gaccauccucuucaucuuc

SEQ ID NO: 1334519 - RNA, 19 nt, Homo sapiens
ccucaccucugccuucagu

SEQ ID NO: 1334520 - RNA, 19 nt, Homo sapiens
agcgacaucugcacaguga

SEQ ID NO: 1334521 - RNA, 19 nt, Homo sapiens
caaucaacagcaagucauu

SEQ ID NO: 1334522 - RNA, 19 nt, Homo sapiens
ucacucccacucaaccaua

SEQ ID NO: 1334523 - RNA, 19 nt, Homo sapiens
uagaggagcagaagaggau

SEQ ID NO: 1334524 - RNA, 19 nt, Homo sapiens
auagggaacugaggagguu

SEQ ID NO: 1334525 - RNA, 19 nt, Homo sapiens
ccacaaagcuaguuucugu

SEQ ID NO: 1334526 - RNA, 19 nt, Homo sapiens
ggauacagcuuuaccucua

SEQ ID NO: 1334527 - RNA, 19 nt, Homo sapiens
ggagucaucuguucugaga

SEQ ID NO: 1334528 - RNA, 19 nt, Homo sapiens
gagagugacuuuaccaaca

SEQ ID NO: 1334529 - RNA, 19 nt, Homo sapiens
uaacagagguggugaugag

SEQ ID NO: 1334530 - RNA, 19 nt, Homo sapiens
gugcacaacugccacauug

SEQ ID NO: 1334531 - RNA, 19 nt, Homo sapiens
gcugaggauuguucacaua

SEQ ID NO: 1334532 - RNA, 19 nt, Homo sapiens
ucgaacagcuucauaaaca

SEQ ID NO: 1334533 - RNA, 19 nt, Homo sapiens
gcauggacaucuucacuca

SEQ ID NO: 1334534 - RNA, 19 nt, Homo sapiens
gaacaucacagcugaggau

SEQ ID NO: 1334535 - RNA, 19 nt, Homo sapiens
gcaucuggcuggacaacuu

SEQ ID NO: 1334536 - RNA, 19 nt, Homo sapiens
guaugagugugccaacuuu

SEQ ID NO: 1334537 - RNA, 19 nt, Homo sapiens
gcaggagccucauacucuu

SEQ ID NO: 1334538 - RNA, 19 nt, Homo sapiens
ggagaccgccuacaucgaa

SEQ ID NO: 1334539 - RNA, 19 nt, Homo sapiens
ggugaucuauucauucugu

SEQ ID NO: 1334540 - RNA, 19 nt, Homo sapiens
caucacagcugaggauugu

SEQ ID NO: 1334541 - RNA, 19 nt, Homo sapiens
cucaggagcuuaccaagaa

SEQ ID NO: 1334542 - RNA, 19 nt, Homo sapiens
ggacccacagugccaaaua

SEQ ID NO: 1334543 - RNA, 19 nt, Homo sapiens
uaccaacaaugcaaugaaa

SEQ ID NO: 1334544 - RNA, 19 nt, Homo sapiens
ggaguucuaucgugccaau

SEQ ID NO: 1334545 - RNA, 19 nt, Homo sapiens
caucuucacucacuaugau

SEQ ID NO: 1334546 - RNA, 19 nt, Homo sapiens
cauauaaggucaguguuuc

SEQ ID NO: 1334547 - RNA, 19 nt, Homo sapiens
gacccacagugccaaauau

SEQ ID NO: 1334548 - RNA, 19 nt, Homo sapiens
gaaucugggugcacaacug

SEQ ID NO: 1334549 - RNA, 19 nt, Homo sapiens
gcacccacaucaccugcaa

SEQ ID NO: 1334550 - RNA, 19 nt, Homo sapiens
gaacagcuucauaaacauc

SEQ ID NO: 1334551 - RNA, 19 nt, Homo sapiens
aaacuacauucuccagguu

SEQ ID NO: 1334552 - RNA, 19 nt, Homo sapiens
gagcagagugugacugaau

SEQ ID NO: 1334553 - RNA, 19 nt, Homo sapiens
ggacaucuucacucacuau

SEQ ID NO: 1334554 - RNA, 19 nt, Homo sapiens
ccucaggggucacauauaa

SEQ ID NO: 1334555 - RNA, 19 nt, Homo sapiens
cugacuaacugcccacaaa

SEQ ID NO: 1334556 - RNA, 19 nt, Homo sapiens
gagcagcaccugacuaacu

SEQ ID NO: 1334557 - RNA, 19 nt, Homo sapiens
gguagagcaucaccugcaa

SEQ ID NO: 1334558 - RNA, 19 nt, Homo sapiens
caacugggauuggguucga

SEQ ID NO: 1334559 - RNA, 19 nt, Homo sapiens
gaggccagcugucaguauc

SEQ ID NO: 1334560 - RNA, 19 nt, Homo sapiens
guggaacugucaagcagaa

SEQ ID NO: 1334561 - RNA, 19 nt, Homo sapiens
ucacauauaaggucagugu

SEQ ID NO: 1334562 - RNA, 19 nt, Homo sapiens
gauacagcuuuaccucuag

SEQ ID NO: 1334563 - RNA, 19 nt, Homo sapiens
cagaccagcaaccagauua

SEQ ID NO: 1334564 - RNA, 19 nt, Homo sapiens
agagugacuuuaccaacaa

SEQ ID NO: 1334565 - RNA, 19 nt, Homo sapiens
gcugagggccacaaagcua

SEQ ID NO: 1334566 - RNA, 19 nt, Homo sapiens
caucauggcacccacauca

SEQ ID NO: 1334567 - RNA, 19 nt, Homo sapiens
ucauugagguagagcauca

SEQ ID NO: 1334568 - RNA, 19 nt, Homo sapiens
ucauaaacaucuucagcau

SEQ ID NO: 1334569 - RNA, 19 nt, Homo sapiens
gaagccaggaaacuacauu

SEQ ID NO: 1334570 - RNA, 19 nt, Homo sapiens
gcgagucgaggugcaaaua

SEQ ID NO: 1334571 - RNA, 19 nt, Homo sapiens
caucagaccaugcacuaug

SEQ ID NO: 1334572 - RNA, 19 nt, Homo sapiens
gccauuaccucaggagcuu

SEQ ID NO: 1334573 - RNA, 19 nt, Homo sapiens
gcacaacugccacauuggu

SEQ ID NO: 1334574 - RNA, 19 nt, Homo sapiens
caacaaugcaaugaaaugu

SEQ ID NO: 1334575 - RNA, 19 nt, Homo sapiens
aagagcagcaccugacuaa

SEQ ID NO: 1334576 - RNA, 19 nt, Homo sapiens
ccaacaaugcaaugaaaug

SEQ ID NO: 1334577 - RNA, 19 nt, Homo sapiens
ugucaucaacccaaacuuu

SEQ ID NO: 1334578 - RNA, 19 nt, Homo sapiens
gcaggagaccgccuacauc

SEQ ID NO: 1334579 - RNA, 19 nt, Homo sapiens
acauauaaggucaguguuu

SEQ ID NO: 1334580 - RNA, 19 nt, Homo sapiens
guacugugcugcggaagag

SEQ ID NO: 1334581 - RNA, 19 nt, Homo sapiens
guucgaacagcuucauaaa

SEQ ID NO: 1334582 - RNA, 19 nt, Homo sapiens
gaaaggcaaggaggaaauc

SEQ ID NO: 1334583 - RNA, 19 nt, Homo sapiens
guacugggacucugggaau

SEQ ID NO: 1334584 - RNA, 19 nt, Homo sapiens
ucuguucccuggaguucua

SEQ ID NO: 1334585 - RNA, 19 nt, Homo sapiens
gcacucaucagaccaugca

SEQ ID NO: 1334586 - RNA, 19 nt, Homo sapiens
ggucugaggcugccauuac

SEQ ID NO: 1334587 - RNA, 19 nt, Homo sapiens
gcccaccucucccucuguu

SEQ ID NO: 1334588 - RNA, 19 nt, Homo sapiens
cauaaacaucuucagcauu

SEQ ID NO: 1334589 - RNA, 19 nt, Homo sapiens
gguucgaacagcuucauaa

SEQ ID NO: 1334590 - RNA, 19 nt, Homo sapiens
gagcccaccacaccacaaa

SEQ ID NO: 1334591 - RNA, 19 nt, Homo sapiens
gguaugagugugccaacuu

SEQ ID NO: 1334592 - RNA, 19 nt, Homo sapiens
cugcaaauaugauggacau

SEQ ID NO: 1334593 - RNA, 19 nt, Homo sapiens
gagacugcaucagaucugu

SEQ ID NO: 1334594 - RNA, 19 nt, Homo sapiens
caaauauggcccuggaaca

SEQ ID NO: 1334595 - RNA, 19 nt, Homo sapiens
cgaacagcuucauaaacau

SEQ ID NO: 1334596 - RNA, 19 nt, Homo sapiens
ucaggagcuuaccaagaaa

SEQ ID NO: 1334597 - RNA, 19 nt, Homo sapiens
uaacugcaaauaugaugga

SEQ ID NO: 1334598 - RNA, 19 nt, Homo sapiens
cugggacucugggaauaua

SEQ ID NO: 1334599 - RNA, 19 nt, Homo sapiens
gagucgaggugcaaauagg

SEQ ID NO: 1334600 - RNA, 19 nt, Homo sapiens
uagcagagagugacuuuac

SEQ ID NO: 1334601 - RNA, 19 nt, Homo sapiens
gcacugccaacugggauug

SEQ ID NO: 1334602 - RNA, 19 nt, Homo sapiens
ggucacauauaaggucagu

SEQ ID NO: 1334603 - RNA, 19 nt, Homo sapiens
gagcaggagccucauacuc

SEQ ID NO: 1334604 - RNA, 19 nt, Homo sapiens
ccagaaaggcaaggaggaa

SEQ ID NO: 1334605 - RNA, 19 nt, Homo sapiens
cagcagcucauuuucuuua

SEQ ID NO: 1334606 - RNA, 19 nt, Homo sapiens
ccaagcaugggaaucuuug

SEQ ID NO: 1334607 - RNA, 19 nt, Homo sapiens
gcagagagugacuuuacca

SEQ ID NO: 1334608 - RNA, 19 nt, Homo sapiens
ucacagcugaggauuguuc

SEQ ID NO: 1334609 - RNA, 19 nt, Homo sapiens
agcuuuaccucuagccuuu

SEQ ID NO: 1334610 - RNA, 19 nt, Homo sapiens
gccaagcaugggaaucuuu

SEQ ID NO: 1334611 - RNA, 19 nt, Homo sapiens
gagagcaaggcaucacugu

SEQ ID NO: 1334612 - RNA, 19 nt, Homo sapiens
cagaagaagcaacaacagu

SEQ ID NO: 1334613 - RNA, 19 nt, Homo sapiens
gauggcagcagcucauuuu

SEQ ID NO: 1334614 - RNA, 19 nt, Homo sapiens
gaucagugugcccaucaug

SEQ ID NO: 1334615 - RNA, 19 nt, Homo sapiens
ucagagcaggagccucaua

SEQ ID NO: 1334616 - RNA, 19 nt, Homo sapiens
aaagagcagcaccugacua

SEQ ID NO: 1334617 - RNA, 19 nt, Homo sapiens
gauguggaacugucaagca

SEQ ID NO: 1334618 - RNA, 19 nt, Homo sapiens
gagugacuuuaccaacaau

SEQ ID NO: 1334619 - RNA, 19 nt, Homo sapiens
gccagaagaagcaacaaca

SEQ ID NO: 1334620 - RNA, 19 nt, Homo sapiens
ucuuggugaucuauucauu

SEQ ID NO: 1334621 - RNA, 19 nt, Homo sapiens
cuucagagcccaggaguca

SEQ ID NO: 1334622 - RNA, 19 nt, Homo sapiens
ggcagcagcucauuuucuu

SEQ ID NO: 1334623 - RNA, 19 nt, Homo sapiens
gcccaccacaccacaaaga

SEQ ID NO: 1334624 - RNA, 19 nt, Homo sapiens
ccagcugucaguaucugua

SEQ ID NO: 1334625 - RNA, 19 nt, Homo sapiens
ggacauagacuuuguacua

SEQ ID NO: 1334626 - RNA, 19 nt, Homo sapiens
cuaccaggcugucguguuu

SEQ ID NO: 1334627 - RNA, 19 nt, Homo sapiens
agaaacagcugacaagagu

SEQ ID NO: 1334628 - RNA, 19 nt, Homo sapiens
gcaguagccaggauacaua

SEQ ID NO: 1334629 - RNA, 19 nt, Homo sapiens
cagcaauacugaagaucua

SEQ ID NO: 1334630 - RNA, 19 nt, Homo sapiens
gagccacacuguuccauca

SEQ ID NO: 1334631 - RNA, 19 nt, Homo sapiens
ggacagaaacagcugacaa

SEQ ID NO: 1334632 - RNA, 19 nt, Homo sapiens
ggauaucaagacuguguua

SEQ ID NO: 1334633 - RNA, 19 nt, Homo sapiens
gaaacagaaaggugauuga

SEQ ID NO: 1334634 - RNA, 19 nt, Homo sapiens
gcugggcucugccaacuug

SEQ ID NO: 1334635 - RNA, 19 nt, Homo sapiens
ggauacuggugcugaauca

SEQ ID NO: 1334636 - RNA, 19 nt, Homo sapiens
acagaaaggugauugaaaa

SEQ ID NO: 1334637 - RNA, 19 nt, Homo sapiens
gaggccagcuccugcuaga

SEQ ID NO: 1334638 - RNA, 19 nt, Homo sapiens
guacaauccgccaguuuga

SEQ ID NO: 1334639 - RNA, 19 nt, Homo sapiens
ggucucaguucacucuuuc

SEQ ID NO: 1334640 - RNA, 19 nt, Homo sapiens
ucaacucacugcucuucaa

SEQ ID NO: 1334641 - RNA, 19 nt, Homo sapiens
gacauagacuuuguacuac

SEQ ID NO: 1334642 - RNA, 19 nt, Homo sapiens
gcagcaagcccuagaacca

SEQ ID NO: 1334643 - RNA, 19 nt, Homo sapiens
gagggauacuggugcugaa

SEQ ID NO: 1334644 - RNA, 19 nt, Homo sapiens
gaaaggugauugaaaaggu

SEQ ID NO: 1334645 - RNA, 19 nt, Homo sapiens
gcaccuaguuaaccaagcu

SEQ ID NO: 1334646 - RNA, 19 nt, Homo sapiens
gcugacaagaguaccauuu

SEQ ID NO: 1334647 - RNA, 19 nt, Homo sapiens
ugacaagaguaccauuugg

SEQ ID NO: 1334648 - RNA, 19 nt, Homo sapiens
aagacuguguuaccuacua

SEQ ID NO: 1334649 - RNA, 19 nt, Homo sapiens
acucacugcucuucaauca

SEQ ID NO: 1334650 - RNA, 19 nt, Homo sapiens
cugaagaucuagagacagu

SEQ ID NO: 1334651 - RNA, 19 nt, Homo sapiens
acccaacgcugugguguuu

SEQ ID NO: 1334652 - RNA, 19 nt, Homo sapiens
guucacucuuuccuuguuu

SEQ ID NO: 1334653 - RNA, 19 nt, Homo sapiens
gggucucaguucacucuuu

SEQ ID NO: 1334654 - RNA, 19 nt, Homo sapiens
ggugguggacauagacuuu

SEQ ID NO: 1334655 - RNA, 19 nt, Homo sapiens
ccaagacccugauccuacu

SEQ ID NO: 1334656 - RNA, 19 nt, Homo sapiens
gaaacagcugacaagagua

SEQ ID NO: 1334657 - RNA, 19 nt, Homo sapiens
caaagcagcaagcccuaga

SEQ ID NO: 1334658 - RNA, 19 nt, Homo sapiens
caccuucucucugcucuug

SEQ ID NO: 1334659 - RNA, 19 nt, Homo sapiens
aaacagaaaggugauugaa

SEQ ID NO: 1334660 - RNA, 19 nt, Homo sapiens
caucuguggccuuuggaua

SEQ ID NO: 1334661 - RNA, 19 nt, Homo sapiens
gacagaaacagcugacaag

SEQ ID NO: 1334662 - RNA, 19 nt, Homo sapiens
ccucagggcucucuuaccu

SEQ ID NO: 1334663 - RNA, 19 nt, Homo sapiens
gggcagacaccuucucucu

SEQ ID NO: 1334664 - RNA, 19 nt, Homo sapiens
ugaccucagggcucucuua

SEQ ID NO: 1334665 - RNA, 19 nt, Homo sapiens
gcacugacucugucugcau

SEQ ID NO: 1334666 - RNA, 19 nt, Homo sapiens
gcaauacugaagaucuaga

SEQ ID NO: 1334667 - RNA, 19 nt, Homo sapiens
uacaaagcaucuuccaagu

SEQ ID NO: 1334668 - RNA, 19 nt, Homo sapiens
cgucugugcccuucccaua

SEQ ID NO: 1334669 - RNA, 19 nt, Homo sapiens
ccggaucccugugcucuau

SEQ ID NO: 1334670 - RNA, 19 nt, Homo sapiens
ucucugcucuuggcucuug

SEQ ID NO: 1334671 - RNA, 19 nt, Homo sapiens
cgaaacagaaaggugauug

SEQ ID NO: 1334672 - RNA, 19 nt, Homo sapiens
gacagucgugaaccacaua

SEQ ID NO: 1334673 - RNA, 19 nt, Homo sapiens
acaagaugcugagcuccuu

SEQ ID NO: 1334674 - RNA, 19 nt, Homo sapiens
uguguuaccuacuacaaag

SEQ ID NO: 1334675 - RNA, 19 nt, Homo sapiens
gccaacuuguggaacgaaa

SEQ ID NO: 1334676 - RNA, 19 nt, Homo sapiens
cagagugacauccuccaaa

SEQ ID NO: 1334677 - RNA, 19 nt, Homo sapiens
caacuuguggaacgaaaca

SEQ ID NO: 1334678 - RNA, 19 nt, Homo sapiens
uacugaagaucuagagaca

SEQ ID NO: 1334679 - RNA, 19 nt, Homo sapiens
accaggcugucguguuuaa

SEQ ID NO: 1334680 - RNA, 19 nt, Homo sapiens
agagugacauccuccaaac

SEQ ID NO: 1334681 - RNA, 19 nt, Homo sapiens
cuacugggcaugugugcuu

SEQ ID NO: 1334682 - RNA, 19 nt, Homo sapiens
cguacaauccgccaguuug

SEQ ID NO: 1334683 - RNA, 19 nt, Homo sapiens
caacucacugcucuucaau

SEQ ID NO: 1334684 - RNA, 19 nt, Homo sapiens
cuaguuaaccaagcucuga

SEQ ID NO: 1334685 - RNA, 19 nt, Homo sapiens
ccaggauacauacgucuug

SEQ ID NO: 1334686 - RNA, 19 nt, Homo sapiens
cagaaacagcugacaagag

SEQ ID NO: 1334687 - RNA, 19 nt, Homo sapiens
ugagccgccucuugcauca

SEQ ID NO: 1334688 - RNA, 19 nt, Homo sapiens
gcaccugggcagacaccuu

SEQ ID NO: 1334689 - RNA, 19 nt, Homo sapiens
aaacagcugacaagaguac

SEQ ID NO: 1334690 - RNA, 19 nt, Homo sapiens
ggaucccugugcucuaucu

SEQ ID NO: 1334691 - RNA, 19 nt, Homo sapiens
ccuagaaccaagauagaug

SEQ ID NO: 1334692 - RNA, 19 nt, Homo sapiens
gcccuagaaccaagauaga

SEQ ID NO: 1334693 - RNA, 19 nt, Homo sapiens
uaucaagacuguguuaccu

SEQ ID NO: 1334694 - RNA, 19 nt, Homo sapiens
acaauccgccaguuugaug

SEQ ID NO: 1334695 - RNA, 19 nt, Homo sapiens
uagagacagucgugaacca

SEQ ID NO: 1334696 - RNA, 19 nt, Homo sapiens
cagcaagcccuagaaccaa

SEQ ID NO: 1334697 - RNA, 19 nt, Homo sapiens
gcucugccaacuuguggaa

SEQ ID NO: 1334698 - RNA, 19 nt, Homo sapiens
ucugugcccuucccauaca

SEQ ID NO: 1334699 - RNA, 19 nt, Homo sapiens
gcaagcccuagaaccaaga

SEQ ID NO: 1334700 - RNA, 19 nt, Homo sapiens
cuuuggauaucaagacugu

SEQ ID NO: 1334701 - RNA, 19 nt, Homo sapiens
aacagaaaggugauugaaa

SEQ ID NO: 1334702 - RNA, 19 nt, Homo sapiens
agacagucgugaaccacau

SEQ ID NO: 1334703 - RNA, 19 nt, Homo sapiens
ccuaguccuuuaucagagu

SEQ ID NO: 1334704 - RNA, 19 nt, Homo sapiens
ggugggaccgcgaguuaca

SEQ ID NO: 1334705 - RNA, 19 nt, Homo sapiens
gguggacauagacuuugua

SEQ ID NO: 1334706 - RNA, 19 nt, Homo sapiens
aaaaggugguggacauaga

SEQ ID NO: 1334707 - RNA, 19 nt, Homo sapiens
cuacuacccagcccauugu

SEQ ID NO: 1334708 - RNA, 19 nt, Homo sapiens
ccuacuacccagcccauug

SEQ ID NO: 1334709 - RNA, 19 nt, Homo sapiens
cuacaggcccguacaaucc

SEQ ID NO: 1334710 - RNA, 19 nt, Homo sapiens
accacucgcucccuggaaa

SEQ ID NO: 1334711 - RNA, 19 nt, Homo sapiens
ccagcaauacugaagaucu

SEQ ID NO: 1334712 - RNA, 19 nt, Homo sapiens
gcuaccaggcugucguguu

SEQ ID NO: 1334713 - RNA, 19 nt, Homo sapiens
gaacgccuauccuauggua

SEQ ID NO: 1334714 - RNA, 19 nt, Homo sapiens
cuaccaggcugucguguuu

SEQ ID NO: 1334715 - RNA, 19 nt, Homo sapiens
agaaacagcugacaagagu

SEQ ID NO: 1334716 - RNA, 19 nt, Homo sapiens
gcaguagccaggauacaua

SEQ ID NO: 1334717 - RNA, 19 nt, Homo sapiens
cagcaauacugaagaucua

SEQ ID NO: 1334718 - RNA, 19 nt, Homo sapiens
gagccacacuguuccauca

SEQ ID NO: 1334719 - RNA, 19 nt, Homo sapiens
ggacagaaacagcugacaa

SEQ ID NO: 1334720 - RNA, 19 nt, Homo sapiens
ggauaucaagacuguguua

SEQ ID NO: 1334721 - RNA, 19 nt, Homo sapiens
gcugggcucugccaacuug

SEQ ID NO: 1334722 - RNA, 19 nt, Homo sapiens
ggauacuggugcugaauca

SEQ ID NO: 1334723 - RNA, 19 nt, Homo sapiens
gaggccagcuccugcuaga

SEQ ID NO: 1334724 - RNA, 19 nt, Homo sapiens
guacaauccgccaguuuga

SEQ ID NO: 1334725 - RNA, 19 nt, Homo sapiens
ggucucaguucacucuuuc

SEQ ID NO: 1334726 - RNA, 19 nt, Homo sapiens
ucaacucacugcucuucaa

SEQ ID NO: 1334727 - RNA, 19 nt, Homo sapiens
gcagcaagcccuagaacca

SEQ ID NO: 1334728 - RNA, 19 nt, Homo sapiens
gagggauacuggugcugaa

SEQ ID NO: 1334729 - RNA, 19 nt, Homo sapiens
gcaccuaguuaaccaagcu

SEQ ID NO: 1334730 - RNA, 19 nt, Homo sapiens
gcugacaagaguaccauuu

SEQ ID NO: 1334731 - RNA, 19 nt, Homo sapiens
ugacaagaguaccauuugg

SEQ ID NO: 1334732 - RNA, 19 nt, Homo sapiens
aagacuguguuaccuacua

SEQ ID NO: 1334733 - RNA, 19 nt, Homo sapiens
acucacugcucuucaauca

SEQ ID NO: 1334734 - RNA, 19 nt, Homo sapiens
cugaagaucuagagacagu

SEQ ID NO: 1334735 - RNA, 19 nt, Homo sapiens
acccaacgcugugguguuu

SEQ ID NO: 1334736 - RNA, 19 nt, Homo sapiens
guucacucuuuccuuguuu

SEQ ID NO: 1334737 - RNA, 19 nt, Homo sapiens
gggucucaguucacucuuu

SEQ ID NO: 1334738 - RNA, 19 nt, Homo sapiens
ccaagacccugauccuacu

SEQ ID NO: 1334739 - RNA, 19 nt, Homo sapiens
gaaacagcugacaagagua

SEQ ID NO: 1334740 - RNA, 19 nt, Homo sapiens
caaagcagcaagcccuaga

SEQ ID NO: 1334741 - RNA, 19 nt, Homo sapiens
caccuucucucugcucuug

SEQ ID NO: 1334742 - RNA, 19 nt, Homo sapiens
caucuguggccuuuggaua

SEQ ID NO: 1334743 - RNA, 19 nt, Homo sapiens
gacagaaacagcugacaag

SEQ ID NO: 1334744 - RNA, 19 nt, Homo sapiens
ccucagggcucucuuaccu

SEQ ID NO: 1334745 - RNA, 19 nt, Homo sapiens
gggcagacaccuucucucu

SEQ ID NO: 1334746 - RNA, 19 nt, Homo sapiens
ugaccucagggcucucuua

SEQ ID NO: 1334747 - RNA, 19 nt, Homo sapiens
guggaacgccuauccuaug

SEQ ID NO: 1334748 - RNA, 19 nt, Homo sapiens
gcacugacucugucugcau

SEQ ID NO: 1334749 - RNA, 19 nt, Homo sapiens
gcaauacugaagaucuaga

SEQ ID NO: 1334750 - RNA, 19 nt, Homo sapiens
uacaaagcaucuuccaagu

SEQ ID NO: 1334751 - RNA, 19 nt, Homo sapiens
cgucugugcccuucccaua

SEQ ID NO: 1334752 - RNA, 19 nt, Homo sapiens
ccggaucccugugcucuau

SEQ ID NO: 1334753 - RNA, 19 nt, Homo sapiens
ucucugcucuuggcucuug

SEQ ID NO: 1334754 - RNA, 19 nt, Homo sapiens
gacagucgugaaccacaua

SEQ ID NO: 1334755 - RNA, 19 nt, Homo sapiens
acaagaugcugagcuccuu

SEQ ID NO: 1334756 - RNA, 19 nt, Homo sapiens
uguguuaccuacuacaaag

SEQ ID NO: 1334757 - RNA, 19 nt, Homo sapiens
cagagugacauccuccaaa

SEQ ID NO: 1334758 - RNA, 19 nt, Homo sapiens
uacugaagaucuagagaca

SEQ ID NO: 1334759 - RNA, 19 nt, Homo sapiens
accaggcugucguguuuaa

SEQ ID NO: 1334760 - RNA, 19 nt, Homo sapiens
agagugacauccuccaaac

SEQ ID NO: 1334761 - RNA, 19 nt, Homo sapiens
cuacugggcaugugugcuu

SEQ ID NO: 1334762 - RNA, 19 nt, Homo sapiens
cguacaauccgccaguuug

SEQ ID NO: 1334763 - RNA, 19 nt, Homo sapiens
caacucacugcucuucaau

SEQ ID NO: 1334764 - RNA, 19 nt, Homo sapiens
cuaguuaaccaagcucuga

SEQ ID NO: 1334765 - RNA, 19 nt, Homo sapiens
ccaggauacauacgucuug

SEQ ID NO: 1334766 - RNA, 19 nt, Homo sapiens
cagaaacagcugacaagag

SEQ ID NO: 1334767 - RNA, 19 nt, Homo sapiens
ugagccgccucuugcauca

SEQ ID NO: 1334768 - RNA, 19 nt, Homo sapiens
gcaccugggcagacaccuu

SEQ ID NO: 1334769 - RNA, 19 nt, Homo sapiens
aaacagcugacaagaguac

SEQ ID NO: 1334770 - RNA, 19 nt, Homo sapiens
ggaucccugugcucuaucu

SEQ ID NO: 1334771 - RNA, 19 nt, Homo sapiens
ccuagaaccaagauagaug

SEQ ID NO: 1334772 - RNA, 19 nt, Homo sapiens
gcccuagaaccaagauaga

SEQ ID NO: 1334773 - RNA, 19 nt, Homo sapiens
uaucaagacuguguuaccu

SEQ ID NO: 1334774 - RNA, 19 nt, Homo sapiens
acaauccgccaguuugaug

SEQ ID NO: 1334775 - RNA, 19 nt, Homo sapiens
uggaacgccuauccuaugg

SEQ ID NO: 1334776 - RNA, 19 nt, Homo sapiens
caacuuguggaacgccuau

SEQ ID NO: 1334777 - RNA, 19 nt, Homo sapiens
uagagacagucgugaacca

SEQ ID NO: 1334778 - RNA, 19 nt, Homo sapiens
cagcaagcccuagaaccaa

SEQ ID NO: 1334779 - RNA, 19 nt, Homo sapiens
gcucugccaacuuguggaa

SEQ ID NO: 1334780 - RNA, 19 nt, Homo sapiens
ucugugcccuucccauaca

SEQ ID NO: 1334781 - RNA, 19 nt, Homo sapiens
gcaagcccuagaaccaaga

SEQ ID NO: 1334782 - RNA, 19 nt, Homo sapiens
cuuuggauaucaagacugu

SEQ ID NO: 1334783 - RNA, 19 nt, Homo sapiens
agacagucgugaaccacau

SEQ ID NO: 1334784 - RNA, 19 nt, Homo sapiens
ccuaguccuuuaucagagu

SEQ ID NO: 1334785 - RNA, 19 nt, Homo sapiens
ggugggaccgcgaguuaca

SEQ ID NO: 1334786 - RNA, 19 nt, Homo sapiens
cuacuacccagcccauugu

SEQ ID NO: 1334787 - RNA, 19 nt, Homo sapiens
ccuacuacccagcccauug

SEQ ID NO: 1334788 - RNA, 19 nt, Homo sapiens
accacucgcucccuggaaa

SEQ ID NO: 1334789 - RNA, 19 nt, Homo sapiens
ccagcaauacugaagaucu

SEQ ID NO: 1334790 - RNA, 19 nt, Homo sapiens
gcuaccaggcugucguguu

SEQ ID NO: 1334791 - RNA, 19 nt, Homo sapiens
gaagaaagcugguaauaga

SEQ ID NO: 1334792 - RNA, 19 nt, Homo sapiens
gaacaaaugugcuuccuuu

SEQ ID NO: 1334793 - RNA, 19 nt, Homo sapiens
gcagacaacucuugcgaua

SEQ ID NO: 1334794 - RNA, 19 nt, Homo sapiens
gaugacaccucuucgauuu

SEQ ID NO: 1334795 - RNA, 19 nt, Homo sapiens
gaucauauccuuccagauu

SEQ ID NO: 1334796 - RNA, 19 nt, Homo sapiens
ggacaaaccagaauucuug

SEQ ID NO: 1334797 - RNA, 19 nt, Homo sapiens
gaagcauucucaaguaauu

SEQ ID NO: 1334798 - RNA, 19 nt, Homo sapiens
ggaaggaaauggacuuuua

SEQ ID NO: 1334799 - RNA, 19 nt, Homo sapiens
aaagagaacuauccagaaa

SEQ ID NO: 1334800 - RNA, 19 nt, Homo sapiens
gaaaucauauguucgaaag

SEQ ID NO: 1334801 - RNA, 19 nt, Homo sapiens
uaaaggauaugcaagagaa

SEQ ID NO: 1334802 - RNA, 19 nt, Homo sapiens
gcaguaaguugucagcauu

SEQ ID NO: 1334803 - RNA, 19 nt, Homo sapiens
agacaacucuugcgauaaa

SEQ ID NO: 1334804 - RNA, 19 nt, Homo sapiens
caaaucauccuuucuagaa

SEQ ID NO: 1334805 - RNA, 19 nt, Homo sapiens
gaucaaacacuggaauaua

SEQ ID NO: 1334806 - RNA, 19 nt, Homo sapiens
ccagaaagcaucaaagaaa

SEQ ID NO: 1334807 - RNA, 19 nt, Homo sapiens
gcaauggcaagguugauua

SEQ ID NO: 1334808 - RNA, 19 nt, Homo sapiens
gaaagagaacuauccagaa

SEQ ID NO: 1334809 - RNA, 19 nt, Homo sapiens
gagagaugauaucaaugua

SEQ ID NO: 1334810 - RNA, 19 nt, Homo sapiens
gaauucaaacgugguauua

SEQ ID NO: 1334811 - RNA, 19 nt, Homo sapiens
cauaaacagucuccaagaa

SEQ ID NO: 1334812 - RNA, 19 nt, Homo sapiens
gcccaaagccagugagaua

SEQ ID NO: 1334813 - RNA, 19 nt, Homo sapiens
accaaucccuuacaauuua

SEQ ID NO: 1334814 - RNA, 19 nt, Homo sapiens
gaugaagacuuuguuaaca

SEQ ID NO: 1334815 - RNA, 19 nt, Homo sapiens
cagcaagucugaugaagug

SEQ ID NO: 1334816 - RNA, 19 nt, Homo sapiens
ggaaauggacuuuuagaua

SEQ ID NO: 1334817 - RNA, 19 nt, Homo sapiens
ggacuucaccuauagauca

SEQ ID NO: 1334818 - RNA, 19 nt, Homo sapiens
guaaaccucuagugcuauu

SEQ ID NO: 1334819 - RNA, 19 nt, Homo sapiens
gcagugugccuauuauaaa

SEQ ID NO: 1334820 - RNA, 19 nt, Homo sapiens
gaccaaucccuuacaauuu

SEQ ID NO: 1334821 - RNA, 19 nt, Homo sapiens
gaacacuacaugaaacaaa

SEQ ID NO: 1334822 - RNA, 19 nt, Homo sapiens
gcagugugauuauagaugu

SEQ ID NO: 1334823 - RNA, 19 nt, Homo sapiens
ccagugagauaauucaaug

SEQ ID NO: 1334824 - RNA, 19 nt, Homo sapiens
caaacaauauggcaacauc

SEQ ID NO: 1334825 - RNA, 19 nt, Homo sapiens
gaagauuacuaugaagguu

SEQ ID NO: 1334826 - RNA, 19 nt, Homo sapiens
ucaaagcaauucaagaugu

SEQ ID NO: 1334827 - RNA, 19 nt, Homo sapiens
caagaaacaagauagauga

SEQ ID NO: 1334828 - RNA, 19 nt, Homo sapiens
ggagagaugauaucaaugu

SEQ ID NO: 1334829 - RNA, 19 nt, Homo sapiens
uaaaagagguguucguauu

SEQ ID NO: 1334830 - RNA, 19 nt, Homo sapiens
gaacaggaggaugauauaa

SEQ ID NO: 1334831 - RNA, 19 nt, Homo sapiens
ggaacaggaggaugauaua

SEQ ID NO: 1334832 - RNA, 19 nt, Homo sapiens
ggauuuacaucagugguuu

SEQ ID NO: 1334833 - RNA, 19 nt, Homo sapiens
guguaaaccucuagugcua

SEQ ID NO: 1334834 - RNA, 19 nt, Homo sapiens
caagguugauuauggagaa

SEQ ID NO: 1334835 - RNA, 19 nt, Homo sapiens
ggauaggaaagccaucuua

SEQ ID NO: 1334836 - RNA, 19 nt, Homo sapiens
gaaagcugguaauagaugu

SEQ ID NO: 1334837 - RNA, 19 nt, Homo sapiens
caagauagaugaaaagugu

SEQ ID NO: 1334838 - RNA, 19 nt, Homo sapiens
caucaaagguggacuucug

SEQ ID NO: 1334839 - RNA, 19 nt, Homo sapiens
caugugaacccaacaaauu

SEQ ID NO: 1334840 - RNA, 19 nt, Homo sapiens
gaagugugauacaugugaa

SEQ ID NO: 1334841 - RNA, 19 nt, Homo sapiens
uauguacuguuguugguua

SEQ ID NO: 1334842 - RNA, 19 nt, Homo sapiens
caaagccagugagauaauu

SEQ ID NO: 1334843 - RNA, 19 nt, Homo sapiens
gguaggaucguaucacgua

SEQ ID NO: 1334844 - RNA, 19 nt, Homo sapiens
caacaugagaagugugaua

SEQ ID NO: 1334845 - RNA, 19 nt, Homo sapiens
cauaugucaucaacacuaa

SEQ ID NO: 1334846 - RNA, 19 nt, Homo sapiens
ucacagaugcaaaguauug

SEQ ID NO: 1334847 - RNA, 19 nt, Homo sapiens
gaugaugaagacuuuguua

SEQ ID NO: 1334848 - RNA, 19 nt, Homo sapiens
guauaggaauaguagauga

SEQ ID NO: 1334849 - RNA, 19 nt, Homo sapiens
gaaauuaaagagggcuaua

SEQ ID NO: 1334850 - RNA, 19 nt, Homo sapiens
gaugggacuucaccuauag

SEQ ID NO: 1334851 - RNA, 19 nt, Homo sapiens
ccaguuguauuuguucuuu

SEQ ID NO: 1334852 - RNA, 19 nt, Homo sapiens
caaguuuccuguccuuuca

SEQ ID NO: 1334853 - RNA, 19 nt, Homo sapiens
agagaacuauccagaaaga

SEQ ID NO: 1334854 - RNA, 19 nt, Homo sapiens
gaaaccuguucuuaauguu

SEQ ID NO: 1334855 - RNA, 19 nt, Homo sapiens
gaaaguuacaucugcauca

SEQ ID NO: 1334856 - RNA, 19 nt, Homo sapiens
uguaaaggaugaucaaaca

SEQ ID NO: 1334857 - RNA, 19 nt, Homo sapiens
cagaugaccuuacgacucu

SEQ ID NO: 1334858 - RNA, 19 nt, Homo sapiens
caacacagaugaccuuacg

SEQ ID NO: 1334859 - RNA, 19 nt, Homo sapiens
ggacaaggaaggaaaugga

SEQ ID NO: 1334860 - RNA, 19 nt, Homo sapiens
caaagcaauucaagaugug

SEQ ID NO: 1334861 - RNA, 19 nt, Homo sapiens
aaacuccgaaucacaaaua

SEQ ID NO: 1334862 - RNA, 19 nt, Homo sapiens
caucucagccuuccagaaa

SEQ ID NO: 1334863 - RNA, 19 nt, Homo sapiens
gagaagaagaaacagauug

SEQ ID NO: 1334864 - RNA, 19 nt, Homo sapiens
gagaagguacuaaaacuua

SEQ ID NO: 1334865 - RNA, 19 nt, Homo sapiens
cuaaugcccaguuguauuu

SEQ ID NO: 1334866 - RNA, 19 nt, Homo sapiens
guuaacaucuuacguacuc

SEQ ID NO: 1334867 - RNA, 19 nt, Homo sapiens
caaaugugcuuccuuuuau

SEQ ID NO: 1334868 - RNA, 19 nt, Homo sapiens
ugaccaaucccuuacaauu

SEQ ID NO: 1334869 - RNA, 19 nt, Homo sapiens
uuacgacucuggauaggaa

SEQ ID NO: 1334870 - RNA, 19 nt, Homo sapiens
ugagaagugugauacaugu

SEQ ID NO: 1334871 - RNA, 19 nt, Homo sapiens
caagcagugugauuauaga

SEQ ID NO: 1334872 - RNA, 19 nt, Homo sapiens
caacagaggaagaaaucaa

SEQ ID NO: 1334873 - RNA, 19 nt, Homo sapiens
ggaaaucauauguucgaaa

SEQ ID NO: 1334874 - RNA, 19 nt, Homo sapiens
gaagaagccaacacagaug

SEQ ID NO: 1334875 - RNA, 19 nt, Homo sapiens
gcacaauguaguuauucua

SEQ ID NO: 1334876 - RNA, 19 nt, Homo sapiens
gaauuuggaaagagaacua

SEQ ID NO: 1334877 - RNA, 19 nt, Homo sapiens
gaucguaucacguaaugga

SEQ ID NO: 1334878 - RNA, 19 nt, Homo sapiens
gaugugagaagguacuaaa

SEQ ID NO: 1334879 - RNA, 19 nt, Homo sapiens
agaaagugaucauauccuu

SEQ ID NO: 1334880 - RNA, 19 nt, Homo sapiens
ccaaggaauaguucaguaa

SEQ ID NO: 1334881 - RNA, 19 nt, Homo sapiens
caaguaauuucaggccauu

SEQ ID NO: 1334882 - RNA, 19 nt, Homo sapiens
acaggaggaugauauaauc

SEQ ID NO: 1334883 - RNA, 19 nt, Homo sapiens
ggaaaacaauaccgacuug

SEQ ID NO: 1334884 - RNA, 19 nt, Homo sapiens
cagagcaagugaugauaga

SEQ ID NO: 1334885 - RNA, 19 nt, Homo sapiens
agaugggacuucaccuaua

SEQ ID NO: 1334886 - RNA, 19 nt, Homo sapiens
gugaagaaagcugguaaua

SEQ ID NO: 1334887 - RNA, 19 nt, Homo sapiens
uacaggaaaucauauguuc

SEQ ID NO: 1334888 - RNA, 19 nt, Homo sapiens
gaauacaggaaaucauaug

SEQ ID NO: 1334889 - RNA, 19 nt, Homo sapiens
ggauaugcaagagaaauuu

SEQ ID NO: 1334890 - RNA, 19 nt, Homo sapiens
caaaacugcuucuauggaa

SEQ ID NO: 1334891 - RNA, 19 nt, Homo sapiens
ggaagaagaagaaggaaua

SEQ ID NO: 1334892 - RNA, 19 nt, Homo sapiens
agaagaagcugcuggcuaa

SEQ ID NO: 1334893 - RNA, 19 nt, Homo sapiens
ggaaggaucugugcugaga

SEQ ID NO: 1334894 - RNA, 19 nt, Homo sapiens
aaacagaccugaacagaca

SEQ ID NO: 1334895 - RNA, 19 nt, Homo sapiens
ggauuuagcugcuggaaag

SEQ ID NO: 1334896 - RNA, 19 nt, Homo sapiens
aaacagaccuggacagaca

SEQ ID NO: 1334897 - RNA, 19 nt, Homo sapiens
aaacagaccuggacagaca

SEQ ID NO: 1334898 - RNA, 19 nt, Homo sapiens
cagcagagaugccagaaug

SEQ ID NO: 1334899 - RNA, 19 nt, Homo sapiens
caagaaagcaggaagaaga

SEQ ID NO: 1334900 - RNA, 19 nt, Homo sapiens
ggacagacaggcagacgua

SEQ ID NO: 1334901 - RNA, 19 nt, Homo sapiens
agacacagauugaaacaga

SEQ ID NO: 1334902 - RNA, 19 nt, Homo sapiens
aaacagaccuagacagaca

SEQ ID NO: 1334903 - RNA, 19 nt, Homo sapiens
gcaaagagcagacacacau

SEQ ID NO: 1334904 - RNA, 19 nt, Homo sapiens
gcuccuggaucuccuguuu

SEQ ID NO: 1334905 - RNA, 19 nt, Homo sapiens
ccauagaccuggaaaugug

SEQ ID NO: 1334906 - RNA, 19 nt, Homo sapiens
ccacaggacccgggaaaua

SEQ ID NO: 1334907 - RNA, 19 nt, Homo sapiens
ccgcgaaccugaccaauuc

SEQ ID NO: 1334908 - RNA, 19 nt, Homo sapiens
gaagaaggaauauaucgau

SEQ ID NO: 1334909 - RNA, 19 nt, Homo sapiens
ugaaagagacccagacaga

SEQ ID NO: 1334910 - RNA, 19 nt, Homo sapiens
ugaaacagacccagacaaa

SEQ ID NO: 1334911 - RNA, 19 nt, Homo sapiens
ugaaacagacccagacaaa

SEQ ID NO: 1334912 - RNA, 19 nt, Homo sapiens
agaaacagccugaaacaga

SEQ ID NO: 1334913 - RNA, 19 nt, Homo sapiens
gcaggaagaagaagaagga

SEQ ID NO: 1334914 - RNA, 19 nt, Homo sapiens
gaaagcaggaagaagaaga

SEQ ID NO: 1334915 - RNA, 19 nt, Homo sapiens
agacacagccugaaacaga

SEQ ID NO: 1334916 - RNA, 19 nt, Homo sapiens
agacacagccugaaacaga

SEQ ID NO: 1334917 - RNA, 19 nt, Homo sapiens
agacacagccugaaacaga

SEQ ID NO: 1334918 - RNA, 19 nt, Homo sapiens
agacacagccugaaacaga

SEQ ID NO: 1334919 - RNA, 19 nt, Homo sapiens
agacacagccugaaacaga

SEQ ID NO: 1334920 - RNA, 19 nt, Homo sapiens
agacacagccugaaacaga

SEQ ID NO: 1334921 - RNA, 19 nt, Homo sapiens
agacacagccugaaacaga

SEQ ID NO: 1334922 - RNA, 19 nt, Homo sapiens
agacacagccugaaacaga

SEQ ID NO: 1334923 - RNA, 19 nt, Homo sapiens
aaacagauccggacagaca

SEQ ID NO: 1334924 - RNA, 19 nt, Homo sapiens
ugaaacagauccggacaga

SEQ ID NO: 1334925 - RNA, 19 nt, Homo sapiens
agacacagccugaaacaga

SEQ ID NO: 1334926 - RNA, 19 nt, Homo sapiens
agacacagccugaaacaga

SEQ ID NO: 1334927 - RNA, 19 nt, Homo sapiens
agacacagccugaaacaga

SEQ ID NO: 1334928 - RNA, 19 nt, Homo sapiens
agacacagccugaaacaga

SEQ ID NO: 1334929 - RNA, 19 nt, Homo sapiens
gaagaagaaggaauauauc

SEQ ID NO: 1334930 - RNA, 19 nt, Homo sapiens
cgacgcagccugaaagaga

SEQ ID NO: 1334931 - RNA, 19 nt, Homo sapiens
aaacagacccagacaaaca

SEQ ID NO: 1334932 - RNA, 19 nt, Homo sapiens
aaacagacccagacaaaca

SEQ ID NO: 1334933 - RNA, 19 nt, Homo sapiens
ugaaacagaccuagacaga

SEQ ID NO: 1334934 - RNA, 19 nt, Homo sapiens
gaccauagaccuggaaaug

SEQ ID NO: 1334935 - RNA, 19 nt, Homo sapiens
gcuuugagcuccuggaucu

SEQ ID NO: 1334936 - RNA, 19 nt, Homo sapiens
aaacagacccggacagaca

SEQ ID NO: 1334937 - RNA, 19 nt, Homo sapiens
aaacagacccggacagaca

SEQ ID NO: 1334938 - RNA, 19 nt, Homo sapiens
aaacagacccggacagaca

SEQ ID NO: 1334939 - RNA, 19 nt, Homo sapiens
aaacagacccggacagaca

SEQ ID NO: 1334940 - RNA, 19 nt, Homo sapiens
ggacagacagacagaaaca

SEQ ID NO: 1334941 - RNA, 19 nt, Homo sapiens
aaacagacccggacagaca

SEQ ID NO: 1334942 - RNA, 19 nt, Homo sapiens
gaaccgacacucagacaca

SEQ ID NO: 1334943 - RNA, 19 nt, Homo sapiens
ugaaacagacccagacaga

SEQ ID NO: 1334944 - RNA, 19 nt, Homo sapiens
ugaaacagacccagacaga

SEQ ID NO: 1334945 - RNA, 19 nt, Homo sapiens
ugaaacagacccagacaga

SEQ ID NO: 1334946 - RNA, 19 nt, Homo sapiens
ugaaacagacccagacaga

SEQ ID NO: 1334947 - RNA, 19 nt, Homo sapiens
agaagcugcuggcuaaaga

SEQ ID NO: 1334948 - RNA, 19 nt, Homo sapiens
caaagagcagacacacaua

SEQ ID NO: 1334949 - RNA, 19 nt, Homo sapiens
gaagaaacuccaggccauu

SEQ ID NO: 1334950 - RNA, 19 nt, Homo sapiens
ugaagccucugugaccaua

SEQ ID NO: 1334951 - RNA, 19 nt, Homo sapiens
gaagaagaagaaggaauau

SEQ ID NO: 1334952 - RNA, 19 nt, Homo sapiens
agacagacacagauugaaa

SEQ ID NO: 1334953 - RNA, 19 nt, Homo sapiens
acagacagccugaaacaga

SEQ ID NO: 1334954 - RNA, 19 nt, Homo sapiens
aaagagacccagacagaga

SEQ ID NO: 1334955 - RNA, 19 nt, Homo sapiens
gcaucacccugcccacuca

SEQ ID NO: 1334956 - RNA, 19 nt, Homo sapiens
aaacagacccagacagaca

SEQ ID NO: 1334957 - RNA, 19 nt, Homo sapiens
aaacagacccagacagaca

SEQ ID NO: 1334958 - RNA, 19 nt, Homo sapiens
aaacagacccagacagaca

SEQ ID NO: 1334959 - RNA, 19 nt, Homo sapiens
aaacagacccagacagaca

SEQ ID NO: 1334960 - RNA, 19 nt, Homo sapiens
agacagaaacagccugaaa

SEQ ID NO: 1334961 - RNA, 19 nt, Homo sapiens
gacacagccugaaacagau

SEQ ID NO: 1334962 - RNA, 19 nt, Homo sapiens
gcaggaaccgacacucaga

SEQ ID NO: 1334963 - RNA, 19 nt, Homo sapiens
caacagaugcgcagcaacu

SEQ ID NO: 1334964 - RNA, 19 nt, Homo sapiens
ggacagacagacagacaca

SEQ ID NO: 1334965 - RNA, 19 nt, Homo sapiens
ggacagacagacagacaca

SEQ ID NO: 1334966 - RNA, 19 nt, Homo sapiens
ggacagacagacagacaca

SEQ ID NO: 1334967 - RNA, 19 nt, Homo sapiens
ggacagacagacagacaca

SEQ ID NO: 1334968 - RNA, 19 nt, Homo sapiens
ccagaacuuugcacaacga

SEQ ID NO: 1334969 - RNA, 19 nt, Homo sapiens
ggcccugccucuccuauca

SEQ ID NO: 1334970 - RNA, 19 nt, Homo sapiens
ggacuuugcgccuguacga

SEQ ID NO: 1334971 - RNA, 19 nt, Homo sapiens
agacagacacagccugaaa

SEQ ID NO: 1334972 - RNA, 19 nt, Homo sapiens
agacagacacagccugaaa

SEQ ID NO: 1334973 - RNA, 19 nt, Homo sapiens
ugaaacagacccagacaca

SEQ ID NO: 1334974 - RNA, 19 nt, Homo sapiens
agacagacacagccugaaa

SEQ ID NO: 1334975 - RNA, 19 nt, Homo sapiens
agacagacacagccugaaa

SEQ ID NO: 1334976 - RNA, 19 nt, Homo sapiens
agacagacacagccugaaa

SEQ ID NO: 1334977 - RNA, 19 nt, Homo sapiens
agacagacacagccugaaa

SEQ ID NO: 1334978 - RNA, 19 nt, Homo sapiens
agacagacacagccugaaa

SEQ ID NO: 1334979 - RNA, 19 nt, Homo sapiens
ugaaacagacccagacaca

SEQ ID NO: 1334980 - RNA, 19 nt, Homo sapiens
agacagacacagccugaaa

SEQ ID NO: 1334981 - RNA, 19 nt, Homo sapiens
agacagacacagccugaaa

SEQ ID NO: 1334982 - RNA, 19 nt, Homo sapiens
agacagacacagccugaaa

SEQ ID NO: 1334983 - RNA, 19 nt, Homo sapiens
acauacagccugaaacaga

SEQ ID NO: 1334984 - RNA, 19 nt, Homo sapiens
ugaaacagaccugaacaga

SEQ ID NO: 1334985 - RNA, 19 nt, Homo sapiens
ucaccgaggaugagaagaa

SEQ ID NO: 1334986 - RNA, 19 nt, Homo sapiens
ugacacaacccgagaagag

SEQ ID NO: 1334987 - RNA, 19 nt, Homo sapiens
agaggaaagucuugcaucu

SEQ ID NO: 1334988 - RNA, 19 nt, Homo sapiens
aagacugccugauccgaaa

SEQ ID NO: 1334989 - RNA, 19 nt, Homo sapiens
acacauacagccugaaaca

SEQ ID NO: 1334990 - RNA, 19 nt, Homo sapiens
gaagcaaagagcagacaca

SEQ ID NO: 1334991 - RNA, 19 nt, Homo sapiens
gcauggagcuggagaagua

SEQ ID NO: 1334992 - RNA, 19 nt, Homo sapiens
agaaauaccuccagaagua

SEQ ID NO: 1334993 - RNA, 19 nt, Homo sapiens
ucaagaaacugaugaauga

SEQ ID NO: 1334994 - RNA, 19 nt, Homo sapiens
gaacacagaucugcuagaa

SEQ ID NO: 1334995 - RNA, 19 nt, Homo sapiens
gaagauggcucaccaacug

SEQ ID NO: 1334996 - RNA, 19 nt, Homo sapiens
ggaaagagcuggagcaaaa

SEQ ID NO: 1334997 - RNA, 19 nt, Homo sapiens
gaaaggagcugggacugaa

SEQ ID NO: 1334998 - RNA, 19 nt, Homo sapiens
ugaaugagcugaugcagaa

SEQ ID NO: 1334999 - RNA, 19 nt, Homo sapiens
gaaagcgucugcagcaaug

SEQ ID NO: 1335000 - RNA, 19 nt, Homo sapiens
ggaaugaacuccggcagaa

SEQ ID NO: 1335001 - RNA, 19 nt, Homo sapiens
ggguaggacuguuagaaua

SEQ ID NO: 1335002 - RNA, 19 nt, Homo sapiens
ggaagaagcccagcagaaa

SEQ ID NO: 1335003 - RNA, 19 nt, Homo sapiens
ggaagcaguucaugagguu

SEQ ID NO: 1335004 - RNA, 19 nt, Homo sapiens
ggaaaggagccgcuuguuu

SEQ ID NO: 1335005 - RNA, 19 nt, Homo sapiens
gcagauagcagcuccuuug

SEQ ID NO: 1335006 - RNA, 19 nt, Homo sapiens
gguccaagccugaagauaa

SEQ ID NO: 1335007 - RNA, 19 nt, Homo sapiens
gaugaaugaugaaugaaug

SEQ ID NO: 1335008 - RNA, 19 nt, Homo sapiens
ggagaaggaugcagaaagg

SEQ ID NO: 1335009 - RNA, 19 nt, Homo sapiens
gaaaggagccgcuuguuuu

SEQ ID NO: 1335010 - RNA, 19 nt, Homo sapiens
guagagggcuccagugaca

SEQ ID NO: 1335011 - RNA, 19 nt, Homo sapiens
cgagagaucccagaaauuu

SEQ ID NO: 1335012 - RNA, 19 nt, Homo sapiens
gcaggaagcuccaucucau

SEQ ID NO: 1335013 - RNA, 19 nt, Homo sapiens
gaaaagagauggauaacgu

SEQ ID NO: 1335014 - RNA, 19 nt, Homo sapiens
gaggacacaugcacuguug

SEQ ID NO: 1335015 - RNA, 19 nt, Homo sapiens
acacagaucugcuagaaag

SEQ ID NO: 1335016 - RNA, 19 nt, Homo sapiens
gcaggaagggugagacuuu

SEQ ID NO: 1335017 - RNA, 19 nt, Homo sapiens
caaaggaggugagcacaau

SEQ ID NO: 1335018 - RNA, 19 nt, Homo sapiens
cgaggagggucaaagcaua

SEQ ID NO: 1335019 - RNA, 19 nt, Homo sapiens
ucaaaugcaucucuucaga

SEQ ID NO: 1335020 - RNA, 19 nt, Homo sapiens
gcaagaguaugaagagaag

SEQ ID NO: 1335021 - RNA, 19 nt, Homo sapiens
gaagaaauaccuccagaag

SEQ ID NO: 1335022 - RNA, 19 nt, Homo sapiens
ucaagaagcugaagauucg

SEQ ID NO: 1335023 - RNA, 19 nt, Homo sapiens
agacagaccuggagacauc

SEQ ID NO: 1335024 - RNA, 19 nt, Homo sapiens
gagcaagcaugaacaaguc

SEQ ID NO: 1335025 - RNA, 19 nt, Homo sapiens
gaaugucucuaaggacgua

SEQ ID NO: 1335026 - RNA, 19 nt, Homo sapiens
ccucugaccuugccgauga

SEQ ID NO: 1335027 - RNA, 19 nt, Homo sapiens
gaggaaagacgacgauguu

SEQ ID NO: 1335028 - RNA, 19 nt, Homo sapiens
gaaguggcauccagugaca

SEQ ID NO: 1335029 - RNA, 19 nt, Homo sapiens
guccaagccugaagauaaa

SEQ ID NO: 1335030 - RNA, 19 nt, Homo sapiens
gaagcuccaucucaucuca

SEQ ID NO: 1335031 - RNA, 19 nt, Homo sapiens
gaaaguccacagagagauu

SEQ ID NO: 1335032 - RNA, 19 nt, Homo sapiens
acaagagccugguggauga

SEQ ID NO: 1335033 - RNA, 19 nt, Homo sapiens
ugaagcagaugcaccagaa

SEQ ID NO: 1335034 - RNA, 19 nt, Homo sapiens
ucagagaaguugcggaaug

SEQ ID NO: 1335035 - RNA, 19 nt, Homo sapiens
gaaccaacccaaacugugu

SEQ ID NO: 1335036 - RNA, 19 nt, Homo sapiens
cgagcauaaugaagaaaua

SEQ ID NO: 1335037 - RNA, 19 nt, Homo sapiens
cgacagaucauccagcaaa

SEQ ID NO: 1335038 - RNA, 19 nt, Homo sapiens
gaauaagaaggacaaagaa

SEQ ID NO: 1335039 - RNA, 19 nt, Homo sapiens
gaacgagagaucccagaaa

SEQ ID NO: 1335040 - RNA, 19 nt, Homo sapiens
guacaagcauucaagaaac

SEQ ID NO: 1335041 - RNA, 19 nt, Homo sapiens
cagagaaaguccacagaga

SEQ ID NO: 1335042 - RNA, 19 nt, Homo sapiens
ggcaaacccuccagacaga

SEQ ID NO: 1335043 - RNA, 19 nt, Homo sapiens
gcaaggaggagcuggagaa

SEQ ID NO: 1335044 - RNA, 19 nt, Homo sapiens
agaagaagcagaagaaguu

SEQ ID NO: 1335045 - RNA, 19 nt, Homo sapiens
ugaaugacuuggaaaggaa

SEQ ID NO: 1335046 - RNA, 19 nt, Homo sapiens
ugaaugagccaaagaacaa

SEQ ID NO: 1335047 - RNA, 19 nt, Homo sapiens
gaaugaaugagccaaagaa

SEQ ID NO: 1335048 - RNA, 19 nt, Homo sapiens
uccagaaggugcagauuaa

SEQ ID NO: 1335049 - RNA, 19 nt, Homo sapiens
cagagaaguugcggaauga

SEQ ID NO: 1335050 - RNA, 19 nt, Homo sapiens
gagaggagcugcggagucu

SEQ ID NO: 1335051 - RNA, 19 nt, Homo sapiens
agaaacugaugaaugauga

SEQ ID NO: 1335052 - RNA, 19 nt, Homo sapiens
gaagggcuccggaggaaga

SEQ ID NO: 1335053 - RNA, 19 nt, Homo sapiens
gcuguggucuuacucauca

SEQ ID NO: 1335054 - RNA, 19 nt, Homo sapiens
gaccuggccucucucauca

SEQ ID NO: 1335055 - RNA, 19 nt, Homo sapiens
aaggauggauuuacucuug

SEQ ID NO: 1335056 - RNA, 19 nt, Homo sapiens
gcagaaaggccucggauac

SEQ ID NO: 1335057 - RNA, 19 nt, Homo sapiens
gcgagucccucuuagaauc

SEQ ID NO: 1335058 - RNA, 19 nt, Homo sapiens
aaaugcagcuggagcaaga

SEQ ID NO: 1335059 - RNA, 19 nt, Homo sapiens
gaauaaacaguuggaagaa

SEQ ID NO: 1335060 - RNA, 19 nt, Homo sapiens
gagaaaguccacagagaga

SEQ ID NO: 1335061 - RNA, 19 nt, Homo sapiens
accaugagcuggagaagaa

SEQ ID NO: 1335062 - RNA, 19 nt, Homo sapiens
ugaauaaacaguuggaaga

SEQ ID NO: 1335063 - RNA, 19 nt, Homo sapiens
gaacacggccaccuucaag

SEQ ID NO: 1335064 - RNA, 19 nt, Homo sapiens
acaauaacuuggagacaga

SEQ ID NO: 1335065 - RNA, 19 nt, Homo sapiens
ccaggaaucccacgacuug

SEQ ID NO: 1335066 - RNA, 19 nt, Homo sapiens
agacagaguuccagaaggu

SEQ ID NO: 1335067 - RNA, 19 nt, Homo sapiens
ggucuuagaugaggaaguc

SEQ ID NO: 1335068 - RNA, 19 nt, Homo sapiens
gcucagggcucaagaugac

SEQ ID NO: 1335069 - RNA, 19 nt, Homo sapiens
gaaguucuguguccaucuc

SEQ ID NO: 1335070 - RNA, 19 nt, Homo sapiens
agaauaagaaggacaaaga

SEQ ID NO: 1335071 - RNA, 19 nt, Homo sapiens
gagcagagcccacaaacac

SEQ ID NO: 1335072 - RNA, 19 nt, Homo sapiens
gcugaaggccgacauggaa

SEQ ID NO: 1335073 - RNA, 19 nt, Homo sapiens
gagcaagaguaugaagaga

SEQ ID NO: 1335074 - RNA, 19 nt, Homo sapiens
gguuugagcuggagaucga

SEQ ID NO: 1335075 - RNA, 19 nt, Homo sapiens
gccaccaucuuaccuguga

SEQ ID NO: 1335076 - RNA, 19 nt, Homo sapiens
agaagaauguggcuguguu

SEQ ID NO: 1335077 - RNA, 19 nt, Homo sapiens
ggucccggcugcacuuuau

SEQ ID NO: 1335078 - RNA, 19 nt, Homo sapiens
ggauuggacuuggaucuca

SEQ ID NO: 1335079 - RNA, 19 nt, Homo sapiens
gaagccagcagaucucuca

SEQ ID NO: 1335080 - RNA, 19 nt, Homo sapiens
acugaugaaugaugaauga

SEQ ID NO: 1335081 - RNA, 19 nt, Homo sapiens
guauaaguguguacaagca

SEQ ID NO: 1335082 - RNA, 19 nt, Homo sapiens
gaaggagaagcacaagcua

SEQ ID NO: 1335083 - RNA, 19 nt, Homo sapiens
uguacaggcugcaguuuga

SEQ ID NO: 1335084 - RNA, 19 nt, Homo sapiens
aggaggagcuggagaaagu

SEQ ID NO: 1335085 - RNA, 19 nt, Homo sapiens
cacaugcacuguugucaga

SEQ ID NO: 1335086 - RNA, 19 nt, Homo sapiens
ucaguugaaugacuuggaa

SEQ ID NO: 1335087 - RNA, 19 nt, Homo sapiens
gaauagaaccaacccaaac

SEQ ID NO: 1335088 - RNA, 19 nt, Homo sapiens
gacaagagcccuccaccau

SEQ ID NO: 1335089 - RNA, 19 nt, Homo sapiens
ccuugaagcugcccuugaa

SEQ ID NO: 1335090 - RNA, 19 nt, Homo sapiens
ccaccaauguccacagcaa

SEQ ID NO: 1335091 - RNA, 19 nt, Homo sapiens
ucgcagcucuggugauuug

SEQ ID NO: 1335092 - RNA, 19 nt, Homo sapiens
gagaagaagcaguggaaga

SEQ ID NO: 1335093 - RNA, 19 nt, Homo sapiens
gcagcgggucuacguauuu

SEQ ID NO: 1335094 - RNA, 19 nt, Homo sapiens
gaugaaccgucgcuccaau

SEQ ID NO: 1335095 - RNA, 19 nt, Homo sapiens
gaaagguggagguggaaga

SEQ ID NO: 1335096 - RNA, 19 nt, Homo sapiens
ggagcuuggugcugaggaa

SEQ ID NO: 1335097 - RNA, 19 nt, Homo sapiens
ccaguucaaugagaccuuu

SEQ ID NO: 1335098 - RNA, 19 nt, Homo sapiens
agaagaagcaguggaagaa

SEQ ID NO: 1335099 - RNA, 19 nt, Homo sapiens
gguugugucuucuucuuca

SEQ ID NO: 1335100 - RNA, 19 nt, Homo sapiens
gauggguugugucuucuuc

SEQ ID NO: 1335101 - RNA, 19 nt, Homo sapiens
cuacguauuuccuccaaag

SEQ ID NO: 1335102 - RNA, 19 nt, Homo sapiens
caaagccgaucaccuugac

SEQ ID NO: 1335103 - RNA, 19 nt, Homo sapiens
ggcagcgggucuacguauu

SEQ ID NO: 1335104 - RNA, 19 nt, Homo sapiens
aagaagcaguggaagaagu

SEQ ID NO: 1335105 - RNA, 19 nt, Homo sapiens
ccaaagccgaucaccuuga

SEQ ID NO: 1335106 - RNA, 19 nt, Homo sapiens
agugauggguugugucuuc

SEQ ID NO: 1335107 - RNA, 19 nt, Homo sapiens
agacagugauggguugugu

SEQ ID NO: 1335108 - RNA, 19 nt, Homo sapiens
cagcgggucuacguauuuc

SEQ ID NO: 1335109 - RNA, 19 nt, Homo sapiens
gaagaagcaguggaagaag

SEQ ID NO: 1335110 - RNA, 19 nt, Homo sapiens
gcuaugcccagcgcuacua

SEQ ID NO: 1335111 - RNA, 19 nt, Homo sapiens
cuccaaagccgaucaccuu

SEQ ID NO: 1335112 - RNA, 19 nt, Homo sapiens
auucgcagcucuggugauu

SEQ ID NO: 1335113 - RNA, 19 nt, Homo sapiens
cggcuccaguucaaugaga

SEQ ID NO: 1335114 - RNA, 19 nt, Homo sapiens
gcugggacuaugagaagaa

SEQ ID NO: 1335115 - RNA, 19 nt, Homo sapiens
cgcagcggguucucaguug

SEQ ID NO: 1335116 - RNA, 19 nt, Homo sapiens
ugugucuucuucuucauug

SEQ ID NO: 1335117 - RNA, 19 nt, Homo sapiens
uguaccggcuccaguucaa

SEQ ID NO: 1335118 - RNA, 19 nt, Homo sapiens
gggaugcacagcucagaag

SEQ ID NO: 1335119 - RNA, 19 nt, Homo sapiens
ggauguaccuuucaaauau

SEQ ID NO: 1335120 - RNA, 19 nt, Homo sapiens
ggagcuagcugcagugugu

SEQ ID NO: 1335121 - RNA, 19 nt, Homo sapiens
aaacucaggugaucuagaa

SEQ ID NO: 1335122 - RNA, 19 nt, Homo sapiens
gaauggaggucccguucga

SEQ ID NO: 1335123 - RNA, 19 nt, Homo sapiens
ggagcaagccgacaucgaa

SEQ ID NO: 1335124 - RNA, 19 nt, Homo sapiens
gauaggaggaucucaguau

SEQ ID NO: 1335125 - RNA, 19 nt, Homo sapiens
gcaaauaccaaaggaaugu

SEQ ID NO: 1335126 - RNA, 19 nt, Homo sapiens
gaggaucucaguauauuug

SEQ ID NO: 1335127 - RNA, 19 nt, Homo sapiens
ggcaagagcagccuaguga

SEQ ID NO: 1335128 - RNA, 19 nt, Homo sapiens
gcaagccgacaucgaagua

SEQ ID NO: 1335129 - RNA, 19 nt, Homo sapiens
ccagaacuuugaauguuug

SEQ ID NO: 1335130 - RNA, 19 nt, Homo sapiens
gauguaccuuucaaauaug

SEQ ID NO: 1335131 - RNA, 19 nt, Homo sapiens
gacaagguuucaccauguu

SEQ ID NO: 1335132 - RNA, 19 nt, Homo sapiens
gcugagagguagugagauc

SEQ ID NO: 1335133 - RNA, 19 nt, Homo sapiens
agacaagguuucaccaugu

SEQ ID NO: 1335134 - RNA, 19 nt, Homo sapiens
gcaacacagcugagaggua

SEQ ID NO: 1335135 - RNA, 19 nt, Homo sapiens
auaggaggaucucaguaua

SEQ ID NO: 1335136 - RNA, 19 nt, Homo sapiens
agagcaggcugaccucauu

SEQ ID NO: 1335137 - RNA, 19 nt, Homo sapiens
ccaaagugcugggaucaca

SEQ ID NO: 1335138 - RNA, 19 nt, Homo sapiens
caggugaucuagaaguguu

SEQ ID NO: 1335139 - RNA, 19 nt, Homo sapiens
uccagaacuuugaauguuu

SEQ ID NO: 1335140 - RNA, 19 nt, Homo sapiens
uggauguaccuuucaaaua

SEQ ID NO: 1335141 - RNA, 19 nt, Homo sapiens
aggaggaucucaguauauu

SEQ ID NO: 1335142 - RNA, 19 nt, Homo sapiens
guggaggccuauaucgauu

SEQ ID NO: 1335143 - RNA, 19 nt, Homo sapiens
ggaggccuauaucgauuuc

SEQ ID NO: 1335144 - RNA, 19 nt, Homo sapiens
ggaucucaguauauuuguu

SEQ ID NO: 1335145 - RNA, 19 nt, Homo sapiens
gaacuuugaauguuugcau

SEQ ID NO: 1335146 - RNA, 19 nt, Homo sapiens
ggucgcagguuguaaaucc

SEQ ID NO: 1335147 - RNA, 19 nt, Homo sapiens
ccaauugggauucucauuc

SEQ ID NO: 1335148 - RNA, 19 nt, Homo sapiens
caauugggauucucauucg

SEQ ID NO: 1335149 - RNA, 19 nt, Homo sapiens
ggaggaucucaguauauuu

SEQ ID NO: 1335150 - RNA, 19 nt, Homo sapiens
ccuuagcccuucugugguu

SEQ ID NO: 1335151 - RNA, 19 nt, Homo sapiens
cagcugagagguagugaga

SEQ ID NO: 1335152 - RNA, 19 nt, Homo sapiens
ggcccugggugcacaucua

SEQ ID NO: 1335153 - RNA, 19 nt, Homo sapiens
uugaauguuugcauacuug

SEQ ID NO: 1335154 - RNA, 19 nt, Homo sapiens
gcaagagcagccuagugaa

SEQ ID NO: 1335155 - RNA, 19 nt, Homo sapiens
cugaguagcugggauuaca

SEQ ID NO: 1335156 - RNA, 19 nt, Homo sapiens
uuccagaacuuugaauguu

SEQ ID NO: 1335157 - RNA, 19 nt, Homo sapiens
caccacgccaggcuaauuu

SEQ ID NO: 1335158 - RNA, 19 nt, Homo sapiens
guggugcgaccucggcuua

SEQ ID NO: 1335159 - RNA, 19 nt, Homo sapiens
gccaccaucuucgcgcuaa

SEQ ID NO: 1335160 - RNA, 19 nt, Homo sapiens
uugcauacuuguggaugua

SEQ ID NO: 1335161 - RNA, 19 nt, Homo sapiens
caagguuucaccauguuga

SEQ ID NO: 1335162 - RNA, 19 nt, Homo sapiens
gcgggucgcagguuguaaa

SEQ ID NO: 1335163 - RNA, 19 nt, Homo sapiens
caaauaccaaaggaaugua

SEQ ID NO: 1335164 - RNA, 19 nt, Homo sapiens
gauccuggacaucaucuuc

SEQ ID NO: 1335165 - RNA, 19 nt, Homo sapiens
ggaagccuguguccaucgu

SEQ ID NO: 1335166 - RNA, 19 nt, Homo sapiens
cagucgaccuggccggauu

SEQ ID NO: 1335167 - RNA, 19 nt, Homo sapiens
gcaggcgaguucacuagac

SEQ ID NO: 1335168 - RNA, 19 nt, Homo sapiens
ccaccacgccaggcuaauu

SEQ ID NO: 1335169 - RNA, 19 nt, Homo sapiens
uggaggcgcugaggaagga

SEQ ID NO: 1335170 - RNA, 19 nt, Homo sapiens
cugcugcuguccugucuga

SEQ ID NO: 1335171 - RNA, 19 nt, Homo sapiens
gaccuuauccacgcggaaa

SEQ ID NO: 1335172 - RNA, 19 nt, Homo sapiens
ggccgagacccucaccaaa

SEQ ID NO: 1335173 - RNA, 19 nt, Homo sapiens
uaggaggaucucaguauau

SEQ ID NO: 1335174 - RNA, 19 nt, Homo sapiens
gccgagacccucaccaaag

SEQ ID NO: 1335175 - RNA, 19 nt, Homo sapiens
guggauguaccuuucaaau

SEQ ID NO: 1335176 - RNA, 19 nt, Homo sapiens
ggugaucuagaaguguuua

SEQ ID NO: 1335177 - RNA, 19 nt, Homo sapiens
ucauucgccugggaaagaa

SEQ ID NO: 1335178 - RNA, 19 nt, Homo sapiens
ggagauccuggacaucauc

SEQ ID NO: 1335179 - RNA, 19 nt, Homo sapiens
caagagcagccuagugaac

SEQ ID NO: 1335180 - RNA, 19 nt, Homo sapiens
uggcuuaaugugugucuuu

SEQ ID NO: 1335181 - RNA, 19 nt, Homo sapiens
cgaccucggcuuacugcaa

SEQ ID NO: 1335182 - RNA, 19 nt, Homo sapiens
gaggcaggcgaguucacua

SEQ ID NO: 1335183 - RNA, 19 nt, Homo sapiens
caaauagugaagcaacaca

SEQ ID NO: 1335184 - RNA, 19 nt, Homo sapiens
ccacguggaggccuauauc

SEQ ID NO: 1335185 - RNA, 19 nt, Homo sapiens
ccgagacccucaccaaagc

SEQ ID NO: 1335186 - RNA, 19 nt, Homo sapiens
uggaugcccucggccacua

SEQ ID NO: 1335187 - RNA, 19 nt, Homo sapiens
gggcaagagcagccuagug

SEQ ID NO: 1335188 - RNA, 19 nt, Homo sapiens
gccacuacaagcagucaaa

SEQ ID NO: 1335189 - RNA, 19 nt, Homo sapiens
auguuugucuuguguauca

SEQ ID NO: 1335190 - RNA, 19 nt, Homo sapiens
ggguugggauggagauagg

SEQ ID NO: 1335191 - RNA, 19 nt, Homo sapiens
gccaauugggauucucauu

SEQ ID NO: 1335192 - RNA, 19 nt, Homo sapiens
cguagaagcuaguauauuu

SEQ ID NO: 1335193 - RNA, 19 nt, Homo sapiens
gaaaguagccacaaucuca

SEQ ID NO: 1335194 - RNA, 19 nt, Homo sapiens
ucaaauggcuccagacaug

SEQ ID NO: 1335195 - RNA, 19 nt, Homo sapiens
ugagaaaguugucauuuga

SEQ ID NO: 1335196 - RNA, 19 nt, Homo sapiens
ggagagagccgcuggaaug

SEQ ID NO: 1335197 - RNA, 19 nt, Homo sapiens
ugacagagguacuuaacaa

SEQ ID NO: 1335198 - RNA, 19 nt, Homo sapiens
aagcaaagcugacggaaga

SEQ ID NO: 1335199 - RNA, 19 nt, Homo sapiens
gaaagugcauagaagaugu

SEQ ID NO: 1335200 - RNA, 19 nt, Homo sapiens
uggagaagcuggagagaaa

SEQ ID NO: 1335201 - RNA, 19 nt, Homo sapiens
gcaaacaagcauucuauau

SEQ ID NO: 1335202 - RNA, 19 nt, Homo sapiens
ggagacgucuuucuuugug

SEQ ID NO: 1335203 - RNA, 19 nt, Homo sapiens
ggaggagacuggcaucugu

SEQ ID NO: 1335204 - RNA, 19 nt, Homo sapiens
ccuaacaaguccaguaauu

SEQ ID NO: 1335205 - RNA, 19 nt, Homo sapiens
gaauuucagugacacauag

SEQ ID NO: 1335206 - RNA, 19 nt, Homo sapiens
caaacaagcauucuauaug

SEQ ID NO: 1335207 - RNA, 19 nt, Homo sapiens
gaaguuacaucugugaagu

SEQ ID NO: 1335208 - RNA, 19 nt, Homo sapiens
gugaaagacuuccacauca

SEQ ID NO: 1335209 - RNA, 19 nt, Homo sapiens
ucaagaaggugcuguacga

SEQ ID NO: 1335210 - RNA, 19 nt, Homo sapiens
uaaauaaggucagcuaguc

SEQ ID NO: 1335211 - RNA, 19 nt, Homo sapiens
gaacaugcguaggcuggaa

SEQ ID NO: 1335212 - RNA, 19 nt, Homo sapiens
gagcaaacaagcauucuau

SEQ ID NO: 1335213 - RNA, 19 nt, Homo sapiens
gugaaaagguuaaaucgua

SEQ ID NO: 1335214 - RNA, 19 nt, Homo sapiens
gccacaaucucaaauaaca

SEQ ID NO: 1335215 - RNA, 19 nt, Homo sapiens
uagccacaaucucaaauaa

SEQ ID NO: 1335216 - RNA, 19 nt, Homo sapiens
gcagaaagugcauagaaga

SEQ ID NO: 1335217 - RNA, 19 nt, Homo sapiens
gaagaaaguagccacaauc

SEQ ID NO: 1335218 - RNA, 19 nt, Homo sapiens
ugaaagacuuccacaucaa

SEQ ID NO: 1335219 - RNA, 19 nt, Homo sapiens
cccagaagaugcuaagaaa

SEQ ID NO: 1335220 - RNA, 19 nt, Homo sapiens
gaaaauauccuccccacaa

SEQ ID NO: 1335221 - RNA, 19 nt, Homo sapiens
gaaaugagggcugaaaaua

SEQ ID NO: 1335222 - RNA, 19 nt, Homo sapiens
ggaaaugugugacuuaacc

SEQ ID NO: 1335223 - RNA, 19 nt, Homo sapiens
gaucuucauuccugccaaa

SEQ ID NO: 1335224 - RNA, 19 nt, Homo sapiens
uagaagaugugauccacuu

SEQ ID NO: 1335225 - RNA, 19 nt, Homo sapiens
uuacaacguuuacacaguu

SEQ ID NO: 1335226 - RNA, 19 nt, Homo sapiens
gagcaggugucgggaaaug

SEQ ID NO: 1335227 - RNA, 19 nt, Homo sapiens
guaggaaugcugaucauga

SEQ ID NO: 1335228 - RNA, 19 nt, Homo sapiens
gcacuuaccacuucaggau

SEQ ID NO: 1335229 - RNA, 19 nt, Homo sapiens
gaagaugugauccacuuug

SEQ ID NO: 1335230 - RNA, 19 nt, Homo sapiens
caauggcucugcuggaaau

SEQ ID NO: 1335231 - RNA, 19 nt, Homo sapiens
caucaggcuucucccagua

SEQ ID NO: 1335232 - RNA, 19 nt, Homo sapiens
gcugggcgcugaaugugaa

SEQ ID NO: 1335233 - RNA, 19 nt, Homo sapiens
cagccucuaugcuugauuu

SEQ ID NO: 1335234 - RNA, 19 nt, Homo sapiens
cggaagaccuguuuaacca

SEQ ID NO: 1335235 - RNA, 19 nt, Homo sapiens
guccagaucugugugugua

SEQ ID NO: 1335236 - RNA, 19 nt, Homo sapiens
ugaagaaaguagccacaau

SEQ ID NO: 1335237 - RNA, 19 nt, Homo sapiens
caugaucugugaaauaaag

SEQ ID NO: 1335238 - RNA, 19 nt, Homo sapiens
accaugaucugugaaauaa

SEQ ID NO: 1335239 - RNA, 19 nt, Homo sapiens
ccauccaggugaauuacua

SEQ ID NO: 1335240 - RNA, 19 nt, Homo sapiens
cugagaaaguugucauuug

SEQ ID NO: 1335241 - RNA, 19 nt, Homo sapiens
gaccaggguucucugaauc

SEQ ID NO: 1335242 - RNA, 19 nt, Homo sapiens
gggcgagugugguuacaga

SEQ ID NO: 1335243 - RNA, 19 nt, Homo sapiens
uaaccaagucccaggaauu

SEQ ID NO: 1335244 - RNA, 19 nt, Homo sapiens
ugacggaagaccuguuuaa

SEQ ID NO: 1335245 - RNA, 19 nt, Homo sapiens
gguauauaaaccaggauua

SEQ ID NO: 1335246 - RNA, 19 nt, Homo sapiens
aaacagaaacucccaacug

SEQ ID NO: 1335247 - RNA, 19 nt, Homo sapiens
ggugaaagacuuccacauc

SEQ ID NO: 1335248 - RNA, 19 nt, Homo sapiens
aaacggugcugcagaaggu

SEQ ID NO: 1335249 - RNA, 19 nt, Homo sapiens
cagagguacuuaacaaugg

SEQ ID NO: 1335250 - RNA, 19 nt, Homo sapiens
caccaugaucugugaaaua

SEQ ID NO: 1335251 - RNA, 19 nt, Homo sapiens
aaagaccacugugauccua

SEQ ID NO: 1335252 - RNA, 19 nt, Homo sapiens
cgggaaaugugugacuuaa

SEQ ID NO: 1335253 - RNA, 19 nt, Homo sapiens
ugaccaggguucucugaau

SEQ ID NO: 1335254 - RNA, 19 nt, Homo sapiens
aaggugcucugcauaauca

SEQ ID NO: 1335255 - RNA, 19 nt, Homo sapiens
ggaaugcugaucaugauag

SEQ ID NO: 1335256 - RNA, 19 nt, Homo sapiens
guauacacuugauuugcuu

SEQ ID NO: 1335257 - RNA, 19 nt, Homo sapiens
aaucguagaagcuaguaua

SEQ ID NO: 1335258 - RNA, 19 nt, Homo sapiens
guagccacaaucucaaaua

SEQ ID NO: 1335259 - RNA, 19 nt, Homo sapiens
uuacaucugugaaguuucu

SEQ ID NO: 1335260 - RNA, 19 nt, Homo sapiens
uaggaaugcugaucaugau

SEQ ID NO: 1335261 - RNA, 19 nt, Homo sapiens
agaaggugcuguacgagau

SEQ ID NO: 1335262 - RNA, 19 nt, Homo sapiens
ccuaaggugcucugcauaa

SEQ ID NO: 1335263 - RNA, 19 nt, Homo sapiens
cuaacaaguccaguaauuu

SEQ ID NO: 1335264 - RNA, 19 nt, Homo sapiens
ggaggagucagucgugguu

SEQ ID NO: 1335265 - RNA, 19 nt, Homo sapiens
gcuagugacggcauuucua

SEQ ID NO: 1335266 - RNA, 19 nt, Homo sapiens
ggucacuucgucaucauuu

SEQ ID NO: 1335267 - RNA, 19 nt, Homo sapiens
gcaauucagccgagagaag

SEQ ID NO: 1335268 - RNA, 19 nt, Homo sapiens
aacaauggcucugcuggaa

SEQ ID NO: 1335269 - RNA, 19 nt, Homo sapiens
aggaacagaugcagaucaa

SEQ ID NO: 1335270 - RNA, 19 nt, Homo sapiens
gaucaugauagguuugguu

SEQ ID NO: 1335271 - RNA, 19 nt, Homo sapiens
ggagaaaauugcacuugug

SEQ ID NO: 1335272 - RNA, 19 nt, Homo sapiens
gcccuguccuuucuugaau

SEQ ID NO: 1335273 - RNA, 19 nt, Homo sapiens
ugaagcauccgguccuuug

SEQ ID NO: 1335274 - RNA, 19 nt, Homo sapiens
gcuggucacuucgucauca

SEQ ID NO: 1335275 - RNA, 19 nt, Homo sapiens
gagcaauucagccgagaga

SEQ ID NO: 1335276 - RNA, 19 nt, Homo sapiens
cuauucagcugucaucucu

SEQ ID NO: 1335277 - RNA, 19 nt, Homo sapiens
cagccaggccugagaauuc

SEQ ID NO: 1335278 - RNA, 19 nt, Homo sapiens
gaagcauccgguccuuuga

SEQ ID NO: 1335279 - RNA, 19 nt, Homo sapiens
cuggagacgucuuucuuug

SEQ ID NO: 1335280 - RNA, 19 nt, Homo sapiens
gaaagacuuccacaucaac

SEQ ID NO: 1335281 - RNA, 19 nt, Homo sapiens
ugaaaacggugcugcagaa

SEQ ID NO: 1335282 - RNA, 19 nt, Homo sapiens
uuacagaggaggcuacaug

SEQ ID NO: 1335283 - RNA, 19 nt, Homo sapiens
gugcauagaagaugugauc

SEQ ID NO: 1335284 - RNA, 19 nt, Homo sapiens
aagcagaaagugcauagaa

SEQ ID NO: 1335285 - RNA, 19 nt, Homo sapiens
cuaaggugcucugcauaau

SEQ ID NO: 1335286 - RNA, 19 nt, Homo sapiens
gacuguauacacuugauuu

SEQ ID NO: 1335287 - RNA, 19 nt, Homo sapiens
gagacuguauacacuugau

SEQ ID NO: 1335288 - RNA, 19 nt, Homo sapiens
aagagacuguauacacuug

SEQ ID NO: 1335289 - RNA, 19 nt, Homo sapiens
gaaucuggucgguuuccua

SEQ ID NO: 1335290 - RNA, 19 nt, Homo sapiens
gaaaguucauuugggguuu

SEQ ID NO: 1335291 - RNA, 19 nt, Homo sapiens
agaggccgcuggucacuuc

SEQ ID NO: 1335292 - RNA, 19 nt, Homo sapiens
gaaggaugcucauuauaua

SEQ ID NO: 1335293 - RNA, 19 nt, Homo sapiens
gaaaagcaguugagucaua

SEQ ID NO: 1335294 - RNA, 19 nt, Homo sapiens
ggaaggaugcucauuauau

SEQ ID NO: 1335295 - RNA, 19 nt, Homo sapiens
gauguuaccuauuucuugu

SEQ ID NO: 1335296 - RNA, 19 nt, Homo sapiens
ugacccaguuuguaaguuu

SEQ ID NO: 1335297 - RNA, 19 nt, Homo sapiens
cauggaaggaugcucauua

SEQ ID NO: 1335298 - RNA, 19 nt, Homo sapiens
ucuugugggucuccuauua

SEQ ID NO: 1335299 - RNA, 19 nt, Homo sapiens
gagaauauggaaaggauug

SEQ ID NO: 1335300 - RNA, 19 nt, Homo sapiens
ggaugcucauuauauauug

SEQ ID NO: 1335301 - RNA, 19 nt, Homo sapiens
ugagacagcugauggaaaa

SEQ ID NO: 1335302 - RNA, 19 nt, Homo sapiens
gauaggcccaggaguaaug

SEQ ID NO: 1335303 - RNA, 19 nt, Homo sapiens
gaugguuucccugaaguua

SEQ ID NO: 1335304 - RNA, 19 nt, Homo sapiens
ggagaccccugcuuccuaa

SEQ ID NO: 1335305 - RNA, 19 nt, Homo sapiens
aaggauaggcccaggagua

SEQ ID NO: 1335306 - RNA, 19 nt, Homo sapiens
gguguaccuuugucguaaa

SEQ ID NO: 1335307 - RNA, 19 nt, Homo sapiens
gaaaaugucaaccaggaaa

SEQ ID NO: 1335308 - RNA, 19 nt, Homo sapiens
ggucuccuauuaccagcuu

SEQ ID NO: 1335309 - RNA, 19 nt, Homo sapiens
cguaaacguuuugauguua

SEQ ID NO: 1335310 - RNA, 19 nt, Homo sapiens
uggaaaagcugagggaaaa

SEQ ID NO: 1335311 - RNA, 19 nt, Homo sapiens
cagcccauccugcaguaua

SEQ ID NO: 1335312 - RNA, 19 nt, Homo sapiens
gcccuuggcccuaccuuug

SEQ ID NO: 1335313 - RNA, 19 nt, Homo sapiens
gcaggagaguuuuaccuau

SEQ ID NO: 1335314 - RNA, 19 nt, Homo sapiens
gggaaaagcaguugaguca

SEQ ID NO: 1335315 - RNA, 19 nt, Homo sapiens
ugaauacugugugccuaga

SEQ ID NO: 1335316 - RNA, 19 nt, Homo sapiens
auggaaggaugcucauuau

SEQ ID NO: 1335317 - RNA, 19 nt, Homo sapiens
caggagaguuuuaccuauu

SEQ ID NO: 1335318 - RNA, 19 nt, Homo sapiens
ugguguaccuuugucguaa

SEQ ID NO: 1335319 - RNA, 19 nt, Homo sapiens
ccugaauccugaugguuuc

SEQ ID NO: 1335320 - RNA, 19 nt, Homo sapiens
ucugucagcaggagaguuu

SEQ ID NO: 1335321 - RNA, 19 nt, Homo sapiens
gacccaguuuguaaguuuc

SEQ ID NO: 1335322 - RNA, 19 nt, Homo sapiens
cauuugugguguaccuuug

SEQ ID NO: 1335323 - RNA, 19 nt, Homo sapiens
ugauguuaccuauuucuug

SEQ ID NO: 1335324 - RNA, 19 nt, Homo sapiens
gagccacaggcaaggauga

SEQ ID NO: 1335325 - RNA, 19 nt, Homo sapiens
uggaaggaugcucauuaua

SEQ ID NO: 1335326 - RNA, 19 nt, Homo sapiens
gugguguaccuuugucgua

SEQ ID NO: 1335327 - RNA, 19 nt, Homo sapiens
ugguuucccugaaguuaau

SEQ ID NO: 1335328 - RNA, 19 nt, Homo sapiens
ccugaugguuucccugaag

SEQ ID NO: 1335329 - RNA, 19 nt, Homo sapiens
guaccuuugucguaaacgu

SEQ ID NO: 1335330 - RNA, 19 nt, Homo sapiens
gugagacagcugauggaaa

SEQ ID NO: 1335331 - RNA, 19 nt, Homo sapiens
aggauaggcccaggaguaa

SEQ ID NO: 1335332 - RNA, 19 nt, Homo sapiens
cuuccuaaacuuacacauu

SEQ ID NO: 1335333 - RNA, 19 nt, Homo sapiens
ggugagacagcugauggaa

SEQ ID NO: 1335334 - RNA, 19 nt, Homo sapiens
ggagagccacaggcaagga

SEQ ID NO: 1335335 - RNA, 19 nt, Homo sapiens
uaacacagcucuuuagauu

SEQ ID NO: 1335336 - RNA, 19 nt, Homo sapiens
aagcagagauggaagaaua

SEQ ID NO: 1335337 - RNA, 19 nt, Homo sapiens
gaaagaacuuaaaggaaga

SEQ ID NO: 1335338 - RNA, 19 nt, Homo sapiens
gaaauuaccagcaucaaga

SEQ ID NO: 1335339 - RNA, 19 nt, Homo sapiens
uuugagagauccacuauua

SEQ ID NO: 1335340 - RNA, 19 nt, Homo sapiens
ccagaugccuuauagguuu

SEQ ID NO: 1335341 - RNA, 19 nt, Homo sapiens
uaacguggcuuaaucugaa

SEQ ID NO: 1335342 - RNA, 19 nt, Homo sapiens
aaacguugcuuucaucaaa

SEQ ID NO: 1335343 - RNA, 19 nt, Homo sapiens
gaaacuacacuauggguaa

SEQ ID NO: 1335344 - RNA, 19 nt, Homo sapiens
agaauuagauguggugaua

SEQ ID NO: 1335345 - RNA, 19 nt, Homo sapiens
caaauaggcuaagaaguug

SEQ ID NO: 1335346 - RNA, 19 nt, Homo sapiens
ggagaaugaccguguguua

SEQ ID NO: 1335347 - RNA, 19 nt, Homo sapiens
uaaaggagcuuggcugguu

SEQ ID NO: 1335348 - RNA, 19 nt, Homo sapiens
agugaaagccucucuauua

SEQ ID NO: 1335349 - RNA, 19 nt, Homo sapiens
gcggagcccugacaucuuu

SEQ ID NO: 1335350 - RNA, 19 nt, Homo sapiens
agagagugguguuugauua

SEQ ID NO: 1335351 - RNA, 19 nt, Homo sapiens
cuaagaaguugaaacacua

SEQ ID NO: 1335352 - RNA, 19 nt, Homo sapiens
acaaauaggcuaagaaguu

SEQ ID NO: 1335353 - RNA, 19 nt, Homo sapiens
caagaucaaucgaguagau

SEQ ID NO: 1335354 - RNA, 19 nt, Homo sapiens
gaacaccagcauacaauga

SEQ ID NO: 1335355 - RNA, 19 nt, Homo sapiens
ccacugguccauaucauua

SEQ ID NO: 1335356 - RNA, 19 nt, Homo sapiens
uagauucccuguuaaguga

SEQ ID NO: 1335357 - RNA, 19 nt, Homo sapiens
ggaagaauuacucuaacua

SEQ ID NO: 1335358 - RNA, 19 nt, Homo sapiens
uguaggagguuaugaagaa

SEQ ID NO: 1335359 - RNA, 19 nt, Homo sapiens
ucacagcaguaaugauaaa

SEQ ID NO: 1335360 - RNA, 19 nt, Homo sapiens
uguggaggauuucucauua

SEQ ID NO: 1335361 - RNA, 19 nt, Homo sapiens
caggagacaucauucuaaa

SEQ ID NO: 1335362 - RNA, 19 nt, Homo sapiens
ggaaaaguaugaucaucua

SEQ ID NO: 1335363 - RNA, 19 nt, Homo sapiens
gcaaugucccucacaacua

SEQ ID NO: 1335364 - RNA, 19 nt, Homo sapiens
ugacagcuuucaugugauu

SEQ ID NO: 1335365 - RNA, 19 nt, Homo sapiens
gugaaagccucucuauuag

SEQ ID NO: 1335366 - RNA, 19 nt, Homo sapiens
gauuccagauggugaaauu

SEQ ID NO: 1335367 - RNA, 19 nt, Homo sapiens
agaaguacaucaggaauga

SEQ ID NO: 1335368 - RNA, 19 nt, Homo sapiens
caacacauuuaucgugaug

SEQ ID NO: 1335369 - RNA, 19 nt, Homo sapiens
ggaagaggcgcucacaaga

SEQ ID NO: 1335370 - RNA, 19 nt, Homo sapiens
gcaguaaugauaaagacua

SEQ ID NO: 1335371 - RNA, 19 nt, Homo sapiens
gcuaagaaguugaaacacu

SEQ ID NO: 1335372 - RNA, 19 nt, Homo sapiens
cgauaguacucaaagcuuu

SEQ ID NO: 1335373 - RNA, 19 nt, Homo sapiens
gacaugaucuucgauaugg

SEQ ID NO: 1335374 - RNA, 19 nt, Homo sapiens
gccaccaucuccuuaauga

SEQ ID NO: 1335375 - RNA, 19 nt, Homo sapiens
uggcaagacugcugaaaga

SEQ ID NO: 1335376 - RNA, 19 nt, Homo sapiens
gaaagugcggcucaucuga

SEQ ID NO: 1335377 - RNA, 19 nt, Homo sapiens
gcacacugcucggagaaug

SEQ ID NO: 1335378 - RNA, 19 nt, Homo sapiens
guacacaugccuccuagaa

SEQ ID NO: 1335379 - RNA, 19 nt, Homo sapiens
ccacccagaugccuuauag

SEQ ID NO: 1335380 - RNA, 19 nt, Homo sapiens
ugucacagcaguaaugaua

SEQ ID NO: 1335381 - RNA, 19 nt, Homo sapiens
gaggauuucucauuacucu

SEQ ID NO: 1335382 - RNA, 19 nt, Homo sapiens
gagagugguguuugauuaa

SEQ ID NO: 1335383 - RNA, 19 nt, Homo sapiens
agaaauggcuaaagcucuu

SEQ ID NO: 1335384 - RNA, 19 nt, Homo sapiens
ggacaugaucuucgauaug

SEQ ID NO: 1335385 - RNA, 19 nt, Homo sapiens
gaagaggcgcucacaagau

SEQ ID NO: 1335386 - RNA, 19 nt, Homo sapiens
ucacauuccuuucuuggau

SEQ ID NO: 1335387 - RNA, 19 nt, Homo sapiens
caaauccauuguugaagga

SEQ ID NO: 1335388 - RNA, 19 nt, Homo sapiens
gcacggcccuuugagagau

SEQ ID NO: 1335389 - RNA, 19 nt, Homo sapiens
uuaagagagugguguuuga

SEQ ID NO: 1335390 - RNA, 19 nt, Homo sapiens
caccaggaacccaaauuua

SEQ ID NO: 1335391 - RNA, 19 nt, Homo sapiens
gcugaaagaacuuaaagga

SEQ ID NO: 1335392 - RNA, 19 nt, Homo sapiens
ccacggugcuuguauaacu

SEQ ID NO: 1335393 - RNA, 19 nt, Homo sapiens
gaacaucauccucgauagu

SEQ ID NO: 1335394 - RNA, 19 nt, Homo sapiens
augagaaggugguaaauau

SEQ ID NO: 1335395 - RNA, 19 nt, Homo sapiens
uuaccacggugcuuguaua

SEQ ID NO: 1335396 - RNA, 19 nt, Homo sapiens
ggucauguggcuggaauua

SEQ ID NO: 1335397 - RNA, 19 nt, Homo sapiens
gagaaugggauuugccuau

SEQ ID NO: 1335398 - RNA, 19 nt, Homo sapiens
aagaggcgcucacaagaug

SEQ ID NO: 1335399 - RNA, 19 nt, Homo sapiens
ggaacccaaauuuagaaua

SEQ ID NO: 1335400 - RNA, 19 nt, Homo sapiens
ccuagaaacuacacuaugg

SEQ ID NO: 1335401 - RNA, 19 nt, Homo sapiens
agucugggcuucugcauug

SEQ ID NO: 1335402 - RNA, 19 nt, Homo sapiens
gaaugggauuugccuaucu

SEQ ID NO: 1335403 - RNA, 19 nt, Homo sapiens
gugacuaucuccuucuuca

SEQ ID NO: 1335404 - RNA, 19 nt, Homo sapiens
cucuuuagauucccuguua

SEQ ID NO: 1335405 - RNA, 19 nt, Homo sapiens
ucauuacucuacaacauug

SEQ ID NO: 1335406 - RNA, 19 nt, Homo sapiens
gggauuugccuaucuaugu

SEQ ID NO: 1335407 - RNA, 19 nt, Homo sapiens
gaggagcagcuuggaauaa

SEQ ID NO: 1335408 - RNA, 19 nt, Homo sapiens
ccaggagacaucauucuaa

SEQ ID NO: 1335409 - RNA, 19 nt, Homo sapiens
gcucacugcccgcuucuuu

SEQ ID NO: 1335410 - RNA, 19 nt, Homo sapiens
gugaggcaguggcauuauu

SEQ ID NO: 1335411 - RNA, 19 nt, Homo sapiens
gcucaguccugcuaacuac

SEQ ID NO: 1335412 - RNA, 19 nt, Homo sapiens
ggagugaggcaguggcauu

SEQ ID NO: 1335413 - RNA, 19 nt, Homo sapiens
caaugucccucacaacuac

SEQ ID NO: 1335414 - RNA, 19 nt, Homo sapiens
ggagacaucauucuaaagg

SEQ ID NO: 1335415 - RNA, 19 nt, Homo sapiens
ugagagauccacuauuaga

SEQ ID NO: 1335416 - RNA, 19 nt, Homo sapiens
cagaacaagauuuaaggua

SEQ ID NO: 1335417 - RNA, 19 nt, Homo sapiens
caugaggcgauuuaaauuu

SEQ ID NO: 1335418 - RNA, 19 nt, Homo sapiens
caagacugcugaaagaacu

SEQ ID NO: 1335419 - RNA, 19 nt, Homo sapiens
gcaguggcauuauugaaaa

SEQ ID NO: 1335420 - RNA, 19 nt, Homo sapiens
caauggacaugaucuucga

SEQ ID NO: 1335421 - RNA, 19 nt, Homo sapiens
acacaugccuccuagaaac

SEQ ID NO: 1335422 - RNA, 19 nt, Homo sapiens
uaaaaugcauugcugagaa

SEQ ID NO: 1335423 - RNA, 19 nt, Homo sapiens
ggcaguggcauuauugaaa

SEQ ID NO: 1335424 - RNA, 19 nt, Homo sapiens
ucacauagagaaugggauu

SEQ ID NO: 1335425 - RNA, 19 nt, Homo sapiens
ggauggcgguguggcauau

SEQ ID NO: 1335426 - RNA, 19 nt, Homo sapiens
gagagauccacuauuagaa

SEQ ID NO: 1335427 - RNA, 19 nt, Homo sapiens
cacauuccuuucuuggaua

SEQ ID NO: 1335428 - RNA, 19 nt, Homo sapiens
caugagaaggugguaaaua

SEQ ID NO: 1335429 - RNA, 19 nt, Homo sapiens
ucgaguagaucccagugaa

SEQ ID NO: 1335430 - RNA, 19 nt, Homo sapiens
ccuguuaagugacucauuc

SEQ ID NO: 1335431 - RNA, 19 nt, Homo sapiens
ccaggaacccaaauuuaga

SEQ ID NO: 1335432 - RNA, 19 nt, Homo sapiens
ggucaugaggcgauuuaaa

SEQ ID NO: 1335433 - RNA, 19 nt, Homo sapiens
ccacugaauucaagcugau

SEQ ID NO: 1335434 - RNA, 19 nt, Homo sapiens
gauggaagaauuagaugug

SEQ ID NO: 1335435 - RNA, 19 nt, Homo sapiens
gaacgaaaccucugaugaa

SEQ ID NO: 1335436 - RNA, 19 nt, Homo sapiens
ucacuaugcuuucagcuua

SEQ ID NO: 1335437 - RNA, 19 nt, Homo sapiens
cgaaaccucugaugaauau

SEQ ID NO: 1335438 - RNA, 19 nt, Homo sapiens
gcaguaaagagcuuaaaua

SEQ ID NO: 1335439 - RNA, 19 nt, Homo sapiens
ccagucaucucugaauuua

SEQ ID NO: 1335440 - RNA, 19 nt, Homo sapiens
gacuugagauuguacauuu

SEQ ID NO: 1335441 - RNA, 19 nt, Homo sapiens
ugaauaugcugaacuagaa

SEQ ID NO: 1335442 - RNA, 19 nt, Homo sapiens
ggugguagaugcugaagaa

SEQ ID NO: 1335443 - RNA, 19 nt, Homo sapiens
gcuuucagcuuacuuuauu

SEQ ID NO: 1335444 - RNA, 19 nt, Homo sapiens
gauaagugcuuuuguguuu

SEQ ID NO: 1335445 - RNA, 19 nt, Homo sapiens
gccauagggugucugauaa

SEQ ID NO: 1335446 - RNA, 19 nt, Homo sapiens
gaaguaaacccugaaacaa

SEQ ID NO: 1335447 - RNA, 19 nt, Homo sapiens
guacauuucuuacuacucu

SEQ ID NO: 1335448 - RNA, 19 nt, Homo sapiens
gagcuuaaauaguuucauc

SEQ ID NO: 1335449 - RNA, 19 nt, Homo sapiens
ggaaguaaacccugaaaca

SEQ ID NO: 1335450 - RNA, 19 nt, Homo sapiens
gaauaugacauugcaguaa

SEQ ID NO: 1335451 - RNA, 19 nt, Homo sapiens
ggcauccacugauagauuu

SEQ ID NO: 1335452 - RNA, 19 nt, Homo sapiens
ugaugaauaugcugaacua

SEQ ID NO: 1335453 - RNA, 19 nt, Homo sapiens
gguagaugcugaagaaagu

SEQ ID NO: 1335454 - RNA, 19 nt, Homo sapiens
caccaucgauaaugauaaa

SEQ ID NO: 1335455 - RNA, 19 nt, Homo sapiens
gagaucagaauaugacauu

SEQ ID NO: 1335456 - RNA, 19 nt, Homo sapiens
gaaauugagcuauccauac

SEQ ID NO: 1335457 - RNA, 19 nt, Homo sapiens
aagcagagauacauccauu

SEQ ID NO: 1335458 - RNA, 19 nt, Homo sapiens
gaagcugucaccaucgaua

SEQ ID NO: 1335459 - RNA, 19 nt, Homo sapiens
agagauacauccauuucaa

SEQ ID NO: 1335460 - RNA, 19 nt, Homo sapiens
ccaaacacacagaacauaa

SEQ ID NO: 1335461 - RNA, 19 nt, Homo sapiens
gcagagauacauccauuuc

SEQ ID NO: 1335462 - RNA, 19 nt, Homo sapiens
aaauugagcuauccauaca

SEQ ID NO: 1335463 - RNA, 19 nt, Homo sapiens
cuacaguuguggucauaaa

SEQ ID NO: 1335464 - RNA, 19 nt, Homo sapiens
ugagagacuugagauugua

SEQ ID NO: 1335465 - RNA, 19 nt, Homo sapiens
caaacacacagaacauaaa

SEQ ID NO: 1335466 - RNA, 19 nt, Homo sapiens
caaaugcugcccuggauga

SEQ ID NO: 1335467 - RNA, 19 nt, Homo sapiens
cagcuuacuuuauuguaug

SEQ ID NO: 1335468 - RNA, 19 nt, Homo sapiens
uaacagauucccuggauca

SEQ ID NO: 1335469 - RNA, 19 nt, Homo sapiens
ugagaaagcaaguucagaa

SEQ ID NO: 1335470 - RNA, 19 nt, Homo sapiens
uguaugauauguaggucua

SEQ ID NO: 1335471 - RNA, 19 nt, Homo sapiens
caaagaacgaaaccucuga

SEQ ID NO: 1335472 - RNA, 19 nt, Homo sapiens
acaagacagucacaucaga

SEQ ID NO: 1335473 - RNA, 19 nt, Homo sapiens
gagggaaaccacggaagua

SEQ ID NO: 1335474 - RNA, 19 nt, Homo sapiens
agucaucucugaauuuaca

SEQ ID NO: 1335475 - RNA, 19 nt, Homo sapiens
agucagugcugguggauau

SEQ ID NO: 1335476 - RNA, 19 nt, Homo sapiens
gauauuaugcuuacaagac

SEQ ID NO: 1335477 - RNA, 19 nt, Homo sapiens
agaagaacuuauaguggaa

SEQ ID NO: 1335478 - RNA, 19 nt, Homo sapiens
ggacugagagacuugagau

SEQ ID NO: 1335479 - RNA, 19 nt, Homo sapiens
guagacauuucagcaacaa

SEQ ID NO: 1335480 - RNA, 19 nt, Homo sapiens
ggaaaccacggaaguaaac

SEQ ID NO: 1335481 - RNA, 19 nt, Homo sapiens
gggaaaccacggaaguaaa

SEQ ID NO: 1335482 - RNA, 19 nt, Homo sapiens
agaaauugagcuauccaua

SEQ ID NO: 1335483 - RNA, 19 nt, Homo sapiens
ucuaacagauucccuggau

SEQ ID NO: 1335484 - RNA, 19 nt, Homo sapiens
aguggaagcugagguggua

SEQ ID NO: 1335485 - RNA, 19 nt, Homo sapiens
caguaaagagcuuaaauag

SEQ ID NO: 1335486 - RNA, 19 nt, Homo sapiens
gccaaacacacagaacaua

SEQ ID NO: 1335487 - RNA, 19 nt, Homo sapiens
gcugguggauauuaugcuu

SEQ ID NO: 1335488 - RNA, 19 nt, Homo sapiens
gguagacauuucagcaaca

SEQ ID NO: 1335489 - RNA, 19 nt, Homo sapiens
ugccauagggugucugaua

SEQ ID NO: 1335490 - RNA, 19 nt, Homo sapiens
cugagagacuugagauugu

SEQ ID NO: 1335491 - RNA, 19 nt, Homo sapiens
cuacucuucuacugucuga

SEQ ID NO: 1335492 - RNA, 19 nt, Homo sapiens
caucagaccaagccaaaca

SEQ ID NO: 1335493 - RNA, 19 nt, Homo sapiens
agaacgaaaccucugauga

SEQ ID NO: 1335494 - RNA, 19 nt, Homo sapiens
uacaaaugcugcccuggau

SEQ ID NO: 1335495 - RNA, 19 nt, Homo sapiens
uuacaagacagucacauca

SEQ ID NO: 1335496 - RNA, 19 nt, Homo sapiens
uaaagaaauugagcuaucc

SEQ ID NO: 1335497 - RNA, 19 nt, Homo sapiens
gagaaagcaaguucagaag

SEQ ID NO: 1335498 - RNA, 19 nt, Homo sapiens
ucagugcugguggauauua

SEQ ID NO: 1335499 - RNA, 19 nt, Homo sapiens
gauacaacaaagaacgaaa

SEQ ID NO: 1335500 - RNA, 19 nt, Homo sapiens
aaacguuaaugggucuuga

SEQ ID NO: 1335501 - RNA, 19 nt, Homo sapiens
augcugaacuagaagaaga

SEQ ID NO: 1335502 - RNA, 19 nt, Homo sapiens
aacgaaaccucugaugaau

SEQ ID NO: 1335503 - RNA, 19 nt, Homo sapiens
ggagaauguugcggaaacu

SEQ ID NO: 1335504 - RNA, 19 nt, Homo sapiens
agaauaugacauugcagua

SEQ ID NO: 1335505 - RNA, 19 nt, Homo sapiens
gaucagaauaugacauugc

SEQ ID NO: 1335506 - RNA, 19 nt, Homo sapiens
cauagggugucugauaagu

SEQ ID NO: 1335507 - RNA, 19 nt, Homo sapiens
uggcauccacugauagauu

SEQ ID NO: 1335508 - RNA, 19 nt, Homo sapiens
gagauacauccauuucaag

SEQ ID NO: 1335509 - RNA, 19 nt, Homo sapiens
caaaugccauagggugucu

SEQ ID NO: 1335510 - RNA, 19 nt, Homo sapiens
acgaaaccucugaugaaua

SEQ ID NO: 1335511 - RNA, 19 nt, Homo sapiens
gacagucacaucagaccaa

SEQ ID NO: 1335512 - RNA, 19 nt, Homo sapiens
ggagaccacagcagucagu

SEQ ID NO: 1335513 - RNA, 19 nt, Homo sapiens
cacaucagaccaagccaaa

SEQ ID NO: 1335514 - RNA, 19 nt, Homo sapiens
ucccagucaucucugaauu

SEQ ID NO: 1335515 - RNA, 19 nt, Homo sapiens
agaccaagccaaacacaca

SEQ ID NO: 1335516 - RNA, 19 nt, Homo sapiens
ccaucgauaaugauaaaga

SEQ ID NO: 1335517 - RNA, 19 nt, Homo sapiens
gagauuguacauuucuuac

SEQ ID NO: 1335518 - RNA, 19 nt, Homo sapiens
guggauauuaugcuuacaa

SEQ ID NO: 1335519 - RNA, 19 nt, Homo sapiens
agaauguugcggaaacuga

SEQ ID NO: 1335520 - RNA, 19 nt, Homo sapiens
guuguaggcgucacaguca

SEQ ID NO: 1335521 - RNA, 19 nt, Homo sapiens
cgagggaaaccacggaagu

SEQ ID NO: 1335522 - RNA, 19 nt, Homo sapiens
ggauauuaugcuuacaaga

SEQ ID NO: 1335523 - RNA, 19 nt, Homo sapiens
cccagucaucucugaauuu

SEQ ID NO: 1335524 - RNA, 19 nt, Homo sapiens
ucaccaucgauaaugauaa

SEQ ID NO: 1335525 - RNA, 19 nt, Homo sapiens
ggaaacugagaaagcaagu

SEQ ID NO: 1335526 - RNA, 19 nt, Homo sapiens
cccagaagaacuuauagug

SEQ ID NO: 1335527 - RNA, 19 nt, Homo sapiens
acugagagacuugagauug

SEQ ID NO: 1335528 - RNA, 19 nt, Homo sapiens
cagagauacauccauuuca

SEQ ID NO: 1335529 - RNA, 19 nt, Homo sapiens
gaggcugcuucggcucaaa

SEQ ID NO: 1335530 - RNA, 19 nt, Homo sapiens
caggaggaagccaguguug

SEQ ID NO: 1335531 - RNA, 19 nt, Homo sapiens
gcugucaccaucgauaaug

SEQ ID NO: 1335532 - RNA, 19 nt, Homo sapiens
cagugcugguggauauuau

SEQ ID NO: 1335533 - RNA, 19 nt, Homo sapiens
gaagaggacuguuguuuua

SEQ ID NO: 1335534 - RNA, 19 nt, Homo sapiens
ugaauaggcugggaaauuu

SEQ ID NO: 1335535 - RNA, 19 nt, Homo sapiens
gaagugaugagcuggauuu

SEQ ID NO: 1335536 - RNA, 19 nt, Homo sapiens
gugaugagcuggauuucuu

SEQ ID NO: 1335537 - RNA, 19 nt, Homo sapiens
gcagcacccuccauacuga

SEQ ID NO: 1335538 - RNA, 19 nt, Homo sapiens
gagcuggauuucuuucuug

SEQ ID NO: 1335539 - RNA, 19 nt, Homo sapiens
aagaggcccugcuccuuua

SEQ ID NO: 1335540 - RNA, 19 nt, Homo sapiens
guccugauauccagucuuu

SEQ ID NO: 1335541 - RNA, 19 nt, Homo sapiens
ccaguggaguguggaauaa

SEQ ID NO: 1335542 - RNA, 19 nt, Homo sapiens
gaacccagagcugauuuaa

SEQ ID NO: 1335543 - RNA, 19 nt, Homo sapiens
ggcaaaaucucucuaguug

SEQ ID NO: 1335544 - RNA, 19 nt, Homo sapiens
gugaauaggcugggaaauu

SEQ ID NO: 1335545 - RNA, 19 nt, Homo sapiens
acaggcagguguagucaaa

SEQ ID NO: 1335546 - RNA, 19 nt, Homo sapiens
ggaggaagaccaagauucu

SEQ ID NO: 1335547 - RNA, 19 nt, Homo sapiens
aaagucugguguccugaua

SEQ ID NO: 1335548 - RNA, 19 nt, Homo sapiens
ucacagugcccucaaguug

SEQ ID NO: 1335549 - RNA, 19 nt, Homo sapiens
ggaaauuucugagccuuuu

SEQ ID NO: 1335550 - RNA, 19 nt, Homo sapiens
cuaguugccuuccuuucaa

SEQ ID NO: 1335551 - RNA, 19 nt, Homo sapiens
gucaauggcugcucaucug

SEQ ID NO: 1335552 - RNA, 19 nt, Homo sapiens
acccagagcugauuuaaaa

SEQ ID NO: 1335553 - RNA, 19 nt, Homo sapiens
augcagaccugggcaguuu

SEQ ID NO: 1335554 - RNA, 19 nt, Homo sapiens
caagcuggagccugacuuu

SEQ ID NO: 1335555 - RNA, 19 nt, Homo sapiens
ugagcuggauuucuuucuu

SEQ ID NO: 1335556 - RNA, 19 nt, Homo sapiens
ccuaucacccaacuucuaa

SEQ ID NO: 1335557 - RNA, 19 nt, Homo sapiens
gugcuaaggugguuuucua

SEQ ID NO: 1335558 - RNA, 19 nt, Homo sapiens
ccagagcucaugaccagaa

SEQ ID NO: 1335559 - RNA, 19 nt, Homo sapiens
uaaggugguuuucuaggua

SEQ ID NO: 1335560 - RNA, 19 nt, Homo sapiens
aggcugcacuggcccauga

SEQ ID NO: 1335561 - RNA, 19 nt, Homo sapiens
gaaagucugguguccugau

SEQ ID NO: 1335562 - RNA, 19 nt, Homo sapiens
ccacaaagaguuccuucuc

SEQ ID NO: 1335563 - RNA, 19 nt, Homo sapiens
gaauaggcugggaaauuuc

SEQ ID NO: 1335564 - RNA, 19 nt, Homo sapiens
acauagaaccccaauauaa

SEQ ID NO: 1335565 - RNA, 19 nt, Homo sapiens
cauagaaccccaauauaaa

SEQ ID NO: 1335566 - RNA, 19 nt, Homo sapiens
ggaggucacuagccauucc

SEQ ID NO: 1335567 - RNA, 19 nt, Homo sapiens
cuggauuucuuucuuguuc

SEQ ID NO: 1335568 - RNA, 19 nt, Homo sapiens
gggaaauuucugagccuuu

SEQ ID NO: 1335569 - RNA, 19 nt, Homo sapiens
cugcucaucuguccaugga

SEQ ID NO: 1335570 - RNA, 19 nt, Homo sapiens
cagccauucucagcccaua

SEQ ID NO: 1335571 - RNA, 19 nt, Homo sapiens
ccagaacccagagcugauu

SEQ ID NO: 1335572 - RNA, 19 nt, Homo sapiens
gccuaucacccaacuucua

SEQ ID NO: 1335573 - RNA, 19 nt, Homo sapiens
ggacuguuguuuuaguuuc

SEQ ID NO: 1335574 - RNA, 19 nt, Homo sapiens
cugaagaggacuguuguuu

SEQ ID NO: 1335575 - RNA, 19 nt, Homo sapiens
ggauuucuuucuuguucca

SEQ ID NO: 1335576 - RNA, 19 nt, Homo sapiens
ugauugauuccuuggguuu

SEQ ID NO: 1335577 - RNA, 19 nt, Homo sapiens
cagccuaucacccaacuuc

SEQ ID NO: 1335578 - RNA, 19 nt, Homo sapiens
uuacauagaaccccaauau

SEQ ID NO: 1335579 - RNA, 19 nt, Homo sapiens
aguggaguguggaauaaau

SEQ ID NO: 1335580 - RNA, 19 nt, Homo sapiens
gagcuccuuuuagcaguua

SEQ ID NO: 1335581 - RNA, 19 nt, Homo sapiens
ggucuucucccagccauuc

SEQ ID NO: 1335582 - RNA, 19 nt, Homo sapiens
gauauccagucuuuucuag

SEQ ID NO: 1335583 - RNA, 19 nt, Homo sapiens
auacugaagaggacuguug

SEQ ID NO: 1335584 - RNA, 19 nt, Homo sapiens
gcagguguagucaaaauga

SEQ ID NO: 1335585 - RNA, 19 nt, Homo sapiens
gccauucucagcccauaug

SEQ ID NO: 1335586 - RNA, 19 nt, Homo sapiens
agaacccagagcugauuua

SEQ ID NO: 1335587 - RNA, 19 nt, Homo sapiens
gggaaugccagcugguaag

SEQ ID NO: 1335588 - RNA, 19 nt, Homo sapiens
uuccaaaccaggagagaaa

SEQ ID NO: 1335589 - RNA, 19 nt, Homo sapiens
ggucacuagccauuccaaa

SEQ ID NO: 1335590 - RNA, 19 nt, Homo sapiens
gaggacuguuguuuuaguu

SEQ ID NO: 1335591 - RNA, 19 nt, Homo sapiens
ugaagaggacuguuguuuu

SEQ ID NO: 1335592 - RNA, 19 nt, Homo sapiens
gaaaggggcaggguggauu

SEQ ID NO: 1335593 - RNA, 19 nt, Homo sapiens
ucuaguugccuuccuuuca

SEQ ID NO: 1335594 - RNA, 19 nt, Homo sapiens
cagaacccagagcugauuu

SEQ ID NO: 1335595 - RNA, 19 nt, Homo sapiens
gcagggauggaggucacua

SEQ ID NO: 1335596 - RNA, 19 nt, Homo sapiens
gguccuuuccuuccacaug

SEQ ID NO: 1335597 - RNA, 19 nt, Homo sapiens
gaugagcuggauuucuuuc

SEQ ID NO: 1335598 - RNA, 19 nt, Homo sapiens
gcacccuccauacugaaga

SEQ ID NO: 1335599 - RNA, 19 nt, Homo sapiens
ugaagaagauucgccguua

SEQ ID NO: 1335600 - RNA, 19 nt, Homo sapiens
ggagagagaggccaagaaa

SEQ ID NO: 1335601 - RNA, 19 nt, Homo sapiens
gaaggcagcagaagucuau

SEQ ID NO: 1335602 - RNA, 19 nt, Homo sapiens
gugaagaggugccugaaug

SEQ ID NO: 1335603 - RNA, 19 nt, Homo sapiens
ggaagacgccugcgcuaaa

SEQ ID NO: 1335604 - RNA, 19 nt, Homo sapiens
cgacaaauguaaagacaag

SEQ ID NO: 1335605 - RNA, 19 nt, Homo sapiens
gaucaaguuugcccuaaag

SEQ ID NO: 1335606 - RNA, 19 nt, Homo sapiens
gaagauucgccguuacaaa

SEQ ID NO: 1335607 - RNA, 19 nt, Homo sapiens
gagaucaaguuugcccuaa

SEQ ID NO: 1335608 - RNA, 19 nt, Homo sapiens
gcaggaagccagcggagaa

SEQ ID NO: 1335609 - RNA, 19 nt, Homo sapiens
gaagacgccugcgcuaaag

SEQ ID NO: 1335610 - RNA, 19 nt, Homo sapiens
gcacagugagaucaaguuu

SEQ ID NO: 1335611 - RNA, 19 nt, Homo sapiens
ggaacgcugugcuguuugu

SEQ ID NO: 1335612 - RNA, 19 nt, Homo sapiens
acaggaagguagagaagaa

SEQ ID NO: 1335613 - RNA, 19 nt, Homo sapiens
gaagaagauucgccguuac

SEQ ID NO: 1335614 - RNA, 19 nt, Homo sapiens
gaagguagagaagaagaaa

SEQ ID NO: 1335615 - RNA, 19 nt, Homo sapiens
caaccaacaugaaaugacu

SEQ ID NO: 1335616 - RNA, 19 nt, Homo sapiens
gagcagagcagagaacugu

SEQ ID NO: 1335617 - RNA, 19 nt, Homo sapiens
ggagaaggcagcagaaguc

SEQ ID NO: 1335618 - RNA, 19 nt, Homo sapiens
gccaagaaaucagcgaaga

SEQ ID NO: 1335619 - RNA, 19 nt, Homo sapiens
cgacaacaguggccugaag

SEQ ID NO: 1335620 - RNA, 19 nt, Homo sapiens
acaaggacguaauggagaa

SEQ ID NO: 1335621 - RNA, 19 nt, Homo sapiens
gaggagaacucggaaagcu

SEQ ID NO: 1335622 - RNA, 19 nt, Homo sapiens
ccucucagauccuccagaa

SEQ ID NO: 1335623 - RNA, 19 nt, Homo sapiens
gggacuugguguucgcuaa

SEQ ID NO: 1335624 - RNA, 19 nt, Homo sapiens
acaguggccugaagaggaa

SEQ ID NO: 1335625 - RNA, 19 nt, Homo sapiens
gagagaggccaagaaauca

SEQ ID NO: 1335626 - RNA, 19 nt, Homo sapiens
ucucagauccuccagaaga

SEQ ID NO: 1335627 - RNA, 19 nt, Homo sapiens
agagagaggccaagaaauc

SEQ ID NO: 1335628 - RNA, 19 nt, Homo sapiens
gaagaggagaacucggaaa

SEQ ID NO: 1335629 - RNA, 19 nt, Homo sapiens
ugugggagauccagaacaa

SEQ ID NO: 1335630 - RNA, 19 nt, Homo sapiens
gaucgaggcggugcagaaa

SEQ ID NO: 1335631 - RNA, 19 nt, Homo sapiens
ggaagguagagaagaagaa

SEQ ID NO: 1335632 - RNA, 19 nt, Homo sapiens
gcugugcuguuuguauuug

SEQ ID NO: 1335633 - RNA, 19 nt, Homo sapiens
acagugagaucaaguuugc

SEQ ID NO: 1335634 - RNA, 19 nt, Homo sapiens
acgaugagcccgucaagaa

SEQ ID NO: 1335635 - RNA, 19 nt, Homo sapiens
ggagaaggccgaggagaag

SEQ ID NO: 1335636 - RNA, 19 nt, Homo sapiens
caacaaguaccccaucuuu

SEQ ID NO: 1335637 - RNA, 19 nt, Homo sapiens
ggacaggaagguagagaag

SEQ ID NO: 1335638 - RNA, 19 nt, Homo sapiens
aaagaugucggucucgaaa

SEQ ID NO: 1335639 - RNA, 19 nt, Homo sapiens
ccaagaaaucagcgaagaa

SEQ ID NO: 1335640 - RNA, 19 nt, Homo sapiens
ggaaaccuggccagaagga

SEQ ID NO: 1335641 - RNA, 19 nt, Homo sapiens
aggccgagcuggagagaga

SEQ ID NO: 1335642 - RNA, 19 nt, Homo sapiens
ggggaacgcugugcuguuu

SEQ ID NO: 1335643 - RNA, 19 nt, Homo sapiens
caagaaaucagcgaagaag

SEQ ID NO: 1335644 - RNA, 19 nt, Homo sapiens
acgcugugcuguuuguauu

SEQ ID NO: 1335645 - RNA, 19 nt, Homo sapiens
agaggaaaggcuucaauga

SEQ ID NO: 1335646 - RNA, 19 nt, Homo sapiens
caagaggaaaggcuucaau

SEQ ID NO: 1335647 - RNA, 19 nt, Homo sapiens
gcccagcaccgaucucuca

SEQ ID NO: 1335648 - RNA, 19 nt, Homo sapiens
guggccaccuugaagaaga

SEQ ID NO: 1335649 - RNA, 19 nt, Homo sapiens
cgacucagacucagacaag

SEQ ID NO: 1335650 - RNA, 19 nt, Homo sapiens
gcuucucgauggacaggaa

SEQ ID NO: 1335651 - RNA, 19 nt, Homo sapiens
caagguguggcuccucuga

SEQ ID NO: 1335652 - RNA, 19 nt, Homo sapiens
ggagaaggcggaggacaag

SEQ ID NO: 1335653 - RNA, 19 nt, Homo sapiens
cgaacaaggacguaaugga

SEQ ID NO: 1335654 - RNA, 19 nt, Homo sapiens
ggaagcccaacaagaggaa

SEQ ID NO: 1335655 - RNA, 19 nt, Homo sapiens
agaucaaguuugcccuaaa

SEQ ID NO: 1335656 - RNA, 19 nt, Homo sapiens
gguguucgcuaagaugaag

SEQ ID NO: 1335657 - RNA, 19 nt, Homo sapiens
ugccuaauuucugugauuu

SEQ ID NO: 1335658 - RNA, 19 nt, Homo sapiens
cugccuaauuucugugauu

SEQ ID NO: 1335659 - RNA, 19 nt, Homo sapiens
ggagagcgcagaggacaag

SEQ ID NO: 1335660 - RNA, 19 nt, Homo sapiens
uacgacaaauguaaagaca

SEQ ID NO: 1335661 - RNA, 19 nt, Homo sapiens
ucgaggcggugcagaaagu

SEQ ID NO: 1335662 - RNA, 19 nt, Homo sapiens
gagagagaggccaagaaau

SEQ ID NO: 1335663 - RNA, 19 nt, Homo sapiens
uaaagaugucggucucgaa

SEQ ID NO: 1335664 - RNA, 19 nt, Homo sapiens
gacaacaguggccugaaga

SEQ ID NO: 1335665 - RNA, 19 nt, Homo sapiens
caggagagcagagcagaga

SEQ ID NO: 1335666 - RNA, 19 nt, Homo sapiens
aggcugggauggagaagga

SEQ ID NO: 1335667 - RNA, 19 nt, Homo sapiens
gaacucggaaagcucaucu

SEQ ID NO: 1335668 - RNA, 19 nt, Homo sapiens
guuacaaagcgaacaagga

SEQ ID NO: 1335669 - RNA, 19 nt, Homo sapiens
aagauucgccguuacaaag

SEQ ID NO: 1335670 - RNA, 19 nt, Homo sapiens
gaacgcugugcuguuugua

SEQ ID NO: 1335671 - RNA, 19 nt, Homo sapiens
gacuugguguucgcuaaga

SEQ ID NO: 1335672 - RNA, 19 nt, Homo sapiens
gaccagcgaccaggacuuc

SEQ ID NO: 1335673 - RNA, 19 nt, Homo sapiens
cgaugugucugugaagaag

SEQ ID NO: 1335674 - RNA, 19 nt, Homo sapiens
ggacuugguguucgcuaag

SEQ ID NO: 1335675 - RNA, 19 nt, Homo sapiens
agacaagaguagcgacaac

SEQ ID NO: 1335676 - RNA, 19 nt, Homo sapiens
cucagauccuccagaagaa

SEQ ID NO: 1335677 - RNA, 19 nt, Homo sapiens
cagaagcugcacagugaga

SEQ ID NO: 1335678 - RNA, 19 nt, Homo sapiens
caagaguagcgacaacagu

SEQ ID NO: 1335679 - RNA, 19 nt, Homo sapiens
caaauguaaagacaaguac

SEQ ID NO: 1335680 - RNA, 19 nt, Homo sapiens
caaagcgaacaaggacgua

SEQ ID NO: 1335681 - RNA, 19 nt, Homo sapiens
gaagcugcacagugagauc

SEQ ID NO: 1335682 - RNA, 19 nt, Homo sapiens
ugaagaccugcacgacgua

SEQ ID NO: 1335683 - RNA, 19 nt, Homo sapiens
gacaggaagguagagaaga

SEQ ID NO: 1335684 - RNA, 19 nt, Homo sapiens
gacucagacucagacaaga

SEQ ID NO: 1335685 - RNA, 19 nt, Homo sapiens
gccagaaggagaagagagu

SEQ ID NO: 1335686 - RNA, 19 nt, Homo sapiens
gauuuccaaccaacaugaa

SEQ ID NO: 1335687 - RNA, 19 nt, Homo sapiens
ggagagcagagcagagaac

SEQ ID NO: 1335688 - RNA, 19 nt, Homo sapiens
aggagaaggccgaggagaa

SEQ ID NO: 1335689 - RNA, 19 nt, Homo sapiens
uggaggagaagcugcagaa

SEQ ID NO: 1335690 - RNA, 19 nt, Homo sapiens
cuacauagcuuuagguaua

SEQ ID NO: 1335691 - RNA, 19 nt, Homo sapiens
gaaacucugucucuacuaa

SEQ ID NO: 1335692 - RNA, 19 nt, Homo sapiens
gcucauggcuucucaggaa

SEQ ID NO: 1335693 - RNA, 19 nt, Homo sapiens
ggauaaggaugguagaguu

SEQ ID NO: 1335694 - RNA, 19 nt, Homo sapiens
gagccaagaucgugccauu

SEQ ID NO: 1335695 - RNA, 19 nt, Homo sapiens
gcauuaagcagauagauau

SEQ ID NO: 1335696 - RNA, 19 nt, Homo sapiens
cuucauuccugguagauua

SEQ ID NO: 1335697 - RNA, 19 nt, Homo sapiens
gcauuaaagccuaaaguga

SEQ ID NO: 1335698 - RNA, 19 nt, Homo sapiens
ugaagaaggugucucuaca

SEQ ID NO: 1335699 - RNA, 19 nt, Homo sapiens
uauacuaccuuuccgcauu

SEQ ID NO: 1335700 - RNA, 19 nt, Homo sapiens
ccacuaccaauuucuauuu

SEQ ID NO: 1335701 - RNA, 19 nt, Homo sapiens
ccagauucaugaaggcuaa

SEQ ID NO: 1335702 - RNA, 19 nt, Homo sapiens
gaucaggaccauugucaga

SEQ ID NO: 1335703 - RNA, 19 nt, Homo sapiens
ucaggaccauugucagaaa

SEQ ID NO: 1335704 - RNA, 19 nt, Homo sapiens
gggaauuccuuuugauuuu

SEQ ID NO: 1335705 - RNA, 19 nt, Homo sapiens
ucagcuggguucuaacaaa

SEQ ID NO: 1335706 - RNA, 19 nt, Homo sapiens
ccugggaggcugagauuua

SEQ ID NO: 1335707 - RNA, 19 nt, Homo sapiens
caugaaggcuaaagggaau

SEQ ID NO: 1335708 - RNA, 19 nt, Homo sapiens
gaccuuguaacuccaauaa

SEQ ID NO: 1335709 - RNA, 19 nt, Homo sapiens
uaaugaugcuaacguguau

SEQ ID NO: 1335710 - RNA, 19 nt, Homo sapiens
ggaaaaugaaguccaguua

SEQ ID NO: 1335711 - RNA, 19 nt, Homo sapiens
aauaagcacugaagaaggu

SEQ ID NO: 1335712 - RNA, 19 nt, Homo sapiens
guugaucuuuguugucauu

SEQ ID NO: 1335713 - RNA, 19 nt, Homo sapiens
ggcauuaagcagauagaua

SEQ ID NO: 1335714 - RNA, 19 nt, Homo sapiens
uagauuaacccuuggcauu

SEQ ID NO: 1335715 - RNA, 19 nt, Homo sapiens
gagguccgcucccaacauc

SEQ ID NO: 1335716 - RNA, 19 nt, Homo sapiens
gaaaaugaaguccaguuaa

SEQ ID NO: 1335717 - RNA, 19 nt, Homo sapiens
ccacguugaucuuuguugu

SEQ ID NO: 1335718 - RNA, 19 nt, Homo sapiens
cuaaugaugcuaacgugua

SEQ ID NO: 1335719 - RNA, 19 nt, Homo sapiens
ugaggaagcagugauguuu

SEQ ID NO: 1335720 - RNA, 19 nt, Homo sapiens
ugguuucacugccuacaua

SEQ ID NO: 1335721 - RNA, 19 nt, Homo sapiens
gcaggagaauggcuugaac

SEQ ID NO: 1335722 - RNA, 19 nt, Homo sapiens
gauaaggaugguagaguug

SEQ ID NO: 1335723 - RNA, 19 nt, Homo sapiens
agauuaacccuuggcauua

SEQ ID NO: 1335724 - RNA, 19 nt, Homo sapiens
ugaauaaugugaggaagca

SEQ ID NO: 1335725 - RNA, 19 nt, Homo sapiens
ccgcauuguuggagcauga

SEQ ID NO: 1335726 - RNA, 19 nt, Homo sapiens
gugaaacucugucucuacu

SEQ ID NO: 1335727 - RNA, 19 nt, Homo sapiens
ccaauaagcacugaagaag

SEQ ID NO: 1335728 - RNA, 19 nt, Homo sapiens
uaacuccaauaagcacuga

SEQ ID NO: 1335729 - RNA, 19 nt, Homo sapiens
cagcaccuuuccuucauuc

SEQ ID NO: 1335730 - RNA, 19 nt, Homo sapiens
uccagaaacuagcccuaaa

SEQ ID NO: 1335731 - RNA, 19 nt, Homo sapiens
gaagaaggugucucuacag

SEQ ID NO: 1335732 - RNA, 19 nt, Homo sapiens
guacguguagucccugcua

SEQ ID NO: 1335733 - RNA, 19 nt, Homo sapiens
aagaaggugucucuacagu

SEQ ID NO: 1335734 - RNA, 19 nt, Homo sapiens
gaucuuuguugucauucuc

SEQ ID NO: 1335735 - RNA, 19 nt, Homo sapiens
ggaaggcaaaucacaaggu

SEQ ID NO: 1335736 - RNA, 19 nt, Homo sapiens
gaggaaggcaaaucacaag

SEQ ID NO: 1335737 - RNA, 19 nt, Homo sapiens
ggaauuccuuuugauuuug

SEQ ID NO: 1335738 - RNA, 19 nt, Homo sapiens
uaugggagguguuagaaaa

SEQ ID NO: 1335739 - RNA, 19 nt, Homo sapiens
ggaagcugaugaggcuaau

SEQ ID NO: 1335740 - RNA, 19 nt, Homo sapiens
gcaccugacucuggaagcu

SEQ ID NO: 1335741 - RNA, 19 nt, Homo sapiens
auacuaccuuuccgcauug

SEQ ID NO: 1335742 - RNA, 19 nt, Homo sapiens
ucaucgcagugcuuuggua

SEQ ID NO: 1335743 - RNA, 19 nt, Homo sapiens
agccucagcuggguucuaa

SEQ ID NO: 1335744 - RNA, 19 nt, Homo sapiens
aagcugaugaggcuaauga

SEQ ID NO: 1335745 - RNA, 19 nt, Homo sapiens
caauuucuauuuccuugac

SEQ ID NO: 1335746 - RNA, 19 nt, Homo sapiens
uaaggaugguagaguugau

SEQ ID NO: 1335747 - RNA, 19 nt, Homo sapiens
ucagcaccuuuccuucauu

SEQ ID NO: 1335748 - RNA, 19 nt, Homo sapiens
gcacccaccccaaguguaa

SEQ ID NO: 1335749 - RNA, 19 nt, Homo sapiens
ucucuacagucccuucuuc

SEQ ID NO: 1335750 - RNA, 19 nt, Homo sapiens
ggaccuuguaacuccaaua

SEQ ID NO: 1335751 - RNA, 19 nt, Homo sapiens
gacuagaauuguggagguu

SEQ ID NO: 1335752 - RNA, 19 nt, Homo sapiens
guaccuccuugcuccuuuc

SEQ ID NO: 1335753 - RNA, 19 nt, Homo sapiens
gcccuccacuaccaauuuc

SEQ ID NO: 1335754 - RNA, 19 nt, Homo sapiens
uaaagugaggcauguucaa

SEQ ID NO: 1335755 - RNA, 19 nt, Homo sapiens
ggcauuaaagccuaaagug

SEQ ID NO: 1335756 - RNA, 19 nt, Homo sapiens
ugaggaaggcaaaucacaa

SEQ ID NO: 1335757 - RNA, 19 nt, Homo sapiens
aaucagcaccuuuccuuca

SEQ ID NO: 1335758 - RNA, 19 nt, Homo sapiens
cagaaacuagcccuaaaca

SEQ ID NO: 1335759 - RNA, 19 nt, Homo sapiens
gguaugggagguguuagaa

SEQ ID NO: 1335760 - RNA, 19 nt, Homo sapiens
ggacugucucacucacauu

SEQ ID NO: 1335761 - RNA, 19 nt, Homo sapiens
ucucaggaagcuuuauaaa

SEQ ID NO: 1335762 - RNA, 19 nt, Homo sapiens
gaggaagcagugauguuuc

SEQ ID NO: 1335763 - RNA, 19 nt, Homo sapiens
cugggaggcugagauuuau

SEQ ID NO: 1335764 - RNA, 19 nt, Homo sapiens
ccuuguaacuccaauaagc

SEQ ID NO: 1335765 - RNA, 19 nt, Homo sapiens
cuuagagacuagaauugug

SEQ ID NO: 1335766 - RNA, 19 nt, Homo sapiens
ucgcagugcuuugguaugg

SEQ ID NO: 1335767 - RNA, 19 nt, Homo sapiens
ccaagaucgugccauugca

SEQ ID NO: 1335768 - RNA, 19 nt, Homo sapiens
ggucagggauaaggauggu

SEQ ID NO: 1335769 - RNA, 19 nt, Homo sapiens
ucuauuuccuugacuaugc

SEQ ID NO: 1335770 - RNA, 19 nt, Homo sapiens
ccagggaacuaaaacugaa

SEQ ID NO: 1335771 - RNA, 19 nt, Homo sapiens
ggagguguuagaaaacuua

SEQ ID NO: 1335772 - RNA, 19 nt, Homo sapiens
cagcuggguucuaacaaaa

SEQ ID NO: 1335773 - RNA, 19 nt, Homo sapiens
gcugaugaggcuaaugaug

SEQ ID NO: 1335774 - RNA, 19 nt, Homo sapiens
ggugaaacucugucucuac

SEQ ID NO: 1335775 - RNA, 19 nt, Homo sapiens
aaaugaaguccaguuaaug

SEQ ID NO: 1335776 - RNA, 19 nt, Homo sapiens
guaugggagguguuagaaa

SEQ ID NO: 1335777 - RNA, 19 nt, Homo sapiens
uaauggaaucagcaccuuu

SEQ ID NO: 1335778 - RNA, 19 nt, Homo sapiens
cacuaccaauuucuauuuc

SEQ ID NO: 1335779 - RNA, 19 nt, Homo sapiens
ccuccacguugaucuuugu

SEQ ID NO: 1335780 - RNA, 19 nt, Homo sapiens
agugaggcauguucaagau

SEQ ID NO: 1335781 - RNA, 19 nt, Homo sapiens
aaaauuagcugggcauggu

SEQ ID NO: 1335782 - RNA, 19 nt, Homo sapiens
ggaugguagaguugauuga

SEQ ID NO: 1335783 - RNA, 19 nt, Homo sapiens
agauuauucuaccagauuc

SEQ ID NO: 1335784 - RNA, 19 nt, Homo sapiens
uuaauggaaucagcaccuu

SEQ ID NO: 1335785 - RNA, 19 nt, Homo sapiens
aggaagcagugauguuucu

SEQ ID NO: 1335786 - RNA, 19 nt, Homo sapiens
uccaauaagcacugaagaa

SEQ ID NO: 1335787 - RNA, 19 nt, Homo sapiens
ccugccaccuccacguuga

SEQ ID NO: 1335788 - RNA, 19 nt, Homo sapiens
cuaccuuuccgcauuguug

SEQ ID NO: 1335789 - RNA, 19 nt, Homo sapiens
gccaagaucgugccauugc

SEQ ID NO: 1335790 - RNA, 19 nt, Homo sapiens
gcagaaagccucaguguug

SEQ ID NO: 1335791 - RNA, 19 nt, Homo sapiens
guacuuggcugccugcuuu

SEQ ID NO: 1335792 - RNA, 19 nt, Homo sapiens
ggucucagcugcucucuuu

SEQ ID NO: 1335793 - RNA, 19 nt, Homo sapiens
gaaauggccaagaaacuua

SEQ ID NO: 1335794 - RNA, 19 nt, Homo sapiens
ggucauggcuccuguacuu

SEQ ID NO: 1335795 - RNA, 19 nt, Homo sapiens
gggcauagcuuuggugaug

SEQ ID NO: 1335796 - RNA, 19 nt, Homo sapiens
gauagaugcucugcgauuu

SEQ ID NO: 1335797 - RNA, 19 nt, Homo sapiens
gcugugggcuucauuguga

SEQ ID NO: 1335798 - RNA, 19 nt, Homo sapiens
gcacuuggcuacagagagu

SEQ ID NO: 1335799 - RNA, 19 nt, Homo sapiens
gaaacggcgugaugcagaa

SEQ ID NO: 1335800 - RNA, 19 nt, Homo sapiens
ggaagacaaucucauuaag

SEQ ID NO: 1335801 - RNA, 19 nt, Homo sapiens
gcgggaggcuggguaguua

SEQ ID NO: 1335802 - RNA, 19 nt, Homo sapiens
gcuguguucuucucugaua

SEQ ID NO: 1335803 - RNA, 19 nt, Homo sapiens
gcugugagcuccugguuca

SEQ ID NO: 1335804 - RNA, 19 nt, Homo sapiens
cagcugcucucuuucugua

SEQ ID NO: 1335805 - RNA, 19 nt, Homo sapiens
gagguagccuagucuguga

SEQ ID NO: 1335806 - RNA, 19 nt, Homo sapiens
gcacuucagccacaacaaa

SEQ ID NO: 1335807 - RNA, 19 nt, Homo sapiens
gcugcucucuuucuguaua

SEQ ID NO: 1335808 - RNA, 19 nt, Homo sapiens
ggaauuggguugcuuuuau

SEQ ID NO: 1335809 - RNA, 19 nt, Homo sapiens
caagaaacuuagccagaug

SEQ ID NO: 1335810 - RNA, 19 nt, Homo sapiens
cuccaaagcuuucuucuuc

SEQ ID NO: 1335811 - RNA, 19 nt, Homo sapiens
cuggauggcuucccgauuu

SEQ ID NO: 1335812 - RNA, 19 nt, Homo sapiens
gagccaagaauuuguggua

SEQ ID NO: 1335813 - RNA, 19 nt, Homo sapiens
uaaccaaggugcucaguac

SEQ ID NO: 1335814 - RNA, 19 nt, Homo sapiens
ccaagaaacuuagccagau

SEQ ID NO: 1335815 - RNA, 19 nt, Homo sapiens
gcucuggccuuuccugugu

SEQ ID NO: 1335816 - RNA, 19 nt, Homo sapiens
caccuaagcuacucacaau

SEQ ID NO: 1335817 - RNA, 19 nt, Homo sapiens
caucuaggacuucauuauu

SEQ ID NO: 1335818 - RNA, 19 nt, Homo sapiens
cagcagagguagccuaguc

SEQ ID NO: 1335819 - RNA, 19 nt, Homo sapiens
ggccucaaguaccucuuua

SEQ ID NO: 1335820 - RNA, 19 nt, Homo sapiens
ucagagaccuagacacagu

SEQ ID NO: 1335821 - RNA, 19 nt, Homo sapiens
ccucaaaucuaccgacaca

SEQ ID NO: 1335822 - RNA, 19 nt, Homo sapiens
gaaugggacgugcugauug

SEQ ID NO: 1335823 - RNA, 19 nt, Homo sapiens
gccaagaauuugugguaug

SEQ ID NO: 1335824 - RNA, 19 nt, Homo sapiens
gagaugauaccuggaaaga

SEQ ID NO: 1335825 - RNA, 19 nt, Homo sapiens
ggaagaggagccacugaug

SEQ ID NO: 1335826 - RNA, 19 nt, Homo sapiens
cagcaggugucccgauuuc

SEQ ID NO: 1335827 - RNA, 19 nt, Homo sapiens
gguacuggaugaucugcaa

SEQ ID NO: 1335828 - RNA, 19 nt, Homo sapiens
cucaggaccuucaagcuaa

SEQ ID NO: 1335829 - RNA, 19 nt, Homo sapiens
uagaugcucugcgauuuga

SEQ ID NO: 1335830 - RNA, 19 nt, Homo sapiens
ggaaaguguuugccccuaa

SEQ ID NO: 1335831 - RNA, 19 nt, Homo sapiens
ggacaauggcauccuggaa

SEQ ID NO: 1335832 - RNA, 19 nt, Homo sapiens
aagacaaucucauuaagca

SEQ ID NO: 1335833 - RNA, 19 nt, Homo sapiens
guggaagacaaucucauua

SEQ ID NO: 1335834 - RNA, 19 nt, Homo sapiens
gcagagcuuccuucuccua

SEQ ID NO: 1335835 - RNA, 19 nt, Homo sapiens
ggacuccugggaacuauug

SEQ ID NO: 1335836 - RNA, 19 nt, Homo sapiens
gcaggugucccgauuucuu

SEQ ID NO: 1335837 - RNA, 19 nt, Homo sapiens
ucaaguaccucuuuauccu

SEQ ID NO: 1335838 - RNA, 19 nt, Homo sapiens
aagcugacuuggauuaugu

SEQ ID NO: 1335839 - RNA, 19 nt, Homo sapiens
ccaagaauuugugguaugg

SEQ ID NO: 1335840 - RNA, 19 nt, Homo sapiens
gccagcugcuuccaccuaa

SEQ ID NO: 1335841 - RNA, 19 nt, Homo sapiens
uggagcgucuggagaauga

SEQ ID NO: 1335842 - RNA, 19 nt, Homo sapiens
gcgcagaaacggcgugaug

SEQ ID NO: 1335843 - RNA, 19 nt, Homo sapiens
uggaagacaaucucauuaa

SEQ ID NO: 1335844 - RNA, 19 nt, Homo sapiens
ccuauaaucccagcacuuu

SEQ ID NO: 1335845 - RNA, 19 nt, Homo sapiens
ugacaucuaggacuucauu

SEQ ID NO: 1335846 - RNA, 19 nt, Homo sapiens
gccauacucuuacuaucau

SEQ ID NO: 1335847 - RNA, 19 nt, Homo sapiens
ccaugugcaucgagucuug

SEQ ID NO: 1335848 - RNA, 19 nt, Homo sapiens
gcucacugccuaccuuuau

SEQ ID NO: 1335849 - RNA, 19 nt, Homo sapiens
ggaugcaucugagggacaa

SEQ ID NO: 1335850 - RNA, 19 nt, Homo sapiens
gagcuuccuucuccuacau

SEQ ID NO: 1335851 - RNA, 19 nt, Homo sapiens
ucaaaucuaccgacacaug

SEQ ID NO: 1335852 - RNA, 19 nt, Homo sapiens
caaggccucugcugacuac

SEQ ID NO: 1335853 - RNA, 19 nt, Homo sapiens
ccucagcucuccaucucaa

SEQ ID NO: 1335854 - RNA, 19 nt, Homo sapiens
gaaugacacacugcuggua

SEQ ID NO: 1335855 - RNA, 19 nt, Homo sapiens
gggagaugauaccuggaaa

SEQ ID NO: 1335856 - RNA, 19 nt, Homo sapiens
cugccuaccuuuauugaug

SEQ ID NO: 1335857 - RNA, 19 nt, Homo sapiens
ggacuucuccugggcauag

SEQ ID NO: 1335858 - RNA, 19 nt, Homo sapiens
gaagacaaucucauuaagc

SEQ ID NO: 1335859 - RNA, 19 nt, Homo sapiens
ugaaauggccaagaaacuu

SEQ ID NO: 1335860 - RNA, 19 nt, Homo sapiens
ccgcugacaucuaggacuu

SEQ ID NO: 1335861 - RNA, 19 nt, Homo sapiens
gggaugcgccucagcacuu

SEQ ID NO: 1335862 - RNA, 19 nt, Homo sapiens
guucuucucugauaguuuu

SEQ ID NO: 1335863 - RNA, 19 nt, Homo sapiens
gcaucucagugggcaauau

SEQ ID NO: 1335864 - RNA, 19 nt, Homo sapiens
ccacacagaccuucuacuc

SEQ ID NO: 1335865 - RNA, 19 nt, Homo sapiens
uggcuucgccgcuauggua

SEQ ID NO: 1335866 - RNA, 19 nt, Homo sapiens
agugauggcugagcuauuc

SEQ ID NO: 1335867 - RNA, 19 nt, Homo sapiens
gaagugauggcugagcuau

SEQ ID NO: 1335868 - RNA, 19 nt, Homo sapiens
gcgcaucagccuuguguuc

SEQ ID NO: 1335869 - RNA, 19 nt, Homo sapiens
gaauuggguugcuuuuaug

SEQ ID NO: 1335870 - RNA, 19 nt, Homo sapiens
gcccugaggcuuggaauug

SEQ ID NO: 1335871 - RNA, 19 nt, Homo sapiens
ggaagugauggcugagcua

SEQ ID NO: 1335872 - RNA, 19 nt, Homo sapiens
gcauagcuuuggugaugag

SEQ ID NO: 1335873 - RNA, 19 nt, Homo sapiens
gagcgcaucagccuugugu

SEQ ID NO: 1335874 - RNA, 19 nt, Homo sapiens
acaauggcauccuggaaca

SEQ ID NO: 1335875 - RNA, 19 nt, Homo sapiens
gguuagagaggaccaaauc

SEQ ID NO: 1335876 - RNA, 19 nt, Homo sapiens
gauuauguggucccucaaa

SEQ ID NO: 1335877 - RNA, 19 nt, Homo sapiens
ucgcuuggcuguguucuuc

SEQ ID NO: 1335878 - RNA, 19 nt, Homo sapiens
cccgauuucuucauaccua

SEQ ID NO: 1335879 - RNA, 19 nt, Homo sapiens
guagccuagucugugauua

SEQ ID NO: 1335880 - RNA, 19 nt, Homo sapiens
gugucccgauuucuucaua

SEQ ID NO: 1335881 - RNA, 19 nt, Homo sapiens
gcagaaacggcgugaugca

SEQ ID NO: 1335882 - RNA, 19 nt, Homo sapiens
ugauagaugcucugcgauu

SEQ ID NO: 1335883 - RNA, 19 nt, Homo sapiens
aggcagaggugggaggauu

SEQ ID NO: 1335884 - RNA, 19 nt, Homo sapiens
gcugacaucuaggacuuca

SEQ ID NO: 1335885 - RNA, 19 nt, Homo sapiens
ugacuguggcugcuuauca

SEQ ID NO: 1335886 - RNA, 19 nt, Homo sapiens
acccugaaauggccaagaa

SEQ ID NO: 1335887 - RNA, 19 nt, Homo sapiens
cauggacaguggugaaugg

SEQ ID NO: 1335888 - RNA, 19 nt, Homo sapiens
agaggauccuggagauuca

SEQ ID NO: 1335889 - RNA, 19 nt, Homo sapiens
gcagaggauccuggagauu

SEQ ID NO: 1335890 - RNA, 19 nt, Homo sapiens
guacuuggcugccugcuuu

SEQ ID NO: 1335891 - RNA, 19 nt, Homo sapiens
ggucucagcugcucucuuu

SEQ ID NO: 1335892 - RNA, 19 nt, Homo sapiens
gaaauggccaagaaacuua

SEQ ID NO: 1335893 - RNA, 19 nt, Homo sapiens
ggucauggcuccuguacuu

SEQ ID NO: 1335894 - RNA, 19 nt, Homo sapiens
gggcauagcuuuggugaug

SEQ ID NO: 1335895 - RNA, 19 nt, Homo sapiens
gcugugggcuucauuguga

SEQ ID NO: 1335896 - RNA, 19 nt, Homo sapiens
gcacuuggcuacagagagu

SEQ ID NO: 1335897 - RNA, 19 nt, Homo sapiens
gcugugagcuccugguuca

SEQ ID NO: 1335898 - RNA, 19 nt, Homo sapiens
cagcugcucucuuucugua

SEQ ID NO: 1335899 - RNA, 19 nt, Homo sapiens
gagguagccuagucuguga

SEQ ID NO: 1335900 - RNA, 19 nt, Homo sapiens
gcugcucucuuucuguaua

SEQ ID NO: 1335901 - RNA, 19 nt, Homo sapiens
cuccaaagcuuucuucuuc

SEQ ID NO: 1335902 - RNA, 19 nt, Homo sapiens
caagaaacuuagccagaug

SEQ ID NO: 1335903 - RNA, 19 nt, Homo sapiens
ccaagaaacuuagccagau

SEQ ID NO: 1335904 - RNA, 19 nt, Homo sapiens
gcucuggccuuuccugugu

SEQ ID NO: 1335905 - RNA, 19 nt, Homo sapiens
caucuaggacuucauuauu

SEQ ID NO: 1335906 - RNA, 19 nt, Homo sapiens
cagcagagguagccuaguc

SEQ ID NO: 1335907 - RNA, 19 nt, Homo sapiens
ggccucaaguaccucuuua

SEQ ID NO: 1335908 - RNA, 19 nt, Homo sapiens
ucagagaccuagacacagu

SEQ ID NO: 1335909 - RNA, 19 nt, Homo sapiens
gaaugggacgugcugauug

SEQ ID NO: 1335910 - RNA, 19 nt, Homo sapiens
ggaagaggagccacugaug

SEQ ID NO: 1335911 - RNA, 19 nt, Homo sapiens
cagcaggugucccgauuuc

SEQ ID NO: 1335912 - RNA, 19 nt, Homo sapiens
gguacuggaugaucugcaa

SEQ ID NO: 1335913 - RNA, 19 nt, Homo sapiens
cucaggaccuucaagcuaa

SEQ ID NO: 1335914 - RNA, 19 nt, Homo sapiens
ggaaaguguuugccccuaa

SEQ ID NO: 1335915 - RNA, 19 nt, Homo sapiens
ggacaauggcauccuggaa

SEQ ID NO: 1335916 - RNA, 19 nt, Homo sapiens
gcaggugucccgauuucuu

SEQ ID NO: 1335917 - RNA, 19 nt, Homo sapiens
ucaaguaccucuuuauccu

SEQ ID NO: 1335918 - RNA, 19 nt, Homo sapiens
uggagcgucuggagaauga

SEQ ID NO: 1335919 - RNA, 19 nt, Homo sapiens
ccuauaaucccagcacuuu

SEQ ID NO: 1335920 - RNA, 19 nt, Homo sapiens
ugacaucuaggacuucauu

SEQ ID NO: 1335921 - RNA, 19 nt, Homo sapiens
gccauacucuuacuaucau

SEQ ID NO: 1335922 - RNA, 19 nt, Homo sapiens
ccaugugcaucgagucuug

SEQ ID NO: 1335923 - RNA, 19 nt, Homo sapiens
ggaugcaucugagggacaa

SEQ ID NO: 1335924 - RNA, 19 nt, Homo sapiens
gagcuuccuucuccuacau

SEQ ID NO: 1335925 - RNA, 19 nt, Homo sapiens
caaggccucugcugacuac

SEQ ID NO: 1335926 - RNA, 19 nt, Homo sapiens
ccucagcucuccaucucaa

SEQ ID NO: 1335927 - RNA, 19 nt, Homo sapiens
gaaugacacacugcuggua

SEQ ID NO: 1335928 - RNA, 19 nt, Homo sapiens
ggacuucuccugggcauag

SEQ ID NO: 1335929 - RNA, 19 nt, Homo sapiens
ugaaauggccaagaaacuu

SEQ ID NO: 1335930 - RNA, 19 nt, Homo sapiens
ccgcugacaucuaggacuu

SEQ ID NO: 1335931 - RNA, 19 nt, Homo sapiens
gggaugcgccucagcacuu

SEQ ID NO: 1335932 - RNA, 19 nt, Homo sapiens
ccacacagaccuucuacuc

SEQ ID NO: 1335933 - RNA, 19 nt, Homo sapiens
agugauggcugagcuauuc

SEQ ID NO: 1335934 - RNA, 19 nt, Homo sapiens
gaagugauggcugagcuau

SEQ ID NO: 1335935 - RNA, 19 nt, Homo sapiens
ggaagugauggcugagcua

SEQ ID NO: 1335936 - RNA, 19 nt, Homo sapiens
gcauagcuuuggugaugag

SEQ ID NO: 1335937 - RNA, 19 nt, Homo sapiens
acaauggcauccuggaaca

SEQ ID NO: 1335938 - RNA, 19 nt, Homo sapiens
cccgauuucuucauaccua

SEQ ID NO: 1335939 - RNA, 19 nt, Homo sapiens
guagccuagucugugauua

SEQ ID NO: 1335940 - RNA, 19 nt, Homo sapiens
gugucccgauuucuucaua

SEQ ID NO: 1335941 - RNA, 19 nt, Homo sapiens
aggcagaggugggaggauu

SEQ ID NO: 1335942 - RNA, 19 nt, Homo sapiens
gcugacaucuaggacuuca

SEQ ID NO: 1335943 - RNA, 19 nt, Homo sapiens
cauggacaguggugaaugg

SEQ ID NO: 1335944 - RNA, 19 nt, Homo sapiens
acccugaaauggccaagaa

SEQ ID NO: 1335945 - RNA, 19 nt, Homo sapiens
gaccccgucucuacuauuu

SEQ ID NO: 1335946 - RNA, 19 nt, Homo sapiens
gcucagccauacucuuacu

SEQ ID NO: 1335947 - RNA, 19 nt, Homo sapiens
agagagugcuggagaacag

SEQ ID NO: 1335948 - RNA, 19 nt, Homo sapiens
uauccuugguauucagauu

SEQ ID NO: 1335949 - RNA, 19 nt, Homo sapiens
ggaugcgccucagcacuuc

SEQ ID NO: 1335950 - RNA, 19 nt, Homo sapiens
ugaaugggacgugcugauu

SEQ ID NO: 1335951 - RNA, 19 nt, Homo sapiens
accaugggaugaccacaaa

SEQ ID NO: 1335952 - RNA, 19 nt, Homo sapiens
gaccaugggaugaccacaa

SEQ ID NO: 1335953 - RNA, 19 nt, Homo sapiens
ggucuccgaaguggaauaa

SEQ ID NO: 1335954 - RNA, 19 nt, Homo sapiens
uacagagagugcuggagaa

SEQ ID NO: 1335955 - RNA, 19 nt, Homo sapiens
uagcuuuggugaugagagu

SEQ ID NO: 1335956 - RNA, 19 nt, Homo sapiens
ccaccagccugucuuucca

SEQ ID NO: 1335957 - RNA, 19 nt, Homo sapiens
ucugcuugcugcugggaua

SEQ ID NO: 1335958 - RNA, 19 nt, Homo sapiens
acucaggaccuucaagcua

SEQ ID NO: 1335959 - RNA, 19 nt, Homo sapiens
ccuaacuccugauuuggau

SEQ ID NO: 1335960 - RNA, 19 nt, Homo sapiens
aguggaguaugaucccuaa

SEQ ID NO: 1335961 - RNA, 19 nt, Homo sapiens
ucuaggacuucauuauucu

SEQ ID NO: 1335962 - RNA, 19 nt, Homo sapiens
ggcauagcuuuggugauga

SEQ ID NO: 1335963 - RNA, 19 nt, Homo sapiens
ggugauuccucaaguuagc

SEQ ID NO: 1335964 - RNA, 19 nt, Homo sapiens
caaguaccucuuuauccuu

SEQ ID NO: 1335965 - RNA, 19 nt, Homo sapiens
gucaagggcugcggaagag

SEQ ID NO: 1335966 - RNA, 19 nt, Homo sapiens
uagacacaguggacaaugg

SEQ ID NO: 1335967 - RNA, 19 nt, Homo sapiens
gaucccuaacuccugauuu

SEQ ID NO: 1335968 - RNA, 19 nt, Homo sapiens
gggccucaaguaccucuuu

SEQ ID NO: 1335969 - RNA, 19 nt, Homo sapiens
gaggaagaggagccacuga

SEQ ID NO: 1335970 - RNA, 19 nt, Homo sapiens
ccaccuccucuuugcagua

SEQ ID NO: 1335971 - RNA, 19 nt, Homo sapiens
ccaaggccucugcugacua

SEQ ID NO: 1335972 - RNA, 19 nt, Homo sapiens
caugggaugaccacaaaug

SEQ ID NO: 1335973 - RNA, 19 nt, Homo sapiens
cucauggucuggaaagugu

SEQ ID NO: 1335974 - RNA, 19 nt, Homo sapiens
aagaggagccacugaugga

SEQ ID NO: 1335975 - RNA, 19 nt, Homo sapiens
aucccuaacuccugauuug

SEQ ID NO: 1335976 - RNA, 19 nt, Homo sapiens
cagccauacucuuacuauc

SEQ ID NO: 1335977 - RNA, 19 nt, Homo sapiens
gcagcugggccucaaguac

SEQ ID NO: 1335978 - RNA, 19 nt, Homo sapiens
aggcgacacugccgacugu

SEQ ID NO: 1335979 - RNA, 19 nt, Homo sapiens
cagaggagccagaggugau

SEQ ID NO: 1335980 - RNA, 19 nt, Homo sapiens
gaccagccuguggaacaua

SEQ ID NO: 1335981 - RNA, 19 nt, Homo sapiens
uauaaucccagcacuuugg

SEQ ID NO: 1335982 - RNA, 19 nt, Homo sapiens
caguguagccuggccugua

SEQ ID NO: 1335983 - RNA, 19 nt, Homo sapiens
gaaaguguuugccccuaag

SEQ ID NO: 1335984 - RNA, 19 nt, Homo sapiens
gcgacacugccgacuguga

SEQ ID NO: 1335985 - RNA, 19 nt, Homo sapiens
ggccugcccaucccauuug

SEQ ID NO: 1335986 - RNA, 19 nt, Homo sapiens
gacaucuaggacuucauua

SEQ ID NO: 1335987 - RNA, 19 nt, Homo sapiens
gguagccuagucugugauu

SEQ ID NO: 1335988 - RNA, 19 nt, Homo sapiens
gccccuaaguucauauuug

SEQ ID NO: 1335989 - RNA, 19 nt, Homo sapiens
ccucaaguaccucuuuauc

SEQ ID NO: 1335990 - RNA, 19 nt, Homo sapiens
gcagugaaaugaacaaaua

SEQ ID NO: 1335991 - RNA, 19 nt, Homo sapiens
gcaagugguuugucuuuau

SEQ ID NO: 1335992 - RNA, 19 nt, Homo sapiens
gugauaagcuuacucuaug

SEQ ID NO: 1335993 - RNA, 19 nt, Homo sapiens
gaugagaccuuggacuuug

SEQ ID NO: 1335994 - RNA, 19 nt, Homo sapiens
gaaagccuguugcguggaa

SEQ ID NO: 1335995 - RNA, 19 nt, Homo sapiens
ggacacaagguuccuguuu

SEQ ID NO: 1335996 - RNA, 19 nt, Homo sapiens
ugaauucugugacuccuaa

SEQ ID NO: 1335997 - RNA, 19 nt, Homo sapiens
ggauugagcuggagaagac

SEQ ID NO: 1335998 - RNA, 19 nt, Homo sapiens
cagagaagcuggaggagau

SEQ ID NO: 1335999 - RNA, 19 nt, Homo sapiens
caccuggucuucagaaauu

SEQ ID NO: 1336000 - RNA, 19 nt, Homo sapiens
gaaagaagauuaggggaaa

SEQ ID NO: 1336001 - RNA, 19 nt, Homo sapiens
uaaccucccugcccucuga

SEQ ID NO: 1336002 - RNA, 19 nt, Homo sapiens
gcaaaccacuacagucagu

SEQ ID NO: 1336003 - RNA, 19 nt, Homo sapiens
gaaaugggguggauuagga

SEQ ID NO: 1336004 - RNA, 19 nt, Homo sapiens
uaaacucucuggguugaaa

SEQ ID NO: 1336005 - RNA, 19 nt, Homo sapiens
gaacaaauagaagaugaga

SEQ ID NO: 1336006 - RNA, 19 nt, Homo sapiens
ggacacagagugcgggaaa

SEQ ID NO: 1336007 - RNA, 19 nt, Homo sapiens
ggagccaucuuccugaauc

SEQ ID NO: 1336008 - RNA, 19 nt, Homo sapiens
ggcaagugguuugucuuua

SEQ ID NO: 1336009 - RNA, 19 nt, Homo sapiens
uaagguuuauuguggauga

SEQ ID NO: 1336010 - RNA, 19 nt, Homo sapiens
gacacaagguuccuguuuc

SEQ ID NO: 1336011 - RNA, 19 nt, Homo sapiens
ggacuagguugcgggagaa

SEQ ID NO: 1336012 - RNA, 19 nt, Homo sapiens
gaguagagaccaugggaaa

SEQ ID NO: 1336013 - RNA, 19 nt, Homo sapiens
guuggugacuccagagaaa

SEQ ID NO: 1336014 - RNA, 19 nt, Homo sapiens
ggacagcaagcaagacuuc

SEQ ID NO: 1336015 - RNA, 19 nt, Homo sapiens
ccaccgaagugacccaaau

SEQ ID NO: 1336016 - RNA, 19 nt, Homo sapiens
ggaaaguggacacaagguu

SEQ ID NO: 1336017 - RNA, 19 nt, Homo sapiens
cuaauaggccaguuuguga

SEQ ID NO: 1336018 - RNA, 19 nt, Homo sapiens
aagcaagacuucaguagca

SEQ ID NO: 1336019 - RNA, 19 nt, Homo sapiens
ggcuggacauggaggauuu

SEQ ID NO: 1336020 - RNA, 19 nt, Homo sapiens
caagugguuugucuuuauc

SEQ ID NO: 1336021 - RNA, 19 nt, Homo sapiens
guagagaccaugggaaaug

SEQ ID NO: 1336022 - RNA, 19 nt, Homo sapiens
gaaguacaggcaagugguu

SEQ ID NO: 1336023 - RNA, 19 nt, Homo sapiens
ccuguugcguggaagauaa

SEQ ID NO: 1336024 - RNA, 19 nt, Homo sapiens
gacuaaaucuuccugucau

SEQ ID NO: 1336025 - RNA, 19 nt, Homo sapiens
gaggaagacauaacagugu

SEQ ID NO: 1336026 - RNA, 19 nt, Homo sapiens
ggaugagaccuuggacuuu

SEQ ID NO: 1336027 - RNA, 19 nt, Homo sapiens
ugauaagcuuacucuauga

SEQ ID NO: 1336028 - RNA, 19 nt, Homo sapiens
uagcaaaccacuacaguca

SEQ ID NO: 1336029 - RNA, 19 nt, Homo sapiens
acaaauagaagaugagaag

SEQ ID NO: 1336030 - RNA, 19 nt, Homo sapiens
aaagagaucaggacagcaa

SEQ ID NO: 1336031 - RNA, 19 nt, Homo sapiens
ccagcaucuucuccucuua

SEQ ID NO: 1336032 - RNA, 19 nt, Homo sapiens
gcaagcaagacuucaguag

SEQ ID NO: 1336033 - RNA, 19 nt, Homo sapiens
cgacuaaaucuuccuguca

SEQ ID NO: 1336034 - RNA, 19 nt, Homo sapiens
gcgggaaaguggacacaag

SEQ ID NO: 1336035 - RNA, 19 nt, Homo sapiens
gcaccuggucuucagaaau

SEQ ID NO: 1336036 - RNA, 19 nt, Homo sapiens
ugacagccgugaggaggaa

SEQ ID NO: 1336037 - RNA, 19 nt, Homo sapiens
aauagaagaugagaaguac

SEQ ID NO: 1336038 - RNA, 19 nt, Homo sapiens
gcaagacuucaguagcaaa

SEQ ID NO: 1336039 - RNA, 19 nt, Homo sapiens
gauucucugucaacucgaa

SEQ ID NO: 1336040 - RNA, 19 nt, Homo sapiens
gagaccugcugcccacugu

SEQ ID NO: 1336041 - RNA, 19 nt, Homo sapiens
cuuaaacucucuggguuga

SEQ ID NO: 1336042 - RNA, 19 nt, Homo sapiens
gacccugacuccagcagau

SEQ ID NO: 1336043 - RNA, 19 nt, Homo sapiens
ucucuggguugaaagaaga

SEQ ID NO: 1336044 - RNA, 19 nt, Homo sapiens
ucuguucccugcauccaaa

SEQ ID NO: 1336045 - RNA, 19 nt, Homo sapiens
gggagaccuuugugcugaa

SEQ ID NO: 1336046 - RNA, 19 nt, Homo sapiens
ugugauaagcuuacucuau

SEQ ID NO: 1336047 - RNA, 19 nt, Homo sapiens
cauggaggauuuggaggaa

SEQ ID NO: 1336048 - RNA, 19 nt, Homo sapiens
agggugggcuggagaucua

SEQ ID NO: 1336049 - RNA, 19 nt, Homo sapiens
gggagucacccacuugcaa

SEQ ID NO: 1336050 - RNA, 19 nt, Homo sapiens
gagcggccuccguagcuaa

SEQ ID NO: 1336051 - RNA, 19 nt, Homo sapiens
gagcuggagaagacuuaaa

SEQ ID NO: 1336052 - RNA, 19 nt, Homo sapiens
ggagucacccacuugcaau

SEQ ID NO: 1336053 - RNA, 19 nt, Homo sapiens
gaccugcugcccacuguga

SEQ ID NO: 1336054 - RNA, 19 nt, Homo sapiens
aauaggccaguuugugaua

SEQ ID NO: 1336055 - RNA, 19 nt, Homo sapiens
ggucagccccagagaauuu

SEQ ID NO: 1336056 - RNA, 19 nt, Homo sapiens
gccaguuugugauaagcuu

SEQ ID NO: 1336057 - RNA, 19 nt, Homo sapiens
ucacccacuugcaaucugu

SEQ ID NO: 1336058 - RNA, 19 nt, Homo sapiens
gcuaaaucuuccagucaac

SEQ ID NO: 1336059 - RNA, 19 nt, Homo sapiens
uugguucacuggacauuuc

SEQ ID NO: 1336060 - RNA, 19 nt, Homo sapiens
uggagaagacuuaaacucu

SEQ ID NO: 1336061 - RNA, 19 nt, Homo sapiens
ccugcuggcuggacaugga

SEQ ID NO: 1336062 - RNA, 19 nt, Homo sapiens
acacaagguuccuguuucc

SEQ ID NO: 1336063 - RNA, 19 nt, Homo sapiens
ugcuaaaucuuccagucaa

SEQ ID NO: 1336064 - RNA, 19 nt, Homo sapiens
ggagaccuuugugcugaag

SEQ ID NO: 1336065 - RNA, 19 nt, Homo sapiens
ggcaccuggucuucagaaa

SEQ ID NO: 1336066 - RNA, 19 nt, Homo sapiens
uaccuggacucgccucuac

SEQ ID NO: 1336067 - RNA, 19 nt, Homo sapiens
uggaugagaccuuggacuu

SEQ ID NO: 1336068 - RNA, 19 nt, Homo sapiens
ugcccacugugaacucuuu

SEQ ID NO: 1336069 - RNA, 19 nt, Homo sapiens
ccaguuugugauaagcuua

SEQ ID NO: 1336070 - RNA, 19 nt, Homo sapiens
ugagcggccuccguagcua

SEQ ID NO: 1336071 - RNA, 19 nt, Homo sapiens
acaggcaagugguuugucu

SEQ ID NO: 1336072 - RNA, 19 nt, Homo sapiens
ugaggaggaagacauaaca

SEQ ID NO: 1336073 - RNA, 19 nt, Homo sapiens
aagagggagucacccacuu

SEQ ID NO: 1336074 - RNA, 19 nt, Homo sapiens
aggcaagugguuugucuuu

SEQ ID NO: 1336075 - RNA, 19 nt, Homo sapiens
guacaggcaagugguuugu

SEQ ID NO: 1336076 - RNA, 19 nt, Homo sapiens
cccagcaucuucuccucuu

SEQ ID NO: 1336077 - RNA, 19 nt, Homo sapiens
gauaagcuuacucuaugag

SEQ ID NO: 1336078 - RNA, 19 nt, Homo sapiens
agacuucaguagcaaacca

SEQ ID NO: 1336079 - RNA, 19 nt, Homo sapiens
auaggccaguuugugauaa

SEQ ID NO: 1336080 - RNA, 19 nt, Homo sapiens
caacaugaagagggaguca

SEQ ID NO: 1336081 - RNA, 19 nt, Homo sapiens
cgggcuacaucuggaaaga

SEQ ID NO: 1336082 - RNA, 19 nt, Homo sapiens
gaacaacaaggacaacuuu

SEQ ID NO: 1336083 - RNA, 19 nt, Homo sapiens
ggucucagguccagcuuua

SEQ ID NO: 1336084 - RNA, 19 nt, Homo sapiens
gcugaugaguuaauuguuu

SEQ ID NO: 1336085 - RNA, 19 nt, Homo sapiens
gagcuuagauucuguaugc

SEQ ID NO: 1336086 - RNA, 19 nt, Homo sapiens
ccacagcccuaguaugaaa

SEQ ID NO: 1336087 - RNA, 19 nt, Homo sapiens
gcuauccucuuauuccuuu

SEQ ID NO: 1336088 - RNA, 19 nt, Homo sapiens
ggucugagcugucccaagu

SEQ ID NO: 1336089 - RNA, 19 nt, Homo sapiens
caaagugcaugcaggagaa

SEQ ID NO: 1336090 - RNA, 19 nt, Homo sapiens
ggauugugcugauguagug

SEQ ID NO: 1336091 - RNA, 19 nt, Homo sapiens
ggaggauugugcugaugua

SEQ ID NO: 1336092 - RNA, 19 nt, Homo sapiens
ucgaggagcugucaaagug

SEQ ID NO: 1336093 - RNA, 19 nt, Homo sapiens
gguuggagcuuugcaauuc

SEQ ID NO: 1336094 - RNA, 19 nt, Homo sapiens
caacaaggacaacuuuaug

SEQ ID NO: 1336095 - RNA, 19 nt, Homo sapiens
aauguaugcuauccucuua

SEQ ID NO: 1336096 - RNA, 19 nt, Homo sapiens
guagugaccaagugcaaua

SEQ ID NO: 1336097 - RNA, 19 nt, Homo sapiens
gcucaagucugucuauugc

SEQ ID NO: 1336098 - RNA, 19 nt, Homo sapiens
aggcuuaacucgcugauga

SEQ ID NO: 1336099 - RNA, 19 nt, Homo sapiens
ggacaacuuuauguagaga

SEQ ID NO: 1336100 - RNA, 19 nt, Homo sapiens
gggcagaaccgaccacuca

SEQ ID NO: 1336101 - RNA, 19 nt, Homo sapiens
ggaggaggauugugcugau

SEQ ID NO: 1336102 - RNA, 19 nt, Homo sapiens
acacaagguuggagcuuug

SEQ ID NO: 1336103 - RNA, 19 nt, Homo sapiens
acuacaagcugcacaaugu

SEQ ID NO: 1336104 - RNA, 19 nt, Homo sapiens
gaagagccggcaccuguug

SEQ ID NO: 1336105 - RNA, 19 nt, Homo sapiens
gggcgguccugcacagauu

SEQ ID NO: 1336106 - RNA, 19 nt, Homo sapiens
gaaccgaccacucaucaag

SEQ ID NO: 1336107 - RNA, 19 nt, Homo sapiens
gcaaggcucguuccuguuc

SEQ ID NO: 1336108 - RNA, 19 nt, Homo sapiens
gcccaggccuagcuacuau

SEQ ID NO: 1336109 - RNA, 19 nt, Homo sapiens
gacgacaaccaccaccuua

SEQ ID NO: 1336110 - RNA, 19 nt, Homo sapiens
aaggacaacuuuauguaga

SEQ ID NO: 1336111 - RNA, 19 nt, Homo sapiens
cggaagauguccaacaagu

SEQ ID NO: 1336112 - RNA, 19 nt, Homo sapiens
uaaagugaguacuguuaag

SEQ ID NO: 1336113 - RNA, 19 nt, Homo sapiens
uguaugcuauccucuuauu

SEQ ID NO: 1336114 - RNA, 19 nt, Homo sapiens
gcaccacggccagaaguaa

SEQ ID NO: 1336115 - RNA, 19 nt, Homo sapiens
ggccgaagcugcugugacu

SEQ ID NO: 1336116 - RNA, 19 nt, Homo sapiens
gcacccagccugcuacaca

SEQ ID NO: 1336117 - RNA, 19 nt, Homo sapiens
gaauaaaaccuacacacaa

SEQ ID NO: 1336118 - RNA, 19 nt, Homo sapiens
acaaggacaacuuuaugua

SEQ ID NO: 1336119 - RNA, 19 nt, Homo sapiens
aaaagaaucggcaguauuu

SEQ ID NO: 1336120 - RNA, 19 nt, Homo sapiens
gugaguacuguuaagaaua

SEQ ID NO: 1336121 - RNA, 19 nt, Homo sapiens
gaggcccacucucugugua

SEQ ID NO: 1336122 - RNA, 19 nt, Homo sapiens
ucccacagcccuaguauga

SEQ ID NO: 1336123 - RNA, 19 nt, Homo sapiens
cgacaaccaccaccuuaug

SEQ ID NO: 1336124 - RNA, 19 nt, Homo sapiens
caaggacaacuuuauguag

SEQ ID NO: 1336125 - RNA, 19 nt, Homo sapiens
gcucguuccuguucagaag

SEQ ID NO: 1336126 - RNA, 19 nt, Homo sapiens
cacacaagguuggagcuuu

SEQ ID NO: 1336127 - RNA, 19 nt, Homo sapiens
uggcuucccucucugaaau

SEQ ID NO: 1336128 - RNA, 19 nt, Homo sapiens
ccaagaagagcaagaaagg

SEQ ID NO: 1336129 - RNA, 19 nt, Homo sapiens
uacaagcugcacaauguua

SEQ ID NO: 1336130 - RNA, 19 nt, Homo sapiens
ccuguggccucuacuacaa

SEQ ID NO: 1336131 - RNA, 19 nt, Homo sapiens
ugacggagagcaugaagau

SEQ ID NO: 1336132 - RNA, 19 nt, Homo sapiens
guggacgucuucuucaauc

SEQ ID NO: 1336133 - RNA, 19 nt, Homo sapiens
gugcugauguagugaccaa

SEQ ID NO: 1336134 - RNA, 19 nt, Homo sapiens
caggaaggaaacaacauuu

SEQ ID NO: 1336135 - RNA, 19 nt, Homo sapiens
ggacaguuguuuggagaac

SEQ ID NO: 1336136 - RNA, 19 nt, Homo sapiens
guacuaguguccgcauaag

SEQ ID NO: 1336137 - RNA, 19 nt, Homo sapiens
gaggaggauugugcugaug

SEQ ID NO: 1336138 - RNA, 19 nt, Homo sapiens
acaacaaggacaacuuuau

SEQ ID NO: 1336139 - RNA, 19 nt, Homo sapiens
caacgccuguggccucuac

SEQ ID NO: 1336140 - RNA, 19 nt, Homo sapiens
gcccugcuaugaaaggaau

SEQ ID NO: 1336141 - RNA, 19 nt, Homo sapiens
uccaacaaguccaagaaga

SEQ ID NO: 1336142 - RNA, 19 nt, Homo sapiens
ggaagauguccaacaaguc

SEQ ID NO: 1336143 - RNA, 19 nt, Homo sapiens
acaggccacugaccaugaa

SEQ ID NO: 1336144 - RNA, 19 nt, Homo sapiens
caagaugaaugggcagaac

SEQ ID NO: 1336145 - RNA, 19 nt, Homo sapiens
cagacgaaggcaaccauuu

SEQ ID NO: 1336146 - RNA, 19 nt, Homo sapiens
cgagguggacgucuucuuc

SEQ ID NO: 1336147 - RNA, 19 nt, Homo sapiens
gaaggaagggauccagacu

SEQ ID NO: 1336148 - RNA, 19 nt, Homo sapiens
aaacgugucccgagcuuag

SEQ ID NO: 1336149 - RNA, 19 nt, Homo sapiens
ggaauaaaaccuacacaca

SEQ ID NO: 1336150 - RNA, 19 nt, Homo sapiens
gugagcuggugccugcuuu

SEQ ID NO: 1336151 - RNA, 19 nt, Homo sapiens
gggauuggcggguccacuu

SEQ ID NO: 1336152 - RNA, 19 nt, Homo sapiens
cagaaccgaccacucauca

SEQ ID NO: 1336153 - RNA, 19 nt, Homo sapiens
gcagaaccgaccacucauc

SEQ ID NO: 1336154 - RNA, 19 nt, Homo sapiens
agugaguacuguuaagaau

SEQ ID NO: 1336155 - RNA, 19 nt, Homo sapiens
gugaccaagugcaauaugg

SEQ ID NO: 1336156 - RNA, 19 nt, Homo sapiens
cggagagcaugaagaugga

SEQ ID NO: 1336157 - RNA, 19 nt, Homo sapiens
gagcuggugccugcuuuga

SEQ ID NO: 1336158 - RNA, 19 nt, Homo sapiens
cacucuggcucccaccuuu

SEQ ID NO: 1336159 - RNA, 19 nt, Homo sapiens
aauguuaacaggccacuga

SEQ ID NO: 1336160 - RNA, 19 nt, Homo sapiens
acaggaaggaaacaacauu

SEQ ID NO: 1336161 - RNA, 19 nt, Homo sapiens
cuacagcagcggacucuuc

SEQ ID NO: 1336162 - RNA, 19 nt, Homo sapiens
aaagugaguacuguuaaga

SEQ ID NO: 1336163 - RNA, 19 nt, Homo sapiens
acuaguguccgcauaagaa

SEQ ID NO: 1336164 - RNA, 19 nt, Homo sapiens
ggaucccacagcccuagua

SEQ ID NO: 1336165 - RNA, 19 nt, Homo sapiens
ucacugacggagagcauga

SEQ ID NO: 1336166 - RNA, 19 nt, Homo sapiens
gagagcaugaagauggaaa

SEQ ID NO: 1336167 - RNA, 19 nt, Homo sapiens
ccaacaaguccaagaagag

SEQ ID NO: 1336168 - RNA, 19 nt, Homo sapiens
accggaagauguccaacaa

SEQ ID NO: 1336169 - RNA, 19 nt, Homo sapiens
acaagcugcacaauguuaa

SEQ ID NO: 1336170 - RNA, 19 nt, Homo sapiens
gagguggacgucuucuuca

SEQ ID NO: 1336171 - RNA, 19 nt, Homo sapiens
ccucuuauuccuuuaaagu

SEQ ID NO: 1336172 - RNA, 19 nt, Homo sapiens
ggccuuugcugcccuuggu

SEQ ID NO: 1336173 - RNA, 19 nt, Homo sapiens
ucacaggaaggaaacaaca

SEQ ID NO: 1336174 - RNA, 19 nt, Homo sapiens
ccugcacccucuucucuuc

SEQ ID NO: 1336175 - RNA, 19 nt, Homo sapiens
gacaaccaccaccuuaugg

SEQ ID NO: 1336176 - RNA, 19 nt, Homo sapiens
gagcaccacggccagaagu

SEQ ID NO: 1336177 - RNA, 19 nt, Homo sapiens
gaucccacagcccuaguau

SEQ ID NO: 1336178 - RNA, 19 nt, Homo sapiens
ggauuggcggguccacuug

SEQ ID NO: 1336179 - RNA, 19 nt, Homo sapiens
gcaugcaggagaagucauc

SEQ ID NO: 1336180 - RNA, 19 nt, Homo sapiens
gccacuaccugugcaaugc

SEQ ID NO: 1336181 - RNA, 19 nt, Homo sapiens
auaaacgugucccgagcuu

SEQ ID NO: 1336182 - RNA, 19 nt, Homo sapiens
ggaaauaaauggugaggaa

SEQ ID NO: 1336183 - RNA, 19 nt, Homo sapiens
gaaggaagauggaauggaa

SEQ ID NO: 1336184 - RNA, 19 nt, Homo sapiens
gguaagaacucagaacaua

SEQ ID NO: 1336185 - RNA, 19 nt, Homo sapiens
gaagaugccuggaaagguu

SEQ ID NO: 1336186 - RNA, 19 nt, Homo sapiens
ggaaagaugaaccaaauaa

SEQ ID NO: 1336187 - RNA, 19 nt, Homo sapiens
gagauagacugcagcauau

SEQ ID NO: 1336188 - RNA, 19 nt, Homo sapiens
gacaauaacuugacucagu

SEQ ID NO: 1336189 - RNA, 19 nt, Homo sapiens
gaacuuugcugaaaucaac

SEQ ID NO: 1336190 - RNA, 19 nt, Homo sapiens
gaauugaugugggaacuuu

SEQ ID NO: 1336191 - RNA, 19 nt, Homo sapiens
gagcacuaaugcccucuua

SEQ ID NO: 1336192 - RNA, 19 nt, Homo sapiens
gcacuaaugcccucuuauu

SEQ ID NO: 1336193 - RNA, 19 nt, Homo sapiens
gaaaccauuugauaggaaa

SEQ ID NO: 1336194 - RNA, 19 nt, Homo sapiens
caacugguguguccaauuc

SEQ ID NO: 1336195 - RNA, 19 nt, Homo sapiens
ggaagaaauccuaaugaaa

SEQ ID NO: 1336196 - RNA, 19 nt, Homo sapiens
aaacauacccugaugaaga

SEQ ID NO: 1336197 - RNA, 19 nt, Homo sapiens
gagaaagaguuugcugaaa

SEQ ID NO: 1336198 - RNA, 19 nt, Homo sapiens
ggaaaccauuugauaggaa

SEQ ID NO: 1336199 - RNA, 19 nt, Homo sapiens
gaaagaauuccucaccauu

SEQ ID NO: 1336200 - RNA, 19 nt, Homo sapiens
uaggaaagaugaaccaaau

SEQ ID NO: 1336201 - RNA, 19 nt, Homo sapiens
ccuaagaaauccaacagaa

SEQ ID NO: 1336202 - RNA, 19 nt, Homo sapiens
ggagaaggauauccagaca

SEQ ID NO: 1336203 - RNA, 19 nt, Homo sapiens
gagaagggaggauauaaga

SEQ ID NO: 1336204 - RNA, 19 nt, Homo sapiens
gcuaauaaauugggaaugg

SEQ ID NO: 1336205 - RNA, 19 nt, Homo sapiens
ggucaaacuggaaauuaua

SEQ ID NO: 1336206 - RNA, 19 nt, Homo sapiens
caaauggaguugagcacuu

SEQ ID NO: 1336207 - RNA, 19 nt, Homo sapiens
gaaaucaaccuguaauacu

SEQ ID NO: 1336208 - RNA, 19 nt, Homo sapiens
ggagaaagaguuugcugaa

SEQ ID NO: 1336209 - RNA, 19 nt, Homo sapiens
gcaaagggagcauacaaau

SEQ ID NO: 1336210 - RNA, 19 nt, Homo sapiens
ggaggaaggcaaagaaguu

SEQ ID NO: 1336211 - RNA, 19 nt, Homo sapiens
caaguucauucuguagaua

SEQ ID NO: 1336212 - RNA, 19 nt, Homo sapiens
agagauagacugcagcaua

SEQ ID NO: 1336213 - RNA, 19 nt, Homo sapiens
gaggaaggcaaagaaguua

SEQ ID NO: 1336214 - RNA, 19 nt, Homo sapiens
ggauauaagagcacuaaug

SEQ ID NO: 1336215 - RNA, 19 nt, Homo sapiens
gaaccaaauaacucaauga

SEQ ID NO: 1336216 - RNA, 19 nt, Homo sapiens
guaagaacucagaacauaa

SEQ ID NO: 1336217 - RNA, 19 nt, Homo sapiens
ugaugaagauccugaacuu

SEQ ID NO: 1336218 - RNA, 19 nt, Homo sapiens
gaaaacacuugacaccaaa

SEQ ID NO: 1336219 - RNA, 19 nt, Homo sapiens
gaguugagcacuugugaaa

SEQ ID NO: 1336220 - RNA, 19 nt, Homo sapiens
ugaaaacacugaaaacuug

SEQ ID NO: 1336221 - RNA, 19 nt, Homo sapiens
acccuaagauagcuaauaa

SEQ ID NO: 1336222 - RNA, 19 nt, Homo sapiens
cgucaaaucuaaugucaag

SEQ ID NO: 1336223 - RNA, 19 nt, Homo sapiens
ccagacagcccuaagaaau

SEQ ID NO: 1336224 - RNA, 19 nt, Homo sapiens
gaaauaaggaaggaagaug

SEQ ID NO: 1336225 - RNA, 19 nt, Homo sapiens
gaaacauccuauuauacca

SEQ ID NO: 1336226 - RNA, 19 nt, Homo sapiens
caaaucuaaugucaaguuc

SEQ ID NO: 1336227 - RNA, 19 nt, Homo sapiens
ggaaauuauagucacagua

SEQ ID NO: 1336228 - RNA, 19 nt, Homo sapiens
gauauaagagcacuaaugc

SEQ ID NO: 1336229 - RNA, 19 nt, Homo sapiens
gaggauauaagagcacuaa

SEQ ID NO: 1336230 - RNA, 19 nt, Homo sapiens
auaccugagugccuucuua

SEQ ID NO: 1336231 - RNA, 19 nt, Homo sapiens
aaacuuccuuuccacaaga

SEQ ID NO: 1336232 - RNA, 19 nt, Homo sapiens
aaacuuggcccuacagugu

SEQ ID NO: 1336233 - RNA, 19 nt, Homo sapiens
uaaggaaaccauuugauag

SEQ ID NO: 1336234 - RNA, 19 nt, Homo sapiens
caaauggcagucugugaaa

SEQ ID NO: 1336235 - RNA, 19 nt, Homo sapiens
ucaaguugcucuccggaau

SEQ ID NO: 1336236 - RNA, 19 nt, Homo sapiens
gaaauucaaguucauucug

SEQ ID NO: 1336237 - RNA, 19 nt, Homo sapiens
agaaagaguuugcugaaaa

SEQ ID NO: 1336238 - RNA, 19 nt, Homo sapiens
caaacuuccuuuccacaag

SEQ ID NO: 1336239 - RNA, 19 nt, Homo sapiens
ggacccagaaggagaaaga

SEQ ID NO: 1336240 - RNA, 19 nt, Homo sapiens
aaagggagcauacaaaugg

SEQ ID NO: 1336241 - RNA, 19 nt, Homo sapiens
ccaaccaagucgucaaauc

SEQ ID NO: 1336242 - RNA, 19 nt, Homo sapiens
ccaagggaccucaaacuuc

SEQ ID NO: 1336243 - RNA, 19 nt, Homo sapiens
ggaucuuguuggaaauauu

SEQ ID NO: 1336244 - RNA, 19 nt, Homo sapiens
caaagggagcauacaaaug

SEQ ID NO: 1336245 - RNA, 19 nt, Homo sapiens
ccagaaggagaaagaguuu

SEQ ID NO: 1336246 - RNA, 19 nt, Homo sapiens
cuaagaaauccaacagaaa

SEQ ID NO: 1336247 - RNA, 19 nt, Homo sapiens
ugaagaccuuggaagaaug

SEQ ID NO: 1336248 - RNA, 19 nt, Homo sapiens
ccagaaguguggcugaaag

SEQ ID NO: 1336249 - RNA, 19 nt, Homo sapiens
aaugauggaugagcuggua

SEQ ID NO: 1336250 - RNA, 19 nt, Homo sapiens
caaccaagucgucaaaucu

SEQ ID NO: 1336251 - RNA, 19 nt, Homo sapiens
ucaaguucauucuguagau

SEQ ID NO: 1336252 - RNA, 19 nt, Homo sapiens
ggagaagggaggauauaag

SEQ ID NO: 1336253 - RNA, 19 nt, Homo sapiens
gggagaagggaggauauaa

SEQ ID NO: 1336254 - RNA, 19 nt, Homo sapiens
uggaugagcugguagaaaa

SEQ ID NO: 1336255 - RNA, 19 nt, Homo sapiens
agaaagaauuccucaccau

SEQ ID NO: 1336256 - RNA, 19 nt, Homo sapiens
aacacaagcuuuagugaca

SEQ ID NO: 1336257 - RNA, 19 nt, Homo sapiens
cagcauaucaagugaggaa

SEQ ID NO: 1336258 - RNA, 19 nt, Homo sapiens
gaaaggcaaauggaguuga

SEQ ID NO: 1336259 - RNA, 19 nt, Homo sapiens
cugaagaccuuggaagaau

SEQ ID NO: 1336260 - RNA, 19 nt, Homo sapiens
caaaaugucagaacuaaga

SEQ ID NO: 1336261 - RNA, 19 nt, Homo sapiens
gaaguguggcugaaagaca

SEQ ID NO: 1336262 - RNA, 19 nt, Homo sapiens
cacuaaugcccucuuauuu

SEQ ID NO: 1336263 - RNA, 19 nt, Homo sapiens
acaaauggcagucugugaa

SEQ ID NO: 1336264 - RNA, 19 nt, Homo sapiens
gggaguauuuccgaaguuc

SEQ ID NO: 1336265 - RNA, 19 nt, Homo sapiens
aauaaauggugaggaagaa

SEQ ID NO: 1336266 - RNA, 19 nt, Homo sapiens
gcucaaguccagcaagaug

SEQ ID NO: 1336267 - RNA, 19 nt, Homo sapiens
uugcugaaaucaaccugua

SEQ ID NO: 1336268 - RNA, 19 nt, Homo sapiens
ugugggaacuuugcugaaa

SEQ ID NO: 1336269 - RNA, 19 nt, Homo sapiens
auaacucaaugauggauga

SEQ ID NO: 1336270 - RNA, 19 nt, Homo sapiens
caaauaacucaaugaugga

SEQ ID NO: 1336271 - RNA, 19 nt, Homo sapiens
gaaagaugaaccaaauaac

SEQ ID NO: 1336272 - RNA, 19 nt, Homo sapiens
uaauauaacaguccaaggu

SEQ ID NO: 1336273 - RNA, 19 nt, Homo sapiens
aaauggaguugagcacuug

SEQ ID NO: 1336274 - RNA, 19 nt, Homo sapiens
ugucagaacuaagacucua

SEQ ID NO: 1336275 - RNA, 19 nt, Homo sapiens
ugaaccaaauaacucaaug

SEQ ID NO: 1336276 - RNA, 19 nt, Homo sapiens
cuaaugucaaguucucuua

SEQ ID NO: 1336277 - RNA, 19 nt, Homo sapiens
gcggauguagcccagguua

SEQ ID NO: 1336278 - RNA, 19 nt, Homo sapiens
uuaccacucuccagaagau

SEQ ID NO: 1336279 - RNA, 19 nt, Homo sapiens
uaucccaacuuucuuuagu

SEQ ID NO: 1336280 - RNA, 19 nt, Homo sapiens
ggaaggcaaagaaguuauc

SEQ ID NO: 1336281 - RNA, 19 nt, Homo sapiens
caaaagaagugaccacaac

SEQ ID NO: 1336282 - RNA, 19 nt, Homo sapiens
ggacaaggcuggcaaagaa

SEQ ID NO: 1336283 - RNA, 19 nt, Homo sapiens
gcgauuagauccucaguua

SEQ ID NO: 1336284 - RNA, 19 nt, Homo sapiens
gaauuauggugcuagauua

SEQ ID NO: 1336285 - RNA, 19 nt, Homo sapiens
gggcacagcugaauggaaa

SEQ ID NO: 1336286 - RNA, 19 nt, Homo sapiens
gaccaagacuggaauuaug

SEQ ID NO: 1336287 - RNA, 19 nt, Homo sapiens
gauuagauccucaguuauu

SEQ ID NO: 1336288 - RNA, 19 nt, Homo sapiens
ggaauuauggugcuagauu

SEQ ID NO: 1336289 - RNA, 19 nt, Homo sapiens
acacgaaggugguuuaagg

SEQ ID NO: 1336290 - RNA, 19 nt, Homo sapiens
gcagaaaccgacacaguca

SEQ ID NO: 1336291 - RNA, 19 nt, Homo sapiens
gcaaaccugccaagcuuga

SEQ ID NO: 1336292 - RNA, 19 nt, Homo sapiens
gaaaaggggcuucacaguu

SEQ ID NO: 1336293 - RNA, 19 nt, Homo sapiens
cagcaagacccaaagaguu

SEQ ID NO: 1336294 - RNA, 19 nt, Homo sapiens
cugcaaaccugccaagcuu

SEQ ID NO: 1336295 - RNA, 19 nt, Homo sapiens
acucucagccuguuugaua

SEQ ID NO: 1336296 - RNA, 19 nt, Homo sapiens
gaauggaaagccaguagga

SEQ ID NO: 1336297 - RNA, 19 nt, Homo sapiens
ggugcuagauuaguaaaca

SEQ ID NO: 1336298 - RNA, 19 nt, Homo sapiens
uuauggugcuagauuagua

SEQ ID NO: 1336299 - RNA, 19 nt, Homo sapiens
uuagacaguuccagaugaa

SEQ ID NO: 1336300 - RNA, 19 nt, Homo sapiens
ggugggcgacacauaauuu

SEQ ID NO: 1336301 - RNA, 19 nt, Homo sapiens
cgucuuagaucugucguau

SEQ ID NO: 1336302 - RNA, 19 nt, Homo sapiens
gaaaagggcgucuuagauc

SEQ ID NO: 1336303 - RNA, 19 nt, Homo sapiens
cuuacuagaugacauuuca

SEQ ID NO: 1336304 - RNA, 19 nt, Homo sapiens
ucuuagaucugucguaugg

SEQ ID NO: 1336305 - RNA, 19 nt, Homo sapiens
aaaccaggguacaguggaa

SEQ ID NO: 1336306 - RNA, 19 nt, Homo sapiens
aaaaggggcuucacaguuc

SEQ ID NO: 1336307 - RNA, 19 nt, Homo sapiens
ggacacgaaggugguuuaa

SEQ ID NO: 1336308 - RNA, 19 nt, Homo sapiens
caagccgacuguuauccuu

SEQ ID NO: 1336309 - RNA, 19 nt, Homo sapiens
ccagaugaaugaccaagac

SEQ ID NO: 1336310 - RNA, 19 nt, Homo sapiens
gacaguuccagaugaauga

SEQ ID NO: 1336311 - RNA, 19 nt, Homo sapiens
cuucacaguucaugggaaa

SEQ ID NO: 1336312 - RNA, 19 nt, Homo sapiens
gcagccggguuugcagaaa

SEQ ID NO: 1336313 - RNA, 19 nt, Homo sapiens
gaucagcaagacccaaaga

SEQ ID NO: 1336314 - RNA, 19 nt, Homo sapiens
gggcaaacaagcaggauca

SEQ ID NO: 1336315 - RNA, 19 nt, Homo sapiens
ucgccgaagucaucagaaa

SEQ ID NO: 1336316 - RNA, 19 nt, Homo sapiens
ccaccuacauaccaugaca

SEQ ID NO: 1336317 - RNA, 19 nt, Homo sapiens
ugaaugaccaagacuggaa

SEQ ID NO: 1336318 - RNA, 19 nt, Homo sapiens
cagccuguuugauaaguau

SEQ ID NO: 1336319 - RNA, 19 nt, Homo sapiens
gcauguaccagcgauucua

SEQ ID NO: 1336320 - RNA, 19 nt, Homo sapiens
ucagucaggagaauacaaa

SEQ ID NO: 1336321 - RNA, 19 nt, Homo sapiens
uuuagacaguuccagauga

SEQ ID NO: 1336322 - RNA, 19 nt, Homo sapiens
cgacacagucaaucaguca

SEQ ID NO: 1336323 - RNA, 19 nt, Homo sapiens
ugaccaagacuggaauuau

SEQ ID NO: 1336324 - RNA, 19 nt, Homo sapiens
ucagccuguuugauaagua

SEQ ID NO: 1336325 - RNA, 19 nt, Homo sapiens
gaacucgaguacgggagau

SEQ ID NO: 1336326 - RNA, 19 nt, Homo sapiens
gcuagauuaguaaacauga

SEQ ID NO: 1336327 - RNA, 19 nt, Homo sapiens
uauaccacccaccuacaua

SEQ ID NO: 1336328 - RNA, 19 nt, Homo sapiens
gcaggacaaggcuggcaaa

SEQ ID NO: 1336329 - RNA, 19 nt, Homo sapiens
ggcggugggcgacacauaa

SEQ ID NO: 1336330 - RNA, 19 nt, Homo sapiens
gacaaggcuggcaaagaaa

SEQ ID NO: 1336331 - RNA, 19 nt, Homo sapiens
aaaccgacacagucaauca

SEQ ID NO: 1336332 - RNA, 19 nt, Homo sapiens
ucaaucagucaggagaaua

SEQ ID NO: 1336333 - RNA, 19 nt, Homo sapiens
cagccggguuugcagaaau

SEQ ID NO: 1336334 - RNA, 19 nt, Homo sapiens
aaacaagcaggaucagcaa

SEQ ID NO: 1336335 - RNA, 19 nt, Homo sapiens
ggacgggaugggcaaacaa

SEQ ID NO: 1336336 - RNA, 19 nt, Homo sapiens
ucaguuauuccuagacaug

SEQ ID NO: 1336337 - RNA, 19 nt, Homo sapiens
ccucaguuauuccuagaca

SEQ ID NO: 1336338 - RNA, 19 nt, Homo sapiens
cauguaccagcgauucuaa

SEQ ID NO: 1336339 - RNA, 19 nt, Homo sapiens
ugccaagcuugaagucuga

SEQ ID NO: 1336340 - RNA, 19 nt, Homo sapiens
caagggcaaggaugggaaa

SEQ ID NO: 1336341 - RNA, 19 nt, Homo sapiens
ugacaugcuuccugcuuuu

SEQ ID NO: 1336342 - RNA, 19 nt, Homo sapiens
ccacccaccuacauaccau

SEQ ID NO: 1336343 - RNA, 19 nt, Homo sapiens
gggacgggaugggcaaaca

SEQ ID NO: 1336344 - RNA, 19 nt, Homo sapiens
gcaugccaccgccugcaaa

SEQ ID NO: 1336345 - RNA, 19 nt, Homo sapiens
gaaugaccaagacuggaau

SEQ ID NO: 1336346 - RNA, 19 nt, Homo sapiens
gucaaucagucaggagaau

SEQ ID NO: 1336347 - RNA, 19 nt, Homo sapiens
cgcaauguccgaucguuug

SEQ ID NO: 1336348 - RNA, 19 nt, Homo sapiens
acaagcaggaucagcaaga

SEQ ID NO: 1336349 - RNA, 19 nt, Homo sapiens
uacagagucuugggaaagu

SEQ ID NO: 1336350 - RNA, 19 nt, Homo sapiens
agacaguuccagaugaaug

SEQ ID NO: 1336351 - RNA, 19 nt, Homo sapiens
ucaguagacgcgauuagau

SEQ ID NO: 1336352 - RNA, 19 nt, Homo sapiens
gaaccagaccaggcagauc

SEQ ID NO: 1336353 - RNA, 19 nt, Homo sapiens
gcucaagccgacuguuauc

SEQ ID NO: 1336354 - RNA, 19 nt, Homo sapiens
cuugaagucugaaaacaaa

SEQ ID NO: 1336355 - RNA, 19 nt, Homo sapiens
guucaugggaaauguauac

SEQ ID NO: 1336356 - RNA, 19 nt, Homo sapiens
ucacaguucaugggaaaug

SEQ ID NO: 1336357 - RNA, 19 nt, Homo sapiens
guaccagcgauucuaagga

SEQ ID NO: 1336358 - RNA, 19 nt, Homo sapiens
augacaugcuuccugcuuu

SEQ ID NO: 1336359 - RNA, 19 nt, Homo sapiens
gggcgacacauaauuucug

SEQ ID NO: 1336360 - RNA, 19 nt, Homo sapiens
gugcuagauuaguaaacau

SEQ ID NO: 1336361 - RNA, 19 nt, Homo sapiens
agcaaguacucgacucuca

SEQ ID NO: 1336362 - RNA, 19 nt, Homo sapiens
guauaccacccaccuacau

SEQ ID NO: 1336363 - RNA, 19 nt, Homo sapiens
cuuacagagucuugggaaa

SEQ ID NO: 1336364 - RNA, 19 nt, Homo sapiens
ggaaccagaccaggcagau

SEQ ID NO: 1336365 - RNA, 19 nt, Homo sapiens
gaaaccgacacagucaauc

SEQ ID NO: 1336366 - RNA, 19 nt, Homo sapiens
ucagcaagacccaaagagu

SEQ ID NO: 1336367 - RNA, 19 nt, Homo sapiens
caagcaggaucagcaagac

SEQ ID NO: 1336368 - RNA, 19 nt, Homo sapiens
caguagacgcgauuagauc

SEQ ID NO: 1336369 - RNA, 19 nt, Homo sapiens
gcaauguccgaucguuugg

SEQ ID NO: 1336370 - RNA, 19 nt, Homo sapiens
agaaaccgacacagucaau

SEQ ID NO: 1336371 - RNA, 19 nt, Homo sapiens
ugucuccaauuugcagaaa

SEQ ID NO: 1336372 - RNA, 19 nt, Homo sapiens
gacauggcuuacagagucu

SEQ ID NO: 1336373 - RNA, 19 nt, Homo sapiens
gaaggaggguuguacuuug

SEQ ID NO: 1336374 - RNA, 19 nt, Homo sapiens
gagcucaacuuucagaaga

SEQ ID NO: 1336375 - RNA, 19 nt, Homo sapiens
gaacaucgaggucaaggaa

SEQ ID NO: 1336376 - RNA, 19 nt, Homo sapiens
ggaaggaggguuguacuuu

SEQ ID NO: 1336377 - RNA, 19 nt, Homo sapiens
caaacuggagcucaacuuu

SEQ ID NO: 1336378 - RNA, 19 nt, Homo sapiens
gggaagcuguaccaucaga

SEQ ID NO: 1336379 - RNA, 19 nt, Homo sapiens
cccaaagacuguucagaga

SEQ ID NO: 1336380 - RNA, 19 nt, Homo sapiens
aaggaggguuguacuuuga

SEQ ID NO: 1336381 - RNA, 19 nt, Homo sapiens
cagagaacaucgaggucaa

SEQ ID NO: 1336382 - RNA, 19 nt, Homo sapiens
ccaaagacuguucagagaa

SEQ ID NO: 1336383 - RNA, 19 nt, Homo sapiens
gcucaacuuucagaagaga

SEQ ID NO: 1336384 - RNA, 19 nt, Homo sapiens
aacuggagcucaacuuuca

SEQ ID NO: 1336385 - RNA, 19 nt, Homo sapiens
ccacuuggagggaggaaga

SEQ ID NO: 1336386 - RNA, 19 nt, Homo sapiens
gaacucugggcuacgcuau

SEQ ID NO: 1336387 - RNA, 19 nt, Homo sapiens
gacccucuauccggcagua

SEQ ID NO: 1336388 - RNA, 19 nt, Homo sapiens
acucugggcuacgcuauug

SEQ ID NO: 1336389 - RNA, 19 nt, Homo sapiens
gcugcagacugaccacuac

SEQ ID NO: 1336390 - RNA, 19 nt, Homo sapiens
ccagugagcccugugauac

SEQ ID NO: 1336391 - RNA, 19 nt, Homo sapiens
aaacuggagcucaacuuuc

SEQ ID NO: 1336392 - RNA, 19 nt, Homo sapiens
aacccaagcucugcggaaa

SEQ ID NO: 1336393 - RNA, 19 nt, Homo sapiens
cccaagcucugcggaaauc

SEQ ID NO: 1336394 - RNA, 19 nt, Homo sapiens
gcuggugguucuggacaug

SEQ ID NO: 1336395 - RNA, 19 nt, Homo sapiens
ggagcucaacuuucagaag

SEQ ID NO: 1336396 - RNA, 19 nt, Homo sapiens
gagcucccuuccaggucaa

SEQ ID NO: 1336397 - RNA, 19 nt, Homo sapiens
guaagagauguuguuauag

SEQ ID NO: 1336398 - RNA, 19 nt, Homo sapiens
ccaaacuggagcucaacuu

SEQ ID NO: 1336399 - RNA, 19 nt, Homo sapiens
ggacauggaggagggaacu

SEQ ID NO: 1336400 - RNA, 19 nt, Homo sapiens
caagcucugcggaaaucaa

SEQ ID NO: 1336401 - RNA, 19 nt, Homo sapiens
ccuuccaggucaauccaaa

SEQ ID NO: 1336402 - RNA, 19 nt, Homo sapiens
caaggaaggaggguuguac

SEQ ID NO: 1336403 - RNA, 19 nt, Homo sapiens
gaagugaaauguccacaaa

SEQ ID NO: 1336404 - RNA, 19 nt, Homo sapiens
gaacuucgguuguguaaag

SEQ ID NO: 1336405 - RNA, 19 nt, Homo sapiens
gaaggguuguggcaaauaa

SEQ ID NO: 1336406 - RNA, 19 nt, Homo sapiens
gggcaucaauacucaaaua

SEQ ID NO: 1336407 - RNA, 19 nt, Homo sapiens
gaaagucacucgacauugg

SEQ ID NO: 1336408 - RNA, 19 nt, Homo sapiens
ggaaacagaugcaccaaag

SEQ ID NO: 1336409 - RNA, 19 nt, Homo sapiens
ccaccucgcuugccuguuu

SEQ ID NO: 1336410 - RNA, 19 nt, Homo sapiens
guauaaagcaucuuccuaa

SEQ ID NO: 1336411 - RNA, 19 nt, Homo sapiens
acucaaugcuggaauauuu

SEQ ID NO: 1336412 - RNA, 19 nt, Homo sapiens
gaagcuagccuuugagugu

SEQ ID NO: 1336413 - RNA, 19 nt, Homo sapiens
ggaaggaaaucaggcauuc

SEQ ID NO: 1336414 - RNA, 19 nt, Homo sapiens
gcccacagcucaccaccua

SEQ ID NO: 1336415 - RNA, 19 nt, Homo sapiens
caaaggccaucucaccaaa

SEQ ID NO: 1336416 - RNA, 19 nt, Homo sapiens
guaggaagucgccaaauuu

SEQ ID NO: 1336417 - RNA, 19 nt, Homo sapiens
ccauagaagucacccauga

SEQ ID NO: 1336418 - RNA, 19 nt, Homo sapiens
ggagcagcaucucguauga

SEQ ID NO: 1336419 - RNA, 19 nt, Homo sapiens
gaacucagcauucaaggau

SEQ ID NO: 1336420 - RNA, 19 nt, Homo sapiens
gaaaucaggcauuccuauu

SEQ ID NO: 1336421 - RNA, 19 nt, Homo sapiens
gaaggcucaugauuguuaa

SEQ ID NO: 1336422 - RNA, 19 nt, Homo sapiens
ugaaggcucaugauuguua

SEQ ID NO: 1336423 - RNA, 19 nt, Homo sapiens
ggcaauaaauuuggucuga

SEQ ID NO: 1336424 - RNA, 19 nt, Homo sapiens
uaacagagugcauuucuug

SEQ ID NO: 1336425 - RNA, 19 nt, Homo sapiens
gaagucauuguucuguuua

SEQ ID NO: 1336426 - RNA, 19 nt, Homo sapiens
gcacuggaauuucuuacca

SEQ ID NO: 1336427 - RNA, 19 nt, Homo sapiens
ggccacaccugucuuugaa

SEQ ID NO: 1336428 - RNA, 19 nt, Homo sapiens
ccaaguggccauccuaauu

SEQ ID NO: 1336429 - RNA, 19 nt, Homo sapiens
cgacauuggucucuugugu

SEQ ID NO: 1336430 - RNA, 19 nt, Homo sapiens
uaaggucugucuccucuga

SEQ ID NO: 1336431 - RNA, 19 nt, Homo sapiens
uaacggguguguuugcuau

SEQ ID NO: 1336432 - RNA, 19 nt, Homo sapiens
ugacuggguuccaaaguug

SEQ ID NO: 1336433 - RNA, 19 nt, Homo sapiens
uguaggaagucgccaaauu

SEQ ID NO: 1336434 - RNA, 19 nt, Homo sapiens
uaucugcucuucucauguu

SEQ ID NO: 1336435 - RNA, 19 nt, Homo sapiens
ugaaaugucucacugaacu

SEQ ID NO: 1336436 - RNA, 19 nt, Homo sapiens
ccugaaggcucaugauugu

SEQ ID NO: 1336437 - RNA, 19 nt, Homo sapiens
gaacauaauggacgugaag

SEQ ID NO: 1336438 - RNA, 19 nt, Homo sapiens
caguugugcugcagcuuua

SEQ ID NO: 1336439 - RNA, 19 nt, Homo sapiens
ccacaccugucuuugaaau

SEQ ID NO: 1336440 - RNA, 19 nt, Homo sapiens
gcgcacaucugcuacuuac

SEQ ID NO: 1336441 - RNA, 19 nt, Homo sapiens
gaagauacgugcaaaaggu

SEQ ID NO: 1336442 - RNA, 19 nt, Homo sapiens
aacaagaugcuuccaguua

SEQ ID NO: 1336443 - RNA, 19 nt, Homo sapiens
uaggaagucgccaaauuua

SEQ ID NO: 1336444 - RNA, 19 nt, Homo sapiens
caaaugggaacuauuaaca

SEQ ID NO: 1336445 - RNA, 19 nt, Homo sapiens
gugcauccguuucaguauu

SEQ ID NO: 1336446 - RNA, 19 nt, Homo sapiens
acaccagccuccagaugua

SEQ ID NO: 1336447 - RNA, 19 nt, Homo sapiens
caacacagcaagcccaaug

SEQ ID NO: 1336448 - RNA, 19 nt, Homo sapiens
gagcucaagguacaaauga

SEQ ID NO: 1336449 - RNA, 19 nt, Homo sapiens
cugcugcgcugauacguuu

SEQ ID NO: 1336450 - RNA, 19 nt, Homo sapiens
uagacuaggguaagaauaa

SEQ ID NO: 1336451 - RNA, 19 nt, Homo sapiens
gccacucaaugcuggaaua

SEQ ID NO: 1336452 - RNA, 19 nt, Homo sapiens
gcucugggcagcuuucaaa

SEQ ID NO: 1336453 - RNA, 19 nt, Homo sapiens
gcagaugccaccaggagaa

SEQ ID NO: 1336454 - RNA, 19 nt, Homo sapiens
caagaugcuuccaguuaca

SEQ ID NO: 1336455 - RNA, 19 nt, Homo sapiens
caacagacaucagccaaaa

SEQ ID NO: 1336456 - RNA, 19 nt, Homo sapiens
aggcauuccuauuucuuua

SEQ ID NO: 1336457 - RNA, 19 nt, Homo sapiens
cagcaaaucagccuccauu

SEQ ID NO: 1336458 - RNA, 19 nt, Homo sapiens
gauguacccugugccauuc

SEQ ID NO: 1336459 - RNA, 19 nt, Homo sapiens
ugcauccguuucaguauua

SEQ ID NO: 1336460 - RNA, 19 nt, Homo sapiens
gcugguaccucuucaacag

SEQ ID NO: 1336461 - RNA, 19 nt, Homo sapiens
aaugggaacuauuaacaga

SEQ ID NO: 1336462 - RNA, 19 nt, Homo sapiens
aaucaggcauuccuauuuc

SEQ ID NO: 1336463 - RNA, 19 nt, Homo sapiens
acauuggucucuuguguug

SEQ ID NO: 1336464 - RNA, 19 nt, Homo sapiens
gcagcgauggugagcauuu

SEQ ID NO: 1336465 - RNA, 19 nt, Homo sapiens
caauaaauuuggucugacu

SEQ ID NO: 1336466 - RNA, 19 nt, Homo sapiens
uaaaucaucccgugaccuu

SEQ ID NO: 1336467 - RNA, 19 nt, Homo sapiens
gcacaucugcuacuuacca

SEQ ID NO: 1336468 - RNA, 19 nt, Homo sapiens
caaagcaagcccugaugaa

SEQ ID NO: 1336469 - RNA, 19 nt, Homo sapiens
caaguggccauccuaauuc

SEQ ID NO: 1336470 - RNA, 19 nt, Homo sapiens
gagaugugguccaggaaag

SEQ ID NO: 1336471 - RNA, 19 nt, Homo sapiens
ggaaggguuguggcaaaua

SEQ ID NO: 1336472 - RNA, 19 nt, Homo sapiens
gauggcugcugucauucaa

SEQ ID NO: 1336473 - RNA, 19 nt, Homo sapiens
uagcaugguuggccugaug

SEQ ID NO: 1336474 - RNA, 19 nt, Homo sapiens
ggagagcugucccuguuuu

SEQ ID NO: 1336475 - RNA, 19 nt, Homo sapiens
agacuaggguaagaauaaa

SEQ ID NO: 1336476 - RNA, 19 nt, Homo sapiens
uugcugggauuuagauauu

SEQ ID NO: 1336477 - RNA, 19 nt, Homo sapiens
aaggaaggguuguggcaaa

SEQ ID NO: 1336478 - RNA, 19 nt, Homo sapiens
cauacaugauggaggguuu

SEQ ID NO: 1336479 - RNA, 19 nt, Homo sapiens
aaugagagauuugcuauac

SEQ ID NO: 1336480 - RNA, 19 nt, Homo sapiens
aaagagcuguguuuuguuu

SEQ ID NO: 1336481 - RNA, 19 nt, Homo sapiens
caacagcugguaccucuuc

SEQ ID NO: 1336482 - RNA, 19 nt, Homo sapiens
ccaaagcaagcccugauga

SEQ ID NO: 1336483 - RNA, 19 nt, Homo sapiens
agagagacccuaccagaug

SEQ ID NO: 1336484 - RNA, 19 nt, Homo sapiens
gcugauacguuucuuacac

SEQ ID NO: 1336485 - RNA, 19 nt, Homo sapiens
caaauuuacccacucuuca

SEQ ID NO: 1336486 - RNA, 19 nt, Homo sapiens
cagagugcauuucuugcuu

SEQ ID NO: 1336487 - RNA, 19 nt, Homo sapiens
ggagaugugguccaggaaa

SEQ ID NO: 1336488 - RNA, 19 nt, Homo sapiens
ggacagauuccaggagugu

SEQ ID NO: 1336489 - RNA, 19 nt, Homo sapiens
ucucaggcuuucagcagua

SEQ ID NO: 1336490 - RNA, 19 nt, Homo sapiens
ggaagugaaauguccacaa

SEQ ID NO: 1336491 - RNA, 19 nt, Homo sapiens
ggaauuucuuaccaaccaa

SEQ ID NO: 1336492 - RNA, 19 nt, Homo sapiens
uagcugcacuggaauuucu

SEQ ID NO: 1336493 - RNA, 19 nt, Homo sapiens
aaagcaagcccugaugaaa

SEQ ID NO: 1336494 - RNA, 19 nt, Homo sapiens
gugccaaaguccucagaga

SEQ ID NO: 1336495 - RNA, 19 nt, Homo sapiens
aaauauaggcugauuaugc

SEQ ID NO: 1336496 - RNA, 19 nt, Homo sapiens
cagcagcgauggugagcau

SEQ ID NO: 1336497 - RNA, 19 nt, Homo sapiens
agugaaauguccacaaaca

SEQ ID NO: 1336498 - RNA, 19 nt, Homo sapiens
acaccugucuuugaaaugu

SEQ ID NO: 1336499 - RNA, 19 nt, Homo sapiens
cauccuaauucagaaagaa

SEQ ID NO: 1336500 - RNA, 19 nt, Homo sapiens
gacggcugcuggugccuuu

SEQ ID NO: 1336501 - RNA, 19 nt, Homo sapiens
ugagcugacuggcaaguuc

SEQ ID NO: 1336502 - RNA, 19 nt, Homo sapiens
ucucaacacuucccauuuu

SEQ ID NO: 1336503 - RNA, 19 nt, Homo sapiens
aggcagggcugacugaaua

SEQ ID NO: 1336504 - RNA, 19 nt, Homo sapiens
gcacugucccugauacaaa

SEQ ID NO: 1336505 - RNA, 19 nt, Homo sapiens
gaaaggcagggcugacuga

SEQ ID NO: 1336506 - RNA, 19 nt, Homo sapiens
gaagaaggaacaugagaag

SEQ ID NO: 1336507 - RNA, 19 nt, Homo sapiens
ggacggaaaggaacaggaa

SEQ ID NO: 1336508 - RNA, 19 nt, Homo sapiens
uggaguaccuggucaagug

SEQ ID NO: 1336509 - RNA, 19 nt, Homo sapiens
gcaagggcaagcuggagua

SEQ ID NO: 1336510 - RNA, 19 nt, Homo sapiens
ggaagcaugcguacaguag

SEQ ID NO: 1336511 - RNA, 19 nt, Homo sapiens
gcaggcagagggaggguuu

SEQ ID NO: 1336512 - RNA, 19 nt, Homo sapiens
aaaucgagguggccacgaa

SEQ ID NO: 1336513 - RNA, 19 nt, Homo sapiens
agaaggaacaugagaagga

SEQ ID NO: 1336514 - RNA, 19 nt, Homo sapiens
ggcugguccuccaaacaua

SEQ ID NO: 1336515 - RNA, 19 nt, Homo sapiens
gcacuucugccaacagucu

SEQ ID NO: 1336516 - RNA, 19 nt, Homo sapiens
aguaggugcucauaggauu

SEQ ID NO: 1336517 - RNA, 19 nt, Homo sapiens
ccuccucgcuacagugaug

SEQ ID NO: 1336518 - RNA, 19 nt, Homo sapiens
gggcugaugaugugcuuug

SEQ ID NO: 1336519 - RNA, 19 nt, Homo sapiens
uacaguaggugcucauagg

SEQ ID NO: 1336520 - RNA, 19 nt, Homo sapiens
gcugguccuccaaacauaa

SEQ ID NO: 1336521 - RNA, 19 nt, Homo sapiens
agaagaaggaacaugagaa

SEQ ID NO: 1336522 - RNA, 19 nt, Homo sapiens
cagaagaaggaacaugaga

SEQ ID NO: 1336523 - RNA, 19 nt, Homo sapiens
agugugggcugaugaugug

SEQ ID NO: 1336524 - RNA, 19 nt, Homo sapiens
ccgagugcauccugagcaa

SEQ ID NO: 1336525 - RNA, 19 nt, Homo sapiens
guacaguaggugcucauag

SEQ ID NO: 1336526 - RNA, 19 nt, Homo sapiens
uccagaagaaggaacauga

SEQ ID NO: 1336527 - RNA, 19 nt, Homo sapiens
guaggugcucauaggauug

SEQ ID NO: 1336528 - RNA, 19 nt, Homo sapiens
aagcaugcguacaguaggu

SEQ ID NO: 1336529 - RNA, 19 nt, Homo sapiens
gaugugcuuuggccuucuc

SEQ ID NO: 1336530 - RNA, 19 nt, Homo sapiens
gaggcagugugggcugaug

SEQ ID NO: 1336531 - RNA, 19 nt, Homo sapiens
uaacccaccuugaacauug

SEQ ID NO: 1336532 - RNA, 19 nt, Homo sapiens
ggaggaacauucagguuuc

SEQ ID NO: 1336533 - RNA, 19 nt, Homo sapiens
ucugagagcugaauuccaa

SEQ ID NO: 1336534 - RNA, 19 nt, Homo sapiens
gaacauugaccaccacaca

SEQ ID NO: 1336535 - RNA, 19 nt, Homo sapiens
cccucaaacuccucaauaa

SEQ ID NO: 1336536 - RNA, 19 nt, Homo sapiens
caucugugguuucgacuca

SEQ ID NO: 1336537 - RNA, 19 nt, Homo sapiens
ccucaaacuccucaauaaa

SEQ ID NO: 1336538 - RNA, 19 nt, Homo sapiens
acacccaucugcucacuca

SEQ ID NO: 1336539 - RNA, 19 nt, Homo sapiens
ucaaacuccucaauaaacg

SEQ ID NO: 1336540 - RNA, 19 nt, Homo sapiens
cagcugcaccgacugaaga

SEQ ID NO: 1336541 - RNA, 19 nt, Homo sapiens
gaggaggaacauucagguu

SEQ ID NO: 1336542 - RNA, 19 nt, Homo sapiens
ucacucacccuggcacauu

SEQ ID NO: 1336543 - RNA, 19 nt, Homo sapiens
gaggaacauucagguuucu

SEQ ID NO: 1336544 - RNA, 19 nt, Homo sapiens
aggaggaacauucagguuu

SEQ ID NO: 1336545 - RNA, 19 nt, Homo sapiens
gcaauacugccagccuuuc

SEQ ID NO: 1336546 - RNA, 19 nt, Homo sapiens
auaaacgcuuucucugguu

SEQ ID NO: 1336547 - RNA, 19 nt, Homo sapiens
gccuuucccuaaucucaga

SEQ ID NO: 1336548 - RNA, 19 nt, Homo sapiens
gagcucacacccucaaacu

SEQ ID NO: 1336549 - RNA, 19 nt, Homo sapiens
gagccuggacucugugaag

SEQ ID NO: 1336550 - RNA, 19 nt, Homo sapiens
cccugucacucaccucaaa

SEQ ID NO: 1336551 - RNA, 19 nt, Homo sapiens
caauggacuccgcccuuga

SEQ ID NO: 1336552 - RNA, 19 nt, Homo sapiens
aagaggacgaggaggauga

SEQ ID NO: 1336553 - RNA, 19 nt, Homo sapiens
gaauuugggucuaguauag

SEQ ID NO: 1336554 - RNA, 19 nt, Homo sapiens
agacagggauggaauguaa

SEQ ID NO: 1336555 - RNA, 19 nt, Homo sapiens
caacaaaggcccugucuug

SEQ ID NO: 1336556 - RNA, 19 nt, Homo sapiens
gaacagaaccagauaugau

SEQ ID NO: 1336557 - RNA, 19 nt, Homo sapiens
gcacagauguuggaaaugg

SEQ ID NO: 1336558 - RNA, 19 nt, Homo sapiens
gaauguaaauauccagaga

SEQ ID NO: 1336559 - RNA, 19 nt, Homo sapiens
agaaauaguuccaacaaga

SEQ ID NO: 1336560 - RNA, 19 nt, Homo sapiens
gagaaagucuuccaguaca

SEQ ID NO: 1336561 - RNA, 19 nt, Homo sapiens
ugggauaucuggaucagua

SEQ ID NO: 1336562 - RNA, 19 nt, Homo sapiens
guacccaucucuuucuauu

SEQ ID NO: 1336563 - RNA, 19 nt, Homo sapiens
uagagaaagucuuccagua

SEQ ID NO: 1336564 - RNA, 19 nt, Homo sapiens
ggucuaguauaguacauuu

SEQ ID NO: 1336565 - RNA, 19 nt, Homo sapiens
ggacuacacccguggauug

SEQ ID NO: 1336566 - RNA, 19 nt, Homo sapiens
cuucagaacuccagccuaa

SEQ ID NO: 1336567 - RNA, 19 nt, Homo sapiens
gaagauguguucuccaaaa

SEQ ID NO: 1336568 - RNA, 19 nt, Homo sapiens
gcugggagcuguugaugau

SEQ ID NO: 1336569 - RNA, 19 nt, Homo sapiens
gcagccggguugagaaauu

SEQ ID NO: 1336570 - RNA, 19 nt, Homo sapiens
gaugaagugguuccucuua

SEQ ID NO: 1336571 - RNA, 19 nt, Homo sapiens
cuagaagaauaccggaaua

SEQ ID NO: 1336572 - RNA, 19 nt, Homo sapiens
aaugaucgccuuugcuuua

SEQ ID NO: 1336573 - RNA, 19 nt, Homo sapiens
caagugcucgugacacaua

SEQ ID NO: 1336574 - RNA, 19 nt, Homo sapiens
gcuagaggcuucagaacuc

SEQ ID NO: 1336575 - RNA, 19 nt, Homo sapiens
gaaauaguuccaacaagau

SEQ ID NO: 1336576 - RNA, 19 nt, Homo sapiens
gaaugugucugcgguggaa

SEQ ID NO: 1336577 - RNA, 19 nt, Homo sapiens
ggaagccagcaaucacuua

SEQ ID NO: 1336578 - RNA, 19 nt, Homo sapiens
caacagguggaacuacaua

SEQ ID NO: 1336579 - RNA, 19 nt, Homo sapiens
ucagagcccuggagcaaga

SEQ ID NO: 1336580 - RNA, 19 nt, Homo sapiens
gaagaauaccggaauagca

SEQ ID NO: 1336581 - RNA, 19 nt, Homo sapiens
cauagagggaaccaaauua

SEQ ID NO: 1336582 - RNA, 19 nt, Homo sapiens
ucagauaaccuguggauca

SEQ ID NO: 1336583 - RNA, 19 nt, Homo sapiens
acaccuuccucaagucaua

SEQ ID NO: 1336584 - RNA, 19 nt, Homo sapiens
gauaucuggaucaguaaua

SEQ ID NO: 1336585 - RNA, 19 nt, Homo sapiens
ucuccaaccuugcaauuug

SEQ ID NO: 1336586 - RNA, 19 nt, Homo sapiens
gggauggaauguaaauauc

SEQ ID NO: 1336587 - RNA, 19 nt, Homo sapiens
agucauaccuggccgaguu

SEQ ID NO: 1336588 - RNA, 19 nt, Homo sapiens
auacaaagccauccaucua

SEQ ID NO: 1336589 - RNA, 19 nt, Homo sapiens
gagguagacgggaaacuuu

SEQ ID NO: 1336590 - RNA, 19 nt, Homo sapiens
gaaagucuuccaguacauu

SEQ ID NO: 1336591 - RNA, 19 nt, Homo sapiens
cuacauagagggaaccaaa

SEQ ID NO: 1336592 - RNA, 19 nt, Homo sapiens
gcaagaucuuccugugaau

SEQ ID NO: 1336593 - RNA, 19 nt, Homo sapiens
gagcaagaucuuccuguga

SEQ ID NO: 1336594 - RNA, 19 nt, Homo sapiens
acaaagccauccaucuaga

SEQ ID NO: 1336595 - RNA, 19 nt, Homo sapiens
ggucagagucuuccaauac

SEQ ID NO: 1336596 - RNA, 19 nt, Homo sapiens
cccaguaucucgcagcaaa

SEQ ID NO: 1336597 - RNA, 19 nt, Homo sapiens
caaaggaagccagcaauca

SEQ ID NO: 1336598 - RNA, 19 nt, Homo sapiens
ggaacagaaccagauauga

SEQ ID NO: 1336599 - RNA, 19 nt, Homo sapiens
ugaugagccuggaacuaaa

SEQ ID NO: 1336600 - RNA, 19 nt, Homo sapiens
ggagguacccaucucuuuc

SEQ ID NO: 1336601 - RNA, 19 nt, Homo sapiens
uggaaucuaugaugaagug

SEQ ID NO: 1336602 - RNA, 19 nt, Homo sapiens
caagaucuuccugugaaua

SEQ ID NO: 1336603 - RNA, 19 nt, Homo sapiens
gaggagcgaccgacaacaa

SEQ ID NO: 1336604 - RNA, 19 nt, Homo sapiens
ggagguagacgggaaacuu

SEQ ID NO: 1336605 - RNA, 19 nt, Homo sapiens
cauaaucauuccauccaau

SEQ ID NO: 1336606 - RNA, 19 nt, Homo sapiens
ccaaugaucgccuuugcuu

SEQ ID NO: 1336607 - RNA, 19 nt, Homo sapiens
ggcauaaucacuccgguuu

SEQ ID NO: 1336608 - RNA, 19 nt, Homo sapiens
ugaagugguuccucuuaca

SEQ ID NO: 1336609 - RNA, 19 nt, Homo sapiens
ggauugcaaauauugauga

SEQ ID NO: 1336610 - RNA, 19 nt, Homo sapiens
gaagccagcaaucacuuau

SEQ ID NO: 1336611 - RNA, 19 nt, Homo sapiens
uuaccacucuuuccuuuua

SEQ ID NO: 1336612 - RNA, 19 nt, Homo sapiens
aggcacagauguuggaaau

SEQ ID NO: 1336613 - RNA, 19 nt, Homo sapiens
caaaggcacagauguugga

SEQ ID NO: 1336614 - RNA, 19 nt, Homo sapiens
ucuagucccucacaugaau

SEQ ID NO: 1336615 - RNA, 19 nt, Homo sapiens
cagccggguugagaaauuu

SEQ ID NO: 1336616 - RNA, 19 nt, Homo sapiens
ccuaauggaucccaaacuc

SEQ ID NO: 1336617 - RNA, 19 nt, Homo sapiens
ccuggucccuggaaucuau

SEQ ID NO: 1336618 - RNA, 19 nt, Homo sapiens
gaaaugcagagaccaggau

SEQ ID NO: 1336619 - RNA, 19 nt, Homo sapiens
agcaagaucuuccugugaa

SEQ ID NO: 1336620 - RNA, 19 nt, Homo sapiens
ccagagaauuugggucuag

SEQ ID NO: 1336621 - RNA, 19 nt, Homo sapiens
cagaagaggaaauaaauac

SEQ ID NO: 1336622 - RNA, 19 nt, Homo sapiens
uccaauaccucccgucauc

SEQ ID NO: 1336623 - RNA, 19 nt, Homo sapiens
gagaauuugggucuaguau

SEQ ID NO: 1336624 - RNA, 19 nt, Homo sapiens
ggauccaccauuccaauug

SEQ ID NO: 1336625 - RNA, 19 nt, Homo sapiens
aaagagcgaucagaacagu

SEQ ID NO: 1336626 - RNA, 19 nt, Homo sapiens
aaucuaugaugaagugguu

SEQ ID NO: 1336627 - RNA, 19 nt, Homo sapiens
cacaagagcguggugcuaa

SEQ ID NO: 1336628 - RNA, 19 nt, Homo sapiens
caggagaucguccacaaga

SEQ ID NO: 1336629 - RNA, 19 nt, Homo sapiens
uugaagauguguucuccaa

SEQ ID NO: 1336630 - RNA, 19 nt, Homo sapiens
acccaucucuuucuauuca

SEQ ID NO: 1336631 - RNA, 19 nt, Homo sapiens
gcacaccuuccucaaguca

SEQ ID NO: 1336632 - RNA, 19 nt, Homo sapiens
ucagaacuccagccuaaug

SEQ ID NO: 1336633 - RNA, 19 nt, Homo sapiens
uggcccagcuccauuaauc

SEQ ID NO: 1336634 - RNA, 19 nt, Homo sapiens
gugccucgcuucagacaag

SEQ ID NO: 1336635 - RNA, 19 nt, Homo sapiens
acccguggauugcaaauau

SEQ ID NO: 1336636 - RNA, 19 nt, Homo sapiens
uuccaugacucuaggacua

SEQ ID NO: 1336637 - RNA, 19 nt, Homo sapiens
ggagcgaucccacgaaagg

SEQ ID NO: 1336638 - RNA, 19 nt, Homo sapiens
gaucuuccugugaauauca

SEQ ID NO: 1336639 - RNA, 19 nt, Homo sapiens
ugucuuggcuuggaucaau

SEQ ID NO: 1336640 - RNA, 19 nt, Homo sapiens
ccagcuccauuaaucacaa

SEQ ID NO: 1336641 - RNA, 19 nt, Homo sapiens
caagagcguggugcuaauu

SEQ ID NO: 1336642 - RNA, 19 nt, Homo sapiens
cgucuagucccucacauga

SEQ ID NO: 1336643 - RNA, 19 nt, Homo sapiens
ccagcaaucacuuauggaa

SEQ ID NO: 1336644 - RNA, 19 nt, Homo sapiens
cauaaucacuccgguuugc

SEQ ID NO: 1336645 - RNA, 19 nt, Homo sapiens
uagagggaaccaaauuauu

SEQ ID NO: 1336646 - RNA, 19 nt, Homo sapiens
gauccaccauuccaauugc

SEQ ID NO: 1336647 - RNA, 19 nt, Homo sapiens
cuacacccguggauugcaa

SEQ ID NO: 1336648 - RNA, 19 nt, Homo sapiens
uugaugagccuggaacuaa

SEQ ID NO: 1336649 - RNA, 19 nt, Homo sapiens
cuccaccacugacuacaaa

SEQ ID NO: 1336650 - RNA, 19 nt, Homo sapiens
cugcacaccuuccucaagu

SEQ ID NO: 1336651 - RNA, 19 nt, Homo sapiens
uaaaaugucuugggauauc

SEQ ID NO: 1336652 - RNA, 19 nt, Homo sapiens
acauagagggaaccaaauu

SEQ ID NO: 1336653 - RNA, 19 nt, Homo sapiens
gaacacagauggaaguuug

SEQ ID NO: 1336654 - RNA, 19 nt, Homo sapiens
ggaguuaggcuuugcauaa

SEQ ID NO: 1336655 - RNA, 19 nt, Homo sapiens
gagauuaaguggauuucaa

SEQ ID NO: 1336656 - RNA, 19 nt, Homo sapiens
ccacagagacgguuucuau

SEQ ID NO: 1336657 - RNA, 19 nt, Homo sapiens
agacaguguucaaagcuua

SEQ ID NO: 1336658 - RNA, 19 nt, Homo sapiens
cagagacgguuucuauugu

SEQ ID NO: 1336659 - RNA, 19 nt, Homo sapiens
gagacgguuucuauuguga

SEQ ID NO: 1336660 - RNA, 19 nt, Homo sapiens
ccagccagcuaacaaguga

SEQ ID NO: 1336661 - RNA, 19 nt, Homo sapiens
gagaucaggcucuuugaga

SEQ ID NO: 1336662 - RNA, 19 nt, Homo sapiens
uuaaguggauuucaaacug

SEQ ID NO: 1336663 - RNA, 19 nt, Homo sapiens
uaaguggauuucaaacugu

SEQ ID NO: 1336664 - RNA, 19 nt, Homo sapiens
guuguuuacugucuccuuu

SEQ ID NO: 1336665 - RNA, 19 nt, Homo sapiens
aaaugccacugaucuguga

SEQ ID NO: 1336666 - RNA, 19 nt, Homo sapiens
ccaccucuguucuguuguu

SEQ ID NO: 1336667 - RNA, 19 nt, Homo sapiens
ugaagccuauuugacuaua

SEQ ID NO: 1336668 - RNA, 19 nt, Homo sapiens
gggcuugaguguaggaauc

SEQ ID NO: 1336669 - RNA, 19 nt, Homo sapiens
gcuaugaaauguggucuac

SEQ ID NO: 1336670 - RNA, 19 nt, Homo sapiens
gaugccaaccgcuaugaaa

SEQ ID NO: 1336671 - RNA, 19 nt, Homo sapiens
ggacaucucagccauccau

SEQ ID NO: 1336672 - RNA, 19 nt, Homo sapiens
gcaccaggaugcccauucg

SEQ ID NO: 1336673 - RNA, 19 nt, Homo sapiens
acagagacgguuucuauug

SEQ ID NO: 1336674 - RNA, 19 nt, Homo sapiens
gaguuaggcuuugcauaag

SEQ ID NO: 1336675 - RNA, 19 nt, Homo sapiens
gccaaccgcuaugaaaugu

SEQ ID NO: 1336676 - RNA, 19 nt, Homo sapiens
cugaggacguuguguguau

SEQ ID NO: 1336677 - RNA, 19 nt, Homo sapiens
gccaaugccuacaggauac

SEQ ID NO: 1336678 - RNA, 19 nt, Homo sapiens
agaucaggcucuuugagaa

SEQ ID NO: 1336679 - RNA, 19 nt, Homo sapiens
guucccagcuguuguagag

SEQ ID NO: 1336680 - RNA, 19 nt, Homo sapiens
gaaguuugggagccuggua

SEQ ID NO: 1336681 - RNA, 19 nt, Homo sapiens
cuagaacggugggaucaga

SEQ ID NO: 1336682 - RNA, 19 nt, Homo sapiens
cgagagauuaaguggauuu

SEQ ID NO: 1336683 - RNA, 19 nt, Homo sapiens
cuggagggcuugaguguag

SEQ ID NO: 1336684 - RNA, 19 nt, Homo sapiens
ggaaaacaagccugucuuu

SEQ ID NO: 1336685 - RNA, 19 nt, Homo sapiens
guaaaugccacugaucugu

SEQ ID NO: 1336686 - RNA, 19 nt, Homo sapiens
gaggacguuguguguauuu

SEQ ID NO: 1336687 - RNA, 19 nt, Homo sapiens
uccuagggcugaugacuga

SEQ ID NO: 1336688 - RNA, 19 nt, Homo sapiens
gaagacaguguucaaagcu

SEQ ID NO: 1336689 - RNA, 19 nt, Homo sapiens
ggcaugacccugugacugu

SEQ ID NO: 1336690 - RNA, 19 nt, Homo sapiens
ucugugggccugcagcuua

SEQ ID NO: 1336691 - RNA, 19 nt, Homo sapiens
guccuugugugcaacuaaa

SEQ ID NO: 1336692 - RNA, 19 nt, Homo sapiens
uuugaagccuauuugacua

SEQ ID NO: 1336693 - RNA, 19 nt, Homo sapiens
ucacucugguguccuggaa

SEQ ID NO: 1336694 - RNA, 19 nt, Homo sapiens
uuuccacggucuuaggaua

SEQ ID NO: 1336695 - RNA, 19 nt, Homo sapiens
gcgaaaaccucucuucacu

SEQ ID NO: 1336696 - RNA, 19 nt, Homo sapiens
ggcaauccgugugcucaga

SEQ ID NO: 1336697 - RNA, 19 nt, Homo sapiens
cagcuguuguagagcauga

SEQ ID NO: 1336698 - RNA, 19 nt, Homo sapiens
gacguuguguguauuucug

SEQ ID NO: 1336699 - RNA, 19 nt, Homo sapiens
cuauaguccuugugugcaa

SEQ ID NO: 1336700 - RNA, 19 nt, Homo sapiens
uaugaaauguggucuacac

SEQ ID NO: 1336701 - RNA, 19 nt, Homo sapiens
gaucaggcucuuugagaag

SEQ ID NO: 1336702 - RNA, 19 nt, Homo sapiens
agauuucugucucaucaau

SEQ ID NO: 1336703 - RNA, 19 nt, Homo sapiens
ucccuucagugcaguuaaa

SEQ ID NO: 1336704 - RNA, 19 nt, Homo sapiens
gagaugccaaccgcuauga

SEQ ID NO: 1336705 - RNA, 19 nt, Homo sapiens
cuccaccucuguucuguug

SEQ ID NO: 1336706 - RNA, 19 nt, Homo sapiens
gugacgcucucccugacuu

SEQ ID NO: 1336707 - RNA, 19 nt, Homo sapiens
gcacggcaagcaugguuca

SEQ ID NO: 1336708 - RNA, 19 nt, Homo sapiens
cucgagagauuaaguggau

SEQ ID NO: 1336709 - RNA, 19 nt, Homo sapiens
caggccgacucgagagauu

SEQ ID NO: 1336710 - RNA, 19 nt, Homo sapiens
ugccaaugccuacaggaua

SEQ ID NO: 1336711 - RNA, 19 nt, Homo sapiens
ccucuguucuguuguuuac

SEQ ID NO: 1336712 - RNA, 19 nt, Homo sapiens
gagcaugaagcaccaggau

SEQ ID NO: 1336713 - RNA, 19 nt, Homo sapiens
agagacgguuucuauugug

SEQ ID NO: 1336714 - RNA, 19 nt, Homo sapiens
ucacugcucaugacucugu

SEQ ID NO: 1336715 - RNA, 19 nt, Homo sapiens
ugaggacguuguguguauu

SEQ ID NO: 1336716 - RNA, 19 nt, Homo sapiens
ucugggaacugcccgaaag

SEQ ID NO: 1336717 - RNA, 19 nt, Homo sapiens
ugaaggcgaagcacccaaa

SEQ ID NO: 1336718 - RNA, 19 nt, Homo sapiens
uugugggaauuauggaaua

SEQ ID NO: 1336719 - RNA, 19 nt, Homo sapiens
acacugagacuccgacucu

SEQ ID NO: 1336720 - RNA, 19 nt, Homo sapiens
ggccgacucgagagauuaa

SEQ ID NO: 1336721 - RNA, 19 nt, Homo sapiens
uccacggucuuaggauaua

SEQ ID NO: 1336722 - RNA, 19 nt, Homo sapiens
gaaaacaagccugucuuug

SEQ ID NO: 1336723 - RNA, 19 nt, Homo sapiens
ugcauaagcaugugagaug

SEQ ID NO: 1336724 - RNA, 19 nt, Homo sapiens
gugccauccucuccacaga

SEQ ID NO: 1336725 - RNA, 19 nt, Homo sapiens
ugacugaccacagccuuug

SEQ ID NO: 1336726 - RNA, 19 nt, Homo sapiens
ccaaccugcugugcugaga

SEQ ID NO: 1336727 - RNA, 19 nt, Homo sapiens
cagccuuccuuucccuuuc

SEQ ID NO: 1336728 - RNA, 19 nt, Homo sapiens
gaugcucccuuccuauucc

SEQ ID NO: 1336729 - RNA, 19 nt, Homo sapiens
uguguguauuucuguguaa

SEQ ID NO: 1336730 - RNA, 19 nt, Homo sapiens
gacgaacacagauggaagu

SEQ ID NO: 1336731 - RNA, 19 nt, Homo sapiens
guucuguuguuuacugucu

SEQ ID NO: 1336732 - RNA, 19 nt, Homo sapiens
ccuguucacuguggagguu

SEQ ID NO: 1336733 - RNA, 19 nt, Homo sapiens
gggcacggcaagcaugguu

SEQ ID NO: 1336734 - RNA, 19 nt, Homo sapiens
ucucgggacacauucuuaa

SEQ ID NO: 1336735 - RNA, 19 nt, Homo sapiens
cagaauggaggcugcuugu

SEQ ID NO: 1336736 - RNA, 19 nt, Homo sapiens
ggcugucacugcagaaguc

SEQ ID NO: 1336737 - RNA, 19 nt, Homo sapiens
aagacaguguucaaagcuu

SEQ ID NO: 1336738 - RNA, 19 nt, Homo sapiens
ucuguucuguuguuuacug

SEQ ID NO: 1336739 - RNA, 19 nt, Homo sapiens
ggcguucccagcuguugua

SEQ ID NO: 1336740 - RNA, 19 nt, Homo sapiens
ucccugacuuggaagaaug

SEQ ID NO: 1336741 - RNA, 19 nt, Homo sapiens
ggacguuguguguauuucu

SEQ ID NO: 1336742 - RNA, 19 nt, Homo sapiens
cacagagacgguuucuauu

SEQ ID NO: 1336743 - RNA, 19 nt, Homo sapiens
ugucugcugggcccacuua

SEQ ID NO: 1336744 - RNA, 19 nt, Homo sapiens
gcaauccgugugcucagau

SEQ ID NO: 1336745 - RNA, 19 nt, Homo sapiens
gagacuccgacucuggaaa

SEQ ID NO: 1336746 - RNA, 19 nt, Homo sapiens
cugugggccugcagcuuaa

SEQ ID NO: 1336747 - RNA, 19 nt, Homo sapiens
cuucacugcucaugacucu

SEQ ID NO: 1336748 - RNA, 19 nt, Homo sapiens
ggcagacuguggcuagaac

SEQ ID NO: 1336749 - RNA, 19 nt, Homo sapiens
cgaacacagauggaaguuu

SEQ ID NO: 1336750 - RNA, 19 nt, Homo sapiens
aaauuucgaggacaucuca

SEQ ID NO: 1336751 - RNA, 19 nt, Homo sapiens
gauuagacauccaacauaa

SEQ ID NO: 1336752 - RNA, 19 nt, Homo sapiens
caagaaaccugcacucaca

SEQ ID NO: 1336753 - RNA, 19 nt, Homo sapiens
ggacuaacaccaauacaaa

SEQ ID NO: 1336754 - RNA, 19 nt, Homo sapiens
caaaggaaguuaguacauu

SEQ ID NO: 1336755 - RNA, 19 nt, Homo sapiens
agauaaagaugcugaguuu

SEQ ID NO: 1336756 - RNA, 19 nt, Homo sapiens
gaacagagguggagaaaag

SEQ ID NO: 1336757 - RNA, 19 nt, Homo sapiens
cccuugagcuguugaaaua

SEQ ID NO: 1336758 - RNA, 19 nt, Homo sapiens
ggauaaccauuccucagaa

SEQ ID NO: 1336759 - RNA, 19 nt, Homo sapiens
ucacaacugccuccuauuu

SEQ ID NO: 1336760 - RNA, 19 nt, Homo sapiens
ccaacuggcuccaaccuau

SEQ ID NO: 1336761 - RNA, 19 nt, Homo sapiens
caaaguggcugugggaagu

SEQ ID NO: 1336762 - RNA, 19 nt, Homo sapiens
uacaaacacuuaagagaug

SEQ ID NO: 1336763 - RNA, 19 nt, Homo sapiens
ucacgaacauggccaagga

SEQ ID NO: 1336764 - RNA, 19 nt, Homo sapiens
ccacuuugguguaucuuug

SEQ ID NO: 1336765 - RNA, 19 nt, Homo sapiens
guucugggcuucaauuuac

SEQ ID NO: 1336766 - RNA, 19 nt, Homo sapiens
gauaaugccuaugcuuaca

SEQ ID NO: 1336767 - RNA, 19 nt, Homo sapiens
gguagaggauaaugccuau

SEQ ID NO: 1336768 - RNA, 19 nt, Homo sapiens
gaugguauacuuacucgaa

SEQ ID NO: 1336769 - RNA, 19 nt, Homo sapiens
caaccuaucuggucaacac

SEQ ID NO: 1336770 - RNA, 19 nt, Homo sapiens
acacuuaagagaugacaua

SEQ ID NO: 1336771 - RNA, 19 nt, Homo sapiens
cagaaaagcuggguugaaa

SEQ ID NO: 1336772 - RNA, 19 nt, Homo sapiens
uguauuaccucagcuauuc

SEQ ID NO: 1336773 - RNA, 19 nt, Homo sapiens
uugcacagauucagauuug

SEQ ID NO: 1336774 - RNA, 19 nt, Homo sapiens
acacguauguuggguagaa

SEQ ID NO: 1336775 - RNA, 19 nt, Homo sapiens
ccacagggcaaaugaaugu

SEQ ID NO: 1336776 - RNA, 19 nt, Homo sapiens
cuauguggcugaugaggaa

SEQ ID NO: 1336777 - RNA, 19 nt, Homo sapiens
cuuaagagaugacauaucg

SEQ ID NO: 1336778 - RNA, 19 nt, Homo sapiens
ggaaguuaguacauuaaac

SEQ ID NO: 1336779 - RNA, 19 nt, Homo sapiens
ccacaggcaccgcaggaua

SEQ ID NO: 1336780 - RNA, 19 nt, Homo sapiens
acaccaauacaaacacuua

SEQ ID NO: 1336781 - RNA, 19 nt, Homo sapiens
cuggcuggcucccugauua

SEQ ID NO: 1336782 - RNA, 19 nt, Homo sapiens
uaaugccuaugcuuacaaa

SEQ ID NO: 1336783 - RNA, 19 nt, Homo sapiens
ggaaccacagggcaaauga

SEQ ID NO: 1336784 - RNA, 19 nt, Homo sapiens
ccaauacaaacacuuaaga

SEQ ID NO: 1336785 - RNA, 19 nt, Homo sapiens
acaacugccuccuauuuua

SEQ ID NO: 1336786 - RNA, 19 nt, Homo sapiens
guaaccacaucaaacucaa

SEQ ID NO: 1336787 - RNA, 19 nt, Homo sapiens
cuugagcuguugaaauaaa

SEQ ID NO: 1336788 - RNA, 19 nt, Homo sapiens
uaaaccggaugggauaaga

SEQ ID NO: 1336789 - RNA, 19 nt, Homo sapiens
gaaaaucucaggugcaaau

SEQ ID NO: 1336790 - RNA, 19 nt, Homo sapiens
gaaccacagggcaaaugaa

SEQ ID NO: 1336791 - RNA, 19 nt, Homo sapiens
gaacauggccaaggacacu

SEQ ID NO: 1336792 - RNA, 19 nt, Homo sapiens
ugaaaucgccacuguccuu

SEQ ID NO: 1336793 - RNA, 19 nt, Homo sapiens
acucacaacugccuccuau

SEQ ID NO: 1336794 - RNA, 19 nt, Homo sapiens
aggauaaugccuaugcuua

SEQ ID NO: 1336795 - RNA, 19 nt, Homo sapiens
ccaacauaaugaggacuaa

SEQ ID NO: 1336796 - RNA, 19 nt, Homo sapiens
ugauuagacauccaacaua

SEQ ID NO: 1336797 - RNA, 19 nt, Homo sapiens
ggguugaaaucgccacugu

SEQ ID NO: 1336798 - RNA, 19 nt, Homo sapiens
ggacacugccagccucuuc

SEQ ID NO: 1336799 - RNA, 19 nt, Homo sapiens
ccucagaacuccucguacu

SEQ ID NO: 1336800 - RNA, 19 nt, Homo sapiens
ggagcugcuuacucucuug

SEQ ID NO: 1336801 - RNA, 19 nt, Homo sapiens
aaguggcgauggcauguaa

SEQ ID NO: 1336802 - RNA, 19 nt, Homo sapiens
aaucgccacuguccuucua

SEQ ID NO: 1336803 - RNA, 19 nt, Homo sapiens
ggcuggauguggagucuga

SEQ ID NO: 1336804 - RNA, 19 nt, Homo sapiens
ccuaucuggucaacacgua

SEQ ID NO: 1336805 - RNA, 19 nt, Homo sapiens
gcuuggagguccguguauu

SEQ ID NO: 1336806 - RNA, 19 nt, Homo sapiens
gauaaccauuccucagaac

SEQ ID NO: 1336807 - RNA, 19 nt, Homo sapiens
cacaggcaccgcaggauaa

SEQ ID NO: 1336808 - RNA, 19 nt, Homo sapiens
ggauaaugccuaugcuuac

SEQ ID NO: 1336809 - RNA, 19 nt, Homo sapiens
gagcccaucaccuguaaau

SEQ ID NO: 1336810 - RNA, 19 nt, Homo sapiens
caauuuacaagcagucaga

SEQ ID NO: 1336811 - RNA, 19 nt, Homo sapiens
acaaacacuuaagagauga

SEQ ID NO: 1336812 - RNA, 19 nt, Homo sapiens
uaacaccaauacaaacacu

SEQ ID NO: 1336813 - RNA, 19 nt, Homo sapiens
uuagacauccaacauaaug

SEQ ID NO: 1336814 - RNA, 19 nt, Homo sapiens
gaugcugaguuuagagucu

SEQ ID NO: 1336815 - RNA, 19 nt, Homo sapiens
cagauaaagaugcugaguu

SEQ ID NO: 1336816 - RNA, 19 nt, Homo sapiens
gggagcugcuuacucucuu

SEQ ID NO: 1336817 - RNA, 19 nt, Homo sapiens
gcuggccucaucuucguua

SEQ ID NO: 1336818 - RNA, 19 nt, Homo sapiens
guagaacagagguggagaa

SEQ ID NO: 1336819 - RNA, 19 nt, Homo sapiens
gaaaagcuggguugaaauc

SEQ ID NO: 1336820 - RNA, 19 nt, Homo sapiens
ugccuaugcuuacaaagug

SEQ ID NO: 1336821 - RNA, 19 nt, Homo sapiens
ccacaucaaacucaacauc

SEQ ID NO: 1336822 - RNA, 19 nt, Homo sapiens
aaguaaaccggaugggaua

SEQ ID NO: 1336823 - RNA, 19 nt, Homo sapiens
gaggauaaugccuaugcuu

SEQ ID NO: 1336824 - RNA, 19 nt, Homo sapiens
cuuggagguccguguauua

SEQ ID NO: 1336825 - RNA, 19 nt, Homo sapiens
aaugaggacuaacaccaau

SEQ ID NO: 1336826 - RNA, 19 nt, Homo sapiens
ucuaccaguugcacagauu

SEQ ID NO: 1336827 - RNA, 19 nt, Homo sapiens
uaaugaggacuaacaccaa

SEQ ID NO: 1336828 - RNA, 19 nt, Homo sapiens
caacaucugcaccuaacuc

SEQ ID NO: 1336829 - RNA, 19 nt, Homo sapiens
ggccucaucuucguuagca

SEQ ID NO: 1336830 - RNA, 19 nt, Homo sapiens
gcucagagucuucccuuuu

SEQ ID NO: 1336831 - RNA, 19 nt, Homo sapiens
ccuucuauguggcugauga

SEQ ID NO: 1336832 - RNA, 19 nt, Homo sapiens
acaucaaacucaacaucug

SEQ ID NO: 1336833 - RNA, 19 nt, Homo sapiens
cacucuggcucugugauuu

SEQ ID NO: 1336834 - RNA, 19 nt, Homo sapiens
ccacucuggcucugugauu

SEQ ID NO: 1336835 - RNA, 19 nt, Homo sapiens
gagugucucaugucuuaau

SEQ ID NO: 1336836 - RNA, 19 nt, Homo sapiens
gugguaggagggaggauuu

SEQ ID NO: 1336837 - RNA, 19 nt, Homo sapiens
aggagcccaucaccuguaa

SEQ ID NO: 1336838 - RNA, 19 nt, Homo sapiens
uagaacagagguggagaaa

SEQ ID NO: 1336839 - RNA, 19 nt, Homo sapiens
caacugccuccuauuuuaa

SEQ ID NO: 1336840 - RNA, 19 nt, Homo sapiens
aagccuagaucagggaugu

SEQ ID NO: 1336841 - RNA, 19 nt, Homo sapiens
ggugauucuuuucucauuu

SEQ ID NO: 1336842 - RNA, 19 nt, Homo sapiens
caauacaaacacuuaagag

SEQ ID NO: 1336843 - RNA, 19 nt, Homo sapiens
acucuggcucugugauuua

SEQ ID NO: 1336844 - RNA, 19 nt, Homo sapiens
uagcuggccucaucuucgu

SEQ ID NO: 1336845 - RNA, 19 nt, Homo sapiens
acccggagcugcaagaaac

SEQ ID NO: 1336846 - RNA, 19 nt, Homo sapiens
gugcuuggagguccgugua

SEQ ID NO: 1336847 - RNA, 19 nt, Homo sapiens
gaagccggaaugcaagaca

SEQ ID NO: 1336848 - RNA, 19 nt, Homo sapiens
gcaccgcaggauaaccauu

SEQ ID NO: 1336849 - RNA, 19 nt, Homo sapiens
caccaauacaaacacuuaa

SEQ ID NO: 1336850 - RNA, 19 nt, Homo sapiens
gccacuugcuugucugcau

SEQ ID NO: 1336851 - RNA, 19 nt, Homo sapiens
gcagaaauuugcauaagua

SEQ ID NO: 1336852 - RNA, 19 nt, Homo sapiens
caaagagacuggcagaauu

SEQ ID NO: 1336853 - RNA, 19 nt, Homo sapiens
ggacuugccuuguuucaga

SEQ ID NO: 1336854 - RNA, 19 nt, Homo sapiens
gaguugggcuguaaagaua

SEQ ID NO: 1336855 - RNA, 19 nt, Homo sapiens
cauuaaaccucuuuccuuu

SEQ ID NO: 1336856 - RNA, 19 nt, Homo sapiens
cauuaaaccucuuuccuuu

SEQ ID NO: 1336857 - RNA, 19 nt, Homo sapiens
gcacgagaacaaacuaaua

SEQ ID NO: 1336858 - RNA, 19 nt, Homo sapiens
gaacugaaguaaaggugau

SEQ ID NO: 1336859 - RNA, 19 nt, Homo sapiens
gcacaaguucucucucuuu

SEQ ID NO: 1336860 - RNA, 19 nt, Homo sapiens
ggccauggguagaaugaua

SEQ ID NO: 1336861 - RNA, 19 nt, Homo sapiens
gaagggaaauguggguuug

SEQ ID NO: 1336862 - RNA, 19 nt, Homo sapiens
gaaguaaaggugauucuug

SEQ ID NO: 1336863 - RNA, 19 nt, Homo sapiens
auaaugauguggucaauga

SEQ ID NO: 1336864 - RNA, 19 nt, Homo sapiens
gaacugugaauccauuaaa

SEQ ID NO: 1336865 - RNA, 19 nt, Homo sapiens
ugaaaugaguuaagacugu

SEQ ID NO: 1336866 - RNA, 19 nt, Homo sapiens
gguagaaugauaugguuua

SEQ ID NO: 1336867 - RNA, 19 nt, Homo sapiens
gcaaagagacuggcagaau

SEQ ID NO: 1336868 - RNA, 19 nt, Homo sapiens
uaaaggugauucuugcuau

SEQ ID NO: 1336869 - RNA, 19 nt, Homo sapiens
guaccuggcagaagaaauu

SEQ ID NO: 1336870 - RNA, 19 nt, Homo sapiens
ugacugcccugcuggauuc

SEQ ID NO: 1336871 - RNA, 19 nt, Homo sapiens
guugggaacugaaguaaag

SEQ ID NO: 1336872 - RNA, 19 nt, Homo sapiens
cauacagagucccuacuaa

SEQ ID NO: 1336873 - RNA, 19 nt, Homo sapiens
ccuagagacuuguugaaug

SEQ ID NO: 1336874 - RNA, 19 nt, Homo sapiens
guaaauugguaccgguaga

SEQ ID NO: 1336875 - RNA, 19 nt, Homo sapiens
ggucuugugauaaugaaua

SEQ ID NO: 1336876 - RNA, 19 nt, Homo sapiens
ccaugcaaauuucaucuug

SEQ ID NO: 1336877 - RNA, 19 nt, Homo sapiens
ugugagacauggagucaaa

SEQ ID NO: 1336878 - RNA, 19 nt, Homo sapiens
ggugauucuugcuauguuu

SEQ ID NO: 1336879 - RNA, 19 nt, Homo sapiens
gaguuccucugcacaaguu

SEQ ID NO: 1336880 - RNA, 19 nt, Homo sapiens
aaagagacuggcagaauuu

SEQ ID NO: 1336881 - RNA, 19 nt, Homo sapiens
guaaaggugauucuugcua

SEQ ID NO: 1336882 - RNA, 19 nt, Homo sapiens
gagaacaaacuaauacagu

SEQ ID NO: 1336883 - RNA, 19 nt, Homo sapiens
caagccagcggcagaaauu

SEQ ID NO: 1336884 - RNA, 19 nt, Homo sapiens
gcagagguuggaacaguuu

SEQ ID NO: 1336885 - RNA, 19 nt, Homo sapiens
ugacuugggugcuguuaag

SEQ ID NO: 1336886 - RNA, 19 nt, Homo sapiens
gaacuugagggagaugauu

SEQ ID NO: 1336887 - RNA, 19 nt, Homo sapiens
cacaaguucucucucuuug

SEQ ID NO: 1336888 - RNA, 19 nt, Homo sapiens
uggaauggguguauuuauc

SEQ ID NO: 1336889 - RNA, 19 nt, Homo sapiens
ggcagaaauuugcauaagu

SEQ ID NO: 1336890 - RNA, 19 nt, Homo sapiens
cuagagacuuguugaaugg

SEQ ID NO: 1336891 - RNA, 19 nt, Homo sapiens
gugaggacaugaaauuugg

SEQ ID NO: 1336892 - RNA, 19 nt, Homo sapiens
caauuucucccauuuggaa

SEQ ID NO: 1336893 - RNA, 19 nt, Homo sapiens
aacuguagcucccacaauu

SEQ ID NO: 1336894 - RNA, 19 nt, Homo sapiens
gaacuguagcucccacaau

SEQ ID NO: 1336895 - RNA, 19 nt, Homo sapiens
ggaaccuccgccuagauua

SEQ ID NO: 1336896 - RNA, 19 nt, Homo sapiens
guguaugucuuuauuagca

SEQ ID NO: 1336897 - RNA, 19 nt, Homo sapiens
gagaucugaugguuuuaua

SEQ ID NO: 1336898 - RNA, 19 nt, Homo sapiens
agaaugauaugguuuagcu

SEQ ID NO: 1336899 - RNA, 19 nt, Homo sapiens
aggaaggcaugauugguuu

SEQ ID NO: 1336900 - RNA, 19 nt, Homo sapiens
gggaaccuccgccuagauu

SEQ ID NO: 1336901 - RNA, 19 nt, Homo sapiens
ggaacuuguugggaacuga

SEQ ID NO: 1336902 - RNA, 19 nt, Homo sapiens
gcagacuaauagagggauu

SEQ ID NO: 1336903 - RNA, 19 nt, Homo sapiens
ggaacugugaauccauuaa

SEQ ID NO: 1336904 - RNA, 19 nt, Homo sapiens
ccaugcuggucuugugaua

SEQ ID NO: 1336905 - RNA, 19 nt, Homo sapiens
caaugagacaggaaagaaa

SEQ ID NO: 1336906 - RNA, 19 nt, Homo sapiens
ugugaaacuuugaacuuga

SEQ ID NO: 1336907 - RNA, 19 nt, Homo sapiens
ccauauaagaugugacuug

SEQ ID NO: 1336908 - RNA, 19 nt, Homo sapiens
ccauauaagaugugacuug

SEQ ID NO: 1336909 - RNA, 19 nt, Homo sapiens
gacaugacuuguuccucuu

SEQ ID NO: 1336910 - RNA, 19 nt, Homo sapiens
ggagaugaggaacuuguug

SEQ ID NO: 1336911 - RNA, 19 nt, Homo sapiens
acucucggauauaucuuua

SEQ ID NO: 1336912 - RNA, 19 nt, Homo sapiens
gcaguuucguguaugucuu

SEQ ID NO: 1336913 - RNA, 19 nt, Homo sapiens
acaaggagccaaguguuaa

SEQ ID NO: 1336914 - RNA, 19 nt, Homo sapiens
agagauuugugaaacuuug

SEQ ID NO: 1336915 - RNA, 19 nt, Homo sapiens
cuagagauuugugaaacuu

SEQ ID NO: 1336916 - RNA, 19 nt, Homo sapiens
gaacuuguugggaacugaa

SEQ ID NO: 1336917 - RNA, 19 nt, Homo sapiens
ccaaaaugcugauaaugau

SEQ ID NO: 1336918 - RNA, 19 nt, Homo sapiens
ggcagagguuggaacaguu

SEQ ID NO: 1336919 - RNA, 19 nt, Homo sapiens
ccauuaaaccucuuuccuu

SEQ ID NO: 1336920 - RNA, 19 nt, Homo sapiens
caugcaaauuucaucuuga

SEQ ID NO: 1336921 - RNA, 19 nt, Homo sapiens
uccaaugccuguacucuca

SEQ ID NO: 1336922 - RNA, 19 nt, Homo sapiens
gcacggaaaacaagaauug

SEQ ID NO: 1336923 - RNA, 19 nt, Homo sapiens
cuauguagcuuagggacuu

SEQ ID NO: 1336924 - RNA, 19 nt, Homo sapiens
ccauauaagacgugacuug

SEQ ID NO: 1336925 - RNA, 19 nt, Homo sapiens
guagaaugauaugguuuag

SEQ ID NO: 1336926 - RNA, 19 nt, Homo sapiens
caggaaggcaugauugguu

SEQ ID NO: 1336927 - RNA, 19 nt, Homo sapiens
uggccaauuucucccauuu

SEQ ID NO: 1336928 - RNA, 19 nt, Homo sapiens
ccauacagagucccuacua

SEQ ID NO: 1336929 - RNA, 19 nt, Homo sapiens
guaacaaggagccaagugu

SEQ ID NO: 1336930 - RNA, 19 nt, Homo sapiens
uaaaugcuaguccauggaa

SEQ ID NO: 1336931 - RNA, 19 nt, Homo sapiens
cagagucccuacuaaaugc

SEQ ID NO: 1336932 - RNA, 19 nt, Homo sapiens
auacagagucccuacuaaa

SEQ ID NO: 1336933 - RNA, 19 nt, Homo sapiens
cacgagaucugaugguuuu

SEQ ID NO: 1336934 - RNA, 19 nt, Homo sapiens
gggcagugcagaagggaaa

SEQ ID NO: 1336935 - RNA, 19 nt, Homo sapiens
gaaccuccgccuagauuac

SEQ ID NO: 1336936 - RNA, 19 nt, Homo sapiens
cgguagaguugggcuguaa

SEQ ID NO: 1336937 - RNA, 19 nt, Homo sapiens
gaauggguguauuuaucca

SEQ ID NO: 1336938 - RNA, 19 nt, Homo sapiens
ucauuaaaccucuuuccuu

SEQ ID NO: 1336939 - RNA, 19 nt, Homo sapiens
gcagcacgagaacaaacua

SEQ ID NO: 1336940 - RNA, 19 nt, Homo sapiens
cggcagaaauuugcauaag

SEQ ID NO: 1336941 - RNA, 19 nt, Homo sapiens
gcucagaagaagacaggaa

SEQ ID NO: 1336942 - RNA, 19 nt, Homo sapiens
ugccuguacucucauugua

SEQ ID NO: 1336943 - RNA, 19 nt, Homo sapiens
aaaggugauucuugcuaug

SEQ ID NO: 1336944 - RNA, 19 nt, Homo sapiens
cgccugcuaucccgcuaua

SEQ ID NO: 1336945 - RNA, 19 nt, Homo sapiens
gcagugugacagcagacua

SEQ ID NO: 1336946 - RNA, 19 nt, Homo sapiens
acagagucccuacuaaaug

SEQ ID NO: 1336947 - RNA, 19 nt, Homo sapiens
acaaugagacaggaaagaa

SEQ ID NO: 1336948 - RNA, 19 nt, Homo sapiens
agauggagaugaggaacuu

SEQ ID NO: 1336949 - RNA, 19 nt, Homo sapiens
gaagaagacaggaaaaugg

SEQ ID NO: 1336950 - RNA, 19 nt, Homo sapiens
ucacgagaucugaugguuu

SEQ ID NO: 1336951 - RNA, 19 nt, Homo sapiens
gaacaugccccaaguuauu

SEQ ID NO: 1336952 - RNA, 19 nt, Homo sapiens
cauggagccugcagccuuu

SEQ ID NO: 1336953 - RNA, 19 nt, Homo sapiens
cagaagaacgggaagcauu

SEQ ID NO: 1336954 - RNA, 19 nt, Homo sapiens
gaaauugugguguacuugu

SEQ ID NO: 1336955 - RNA, 19 nt, Homo sapiens
cagaccaacuaugaagaua

SEQ ID NO: 1336956 - RNA, 19 nt, Homo sapiens
ccaaguuauucgucaguga

SEQ ID NO: 1336957 - RNA, 19 nt, Homo sapiens
agaagaacgggaagcauuu

SEQ ID NO: 1336958 - RNA, 19 nt, Homo sapiens
aggcggaaauuguggugua

SEQ ID NO: 1336959 - RNA, 19 nt, Homo sapiens
gccugcagccuuuguuuaa

SEQ ID NO: 1336960 - RNA, 19 nt, Homo sapiens
aaauugugguguacuuguu

SEQ ID NO: 1336961 - RNA, 19 nt, Homo sapiens
ucagugaggcggaaauugu

SEQ ID NO: 1336962 - RNA, 19 nt, Homo sapiens
ggaaauugugguguacuug

SEQ ID NO: 1336963 - RNA, 19 nt, Homo sapiens
cggaaauugugguguacuu

SEQ ID NO: 1336964 - RNA, 19 nt, Homo sapiens
gagccugcagccuuuguuu

SEQ ID NO: 1336965 - RNA, 19 nt, Homo sapiens
cagccuuuguuuaacuuau

SEQ ID NO: 1336966 - RNA, 19 nt, Homo sapiens
uccgagcagucaagaagaa

SEQ ID NO: 1336967 - RNA, 19 nt, Homo sapiens
gggccgaguucccuacaac

SEQ ID NO: 1336968 - RNA, 19 nt, Homo sapiens
ccagaccaacuaugaagau

SEQ ID NO: 1336969 - RNA, 19 nt, Homo sapiens
gcagccuuuguuuaacuua

SEQ ID NO: 1336970 - RNA, 19 nt, Homo sapiens
gaagaacgggaagcauuuu

SEQ ID NO: 1336971 - RNA, 19 nt, Homo sapiens
ugccugagcuccgcaugga

SEQ ID NO: 1336972 - RNA, 19 nt, Homo sapiens
gagcagucaagaagaacau

SEQ ID NO: 1336973 - RNA, 19 nt, Homo sapiens
gccgaguucccuacaacaa

SEQ ID NO: 1336974 - RNA, 19 nt, Homo sapiens
gaacauaucagccucaaga

SEQ ID NO: 1336975 - RNA, 19 nt, Homo sapiens
cuaggugacuuauuuguau

SEQ ID NO: 1336976 - RNA, 19 nt, Homo sapiens
guaaagucauugaaguugu

SEQ ID NO: 1336977 - RNA, 19 nt, Homo sapiens
caaaggaccguguaaaguc

SEQ ID NO: 1336978 - RNA, 19 nt, Homo sapiens
uaaagucauugaaguugug

SEQ ID NO: 1336979 - RNA, 19 nt, Homo sapiens
ggcaucaggugcugcugua

SEQ ID NO: 1336980 - RNA, 19 nt, Homo sapiens
ccacaugagacaguaauaa

SEQ ID NO: 1336981 - RNA, 19 nt, Homo sapiens
caaaaucacauuccaguuu

SEQ ID NO: 1336982 - RNA, 19 nt, Homo sapiens
ucauugaaguugugaaagu

SEQ ID NO: 1336983 - RNA, 19 nt, Homo sapiens
gaaauucacaggacugacu

SEQ ID NO: 1336984 - RNA, 19 nt, Homo sapiens
aaaggaccguguaaaguca

SEQ ID NO: 1336985 - RNA, 19 nt, Homo sapiens
cacaugagacaguaauaaa

SEQ ID NO: 1336986 - RNA, 19 nt, Homo sapiens
gaccugaucuguccuuccu

SEQ ID NO: 1336987 - RNA, 19 nt, Homo sapiens
cguguaaagucauugaagu

SEQ ID NO: 1336988 - RNA, 19 nt, Homo sapiens
guaaacuaggugacuuauu

SEQ ID NO: 1336989 - RNA, 19 nt, Homo sapiens
caugaaccauuguguuacu

SEQ ID NO: 1336990 - RNA, 19 nt, Homo sapiens
gccuaaucaugaaccauug

SEQ ID NO: 1336991 - RNA, 19 nt, Homo sapiens
cagaacauaucagccucaa

SEQ ID NO: 1336992 - RNA, 19 nt, Homo sapiens
aaacuaggugacuuauuug

SEQ ID NO: 1336993 - RNA, 19 nt, Homo sapiens
aucaugaaccauuguguua

SEQ ID NO: 1336994 - RNA, 19 nt, Homo sapiens
caaaguaaacuaggugacu

SEQ ID NO: 1336995 - RNA, 19 nt, Homo sapiens
guguaaagucauugaaguu

SEQ ID NO: 1336996 - RNA, 19 nt, Homo sapiens
acaaaggaccguguaaagu

SEQ ID NO: 1336997 - RNA, 19 nt, Homo sapiens
gaaguugugaaagucuauu

SEQ ID NO: 1336998 - RNA, 19 nt, Homo sapiens
uguaaagucauugaaguug

SEQ ID NO: 1336999 - RNA, 19 nt, Homo sapiens
aaucaugaaccauuguguu

SEQ ID NO: 1337000 - RNA, 19 nt, Homo sapiens
cauugaaguugugaaaguc

SEQ ID NO: 1337001 - RNA, 19 nt, Homo sapiens
gaccguguaaagucauuga

SEQ ID NO: 1337002 - RNA, 19 nt, Homo sapiens
acuaggugacuuauuugua

SEQ ID NO: 1337003 - RNA, 19 nt, Homo sapiens
uugaaguugugaaagucua

SEQ ID NO: 1337004 - RNA, 19 nt, Homo sapiens
ugcuguaccugguguagga

SEQ ID NO: 1337005 - RNA, 19 nt, Homo sapiens
ccacugguuuuacaaagga

SEQ ID NO: 1337006 - RNA, 19 nt, Homo sapiens
gaagaagacuuacauagaa

SEQ ID NO: 1337007 - RNA, 19 nt, Homo sapiens
gaaaugaguugagacuuug

SEQ ID NO: 1337008 - RNA, 19 nt, Homo sapiens
ugaaaugaguugagacuuu

SEQ ID NO: 1337009 - RNA, 19 nt, Homo sapiens
ggaagaagacuuacauaga

SEQ ID NO: 1337010 - RNA, 19 nt, Homo sapiens
caaaggaugugacuugcuu

SEQ ID NO: 1337011 - RNA, 19 nt, Homo sapiens
gaacugugaguccaauuaa

SEQ ID NO: 1337012 - RNA, 19 nt, Homo sapiens
gggaaggcaugauugguuu

SEQ ID NO: 1337013 - RNA, 19 nt, Homo sapiens
ggaacugugaguccaauua

SEQ ID NO: 1337014 - RNA, 19 nt, Homo sapiens
gaaugggucucacaagauc

SEQ ID NO: 1337015 - RNA, 19 nt, Homo sapiens
cacaagaucugaugguguu

SEQ ID NO: 1337016 - RNA, 19 nt, Homo sapiens
acccaaaucucaucuugua

SEQ ID NO: 1337017 - RNA, 19 nt, Homo sapiens
ggaccuagacuccuugaug

SEQ ID NO: 1337018 - RNA, 19 nt, Homo sapiens
ggaggagacuugcuuuguc

SEQ ID NO: 1337019 - RNA, 19 nt, Homo sapiens
gagaaagacccaugugauc

SEQ ID NO: 1337020 - RNA, 19 nt, Homo sapiens
ggucagggguggaaugaua

SEQ ID NO: 1337021 - RNA, 19 nt, Homo sapiens
ccacccaaaucucaucuug

SEQ ID NO: 1337022 - RNA, 19 nt, Homo sapiens
ccauaauccucccauguug

SEQ ID NO: 1337023 - RNA, 19 nt, Homo sapiens
ccaauuaaaccucuuucuu

SEQ ID NO: 1337024 - RNA, 19 nt, Homo sapiens
caugagcugugaugaaauc

SEQ ID NO: 1337025 - RNA, 19 nt, Homo sapiens
gaaagacccaugugaucau

SEQ ID NO: 1337026 - RNA, 19 nt, Homo sapiens
ucuuguagcucccauaauc

SEQ ID NO: 1337027 - RNA, 19 nt, Homo sapiens
gcccaaagcagcaaaugga

SEQ ID NO: 1337028 - RNA, 19 nt, Homo sapiens
gcaaggccgucagaugcuu

SEQ ID NO: 1337029 - RNA, 19 nt, Homo sapiens
gggaagaagacuuacauag

SEQ ID NO: 1337030 - RNA, 19 nt, Homo sapiens
caaagcagcaaauggaauc

SEQ ID NO: 1337031 - RNA, 19 nt, Homo sapiens
accaugagcugugaugaaa

SEQ ID NO: 1337032 - RNA, 19 nt, Homo sapiens
ucagaugcuuguccuggaa

SEQ ID NO: 1337033 - RNA, 19 nt, Homo sapiens
caucuuguagcucccauaa

SEQ ID NO: 1337034 - RNA, 19 nt, Homo sapiens
gaguuucucugcacaagcu

SEQ ID NO: 1337035 - RNA, 19 nt, Homo sapiens
aagaucugaugguguuaaa

SEQ ID NO: 1337036 - RNA, 19 nt, Homo sapiens
caagaucugaugguguuaa

SEQ ID NO: 1337037 - RNA, 19 nt, Homo sapiens
augaaugggucucacaaga

SEQ ID NO: 1337038 - RNA, 19 nt, Homo sapiens
ugagaaagacccaugugau

SEQ ID NO: 1337039 - RNA, 19 nt, Homo sapiens
gugagaaagacccauguga

SEQ ID NO: 1337040 - RNA, 19 nt, Homo sapiens
ggaccaucaucugacauag

SEQ ID NO: 1337041 - RNA, 19 nt, Homo sapiens
gaaauccaggcaacugagu

SEQ ID NO: 1337042 - RNA, 19 nt, Homo sapiens
gaugaaauccaggcaacug

SEQ ID NO: 1337043 - RNA, 19 nt, Homo sapiens
agaaagacccaugugauca

SEQ ID NO: 1337044 - RNA, 19 nt, Homo sapiens
aagaagacuuacauagaag

SEQ ID NO: 1337045 - RNA, 19 nt, Homo sapiens
gguggaaugauaugguuug

SEQ ID NO: 1337046 - RNA, 19 nt, Homo sapiens
ugaaugggucucacaagau

SEQ ID NO: 1337047 - RNA, 19 nt, Homo sapiens
cccauaauccucccauguu

SEQ ID NO: 1337048 - RNA, 19 nt, Homo sapiens
caaaucucaucuuguagcu

SEQ ID NO: 1337049 - RNA, 19 nt, Homo sapiens
gaaggcaugauugguuuua

SEQ ID NO: 1337050 - RNA, 19 nt, Homo sapiens
acuguggacuuuugaguua

SEQ ID NO: 1337051 - RNA, 19 nt, Homo sapiens
ccaaagcagcaaauggaau

SEQ ID NO: 1337052 - RNA, 19 nt, Homo sapiens
ccaagaucaugcucauagg

SEQ ID NO: 1337053 - RNA, 19 nt, Homo sapiens
uaaccagcacccaagauca

SEQ ID NO: 1337054 - RNA, 19 nt, Homo sapiens
cccaagaucaugcucauag

SEQ ID NO: 1337055 - RNA, 19 nt, Homo sapiens
gggaguuucucugcacaag

SEQ ID NO: 1337056 - RNA, 19 nt, Homo sapiens
ggucucacaagaucugaug

SEQ ID NO: 1337057 - RNA, 19 nt, Homo sapiens
ugauaugguuuggcucugu

SEQ ID NO: 1337058 - RNA, 19 nt, Homo sapiens
aaccaaccaugagcuguga

SEQ ID NO: 1337059 - RNA, 19 nt, Homo sapiens
ugaguuaaugcugaaauga

SEQ ID NO: 1337060 - RNA, 19 nt, Homo sapiens
cauaggggaagaagacuua

SEQ ID NO: 1337061 - RNA, 19 nt, Homo sapiens
ugggaaggcaugauugguu

SEQ ID NO: 1337062 - RNA, 19 nt, Homo sapiens
gaguuaaugcugaaaugag

SEQ ID NO: 1337063 - RNA, 19 nt, Homo sapiens
uugaguuaaugcugaaaug

SEQ ID NO: 1337064 - RNA, 19 nt, Homo sapiens
aguuaaugcugaaaugagu

SEQ ID NO: 1337065 - RNA, 19 nt, Homo sapiens
agaugagacuuuggacugu

SEQ ID NO: 1337066 - RNA, 19 nt, Homo sapiens
gguggaggagacuugcuuu

SEQ ID NO: 1337067 - RNA, 19 nt, Homo sapiens
caagaucaugcucauaggu

SEQ ID NO: 1337068 - RNA, 19 nt, Homo sapiens
cacccaagaucaugcucau

SEQ ID NO: 1337069 - RNA, 19 nt, Homo sapiens
aacugugaguccaauuaaa

SEQ ID NO: 1337070 - RNA, 19 nt, Homo sapiens
acuuuggacuguggacuuu

SEQ ID NO: 1337071 - RNA, 19 nt, Homo sapiens
ggaagacucacuaguaaua

SEQ ID NO: 1337072 - RNA, 19 nt, Homo sapiens
agaaauaacucccaaacaa

SEQ ID NO: 1337073 - RNA, 19 nt, Homo sapiens
caaauuaccugccgcacaa

SEQ ID NO: 1337074 - RNA, 19 nt, Homo sapiens
gugcaagucugaagaauga

SEQ ID NO: 1337075 - RNA, 19 nt, Homo sapiens
gagcagcagucagaaauaa

SEQ ID NO: 1337076 - RNA, 19 nt, Homo sapiens
gaaauaacucccaaacaaa

SEQ ID NO: 1337077 - RNA, 19 nt, Homo sapiens
gggaacaccugcuucauga

SEQ ID NO: 1337078 - RNA, 19 nt, Homo sapiens
acaggaugcucacgaauua

SEQ ID NO: 1337079 - RNA, 19 nt, Homo sapiens
caacacaacccuaaacuga

SEQ ID NO: 1337080 - RNA, 19 nt, Homo sapiens
uaaucaacguuuccacuua

SEQ ID NO: 1337081 - RNA, 19 nt, Homo sapiens
gccaagaaguuacugauga

SEQ ID NO: 1337082 - RNA, 19 nt, Homo sapiens
uggcagaucucaucauuug

SEQ ID NO: 1337083 - RNA, 19 nt, Homo sapiens
ccagaguccuguucgauuu

SEQ ID NO: 1337084 - RNA, 19 nt, Homo sapiens
ugauggacauuuacaagua

SEQ ID NO: 1337085 - RNA, 19 nt, Homo sapiens
gauagccuuucacuaagua

SEQ ID NO: 1337086 - RNA, 19 nt, Homo sapiens
gaaagaaagaagcguagaa

SEQ ID NO: 1337087 - RNA, 19 nt, Homo sapiens
gcagcaggaauauauguua

SEQ ID NO: 1337088 - RNA, 19 nt, Homo sapiens
ggagguaccuuugucuaau

SEQ ID NO: 1337089 - RNA, 19 nt, Homo sapiens
ugacaacuguacaaagauu

SEQ ID NO: 1337090 - RNA, 19 nt, Homo sapiens
gcgccuaccugcuguucua

SEQ ID NO: 1337091 - RNA, 19 nt, Homo sapiens
uuaauaagcaggcccauaa

SEQ ID NO: 1337092 - RNA, 19 nt, Homo sapiens
gaucucaucauuugaagaa

SEQ ID NO: 1337093 - RNA, 19 nt, Homo sapiens
gcagaucucaucauuugaa

SEQ ID NO: 1337094 - RNA, 19 nt, Homo sapiens
acaccaguauuuauccuua

SEQ ID NO: 1337095 - RNA, 19 nt, Homo sapiens
ccacaccaguucugaauca

SEQ ID NO: 1337096 - RNA, 19 nt, Homo sapiens
cauggaagacucacuagua

SEQ ID NO: 1337097 - RNA, 19 nt, Homo sapiens
ucagguggcuggaagaguu

SEQ ID NO: 1337098 - RNA, 19 nt, Homo sapiens
ggaacccucucucaacuag

SEQ ID NO: 1337099 - RNA, 19 nt, Homo sapiens
ggacauaaaccuagucaac

SEQ ID NO: 1337100 - RNA, 19 nt, Homo sapiens
ugugacaacuguacaaaga

SEQ ID NO: 1337101 - RNA, 19 nt, Homo sapiens
gaugaggucuuagaugcaa

SEQ ID NO: 1337102 - RNA, 19 nt, Homo sapiens
ucaaugaguuccugaugau

SEQ ID NO: 1337103 - RNA, 19 nt, Homo sapiens
uuugauagccuuucacuaa

SEQ ID NO: 1337104 - RNA, 19 nt, Homo sapiens
ggaagucucaacauccuuu

SEQ ID NO: 1337105 - RNA, 19 nt, Homo sapiens
ugccuggccuuguuaauuu

SEQ ID NO: 1337106 - RNA, 19 nt, Homo sapiens
caucugauacagguaauua

SEQ ID NO: 1337107 - RNA, 19 nt, Homo sapiens
caugcacucuggacacuuu

SEQ ID NO: 1337108 - RNA, 19 nt, Homo sapiens
cgucagauauaaagucaug

SEQ ID NO: 1337109 - RNA, 19 nt, Homo sapiens
aauguuagguguucucaga

SEQ ID NO: 1337110 - RNA, 19 nt, Homo sapiens
ccaagaaguuacugaugau

SEQ ID NO: 1337111 - RNA, 19 nt, Homo sapiens
aggcaacaauuuagaagaa

SEQ ID NO: 1337112 - RNA, 19 nt, Homo sapiens
acccuaaacugaacaagaa

SEQ ID NO: 1337113 - RNA, 19 nt, Homo sapiens
cagcaggaauauauguuau

SEQ ID NO: 1337114 - RNA, 19 nt, Homo sapiens
ggagcagcagucagaaaua

SEQ ID NO: 1337115 - RNA, 19 nt, Homo sapiens
ggaguuauagguggaauug

SEQ ID NO: 1337116 - RNA, 19 nt, Homo sapiens
gggagguaccuuugucuaa

SEQ ID NO: 1337117 - RNA, 19 nt, Homo sapiens
guaauauggucugcaaaca

SEQ ID NO: 1337118 - RNA, 19 nt, Homo sapiens
cuaguaauauggucugcaa

SEQ ID NO: 1337119 - RNA, 19 nt, Homo sapiens
gagguaccuuugucuaauc

SEQ ID NO: 1337120 - RNA, 19 nt, Homo sapiens
gcccuucccucucccaguu

SEQ ID NO: 1337121 - RNA, 19 nt, Homo sapiens
auggaagacucacuaguaa

SEQ ID NO: 1337122 - RNA, 19 nt, Homo sapiens
ggcaacaauuuagaagaaa

SEQ ID NO: 1337123 - RNA, 19 nt, Homo sapiens
aaagaaagaagcguagaaa

SEQ ID NO: 1337124 - RNA, 19 nt, Homo sapiens
gaggaccacuuuuguuaaa

SEQ ID NO: 1337125 - RNA, 19 nt, Homo sapiens
ggagugcaagucugaagaa

SEQ ID NO: 1337126 - RNA, 19 nt, Homo sapiens
ccaccuccuuggacauaaa

SEQ ID NO: 1337127 - RNA, 19 nt, Homo sapiens
gucauuaccucgucauugg

SEQ ID NO: 1337128 - RNA, 19 nt, Homo sapiens
agaacaggaugcucacgaa

SEQ ID NO: 1337129 - RNA, 19 nt, Homo sapiens
uuggaugucuuaagaaugu

SEQ ID NO: 1337130 - RNA, 19 nt, Homo sapiens
gaagacucacuaguaauau

SEQ ID NO: 1337131 - RNA, 19 nt, Homo sapiens
ggucacacauuuguuugau

SEQ ID NO: 1337132 - RNA, 19 nt, Homo sapiens
gccuggccuuguuaauuua

SEQ ID NO: 1337133 - RNA, 19 nt, Homo sapiens
gacuacagcuccuccacau

SEQ ID NO: 1337134 - RNA, 19 nt, Homo sapiens
ccacugccuucaccacuuc

SEQ ID NO: 1337135 - RNA, 19 nt, Homo sapiens
gaacaggaugcucacgaau

SEQ ID NO: 1337136 - RNA, 19 nt, Homo sapiens
cuuguuggaugucuuaaga

SEQ ID NO: 1337137 - RNA, 19 nt, Homo sapiens
gaacaccugcuucaugaac

SEQ ID NO: 1337138 - RNA, 19 nt, Homo sapiens
ugucugcacuguccaggaa

SEQ ID NO: 1337139 - RNA, 19 nt, Homo sapiens
gauggacauuuacaaguac

SEQ ID NO: 1337140 - RNA, 19 nt, Homo sapiens
gauuugauaccuuugauag

SEQ ID NO: 1337141 - RNA, 19 nt, Homo sapiens
caacauccuuuucauggaa

SEQ ID NO: 1337142 - RNA, 19 nt, Homo sapiens
gcuugugccuggccuuguu

SEQ ID NO: 1337143 - RNA, 19 nt, Homo sapiens
ggcaugagcacgugcaguu

SEQ ID NO: 1337144 - RNA, 19 nt, Homo sapiens
gaacaccagaggaccacuu

SEQ ID NO: 1337145 - RNA, 19 nt, Homo sapiens
caccaguauuuauccuuaa

SEQ ID NO: 1337146 - RNA, 19 nt, Homo sapiens
acacaacccuaaacugaac

SEQ ID NO: 1337147 - RNA, 19 nt, Homo sapiens
aaucaacguuuccacuuag

SEQ ID NO: 1337148 - RNA, 19 nt, Homo sapiens
agaaagcauucauuauguc

SEQ ID NO: 1337149 - RNA, 19 nt, Homo sapiens
cuucugguguguucuaaga

SEQ ID NO: 1337150 - RNA, 19 nt, Homo sapiens
gacauaaaccuagucaaca

SEQ ID NO: 1337151 - RNA, 19 nt, Homo sapiens
gaugauggacauuuacaag

SEQ ID NO: 1337152 - RNA, 19 nt, Homo sapiens
gaugaugaggucuuagaug

SEQ ID NO: 1337153 - RNA, 19 nt, Homo sapiens
guguguaggugguucuguu

SEQ ID NO: 1337154 - RNA, 19 nt, Homo sapiens
cagaggaccacuuuuguua

SEQ ID NO: 1337155 - RNA, 19 nt, Homo sapiens
gccgucagauauaaaguca

SEQ ID NO: 1337156 - RNA, 19 nt, Homo sapiens
guaggugguucuguugugu

SEQ ID NO: 1337157 - RNA, 19 nt, Homo sapiens
caggaacccucucucaacu

SEQ ID NO: 1337158 - RNA, 19 nt, Homo sapiens
cagaaucagugcgggaugu

SEQ ID NO: 1337159 - RNA, 19 nt, Homo sapiens
aggugguucuguuguguua

SEQ ID NO: 1337160 - RNA, 19 nt, Homo sapiens
ggcugugggucuccgauga

SEQ ID NO: 1337161 - RNA, 19 nt, Homo sapiens
uggaauugcugcugcucuu

SEQ ID NO: 1337162 - RNA, 19 nt, Homo sapiens
uaauaagcaggcccauaaa

SEQ ID NO: 1337163 - RNA, 19 nt, Homo sapiens
cuacagcuccuccacauac

SEQ ID NO: 1337164 - RNA, 19 nt, Homo sapiens
uucaaugaguuccugauga

SEQ ID NO: 1337165 - RNA, 19 nt, Homo sapiens
gaagccaagggaacguuga

SEQ ID NO: 1337166 - RNA, 19 nt, Homo sapiens
ccacuucaucucaucagaa

SEQ ID NO: 1337167 - RNA, 19 nt, Homo sapiens
ugauagccuuucacuaagu

SEQ ID NO: 1337168 - RNA, 19 nt, Homo sapiens
aagacucacuaguaauaug

SEQ ID NO: 1337169 - RNA, 19 nt, Homo sapiens
cuagucaacacaacccuaa

SEQ ID NO: 1337170 - RNA, 19 nt, Homo sapiens
gugccuggccuuguuaauu

SEQ ID NO: 1337171 - RNA, 19 nt, Homo sapiens
gaaaagaacuuaugugugu

SEQ ID NO: 1337172 - RNA, 19 nt, Homo sapiens
ggauguaagugaguaauaa

SEQ ID NO: 1337173 - RNA, 19 nt, Homo sapiens
ggaccuaccuccaucauca

SEQ ID NO: 1337174 - RNA, 19 nt, Homo sapiens
gaaagaagcccaggcacua

SEQ ID NO: 1337175 - RNA, 19 nt, Homo sapiens
caaaguagaaugucuugua

SEQ ID NO: 1337176 - RNA, 19 nt, Homo sapiens
gggagacgaucuagcuaua

SEQ ID NO: 1337177 - RNA, 19 nt, Homo sapiens
gaagauacccaccugaguu

SEQ ID NO: 1337178 - RNA, 19 nt, Homo sapiens
cagacuggcuuccaaguaa

SEQ ID NO: 1337179 - RNA, 19 nt, Homo sapiens
guacugacuuuaacauaga

SEQ ID NO: 1337180 - RNA, 19 nt, Homo sapiens
gcauuccucuucuauggua

SEQ ID NO: 1337181 - RNA, 19 nt, Homo sapiens
gaacuccaauugugcugaa

SEQ ID NO: 1337182 - RNA, 19 nt, Homo sapiens
uaagguggcugguugauag

SEQ ID NO: 1337183 - RNA, 19 nt, Homo sapiens
ccacauacuuacugccuuu

SEQ ID NO: 1337184 - RNA, 19 nt, Homo sapiens
caucaugacugggcuguuu

SEQ ID NO: 1337185 - RNA, 19 nt, Homo sapiens
guacuuuccuugugcaaug

SEQ ID NO: 1337186 - RNA, 19 nt, Homo sapiens
auaauuaguugcugcagua

SEQ ID NO: 1337187 - RNA, 19 nt, Homo sapiens
ccaaagcauuccucuucua

SEQ ID NO: 1337188 - RNA, 19 nt, Homo sapiens
gaccaaagcauuccucuuc

SEQ ID NO: 1337189 - RNA, 19 nt, Homo sapiens
ccacaggcauucaguuugu

SEQ ID NO: 1337190 - RNA, 19 nt, Homo sapiens
gaauugcuaugcuuaugau

SEQ ID NO: 1337191 - RNA, 19 nt, Homo sapiens
acaauuacaucgacgcauu

SEQ ID NO: 1337192 - RNA, 19 nt, Homo sapiens
caaaagugcuauucuugua

SEQ ID NO: 1337193 - RNA, 19 nt, Homo sapiens
gaugauagccuaagaagac

SEQ ID NO: 1337194 - RNA, 19 nt, Homo sapiens
ggaaaacacuggcucaugu

SEQ ID NO: 1337195 - RNA, 19 nt, Homo sapiens
uagguugccuuaauauuug

SEQ ID NO: 1337196 - RNA, 19 nt, Homo sapiens
uaacauagauagcuuaccu

SEQ ID NO: 1337197 - RNA, 19 nt, Homo sapiens
gguacugacuuuaacauag

SEQ ID NO: 1337198 - RNA, 19 nt, Homo sapiens
gcagaugcuuguuucuuca

SEQ ID NO: 1337199 - RNA, 19 nt, Homo sapiens
ggaaggaguuuaaaaguuc

SEQ ID NO: 1337200 - RNA, 19 nt, Homo sapiens
gaauggcagugcaggaaau

SEQ ID NO: 1337201 - RNA, 19 nt, Homo sapiens
gguagucccuguauauuac

SEQ ID NO: 1337202 - RNA, 19 nt, Homo sapiens
ggguagucccuguauauua

SEQ ID NO: 1337203 - RNA, 19 nt, Homo sapiens
gcauugaaguccugaaguc

SEQ ID NO: 1337204 - RNA, 19 nt, Homo sapiens
gaagcugauuugucuguuc

SEQ ID NO: 1337205 - RNA, 19 nt, Homo sapiens
gaucccaucuguugguuuc

SEQ ID NO: 1337206 - RNA, 19 nt, Homo sapiens
cagcaggcauucccacuug

SEQ ID NO: 1337207 - RNA, 19 nt, Homo sapiens
cuagguugccuuaauauuu

SEQ ID NO: 1337208 - RNA, 19 nt, Homo sapiens
ccacuguugugucaugauu

SEQ ID NO: 1337209 - RNA, 19 nt, Homo sapiens
gagcagcgcgagaguagaa

SEQ ID NO: 1337210 - RNA, 19 nt, Homo sapiens
guaugaggccuauguagaa

SEQ ID NO: 1337211 - RNA, 19 nt, Homo sapiens
cuacaucacugagaaguuc

SEQ ID NO: 1337212 - RNA, 19 nt, Homo sapiens
uuucuagguugccuuaaua

SEQ ID NO: 1337213 - RNA, 19 nt, Homo sapiens
uagcuauucuguugacuau

SEQ ID NO: 1337214 - RNA, 19 nt, Homo sapiens
gacgagagaacaccuggua

SEQ ID NO: 1337215 - RNA, 19 nt, Homo sapiens
ccaccucucucacuuucuu

SEQ ID NO: 1337216 - RNA, 19 nt, Homo sapiens
caacagcuuauugguauuu

SEQ ID NO: 1337217 - RNA, 19 nt, Homo sapiens
cucaacagcuuauugguau

SEQ ID NO: 1337218 - RNA, 19 nt, Homo sapiens
gugcuauucuuguaucaga

SEQ ID NO: 1337219 - RNA, 19 nt, Homo sapiens
gaagucacuccgauaccua

SEQ ID NO: 1337220 - RNA, 19 nt, Homo sapiens
gaaaagaaaaugggaauug

SEQ ID NO: 1337221 - RNA, 19 nt, Homo sapiens
gcccagagcccacaguguu

SEQ ID NO: 1337222 - RNA, 19 nt, Homo sapiens
uucgcgagcugaugacuua

SEQ ID NO: 1337223 - RNA, 19 nt, Homo sapiens
ggagguuucuagaugauac

SEQ ID NO: 1337224 - RNA, 19 nt, Homo sapiens
ccagggauguaagugagua

SEQ ID NO: 1337225 - RNA, 19 nt, Homo sapiens
uucaaggacugauuucaaa

SEQ ID NO: 1337226 - RNA, 19 nt, Homo sapiens
gagaaugcaguuugugaug

SEQ ID NO: 1337227 - RNA, 19 nt, Homo sapiens
caaagcauuccucuucuau

SEQ ID NO: 1337228 - RNA, 19 nt, Homo sapiens
caguaacuccuguguguuu

SEQ ID NO: 1337229 - RNA, 19 nt, Homo sapiens
ggacacugguuaucuucca

SEQ ID NO: 1337230 - RNA, 19 nt, Homo sapiens
gaacaauccaagaaagaag

SEQ ID NO: 1337231 - RNA, 19 nt, Homo sapiens
gaaaggaaggaguuuaaaa
